United States Patent 12,590,386 (RECOMBINANT POLYCLONAL PROTEINS AND METHODS OF USE THEREOF) - sequence listing, part 3

SEQ ID NO: 56603 - protein, 9 aa, Homo sapiens
  light chain complementarity determining region 3 for antibody 28302
PQRSNWPLT

SEQ ID NO: 56604 - protein, 19 aa, Homo sapiens
  heavy chain complementarity determining region 3 for antibody 28302
AKTVSTTQADTAIIRGGDY

SEQ ID NO: 56605 - protein, 10 aa, Homo sapiens
  light chain complementarity determining region 3 for antibody 28303
PQRSKWPPLT

SEQ ID NO: 56606 - protein, 9 aa, Homo sapiens
  heavy chain complementarity determining region 3 for antibody 28303
ARVDGYFDY

SEQ ID NO: 56607 - protein, 9 aa, Homo sapiens
  light chain complementarity determining region 3 for antibody 28304
PQRHNWPWT

SEQ ID NO: 56608 - protein, 17 aa, Homo sapiens
  heavy chain complementarity determining region 3 for antibody 28304
VVPQFSRTDWPTEPSDY

SEQ ID NO: 56609 - protein, 9 aa, Homo sapiens
  light chain complementarity determining region 3 for antibody 28305
PQNEYWPRT

SEQ ID NO: 56610 - protein, 11 aa, Homo sapiens
  heavy chain complementarity determining region 3 for antibody 28305
VRVGGAGYFDH

SEQ ID NO: 56611 - protein, 9 aa, Homo sapiens
  light chain complementarity determining region 3 for antibody 28306
PQHDNFPGT

SEQ ID NO: 56612 - protein, 20 aa, Homo sapiens
  heavy chain complementarity determining region 3 for antibody 28306
AREVYYDRSGYYYNHKWFDP

SEQ ID NO: 56613 - protein, 9 aa, Homo sapiens
  light chain complementarity determining region 3 for antibody 28307
PPYYTTPRT

SEQ ID NO: 56614 - protein, 8 aa, Homo sapiens
  heavy chain complementarity determining region 3 for antibody 28307
ARDGAFDS

SEQ ID NO: 56615 - protein, 9 aa, Homo sapiens
  light chain complementarity determining region 3 for antibody 28308
PHTSTFPRT

SEQ ID NO: 56616 - protein, 20 aa, Homo sapiens
  heavy chain complementarity determining region 3 for antibody 28308
ARGRRIAALSTAHYYYGMDV

SEQ ID NO: 56617 - protein, 6 aa, Homo sapiens
  light chain complementarity determining region 3 for antibody 28309
PHRGRS

SEQ ID NO: 56618 - protein, 17 aa, Homo sapiens
  heavy chain complementarity determining region 3 for antibody 28309
ATFSRQVVTGYYWYFDL

SEQ ID NO: 56619 - protein, 8 aa, Homo sapiens
  light chain complementarity determining region 3 for antibody 28310
MRGVERYP

SEQ ID NO: 56620 - protein, 7 aa, Homo sapiens
  heavy chain complementarity determining region 3 for antibody 28310
ATKMGDY

SEQ ID NO: 56621 - protein, 9 aa, Homo sapiens
  light chain complementarity determining region 3 for antibody 28311
MQVLRTPYI

SEQ ID NO: 56622 - protein, 17 aa, Homo sapiens
  heavy chain complementarity determining region 3 for antibody 28311
ARWYYYDSSGYYSRFDY

SEQ ID NO: 56623 - protein, 9 aa, Homo sapiens
  light chain complementarity determining region 3 for antibody 28312
MQVLRTPSI

SEQ ID NO: 56624 - protein, 17 aa, Homo sapiens
  heavy chain complementarity determining region 3 for antibody 28312
ARWYYYDSSGYYSHFDY

SEQ ID NO: 56625 - protein, 9 aa, Homo sapiens
  light chain complementarity determining region 3 for antibody 28313
MQVLQTPLT

SEQ ID NO: 56626 - protein, 12 aa, Homo sapiens
  heavy chain complementarity determining region 3 for antibody 28313
VKESDKKWELLD

SEQ ID NO: 56627 - protein, 9 aa, Homo sapiens
  light chain complementarity determining region 3 for antibody 28314
MQVLQPPLT

SEQ ID NO: 56628 - protein, 12 aa, Homo sapiens
  heavy chain complementarity determining region 3 for antibody 28314
AKDSEQKWELHD

SEQ ID NO: 56629 - protein, 9 aa, Homo sapiens
  light chain complementarity determining region 3 for antibody 28315
MQVLKTPLP

SEQ ID NO: 56630 - protein, 12 aa, Homo sapiens
  heavy chain complementarity determining region 3 for antibody 28315
VKDSDKKWELLD

SEQ ID NO: 56631 - protein, 9 aa, Homo sapiens
  light chain complementarity determining region 3 for antibody 28316
MQTFQIPPT

SEQ ID NO: 56632 - protein, 11 aa, Homo sapiens
  heavy chain complementarity determining region 3 for antibody 28316
AHKSSGSSYTS

SEQ ID NO: 56633 - protein, 9 aa, Homo sapiens
  light chain complementarity determining region 3 for antibody 28317
MQSRRWPQT

SEQ ID NO: 56634 - protein, 8 aa, Homo sapiens
  heavy chain complementarity determining region 3 for antibody 28317
TAWGSSHH

SEQ ID NO: 56635 - protein, 9 aa, Homo sapiens
  light chain complementarity determining region 3 for antibody 28318
MQSRRWPPT

SEQ ID NO: 56636 - protein, 8 aa, Homo sapiens
  heavy chain complementarity determining region 3 for antibody 28318
TAWGSSHH

SEQ ID NO: 56637 - protein, 9 aa, Homo sapiens
  light chain complementarity determining region 3 for antibody 28319
MQSRRWPPP

SEQ ID NO: 56638 - protein, 8 aa, Homo sapiens
  heavy chain complementarity determining region 3 for antibody 28319
TAWGSSQH

SEQ ID NO: 56639 - protein, 9 aa, Homo sapiens
  light chain complementarity determining region 3 for antibody 28320
MQSRRWPHT

SEQ ID NO: 56640 - protein, 8 aa, Homo sapiens
  heavy chain complementarity determining region 3 for antibody 28320
TAWGSPHH

SEQ ID NO: 56641 - protein, 9 aa, Homo sapiens
  light chain complementarity determining region 3 for antibody 28321
MQSRRWPHT

SEQ ID NO: 56642 - protein, 8 aa, Homo sapiens
  heavy chain complementarity determining region 3 for antibody 28321
TAWGRSQH

SEQ ID NO: 56643 - protein, 9 aa, Homo sapiens
  light chain complementarity determining region 3 for antibody 28322
MQSRRWPHP

SEQ ID NO: 56644 - protein, 8 aa, Homo sapiens
  heavy chain complementarity determining region 3 for antibody 28322
TAWGSSHH

SEQ ID NO: 56645 - protein, 9 aa, Homo sapiens
  light chain complementarity determining region 3 for antibody 28323
MQSRRWPDT

SEQ ID NO: 56646 - protein, 8 aa, Homo sapiens
  heavy chain complementarity determining region 3 for antibody 28323
TAWGSSQH

SEQ ID NO: 56647 - protein, 9 aa, Homo sapiens
  light chain complementarity determining region 3 for antibody 28324
MQSRRWLHT

SEQ ID NO: 56648 - protein, 8 aa, Homo sapiens
  heavy chain complementarity determining region 3 for antibody 28324
TAWGSSQH

SEQ ID NO: 56649 - protein, 9 aa, Homo sapiens
  light chain complementarity determining region 3 for antibody 28325
MQSRQTVGT

SEQ ID NO: 56650 - protein, 18 aa, Homo sapiens
  heavy chain complementarity determining region 3 for antibody 28325
ARLDYYYGSGMPGRGFDH

SEQ ID NO: 56651 - protein, 9 aa, Homo sapiens
  light chain complementarity determining region 3 for antibody 28326
MQSGRWPHT

SEQ ID NO: 56652 - protein, 8 aa, Homo sapiens
  heavy chain complementarity determining region 3 for antibody 28326
TAWGSSQH

SEQ ID NO: 56653 - protein, 9 aa, Homo sapiens
  light chain complementarity determining region 3 for antibody 28327
MQRRRWPHP

SEQ ID NO: 56654 - protein, 8 aa, Homo sapiens
  heavy chain complementarity determining region 3 for antibody 28327
TAWGSSQH

SEQ ID NO: 56655 - protein, 9 aa, Homo sapiens
  light chain complementarity determining region 3 for antibody 28328
MQRIDFPLT

SEQ ID NO: 56656 - protein, 12 aa, Homo sapiens
  heavy chain complementarity determining region 3 for antibody 28328
TRSRRWFRGFDH

SEQ ID NO: 56657 - protein, 9 aa, Homo sapiens
  light chain complementarity determining region 3 for antibody 28329
MQPLQTPVP

SEQ ID NO: 56658 - protein, 18 aa, Homo sapiens
  heavy chain complementarity determining region 3 for antibody 28329
ARSHISLIVGVASDGFDL

SEQ ID NO: 56659 - protein, 9 aa, Homo sapiens
  light chain complementarity determining region 3 for antibody 28330
MQPLQAPGT

SEQ ID NO: 56660 - protein, 21 aa, Homo sapiens
  heavy chain complementarity determining region 3 for antibody 28330
AREGQKPPPIISSGSRGGLDY

SEQ ID NO: 56661 - protein, 9 aa, Homo sapiens
  light chain complementarity determining region 3 for antibody 28331
MQPLHTPST

SEQ ID NO: 56662 - protein, 18 aa, Homo sapiens
  heavy chain complementarity determining region 3 for antibody 28331
ARPFYDSYTYHYYYGLDV

SEQ ID NO: 56663 - protein, 9 aa, Homo sapiens
  light chain complementarity determining region 3 for antibody 28332
MQPLHTPIP

SEQ ID NO: 56664 - protein, 18 aa, Homo sapiens
  heavy chain complementarity determining region 3 for antibody 28332
ARPFYDSYTYHYYYGLDV

SEQ ID NO: 56665 - protein, 9 aa, Homo sapiens
  light chain complementarity determining region 3 for antibody 28333
MQILKTPIT

SEQ ID NO: 56666 - protein, 12 aa, Homo sapiens
  heavy chain complementarity determining region 3 for antibody 28333
ARDGGSSWSEFT

SEQ ID NO: 56667 - protein, 9 aa, Homo sapiens
  light chain complementarity determining region 3 for antibody 28334
MQGTYWPPI

SEQ ID NO: 56668 - protein, 11 aa, Homo sapiens
  heavy chain complementarity determining region 3 for antibody 28334
ARDPFFGALDC

SEQ ID NO: 56669 - protein, 9 aa, Homo sapiens
  light chain complementarity determining region 3 for antibody 28335
MQGTYGPNT

SEQ ID NO: 56670 - protein, 11 aa, Homo sapiens
  heavy chain complementarity determining region 3 for antibody 28335
ARNPDWGALDY

SEQ ID NO: 56671 - protein, 10 aa, Homo sapiens
  light chain complementarity determining region 3 for antibody 28336
MQGTTWPPWT

SEQ ID NO: 56672 - protein, 17 aa, Homo sapiens
  heavy chain complementarity determining region 3 for antibody 28336
VRDGYTASGRRNAPGAN

SEQ ID NO: 56673 - protein, 9 aa, Homo sapiens
  light chain complementarity determining region 3 for antibody 28337
MQGTQRPPT

SEQ ID NO: 56674 - protein, 15 aa, Homo sapiens
  heavy chain complementarity determining region 3 for antibody 28337
AKSSGPSIAVTGFDY

SEQ ID NO: 56675 - protein, 9 aa, Homo sapiens
  light chain complementarity determining region 3 for antibody 28338
MQGTPWPNT

SEQ ID NO: 56676 - protein, 11 aa, Homo sapiens
  heavy chain complementarity determining region 3 for antibody 28338
ARDPGWGARDY

SEQ ID NO: 56677 - protein, 9 aa, Homo sapiens
  light chain complementarity determining region 3 for antibody 28339
MQGTPWPHP

SEQ ID NO: 56678 - protein, 11 aa, Homo sapiens
  heavy chain complementarity determining region 3 for antibody 28339
ARDPGWGARDY

SEQ ID NO: 56679 - protein, 9 aa, Homo sapiens
  light chain complementarity determining region 3 for antibody 28340
MQGTPCPHT

SEQ ID NO: 56680 - protein, 11 aa, Homo sapiens
  heavy chain complementarity determining region 3 for antibody 28340
ARDPGWGARDY

SEQ ID NO: 56681 - protein, 9 aa, Homo sapiens
  light chain complementarity determining region 3 for antibody 28341
MQGTNWPYT

SEQ ID NO: 56682 - protein, 11 aa, Homo sapiens
  heavy chain complementarity determining region 3 for antibody 28341
IKDMSPGGADV

SEQ ID NO: 56683 - protein, 9 aa, Homo sapiens
  light chain complementarity determining region 3 for antibody 28342
MQGTNWPRT

SEQ ID NO: 56684 - protein, 17 aa, Homo sapiens
  heavy chain complementarity determining region 3 for antibody 28342
ARDAGSSWYLIVDAFDI

SEQ ID NO: 56685 - protein, 9 aa, Homo sapiens
  light chain complementarity determining region 3 for antibody 28343
MQGTNWPPT

SEQ ID NO: 56686 - protein, 13 aa, Homo sapiens
  heavy chain complementarity determining region 3 for antibody 28343
AGGNGVYDYFCDY

SEQ ID NO: 56687 - protein, 10 aa, Homo sapiens
  light chain complementarity determining region 3 for antibody 28344
MQGTNWPPGT

SEQ ID NO: 56688 - protein, 12 aa, Homo sapiens
  heavy chain complementarity determining region 3 for antibody 28344
TTGLNWGWEPDC

SEQ ID NO: 56689 - protein, 9 aa, Homo sapiens
  light chain complementarity determining region 3 for antibody 28345
MQGTHWPYP

SEQ ID NO: 56690 - protein, 11 aa, Homo sapiens
  heavy chain complementarity determining region 3 for antibody 28345
GKDLLPGGLDV

SEQ ID NO: 56691 - protein, 8 aa, Homo sapiens
  light chain complementarity determining region 3 for antibody 28346
MQGTHWPT

SEQ ID NO: 56692 - protein, 21 aa, Homo sapiens
  heavy chain complementarity determining region 3 for antibody 28346
AKDRTNYYESNGQYYTPKGDL

SEQ ID NO: 56693 - protein, 9 aa, Homo sapiens
  light chain complementarity determining region 3 for antibody 28347
MQGTHWPST

SEQ ID NO: 56694 - protein, 11 aa, Homo sapiens
  heavy chain complementarity determining region 3 for antibody 28347
ARDPAWGALDI

SEQ ID NO: 56695 - protein, 9 aa, Homo sapiens
  light chain complementarity determining region 3 for antibody 28348
MQGTHWPRT

SEQ ID NO: 56696 - protein, 10 aa, Homo sapiens
  heavy chain complementarity determining region 3 for antibody 28348
VLTGDSWGDR

SEQ ID NO: 56697 - protein, 10 aa, Homo sapiens
  light chain complementarity determining region 3 for antibody 28349
MQGTHWPRRT

SEQ ID NO: 56698 - protein, 12 aa, Homo sapiens
  heavy chain complementarity determining region 3 for antibody 28349
VRDPQIGDVSDY

SEQ ID NO: 56699 - protein, 9 aa, Homo sapiens
  light chain complementarity determining region 3 for antibody 28350
MQGTHWPRP

SEQ ID NO: 56700 - protein, 12 aa, Homo sapiens
  heavy chain complementarity determining region 3 for antibody 28350
ATLSMANAKFDH

SEQ ID NO: 56701 - protein, 9 aa, Homo sapiens
  light chain complementarity determining region 3 for antibody 28351
MQGTHWPRG

SEQ ID NO: 56702 - protein, 18 aa, Homo sapiens
  heavy chain complementarity determining region 3 for antibody 28351
ARDERDTCTNGLCYYFDY

SEQ ID NO: 56703 - protein, 10 aa, Homo sapiens
  light chain complementarity determining region 3 for antibody 28352
MQGTHWPPWR

SEQ ID NO: 56704 - protein, 17 aa, Homo sapiens
  heavy chain complementarity determining region 3 for antibody 28352
VRDGYTASGRRNAPGAN

SEQ ID NO: 56705 - protein, 10 aa, Homo sapiens
  light chain complementarity determining region 3 for antibody 28353
MQGTHWPPWR

SEQ ID NO: 56706 - protein, 12 aa, Homo sapiens
  heavy chain complementarity determining region 3 for antibody 28353
TTGLNWGWEPDC

SEQ ID NO: 56707 - protein, 10 aa, Homo sapiens
  light chain complementarity determining region 3 for antibody 28354
MQGTHWPPTT

SEQ ID NO: 56708 - protein, 14 aa, Homo sapiens
  heavy chain complementarity determining region 3 for antibody 28354
ARSNYGDDGFGMDV

SEQ ID NO: 56709 - protein, 9 aa, Homo sapiens
  light chain complementarity determining region 3 for antibody 28355
MQGTHWPPT

SEQ ID NO: 56710 - protein, 18 aa, Homo sapiens
  heavy chain complementarity determining region 3 for antibody 28355
ARGPYSGYSFETTYYYDY

SEQ ID NO: 56711 - protein, 10 aa, Homo sapiens
  light chain complementarity determining region 3 for antibody 28356
MQGTHWPPGT

SEQ ID NO: 56712 - protein, 12 aa, Homo sapiens
  heavy chain complementarity determining region 3 for antibody 28356
VRDPQIGDVSDY

SEQ ID NO: 56713 - protein, 10 aa, Homo sapiens
  light chain complementarity determining region 3 for antibody 28357
MQGTHWPLRT

SEQ ID NO: 56714 - protein, 12 aa, Homo sapiens
  heavy chain complementarity determining region 3 for antibody 28357
TTGLNWGWEPDY

SEQ ID NO: 56715 - protein, 9 aa, Homo sapiens
  light chain complementarity determining region 3 for antibody 28358
MQGTHWPHT

SEQ ID NO: 56716 - protein, 11 aa, Homo sapiens
  heavy chain complementarity determining region 3 for antibody 28358
IKDMSPGGADV

SEQ ID NO: 56717 - protein, 9 aa, Homo sapiens
  light chain complementarity determining region 3 for antibody 28359
MQGTHWPGT

SEQ ID NO: 56718 - protein, 13 aa, Homo sapiens
  heavy chain complementarity determining region 3 for antibody 28359
ATMLRGHHGADGD

SEQ ID NO: 56719 - protein, 9 aa, Homo sapiens
  light chain complementarity determining region 3 for antibody 28360
MQGTHWPGT

SEQ ID NO: 56720 - protein, 12 aa, Homo sapiens
  heavy chain complementarity determining region 3 for antibody 28360
ATLSMANAKFDH

SEQ ID NO: 56721 - protein, 9 aa, Homo sapiens
  light chain complementarity determining region 3 for antibody 28361
MQGTHWPGT

SEQ ID NO: 56722 - protein, 23 aa, Homo sapiens
  heavy chain complementarity determining region 3 for antibody 28361
ARAQPRWGIAVAGPPGRYYGMDV

SEQ ID NO: 56723 - protein, 9 aa, Homo sapiens
  light chain complementarity determining region 3 for antibody 28362
MQGTHRPPP

SEQ ID NO: 56724 - protein, 15 aa, Homo sapiens
  heavy chain complementarity determining region 3 for antibody 28362
AKSSGPSIAVTGFDY

SEQ ID NO: 56725 - protein, 9 aa, Homo sapiens
  light chain complementarity determining region 3 for antibody 28363
MQGTHRHPT

SEQ ID NO: 56726 - protein, 15 aa, Homo sapiens
  heavy chain complementarity determining region 3 for antibody 28363
AKSSGPSIAVTGFDY

SEQ ID NO: 56727 - protein, 9 aa, Homo sapiens
  light chain complementarity determining region 3 for antibody 28364
MQGTHGPYT

SEQ ID NO: 56728 - protein, 11 aa, Homo sapiens
  heavy chain complementarity determining region 3 for antibody 28364
IKDMSPGGADV

SEQ ID NO: 56729 - protein, 9 aa, Homo sapiens
  light chain complementarity determining region 3 for antibody 28365
MQGTHGPYT

SEQ ID NO: 56730 - protein, 11 aa, Homo sapiens
  heavy chain complementarity determining region 3 for antibody 28365
GKDLLPGGLDV

SEQ ID NO: 56731 - protein, 9 aa, Homo sapiens
  light chain complementarity determining region 3 for antibody 28366
MQGTHGPYT

SEQ ID NO: 56732 - protein, 11 aa, Homo sapiens
  heavy chain complementarity determining region 3 for antibody 28366
ATLRTVGAVDY

SEQ ID NO: 56733 - protein, 9 aa, Homo sapiens
  light chain complementarity determining region 3 for antibody 28367
MQGTHGPWT

SEQ ID NO: 56734 - protein, 12 aa, Homo sapiens
  heavy chain complementarity determining region 3 for antibody 28367
AKGPLITMTGMV

SEQ ID NO: 56735 - protein, 8 aa, Homo sapiens
  light chain complementarity determining region 3 for antibody 28368
MQGTHGPT

SEQ ID NO: 56736 - protein, 21 aa, Homo sapiens
  heavy chain complementarity determining region 3 for antibody 28368
AKDRPNYYESNGQYYTPKGDL

SEQ ID NO: 56737 - protein, 9 aa, Homo sapiens
  light chain complementarity determining region 3 for antibody 28369
MQGTHGPRT

SEQ ID NO: 56738 - protein, 17 aa, Homo sapiens
  heavy chain complementarity determining region 3 for antibody 28369
ARDAGSSWYLIVDAFDI

SEQ ID NO: 56739 - protein, 9 aa, Homo sapiens
  light chain complementarity determining region 3 for antibody 28370
MQGTHGPPT

SEQ ID NO: 56740 - protein, 15 aa, Homo sapiens
  heavy chain complementarity determining region 3 for antibody 28370
AKSSGPNIAVAGFDC

SEQ ID NO: 56741 - protein, 9 aa, Homo sapiens
  light chain complementarity determining region 3 for antibody 28371
MQGTHGPPT

SEQ ID NO: 56742 - protein, 13 aa, Homo sapiens
  heavy chain complementarity determining region 3 for antibody 28371
AGGNGVYDYFCDY

SEQ ID NO: 56743 - protein, 10 aa, Homo sapiens
  light chain complementarity determining region 3 for antibody 28372
MQGSYWPPWT

SEQ ID NO: 56744 - protein, 11 aa, Homo sapiens
  heavy chain complementarity determining region 3 for antibody 28372
ARDTPGVGIDC

SEQ ID NO: 56745 - protein, 10 aa, Homo sapiens
  light chain complementarity determining region 3 for antibody 28373
MQGSYWPPWP

SEQ ID NO: 56746 - protein, 11 aa, Homo sapiens
  heavy chain complementarity determining region 3 for antibody 28373
ARDTPGVGIDY

SEQ ID NO: 56747 - protein, 10 aa, Homo sapiens
  light chain complementarity determining region 3 for antibody 28374
MQGSYWPPWP

SEQ ID NO: 56748 - protein, 11 aa, Homo sapiens
  heavy chain complementarity determining region 3 for antibody 28374
ARDTPGIGIDY

SEQ ID NO: 56749 - protein, 9 aa, Homo sapiens
  light chain complementarity determining region 3 for antibody 28375
MQGSHWPWT

SEQ ID NO: 56750 - protein, 12 aa, Homo sapiens
  heavy chain complementarity determining region 3 for antibody 28375
VNWAEAKTNVAF

SEQ ID NO: 56751 - protein, 9 aa, Homo sapiens
  light chain complementarity determining region 3 for antibody 28376
MQGSHGPPT

SEQ ID NO: 56752 - protein, 7 aa, Homo sapiens
  heavy chain complementarity determining region 3 for antibody 28376
ATNADYL

SEQ ID NO: 56753 - protein, 9 aa, Homo sapiens
  light chain complementarity determining region 3 for antibody 28377
MQGPPWPWT

SEQ ID NO: 56754 - protein, 7 aa, Homo sapiens
  heavy chain complementarity determining region 3 for antibody 28377
STDFLDL

SEQ ID NO: 56755 - protein, 9 aa, Homo sapiens
  light chain complementarity determining region 3 for antibody 28378
MQGLQTPYP

SEQ ID NO: 56756 - protein, 10 aa, Homo sapiens
  heavy chain complementarity determining region 3 for antibody 28378
GRDLSGARDY

SEQ ID NO: 56757 - protein, 9 aa, Homo sapiens
  light chain complementarity determining region 3 for antibody 28379
MQGLQTPST

SEQ ID NO: 56758 - protein, 11 aa, Homo sapiens
  heavy chain complementarity determining region 3 for antibody 28379
ARGSDDWHFDL

SEQ ID NO: 56759 - protein, 9 aa, Homo sapiens
  light chain complementarity determining region 3 for antibody 28380
MQGLQTPQT

SEQ ID NO: 56760 - protein, 15 aa, Homo sapiens
  heavy chain complementarity determining region 3 for antibody 28380
ARGGKVSYSSGRWDY

SEQ ID NO: 56761 - protein, 9 aa, Homo sapiens
  light chain complementarity determining region 3 for antibody 28381
MQGLQTPLT

SEQ ID NO: 56762 - protein, 12 aa, Homo sapiens
  heavy chain complementarity determining region 3 for antibody 28381
AKDSEQKWELHD

SEQ ID NO: 56763 - protein, 9 aa, Homo sapiens
  light chain complementarity determining region 3 for antibody 28382
MQGLQTPLT

SEQ ID NO: 56764 - protein, 12 aa, Homo sapiens
  heavy chain complementarity determining region 3 for antibody 28382
AKDSAKKWELLD

SEQ ID NO: 56765 - protein, 9 aa, Homo sapiens
  light chain complementarity determining region 3 for antibody 28383
MQGLQTPDT

SEQ ID NO: 56766 - protein, 10 aa, Homo sapiens
  heavy chain complementarity determining region 3 for antibody 28383
GRDLTGSKDY

SEQ ID NO: 56767 - protein, 9 aa, Homo sapiens
  light chain complementarity determining region 3 for antibody 28384
MQGLQTPDT

SEQ ID NO: 56768 - protein, 10 aa, Homo sapiens
  heavy chain complementarity determining region 3 for antibody 28384
GRDLSGARDY

SEQ ID NO: 56769 - protein, 8 aa, Homo sapiens
  light chain complementarity determining region 3 for antibody 28385
MQGLQTLT

SEQ ID NO: 56770 - protein, 16 aa, Homo sapiens
  heavy chain complementarity determining region 3 for antibody 28385
AKAGWLVGYDLSRGCA

SEQ ID NO: 56771 - protein, 9 aa, Homo sapiens
  light chain complementarity determining region 3 for antibody 28386
MQGLQSPPP

SEQ ID NO: 56772 - protein, 18 aa, Homo sapiens
  heavy chain complementarity determining region 3 for antibody 28386
THRAVSFHGYYSAWSFDY

SEQ ID NO: 56773 - protein, 9 aa, Homo sapiens
  light chain complementarity determining region 3 for antibody 28387
MQGLQNPPT

SEQ ID NO: 56774 - protein, 12 aa, Homo sapiens
  heavy chain complementarity determining region 3 for antibody 28387
VRNDYGDYGFQY

SEQ ID NO: 56775 - protein, 9 aa, Homo sapiens
  light chain complementarity determining region 3 for antibody 28388
MQGLQNPLT

SEQ ID NO: 56776 - protein, 12 aa, Homo sapiens
  heavy chain complementarity determining region 3 for antibody 28388
VRNDCGDYGFQY

SEQ ID NO: 56777 - protein, 9 aa, Homo sapiens
  light chain complementarity determining region 3 for antibody 28389
MQGLETPFT

SEQ ID NO: 56778 - protein, 15 aa, Homo sapiens
  heavy chain complementarity determining region 3 for antibody 28389
VRHYRIITAPLEGDS

SEQ ID NO: 56779 - protein, 9 aa, Homo sapiens
  light chain complementarity determining region 3 for antibody 28390
MQGLETPFT

SEQ ID NO: 56780 - protein, 15 aa, Homo sapiens
  heavy chain complementarity determining region 3 for antibody 28390
VRHYRETVAGIEGDS

SEQ ID NO: 56781 - protein, 9 aa, Homo sapiens
  light chain complementarity determining region 3 for antibody 28391
MQGLETPFT

SEQ ID NO: 56782 - protein, 15 aa, Homo sapiens
  heavy chain complementarity determining region 3 for antibody 28391
VRHYRELATGIEGDS

SEQ ID NO: 56783 - protein, 9 aa, Homo sapiens
  light chain complementarity determining region 3 for antibody 28392
MQGIHWPGR

SEQ ID NO: 56784 - protein, 6 aa, Homo sapiens
  heavy chain complementarity determining region 3 for antibody 28392
AREGSV

SEQ ID NO: 56785 - protein, 9 aa, Homo sapiens
  light chain complementarity determining region 3 for antibody 28393
MQGAHWPPP

SEQ ID NO: 56786 - protein, 13 aa, Homo sapiens
  heavy chain complementarity determining region 3 for antibody 28393
VRDRGDGYNQIDH

SEQ ID NO: 56787 - protein, 10 aa, Homo sapiens
  light chain complementarity determining region 3 for antibody 28394
MQATHWPSYT

SEQ ID NO: 56788 - protein, 15 aa, Homo sapiens
  heavy chain complementarity determining region 3 for antibody 28394
ARGARGYFSPLDLDF

SEQ ID NO: 56789 - protein, 9 aa, Homo sapiens
  light chain complementarity determining region 3 for antibody 28395
MQATHWPLT

SEQ ID NO: 56790 - protein, 14 aa, Homo sapiens
  heavy chain complementarity determining region 3 for antibody 28395
VRDEGTPVNYRFDY

SEQ ID NO: 56791 - protein, 9 aa, Homo sapiens
  light chain complementarity determining region 3 for antibody 28396
MQATHGPLT

SEQ ID NO: 56792 - protein, 19 aa, Homo sapiens
  heavy chain complementarity determining region 3 for antibody 28396
VKDQDGSGSYYKTPPTFDY

SEQ ID NO: 56793 - protein, 8 aa, Homo sapiens
  light chain complementarity determining region 3 for antibody 28397
MQAQQTPG

SEQ ID NO: 56794 - protein, 19 aa, Homo sapiens
  heavy chain complementarity determining region 3 for antibody 28397
ANFGSGNFYNVRYYYGMDV

SEQ ID NO: 56795 - protein, 9 aa, Homo sapiens
  light chain complementarity determining region 3 for antibody 28398
MQALRSPPT

SEQ ID NO: 56796 - protein, 19 aa, Homo sapiens
  heavy chain complementarity determining region 3 for antibody 28398
ARRGATVAGISGWGYGMDV

SEQ ID NO: 56797 - protein, 8 aa, Homo sapiens
  light chain complementarity determining region 3 for antibody 28399
MQALRPLT

SEQ ID NO: 56798 - protein, 16 aa, Homo sapiens
  heavy chain complementarity determining region 3 for antibody 28399
AKGGWLVGYDLSRGSA

SEQ ID NO: 56799 - protein, 8 aa, Homo sapiens
  light chain complementarity determining region 3 for antibody 28400
MQALRGLP

SEQ ID NO: 56800 - protein, 14 aa, Homo sapiens
  heavy chain complementarity determining region 3 for antibody 28400
AYNSPTVLTPGFDY

SEQ ID NO: 56801 - protein, 8 aa, Homo sapiens
  light chain complementarity determining region 3 for antibody 28401
MQALRGFI

SEQ ID NO: 56802 - protein, 14 aa, Homo sapiens
  heavy chain complementarity determining region 3 for antibody 28401
AYNSPTVLTPGFDY

SEQ ID NO: 56803 - protein, 8 aa, Homo sapiens
  light chain complementarity determining region 3 for antibody 28402
MQALQTRT

SEQ ID NO: 56804 - protein, 16 aa, Homo sapiens
  heavy chain complementarity determining region 3 for antibody 28402
AKDRLTSDYDFDSFDI

SEQ ID NO: 56805 - protein, 9 aa, Homo sapiens
  light chain complementarity determining region 3 for antibody 28403
MQALQTRFT

SEQ ID NO: 56806 - protein, 12 aa, Homo sapiens
  heavy chain complementarity determining region 3 for antibody 28403
SKMVGWPYGMDV

SEQ ID NO: 56807 - protein, 9 aa, Homo sapiens
  light chain complementarity determining region 3 for antibody 28404
MQALQTPVT

SEQ ID NO: 56808 - protein, 17 aa, Homo sapiens
  heavy chain complementarity determining region 3 for antibody 28404
ARVRYFGSGSSLYYFDY

SEQ ID NO: 56809 - protein, 9 aa, Homo sapiens
  light chain complementarity determining region 3 for antibody 28405
MQALQTPST

SEQ ID NO: 56810 - protein, 9 aa, Homo sapiens
  heavy chain complementarity determining region 3 for antibody 28405
ARGDGAMDV

SEQ ID NO: 56811 - protein, 9 aa, Homo sapiens
  light chain complementarity determining region 3 for antibody 28406
MQALQTPRT

SEQ ID NO: 56812 - protein, 13 aa, Homo sapiens
  heavy chain complementarity determining region 3 for antibody 28406
AAHPDPDLYYFDY

SEQ ID NO: 56813 - protein, 9 aa, Homo sapiens
  light chain complementarity determining region 3 for antibody 28407
MQALQTPRP

SEQ ID NO: 56814 - protein, 23 aa, Homo sapiens
  heavy chain complementarity determining region 3 for antibody 28407
ARHREYASGPYYSPLYYYYGVDV

SEQ ID NO: 56815 - protein, 9 aa, Homo sapiens
  light chain complementarity determining region 3 for antibody 28408
MQALQTPRP

SEQ ID NO: 56816 - protein, 25 aa, Homo sapiens
  heavy chain complementarity determining region 3 for antibody 28408
ARGAGRDGVVVADARSWAYYYGMDV

SEQ ID NO: 56817 - protein, 9 aa, Homo sapiens
  light chain complementarity determining region 3 for antibody 28409
MQALQTPQT

SEQ ID NO: 56818 - protein, 19 aa, Homo sapiens
  heavy chain complementarity determining region 3 for antibody 28409
VRGFNCIRSGRIPPDAFDI

SEQ ID NO: 56819 - protein, 9 aa, Homo sapiens
  light chain complementarity determining region 3 for antibody 28410
MQALQTPQP

SEQ ID NO: 56820 - protein, 15 aa, Homo sapiens
  heavy chain complementarity determining region 3 for antibody 28410
ARGGKVSYSSGRWDY

SEQ ID NO: 56821 - protein, 10 aa, Homo sapiens
  light chain complementarity determining region 3 for antibody 28411
MQALQTPPYT

SEQ ID NO: 56822 - protein, 17 aa, Homo sapiens
  heavy chain complementarity determining region 3 for antibody 28411
AIVFNSGSYLSGNPFEI

SEQ ID NO: 56823 - protein, 9 aa, Homo sapiens
  light chain complementarity determining region 3 for antibody 28412
MQALQTPNT

SEQ ID NO: 56824 - protein, 9 aa, Homo sapiens
  heavy chain complementarity determining region 3 for antibody 28412
ARGDGAMDV

SEQ ID NO: 56825 - protein, 9 aa, Homo sapiens
  light chain complementarity determining region 3 for antibody 28413
MQALQTPNT

SEQ ID NO: 56826 - protein, 21 aa, Homo sapiens
  heavy chain complementarity determining region 3 for antibody 28413
ARDKNTWNSDGRYYYYWGLDV

SEQ ID NO: 56827 - protein, 9 aa, Homo sapiens
  light chain complementarity determining region 3 for antibody 28414
MQALQTPLT

SEQ ID NO: 56828 - protein, 17 aa, Homo sapiens
  heavy chain complementarity determining region 3 for antibody 28414
TRGYCTTTSCQLNWFDP

SEQ ID NO: 56829 - protein, 9 aa, Homo sapiens
  light chain complementarity determining region 3 for antibody 28415
MQALQTPLT

SEQ ID NO: 56830 - protein, 19 aa, Homo sapiens
  heavy chain complementarity determining region 3 for antibody 28415
ASEAYCSGDNCYEIYGMDV

SEQ ID NO: 56831 - protein, 9 aa, Homo sapiens
  light chain complementarity determining region 3 for antibody 28416
MQALQTPLT

SEQ ID NO: 56832 - protein, 12 aa, Homo sapiens
  heavy chain complementarity determining region 3 for antibody 28416
ARIRDWNRGMDV

SEQ ID NO: 56833 - protein, 9 aa, Homo sapiens
  light chain complementarity determining region 3 for antibody 28417
MQALQTPLT

SEQ ID NO: 56834 - protein, 27 aa, Homo sapiens
  heavy chain complementarity determining region 3 for antibody 28417
AKDLKTINPYKYDSSAYYPYYYYGMDV

SEQ ID NO: 56835 - protein, 10 aa, Homo sapiens
  light chain complementarity determining region 3 for antibody 28418
MQALQTPKVT

SEQ ID NO: 56836 - protein, 18 aa, Homo sapiens
  heavy chain complementarity determining region 3 for antibody 28418
ARRPRLVHMIISGDFVDP

SEQ ID NO: 56837 - protein, 9 aa, Homo sapiens
  light chain complementarity determining region 3 for antibody 28419
MQALQTPKT

SEQ ID NO: 56838 - protein, 19 aa, Homo sapiens
  heavy chain complementarity determining region 3 for antibody 28419
VRGFNFIRSGRIPPDAFDI

SEQ ID NO: 56839 - protein, 10 aa, Homo sapiens
  light chain complementarity determining region 3 for antibody 28420
MQALQTPKGT

SEQ ID NO: 56840 - protein, 18 aa, Homo sapiens
  heavy chain complementarity determining region 3 for antibody 28420
ARRPRLMHMIISGDFVDP

SEQ ID NO: 56841 - protein, 10 aa, Homo sapiens
  light chain complementarity determining region 3 for antibody 28421
MQALQTPGET

SEQ ID NO: 56842 - protein, 14 aa, Homo sapiens
  heavy chain complementarity determining region 3 for antibody 28421
ARISKGTASIGFDP

SEQ ID NO: 56843 - protein, 10 aa, Homo sapiens
  light chain complementarity determining region 3 for antibody 28422
MQALQTPGAT

SEQ ID NO: 56844 - protein, 14 aa, Homo sapiens
  heavy chain complementarity determining region 3 for antibody 28422
ARISKGTASIGFDP

SEQ ID NO: 56845 - protein, 9 aa, Homo sapiens
  light chain complementarity determining region 3 for antibody 28423
MQALQTPFT

SEQ ID NO: 56846 - protein, 10 aa, Homo sapiens
  heavy chain complementarity determining region 3 for antibody 28423
ATGSSSWIDY

SEQ ID NO: 56847 - protein, 8 aa, Homo sapiens
  light chain complementarity determining region 3 for antibody 28424
MQALQTPF

SEQ ID NO: 56848 - protein, 23 aa, Homo sapiens
  heavy chain complementarity determining region 3 for antibody 28424
AHSPDVLRYFDPLWGQGFAPFDI

SEQ ID NO: 56849 - protein, 9 aa, Homo sapiens
  light chain complementarity determining region 3 for antibody 28425
MQALQTPDT

SEQ ID NO: 56850 - protein, 9 aa, Homo sapiens
  heavy chain complementarity determining region 3 for antibody 28425
ARGDGAMDV

SEQ ID NO: 56851 - protein, 9 aa, Homo sapiens
  light chain complementarity determining region 3 for antibody 28426
MQALQSPFT

SEQ ID NO: 56852 - protein, 14 aa, Homo sapiens
  heavy chain complementarity determining region 3 for antibody 28426
ASGYSHDRAGAFNI

SEQ ID NO: 56853 - protein, 9 aa, Homo sapiens
  light chain complementarity determining region 3 for antibody 28427
MQALQPRFT

SEQ ID NO: 56854 - protein, 12 aa, Homo sapiens
  heavy chain complementarity determining region 3 for antibody 28427
SKMVGWTYGMDV

SEQ ID NO: 56855 - protein, 8 aa, Homo sapiens
  light chain complementarity determining region 3 for antibody 28428
MQALQPPT

SEQ ID NO: 56856 - protein, 15 aa, Homo sapiens
  heavy chain complementarity determining region 3 for antibody 28428
ARRDYYDSSGYRLDY

SEQ ID NO: 56857 - protein, 10 aa, Homo sapiens
  light chain complementarity determining region 3 for antibody 28429
MQALQPHGNT

SEQ ID NO: 56858 - protein, 20 aa, Homo sapiens
  heavy chain complementarity determining region 3 for antibody 28429
ARLKAASAGLPSYYYAGMDV

SEQ ID NO: 56859 - protein, 8 aa, Homo sapiens
  light chain complementarity determining region 3 for antibody 28430
MQALQLLT

SEQ ID NO: 56860 - protein, 16 aa, Homo sapiens
  heavy chain complementarity determining region 3 for antibody 28430
AKAGWVVGYDLSRGCA

SEQ ID NO: 56861 - protein, 9 aa, Homo sapiens
  light chain complementarity determining region 3 for antibody 28431
MQALQIPWT

SEQ ID NO: 56862 - protein, 16 aa, Homo sapiens
  heavy chain complementarity determining region 3 for antibody 28431
ARDLNRYTGSQGSFDI

SEQ ID NO: 56863 - protein, 8 aa, Homo sapiens
  light chain complementarity determining region 3 for antibody 28432
MQALQIPT

SEQ ID NO: 56864 - protein, 9 aa, Homo sapiens
  heavy chain complementarity determining region 3 for antibody 28432
ARDSSAFGP

SEQ ID NO: 56865 - protein, 9 aa, Homo sapiens
  light chain complementarity determining region 3 for antibody 28433
MQALQIPRT

SEQ ID NO: 56866 - protein, 13 aa, Homo sapiens
  heavy chain complementarity determining region 3 for antibody 28433
AKHSGLAGYPLDY

SEQ ID NO: 56867 - protein, 9 aa, Homo sapiens
  light chain complementarity determining region 3 for antibody 28434
MQALQIPPT

SEQ ID NO: 56868 - protein, 11 aa, Homo sapiens
  heavy chain complementarity determining region 3 for antibody 28434
PRYFDRQSFDY

SEQ ID NO: 56869 - protein, 9 aa, Homo sapiens
  light chain complementarity determining region 3 for antibody 28435
MQALLSPRT

SEQ ID NO: 56870 - protein, 13 aa, Homo sapiens
  heavy chain complementarity determining region 3 for antibody 28435
ARDRLGMGNFFDF

SEQ ID NO: 56871 - protein, 9 aa, Homo sapiens
  light chain complementarity determining region 3 for antibody 28436
MQALKTPPA

SEQ ID NO: 56872 - protein, 13 aa, Homo sapiens
  heavy chain complementarity determining region 3 for antibody 28436
ARGVDGYDPYLDY

SEQ ID NO: 56873 - protein, 9 aa, Homo sapiens
  light chain complementarity determining region 3 for antibody 28437
MQALKTLYT

SEQ ID NO: 56874 - protein, 14 aa, Homo sapiens
  heavy chain complementarity determining region 3 for antibody 28437
ARPPGSSWQSGVVY

SEQ ID NO: 56875 - protein, 7 aa, Homo sapiens
  light chain complementarity determining region 3 for antibody 28438
MQALKTL

SEQ ID NO: 56876 - protein, 15 aa, Homo sapiens
  heavy chain complementarity determining region 3 for antibody 28438
ARGGYGGSLYWYFDL

SEQ ID NO: 56877 - protein, 9 aa, Homo sapiens
  light chain complementarity determining region 3 for antibody 28439
MQALKNPRT

SEQ ID NO: 56878 - protein, 13 aa, Homo sapiens
  heavy chain complementarity determining region 3 for antibody 28439
AKHSGLAGYPLDY

SEQ ID NO: 56879 - protein, 8 aa, Homo sapiens
  light chain complementarity determining region 3 for antibody 28440
MQALHTPT

SEQ ID NO: 56880 - protein, 9 aa, Homo sapiens
  heavy chain complementarity determining region 3 for antibody 28440
ARDSSAFGP

SEQ ID NO: 56881 - protein, 9 aa, Homo sapiens
  light chain complementarity determining region 3 for antibody 28441
MQALHTPPA

SEQ ID NO: 56882 - protein, 13 aa, Homo sapiens
  heavy chain complementarity determining region 3 for antibody 28441
ARGVDGYDPYLDY

SEQ ID NO: 56883 - protein, 9 aa, Homo sapiens
  light chain complementarity determining region 3 for antibody 28442
MQALHSPLT

SEQ ID NO: 56884 - protein, 14 aa, Homo sapiens
  heavy chain complementarity determining region 3 for antibody 28442
ASGYSHDRAGAFNI

SEQ ID NO: 56885 - protein, 9 aa, Homo sapiens
  light chain complementarity determining region 3 for antibody 28443
MQALGTPFT

SEQ ID NO: 56886 - protein, 15 aa, Homo sapiens
  heavy chain complementarity determining region 3 for antibody 28443
VRHYRIITAPLEGDS

SEQ ID NO: 56887 - protein, 9 aa, Homo sapiens
  light chain complementarity determining region 3 for antibody 28444
MQALGTPFT

SEQ ID NO: 56888 - protein, 15 aa, Homo sapiens
  heavy chain complementarity determining region 3 for antibody 28444
VRHYRELTTGIEGDS

SEQ ID NO: 56889 - protein, 8 aa, Homo sapiens
  light chain complementarity determining region 3 for antibody 28445
MQALGGFT

SEQ ID NO: 56890 - protein, 14 aa, Homo sapiens
  heavy chain complementarity determining region 3 for antibody 28445
AYNSPTVLTPGFDY

SEQ ID NO: 56891 - protein, 9 aa, Homo sapiens
  light chain complementarity determining region 3 for antibody 28446
MQALETPST

SEQ ID NO: 56892 - protein, 15 aa, Homo sapiens
  heavy chain complementarity determining region 3 for antibody 28446
VRHYRIITAPLEGDS

SEQ ID NO: 56893 - protein, 9 aa, Homo sapiens
  light chain complementarity determining region 3 for antibody 28447
MQALETPLT

SEQ ID NO: 56894 - protein, 15 aa, Homo sapiens
  heavy chain complementarity determining region 3 for antibody 28447
VRHYRELATGIEGDS

SEQ ID NO: 56895 - protein, 9 aa, Homo sapiens
  light chain complementarity determining region 3 for antibody 28448
MQALETPFT

SEQ ID NO: 56896 - protein, 15 aa, Homo sapiens
  heavy chain complementarity determining region 3 for antibody 28448
VRHDRETVAGIEGDS

SEQ ID NO: 56897 - protein, 9 aa, Homo sapiens
  light chain complementarity determining region 3 for antibody 28449
MQALETPFT

SEQ ID NO: 56898 - protein, 19 aa, Homo sapiens
  heavy chain complementarity determining region 3 for antibody 28449
ARATSYSSPWVVFYYGVDL

SEQ ID NO: 56899 - protein, 9 aa, Homo sapiens
  light chain complementarity determining region 3 for antibody 28450
MQALEPPFT

SEQ ID NO: 56900 - protein, 15 aa, Homo sapiens
  heavy chain complementarity determining region 3 for antibody 28450
VRHYRELATGIEGDS

SEQ ID NO: 56901 - protein, 9 aa, Homo sapiens
  light chain complementarity determining region 3 for antibody 28451
MQALEIPLT

SEQ ID NO: 56902 - protein, 12 aa, Homo sapiens
  heavy chain complementarity determining region 3 for antibody 28451
THRLNWGSGFDY

SEQ ID NO: 56903 - protein, 9 aa, Homo sapiens
  light chain complementarity determining region 3 for antibody 28452
MQALEIPLT

SEQ ID NO: 56904 - protein, 24 aa, Homo sapiens
  heavy chain complementarity determining region 3 for antibody 28452
ARDGGPLVRGIIHPSLYYYYGLDV

SEQ ID NO: 56905 - protein, 9 aa, Homo sapiens
  light chain complementarity determining region 3 for antibody 28453
MQALATPFT

SEQ ID NO: 56906 - protein, 15 aa, Homo sapiens
  heavy chain complementarity determining region 3 for antibody 28453
VRHYRELATGIEGDS

SEQ ID NO: 56907 - protein, 9 aa, Homo sapiens
  light chain complementarity determining region 3 for antibody 28454
MQAIETPFT

SEQ ID NO: 56908 - protein, 15 aa, Homo sapiens
  heavy chain complementarity determining region 3 for antibody 28454
VRHYRETVAGIEGDS

SEQ ID NO: 56909 - protein, 9 aa, Homo sapiens
  light chain complementarity determining region 3 for antibody 28455
MPVLQTPLT

SEQ ID NO: 56910 - protein, 12 aa, Homo sapiens
  heavy chain complementarity determining region 3 for antibody 28455
VKDSDKKWELLD

SEQ ID NO: 56911 - protein, 9 aa, Homo sapiens
  light chain complementarity determining region 3 for antibody 28456
MPSRRWPHT

SEQ ID NO: 56912 - protein, 8 aa, Homo sapiens
  heavy chain complementarity determining region 3 for antibody 28456
TAWGSSQH

SEQ ID NO: 56913 - protein, 8 aa, Homo sapiens
  light chain complementarity determining region 3 for antibody 28457
MKGTKGRP

SEQ ID NO: 56914 - protein, 15 aa, Homo sapiens
  heavy chain complementarity determining region 3 for antibody 28457
ATDWSFQMIEGNFHH

SEQ ID NO: 56915 - protein, 9 aa, Homo sapiens
  light chain complementarity determining region 3 for antibody 28458
MHALRTRLT

SEQ ID NO: 56916 - protein, 23 aa, Homo sapiens
  heavy chain complementarity determining region 3 for antibody 28458
ARVSQNLGEWSGSSRYGINAFDP

SEQ ID NO: 56917 - protein, 9 aa, Homo sapiens
  light chain complementarity determining region 3 for antibody 28459
MHALQTPRT

SEQ ID NO: 56918 - protein, 18 aa, Homo sapiens
  heavy chain complementarity determining region 3 for antibody 28459
ATSGCRSTSCYADYGMDV

SEQ ID NO: 56919 - protein, 8 aa, Homo sapiens
  light chain complementarity determining region 3 for antibody 28460
MHALQTPG

SEQ ID NO: 56920 - protein, 19 aa, Homo sapiens
  heavy chain complementarity determining region 3 for antibody 28460
ANFCSGNFYNVRYYYGMDV

SEQ ID NO: 56921 - protein, 8 aa, Homo sapiens
  light chain complementarity determining region 3 for antibody 28461
MHALQTPG

SEQ ID NO: 56922 - protein, 19 aa, Homo sapiens
  heavy chain complementarity determining region 3 for antibody 28461
ANCGSGNFYNVRYYYGMDV

SEQ ID NO: 56923 - protein, 9 aa, Homo sapiens
  light chain complementarity determining region 3 for antibody 28462
MHALETPFT

SEQ ID NO: 56924 - protein, 15 aa, Homo sapiens
  heavy chain complementarity determining region 3 for antibody 28462
VRHYRETVAGIEGDS

SEQ ID NO: 56925 - protein, 9 aa, Homo sapiens
  light chain complementarity determining region 3 for antibody 28463
LQYYVTPWT

SEQ ID NO: 56926 - protein, 15 aa, Homo sapiens
  heavy chain complementarity determining region 3 for antibody 28463
VRQSKVDNNYNYPDF

SEQ ID NO: 56927 - protein, 9 aa, Homo sapiens
  light chain complementarity determining region 3 for antibody 28464
LQYYSTPGT

SEQ ID NO: 56928 - protein, 15 aa, Homo sapiens
  heavy chain complementarity determining region 3 for antibody 28464
IRQSKVDNYYNYPDF

SEQ ID NO: 56929 - protein, 10 aa, Homo sapiens
  light chain complementarity determining region 3 for antibody 28465
LQYYGDPPYT

SEQ ID NO: 56930 - protein, 21 aa, Homo sapiens
  heavy chain complementarity determining region 3 for antibody 28465
ASGGMYEYNWENSWENQKFDN

SEQ ID NO: 56931 - protein, 9 aa, Homo sapiens
  light chain complementarity determining region 3 for antibody 28466
LQYYATPRT

SEQ ID NO: 56932 - protein, 15 aa, Homo sapiens
  heavy chain complementarity determining region 3 for antibody 28466
VRQSKVDNNYNYPDF

SEQ ID NO: 56933 - protein, 9 aa, Homo sapiens
  light chain complementarity determining region 3 for antibody 28467
LQYYANPWT

SEQ ID NO: 56934 - protein, 15 aa, Homo sapiens
  heavy chain complementarity determining region 3 for antibody 28467
VRQSKVDNNYNYPDF

SEQ ID NO: 56935 - protein, 9 aa, Homo sapiens
  light chain complementarity determining region 3 for antibody 28468
LQYRNYKWT

SEQ ID NO: 56936 - protein, 16 aa, Homo sapiens
  heavy chain complementarity determining region 3 for antibody 28468
VKWAPRGLKELRRDDA

SEQ ID NO: 56937 - protein, 9 aa, Homo sapiens
  light chain complementarity determining region 3 for antibody 28469
LQYNYYPPT

SEQ ID NO: 56938 - protein, 18 aa, Homo sapiens
  heavy chain complementarity determining region 3 for antibody 28469
ARDMSGYYGSGSYAPFDY

SEQ ID NO: 56939 - protein, 9 aa, Homo sapiens
  light chain complementarity determining region 3 for antibody 28470
LQYNSYPRT

SEQ ID NO: 56940 - protein, 6 aa, Homo sapiens
  heavy chain complementarity determining region 3 for antibody 28470
SRALDY

SEQ ID NO: 56941 - protein, 9 aa, Homo sapiens
  light chain complementarity determining region 3 for antibody 28471
LQYNSYPRP

SEQ ID NO: 56942 - protein, 9 aa, Homo sapiens
  heavy chain complementarity determining region 3 for antibody 28471
ARGGWATDY

SEQ ID NO: 56943 - protein, 10 aa, Homo sapiens
  light chain complementarity determining region 3 for antibody 28472
LQYNSYPRLT

SEQ ID NO: 56944 - protein, 17 aa, Homo sapiens
  heavy chain complementarity determining region 3 for antibody 28472
TKVGGSNYFYDEEGIDY

SEQ ID NO: 56945 - protein, 9 aa, Homo sapiens
  light chain complementarity determining region 3 for antibody 28473
LQYNNYPYT

SEQ ID NO: 56946 - protein, 9 aa, Homo sapiens
  heavy chain complementarity determining region 3 for antibody 28473
GRGVRSFDP

SEQ ID NO: 56947 - protein, 9 aa, Homo sapiens
  light chain complementarity determining region 3 for antibody 28474
LQYNNYPYT

SEQ ID NO: 56948 - protein, 9 aa, Homo sapiens
  heavy chain complementarity determining region 3 for antibody 28474
GRGVRAFNP

SEQ ID NO: 56949 - protein, 9 aa, Homo sapiens
  light chain complementarity determining region 3 for antibody 28475
LQYNNYPYP

SEQ ID NO: 56950 - protein, 9 aa, Homo sapiens
  heavy chain complementarity determining region 3 for antibody 28475
GRGVRSFNP

SEQ ID NO: 56951 - protein, 9 aa, Homo sapiens
  light chain complementarity determining region 3 for antibody 28476
LQYNNYPST

SEQ ID NO: 56952 - protein, 9 aa, Homo sapiens
  heavy chain complementarity determining region 3 for antibody 28476
GRGVRSFNP

SEQ ID NO: 56953 - protein, 10 aa, Homo sapiens
  light chain complementarity determining region 3 for antibody 28477
LQYNNWPPYT

SEQ ID NO: 56954 - protein, 19 aa, Homo sapiens
  heavy chain complementarity determining region 3 for antibody 28477
ATVSPPHDGGGYAPNWLDP

SEQ ID NO: 56955 - protein, 9 aa, Homo sapiens
  light chain complementarity determining region 3 for antibody 28478
LQYNDWPLI

SEQ ID NO: 56956 - protein, 9 aa, Homo sapiens
  heavy chain complementarity determining region 3 for antibody 28478
AGWFGEFYL

SEQ ID NO: 56957 - protein, 9 aa, Homo sapiens
  light chain complementarity determining region 3 for antibody 28479
LQYNDWPFL

SEQ ID NO: 56958 - protein, 9 aa, Homo sapiens
  heavy chain complementarity determining region 3 for antibody 28479
AGWFGEFYL

SEQ ID NO: 56959 - protein, 9 aa, Homo sapiens
  light chain complementarity determining region 3 for antibody 28480
LQYLHLPRA

SEQ ID NO: 56960 - protein, 16 aa, Homo sapiens
  heavy chain complementarity determining region 3 for antibody 28480
ARGLYGSGGHSNPFDC

SEQ ID NO: 56961 - protein, 9 aa, Homo sapiens
  light chain complementarity determining region 3 for antibody 28481
LQYHSFPLT

SEQ ID NO: 56962 - protein, 5 aa, Homo sapiens
  heavy chain complementarity determining region 3 for antibody 28481
ARVDY

SEQ ID NO: 56963 - protein, 9 aa, Homo sapiens
  light chain complementarity determining region 3 for antibody 28482
LQYGFAQHS

SEQ ID NO: 56964 - protein, 18 aa, Homo sapiens
  heavy chain complementarity determining region 3 for antibody 28482
TGVHGLTMLRGATKPFDF

SEQ ID NO: 56965 - protein, 9 aa, Homo sapiens
  light chain complementarity determining region 3 for antibody 28483
LQYAISPRT

SEQ ID NO: 56966 - protein, 12 aa, Homo sapiens
  heavy chain complementarity determining region 3 for antibody 28483
TTMYGFLHSIDY

SEQ ID NO: 56967 - protein, 9 aa, Homo sapiens
  light chain complementarity determining region 3 for antibody 28484
LQVVSFPRT

SEQ ID NO: 56968 - protein, 8 aa, Homo sapiens
  heavy chain complementarity determining region 3 for antibody 28484
TRNSGWYD

SEQ ID NO: 56969 - protein, 9 aa, Homo sapiens
  light chain complementarity determining region 3 for antibody 28485
LQVVRFPRT

SEQ ID NO: 56970 - protein, 8 aa, Homo sapiens
  heavy chain complementarity determining region 3 for antibody 28485
ARNSGWYD

SEQ ID NO: 56971 - protein, 9 aa, Homo sapiens
  light chain complementarity determining region 3 for antibody 28486
LQTYRTPLP

SEQ ID NO: 56972 - protein, 14 aa, Homo sapiens
  heavy chain complementarity determining region 3 for antibody 28486
ARLSVTQRRDAFDI

SEQ ID NO: 56973 - protein, 9 aa, Homo sapiens
  light chain complementarity determining region 3 for antibody 28487
LQTLKTPWT

SEQ ID NO: 56974 - protein, 13 aa, Homo sapiens
  heavy chain complementarity determining region 3 for antibody 28487
AKVVSYGSGGLQY

SEQ ID NO: 56975 - protein, 9 aa, Homo sapiens
  light chain complementarity determining region 3 for antibody 28488
LQSLQSPLT

SEQ ID NO: 56976 - protein, 13 aa, Homo sapiens
  heavy chain complementarity determining region 3 for antibody 28488
ATSDVWLGELFDF

SEQ ID NO: 56977 - protein, 9 aa, Homo sapiens
  light chain complementarity determining region 3 for antibody 28489
LQSLQSPFP

SEQ ID NO: 56978 - protein, 13 aa, Homo sapiens
  heavy chain complementarity determining region 3 for antibody 28489
ATSDVWLGELFDF

SEQ ID NO: 56979 - protein, 9 aa, Homo sapiens
  light chain complementarity determining region 3 for antibody 28490
LQSLKSPFT

SEQ ID NO: 56980 - protein, 13 aa, Homo sapiens
  heavy chain complementarity determining region 3 for antibody 28490
ATSDVWLGELFDF

SEQ ID NO: 56981 - protein, 9 aa, Homo sapiens
  light chain complementarity determining region 3 for antibody 28491
LQSLHSPFT

SEQ ID NO: 56982 - protein, 13 aa, Homo sapiens
  heavy chain complementarity determining region 3 for antibody 28491
ATSDVWLGELFDF

SEQ ID NO: 56983 - protein, 9 aa, Homo sapiens
  light chain complementarity determining region 3 for antibody 28492
LQSEYWPRT

SEQ ID NO: 56984 - protein, 11 aa, Homo sapiens
  heavy chain complementarity determining region 3 for antibody 28492
VRVGGAGYFDH

SEQ ID NO: 56985 - protein, 9 aa, Homo sapiens
  light chain complementarity determining region 3 for antibody 28493
LQRTPWPPG

SEQ ID NO: 56986 - protein, 18 aa, Homo sapiens
  heavy chain complementarity determining region 3 for antibody 28493
ARDRYSCDSGGCFHWFDP

SEQ ID NO: 56987 - protein, 9 aa, Homo sapiens
  light chain complementarity determining region 3 for antibody 28494
LQNEYWPRT

SEQ ID NO: 56988 - protein, 11 aa, Homo sapiens
  heavy chain complementarity determining region 3 for antibody 28494
MRVGGAGYFDH

SEQ ID NO: 56989 - protein, 9 aa, Homo sapiens
  light chain complementarity determining region 3 for antibody 28495
LQNEYWPRN

SEQ ID NO: 56990 - protein, 11 aa, Homo sapiens
  heavy chain complementarity determining region 3 for antibody 28495
VRVGGAGYFDH

SEQ ID NO: 56991 - protein, 9 aa, Homo sapiens
  light chain complementarity determining region 3 for antibody 28496
LQNEYLPRT

SEQ ID NO: 56992 - protein, 11 aa, Homo sapiens
  heavy chain complementarity determining region 3 for antibody 28496
VRVGGAGYFDH

SEQ ID NO: 56993 - protein, 9 aa, Homo sapiens
  light chain complementarity determining region 3 for antibody 28497
LQNENWPRT

SEQ ID NO: 56994 - protein, 11 aa, Homo sapiens
  heavy chain complementarity determining region 3 for antibody 28497
VRVGGAGYFDH

SEQ ID NO: 56995 - protein, 9 aa, Homo sapiens
  light chain complementarity determining region 3 for antibody 28498
LQKEYWPRT

SEQ ID NO: 56996 - protein, 11 aa, Homo sapiens
  heavy chain complementarity determining region 3 for antibody 28498
VRVGGAGYFDH

SEQ ID NO: 56997 - protein, 9 aa, Homo sapiens
  light chain complementarity determining region 3 for antibody 28499
LQHYTYPWT

SEQ ID NO: 56998 - protein, 16 aa, Homo sapiens
  heavy chain complementarity determining region 3 for antibody 28499
NTDCYYPSSGYSYVDF

SEQ ID NO: 56999 - protein, 9 aa, Homo sapiens
  light chain complementarity determining region 3 for antibody 28500
LQHSSPPLT

SEQ ID NO: 57000 - protein, 6 aa, Homo sapiens
  heavy chain complementarity determining region 3 for antibody 28500
AKFGLV

SEQ ID NO: 57001 - protein, 9 aa, Homo sapiens
  light chain complementarity determining region 3 for antibody 28501
LQHSLDPGT

SEQ ID NO: 57002 - protein, 7 aa, Homo sapiens
  heavy chain complementarity determining region 3 for antibody 28501
ARGGSDY

SEQ ID NO: 57003 - protein, 9 aa, Homo sapiens
  light chain complementarity determining region 3 for antibody 28502
LQHNSYPWT

SEQ ID NO: 57004 - protein, 18 aa, Homo sapiens
  heavy chain complementarity determining region 3 for antibody 28502
ARGGPYDSSGYYSPPIGY

SEQ ID NO: 57005 - protein, 9 aa, Homo sapiens
  light chain complementarity determining region 3 for antibody 28503
LQHNSYPLT

SEQ ID NO: 57006 - protein, 21 aa, Homo sapiens
  heavy chain complementarity determining region 3 for antibody 28503
ATDQVLTGYCSGGSCLEYFQH

SEQ ID NO: 57007 - protein, 9 aa, Homo sapiens
  light chain complementarity determining region 3 for antibody 28504
LQHNSFPWT

SEQ ID NO: 57008 - protein, 11 aa, Homo sapiens
  heavy chain complementarity determining region 3 for antibody 28504
VRDVPPAHLDY

SEQ ID NO: 57009 - protein, 9 aa, Homo sapiens
  light chain complementarity determining region 3 for antibody 28505
LQHNSFPWP

SEQ ID NO: 57010 - protein, 11 aa, Homo sapiens
  heavy chain complementarity determining region 3 for antibody 28505
VRDVPTAHLDY

SEQ ID NO: 57011 - protein, 9 aa, Homo sapiens
  light chain complementarity determining region 3 for antibody 28506
LQHNAFPYT

SEQ ID NO: 57012 - protein, 16 aa, Homo sapiens
  heavy chain complementarity determining region 3 for antibody 28506
TFFYACSPTGICARNY

SEQ ID NO: 57013 - protein, 9 aa, Homo sapiens
  light chain complementarity determining region 3 for antibody 28507
LQHDTNPRT

SEQ ID NO: 57014 - protein, 22 aa, Homo sapiens
  heavy chain complementarity determining region 3 for antibody 28507
VRDDLGDPGASSRIHNYYGMDV

SEQ ID NO: 57015 - protein, 10 aa, Homo sapiens
  light chain complementarity determining region 3 for antibody 28508
LQHDNFPLYT

SEQ ID NO: 57016 - protein, 17 aa, Homo sapiens
  heavy chain complementarity determining region 3 for antibody 28508
ARNFWSSVAMGGIYFDL

SEQ ID NO: 57017 - protein, 9 aa, Homo sapiens
  light chain complementarity determining region 3 for antibody 28509
LQHDNFPGT

SEQ ID NO: 57018 - protein, 20 aa, Homo sapiens
  heavy chain complementarity determining region 3 for antibody 28509
AREVYYDRSGYYYSHKWFDP

SEQ ID NO: 57019 - protein, 9 aa, Homo sapiens
  light chain complementarity determining region 3 for antibody 28510
LQHDNFPGK

SEQ ID NO: 57020 - protein, 20 aa, Homo sapiens
  heavy chain complementarity determining region 3 for antibody 28510
AREVYYDRSGYYYNHKWFDP

SEQ ID NO: 57021 - protein, 8 aa, Homo sapiens
  light chain complementarity determining region 3 for antibody 28511
LQHDNFPF

SEQ ID NO: 57022 - protein, 16 aa, Homo sapiens
  heavy chain complementarity determining region 3 for antibody 28511
ARHSLGLEWEFQWGDY

SEQ ID NO: 57023 - protein, 9 aa, Homo sapiens
  light chain complementarity determining region 3 for antibody 28512
LQHDDYLLT

SEQ ID NO: 57024 - protein, 12 aa, Homo sapiens
  heavy chain complementarity determining region 3 for antibody 28512
TTLYRIHLWPDL

SEQ ID NO: 57025 - protein, 9 aa, Homo sapiens
  light chain complementarity determining region 3 for antibody 28513
LQGVSFPRT

SEQ ID NO: 57026 - protein, 8 aa, Homo sapiens
  heavy chain complementarity determining region 3 for antibody 28513
ARNSGWYD

SEQ ID NO: 57027 - protein, 9 aa, Homo sapiens
  light chain complementarity determining region 3 for antibody 28514
LQGNRFPHT

SEQ ID NO: 57028 - protein, 13 aa, Homo sapiens
  heavy chain complementarity determining region 3 for antibody 28514
ARCSGNSCYSMDH

SEQ ID NO: 57029 - protein, 9 aa, Homo sapiens
  light chain complementarity determining region 3 for antibody 28515
LQEDTYPVS

SEQ ID NO: 57030 - protein, 15 aa, Homo sapiens
  heavy chain complementarity determining region 3 for antibody 28515
ARIRRYGSTWETLDH

SEQ ID NO: 57031 - protein, 9 aa, Homo sapiens
  light chain complementarity determining region 3 for antibody 28516
LQDYNYPVS

SEQ ID NO: 57032 - protein, 14 aa, Homo sapiens
  heavy chain complementarity determining region 3 for antibody 28516
ARRFPFSSGWYVDF

SEQ ID NO: 57033 - protein, 9 aa, Homo sapiens
  light chain complementarity determining region 3 for antibody 28517
LQDYNYPRT

SEQ ID NO: 57034 - protein, 23 aa, Homo sapiens
  heavy chain complementarity determining region 3 for antibody 28517
ALMAKQSPYCSSTSCRNYYGMDV

SEQ ID NO: 57035 - protein, 9 aa, Homo sapiens
  light chain complementarity determining region 3 for antibody 28518
LQDNNYPYT

SEQ ID NO: 57036 - protein, 9 aa, Homo sapiens
  heavy chain complementarity determining region 3 for antibody 28518
GRGVRSFNP

SEQ ID NO: 57037 - protein, 9 aa, Homo sapiens
  light chain complementarity determining region 3 for antibody 28519
LQDGFAQYS

SEQ ID NO: 57038 - protein, 18 aa, Homo sapiens
  heavy chain complementarity determining region 3 for antibody 28519
TGVHGLTMLRGATKPFDF

SEQ ID NO: 57039 - protein, 9 aa, Homo sapiens
  light chain complementarity determining region 3 for antibody 28520
LQDFAYPRI

SEQ ID NO: 57040 - protein, 19 aa, Homo sapiens
  heavy chain complementarity determining region 3 for antibody 28520
VRDLSPVLETNSAIDAFDF

SEQ ID NO: 57041 - protein, 9 aa, Homo sapiens
  light chain complementarity determining region 3 for antibody 28521
LQDDTYPGT

SEQ ID NO: 57042 - protein, 17 aa, Homo sapiens
  heavy chain complementarity determining region 3 for antibody 28521
ARVKWLQLQDFYYGMDV

SEQ ID NO: 57043 - protein, 9 aa, Homo sapiens
  light chain complementarity determining region 3 for antibody 28522
LQCHNLPLI

SEQ ID NO: 57044 - protein, 13 aa, Homo sapiens
  heavy chain complementarity determining region 3 for antibody 28522
AKDIFPHILHPNH

SEQ ID NO: 57045 - protein, 9 aa, Homo sapiens
  light chain complementarity determining region 3 for antibody 28523
LQALQTRFT

SEQ ID NO: 57046 - protein, 12 aa, Homo sapiens
  heavy chain complementarity determining region 3 for antibody 28523
SKMVGWTYGMDV

SEQ ID NO: 57047 - protein, 9 aa, Homo sapiens
  light chain complementarity determining region 3 for antibody 28524
LQALETPLT

SEQ ID NO: 57048 - protein, 12 aa, Homo sapiens
  heavy chain complementarity determining region 3 for antibody 28524
THRLNWGSGFDY

SEQ ID NO: 57049 - protein, 9 aa, Homo sapiens
  light chain complementarity determining region 3 for antibody 28525
LQALETPFT

SEQ ID NO: 57050 - protein, 15 aa, Homo sapiens
  heavy chain complementarity determining region 3 for antibody 28525
VRHYRETVAGIEGDS

SEQ ID NO: 57051 - protein, 11 aa, Homo sapiens
  light chain complementarity determining region 3 for antibody 28526
LHYNNWPLMYP

SEQ ID NO: 57052 - protein, 12 aa, Homo sapiens
  heavy chain complementarity determining region 3 for antibody 28526
ATGITTISNFDY

SEQ ID NO: 57053 - protein, 9 aa, Homo sapiens
  light chain complementarity determining region 3 for antibody 28527
LHYHSFPLT

SEQ ID NO: 57054 - protein, 5 aa, Homo sapiens
  heavy chain complementarity determining region 3 for antibody 28527
ARGDY

SEQ ID NO: 57055 - protein, 9 aa, Homo sapiens
  light chain complementarity determining region 3 for antibody 28528
LHYGSSPRT

SEQ ID NO: 57056 - protein, 9 aa, Homo sapiens
  heavy chain complementarity determining region 3 for antibody 28528
AREYSSFEY

SEQ ID NO: 57057 - protein, 9 aa, Homo sapiens
  light chain complementarity determining region 3 for antibody 28529
LHLHSFPLP

SEQ ID NO: 57058 - protein, 15 aa, Homo sapiens
  heavy chain complementarity determining region 3 for antibody 28529
ARAGAYSGGRYYFDY

SEQ ID NO: 57059 - protein, 9 aa, Homo sapiens
  light chain complementarity determining region 3 for antibody 28530
LHLHIFPLT

SEQ ID NO: 57060 - protein, 15 aa, Homo sapiens
  heavy chain complementarity determining region 3 for antibody 28530
ARAGAYSGGRYYFDY

SEQ ID NO: 57061 - protein, 9 aa, Homo sapiens
  light chain complementarity determining region 3 for antibody 28531
LHHSLDPWT

SEQ ID NO: 57062 - protein, 7 aa, Homo sapiens
  heavy chain complementarity determining region 3 for antibody 28531
ARGGSDY

SEQ ID NO: 57063 - protein, 9 aa, Homo sapiens
  light chain complementarity determining region 3 for antibody 28532
LHEYTYPVS

SEQ ID NO: 57064 - protein, 15 aa, Homo sapiens
  heavy chain complementarity determining region 3 for antibody 28532
ARIRRYGSTWETLDH

SEQ ID NO: 57065 - protein, 9 aa, Homo sapiens
  light chain complementarity determining region 3 for antibody 28533
LHDYNYPVS

SEQ ID NO: 57066 - protein, 15 aa, Homo sapiens
  heavy chain complementarity determining region 3 for antibody 28533
ARVTRYGGAWETLDY

SEQ ID NO: 57067 - protein, 9 aa, Homo sapiens
  light chain complementarity determining region 3 for antibody 28534
LHDYNYPCT

SEQ ID NO: 57068 - protein, 12 aa, Homo sapiens
  heavy chain complementarity determining region 3 for antibody 28534
ARFGGDGGYLDY

SEQ ID NO: 57069 - protein, 9 aa, Homo sapiens
  light chain complementarity determining region 3 for antibody 28535
LHDYNYLWT

SEQ ID NO: 57070 - protein, 12 aa, Homo sapiens
  heavy chain complementarity determining region 3 for antibody 28535
ARFGGDGGYLDY

SEQ ID NO: 57071 - protein, 10 aa, Homo sapiens
  light chain complementarity determining region 3 for antibody 28536
LEYKSWPAFT

SEQ ID NO: 57072 - protein, 11 aa, Homo sapiens
  heavy chain complementarity determining region 3 for antibody 28536
ARRWGSAPFDH

SEQ ID NO: 57073 - protein, 9 aa, Homo sapiens
  light chain complementarity determining region 3 for antibody 28537
KQNDNSPWT

SEQ ID NO: 57074 - protein, 16 aa, Homo sapiens
  heavy chain complementarity determining region 3 for antibody 28537
ARDKFYDSSGYHPFDY

SEQ ID NO: 57075 - protein, 9 aa, Homo sapiens
  light chain complementarity determining region 3 for antibody 28538
KQDDNSPWT

SEQ ID NO: 57076 - protein, 16 aa, Homo sapiens
  heavy chain complementarity determining region 3 for antibody 28538
ARDKFYDSSGYHPFDY

SEQ ID NO: 57077 - protein, 9 aa, Homo sapiens
  light chain complementarity determining region 3 for antibody 28539
HQYYSAPPT

SEQ ID NO: 57078 - protein, 21 aa, Homo sapiens
  heavy chain complementarity determining region 3 for antibody 28539
AKDEGLSVFRSFDGLFDAFDI

SEQ ID NO: 57079 - protein, 9 aa, Homo sapiens
  light chain complementarity determining region 3 for antibody 28540
HQYSTSPRT

SEQ ID NO: 57080 - protein, 17 aa, Homo sapiens
  heavy chain complementarity determining region 3 for antibody 28540
VKPREIYSSGWVDAFDI

SEQ ID NO: 57081 - protein, 9 aa, Homo sapiens
  light chain complementarity determining region 3 for antibody 28541
HQYNTYSKT

SEQ ID NO: 57082 - protein, 23 aa, Homo sapiens
  heavy chain complementarity determining region 3 for antibody 28541
AQDHGGHYDVLTDSWLGYLWIDP

SEQ ID NO: 57083 - protein, 9 aa, Homo sapiens
  light chain complementarity determining region 3 for antibody 28542
HQYNSALGT

SEQ ID NO: 57084 - protein, 12 aa, Homo sapiens
  heavy chain complementarity determining region 3 for antibody 28542
ARDGYNNKESDY

SEQ ID NO: 57085 - protein, 9 aa, Homo sapiens
  light chain complementarity determining region 3 for antibody 28543
HQYNIYSGT

SEQ ID NO: 57086 - protein, 12 aa, Homo sapiens
  heavy chain complementarity determining region 3 for antibody 28543
AKLSGAVATLDY

SEQ ID NO: 57087 - protein, 8 aa, Homo sapiens
  light chain complementarity determining region 3 for antibody 28544
HQYGTSIT

SEQ ID NO: 57088 - protein, 16 aa, Homo sapiens
  heavy chain complementarity determining region 3 for antibody 28544
AHSRYGSNIDPVPFDN

SEQ ID NO: 57089 - protein, 9 aa, Homo sapiens
  light chain complementarity determining region 3 for antibody 28545
HQYGSSPST

SEQ ID NO: 57090 - protein, 11 aa, Homo sapiens
  heavy chain complementarity determining region 3 for antibody 28545
ARGVTMAGSGY

SEQ ID NO: 57091 - protein, 10 aa, Homo sapiens
  light chain complementarity determining region 3 for antibody 28546
HQYGSSPPDT

SEQ ID NO: 57092 - protein, 14 aa, Homo sapiens
  heavy chain complementarity determining region 3 for antibody 28546
ARRGQWLVREAIDY

SEQ ID NO: 57093 - protein, 9 aa, Homo sapiens
  light chain complementarity determining region 3 for antibody 28547
HQYGSSPLT

SEQ ID NO: 57094 - protein, 16 aa, Homo sapiens
  heavy chain complementarity determining region 3 for antibody 28547
TTDHDGSGHYYVAFVS

SEQ ID NO: 57095 - protein, 9 aa, Homo sapiens
  light chain complementarity determining region 3 for antibody 28548
HQYGSSPLT

SEQ ID NO: 57096 - protein, 16 aa, Homo sapiens
  heavy chain complementarity determining region 3 for antibody 28548
TTDHDGSGHYYVAFCS

SEQ ID NO: 57097 - protein, 9 aa, Homo sapiens
  light chain complementarity determining region 3 for antibody 28549
HQYGSSPGT

SEQ ID NO: 57098 - protein, 20 aa, Homo sapiens
  heavy chain complementarity determining region 3 for antibody 28549
ASPRGVSHLATAGSPDYFDL

SEQ ID NO: 57099 - protein, 9 aa, Homo sapiens
  light chain complementarity determining region 3 for antibody 28550
HQYGSSPGP

SEQ ID NO: 57100 - protein, 20 aa, Homo sapiens
  heavy chain complementarity determining region 3 for antibody 28550
ARPRGVSHLATAGSPDYFDL

SEQ ID NO: 57101 - protein, 8 aa, Homo sapiens
  light chain complementarity determining region 3 for antibody 28551
HQYGSSFT

SEQ ID NO: 57102 - protein, 16 aa, Homo sapiens
  heavy chain complementarity determining region 3 for antibody 28551
AHSRYSSNSYPVPFDN

SEQ ID NO: 57103 - protein, 8 aa, Homo sapiens
  light chain complementarity determining region 3 for antibody 28552
HQYGSSFT

SEQ ID NO: 57104 - protein, 16 aa, Homo sapiens
  heavy chain complementarity determining region 3 for antibody 28552
AHSRYSSNICPVPFDN

SEQ ID NO: 57105 - protein, 8 aa, Homo sapiens
  light chain complementarity determining region 3 for antibody 28553
HQYGSSFT

SEQ ID NO: 57106 - protein, 16 aa, Homo sapiens
  heavy chain complementarity determining region 3 for antibody 28553
AHSRYASNLYPVPFDH

SEQ ID NO: 57107 - protein, 8 aa, Homo sapiens
  light chain complementarity determining region 3 for antibody 28554
HQYGSSFP

SEQ ID NO: 57108 - protein, 16 aa, Homo sapiens
  heavy chain complementarity determining region 3 for antibody 28554
AHSRYSSNIYPVPFDN

SEQ ID NO: 57109 - protein, 9 aa, Homo sapiens
  light chain complementarity determining region 3 for antibody 28555
HQYGSLPLT

SEQ ID NO: 57110 - protein, 15 aa, Homo sapiens
  heavy chain complementarity determining region 3 for antibody 28555
AHRPNYYDKAGAFDI

SEQ ID NO: 57111 - protein, 9 aa, Homo sapiens
  light chain complementarity determining region 3 for antibody 28556
HQYGHSPRT

SEQ ID NO: 57112 - protein, 22 aa, Homo sapiens
  heavy chain complementarity determining region 3 for antibody 28556
VRDWERQAYCDGGGCQQDAFDI

SEQ ID NO: 57113 - protein, 9 aa, Homo sapiens
  light chain complementarity determining region 3 for antibody 28557
HQYGDKPRT

SEQ ID NO: 57114 - protein, 16 aa, Homo sapiens
  heavy chain complementarity determining region 3 for antibody 28557
AGLSASGHLAPNTFDV

SEQ ID NO: 57115 - protein, 9 aa, Homo sapiens
  light chain complementarity determining region 3 for antibody 28558
HQYGATPRT

SEQ ID NO: 57116 - protein, 16 aa, Homo sapiens
  heavy chain complementarity determining region 3 for antibody 28558
AGLSASGHLAPNTFDV

SEQ ID NO: 57117 - protein, 9 aa, Homo sapiens
  light chain complementarity determining region 3 for antibody 28559
HQYATSPRT

SEQ ID NO: 57118 - protein, 14 aa, Homo sapiens
  heavy chain complementarity determining region 3 for antibody 28559
ARFGWLDYYYGMDV

SEQ ID NO: 57119 - protein, 9 aa, Homo sapiens
  light chain complementarity determining region 3 for antibody 28560
HQYATSPCT

SEQ ID NO: 57120 - protein, 14 aa, Homo sapiens
  heavy chain complementarity determining region 3 for antibody 28560
ARFGWLDYYYGMDV

SEQ ID NO: 57121 - protein, 10 aa, Homo sapiens
  light chain complementarity determining region 3 for antibody 28561
HQYASSPPTP

SEQ ID NO: 57122 - protein, 18 aa, Homo sapiens
  heavy chain complementarity determining region 3 for antibody 28561
AKEGYYYNSGSYYNPLDY

SEQ ID NO: 57123 - protein, 8 aa, Homo sapiens
  light chain complementarity determining region 3 for antibody 28562
HQVNSYPR

SEQ ID NO: 57124 - protein, 20 aa, Homo sapiens
  heavy chain complementarity determining region 3 for antibody 28562
ARDGAVIAPRTRGPGFYFDS

SEQ ID NO: 57125 - protein, 9 aa, Homo sapiens
  light chain complementarity determining region 3 for antibody 28563
HQTYSTPLT

SEQ ID NO: 57126 - protein, 18 aa, Homo sapiens
  heavy chain complementarity determining region 3 for antibody 28563
ARSGRRDSSGFLVNWFDY

SEQ ID NO: 57127 - protein, 9 aa, Homo sapiens
  light chain complementarity determining region 3 for antibody 28564
HQTSTFPRT

SEQ ID NO: 57128 - protein, 20 aa, Homo sapiens
  heavy chain complementarity determining region 3 for antibody 28564
ARGRRIAALSTAHYYYGMDV

SEQ ID NO: 57129 - protein, 9 aa, Homo sapiens
  light chain complementarity determining region 3 for antibody 28565
HQTIAVPPT

SEQ ID NO: 57130 - protein, 15 aa, Homo sapiens
  heavy chain complementarity determining region 3 for antibody 28565
GRDGYFYGPHWYIDL

SEQ ID NO: 57131 - protein, 9 aa, Homo sapiens
  light chain complementarity determining region 3 for antibody 28566
HQTGGLPHP

SEQ ID NO: 57132 - protein, 7 aa, Homo sapiens
  heavy chain complementarity determining region 3 for antibody 28566
VSVTRGV

SEQ ID NO: 57133 - protein, 9 aa, Homo sapiens
  light chain complementarity determining region 3 for antibody 28567
HQTGGFPHT

SEQ ID NO: 57134 - protein, 7 aa, Homo sapiens
  heavy chain complementarity determining region 3 for antibody 28567
VSVTRGV

SEQ ID NO: 57135 - protein, 9 aa, Homo sapiens
  light chain complementarity determining region 3 for antibody 28568
HQSYNTWDT

SEQ ID NO: 57136 - protein, 12 aa, Homo sapiens
  heavy chain complementarity determining region 3 for antibody 28568
ARDLRPGGAFDI

SEQ ID NO: 57137 - protein, 9 aa, Homo sapiens
  light chain complementarity determining region 3 for antibody 28569
HQSSSLPNT

SEQ ID NO: 57138 - protein, 15 aa, Homo sapiens
  heavy chain complementarity determining region 3 for antibody 28569
ARDRNNDFWSGYRVY

SEQ ID NO: 57139 - protein, 9 aa, Homo sapiens
  light chain complementarity determining region 3 for antibody 28570
HQSSSFPQT

SEQ ID NO: 57140 - protein, 11 aa, Homo sapiens
  heavy chain complementarity determining region 3 for antibody 28570
ARHGPEMEVDF

SEQ ID NO: 57141 - protein, 9 aa, Homo sapiens
  light chain complementarity determining region 3 for antibody 28571
HQSSILPFT

SEQ ID NO: 57142 - protein, 20 aa, Homo sapiens
  heavy chain complementarity determining region 3 for antibody 28571
ARQNDYLWGSFRLRVPYFDF

SEQ ID NO: 57143 - protein, 9 aa, Homo sapiens
  light chain complementarity determining region 3 for antibody 28572
HQSRTSPVT

SEQ ID NO: 57144 - protein, 14 aa, Homo sapiens
  heavy chain complementarity determining region 3 for antibody 28572
IRQSKSDNWNYPDY

SEQ ID NO: 57145 - protein, 9 aa, Homo sapiens
  light chain complementarity determining region 3 for antibody 28573
HQSGYLPRT

SEQ ID NO: 57146 - protein, 15 aa, Homo sapiens
  heavy chain complementarity determining region 3 for antibody 28573
VHTHLWFGDQCYFDF

SEQ ID NO: 57147 - protein, 9 aa, Homo sapiens
  light chain complementarity determining region 3 for antibody 28574
HQSGDLPST

SEQ ID NO: 57148 - protein, 12 aa, Homo sapiens
  heavy chain complementarity determining region 3 for antibody 28574
ARVDSGSYWEDY

SEQ ID NO: 57149 - protein, 9 aa, Homo sapiens
  light chain complementarity determining region 3 for antibody 28575
HQSGALPGT

SEQ ID NO: 57150 - protein, 14 aa, Homo sapiens
  heavy chain complementarity determining region 3 for antibody 28575
VRDASGNSGWYADS

SEQ ID NO: 57151 - protein, 9 aa, Homo sapiens
  light chain complementarity determining region 3 for antibody 28576
HQRRTFPVT

SEQ ID NO: 57152 - protein, 19 aa, Homo sapiens
  heavy chain complementarity determining region 3 for antibody 28576
ARVSARRILTAPRYPLIDS

SEQ ID NO: 57153 - protein, 9 aa, Homo sapiens
  light chain complementarity determining region 3 for antibody 28577
HQRGSLPET

SEQ ID NO: 57154 - protein, 8 aa, Homo sapiens
  heavy chain complementarity determining region 3 for antibody 28577
AVYSSLDY

SEQ ID NO: 57155 - protein, 9 aa, Homo sapiens
  light chain complementarity determining region 3 for antibody 28578
HQRGALPWP

SEQ ID NO: 57156 - protein, 14 aa, Homo sapiens
  heavy chain complementarity determining region 3 for antibody 28578
VRDASGNSGWYADS

SEQ ID NO: 57157 - protein, 8 aa, Homo sapiens
  light chain complementarity determining region 3 for antibody 28579
HQNGTSIT

SEQ ID NO: 57158 - protein, 16 aa, Homo sapiens
  heavy chain complementarity determining region 3 for antibody 28579
AHSRYGSNIYPVPFDN

SEQ ID NO: 57159 - protein, 9 aa, Homo sapiens
  light chain complementarity determining region 3 for antibody 28580
HQNGLSPRT

SEQ ID NO: 57160 - protein, 13 aa, Homo sapiens
  heavy chain complementarity determining region 3 for antibody 28580
ARTGRVAGVEGAS

SEQ ID NO: 57161 - protein, 9 aa, Homo sapiens
  light chain complementarity determining region 3 for antibody 28581
HQNGESPRM

SEQ ID NO: 57162 - protein, 16 aa, Homo sapiens
  heavy chain complementarity determining region 3 for antibody 28581
AKSLGVDAMTTRVYDS

SEQ ID NO: 57163 - protein, 9 aa, Homo sapiens
  light chain complementarity determining region 3 for antibody 28582
HQNGDTPRT

SEQ ID NO: 57164 - protein, 16 aa, Homo sapiens
  heavy chain complementarity determining region 3 for antibody 28582
AGLSASGHLAPNTFDV

SEQ ID NO: 57165 - protein, 9 aa, Homo sapiens
  light chain complementarity determining region 3 for antibody 28583
HQNGDLPYT

SEQ ID NO: 57166 - protein, 12 aa, Homo sapiens
  heavy chain complementarity determining region 3 for antibody 28583
ARVDSGSYWEDY

SEQ ID NO: 57167 - protein, 9 aa, Homo sapiens
  light chain complementarity determining region 3 for antibody 28584
HQGYRPPFI

SEQ ID NO: 57168 - protein, 15 aa, Homo sapiens
  heavy chain complementarity determining region 3 for antibody 28584
TRAQVIWGQLYYFDY

SEQ ID NO: 57169 - protein, 9 aa, Homo sapiens
  light chain complementarity determining region 3 for antibody 28585
HQFYSVPWP

SEQ ID NO: 57170 - protein, 11 aa, Homo sapiens
  heavy chain complementarity determining region 3 for antibody 28585
AGGEQMFPSSR

SEQ ID NO: 57171 - protein, 9 aa, Homo sapiens
  light chain complementarity determining region 3 for antibody 28586
HQFGNSPSV

SEQ ID NO: 57172 - protein, 13 aa, Homo sapiens
  heavy chain complementarity determining region 3 for antibody 28586
ARHGRRSGWYYTY

SEQ ID NO: 57173 - protein, 9 aa, Homo sapiens
  light chain complementarity determining region 3 for antibody 28587
HQFGGAPRT

SEQ ID NO: 57174 - protein, 16 aa, Homo sapiens
  heavy chain complementarity determining region 3 for antibody 28587
ARDPRGGVAVPADFNY

SEQ ID NO: 57175 - protein, 9 aa, Homo sapiens
  light chain complementarity determining region 3 for antibody 28588
HQDGSSPWT

SEQ ID NO: 57176 - protein, 14 aa, Homo sapiens
  heavy chain complementarity determining region 3 for antibody 28588
ARDLSLGMPGGFDY

SEQ ID NO: 57177 - protein, 9 aa, Homo sapiens
  light chain complementarity determining region 3 for antibody 28589
HQDGESPRM

SEQ ID NO: 57178 - protein, 16 aa, Homo sapiens
  heavy chain complementarity determining region 3 for antibody 28589
AKSLGVDAMTTRVYDS

SEQ ID NO: 57179 - protein, 9 aa, Homo sapiens
  light chain complementarity determining region 3 for antibody 28590
HQDGDTPRT

SEQ ID NO: 57180 - protein, 16 aa, Homo sapiens
  heavy chain complementarity determining region 3 for antibody 28590
AGLSASGHLAPNTFDV

SEQ ID NO: 57181 - protein, 10 aa, Homo sapiens
  light chain complementarity determining region 3 for antibody 28591
HQDASSPPTT

SEQ ID NO: 57182 - protein, 18 aa, Homo sapiens
  heavy chain complementarity determining region 3 for antibody 28591
AKEGYYYNSGSYYNPLDY

SEQ ID NO: 57183 - protein, 9 aa, Homo sapiens
  light chain complementarity determining region 3 for antibody 28592
HQCGTSPYT

SEQ ID NO: 57184 - protein, 14 aa, Homo sapiens
  heavy chain complementarity determining region 3 for antibody 28592
ARGRTIQFRDGMDV

SEQ ID NO: 57185 - protein, 9 aa, Homo sapiens
  light chain complementarity determining region 3 for antibody 28593
HPYGESPRM

SEQ ID NO: 57186 - protein, 16 aa, Homo sapiens
  heavy chain complementarity determining region 3 for antibody 28593
AKSLGVDAMTTRVYDS

SEQ ID NO: 57187 - protein, 9 aa, Homo sapiens
  light chain complementarity determining region 3 for antibody 28594
HPTSTFPRT

SEQ ID NO: 57188 - protein, 20 aa, Homo sapiens
  heavy chain complementarity determining region 3 for antibody 28594
ARGRRIAALSTAHYYYGMDV

SEQ ID NO: 57189 - protein, 9 aa, Homo sapiens
  light chain complementarity determining region 3 for antibody 28595
HPFYSVPWT

SEQ ID NO: 57190 - protein, 11 aa, Homo sapiens
  heavy chain complementarity determining region 3 for antibody 28595
AGGEQMFPSSR

SEQ ID NO: 57191 - protein, 9 aa, Homo sapiens
  light chain complementarity determining region 3 for antibody 28596
HHYYSSPRM

SEQ ID NO: 57192 - protein, 13 aa, Homo sapiens
  heavy chain complementarity determining region 3 for antibody 28596
ARGQSGDPRTYDY

SEQ ID NO: 57193 - protein, 9 aa, Homo sapiens
  light chain complementarity determining region 3 for antibody 28597
HHYYGNLPA

SEQ ID NO: 57194 - protein, 16 aa, Homo sapiens
  heavy chain complementarity determining region 3 for antibody 28597
AREGYDSDAFSHGLDV

SEQ ID NO: 57195 - protein, 9 aa, Homo sapiens
  light chain complementarity determining region 3 for antibody 28598
HHYSTSPRT

SEQ ID NO: 57196 - protein, 17 aa, Homo sapiens
  heavy chain complementarity determining region 3 for antibody 28598
VKPREIYSSGWVDAFDM

SEQ ID NO: 57197 - protein, 9 aa, Homo sapiens
  light chain complementarity determining region 3 for antibody 28599
HHYGTSSGP

SEQ ID NO: 57198 - protein, 12 aa, Homo sapiens
  heavy chain complementarity determining region 3 for antibody 28599
ARDHILLGGFDL

SEQ ID NO: 57199 - protein, 9 aa, Homo sapiens
  light chain complementarity determining region 3 for antibody 28600
HHYGSSPYT

SEQ ID NO: 57200 - protein, 11 aa, Homo sapiens
  heavy chain complementarity determining region 3 for antibody 28600
ARGVTMAGSGY

SEQ ID NO: 57201 - protein, 9 aa, Homo sapiens
  light chain complementarity determining region 3 for antibody 28601
HHYGSSPRP

SEQ ID NO: 57202 - protein, 18 aa, Homo sapiens
  heavy chain complementarity determining region 3 for antibody 28601
AREVPDKRGSNSKPYADV

SEQ ID NO: 57203 - protein, 9 aa, Homo sapiens
  light chain complementarity determining region 3 for antibody 28602
HHYGSSLYP

SEQ ID NO: 57204 - protein, 18 aa, Homo sapiens
  heavy chain complementarity determining region 3 for antibody 28602
ARGFGGYSGYTGREHIDF

SEQ ID NO: 57205 - protein, 9 aa, Homo sapiens
  light chain complementarity determining region 3 for antibody 28603
HHYGRSPLS

SEQ ID NO: 57206 - protein, 14 aa, Homo sapiens
  heavy chain complementarity determining region 3 for antibody 28603
AGRIVAPTKTPFEF

SEQ ID NO: 57207 - protein, 9 aa, Homo sapiens
  light chain complementarity determining region 3 for antibody 28604
HHYGPSPRP

SEQ ID NO: 57208 - protein, 18 aa, Homo sapiens
  heavy chain complementarity determining region 3 for antibody 28604
AREVPDKRGSNSNPYADV

SEQ ID NO: 57209 - protein, 10 aa, Homo sapiens
  light chain complementarity determining region 3 for antibody 28605
HHYGKSPPWR

SEQ ID NO: 57210 - protein, 15 aa, Homo sapiens
  heavy chain complementarity determining region 3 for antibody 28605
ARHRAPDTRKSALGY

SEQ ID NO: 57211 - protein, 9 aa, Homo sapiens
  light chain complementarity determining region 3 for antibody 28606
HHTSTFPRT

SEQ ID NO: 57212 - protein, 20 aa, Homo sapiens
  heavy chain complementarity determining region 3 for antibody 28606
ARGRRIAALSTAHCYYGMDV

SEQ ID NO: 57213 - protein, 9 aa, Homo sapiens
  light chain complementarity determining region 3 for antibody 28607
HHTSPFPRT

SEQ ID NO: 57214 - protein, 20 aa, Homo sapiens
  heavy chain complementarity determining region 3 for antibody 28607
ARGRRIAALSTAHYYYGMDV

SEQ ID NO: 57215 - protein, 9 aa, Homo sapiens
  light chain complementarity determining region 3 for antibody 28608
GQGKYWPYT

SEQ ID NO: 57216 - protein, 11 aa, Homo sapiens
  heavy chain complementarity determining region 3 for antibody 28608
AKDDAAGSIDS

SEQ ID NO: 57217 - protein, 9 aa, Homo sapiens
  light chain complementarity determining region 3 for antibody 28609
YQYGWSPPA

SEQ ID NO: 57218 - protein, 14 aa, Homo sapiens
  heavy chain complementarity determining region 3 for antibody 28609
AKDAGAVAVHYFDH

SEQ ID NO: 57219 - protein, 9 aa, Homo sapiens
  light chain complementarity determining region 3 for antibody 28610
YQYDHSPRT

SEQ ID NO: 57220 - protein, 22 aa, Homo sapiens
  heavy chain complementarity determining region 3 for antibody 28610
VRDWERQAYCDGGGCQQDAFDI

SEQ ID NO: 57221 - protein, 9 aa, Homo sapiens
  light chain complementarity determining region 3 for antibody 28611
YQDGWSPPG

SEQ ID NO: 57222 - protein, 14 aa, Homo sapiens
  heavy chain complementarity determining region 3 for antibody 28611
AKDAGAVAVHYFDH

SEQ ID NO: 57223 - protein, 9 aa, Homo sapiens
  light chain complementarity determining region 3 for antibody 28612
VQYTRYPRT

SEQ ID NO: 57224 - protein, 6 aa, Homo sapiens
  heavy chain complementarity determining region 3 for antibody 28612
TRALDY

SEQ ID NO: 57225 - protein, 9 aa, Homo sapiens
  light chain complementarity determining region 3 for antibody 28613
VQYSRYPRT

SEQ ID NO: 57226 - protein, 6 aa, Homo sapiens
  heavy chain complementarity determining region 3 for antibody 28613
TRALDY

SEQ ID NO: 57227 - protein, 9 aa, Homo sapiens
  light chain complementarity determining region 3 for antibody 28614
VQYNSNPRT

SEQ ID NO: 57228 - protein, 6 aa, Homo sapiens
  heavy chain complementarity determining region 3 for antibody 28614
TRALDY

SEQ ID NO: 57229 - protein, 9 aa, Homo sapiens
  light chain complementarity determining region 3 for antibody 28615
VQYNRYPRT

SEQ ID NO: 57230 - protein, 6 aa, Homo sapiens
  heavy chain complementarity determining region 3 for antibody 28615
PRALDY

SEQ ID NO: 57231 - protein, 9 aa, Homo sapiens
  light chain complementarity determining region 3 for antibody 28616
VQYNRYPLT

SEQ ID NO: 57232 - protein, 6 aa, Homo sapiens
  heavy chain complementarity determining region 3 for antibody 28616
TRALDY

SEQ ID NO: 57233 - protein, 9 aa, Homo sapiens
  light chain complementarity determining region 3 for antibody 28617
VQYNRCPRT

SEQ ID NO: 57234 - protein, 6 aa, Homo sapiens
  heavy chain complementarity determining region 3 for antibody 28617
TRALDY

SEQ ID NO: 57235 - protein, 9 aa, Homo sapiens
  light chain complementarity determining region 3 for antibody 28618
VQYNGNPRT

SEQ ID NO: 57236 - protein, 6 aa, Homo sapiens
  heavy chain complementarity determining region 3 for antibody 28618
TRALDY

SEQ ID NO: 57237 - protein, 9 aa, Homo sapiens
  light chain complementarity determining region 3 for antibody 28619
VQYNATPVT

SEQ ID NO: 57238 - protein, 9 aa, Homo sapiens
  heavy chain complementarity determining region 3 for antibody 28619
ATGVDADYG

SEQ ID NO: 57239 - protein, 9 aa, Homo sapiens
  light chain complementarity determining region 3 for antibody 28620
VQYNATPGT

SEQ ID NO: 57240 - protein, 9 aa, Homo sapiens
  heavy chain complementarity determining region 3 for antibody 28620
ATGVDADYG

SEQ ID NO: 57241 - protein, 9 aa, Homo sapiens
  light chain complementarity determining region 3 for antibody 28621
VQYHGTPVT

SEQ ID NO: 57242 - protein, 9 aa, Homo sapiens
  heavy chain complementarity determining region 3 for antibody 28621
ATGVDADYG

SEQ ID NO: 57243 - protein, 9 aa, Homo sapiens
  light chain complementarity determining region 3 for antibody 28622
VQYHDTPVT

SEQ ID NO: 57244 - protein, 9 aa, Homo sapiens
  heavy chain complementarity determining region 3 for antibody 28622
ATGVDADYG

SEQ ID NO: 57245 - protein, 9 aa, Homo sapiens
  light chain complementarity determining region 3 for antibody 28623
VQYHATPVT

SEQ ID NO: 57246 - protein, 9 aa, Homo sapiens
  heavy chain complementarity determining region 3 for antibody 28623
ATGVDADCG

SEQ ID NO: 57247 - protein, 9 aa, Homo sapiens
  light chain complementarity determining region 3 for antibody 28624
VQYHATPVT

SEQ ID NO: 57248 - protein, 9 aa, Homo sapiens
  heavy chain complementarity determining region 3 for antibody 28624
ATGLDADYG

SEQ ID NO: 57249 - protein, 9 aa, Homo sapiens
  light chain complementarity determining region 3 for antibody 28625
VQYHATPVP

SEQ ID NO: 57250 - protein, 9 aa, Homo sapiens
  heavy chain complementarity determining region 3 for antibody 28625
ATGVDADYG

SEQ ID NO: 57251 - protein, 9 aa, Homo sapiens
  light chain complementarity determining region 3 for antibody 28626
VQYHATPVI

SEQ ID NO: 57252 - protein, 9 aa, Homo sapiens
  heavy chain complementarity determining region 3 for antibody 28626
ATGVDADYG

SEQ ID NO: 57253 - protein, 9 aa, Homo sapiens
  light chain complementarity determining region 3 for antibody 28627
VQYHATPAT

SEQ ID NO: 57254 - protein, 9 aa, Homo sapiens
  heavy chain complementarity determining region 3 for antibody 28627
ATGVDADYG

SEQ ID NO: 57255 - protein, 9 aa, Homo sapiens
  light chain complementarity determining region 3 for antibody 28628
VQYHANPVT

SEQ ID NO: 57256 - protein, 9 aa, Homo sapiens
  heavy chain complementarity determining region 3 for antibody 28628
ATGVDADYG

SEQ ID NO: 57257 - protein, 9 aa, Homo sapiens
  light chain complementarity determining region 3 for antibody 28629
VQYHAKPVT

SEQ ID NO: 57258 - protein, 9 aa, Homo sapiens
  heavy chain complementarity determining region 3 for antibody 28629
ATGVDADYG

SEQ ID NO: 57259 - protein, 9 aa, Homo sapiens
  light chain complementarity determining region 3 for antibody 28630
VQTQQTPDT

SEQ ID NO: 57260 - protein, 14 aa, Homo sapiens
  heavy chain complementarity determining region 3 for antibody 28630
RGVITQGVESAVDI

SEQ ID NO: 57261 - protein, 9 aa, Homo sapiens
  light chain complementarity determining region 3 for antibody 28631
VQHHATPVT

SEQ ID NO: 57262 - protein, 9 aa, Homo sapiens
  heavy chain complementarity determining region 3 for antibody 28631
ATGVDADYG

SEQ ID NO: 57263 - protein, 9 aa, Homo sapiens
  light chain complementarity determining region 3 for antibody 28632
VQGKYGPYT

SEQ ID NO: 57264 - protein, 11 aa, Homo sapiens
  heavy chain complementarity determining region 3 for antibody 28632
AKDDAAGSIDS

SEQ ID NO: 57265 - protein, 9 aa, Homo sapiens
  light chain complementarity determining region 3 for antibody 28633
VQDHATPVT

SEQ ID NO: 57266 - protein, 9 aa, Homo sapiens
  heavy chain complementarity determining region 3 for antibody 28633
ATGVDADYG

SEQ ID NO: 57267 - protein, 9 aa, Homo sapiens
  light chain complementarity determining region 3 for antibody 28634
VQDATPPYT

SEQ ID NO: 57268 - protein, 15 aa, Homo sapiens
  heavy chain complementarity determining region 3 for antibody 28634
ARGGYDYGGYVAFDV

SEQ ID NO: 57269 - protein, 9 aa, Homo sapiens
  light chain complementarity determining region 3 for antibody 28635
VQCNRYPRT

SEQ ID NO: 57270 - protein, 6 aa, Homo sapiens
  heavy chain complementarity determining region 3 for antibody 28635
TRALDY

SEQ ID NO: 57271 - protein, 9 aa, Homo sapiens
  light chain complementarity determining region 3 for antibody 28636
VKYNRYPRT

SEQ ID NO: 57272 - protein, 6 aa, Homo sapiens
  heavy chain complementarity determining region 3 for antibody 28636
TRALDY

SEQ ID NO: 57273 - protein, 9 aa, Homo sapiens
  light chain complementarity determining region 3 for antibody 28637
TQAHQTPPT

SEQ ID NO: 57274 - protein, 15 aa, Homo sapiens
  heavy chain complementarity determining region 3 for antibody 28637
ARTGSSTWYGYGMDV

SEQ ID NO: 57275 - protein, 9 aa, Homo sapiens
  light chain complementarity determining region 3 for antibody 28638
SQYYTTPRT

SEQ ID NO: 57276 - protein, 8 aa, Homo sapiens
  heavy chain complementarity determining region 3 for antibody 28638
ARDGAFDS

SEQ ID NO: 57277 - protein, 9 aa, Homo sapiens
  light chain complementarity determining region 3 for antibody 28639
SQRSSWPWT

SEQ ID NO: 57278 - protein, 9 aa, Homo sapiens
  heavy chain complementarity determining region 3 for antibody 28639
ARVLVAGGG

SEQ ID NO: 57279 - protein, 9 aa, Homo sapiens
  light chain complementarity determining region 3 for antibody 28640
RQYRRSPST

SEQ ID NO: 57280 - protein, 17 aa, Homo sapiens
  heavy chain complementarity determining region 3 for antibody 28640
AGLSSRLGDGSPSLFDY

SEQ ID NO: 57281 - protein, 9 aa, Homo sapiens
  light chain complementarity determining region 3 for antibody 28641
RQYNTWPRT

SEQ ID NO: 57282 - protein, 22 aa, Homo sapiens
  heavy chain complementarity determining region 3 for antibody 28641
AREVRASGYDDFYNYYYYGLDV

SEQ ID NO: 57283 - protein, 9 aa, Homo sapiens
  light chain complementarity determining region 3 for antibody 28642
RQYNSYSYI

SEQ ID NO: 57284 - protein, 11 aa, Homo sapiens
  heavy chain complementarity determining region 3 for antibody 28642
VRENGEDAFDL

SEQ ID NO: 57285 - protein, 10 aa, Homo sapiens
  light chain complementarity determining region 3 for antibody 28643
RQYNSWPPIT

SEQ ID NO: 57286 - protein, 9 aa, Homo sapiens
  heavy chain complementarity determining region 3 for antibody 28643
ARGHYGMDV

SEQ ID NO: 57287 - protein, 8 aa, Homo sapiens
  light chain complementarity determining region 3 for antibody 28644
RQYNNWPV

SEQ ID NO: 57288 - protein, 14 aa, Homo sapiens
  heavy chain complementarity determining region 3 for antibody 28644
AGKGYSASGNYYAN

SEQ ID NO: 57289 - protein, 9 aa, Homo sapiens
  light chain complementarity determining region 3 for antibody 28645
RQYNNWPNT

SEQ ID NO: 57290 - protein, 16 aa, Homo sapiens
  heavy chain complementarity determining region 3 for antibody 28645
ARGLSSLASKPGACDF

SEQ ID NO: 57291 - protein, 10 aa, Homo sapiens
  light chain complementarity determining region 3 for antibody 28646
RQYNNWLGWT

SEQ ID NO: 57292 - protein, 13 aa, Homo sapiens
  heavy chain complementarity determining region 3 for antibody 28646
ARHGRRSGWYYTY

SEQ ID NO: 57293 - protein, 9 aa, Homo sapiens
  light chain complementarity determining region 3 for antibody 28647
RQYNDWPIT

SEQ ID NO: 57294 - protein, 14 aa, Homo sapiens
  heavy chain complementarity determining region 3 for antibody 28647
ALTGDLRLRAYFEY

SEQ ID NO: 57295 - protein, 9 aa, Homo sapiens
  light chain complementarity determining region 3 for antibody 28648
RQYNDWPFI

SEQ ID NO: 57296 - protein, 9 aa, Homo sapiens
  heavy chain complementarity determining region 3 for antibody 28648
AGWFGEFYL

SEQ ID NO: 57297 - protein, 9 aa, Homo sapiens
  light chain complementarity determining region 3 for antibody 28649
RQYHSYPLT

SEQ ID NO: 57298 - protein, 13 aa, Homo sapiens
  heavy chain complementarity determining region 3 for antibody 28649
ATDLTVVTETHHY

SEQ ID NO: 57299 - protein, 10 aa, Homo sapiens
  light chain complementarity determining region 3 for antibody 28650
RQYHDWPPYT

SEQ ID NO: 57300 - protein, 22 aa, Homo sapiens
  heavy chain complementarity determining region 3 for antibody 28650
AKDQASTVVVVSRPWEVSDLTF

SEQ ID NO: 57301 - protein, 9 aa, Homo sapiens
  light chain complementarity determining region 3 for antibody 28651
RQYGTPPRT

SEQ ID NO: 57302 - protein, 25 aa, Homo sapiens
  heavy chain complementarity determining region 3 for antibody 28651
ARLRVDRLRLPGAMRGPLYDRGLNV

SEQ ID NO: 57303 - protein, 6 aa, Homo sapiens
  light chain complementarity determining region 3 for antibody 28652
RQYGMT

SEQ ID NO: 57304 - protein, 12 aa, Homo sapiens
  heavy chain complementarity determining region 3 for antibody 28652
ARFANSWYPYDF

SEQ ID NO: 57305 - protein, 9 aa, Homo sapiens
  light chain complementarity determining region 3 for antibody 28653
RQYDNSRLT

SEQ ID NO: 57306 - protein, 23 aa, Homo sapiens
  heavy chain complementarity determining region 3 for antibody 28653
ARGPAGAAYGTTFARPRGGYFGV

SEQ ID NO: 57307 - protein, 9 aa, Homo sapiens
  light chain complementarity determining region 3 for antibody 28654
RQVLQTPLT

SEQ ID NO: 57308 - protein, 12 aa, Homo sapiens
  heavy chain complementarity determining region 3 for antibody 28654
VKDSDKKWELLD

SEQ ID NO: 57309 - protein, 9 aa, Homo sapiens
  light chain complementarity determining region 3 for antibody 28655
RQVHSFPPT

SEQ ID NO: 57310 - protein, 12 aa, Homo sapiens
  heavy chain complementarity determining region 3 for antibody 28655
ARDTDGSFGLDV

SEQ ID NO: 57311 - protein, 10 aa, Homo sapiens
  light chain complementarity determining region 3 for antibody 28656
RQSIQPPRWT

SEQ ID NO: 57312 - protein, 8 aa, Homo sapiens
  heavy chain complementarity determining region 3 for antibody 28656
AKGYGFDC

SEQ ID NO: 57313 - protein, 11 aa, Homo sapiens
  light chain complementarity determining region 3 for antibody 28657
RQRTNWPLSFT

SEQ ID NO: 57314 - protein, 17 aa, Homo sapiens
  heavy chain complementarity determining region 3 for antibody 28657
ARVKGYGGNSYPDAFHI

SEQ ID NO: 57315 - protein, 10 aa, Homo sapiens
  light chain complementarity determining region 3 for antibody 28658
RQRTDRPPYP

SEQ ID NO: 57316 - protein, 15 aa, Homo sapiens
  heavy chain complementarity determining region 3 for antibody 28658
ARLMGDWELPRGTDY

SEQ ID NO: 57317 - protein, 10 aa, Homo sapiens
  light chain complementarity determining region 3 for antibody 28659
RQRSTWTPLT

SEQ ID NO: 57318 - protein, 9 aa, Homo sapiens
  heavy chain complementarity determining region 3 for antibody 28659
ATPFGETPF

SEQ ID NO: 57319 - protein, 10 aa, Homo sapiens
  light chain complementarity determining region 3 for antibody 28660
RQRSNWPPYT

SEQ ID NO: 57320 - protein, 13 aa, Homo sapiens
  heavy chain complementarity determining region 3 for antibody 28660
ARVGQQRLRGFDI

SEQ ID NO: 57321 - protein, 9 aa, Homo sapiens
  light chain complementarity determining region 3 for antibody 28661
RQRSNWPLT

SEQ ID NO: 57322 - protein, 19 aa, Homo sapiens
  heavy chain complementarity determining region 3 for antibody 28661
AKTVSTTQADTAIIRGGDY

SEQ ID NO: 57323 - protein, 9 aa, Homo sapiens
  light chain complementarity determining region 3 for antibody 28662
RQRSNWPGT

SEQ ID NO: 57324 - protein, 14 aa, Homo sapiens
  heavy chain complementarity determining region 3 for antibody 28662
AVTHYYDSSTIGDY

SEQ ID NO: 57325 - protein, 9 aa, Homo sapiens
  light chain complementarity determining region 3 for antibody 28663
RQRGKWPLT

SEQ ID NO: 57326 - protein, 15 aa, Homo sapiens
  heavy chain complementarity determining region 3 for antibody 28663
ARIGGYYDSGTISDY

SEQ ID NO: 57327 - protein, 9 aa, Homo sapiens
  light chain complementarity determining region 3 for antibody 28664
RQRFKWPPT

SEQ ID NO: 57328 - protein, 19 aa, Homo sapiens
  heavy chain complementarity determining region 3 for antibody 28664
AREVSSADHYGVGKNWFDP

SEQ ID NO: 57329 - protein, 9 aa, Homo sapiens
  light chain complementarity determining region 3 for antibody 28665
RQNGSSPRT

SEQ ID NO: 57330 - protein, 25 aa, Homo sapiens
  heavy chain complementarity determining region 3 for antibody 28665
ARLRIDRLRLPGAMRGPLYDCGLNV

SEQ ID NO: 57331 - protein, 9 aa, Homo sapiens
  light chain complementarity determining region 3 for antibody 28666
RQLNSYPLT

SEQ ID NO: 57332 - protein, 15 aa, Homo sapiens
  heavy chain complementarity determining region 3 for antibody 28666
AREFYGSGSYYLIDY

SEQ ID NO: 57333 - protein, 9 aa, Homo sapiens
  light chain complementarity determining region 3 for antibody 28667
RQGTHWPRT

SEQ ID NO: 57334 - protein, 23 aa, Homo sapiens
  heavy chain complementarity determining region 3 for antibody 28667
ARAQPRWGIAVAGPPGRYYGMDV

SEQ ID NO: 57335 - protein, 10 aa, Homo sapiens
  light chain complementarity determining region 3 for antibody 28668
RQGSYWPPGT

SEQ ID NO: 57336 - protein, 11 aa, Homo sapiens
  heavy chain complementarity determining region 3 for antibody 28668
ARDTPGVGIDY

SEQ ID NO: 57337 - protein, 9 aa, Homo sapiens
  light chain complementarity determining region 3 for antibody 28669
RQGSTYPLT

SEQ ID NO: 57338 - protein, 20 aa, Homo sapiens
  heavy chain complementarity determining region 3 for antibody 28669
ARYPRREHNPGTTGYYSFDY

SEQ ID NO: 57339 - protein, 9 aa, Homo sapiens
  light chain complementarity determining region 3 for antibody 28670
RQGSHWPHT

SEQ ID NO: 57340 - protein, 11 aa, Homo sapiens
  heavy chain complementarity determining region 3 for antibody 28670
ARDPAWGARDY

SEQ ID NO: 57341 - protein, 9 aa, Homo sapiens
  light chain complementarity determining region 3 for antibody 28671
RQGLQSLYT

SEQ ID NO: 57342 - protein, 15 aa, Homo sapiens
  heavy chain complementarity determining region 3 for antibody 28671
ARHRYYGSGNYEFDY

SEQ ID NO: 57343 - protein, 9 aa, Homo sapiens
  light chain complementarity determining region 3 for antibody 28672
RQGALWPLT

SEQ ID NO: 57344 - protein, 11 aa, Homo sapiens
  heavy chain complementarity determining region 3 for antibody 28672
ARGGFWGDAAP

SEQ ID NO: 57345 - protein, 9 aa, Homo sapiens
  light chain complementarity determining region 3 for antibody 28673
RQGAHWPDT

SEQ ID NO: 57346 - protein, 11 aa, Homo sapiens
  heavy chain complementarity determining region 3 for antibody 28673
ATVRLVGAVDY

SEQ ID NO: 57347 - protein, 9 aa, Homo sapiens
  light chain complementarity determining region 3 for antibody 28674
RQATPWPWT

SEQ ID NO: 57348 - protein, 15 aa, Homo sapiens
  heavy chain complementarity determining region 3 for antibody 28674
ASAVRGAPFGNWFDP

SEQ ID NO: 57349 - protein, 9 aa, Homo sapiens
  light chain complementarity determining region 3 for antibody 28675
RQANTFPWT

SEQ ID NO: 57350 - protein, 11 aa, Homo sapiens
  heavy chain complementarity determining region 3 for antibody 28675
ARVRGLSGFDY

SEQ ID NO: 57351 - protein, 8 aa, Homo sapiens
  light chain complementarity determining region 3 for antibody 28676
RQALRGFT

SEQ ID NO: 57352 - protein, 14 aa, Homo sapiens
  heavy chain complementarity determining region 3 for antibody 28676
AYNSPTVLTPGFDY

SEQ ID NO: 57353 - protein, 9 aa, Homo sapiens
  light chain complementarity determining region 3 for antibody 28677
RQALQTPRT

SEQ ID NO: 57354 - protein, 13 aa, Homo sapiens
  heavy chain complementarity determining region 3 for antibody 28677
ARASGGDYGLPAY

SEQ ID NO: 57355 - protein, 9 aa, Homo sapiens
  light chain complementarity determining region 3 for antibody 28678
RQALQTPQT

SEQ ID NO: 57356 - protein, 15 aa, Homo sapiens
  heavy chain complementarity determining region 3 for antibody 28678
ARGGKVSYSSGRWDY

SEQ ID NO: 57357 - protein, 8 aa, Homo sapiens
  light chain complementarity determining region 3 for antibody 28679
RQALQTPP

SEQ ID NO: 57358 - protein, 9 aa, Homo sapiens
  heavy chain complementarity determining region 3 for antibody 28679
ARDSSAFGP

SEQ ID NO: 57359 - protein, 9 aa, Homo sapiens
  light chain complementarity determining region 3 for antibody 28680
RQALQTPIT

SEQ ID NO: 57360 - protein, 17 aa, Homo sapiens
  heavy chain complementarity determining region 3 for antibody 28680
TRGYCTTTSCQLNWFDP

SEQ ID NO: 57361 - protein, 9 aa, Homo sapiens
  light chain complementarity determining region 3 for antibody 28681
RQALQTPGT

SEQ ID NO: 57362 - protein, 23 aa, Homo sapiens
  heavy chain complementarity determining region 3 for antibody 28681
ARHREYASGPYYSPLYYYYGVDV

SEQ ID NO: 57363 - protein, 8 aa, Homo sapiens
  light chain complementarity determining region 3 for antibody 28682
RQALQTLP

SEQ ID NO: 57364 - protein, 16 aa, Homo sapiens
  heavy chain complementarity determining region 3 for antibody 28682
AKAGWLVGYDLSRGCA

SEQ ID NO: 57365 - protein, 9 aa, Homo sapiens
  light chain complementarity determining region 3 for antibody 28683
RQALQNPRT

SEQ ID NO: 57366 - protein, 13 aa, Homo sapiens
  heavy chain complementarity determining region 3 for antibody 28683
AKHSGLAGYPLDY

SEQ ID NO: 57367 - protein, 9 aa, Homo sapiens
  light chain complementarity determining region 3 for antibody 28684
RQALQLPYT

SEQ ID NO: 57368 - protein, 10 aa, Homo sapiens
  heavy chain complementarity determining region 3 for antibody 28684
ARRNQGKFDT

SEQ ID NO: 57369 - protein, 10 aa, Homo sapiens
  light chain complementarity determining region 3 for antibody 28685
RQALHTPLFT

SEQ ID NO: 57370 - protein, 15 aa, Homo sapiens
  heavy chain complementarity determining region 3 for antibody 28685
APYYFDTSAYYGGGY

SEQ ID NO: 57371 - protein, 9 aa, Homo sapiens
  light chain complementarity determining region 3 for antibody 28686
RQALETPFT

SEQ ID NO: 57372 - protein, 15 aa, Homo sapiens
  heavy chain complementarity determining region 3 for antibody 28686
VRHYRIITAPLEGDS

SEQ ID NO: 57373 - protein, 9 aa, Homo sapiens
  light chain complementarity determining region 3 for antibody 28687
RHRSYWPWT

SEQ ID NO: 57374 - protein, 17 aa, Homo sapiens
  heavy chain complementarity determining region 3 for antibody 28687
GREYYDARSGSGNWFDP

SEQ ID NO: 57375 - protein, 6 aa, Homo sapiens
  light chain complementarity determining region 3 for antibody 28688
RHRGRS

SEQ ID NO: 57376 - protein, 17 aa, Homo sapiens
  heavy chain complementarity determining region 3 for antibody 28688
ATFSRQVVTGYYWYFDL

SEQ ID NO: 57377 - protein, 10 aa, Homo sapiens
  light chain complementarity determining region 3 for antibody 28689
REYKSWPAFT

SEQ ID NO: 57378 - protein, 11 aa, Homo sapiens
  heavy chain complementarity determining region 3 for antibody 28689
ARRWGSAPFDH

SEQ ID NO: 57379 - protein, 9 aa, Homo sapiens
  light chain complementarity determining region 3 for antibody 28690
RDLNGFPFT

SEQ ID NO: 57380 - protein, 12 aa, Homo sapiens
  heavy chain complementarity determining region 3 for antibody 28690
AIWGGAQGGVEF

SEQ ID NO: 57381 - protein, 8 aa, Homo sapiens
  light chain complementarity determining region 3 for antibody 28691
QYYSNSPT

SEQ ID NO: 57382 - protein, 15 aa, Homo sapiens
  heavy chain complementarity determining region 3 for antibody 28691
AKEVLTRSSDWYWLD

SEQ ID NO: 57383 - protein, 8 aa, Homo sapiens
  light chain complementarity determining region 3 for antibody 28692
QYYSNRPT

SEQ ID NO: 57384 - protein, 15 aa, Homo sapiens
  heavy chain complementarity determining region 3 for antibody 28692
AKEVLTRSSDWYWFD

SEQ ID NO: 57385 - protein, 8 aa, Homo sapiens
  light chain complementarity determining region 3 for antibody 28693
QYYSNRPP

SEQ ID NO: 57386 - protein, 15 aa, Homo sapiens
  heavy chain complementarity determining region 3 for antibody 28693
AKEVLTRSSDWYWVD

SEQ ID NO: 57387 - protein, 8 aa, Homo sapiens
  light chain complementarity determining region 3 for antibody 28694
QYYSNRPI

SEQ ID NO: 57388 - protein, 15 aa, Homo sapiens
  heavy chain complementarity determining region 3 for antibody 28694
AKEVLTRSSDWYWLD

SEQ ID NO: 57389 - protein, 8 aa, Homo sapiens
  light chain complementarity determining region 3 for antibody 28695
QYYRNRPT

SEQ ID NO: 57390 - protein, 15 aa, Homo sapiens
  heavy chain complementarity determining region 3 for antibody 28695
AKEVLTRSSDWYWLD

SEQ ID NO: 57391 - protein, 8 aa, Homo sapiens
  light chain complementarity determining region 3 for antibody 28696
QYYGSSPP

SEQ ID NO: 57392 - protein, 9 aa, Homo sapiens
  heavy chain complementarity determining region 3 for antibody 28696
ARGYDAFDY

SEQ ID NO: 57393 - protein, 10 aa, Homo sapiens
  light chain complementarity determining region 3 for antibody 28697
QYYGRSPPYS

SEQ ID NO: 57394 - protein, 23 aa, Homo sapiens
  heavy chain complementarity determining region 3 for antibody 28697
ARGLRSSDWSKVMDMDSYYGLDV

SEQ ID NO: 57395 - protein, 10 aa, Homo sapiens
  light chain complementarity determining region 3 for antibody 28698
QYYGRSPPYL

SEQ ID NO: 57396 - protein, 23 aa, Homo sapiens
  heavy chain complementarity determining region 3 for antibody 28698
ARGLRSSDWSKIMDMDSYYGLDV

SEQ ID NO: 57397 - protein, 10 aa, Homo sapiens
  light chain complementarity determining region 3 for antibody 28699
QYYGRPPPYS

SEQ ID NO: 57398 - protein, 23 aa, Homo sapiens
  heavy chain complementarity determining region 3 for antibody 28699
ARGLRSSDWSKIMDMDSYYGLDV

SEQ ID NO: 57399 - protein, 10 aa, Homo sapiens
  light chain complementarity determining region 3 for antibody 28700
QYYGRAPPYS

SEQ ID NO: 57400 - protein, 23 aa, Homo sapiens
  heavy chain complementarity determining region 3 for antibody 28700
ARGLRSSDWSKIMDMDSYYGLDV

SEQ ID NO: 57401 - protein, 9 aa, Homo sapiens
  light chain complementarity determining region 3 for antibody 28701
QYYGGSPLT

SEQ ID NO: 57402 - protein, 17 aa, Homo sapiens
  heavy chain complementarity determining region 3 for antibody 28701
TTGIAVVPFAPSLVDTY

SEQ ID NO: 57403 - protein, 11 aa, Homo sapiens
  light chain complementarity determining region 3 for antibody 28702
QYYDNLPPTWT

SEQ ID NO: 57404 - protein, 16 aa, Homo sapiens
  heavy chain complementarity determining region 3 for antibody 28702
ARVSAHDPGRSLGMDV

SEQ ID NO: 57405 - protein, 10 aa, Homo sapiens
  light chain complementarity determining region 3 for antibody 28703
QYYDDSPGYT

SEQ ID NO: 57406 - protein, 12 aa, Homo sapiens
  heavy chain complementarity determining region 3 for antibody 28703
ARETTNIGELDY

SEQ ID NO: 57407 - protein, 8 aa, Homo sapiens
  light chain complementarity determining region 3 for antibody 28704
QYYCNRPT

SEQ ID NO: 57408 - protein, 15 aa, Homo sapiens
  heavy chain complementarity determining region 3 for antibody 28704
AKEVLTRSSDWYWLD

SEQ ID NO: 57409 - protein, 10 aa, Homo sapiens
  light chain complementarity determining region 3 for antibody 28705
QYHGYSPLYT

SEQ ID NO: 57410 - protein, 12 aa, Homo sapiens
  heavy chain complementarity determining region 3 for antibody 28705
AKGILGRGGMDV

SEQ ID NO: 57411 - protein, 9 aa, Homo sapiens
  light chain complementarity determining region 3 for antibody 28706
QWYDDLLFG

SEQ ID NO: 57412 - protein, 11 aa, Homo sapiens
  heavy chain complementarity determining region 3 for antibody 28706
VRQARVGSFDI

SEQ ID NO: 57413 - protein, 10 aa, Homo sapiens
  light chain complementarity determining region 3 for antibody 28707
QVYDSSYLWT

SEQ ID NO: 57414 - protein, 19 aa, Homo sapiens
  heavy chain complementarity determining region 3 for antibody 28707
ARESFVRKVGGQRPYYFDI

SEQ ID NO: 57415 - protein, 10 aa, Homo sapiens
  light chain complementarity determining region 3 for antibody 28708
QVYDSSSRWT

SEQ ID NO: 57416 - protein, 19 aa, Homo sapiens
  heavy chain complementarity determining region 3 for antibody 28708
ARESFVRKVGGQRPYYFDI

SEQ ID NO: 57417 - protein, 10 aa, Homo sapiens
  light chain complementarity determining region 3 for antibody 28709
QVYDSSSLWT

SEQ ID NO: 57418 - protein, 19 aa, Homo sapiens
  heavy chain complementarity determining region 3 for antibody 28709
ARESSVRKVGGQRPYYFDI

SEQ ID NO: 57419 - protein, 10 aa, Homo sapiens
  light chain complementarity determining region 3 for antibody 28710
QVYDSSSLGR

SEQ ID NO: 57420 - protein, 19 aa, Homo sapiens
  heavy chain complementarity determining region 3 for antibody 28710
ARESFVRKVGGQRPYYFDI

SEQ ID NO: 57421 - protein, 10 aa, Homo sapiens
  light chain complementarity determining region 3 for antibody 28711
QVYASSSLWT

SEQ ID NO: 57422 - protein, 19 aa, Homo sapiens
  heavy chain complementarity determining region 3 for antibody 28711
ARESFVRKVGGQRPYYFDI

SEQ ID NO: 57423 - protein, 10 aa, Homo sapiens
  light chain complementarity determining region 3 for antibody 28712
QVRDKWPPVI

SEQ ID NO: 57424 - protein, 12 aa, Homo sapiens
  heavy chain complementarity determining region 3 for antibody 28712
VRDGSTGWHFDS

SEQ ID NO: 57425 - protein, 10 aa, Homo sapiens
  light chain complementarity determining region 3 for antibody 28713
QVDDSSSLWR

SEQ ID NO: 57426 - protein, 19 aa, Homo sapiens
  heavy chain complementarity determining region 3 for antibody 28713
ARESFVRKVGGQRPYYFDI

SEQ ID NO: 57427 - protein, 9 aa, Homo sapiens
  light chain complementarity determining region 3 for antibody 28714
QTYNSVPLT

SEQ ID NO: 57428 - protein, 14 aa, Homo sapiens
  heavy chain complementarity determining region 3 for antibody 28714
ARPQTWDLLYAFDM

SEQ ID NO: 57429 - protein, 8 aa, Homo sapiens
  light chain complementarity determining region 3 for antibody 28715
QSYNIVFT

SEQ ID NO: 57430 - protein, 15 aa, Homo sapiens
  heavy chain complementarity determining region 3 for antibody 28715
ARGLGGILRGSYFDS

SEQ ID NO: 57431 - protein, 8 aa, Homo sapiens
  light chain complementarity determining region 3 for antibody 28716
QRYNIVFT

SEQ ID NO: 57432 - protein, 15 aa, Homo sapiens
  heavy chain complementarity determining region 3 for antibody 28716
ASGLGGILRGYYFDS

SEQ ID NO: 57433 - protein, 9 aa, Homo sapiens
  light chain complementarity determining region 3 for antibody 28717
QRYGTSPRT

SEQ ID NO: 57434 - protein, 13 aa, Homo sapiens
  heavy chain complementarity determining region 3 for antibody 28717
PIGFYDRSGYHEY

SEQ ID NO: 57435 - protein, 9 aa, Homo sapiens
  light chain complementarity determining region 3 for antibody 28718
QRYGSTWWT

SEQ ID NO: 57436 - protein, 15 aa, Homo sapiens
  heavy chain complementarity determining region 3 for antibody 28718
ARHMARDSIGYYHDF

SEQ ID NO: 57437 - protein, 9 aa, Homo sapiens
  light chain complementarity determining region 3 for antibody 28719
QRYGSSPYT

SEQ ID NO: 57438 - protein, 17 aa, Homo sapiens
  heavy chain complementarity determining region 3 for antibody 28719
ARGTGYNYGYGGVHFDY

SEQ ID NO: 57439 - protein, 9 aa, Homo sapiens
  light chain complementarity determining region 3 for antibody 28720
QRYGSSPRT

SEQ ID NO: 57440 - protein, 14 aa, Homo sapiens
  heavy chain complementarity determining region 3 for antibody 28720
ARDRGSSWYPPFQH

SEQ ID NO: 57441 - protein, 8 aa, Homo sapiens
  light chain complementarity determining region 3 for antibody 28721
QRYGSSLT

SEQ ID NO: 57442 - protein, 16 aa, Homo sapiens
  heavy chain complementarity determining region 3 for antibody 28721
VRDRPRSSSSWTSFEY

SEQ ID NO: 57443 - protein, 9 aa, Homo sapiens
  light chain complementarity determining region 3 for antibody 28722
QRYGSSHIT

SEQ ID NO: 57444 - protein, 23 aa, Homo sapiens
  heavy chain complementarity determining region 3 for antibody 28722
AKDGLESYYDSSGTNLAYWYFDL

SEQ ID NO: 57445 - protein, 9 aa, Homo sapiens
  light chain complementarity determining region 3 for antibody 28723
QRYGSLPLT

SEQ ID NO: 57446 - protein, 15 aa, Homo sapiens
  heavy chain complementarity determining region 3 for antibody 28723
AHRPNYYDKAGAFDI

SEQ ID NO: 57447 - protein, 9 aa, Homo sapiens
  light chain complementarity determining region 3 for antibody 28724
QRYGNSPLT

SEQ ID NO: 57448 - protein, 15 aa, Homo sapiens
  heavy chain complementarity determining region 3 for antibody 28724
AKSDSQYYYYYAMDV

SEQ ID NO: 57449 - protein, 9 aa, Homo sapiens
  light chain complementarity determining region 3 for antibody 28725
QRYGNSLPA

SEQ ID NO: 57450 - protein, 13 aa, Homo sapiens
  heavy chain complementarity determining region 3 for antibody 28725
ARCPTGFPNWFDP

SEQ ID NO: 57451 - protein, 9 aa, Homo sapiens
  light chain complementarity determining region 3 for antibody 28726
QRYESSLWT

SEQ ID NO: 57452 - protein, 12 aa, Homo sapiens
  heavy chain complementarity determining region 3 for antibody 28726
ARDFGLYQEPDS

SEQ ID NO: 57453 - protein, 10 aa, Homo sapiens
  light chain complementarity determining region 3 for antibody 28727
QRYEPLSGLT

SEQ ID NO: 57454 - protein, 11 aa, Homo sapiens
  heavy chain complementarity determining region 3 for antibody 28727
AADSRNCWFFY

SEQ ID NO: 57455 - protein, 10 aa, Homo sapiens
  light chain complementarity determining region 3 for antibody 28728
QRYDYLPSLP

SEQ ID NO: 57456 - protein, 17 aa, Homo sapiens
  heavy chain complementarity determining region 3 for antibody 28728
ARLYCGGDCYSLGYLDH

SEQ ID NO: 57457 - protein, 11 aa, Homo sapiens
  light chain complementarity determining region 3 for antibody 28729
QRYDTSPPRDS

SEQ ID NO: 57458 - protein, 14 aa, Homo sapiens
  heavy chain complementarity determining region 3 for antibody 28729
ARHKQESGTRGFDF

SEQ ID NO: 57459 - protein, 11 aa, Homo sapiens
  light chain complementarity determining region 3 for antibody 28730
QRYDTSPLRYS

SEQ ID NO: 57460 - protein, 14 aa, Homo sapiens
  heavy chain complementarity determining region 3 for antibody 28730
ARHKQESGTRGFDF

SEQ ID NO: 57461 - protein, 10 aa, Homo sapiens
  light chain complementarity determining region 3 for antibody 28731
QRYDTLSGLT

SEQ ID NO: 57462 - protein, 11 aa, Homo sapiens
  heavy chain complementarity determining region 3 for antibody 28731
AADSRNCWFCY

SEQ ID NO: 57463 - protein, 10 aa, Homo sapiens
  light chain complementarity determining region 3 for antibody 28732
QRYDTLSGLP

SEQ ID NO: 57464 - protein, 11 aa, Homo sapiens
  heavy chain complementarity determining region 3 for antibody 28732
AADSRNCWFFY

SEQ ID NO: 57465 - protein, 10 aa, Homo sapiens
  light chain complementarity determining region 3 for antibody 28733
QRYDTLSGLI

SEQ ID NO: 57466 - protein, 11 aa, Homo sapiens
  heavy chain complementarity determining region 3 for antibody 28733
AADSRNCWFFY

SEQ ID NO: 57467 - protein, 9 aa, Homo sapiens
  light chain complementarity determining region 3 for antibody 28734
QRYDSAPRT

SEQ ID NO: 57468 - protein, 13 aa, Homo sapiens
  heavy chain complementarity determining region 3 for antibody 28734
ASPFSGIAPAGGY

SEQ ID NO: 57469 - protein, 10 aa, Homo sapiens
  light chain complementarity determining region 3 for antibody 28735
QRYDNLPSFS

SEQ ID NO: 57470 - protein, 13 aa, Homo sapiens
  heavy chain complementarity determining region 3 for antibody 28735
ARTLLAVAGTFDY

SEQ ID NO: 57471 - protein, 10 aa, Homo sapiens
  light chain complementarity determining region 3 for antibody 28736
QRTCIAPLST

SEQ ID NO: 57472 - protein, 14 aa, Homo sapiens
  heavy chain complementarity determining region 3 for antibody 28736
TKGSPHGGSTLRTS

SEQ ID NO: 57473 - protein, 8 aa, Homo sapiens
  light chain complementarity determining region 3 for antibody 28737
QRSYSTPS

SEQ ID NO: 57474 - protein, 15 aa, Homo sapiens
  heavy chain complementarity determining region 3 for antibody 28737
ARESWDGSDRSAFDI

SEQ ID NO: 57475 - protein, 9 aa, Homo sapiens
  light chain complementarity determining region 3 for antibody 28738
QRSGSKPFT

SEQ ID NO: 57476 - protein, 14 aa, Homo sapiens
  heavy chain complementarity determining region 3 for antibody 28738
ARDNSNNWYEGMDV

SEQ ID NO: 57477 - protein, 10 aa, Homo sapiens
  light chain complementarity determining region 3 for antibody 28739
QRRSNWPPYT

SEQ ID NO: 57478 - protein, 12 aa, Homo sapiens
  heavy chain complementarity determining region 3 for antibody 28739
VRGDPGSPRFDY

SEQ ID NO: 57479 - protein, 9 aa, Homo sapiens
  light chain complementarity determining region 3 for antibody 28740
QRRHNWPWT

SEQ ID NO: 57480 - protein, 17 aa, Homo sapiens
  heavy chain complementarity determining region 3 for antibody 28740
VVPQFSRTDWPTEPSDY

SEQ ID NO: 57481 - protein, 9 aa, Homo sapiens
  light chain complementarity determining region 3 for antibody 28741
QRLKNYFFT

SEQ ID NO: 57482 - protein, 19 aa, Homo sapiens
  heavy chain complementarity determining region 3 for antibody 28741
AKAASVPNRRSVTTAPFDY

SEQ ID NO: 57483 - protein, 9 aa, Homo sapiens
  light chain complementarity determining region 3 for antibody 28742
QREGGAPYT

SEQ ID NO: 57484 - protein, 20 aa, Homo sapiens
  heavy chain complementarity determining region 3 for antibody 28742
ARAWGYFDSNDYYYTTSFHL

SEQ ID NO: 57485 - protein, 9 aa, Homo sapiens
  light chain complementarity determining region 3 for antibody 28743
QQYYTTPRT

SEQ ID NO: 57486 - protein, 8 aa, Homo sapiens
  heavy chain complementarity determining region 3 for antibody 28743
AGDGAFDS

SEQ ID NO: 57487 - protein, 9 aa, Homo sapiens
  light chain complementarity determining region 3 for antibody 28744
QQYYTTPRN

SEQ ID NO: 57488 - protein, 8 aa, Homo sapiens
  heavy chain complementarity determining region 3 for antibody 28744
ARDGAFDS

SEQ ID NO: 57489 - protein, 11 aa, Homo sapiens
  light chain complementarity determining region 3 for antibody 28745
QQYYTTPPMYT

SEQ ID NO: 57490 - protein, 16 aa, Homo sapiens
  heavy chain complementarity determining region 3 for antibody 28745
ARDPDTSGWYLHAFDI

SEQ ID NO: 57491 - protein, 9 aa, Homo sapiens
  light chain complementarity determining region 3 for antibody 28746
QQYYTSVRT

SEQ ID NO: 57492 - protein, 12 aa, Homo sapiens
  heavy chain complementarity determining region 3 for antibody 28746
VKDGGLGGSRDF

SEQ ID NO: 57493 - protein, 9 aa, Homo sapiens
  light chain complementarity determining region 3 for antibody 28747
QQYYTSVRT

SEQ ID NO: 57494 - protein, 8 aa, Homo sapiens
  heavy chain complementarity determining region 3 for antibody 28747
GLGGSRDS

SEQ ID NO: 57495 - protein, 9 aa, Homo sapiens
  light chain complementarity determining region 3 for antibody 28748
QQYYTSVRM

SEQ ID NO: 57496 - protein, 12 aa, Homo sapiens
  heavy chain complementarity determining region 3 for antibody 28748
VKDCGLGGSRDS

SEQ ID NO: 57497 - protein, 9 aa, Homo sapiens
  light chain complementarity determining region 3 for antibody 28749
QQYYTSVRK

SEQ ID NO: 57498 - protein, 12 aa, Homo sapiens
  heavy chain complementarity determining region 3 for antibody 28749
VKDCGLGGSRDS

SEQ ID NO: 57499 - protein, 9 aa, Homo sapiens
  light chain complementarity determining region 3 for antibody 28750
QQYYTSVRA

SEQ ID NO: 57500 - protein, 12 aa, Homo sapiens
  heavy chain complementarity determining region 3 for antibody 28750
VKDCGLGGSRDF

SEQ ID NO: 57501 - protein, 9 aa, Homo sapiens
  light chain complementarity determining region 3 for antibody 28751
QQYYTSSRT

SEQ ID NO: 57502 - protein, 12 aa, Homo sapiens
  heavy chain complementarity determining region 3 for antibody 28751
VKDCGLGGSRDS

SEQ ID NO: 57503 - protein, 9 aa, Homo sapiens
  light chain complementarity determining region 3 for antibody 28752
QQYYTSLRT

SEQ ID NO: 57504 - protein, 12 aa, Homo sapiens
  heavy chain complementarity determining region 3 for antibody 28752
VKDCGLGGLRDS

SEQ ID NO: 57505 - protein, 9 aa, Homo sapiens
  light chain complementarity determining region 3 for antibody 28753
QQYYTSLRT

SEQ ID NO: 57506 - protein, 12 aa, Homo sapiens
  heavy chain complementarity determining region 3 for antibody 28753
VKDCDLGGSRDS

SEQ ID NO: 57507 - protein, 9 aa, Homo sapiens
  light chain complementarity determining region 3 for antibody 28754
QQYYTSLRT

SEQ ID NO: 57508 - protein, 12 aa, Homo sapiens
  heavy chain complementarity determining region 3 for antibody 28754
VKDCCLGGSRDS

SEQ ID NO: 57509 - protein, 9 aa, Homo sapiens
  light chain complementarity determining region 3 for antibody 28755
QQYYTSLRT

SEQ ID NO: 57510 - protein, 12 aa, Homo sapiens
  heavy chain complementarity determining region 3 for antibody 28755
GKDCGLGGSRDS

SEQ ID NO: 57511 - protein, 9 aa, Homo sapiens
  light chain complementarity determining region 3 for antibody 28756
QQYYTSIRP

SEQ ID NO: 57512 - protein, 12 aa, Homo sapiens
  heavy chain complementarity determining region 3 for antibody 28756
VKDCGLGGSRDS

SEQ ID NO: 57513 - protein, 9 aa, Homo sapiens
  light chain complementarity determining region 3 for antibody 28757
QQYYTSFRP

SEQ ID NO: 57514 - protein, 12 aa, Homo sapiens
  heavy chain complementarity determining region 3 for antibody 28757
VKDCGLGGSRDF

SEQ ID NO: 57515 - protein, 9 aa, Homo sapiens
  light chain complementarity determining region 3 for antibody 28758
QQYYTSCRT

SEQ ID NO: 57516 - protein, 12 aa, Homo sapiens
  heavy chain complementarity determining region 3 for antibody 28758
VKDCGLGGSRDS

SEQ ID NO: 57517 - protein, 9 aa, Homo sapiens
  light chain complementarity determining region 3 for antibody 28759
QQYYTSART

SEQ ID NO: 57518 - protein, 12 aa, Homo sapiens
  heavy chain complementarity determining region 3 for antibody 28759
VKDCGLGGPRDY

SEQ ID NO: 57519 - protein, 9 aa, Homo sapiens
  light chain complementarity determining region 3 for antibody 28760
QQYYTIPWT

SEQ ID NO: 57520 - protein, 18 aa, Homo sapiens
  heavy chain complementarity determining region 3 for antibody 28760
VKDPEEVDFGDTGGYLQH

SEQ ID NO: 57521 - protein, 9 aa, Homo sapiens
  light chain complementarity determining region 3 for antibody 28761
QQYYTIPRT

SEQ ID NO: 57522 - protein, 8 aa, Homo sapiens
  heavy chain complementarity determining region 3 for antibody 28761
ARDGAFDS

SEQ ID NO: 57523 - protein, 9 aa, Homo sapiens
  light chain complementarity determining region 3 for antibody 28762
QQYYTIPLT

SEQ ID NO: 57524 - protein, 14 aa, Homo sapiens
  heavy chain complementarity determining region 3 for antibody 28762
ARDQGDHWLNYFDY

SEQ ID NO: 57525 - protein, 9 aa, Homo sapiens
  light chain complementarity determining region 3 for antibody 28763
QQYYTHPLP

SEQ ID NO: 57526 - protein, 13 aa, Homo sapiens
  heavy chain complementarity determining region 3 for antibody 28763
AKDPSGNYGSWVH

SEQ ID NO: 57527 - protein, 9 aa, Homo sapiens
  light chain complementarity determining region 3 for antibody 28764
QQYYTFLRT

SEQ ID NO: 57528 - protein, 12 aa, Homo sapiens
  heavy chain complementarity determining region 3 for antibody 28764
VKDCGLGGSRDF

SEQ ID NO: 57529 - protein, 9 aa, Homo sapiens
  light chain complementarity determining region 3 for antibody 28765
QQYYTFLRT

SEQ ID NO: 57530 - protein, 12 aa, Homo sapiens
  heavy chain complementarity determining region 3 for antibody 28765
VKDCGLGGPRDY

SEQ ID NO: 57531 - protein, 9 aa, Homo sapiens
  light chain complementarity determining region 3 for antibody 28766
QQYYTFLRP

SEQ ID NO: 57532 - protein, 12 aa, Homo sapiens
  heavy chain complementarity determining region 3 for antibody 28766
VKDCGLGGSRDS

SEQ ID NO: 57533 - protein, 9 aa, Homo sapiens
  light chain complementarity determining region 3 for antibody 28767
QQYYTFFRT

SEQ ID NO: 57534 - protein, 12 aa, Homo sapiens
  heavy chain complementarity determining region 3 for antibody 28767
VKDCGLGGPRDY

SEQ ID NO: 57535 - protein, 9 aa, Homo sapiens
  light chain complementarity determining region 3 for antibody 28768
QQYYSYPLA

SEQ ID NO: 57536 - protein, 12 aa, Homo sapiens
  heavy chain complementarity determining region 3 for antibody 28768
TRQSRPNSGYDY

SEQ ID NO: 57537 - protein, 9 aa, Homo sapiens
  light chain complementarity determining region 3 for antibody 28769
QQYYSVPRT

SEQ ID NO: 57538 - protein, 15 aa, Homo sapiens
  heavy chain complementarity determining region 3 for antibody 28769
ASRGAPFERSYGMDV

SEQ ID NO: 57539 - protein, 9 aa, Homo sapiens
  light chain complementarity determining region 3 for antibody 28770
QQYYSVPRT

SEQ ID NO: 57540 - protein, 17 aa, Homo sapiens
  heavy chain complementarity determining region 3 for antibody 28770
ARGSSIGPCTSCEYFQH

SEQ ID NO: 57541 - protein, 9 aa, Homo sapiens
  light chain complementarity determining region 3 for antibody 28771
QQYYSVPRP

SEQ ID NO: 57542 - protein, 17 aa, Homo sapiens
  heavy chain complementarity determining region 3 for antibody 28771
ARGSSSGPCTSCEYFQH

SEQ ID NO: 57543 - protein, 9 aa, Homo sapiens
  light chain complementarity determining region 3 for antibody 28772
QQYYSTTNT

SEQ ID NO: 57544 - protein, 15 aa, Homo sapiens
  heavy chain complementarity determining region 3 for antibody 28772
ARATRQWLDHNCFDP

SEQ ID NO: 57545 - protein, 9 aa, Homo sapiens
  light chain complementarity determining region 3 for antibody 28773
QQYYSTPWT

SEQ ID NO: 57546 - protein, 11 aa, Homo sapiens
  heavy chain complementarity determining region 3 for antibody 28773
TRHYGYAAFDI

SEQ ID NO: 57547 - protein, 9 aa, Homo sapiens
  light chain complementarity determining region 3 for antibody 28774
QQYYSTPWT

SEQ ID NO: 57548 - protein, 10 aa, Homo sapiens
  heavy chain complementarity determining region 3 for antibody 28774
STPSRVGAEF

SEQ ID NO: 57549 - protein, 9 aa, Homo sapiens
  light chain complementarity determining region 3 for antibody 28775
QQYYSTPWP

SEQ ID NO: 57550 - protein, 15 aa, Homo sapiens
  heavy chain complementarity determining region 3 for antibody 28775
IRQSKMNNNWDYPDS

SEQ ID NO: 57551 - protein, 9 aa, Homo sapiens
  light chain complementarity determining region 3 for antibody 28776
QQYYSTPVT

SEQ ID NO: 57552 - protein, 8 aa, Homo sapiens
  heavy chain complementarity determining region 3 for antibody 28776
VGGDQRDS

SEQ ID NO: 57553 - protein, 9 aa, Homo sapiens
  light chain complementarity determining region 3 for antibody 28777
QQYYSTPVP

SEQ ID NO: 57554 - protein, 14 aa, Homo sapiens
  heavy chain complementarity determining region 3 for antibody 28777
ARHEHDGSGSVIDY

SEQ ID NO: 57555 - protein, 9 aa, Homo sapiens
  light chain complementarity determining region 3 for antibody 28778
QQYYSTPRT

SEQ ID NO: 57556 - protein, 10 aa, Homo sapiens
  heavy chain complementarity determining region 3 for antibody 28778
STPSRVGAKF

SEQ ID NO: 57557 - protein, 9 aa, Homo sapiens
  light chain complementarity determining region 3 for antibody 28779
QQYYSTPRT

SEQ ID NO: 57558 - protein, 13 aa, Homo sapiens
  heavy chain complementarity determining region 3 for antibody 28779
ARVGVGSYYAFDI

SEQ ID NO: 57559 - protein, 9 aa, Homo sapiens
  light chain complementarity determining region 3 for antibody 28780
QQYYSTPPT

SEQ ID NO: 57560 - protein, 12 aa, Homo sapiens
  heavy chain complementarity determining region 3 for antibody 28780
ARVLGVDYSFDY

SEQ ID NO: 57561 - protein, 9 aa, Homo sapiens
  light chain complementarity determining region 3 for antibody 28781
QQYYSTPPT

SEQ ID NO: 57562 - protein, 17 aa, Homo sapiens
  heavy chain complementarity determining region 3 for antibody 28781
ARVITMTVVLTHDAFDI

SEQ ID NO: 57563 - protein, 9 aa, Homo sapiens
  light chain complementarity determining region 3 for antibody 28782
QQYYSTPNT

SEQ ID NO: 57564 - protein, 20 aa, Homo sapiens
  heavy chain complementarity determining region 3 for antibody 28782
ARGNYSSSWHTTDYYYGMHV

SEQ ID NO: 57565 - protein, 10 aa, Homo sapiens
  light chain complementarity determining region 3 for antibody 28783
QQYYSTPLYT

SEQ ID NO: 57566 - protein, 12 aa, Homo sapiens
  heavy chain complementarity determining region 3 for antibody 28783
ARPFDDYGENDY

SEQ ID NO: 57567 - protein, 9 aa, Homo sapiens
  light chain complementarity determining region 3 for antibody 28784
QQYYSTPLT

SEQ ID NO: 57568 - protein, 12 aa, Homo sapiens
  heavy chain complementarity determining region 3 for antibody 28784
ARVLGVDYSFDY

SEQ ID NO: 57569 - protein, 9 aa, Homo sapiens
  light chain complementarity determining region 3 for antibody 28785
QQYYSTPLT

SEQ ID NO: 57570 - protein, 20 aa, Homo sapiens
  heavy chain complementarity determining region 3 for antibody 28785
ARDQAYCYALGSSGVDWLDP

SEQ ID NO: 57571 - protein, 9 aa, Homo sapiens
  light chain complementarity determining region 3 for antibody 28786
QQYYSTPGT

SEQ ID NO: 57572 - protein, 15 aa, Homo sapiens
  heavy chain complementarity determining region 3 for antibody 28786
IRQSKMNNNWDYPDS

SEQ ID NO: 57573 - protein, 9 aa, Homo sapiens
  light chain complementarity determining region 3 for antibody 28787
QQYYSTPGT

SEQ ID NO: 57574 - protein, 14 aa, Homo sapiens
  heavy chain complementarity determining region 3 for antibody 28787
ARHEHDGSGSVIDY

SEQ ID NO: 57575 - protein, 9 aa, Homo sapiens
  light chain complementarity determining region 3 for antibody 28788
QQYYSTPGT

SEQ ID NO: 57576 - protein, 18 aa, Homo sapiens
  heavy chain complementarity determining region 3 for antibody 28788
AGRPCSGGSCYAGGWFDP

SEQ ID NO: 57577 - protein, 9 aa, Homo sapiens
  light chain complementarity determining region 3 for antibody 28789
QQYYSSPWT

SEQ ID NO: 57578 - protein, 10 aa, Homo sapiens
  heavy chain complementarity determining region 3 for antibody 28789
STPSRVGAKF

SEQ ID NO: 57579 - protein, 9 aa, Homo sapiens
  light chain complementarity determining region 3 for antibody 28790
QQYYSSPPP

SEQ ID NO: 57580 - protein, 13 aa, Homo sapiens
  heavy chain complementarity determining region 3 for antibody 28790
ARQAYGSGSYYNV

SEQ ID NO: 57581 - protein, 9 aa, Homo sapiens
  light chain complementarity determining region 3 for antibody 28791
QQYYSSPLT

SEQ ID NO: 57582 - protein, 13 aa, Homo sapiens
  heavy chain complementarity determining region 3 for antibody 28791
ARLYRESPMVPDY

SEQ ID NO: 57583 - protein, 9 aa, Homo sapiens
  light chain complementarity determining region 3 for antibody 28792
QQYYSSPGP

SEQ ID NO: 57584 - protein, 15 aa, Homo sapiens
  heavy chain complementarity determining region 3 for antibody 28792
ARAPSGTSSPHHFDH

SEQ ID NO: 57585 - protein, 9 aa, Homo sapiens
  light chain complementarity determining region 3 for antibody 28793
QQYYSPPWT

SEQ ID NO: 57586 - protein, 18 aa, Homo sapiens
  heavy chain complementarity determining region 3 for antibody 28793
AGRPCSGGSCYAGGWFDP

SEQ ID NO: 57587 - protein, 9 aa, Homo sapiens
  light chain complementarity determining region 3 for antibody 28794
QQYYSPPLT

SEQ ID NO: 57588 - protein, 20 aa, Homo sapiens
  heavy chain complementarity determining region 3 for antibody 28794
ARDQAYFYALGSSGVDWLDP

SEQ ID NO: 57589 - protein, 8 aa, Homo sapiens
  light chain complementarity determining region 3 for antibody 28795
QQYYSPIT

SEQ ID NO: 57590 - protein, 10 aa, Homo sapiens
  heavy chain complementarity determining region 3 for antibody 28795
VRGRGWTLDH

SEQ ID NO: 57591 - protein, 10 aa, Homo sapiens
  light chain complementarity determining region 3 for antibody 28796
QQYYSNRAPT

SEQ ID NO: 57592 - protein, 19 aa, Homo sapiens
  heavy chain complementarity determining region 3 for antibody 28796
ARGGDYGSGTYARFRAFDI

SEQ ID NO: 57593 - protein, 9 aa, Homo sapiens
  light chain complementarity determining region 3 for antibody 28797
QQYYSNPWT

SEQ ID NO: 57594 - protein, 14 aa, Homo sapiens
  heavy chain complementarity determining region 3 for antibody 28797
ARGLHYDFWSGSLP

SEQ ID NO: 57595 - protein, 11 aa, Homo sapiens
  light chain complementarity determining region 3 for antibody 28798
QQYYSNPTMNT

SEQ ID NO: 57596 - protein, 14 aa, Homo sapiens
  heavy chain complementarity determining region 3 for antibody 28798
ARDIVGAHPYYFDY

SEQ ID NO: 57597 - protein, 9 aa, Homo sapiens
  light chain complementarity determining region 3 for antibody 28799
QQYYSNPGT

SEQ ID NO: 57598 - protein, 14 aa, Homo sapiens
  heavy chain complementarity determining region 3 for antibody 28799
ARGLHYDFWSGSLP

SEQ ID NO: 57599 - protein, 8 aa, Homo sapiens
  light chain complementarity determining region 3 for antibody 28800
QQYYSNPF

SEQ ID NO: 57600 - protein, 20 aa, Homo sapiens
  heavy chain complementarity determining region 3 for antibody 28800
ARAAKVSGYYINRWGGAFDI

SEQ ID NO: 57601 - protein, 9 aa, Homo sapiens
  light chain complementarity determining region 3 for antibody 28801
QQYYSIPPT

SEQ ID NO: 57602 - protein, 12 aa, Homo sapiens
  heavy chain complementarity determining region 3 for antibody 28801
ARSDSGGGSYDY

SEQ ID NO: 57603 - protein, 9 aa, Homo sapiens
  light chain complementarity determining region 3 for antibody 28802
QQYYSFSGT

SEQ ID NO: 57604 - protein, 16 aa, Homo sapiens
  heavy chain complementarity determining region 3 for antibody 28802
ARGGDYDFWSGYPTDY

SEQ ID NO: 57605 - protein, 9 aa, Homo sapiens
  light chain complementarity determining region 3 for antibody 28803
QQYYSFPPT

SEQ ID NO: 57606 - protein, 11 aa, Homo sapiens
  heavy chain complementarity determining region 3 for antibody 28803
ARVGFLVPFDC

SEQ ID NO: 57607 - protein, 9 aa, Homo sapiens
  light chain complementarity determining region 3 for antibody 28804
QQYYSFLYT

SEQ ID NO: 57608 - protein, 19 aa, Homo sapiens
  heavy chain complementarity determining region 3 for antibody 28804
ARDYEYYDRRDRYEDVFDS

SEQ ID NO: 57609 - protein, 10 aa, Homo sapiens
  light chain complementarity determining region 3 for antibody 28805
QQYYSARPFP

SEQ ID NO: 57610 - protein, 11 aa, Homo sapiens
  heavy chain complementarity determining region 3 for antibody 28805
AGGHGGNLEDY

SEQ ID NO: 57611 - protein, 9 aa, Homo sapiens
  light chain complementarity determining region 3 for antibody 28806
QQYYRYSPT

SEQ ID NO: 57612 - protein, 19 aa, Homo sapiens
  heavy chain complementarity determining region 3 for antibody 28806
ARDPGIGGMAAGASLAFDI

SEQ ID NO: 57613 - protein, 9 aa, Homo sapiens
  light chain complementarity determining region 3 for antibody 28807
QQYYRYSHT

SEQ ID NO: 57614 - protein, 19 aa, Homo sapiens
  heavy chain complementarity determining region 3 for antibody 28807
ARDPGSGGMAAGASLAFDI

SEQ ID NO: 57615 - protein, 9 aa, Homo sapiens
  light chain complementarity determining region 3 for antibody 28808
QQYYRTPYT

SEQ ID NO: 57616 - protein, 15 aa, Homo sapiens
  heavy chain complementarity determining region 3 for antibody 28808
ARVGVDPNYYCGLDV

SEQ ID NO: 57617 - protein, 9 aa, Homo sapiens
  light chain complementarity determining region 3 for antibody 28809
QQYYRTPYT

SEQ ID NO: 57618 - protein, 15 aa, Homo sapiens
  heavy chain complementarity determining region 3 for antibody 28809
ARVGVDPNCYYGLDV

SEQ ID NO: 57619 - protein, 9 aa, Homo sapiens
  light chain complementarity determining region 3 for antibody 28810
QQYYRTPRT

SEQ ID NO: 57620 - protein, 18 aa, Homo sapiens
  heavy chain complementarity determining region 3 for antibody 28810
ARGGRNRYGYSSSWPTDY

SEQ ID NO: 57621 - protein, 9 aa, Homo sapiens
  light chain complementarity determining region 3 for antibody 28811
QQYYRTLWT

SEQ ID NO: 57622 - protein, 8 aa, Homo sapiens
  heavy chain complementarity determining region 3 for antibody 28811
ARGGGFDP

SEQ ID NO: 57623 - protein, 10 aa, Homo sapiens
  light chain complementarity determining region 3 for antibody 28812
QQYYRPFIYT

SEQ ID NO: 57624 - protein, 11 aa, Homo sapiens
  heavy chain complementarity determining region 3 for antibody 28812
ASLSGEDAFDF

SEQ ID NO: 57625 - protein, 9 aa, Homo sapiens
  light chain complementarity determining region 3 for antibody 28813
QQYYRNPYT

SEQ ID NO: 57626 - protein, 15 aa, Homo sapiens
  heavy chain complementarity determining region 3 for antibody 28813
ARVGVDPNYYYGLDV

SEQ ID NO: 57627 - protein, 10 aa, Homo sapiens
  light chain complementarity determining region 3 for antibody 28814
QQYYRDPPLT

SEQ ID NO: 57628 - protein, 11 aa, Homo sapiens
  heavy chain complementarity determining region 3 for antibody 28814
ARGGIAARMQA

SEQ ID NO: 57629 - protein, 9 aa, Homo sapiens
  light chain complementarity determining region 3 for antibody 28815
QQYYPSFRT

SEQ ID NO: 57630 - protein, 12 aa, Homo sapiens
  heavy chain complementarity determining region 3 for antibody 28815
VKDCGLGGSRDS

SEQ ID NO: 57631 - protein, 10 aa, Homo sapiens
  light chain complementarity determining region 3 for antibody 28816
QQYYNYSGGT

SEQ ID NO: 57632 - protein, 17 aa, Homo sapiens
  heavy chain complementarity determining region 3 for antibody 28816
GCSPSMIGGLIPGAFHY

SEQ ID NO: 57633 - protein, 9 aa, Homo sapiens
  light chain complementarity determining region 3 for antibody 28817
QQYYNYPYT

SEQ ID NO: 57634 - protein, 15 aa, Homo sapiens
  heavy chain complementarity determining region 3 for antibody 28817
ARGQGSGTYNPYFAF

SEQ ID NO: 57635 - protein, 10 aa, Homo sapiens
  light chain complementarity determining region 3 for antibody 28818
QQYYNYPQYT

SEQ ID NO: 57636 - protein, 16 aa, Homo sapiens
  heavy chain complementarity determining region 3 for antibody 28818
ARDTAYDYVWGSPIDY

SEQ ID NO: 57637 - protein, 10 aa, Homo sapiens
  light chain complementarity determining region 3 for antibody 28819
QQYYNYPPYT

SEQ ID NO: 57638 - protein, 16 aa, Homo sapiens
  heavy chain complementarity determining region 3 for antibody 28819
ARDTAYDYVWGRPIDY

SEQ ID NO: 57639 - protein, 10 aa, Homo sapiens
  light chain complementarity determining region 3 for antibody 28820
QQYYNYPPYP

SEQ ID NO: 57640 - protein, 16 aa, Homo sapiens
  heavy chain complementarity determining region 3 for antibody 28820
ARDTAYDYVWGSPIDY

SEQ ID NO: 57641 - protein, 10 aa, Homo sapiens
  light chain complementarity determining region 3 for antibody 28821
QQYYNYLGGT

SEQ ID NO: 57642 - protein, 17 aa, Homo sapiens
  heavy chain complementarity determining region 3 for antibody 28821
GYSPSMIGGLIPGAFHY

SEQ ID NO: 57643 - protein, 9 aa, Homo sapiens
  light chain complementarity determining region 3 for antibody 28822
QQYYNWPYP

SEQ ID NO: 57644 - protein, 18 aa, Homo sapiens
  heavy chain complementarity determining region 3 for antibody 28822
ARDSGGSDWYYTMYYFDY

SEQ ID NO: 57645 - protein, 10 aa, Homo sapiens
  light chain complementarity determining region 3 for antibody 28823
QQYYNWPPGG

SEQ ID NO: 57646 - protein, 13 aa, Homo sapiens
  heavy chain complementarity determining region 3 for antibody 28823
VRTSGGFLGYFDF

SEQ ID NO: 57647 - protein, 8 aa, Homo sapiens
  light chain complementarity determining region 3 for antibody 28824
QQYYNVPS

SEQ ID NO: 57648 - protein, 15 aa, Homo sapiens
  heavy chain complementarity determining region 3 for antibody 28824
AKTRPFRGAARPSDF

SEQ ID NO: 57649 - protein, 8 aa, Homo sapiens
  light chain complementarity determining region 3 for antibody 28825
QQYYNTVT

SEQ ID NO: 57650 - protein, 17 aa, Homo sapiens
  heavy chain complementarity determining region 3 for antibody 28825
ARVVPSHYPTTVERMDV

SEQ ID NO: 57651 - protein, 9 aa, Homo sapiens
  light chain complementarity determining region 3 for antibody 28826
QQYYNTPYT

SEQ ID NO: 57652 - protein, 12 aa, Homo sapiens
  heavy chain complementarity determining region 3 for antibody 28826
ARVPAPEQHADY

SEQ ID NO: 57653 - protein, 9 aa, Homo sapiens
  light chain complementarity determining region 3 for antibody 28827
QQYYISPPT

SEQ ID NO: 57654 - protein, 23 aa, Homo sapiens
  heavy chain complementarity determining region 3 for antibody 28827
ARGAPPDVVTAMVPSPYVDLFDF

SEQ ID NO: 57655 - protein, 9 aa, Homo sapiens
  light chain complementarity determining region 3 for antibody 28828
QQYYISFRT

SEQ ID NO: 57656 - protein, 12 aa, Homo sapiens
  heavy chain complementarity determining region 3 for antibody 28828
VKDCGLGGSRDF

SEQ ID NO: 57657 - protein, 9 aa, Homo sapiens
  light chain complementarity determining region 3 for antibody 28829
QQYYIIPLT

SEQ ID NO: 57658 - protein, 19 aa, Homo sapiens
  heavy chain complementarity determining region 3 for antibody 28829
ARHNSKDYYSSSLLPGNDH

SEQ ID NO: 57659 - protein, 10 aa, Homo sapiens
  light chain complementarity determining region 3 for antibody 28830
QQYYGSPPFT

SEQ ID NO: 57660 - protein, 14 aa, Homo sapiens
  heavy chain complementarity determining region 3 for antibody 28830
AKDLLKLWGSCSGD

SEQ ID NO: 57661 - protein, 10 aa, Homo sapiens
  light chain complementarity determining region 3 for antibody 28831
QQYYGPPPFT

SEQ ID NO: 57662 - protein, 14 aa, Homo sapiens
  heavy chain complementarity determining region 3 for antibody 28831
AKDLLKLWGSCSGD

SEQ ID NO: 57663 - protein, 10 aa, Homo sapiens
  light chain complementarity determining region 3 for antibody 28832
QQYYGNPPFT

SEQ ID NO: 57664 - protein, 14 aa, Homo sapiens
  heavy chain complementarity determining region 3 for antibody 28832
AKDLLKLWGSCSGD

SEQ ID NO: 57665 - protein, 9 aa, Homo sapiens
  light chain complementarity determining region 3 for antibody 28833
QQYYDPPRT

SEQ ID NO: 57666 - protein, 19 aa, Homo sapiens
  heavy chain complementarity determining region 3 for antibody 28833
ARDGRPDCKDDICYSWFDL

SEQ ID NO: 57667 - protein, 9 aa, Homo sapiens
  light chain complementarity determining region 3 for antibody 28834
QQYWTTPIT

SEQ ID NO: 57668 - protein, 8 aa, Homo sapiens
  heavy chain complementarity determining region 3 for antibody 28834
VKFSDGIK

SEQ ID NO: 57669 - protein, 9 aa, Homo sapiens
  light chain complementarity determining region 3 for antibody 28835
QQYWGALFK

SEQ ID NO: 57670 - protein, 10 aa, Homo sapiens
  heavy chain complementarity determining region 3 for antibody 28835
TGGEGSKFDY

SEQ ID NO: 57671 - protein, 9 aa, Homo sapiens
  light chain complementarity determining region 3 for antibody 28836
QQYVTYPTT

SEQ ID NO: 57672 - protein, 13 aa, Homo sapiens
  heavy chain complementarity determining region 3 for antibody 28836
GRGGYTSSWYWVY

SEQ ID NO: 57673 - protein, 9 aa, Homo sapiens
  light chain complementarity determining region 3 for antibody 28837
QQYVTYPST

SEQ ID NO: 57674 - protein, 13 aa, Homo sapiens
  heavy chain complementarity determining region 3 for antibody 28837
GRGGYTSSWYWVY

SEQ ID NO: 57675 - protein, 9 aa, Homo sapiens
  light chain complementarity determining region 3 for antibody 28838
QQYVTYPIT

SEQ ID NO: 57676 - protein, 13 aa, Homo sapiens
  heavy chain complementarity determining region 3 for antibody 28838
GRGGYTSSWYRVY

SEQ ID NO: 57677 - protein, 9 aa, Homo sapiens
  light chain complementarity determining region 3 for antibody 28839
QQYVTSPWT

SEQ ID NO: 57678 - protein, 12 aa, Homo sapiens
  heavy chain complementarity determining region 3 for antibody 28839
ARGLRSGWGLDY

SEQ ID NO: 57679 - protein, 9 aa, Homo sapiens
  light chain complementarity determining region 3 for antibody 28840
QQYVTSPIT

SEQ ID NO: 57680 - protein, 13 aa, Homo sapiens
  heavy chain complementarity determining region 3 for antibody 28840
GRGGYTSSWYWVY

SEQ ID NO: 57681 - protein, 9 aa, Homo sapiens
  light chain complementarity determining region 3 for antibody 28841
QQYVSSSYT

SEQ ID NO: 57682 - protein, 11 aa, Homo sapiens
  heavy chain complementarity determining region 3 for antibody 28841
ARGGFYGSFDF

SEQ ID NO: 57683 - protein, 9 aa, Homo sapiens
  light chain complementarity determining region 3 for antibody 28842
QQYVSSPRT

SEQ ID NO: 57684 - protein, 25 aa, Homo sapiens
  heavy chain complementarity determining region 3 for antibody 28842
ARLRIDRLRLPGAMRGPLYDCGLNV

SEQ ID NO: 57685 - protein, 9 aa, Homo sapiens
  light chain complementarity determining region 3 for antibody 28843
QQYVSSPRT

SEQ ID NO: 57686 - protein, 14 aa, Homo sapiens
  heavy chain complementarity determining region 3 for antibody 28843
ARERSGGGHWYFDL

SEQ ID NO: 57687 - protein, 9 aa, Homo sapiens
  light chain complementarity determining region 3 for antibody 28844
QQYVSSPRT

SEQ ID NO: 57688 - protein, 14 aa, Homo sapiens
  heavy chain complementarity determining region 3 for antibody 28844
ARERIGGGHWSFDL

SEQ ID NO: 57689 - protein, 9 aa, Homo sapiens
  light chain complementarity determining region 3 for antibody 28845
QQYVSSPRP

SEQ ID NO: 57690 - protein, 14 aa, Homo sapiens
  heavy chain complementarity determining region 3 for antibody 28845
ARERIGGGHWYFDL

SEQ ID NO: 57691 - protein, 9 aa, Homo sapiens
  light chain complementarity determining region 3 for antibody 28846
QQYVSLPWT

SEQ ID NO: 57692 - protein, 19 aa, Homo sapiens
  heavy chain complementarity determining region 3 for antibody 28846
ARTAIGKRYWASSGDQFDY

SEQ ID NO: 57693 - protein, 8 aa, Homo sapiens
  light chain complementarity determining region 3 for antibody 28847
QQYVRSLT

SEQ ID NO: 57694 - protein, 15 aa, Homo sapiens
  heavy chain complementarity determining region 3 for antibody 28847
ASGGLPLRRNGYFDS

SEQ ID NO: 57695 - protein, 8 aa, Homo sapiens
  light chain complementarity determining region 3 for antibody 28848
QQYVRSLT

SEQ ID NO: 57696 - protein, 15 aa, Homo sapiens
  heavy chain complementarity determining region 3 for antibody 28848
ARGGRPLRRNGYFDS

SEQ ID NO: 57697 - protein, 8 aa, Homo sapiens
  light chain complementarity determining region 3 for antibody 28849
QQYVRSLT

SEQ ID NO: 57698 - protein, 15 aa, Homo sapiens
  heavy chain complementarity determining region 3 for antibody 28849
ARGGLPLRRNGYFGS

SEQ ID NO: 57699 - protein, 8 aa, Homo sapiens
  light chain complementarity determining region 3 for antibody 28850
QQYVRSLT

SEQ ID NO: 57700 - protein, 15 aa, Homo sapiens
  heavy chain complementarity determining region 3 for antibody 28850
ARGGLALRRNGYFDS

SEQ ID NO: 57701 - protein, 8 aa, Homo sapiens
  light chain complementarity determining region 3 for antibody 28851
QQYVRSLP

SEQ ID NO: 57702 - protein, 15 aa, Homo sapiens
  heavy chain complementarity determining region 3 for antibody 28851
ARGGLPLRRNGYFDS

SEQ ID NO: 57703 - protein, 8 aa, Homo sapiens
  light chain complementarity determining region 3 for antibody 28852
QQYVRSLN

SEQ ID NO: 57704 - protein, 15 aa, Homo sapiens
  heavy chain complementarity determining region 3 for antibody 28852
ARGGLPLRRNGYFDS

SEQ ID NO: 57705 - protein, 8 aa, Homo sapiens
  light chain complementarity determining region 3 for antibody 28853
QQYVRSIT

SEQ ID NO: 57706 - protein, 15 aa, Homo sapiens
  heavy chain complementarity determining region 3 for antibody 28853
ARGGLPLRRNGYFDS

SEQ ID NO: 57707 - protein, 8 aa, Homo sapiens
  light chain complementarity determining region 3 for antibody 28854
QQYVRSFT

SEQ ID NO: 57708 - protein, 15 aa, Homo sapiens
  heavy chain complementarity determining region 3 for antibody 28854
ARGGLPLRRNGYFDS

SEQ ID NO: 57709 - protein, 8 aa, Homo sapiens
  light chain complementarity determining region 3 for antibody 28855
QQYVRPLT

SEQ ID NO: 57710 - protein, 15 aa, Homo sapiens
  heavy chain complementarity determining region 3 for antibody 28855
ARGGLPLRRNGYFDS

SEQ ID NO: 57711 - protein, 9 aa, Homo sapiens
  light chain complementarity determining region 3 for antibody 28856
QQYVKLPWT

SEQ ID NO: 57712 - protein, 11 aa, Homo sapiens
  heavy chain complementarity determining region 3 for antibody 28856
AREDWPDGFDI

SEQ ID NO: 57713 - protein, 8 aa, Homo sapiens
  light chain complementarity determining region 3 for antibody 28857
QQYTTYWT

SEQ ID NO: 57714 - protein, 14 aa, Homo sapiens
  heavy chain complementarity determining region 3 for antibody 28857
AVLGSNWQVYNFDY

SEQ ID NO: 57715 - protein, 9 aa, Homo sapiens
  light chain complementarity determining region 3 for antibody 28858
QQYTTYPWP

SEQ ID NO: 57716 - protein, 17 aa, Homo sapiens
  heavy chain complementarity determining region 3 for antibody 28858
AREGGYSYGLYGDAFDI

SEQ ID NO: 57717 - protein, 9 aa, Homo sapiens
  light chain complementarity determining region 3 for antibody 28859
QQYTTPMYT

SEQ ID NO: 57718 - protein, 12 aa, Homo sapiens
  heavy chain complementarity determining region 3 for antibody 28859
AREPPEPCYFDY

SEQ ID NO: 57719 - protein, 8 aa, Homo sapiens
  light chain complementarity determining region 3 for antibody 28860
QQYTGLFT

SEQ ID NO: 57720 - protein, 12 aa, Homo sapiens
  heavy chain complementarity determining region 3 for antibody 28860
ARYVSHWGKFDH

SEQ ID NO: 57721 - protein, 8 aa, Homo sapiens
  light chain complementarity determining region 3 for antibody 28861
QQYTDLFT

SEQ ID NO: 57722 - protein, 12 aa, Homo sapiens
  heavy chain complementarity determining region 3 for antibody 28861
ARYVCHWGKFDH

SEQ ID NO: 57723 - protein, 8 aa, Homo sapiens
  light chain complementarity determining region 3 for antibody 28862
QQYTDFFT

SEQ ID NO: 57724 - protein, 12 aa, Homo sapiens
  heavy chain complementarity determining region 3 for antibody 28862
ARYVSHWGKFDH

SEQ ID NO: 57725 - protein, 10 aa, Homo sapiens
  light chain complementarity determining region 3 for antibody 28863
QQYSYWPPGP

SEQ ID NO: 57726 - protein, 11 aa, Homo sapiens
  heavy chain complementarity determining region 3 for antibody 28863
ARDPLEHYFDY

SEQ ID NO: 57727 - protein, 9 aa, Homo sapiens
  light chain complementarity determining region 3 for antibody 28864
QQYSTYPWP

SEQ ID NO: 57728 - protein, 16 aa, Homo sapiens
  heavy chain complementarity determining region 3 for antibody 28864
ARVRYPISADNRVVDH

SEQ ID NO: 57729 - protein, 9 aa, Homo sapiens
  light chain complementarity determining region 3 for antibody 28865
QQYSTYPRT

SEQ ID NO: 57730 - protein, 16 aa, Homo sapiens
  heavy chain complementarity determining region 3 for antibody 28865
ARVRYPISADNRVVDH

SEQ ID NO: 57731 - protein, 9 aa, Homo sapiens
  light chain complementarity determining region 3 for antibody 28866
QQYSTTPRT

SEQ ID NO: 57732 - protein, 19 aa, Homo sapiens
  heavy chain complementarity determining region 3 for antibody 28866
ATDVGNEQAMADSRYAFDV

SEQ ID NO: 57733 - protein, 8 aa, Homo sapiens
  light chain complementarity determining region 3 for antibody 28867
QQYSTSPT

SEQ ID NO: 57734 - protein, 22 aa, Homo sapiens
  heavy chain complementarity determining region 3 for antibody 28867
ARGRGTVIRGATTKSYFNVMDV

SEQ ID NO: 57735 - protein, 9 aa, Homo sapiens
  light chain complementarity determining region 3 for antibody 28868
QQYSSSPWT

SEQ ID NO: 57736 - protein, 13 aa, Homo sapiens
  heavy chain complementarity determining region 3 for antibody 28868
ARGSTNWRDWFDP

SEQ ID NO: 57737 - protein, 9 aa, Homo sapiens
  light chain complementarity determining region 3 for antibody 28869
QQYSSSPWP

SEQ ID NO: 57738 - protein, 13 aa, Homo sapiens
  heavy chain complementarity determining region 3 for antibody 28869
ARGSTNWRNWFDP

SEQ ID NO: 57739 - protein, 9 aa, Homo sapiens
  light chain complementarity determining region 3 for antibody 28870
QQYSSSPGT

SEQ ID NO: 57740 - protein, 13 aa, Homo sapiens
  heavy chain complementarity determining region 3 for antibody 28870
ARGSTNWRNWFDP

SEQ ID NO: 57741 - protein, 9 aa, Homo sapiens
  light chain complementarity determining region 3 for antibody 28871
QQYSSSLIN

SEQ ID NO: 57742 - protein, 12 aa, Homo sapiens
  heavy chain complementarity determining region 3 for antibody 28871
ARDYVAGDAFDV

SEQ ID NO: 57743 - protein, 9 aa, Homo sapiens
  light chain complementarity determining region 3 for antibody 28872
QQYSSSLFP

SEQ ID NO: 57744 - protein, 12 aa, Homo sapiens
  heavy chain complementarity determining region 3 for antibody 28872
ARDYVAGDAFDV

SEQ ID NO: 57745 - protein, 9 aa, Homo sapiens
  light chain complementarity determining region 3 for antibody 28873
QQYSSLPLT

SEQ ID NO: 57746 - protein, 15 aa, Homo sapiens
  heavy chain complementarity determining region 3 for antibody 28873
AHRPNYYDKAGAFDI

SEQ ID NO: 57747 - protein, 8 aa, Homo sapiens
  light chain complementarity determining region 3 for antibody 28874
QQYSRSRT

SEQ ID NO: 57748 - protein, 19 aa, Homo sapiens
  heavy chain complementarity determining region 3 for antibody 28874
ARDGVTCSGGSCSETAVDS

SEQ ID NO: 57749 - protein, 9 aa, Homo sapiens
  light chain complementarity determining region 3 for antibody 28875
QQYSRSPVT

SEQ ID NO: 57750 - protein, 15 aa, Homo sapiens
  heavy chain complementarity determining region 3 for antibody 28875
AREPNSYGLEYYFAY

SEQ ID NO: 57751 - protein, 9 aa, Homo sapiens
  light chain complementarity determining region 3 for antibody 28876
QQYSRSLIT

SEQ ID NO: 57752 - protein, 12 aa, Homo sapiens
  heavy chain complementarity determining region 3 for antibody 28876
ARDYVAGDAFDV

SEQ ID NO: 57753 - protein, 8 aa, Homo sapiens
  light chain complementarity determining region 3 for antibody 28877
QQYSRPRT

SEQ ID NO: 57754 - protein, 19 aa, Homo sapiens
  heavy chain complementarity determining region 3 for antibody 28877
ARDGVTCSGGSCIETAVDS

SEQ ID NO: 57755 - protein, 8 aa, Homo sapiens
  light chain complementarity determining region 3 for antibody 28878
QQYSNWYT

SEQ ID NO: 57756 - protein, 17 aa, Homo sapiens
  heavy chain complementarity determining region 3 for antibody 28878
AGQLIPFGGVIIEGFDY

SEQ ID NO: 57757 - protein, 9 aa, Homo sapiens
  light chain complementarity determining region 3 for antibody 28879
QQYSNWPWT

SEQ ID NO: 57758 - protein, 20 aa, Homo sapiens
  heavy chain complementarity determining region 3 for antibody 28879
AHRRVRDTARGNYYSDGMDV

SEQ ID NO: 57759 - protein, 9 aa, Homo sapiens
  light chain complementarity determining region 3 for antibody 28880
QQYSNWPRT

SEQ ID NO: 57760 - protein, 19 aa, Homo sapiens
  heavy chain complementarity determining region 3 for antibody 28880
ARGPWERGADDYGDTAYDY

SEQ ID NO: 57761 - protein, 9 aa, Homo sapiens
  light chain complementarity determining region 3 for antibody 28881
QQYSNWPRT

SEQ ID NO: 57762 - protein, 19 aa, Homo sapiens
  heavy chain complementarity determining region 3 for antibody 28881
ARGPWARGADDSGDTAYDY

SEQ ID NO: 57763 - protein, 9 aa, Homo sapiens
  light chain complementarity determining region 3 for antibody 28882
QQYSNWPRT

SEQ ID NO: 57764 - protein, 19 aa, Homo sapiens
  heavy chain complementarity determining region 3 for antibody 28882
ARGPWARGADAYGDTAYDY

SEQ ID NO: 57765 - protein, 9 aa, Homo sapiens
  light chain complementarity determining region 3 for antibody 28883
QQYSNWPLT

SEQ ID NO: 57766 - protein, 20 aa, Homo sapiens
  heavy chain complementarity determining region 3 for antibody 28883
AKWHMITFGGAIVEPDTFDI

SEQ ID NO: 57767 - protein, 9 aa, Homo sapiens
  light chain complementarity determining region 3 for antibody 28884
QQYSNWPHP

SEQ ID NO: 57768 - protein, 12 aa, Homo sapiens
  heavy chain complementarity determining region 3 for antibody 28884
ATWGFSLLKEDF

SEQ ID NO: 57769 - protein, 9 aa, Homo sapiens
  light chain complementarity determining region 3 for antibody 28885
QQYSNWLWT

SEQ ID NO: 57770 - protein, 20 aa, Homo sapiens
  heavy chain complementarity determining region 3 for antibody 28885
AHRRVRDTARGNYYADGMDV

SEQ ID NO: 57771 - protein, 9 aa, Homo sapiens
  light chain complementarity determining region 3 for antibody 28886
QQYSNWLWT

SEQ ID NO: 57772 - protein, 20 aa, Homo sapiens
  heavy chain complementarity determining region 3 for antibody 28886
AHRRVRATARGNYYSDGMDV

SEQ ID NO: 57773 - protein, 9 aa, Homo sapiens
  light chain complementarity determining region 3 for antibody 28887
QQYSKYPWT

SEQ ID NO: 57774 - protein, 16 aa, Homo sapiens
  heavy chain complementarity determining region 3 for antibody 28887
AAVPNYGWNSDDAFHI

SEQ ID NO: 57775 - protein, 8 aa, Homo sapiens
  light chain complementarity determining region 3 for antibody 28888
QQYSIYWT

SEQ ID NO: 57776 - protein, 14 aa, Homo sapiens
  heavy chain complementarity determining region 3 for antibody 28888
VVLGSNWQVYNFDY

SEQ ID NO: 57777 - protein, 10 aa, Homo sapiens
  light chain complementarity determining region 3 for antibody 28889
QQYSISPKWT

SEQ ID NO: 57778 - protein, 17 aa, Homo sapiens
  heavy chain complementarity determining region 3 for antibody 28889
ARDPCKEATDVVCAWDS

SEQ ID NO: 57779 - protein, 10 aa, Homo sapiens
  light chain complementarity determining region 3 for antibody 28890
QQYSISPKWR

SEQ ID NO: 57780 - protein, 17 aa, Homo sapiens
  heavy chain complementarity determining region 3 for antibody 28890
ARDPCKKATDVVCAWDS

SEQ ID NO: 57781 - protein, 10 aa, Homo sapiens
  light chain complementarity determining region 3 for antibody 28891
QQYSISPKWA

SEQ ID NO: 57782 - protein, 17 aa, Homo sapiens
  heavy chain complementarity determining region 3 for antibody 28891
ARDPCKKATDVVCAWDS

SEQ ID NO: 57783 - protein, 10 aa, Homo sapiens
  light chain complementarity determining region 3 for antibody 28892
QQYSHWPWYP

SEQ ID NO: 57784 - protein, 11 aa, Homo sapiens
  heavy chain complementarity determining region 3 for antibody 28892
TRGGSGWPVDY

SEQ ID NO: 57785 - protein, 10 aa, Homo sapiens
  light chain complementarity determining region 3 for antibody 28893
QQYSHWPPEP

SEQ ID NO: 57786 - protein, 16 aa, Homo sapiens
  heavy chain complementarity determining region 3 for antibody 28893
ATYYSNWPYFYYGFDV

SEQ ID NO: 57787 - protein, 10 aa, Homo sapiens
  light chain complementarity determining region 3 for antibody 28894
QQYSHWPPEA

SEQ ID NO: 57788 - protein, 16 aa, Homo sapiens
  heavy chain complementarity determining region 3 for antibody 28894
ATYYSNWPYFYYGFDV

SEQ ID NO: 57789 - protein, 9 aa, Homo sapiens
  light chain complementarity determining region 3 for antibody 28895
QQYSHDPWT

SEQ ID NO: 57790 - protein, 16 aa, Homo sapiens
  heavy chain complementarity determining region 3 for antibody 28895
AAVPNYGWNSDDAFHI

SEQ ID NO: 57791 - protein, 9 aa, Homo sapiens
  light chain complementarity determining region 3 for antibody 28896
QQYSGVPLT

SEQ ID NO: 57792 - protein, 9 aa, Homo sapiens
  heavy chain complementarity determining region 3 for antibody 28896
VCLGVTPPV

SEQ ID NO: 57793 - protein, 11 aa, Homo sapiens
  light chain complementarity determining region 3 for antibody 28897
QQYSDWPTSFT

SEQ ID NO: 57794 - protein, 14 aa, Homo sapiens
  heavy chain complementarity determining region 3 for antibody 28897
VRASGSNVKMPFDF

SEQ ID NO: 57795 - protein, 11 aa, Homo sapiens
  light chain complementarity determining region 3 for antibody 28898
QQYSDWPTSFT

SEQ ID NO: 57796 - protein, 14 aa, Homo sapiens
  heavy chain complementarity determining region 3 for antibody 28898
ARASGSNVKMPSDF

SEQ ID NO: 57797 - protein, 11 aa, Homo sapiens
  light chain complementarity determining region 3 for antibody 28899
QQYSDWPTSFT

SEQ ID NO: 57798 - protein, 14 aa, Homo sapiens
  heavy chain complementarity determining region 3 for antibody 28899
ARASGSNVKMPFDS

SEQ ID NO: 57799 - protein, 9 aa, Homo sapiens
  light chain complementarity determining region 3 for antibody 28900
QQYSDWPPF

SEQ ID NO: 57800 - protein, 20 aa, Homo sapiens
  heavy chain complementarity determining region 3 for antibody 28900
ARGGGQGPTANGWFGGGADY

SEQ ID NO: 57801 - protein, 9 aa, Homo sapiens
  light chain complementarity determining region 3 for antibody 28901
QQYSDWPPF

SEQ ID NO: 57802 - protein, 20 aa, Homo sapiens
  heavy chain complementarity determining region 3 for antibody 28901
AREGGQAPTANGWFGGGADY

SEQ ID NO: 57803 - protein, 9 aa, Homo sapiens
  light chain complementarity determining region 3 for antibody 28902
QQYSDWPPF

SEQ ID NO: 57804 - protein, 20 aa, Homo sapiens
  heavy chain complementarity determining region 3 for antibody 28902
AREGGEGPTANGWFGGGADY

SEQ ID NO: 57805 - protein, 9 aa, Homo sapiens
  light chain complementarity determining region 3 for antibody 28903
QQYRTYPYT

SEQ ID NO: 57806 - protein, 13 aa, Homo sapiens
  heavy chain complementarity determining region 3 for antibody 28903
AKRDILPREAFDI

SEQ ID NO: 57807 - protein, 9 aa, Homo sapiens
  light chain complementarity determining region 3 for antibody 28904
QQYRSSPWT

SEQ ID NO: 57808 - protein, 22 aa, Homo sapiens
  heavy chain complementarity determining region 3 for antibody 28904
AGAVSTNRWGRSTGDWGGAYDI

SEQ ID NO: 57809 - protein, 9 aa, Homo sapiens
  light chain complementarity determining region 3 for antibody 28905
QQYRSSPWR

SEQ ID NO: 57810 - protein, 22 aa, Homo sapiens
  heavy chain complementarity determining region 3 for antibody 28905
ARAVSTNRWGRSTGDWGGAYDI

SEQ ID NO: 57811 - protein, 9 aa, Homo sapiens
  light chain complementarity determining region 3 for antibody 28906
QQYRRSPVT

SEQ ID NO: 57812 - protein, 15 aa, Homo sapiens
  heavy chain complementarity determining region 3 for antibody 28906
AREPNSYGLEYYFTY

SEQ ID NO: 57813 - protein, 9 aa, Homo sapiens
  light chain complementarity determining region 3 for antibody 28907
QQYRRSPST

SEQ ID NO: 57814 - protein, 17 aa, Homo sapiens
  heavy chain complementarity determining region 3 for antibody 28907
AGLSSRLGDGSPSRFDY

SEQ ID NO: 57815 - protein, 9 aa, Homo sapiens
  light chain complementarity determining region 3 for antibody 28908
QQYRRSPSR

SEQ ID NO: 57816 - protein, 17 aa, Homo sapiens
  heavy chain complementarity determining region 3 for antibody 28908
AGLSSRLGDGSPSLFDY

SEQ ID NO: 57817 - protein, 9 aa, Homo sapiens
  light chain complementarity determining region 3 for antibody 28909
QQYRGSPST

SEQ ID NO: 57818 - protein, 17 aa, Homo sapiens
  heavy chain complementarity determining region 3 for antibody 28909
AGLSSRLGDGSPSLFDY

SEQ ID NO: 57819 - protein, 9 aa, Homo sapiens
  light chain complementarity determining region 3 for antibody 28910
QQYRGDRYS

SEQ ID NO: 57820 - protein, 20 aa, Homo sapiens
  heavy chain complementarity determining region 3 for antibody 28910
ARDVDYCENGVCYSYWYFDL

SEQ ID NO: 57821 - protein, 9 aa, Homo sapiens
  light chain complementarity determining region 3 for antibody 28911
QQYRGDPYG

SEQ ID NO: 57822 - protein, 20 aa, Homo sapiens
  heavy chain complementarity determining region 3 for antibody 28911
ARDVDYCENGVCYSYWYFDL

SEQ ID NO: 57823 - protein, 9 aa, Homo sapiens
  light chain complementarity determining region 3 for antibody 28912
QQYQTYSYT

SEQ ID NO: 57824 - protein, 13 aa, Homo sapiens
  heavy chain complementarity determining region 3 for antibody 28912
AHIAYGGYAYFDH

SEQ ID NO: 57825 - protein, 9 aa, Homo sapiens
  light chain complementarity determining region 3 for antibody 28913
QQYQNHPPT

SEQ ID NO: 57826 - protein, 15 aa, Homo sapiens
  heavy chain complementarity determining region 3 for antibody 28913
ARDLTIFGVLMPFDY

SEQ ID NO: 57827 - protein, 8 aa, Homo sapiens
  light chain complementarity determining region 3 for antibody 28914
QQYPSPIT

SEQ ID NO: 57828 - protein, 10 aa, Homo sapiens
  heavy chain complementarity determining region 3 for antibody 28914
VRGRGWTLDH

SEQ ID NO: 57829 - protein, 9 aa, Homo sapiens
  light chain complementarity determining region 3 for antibody 28915
QQYPSDPLT

SEQ ID NO: 57830 - protein, 10 aa, Homo sapiens
  heavy chain complementarity determining region 3 for antibody 28915
AGGTGWILDT

SEQ ID NO: 57831 - protein, 9 aa, Homo sapiens
  light chain complementarity determining region 3 for antibody 28916
QQYPFTPFT

SEQ ID NO: 57832 - protein, 14 aa, Homo sapiens
  heavy chain complementarity determining region 3 for antibody 28916
ARHEEMGTTAAFDV

SEQ ID NO: 57833 - protein, 11 aa, Homo sapiens
  light chain complementarity determining region 3 for antibody 28917
QQYNTYSPPCT

SEQ ID NO: 57834 - protein, 15 aa, Homo sapiens
  heavy chain complementarity determining region 3 for antibody 28917
AGGPSGVWLGYYSDY

SEQ ID NO: 57835 - protein, 11 aa, Homo sapiens
  light chain complementarity determining region 3 for antibody 28918
QQYNTYSPPCT

SEQ ID NO: 57836 - protein, 15 aa, Homo sapiens
  heavy chain complementarity determining region 3 for antibody 28918
AGGPGGVWLGYYFDY

SEQ ID NO: 57837 - protein, 9 aa, Homo sapiens
  light chain complementarity determining region 3 for antibody 28919
QQYNTYPRT

SEQ ID NO: 57838 - protein, 18 aa, Homo sapiens
  heavy chain complementarity determining region 3 for antibody 28919
ARTRGIVFGGGPRVPLDY

SEQ ID NO: 57839 - protein, 9 aa, Homo sapiens
  light chain complementarity determining region 3 for antibody 28920
QQYNTYPRP

SEQ ID NO: 57840 - protein, 18 aa, Homo sapiens
  heavy chain complementarity determining region 3 for antibody 28920
ARTRRIVFGGGPRVPLDY

SEQ ID NO: 57841 - protein, 9 aa, Homo sapiens
  light chain complementarity determining region 3 for antibody 28921
QQYNTYPLT

SEQ ID NO: 57842 - protein, 8 aa, Homo sapiens
  heavy chain complementarity determining region 3 for antibody 28921
INYNTGWS

SEQ ID NO: 57843 - protein, 9 aa, Homo sapiens
  light chain complementarity determining region 3 for antibody 28922
QQYNTYLYP

SEQ ID NO: 57844 - protein, 16 aa, Homo sapiens
  heavy chain complementarity determining region 3 for antibody 28922
ASAPPGLDWFLHYFDS

SEQ ID NO: 57845 - protein, 8 aa, Homo sapiens
  light chain complementarity determining region 3 for antibody 28923
QQYNTYLT

SEQ ID NO: 57846 - protein, 14 aa, Homo sapiens
  heavy chain complementarity determining region 3 for antibody 28923
AVLGSNWQVYNFDY

SEQ ID NO: 57847 - protein, 8 aa, Homo sapiens
  light chain complementarity determining region 3 for antibody 28924
QQYNTYAT

SEQ ID NO: 57848 - protein, 17 aa, Homo sapiens
  heavy chain complementarity determining region 3 for antibody 28924
ARRLDHNGMWNEGIFDH

SEQ ID NO: 57849 - protein, 8 aa, Homo sapiens
  light chain complementarity determining region 3 for antibody 28925
QQYNTYAT

SEQ ID NO: 57850 - protein, 17 aa, Homo sapiens
  heavy chain complementarity determining region 3 for antibody 28925
AHRRDHNGMWNEGIFDH

SEQ ID NO: 57851 - protein, 8 aa, Homo sapiens
  light chain complementarity determining region 3 for antibody 28926
QQYNTYAT

SEQ ID NO: 57852 - protein, 17 aa, Homo sapiens
  heavy chain complementarity determining region 3 for antibody 28926
AHRLDHNGRWNEGIFDH

SEQ ID NO: 57853 - protein, 8 aa, Homo sapiens
  light chain complementarity determining region 3 for antibody 28927
QQYNTYAT

SEQ ID NO: 57854 - protein, 17 aa, Homo sapiens
  heavy chain complementarity determining region 3 for antibody 28927
AHRLAHNGMWNEGIFDH

SEQ ID NO: 57855 - protein, 9 aa, Homo sapiens
  light chain complementarity determining region 3 for antibody 28928
QQYNTWPWT

SEQ ID NO: 57856 - protein, 22 aa, Homo sapiens
  heavy chain complementarity determining region 3 for antibody 28928
AREVRASGYDDFYNYYYYGLDV

SEQ ID NO: 57857 - protein, 9 aa, Homo sapiens
  light chain complementarity determining region 3 for antibody 28929
QQYNTWPRP

SEQ ID NO: 57858 - protein, 22 aa, Homo sapiens
  heavy chain complementarity determining region 3 for antibody 28929
AREVRASGYDDFYNYYYYGLDV

SEQ ID NO: 57859 - protein, 10 aa, Homo sapiens
  light chain complementarity determining region 3 for antibody 28930
QQYNTWPLSP

SEQ ID NO: 57860 - protein, 15 aa, Homo sapiens
  heavy chain complementarity determining region 3 for antibody 28930
ATVGAGSWYRGFFDH

SEQ ID NO: 57861 - protein, 8 aa, Homo sapiens
  light chain complementarity determining region 3 for antibody 28931
QQYNTWLS

SEQ ID NO: 57862 - protein, 12 aa, Homo sapiens
  heavy chain complementarity determining region 3 for antibody 28931
ARLLWDSCYFDS

SEQ ID NO: 57863 - protein, 8 aa, Homo sapiens
  light chain complementarity determining region 3 for antibody 28932
QQYNTWLS

SEQ ID NO: 57864 - protein, 12 aa, Homo sapiens
  heavy chain complementarity determining region 3 for antibody 28932
ARLLRDSYYFDS

SEQ ID NO: 57865 - protein, 8 aa, Homo sapiens
  light chain complementarity determining region 3 for antibody 28933
QQYNTWLR

SEQ ID NO: 57866 - protein, 12 aa, Homo sapiens
  heavy chain complementarity determining region 3 for antibody 28933
ARLLWDSYYFDS

SEQ ID NO: 57867 - protein, 9 aa, Homo sapiens
  light chain complementarity determining region 3 for antibody 28934
QQYNTSVRT

SEQ ID NO: 57868 - protein, 12 aa, Homo sapiens
  heavy chain complementarity determining region 3 for antibody 28934
VKDCGLGGSRDS

SEQ ID NO: 57869 - protein, 9 aa, Homo sapiens
  light chain complementarity determining region 3 for antibody 28935
QQYNTRPRT

SEQ ID NO: 57870 - protein, 22 aa, Homo sapiens
  heavy chain complementarity determining region 3 for antibody 28935
AREVRASGYDDFYNYYYYGLDV

SEQ ID NO: 57871 - protein, 9 aa, Homo sapiens
  light chain complementarity determining region 3 for antibody 28936
QQYNTLPRT

SEQ ID NO: 57872 - protein, 22 aa, Homo sapiens
  heavy chain complementarity determining region 3 for antibody 28936
AREVRASGYDDFYNYYYYGLDV

SEQ ID NO: 57873 - protein, 8 aa, Homo sapiens
  light chain complementarity determining region 3 for antibody 28937
QQYNTGLS

SEQ ID NO: 57874 - protein, 12 aa, Homo sapiens
  heavy chain complementarity determining region 3 for antibody 28937
ARLLWDSYYFDS

SEQ ID NO: 57875 - protein, 7 aa, Homo sapiens
  light chain complementarity determining region 3 for antibody 28938
QQYNTFS

SEQ ID NO: 57876 - protein, 19 aa, Homo sapiens
  heavy chain complementarity determining region 3 for antibody 28938
ATRTPRYYDTAGHEGAFDI

SEQ ID NO: 57877 - protein, 8 aa, Homo sapiens
  light chain complementarity determining region 3 for antibody 28939
QQYNTDST

SEQ ID NO: 57878 - protein, 16 aa, Homo sapiens
  heavy chain complementarity determining region 3 for antibody 28939
ARDGLPVTSKPYYFDY

SEQ ID NO: 57879 - protein, 8 aa, Homo sapiens
  light chain complementarity determining region 3 for antibody 28940
QQYNSYYT

SEQ ID NO: 57880 - protein, 15 aa, Homo sapiens
  heavy chain complementarity determining region 3 for antibody 28940
ARLHRPTWIRDYSDY

SEQ ID NO: 57881 - protein, 9 aa, Homo sapiens
  light chain complementarity determining region 3 for antibody 28941
QQYNSYYPT

SEQ ID NO: 57882 - protein, 15 aa, Homo sapiens
  heavy chain complementarity determining region 3 for antibody 28941
AKGPVVTTLSDAFHI

SEQ ID NO: 57883 - protein, 9 aa, Homo sapiens
  light chain complementarity determining region 3 for antibody 28942
QQYNSYYFT

SEQ ID NO: 57884 - protein, 14 aa, Homo sapiens
  heavy chain complementarity determining region 3 for antibody 28942
ARRPTSRGLGTFDY

SEQ ID NO: 57885 - protein, 8 aa, Homo sapiens
  light chain complementarity determining region 3 for antibody 28943
QQYNSYWT

SEQ ID NO: 57886 - protein, 13 aa, Homo sapiens
  heavy chain complementarity determining region 3 for antibody 28943
ARNAYSGYVPFDY

SEQ ID NO: 57887 - protein, 8 aa, Homo sapiens
  light chain complementarity determining region 3 for antibody 28944
QQYNSYWT

SEQ ID NO: 57888 - protein, 14 aa, Homo sapiens
  heavy chain complementarity determining region 3 for antibody 28944
ARDRVAPAGEYFHH

SEQ ID NO: 57889 - protein, 8 aa, Homo sapiens
  light chain complementarity determining region 3 for antibody 28945
QQYNSYVS

SEQ ID NO: 57890 - protein, 12 aa, Homo sapiens
  heavy chain complementarity determining region 3 for antibody 28945
ARNRIWFGDLHF

SEQ ID NO: 57891 - protein, 9 aa, Homo sapiens
  light chain complementarity determining region 3 for antibody 28946
QQYNSYTWT

SEQ ID NO: 57892 - protein, 14 aa, Homo sapiens
  heavy chain complementarity determining region 3 for antibody 28946
ATMGFPMTTVASDS

SEQ ID NO: 57893 - protein, 9 aa, Homo sapiens
  light chain complementarity determining region 3 for antibody 28947
QQYNSYSWT

SEQ ID NO: 57894 - protein, 12 aa, Homo sapiens
  heavy chain complementarity determining region 3 for antibody 28947
ARYPVAGVYFQL

SEQ ID NO: 57895 - protein, 9 aa, Homo sapiens
  light chain complementarity determining region 3 for antibody 28948
QQYNSYSWT

SEQ ID NO: 57896 - protein, 16 aa, Homo sapiens
  heavy chain complementarity determining region 3 for antibody 28948
ARMPCDSRGYYCYPDY

SEQ ID NO: 57897 - protein, 8 aa, Homo sapiens
  light chain complementarity determining region 3 for antibody 28949
QQYNSYST

SEQ ID NO: 57898 - protein, 16 aa, Homo sapiens
  heavy chain complementarity determining region 3 for antibody 28949
ARDGFPLTSKPYYFDY

SEQ ID NO: 57899 - protein, 10 aa, Homo sapiens
  light chain complementarity determining region 3 for antibody 28950
QQYNSYSSYT

SEQ ID NO: 57900 - protein, 15 aa, Homo sapiens
  heavy chain complementarity determining region 3 for antibody 28950
ASRRVSVNYYDGMDV

SEQ ID NO: 57901 - protein, 10 aa, Homo sapiens
  light chain complementarity determining region 3 for antibody 28951
QQYNSYSSYT

SEQ ID NO: 57902 - protein, 15 aa, Homo sapiens
  heavy chain complementarity determining region 3 for antibody 28951
ARTKLERRRDHSFDY

SEQ ID NO: 57903 - protein, 10 aa, Homo sapiens
  light chain complementarity determining region 3 for antibody 28952
QQYNSYSSST

SEQ ID NO: 57904 - protein, 15 aa, Homo sapiens
  heavy chain complementarity determining region 3 for antibody 28952
ARTKLERRRDHYFDY

SEQ ID NO: 57905 - protein, 9 aa, Homo sapiens
  light chain complementarity determining region 3 for antibody 28953
QQYNSYSRT

SEQ ID NO: 57906 - protein, 16 aa, Homo sapiens
  heavy chain complementarity determining region 3 for antibody 28953
AAGVGMGRGISTPFDY

SEQ ID NO: 57907 - protein, 9 aa, Homo sapiens
  light chain complementarity determining region 3 for antibody 28954
QQYNSYSPP

SEQ ID NO: 57908 - protein, 16 aa, Homo sapiens
  heavy chain complementarity determining region 3 for antibody 28954
AVPRQMATIRNDAFDI

SEQ ID NO: 57909 - protein, 11 aa, Homo sapiens
  light chain complementarity determining region 3 for antibody 28955
QQYNSYSPLFT

SEQ ID NO: 57910 - protein, 14 aa, Homo sapiens
  heavy chain complementarity determining region 3 for antibody 28955
ARGRQLGNPVSQDY

SEQ ID NO: 57911 - protein, 11 aa, Homo sapiens
  light chain complementarity determining region 3 for antibody 28956
QQYNSYSPLFT

SEQ ID NO: 57912 - protein, 14 aa, Homo sapiens
  heavy chain complementarity determining region 3 for antibody 28956
ARGHQLGSPVSQDY

SEQ ID NO: 57913 - protein, 10 aa, Homo sapiens
  light chain complementarity determining region 3 for antibody 28957
QQYNSYSPIP

SEQ ID NO: 57914 - protein, 15 aa, Homo sapiens
  heavy chain complementarity determining region 3 for antibody 28957
AKDPSCDSIWNYFDY

SEQ ID NO: 57915 - protein, 10 aa, Homo sapiens
  light chain complementarity determining region 3 for antibody 28958
QQYNSYSPDT

SEQ ID NO: 57916 - protein, 12 aa, Homo sapiens
  heavy chain complementarity determining region 3 for antibody 28958
TPHPQCWSGSDY

SEQ ID NO: 57917 - protein, 8 aa, Homo sapiens
  light chain complementarity determining region 3 for antibody 28959
QQYNSYSP

SEQ ID NO: 57918 - protein, 13 aa, Homo sapiens
  heavy chain complementarity determining region 3 for antibody 28959
ATESGPRRRTLNY

SEQ ID NO: 57919 - protein, 9 aa, Homo sapiens
  light chain complementarity determining region 3 for antibody 28960
QQYNSYSKT

SEQ ID NO: 57920 - protein, 20 aa, Homo sapiens
  heavy chain complementarity determining region 3 for antibody 28960
ARESADSGSYTGSLGYYFDN

SEQ ID NO: 57921 - protein, 9 aa, Homo sapiens
  light chain complementarity determining region 3 for antibody 28961
QQYNSYSGT

SEQ ID NO: 57922 - protein, 12 aa, Homo sapiens
  heavy chain complementarity determining region 3 for antibody 28961
ARETTNIGEFDY

SEQ ID NO: 57923 - protein, 8 aa, Homo sapiens
  light chain complementarity determining region 3 for antibody 28962
QQYNSYSG

SEQ ID NO: 57924 - protein, 19 aa, Homo sapiens
  heavy chain complementarity determining region 3 for antibody 28962
ARRKYISSWYILSDGAFDI

SEQ ID NO: 57925 - protein, 8 aa, Homo sapiens
  light chain complementarity determining region 3 for antibody 28963
QQYNSYRT

SEQ ID NO: 57926 - protein, 13 aa, Homo sapiens
  heavy chain complementarity determining region 3 for antibody 28963
GRDKGGSCYGMDV

SEQ ID NO: 57927 - protein, 8 aa, Homo sapiens
  light chain complementarity determining region 3 for antibody 28964
QQYNSYRS

SEQ ID NO: 57928 - protein, 18 aa, Homo sapiens
  heavy chain complementarity determining region 3 for antibody 28964
SVDQDDSYVSGWFGYLRH

SEQ ID NO: 57929 - protein, 8 aa, Homo sapiens
  light chain complementarity determining region 3 for antibody 28965
QQYNSYRP

SEQ ID NO: 57930 - protein, 13 aa, Homo sapiens
  heavy chain complementarity determining region 3 for antibody 28965
GRDKGGSYYGMDV

SEQ ID NO: 57931 - protein, 9 aa, Homo sapiens
  light chain complementarity determining region 3 for antibody 28966
QQYNSYPYT

SEQ ID NO: 57932 - protein, 15 aa, Homo sapiens
  heavy chain complementarity determining region 3 for antibody 28966
ARDAFRGVIITPIDY

SEQ ID NO: 57933 - protein, 9 aa, Homo sapiens
  light chain complementarity determining region 3 for antibody 28967
QQYNSYPWT

SEQ ID NO: 57934 - protein, 19 aa, Homo sapiens
  heavy chain complementarity determining region 3 for antibody 28967
ARVSARRILTAPRYPLIDS

SEQ ID NO: 57935 - protein, 9 aa, Homo sapiens
  light chain complementarity determining region 3 for antibody 28968
QQYNSYPWT

SEQ ID NO: 57936 - protein, 13 aa, Homo sapiens
  heavy chain complementarity determining region 3 for antibody 28968
AREGTGNLGGFDS

SEQ ID NO: 57937 - protein, 9 aa, Homo sapiens
  light chain complementarity determining region 3 for antibody 28969
QQYNSYPWT

SEQ ID NO: 57938 - protein, 13 aa, Homo sapiens
  heavy chain complementarity determining region 3 for antibody 28969
AREENWGSGVWDY

SEQ ID NO: 57939 - protein, 8 aa, Homo sapiens
  light chain complementarity determining region 3 for antibody 28970
QQYNSYPT

SEQ ID NO: 57940 - protein, 12 aa, Homo sapiens
  heavy chain complementarity determining region 3 for antibody 28970
ASTTVTTLSFQH

SEQ ID NO: 57941 - protein, 9 aa, Homo sapiens
  light chain complementarity determining region 3 for antibody 28971
QQYNSYPRT

SEQ ID NO: 57942 - protein, 24 aa, Homo sapiens
  heavy chain complementarity determining region 3 for antibody 28971
ARGRLPSGWYRLKDRTYYYCGLDV

SEQ ID NO: 57943 - protein, 9 aa, Homo sapiens
  light chain complementarity determining region 3 for antibody 28972
QQYNSYPRK

SEQ ID NO: 57944 - protein, 24 aa, Homo sapiens
  heavy chain complementarity determining region 3 for antibody 28972
ARGRLPSGWYRLKDRTYYYFGLDV

SEQ ID NO: 57945 - protein, 9 aa, Homo sapiens
  light chain complementarity determining region 3 for antibody 28973
QQYNSYPPT

SEQ ID NO: 57946 - protein, 16 aa, Homo sapiens
  heavy chain complementarity determining region 3 for antibody 28973
ARPLADFWSGYYTTDY

SEQ ID NO: 57947 - protein, 8 aa, Homo sapiens
  light chain complementarity determining region 3 for antibody 28974
QQYNSYPP

SEQ ID NO: 57948 - protein, 12 aa, Homo sapiens
  heavy chain complementarity determining region 3 for antibody 28974
ASTTVTTLYFQH

SEQ ID NO: 57949 - protein, 9 aa, Homo sapiens
  light chain complementarity determining region 3 for antibody 28975
QQYNSYPLT

SEQ ID NO: 57950 - protein, 20 aa, Homo sapiens
  heavy chain complementarity determining region 3 for antibody 28975
AKERSHYDSNKFRPPFFFDY

SEQ ID NO: 57951 - protein, 9 aa, Homo sapiens
  light chain complementarity determining region 3 for antibody 28976
QQYNSYPLT

SEQ ID NO: 57952 - protein, 20 aa, Homo sapiens
  heavy chain complementarity determining region 3 for antibody 28976
AKERSHYDSNKFPPPFFFDY

SEQ ID NO: 57953 - protein, 9 aa, Homo sapiens
  light chain complementarity determining region 3 for antibody 28977
QQYNSYPLT

SEQ ID NO: 57954 - protein, 20 aa, Homo sapiens
  heavy chain complementarity determining region 3 for antibody 28977
AKERSHYDSNKFHPPCFFDY

SEQ ID NO: 57955 - protein, 9 aa, Homo sapiens
  light chain complementarity determining region 3 for antibody 28978
QQYNSYPLP

SEQ ID NO: 57956 - protein, 16 aa, Homo sapiens
  heavy chain complementarity determining region 3 for antibody 28978
ARDQYTSDYYIRPFDV

SEQ ID NO: 57957 - protein, 9 aa, Homo sapiens
  light chain complementarity determining region 3 for antibody 28979
QQYNSYPIT

SEQ ID NO: 57958 - protein, 13 aa, Homo sapiens
  heavy chain complementarity determining region 3 for antibody 28979
VRDQAAYINWFDP

SEQ ID NO: 57959 - protein, 9 aa, Homo sapiens
  light chain complementarity determining region 3 for antibody 28980
QQYNSYPGT

SEQ ID NO: 57960 - protein, 20 aa, Homo sapiens
  heavy chain complementarity determining region 3 for antibody 28980
ATGSALFYYDTRVRGYYFDS

SEQ ID NO: 57961 - protein, 9 aa, Homo sapiens
  light chain complementarity determining region 3 for antibody 28981
QQYNSYPGT

SEQ ID NO: 57962 - protein, 20 aa, Homo sapiens
  heavy chain complementarity determining region 3 for antibody 28981
ARDKQGHNSEGIYYYFGMDV

SEQ ID NO: 57963 - protein, 9 aa, Homo sapiens
  light chain complementarity determining region 3 for antibody 28982
QQYNSYPFT

SEQ ID NO: 57964 - protein, 20 aa, Homo sapiens
  heavy chain complementarity determining region 3 for antibody 28982
VRAEHYHDSSGNYCGPHFNN

SEQ ID NO: 57965 - protein, 9 aa, Homo sapiens
  light chain complementarity determining region 3 for antibody 28983
QQYNSYPFT

SEQ ID NO: 57966 - protein, 25 aa, Homo sapiens
  heavy chain complementarity determining region 3 for antibody 28983
ARDRYYYDTTGDSRDWGYYYYGMDV

SEQ ID NO: 57967 - protein, 9 aa, Homo sapiens
  light chain complementarity determining region 3 for antibody 28984
QQYNSYPDT

SEQ ID NO: 57968 - protein, 15 aa, Homo sapiens
  heavy chain complementarity determining region 3 for antibody 28984
AKDRSNLYTSGWYVN

SEQ ID NO: 57969 - protein, 8 aa, Homo sapiens
  light chain complementarity determining region 3 for antibody 28985
QQYNSYLT

SEQ ID NO: 57970 - protein, 17 aa, Homo sapiens
  heavy chain complementarity determining region 3 for antibody 28985
ARDVLLWFGERSGVFDI

SEQ ID NO: 57971 - protein, 9 aa, Homo sapiens
  light chain complementarity determining region 3 for antibody 28986
QQYNSYLGA

SEQ ID NO: 57972 - protein, 11 aa, Homo sapiens
  heavy chain complementarity determining region 3 for antibody 28986
ATGDRRYAHDN

SEQ ID NO: 57973 - protein, 8 aa, Homo sapiens
  light chain complementarity determining region 3 for antibody 28987
QQYNSYGS

SEQ ID NO: 57974 - protein, 12 aa, Homo sapiens
  heavy chain complementarity determining region 3 for antibody 28987
ARNRIWFGDLRF

SEQ ID NO: 57975 - protein, 11 aa, Homo sapiens
  light chain complementarity determining region 3 for antibody 28988
QQYNSYFPQYT

SEQ ID NO: 57976 - protein, 15 aa, Homo sapiens
  heavy chain complementarity determining region 3 for antibody 28988
ARSASMYSSSSLFDY

SEQ ID NO: 57977 - protein, 8 aa, Homo sapiens
  light chain complementarity determining region 3 for antibody 28989
QQYNSYCT

SEQ ID NO: 57978 - protein, 14 aa, Homo sapiens
  heavy chain complementarity determining region 3 for antibody 28989
ARDRVAPAGEYFQH

SEQ ID NO: 57979 - protein, 8 aa, Homo sapiens
  light chain complementarity determining region 3 for antibody 28990
QQYNSWRT

SEQ ID NO: 57980 - protein, 18 aa, Homo sapiens
  heavy chain complementarity determining region 3 for antibody 28990
AREKGYIYSGRNTDGFDI

SEQ ID NO: 57981 - protein, 10 aa, Homo sapiens
  light chain complementarity determining region 3 for antibody 28991
QQYNSWPPLT

SEQ ID NO: 57982 - protein, 9 aa, Homo sapiens
  heavy chain complementarity determining region 3 for antibody 28991
ARGHYGMDV

SEQ ID NO: 57983 - protein, 10 aa, Homo sapiens
  light chain complementarity determining region 3 for antibody 28992
QQYNSWPPIT

SEQ ID NO: 57984 - protein, 9 aa, Homo sapiens
  heavy chain complementarity determining region 3 for antibody 28992
ASGHYGMDV

SEQ ID NO: 57985 - protein, 10 aa, Homo sapiens
  light chain complementarity determining region 3 for antibody 28993
QQYNSWPLIT

SEQ ID NO: 57986 - protein, 9 aa, Homo sapiens
  heavy chain complementarity determining region 3 for antibody 28993
ARGHYGMDV

SEQ ID NO: 57987 - protein, 8 aa, Homo sapiens
  light chain complementarity determining region 3 for antibody 28994
QQYNSSST

SEQ ID NO: 57988 - protein, 16 aa, Homo sapiens
  heavy chain complementarity determining region 3 for antibody 28994
ARDGLPLTSKPYYFDY

SEQ ID NO: 57989 - protein, 9 aa, Homo sapiens
  light chain complementarity determining region 3 for antibody 28995
QQYNSSSRT

SEQ ID NO: 57990 - protein, 13 aa, Homo sapiens
  heavy chain complementarity determining region 3 for antibody 28995
ARGSPGYYYVFAC

SEQ ID NO: 57991 - protein, 9 aa, Homo sapiens
  light chain complementarity determining region 3 for antibody 28996
QQYNSSPLT

SEQ ID NO: 57992 - protein, 16 aa, Homo sapiens
  heavy chain complementarity determining region 3 for antibody 28996
ARQGLVVVVTASAFDI

SEQ ID NO: 57993 - protein, 8 aa, Homo sapiens
  light chain complementarity determining region 3 for antibody 28997
QQYNSPWT

SEQ ID NO: 57994 - protein, 17 aa, Homo sapiens
  heavy chain complementarity determining region 3 for antibody 28997
AREKRWELRPGPDAFDI

SEQ ID NO: 57995 - protein, 8 aa, Homo sapiens
  light chain complementarity determining region 3 for antibody 28998
QQYNSPWT

SEQ ID NO: 57996 - protein, 17 aa, Homo sapiens
  heavy chain complementarity determining region 3 for antibody 28998
AREKMWELRPGPGAFDI

SEQ ID NO: 57997 - protein, 8 aa, Homo sapiens
  light chain complementarity determining region 3 for antibody 28999
QQYNSLWT

SEQ ID NO: 57998 - protein, 13 aa, Homo sapiens
  heavy chain complementarity determining region 3 for antibody 28999
AREVITSGGAYDY

SEQ ID NO: 57999 - protein, 8 aa, Homo sapiens
  light chain complementarity determining region 3 for antibody 29000
QQYNSLWT

SEQ ID NO: 58000 - protein, 13 aa, Homo sapiens
  heavy chain complementarity determining region 3 for antibody 29000
AREVITSDGTYDY

SEQ ID NO: 58001 - protein, 8 aa, Homo sapiens
  light chain complementarity determining region 3 for antibody 29001
QQYNSLPT

SEQ ID NO: 58002 - protein, 17 aa, Homo sapiens
  heavy chain complementarity determining region 3 for antibody 29001
VKDGAGYSSSWWSYFDY

SEQ ID NO: 58003 - protein, 9 aa, Homo sapiens
  light chain complementarity determining region 3 for antibody 29002
QQYNSIPWR

SEQ ID NO: 58004 - protein, 14 aa, Homo sapiens
  heavy chain complementarity determining region 3 for antibody 29002
TKCAYNYGNDAFDV

SEQ ID NO: 58005 - protein, 9 aa, Homo sapiens
  light chain complementarity determining region 3 for antibody 29003
QQYNSIPRT

SEQ ID NO: 58006 - protein, 14 aa, Homo sapiens
  heavy chain complementarity determining region 3 for antibody 29003
TKCAYNYGNDAFDV

SEQ ID NO: 58007 - protein, 8 aa, Homo sapiens
  light chain complementarity determining region 3 for antibody 29004
QQYNSHSS

SEQ ID NO: 58008 - protein, 16 aa, Homo sapiens
  heavy chain complementarity determining region 3 for antibody 29004
IKEKRTERVGFDALDV

SEQ ID NO: 58009 - protein, 9 aa, Homo sapiens
  light chain complementarity determining region 3 for antibody 29005
QQYNSHPYT

SEQ ID NO: 58010 - protein, 17 aa, Homo sapiens
  heavy chain complementarity determining region 3 for antibody 29005
ARDPGVQWLLTNDVFDI

SEQ ID NO: 58011 - protein, 9 aa, Homo sapiens
  light chain complementarity determining region 3 for antibody 29006
QQYNSFSGT

SEQ ID NO: 58012 - protein, 12 aa, Homo sapiens
  heavy chain complementarity determining region 3 for antibody 29006
ARETTNIGELDY

SEQ ID NO: 58013 - protein, 9 aa, Homo sapiens
  light chain complementarity determining region 3 for antibody 29007
QQYNSFPYT

SEQ ID NO: 58014 - protein, 8 aa, Homo sapiens
  heavy chain complementarity determining region 3 for antibody 29007
PRGFAFDY

SEQ ID NO: 58015 - protein, 9 aa, Homo sapiens
  light chain complementarity determining region 3 for antibody 29008
QQYNSFPWT

SEQ ID NO: 58016 - protein, 14 aa, Homo sapiens
  heavy chain complementarity determining region 3 for antibody 29008
TKCAYNYGNDAFDV

SEQ ID NO: 58017 - protein, 9 aa, Homo sapiens
  light chain complementarity determining region 3 for antibody 29009
QQYNSAQLT

SEQ ID NO: 58018 - protein, 15 aa, Homo sapiens
  heavy chain complementarity determining region 3 for antibody 29009
ARRSNDFWSGYHPDY

SEQ ID NO: 58019 - protein, 10 aa, Homo sapiens
  light chain complementarity determining region 3 for antibody 29010
QQYNSAPPWT

SEQ ID NO: 58020 - protein, 14 aa, Homo sapiens
  heavy chain complementarity determining region 3 for antibody 29010
AKGEKWLSSGAFDI

SEQ ID NO: 58021 - protein, 9 aa, Homo sapiens
  light chain complementarity determining region 3 for antibody 29011
QQYNSAPPT

SEQ ID NO: 58022 - protein, 17 aa, Homo sapiens
  heavy chain complementarity determining region 3 for antibody 29011
ARSDILTGFTTPGLRDV

SEQ ID NO: 58023 - protein, 9 aa, Homo sapiens
  light chain complementarity determining region 3 for antibody 29012
QQYNSAPLT

SEQ ID NO: 58024 - protein, 14 aa, Homo sapiens
  heavy chain complementarity determining region 3 for antibody 29012
ARGGFIVAWGLFDY

SEQ ID NO: 58025 - protein, 9 aa, Homo sapiens
  light chain complementarity determining region 3 for antibody 29013
QQYNRYPYT

SEQ ID NO: 58026 - protein, 11 aa, Homo sapiens
  heavy chain complementarity determining region 3 for antibody 29013
ARQPRGNAIAT

SEQ ID NO: 58027 - protein, 9 aa, Homo sapiens
  light chain complementarity determining region 3 for antibody 29014
QQYNRIPWT

SEQ ID NO: 58028 - protein, 14 aa, Homo sapiens
  heavy chain complementarity determining region 3 for antibody 29014
TKCAYNYGNDAFDV

SEQ ID NO: 58029 - protein, 9 aa, Homo sapiens
  light chain complementarity determining region 3 for antibody 29015
QQYNRIPGT

SEQ ID NO: 58030 - protein, 14 aa, Homo sapiens
  heavy chain complementarity determining region 3 for antibody 29015
TKCAYNYGNDAFDV

SEQ ID NO: 58031 - protein, 9 aa, Homo sapiens
  light chain complementarity determining region 3 for antibody 29016
QQYNRFPWT

SEQ ID NO: 58032 - protein, 23 aa, Homo sapiens
  heavy chain complementarity determining region 3 for antibody 29016
TRGKFRFLQWVGTSYSYYYDMDV

SEQ ID NO: 58033 - protein, 9 aa, Homo sapiens
  light chain complementarity determining region 3 for antibody 29017
QQYNQWPPT

SEQ ID NO: 58034 - protein, 15 aa, Homo sapiens
  heavy chain complementarity determining region 3 for antibody 29017
AREPDSDYDGKWFDP

SEQ ID NO: 58035 - protein, 9 aa, Homo sapiens
  light chain complementarity determining region 3 for antibody 29018
QQYNQRPYS

SEQ ID NO: 58036 - protein, 8 aa, Homo sapiens
  heavy chain complementarity determining region 3 for antibody 29018
ARDIVLYH

SEQ ID NO: 58037 - protein, 9 aa, Homo sapiens
  light chain complementarity determining region 3 for antibody 29019
QQYNPYPWT

SEQ ID NO: 58038 - protein, 19 aa, Homo sapiens
  heavy chain complementarity determining region 3 for antibody 29019
AKDRVAHYGDYVELPFFDS

SEQ ID NO: 58039 - protein, 8 aa, Homo sapiens
  light chain complementarity determining region 3 for antibody 29020
QQYNNYRT

SEQ ID NO: 58040 - protein, 18 aa, Homo sapiens
  heavy chain complementarity determining region 3 for antibody 29020
ARGRLDYVWGSYRSAVDY

SEQ ID NO: 58041 - protein, 9 aa, Homo sapiens
  light chain complementarity determining region 3 for antibody 29021
QQYNNYPWT

SEQ ID NO: 58042 - protein, 14 aa, Homo sapiens
  heavy chain complementarity determining region 3 for antibody 29021
AKEESDGYYRTADY

SEQ ID NO: 58043 - protein, 10 aa, Homo sapiens
  light chain complementarity determining region 3 for antibody 29022
QQYNNYPPIT

SEQ ID NO: 58044 - protein, 18 aa, Homo sapiens
  heavy chain complementarity determining region 3 for antibody 29022
AGQYYYNSSGYFLAPLDY

SEQ ID NO: 58045 - protein, 8 aa, Homo sapiens
  light chain complementarity determining region 3 for antibody 29023
QQYNNYAT

SEQ ID NO: 58046 - protein, 17 aa, Homo sapiens
  heavy chain complementarity determining region 3 for antibody 29023
AHRLDHNGMWNEGIFDH

SEQ ID NO: 58047 - protein, 9 aa, Homo sapiens
  light chain complementarity determining region 3 for antibody 29024
QQYNNWSNT

SEQ ID NO: 58048 - protein, 16 aa, Homo sapiens
  heavy chain complementarity determining region 3 for antibody 29024
ARGLSSLASKPGACDF

SEQ ID NO: 58049 - protein, 9 aa, Homo sapiens
  light chain complementarity determining region 3 for antibody 29025
QQYNNWPYT

SEQ ID NO: 58050 - protein, 12 aa, Homo sapiens
  heavy chain complementarity determining region 3 for antibody 29025
PQVPVGRDAFDI

SEQ ID NO: 58051 - protein, 9 aa, Homo sapiens
  light chain complementarity determining region 3 for antibody 29026
QQYNNWPYT

SEQ ID NO: 58052 - protein, 12 aa, Homo sapiens
  heavy chain complementarity determining region 3 for antibody 29026
PQMPVGRDAFDI

SEQ ID NO: 58053 - protein, 9 aa, Homo sapiens
  light chain complementarity determining region 3 for antibody 29027
QQYNNWPYT

SEQ ID NO: 58054 - protein, 11 aa, Homo sapiens
  heavy chain complementarity determining region 3 for antibody 29027
CGYSHGGPFGY

SEQ ID NO: 58055 - protein, 9 aa, Homo sapiens
  light chain complementarity determining region 3 for antibody 29028
QQYNNWPWT

SEQ ID NO: 58056 - protein, 20 aa, Homo sapiens
  heavy chain complementarity determining region 3 for antibody 29028
ARVFFPFPRGPDSFDDVFDL

SEQ ID NO: 58057 - protein, 9 aa, Homo sapiens
  light chain complementarity determining region 3 for antibody 29029
QQYNNWPWT

SEQ ID NO: 58058 - protein, 15 aa, Homo sapiens
  heavy chain complementarity determining region 3 for antibody 29029
ARDFSSLWELLPFDS

SEQ ID NO: 58059 - protein, 9 aa, Homo sapiens
  light chain complementarity determining region 3 for antibody 29030
QQYNNWPWT

SEQ ID NO: 58060 - protein, 20 aa, Homo sapiens
  heavy chain complementarity determining region 3 for antibody 29030
ARDFLPFPRGPDSFDDVFDL

SEQ ID NO: 58061 - protein, 9 aa, Homo sapiens
  light chain complementarity determining region 3 for antibody 29031
QQYNNWPTT

SEQ ID NO: 58062 - protein, 16 aa, Homo sapiens
  heavy chain complementarity determining region 3 for antibody 29031
ARGLSSLASKPGACDF

SEQ ID NO: 58063 - protein, 10 aa, Homo sapiens [sequence omitted]

SEQ ID NO: 58064 - protein, 15 aa, Homo sapiens
  heavy chain complementarity determining region 3 for antibody 29032
ARDAYEGSYLGYFDL

SEQ ID NO: 58065 - protein, 9 aa, Homo sapiens
  light chain complementarity determining region 3 for antibody 29033
QQYNNWPRT

SEQ ID NO: 58066 - protein, 11 aa, Homo sapiens
  heavy chain complementarity determining region 3 for antibody 29033
ARLRYQGYLDV

SEQ ID NO: 58067 - protein, 9 aa, Homo sapiens
  light chain complementarity determining region 3 for antibody 29034
QQYNNWPRT

SEQ ID NO: 58068 - protein, 14 aa, Homo sapiens
  heavy chain complementarity determining region 3 for antibody 29034
ARGRLEVAGIILDH

SEQ ID NO: 58069 - protein, 9 aa, Homo sapiens
  light chain complementarity determining region 3 for antibody 29035
QQYNNWPRT

SEQ ID NO: 58070 - protein, 22 aa, Homo sapiens
  heavy chain complementarity determining region 3 for antibody 29035
AREVRASGYDDFYNYYYYGLDV

SEQ ID NO: 58071 - protein, 9 aa, Homo sapiens
  light chain complementarity determining region 3 for antibody 29036
QQYNNWPRT

SEQ ID NO: 58072 - protein, 15 aa, Homo sapiens
  heavy chain complementarity determining region 3 for antibody 29036
ARAPTYSSSSGSLDN

SEQ ID NO: 58073 - protein, 9 aa, Homo sapiens
  light chain complementarity determining region 3 for antibody 29037
QQYNNWPRT

SEQ ID NO: 58074 - protein, 9 aa, Homo sapiens
  heavy chain complementarity determining region 3 for antibody 29037
AAGAGSEHY

SEQ ID NO: 58075 - protein, 10 aa, Homo sapiens
  light chain complementarity determining region 3 for antibody 29038
QQYNNWPPYT

SEQ ID NO: 58076 - protein, 14 aa, Homo sapiens
  heavy chain complementarity determining region 3 for antibody 29038
ARGGRLRLFSLSDY

SEQ ID NO: 58077 - protein, 10 aa, Homo sapiens
  light chain complementarity determining region 3 for antibody 29039
QQYNNWPPYT

SEQ ID NO: 58078 - protein, 14 aa, Homo sapiens
  heavy chain complementarity determining region 3 for antibody 29039
ARGGRLRLFSFSGY

SEQ ID NO: 58079 - protein, 10 aa, Homo sapiens
  light chain complementarity determining region 3 for antibody 29040
QQYNNWPPYP

SEQ ID NO: 58080 - protein, 14 aa, Homo sapiens
  heavy chain complementarity determining region 3 for antibody 29040
ARGGRLRLFSFSDY

SEQ ID NO: 58081 - protein, 10 aa, Homo sapiens
  light chain complementarity determining region 3 for antibody 29041
QQYNNWPPYP

SEQ ID NO: 58082 - protein, 20 aa, Homo sapiens
  heavy chain complementarity determining region 3 for antibody 29041
AKDSNYYGSGSYYNSHFFQH

SEQ ID NO: 58083 - protein, 10 aa, Homo sapiens
  light chain complementarity determining region 3 for antibody 29042
QQYNNWPPYN

SEQ ID NO: 58084 - protein, 14 aa, Homo sapiens
  heavy chain complementarity determining region 3 for antibody 29042
ARGGRLRLFSFSDY

SEQ ID NO: 58085 - protein, 10 aa, Homo sapiens
  light chain complementarity determining region 3 for antibody 29043
QQYNNWPPWP

SEQ ID NO: 58086 - protein, 13 aa, Homo sapiens
  heavy chain complementarity determining region 3 for antibody 29043
GRGGYTSSWYWVY

SEQ ID NO: 58087 - protein, 10 aa, Homo sapiens
  light chain complementarity determining region 3 for antibody 29044
QQYNNWPPTT

SEQ ID NO: 58088 - protein, 18 aa, Homo sapiens
  heavy chain complementarity determining region 3 for antibody 29044
ARGPPDFWSGYYKYYFDY

SEQ ID NO: 58089 - protein, 10 aa, Homo sapiens
  light chain complementarity determining region 3 for antibody 29045
QQYNNWPPTT

SEQ ID NO: 58090 - protein, 16 aa, Homo sapiens
  heavy chain complementarity determining region 3 for antibody 29045
ARAGSSGWNKAGGYDI

SEQ ID NO: 58091 - protein, 9 aa, Homo sapiens
  light chain complementarity determining region 3 for antibody 29046
QQYNNWPPT

SEQ ID NO: 58092 - protein, 13 aa, Homo sapiens
  heavy chain complementarity determining region 3 for antibody 29046
ARVVSSQSGYGDS

SEQ ID NO: 58093 - protein, 9 aa, Homo sapiens
  light chain complementarity determining region 3 for antibody 29047
QQYNNWPPT

SEQ ID NO: 58094 - protein, 12 aa, Homo sapiens
  heavy chain complementarity determining region 3 for antibody 29047
ARTLVQALSWDY

SEQ ID NO: 58095 - protein, 9 aa, Homo sapiens
  light chain complementarity determining region 3 for antibody 29048
QQYNNWPPT

SEQ ID NO: 58096 - protein, 19 aa, Homo sapiens
  heavy chain complementarity determining region 3 for antibody 29048
AHRRGTRGIQVDGTYGVDV

SEQ ID NO: 58097 - protein, 10 aa, Homo sapiens
  light chain complementarity determining region 3 for antibody 29049
QQYNNWPPLT

SEQ ID NO: 58098 - protein, 18 aa, Homo sapiens
  heavy chain complementarity determining region 3 for antibody 29049
ARGPPDFWSGYYKYYFDY

SEQ ID NO: 58099 - protein, 10 aa, Homo sapiens
  light chain complementarity determining region 3 for antibody 29050
QQYNNWPPLT

SEQ ID NO: 58100 - protein, 22 aa, Homo sapiens
  heavy chain complementarity determining region 3 for antibody 29050
AKQYAHYFESSGYPPDSLYFDY

SEQ ID NO: 58101 - protein, 11 aa, Homo sapiens
  light chain complementarity determining region 3 for antibody 29051
QQYNNWPPLFT

SEQ ID NO: 58102 - protein, 22 aa, Homo sapiens
  heavy chain complementarity determining region 3 for antibody 29051
AREPFYFGSGSYIQGYWGTFDY

SEQ ID NO: 58103 - protein, 10 aa, Homo sapiens
  light chain complementarity determining region 3 for antibody 29052
QQYNNWPPIT

SEQ ID NO: 58104 - protein, 13 aa, Homo sapiens
  heavy chain complementarity determining region 3 for antibody 29052
VSDHYYDSSGYYS

SEQ ID NO: 58105 - protein, 10 aa, Homo sapiens
  light chain complementarity determining region 3 for antibody 29053
QQYNNWPPIP

SEQ ID NO: 58106 - protein, 18 aa, Homo sapiens
  heavy chain complementarity determining region 3 for antibody 29053
ARGPPDFWSGYYKYYFDY

SEQ ID NO: 58107 - protein, 10 aa, Homo sapiens
  light chain complementarity determining region 3 for antibody 29054
QQYNNWPPHT

SEQ ID NO: 58108 - protein, 14 aa, Homo sapiens
  heavy chain complementarity determining region 3 for antibody 29054
ARGGRLRLFSFSDY

SEQ ID NO: 58109 - protein, 12 aa, Homo sapiens
  light chain complementarity determining region 3 for antibody 29055
QQYNNWPPFMYT

SEQ ID NO: 58110 - protein, 19 aa, Homo sapiens
  heavy chain complementarity determining region 3 for antibody 29055
AKDIGSYYYGSGTINPFDI

SEQ ID NO: 58111 - protein, 10 aa, Homo sapiens
  light chain complementarity determining region 3 for antibody 29056
QQYNNWPPDT

SEQ ID NO: 58112 - protein, 14 aa, Homo sapiens
  heavy chain complementarity determining region 3 for antibody 29056
ARGGRLRLFSFSDY

SEQ ID NO: 58113 - protein, 9 aa, Homo sapiens
  light chain complementarity determining region 3 for antibody 29057
QQYNNWPLT

SEQ ID NO: 58114 - protein, 14 aa, Homo sapiens
  heavy chain complementarity determining region 3 for antibody 29057
ARSTGSGVGFYSDY

SEQ ID NO: 58115 - protein, 9 aa, Homo sapiens
  light chain complementarity determining region 3 for antibody 29058
QQYNNWPLT

SEQ ID NO: 58116 - protein, 19 aa, Homo sapiens
  heavy chain complementarity determining region 3 for antibody 29058
ARRRGTRGIQVDGTYGVDV

SEQ ID NO: 58117 - protein, 9 aa, Homo sapiens
  light chain complementarity determining region 3 for antibody 29059
QQYNNWPLT

SEQ ID NO: 58118 - protein, 19 aa, Homo sapiens
  heavy chain complementarity determining region 3 for antibody 29059
AHRRGARGIQVDGTYGVDV

SEQ ID NO: 58119 - protein, 9 aa, Homo sapiens
  light chain complementarity determining region 3 for antibody 29060
QQYNNWLYT

SEQ ID NO: 58120 - protein, 13 aa, Homo sapiens
  heavy chain complementarity determining region 3 for antibody 29060
ARMDSVGYGFFDY

SEQ ID NO: 58121 - protein, 10 aa, Homo sapiens
  light chain complementarity determining region 3 for antibody 29061
QQYNNWLVWT

SEQ ID NO: 58122 - protein, 13 aa, Homo sapiens
  heavy chain complementarity determining region 3 for antibody 29061
ARHGRRSGWYYTY

SEQ ID NO: 58123 - protein, 10 aa, Homo sapiens
  light chain complementarity determining region 3 for antibody 29062
QQYNNWLGWT

SEQ ID NO: 58124 - protein, 13 aa, Homo sapiens
  heavy chain complementarity determining region 3 for antibody 29062
ARHGRRSGWHYTY

SEQ ID NO: 58125 - protein, 10 aa, Homo sapiens
  light chain complementarity determining region 3 for antibody 29063
QQYNNWLGWR

SEQ ID NO: 58126 - protein, 13 aa, Homo sapiens
  heavy chain complementarity determining region 3 for antibody 29063
ARHGRRSGWYYTY

SEQ ID NO: 58127 - protein, 10 aa, Homo sapiens
  light chain complementarity determining region 3 for antibody 29064
QQYNNWLGWK

SEQ ID NO: 58128 - protein, 13 aa, Homo sapiens
  heavy chain complementarity determining region 3 for antibody 29064
ARHGRRSGWYYTY

SEQ ID NO: 58129 - protein, 10 aa, Homo sapiens
  light chain complementarity determining region 3 for antibody 29065
QQYNNWLGCT

SEQ ID NO: 58130 - protein, 13 aa, Homo sapiens
  heavy chain complementarity determining region 3 for antibody 29065
ARHGRRSGWYYTY

SEQ ID NO: 58131 - protein, 10 aa, Homo sapiens
  light chain complementarity determining region 3 for antibody 29066
QQYNNWHPYT

SEQ ID NO: 58132 - protein, 14 aa, Homo sapiens
  heavy chain complementarity determining region 3 for antibody 29066
ARGGGYSSRWPGES

SEQ ID NO: 58133 - protein, 10 aa, Homo sapiens
  light chain complementarity determining region 3 for antibody 29067
QQYNNWFGWT

SEQ ID NO: 58134 - protein, 13 aa, Homo sapiens
  heavy chain complementarity determining region 3 for antibody 29067
ARHGRRSGWYYTY

SEQ ID NO: 58135 - protein, 10 aa, Homo sapiens
  light chain complementarity determining region 3 for antibody 29068
QQYNNWARLS

SEQ ID NO: 58136 - protein, 12 aa, Homo sapiens
  heavy chain complementarity determining region 3 for antibody 29068
AKAYYFDTSGSF

SEQ ID NO: 58137 - protein, 9 aa, Homo sapiens
  light chain complementarity determining region 3 for antibody 29069
QQYNNVPLT

SEQ ID NO: 58138 - protein, 16 aa, Homo sapiens
  heavy chain complementarity determining region 3 for antibody 29069
ARIKVDSSSWYSSLDY

SEQ ID NO: 58139 - protein, 9 aa, Homo sapiens
  light chain complementarity determining region 3 for antibody 29070
QQYNNSPWT

SEQ ID NO: 58140 - protein, 12 aa, Homo sapiens
  heavy chain complementarity determining region 3 for antibody 29070
ARGLSSGWGLDY

SEQ ID NO: 58141 - protein, 10 aa, Homo sapiens
  light chain complementarity determining region 3 for antibody 29071
QQYNNGPPIT

SEQ ID NO: 58142 - protein, 18 aa, Homo sapiens
  heavy chain complementarity determining region 3 for antibody 29071
ARGPPDFWSGYYKYYFDY

SEQ ID NO: 58143 - protein, 10 aa, Homo sapiens
  light chain complementarity determining region 3 for antibody 29072
QQYNNGLGWT

SEQ ID NO: 58144 - protein, 13 aa, Homo sapiens
  heavy chain complementarity determining region 3 for antibody 29072
ARHGRRSGWYYTY

SEQ ID NO: 58145 - protein, 9 aa, Homo sapiens
  light chain complementarity determining region 3 for antibody 29073
QQYNNFPWT

SEQ ID NO: 58146 - protein, 23 aa, Homo sapiens
  heavy chain complementarity determining region 3 for antibody 29073
TRGRFRFLQWVETSYSYYYDMDV

SEQ ID NO: 58147 - protein, 9 aa, Homo sapiens
  light chain complementarity determining region 3 for antibody 29074
QQYNNFPWT

SEQ ID NO: 58148 - protein, 12 aa, Homo sapiens
  heavy chain complementarity determining region 3 for antibody 29074
ARGLSSGWGLDY

SEQ ID NO: 58149 - protein, 8 aa, Homo sapiens
  light chain complementarity determining region 3 for antibody 29075
QQYNNCWT

SEQ ID NO: 58150 - protein, 15 aa, Homo sapiens
  heavy chain complementarity determining region 3 for antibody 29075
ARDFPDSDSSSFLDL

SEQ ID NO: 58151 - protein, 10 aa, Homo sapiens
  light chain complementarity determining region 3 for antibody 29076
QQYNNCPSYT

SEQ ID NO: 58152 - protein, 24 aa, Homo sapiens
  heavy chain complementarity determining region 3 for antibody 29076
ARDQRRSLTDISIFGGVRDYGLDV

SEQ ID NO: 58153 - protein, 10 aa, Homo sapiens
  light chain complementarity determining region 3 for antibody 29077
QQYNNCPPYT

SEQ ID NO: 58154 - protein, 13 aa, Homo sapiens
  heavy chain complementarity determining region 3 for antibody 29077
ARVTGYSSRYIGY

SEQ ID NO: 58155 - protein, 9 aa, Homo sapiens
  light chain complementarity determining region 3 for antibody 29078
QQYNNAHLT

SEQ ID NO: 58156 - protein, 11 aa, Homo sapiens
  heavy chain complementarity determining region 3 for antibody 29078
ARGGYDYYFEY

SEQ ID NO: 58157 - protein, 8 aa, Homo sapiens
  light chain complementarity determining region 3 for antibody 29079
QQYNKFLP

SEQ ID NO: 58158 - protein, 15 aa, Homo sapiens
  heavy chain complementarity determining region 3 for antibody 29079
AKGLTASSGWYVFDL

SEQ ID NO: 58159 - protein, 9 aa, Homo sapiens
  light chain complementarity determining region 3 for antibody 29080
QQYNIYSPT

SEQ ID NO: 58160 - protein, 20 aa, Homo sapiens
  heavy chain complementarity determining region 3 for antibody 29080
ARDNYDYHSGGYYSPSYFDY

SEQ ID NO: 58161 - protein, 10 aa, Homo sapiens
  light chain complementarity determining region 3 for antibody 29081
QQYNIRPPDT

SEQ ID NO: 58162 - protein, 14 aa, Homo sapiens
  heavy chain complementarity determining region 3 for antibody 29081
ARDPPGIALAGNSA

SEQ ID NO: 58163 - protein, 9 aa, Homo sapiens
  light chain complementarity determining region 3 for antibody 29082
QQYNGYRYT

SEQ ID NO: 58164 - protein, 14 aa, Homo sapiens
  heavy chain complementarity determining region 3 for antibody 29082
TRLFSSASRRVFDP

SEQ ID NO: 58165 - protein, 9 aa, Homo sapiens
  light chain complementarity determining region 3 for antibody 29083
QQYNGYPLT

SEQ ID NO: 58166 - protein, 21 aa, Homo sapiens
  heavy chain complementarity determining region 3 for antibody 29083
AREGGILRFLDPSQAAYPINF

SEQ ID NO: 58167 - protein, 9 aa, Homo sapiens
  light chain complementarity determining region 3 for antibody 29084
QQYNEWPLT

SEQ ID NO: 58168 - protein, 17 aa, Homo sapiens
  heavy chain complementarity determining region 3 for antibody 29084
AIAEGWDNYKGVDAFDI

SEQ ID NO: 58169 - protein, 9 aa, Homo sapiens
  light chain complementarity determining region 3 for antibody 29085
QQYNDYRYT

SEQ ID NO: 58170 - protein, 14 aa, Homo sapiens
  heavy chain complementarity determining region 3 for antibody 29085
TRLFSSASRRVLDP

SEQ ID NO: 58171 - protein, 9 aa, Homo sapiens
  light chain complementarity determining region 3 for antibody 29086
QQYNDYRYP

SEQ ID NO: 58172 - protein, 14 aa, Homo sapiens
  heavy chain complementarity determining region 3 for antibody 29086
TRLFSSASRRVFDP

SEQ ID NO: 58173 - protein, 13 aa, Homo sapiens
  light chain complementarity determining region 3 for antibody 29087
QQYNDWPPTGRDS

SEQ ID NO: 58174 - protein, 13 aa, Homo sapiens
  heavy chain complementarity determining region 3 for antibody 29087
TTVDFGYYFGMDV

SEQ ID NO: 58175 - protein, 9 aa, Homo sapiens
  light chain complementarity determining region 3 for antibody 29088
QQYNDWPIT

SEQ ID NO: 58176 - protein, 14 aa, Homo sapiens
  heavy chain complementarity determining region 3 for antibody 29088
ALTGDLRLRAYFDY

SEQ ID NO: 58177 - protein, 9 aa, Homo sapiens
  light chain complementarity determining region 3 for antibody 29089
QQYNDWLFT

SEQ ID NO: 58178 - protein, 23 aa, Homo sapiens
  heavy chain complementarity determining region 3 for antibody 29089
ARGPNIFSGSGTSYTGGFNWFDP

SEQ ID NO: 58179 - protein, 9 aa, Homo sapiens
  light chain complementarity determining region 3 for antibody 29090
QQYNDRLLT

SEQ ID NO: 58180 - protein, 23 aa, Homo sapiens
  heavy chain complementarity determining region 3 for antibody 29090
ARGPNIFSGSGTSYTGGFNWFDP

SEQ ID NO: 58181 - protein, 10 aa, Homo sapiens
  light chain complementarity determining region 3 for antibody 29091
QQYNDGPPYT

SEQ ID NO: 58182 - protein, 16 aa, Homo sapiens
  heavy chain complementarity determining region 3 for antibody 29091
VKSPLSRLQGHVWFDP

SEQ ID NO: 58183 - protein, 9 aa, Homo sapiens
  light chain complementarity determining region 3 for antibody 29092
QQYNCYSRT

SEQ ID NO: 58184 - protein, 18 aa, Homo sapiens
  heavy chain complementarity determining region 3 for antibody 29092
ARDFGGRAYTKVENAFDI

SEQ ID NO: 58185 - protein, 9 aa, Homo sapiens
  light chain complementarity determining region 3 for antibody 29093
QQYNCYPYT

SEQ ID NO: 58186 - protein, 13 aa, Homo sapiens
  heavy chain complementarity determining region 3 for antibody 29093
ARGYDYVQDAFDI

SEQ ID NO: 58187 - protein, 9 aa, Homo sapiens
  light chain complementarity determining region 3 for antibody 29094
QQYNAYALT

SEQ ID NO: 58188 - protein, 16 aa, Homo sapiens
  heavy chain complementarity determining region 3 for antibody 29094
ARGKYSDFDSGHGMDV

SEQ ID NO: 58189 - protein, 8 aa, Homo sapiens
  light chain complementarity determining region 3 for antibody 29095
QQYMYPFT

SEQ ID NO: 58190 - protein, 12 aa, Homo sapiens
  heavy chain complementarity determining region 3 for antibody 29095
ARALSASWYAFY

SEQ ID NO: 58191 - protein, 8 aa, Homo sapiens
  light chain complementarity determining region 3 for antibody 29096
QQYMSPLT

SEQ ID NO: 58192 - protein, 12 aa, Homo sapiens
  heavy chain complementarity determining region 3 for antibody 29096
ARALSASWYACY

SEQ ID NO: 58193 - protein, 8 aa, Homo sapiens
  light chain complementarity determining region 3 for antibody 29097
QQYMSPFT

SEQ ID NO: 58194 - protein, 12 aa, Homo sapiens
  heavy chain complementarity determining region 3 for antibody 29097
ARALSASWYAFH

SEQ ID NO: 58195 - protein, 8 aa, Homo sapiens
  light chain complementarity determining region 3 for antibody 29098
QQYMSPFT

SEQ ID NO: 58196 - protein, 12 aa, Homo sapiens
  heavy chain complementarity determining region 3 for antibody 29098
ARALSASWSAFY

SEQ ID NO: 58197 - protein, 8 aa, Homo sapiens
  light chain complementarity determining region 3 for antibody 29099
QQYMFPFT

SEQ ID NO: 58198 - protein, 12 aa, Homo sapiens
  heavy chain complementarity determining region 3 for antibody 29099
ARALSASWYAFY

SEQ ID NO: 58199 - protein, 9 aa, Homo sapiens
  light chain complementarity determining region 3 for antibody 29100
QQYLTPPLT

SEQ ID NO: 58200 - protein, 13 aa, Homo sapiens
  heavy chain complementarity determining region 3 for antibody 29100
VKDPDFNYGSWVS

SEQ ID NO: 58201 - protein, 9 aa, Homo sapiens
  light chain complementarity determining region 3 for antibody 29101
QQYLSYPWT

SEQ ID NO: 58202 - protein, 19 aa, Homo sapiens
  heavy chain complementarity determining region 3 for antibody 29101
ARVSARRILTAPRYPLIDS

SEQ ID NO: 58203 - protein, 9 aa, Homo sapiens
  light chain complementarity determining region 3 for antibody 29102
QQYLRSPST

SEQ ID NO: 58204 - protein, 17 aa, Homo sapiens
  heavy chain complementarity determining region 3 for antibody 29102
AGLSSRLGDGSPSLFDY

SEQ ID NO: 58205 - protein, 9 aa, Homo sapiens
  light chain complementarity determining region 3 for antibody 29103
QQYKYHPPT

SEQ ID NO: 58206 - protein, 14 aa, Homo sapiens
  heavy chain complementarity determining region 3 for antibody 29103
ARDLATAGTGLFDF

SEQ ID NO: 58207 - protein, 9 aa, Homo sapiens
  light chain complementarity determining region 3 for antibody 29104
QQYKTYPYT

SEQ ID NO: 58208 - protein, 13 aa, Homo sapiens
  heavy chain complementarity determining region 3 for antibody 29104
AHIAYGGYAYFDH

SEQ ID NO: 58209 - protein, 9 aa, Homo sapiens
  light chain complementarity determining region 3 for antibody 29105
QQYKTYPFP

SEQ ID NO: 58210 - protein, 14 aa, Homo sapiens
  heavy chain complementarity determining region 3 for antibody 29105
AKSSDTSGYSLFDY

SEQ ID NO: 58211 - protein, 8 aa, Homo sapiens
  light chain complementarity determining region 3 for antibody 29106
QQYKTDST

SEQ ID NO: 58212 - protein, 16 aa, Homo sapiens
  heavy chain complementarity determining region 3 for antibody 29106
ARDGFPVTSKPYYFDY

SEQ ID NO: 58213 - protein, 8 aa, Homo sapiens
  light chain complementarity determining region 3 for antibody 29107
QQYKSPFT

SEQ ID NO: 58214 - protein, 12 aa, Homo sapiens
  heavy chain complementarity determining region 3 for antibody 29107
ARALSASWYAFY

SEQ ID NO: 58215 - protein, 11 aa, Homo sapiens
  light chain complementarity determining region 3 for antibody 29108
QQYKNWPPRPT

SEQ ID NO: 58216 - protein, 19 aa, Homo sapiens
  heavy chain complementarity determining region 3 for antibody 29108
ARLSGLAYAFGGGWGAFDL

SEQ ID NO: 58217 - protein, 11 aa, Homo sapiens
  light chain complementarity determining region 3 for antibody 29109
QQYKNWPPRLP

SEQ ID NO: 58218 - protein, 19 aa, Homo sapiens
  heavy chain complementarity determining region 3 for antibody 29109
ARLSGLAYAFGGGWGAFDL

SEQ ID NO: 58219 - protein, 7 aa, Homo sapiens
  light chain complementarity determining region 3 for antibody 29110
QQYKNFS

SEQ ID NO: 58220 - protein, 19 aa, Homo sapiens
  heavy chain complementarity determining region 3 for antibody 29110
ATRTPRYYDTAGHEGAFDI

SEQ ID NO: 58221 - protein, 9 aa, Homo sapiens
  light chain complementarity determining region 3 for antibody 29111
QQYKGYSYT

SEQ ID NO: 58222 - protein, 16 aa, Homo sapiens
  heavy chain complementarity determining region 3 for antibody 29111
ARVTIRGNWFWTPFDY

SEQ ID NO: 58223 - protein, 9 aa, Homo sapiens
  light chain complementarity determining region 3 for antibody 29112
QQYKDYPYT

SEQ ID NO: 58224 - protein, 12 aa, Homo sapiens
  heavy chain complementarity determining region 3 for antibody 29112
VRGEGYDFGFDF

SEQ ID NO: 58225 - protein, 9 aa, Homo sapiens
  light chain complementarity determining region 3 for antibody 29113
QQYKADPWT

SEQ ID NO: 58226 - protein, 13 aa, Homo sapiens
  heavy chain complementarity determining region 3 for antibody 29113
IRWQEYSVSSWPD

SEQ ID NO: 58227 - protein, 9 aa, Homo sapiens
  light chain complementarity determining region 3 for antibody 29114
QQYKADPWT

SEQ ID NO: 58228 - protein, 13 aa, Homo sapiens
  heavy chain complementarity determining region 3 for antibody 29114
IRWQEYSASSGPD

SEQ ID NO: 58229 - protein, 11 aa, Homo sapiens
  light chain complementarity determining region 3 for antibody 29115
QQYITSPPGYP

SEQ ID NO: 58230 - protein, 11 aa, Homo sapiens
  heavy chain complementarity determining region 3 for antibody 29115
ARHGNDFYFDY

SEQ ID NO: 58231 - protein, 11 aa, Homo sapiens
  light chain complementarity determining region 3 for antibody 29116
QQYITSPPGNT

SEQ ID NO: 58232 - protein, 11 aa, Homo sapiens
  heavy chain complementarity determining region 3 for antibody 29116
ARHGNDFYFDY

SEQ ID NO: 58233 - protein, 11 aa, Homo sapiens
  light chain complementarity determining region 3 for antibody 29117
QQYITSFPGST

SEQ ID NO: 58234 - protein, 11 aa, Homo sapiens
  heavy chain complementarity determining region 3 for antibody 29117
ARHGDHYYFDY

SEQ ID NO: 58235 - protein, 11 aa, Homo sapiens
  light chain complementarity determining region 3 for antibody 29118
QQYITSFPGDT

SEQ ID NO: 58236 - protein, 11 aa, Homo sapiens
  heavy chain complementarity determining region 3 for antibody 29118
ARHGDHYYFDY

SEQ ID NO: 58237 - protein, 9 aa, Homo sapiens
  light chain complementarity determining region 3 for antibody 29119
QQYISYSWT

SEQ ID NO: 58238 - protein, 19 aa, Homo sapiens
  heavy chain complementarity determining region 3 for antibody 29119
ARVSARRILTAPRYPLIDS

SEQ ID NO: 58239 - protein, 9 aa, Homo sapiens
  light chain complementarity determining region 3 for antibody 29120
QQYISYPWT

SEQ ID NO: 58240 - protein, 19 aa, Homo sapiens
  heavy chain complementarity determining region 3 for antibody 29120
ARVSARRILTAPRYPLIDA

SEQ ID NO: 58241 - protein, 9 aa, Homo sapiens
  light chain complementarity determining region 3 for antibody 29121
QQYISYPWT

SEQ ID NO: 58242 - protein, 16 aa, Homo sapiens
  heavy chain complementarity determining region 3 for antibody 29121
ARDEWNYNNFLTGIDN

SEQ ID NO: 58243 - protein, 9 aa, Homo sapiens
  light chain complementarity determining region 3 for antibody 29122
QQYISYPWQ

SEQ ID NO: 58244 - protein, 19 aa, Homo sapiens
  heavy chain complementarity determining region 3 for antibody 29122
ARVSARRILTAPRYPLIDS

SEQ ID NO: 58245 - protein, 9 aa, Homo sapiens
  light chain complementarity determining region 3 for antibody 29123
QQYISYPLN

SEQ ID NO: 58246 - protein, 12 aa, Homo sapiens
  heavy chain complementarity determining region 3 for antibody 29123
IRVVSGTNHLDF

SEQ ID NO: 58247 - protein, 9 aa, Homo sapiens
  light chain complementarity determining region 3 for antibody 29124
QQYISYAYT

SEQ ID NO: 58248 - protein, 13 aa, Homo sapiens
  heavy chain complementarity determining region 3 for antibody 29124
ARGYDYVQDAFDI

SEQ ID NO: 58249 - protein, 9 aa, Homo sapiens
  light chain complementarity determining region 3 for antibody 29125
QQYISSPWT

SEQ ID NO: 58250 - protein, 19 aa, Homo sapiens
  heavy chain complementarity determining region 3 for antibody 29125
ARVSARRILTAPRYPLIDS

SEQ ID NO: 58251 - protein, 8 aa, Homo sapiens
  light chain complementarity determining region 3 for antibody 29126
QQYINWPT

SEQ ID NO: 58252 - protein, 9 aa, Homo sapiens
  heavy chain complementarity determining region 3 for antibody 29126
AAGNVYAIY

SEQ ID NO: 58253 - protein, 9 aa, Homo sapiens
  light chain complementarity determining region 3 for antibody 29127
QQYIIYPWT

SEQ ID NO: 58254 - protein, 19 aa, Homo sapiens
  heavy chain complementarity determining region 3 for antibody 29127
ARVSARRILTAPRYPLIDS

SEQ ID NO: 58255 - protein, 9 aa, Homo sapiens
  light chain complementarity determining region 3 for antibody 29128
QQYHYPPFT

SEQ ID NO: 58256 - protein, 14 aa, Homo sapiens
  heavy chain complementarity determining region 3 for antibody 29128
ARHEEMGTTAAFDV

SEQ ID NO: 58257 - protein, 9 aa, Homo sapiens
  light chain complementarity determining region 3 for antibody 29129
QQYHTYPVT

SEQ ID NO: 58258 - protein, 15 aa, Homo sapiens
  heavy chain complementarity determining region 3 for antibody 29129
AHGVWVRGVTSRFDY

SEQ ID NO: 58259 - protein, 9 aa, Homo sapiens
  light chain complementarity determining region 3 for antibody 29130
QQYHTSPWT

SEQ ID NO: 58260 - protein, 14 aa, Homo sapiens
  heavy chain complementarity determining region 3 for antibody 29130
AREGDLDFHYGMDV

SEQ ID NO: 58261 - protein, 9 aa, Homo sapiens
  light chain complementarity determining region 3 for antibody 29131
QQYHTSPLT

SEQ ID NO: 58262 - protein, 16 aa, Homo sapiens
  heavy chain complementarity determining region 3 for antibody 29131
ARGHYGSGNFPCDPDF

SEQ ID NO: 58263 - protein, 9 aa, Homo sapiens
  light chain complementarity determining region 3 for antibody 29132
QQYHTPPRT

SEQ ID NO: 58264 - protein, 14 aa, Homo sapiens
  heavy chain complementarity determining region 3 for antibody 29132
AREGDLDFHYGMDV

SEQ ID NO: 58265 - protein, 9 aa, Homo sapiens
  light chain complementarity determining region 3 for antibody 29133
QQYHSYSRT

SEQ ID NO: 58266 - protein, 11 aa, Homo sapiens
  heavy chain complementarity determining region 3 for antibody 29133
ARDKGGGVYDY

SEQ ID NO: 58267 - protein, 9 aa, Homo sapiens
  light chain complementarity determining region 3 for antibody 29134
QQYHSYPRT

SEQ ID NO: 58268 - protein, 10 aa, Homo sapiens
  heavy chain complementarity determining region 3 for antibody 29134
ARGPGNYPDF

SEQ ID NO: 58269 - protein, 9 aa, Homo sapiens
  light chain complementarity determining region 3 for antibody 29135
QQYHSTPLT

SEQ ID NO: 58270 - protein, 12 aa, Homo sapiens
  heavy chain complementarity determining region 3 for antibody 29135
ARDNGAEWLIDY

SEQ ID NO: 58271 - protein, 9 aa, Homo sapiens
  light chain complementarity determining region 3 for antibody 29136
QQYHSPPGT

SEQ ID NO: 58272 - protein, 11 aa, Homo sapiens
  heavy chain complementarity determining region 3 for antibody 29136
TRGLDDAKTGY

SEQ ID NO: 58273 - protein, 8 aa, Homo sapiens
  light chain complementarity determining region 3 for antibody 29137
QQYHSPFT

SEQ ID NO: 58274 - protein, 10 aa, Homo sapiens
  heavy chain complementarity determining region 3 for antibody 29137
VRGRGWTLDH

SEQ ID NO: 58275 - protein, 9 aa, Homo sapiens
  light chain complementarity determining region 3 for antibody 29138
QQYHRYPWS

SEQ ID NO: 58276 - protein, 19 aa, Homo sapiens
  heavy chain complementarity determining region 3 for antibody 29138
AKDQDDHFCGADRVCFFDS

SEQ ID NO: 58277 - protein, 9 aa, Homo sapiens
  light chain complementarity determining region 3 for antibody 29139
QQYHRYPGS

SEQ ID NO: 58278 - protein, 19 aa, Homo sapiens
  heavy chain complementarity determining region 3 for antibody 29139
AKDQDEHFCGADRVCFFDS

SEQ ID NO: 58279 - protein, 9 aa, Homo sapiens
  light chain complementarity determining region 3 for antibody 29140
QQYHNYPRT

SEQ ID NO: 58280 - protein, 20 aa, Homo sapiens
  heavy chain complementarity determining region 3 for antibody 29140
ARGLGSGSYYRSPPRPGDDY

SEQ ID NO: 58281 - protein, 10 aa, Homo sapiens
  light chain complementarity determining region 3 for antibody 29141
QQYHNWPPWT

SEQ ID NO: 58282 - protein, 21 aa, Homo sapiens
  heavy chain complementarity determining region 3 for antibody 29141
ARTGAEPTSWSSAPEDSWFDP

SEQ ID NO: 58283 - protein, 10 aa, Homo sapiens
  light chain complementarity determining region 3 for antibody 29142
QQYHNWPPWT

SEQ ID NO: 58284 - protein, 21 aa, Homo sapiens
  heavy chain complementarity determining region 3 for antibody 29142
ARTGAEPNSWSPAPEDSWFDP

SEQ ID NO: 58285 - protein, 10 aa, Homo sapiens
  light chain complementarity determining region 3 for antibody 29143
QQYHNWPPWP

SEQ ID NO: 58286 - protein, 21 aa, Homo sapiens
  heavy chain complementarity determining region 3 for antibody 29143
ARTGAEPNSWSSAPEDSWFDP

SEQ ID NO: 58287 - protein, 9 aa, Homo sapiens
  light chain complementarity determining region 3 for antibody 29144
QQYHNSRRT

SEQ ID NO: 58288 - protein, 11 aa, Homo sapiens
  heavy chain complementarity determining region 3 for antibody 29144
AQSPSANIADV

SEQ ID NO: 58289 - protein, 10 aa, Homo sapiens
  light chain complementarity determining region 3 for antibody 29145
QQYHNRPPDT

SEQ ID NO: 58290 - protein, 14 aa, Homo sapiens
  heavy chain complementarity determining region 3 for antibody 29145
ARDPPGIALAGNSG

SEQ ID NO: 58291 - protein, 9 aa, Homo sapiens
  light chain complementarity determining region 3 for antibody 29146
QQYHIPPGT

SEQ ID NO: 58292 - protein, 11 aa, Homo sapiens
  heavy chain complementarity determining region 3 for antibody 29146
TRGLDDAKTGY

SEQ ID NO: 58293 - protein, 8 aa, Homo sapiens
  light chain complementarity determining region 3 for antibody 29147
QQYHHLLP

SEQ ID NO: 58294 - protein, 11 aa, Homo sapiens
  heavy chain complementarity determining region 3 for antibody 29147
ARRRFTDAFDI

SEQ ID NO: 58295 - protein, 9 aa, Homo sapiens
  light chain complementarity determining region 3 for antibody 29148
QQYHFTPFP

SEQ ID NO: 58296 - protein, 14 aa, Homo sapiens
  heavy chain complementarity determining region 3 for antibody 29148
ARHEEMGTTAAFDV

SEQ ID NO: 58297 - protein, 9 aa, Homo sapiens
  light chain complementarity determining region 3 for antibody 29149
QQYHDYSWT

SEQ ID NO: 58298 - protein, 19 aa, Homo sapiens
  heavy chain complementarity determining region 3 for antibody 29149
ARDDGSRADSYGIAYVFDS

SEQ ID NO: 58299 - protein, 9 aa, Homo sapiens
  light chain complementarity determining region 3 for antibody 29150
QQYHALPLT

SEQ ID NO: 58300 - protein, 13 aa, Homo sapiens
  heavy chain complementarity determining region 3 for antibody 29150
ARDGVPGKCNRAH

SEQ ID NO: 58301 - protein, 9 aa, Homo sapiens
  light chain complementarity determining region 3 for antibody 29151
QQYHALPLS

SEQ ID NO: 58302 - protein, 13 aa, Homo sapiens
  heavy chain complementarity determining region 3 for antibody 29151
ARDGVPGKFNRAH

SEQ ID NO: 58303 - protein, 10 aa, Homo sapiens
  light chain complementarity determining region 3 for antibody 29152
QQYGYSPKLL

SEQ ID NO: 58304 - protein, 18 aa, Homo sapiens
  heavy chain complementarity determining region 3 for antibody 29152
ATGHPLRLHDYYYFVMDV

SEQ ID NO: 58305 - protein, 10 aa, Homo sapiens
  light chain complementarity determining region 3 for antibody 29153
QQYGYSPKIT

SEQ ID NO: 58306 - protein, 18 aa, Homo sapiens
  heavy chain complementarity determining region 3 for antibody 29153
ATGHPLRLHDYYYFVMDV

SEQ ID NO: 58307 - protein, 9 aa, Homo sapiens
  light chain complementarity determining region 3 for antibody 29154
QQYGYSPIT

SEQ ID NO: 58308 - protein, 10 aa, Homo sapiens
  heavy chain complementarity determining region 3 for antibody 29154
ATGAGWLVDY

SEQ ID NO: 58309 - protein, 10 aa, Homo sapiens
  light chain complementarity determining region 3 for antibody 29155
QQYGYPPPDT

SEQ ID NO: 58310 - protein, 11 aa, Homo sapiens
  heavy chain complementarity determining region 3 for antibody 29155
TRWRSDGHFDY

SEQ ID NO: 58311 - protein, 9 aa, Homo sapiens
  light chain complementarity determining region 3 for antibody 29156
QQYGYFPYT

SEQ ID NO: 58312 - protein, 12 aa, Homo sapiens
  heavy chain complementarity determining region 3 for antibody 29156
VRLLDSSGSLGY

SEQ ID NO: 58313 - protein, 9 aa, Homo sapiens
  light chain complementarity determining region 3 for antibody 29157
QQYGVSPLT

SEQ ID NO: 58314 - protein, 15 aa, Homo sapiens
  heavy chain complementarity determining region 3 for antibody 29157
AKGRRGSYSHDAFDV

SEQ ID NO: 58315 - protein, 9 aa, Homo sapiens
  light chain complementarity determining region 3 for antibody 29158
QQYGTYPLT

SEQ ID NO: 58316 - protein, 11 aa, Homo sapiens
  heavy chain complementarity determining region 3 for antibody 29158
THRLVWEGVGH

SEQ ID NO: 58317 - protein, 9 aa, Homo sapiens
  light chain complementarity determining region 3 for antibody 29159
QQYGTSWYP

SEQ ID NO: 58318 - protein, 12 aa, Homo sapiens
  heavy chain complementarity determining region 3 for antibody 29159
ARESEDDDAFDI

SEQ ID NO: 58319 - protein, 12 aa, Homo sapiens
  light chain complementarity determining region 3 for antibody 29160
QQYGTSVPWPWR

SEQ ID NO: 58320 - protein, 14 aa, Homo sapiens
  heavy chain complementarity determining region 3 for antibody 29160
VRGGSSGYNHQVDY

SEQ ID NO: 58321 - protein, 12 aa, Homo sapiens
  light chain complementarity determining region 3 for antibody 29161
QQYGTSVPGPWT

SEQ ID NO: 58322 - protein, 14 aa, Homo sapiens
  heavy chain complementarity determining region 3 for antibody 29161
VRGGSSGYNHQVDY

SEQ ID NO: 58323 - protein, 9 aa, Homo sapiens
  light chain complementarity determining region 3 for antibody 29162
QQYGTSVLP

SEQ ID NO: 58324 - protein, 17 aa, Homo sapiens
  heavy chain complementarity determining region 3 for antibody 29162
ARPGSGFGYDNEDAFDI

SEQ ID NO: 58325 - protein, 9 aa, Homo sapiens
  light chain complementarity determining region 3 for antibody 29163
QQYGTSSGT

SEQ ID NO: 58326 - protein, 16 aa, Homo sapiens
  heavy chain complementarity determining region 3 for antibody 29163
VKDLGNEFFSGPMMDS

SEQ ID NO: 58327 - protein, 8 aa, Homo sapiens
  light chain complementarity determining region 3 for antibody 29164
QQYGTSRQ

SEQ ID NO: 58328 - protein, 15 aa, Homo sapiens
  heavy chain complementarity determining region 3 for antibody 29164
ARGEFYRDSRGYRED

SEQ ID NO: 58329 - protein, 9 aa, Homo sapiens
  light chain complementarity determining region 3 for antibody 29165
QQYGTSPYT

SEQ ID NO: 58330 - protein, 9 aa, Homo sapiens
  heavy chain complementarity determining region 3 for antibody 29165
ARETEGFDI

SEQ ID NO: 58331 - protein, 11 aa, Homo sapiens
  light chain complementarity determining region 3 for antibody 29166
QQYGTSPWAGP

SEQ ID NO: 58332 - protein, 13 aa, Homo sapiens
  heavy chain complementarity determining region 3 for antibody 29166
ARVAVPGLGYFQH

SEQ ID NO: 58333 - protein, 9 aa, Homo sapiens
  light chain complementarity determining region 3 for antibody 29167
QQYGTSPVT

SEQ ID NO: 58334 - protein, 14 aa, Homo sapiens
  heavy chain complementarity determining region 3 for antibody 29167
ARDLFRGIPDYLDY

SEQ ID NO: 58335 - protein, 8 aa, Homo sapiens
  light chain complementarity determining region 3 for antibody 29168
QQYGTSPT

SEQ ID NO: 58336 - protein, 22 aa, Homo sapiens
  heavy chain complementarity determining region 3 for antibody 29168
ARGRGTVIRGATTKAYFNVMDV

SEQ ID NO: 58337 - protein, 9 aa, Homo sapiens
  light chain complementarity determining region 3 for antibody 29169
QQYGTSPRT

SEQ ID NO: 58338 - protein, 13 aa, Homo sapiens
  heavy chain complementarity determining region 3 for antibody 29169
PIGCYDRSGYHEY

SEQ ID NO: 58339 - protein, 9 aa, Homo sapiens
  light chain complementarity determining region 3 for antibody 29170
QQYGTSPRT

SEQ ID NO: 58340 - protein, 14 aa, Homo sapiens
  heavy chain complementarity determining region 3 for antibody 29170
ARRARGWGSNYFDY

SEQ ID NO: 58341 - protein, 9 aa, Homo sapiens
  light chain complementarity determining region 3 for antibody 29171
QQYGTSPRP

SEQ ID NO: 58342 - protein, 16 aa, Homo sapiens
  heavy chain complementarity determining region 3 for antibody 29171
ARLPPLGAENSLAFDI

SEQ ID NO: 58343 - protein, 11 aa, Homo sapiens
  light chain complementarity determining region 3 for antibody 29172
QQYGTSPPMST

SEQ ID NO: 58344 - protein, 23 aa, Homo sapiens
  heavy chain complementarity determining region 3 for antibody 29172
ARGNRGYRRSNSRMDFYNFGMDV

SEQ ID NO: 58345 - protein, 11 aa, Homo sapiens
  light chain complementarity determining region 3 for antibody 29173
QQYGTSPPGST

SEQ ID NO: 58346 - protein, 17 aa, Homo sapiens
  heavy chain complementarity determining region 3 for antibody 29173
ARGLALIRGLVTKDIDD

SEQ ID NO: 58347 - protein, 11 aa, Homo sapiens
  light chain complementarity determining region 3 for antibody 29174
QQYGTSPPGNT

SEQ ID NO: 58348 - protein, 17 aa, Homo sapiens
  heavy chain complementarity determining region 3 for antibody 29174
ARGLALIRGLVTKDIDD

SEQ ID NO: 58349 - protein, 11 aa, Homo sapiens
  light chain complementarity determining region 3 for antibody 29175
QQYGTSPPGNP

SEQ ID NO: 58350 - protein, 17 aa, Homo sapiens
  heavy chain complementarity determining region 3 for antibody 29175
ARGLALIRGLVTKDIDD

SEQ ID NO: 58351 - protein, 14 aa, Homo sapiens
  light chain complementarity determining region 3 for antibody 29176
QQYGTSPPDGSPWT

SEQ ID NO: 58352 - protein, 13 aa, Homo sapiens
  heavy chain complementarity determining region 3 for antibody 29176
ARVAVPGMGYFQY

SEQ ID NO: 58353 - protein, 10 aa, Homo sapiens
  light chain complementarity determining region 3 for antibody 29177
QQYGTSPMYS

SEQ ID NO: 58354 - protein, 11 aa, Homo sapiens
  heavy chain complementarity determining region 3 for antibody 29177
ARGGQWGSLDY

SEQ ID NO: 58355 - protein, 10 aa, Homo sapiens
  light chain complementarity determining region 3 for antibody 29178
QQYGTSPLYP

SEQ ID NO: 58356 - protein, 20 aa, Homo sapiens
  heavy chain complementarity determining region 3 for antibody 29178
ARGHYDYVWGSYRYTGELDY

SEQ ID NO: 58357 - protein, 9 aa, Homo sapiens
  light chain complementarity determining region 3 for antibody 29179
QQYGTSPLT

SEQ ID NO: 58358 - protein, 14 aa, Homo sapiens
  heavy chain complementarity determining region 3 for antibody 29179
ARRARGWGSSYFDY

SEQ ID NO: 58359 - protein, 9 aa, Homo sapiens
  light chain complementarity determining region 3 for antibody 29180
QQYGTSPLT

SEQ ID NO: 58360 - protein, 14 aa, Homo sapiens
  heavy chain complementarity determining region 3 for antibody 29180
ARRARGWGSNYSDY

SEQ ID NO: 58361 - protein, 9 aa, Homo sapiens
  light chain complementarity determining region 3 for antibody 29181
QQYGTSPLT

SEQ ID NO: 58362 - protein, 13 aa, Homo sapiens
  heavy chain complementarity determining region 3 for antibody 29181
AKSQHLSIDIFDI

SEQ ID NO: 58363 - protein, 14 aa, Homo sapiens
  light chain complementarity determining region 3 for antibody 29182
QQYGTSPHDGPPWT

SEQ ID NO: 58364 - protein, 13 aa, Homo sapiens
  heavy chain complementarity determining region 3 for antibody 29182
ARVAVPGMGYFQY

SEQ ID NO: 58365 - protein, 14 aa, Homo sapiens
  light chain complementarity determining region 3 for antibody 29183
QQYGTSPHDGAPWT

SEQ ID NO: 58366 - protein, 13 aa, Homo sapiens
  heavy chain complementarity determining region 3 for antibody 29183
ARVAVPGMGYFQY

SEQ ID NO: 58367 - protein, 9 aa, Homo sapiens
  light chain complementarity determining region 3 for antibody 29184
QQYGTPPVT

SEQ ID NO: 58368 - protein, 14 aa, Homo sapiens
  heavy chain complementarity determining region 3 for antibody 29184
ARDLFRGIPDYLDY

SEQ ID NO: 58369 - protein, 9 aa, Homo sapiens
  light chain complementarity determining region 3 for antibody 29185
QQYGTPPRT

SEQ ID NO: 58370 - protein, 25 aa, Homo sapiens
  heavy chain complementarity determining region 3 for antibody 29185
ASLRVDRLRLPGAMRGPLYDRGLDV

SEQ ID NO: 58371 - protein, 9 aa, Homo sapiens
  light chain complementarity determining region 3 for antibody 29186
QQYGTPPRT

SEQ ID NO: 58372 - protein, 25 aa, Homo sapiens
  heavy chain complementarity determining region 3 for antibody 29186
ARRRVDRLRLPGAMRGPLYDRGLNV

SEQ ID NO: 58373 - protein, 9 aa, Homo sapiens
  light chain complementarity determining region 3 for antibody 29187
QQYGTPPGT

SEQ ID NO: 58374 - protein, 14 aa, Homo sapiens
  heavy chain complementarity determining region 3 for antibody 29187
ARDLFRGIPDYLDY

SEQ ID NO: 58375 - protein, 9 aa, Homo sapiens
  light chain complementarity determining region 3 for antibody 29188
QQYGTIPRT

SEQ ID NO: 58376 - protein, 13 aa, Homo sapiens
  heavy chain complementarity determining region 3 for antibody 29188
AGGLFDSSGFSEF

SEQ ID NO: 58377 - protein, 9 aa, Homo sapiens
  light chain complementarity determining region 3 for antibody 29189
QQYGTIPRT

SEQ ID NO: 58378 - protein, 13 aa, Homo sapiens
  heavy chain complementarity determining region 3 for antibody 29189
AGGLFDSSGCSEF

SEQ ID NO: 58379 - protein, 9 aa, Homo sapiens
  light chain complementarity determining region 3 for antibody 29190
QQYGTIPRT

SEQ ID NO: 58380 - protein, 13 aa, Homo sapiens
  heavy chain complementarity determining region 3 for antibody 29190
AGGLCDSSGYSEF

SEQ ID NO: 58381 - protein, 9 aa, Homo sapiens
  light chain complementarity determining region 3 for antibody 29191
QQYGTFPST

SEQ ID NO: 58382 - protein, 17 aa, Homo sapiens
  heavy chain complementarity determining region 3 for antibody 29191
ARPSYGSGRHGRYPLDP

SEQ ID NO: 58383 - protein, 9 aa, Homo sapiens
  light chain complementarity determining region 3 for antibody 29192
QQYGTEPVT

SEQ ID NO: 58384 - protein, 14 aa, Homo sapiens
  heavy chain complementarity determining region 3 for antibody 29192
ARDLFRGIPDYLDY

SEQ ID NO: 58385 - protein, 9 aa, Homo sapiens
  light chain complementarity determining region 3 for antibody 29193
QQYGTATVT

SEQ ID NO: 58386 - protein, 14 aa, Homo sapiens
  heavy chain complementarity determining region 3 for antibody 29193
ARDLFRGIPDYLDY

SEQ ID NO: 58387 - protein, 9 aa, Homo sapiens
  light chain complementarity determining region 3 for antibody 29194
QQYGTAPVT

SEQ ID NO: 58388 - protein, 14 aa, Homo sapiens
  heavy chain complementarity determining region 3 for antibody 29194
ARDLFRGIPDYRDY

SEQ ID NO: 58389 - protein, 9 aa, Homo sapiens
  light chain complementarity determining region 3 for antibody 29195
QQYGTAPVS

SEQ ID NO: 58390 - protein, 14 aa, Homo sapiens
  heavy chain complementarity determining region 3 for antibody 29195
ARDLFRGIPDYLDY

SEQ ID NO: 58391 - protein, 9 aa, Homo sapiens
  light chain complementarity determining region 3 for antibody 29196
QQYGTAPVA

SEQ ID NO: 58392 - protein, 14 aa, Homo sapiens
  heavy chain complementarity determining region 3 for antibody 29196
ARDLFRGIPDYLDY

SEQ ID NO: 58393 - protein, 9 aa, Homo sapiens
  light chain complementarity determining region 3 for antibody 29197
QQYGTAPLT

SEQ ID NO: 58394 - protein, 14 aa, Homo sapiens
  heavy chain complementarity determining region 3 for antibody 29197
ARDLFRGIPDYLDY

SEQ ID NO: 58395 - protein, 9 aa, Homo sapiens
  light chain complementarity determining region 3 for antibody 29198
QQYGTAPGP

SEQ ID NO: 58396 - protein, 14 aa, Homo sapiens
  heavy chain complementarity determining region 3 for antibody 29198
ARDLFRGIPDYLDY

SEQ ID NO: 58397 - protein, 9 aa, Homo sapiens
  light chain complementarity determining region 3 for antibody 29199
QQYGSYPRS

SEQ ID NO: 58398 - protein, 25 aa, Homo sapiens
  heavy chain complementarity determining region 3 for antibody 29199
ARLRIDRLRLPGAMRGPLYDCGLNV

SEQ ID NO: 58399 - protein, 9 aa, Homo sapiens
  light chain complementarity determining region 3 for antibody 29200
QQYGSYPRP

SEQ ID NO: 58400 - protein, 25 aa, Homo sapiens
  heavy chain complementarity determining region 3 for antibody 29200
ARLRIDRLRLPGAMRGPLYDCGLNV

SEQ ID NO: 58401 - protein, 7 aa, Homo sapiens
  light chain complementarity determining region 3 for antibody 29201
QQYGSWA

SEQ ID NO: 58402 - protein, 11 aa, Homo sapiens
  heavy chain complementarity determining region 3 for antibody 29201
AVVETTLAMPK

SEQ ID NO: 58403 - protein, 9 aa, Homo sapiens
  light chain complementarity determining region 3 for antibody 29202
QQYGSTWWT

SEQ ID NO: 58404 - protein, 15 aa, Homo sapiens
  heavy chain complementarity determining region 3 for antibody 29202
ASHMARDSIGYYHDF

SEQ ID NO: 58405 - protein, 9 aa, Homo sapiens
  light chain complementarity determining region 3 for antibody 29203
QQYGSTWWT

SEQ ID NO: 58406 - protein, 15 aa, Homo sapiens
  heavy chain complementarity determining region 3 for antibody 29203
ARHMARGSIGYYHDF

SEQ ID NO: 58407 - protein, 9 aa, Homo sapiens
  light chain complementarity determining region 3 for antibody 29204
QQYGSTWWT

SEQ ID NO: 58408 - protein, 15 aa, Homo sapiens
  heavy chain complementarity determining region 3 for antibody 29204
ARHMARDSIGYYRDF

SEQ ID NO: 58409 - protein, 9 aa, Homo sapiens
  light chain complementarity determining region 3 for antibody 29205
QQYGSTWWT

SEQ ID NO: 58410 - protein, 15 aa, Homo sapiens
  heavy chain complementarity determining region 3 for antibody 29205
ARHMARDSIEYYHDF

SEQ ID NO: 58411 - protein, 9 aa, Homo sapiens
  light chain complementarity determining region 3 for antibody 29206
QQYGSTWWT

SEQ ID NO: 58412 - protein, 15 aa, Homo sapiens
  heavy chain complementarity determining region 3 for antibody 29206
AGHMARDSIGYYHDF

SEQ ID NO: 58413 - protein, 9 aa, Homo sapiens
  light chain complementarity determining region 3 for antibody 29207
QQYGSTWGA

SEQ ID NO: 58414 - protein, 15 aa, Homo sapiens
  heavy chain complementarity determining region 3 for antibody 29207
ARHMARDSIGYYHDF

SEQ ID NO: 58415 - protein, 9 aa, Homo sapiens
  light chain complementarity determining region 3 for antibody 29208
QQYGSTPRT

SEQ ID NO: 58416 - protein, 14 aa, Homo sapiens
  heavy chain complementarity determining region 3 for antibody 29208
AGGDFCGGDCYSEY

SEQ ID NO: 58417 - protein, 9 aa, Homo sapiens
  light chain complementarity determining region 3 for antibody 29209
QQYGSSWWT

SEQ ID NO: 58418 - protein, 15 aa, Homo sapiens
  heavy chain complementarity determining region 3 for antibody 29209
ARHVARGDIGYYHDL

SEQ ID NO: 58419 - protein, 9 aa, Homo sapiens
  light chain complementarity determining region 3 for antibody 29210
QQYGSSWWT

SEQ ID NO: 58420 - protein, 15 aa, Homo sapiens
  heavy chain complementarity determining region 3 for antibody 29210
ARHVARDDSGYYHDL

SEQ ID NO: 58421 - protein, 9 aa, Homo sapiens
  light chain complementarity determining region 3 for antibody 29211
QQYGSSWWT

SEQ ID NO: 58422 - protein, 15 aa, Homo sapiens
  heavy chain complementarity determining region 3 for antibody 29211
ARHVARDDIGYYLDF

SEQ ID NO: 58423 - protein, 9 aa, Homo sapiens
  light chain complementarity determining region 3 for antibody 29212
QQYGSSWWT

SEQ ID NO: 58424 - protein, 15 aa, Homo sapiens
  heavy chain complementarity determining region 3 for antibody 29212
ARHMARDSIGYSHDF

SEQ ID NO: 58425 - protein, 9 aa, Homo sapiens
  light chain complementarity determining region 3 for antibody 29213
QQYGSSWVT

SEQ ID NO: 58426 - protein, 20 aa, Homo sapiens
  heavy chain complementarity determining region 3 for antibody 29213
AREGGHRQWLEIYDPRYFHH

SEQ ID NO: 58427 - protein, 9 aa, Homo sapiens
  light chain complementarity determining region 3 for antibody 29214
QQYGSSWVP

SEQ ID NO: 58428 - protein, 20 aa, Homo sapiens
  heavy chain complementarity determining region 3 for antibody 29214
AREGGHRQWLEIYDPGYFHH

SEQ ID NO: 58429 - protein, 9 aa, Homo sapiens
  light chain complementarity determining region 3 for antibody 29215
QQYGSSWVA

SEQ ID NO: 58430 - protein, 20 aa, Homo sapiens
  heavy chain complementarity determining region 3 for antibody 29215
AREGGHRQWLEIYDPGYFHH

SEQ ID NO: 58431 - protein, 9 aa, Homo sapiens
  light chain complementarity determining region 3 for antibody 29216
QQYGSSWGS

SEQ ID NO: 58432 - protein, 20 aa, Homo sapiens
  heavy chain complementarity determining region 3 for antibody 29216
AREGGHRQWLEIYDPGYFHH

SEQ ID NO: 58433 - protein, 9 aa, Homo sapiens
  light chain complementarity determining region 3 for antibody 29217
QQYGSSWAT

SEQ ID NO: 58434 - protein, 20 aa, Homo sapiens
  heavy chain complementarity determining region 3 for antibody 29217
AREGGHRQWLEIYDPGYFHH

SEQ ID NO: 58435 - protein, 10 aa, Homo sapiens
  light chain complementarity determining region 3 for antibody 29218
QQYGSSVTLT

SEQ ID NO: 58436 - protein, 18 aa, Homo sapiens
  heavy chain complementarity determining region 3 for antibody 29218
AGGRCSSFSCYVFYAFDL

SEQ ID NO: 58437 - protein, 8 aa, Homo sapiens
  light chain complementarity determining region 3 for antibody 29219
QQYGSSVT

SEQ ID NO: 58438 - protein, 21 aa, Homo sapiens
  heavy chain complementarity determining region 3 for antibody 29219
ARGSFVHCSGGSCYFYYGMDV

SEQ ID NO: 58439 - protein, 9 aa, Homo sapiens
  light chain complementarity determining region 3 for antibody 29220
QQYGSSTRT

SEQ ID NO: 58440 - protein, 25 aa, Homo sapiens
  heavy chain complementarity determining region 3 for antibody 29220
ARLRIDRLRLPGAMRGPLYDCGLNV

SEQ ID NO: 58441 - protein, 10 aa, Homo sapiens
  light chain complementarity determining region 3 for antibody 29221
QQYGSSTPFS

SEQ ID NO: 58442 - protein, 13 aa, Homo sapiens
  heavy chain complementarity determining region 3 for antibody 29221
ARVVVPGRGYFQH

SEQ ID NO: 58443 - protein, 9 aa, Homo sapiens
  light chain complementarity determining region 3 for antibody 29222
QQYGSSSST

SEQ ID NO: 58444 - protein, 15 aa, Homo sapiens
  heavy chain complementarity determining region 3 for antibody 29222
ARRISPYNNAWSLDY

SEQ ID NO: 58445 - protein, 9 aa, Homo sapiens
  light chain complementarity determining region 3 for antibody 29223
QQYGSSSRT

SEQ ID NO: 58446 - protein, 15 aa, Homo sapiens
  heavy chain complementarity determining region 3 for antibody 29223
ARRISPYNNAWYLDY

SEQ ID NO: 58447 - protein, 10 aa, Homo sapiens
  light chain complementarity determining region 3 for antibody 29224
QQYGSSSMYS

SEQ ID NO: 58448 - protein, 11 aa, Homo sapiens
  heavy chain complementarity determining region 3 for antibody 29224
ARGGQWGSLDY

SEQ ID NO: 58449 - protein, 9 aa, Homo sapiens
  light chain complementarity determining region 3 for antibody 29225
QQYGSSSIP

SEQ ID NO: 58450 - protein, 13 aa, Homo sapiens
  heavy chain complementarity determining region 3 for antibody 29225
VKEFFLVFDAFHM

SEQ ID NO: 58451 - protein, 9 aa, Homo sapiens
  light chain complementarity determining region 3 for antibody 29226
QQYGSSRRT

SEQ ID NO: 58452 - protein, 15 aa, Homo sapiens
  heavy chain complementarity determining region 3 for antibody 29226
ARQKIMISGEETFDI

SEQ ID NO: 58453 - protein, 9 aa, Homo sapiens
  light chain complementarity determining region 3 for antibody 29227
QQYGSSPYT

SEQ ID NO: 58454 - protein, 16 aa, Homo sapiens
  heavy chain complementarity determining region 3 for antibody 29227
ATPGQHSSGWDYRFDY

SEQ ID NO: 58455 - protein, 9 aa, Homo sapiens
  light chain complementarity determining region 3 for antibody 29228
QQYGSSPYT

SEQ ID NO: 58456 - protein, 14 aa, Homo sapiens
  heavy chain complementarity determining region 3 for antibody 29228
ARSVVAGTFGAFDI

SEQ ID NO: 58457 - protein, 9 aa, Homo sapiens
  light chain complementarity determining region 3 for antibody 29229
QQYGSSPYT

SEQ ID NO: 58458 - protein, 17 aa, Homo sapiens
  heavy chain complementarity determining region 3 for antibody 29229
ARGTGYNYGYGGVRFDY

SEQ ID NO: 58459 - protein, 9 aa, Homo sapiens
  light chain complementarity determining region 3 for antibody 29230
QQYGSSPYT

SEQ ID NO: 58460 - protein, 17 aa, Homo sapiens
  heavy chain complementarity determining region 3 for antibody 29230
ARGTGYNYGYGGVPFDY

SEQ ID NO: 58461 - protein, 9 aa, Homo sapiens
  light chain complementarity determining region 3 for antibody 29231
QQYGSSPYT

SEQ ID NO: 58462 - protein, 17 aa, Homo sapiens
  heavy chain complementarity determining region 3 for antibody 29231
ARGTGYDYGYGGVHFDY

SEQ ID NO: 58463 - protein, 9 aa, Homo sapiens
  light chain complementarity determining region 3 for antibody 29232
QQYGSSPYT

SEQ ID NO: 58464 - protein, 17 aa, Homo sapiens
  heavy chain complementarity determining region 3 for antibody 29232
ARGTGCNYGYGGVHFDY

SEQ ID NO: 58465 - protein, 9 aa, Homo sapiens
  light chain complementarity determining region 3 for antibody 29233
QQYGSSPYT

SEQ ID NO: 58466 - protein, 13 aa, Homo sapiens
  heavy chain complementarity determining region 3 for antibody 29233
ARGRGSGNDPFDF

SEQ ID NO: 58467 - protein, 9 aa, Homo sapiens
  light chain complementarity determining region 3 for antibody 29234
QQYGSSPYS

SEQ ID NO: 58468 - protein, 13 aa, Homo sapiens
  heavy chain complementarity determining region 3 for antibody 29234
ARALQYSGRIFDY

SEQ ID NO: 58469 - protein, 9 aa, Homo sapiens
  light chain complementarity determining region 3 for antibody 29235
QQYGSSPYP

SEQ ID NO: 58470 - protein, 14 aa, Homo sapiens
  heavy chain complementarity determining region 3 for antibody 29235
AKGGPLGYYEYFQH

SEQ ID NO: 58471 - protein, 9 aa, Homo sapiens
  light chain complementarity determining region 3 for antibody 29236
QQYGSSPYN

SEQ ID NO: 58472 - protein, 16 aa, Homo sapiens
  heavy chain complementarity determining region 3 for antibody 29236
ATPGQHNSGWDYRFDY

SEQ ID NO: 58473 - protein, 9 aa, Homo sapiens
  light chain complementarity determining region 3 for antibody 29237
QQYGSSPYN

SEQ ID NO: 58474 - protein, 17 aa, Homo sapiens
  heavy chain complementarity determining region 3 for antibody 29237
ARGTGYNYGYGGVHFDY

SEQ ID NO: 58475 - protein, 9 aa, Homo sapiens
  light chain complementarity determining region 3 for antibody 29238
QQYGSSPYA

SEQ ID NO: 58476 - protein, 13 aa, Homo sapiens
  heavy chain complementarity determining region 3 for antibody 29238
ARAVQYSGRIFDY

SEQ ID NO: 58477 - protein, 9 aa, Homo sapiens
  light chain complementarity determining region 3 for antibody 29239
QQYGSSPYA

SEQ ID NO: 58478 - protein, 13 aa, Homo sapiens
  heavy chain complementarity determining region 3 for antibody 29239
ARALQYSGRIFDC

SEQ ID NO: 58479 - protein, 9 aa, Homo sapiens
  light chain complementarity determining region 3 for antibody 29240
QQYGSSPYA

SEQ ID NO: 58480 - protein, 13 aa, Homo sapiens
  heavy chain complementarity determining region 3 for antibody 29240
ARALQYRGRIFDY

SEQ ID NO: 58481 - protein, 9 aa, Homo sapiens
  light chain complementarity determining region 3 for antibody 29241
QQYGSSPYA

SEQ ID NO: 58482 - protein, 8 aa, Homo sapiens
  heavy chain complementarity determining region 3 for antibody 29241
ARALQYNY

SEQ ID NO: 58483 - protein, 10 aa, Homo sapiens
  light chain complementarity determining region 3 for antibody 29242
QQYGSSPWYS

SEQ ID NO: 58484 - protein, 11 aa, Homo sapiens
  heavy chain complementarity determining region 3 for antibody 29242
ARGGQWGSLDY

SEQ ID NO: 58485 - protein, 9 aa, Homo sapiens
  light chain complementarity determining region 3 for antibody 29243
QQYGSSPWT

SEQ ID NO: 58486 - protein, 24 aa, Homo sapiens
  heavy chain complementarity determining region 3 for antibody 29243
ARVRVMMTRRVDVVVNYDHHGMDV

SEQ ID NO: 58487 - protein, 9 aa, Homo sapiens
  light chain complementarity determining region 3 for antibody 29244
QQYGSSPWT

SEQ ID NO: 58488 - protein, 18 aa, Homo sapiens
  heavy chain complementarity determining region 3 for antibody 29244
ARQIDYGDYASYHGYCDV

SEQ ID NO: 58489 - protein, 9 aa, Homo sapiens
  light chain complementarity determining region 3 for antibody 29245
QQYGSSPWT

SEQ ID NO: 58490 - protein, 20 aa, Homo sapiens
  heavy chain complementarity determining region 3 for antibody 29245
ARLKAASAGLPSYYYAGLDV

SEQ ID NO: 58491 - protein, 9 aa, Homo sapiens
  light chain complementarity determining region 3 for antibody 29246
QQYGSSPWT

SEQ ID NO: 58492 - protein, 20 aa, Homo sapiens
  heavy chain complementarity determining region 3 for antibody 29246
ARLKAASAGLPSCYYAGMDV

SEQ ID NO: 58493 - protein, 9 aa, Homo sapiens
  light chain complementarity determining region 3 for antibody 29247
QQYGSSPWT

SEQ ID NO: 58494 - protein, 14 aa, Homo sapiens
  heavy chain complementarity determining region 3 for antibody 29247
AKGQSGSLYDTFDM

SEQ ID NO: 58495 - protein, 9 aa, Homo sapiens
  light chain complementarity determining region 3 for antibody 29248
QQYGSSPWK

SEQ ID NO: 58496 - protein, 20 aa, Homo sapiens
  heavy chain complementarity determining region 3 for antibody 29248
ARLKAASAGLPSYYYAGMDV

SEQ ID NO: 58497 - protein, 9 aa, Homo sapiens
  light chain complementarity determining region 3 for antibody 29249
QQYGSSPVT

SEQ ID NO: 58498 - protein, 21 aa, Homo sapiens
  heavy chain complementarity determining region 3 for antibody 29249
ASVPPRYDSSGYPTPGGYMDV

SEQ ID NO: 58499 - protein, 9 aa, Homo sapiens
  light chain complementarity determining region 3 for antibody 29250
QQYGSSPVT

SEQ ID NO: 58500 - protein, 21 aa, Homo sapiens
  heavy chain complementarity determining region 3 for antibody 29250
ARAPPRYDSSGYPTPGGYMDV

SEQ ID NO: 58501 - protein, 9 aa, Homo sapiens
  light chain complementarity determining region 3 for antibody 29251
QQYGSSPVT

SEQ ID NO: 58502 - protein, 21 aa, Homo sapiens
  heavy chain complementarity determining region 3 for antibody 29251
AGVPPRYDSSGYPTPGGYMDV

SEQ ID NO: 58503 - protein, 9 aa, Homo sapiens
  light chain complementarity determining region 3 for antibody 29252
QQYGSSPVP

SEQ ID NO: 58504 - protein, 21 aa, Homo sapiens
  heavy chain complementarity determining region 3 for antibody 29252
ARVPPRYDSSGYPTPGGYMDV

SEQ ID NO: 58505 - protein, 10 aa, Homo sapiens
  light chain complementarity determining region 3 for antibody 29253
QQYGSSPTWP

SEQ ID NO: 58506 - protein, 20 aa, Homo sapiens
  heavy chain complementarity determining region 3 for antibody 29253
ATLRRRITLGRGVIPDAFDI

SEQ ID NO: 58507 - protein, 8 aa, Homo sapiens
  light chain complementarity determining region 3 for antibody 29254
QQYGSSPT

SEQ ID NO: 58508 - protein, 16 aa, Homo sapiens
  heavy chain complementarity determining region 3 for antibody 29254
VRDRPRSSSSWTSFEY

SEQ ID NO: 58509 - protein, 9 aa, Homo sapiens
  light chain complementarity determining region 3 for antibody 29255
QQYGSSPTT

SEQ ID NO: 58510 - protein, 17 aa, Homo sapiens
  heavy chain complementarity determining region 3 for antibody 29255
ARPYFGPVRAGTNGYDM

SEQ ID NO: 58511 - protein, 9 aa, Homo sapiens
  light chain complementarity determining region 3 for antibody 29256
QQYGSSPTT

SEQ ID NO: 58512 - protein, 11 aa, Homo sapiens
  heavy chain complementarity determining region 3 for antibody 29256
AKDNSNYLFDY

SEQ ID NO: 58513 - protein, 10 aa, Homo sapiens
  light chain complementarity determining region 3 for antibody 29257
QQYGSSPTFT

SEQ ID NO: 58514 - protein, 14 aa, Homo sapiens
  heavy chain complementarity determining region 3 for antibody 29257
ARDLRWLVLGRLDY

SEQ ID NO: 58515 - protein, 9 aa, Homo sapiens
  light chain complementarity determining region 3 for antibody 29258
QQYGSSPST

SEQ ID NO: 58516 - protein, 16 aa, Homo sapiens
  heavy chain complementarity determining region 3 for antibody 29258
ATPGQHNSGWDYRFDY

SEQ ID NO: 58517 - protein, 9 aa, Homo sapiens
  light chain complementarity determining region 3 for antibody 29259
QQYGSSPST

SEQ ID NO: 58518 - protein, 12 aa, Homo sapiens
  heavy chain complementarity determining region 3 for antibody 29259
ARGPQLWFYFDY

SEQ ID NO: 58519 - protein, 9 aa, Homo sapiens
  light chain complementarity determining region 3 for antibody 29260
QQYGSSPST

SEQ ID NO: 58520 - protein, 9 aa, Homo sapiens
  heavy chain complementarity determining region 3 for antibody 29260
ARETEGFDI

SEQ ID NO: 58521 - protein, 9 aa, Homo sapiens
  light chain complementarity determining region 3 for antibody 29261
QQYGSSPST

SEQ ID NO: 58522 - protein, 17 aa, Homo sapiens
  heavy chain complementarity determining region 3 for antibody 29261
ARERTEVPGPMPADLDY

SEQ ID NO: 58523 - protein, 11 aa, Homo sapiens
  light chain complementarity determining region 3 for antibody 29262
QQYGSSPSMYP

SEQ ID NO: 58524 - protein, 15 aa, Homo sapiens
  heavy chain complementarity determining region 3 for antibody 29262
AKTVSPFSVAAPLDY

SEQ ID NO: 58525 - protein, 11 aa, Homo sapiens
  light chain complementarity determining region 3 for antibody 29263
QQYGSSPSMST

SEQ ID NO: 58526 - protein, 15 aa, Homo sapiens
  heavy chain complementarity determining region 3 for antibody 29263
AKTVSPFSVAAPLDY

SEQ ID NO: 58527 - protein, 9 aa, Homo sapiens
  light chain complementarity determining region 3 for antibody 29264
QQYGSSPRT

SEQ ID NO: 58528 - protein, 11 aa, Homo sapiens
  heavy chain complementarity determining region 3 for antibody 29264
TLAGYLAAFDI

SEQ ID NO: 58529 - protein, 9 aa, Homo sapiens
  light chain complementarity determining region 3 for antibody 29265
QQYGSSPRT

SEQ ID NO: 58530 - protein, 14 aa, Homo sapiens
  heavy chain complementarity determining region 3 for antibody 29265
ATGFLDSSRYYLEY

SEQ ID NO: 58531 - protein, 9 aa, Homo sapiens
  light chain complementarity determining region 3 for antibody 29266
QQYGSSPRT

SEQ ID NO: 58532 - protein, 14 aa, Homo sapiens
  heavy chain complementarity determining region 3 for antibody 29266
ATGFFDSSCYYLEY

SEQ ID NO: 58533 - protein, 9 aa, Homo sapiens
  light chain complementarity determining region 3 for antibody 29267
QQYGSSPRT

SEQ ID NO: 58534 - protein, 24 aa, Homo sapiens
  heavy chain complementarity determining region 3 for antibody 29267
ARVRVIMTRRVDVVVNYDHHGMDV

SEQ ID NO: 58535 - protein, 9 aa, Homo sapiens
  light chain complementarity determining region 3 for antibody 29268
QQYGSSPRT

SEQ ID NO: 58536 - protein, 25 aa, Homo sapiens
  heavy chain complementarity determining region 3 for antibody 29268
ARLSIDRLRLPGAMRGPLYDCGLNV

SEQ ID NO: 58537 - protein, 9 aa, Homo sapiens
  light chain complementarity determining region 3 for antibody 29269
QQYGSSPRT

SEQ ID NO: 58538 - protein, 25 aa, Homo sapiens
  heavy chain complementarity determining region 3 for antibody 29269
ARLRTDRLRLPGAMRGPLYDCGLNV

SEQ ID NO: 58539 - protein, 9 aa, Homo sapiens
  light chain complementarity determining region 3 for antibody 29270
QQYGSSPRT

SEQ ID NO: 58540 - protein, 25 aa, Homo sapiens
  heavy chain complementarity determining region 3 for antibody 29270
ARLRLDRLRLPGAMRGPLYDCGLNV

SEQ ID NO: 58541 - protein, 9 aa, Homo sapiens
  light chain complementarity determining region 3 for antibody 29271
QQYGSSPRT

SEQ ID NO: 58542 - protein, 25 aa, Homo sapiens
  heavy chain complementarity determining region 3 for antibody 29271
ARLRIGRLRLPGAMRGPLYDCGLNV

SEQ ID NO: 58543 - protein, 9 aa, Homo sapiens
  light chain complementarity determining region 3 for antibody 29272
QQYGSSPRT

SEQ ID NO: 58544 - protein, 25 aa, Homo sapiens
  heavy chain complementarity determining region 3 for antibody 29272
ARLRIERLRLPGAMRGPLYDCGLNV

SEQ ID NO: 58545 - protein, 9 aa, Homo sapiens
  light chain complementarity determining region 3 for antibody 29273
QQYGSSPRT

SEQ ID NO: 58546 - protein, 25 aa, Homo sapiens
  heavy chain complementarity determining region 3 for antibody 29273
ARLRIDRLRRPGAMRGPLYDCGLNV

SEQ ID NO: 58547 - protein, 9 aa, Homo sapiens
  light chain complementarity determining region 3 for antibody 29274
QQYGSSPRT

SEQ ID NO: 58548 - protein, 25 aa, Homo sapiens
  heavy chain complementarity determining region 3 for antibody 29274
ARLRIDRLRPPGAMRGPLYDCGLNV

SEQ ID NO: 58549 - protein, 9 aa, Homo sapiens
  light chain complementarity determining region 3 for antibody 29275
QQYGSSPRT

SEQ ID NO: 58550 - protein, 25 aa, Homo sapiens
  heavy chain complementarity determining region 3 for antibody 29275
ARLRIDRLRLTGAMRGPLYDCGLNV

SEQ ID NO: 58551 - protein, 9 aa, Homo sapiens
  light chain complementarity determining region 3 for antibody 29276
QQYGSSPRT

SEQ ID NO: 58552 - protein, 25 aa, Homo sapiens
  heavy chain complementarity determining region 3 for antibody 29276
ARLRIDRLRLQGAMRGPLYDCGLNV

SEQ ID NO: 58553 - protein, 9 aa, Homo sapiens
  light chain complementarity determining region 3 for antibody 29277
QQYGSSPRT

SEQ ID NO: 58554 - protein, 25 aa, Homo sapiens
  heavy chain complementarity determining region 3 for antibody 29277
ARLRIDRLRLPGAVRGPLYDCGLNV

SEQ ID NO: 58555 - protein, 9 aa, Homo sapiens
  light chain complementarity determining region 3 for antibody 29278
QQYGSSPRT

SEQ ID NO: 58556 - protein, 25 aa, Homo sapiens
  heavy chain complementarity determining region 3 for antibody 29278
ARLRIDRLRLPGAMRGTLYDCGLNV

SEQ ID NO: 58557 - protein, 9 aa, Homo sapiens
  light chain complementarity determining region 3 for antibody 29279
QQYGSSPRT

SEQ ID NO: 58558 - protein, 25 aa, Homo sapiens
  heavy chain complementarity determining region 3 for antibody 29279
ARLRIDRLRLPGAMRGPLYDGGLNV

SEQ ID NO: 58559 - protein, 9 aa, Homo sapiens
  light chain complementarity determining region 3 for antibody 29280
QQYGSSPRT

SEQ ID NO: 58560 - protein, 25 aa, Homo sapiens
  heavy chain complementarity determining region 3 for antibody 29280
ARLRIDRLRLPGAMRGPLYDCSLNV

SEQ ID NO: 58561 - protein, 9 aa, Homo sapiens
  light chain complementarity determining region 3 for antibody 29281
QQYGSSPRT

SEQ ID NO: 58562 - protein, 25 aa, Homo sapiens
  heavy chain complementarity determining region 3 for antibody 29281
ARLRIDRLRIPGAMRGPLYDCGLNV

SEQ ID NO: 58563 - protein, 9 aa, Homo sapiens
  light chain complementarity determining region 3 for antibody 29282
QQYGSSPRT

SEQ ID NO: 58564 - protein, 25 aa, Homo sapiens
  heavy chain complementarity determining region 3 for antibody 29282
ARLRIDRLGLPGAMRGPLYDCGLNV

SEQ ID NO: 58565 - protein, 9 aa, Homo sapiens
  light chain complementarity determining region 3 for antibody 29283
QQYGSSPRT

SEQ ID NO: 58566 - protein, 25 aa, Homo sapiens
  heavy chain complementarity determining region 3 for antibody 29283
ARLRIDQLRLPGAMRGALYHCGMNV

SEQ ID NO: 58567 - protein, 9 aa, Homo sapiens
  light chain complementarity determining region 3 for antibody 29284
QQYGSSPRT

SEQ ID NO: 58568 - protein, 25 aa, Homo sapiens
  heavy chain complementarity determining region 3 for antibody 29284
ARLRIDQLRLPGAMRGALYHCGLDV

SEQ ID NO: 58569 - protein, 9 aa, Homo sapiens
  light chain complementarity determining region 3 for antibody 29285
QQYGSSPRT

SEQ ID NO: 58570 - protein, 16 aa, Homo sapiens
  heavy chain complementarity determining region 3 for antibody 29285
ARLKRYSGYEDDGMDV

SEQ ID NO: 58571 - protein, 9 aa, Homo sapiens
  light chain complementarity determining region 3 for antibody 29286
QQYGSSPRT

SEQ ID NO: 58572 - protein, 13 aa, Homo sapiens
  heavy chain complementarity determining region 3 for antibody 29286
ARGKYESSGYKDN

SEQ ID NO: 58573 - protein, 9 aa, Homo sapiens
  light chain complementarity determining region 3 for antibody 29287
QQYGSSPRT

SEQ ID NO: 58574 - protein, 13 aa, Homo sapiens
  heavy chain complementarity determining region 3 for antibody 29287
ARGKYESSGDKEN

SEQ ID NO: 58575 - protein, 9 aa, Homo sapiens
  light chain complementarity determining region 3 for antibody 29288
QQYGSSPRT

SEQ ID NO: 58576 - protein, 32 aa, Homo sapiens; identical to SEQ ID NO: 49610
  heavy chain complementarity determining region 3 for antibody 29288

SEQ ID NO: 58577 - protein, 9 aa, Homo sapiens
  light chain complementarity determining region 3 for antibody 29289
QQYGSSPRT

SEQ ID NO: 58578 - protein, 14 aa, Homo sapiens
  heavy chain complementarity determining region 3 for antibody 29289
ARERIGGGHWYFDL

SEQ ID NO: 58579 - protein, 9 aa, Homo sapiens
  light chain complementarity determining region 3 for antibody 29290
QQYGSSPRT

SEQ ID NO: 58580 - protein, 17 aa, Homo sapiens
  heavy chain complementarity determining region 3 for antibody 29290
ARDVATAPPGTTENFDH

SEQ ID NO: 58581 - protein, 9 aa, Homo sapiens
  light chain complementarity determining region 3 for antibody 29291
QQYGSSPRT

SEQ ID NO: 58582 - protein, 12 aa, Homo sapiens
  heavy chain complementarity determining region 3 for antibody 29291
ARASWFLSVFDS

SEQ ID NO: 58583 - protein, 9 aa, Homo sapiens
  light chain complementarity determining region 3 for antibody 29292
QQYGSSPRT

SEQ ID NO: 58584 - protein, 15 aa, Homo sapiens
  heavy chain complementarity determining region 3 for antibody 29292
ARANGVIITTGVLRH

SEQ ID NO: 58585 - protein, 9 aa, Homo sapiens
  light chain complementarity determining region 3 for antibody 29293
QQYGSSPRT

SEQ ID NO: 58586 - protein, 15 aa, Homo sapiens
  heavy chain complementarity determining region 3 for antibody 29293
ARANGVIIATGVLRY

SEQ ID NO: 58587 - protein, 9 aa, Homo sapiens
  light chain complementarity determining region 3 for antibody 29294
QQYGSSPRT

SEQ ID NO: 58588 - protein, 15 aa, Homo sapiens
  heavy chain complementarity determining region 3 for antibody 29294
AKDRSAGYTYGFSDS

SEQ ID NO: 58589 - protein, 9 aa, Homo sapiens
  light chain complementarity determining region 3 for antibody 29295
QQYGSSPRT

SEQ ID NO: 58590 - protein, 14 aa, Homo sapiens
  heavy chain complementarity determining region 3 for antibody 29295
AAGFFDSSRYYLEY

SEQ ID NO: 58591 - protein, 10 aa, Homo sapiens
  light chain complementarity determining region 3 for antibody 29296
QQYGSSPRSS

SEQ ID NO: 58592 - protein, 11 aa, Homo sapiens
  heavy chain complementarity determining region 3 for antibody 29296
ARGGQWGSLDY

SEQ ID NO: 58593 - protein, 9 aa, Homo sapiens
  light chain complementarity determining region 3 for antibody 29297
QQYGSSPRS

SEQ ID NO: 58594 - protein, 13 aa, Homo sapiens
  heavy chain complementarity determining region 3 for antibody 29297
AHINVRGVIPFDY

SEQ ID NO: 58595 - protein, 9 aa, Homo sapiens
  light chain complementarity determining region 3 for antibody 29298
QQYGSSPRR

SEQ ID NO: 58596 - protein, 25 aa, Homo sapiens
  heavy chain complementarity determining region 3 for antibody 29298
ARLRIDRLRLPGAMRGPLYDCGLNV

SEQ ID NO: 58597 - protein, 9 aa, Homo sapiens
  light chain complementarity determining region 3 for antibody 29299
QQYGSSPRP

SEQ ID NO: 58598 - protein, 25 aa, Homo sapiens
  heavy chain complementarity determining region 3 for antibody 29299
ASLRIDRLRLPGAMRGPLYDCGLNV

SEQ ID NO: 58599 - protein, 9 aa, Homo sapiens
  light chain complementarity determining region 3 for antibody 29300
QQYGSSPRP

SEQ ID NO: 58600 - protein, 12 aa, Homo sapiens
  heavy chain complementarity determining region 3 for antibody 29300
ARVRGSGSYPDY

SEQ ID NO: 58601 - protein, 9 aa, Homo sapiens
  light chain complementarity determining region 3 for antibody 29301
QQYGSSPRP

SEQ ID NO: 58602 - protein, 14 aa, Homo sapiens
  heavy chain complementarity determining region 3 for antibody 29301
ARVMYYYGSGSFDY

SEQ ID NO: 58603 - protein, 9 aa, Homo sapiens
  light chain complementarity determining region 3 for antibody 29302
QQYGSSPRP

SEQ ID NO: 58604 - protein, 13 aa, Homo sapiens
  heavy chain complementarity determining region 3 for antibody 29302
AKDMDTKVTGSDH

SEQ ID NO: 58605 - protein, 9 aa, Homo sapiens
  light chain complementarity determining region 3 for antibody 29303
QQYGSSPRP

SEQ ID NO: 58606 - protein, 15 aa, Homo sapiens
  heavy chain complementarity determining region 3 for antibody 29303
AKDGPYCGSDCYFEF

SEQ ID NO: 58607 - protein, 9 aa, Homo sapiens
  light chain complementarity determining region 3 for antibody 29304
QQYGSSPRP

SEQ ID NO: 58608 - protein, 13 aa, Homo sapiens
  heavy chain complementarity determining region 3 for antibody 29304
AHINVRGVIPFDY

SEQ ID NO: 58609 - protein, 9 aa, Homo sapiens
  light chain complementarity determining region 3 for antibody 29305
QQYGSSPRN

SEQ ID NO: 58610 - protein, 14 aa, Homo sapiens
  heavy chain complementarity determining region 3 for antibody 29305
ARDRGSSWYPPFQH

SEQ ID NO: 58611 - protein, 9 aa, Homo sapiens
  light chain complementarity determining region 3 for antibody 29306
QQYGSSPRK

SEQ ID NO: 58612 - protein, 11 aa, Homo sapiens
  heavy chain complementarity determining region 3 for antibody 29306
TLSGYLAAFDI

SEQ ID NO: 58613 - protein, 10 aa, Homo sapiens
  light chain complementarity determining region 3 for antibody 29307
QQYGSSPRHS

SEQ ID NO: 58614 - protein, 11 aa, Homo sapiens
  heavy chain complementarity determining region 3 for antibody 29307
ARGGQWGSLDY

SEQ ID NO: 58615 - protein, 9 aa, Homo sapiens
  light chain complementarity determining region 3 for antibody 29308
QQYGSSPRA

SEQ ID NO: 58616 - protein, 15 aa, Homo sapiens
  heavy chain complementarity determining region 3 for antibody 29308
ARANGVIITTGVLRY

SEQ ID NO: 58617 - protein, 10 aa, Homo sapiens
  light chain complementarity determining region 3 for antibody 29309
QQYGSSPQWT

SEQ ID NO: 58618 - protein, 11 aa, Homo sapiens
  heavy chain complementarity determining region 3 for antibody 29309
TREKVVGYFDY

SEQ ID NO: 58619 - protein, 10 aa, Homo sapiens
  light chain complementarity determining region 3 for antibody 29310
QQYGSSPQWR

SEQ ID NO: 58620 - protein, 11 aa, Homo sapiens
  heavy chain complementarity determining region 3 for antibody 29310
TREKVGGYFDY

SEQ ID NO: 58621 - protein, 10 aa, Homo sapiens
  light chain complementarity determining region 3 for antibody 29311
QQYGSSPQWP

SEQ ID NO: 58622 - protein, 11 aa, Homo sapiens
  heavy chain complementarity determining region 3 for antibody 29311
TREKVGGYFDY

SEQ ID NO: 58623 - protein, 9 aa, Homo sapiens
  light chain complementarity determining region 3 for antibody 29312
QQYGSSPQT

SEQ ID NO: 58624 - protein, 11 aa, Homo sapiens
  heavy chain complementarity determining region 3 for antibody 29312
ARGDRWSAFDI

SEQ ID NO: 58625 - protein, 9 aa, Homo sapiens
  light chain complementarity determining region 3 for antibody 29313
QQYGSSPQT

SEQ ID NO: 58626 - protein, 14 aa, Homo sapiens
  heavy chain complementarity determining region 3 for antibody 29313
ARDNPHRLERYFDL

SEQ ID NO: 58627 - protein, 10 aa, Homo sapiens
  light chain complementarity determining region 3 for antibody 29314
QQYGSSPPYP

SEQ ID NO: 58628 - protein, 14 aa, Homo sapiens
  heavy chain complementarity determining region 3 for antibody 29314
ARHKHDGSGSVIDY

SEQ ID NO: 58629 - protein, 10 aa, Homo sapiens
  light chain complementarity determining region 3 for antibody 29315
QQYGSSPPYP

SEQ ID NO: 58630 - protein, 23 aa, Homo sapiens
  heavy chain complementarity determining region 3 for antibody 29315
ARDGAHDYIHRLRKKHRIDAFDI

SEQ ID NO: 58631 - protein, 9 aa, Homo sapiens
  light chain complementarity determining region 3 for antibody 29316
QQYGSSPPT

SEQ ID NO: 58632 - protein, 16 aa, Homo sapiens
  heavy chain complementarity determining region 3 for antibody 29316
GRDLPPRAASATAYDV

SEQ ID NO: 58633 - protein, 9 aa, Homo sapiens
  light chain complementarity determining region 3 for antibody 29317
QQYGSSPPT

SEQ ID NO: 58634 - protein, 16 aa, Homo sapiens
  heavy chain complementarity determining region 3 for antibody 29317
ARQGLYSSGWFDAFDI

SEQ ID NO: 58635 - protein, 9 aa, Homo sapiens
  light chain complementarity determining region 3 for antibody 29318
QQYGSSPPT

SEQ ID NO: 58636 - protein, 17 aa, Homo sapiens
  heavy chain complementarity determining region 3 for antibody 29318
ARPYFGPVRDGTNGYDM

SEQ ID NO: 58637 - protein, 9 aa, Homo sapiens
  light chain complementarity determining region 3 for antibody 29319
QQYGSSPPT

SEQ ID NO: 58638 - protein, 12 aa, Homo sapiens
  heavy chain complementarity determining region 3 for antibody 29319
ARGPQLWFYLDY

SEQ ID NO: 58639 - protein, 9 aa, Homo sapiens
  light chain complementarity determining region 3 for antibody 29320
QQYGSSPPT

SEQ ID NO: 58640 - protein, 12 aa, Homo sapiens
  heavy chain complementarity determining region 3 for antibody 29320
ARGPQLWFCFDY

SEQ ID NO: 58641 - protein, 9 aa, Homo sapiens
  light chain complementarity determining region 3 for antibody 29321
QQYGSSPPT

SEQ ID NO: 58642 - protein, 13 aa, Homo sapiens
  heavy chain complementarity determining region 3 for antibody 29321
AKPMWRKLCYFDY

SEQ ID NO: 58643 - protein, 11 aa, Homo sapiens
  light chain complementarity determining region 3 for antibody 29322
QQYGSSPPSYT

SEQ ID NO: 58644 - protein, 24 aa, Homo sapiens
  heavy chain complementarity determining region 3 for antibody 29322
AVNHGIFGVVIHPSLRNSYCGMDV

SEQ ID NO: 58645 - protein, 11 aa, Homo sapiens
  light chain complementarity determining region 3 for antibody 29323
QQYGSSPPSNT

SEQ ID NO: 58646 - protein, 24 aa, Homo sapiens
  heavy chain complementarity determining region 3 for antibody 29323
AVNHGIFGVVIHPSLRNSYYGMDV

SEQ ID NO: 58647 - protein, 11 aa, Homo sapiens
  light chain complementarity determining region 3 for antibody 29324
QQYGSSPPRDT

SEQ ID NO: 58648 - protein, 12 aa, Homo sapiens
  heavy chain complementarity determining region 3 for antibody 29324
ATTGSYYRSFDY

SEQ ID NO: 58649 - protein, 9 aa, Homo sapiens
  light chain complementarity determining region 3 for antibody 29325
QQYGSSPPP

SEQ ID NO: 58650 - protein, 12 aa, Homo sapiens
  heavy chain complementarity determining region 3 for antibody 29325
VVGYSSGWYEVD

SEQ ID NO: 58651 - protein, 9 aa, Homo sapiens
  light chain complementarity determining region 3 for antibody 29326
QQYGSSPPP

SEQ ID NO: 58652 - protein, 17 aa, Homo sapiens
  heavy chain complementarity determining region 3 for antibody 29326
ARPYFGPVRAGTNGYDM

SEQ ID NO: 58653 - protein, 9 aa, Homo sapiens
  light chain complementarity determining region 3 for antibody 29327
QQYGSSPPP

SEQ ID NO: 58654 - protein, 12 aa, Homo sapiens
  heavy chain complementarity determining region 3 for antibody 29327
ARASWFLSVFDS

SEQ ID NO: 58655 - protein, 9 aa, Homo sapiens
  light chain complementarity determining region 3 for antibody 29328
QQYGSSPPP

SEQ ID NO: 58656 - protein, 16 aa, Homo sapiens
  heavy chain complementarity determining region 3 for antibody 29328
AKDISGGFDGWWFFDY

SEQ ID NO: 58657 - protein, 10 aa, Homo sapiens
  light chain complementarity determining region 3 for antibody 29329
QQYGSSPPNT

SEQ ID NO: 58658 - protein, 14 aa, Homo sapiens
  heavy chain complementarity determining region 3 for antibody 29329
ARHEHDGSGSVIDY

SEQ ID NO: 58659 - protein, 11 aa, Homo sapiens
  light chain complementarity determining region 3 for antibody 29330
QQYGSSPPLYT

SEQ ID NO: 58660 - protein, 10 aa, Homo sapiens
  heavy chain complementarity determining region 3 for antibody 29330
ARNDVYRIDH

SEQ ID NO: 58661 - protein, 10 aa, Homo sapiens
  light chain complementarity determining region 3 for antibody 29331
QQYGSSPPLT

SEQ ID NO: 58662 - protein, 15 aa, Homo sapiens
  heavy chain complementarity determining region 3 for antibody 29331
ASRPPDGHTILVFNY

SEQ ID NO: 58663 - protein, 10 aa, Homo sapiens
  light chain complementarity determining region 3 for antibody 29332
QQYGSSPPIT

SEQ ID NO: 58664 - protein, 13 aa, Homo sapiens
  heavy chain complementarity determining region 3 for antibody 29332
AHSRVWFGAAFDY

SEQ ID NO: 58665 - protein, 10 aa, Homo sapiens
  light chain complementarity determining region 3 for antibody 29333
QQYGSSPPIP

SEQ ID NO: 58666 - protein, 15 aa, Homo sapiens
  heavy chain complementarity determining region 3 for antibody 29333
ASRPPDGHTILVFNY

SEQ ID NO: 58667 - protein, 10 aa, Homo sapiens
  light chain complementarity determining region 3 for antibody 29334
QQYGSSPPHT

SEQ ID NO: 58668 - protein, 14 aa, Homo sapiens
  heavy chain complementarity determining region 3 for antibody 29334
ARHEHDGSGSVIDY

SEQ ID NO: 58669 - protein, 10 aa, Homo sapiens
  light chain complementarity determining region 3 for antibody 29335
QQYGSSPPFT

SEQ ID NO: 58670 - protein, 14 aa, Homo sapiens
  heavy chain complementarity determining region 3 for antibody 29335
ARDLQWLVLGRLDY

SEQ ID NO: 58671 - protein, 10 aa, Homo sapiens
  light chain complementarity determining region 3 for antibody 29336
QQYGSSPPFI

SEQ ID NO: 58672 - protein, 14 aa, Homo sapiens
  heavy chain complementarity determining region 3 for antibody 29336
ARDLRWLVLGRLDY

SEQ ID NO: 58673 - protein, 9 aa, Homo sapiens
  light chain complementarity determining region 3 for antibody 29337
QQYGSSPPA

SEQ ID NO: 58674 - protein, 13 aa, Homo sapiens
  heavy chain complementarity determining region 3 for antibody 29337
AKPMWRKLYYFDY

SEQ ID NO: 58675 - protein, 9 aa, Homo sapiens
  light chain complementarity determining region 3 for antibody 29338
QQYGSSPNT

SEQ ID NO: 58676 - protein, 17 aa, Homo sapiens
  heavy chain complementarity determining region 3 for antibody 29338
ARGTGYNYGYGGVHFDY

SEQ ID NO: 58677 - protein, 9 aa, Homo sapiens
  light chain complementarity determining region 3 for antibody 29339
QQYGSSPNT

SEQ ID NO: 58678 - protein, 9 aa, Homo sapiens
  heavy chain complementarity determining region 3 for antibody 29339
ARETEGFDI

SEQ ID NO: 58679 - protein, 10 aa, Homo sapiens
  light chain complementarity determining region 3 for antibody 29340
QQYGSSPMYS

SEQ ID NO: 58680 - protein, 11 aa, Homo sapiens
  heavy chain complementarity determining region 3 for antibody 29340
ARGGQWGSLDD

SEQ ID NO: 58681 - protein, 10 aa, Homo sapiens
  light chain complementarity determining region 3 for antibody 29341
QQYGSSPMAS

SEQ ID NO: 58682 - protein, 11 aa, Homo sapiens
  heavy chain complementarity determining region 3 for antibody 29341
ARGGQWGSLDY

SEQ ID NO: 58683 - protein, 9 aa, Homo sapiens
  light chain complementarity determining region 3 for antibody 29342
QQYGSSPLT

SEQ ID NO: 58684 - protein, 17 aa, Homo sapiens
  heavy chain complementarity determining region 3 for antibody 29342
ARVLTSVTAGIYYGFDV

SEQ ID NO: 58685 - protein, 9 aa, Homo sapiens
  light chain complementarity determining region 3 for antibody 29343
QQYGSSPLT

SEQ ID NO: 58686 - protein, 21 aa, Homo sapiens
  heavy chain complementarity determining region 3 for antibody 29343
ARVGVERNRYGRTLPVWYFDY

SEQ ID NO: 58687 - protein, 9 aa, Homo sapiens
  light chain complementarity determining region 3 for antibody 29344
QQYGSSPLT

SEQ ID NO: 58688 - protein, 17 aa, Homo sapiens
  heavy chain complementarity determining region 3 for antibody 29344
ARPYFGPVRAGTNGYDM

SEQ ID NO: 58689 - protein, 9 aa, Homo sapiens
  light chain complementarity determining region 3 for antibody 29345
QQYGSSPLT

SEQ ID NO: 58690 - protein, 15 aa, Homo sapiens
  heavy chain complementarity determining region 3 for antibody 29345
ARGVAGFGDLEYFDY

SEQ ID NO: 58691 - protein, 9 aa, Homo sapiens
  light chain complementarity determining region 3 for antibody 29346
QQYGSSPLT

SEQ ID NO: 58692 - protein, 12 aa, Homo sapiens
  heavy chain complementarity determining region 3 for antibody 29346
ARGPQLWFYFDY

SEQ ID NO: 58693 - protein, 9 aa, Homo sapiens
  light chain complementarity determining region 3 for antibody 29347
QQYGSSPLT

SEQ ID NO: 58694 - protein, 18 aa, Homo sapiens
  heavy chain complementarity determining region 3 for antibody 29347
AKLPAPYGNRPRLYYFDY

SEQ ID NO: 58695 - protein, 9 aa, Homo sapiens
  light chain complementarity determining region 3 for antibody 29348
QQYGSSPLT

SEQ ID NO: 58696 - protein, 15 aa, Homo sapiens
  heavy chain complementarity determining region 3 for antibody 29348
AKDGPYCGSDCYFEF

SEQ ID NO: 58697 - protein, 10 aa, Homo sapiens
  light chain complementarity determining region 3 for antibody 29349
QQYGSSPLST

SEQ ID NO: 58698 - protein, 13 aa, Homo sapiens
  heavy chain complementarity determining region 3 for antibody 29349
AAIRDPVSWSCSE

SEQ ID NO: 58699 - protein, 9 aa, Homo sapiens
  light chain complementarity determining region 3 for antibody 29350
QQYGSSPLP

SEQ ID NO: 58700 - protein, 15 aa, Homo sapiens
  heavy chain complementarity determining region 3 for antibody 29350
AKDEGGWYSGDAFDI

SEQ ID NO: 58701 - protein, 10 aa, Homo sapiens
  light chain complementarity determining region 3 for antibody 29351
QQYGSSPLLT

SEQ ID NO: 58702 - protein, 15 aa, Homo sapiens
  heavy chain complementarity determining region 3 for antibody 29351
TTAGYSYGYRFFFDY

SEQ ID NO: 58703 - protein, 9 aa, Homo sapiens
  light chain complementarity determining region 3 for antibody 29352
QQYGSSPLI

SEQ ID NO: 58704 - protein, 12 aa, Homo sapiens
  heavy chain complementarity determining region 3 for antibody 29352
ARASWFLSVFDS

SEQ ID NO: 58705 - protein, 10 aa, Homo sapiens
  light chain complementarity determining region 3 for antibody 29353
QQYGSSPLGT

SEQ ID NO: 58706 - protein, 18 aa, Homo sapiens
  heavy chain complementarity determining region 3 for antibody 29353
RKSQQLATSYYYYYGMDV

SEQ ID NO: 58707 - protein, 9 aa, Homo sapiens
  light chain complementarity determining region 3 for antibody 29354
QQYGSSPIT

SEQ ID NO: 58708 - protein, 15 aa, Homo sapiens
  heavy chain complementarity determining region 3 for antibody 29354
ARVYSGYDYLYYSDS

SEQ ID NO: 58709 - protein, 9 aa, Homo sapiens
  light chain complementarity determining region 3 for antibody 29355
QQYGSSPIT

SEQ ID NO: 58710 - protein, 9 aa, Homo sapiens
  heavy chain complementarity determining region 3 for antibody 29355
ARRRGYYNH

SEQ ID NO: 58711 - protein, 9 aa, Homo sapiens
  light chain complementarity determining region 3 for antibody 29356
QQYGSSPGT

SEQ ID NO: 58712 - protein, 20 aa, Homo sapiens
  heavy chain complementarity determining region 3 for antibody 29356
ARVYKLSAVRGGGWYGAFDI

SEQ ID NO: 58713 - protein, 9 aa, Homo sapiens
  light chain complementarity determining region 3 for antibody 29357
QQYGSSPGT

SEQ ID NO: 58714 - protein, 15 aa, Homo sapiens
  heavy chain complementarity determining region 3 for antibody 29357
ARGVAGFGDLEYFDY

SEQ ID NO: 58715 - protein, 9 aa, Homo sapiens
  light chain complementarity determining region 3 for antibody 29358
QQYGSSPGR

SEQ ID NO: 58716 - protein, 20 aa, Homo sapiens
  heavy chain complementarity determining region 3 for antibody 29358
ARVYKLSAFRGGGWYGAFDI

SEQ ID NO: 58717 - protein, 10 aa, Homo sapiens
  light chain complementarity determining region 3 for antibody 29359
QQYGSSPGPT

SEQ ID NO: 58718 - protein, 19 aa, Homo sapiens
  heavy chain complementarity determining region 3 for antibody 29359
GRVGRRYIFNRQYNIAMDV

SEQ ID NO: 58719 - protein, 9 aa, Homo sapiens
  light chain complementarity determining region 3 for antibody 29360
QQYGSSPGP

SEQ ID NO: 58720 - protein, 20 aa, Homo sapiens
  heavy chain complementarity determining region 3 for antibody 29360
ARVYKLSAFRGGGWYGAFDI

SEQ ID NO: 58721 - protein, 10 aa, Homo sapiens
  light chain complementarity determining region 3 for antibody 29361
QQYGSSPGLT

SEQ ID NO: 58722 - protein, 23 aa, Homo sapiens
  heavy chain complementarity determining region 3 for antibody 29361
ARAPSQYYYDSSGYYYPTNWFDP

SEQ ID NO: 58723 - protein, 9 aa, Homo sapiens
  light chain complementarity determining region 3 for antibody 29362
QQYGSSPGK

SEQ ID NO: 58724 - protein, 14 aa, Homo sapiens
  heavy chain complementarity determining region 3 for antibody 29362
ARDSFRGSGSYFAN

SEQ ID NO: 58725 - protein, 9 aa, Homo sapiens
  light chain complementarity determining region 3 for antibody 29363
QQYGSSPFT

SEQ ID NO: 58726 - protein, 6 aa, Homo sapiens
  heavy chain complementarity determining region 3 for antibody 29363
VSLMCA

SEQ ID NO: 58727 - protein, 9 aa, Homo sapiens
  light chain complementarity determining region 3 for antibody 29364
QQYGSSPFT

SEQ ID NO: 58728 - protein, 21 aa, Homo sapiens
  heavy chain complementarity determining region 3 for antibody 29364
ARVGVERNRYGRTRPVWYFDY

SEQ ID NO: 58729 - protein, 9 aa, Homo sapiens
  light chain complementarity determining region 3 for antibody 29365
QQYGSSPFT

SEQ ID NO: 58730 - protein, 21 aa, Homo sapiens
  heavy chain complementarity determining region 3 for antibody 29365
ARVGVERNRYGRTLPVWSFDY

SEQ ID NO: 58731 - protein, 9 aa, Homo sapiens
  light chain complementarity determining region 3 for antibody 29366
QQYGSSPFT

SEQ ID NO: 58732 - protein, 21 aa, Homo sapiens
  heavy chain complementarity determining region 3 for antibody 29366
ARVGVERNRYGRSLPVWYFDY

SEQ ID NO: 58733 - protein, 9 aa, Homo sapiens
  light chain complementarity determining region 3 for antibody 29367
QQYGSSPFT

SEQ ID NO: 58734 - protein, 21 aa, Homo sapiens
  heavy chain complementarity determining region 3 for antibody 29367
ARVGVERNRYGRALPVWYFDY

SEQ ID NO: 58735 - protein, 9 aa, Homo sapiens
  light chain complementarity determining region 3 for antibody 29368
QQYGSSPFT

SEQ ID NO: 58736 - protein, 19 aa, Homo sapiens
  heavy chain complementarity determining region 3 for antibody 29368
ARGSSSSRRRAAVVGYFDL

SEQ ID NO: 58737 - protein, 9 aa, Homo sapiens
  light chain complementarity determining region 3 for antibody 29369
QQYGSSPFT

SEQ ID NO: 58738 - protein, 15 aa, Homo sapiens
  heavy chain complementarity determining region 3 for antibody 29369
AKDEGGWYSGDAFDI

SEQ ID NO: 58739 - protein, 9 aa, Homo sapiens
  light chain complementarity determining region 3 for antibody 29370
QQYGSSPFS

SEQ ID NO: 58740 - protein, 21 aa, Homo sapiens
  heavy chain complementarity determining region 3 for antibody 29370
ARVGVERNRYGRTLPVWYFDY

SEQ ID NO: 58741 - protein, 9 aa, Homo sapiens
  light chain complementarity determining region 3 for antibody 29371
QQYGSSPFN

SEQ ID NO: 58742 - protein, 21 aa, Homo sapiens
  heavy chain complementarity determining region 3 for antibody 29371
ARVGVERNRYGRTLPVWYFDY

SEQ ID NO: 58743 - protein, 9 aa, Homo sapiens
  light chain complementarity determining region 3 for antibody 29372
QQYGSSPDT

SEQ ID NO: 58744 - protein, 16 aa, Homo sapiens
  heavy chain complementarity determining region 3 for antibody 29372
ATPGQHNSGWDYRFDY

SEQ ID NO: 58745 - protein, 9 aa, Homo sapiens
  light chain complementarity determining region 3 for antibody 29373
QQYGSSPDT

SEQ ID NO: 58746 - protein, 14 aa, Homo sapiens
  heavy chain complementarity determining region 3 for antibody 29373
AKGGPLGYYEYFQH

SEQ ID NO: 58747 - protein, 10 aa, Homo sapiens
  light chain complementarity determining region 3 for antibody 29374
QQYGSSPAPT

SEQ ID NO: 58748 - protein, 23 aa, Homo sapiens
  heavy chain complementarity determining region 3 for antibody 29374
ARAPSQYYYDSSGYYYPTNWFDP

SEQ ID NO: 58749 - protein, 10 aa, Homo sapiens
  light chain complementarity determining region 3 for antibody 29375
QQYGSSPALT

SEQ ID NO: 58750 - protein, 23 aa, Homo sapiens
  heavy chain complementarity determining region 3 for antibody 29375
ARAPSQYYYDSSGYYYPTSWFDP

SEQ ID NO: 58751 - protein, 10 aa, Homo sapiens
  light chain complementarity determining region 3 for antibody 29376
QQYGSSPALT

SEQ ID NO: 58752 - protein, 23 aa, Homo sapiens
  heavy chain complementarity determining region 3 for antibody 29376
ARAPSQYYYDSSGYYSPTNWFDP

SEQ ID NO: 58753 - protein, 9 aa, Homo sapiens
  light chain complementarity determining region 3 for antibody 29377
QQYGSSLYT

SEQ ID NO: 58754 - protein, 9 aa, Homo sapiens
  heavy chain complementarity determining region 3 for antibody 29377
IYGINAFDI

SEQ ID NO: 58755 - protein, 9 aa, Homo sapiens
  light chain complementarity determining region 3 for antibody 29378
QQYGSSLYT

SEQ ID NO: 58756 - protein, 16 aa, Homo sapiens
  heavy chain complementarity determining region 3 for antibody 29378
ATPGQHNSGWDYRFDY

SEQ ID NO: 58757 - protein, 9 aa, Homo sapiens
  light chain complementarity determining region 3 for antibody 29379
QQYGSSLYT

SEQ ID NO: 58758 - protein, 16 aa, Homo sapiens
  heavy chain complementarity determining region 3 for antibody 29379
ARAKHYGDYYYYGMDT

SEQ ID NO: 58759 - protein, 9 aa, Homo sapiens
  light chain complementarity determining region 3 for antibody 29380
QQYGSSLYT

SEQ ID NO: 58760 - protein, 15 aa, Homo sapiens
  heavy chain complementarity determining region 3 for antibody 29380
ARAKHYGDYYYGMDA

SEQ ID NO: 58761 - protein, 9 aa, Homo sapiens
  light chain complementarity determining region 3 for antibody 29381
QQYGSSLYT

SEQ ID NO: 58762 - protein, 15 aa, Homo sapiens
  heavy chain complementarity determining region 3 for antibody 29381
AGLPEYSSSWYYFDF

SEQ ID NO: 58763 - protein, 9 aa, Homo sapiens
  light chain complementarity determining region 3 for antibody 29382
QQYGSSLYP

SEQ ID NO: 58764 - protein, 16 aa, Homo sapiens
  heavy chain complementarity determining region 3 for antibody 29382
ARAKHYGDYYYYGMDA

SEQ ID NO: 58765 - protein, 9 aa, Homo sapiens
  light chain complementarity determining region 3 for antibody 29383
QQYGSSLST

SEQ ID NO: 58766 - protein, 15 aa, Homo sapiens
  heavy chain complementarity determining region 3 for antibody 29383
ARLPEYSSSWYYFDF

SEQ ID NO: 58767 - protein, 9 aa, Homo sapiens
  light chain complementarity determining region 3 for antibody 29384
QQYGSSLST

SEQ ID NO: 58768 - protein, 16 aa, Homo sapiens
  heavy chain complementarity determining region 3 for antibody 29384
ARAKHYGDYYYYGMDA

SEQ ID NO: 58769 - protein, 10 aa, Homo sapiens
  light chain complementarity determining region 3 for antibody 29385
QQYGSSLSLT

SEQ ID NO: 58770 - protein, 14 aa, Homo sapiens
  heavy chain complementarity determining region 3 for antibody 29385
ARLGLFPYYYGMDV

SEQ ID NO: 58771 - protein, 10 aa, Homo sapiens
  light chain complementarity determining region 3 for antibody 29386
QQYGSSLSLP

SEQ ID NO: 58772 - protein, 14 aa, Homo sapiens
  heavy chain complementarity determining region 3 for antibody 29386
ARLGLLPYYYGMDV

SEQ ID NO: 58773 - protein, 10 aa, Homo sapiens
  light chain complementarity determining region 3 for antibody 29387
QQYGSSLPST

SEQ ID NO: 58774 - protein, 23 aa, Homo sapiens
  heavy chain complementarity determining region 3 for antibody 29387
ARAQPRWGIAVAGPPGRYYGMDV

SEQ ID NO: 58775 - protein, 10 aa, Homo sapiens
  light chain complementarity determining region 3 for antibody 29388
QQYGSSLPRT

SEQ ID NO: 58776 - protein, 23 aa, Homo sapiens
  heavy chain complementarity determining region 3 for antibody 29388
ARAQPRWGIAVAGPPGRYYGMDV

SEQ ID NO: 58777 - protein, 10 aa, Homo sapiens
  light chain complementarity determining region 3 for antibody 29389
QQYGSSLPCP

SEQ ID NO: 58778 - protein, 23 aa, Homo sapiens
  heavy chain complementarity determining region 3 for antibody 29389
ARAQPRWGIAVAGPPGRYYGMDV

SEQ ID NO: 58779 - protein, 8 aa, Homo sapiens
  light chain complementarity determining region 3 for antibody 29390
QQYGSSLP

SEQ ID NO: 58780 - protein, 18 aa, Homo sapiens
  heavy chain complementarity determining region 3 for antibody 29390
ARAIVYDSSDYYRYYFDS

SEQ ID NO: 58781 - protein, 9 aa, Homo sapiens
  light chain complementarity determining region 3 for antibody 29391
QQYGSSLNT

SEQ ID NO: 58782 - protein, 9 aa, Homo sapiens
  heavy chain complementarity determining region 3 for antibody 29391
IYEINAFDI

SEQ ID NO: 58783 - protein, 10 aa, Homo sapiens
  light chain complementarity determining region 3 for antibody 29392
QQYGSSLLLT

SEQ ID NO: 58784 - protein, 14 aa, Homo sapiens
  heavy chain complementarity determining region 3 for antibody 29392
ARLGLLPYYYGMDV

SEQ ID NO: 58785 - protein, 10 aa, Homo sapiens
  light chain complementarity determining region 3 for antibody 29393
QQYGSSLLIP

SEQ ID NO: 58786 - protein, 17 aa, Homo sapiens
  heavy chain complementarity determining region 3 for antibody 29393
ARRSRYSSNWYSHFFDY

SEQ ID NO: 58787 - protein, 9 aa, Homo sapiens
  light chain complementarity determining region 3 for antibody 29394
QQYGSSLKT

SEQ ID NO: 58788 - protein, 9 aa, Homo sapiens
  heavy chain complementarity determining region 3 for antibody 29394
IYEINAFDI

SEQ ID NO: 58789 - protein, 10 aa, Homo sapiens
  light chain complementarity determining region 3 for antibody 29395
QQYGSSLGYT

SEQ ID NO: 58790 - protein, 13 aa, Homo sapiens
  heavy chain complementarity determining region 3 for antibody 29395
AHSGYQVYYGIDV

SEQ ID NO: 58791 - protein, 9 aa, Homo sapiens
  light chain complementarity determining region 3 for antibody 29396
QQYGSSLFT

SEQ ID NO: 58792 - protein, 16 aa, Homo sapiens
  heavy chain complementarity determining region 3 for antibody 29396
ATTQYCLAGGHCYFGT

SEQ ID NO: 58793 - protein, 10 aa, Homo sapiens
  light chain complementarity determining region 3 for antibody 29397
QQYGSSHPLT

SEQ ID NO: 58794 - protein, 20 aa, Homo sapiens
  heavy chain complementarity determining region 3 for antibody 29397
ARLRKQLVLSNVYYYYGMDV

SEQ ID NO: 58795 - protein, 10 aa, Homo sapiens
  light chain complementarity determining region 3 for antibody 29398
QQYGSSHPFT

SEQ ID NO: 58796 - protein, 14 aa, Homo sapiens
  heavy chain complementarity determining region 3 for antibody 29398
ARDLRWLVLGRLDY

SEQ ID NO: 58797 - protein, 9 aa, Homo sapiens
  light chain complementarity determining region 3 for antibody 29399
QQYGSSHIT

SEQ ID NO: 58798 - protein, 23 aa, Homo sapiens
  heavy chain complementarity determining region 3 for antibody 29399
AKDGLESYYDSSGANLAYWYFDL

SEQ ID NO: 58799 - protein, 9 aa, Homo sapiens
  light chain complementarity determining region 3 for antibody 29400
QQYGSPWWT

SEQ ID NO: 58800 - protein, 15 aa, Homo sapiens
  heavy chain complementarity determining region 3 for antibody 29400
ARHRARDSIGYYHDF

SEQ ID NO: 58801 - protein, 9 aa, Homo sapiens
  light chain complementarity determining region 3 for antibody 29401
QQYGSPWWN

SEQ ID NO: 58802 - protein, 15 aa, Homo sapiens
  heavy chain complementarity determining region 3 for antibody 29401
ARHMARDSIGYYHDF

SEQ ID NO: 58803 - protein, 9 aa, Homo sapiens
  light chain complementarity determining region 3 for antibody 29402
QQYGSPWWA

SEQ ID NO: 58804 - protein, 15 aa, Homo sapiens
  heavy chain complementarity determining region 3 for antibody 29402
ARHMARDSIGYYHDF

SEQ ID NO: 58805 - protein, 9 aa, Homo sapiens
  light chain complementarity determining region 3 for antibody 29403
QQYGSPWGT

SEQ ID NO: 58806 - protein, 15 aa, Homo sapiens
  heavy chain complementarity determining region 3 for antibody 29403
ARHMARDSIGYYHDF

SEQ ID NO: 58807 - protein, 11 aa, Homo sapiens
  light chain complementarity determining region 3 for antibody 29404
QQYGSPVPVIS

SEQ ID NO: 58808 - protein, 16 aa, Homo sapiens
  heavy chain complementarity determining region 3 for antibody 29404
VKDQVAANGICDPFDI

SEQ ID NO: 58809 - protein, 11 aa, Homo sapiens
  light chain complementarity determining region 3 for antibody 29405
QQYGSPVPGFS

SEQ ID NO: 58810 - protein, 16 aa, Homo sapiens
  heavy chain complementarity determining region 3 for antibody 29405
VKDQVAANGICDPFDI

SEQ ID NO: 58811 - protein, 11 aa, Homo sapiens
  light chain complementarity determining region 3 for antibody 29406
QQYGSPVLVYS

SEQ ID NO: 58812 - protein, 16 aa, Homo sapiens
  heavy chain complementarity determining region 3 for antibody 29406
VKDQVAANGICDPFDI

SEQ ID NO: 58813 - protein, 10 aa, Homo sapiens
  light chain complementarity determining region 3 for antibody 29407
QQYGSPTPFT

SEQ ID NO: 58814 - protein, 13 aa, Homo sapiens
  heavy chain complementarity determining region 3 for antibody 29407
ARVVVPGRGYFQH

SEQ ID NO: 58815 - protein, 9 aa, Homo sapiens
  light chain complementarity determining region 3 for antibody 29408
QQYGSPPYA

SEQ ID NO: 58816 - protein, 13 aa, Homo sapiens
  heavy chain complementarity determining region 3 for antibody 29408
ARALQYSGRIFDY

SEQ ID NO: 58817 - protein, 9 aa, Homo sapiens
  light chain complementarity determining region 3 for antibody 29409
QQYGSPPVT

SEQ ID NO: 58818 - protein, 11 aa, Homo sapiens
  heavy chain complementarity determining region 3 for antibody 29409
ARGGYYTHAGP

SEQ ID NO: 58819 - protein, 9 aa, Homo sapiens
  light chain complementarity determining region 3 for antibody 29410
QQYGSPPRT

SEQ ID NO: 58820 - protein, 15 aa, Homo sapiens
  heavy chain complementarity determining region 3 for antibody 29410
ARANGVIITTGVLRY

SEQ ID NO: 58821 - protein, 9 aa, Homo sapiens
  light chain complementarity determining region 3 for antibody 29411
QQYGSPPPT

SEQ ID NO: 58822 - protein, 17 aa, Homo sapiens
  heavy chain complementarity determining region 3 for antibody 29411
ARPYFGPVRAGTNGYDM

SEQ ID NO: 58823 - protein, 9 aa, Homo sapiens
  light chain complementarity determining region 3 for antibody 29412
QQYGSPPPT

SEQ ID NO: 58824 - protein, 12 aa, Homo sapiens
  heavy chain complementarity determining region 3 for antibody 29412
ARGPQLWFYFDY

SEQ ID NO: 58825 - protein, 9 aa, Homo sapiens
  light chain complementarity determining region 3 for antibody 29413
QQYGSPLYT

SEQ ID NO: 58826 - protein, 9 aa, Homo sapiens
  heavy chain complementarity determining region 3 for antibody 29413
IYEINAFDI

SEQ ID NO: 58827 - protein, 9 aa, Homo sapiens
  light chain complementarity determining region 3 for antibody 29414
QQYGSLRLT

SEQ ID NO: 58828 - protein, 15 aa, Homo sapiens
  heavy chain complementarity determining region 3 for antibody 29414
AHRPNYYDKAGAFDI

SEQ ID NO: 58829 - protein, 9 aa, Homo sapiens
  light chain complementarity determining region 3 for antibody 29415
QQYGSLPWT

SEQ ID NO: 58830 - protein, 12 aa, Homo sapiens
  heavy chain complementarity determining region 3 for antibody 29415
ARGLRLGWGLDY

SEQ ID NO: 58831 - protein, 9 aa, Homo sapiens
  light chain complementarity determining region 3 for antibody 29416
QQYGSLPTT

SEQ ID NO: 58832 - protein, 15 aa, Homo sapiens
  heavy chain complementarity determining region 3 for antibody 29416
AHRPNYYDKAGAFDI

SEQ ID NO: 58833 - protein, 9 aa, Homo sapiens
  light chain complementarity determining region 3 for antibody 29417
QQYGSLPRT

SEQ ID NO: 58834 - protein, 15 aa, Homo sapiens
  heavy chain complementarity determining region 3 for antibody 29417
ARANGVIITTGVLRY

SEQ ID NO: 58835 - protein, 9 aa, Homo sapiens
  light chain complementarity determining region 3 for antibody 29418
QQYGSLPRT

SEQ ID NO: 58836 - protein, 13 aa, Homo sapiens
  heavy chain complementarity determining region 3 for antibody 29418
AGGNFHSGGYGEY

SEQ ID NO: 58837 - protein, 9 aa, Homo sapiens
  light chain complementarity determining region 3 for antibody 29419
QQYGSLPRT

SEQ ID NO: 58838 - protein, 14 aa, Homo sapiens
  heavy chain complementarity determining region 3 for antibody 29419
AGGKFCGGDCYRDY

SEQ ID NO: 58839 - protein, 9 aa, Homo sapiens
  light chain complementarity determining region 3 for antibody 29420
QQYGSLPRT

SEQ ID NO: 58840 - protein, 14 aa, Homo sapiens
  heavy chain complementarity determining region 3 for antibody 29420
AGGDVCGSDCYSEY

SEQ ID NO: 58841 - protein, 9 aa, Homo sapiens
  light chain complementarity determining region 3 for antibody 29421
QQYGSLPRP

SEQ ID NO: 58842 - protein, 15 aa, Homo sapiens
  heavy chain complementarity determining region 3 for antibody 29421
AHRPNYYDKAGAFDI

SEQ ID NO: 58843 - protein, 9 aa, Homo sapiens
  light chain complementarity determining region 3 for antibody 29422
QQYGSLPRP

SEQ ID NO: 58844 - protein, 14 aa, Homo sapiens
  heavy chain complementarity determining region 3 for antibody 29422
AGGKFCGGDCYREY

SEQ ID NO: 58845 - protein, 9 aa, Homo sapiens
  light chain complementarity determining region 3 for antibody 29423
QQYGSLPQT

SEQ ID NO: 58846 - protein, 11 aa, Homo sapiens
  heavy chain complementarity determining region 3 for antibody 29423
ARGDLWSAFDI

SEQ ID NO: 58847 - protein, 9 aa, Homo sapiens
  light chain complementarity determining region 3 for antibody 29424
QQYGSLPQT

SEQ ID NO: 58848 - protein, 14 aa, Homo sapiens
  heavy chain complementarity determining region 3 for antibody 29424
AGGDFCGSDCYSEY

SEQ ID NO: 58849 - protein, 10 aa, Homo sapiens
  light chain complementarity determining region 3 for antibody 29425
QQYGSLPPFT

SEQ ID NO: 58850 - protein, 14 aa, Homo sapiens
  heavy chain complementarity determining region 3 for antibody 29425
ARDLRWLVLGRLDY

SEQ ID NO: 58851 - protein, 9 aa, Homo sapiens
  light chain complementarity determining region 3 for antibody 29426
QQYGSLPLT

SEQ ID NO: 58852 - protein, 15 aa, Homo sapiens
  heavy chain complementarity determining region 3 for antibody 29426
AYRPNYYDKAGAFDI

SEQ ID NO: 58853 - protein, 9 aa, Homo sapiens
  light chain complementarity determining region 3 for antibody 29427
QQYGSLPLT

SEQ ID NO: 58854 - protein, 15 aa, Homo sapiens
  heavy chain complementarity determining region 3 for antibody 29427
ARRPNYYDKAGAFDI

SEQ ID NO: 58855 - protein, 9 aa, Homo sapiens
  light chain complementarity determining region 3 for antibody 29428
QQYGSLPLT

SEQ ID NO: 58856 - protein, 19 aa, Homo sapiens
  heavy chain complementarity determining region 3 for antibody 29428
ARGSSSSRRRAAVVGYFDL

SEQ ID NO: 58857 - protein, 9 aa, Homo sapiens
  light chain complementarity determining region 3 for antibody 29429
QQYGSLPLT

SEQ ID NO: 58858 - protein, 15 aa, Homo sapiens
  heavy chain complementarity determining region 3 for antibody 29429
AKDEGGWYSGDAFDI

SEQ ID NO: 58859 - protein, 9 aa, Homo sapiens
  light chain complementarity determining region 3 for antibody 29430
QQYGSLPLT

SEQ ID NO: 58860 - protein, 15 aa, Homo sapiens
  heavy chain complementarity determining region 3 for antibody 29430
AHRPSYYDKAGAFDI

SEQ ID NO: 58861 - protein, 9 aa, Homo sapiens
  light chain complementarity determining region 3 for antibody 29431
QQYGSLPLT

SEQ ID NO: 58862 - protein, 15 aa, Homo sapiens
  heavy chain complementarity determining region 3 for antibody 29431
AHRPNYYDNAGAFDI

SEQ ID NO: 58863 - protein, 9 aa, Homo sapiens
  light chain complementarity determining region 3 for antibody 29432
QQYGSLPLT

SEQ ID NO: 58864 - protein, 15 aa, Homo sapiens
  heavy chain complementarity determining region 3 for antibody 29432
AHRPNYYDKSGAFDI

SEQ ID NO: 58865 - protein, 9 aa, Homo sapiens
  light chain complementarity determining region 3 for antibody 29433
QQYGSLPLT

SEQ ID NO: 58866 - protein, 15 aa, Homo sapiens
  heavy chain complementarity determining region 3 for antibody 29433
AHRPNYYDKASAFDI

SEQ ID NO: 58867 - protein, 9 aa, Homo sapiens
  light chain complementarity determining region 3 for antibody 29434
QQYGSLPLT

SEQ ID NO: 58868 - protein, 15 aa, Homo sapiens
  heavy chain complementarity determining region 3 for antibody 29434
AHRANYYDKAGAFDI

SEQ ID NO: 58869 - protein, 9 aa, Homo sapiens
  light chain complementarity determining region 3 for antibody 29435
QQYGSKPRT

SEQ ID NO: 58870 - protein, 14 aa, Homo sapiens
  heavy chain complementarity determining region 3 for antibody 29435
AGGKFCGGDCYREY

SEQ ID NO: 58871 - protein, 9 aa, Homo sapiens
  light chain complementarity determining region 3 for antibody 29436
QQYGSIPRT

SEQ ID NO: 58872 - protein, 14 aa, Homo sapiens
  heavy chain complementarity determining region 3 for antibody 29436
AGGKLCGGDCYREY

SEQ ID NO: 58873 - protein, 9 aa, Homo sapiens
  light chain complementarity determining region 3 for antibody 29437
QQYGSIPRT

SEQ ID NO: 58874 - protein, 13 aa, Homo sapiens
  heavy chain complementarity determining region 3 for antibody 29437
AGGKFCGGDCWEY

SEQ ID NO: 58875 - protein, 9 aa, Homo sapiens
  light chain complementarity determining region 3 for antibody 29438
QQYGSIPRT

SEQ ID NO: 58876 - protein, 14 aa, Homo sapiens
  heavy chain complementarity determining region 3 for antibody 29438
AGGKFCGGACYREY

SEQ ID NO: 58877 - protein, 9 aa, Homo sapiens
  light chain complementarity determining region 3 for antibody 29439
QQYGSIPRT

SEQ ID NO: 58878 - protein, 14 aa, Homo sapiens
  heavy chain complementarity determining region 3 for antibody 29439
AGGKCCGGACYREY

SEQ ID NO: 58879 - protein, 9 aa, Homo sapiens
  light chain complementarity determining region 3 for antibody 29440
QQYGSIPRT

SEQ ID NO: 58880 - protein, 14 aa, Homo sapiens
  heavy chain complementarity determining region 3 for antibody 29440
AGGDSCGGDCYSEY

SEQ ID NO: 58881 - protein, 9 aa, Homo sapiens
  light chain complementarity determining region 3 for antibody 29441
QQYGSIPRT

SEQ ID NO: 58882 - protein, 14 aa, Homo sapiens
  heavy chain complementarity determining region 3 for antibody 29441
AGGDLCGGDCYSEY

SEQ ID NO: 58883 - protein, 9 aa, Homo sapiens
  light chain complementarity determining region 3 for antibody 29442
QQYGSIPPT

SEQ ID NO: 58884 - protein, 14 aa, Homo sapiens
  heavy chain complementarity determining region 3 for antibody 29442
AGGDFCGGDCYSEY

SEQ ID NO: 58885 - protein, 9 aa, Homo sapiens
  light chain complementarity determining region 3 for antibody 29443
QQYGSIPLT

SEQ ID NO: 58886 - protein, 14 aa, Homo sapiens
  heavy chain complementarity determining region 3 for antibody 29443
AGGKFCGGDCYREY

SEQ ID NO: 58887 - protein, 9 aa, Homo sapiens
  light chain complementarity determining region 3 for antibody 29444
QQYGSFPYT

SEQ ID NO: 58888 - protein, 14 aa, Homo sapiens
  heavy chain complementarity determining region 3 for antibody 29444
VRGGMIVAWGLFDY

SEQ ID NO: 58889 - protein, 9 aa, Homo sapiens
  light chain complementarity determining region 3 for antibody 29445
QQYGSFPYP

SEQ ID NO: 58890 - protein, 14 aa, Homo sapiens
  heavy chain complementarity determining region 3 for antibody 29445
VRGGMIVAWGLFDY

SEQ ID NO: 58891 - protein, 9 aa, Homo sapiens
  light chain complementarity determining region 3 for antibody 29446
QQYGSFPST

SEQ ID NO: 58892 - protein, 14 aa, Homo sapiens
  heavy chain complementarity determining region 3 for antibody 29446
ARGGFIVAWGLFDY

SEQ ID NO: 58893 - protein, 9 aa, Homo sapiens
  light chain complementarity determining region 3 for antibody 29447
QQYGSFPHT

SEQ ID NO: 58894 - protein, 14 aa, Homo sapiens
  heavy chain complementarity determining region 3 for antibody 29447
ARGGFIVAWGLFDY

SEQ ID NO: 58895 - protein, 9 aa, Homo sapiens
  light chain complementarity determining region 3 for antibody 29448
QQYGSFLYT

SEQ ID NO: 58896 - protein, 9 aa, Homo sapiens
  heavy chain complementarity determining region 3 for antibody 29448
IYEINAFDI

SEQ ID NO: 58897 - protein, 8 aa, Homo sapiens
  light chain complementarity determining region 3 for antibody 29449
QQYGSFFT

SEQ ID NO: 58898 - protein, 14 aa, Homo sapiens
  heavy chain complementarity determining region 3 for antibody 29449
ARHGPGSPWSYLDN

SEQ ID NO: 58899 - protein, 9 aa, Homo sapiens
  light chain complementarity determining region 3 for antibody 29450
QQYGRTWWP

SEQ ID NO: 58900 - protein, 15 aa, Homo sapiens
  heavy chain complementarity determining region 3 for antibody 29450
ARHMARDSIGYYHDF

SEQ ID NO: 58901 - protein, 9 aa, Homo sapiens
  light chain complementarity determining region 3 for antibody 29451
QQYGRTPST

SEQ ID NO: 58902 - protein, 14 aa, Homo sapiens
  heavy chain complementarity determining region 3 for antibody 29451
AREWVSTIRGWFDP

SEQ ID NO: 58903 - protein, 9 aa, Homo sapiens
  light chain complementarity determining region 3 for antibody 29452
QQYGRSWVT

SEQ ID NO: 58904 - protein, 20 aa, Homo sapiens
  heavy chain complementarity determining region 3 for antibody 29452
AREGGHRQWLEIYDPGYFHH

SEQ ID NO: 58905 - protein, 9 aa, Homo sapiens
  light chain complementarity determining region 3 for antibody 29453
QQYGRSWVP

SEQ ID NO: 58906 - protein, 20 aa, Homo sapiens
  heavy chain complementarity determining region 3 for antibody 29453
AREGGHRQWLEIYDPGYFHH

SEQ ID NO: 58907 - protein, 9 aa, Homo sapiens
  light chain complementarity determining region 3 for antibody 29454
QQYGRSWGT

SEQ ID NO: 58908 - protein, 15 aa, Homo sapiens
  heavy chain complementarity determining region 3 for antibody 29454
ARHVARDDIGYYHDL

SEQ ID NO: 58909 - protein, 9 aa, Homo sapiens
  light chain complementarity determining region 3 for antibody 29455
QQYGRSVLT

SEQ ID NO: 58910 - protein, 17 aa, Homo sapiens
  heavy chain complementarity determining region 3 for antibody 29455
ARPGSGFGYDNEDAFDI

SEQ ID NO: 58911 - protein, 9 aa, Homo sapiens
  light chain complementarity determining region 3 for antibody 29456
QQYGRSPYT

SEQ ID NO: 58912 - protein, 9 aa, Homo sapiens
  heavy chain complementarity determining region 3 for antibody 29456
ARETEGFDI

SEQ ID NO: 58913 - protein, 9 aa, Homo sapiens
  light chain complementarity determining region 3 for antibody 29457
QQYGRSPWT

SEQ ID NO: 58914 - protein, 18 aa, Homo sapiens
  heavy chain complementarity determining region 3 for antibody 29457
ATNPSIAEPGSIYWYFDL

SEQ ID NO: 58915 - protein, 9 aa, Homo sapiens
  light chain complementarity determining region 3 for antibody 29458
QQYGRSPWT

SEQ ID NO: 58916 - protein, 14 aa, Homo sapiens
  heavy chain complementarity determining region 3 for antibody 29458
ARGQSGSLYDTFDM

SEQ ID NO: 58917 - protein, 10 aa, Homo sapiens
  light chain complementarity determining region 3 for antibody 29459
QQYGRSPWGV

SEQ ID NO: 58918 - protein, 17 aa, Homo sapiens
  heavy chain complementarity determining region 3 for antibody 29459
AKDYGTVTKDLVGYLDY

SEQ ID NO: 58919 - protein, 11 aa, Homo sapiens
  light chain complementarity determining region 3 for antibody 29460
QQYGRSPSGYT

SEQ ID NO: 58920 - protein, 14 aa, Homo sapiens
  heavy chain complementarity determining region 3 for antibody 29460
ARETNNSRKRSFDQ

SEQ ID NO: 58921 - protein, 9 aa, Homo sapiens
  light chain complementarity determining region 3 for antibody 29461
QQYGRSPRT

SEQ ID NO: 58922 - protein, 11 aa, Homo sapiens
  heavy chain complementarity determining region 3 for antibody 29461
TLSGYLAAFDI

SEQ ID NO: 58923 - protein, 9 aa, Homo sapiens
  light chain complementarity determining region 3 for antibody 29462
QQYGRSPRT

SEQ ID NO: 58924 - protein, 13 aa, Homo sapiens
  heavy chain complementarity determining region 3 for antibody 29462
ASSGYGDYDDLPY

SEQ ID NO: 58925 - protein, 9 aa, Homo sapiens
  light chain complementarity determining region 3 for antibody 29463
QQYGRSPRT

SEQ ID NO: 58926 - protein, 15 aa, Homo sapiens
  heavy chain complementarity determining region 3 for antibody 29463
AKEGEFCGSNCYFGS

SEQ ID NO: 58927 - protein, 9 aa, Homo sapiens
  light chain complementarity determining region 3 for antibody 29464
QQYGRSPRT

SEQ ID NO: 58928 - protein, 15 aa, Homo sapiens
  heavy chain complementarity determining region 3 for antibody 29464
AKDGPYCGSDCYFEF

SEQ ID NO: 58929 - protein, 9 aa, Homo sapiens
  light chain complementarity determining region 3 for antibody 29465
QQYGRSPRT

SEQ ID NO: 58930 - protein, 15 aa, Homo sapiens
  heavy chain complementarity determining region 3 for antibody 29465
AKDGEFCGSNCYFGP

SEQ ID NO: 58931 - protein, 11 aa, Homo sapiens
  light chain complementarity determining region 3 for antibody 29466
QQYGRSPPGDT

SEQ ID NO: 58932 - protein, 14 aa, Homo sapiens
  heavy chain complementarity determining region 3 for antibody 29466
ARETNNSRKRSFDQ

SEQ ID NO: 58933 - protein, 11 aa, Homo sapiens
  light chain complementarity determining region 3 for antibody 29467
QQYGRSPPGCT

SEQ ID NO: 58934 - protein, 14 aa, Homo sapiens
  heavy chain complementarity determining region 3 for antibody 29467
ARETNNSRKRSFDQ

SEQ ID NO: 58935 - protein, 9 aa, Homo sapiens
  light chain complementarity determining region 3 for antibody 29468
QQYGRSPLT

SEQ ID NO: 58936 - protein, 11 aa, Homo sapiens
  heavy chain complementarity determining region 3 for antibody 29468
AREGTYKPHDY

SEQ ID NO: 58937 - protein, 9 aa, Homo sapiens
  light chain complementarity determining region 3 for antibody 29469
QQYGRSPGT

SEQ ID NO: 58938 - protein, 18 aa, Homo sapiens
  heavy chain complementarity determining region 3 for antibody 29469
ATMPSLAEPGRIYWYFDL

SEQ ID NO: 58939 - protein, 9 aa, Homo sapiens
  light chain complementarity determining region 3 for antibody 29470
QQYGRSPGT

SEQ ID NO: 58940 - protein, 16 aa, Homo sapiens
  heavy chain complementarity determining region 3 for antibody 29470
ARAVWGASWSVGWFDS

SEQ ID NO: 58941 - protein, 9 aa, Homo sapiens
  light chain complementarity determining region 3 for antibody 29471
QQYGRSPFT

SEQ ID NO: 58942 - protein, 23 aa, Homo sapiens
  heavy chain complementarity determining region 3 for antibody 29471
ARGLRSSDWSKIMDMDSYYALDV

SEQ ID NO: 58943 - protein, 9 aa, Homo sapiens
  light chain complementarity determining region 3 for antibody 29472
QQYGRSPDT

SEQ ID NO: 58944 - protein, 26 aa, Homo sapiens
  heavy chain complementarity determining region 3 for antibody 29472
ARDSHLGFYDDTNGYYVPHYYNGMDV

SEQ ID NO: 58945 - protein, 9 aa, Homo sapiens
  light chain complementarity determining region 3 for antibody 29473
QQYGRSPCT

SEQ ID NO: 58946 - protein, 18 aa, Homo sapiens
  heavy chain complementarity determining region 3 for antibody 29473
ATNPSIAEPGNIYWYFDL

SEQ ID NO: 58947 - protein, 8 aa, Homo sapiens
  light chain complementarity determining region 3 for antibody 29474
QQYGRSIT

SEQ ID NO: 58948 - protein, 15 aa, Homo sapiens
  heavy chain complementarity determining region 3 for antibody 29474
VRNFGSGTYHDAFHI

SEQ ID NO: 58949 - protein, 9 aa, Homo sapiens
  light chain complementarity determining region 3 for antibody 29475
QQYGRPPWT

SEQ ID NO: 58950 - protein, 18 aa, Homo sapiens
  heavy chain complementarity determining region 3 for antibody 29475
ATNPSIAEPGNIYWYFDL

SEQ ID NO: 58951 - protein, 9 aa, Homo sapiens
  light chain complementarity determining region 3 for antibody 29476
QQYGRPPLT

SEQ ID NO: 58952 - protein, 19 aa, Homo sapiens
  heavy chain complementarity determining region 3 for antibody 29476
ARTNTYYDSTGYYFLDFDY

SEQ ID NO: 58953 - protein, 9 aa, Homo sapiens
  light chain complementarity determining region 3 for antibody 29477
QQYGRLPWT

SEQ ID NO: 58954 - protein, 18 aa, Homo sapiens
  heavy chain complementarity determining region 3 for antibody 29477
ATMPSLAEPGRIYWYFDL

SEQ ID NO: 58955 - protein, 9 aa, Homo sapiens
  light chain complementarity determining region 3 for antibody 29478
QQYGRLPRT

SEQ ID NO: 58956 - protein, 14 aa, Homo sapiens
  heavy chain complementarity determining region 3 for antibody 29478
AGGKFCGGDCYREY

SEQ ID NO: 58957 - protein, 9 aa, Homo sapiens
  light chain complementarity determining region 3 for antibody 29479
QQYGRLPRT

SEQ ID NO: 58958 - protein, 14 aa, Homo sapiens
  heavy chain complementarity determining region 3 for antibody 29479
AGGDFCGSDCYSEY

SEQ ID NO: 58959 - protein, 9 aa, Homo sapiens
  light chain complementarity determining region 3 for antibody 29480
QQYGRLPRP

SEQ ID NO: 58960 - protein, 14 aa, Homo sapiens
  heavy chain complementarity determining region 3 for antibody 29480
AGGKFCGGDCYREY

SEQ ID NO: 58961 - protein, 9 aa, Homo sapiens
  light chain complementarity determining region 3 for antibody 29481
QQYGRLPLT

SEQ ID NO: 58962 - protein, 11 aa, Homo sapiens
  heavy chain complementarity determining region 3 for antibody 29481
AREGNYKPHDY

SEQ ID NO: 58963 - protein, 9 aa, Homo sapiens
  light chain complementarity determining region 3 for antibody 29482
QQYGRLPLT

SEQ ID NO: 58964 - protein, 11 aa, Homo sapiens
  heavy chain complementarity determining region 3 for antibody 29482
AHRFRTYYFDF

SEQ ID NO: 58965 - protein, 9 aa, Homo sapiens
  light chain complementarity determining region 3 for antibody 29483
QQYGRLPIT

SEQ ID NO: 58966 - protein, 15 aa, Homo sapiens
  heavy chain complementarity determining region 3 for antibody 29483
AHRPNYYDKAGAFDI

SEQ ID NO: 58967 - protein, 9 aa, Homo sapiens
  light chain complementarity determining region 3 for antibody 29484
QQYGRLPIT

SEQ ID NO: 58968 - protein, 11 aa, Homo sapiens
  heavy chain complementarity determining region 3 for antibody 29484
AHRFRTYSFDF

SEQ ID NO: 58969 - protein, 9 aa, Homo sapiens
  light chain complementarity determining region 3 for antibody 29485
QQYGRLPIP

SEQ ID NO: 58970 - protein, 11 aa, Homo sapiens
  heavy chain complementarity determining region 3 for antibody 29485
AHRFRTYYFDF

SEQ ID NO: 58971 - protein, 9 aa, Homo sapiens
  light chain complementarity determining region 3 for antibody 29486
QQYGRFPPT

SEQ ID NO: 58972 - protein, 17 aa, Homo sapiens
  heavy chain complementarity determining region 3 for antibody 29486
ARGLMERWLVPLYYFDL

SEQ ID NO: 58973 - protein, 9 aa, Homo sapiens
  light chain complementarity determining region 3 for antibody 29487
QQYGRAPWT

SEQ ID NO: 58974 - protein, 18 aa, Homo sapiens
  heavy chain complementarity determining region 3 for antibody 29487
ATMPSLAEPGRIYWYFDL

SEQ ID NO: 58975 - protein, 9 aa, Homo sapiens
  light chain complementarity determining region 3 for antibody 29488
QQYGPTGGT

SEQ ID NO: 58976 - protein, 19 aa, Homo sapiens
  heavy chain complementarity determining region 3 for antibody 29488
AREAYYDSSGYFPSRYFDL

SEQ ID NO: 58977 - protein, 9 aa, Homo sapiens
  light chain complementarity determining region 3 for antibody 29489
QQYGPSPRT

SEQ ID NO: 58978 - protein, 13 aa, Homo sapiens
  heavy chain complementarity determining region 3 for antibody 29489
PIGFYDRSGYHEY

SEQ ID NO: 58979 - protein, 11 aa, Homo sapiens
  light chain complementarity determining region 3 for antibody 29490
QQYGPSPPPYT

SEQ ID NO: 58980 - protein, 10 aa, Homo sapiens
  heavy chain complementarity determining region 3 for antibody 29490
ARNDVYRIDH

SEQ ID NO: 58981 - protein, 11 aa, Homo sapiens
  light chain complementarity determining region 3 for antibody 29491
QQYGPSPPPYP

SEQ ID NO: 58982 - protein, 10 aa, Homo sapiens
  heavy chain complementarity determining region 3 for antibody 29491
ARNDVYRIDH

SEQ ID NO: 58983 - protein, 9 aa, Homo sapiens
  light chain complementarity determining region 3 for antibody 29492
QQYGPLPST

SEQ ID NO: 58984 - protein, 17 aa, Homo sapiens
  heavy chain complementarity determining region 3 for antibody 29492
ARPSYGSGRHGRYPLDP

SEQ ID NO: 58985 - protein, 9 aa, Homo sapiens
  light chain complementarity determining region 3 for antibody 29493
QQYGNVPYT

SEQ ID NO: 58986 - protein, 15 aa, Homo sapiens
  heavy chain complementarity determining region 3 for antibody 29493
VRDHSSTYYVDYYDL

SEQ ID NO: 58987 - protein, 9 aa, Homo sapiens
  light chain complementarity determining region 3 for antibody 29494
QQYGNVPDT

SEQ ID NO: 58988 - protein, 15 aa, Homo sapiens
  heavy chain complementarity determining region 3 for antibody 29494
VRDHSNTYYVDYYDL

SEQ ID NO: 58989 - protein, 9 aa, Homo sapiens
  light chain complementarity determining region 3 for antibody 29495
QQYGNSRWT

SEQ ID NO: 58990 - protein, 13 aa, Homo sapiens
  heavy chain complementarity determining region 3 for antibody 29495
ARTGEEIPDVFDV

SEQ ID NO: 58991 - protein, 9 aa, Homo sapiens
  light chain complementarity determining region 3 for antibody 29496
QQYGNSPWT

SEQ ID NO: 58992 - protein, 17 aa, Homo sapiens
  heavy chain complementarity determining region 3 for antibody 29496
ALASGAAPGRIQWYFDL

SEQ ID NO: 58993 - protein, 9 aa, Homo sapiens
  light chain complementarity determining region 3 for antibody 29497
QQYGNSPWT

SEQ ID NO: 58994 - protein, 17 aa, Homo sapiens
  heavy chain complementarity determining region 3 for antibody 29497
ALARVAAPGRIQWYFDL

SEQ ID NO: 58995 - protein, 9 aa, Homo sapiens
  light chain complementarity determining region 3 for antibody 29498
QQYGNSPWP

SEQ ID NO: 58996 - protein, 17 aa, Homo sapiens
  heavy chain complementarity determining region 3 for antibody 29498
ALASVAAPGRIQWYFDL

SEQ ID NO: 58997 - protein, 9 aa, Homo sapiens
  light chain complementarity determining region 3 for antibody 29499
QQYGNSPWK

SEQ ID NO: 58998 - protein, 17 aa, Homo sapiens
  heavy chain complementarity determining region 3 for antibody 29499
ALASVAAPGRIQWYFDL

SEQ ID NO: 58999 - protein, 9 aa, Homo sapiens
  light chain complementarity determining region 3 for antibody 29500
QQYGNSPRT

SEQ ID NO: 59000 - protein, 13 aa, Homo sapiens
  heavy chain complementarity determining region 3 for antibody 29500
ASKTSVRTYSSDL

SEQ ID NO: 59001 - protein, 9 aa, Homo sapiens
  light chain complementarity determining region 3 for antibody 29501
QQYGNSPLT

SEQ ID NO: 59002 - protein, 13 aa, Homo sapiens
  heavy chain complementarity determining region 3 for antibody 29501
ASKTSVRTYSADL

SEQ ID NO: 59003 - protein, 9 aa, Homo sapiens
  light chain complementarity determining region 3 for antibody 29502
QQYGNSPLT

SEQ ID NO: 59004 - protein, 13 aa, Homo sapiens
  heavy chain complementarity determining region 3 for antibody 29502
ASKTSVRPYSSDL

SEQ ID NO: 59005 - protein, 9 aa, Homo sapiens
  light chain complementarity determining region 3 for antibody 29503
QQYGNSPLT

SEQ ID NO: 59006 - protein, 15 aa, Homo sapiens
  heavy chain complementarity determining region 3 for antibody 29503
ARQKGQRASAGYFDS

SEQ ID NO: 59007 - protein, 9 aa, Homo sapiens
  light chain complementarity determining region 3 for antibody 29504
QQYGNSPLT

SEQ ID NO: 59008 - protein, 13 aa, Homo sapiens
  heavy chain complementarity determining region 3 for antibody 29504
ARKTSVRTYSSDL

SEQ ID NO: 59009 - protein, 9 aa, Homo sapiens
  light chain complementarity determining region 3 for antibody 29505
QQYGNSPLT

SEQ ID NO: 59010 - protein, 16 aa, Homo sapiens
  heavy chain complementarity determining region 3 for antibody 29505
AKDRYGGVMPTYYFDS

SEQ ID NO: 59011 - protein, 9 aa, Homo sapiens
  light chain complementarity determining region 3 for antibody 29506
QQYGNSPLL

SEQ ID NO: 59012 - protein, 13 aa, Homo sapiens
  heavy chain complementarity determining region 3 for antibody 29506
ASKTSVRTYSSDL

SEQ ID NO: 59013 - protein, 9 aa, Homo sapiens
  light chain complementarity determining region 3 for antibody 29507
QQYGNSPLI

SEQ ID NO: 59014 - protein, 13 aa, Homo sapiens
  heavy chain complementarity determining region 3 for antibody 29507
ASKTSVRTYSSDL

SEQ ID NO: 59015 - protein, 9 aa, Homo sapiens
  light chain complementarity determining region 3 for antibody 29508
QQYGNSPCT

SEQ ID NO: 59016 - protein, 17 aa, Homo sapiens
  heavy chain complementarity determining region 3 for antibody 29508
ALASVAAPGRIQWYFDL

SEQ ID NO: 59017 - protein, 10 aa, Homo sapiens
  light chain complementarity determining region 3 for antibody 29509
QQYGNPTQTT

SEQ ID NO: 59018 - protein, 16 aa, Homo sapiens
  heavy chain complementarity determining region 3 for antibody 29509
TREIRGVIKPEEDFDY

SEQ ID NO: 59019 - protein, 10 aa, Homo sapiens
  light chain complementarity determining region 3 for antibody 29510
QQYGNPTQIT

SEQ ID NO: 59020 - protein, 16 aa, Homo sapiens
  heavy chain complementarity determining region 3 for antibody 29510
TRESRGVIKPEEDFDY

SEQ ID NO: 59021 - protein, 10 aa, Homo sapiens
  light chain complementarity determining region 3 for antibody 29511
QQYGNPTQIT

SEQ ID NO: 59022 - protein, 16 aa, Homo sapiens
  heavy chain complementarity determining region 3 for antibody 29511
TREMRGVIKPEEDFDY

SEQ ID NO: 59023 - protein, 10 aa, Homo sapiens
  light chain complementarity determining region 3 for antibody 29512
QQYGNPTQIT

SEQ ID NO: 59024 - protein, 16 aa, Homo sapiens
  heavy chain complementarity determining region 3 for antibody 29512
TREIRGVIKPDEDFDY

SEQ ID NO: 59025 - protein, 10 aa, Homo sapiens
  light chain complementarity determining region 3 for antibody 29513
QQYGNPTKIT

SEQ ID NO: 59026 - protein, 16 aa, Homo sapiens
  heavy chain complementarity determining region 3 for antibody 29513
TREIRGVIKPEEDFDY

SEQ ID NO: 59027 - protein, 9 aa, Homo sapiens
  light chain complementarity determining region 3 for antibody 29514
QQYGNPPFT

SEQ ID NO: 59028 - protein, 24 aa, Homo sapiens
  heavy chain complementarity determining region 3 for antibody 29514
ARCRYHHHAFWNGPGSFYYYAMDV

SEQ ID NO: 59029 - protein, 9 aa, Homo sapiens
  light chain complementarity determining region 3 for antibody 29515
QQYGNLPRT

SEQ ID NO: 59030 - protein, 14 aa, Homo sapiens
  heavy chain complementarity determining region 3 for antibody 29515
AGGTFVSSGYYYEY

SEQ ID NO: 59031 - protein, 9 aa, Homo sapiens
  light chain complementarity determining region 3 for antibody 29516
QQYGNLPRT

SEQ ID NO: 59032 - protein, 13 aa, Homo sapiens
  heavy chain complementarity determining region 3 for antibody 29516
AGGSFHSGGYGEY

SEQ ID NO: 59033 - protein, 9 aa, Homo sapiens
  light chain complementarity determining region 3 for antibody 29517
QQYGNLPRT

SEQ ID NO: 59034 - protein, 13 aa, Homo sapiens
  heavy chain complementarity determining region 3 for antibody 29517
AGGNYEAGRYEEY

SEQ ID NO: 59035 - protein, 9 aa, Homo sapiens
  light chain complementarity determining region 3 for antibody 29518
QQYGNLPRT

SEQ ID NO: 59036 - protein, 13 aa, Homo sapiens
  heavy chain complementarity determining region 3 for antibody 29518
AGGNFHSGGDGEY

SEQ ID NO: 59037 - protein, 9 aa, Homo sapiens
  light chain complementarity determining region 3 for antibody 29519
QQYGNLPRP

SEQ ID NO: 59038 - protein, 13 aa, Homo sapiens
  heavy chain complementarity determining region 3 for antibody 29519
AGGNYETGRYEEY

SEQ ID NO: 59039 - protein, 9 aa, Homo sapiens
  light chain complementarity determining region 3 for antibody 29520
QQYGNIPRT

SEQ ID NO: 59040 - protein, 14 aa, Homo sapiens
  heavy chain complementarity determining region 3 for antibody 29520
AGGTVDSSGYYYEY

SEQ ID NO: 59041 - protein, 9 aa, Homo sapiens
  light chain complementarity determining region 3 for antibody 29521
QQYGNIPRT

SEQ ID NO: 59042 - protein, 14 aa, Homo sapiens
  heavy chain complementarity determining region 3 for antibody 29521
AGGTFDSSGYYSEY

SEQ ID NO: 59043 - protein, 9 aa, Homo sapiens
  light chain complementarity determining region 3 for antibody 29522
QQYGNIPRT

SEQ ID NO: 59044 - protein, 14 aa, Homo sapiens
  heavy chain complementarity determining region 3 for antibody 29522
AGGTCDSSGYYYEY

SEQ ID NO: 59045 - protein, 9 aa, Homo sapiens
  light chain complementarity determining region 3 for antibody 29523
QQYGNIPRS

SEQ ID NO: 59046 - protein, 13 aa, Homo sapiens
  heavy chain complementarity determining region 3 for antibody 29523
AGGTWHSGIYYDS

SEQ ID NO: 59047 - protein, 9 aa, Homo sapiens
  light chain complementarity determining region 3 for antibody 29524
QQYGNIPRA

SEQ ID NO: 59048 - protein, 13 aa, Homo sapiens
  heavy chain complementarity determining region 3 for antibody 29524
AGGTWHSGIYYES

SEQ ID NO: 59049 - protein, 9 aa, Homo sapiens
  light chain complementarity determining region 3 for antibody 29525
QQYGNIPQS

SEQ ID NO: 59050 - protein, 13 aa, Homo sapiens
  heavy chain complementarity determining region 3 for antibody 29525
AGGTWHSGIYYES

SEQ ID NO: 59051 - protein, 9 aa, Homo sapiens
  light chain complementarity determining region 3 for antibody 29526
QQYGNFPRS

SEQ ID NO: 59052 - protein, 13 aa, Homo sapiens
  heavy chain complementarity determining region 3 for antibody 29526
AGGTWHSGIYYES

SEQ ID NO: 59053 - protein, 6 aa, Homo sapiens
  light chain complementarity determining region 3 for antibody 29527
QQYGLT

SEQ ID NO: 59054 - protein, 12 aa, Homo sapiens
  heavy chain complementarity determining region 3 for antibody 29527
ARFANSWYPYDF

SEQ ID NO: 59055 - protein, 9 aa, Homo sapiens
  light chain complementarity determining region 3 for antibody 29528
QQYGLSTET

SEQ ID NO: 59056 - protein, 15 aa, Homo sapiens
  heavy chain complementarity determining region 3 for antibody 29528
AFRGIQVVNGVRFDY

SEQ ID NO: 59057 - protein, 9 aa, Homo sapiens
  light chain complementarity determining region 3 for antibody 29529
QQYGLSPQT

SEQ ID NO: 59058 - protein, 15 aa, Homo sapiens
  heavy chain complementarity determining region 3 for antibody 29529
AFRGIQVVNGVRFDY

SEQ ID NO: 59059 - protein, 9 aa, Homo sapiens
  light chain complementarity determining region 3 for antibody 29530
QQYGLSPKT

SEQ ID NO: 59060 - protein, 15 aa, Homo sapiens
  heavy chain complementarity determining region 3 for antibody 29530
AFRGIQVVNGVRFDY

SEQ ID NO: 59061 - protein, 9 aa, Homo sapiens
  light chain complementarity determining region 3 for antibody 29531
QQYGLSPET

SEQ ID NO: 59062 - protein, 15 aa, Homo sapiens
  heavy chain complementarity determining region 3 for antibody 29531
AFRGMQVVNGVRFDY

SEQ ID NO: 59063 - protein, 9 aa, Homo sapiens
  light chain complementarity determining region 3 for antibody 29532
QQYGLSPET

SEQ ID NO: 59064 - protein, 15 aa, Homo sapiens
  heavy chain complementarity determining region 3 for antibody 29532
AFRGIQVVSGVRFDY

SEQ ID NO: 59065 - protein, 9 aa, Homo sapiens
  light chain complementarity determining region 3 for antibody 29533
QQYGLSPET

SEQ ID NO: 59066 - protein, 15 aa, Homo sapiens
  heavy chain complementarity determining region 3 for antibody 29533
AFRGIQVVNGVRFGY

SEQ ID NO: 59067 - protein, 9 aa, Homo sapiens
  light chain complementarity determining region 3 for antibody 29534
QQYGLSPDT

SEQ ID NO: 59068 - protein, 15 aa, Homo sapiens
  heavy chain complementarity determining region 3 for antibody 29534
AFRGIQVVNGVRFDY

SEQ ID NO: 59069 - protein, 9 aa, Homo sapiens
  light chain complementarity determining region 3 for antibody 29535
QQYGLSPAT

SEQ ID NO: 59070 - protein, 15 aa, Homo sapiens
  heavy chain complementarity determining region 3 for antibody 29535
AFRGIQVVNGVRFDY

SEQ ID NO: 59071 - protein, 9 aa, Homo sapiens
  light chain complementarity determining region 3 for antibody 29536
QQYGLPPET

SEQ ID NO: 59072 - protein, 15 aa, Homo sapiens
  heavy chain complementarity determining region 3 for antibody 29536
AFRGIQVVNGVRFDY

SEQ ID NO: 59073 - protein, 8 aa, Homo sapiens
  light chain complementarity determining region 3 for antibody 29537
QQYGISRT

SEQ ID NO: 59074 - protein, 15 aa, Homo sapiens
  heavy chain complementarity determining region 3 for antibody 29537
ARGVTTYYIYYGLDV

SEQ ID NO: 59075 - protein, 9 aa, Homo sapiens
  light chain complementarity determining region 3 for antibody 29538
QQYGISPRT

SEQ ID NO: 59076 - protein, 15 aa, Homo sapiens
  heavy chain complementarity determining region 3 for antibody 29538
ARANGVIITTGVLRY

SEQ ID NO: 59077 - protein, 9 aa, Homo sapiens
  light chain complementarity determining region 3 for antibody 29539
QQYGISPQT

SEQ ID NO: 59078 - protein, 11 aa, Homo sapiens
  heavy chain complementarity determining region 3 for antibody 29539
ARGDLWSAFDI

SEQ ID NO: 59079 - protein, 10 aa, Homo sapiens
  light chain complementarity determining region 3 for antibody 29540
QQYGISPMYS

SEQ ID NO: 59080 - protein, 11 aa, Homo sapiens
  heavy chain complementarity determining region 3 for antibody 29540
ARGGQWGSLDY

SEQ ID NO: 59081 - protein, 9 aa, Homo sapiens
  light chain complementarity determining region 3 for antibody 29541
QQYGISPET

SEQ ID NO: 59082 - protein, 15 aa, Homo sapiens
  heavy chain complementarity determining region 3 for antibody 29541
AFRGIQVVNGVRFDY

SEQ ID NO: 59083 - protein, 9 aa, Homo sapiens
  light chain complementarity determining region 3 for antibody 29542
QQYGILPRT

SEQ ID NO: 59084 - protein, 14 aa, Homo sapiens
  heavy chain complementarity determining region 3 for antibody 29542
AGGDFCGSDCYSEY

SEQ ID NO: 59085 - protein, 9 aa, Homo sapiens
  light chain complementarity determining region 3 for antibody 29543
QQYGHSPWT

SEQ ID NO: 59086 - protein, 17 aa, Homo sapiens
  heavy chain complementarity determining region 3 for antibody 29543
ALASVAAPGRIQWYFDL

SEQ ID NO: 59087 - protein, 10 aa, Homo sapiens
  light chain complementarity determining region 3 for antibody 29544
QQYGHSPRYS

SEQ ID NO: 59088 - protein, 13 aa, Homo sapiens
  heavy chain complementarity determining region 3 for antibody 29544
AYIARSSNMDLMS

SEQ ID NO: 59089 - protein, 10 aa, Homo sapiens
  light chain complementarity determining region 3 for antibody 29545
QQYGHSPMYS

SEQ ID NO: 59090 - protein, 13 aa, Homo sapiens
  heavy chain complementarity determining region 3 for antibody 29545
AYRARSSNMDLMS

SEQ ID NO: 59091 - protein, 9 aa, Homo sapiens
  light chain complementarity determining region 3 for antibody 29546
QQYGGTRGP

SEQ ID NO: 59092 - protein, 16 aa, Homo sapiens
  heavy chain complementarity determining region 3 for antibody 29546
ARVVWGGSWYVGYFDP

SEQ ID NO: 59093 - protein, 9 aa, Homo sapiens
  light chain complementarity determining region 3 for antibody 29547
QQYGGSTWT

SEQ ID NO: 59094 - protein, 15 aa, Homo sapiens
  heavy chain complementarity determining region 3 for antibody 29547
ARGGRGPGMAHCFDL

SEQ ID NO: 59095 - protein, 9 aa, Homo sapiens
  light chain complementarity determining region 3 for antibody 29548
QQYGGSTGT

SEQ ID NO: 59096 - protein, 15 aa, Homo sapiens
  heavy chain complementarity determining region 3 for antibody 29548
ARGGRGTGMAHCFDL

SEQ ID NO: 59097 - protein, 9 aa, Homo sapiens
  light chain complementarity determining region 3 for antibody 29549
QQYGGSSYT

SEQ ID NO: 59098 - protein, 16 aa, Homo sapiens
  heavy chain complementarity determining region 3 for antibody 29549
ANWFSSVGDFLGPFDY

SEQ ID NO: 59099 - protein, 9 aa, Homo sapiens
  light chain complementarity determining region 3 for antibody 29550
QQYGGSSYT

SEQ ID NO: 59100 - protein, 16 aa, Homo sapiens
  heavy chain complementarity determining region 3 for antibody 29550
ANWFGSVGDSLGPFDY

SEQ ID NO: 59101 - protein, 9 aa, Homo sapiens
  light chain complementarity determining region 3 for antibody 29551
QQYGGSSYT

SEQ ID NO: 59102 - protein, 16 aa, Homo sapiens
  heavy chain complementarity determining region 3 for antibody 29551
ANWFGSVGDFLGPSDY

SEQ ID NO: 59103 - protein, 9 aa, Homo sapiens
  light chain complementarity determining region 3 for antibody 29552
QQYGGSSNT

SEQ ID NO: 59104 - protein, 16 aa, Homo sapiens
  heavy chain complementarity determining region 3 for antibody 29552
ANWFGSVGDFLGPFDY

SEQ ID NO: 59105 - protein, 9 aa, Homo sapiens
  light chain complementarity determining region 3 for antibody 29553
QQYGGSPYT

SEQ ID NO: 59106 - protein, 16 aa, Homo sapiens
  heavy chain complementarity determining region 3 for antibody 29553
ANWFGSVGDFLGPFDY

SEQ ID NO: 59107 - protein, 9 aa, Homo sapiens
  light chain complementarity determining region 3 for antibody 29554
QQYGGSPSP

SEQ ID NO: 59108 - protein, 11 aa, Homo sapiens
  heavy chain complementarity determining region 3 for antibody 29554
ARKPTGMAFDC

SEQ ID NO: 59109 - protein, 9 aa, Homo sapiens
  light chain complementarity determining region 3 for antibody 29555
QQYGGSPRT

SEQ ID NO: 59110 - protein, 11 aa, Homo sapiens
  heavy chain complementarity determining region 3 for antibody 29555
ARKPTGMAFDC

SEQ ID NO: 59111 - protein, 10 aa, Homo sapiens
  light chain complementarity determining region 3 for antibody 29556
QQYGGSPQYP

SEQ ID NO: 59112 - protein, 15 aa, Homo sapiens
  heavy chain complementarity determining region 3 for antibody 29556
ARDDRFATRFHSLDT

SEQ ID NO: 59113 - protein, 10 aa, Homo sapiens
  light chain complementarity determining region 3 for antibody 29557
QQYGGSPPGP

SEQ ID NO: 59114 - protein, 14 aa, Homo sapiens
  heavy chain complementarity determining region 3 for antibody 29557
ARGGKSTYIPHFDY

SEQ ID NO: 59115 - protein, 11 aa, Homo sapiens
  light chain complementarity determining region 3 for antibody 29558
QQYGGSPPALP

SEQ ID NO: 59116 - protein, 17 aa, Homo sapiens
  heavy chain complementarity determining region 3 for antibody 29558
ARVSGGGYYKLYYGMDV

SEQ ID NO: 59117 - protein, 10 aa, Homo sapiens
  light chain complementarity determining region 3 for antibody 29559
QQYGGSPMST

SEQ ID NO: 59118 - protein, 15 aa, Homo sapiens
  heavy chain complementarity determining region 3 for antibody 29559
LRHYRALVAGTEEDY

SEQ ID NO: 59119 - protein, 10 aa, Homo sapiens
  light chain complementarity determining region 3 for antibody 29560
QQYGGSPMDT

SEQ ID NO: 59120 - protein, 15 aa, Homo sapiens
  heavy chain complementarity determining region 3 for antibody 29560
LRHYRALVAGTEEDY

SEQ ID NO: 59121 - protein, 10 aa, Homo sapiens
  light chain complementarity determining region 3 for antibody 29561
QQYGGSPLLT

SEQ ID NO: 59122 - protein, 14 aa, Homo sapiens
  heavy chain complementarity determining region 3 for antibody 29561
ARDPVAGSPDYFDY

SEQ ID NO: 59123 - protein, 10 aa, Homo sapiens
  light chain complementarity determining region 3 for antibody 29562
QQYGGSPLIP

SEQ ID NO: 59124 - protein, 14 aa, Homo sapiens
  heavy chain complementarity determining region 3 for antibody 29562
ARDPVAGSPDYFDY

SEQ ID NO: 59125 - protein, 10 aa, Homo sapiens
  light chain complementarity determining region 3 for antibody 29563
QQYGGSPGWR

SEQ ID NO: 59126 - protein, 14 aa, Homo sapiens
  heavy chain complementarity determining region 3 for antibody 29563
ARHGGWRLLEPLDY

SEQ ID NO: 59127 - protein, 10 aa, Homo sapiens
  light chain complementarity determining region 3 for antibody 29564
QQYGGSPGRT

SEQ ID NO: 59128 - protein, 14 aa, Homo sapiens
  heavy chain complementarity determining region 3 for antibody 29564
ARHGGWRLLEPLDY

SEQ ID NO: 59129 - protein, 10 aa, Homo sapiens
  light chain complementarity determining region 3 for antibody 29565
QQYGGSPGFT

SEQ ID NO: 59130 - protein, 17 aa, Homo sapiens
  heavy chain complementarity determining region 3 for antibody 29565
AREISRVREVVIRPVDY

SEQ ID NO: 59131 - protein, 9 aa, Homo sapiens
  light chain complementarity determining region 3 for antibody 29566
QQYGGSLFT

SEQ ID NO: 59132 - protein, 20 aa, Homo sapiens
  heavy chain complementarity determining region 3 for antibody 29566
ARNRETAVTTQGYYYYGMDV

SEQ ID NO: 59133 - protein, 9 aa, Homo sapiens
  light chain complementarity determining region 3 for antibody 29567
QQYGGSLFP

SEQ ID NO: 59134 - protein, 20 aa, Homo sapiens
  heavy chain complementarity determining region 3 for antibody 29567
ARNIETAVTTQGYYYYGMDV

SEQ ID NO: 59135 - protein, 9 aa, Homo sapiens
  light chain complementarity determining region 3 for antibody 29568
QQYGGSGYT

SEQ ID NO: 59136 - protein, 17 aa, Homo sapiens
  heavy chain complementarity determining region 3 for antibody 29568
ARPAVTELRGINDALDI

SEQ ID NO: 59137 - protein, 9 aa, Homo sapiens
  light chain complementarity determining region 3 for antibody 29569
QQYGGSGYP

SEQ ID NO: 59138 - protein, 17 aa, Homo sapiens
  heavy chain complementarity determining region 3 for antibody 29569
ARPAVTEFRGINDALDI

SEQ ID NO: 59139 - protein, 9 aa, Homo sapiens
  light chain complementarity determining region 3 for antibody 29570
QQYGGSAYT

SEQ ID NO: 59140 - protein, 16 aa, Homo sapiens
  heavy chain complementarity determining region 3 for antibody 29570
ANWFGSVGDFLGPFDY

SEQ ID NO: 59141 - protein, 10 aa, Homo sapiens
  light chain complementarity determining region 3 for antibody 29571
QQYGGSAGWT

SEQ ID NO: 59142 - protein, 14 aa, Homo sapiens
  heavy chain complementarity determining region 3 for antibody 29571
ARELCRGGNCCFDS

SEQ ID NO: 59143 - protein, 10 aa, Homo sapiens
  light chain complementarity determining region 3 for antibody 29572
QQYGGSAGWT

SEQ ID NO: 59144 - protein, 14 aa, Homo sapiens
  heavy chain complementarity determining region 3 for antibody 29572
AREFCRGGSCCFDS

SEQ ID NO: 59145 - protein, 8 aa, Homo sapiens
  light chain complementarity determining region 3 for antibody 29573
QQYGGLPS

SEQ ID NO: 59146 - protein, 16 aa, Homo sapiens
  heavy chain complementarity determining region 3 for antibody 29573
ATDWGSGTQWIRAFDV

SEQ ID NO: 59147 - protein, 9 aa, Homo sapiens
  light chain complementarity determining region 3 for antibody 29574
QQYGGFPIT

SEQ ID NO: 59148 - protein, 16 aa, Homo sapiens
  heavy chain complementarity determining region 3 for antibody 29574
ARSTIGFLEWFGAFEI

SEQ ID NO: 59149 - protein, 9 aa, Homo sapiens
  light chain complementarity determining region 3 for antibody 29575
QQYGGAPFK

SEQ ID NO: 59150 - protein, 10 aa, Homo sapiens
  heavy chain complementarity determining region 3 for antibody 29575
TGGEGSKFDY

SEQ ID NO: 59151 - protein, 11 aa, Homo sapiens
  light chain complementarity determining region 3 for antibody 29576
QQYGFSPPHWA

SEQ ID NO: 59152 - protein, 12 aa, Homo sapiens
  heavy chain complementarity determining region 3 for antibody 29576
VKEKGGVRVFDF

SEQ ID NO: 59153 - protein, 9 aa, Homo sapiens
  light chain complementarity determining region 3 for antibody 29577
QQYGFSPET

SEQ ID NO: 59154 - protein, 15 aa, Homo sapiens
  heavy chain complementarity determining region 3 for antibody 29577
AFRGIQVVNGVRFDY

SEQ ID NO: 59155 - protein, 6 aa, Homo sapiens
  light chain complementarity determining region 3 for antibody 29578
QQYGET

SEQ ID NO: 59156 - protein, 12 aa, Homo sapiens
  heavy chain complementarity determining region 3 for antibody 29578
ARGHSSGWSLSN

SEQ ID NO: 59157 - protein, 6 aa, Homo sapiens
  light chain complementarity determining region 3 for antibody 29579
QQYGET

SEQ ID NO: 59158 - protein, 12 aa, Homo sapiens
  heavy chain complementarity determining region 3 for antibody 29579
ARDHSSGWSLPN

SEQ ID NO: 59159 - protein, 6 aa, Homo sapiens
  light chain complementarity determining region 3 for antibody 29580
QQYGER

SEQ ID NO: 59160 - protein, 12 aa, Homo sapiens
  heavy chain complementarity determining region 3 for antibody 29580
ARDHSSGWSLSN

SEQ ID NO: 59161 - protein, 6 aa, Homo sapiens
  light chain complementarity determining region 3 for antibody 29581
QQYGEP

SEQ ID NO: 59162 - protein, 12 aa, Homo sapiens
  heavy chain complementarity determining region 3 for antibody 29581
ARDHSSGWSLSN

SEQ ID NO: 59163 - protein, 6 aa, Homo sapiens
  light chain complementarity determining region 3 for antibody 29582
QQYGEK

SEQ ID NO: 59164 - protein, 12 aa, Homo sapiens
  heavy chain complementarity determining region 3 for antibody 29582
ARDHSSGWSLSN

SEQ ID NO: 59165 - protein, 10 aa, Homo sapiens
  light chain complementarity determining region 3 for antibody 29583
QQYGDSPVVT

SEQ ID NO: 59166 - protein, 16 aa, Homo sapiens
  heavy chain complementarity determining region 3 for antibody 29583
ARDATFWFGEFTFFDH

SEQ ID NO: 59167 - protein, 9 aa, Homo sapiens
  light chain complementarity determining region 3 for antibody 29584
QQYGDSPLT

SEQ ID NO: 59168 - protein, 15 aa, Homo sapiens
  heavy chain complementarity determining region 3 for antibody 29584
AKGRRGSYSHDAFDA

SEQ ID NO: 59169 - protein, 10 aa, Homo sapiens
  light chain complementarity determining region 3 for antibody 29585
QQYGDSPDVT

SEQ ID NO: 59170 - protein, 16 aa, Homo sapiens
  heavy chain complementarity determining region 3 for antibody 29585
ARDATFWFGEFPFFDH

SEQ ID NO: 59171 - protein, 10 aa, Homo sapiens
  light chain complementarity determining region 3 for antibody 29586
QQYGDSPDVT

SEQ ID NO: 59172 - protein, 16 aa, Homo sapiens
  heavy chain complementarity determining region 3 for antibody 29586
ARDATFWFGECTFFDH

SEQ ID NO: 59173 - protein, 10 aa, Homo sapiens
  light chain complementarity determining region 3 for antibody 29587
QQYGDSPDVT

SEQ ID NO: 59174 - protein, 16 aa, Homo sapiens
  heavy chain complementarity determining region 3 for antibody 29587
ARAATFWFGEFTFFDH

SEQ ID NO: 59175 - protein, 10 aa, Homo sapiens
  light chain complementarity determining region 3 for antibody 29588
QQYGDSPDVP

SEQ ID NO: 59176 - protein, 16 aa, Homo sapiens
  heavy chain complementarity determining region 3 for antibody 29588
ARDATFWFGEFTCFDH

SEQ ID NO: 59177 - protein, 8 aa, Homo sapiens
  light chain complementarity determining region 3 for antibody 29589
QQYGDSMT

SEQ ID NO: 59178 - protein, 16 aa, Homo sapiens
  heavy chain complementarity determining region 3 for antibody 29589
ARGVSIIRGVMSPFDL

SEQ ID NO: 59179 - protein, 8 aa, Homo sapiens
  light chain complementarity determining region 3 for antibody 29590
QQYGDSMT

SEQ ID NO: 59180 - protein, 16 aa, Homo sapiens
  heavy chain complementarity determining region 3 for antibody 29590
ARGPSIIRGVMSPFDL

SEQ ID NO: 59181 - protein, 8 aa, Homo sapiens
  light chain complementarity determining region 3 for antibody 29591
QQYGDSMT

SEQ ID NO: 59182 - protein, 16 aa, Homo sapiens
  heavy chain complementarity determining region 3 for antibody 29591
ARGLGIIRGVMSPFDL

SEQ ID NO: 59183 - protein, 8 aa, Homo sapiens
  light chain complementarity determining region 3 for antibody 29592
QQYGDSLT

SEQ ID NO: 59184 - protein, 16 aa, Homo sapiens
  heavy chain complementarity determining region 3 for antibody 29592
ARGLSIIRGVMSPFDL

SEQ ID NO: 59185 - protein, 10 aa, Homo sapiens
  light chain complementarity determining region 3 for antibody 29593
QQYGDSFLFI

SEQ ID NO: 59186 - protein, 16 aa, Homo sapiens
  heavy chain complementarity determining region 3 for antibody 29593
ARVYGDNDPTQGAFDI

SEQ ID NO: 59187 - protein, 10 aa, Homo sapiens
  light chain complementarity determining region 3 for antibody 29594
QQYGDLPDVT

SEQ ID NO: 59188 - protein, 16 aa, Homo sapiens
  heavy chain complementarity determining region 3 for antibody 29594
ARDATFWFGEFTFFDH

SEQ ID NO: 59189 - protein, 9 aa, Homo sapiens
  light chain complementarity determining region 3 for antibody 29595
QQYGDFPST

SEQ ID NO: 59190 - protein, 13 aa, Homo sapiens
  heavy chain complementarity determining region 3 for antibody 29595
ARDANWFGSGIPD

SEQ ID NO: 59191 - protein, 9 aa, Homo sapiens
  light chain complementarity determining region 3 for antibody 29596
QQYGDFPLT

SEQ ID NO: 59192 - protein, 13 aa, Homo sapiens
  heavy chain complementarity determining region 3 for antibody 29596
ARDANWFGSGISD

SEQ ID NO: 59193 - protein, 9 aa, Homo sapiens
  light chain complementarity determining region 3 for antibody 29597
QQYGCTWWT

SEQ ID NO: 59194 - protein, 15 aa, Homo sapiens
  heavy chain complementarity determining region 3 for antibody 29597
ARHMARDSIGYYHDF

SEQ ID NO: 59195 - protein, 9 aa, Homo sapiens
  light chain complementarity determining region 3 for antibody 29598
QQYGCSWWT

SEQ ID NO: 59196 - protein, 15 aa, Homo sapiens
  heavy chain complementarity determining region 3 for antibody 29598
ARHVARDDIGYYHDL

SEQ ID NO: 59197 - protein, 9 aa, Homo sapiens
  light chain complementarity determining region 3 for antibody 29599
QQYGCSWVT

SEQ ID NO: 59198 - protein, 20 aa, Homo sapiens
  heavy chain complementarity determining region 3 for antibody 29599
AREGGHRQWLEIYDPGYFHH

SEQ ID NO: 59199 - protein, 8 aa, Homo sapiens
  light chain complementarity determining region 3 for antibody 29600
QQYGCSPR

SEQ ID NO: 59200 - protein, 16 aa, Homo sapiens
  heavy chain complementarity determining region 3 for antibody 29600
ATDWGSGTQWIRAFDV

SEQ ID NO: 59201 - protein, 9 aa, Homo sapiens
  light chain complementarity determining region 3 for antibody 29601
QQYGCSPQT

SEQ ID NO: 59202 - protein, 32 aa, Homo sapiens; identical to SEQ ID NO: 49610
  heavy chain complementarity determining region 3 for antibody 29601

SEQ ID NO: 59203 - protein, 9 aa, Homo sapiens
  light chain complementarity determining region 3 for antibody 29602
QQYGCIPRT

SEQ ID NO: 59204 - protein, 14 aa, Homo sapiens
  heavy chain complementarity determining region 3 for antibody 29602
AGGKFCGGDCYREY

SEQ ID NO: 59205 - protein, 9 aa, Homo sapiens
  light chain complementarity determining region 3 for antibody 29603
QQYGASPRK

SEQ ID NO: 59206 - protein, 16 aa, Homo sapiens
  heavy chain complementarity determining region 3 for antibody 29603
AKSLGWDTMTTRVYDS

SEQ ID NO: 59207 - protein, 9 aa, Homo sapiens
  light chain complementarity determining region 3 for antibody 29604
QQYGASPLT

SEQ ID NO: 59208 - protein, 15 aa, Homo sapiens
  heavy chain complementarity determining region 3 for antibody 29604
AKGRRGSYSHDAFDV

SEQ ID NO: 59209 - protein, 8 aa, Homo sapiens
  light chain complementarity determining region 3 for antibody 29605
QQYGASMT

SEQ ID NO: 59210 - protein, 16 aa, Homo sapiens
  heavy chain complementarity determining region 3 for antibody 29605
ARGLSIIRGVMSPFDF

SEQ ID NO: 59211 - protein, 8 aa, Homo sapiens
  light chain complementarity determining region 3 for antibody 29606
QQYFYWQT

SEQ ID NO: 59212 - protein, 13 aa, Homo sapiens
  heavy chain complementarity determining region 3 for antibody 29606
ARKGGGDFYYLPY

SEQ ID NO: 59213 - protein, 9 aa, Homo sapiens
  light chain complementarity determining region 3 for antibody 29607
QQYFVTPPT

SEQ ID NO: 59214 - protein, 17 aa, Homo sapiens
  heavy chain complementarity determining region 3 for antibody 29607
ARGRECGRVNCYRAWDY

SEQ ID NO: 59215 - protein, 9 aa, Homo sapiens
  light chain complementarity determining region 3 for antibody 29608
QQYFTTPRP

SEQ ID NO: 59216 - protein, 8 aa, Homo sapiens
  heavy chain complementarity determining region 3 for antibody 29608
ARDGAFDS

SEQ ID NO: 59217 - protein, 9 aa, Homo sapiens
  light chain complementarity determining region 3 for antibody 29609
QQYFTSVRP

SEQ ID NO: 59218 - protein, 12 aa, Homo sapiens
  heavy chain complementarity determining region 3 for antibody 29609
VKDCGLGGSRDS

SEQ ID NO: 59219 - protein, 11 aa, Homo sapiens
  light chain complementarity determining region 3 for antibody 29610
QQYFTSPPGYT

SEQ ID NO: 59220 - protein, 11 aa, Homo sapiens
  heavy chain complementarity determining region 3 for antibody 29610
ARHGNDFYFDY

SEQ ID NO: 59221 - protein, 9 aa, Homo sapiens
  light chain complementarity determining region 3 for antibody 29611
QQYFTSLRT

SEQ ID NO: 59222 - protein, 12 aa, Homo sapiens
  heavy chain complementarity determining region 3 for antibody 29611
VKDCGLGGSRDF

SEQ ID NO: 59223 - protein, 9 aa, Homo sapiens
  light chain complementarity determining region 3 for antibody 29612
QQYFSYPGT

SEQ ID NO: 59224 - protein, 19 aa, Homo sapiens
  heavy chain complementarity determining region 3 for antibody 29612
ARVSARRILTAPRYPLIDS

SEQ ID NO: 59225 - protein, 8 aa, Homo sapiens
  light chain complementarity determining region 3 for antibody 29613
QQYFSMFT

SEQ ID NO: 59226 - protein, 17 aa, Homo sapiens
  heavy chain complementarity determining region 3 for antibody 29613
ARFKSSSWYRAPYYFDY

SEQ ID NO: 59227 - protein, 9 aa, Homo sapiens
  light chain complementarity determining region 3 for antibody 29614
QQYFSHVYT

SEQ ID NO: 59228 - protein, 18 aa, Homo sapiens
  heavy chain complementarity determining region 3 for antibody 29614
AQERDGYCDSHAGYGLDV

SEQ ID NO: 59229 - protein, 9 aa, Homo sapiens
  light chain complementarity determining region 3 for antibody 29615
QQYFSHVYT

SEQ ID NO: 59230 - protein, 18 aa, Homo sapiens
  heavy chain complementarity determining region 3 for antibody 29615
AQERDGYCDSHACYGLDF

SEQ ID NO: 59231 - protein, 9 aa, Homo sapiens
  light chain complementarity determining region 3 for antibody 29616
QQYFSAPLT

SEQ ID NO: 59232 - protein, 10 aa, Homo sapiens
  heavy chain complementarity determining region 3 for antibody 29616
ARGAVGGHDY

SEQ ID NO: 59233 - protein, 9 aa, Homo sapiens
  light chain complementarity determining region 3 for antibody 29617
QQYFRIPPT

SEQ ID NO: 59234 - protein, 17 aa, Homo sapiens
  heavy chain complementarity determining region 3 for antibody 29617
ANAQRGSAPSTTFYFES

SEQ ID NO: 59235 - protein, 9 aa, Homo sapiens
  light chain complementarity determining region 3 for antibody 29618
QQYFDVPLT

SEQ ID NO: 59236 - protein, 9 aa, Homo sapiens
  heavy chain complementarity determining region 3 for antibody 29618
VCLGVTPPV

SEQ ID NO: 59237 - protein, 9 aa, Homo sapiens
  light chain complementarity determining region 3 for antibody 29619
QQYFDTPRT

SEQ ID NO: 59238 - protein, 19 aa, Homo sapiens
  heavy chain complementarity determining region 3 for antibody 29619
ARDGRPDCKDDICYSWFDL

SEQ ID NO: 59239 - protein, 9 aa, Homo sapiens
  light chain complementarity determining region 3 for antibody 29620
QQYETYPWT

SEQ ID NO: 59240 - protein, 17 aa, Homo sapiens
  heavy chain complementarity determining region 3 for antibody 29620
VRRGGGLPDDRDSGLDV

SEQ ID NO: 59241 - protein, 8 aa, Homo sapiens
  light chain complementarity determining region 3 for antibody 29621
QQYETWPQ

SEQ ID NO: 59242 - protein, 13 aa, Homo sapiens
  heavy chain complementarity determining region 3 for antibody 29621
ARARWLFDPWFDF

SEQ ID NO: 59243 - protein, 11 aa, Homo sapiens
  light chain complementarity determining region 3 for antibody 29622
QQYETSPPGNP

SEQ ID NO: 59244 - protein, 14 aa, Homo sapiens
  heavy chain complementarity determining region 3 for antibody 29622
ARENSISRKRSFDQ

SEQ ID NO: 59245 - protein, 11 aa, Homo sapiens
  light chain complementarity determining region 3 for antibody 29623
QQYETSPPGCT

SEQ ID NO: 59246 - protein, 14 aa, Homo sapiens
  heavy chain complementarity determining region 3 for antibody 29623
ARENSISRKRSFDQ

SEQ ID NO: 59247 - protein, 8 aa, Homo sapiens
  light chain complementarity determining region 3 for antibody 29624
QQYETLST

SEQ ID NO: 59248 - protein, 12 aa, Homo sapiens
  heavy chain complementarity determining region 3 for antibody 29624
TTLVFAESGFDY

SEQ ID NO: 59249 - protein, 8 aa, Homo sapiens
  light chain complementarity determining region 3 for antibody 29625
QQYETFSS

SEQ ID NO: 59250 - protein, 22 aa, Homo sapiens
  heavy chain complementarity determining region 3 for antibody 29625
VRGEYFYDGSHYLWLTTEYFHH

SEQ ID NO: 59251 - protein, 9 aa, Homo sapiens
  light chain complementarity determining region 3 for antibody 29626
QQYESSSYT

SEQ ID NO: 59252 - protein, 18 aa, Homo sapiens
  heavy chain complementarity determining region 3 for antibody 29626
GRDLESGFGAKYYYAIDV

SEQ ID NO: 59253 - protein, 9 aa, Homo sapiens
  light chain complementarity determining region 3 for antibody 29627
QQYESSPWT

SEQ ID NO: 59254 - protein, 18 aa, Homo sapiens
  heavy chain complementarity determining region 3 for antibody 29627
ARQIDSGDYASYHGYCDV

SEQ ID NO: 59255 - protein, 9 aa, Homo sapiens
  light chain complementarity determining region 3 for antibody 29628
QQYESSPWT

SEQ ID NO: 59256 - protein, 18 aa, Homo sapiens
  heavy chain complementarity determining region 3 for antibody 29628
ARQIDCGDYASYHGYCDV

SEQ ID NO: 59257 - protein, 9 aa, Homo sapiens
  light chain complementarity determining region 3 for antibody 29629
QQYESSPGT

SEQ ID NO: 59258 - protein, 18 aa, Homo sapiens
  heavy chain complementarity determining region 3 for antibody 29629
ARQIDYGDYASYHGYCDV

SEQ ID NO: 59259 - protein, 9 aa, Homo sapiens
  light chain complementarity determining region 3 for antibody 29630
QQYESSLWS

SEQ ID NO: 59260 - protein, 12 aa, Homo sapiens
  heavy chain complementarity determining region 3 for antibody 29630
ARDFGLYQEPDS

SEQ ID NO: 59261 - protein, 9 aa, Homo sapiens
  light chain complementarity determining region 3 for antibody 29631
QQYESSLWP

SEQ ID NO: 59262 - protein, 12 aa, Homo sapiens
  heavy chain complementarity determining region 3 for antibody 29631
ARDFGLYQEPDS

SEQ ID NO: 59263 - protein, 9 aa, Homo sapiens
  light chain complementarity determining region 3 for antibody 29632
QQYESPPFT

SEQ ID NO: 59264 - protein, 14 aa, Homo sapiens
  heavy chain complementarity determining region 3 for antibody 29632
TSPNKASSRGYFDN

SEQ ID NO: 59265 - protein, 9 aa, Homo sapiens
  light chain complementarity determining region 3 for antibody 29633
QQYESPLWT

SEQ ID NO: 59266 - protein, 12 aa, Homo sapiens
  heavy chain complementarity determining region 3 for antibody 29633
ARDFGLYQEPDS

SEQ ID NO: 59267 - protein, 9 aa, Homo sapiens
  light chain complementarity determining region 3 for antibody 29634
QQYERSLWT

SEQ ID NO: 59268 - protein, 12 aa, Homo sapiens
  heavy chain complementarity determining region 3 for antibody 29634
ARDFGLYQEPDS

SEQ ID NO: 59269 - protein, 10 aa, Homo sapiens
  light chain complementarity determining region 3 for antibody 29635
QQYENWPPWT

SEQ ID NO: 59270 - protein, 12 aa, Homo sapiens
  heavy chain complementarity determining region 3 for antibody 29635
AASEWSGATFNY

SEQ ID NO: 59271 - protein, 9 aa, Homo sapiens
  light chain complementarity determining region 3 for antibody 29636
QQYENLPLT

SEQ ID NO: 59272 - protein, 15 aa, Homo sapiens
  heavy chain complementarity determining region 3 for antibody 29636
TRGFSWGSELCRFDY

SEQ ID NO: 59273 - protein, 9 aa, Homo sapiens
  light chain complementarity determining region 3 for antibody 29637
QQYENIPFT

SEQ ID NO: 59274 - protein, 19 aa, Homo sapiens
  heavy chain complementarity determining region 3 for antibody 29637
ARDRAVDTFAAYYYYGMGL

SEQ ID NO: 59275 - protein, 8 aa, Homo sapiens
  light chain complementarity determining region 3 for antibody 29638
QQYEFAIT

SEQ ID NO: 59276 - protein, 7 aa, Homo sapiens
  heavy chain complementarity determining region 3 for antibody 29638
AREFGDP

SEQ ID NO: 59277 - protein, 9 aa, Homo sapiens
  light chain complementarity determining region 3 for antibody 29639
QQYEDLPFT

SEQ ID NO: 59278 - protein, 15 aa, Homo sapiens
  heavy chain complementarity determining region 3 for antibody 29639
TASPGSWDHGELVDY

SEQ ID NO: 59279 - protein, 9 aa, Homo sapiens
  light chain complementarity determining region 3 for antibody 29640
QQYDYSPPT

SEQ ID NO: 59280 - protein, 19 aa, Homo sapiens
  heavy chain complementarity determining region 3 for antibody 29640
ARDHFPLARGVVSYFYYNY

SEQ ID NO: 59281 - protein, 9 aa, Homo sapiens
  light chain complementarity determining region 3 for antibody 29641
QQYDYLSVT

SEQ ID NO: 59282 - protein, 15 aa, Homo sapiens
  heavy chain complementarity determining region 3 for antibody 29641
ARPPHAFTGENYFTF

SEQ ID NO: 59283 - protein, 9 aa, Homo sapiens
  light chain complementarity determining region 3 for antibody 29642
QQYDYLPVT

SEQ ID NO: 59284 - protein, 15 aa, Homo sapiens
  heavy chain complementarity determining region 3 for antibody 29642
ARPPHAFTGESYFTF

SEQ ID NO: 59285 - protein, 9 aa, Homo sapiens
  light chain complementarity determining region 3 for antibody 29643
QQYDYLPVT

SEQ ID NO: 59286 - protein, 15 aa, Homo sapiens
  heavy chain complementarity determining region 3 for antibody 29643
ARPPHAFTGENYFAF

SEQ ID NO: 59287 - protein, 9 aa, Homo sapiens
  light chain complementarity determining region 3 for antibody 29644
QQYDYLPVT

SEQ ID NO: 59288 - protein, 15 aa, Homo sapiens
  heavy chain complementarity determining region 3 for antibody 29644
AGPPHAFTGENYFNF

SEQ ID NO: 59289 - protein, 8 aa, Homo sapiens
  light chain complementarity determining region 3 for antibody 29645
QQYDYLPA

SEQ ID NO: 59290 - protein, 12 aa, Homo sapiens
  heavy chain complementarity determining region 3 for antibody 29645
ARSNWSIIAFDL

SEQ ID NO: 59291 - protein, 8 aa, Homo sapiens
  light chain complementarity determining region 3 for antibody 29646
QQYDYLPA

SEQ ID NO: 59292 - protein, 12 aa, Homo sapiens
  heavy chain complementarity determining region 3 for antibody 29646
ARSNRNIIAFDL

SEQ ID NO: 59293 - protein, 8 aa, Homo sapiens
  light chain complementarity determining region 3 for antibody 29647
QQYDYIPA

SEQ ID NO: 59294 - protein, 12 aa, Homo sapiens
  heavy chain complementarity determining region 3 for antibody 29647
ARSNWNIIAFDL

SEQ ID NO: 59295 - protein, 9 aa, Homo sapiens
  light chain complementarity determining region 3 for antibody 29648
QQYDYFPVT

SEQ ID NO: 59296 - protein, 15 aa, Homo sapiens
  heavy chain complementarity determining region 3 for antibody 29648
ARPPHAFTGENYFTF

SEQ ID NO: 59297 - protein, 9 aa, Homo sapiens
  light chain complementarity determining region 3 for antibody 29649
QQYDTYSHT

SEQ ID NO: 59298 - protein, 22 aa, Homo sapiens
  heavy chain complementarity determining region 3 for antibody 29649
AMRTRGMFYFNSGAYSGPPADY

SEQ ID NO: 59299 - protein, 9 aa, Homo sapiens
  light chain complementarity determining region 3 for antibody 29650
QQYDTYSHT

SEQ ID NO: 59300 - protein, 22 aa, Homo sapiens
  heavy chain complementarity determining region 3 for antibody 29650
AMRTRGMFYCNSGAYSGSPADY

SEQ ID NO: 59301 - protein, 9 aa, Homo sapiens
  light chain complementarity determining region 3 for antibody 29651
QQYDTYPWT

SEQ ID NO: 59302 - protein, 14 aa, Homo sapiens
  heavy chain complementarity determining region 3 for antibody 29651
AKGTYSILTGPFDY

SEQ ID NO: 59303 - protein, 9 aa, Homo sapiens
  light chain complementarity determining region 3 for antibody 29652
QQYDTYPNT

SEQ ID NO: 59304 - protein, 6 aa, Homo sapiens
  heavy chain complementarity determining region 3 for antibody 29652
MTMGAT

SEQ ID NO: 59305 - protein, 9 aa, Homo sapiens
  light chain complementarity determining region 3 for antibody 29653
QQYDTYPDT

SEQ ID NO: 59306 - protein, 20 aa, Homo sapiens
  heavy chain complementarity determining region 3 for antibody 29653
ARGGHIVVVTSFHNDGPLSA

SEQ ID NO: 59307 - protein, 9 aa, Homo sapiens
  light chain complementarity determining region 3 for antibody 29654
QQYDTYFWT

SEQ ID NO: 59308 - protein, 16 aa, Homo sapiens
  heavy chain complementarity determining region 3 for antibody 29654
ASLGGAHYYGSGSHYF

SEQ ID NO: 59309 - protein, 9 aa, Homo sapiens
  light chain complementarity determining region 3 for antibody 29655
QQYDTTPRT

SEQ ID NO: 59310 - protein, 8 aa, Homo sapiens
  heavy chain complementarity determining region 3 for antibody 29655
ARDGAFDS

SEQ ID NO: 59311 - protein, 9 aa, Homo sapiens
  light chain complementarity determining region 3 for antibody 29656
QQYDTSRLT

SEQ ID NO: 59312 - protein, 13 aa, Homo sapiens
  heavy chain complementarity determining region 3 for antibody 29656
ASESDDHDYGMDV

SEQ ID NO: 59313 - protein, 8 aa, Homo sapiens
  light chain complementarity determining region 3 for antibody 29657
QQYDTSRK

SEQ ID NO: 59314 - protein, 15 aa, Homo sapiens
  heavy chain complementarity determining region 3 for antibody 29657
AREVTNNDSYSGMDV

SEQ ID NO: 59315 - protein, 9 aa, Homo sapiens
  light chain complementarity determining region 3 for antibody 29658
QQYDTSPWT

SEQ ID NO: 59316 - protein, 9 aa, Homo sapiens
  heavy chain complementarity determining region 3 for antibody 29658
ATGGGSCSH

SEQ ID NO: 59317 - protein, 9 aa, Homo sapiens
  light chain complementarity determining region 3 for antibody 29659
QQYDTSPWK

SEQ ID NO: 59318 - protein, 15 aa, Homo sapiens
  heavy chain complementarity determining region 3 for antibody 29659
VHTQLWFGDQCYFDF

SEQ ID NO: 59319 - protein, 11 aa, Homo sapiens
  light chain complementarity determining region 3 for antibody 29660
QQYDTSPPGYT

SEQ ID NO: 59320 - protein, 14 aa, Homo sapiens
  heavy chain complementarity determining region 3 for antibody 29660
ARENSISRKRSFDQ

SEQ ID NO: 59321 - protein, 11 aa, Homo sapiens
  light chain complementarity determining region 3 for antibody 29661
QQYDTSPPGDT

SEQ ID NO: 59322 - protein, 14 aa, Homo sapiens
  heavy chain complementarity determining region 3 for antibody 29661
ARETSNSRKRSFDQ

SEQ ID NO: 59323 - protein, 9 aa, Homo sapiens
  light chain complementarity determining region 3 for antibody 29662
QQYDTPPWT

SEQ ID NO: 59324 - protein, 9 aa, Homo sapiens
  heavy chain complementarity determining region 3 for antibody 29662
ATGGGSYSH

SEQ ID NO: 59325 - protein, 9 aa, Homo sapiens
  light chain complementarity determining region 3 for antibody 29663
QQYDTPPWT

SEQ ID NO: 59326 - protein, 13 aa, Homo sapiens
  heavy chain complementarity determining region 3 for antibody 29663
ARETLIHLPAVEH

SEQ ID NO: 59327 - protein, 9 aa, Homo sapiens
  light chain complementarity determining region 3 for antibody 29664
QQYDTPPRT

SEQ ID NO: 59328 - protein, 13 aa, Homo sapiens
  heavy chain complementarity determining region 3 for antibody 29664
ARETLIHLPAFEH

SEQ ID NO: 59329 - protein, 9 aa, Homo sapiens
  light chain complementarity determining region 3 for antibody 29665
QQYDTIPRT

SEQ ID NO: 59330 - protein, 13 aa, Homo sapiens
  heavy chain complementarity determining region 3 for antibody 29665
AGGLFDSSGYSEF

SEQ ID NO: 59331 - protein, 10 aa, Homo sapiens
  light chain complementarity determining region 3 for antibody 29666
QQYDTHSPWP

SEQ ID NO: 59332 - protein, 20 aa, Homo sapiens
  heavy chain complementarity determining region 3 for antibody 29666
AKPEGWWDGSGTYPTYYFDY

SEQ ID NO: 59333 - protein, 9 aa, Homo sapiens
  light chain complementarity determining region 3 for antibody 29667
QQYDTFPLT

SEQ ID NO: 59334 - protein, 17 aa, Homo sapiens
  heavy chain complementarity determining region 3 for antibody 29667
ATAGGLSYSGGTMYLDN

SEQ ID NO: 59335 - protein, 9 aa, Homo sapiens
  light chain complementarity determining region 3 for antibody 29668
QQYDSSSYT

SEQ ID NO: 59336 - protein, 11 aa, Homo sapiens
  heavy chain complementarity determining region 3 for antibody 29668
ARGGFYGSSDF

SEQ ID NO: 59337 - protein, 9 aa, Homo sapiens
  light chain complementarity determining region 3 for antibody 29669
QQYDSSSFT

SEQ ID NO: 59338 - protein, 11 aa, Homo sapiens
  heavy chain complementarity determining region 3 for antibody 29669
ARGGFYGSFDF

SEQ ID NO: 59339 - protein, 9 aa, Homo sapiens
  light chain complementarity determining region 3 for antibody 29670
QQYDSSSDT

SEQ ID NO: 59340 - protein, 11 aa, Homo sapiens
  heavy chain complementarity determining region 3 for antibody 29670
ARGGFYGSFDF

SEQ ID NO: 59341 - protein, 9 aa, Homo sapiens
  light chain complementarity determining region 3 for antibody 29671
QQYDSSPRT

SEQ ID NO: 59342 - protein, 25 aa, Homo sapiens
  heavy chain complementarity determining region 3 for antibody 29671
ARLRIDRLRLPGAMRGPLYDCGLNV

SEQ ID NO: 59343 - protein, 9 aa, Homo sapiens
  light chain complementarity determining region 3 for antibody 29672
QQYDSSPQP

SEQ ID NO: 59344 - protein, 14 aa, Homo sapiens
  heavy chain complementarity determining region 3 for antibody 29672
ARDNPHRLERYFDL

SEQ ID NO: 59345 - protein, 9 aa, Homo sapiens
  light chain complementarity determining region 3 for antibody 29673
QQYDSSPPT

SEQ ID NO: 59346 - protein, 14 aa, Homo sapiens
  heavy chain complementarity determining region 3 for antibody 29673
ARDNPHRLERYFDL

SEQ ID NO: 59347 - protein, 11 aa, Homo sapiens
  light chain complementarity determining region 3 for antibody 29674
QQYDSSPPRYT

SEQ ID NO: 59348 - protein, 23 aa, Homo sapiens
  heavy chain complementarity determining region 3 for antibody 29674
ARAHRGYRRSNSRVDYYNFGMDV

SEQ ID NO: 59349 - protein, 11 aa, Homo sapiens
  light chain complementarity determining region 3 for antibody 29675
QQYDSSPPMYP

SEQ ID NO: 59350 - protein, 23 aa, Homo sapiens
  heavy chain complementarity determining region 3 for antibody 29675
ARAHRGYRRSNSRVDYYNFGMDV

SEQ ID NO: 59351 - protein, 9 aa, Homo sapiens
  light chain complementarity determining region 3 for antibody 29676
QQYDSSPFT

SEQ ID NO: 59352 - protein, 17 aa, Homo sapiens
  heavy chain complementarity determining region 3 for antibody 29676
TRDRGSSWYSGAEHFQY

SEQ ID NO: 59353 - protein, 9 aa, Homo sapiens
  light chain complementarity determining region 3 for antibody 29677
QQYDSSPFT

SEQ ID NO: 59354 - protein, 17 aa, Homo sapiens
  heavy chain complementarity determining region 3 for antibody 29677
ARDRGSSWYSGAERFQY

SEQ ID NO: 59355 - protein, 9 aa, Homo sapiens
  light chain complementarity determining region 3 for antibody 29678
QQYDSSPFT

SEQ ID NO: 59356 - protein, 17 aa, Homo sapiens
  heavy chain complementarity determining region 3 for antibody 29678
ARDRGSSWYSGAEPFQY

SEQ ID NO: 59357 - protein, 9 aa, Homo sapiens
  light chain complementarity determining region 3 for antibody 29679
QQYDSSPFT

SEQ ID NO: 59358 - protein, 17 aa, Homo sapiens
  heavy chain complementarity determining region 3 for antibody 29679
ARDRGSSWYSGAEHFHY

SEQ ID NO: 59359 - protein, 9 aa, Homo sapiens
  light chain complementarity determining region 3 for antibody 29680
QQYDSSPFT

SEQ ID NO: 59360 - protein, 17 aa, Homo sapiens
  heavy chain complementarity determining region 3 for antibody 29680
ARDRGSSWYSGAEHFEY

SEQ ID NO: 59361 - protein, 9 aa, Homo sapiens
  light chain complementarity determining region 3 for antibody 29681
QQYDSSLYT

SEQ ID NO: 59362 - protein, 11 aa, Homo sapiens
  heavy chain complementarity determining region 3 for antibody 29681
ARGGFYGSFDF

SEQ ID NO: 59363 - protein, 10 aa, Homo sapiens
  light chain complementarity determining region 3 for antibody 29682
QQYDSSFYFT

SEQ ID NO: 59364 - protein, 14 aa, Homo sapiens
  heavy chain complementarity determining region 3 for antibody 29682
ASVKRGGGRPRFDN

SEQ ID NO: 59365 - protein, 9 aa, Homo sapiens
  light chain complementarity determining region 3 for antibody 29683
QQYDSPSYT

SEQ ID NO: 59366 - protein, 11 aa, Homo sapiens
  heavy chain complementarity determining region 3 for antibody 29683
ARGGFYGSFDF

SEQ ID NO: 59367 - protein, 9 aa, Homo sapiens
  light chain complementarity determining region 3 for antibody 29684
QQYDSPPQT

SEQ ID NO: 59368 - protein, 14 aa, Homo sapiens
  heavy chain complementarity determining region 3 for antibody 29684
ARDNPHRLERYFDL

SEQ ID NO: 59369 - protein, 11 aa, Homo sapiens
  light chain complementarity determining region 3 for antibody 29685
QQYDSPPPMYT

SEQ ID NO: 59370 - protein, 23 aa, Homo sapiens
  heavy chain complementarity determining region 3 for antibody 29685
ARAHRGYRRSNSRVDYYNFGMDV

SEQ ID NO: 59371 - protein, 9 aa, Homo sapiens
  light chain complementarity determining region 3 for antibody 29686
QQYDSPPFT

SEQ ID NO: 59372 - protein, 17 aa, Homo sapiens
  heavy chain complementarity determining region 3 for antibody 29686
ARDRGSSWYSGAEHFQY

SEQ ID NO: 59373 - protein, 9 aa, Homo sapiens
  light chain complementarity determining region 3 for antibody 29687
QQYDSLPYT

SEQ ID NO: 59374 - protein, 17 aa, Homo sapiens
  heavy chain complementarity determining region 3 for antibody 29687
ARSSGYSRGWYSGQFDN

SEQ ID NO: 59375 - protein, 9 aa, Homo sapiens
  light chain complementarity determining region 3 for antibody 29688
QQYDSLPWT

SEQ ID NO: 59376 - protein, 19 aa, Homo sapiens
  heavy chain complementarity determining region 3 for antibody 29688
ARTAIGKRYWASSGDQFDS

SEQ ID NO: 59377 - protein, 9 aa, Homo sapiens
  light chain complementarity determining region 3 for antibody 29689
QQYDSLPRT

SEQ ID NO: 59378 - protein, 19 aa, Homo sapiens
  heavy chain complementarity determining region 3 for antibody 29689
ARTAIGKRYWASSGDQFDY

SEQ ID NO: 59379 - protein, 9 aa, Homo sapiens
  light chain complementarity determining region 3 for antibody 29690
QQYDSLPLT

SEQ ID NO: 59380 - protein, 17 aa, Homo sapiens
  heavy chain complementarity determining region 3 for antibody 29690
ARARVSGWPLYYYPLDV

SEQ ID NO: 59381 - protein, 9 aa, Homo sapiens
  light chain complementarity determining region 3 for antibody 29691
QQYDSLPGT

SEQ ID NO: 59382 - protein, 16 aa, Homo sapiens
  heavy chain complementarity determining region 3 for antibody 29691
AKDRRRMATISAHFDS

SEQ ID NO: 59383 - protein, 10 aa, Homo sapiens
  light chain complementarity determining region 3 for antibody 29692
QQYDSLLRLP

SEQ ID NO: 59384 - protein, 11 aa, Homo sapiens
  heavy chain complementarity determining region 3 for antibody 29692
ALFGFAELKEF

SEQ ID NO: 59385 - protein, 9 aa, Homo sapiens
  light chain complementarity determining region 3 for antibody 29693
QQYDSFPYT

SEQ ID NO: 59386 - protein, 17 aa, Homo sapiens
  heavy chain complementarity determining region 3 for antibody 29693
ARSRGYSRGWYSGQFDN

SEQ ID NO: 59387 - protein, 9 aa, Homo sapiens
  light chain complementarity determining region 3 for antibody 29694
QQYDSFPYT

SEQ ID NO: 59388 - protein, 15 aa, Homo sapiens
  heavy chain complementarity determining region 3 for antibody 29694
ARETRYDTRVRAFDI

SEQ ID NO: 59389 - protein, 9 aa, Homo sapiens
  light chain complementarity determining region 3 for antibody 29695
QQYDSFPYT

SEQ ID NO: 59390 - protein, 15 aa, Homo sapiens
  heavy chain complementarity determining region 3 for antibody 29695
ARETRYDTRGSAFDI

SEQ ID NO: 59391 - protein, 9 aa, Homo sapiens
  light chain complementarity determining region 3 for antibody 29696
QQYDSAPLT

SEQ ID NO: 59392 - protein, 15 aa, Homo sapiens
  heavy chain complementarity determining region 3 for antibody 29696
ARDGGPYQVLLPFSD

SEQ ID NO: 59393 - protein, 10 aa, Homo sapiens
  light chain complementarity determining region 3 for antibody 29697
QQYDRSPPWT

SEQ ID NO: 59394 - protein, 14 aa, Homo sapiens
  heavy chain complementarity determining region 3 for antibody 29697
VTHASGWYRRPFDI

SEQ ID NO: 59395 - protein, 11 aa, Homo sapiens
  light chain complementarity determining region 3 for antibody 29698
QQYDRSPPGVT

SEQ ID NO: 59396 - protein, 14 aa, Homo sapiens
  heavy chain complementarity determining region 3 for antibody 29698
ARETHNSRKRSFDQ

SEQ ID NO: 59397 - protein, 11 aa, Homo sapiens
  light chain complementarity determining region 3 for antibody 29699
QQYDRSPPGVP

SEQ ID NO: 59398 - protein, 14 aa, Homo sapiens
  heavy chain complementarity determining region 3 for antibody 29699
ARETHNSRKRSFDQ

SEQ ID NO: 59399 - protein, 11 aa, Homo sapiens
  light chain complementarity determining region 3 for antibody 29700
QQYDRSPPGST

SEQ ID NO: 59400 - protein, 14 aa, Homo sapiens
  heavy chain complementarity determining region 3 for antibody 29700
ARETHNSRKRSFDQ

SEQ ID NO: 59401 - protein, 11 aa, Homo sapiens
  light chain complementarity determining region 3 for antibody 29701
QQYDRSPPGFS

SEQ ID NO: 59402 - protein, 14 aa, Homo sapiens
  heavy chain complementarity determining region 3 for antibody 29701
ARETHNSRKRSFDQ

SEQ ID NO: 59403 - protein, 9 aa, Homo sapiens
  light chain complementarity determining region 3 for antibody 29702
QQYDRSHRT

SEQ ID NO: 59404 - protein, 21 aa, Homo sapiens
  heavy chain complementarity determining region 3 for antibody 29702
CRESEYFDILTTSWTVDGFDI

SEQ ID NO: 59405 - protein, 7 aa, Homo sapiens
  light chain complementarity determining region 3 for antibody 29703
QQYDRPT

SEQ ID NO: 59406 - protein, 17 aa, Homo sapiens
  heavy chain complementarity determining region 3 for antibody 29703
AGARTQFGSGAHYCFDY

SEQ ID NO: 59407 - protein, 9 aa, Homo sapiens
  light chain complementarity determining region 3 for antibody 29704
QQYDRKPFT

SEQ ID NO: 59408 - protein, 14 aa, Homo sapiens
  heavy chain complementarity determining region 3 for antibody 29704
ARDNSNNWYEGMDV

SEQ ID NO: 59409 - protein, 9 aa, Homo sapiens
  light chain complementarity determining region 3 for antibody 29705
QQYDRFRGT

SEQ ID NO: 59410 - protein, 16 aa, Homo sapiens
  heavy chain complementarity determining region 3 for antibody 29705
ARWGVECSGGYCYFEY

SEQ ID NO: 59411 - protein, 9 aa, Homo sapiens
  light chain complementarity determining region 3 for antibody 29706
QQYDRFRET

SEQ ID NO: 59412 - protein, 16 aa, Homo sapiens
  heavy chain complementarity determining region 3 for antibody 29706
ARWGVECSGGYCYFEY

SEQ ID NO: 59413 - protein, 9 aa, Homo sapiens
  light chain complementarity determining region 3 for antibody 29707
QQYDPSPWT

SEQ ID NO: 59414 - protein, 15 aa, Homo sapiens
  heavy chain complementarity determining region 3 for antibody 29707
VHTQLWFGDQCYFDF

SEQ ID NO: 59415 - protein, 9 aa, Homo sapiens
  light chain complementarity determining region 3 for antibody 29708
QQYDNWRIS

SEQ ID NO: 59416 - protein, 16 aa, Homo sapiens
  heavy chain complementarity determining region 3 for antibody 29708
ARDHSATVAGRRWFDP

SEQ ID NO: 59417 - protein, 9 aa, Homo sapiens
  light chain complementarity determining region 3 for antibody 29709
QQYDNWRGT

SEQ ID NO: 59418 - protein, 26 aa, Homo sapiens
  heavy chain complementarity determining region 3 for antibody 29709
SRGLGYSYTLRAKSLGLRAKAYFFDY

SEQ ID NO: 59419 - protein, 9 aa, Homo sapiens
  light chain complementarity determining region 3 for antibody 29710
QQYDNWRCN

SEQ ID NO: 59420 - protein, 26 aa, Homo sapiens
  heavy chain complementarity determining region 3 for antibody 29710
SRGLGYSYTLRAKSLGLRAKAYFFDY

SEQ ID NO: 59421 - protein, 9 aa, Homo sapiens
  light chain complementarity determining region 3 for antibody 29711
QQYDNWPQE

SEQ ID NO: 59422 - protein, 16 aa, Homo sapiens
  heavy chain complementarity determining region 3 for antibody 29711
ASLPRGGTYWKNVLDV

SEQ ID NO: 59423 - protein, 9 aa, Homo sapiens
  light chain complementarity determining region 3 for antibody 29712
QQYDNWPQA

SEQ ID NO: 59424 - protein, 16 aa, Homo sapiens
  heavy chain complementarity determining region 3 for antibody 29712
ASLPRGGTYWKSVLDV

SEQ ID NO: 59425 - protein, 11 aa, Homo sapiens
  light chain complementarity determining region 3 for antibody 29713
QQYDNWPPGRG

SEQ ID NO: 59426 - protein, 16 aa, Homo sapiens
  heavy chain complementarity determining region 3 for antibody 29713
AKGNTVTGYSSGWYMF

SEQ ID NO: 59427 - protein, 9 aa, Homo sapiens
  light chain complementarity determining region 3 for antibody 29714
QQYDNVPYY

SEQ ID NO: 59428 - protein, 12 aa, Homo sapiens
  heavy chain complementarity determining region 3 for antibody 29714
VREGRPSLALDI

SEQ ID NO: 59429 - protein, 8 aa, Homo sapiens
  light chain complementarity determining region 3 for antibody 29715
QQYDNVPT

SEQ ID NO: 59430 - protein, 15 aa, Homo sapiens
  heavy chain complementarity determining region 3 for antibody 29715
ARTSTSFGMVIAFDY

SEQ ID NO: 59431 - protein, 11 aa, Homo sapiens
  light chain complementarity determining region 3 for antibody 29716
QQYDNSVLEFT

SEQ ID NO: 59432 - protein, 15 aa, Homo sapiens
  heavy chain complementarity determining region 3 for antibody 29716
VREVVTMIEPGGFDV

SEQ ID NO: 59433 - protein, 9 aa, Homo sapiens
  light chain complementarity determining region 3 for antibody 29717
QQYDNSTPT

SEQ ID NO: 59434 - protein, 19 aa, Homo sapiens
  heavy chain complementarity determining region 3 for antibody 29717
ARDHFPLARGVVSYFYYNY

SEQ ID NO: 59435 - protein, 9 aa, Homo sapiens
  light chain complementarity determining region 3 for antibody 29718
QQYDNSRPT

SEQ ID NO: 59436 - protein, 23 aa, Homo sapiens
  heavy chain complementarity determining region 3 for antibody 29718
ARGPAGAAYGTTFARPRGGYFGV

SEQ ID NO: 59437 - protein, 9 aa, Homo sapiens
  light chain complementarity determining region 3 for antibody 29719
QQYDNSPRT

SEQ ID NO: 59438 - protein, 15 aa, Homo sapiens
  heavy chain complementarity determining region 3 for antibody 29719
ARDRGSSSRSGGFDY

SEQ ID NO: 59439 - protein, 9 aa, Homo sapiens
  light chain complementarity determining region 3 for antibody 29720
QQYDNSPPT

SEQ ID NO: 59440 - protein, 19 aa, Homo sapiens
  heavy chain complementarity determining region 3 for antibody 29720
ARGHFPLARGVVSYFYYNY

SEQ ID NO: 59441 - protein, 9 aa, Homo sapiens
  light chain complementarity determining region 3 for antibody 29721
QQYDNSPPT

SEQ ID NO: 59442 - protein, 19 aa, Homo sapiens
  heavy chain complementarity determining region 3 for antibody 29721
ARDHVPLARGVVSYFYYNY

SEQ ID NO: 59443 - protein, 9 aa, Homo sapiens
  light chain complementarity determining region 3 for antibody 29722
QQYDNSPPT

SEQ ID NO: 59444 - protein, 19 aa, Homo sapiens
  heavy chain complementarity determining region 3 for antibody 29722
ARDHFPLARGVVSYFYYDY

SEQ ID NO: 59445 - protein, 9 aa, Homo sapiens
  light chain complementarity determining region 3 for antibody 29723
QQYDNSPPT

SEQ ID NO: 59446 - protein, 19 aa, Homo sapiens
  heavy chain complementarity determining region 3 for antibody 29723
ARDHFPLARGVVSYCYYNY

SEQ ID NO: 59447 - protein, 9 aa, Homo sapiens
  light chain complementarity determining region 3 for antibody 29724
QQYDNSLLT

SEQ ID NO: 59448 - protein, 20 aa, Homo sapiens
  heavy chain complementarity determining region 3 for antibody 29724
ATPDTRYGSGRYHDTYAFDI

SEQ ID NO: 59449 - protein, 11 aa, Homo sapiens
  light chain complementarity determining region 3 for antibody 29725
QQYDNSGLEFT

SEQ ID NO: 59450 - protein, 15 aa, Homo sapiens
  heavy chain complementarity determining region 3 for antibody 29725
VREVVTMIEPGGFDV

SEQ ID NO: 59451 - protein, 11 aa, Homo sapiens
  light chain complementarity determining region 3 for antibody 29726
QQYDNSAREFT

SEQ ID NO: 59452 - protein, 15 aa, Homo sapiens
  heavy chain complementarity determining region 3 for antibody 29726
VREVVTMIEPGGFDV

SEQ ID NO: 59453 - protein, 11 aa, Homo sapiens
  light chain complementarity determining region 3 for antibody 29727
QQYDNSALGFT

SEQ ID NO: 59454 - protein, 15 aa, Homo sapiens
  heavy chain complementarity determining region 3 for antibody 29727
VREVVTMIEPGGFDV

SEQ ID NO: 59455 - protein, 11 aa, Homo sapiens
  light chain complementarity determining region 3 for antibody 29728
QQYDNSALEST

SEQ ID NO: 59456 - protein, 15 aa, Homo sapiens
  heavy chain complementarity determining region 3 for antibody 29728
VREVVTMIEPGGFDV

SEQ ID NO: 59457 - protein, 11 aa, Homo sapiens
  light chain complementarity determining region 3 for antibody 29729
QQYDNSALEFN

SEQ ID NO: 59458 - protein, 15 aa, Homo sapiens
  heavy chain complementarity determining region 3 for antibody 29729
VREVVTMIEPGGFDV

SEQ ID NO: 59459 - protein, 11 aa, Homo sapiens
  light chain complementarity determining region 3 for antibody 29730
QQYDNSALEFH

SEQ ID NO: 59460 - protein, 15 aa, Homo sapiens
  heavy chain complementarity determining region 3 for antibody 29730
VREVVTMIEPGGFDV

SEQ ID NO: 59461 - protein, 9 aa, Homo sapiens
  light chain complementarity determining region 3 for antibody 29731
QQYDNPPPT

SEQ ID NO: 59462 - protein, 17 aa, Homo sapiens
  heavy chain complementarity determining region 3 for antibody 29731
GYSYGSRESYYYYGMDV

SEQ ID NO: 59463 - protein, 9 aa, Homo sapiens
  light chain complementarity determining region 3 for antibody 29732
QQYDNPLYT

SEQ ID NO: 59464 - protein, 15 aa, Homo sapiens
  heavy chain complementarity determining region 3 for antibody 29732
ARGAYYDFWSGYSDY

SEQ ID NO: 59465 - protein, 8 aa, Homo sapiens
  light chain complementarity determining region 3 for antibody 29733
QQYDNLYT

SEQ ID NO: 59466 - protein, 13 aa, Homo sapiens
  heavy chain complementarity determining region 3 for antibody 29733
VTGGIYTTGPLDF

SEQ ID NO: 59467 - protein, 9 aa, Homo sapiens
  light chain complementarity determining region 3 for antibody 29734
QQYDNLRIT

SEQ ID NO: 59468 - protein, 18 aa, Homo sapiens
  heavy chain complementarity determining region 3 for antibody 29734
ARQKRDGSGSYYDWYFDL

SEQ ID NO: 59469 - protein, 9 aa, Homo sapiens
  light chain complementarity determining region 3 for antibody 29735
QQYDNLPYT

SEQ ID NO: 59470 - protein, 9 aa, Homo sapiens
  heavy chain complementarity determining region 3 for antibody 29735
AGGDYSFDY

SEQ ID NO: 59471 - protein, 9 aa, Homo sapiens
  light chain complementarity determining region 3 for antibody 29736
QQYDNLPVT

SEQ ID NO: 59472 - protein, 12 aa, Homo sapiens
  heavy chain complementarity determining region 3 for antibody 29736
AKDSEQKWELHD

SEQ ID NO: 59473 - protein, 9 aa, Homo sapiens
  light chain complementarity determining region 3 for antibody 29737
QQYDNLPTT

SEQ ID NO: 59474 - protein, 17 aa, Homo sapiens
  heavy chain complementarity determining region 3 for antibody 29737
GYSYGSRESYYYYGMDV

SEQ ID NO: 59475 - protein, 10 aa, Homo sapiens
  light chain complementarity determining region 3 for antibody 29738
QQYDNLPSFT

SEQ ID NO: 59476 - protein, 19 aa, Homo sapiens
  heavy chain complementarity determining region 3 for antibody 29738
ARDRSPCTGGNCHLGWLVF

SEQ ID NO: 59477 - protein, 9 aa, Homo sapiens
  light chain complementarity determining region 3 for antibody 29739
QQYDNLPPT

SEQ ID NO: 59478 - protein, 16 aa, Homo sapiens
  heavy chain complementarity determining region 3 for antibody 29739
GYSYGSRESYYYGMDV

SEQ ID NO: 59479 - protein, 9 aa, Homo sapiens
  light chain complementarity determining region 3 for antibody 29740
QQYDNLPPT

SEQ ID NO: 59480 - protein, 17 aa, Homo sapiens
  heavy chain complementarity determining region 3 for antibody 29740
GYSYGSRESYSYSGMDV

SEQ ID NO: 59481 - protein, 9 aa, Homo sapiens
  light chain complementarity determining region 3 for antibody 29741
QQYDNLPPT

SEQ ID NO: 59482 - protein, 17 aa, Homo sapiens
  heavy chain complementarity determining region 3 for antibody 29741
GYSYGSRESCYYYGMDV

SEQ ID NO: 59483 - protein, 9 aa, Homo sapiens
  light chain complementarity determining region 3 for antibody 29742
QQYDNLPPT

SEQ ID NO: 59484 - protein, 19 aa, Homo sapiens
  heavy chain complementarity determining region 3 for antibody 29742
ARDHFPLARGVVSYFYYNY

SEQ ID NO: 59485 - protein, 10 aa, Homo sapiens
  light chain complementarity determining region 3 for antibody 29743
QQYDNLPPPT

SEQ ID NO: 59486 - protein, 14 aa, Homo sapiens
  heavy chain complementarity determining region 3 for antibody 29743
AKGHRIVGATYFDY

SEQ ID NO: 59487 - protein, 11 aa, Homo sapiens
  light chain complementarity determining region 3 for antibody 29744
QQYDNLPPPLT

SEQ ID NO: 59488 - protein, 15 aa, Homo sapiens
  heavy chain complementarity determining region 3 for antibody 29744
ASMPYNNVPFPPFDH

SEQ ID NO: 59489 - protein, 10 aa, Homo sapiens
  light chain complementarity determining region 3 for antibody 29745
QQYDNLPPIT

SEQ ID NO: 59490 - protein, 17 aa, Homo sapiens
  heavy chain complementarity determining region 3 for antibody 29745
VRPSDYTSGWYGVAFDP

SEQ ID NO: 59491 - protein, 9 aa, Homo sapiens
  light chain complementarity determining region 3 for antibody 29746
QQYDNLPLT

SEQ ID NO: 59492 - protein, 8 aa, Homo sapiens
  heavy chain complementarity determining region 3 for antibody 29746
ANGRYFDH

SEQ ID NO: 59493 - protein, 9 aa, Homo sapiens
  light chain complementarity determining region 3 for antibody 29747
QQYDNLPIT

SEQ ID NO: 59494 - protein, 12 aa, Homo sapiens
  heavy chain complementarity determining region 3 for antibody 29747
ARDSEQKWELHD

SEQ ID NO: 59495 - protein, 9 aa, Homo sapiens
  light chain complementarity determining region 3 for antibody 29748
QQYDNLPFT

SEQ ID NO: 59496 - protein, 19 aa, Homo sapiens
  heavy chain complementarity determining region 3 for antibody 29748
ARDRAVDTFAAYYYYGMGL

SEQ ID NO: 59497 - protein, 9 aa, Homo sapiens
  light chain complementarity determining region 3 for antibody 29749
QQYDNISLT

SEQ ID NO: 59498 - protein, 18 aa, Homo sapiens
  heavy chain complementarity determining region 3 for antibody 29749
ARHAPDLEYATSSNGMDV

SEQ ID NO: 59499 - protein, 8 aa, Homo sapiens
  light chain complementarity determining region 3 for antibody 29750
QQYDNIPT

SEQ ID NO: 59500 - protein, 14 aa, Homo sapiens
  heavy chain complementarity determining region 3 for antibody 29750
AKVRGSWYFGGLDY

SEQ ID NO: 59501 - protein, 9 aa, Homo sapiens
  light chain complementarity determining region 3 for antibody 29751
QQYDNIPPT

SEQ ID NO: 59502 - protein, 17 aa, Homo sapiens
  heavy chain complementarity determining region 3 for antibody 29751
GYSYGSRESYYYYGMDV

SEQ ID NO: 59503 - protein, 9 aa, Homo sapiens
  light chain complementarity determining region 3 for antibody 29752
QQYDNFPPT

SEQ ID NO: 59504 - protein, 17 aa, Homo sapiens
  heavy chain complementarity determining region 3 for antibody 29752
GYSYGSRESYYYYGMDV

SEQ ID NO: 59505 - protein, 9 aa, Homo sapiens
  light chain complementarity determining region 3 for antibody 29753
QQYDNFPLT

SEQ ID NO: 59506 - protein, 13 aa, Homo sapiens
  heavy chain complementarity determining region 3 for antibody 29753
ARDRAVGDHIFDY

SEQ ID NO: 59507 - protein, 9 aa, Homo sapiens
  light chain complementarity determining region 3 for antibody 29754
QQYDNFPLT

SEQ ID NO: 59508 - protein, 8 aa, Homo sapiens
  heavy chain complementarity determining region 3 for antibody 29754
ANGRYFEH

SEQ ID NO: 59509 - protein, 9 aa, Homo sapiens
  light chain complementarity determining region 3 for antibody 29755
QQYDLLSPT

SEQ ID NO: 59510 - protein, 21 aa, Homo sapiens
  heavy chain complementarity determining region 3 for antibody 29755
ARGLHIVVVTSIYRGFWHFGL

SEQ ID NO: 59511 - protein, 9 aa, Homo sapiens
  light chain complementarity determining region 3 for antibody 29756
QQYDLLPPT

SEQ ID NO: 59512 - protein, 21 aa, Homo sapiens
  heavy chain complementarity determining region 3 for antibody 29756
ARGMHVVVVTSILRGFWYFGL

SEQ ID NO: 59513 - protein, 9 aa, Homo sapiens
  light chain complementarity determining region 3 for antibody 29757
QQYDLLPPT

SEQ ID NO: 59514 - protein, 21 aa, Homo sapiens
  heavy chain complementarity determining region 3 for antibody 29757
ARGLHVVVVTSSLRGFWYFGL

SEQ ID NO: 59515 - protein, 9 aa, Homo sapiens
  light chain complementarity determining region 3 for antibody 29758
QQYDLLPPT

SEQ ID NO: 59516 - protein, 21 aa, Homo sapiens
  heavy chain complementarity determining region 3 for antibody 29758
ARGLHVVVVTSILRGFWSFGL

SEQ ID NO: 59517 - protein, 9 aa, Homo sapiens
  light chain complementarity determining region 3 for antibody 29759
QQYDLLPPT

SEQ ID NO: 59518 - protein, 21 aa, Homo sapiens
  heavy chain complementarity determining region 3 for antibody 29759
ARGLHSVVVTSIYRGFWHFGL

SEQ ID NO: 59519 - protein, 9 aa, Homo sapiens
  light chain complementarity determining region 3 for antibody 29760
QQYDLLPPT

SEQ ID NO: 59520 - protein, 21 aa, Homo sapiens
  heavy chain complementarity determining region 3 for antibody 29760
AGGLHVVVVTSILRGFWYFGL

SEQ ID NO: 59521 - protein, 9 aa, Homo sapiens
  light chain complementarity determining region 3 for antibody 29761
QQYDLLPPS

SEQ ID NO: 59522 - protein, 21 aa, Homo sapiens
  heavy chain complementarity determining region 3 for antibody 29761
ARGLHVVVVTSILRGFWYFGL

SEQ ID NO: 59523 - protein, 9 aa, Homo sapiens
  light chain complementarity determining region 3 for antibody 29762
QQYDLFRET

SEQ ID NO: 59524 - protein, 16 aa, Homo sapiens
  heavy chain complementarity determining region 3 for antibody 29762
ARWGVECSGGYCYSEY

SEQ ID NO: 59525 - protein, 9 aa, Homo sapiens
  light chain complementarity determining region 3 for antibody 29763
QQYDLFRET

SEQ ID NO: 59526 - protein, 16 aa, Homo sapiens
  heavy chain complementarity determining region 3 for antibody 29763
ARWGVECSGGYCYFEH

SEQ ID NO: 59527 - protein, 9 aa, Homo sapiens
  light chain complementarity determining region 3 for antibody 29764
QQYDLFPPT

SEQ ID NO: 59528 - protein, 21 aa, Homo sapiens
  heavy chain complementarity determining region 3 for antibody 29764
ARGLHVVVVTSILRGFWYFGL

SEQ ID NO: 59529 - protein, 9 aa, Homo sapiens
  light chain complementarity determining region 3 for antibody 29765
QQYDLFPET

SEQ ID NO: 59530 - protein, 16 aa, Homo sapiens
  heavy chain complementarity determining region 3 for antibody 29765
ARWGVECSGGYCYFEY

SEQ ID NO: 59531 - protein, 8 aa, Homo sapiens
  light chain complementarity determining region 3 for antibody 29766
QQYDKWYT

SEQ ID NO: 59532 - protein, 13 aa, Homo sapiens
  heavy chain complementarity determining region 3 for antibody 29766
VTGGIYTTGPLDF

SEQ ID NO: 59533 - protein, 8 aa, Homo sapiens
  light chain complementarity determining region 3 for antibody 29767
QQYDKLYT

SEQ ID NO: 59534 - protein, 13 aa, Homo sapiens
  heavy chain complementarity determining region 3 for antibody 29767
VTGGIYTSGPLDF

SEQ ID NO: 59535 - protein, 8 aa, Homo sapiens
  light chain complementarity determining region 3 for antibody 29768
QQYDKFYT

SEQ ID NO: 59536 - protein, 13 aa, Homo sapiens
  heavy chain complementarity determining region 3 for antibody 29768
VTGGIYTTGPLDF

SEQ ID NO: 59537 - protein, 9 aa, Homo sapiens
  light chain complementarity determining region 3 for antibody 29769
QQYDISPMT

SEQ ID NO: 59538 - protein, 16 aa, Homo sapiens
  heavy chain complementarity determining region 3 for antibody 29769
AREAKDCGDYVDAFDV

SEQ ID NO: 59539 - protein, 9 aa, Homo sapiens
  light chain complementarity determining region 3 for antibody 29770
QQYDILPPT

SEQ ID NO: 59540 - protein, 21 aa, Homo sapiens
  heavy chain complementarity determining region 3 for antibody 29770
ARGLHVVVVTSILRGFWYFGL

SEQ ID NO: 59541 - protein, 9 aa, Homo sapiens
  light chain complementarity determining region 3 for antibody 29771
QQYDGYSVP

SEQ ID NO: 59542 - protein, 11 aa, Homo sapiens
  heavy chain complementarity determining region 3 for antibody 29771
ARGNSGYHIEY

SEQ ID NO: 59543 - protein, 8 aa, Homo sapiens
  light chain complementarity determining region 3 for antibody 29772
QQYDGSST

SEQ ID NO: 59544 - protein, 15 aa, Homo sapiens
  heavy chain complementarity determining region 3 for antibody 29772
ARVPAPVVTAMSLDY

SEQ ID NO: 59545 - protein, 9 aa, Homo sapiens
  light chain complementarity determining region 3 for antibody 29773
QQYDFFREP

SEQ ID NO: 59546 - protein, 16 aa, Homo sapiens
  heavy chain complementarity determining region 3 for antibody 29773
ARWGVECSGGYCYFEY

SEQ ID NO: 59547 - protein, 9 aa, Homo sapiens
  light chain complementarity determining region 3 for antibody 29774
QQYDDLPYT

SEQ ID NO: 59548 - protein, 13 aa, Homo sapiens
  heavy chain complementarity determining region 3 for antibody 29774
ARPYFSGSYPRDY

SEQ ID NO: 59549 - protein, 9 aa, Homo sapiens
  light chain complementarity determining region 3 for antibody 29775
QQYDDLPNT

SEQ ID NO: 59550 - protein, 16 aa, Homo sapiens
  heavy chain complementarity determining region 3 for antibody 29775
ARDRRPMFGAYFGMDV

SEQ ID NO: 59551 - protein, 9 aa, Homo sapiens
  light chain complementarity determining region 3 for antibody 29776
QQYDDLPIT

SEQ ID NO: 59552 - protein, 14 aa, Homo sapiens
  heavy chain complementarity determining region 3 for antibody 29776
TTDSLLFFDGTDDH

SEQ ID NO: 59553 - protein, 9 aa, Homo sapiens
  light chain complementarity determining region 3 for antibody 29777
QQYDCLPVT

SEQ ID NO: 59554 - protein, 15 aa, Homo sapiens
  heavy chain complementarity determining region 3 for antibody 29777
ARPPHAFTGENYFNF

SEQ ID NO: 59555 - protein, 11 aa, Homo sapiens
  light chain complementarity determining region 3 for antibody 29778
QQYDASPPMYS

SEQ ID NO: 59556 - protein, 14 aa, Homo sapiens
  heavy chain complementarity determining region 3 for antibody 29778
ARHKQIPGTRGFDS

SEQ ID NO: 59557 - protein, 9 aa, Homo sapiens
  light chain complementarity determining region 3 for antibody 29779
QQYDAQSWS

SEQ ID NO: 59558 - protein, 11 aa, Homo sapiens
  heavy chain complementarity determining region 3 for antibody 29779
ARGWRDNSFDY

SEQ ID NO: 59559 - protein, 9 aa, Homo sapiens
  light chain complementarity determining region 3 for antibody 29780
QQYDAQSWP

SEQ ID NO: 59560 - protein, 11 aa, Homo sapiens
  heavy chain complementarity determining region 3 for antibody 29780
ARGWRDNSFDY

SEQ ID NO: 59561 - protein, 9 aa, Homo sapiens
  light chain complementarity determining region 3 for antibody 29781
QQYDAQSVT

SEQ ID NO: 59562 - protein, 11 aa, Homo sapiens
  heavy chain complementarity determining region 3 for antibody 29781
ARGWRDNSFDY

SEQ ID NO: 59563 - protein, 9 aa, Homo sapiens
  light chain complementarity determining region 3 for antibody 29782
QQYDAQLWT

SEQ ID NO: 59564 - protein, 11 aa, Homo sapiens
  heavy chain complementarity determining region 3 for antibody 29782
ARGWRDNSFDY

SEQ ID NO: 59565 - protein, 9 aa, Homo sapiens
  light chain complementarity determining region 3 for antibody 29783
QQYDAKSWT

SEQ ID NO: 59566 - protein, 11 aa, Homo sapiens
  heavy chain complementarity determining region 3 for antibody 29783
ARGWRDNSFDY

SEQ ID NO: 59567 - protein, 9 aa, Homo sapiens
  light chain complementarity determining region 3 for antibody 29784
QQYCTTPNT

SEQ ID NO: 59568 - protein, 8 aa, Homo sapiens
  heavy chain complementarity determining region 3 for antibody 29784
VKFSDGIK

SEQ ID NO: 59569 - protein, 9 aa, Homo sapiens
  light chain complementarity determining region 3 for antibody 29785
QQYCTTPIT

SEQ ID NO: 59570 - protein, 8 aa, Homo sapiens
  heavy chain complementarity determining region 3 for antibody 29785
VKLSDGSK

SEQ ID NO: 59571 - protein, 9 aa, Homo sapiens
  light chain complementarity determining region 3 for antibody 29786
QQYCTTPIP

SEQ ID NO: 59572 - protein, 8 aa, Homo sapiens
  heavy chain complementarity determining region 3 for antibody 29786
VKLSDGIK

SEQ ID NO: 59573 - protein, 9 aa, Homo sapiens
  light chain complementarity determining region 3 for antibody 29787
QQYCTPPTT

SEQ ID NO: 59574 - protein, 8 aa, Homo sapiens
  heavy chain complementarity determining region 3 for antibody 29787
VKLSDGIK

SEQ ID NO: 59575 - protein, 9 aa, Homo sapiens
  light chain complementarity determining region 3 for antibody 29788
QQYCSSPLT

SEQ ID NO: 59576 - protein, 19 aa, Homo sapiens
  heavy chain complementarity determining region 3 for antibody 29788
AITLSLYYHDSSGYDAFDI

SEQ ID NO: 59577 - protein, 9 aa, Homo sapiens
  light chain complementarity determining region 3 for antibody 29789
QQYCSLPLT

SEQ ID NO: 59578 - protein, 15 aa, Homo sapiens
  heavy chain complementarity determining region 3 for antibody 29789
AHRPNYYDKAGAFDI

SEQ ID NO: 59579 - protein, 9 aa, Homo sapiens
  light chain complementarity determining region 3 for antibody 29790
QQYCRSPWT

SEQ ID NO: 59580 - protein, 18 aa, Homo sapiens
  heavy chain complementarity determining region 3 for antibody 29790
ATMPSLAEPGRIYWYFDL

SEQ ID NO: 59581 - protein, 11 aa, Homo sapiens
  light chain complementarity determining region 3 for antibody 29791
QQYCPSPPLYT

SEQ ID NO: 59582 - protein, 10 aa, Homo sapiens
  heavy chain complementarity determining region 3 for antibody 29791
ARNDVYRIDH

SEQ ID NO: 59583 - protein, 9 aa, Homo sapiens
  light chain complementarity determining region 3 for antibody 29792
QQYCNLPRT

SEQ ID NO: 59584 - protein, 13 aa, Homo sapiens
  heavy chain complementarity determining region 3 for antibody 29792
AGGNFHSGGYGEY

SEQ ID NO: 59585 - protein, 9 aa, Homo sapiens
  light chain complementarity determining region 3 for antibody 29793
QQYCGSSYT

SEQ ID NO: 59586 - protein, 16 aa, Homo sapiens
  heavy chain complementarity determining region 3 for antibody 29793
ANWFGSVGDFLGPFDY

SEQ ID NO: 59587 - protein, 9 aa, Homo sapiens
  light chain complementarity determining region 3 for antibody 29794
QQYCDSPGT

SEQ ID NO: 59588 - protein, 22 aa, Homo sapiens
  heavy chain complementarity determining region 3 for antibody 29794
ARPKTQGGYYEASGYERGAFDI

SEQ ID NO: 59589 - protein, 9 aa, Homo sapiens
  light chain complementarity determining region 3 for antibody 29795
QQYAYSQIT

SEQ ID NO: 59590 - protein, 10 aa, Homo sapiens
  heavy chain complementarity determining region 3 for antibody 29795
ATGAGWLVDY

SEQ ID NO: 59591 - protein, 9 aa, Homo sapiens
  light chain complementarity determining region 3 for antibody 29796
QQYAYSPVT

SEQ ID NO: 59592 - protein, 10 aa, Homo sapiens
  heavy chain complementarity determining region 3 for antibody 29796
ATGAGWLVDY

SEQ ID NO: 59593 - protein, 9 aa, Homo sapiens
  light chain complementarity determining region 3 for antibody 29797
QQYAYSPNT

SEQ ID NO: 59594 - protein, 10 aa, Homo sapiens
  heavy chain complementarity determining region 3 for antibody 29797
ATGAGWLVDY

SEQ ID NO: 59595 - protein, 9 aa, Homo sapiens
  light chain complementarity determining region 3 for antibody 29798
QQYAYSPIT

SEQ ID NO: 59596 - protein, 10 aa, Homo sapiens
  heavy chain complementarity determining region 3 for antibody 29798
ATGAGWLFDY

SEQ ID NO: 59597 - protein, 9 aa, Homo sapiens
  light chain complementarity determining region 3 for antibody 29799
QQYAYSPIT

SEQ ID NO: 59598 - protein, 10 aa, Homo sapiens
  heavy chain complementarity determining region 3 for antibody 29799
ATGAEWLVDY

SEQ ID NO: 59599 - protein, 9 aa, Homo sapiens
  light chain complementarity determining region 3 for antibody 29800
QQYAYSPIT

SEQ ID NO: 59600 - protein, 10 aa, Homo sapiens
  heavy chain complementarity determining region 3 for antibody 29800
APGAGWLVDY

SEQ ID NO: 59601 - protein, 9 aa, Homo sapiens
  light chain complementarity determining region 3 for antibody 29801
QQYAYSPIN

SEQ ID NO: 59602 - protein, 10 aa, Homo sapiens
  heavy chain complementarity determining region 3 for antibody 29801
ATGAGWLVDY

SEQ ID NO: 59603 - protein, 8 aa, Homo sapiens
  light chain complementarity determining region 3 for antibody 29802
QQYAYLPA

SEQ ID NO: 59604 - protein, 12 aa, Homo sapiens
  heavy chain complementarity determining region 3 for antibody 29802
ARSNWNIIAFDL

SEQ ID NO: 59605 - protein, 9 aa, Homo sapiens
  light chain complementarity determining region 3 for antibody 29803
QQYATSPRT

SEQ ID NO: 59606 - protein, 10 aa, Homo sapiens
  heavy chain complementarity determining region 3 for antibody 29803
TTGGGWLVDY

SEQ ID NO: 59607 - protein, 9 aa, Homo sapiens
  light chain complementarity determining region 3 for antibody 29804
QQYATSPLT

SEQ ID NO: 59608 - protein, 10 aa, Homo sapiens
  heavy chain complementarity determining region 3 for antibody 29804
TTGGGWLVDS

SEQ ID NO: 59609 - protein, 9 aa, Homo sapiens
  light chain complementarity determining region 3 for antibody 29805
QQYATSPLT

SEQ ID NO: 59610 - protein, 10 aa, Homo sapiens
  heavy chain complementarity determining region 3 for antibody 29805
TPGGGWLVDY

SEQ ID NO: 59611 - protein, 9 aa, Homo sapiens
  light chain complementarity determining region 3 for antibody 29806
QQYATSPLT

SEQ ID NO: 59612 - protein, 10 aa, Homo sapiens
  heavy chain complementarity determining region 3 for antibody 29806
TAGGGWLVDY

SEQ ID NO: 59613 - protein, 9 aa, Homo sapiens
  light chain complementarity determining region 3 for antibody 29807
QQYATSPLP

SEQ ID NO: 59614 - protein, 10 aa, Homo sapiens
  heavy chain complementarity determining region 3 for antibody 29807
VAGAGWLPDY

SEQ ID NO: 59615 - protein, 9 aa, Homo sapiens
  light chain complementarity determining region 3 for antibody 29808
QQYATSPLN

SEQ ID NO: 59616 - protein, 10 aa, Homo sapiens
  heavy chain complementarity determining region 3 for antibody 29808
TTGGGWLVDY

SEQ ID NO: 59617 - protein, 9 aa, Homo sapiens
  light chain complementarity determining region 3 for antibody 29809
QQYASSSYT

SEQ ID NO: 59618 - protein, 11 aa, Homo sapiens
  heavy chain complementarity determining region 3 for antibody 29809
ARGGFYGSFDF

SEQ ID NO: 59619 - protein, 9 aa, Homo sapiens
  light chain complementarity determining region 3 for antibody 29810
QQYASSPRT

SEQ ID NO: 59620 - protein, 12 aa, Homo sapiens
  heavy chain complementarity determining region 3 for antibody 29810
TTKRGYIYGAEY

SEQ ID NO: 59621 - protein, 9 aa, Homo sapiens
  light chain complementarity determining region 3 for antibody 29811
QQYASAPMT

SEQ ID NO: 59622 - protein, 15 aa, Homo sapiens
  heavy chain complementarity determining region 3 for antibody 29811
AKAHSSRNYEDFYDS

SEQ ID NO: 59623 - protein, 9 aa, Homo sapiens
  light chain complementarity determining region 3 for antibody 29812
QQYAPSPLT

SEQ ID NO: 59624 - protein, 10 aa, Homo sapiens
  heavy chain complementarity determining region 3 for antibody 29812
VAGAGWLPDY

SEQ ID NO: 59625 - protein, 10 aa, Homo sapiens
  light chain complementarity determining region 3 for antibody 29813
QQYANQPPIT

SEQ ID NO: 59626 - protein, 12 aa, Homo sapiens
  heavy chain complementarity determining region 3 for antibody 29813
ARVRDSLSPAFH

SEQ ID NO: 59627 - protein, 10 aa, Homo sapiens
  light chain complementarity determining region 3 for antibody 29814
QQYANQPPIP

SEQ ID NO: 59628 - protein, 12 aa, Homo sapiens
  heavy chain complementarity determining region 3 for antibody 29814
ARVLDSLSPAFH

SEQ ID NO: 59629 - protein, 9 aa, Homo sapiens
  light chain complementarity determining region 3 for antibody 29815
QQYAGAPRT

SEQ ID NO: 59630 - protein, 14 aa, Homo sapiens
  heavy chain complementarity determining region 3 for antibody 29815
TRDGDNFRWGNYHY

SEQ ID NO: 59631 - protein, 9 aa, Homo sapiens
  light chain complementarity determining region 3 for antibody 29816
QQYAGAPRT

SEQ ID NO: 59632 - protein, 14 aa, Homo sapiens
  heavy chain complementarity determining region 3 for antibody 29816
TRDGDNFLWGNYNY

SEQ ID NO: 59633 - protein, 9 aa, Homo sapiens
  light chain complementarity determining region 3 for antibody 29817
QQYAGAPRN

SEQ ID NO: 59634 - protein, 14 aa, Homo sapiens
  heavy chain complementarity determining region 3 for antibody 29817
TRDGDNFLWGNYHY

SEQ ID NO: 59635 - protein, 8 aa, Homo sapiens
  light chain complementarity determining region 3 for antibody 29818
QQYAFSLP

SEQ ID NO: 59636 - protein, 12 aa, Homo sapiens
  heavy chain complementarity determining region 3 for antibody 29818
AGEIDTTGYFDP

SEQ ID NO: 59637 - protein, 9 aa, Homo sapiens
  light chain complementarity determining region 3 for antibody 29819
QQYAFLPIT

SEQ ID NO: 59638 - protein, 10 aa, Homo sapiens
  heavy chain complementarity determining region 3 for antibody 29819
ATGAGWLVDY

SEQ ID NO: 59639 - protein, 8 aa, Homo sapiens
  light chain complementarity determining region 3 for antibody 29820
QQYAAWLT

SEQ ID NO: 59640 - protein, 15 aa, Homo sapiens
  heavy chain complementarity determining region 3 for antibody 29820
VKNPGGWRDTYYFHY

SEQ ID NO: 59641 - protein, 9 aa, Homo sapiens
  light chain complementarity determining region 3 for antibody 29821
QQWVSFPIT

SEQ ID NO: 59642 - protein, 12 aa, Homo sapiens
  heavy chain complementarity determining region 3 for antibody 29821
TRHRSSERKFDP

SEQ ID NO: 59643 - protein, 10 aa, Homo sapiens
  light chain complementarity determining region 3 for antibody 29822
QQWTNSPPWT

SEQ ID NO: 59644 - protein, 14 aa, Homo sapiens
  heavy chain complementarity determining region 3 for antibody 29822
ASLAYGANQDAFDL

SEQ ID NO: 59645 - protein, 11 aa, Homo sapiens
  light chain complementarity determining region 3 for antibody 29823
QQWSTSGSRDS

SEQ ID NO: 59646 - protein, 14 aa, Homo sapiens
  heavy chain complementarity determining region 3 for antibody 29823
ARHTEMTGLRGFDR

SEQ ID NO: 59647 - protein, 11 aa, Homo sapiens
  light chain complementarity determining region 3 for antibody 29824
QQWSTSGSGYS

SEQ ID NO: 59648 - protein, 14 aa, Homo sapiens
  heavy chain complementarity determining region 3 for antibody 29824
ARHTEMTGLRGFDR

SEQ ID NO: 59649 - protein, 9 aa, Homo sapiens
  light chain complementarity determining region 3 for antibody 29825
QQWNSYPLT

SEQ ID NO: 59650 - protein, 12 aa, Homo sapiens
  heavy chain complementarity determining region 3 for antibody 29825
TRGGGPNSPFHY

SEQ ID NO: 59651 - protein, 9 aa, Homo sapiens
  light chain complementarity determining region 3 for antibody 29826
QQWKSWPLT

SEQ ID NO: 59652 - protein, 11 aa, Homo sapiens
  heavy chain complementarity determining region 3 for antibody 29826
AAATRWLAFDS

SEQ ID NO: 59653 - protein, 11 aa, Homo sapiens
  light chain complementarity determining region 3 for antibody 29827
QQWGTSGSGYT

SEQ ID NO: 59654 - protein, 14 aa, Homo sapiens
  heavy chain complementarity determining region 3 for antibody 29827
ARHTSMAGLRGFDQ

SEQ ID NO: 59655 - protein, 9 aa, Homo sapiens
  light chain complementarity determining region 3 for antibody 29828
QQVYSNLRT

SEQ ID NO: 59656 - protein, 21 aa, Homo sapiens
  heavy chain complementarity determining region 3 for antibody 29828
AKDSMDSRGTVPGTVVGAFDY

SEQ ID NO: 59657 - protein, 9 aa, Homo sapiens
  light chain complementarity determining region 3 for antibody 29829
QQVNTFPLT

SEQ ID NO: 59658 - protein, 20 aa, Homo sapiens
  heavy chain complementarity determining region 3 for antibody 29829
ARDSNTPTLSDYDYHYGMDV

SEQ ID NO: 59659 - protein, 8 aa, Homo sapiens
  light chain complementarity determining region 3 for antibody 29830
QQVNSYSR

SEQ ID NO: 59660 - protein, 20 aa, Homo sapiens
  heavy chain complementarity determining region 3 for antibody 29830
ARDGAVIAPRTRGPGFYFDS

SEQ ID NO: 59661 - protein, 8 aa, Homo sapiens
  light chain complementarity determining region 3 for antibody 29831
QQVNSYPR

SEQ ID NO: 59662 - protein, 20 aa, Homo sapiens
  heavy chain complementarity determining region 3 for antibody 29831
ASDGAVIAPRTRGPGFYFDS

SEQ ID NO: 59663 - protein, 8 aa, Homo sapiens
  light chain complementarity determining region 3 for antibody 29832
QQVNSYPP

SEQ ID NO: 59664 - protein, 20 aa, Homo sapiens
  heavy chain complementarity determining region 3 for antibody 29832
ARDGAVIAPRTRGPGFYFDS

SEQ ID NO: 59665 - protein, 9 aa, Homo sapiens
  light chain complementarity determining region 3 for antibody 29833
QQVNRLPLT

SEQ ID NO: 59666 - protein, 14 aa, Homo sapiens
  heavy chain complementarity determining region 3 for antibody 29833
TTDSPLRRYNYFVY

SEQ ID NO: 59667 - protein, 9 aa, Homo sapiens
  light chain complementarity determining region 3 for antibody 29834
QQVNRFPLP

SEQ ID NO: 59668 - protein, 14 aa, Homo sapiens
  heavy chain complementarity determining region 3 for antibody 29834
TTDSPLRRYNYFVY

SEQ ID NO: 59669 - protein, 9 aa, Homo sapiens
  light chain complementarity determining region 3 for antibody 29835
QQVKDYHIT

SEQ ID NO: 59670 - protein, 16 aa, Homo sapiens
  heavy chain complementarity determining region 3 for antibody 29835
ARVVHKSLLTQPPNDY

SEQ ID NO: 59671 - protein, 9 aa, Homo sapiens
  light chain complementarity determining region 3 for antibody 29836
QQVHSYPIT

SEQ ID NO: 59672 - protein, 17 aa, Homo sapiens
  heavy chain complementarity determining region 3 for antibody 29836
ARSGPYHSSGYYYYLDS

SEQ ID NO: 59673 - protein, 9 aa, Homo sapiens
  light chain complementarity determining region 3 for antibody 29837
QQVHSFPPT

SEQ ID NO: 59674 - protein, 12 aa, Homo sapiens
  heavy chain complementarity determining region 3 for antibody 29837
ARDTDGSVGLDV

SEQ ID NO: 59675 - protein, 9 aa, Homo sapiens
  light chain complementarity determining region 3 for antibody 29838
QQVHRFPLT

SEQ ID NO: 59676 - protein, 14 aa, Homo sapiens
  heavy chain complementarity determining region 3 for antibody 29838
TTDSPLRRYNYFVY

SEQ ID NO: 59677 - protein, 9 aa, Homo sapiens
  light chain complementarity determining region 3 for antibody 29839
QQVHLYPFT

SEQ ID NO: 59678 - protein, 12 aa, Homo sapiens
  heavy chain complementarity determining region 3 for antibody 29839
ARPLDGDFGFDP

SEQ ID NO: 59679 - protein, 9 aa, Homo sapiens
  light chain complementarity determining region 3 for antibody 29840
QQVHIYPFT

SEQ ID NO: 59680 - protein, 12 aa, Homo sapiens
  heavy chain complementarity determining region 3 for antibody 29840
ARPLYGDFGFDP

SEQ ID NO: 59681 - protein, 9 aa, Homo sapiens
  light chain complementarity determining region 3 for antibody 29841
QQVHISPFT

SEQ ID NO: 59682 - protein, 12 aa, Homo sapiens
  heavy chain complementarity determining region 3 for antibody 29841
ARPLDGDFGFDP

SEQ ID NO: 59683 - protein, 9 aa, Homo sapiens
  light chain complementarity determining region 3 for antibody 29842
QQVGSSPRT

SEQ ID NO: 59684 - protein, 25 aa, Homo sapiens
  heavy chain complementarity determining region 3 for antibody 29842
ARLRIDRLRLPGAMRGPLYDCGLNV

SEQ ID NO: 59685 - protein, 10 aa, Homo sapiens
  light chain complementarity determining region 3 for antibody 29843
QQVGNSPPWT

SEQ ID NO: 59686 - protein, 12 aa, Homo sapiens
  heavy chain complementarity determining region 3 for antibody 29843
AKEGLIGGYFDL

SEQ ID NO: 59687 - protein, 9 aa, Homo sapiens
  light chain complementarity determining region 3 for antibody 29844
QQVEDYPIP

SEQ ID NO: 59688 - protein, 16 aa, Homo sapiens
  heavy chain complementarity determining region 3 for antibody 29844
SRVVAKSILPQPPNDY

SEQ ID NO: 59689 - protein, 9 aa, Homo sapiens
  light chain complementarity determining region 3 for antibody 29845
QQTYTSPFN

SEQ ID NO: 59690 - protein, 18 aa, Homo sapiens
  heavy chain complementarity determining region 3 for antibody 29845
AKELIPDVSVLRGGSPES

SEQ ID NO: 59691 - protein, 9 aa, Homo sapiens
  light chain complementarity determining region 3 for antibody 29846
QQTYTIVVT

SEQ ID NO: 59692 - protein, 15 aa, Homo sapiens
  heavy chain complementarity determining region 3 for antibody 29846
ARDSFDGSYSGSFDY

SEQ ID NO: 59693 - protein, 9 aa, Homo sapiens
  light chain complementarity determining region 3 for antibody 29847
QQTYTIGVP

SEQ ID NO: 59694 - protein, 15 aa, Homo sapiens
  heavy chain complementarity determining region 3 for antibody 29847
ARDSFDGSYSGSFDY

SEQ ID NO: 59695 - protein, 9 aa, Homo sapiens
  light chain complementarity determining region 3 for antibody 29848
QQTYSVPRT

SEQ ID NO: 59696 - protein, 17 aa, Homo sapiens
  heavy chain complementarity determining region 3 for antibody 29848
ARDMATAPPGTTENFDH

SEQ ID NO: 59697 - protein, 9 aa, Homo sapiens
  light chain complementarity determining region 3 for antibody 29849
QQTYSTPST

SEQ ID NO: 59698 - protein, 22 aa, Homo sapiens
  heavy chain complementarity determining region 3 for antibody 29849
ARNGFYDFWSGNYAGAHYGLDV

SEQ ID NO: 59699 - protein, 10 aa, Homo sapiens
  light chain complementarity determining region 3 for antibody 29850
QQTYSTPSCP

SEQ ID NO: 59700 - protein, 12 aa, Homo sapiens
  heavy chain complementarity determining region 3 for antibody 29850
ATDYGDYGAFDN

SEQ ID NO: 59701 - protein, 9 aa, Homo sapiens
  light chain complementarity determining region 3 for antibody 29851
QQTYSTPRT

SEQ ID NO: 59702 - protein, 21 aa, Homo sapiens
  heavy chain complementarity determining region 3 for antibody 29851
VREYAFQWNDETGYHNYGMDV

SEQ ID NO: 59703 - protein, 8 aa, Homo sapiens
  light chain complementarity determining region 3 for antibody 29852
QQTYSTPR

SEQ ID NO: 59704 - protein, 16 aa, Homo sapiens
  heavy chain complementarity determining region 3 for antibody 29852
ARDLADVWRFSWRFDP

SEQ ID NO: 59705 - protein, 10 aa, Homo sapiens
  light chain complementarity determining region 3 for antibody 29853
QQTYSTPPYT

SEQ ID NO: 59706 - protein, 19 aa, Homo sapiens
  heavy chain complementarity determining region 3 for antibody 29853
EKDRDSSGWDNYYYYGMDV

SEQ ID NO: 59707 - protein, 10 aa, Homo sapiens
  light chain complementarity determining region 3 for antibody 29854
QQTYSTPPTT

SEQ ID NO: 59708 - protein, 19 aa, Homo sapiens
  heavy chain complementarity determining region 3 for antibody 29854
AKDRDSSGWDNYYYYGMDV

SEQ ID NO: 59709 - protein, 10 aa, Homo sapiens
  light chain complementarity determining region 3 for antibody 29855
QQTYSTPPNT

SEQ ID NO: 59710 - protein, 19 aa, Homo sapiens
  heavy chain complementarity determining region 3 for antibody 29855
AKDRDSSGWDNYYYYGMDV

SEQ ID NO: 59711 - protein, 10 aa, Homo sapiens
  light chain complementarity determining region 3 for antibody 29856
QQTYSTPPLP

SEQ ID NO: 59712 - protein, 21 aa, Homo sapiens
  heavy chain complementarity determining region 3 for antibody 29856
AKDTYSGSFLEPYYYYYGMDV

SEQ ID NO: 59713 - protein, 9 aa, Homo sapiens
  light chain complementarity determining region 3 for antibody 29857
QQTYSTPNT

SEQ ID NO: 59714 - protein, 22 aa, Homo sapiens
  heavy chain complementarity determining region 3 for antibody 29857
ARNGFYDFWSGNYAGAHYGLDV

SEQ ID NO: 59715 - protein, 9 aa, Homo sapiens
  light chain complementarity determining region 3 for antibody 29858
QQTYSTPHT

SEQ ID NO: 59716 - protein, 22 aa, Homo sapiens
  heavy chain complementarity determining region 3 for antibody 29858
ARNGFYDFWSGNYAGAHYGLDV

SEQ ID NO: 59717 - protein, 9 aa, Homo sapiens
  light chain complementarity determining region 3 for antibody 29859
QQTYSTLST

SEQ ID NO: 59718 - protein, 13 aa, Homo sapiens
  heavy chain complementarity determining region 3 for antibody 29859
ARGGISTRPSHDC

SEQ ID NO: 59719 - protein, 10 aa, Homo sapiens
  light chain complementarity determining region 3 for antibody 29860
QQTYSTLGYT

SEQ ID NO: 59720 - protein, 14 aa, Homo sapiens
  heavy chain complementarity determining region 3 for antibody 29860
ARDLTGSRAPYFDY

SEQ ID NO: 59721 - protein, 10 aa, Homo sapiens
  light chain complementarity determining region 3 for antibody 29861
QQTYSTLGNT

SEQ ID NO: 59722 - protein, 14 aa, Homo sapiens
  heavy chain complementarity determining region 3 for antibody 29861
ARDLTGYRAPYFDY

SEQ ID NO: 59723 - protein, 10 aa, Homo sapiens
  light chain complementarity determining region 3 for antibody 29862
QQTYSTFTWT

SEQ ID NO: 59724 - protein, 17 aa, Homo sapiens
  heavy chain complementarity determining region 3 for antibody 29862
ARASDYGGNSGVYYFDY

SEQ ID NO: 59725 - protein, 9 aa, Homo sapiens
  light chain complementarity determining region 3 for antibody 29863
QQTYSSPLP

SEQ ID NO: 59726 - protein, 17 aa, Homo sapiens
  heavy chain complementarity determining region 3 for antibody 29863
ARSGPEWLVHADRPLDY

SEQ ID NO: 59727 - protein, 9 aa, Homo sapiens
  light chain complementarity determining region 3 for antibody 29864
QQTYSSPFT

SEQ ID NO: 59728 - protein, 14 aa, Homo sapiens
  heavy chain complementarity determining region 3 for antibody 29864
ARARDTSGYSGLDY

SEQ ID NO: 59729 - protein, 8 aa, Homo sapiens
  light chain complementarity determining region 3 for antibody 29865
QQTYSSKP

SEQ ID NO: 59730 - protein, 18 aa, Homo sapiens
  heavy chain complementarity determining region 3 for antibody 29865
ARRHYYDGTAFRAEYFDD

SEQ ID NO: 59731 - protein, 9 aa, Homo sapiens
  light chain complementarity determining region 3 for antibody 29866
QQTYSPPRT

SEQ ID NO: 59732 - protein, 21 aa, Homo sapiens
  heavy chain complementarity determining region 3 for antibody 29866
AKVAVGVPSTTGFGEYCGLDV

SEQ ID NO: 59733 - protein, 9 aa, Homo sapiens
  light chain complementarity determining region 3 for antibody 29867
QQTYSPPRT

SEQ ID NO: 59734 - protein, 21 aa, Homo sapiens
  heavy chain complementarity determining region 3 for antibody 29867
AKVAVGVPSTSGFGEYYGLDV

SEQ ID NO: 59735 - protein, 9 aa, Homo sapiens
  light chain complementarity determining region 3 for antibody 29868
QQTYSPPRP

SEQ ID NO: 59736 - protein, 21 aa, Homo sapiens
  heavy chain complementarity determining region 3 for antibody 29868
AKVAVGVPSTTGFGEYYGLDV

SEQ ID NO: 59737 - protein, 9 aa, Homo sapiens
  light chain complementarity determining region 3 for antibody 29869
QQTYSPPLT

SEQ ID NO: 59738 - protein, 24 aa, Homo sapiens
  heavy chain complementarity determining region 3 for antibody 29869
ARGSLEWYYDSSGYYYAPGDAFDI

SEQ ID NO: 59739 - protein, 9 aa, Homo sapiens
  light chain complementarity determining region 3 for antibody 29870
QQTYSNPLT

SEQ ID NO: 59740 - protein, 18 aa, Homo sapiens
  heavy chain complementarity determining region 3 for antibody 29870
ARSGRRDSSGFLVNWFDY

SEQ ID NO: 59741 - protein, 9 aa, Homo sapiens
  light chain complementarity determining region 3 for antibody 29871
QQTYSIPPT

SEQ ID NO: 59742 - protein, 14 aa, Homo sapiens
  heavy chain complementarity determining region 3 for antibody 29871
ARVGTLWWIDTFDR

SEQ ID NO: 59743 - protein, 9 aa, Homo sapiens
  light chain complementarity determining region 3 for antibody 29872
QQTYRIPQT

SEQ ID NO: 59744 - protein, 14 aa, Homo sapiens
  heavy chain complementarity determining region 3 for antibody 29872
ARVGTLWWIDTFDR

SEQ ID NO: 59745 - protein, 10 aa, Homo sapiens
  light chain complementarity determining region 3 for antibody 29873
QQTYNTPPYP

SEQ ID NO: 59746 - protein, 14 aa, Homo sapiens
  heavy chain complementarity determining region 3 for antibody 29873
AKVTPSPYGDSLND

SEQ ID NO: 59747 - protein, 9 aa, Homo sapiens
  light chain complementarity determining region 3 for antibody 29874
QQTYISPFN

SEQ ID NO: 59748 - protein, 18 aa, Homo sapiens
  heavy chain complementarity determining region 3 for antibody 29874
AKDLIPDVSVLRGGSPES

SEQ ID NO: 59749 - protein, 9 aa, Homo sapiens
  light chain complementarity determining region 3 for antibody 29875
QQTSSTPLT

SEQ ID NO: 59750 - protein, 18 aa, Homo sapiens
  heavy chain complementarity determining region 3 for antibody 29875
ARSGRRDSSGFLVNWFDY

SEQ ID NO: 59751 - protein, 9 aa, Homo sapiens
  light chain complementarity determining region 3 for antibody 29876
QQTNNLPVS

SEQ ID NO: 59752 - protein, 25 aa, Homo sapiens
  heavy chain complementarity determining region 3 for antibody 29876
ARERHDFSSGSYTGGREYYYYGLDV

SEQ ID NO: 59753 - protein, 9 aa, Homo sapiens
  light chain complementarity determining region 3 for antibody 29877
QQTNITPCT

SEQ ID NO: 59754 - protein, 14 aa, Homo sapiens
  heavy chain complementarity determining region 3 for antibody 29877
TRAPSRIGIYYPHL

SEQ ID NO: 59755 - protein, 10 aa, Homo sapiens
  light chain complementarity determining region 3 for antibody 29878
QQTHSSPPLT

SEQ ID NO: 59756 - protein, 15 aa, Homo sapiens
  heavy chain complementarity determining region 3 for antibody 29878
ARTPWFGDFLHTNDY

SEQ ID NO: 59757 - protein, 10 aa, Homo sapiens
  light chain complementarity determining region 3 for antibody 29879
QQTHSFPPLT

SEQ ID NO: 59758 - protein, 15 aa, Homo sapiens
  heavy chain complementarity determining region 3 for antibody 29879
ARTPWFGDFLHANDY

SEQ ID NO: 59759 - protein, 10 aa, Homo sapiens
  light chain complementarity determining region 3 for antibody 29880
QQTHSFPPLP

SEQ ID NO: 59760 - protein, 15 aa, Homo sapiens
  heavy chain complementarity determining region 3 for antibody 29880
ARTPWFGDFLHTNDY

SEQ ID NO: 59761 - protein, 9 aa, Homo sapiens
  light chain complementarity determining region 3 for antibody 29881
QQTFSSPPT

SEQ ID NO: 59762 - protein, 16 aa, Homo sapiens
  heavy chain complementarity determining region 3 for antibody 29881
VTYRETVTASGYGLDD

SEQ ID NO: 59763 - protein, 9 aa, Homo sapiens
  light chain complementarity determining region 3 for antibody 29882
QQTFSSPPT

SEQ ID NO: 59764 - protein, 16 aa, Homo sapiens
  heavy chain complementarity determining region 3 for antibody 29882
VTYRDTVTDSGYGLDD

SEQ ID NO: 59765 - protein, 10 aa, Homo sapiens
  light chain complementarity determining region 3 for antibody 29883
QQTFSPLAFT

SEQ ID NO: 59766 - protein, 23 aa, Homo sapiens
  heavy chain complementarity determining region 3 for antibody 29883
ARTPPFGDFSSVTFYQFFYGMDV

SEQ ID NO: 59767 - protein, 9 aa, Homo sapiens
  light chain complementarity determining region 3 for antibody 29884
QQTDRFPIT

SEQ ID NO: 59768 - protein, 14 aa, Homo sapiens
  heavy chain complementarity determining region 3 for antibody 29884
ARFMVRDVLYYFDL

SEQ ID NO: 59769 - protein, 9 aa, Homo sapiens
  light chain complementarity determining region 3 for antibody 29885
QQSYTTPWT

SEQ ID NO: 59770 - protein, 16 aa, Homo sapiens
  heavy chain complementarity determining region 3 for antibody 29885
TTDSLTMVRGEGVFDY

SEQ ID NO: 59771 - protein, 9 aa, Homo sapiens
  light chain complementarity determining region 3 for antibody 29886
QQSYTTPWT

SEQ ID NO: 59772 - protein, 18 aa, Homo sapiens
  heavy chain complementarity determining region 3 for antibody 29886
ARAYRFRATIIAFDGLDM

SEQ ID NO: 59773 - protein, 9 aa, Homo sapiens
  light chain complementarity determining region 3 for antibody 29887
QQSYTTPRT

SEQ ID NO: 59774 - protein, 21 aa, Homo sapiens
  heavy chain complementarity determining region 3 for antibody 29887
VREYALQWNDETGYYYYVMDM

SEQ ID NO: 59775 - protein, 9 aa, Homo sapiens
  light chain complementarity determining region 3 for antibody 29888
QQSYTTPRT

SEQ ID NO: 59776 - protein, 21 aa, Homo sapiens
  heavy chain complementarity determining region 3 for antibody 29888
TRDFALNWNDETGYYHHGLDV

SEQ ID NO: 59777 - protein, 9 aa, Homo sapiens
  light chain complementarity determining region 3 for antibody 29889
QQSYTTPRT

SEQ ID NO: 59778 - protein, 20 aa, Homo sapiens
  heavy chain complementarity determining region 3 for antibody 29889
ARESGVFPIFDWLPYAWFDP

SEQ ID NO: 59779 - protein, 9 aa, Homo sapiens
  light chain complementarity determining region 3 for antibody 29890
QQSYTTPRT

SEQ ID NO: 59780 - protein, 8 aa, Homo sapiens
  heavy chain complementarity determining region 3 for antibody 29890
ARDGAFDS

SEQ ID NO: 59781 - protein, 9 aa, Homo sapiens
  light chain complementarity determining region 3 for antibody 29891
QQSYTTPRP

SEQ ID NO: 59782 - protein, 20 aa, Homo sapiens
  heavy chain complementarity determining region 3 for antibody 29891
ARESGVFPIFDWLPYTWFDP

SEQ ID NO: 59783 - protein, 10 aa, Homo sapiens
  light chain complementarity determining region 3 for antibody 29892
QQSYTTPLTT

SEQ ID NO: 59784 - protein, 14 aa, Homo sapiens
  heavy chain complementarity determining region 3 for antibody 29892
ARDRKTRLGDNLDI

SEQ ID NO: 59785 - protein, 9 aa, Homo sapiens
  light chain complementarity determining region 3 for antibody 29893
QQSYTTPLT

SEQ ID NO: 59786 - protein, 14 aa, Homo sapiens
  heavy chain complementarity determining region 3 for antibody 29893
ARGTHYFGSEPYDY

SEQ ID NO: 59787 - protein, 9 aa, Homo sapiens
  light chain complementarity determining region 3 for antibody 29894
QQSYTTPLP

SEQ ID NO: 59788 - protein, 14 aa, Homo sapiens
  heavy chain complementarity determining region 3 for antibody 29894
ARGTHYFGSETYDY

SEQ ID NO: 59789 - protein, 10 aa, Homo sapiens
  light chain complementarity determining region 3 for antibody 29895
QQSYTTPLKT

SEQ ID NO: 59790 - protein, 14 aa, Homo sapiens
  heavy chain complementarity determining region 3 for antibody 29895
ARDRKTRLGDNFDI

SEQ ID NO: 59791 - protein, 10 aa, Homo sapiens
  light chain complementarity determining region 3 for antibody 29896
QQSYTTPLKS

SEQ ID NO: 59792 - protein, 14 aa, Homo sapiens
  heavy chain complementarity determining region 3 for antibody 29896
ARDRKTRLGDNLDI

SEQ ID NO: 59793 - protein, 10 aa, Homo sapiens
  light chain complementarity determining region 3 for antibody 29897
QQSYTTPLKP

SEQ ID NO: 59794 - protein, 14 aa, Homo sapiens
  heavy chain complementarity determining region 3 for antibody 29897
ARDRKTRLGDNLDI

SEQ ID NO: 59795 - protein, 9 aa, Homo sapiens
  light chain complementarity determining region 3 for antibody 29898
QQSYTTPHT

SEQ ID NO: 59796 - protein, 11 aa, Homo sapiens
  heavy chain complementarity determining region 3 for antibody 29898
ARVQSGYWFDS

SEQ ID NO: 59797 - protein, 9 aa, Homo sapiens
  light chain complementarity determining region 3 for antibody 29899
QQSYTSVRT

SEQ ID NO: 59798 - protein, 12 aa, Homo sapiens
  heavy chain complementarity determining region 3 for antibody 29899
VKDCSLGGSRDS

SEQ ID NO: 59799 - protein, 9 aa, Homo sapiens
  light chain complementarity determining region 3 for antibody 29900
QQSYTSVRP

SEQ ID NO: 59800 - protein, 12 aa, Homo sapiens
  heavy chain complementarity determining region 3 for antibody 29900
VKDCGLGGSRDS

SEQ ID NO: 59801 - protein, 9 aa, Homo sapiens
  light chain complementarity determining region 3 for antibody 29901
QQSYTSRRT

SEQ ID NO: 59802 - protein, 21 aa, Homo sapiens
  heavy chain complementarity determining region 3 for antibody 29901
ARDHAFQWNDETGYYYYALDV

SEQ ID NO: 59803 - protein, 9 aa, Homo sapiens
  light chain complementarity determining region 3 for antibody 29902
QQSYTIPRT

SEQ ID NO: 59804 - protein, 13 aa, Homo sapiens
  heavy chain complementarity determining region 3 for antibody 29902
AREHIAGRRVLAG

SEQ ID NO: 59805 - protein, 9 aa, Homo sapiens
  light chain complementarity determining region 3 for antibody 29903
QQSYTIPLT

SEQ ID NO: 59806 - protein, 13 aa, Homo sapiens
  heavy chain complementarity determining region 3 for antibody 29903
SWRCCEEHDAFDF

SEQ ID NO: 59807 - protein, 10 aa, Homo sapiens
  light chain complementarity determining region 3 for antibody 29904
QQSYSYFSIT

SEQ ID NO: 59808 - protein, 14 aa, Homo sapiens
  heavy chain complementarity determining region 3 for antibody 29904
ARDFVRGLWRSFDI

SEQ ID NO: 59809 - protein, 9 aa, Homo sapiens
  light chain complementarity determining region 3 for antibody 29905
QQSYSVRWA

SEQ ID NO: 59810 - protein, 20 aa, Homo sapiens
  heavy chain complementarity determining region 3 for antibody 29905
VRDGTPATHESNSVWNAFDI

SEQ ID NO: 59811 - protein, 9 aa, Homo sapiens
  light chain complementarity determining region 3 for antibody 29906
QQSYSVPPT

SEQ ID NO: 59812 - protein, 17 aa, Homo sapiens
  heavy chain complementarity determining region 3 for antibody 29906
VRDRHNWNYGPKGLFDN

SEQ ID NO: 59813 - protein, 9 aa, Homo sapiens
  light chain complementarity determining region 3 for antibody 29907
QQSYSTSWP

SEQ ID NO: 59814 - protein, 12 aa, Homo sapiens
  heavy chain complementarity determining region 3 for antibody 29907
ARVEYGDYCVDY

SEQ ID NO: 59815 - protein, 8 aa, Homo sapiens
  light chain complementarity determining region 3 for antibody 29908
QQSYSTRP

SEQ ID NO: 59816 - protein, 19 aa, Homo sapiens
  heavy chain complementarity determining region 3 for antibody 29908
ARETYYDILAPKDYYVMDV

SEQ ID NO: 59817 - protein, 9 aa, Homo sapiens
  light chain complementarity determining region 3 for antibody 29909
QQSYSTQFT

SEQ ID NO: 59818 - protein, 10 aa, Homo sapiens
  heavy chain complementarity determining region 3 for antibody 29909
TTMTTAGSDS

SEQ ID NO: 59819 - protein, 9 aa, Homo sapiens
  light chain complementarity determining region 3 for antibody 29910
QQSYSTPYT

SEQ ID NO: 59820 - protein, 8 aa, Homo sapiens
  heavy chain complementarity determining region 3 for antibody 29910
PAWGSSHH

SEQ ID NO: 59821 - protein, 9 aa, Homo sapiens
  light chain complementarity determining region 3 for antibody 29911
QQSYSTPYT

SEQ ID NO: 59822 - protein, 17 aa, Homo sapiens
  heavy chain complementarity determining region 3 for antibody 29911
AVYASTDGIFNKDAFDI

SEQ ID NO: 59823 - protein, 9 aa, Homo sapiens
  light chain complementarity determining region 3 for antibody 29912
QQSYSTPYT

SEQ ID NO: 59824 - protein, 19 aa, Homo sapiens
  heavy chain complementarity determining region 3 for antibody 29912
ARQGYYGSGSISRADWFAP

SEQ ID NO: 59825 - protein, 9 aa, Homo sapiens
  light chain complementarity determining region 3 for antibody 29913
QQSYSTPYT

SEQ ID NO: 59826 - protein, 25 aa, Homo sapiens
  heavy chain complementarity determining region 3 for antibody 29913
ARMDLLYDYWSRDPQRGLQYYGMDV

SEQ ID NO: 59827 - protein, 9 aa, Homo sapiens
  light chain complementarity determining region 3 for antibody 29914
QQSYSTPYT

SEQ ID NO: 59828 - protein, 20 aa, Homo sapiens
  heavy chain complementarity determining region 3 for antibody 29914
AREFPDVSDGSGYPPSHFDY

SEQ ID NO: 59829 - protein, 9 aa, Homo sapiens
  light chain complementarity determining region 3 for antibody 29915
QQSYSTPYP

SEQ ID NO: 59830 - protein, 8 aa, Homo sapiens
  heavy chain complementarity determining region 3 for antibody 29915
TAWGSSQH

SEQ ID NO: 59831 - protein, 9 aa, Homo sapiens
  light chain complementarity determining region 3 for antibody 29916
QQSYSTPWH

SEQ ID NO: 59832 - protein, 15 aa, Homo sapiens
  heavy chain complementarity determining region 3 for antibody 29916
ASRYSSGWYYYGMDV

SEQ ID NO: 59833 - protein, 8 aa, Homo sapiens
  light chain complementarity determining region 3 for antibody 29917
QQSYSTPT

SEQ ID NO: 59834 - protein, 17 aa, Homo sapiens
  heavy chain complementarity determining region 3 for antibody 29917
ARDRRGYNYSPGYAFDI

SEQ ID NO: 59835 - protein, 10 aa, Homo sapiens
  light chain complementarity determining region 3 for antibody 29918
QQSYSTPSWT

SEQ ID NO: 59836 - protein, 13 aa, Homo sapiens
  heavy chain complementarity determining region 3 for antibody 29918
ATDWTLERHAFDV

SEQ ID NO: 59837 - protein, 10 aa, Homo sapiens
  light chain complementarity determining region 3 for antibody 29919
QQSYSTPSWP

SEQ ID NO: 59838 - protein, 13 aa, Homo sapiens
  heavy chain complementarity determining region 3 for antibody 29919
ATDWTLERHAFDI

SEQ ID NO: 59839 - protein, 9 aa, Homo sapiens
  light chain complementarity determining region 3 for antibody 29920
QQSYSTPST

SEQ ID NO: 59840 - protein, 14 aa, Homo sapiens
  heavy chain complementarity determining region 3 for antibody 29920
ARSYDTSGYSALDY

SEQ ID NO: 59841 - protein, 9 aa, Homo sapiens
  light chain complementarity determining region 3 for antibody 29921
QQSYSTPST

SEQ ID NO: 59842 - protein, 16 aa, Homo sapiens
  heavy chain complementarity determining region 3 for antibody 29921
AREHYVWGSYRADFDY

SEQ ID NO: 59843 - protein, 10 aa, Homo sapiens
  light chain complementarity determining region 3 for antibody 29922
QQSYSTPSLP

SEQ ID NO: 59844 - protein, 14 aa, Homo sapiens
  heavy chain complementarity determining region 3 for antibody 29922
ARESHSSSYYYFDY

SEQ ID NO: 59845 - protein, 10 aa, Homo sapiens
  light chain complementarity determining region 3 for antibody 29923
QQSYSTPSIT

SEQ ID NO: 59846 - protein, 14 aa, Homo sapiens
  heavy chain complementarity determining region 3 for antibody 29923
ASSISRSYYSWFDA

SEQ ID NO: 59847 - protein, 10 aa, Homo sapiens
  light chain complementarity determining region 3 for antibody 29924
QQSYSTPSIT

SEQ ID NO: 59848 - protein, 14 aa, Homo sapiens
  heavy chain complementarity determining region 3 for antibody 29924
ASSISRGYYNWFDA

SEQ ID NO: 59849 - protein, 10 aa, Homo sapiens
  light chain complementarity determining region 3 for antibody 29925
QQSYSTPSIP

SEQ ID NO: 59850 - protein, 14 aa, Homo sapiens
  heavy chain complementarity determining region 3 for antibody 29925
ASSISRSYYNWFDA

SEQ ID NO: 59851 - protein, 10 aa, Homo sapiens
  light chain complementarity determining region 3 for antibody 29926
QQSYSTPSGT

SEQ ID NO: 59852 - protein, 13 aa, Homo sapiens
  heavy chain complementarity determining region 3 for antibody 29926
ATDWTLERHAFDI

SEQ ID NO: 59853 - protein, 8 aa, Homo sapiens
  light chain complementarity determining region 3 for antibody 29927
QQSYSTPS

SEQ ID NO: 59854 - protein, 15 aa, Homo sapiens
  heavy chain complementarity determining region 3 for antibody 29927
ARAQTGGYSYGPEDY

SEQ ID NO: 59855 - protein, 8 aa, Homo sapiens
  light chain complementarity determining region 3 for antibody 29928
QQSYSTPS

SEQ ID NO: 59856 - protein, 15 aa, Homo sapiens
  heavy chain complementarity determining region 3 for antibody 29928
ARAQPGGYSYGTEDY

SEQ ID NO: 59857 - protein, 10 aa, Homo sapiens
  light chain complementarity determining region 3 for antibody 29929
QQSYSTPRWT

SEQ ID NO: 59858 - protein, 13 aa, Homo sapiens
  heavy chain complementarity determining region 3 for antibody 29929
ARVVSAAVDFFDY

SEQ ID NO: 59859 - protein, 9 aa, Homo sapiens
  light chain complementarity determining region 3 for antibody 29930
QQSYSTPRT

SEQ ID NO: 59860 - protein, 12 aa, Homo sapiens
  heavy chain complementarity determining region 3 for antibody 29930
ASYNFWSHYWDY

SEQ ID NO: 59861 - protein, 9 aa, Homo sapiens
  light chain complementarity determining region 3 for antibody 29931
QQSYSTPRT

SEQ ID NO: 59862 - protein, 19 aa, Homo sapiens
  heavy chain complementarity determining region 3 for antibody 29931
ARVSARRILTAPRYPLIDS

SEQ ID NO: 59863 - protein, 9 aa, Homo sapiens
  light chain complementarity determining region 3 for antibody 29932
QQSYSTPRT

SEQ ID NO: 59864 - protein, 14 aa, Homo sapiens
  heavy chain complementarity determining region 3 for antibody 29932
ARDLSGSVTGPFDY

SEQ ID NO: 59865 - protein, 10 aa, Homo sapiens
  light chain complementarity determining region 3 for antibody 29933
QQSYSTPQYT

SEQ ID NO: 59866 - protein, 15 aa, Homo sapiens
  heavy chain complementarity determining region 3 for antibody 29933
ARQHDYGNYWRAFDT

SEQ ID NO: 59867 - protein, 10 aa, Homo sapiens
  light chain complementarity determining region 3 for antibody 29934
QQSYSTPPYT

SEQ ID NO: 59868 - protein, 15 aa, Homo sapiens
  heavy chain complementarity determining region 3 for antibody 29934
ARQHDYGNYWRAFDI

SEQ ID NO: 59869 - protein, 10 aa, Homo sapiens
  light chain complementarity determining region 3 for antibody 29935
QQSYSTPPWT

SEQ ID NO: 59870 - protein, 16 aa, Homo sapiens
  heavy chain complementarity determining region 3 for antibody 29935
TTGFGCNYDECHKGDY

SEQ ID NO: 59871 - protein, 9 aa, Homo sapiens
  light chain complementarity determining region 3 for antibody 29936
QQSYSTPPT

SEQ ID NO: 59872 - protein, 18 aa, Homo sapiens
  heavy chain complementarity determining region 3 for antibody 29936
VHLSGYCIDHGYCPPFAD

SEQ ID NO: 59873 - protein, 9 aa, Homo sapiens
  light chain complementarity determining region 3 for antibody 29937
QQSYSTPPT

SEQ ID NO: 59874 - protein, 18 aa, Homo sapiens
  heavy chain complementarity determining region 3 for antibody 29937
ARVVDSSSWYFYFYGMDD

SEQ ID NO: 59875 - protein, 9 aa, Homo sapiens
  light chain complementarity determining region 3 for antibody 29938
QQSYSTPPT

SEQ ID NO: 59876 - protein, 18 aa, Homo sapiens
  heavy chain complementarity determining region 3 for antibody 29938
ARVVDSSSWYFSFYGMDV

SEQ ID NO: 59877 - protein, 9 aa, Homo sapiens
  light chain complementarity determining region 3 for antibody 29939
QQSYSTPPP

SEQ ID NO: 59878 - protein, 23 aa, Homo sapiens
  heavy chain complementarity determining region 3 for antibody 29939
ARSATRGRRRTEASGTYEGYFDF

SEQ ID NO: 59879 - protein, 10 aa, Homo sapiens
  light chain complementarity determining region 3 for antibody 29940
QQSYSTPPLT

SEQ ID NO: 59880 - protein, 11 aa, Homo sapiens
  heavy chain complementarity determining region 3 for antibody 29940
ARHVRTLTFDL

SEQ ID NO: 59881 - protein, 10 aa, Homo sapiens
  light chain complementarity determining region 3 for antibody 29941
QQSYSTPPLT

SEQ ID NO: 59882 - protein, 16 aa, Homo sapiens
  heavy chain complementarity determining region 3 for antibody 29941
AKDWGETYNYGSNFDC

SEQ ID NO: 59883 - protein, 10 aa, Homo sapiens
  light chain complementarity determining region 3 for antibody 29942
QQSYSTPPIT

SEQ ID NO: 59884 - protein, 16 aa, Homo sapiens
  heavy chain complementarity determining region 3 for antibody 29942
ATEPCSGGSCYPQMDS

SEQ ID NO: 59885 - protein, 10 aa, Homo sapiens
  light chain complementarity determining region 3 for antibody 29943
QQSYSTPPDT

SEQ ID NO: 59886 - protein, 12 aa, Homo sapiens
  heavy chain complementarity determining region 3 for antibody 29943
ARDDSGDYALDY

SEQ ID NO: 59887 - protein, 9 aa, Homo sapiens
  light chain complementarity determining region 3 for antibody 29944
QQSYSTPNT

SEQ ID NO: 59888 - protein, 14 aa, Homo sapiens
  heavy chain complementarity determining region 3 for antibody 29944
GRYDTSSSSHAMDV

SEQ ID NO: 59889 - protein, 10 aa, Homo sapiens
  light chain complementarity determining region 3 for antibody 29945
QQSYSTPLYT

SEQ ID NO: 59890 - protein, 18 aa, Homo sapiens
  heavy chain complementarity determining region 3 for antibody 29945
VREMDVAVHRVMFNIFDS

SEQ ID NO: 59891 - protein, 9 aa, Homo sapiens
  light chain complementarity determining region 3 for antibody 29946
QQSYSTPLT

SEQ ID NO: 59892 - protein, 17 aa, Homo sapiens
  heavy chain complementarity determining region 3 for antibody 29946
VKDLSGVIGGSYGSFDF

SEQ ID NO: 59893 - protein, 9 aa, Homo sapiens
  light chain complementarity determining region 3 for antibody 29947
QQSYSTPLT

SEQ ID NO: 59894 - protein, 15 aa, Homo sapiens
  heavy chain complementarity determining region 3 for antibody 29947
SRDADYGDYVGFLDY

SEQ ID NO: 59895 - protein, 9 aa, Homo sapiens
  light chain complementarity determining region 3 for antibody 29948
QQSYSTPLT

SEQ ID NO: 59896 - protein, 19 aa, Homo sapiens
  heavy chain complementarity determining region 3 for antibody 29948
ATFRGDSYRNPRHFDAFNI

SEQ ID NO: 59897 - protein, 9 aa, Homo sapiens
  light chain complementarity determining region 3 for antibody 29949
QQSYSTPLT

SEQ ID NO: 59898 - protein, 12 aa, Homo sapiens
  heavy chain complementarity determining region 3 for antibody 29949
ARGGSYYGVWVD

SEQ ID NO: 59899 - protein, 9 aa, Homo sapiens
  light chain complementarity determining region 3 for antibody 29950
QQSYSTPLT

SEQ ID NO: 59900 - protein, 18 aa, Homo sapiens
  heavy chain complementarity determining region 3 for antibody 29950
ARELHEIVAAAGHDAFDI

SEQ ID NO: 59901 - protein, 9 aa, Homo sapiens
  light chain complementarity determining region 3 for antibody 29951
QQSYSTPLT

SEQ ID NO: 59902 - protein, 21 aa, Homo sapiens
  heavy chain complementarity determining region 3 for antibody 29951
ARDGYYYGSRLPRGGYYGVDV

SEQ ID NO: 59903 - protein, 9 aa, Homo sapiens
  light chain complementarity determining region 3 for antibody 29952
QQSYSTPLT

SEQ ID NO: 59904 - protein, 17 aa, Homo sapiens
  heavy chain complementarity determining region 3 for antibody 29952
ARAVTSGNYPPVGHFDY

SEQ ID NO: 59905 - protein, 9 aa, Homo sapiens
  light chain complementarity determining region 3 for antibody 29953
QQSYSTPLT

SEQ ID NO: 59906 - protein, 17 aa, Homo sapiens
  heavy chain complementarity determining region 3 for antibody 29953
ARAVTSGNSPPVGYFDY

SEQ ID NO: 59907 - protein, 9 aa, Homo sapiens
  light chain complementarity determining region 3 for antibody 29954
QQSYSTPLT

SEQ ID NO: 59908 - protein, 17 aa, Homo sapiens
  heavy chain complementarity determining region 3 for antibody 29954
AKDRRSNGYSVLDAFAI

SEQ ID NO: 59909 - protein, 9 aa, Homo sapiens
  light chain complementarity determining region 3 for antibody 29955
QQSYSTPLT

SEQ ID NO: 59910 - protein, 15 aa, Homo sapiens
  heavy chain complementarity determining region 3 for antibody 29955
AKDRGGGVEESAFDI

SEQ ID NO: 59911 - protein, 9 aa, Homo sapiens
  light chain complementarity determining region 3 for antibody 29956
QQSYSTPLP

SEQ ID NO: 59912 - protein, 12 aa, Homo sapiens
  heavy chain complementarity determining region 3 for antibody 29956
TTTQWLDEYFQH

SEQ ID NO: 59913 - protein, 10 aa, Homo sapiens
  light chain complementarity determining region 3 for antibody 29957
QQSYSTPLFT

SEQ ID NO: 59914 - protein, 19 aa, Homo sapiens
  heavy chain complementarity determining region 3 for antibody 29957
VKDSTWGSSGYYSSEYFHH

SEQ ID NO: 59915 - protein, 9 aa, Homo sapiens
  light chain complementarity determining region 3 for antibody 29958
QQSYSTPLA

SEQ ID NO: 59916 - protein, 12 aa, Homo sapiens
  heavy chain complementarity determining region 3 for antibody 29958
AHLTGARRYFDY

SEQ ID NO: 59917 - protein, 9 aa, Homo sapiens
  light chain complementarity determining region 3 for antibody 29959
QQSYSTPKT

SEQ ID NO: 59918 - protein, 16 aa, Homo sapiens
  heavy chain complementarity determining region 3 for antibody 29959
AREPSWIAVAGTRNDY

SEQ ID NO: 59919 - protein, 9 aa, Homo sapiens
  light chain complementarity determining region 3 for antibody 29960
QQSYSTPKT

SEQ ID NO: 59920 - protein, 15 aa, Homo sapiens
  heavy chain complementarity determining region 3 for antibody 29960
ARDRGRLWSEDAFDI

SEQ ID NO: 59921 - protein, 9 aa, Homo sapiens
  light chain complementarity determining region 3 for antibody 29961
QQSYSTPKT

SEQ ID NO: 59922 - protein, 11 aa, Homo sapiens
  heavy chain complementarity determining region 3 for antibody 29961
ARDPAWGAYDL

SEQ ID NO: 59923 - protein, 9 aa, Homo sapiens
  light chain complementarity determining region 3 for antibody 29962
QQSYSTPIT

SEQ ID NO: 59924 - protein, 15 aa, Homo sapiens
  heavy chain complementarity determining region 3 for antibody 29962
VRFPPDLDIVGMIDP

SEQ ID NO: 59925 - protein, 9 aa, Homo sapiens
  light chain complementarity determining region 3 for antibody 29963
QQSYSTPIT

SEQ ID NO: 59926 - protein, 14 aa, Homo sapiens
  heavy chain complementarity determining region 3 for antibody 29963
VRDFGPGRYNWFAP

SEQ ID NO: 59927 - protein, 9 aa, Homo sapiens
  light chain complementarity determining region 3 for antibody 29964
QQSYSTPIT

SEQ ID NO: 59928 - protein, 16 aa, Homo sapiens
  heavy chain complementarity determining region 3 for antibody 29964
ARDVGGSYAAWDYFDY

SEQ ID NO: 59929 - protein, 9 aa, Homo sapiens
  light chain complementarity determining region 3 for antibody 29965
QQSYSTPIT

SEQ ID NO: 59930 - protein, 17 aa, Homo sapiens
  heavy chain complementarity determining region 3 for antibody 29965
AKKQQGYYYDRTPYYGV

SEQ ID NO: 59931 - protein, 9 aa, Homo sapiens
  light chain complementarity determining region 3 for antibody 29966
QQSYSTPIP

SEQ ID NO: 59932 - protein, 14 aa, Homo sapiens
  heavy chain complementarity determining region 3 for antibody 29966
VRDFGPGRYNWFDP

SEQ ID NO: 59933 - protein, 9 aa, Homo sapiens
  light chain complementarity determining region 3 for antibody 29967
QQSYSTPHT

SEQ ID NO: 59934 - protein, 12 aa, Homo sapiens
  heavy chain complementarity determining region 3 for antibody 29967
ARRLGVSGSYHN

SEQ ID NO: 59935 - protein, 9 aa, Homo sapiens
  light chain complementarity determining region 3 for antibody 29968
QQSYSTPHT

SEQ ID NO: 59936 - protein, 16 aa, Homo sapiens
  heavy chain complementarity determining region 3 for antibody 29968
AGLNPPHLAAPDAFDI

SEQ ID NO: 59937 - protein, 9 aa, Homo sapiens
  light chain complementarity determining region 3 for antibody 29969
QQSYSTPGT

SEQ ID NO: 59938 - protein, 12 aa, Homo sapiens
  heavy chain complementarity determining region 3 for antibody 29969
ARVQTGDQGFDY

SEQ ID NO: 59939 - protein, 9 aa, Homo sapiens
  light chain complementarity determining region 3 for antibody 29970
QQSYSTPGP

SEQ ID NO: 59940 - protein, 13 aa, Homo sapiens
  heavy chain complementarity determining region 3 for antibody 29970
ARDYGSGTYYTDY

SEQ ID NO: 59941 - protein, 9 aa, Homo sapiens
  light chain complementarity determining region 3 for antibody 29971
QQSYSTPFT

SEQ ID NO: 59942 - protein, 15 aa, Homo sapiens
  heavy chain complementarity determining region 3 for antibody 29971
SRDADYGDYVGFLGY

SEQ ID NO: 59943 - protein, 9 aa, Homo sapiens
  light chain complementarity determining region 3 for antibody 29972
QQSYSTPFT

SEQ ID NO: 59944 - protein, 15 aa, Homo sapiens
  heavy chain complementarity determining region 3 for antibody 29972
SRDADYGDYVGCLDY

SEQ ID NO: 59945 - protein, 9 aa, Homo sapiens
  light chain complementarity determining region 3 for antibody 29973
QQSYSTPFT

SEQ ID NO: 59946 - protein, 16 aa, Homo sapiens
  heavy chain complementarity determining region 3 for antibody 29973
ARQAPTKAKSIGIFDN

SEQ ID NO: 59947 - protein, 9 aa, Homo sapiens
  light chain complementarity determining region 3 for antibody 29974
QQSYSTPFT

SEQ ID NO: 59948 - protein, 12 aa, Homo sapiens
  heavy chain complementarity determining region 3 for antibody 29974
ARGGSYYGVWDD

SEQ ID NO: 59949 - protein, 9 aa, Homo sapiens
  light chain complementarity determining region 3 for antibody 29975
QQSYSTPFT

SEQ ID NO: 59950 - protein, 12 aa, Homo sapiens
  heavy chain complementarity determining region 3 for antibody 29975
ARGGRYYGVWVD

SEQ ID NO: 59951 - protein, 9 aa, Homo sapiens
  light chain complementarity determining region 3 for antibody 29976
QQSYSTPFN

SEQ ID NO: 59952 - protein, 15 aa, Homo sapiens
  heavy chain complementarity determining region 3 for antibody 29976
SRDADYGDYVGFLDY

SEQ ID NO: 59953 - protein, 10 aa, Homo sapiens
  light chain complementarity determining region 3 for antibody 29977
QQSYSTPALT

SEQ ID NO: 59954 - protein, 16 aa, Homo sapiens
  heavy chain complementarity determining region 3 for antibody 29977
ARRKTVFGGAHHWFDP

SEQ ID NO: 59955 - protein, 9 aa, Homo sapiens
  light chain complementarity determining region 3 for antibody 29978
QQSYSTLTA

SEQ ID NO: 59956 - protein, 14 aa, Homo sapiens
  heavy chain complementarity determining region 3 for antibody 29978
ARESFHNSGYALDY

SEQ ID NO: 59957 - protein, 10 aa, Homo sapiens
  light chain complementarity determining region 3 for antibody 29979
QQSYSTLPLP

SEQ ID NO: 59958 - protein, 18 aa, Homo sapiens
  heavy chain complementarity determining region 3 for antibody 29979
ARDRYSCDSGGCFHWFGP

SEQ ID NO: 59959 - protein, 10 aa, Homo sapiens
  light chain complementarity determining region 3 for antibody 29980
QQSYSTLMYT

SEQ ID NO: 59960 - protein, 20 aa, Homo sapiens
  heavy chain complementarity determining region 3 for antibody 29980
ARHLGYCTGGSGYSYYGLDV

SEQ ID NO: 59961 - protein, 10 aa, Homo sapiens
  light chain complementarity determining region 3 for antibody 29981
QQSYSTLMST

SEQ ID NO: 59962 - protein, 20 aa, Homo sapiens
  heavy chain complementarity determining region 3 for antibody 29981
ARHLGYCTGGSCYSYYGLDV

SEQ ID NO: 59963 - protein, 10 aa, Homo sapiens
  light chain complementarity determining region 3 for antibody 29982
QQSYSTLLLT

SEQ ID NO: 59964 - protein, 20 aa, Homo sapiens
  heavy chain complementarity determining region 3 for antibody 29982
AREVYYDRSGYYYNHKWSDP

SEQ ID NO: 59965 - protein, 10 aa, Homo sapiens
  light chain complementarity determining region 3 for antibody 29983
QQSYSTLLLT

SEQ ID NO: 59966 - protein, 20 aa, Homo sapiens
  heavy chain complementarity determining region 3 for antibody 29983
AREVSYDRSGYYYNHKWFDP

SEQ ID NO: 59967 - protein, 10 aa, Homo sapiens
  light chain complementarity determining region 3 for antibody 29984
QQSYSTLLFT

SEQ ID NO: 59968 - protein, 20 aa, Homo sapiens
  heavy chain complementarity determining region 3 for antibody 29984
AREVYYDRSGYYYNHKWFDP

SEQ ID NO: 59969 - protein, 10 aa, Homo sapiens
  light chain complementarity determining region 3 for antibody 29985
QQSYSTLGNT

SEQ ID NO: 59970 - protein, 17 aa, Homo sapiens
  heavy chain complementarity determining region 3 for antibody 29985
AKALAPVDIAKIANFDH

SEQ ID NO: 59971 - protein, 8 aa, Homo sapiens
  light chain complementarity determining region 3 for antibody 29986
QQSYSTLG

SEQ ID NO: 59972 - protein, 10 aa, Homo sapiens
  heavy chain complementarity determining region 3 for antibody 29986
AHLIRSYFDY

SEQ ID NO: 59973 - protein, 9 aa, Homo sapiens
  light chain complementarity determining region 3 for antibody 29987
QQSYSTLFS

SEQ ID NO: 59974 - protein, 19 aa, Homo sapiens
  heavy chain complementarity determining region 3 for antibody 29987
ARGGDGSGSDSQWYKGMDV

SEQ ID NO: 59975 - protein, 9 aa, Homo sapiens
  light chain complementarity determining region 3 for antibody 29988
QQSYSTLAS

SEQ ID NO: 59976 - protein, 14 aa, Homo sapiens
  heavy chain complementarity determining region 3 for antibody 29988
ARESFHNSGYALDY

SEQ ID NO: 59977 - protein, 9 aa, Homo sapiens
  light chain complementarity determining region 3 for antibody 29989
QQSYSTLAA

SEQ ID NO: 59978 - protein, 14 aa, Homo sapiens
  heavy chain complementarity determining region 3 for antibody 29989
ARESVHNSGYALDY

SEQ ID NO: 59979 - protein, 8 aa, Homo sapiens
  light chain complementarity determining region 3 for antibody 29990
QQSYSTKT

SEQ ID NO: 59980 - protein, 15 aa, Homo sapiens
  heavy chain complementarity determining region 3 for antibody 29990
AREGRRPSSGSYFDY

SEQ ID NO: 59981 - protein, 8 aa, Homo sapiens
  light chain complementarity determining region 3 for antibody 29991
QQSYSTHT

SEQ ID NO: 59982 - protein, 15 aa, Homo sapiens
  heavy chain complementarity determining region 3 for antibody 29991
AREGRRPSSGSYFDY

SEQ ID NO: 59983 - protein, 9 aa, Homo sapiens
  light chain complementarity determining region 3 for antibody 29992
QQSYSTHRT

SEQ ID NO: 59984 - protein, 15 aa, Homo sapiens
  heavy chain complementarity determining region 3 for antibody 29992
VRHYRELTTGIEGDS

SEQ ID NO: 59985 - protein, 9 aa, Homo sapiens
  light chain complementarity determining region 3 for antibody 29993
QQSYSTHPT

SEQ ID NO: 59986 - protein, 18 aa, Homo sapiens
  heavy chain complementarity determining region 3 for antibody 29993
ARVVDSSSWYFYFYGMDV

SEQ ID NO: 59987 - protein, 10 aa, Homo sapiens
  light chain complementarity determining region 3 for antibody 29994
QQSYSTHPLT

SEQ ID NO: 59988 - protein, 16 aa, Homo sapiens
  heavy chain complementarity determining region 3 for antibody 29994
AKDWGETYNYGSNFDF

SEQ ID NO: 59989 - protein, 9 aa, Homo sapiens
  light chain complementarity determining region 3 for antibody 29995
QQSYSSVPT

SEQ ID NO: 59990 - protein, 16 aa, Homo sapiens
  heavy chain complementarity determining region 3 for antibody 29995
AREGGGTYTSSRAFDF

SEQ ID NO: 59991 - protein, 9 aa, Homo sapiens
  light chain complementarity determining region 3 for antibody 29996
QQSYSSVLT

SEQ ID NO: 59992 - protein, 16 aa, Homo sapiens
  heavy chain complementarity determining region 3 for antibody 29996
SREGGGTYTSSRAFDF

SEQ ID NO: 59993 - protein, 9 aa, Homo sapiens
  light chain complementarity determining region 3 for antibody 29997
QQSYSSVLT

SEQ ID NO: 59994 - protein, 16 aa, Homo sapiens
  heavy chain complementarity determining region 3 for antibody 29997
AREGGGTYTSRRAFDF

SEQ ID NO: 59995 - protein, 9 aa, Homo sapiens
  light chain complementarity determining region 3 for antibody 29998
QQSYSSVLP

SEQ ID NO: 59996 - protein, 16 aa, Homo sapiens
  heavy chain complementarity determining region 3 for antibody 29998
AREGGGTYTSSRAFDF

SEQ ID NO: 59997 - protein, 9 aa, Homo sapiens
  light chain complementarity determining region 3 for antibody 29999
QQSYSSTWP

SEQ ID NO: 59998 - protein, 6 aa, Homo sapiens
  heavy chain complementarity determining region 3 for antibody 29999
GSLFEY

SEQ ID NO: 59999 - protein, 9 aa, Homo sapiens
  light chain complementarity determining region 3 for antibody 30000
QQSYSSPRT

SEQ ID NO: 60000 - protein, 17 aa, Homo sapiens
  heavy chain complementarity determining region 3 for antibody 30000
ARDSARFAVAARPPIDY

SEQ ID NO: 60001 - protein, 9 aa, Homo sapiens
  light chain complementarity determining region 3 for antibody 30001
QQSYSSPRP

SEQ ID NO: 60002 - protein, 17 aa, Homo sapiens
  heavy chain complementarity determining region 3 for antibody 30001
VRVVGLAPVYSRNWYDP

SEQ ID NO: 60003 - protein, 10 aa, Homo sapiens
  light chain complementarity determining region 3 for antibody 30002
QQSYSSPPFP

SEQ ID NO: 60004 - protein, 15 aa, Homo sapiens
  heavy chain complementarity determining region 3 for antibody 30002
ARDNLRTAQHGGLDP

SEQ ID NO: 60005 - protein, 9 aa, Homo sapiens
  light chain complementarity determining region 3 for antibody 30003
QQSYSSPLT

SEQ ID NO: 60006 - protein, 14 aa, Homo sapiens
  heavy chain complementarity determining region 3 for antibody 30003
TRGRGGRSYYDLDC

SEQ ID NO: 60007 - protein, 10 aa, Homo sapiens
  light chain complementarity determining region 3 for antibody 30004
QQSYSSFSIT

SEQ ID NO: 60008 - protein, 14 aa, Homo sapiens
  heavy chain complementarity determining region 3 for antibody 30004
ARDFVRGLWRRFDI

SEQ ID NO: 60009 - protein, 10 aa, Homo sapiens
  light chain complementarity determining region 3 for antibody 30005
QQSYSSFSIT

SEQ ID NO: 60010 - protein, 14 aa, Homo sapiens
  heavy chain complementarity determining region 3 for antibody 30005
ARDFVRGLCRSFDI

SEQ ID NO: 60011 - protein, 10 aa, Homo sapiens
  light chain complementarity determining region 3 for antibody 30006
QQSYSSFPIT

SEQ ID NO: 60012 - protein, 14 aa, Homo sapiens
  heavy chain complementarity determining region 3 for antibody 30006
ARDFVRGLWRSFDI

SEQ ID NO: 60013 - protein, 9 aa, Homo sapiens
  light chain complementarity determining region 3 for antibody 30007
QQSYSPPWT

SEQ ID NO: 60014 - protein, 13 aa, Homo sapiens
  heavy chain complementarity determining region 3 for antibody 30007
ARGGEFLGRSFDP

SEQ ID NO: 60015 - protein, 9 aa, Homo sapiens
  light chain complementarity determining region 3 for antibody 30008
QQSYSPPLP

SEQ ID NO: 60016 - protein, 12 aa, Homo sapiens
  heavy chain complementarity determining region 3 for antibody 30008
AHLTGARRYFDY

SEQ ID NO: 60017 - protein, 9 aa, Homo sapiens
  light chain complementarity determining region 3 for antibody 30009
QQSYSPPFT

SEQ ID NO: 60018 - protein, 15 aa, Homo sapiens
  heavy chain complementarity determining region 3 for antibody 30009
SRDADYGDYVGFLDY

SEQ ID NO: 60019 - protein, 9 aa, Homo sapiens
  light chain complementarity determining region 3 for antibody 30010
QQSYSPPFP

SEQ ID NO: 60020 - protein, 12 aa, Homo sapiens
  heavy chain complementarity determining region 3 for antibody 30010
VTDRLRFLEWSY

SEQ ID NO: 60021 - protein, 9 aa, Homo sapiens
  light chain complementarity determining region 3 for antibody 30011
QQSYSPMYT

SEQ ID NO: 60022 - protein, 16 aa, Homo sapiens
  heavy chain complementarity determining region 3 for antibody 30011
ARDPGNGDRSPYCFDY

SEQ ID NO: 60023 - protein, 9 aa, Homo sapiens
  light chain complementarity determining region 3 for antibody 30012
QQSYSNVWT

SEQ ID NO: 60024 - protein, 12 aa, Homo sapiens
  heavy chain complementarity determining region 3 for antibody 30012
ARAPALRAGLNY

SEQ ID NO: 60025 - protein, 9 aa, Homo sapiens
  light chain complementarity determining region 3 for antibody 30013
QQSYSNVWP

SEQ ID NO: 60026 - protein, 12 aa, Homo sapiens
  heavy chain complementarity determining region 3 for antibody 30013
ARAPALRSGLNY

SEQ ID NO: 60027 - protein, 9 aa, Homo sapiens
  light chain complementarity determining region 3 for antibody 30014
QQSYSNPWT

SEQ ID NO: 60028 - protein, 10 aa, Homo sapiens
  heavy chain complementarity determining region 3 for antibody 30014
STPSRVGAKF

SEQ ID NO: 60029 - protein, 9 aa, Homo sapiens
  light chain complementarity determining region 3 for antibody 30015
QQSYSNPWT

SEQ ID NO: 60030 - protein, 15 aa, Homo sapiens
  heavy chain complementarity determining region 3 for antibody 30015
ASRYSSGWYYYGMDV

SEQ ID NO: 60031 - protein, 9 aa, Homo sapiens
  light chain complementarity determining region 3 for antibody 30016
QQSYSNPVT

SEQ ID NO: 60032 - protein, 11 aa, Homo sapiens
  heavy chain complementarity determining region 3 for antibody 30016
ARGGNWEYFDY

SEQ ID NO: 60033 - protein, 9 aa, Homo sapiens
  light chain complementarity determining region 3 for antibody 30017
QQSYSNPQT

SEQ ID NO: 60034 - protein, 11 aa, Homo sapiens
  heavy chain complementarity determining region 3 for antibody 30017
ARDPAWGAYDL

SEQ ID NO: 60035 - protein, 8 aa, Homo sapiens
  light chain complementarity determining region 3 for antibody 30018
QQSYSNPP

SEQ ID NO: 60036 - protein, 12 aa, Homo sapiens
  heavy chain complementarity determining region 3 for antibody 30018
AREGGMAAAPEF

SEQ ID NO: 60037 - protein, 9 aa, Homo sapiens
  light chain complementarity determining region 3 for antibody 30019
QQSYSNPFT

SEQ ID NO: 60038 - protein, 15 aa, Homo sapiens
  heavy chain complementarity determining region 3 for antibody 30019
SRDADYGDYVGFLDY

SEQ ID NO: 60039 - protein, 9 aa, Homo sapiens
  light chain complementarity determining region 3 for antibody 30020
QQSYSMPLT

SEQ ID NO: 60040 - protein, 15 aa, Homo sapiens
  heavy chain complementarity determining region 3 for antibody 30020
ARDQTMIVLDWRFDL

SEQ ID NO: 60041 - protein, 9 aa, Homo sapiens
  light chain complementarity determining region 3 for antibody 30021
QQSYSLLYT

SEQ ID NO: 60042 - protein, 16 aa, Homo sapiens
  heavy chain complementarity determining region 3 for antibody 30021
ARDPGNGDRSPYCFDY

SEQ ID NO: 60043 - protein, 9 aa, Homo sapiens
  light chain complementarity determining region 3 for antibody 30022
QQSYSKLAA

SEQ ID NO: 60044 - protein, 14 aa, Homo sapiens
  heavy chain complementarity determining region 3 for antibody 30022
ARESFHNSGYALDY

SEQ ID NO: 60045 - protein, 9 aa, Homo sapiens
  light chain complementarity determining region 3 for antibody 30023
QQSYSIPPT

SEQ ID NO: 60046 - protein, 13 aa, Homo sapiens
  heavy chain complementarity determining region 3 for antibody 30023
VRHAVVRPMVVDD

SEQ ID NO: 60047 - protein, 10 aa, Homo sapiens
  light chain complementarity determining region 3 for antibody 30024
QQSYSIPPLS

SEQ ID NO: 60048 - protein, 15 aa, Homo sapiens
  heavy chain complementarity determining region 3 for antibody 30024
ARPHLDSNGYFGFDY

SEQ ID NO: 60049 - protein, 9 aa, Homo sapiens
  light chain complementarity determining region 3 for antibody 30025
QQSYSIPGT

SEQ ID NO: 60050 - protein, 10 aa, Homo sapiens
  heavy chain complementarity determining region 3 for antibody 30025
ARTDILTGYK

SEQ ID NO: 60051 - protein, 9 aa, Homo sapiens
  light chain complementarity determining region 3 for antibody 30026
QQSYSIPAT

SEQ ID NO: 60052 - protein, 12 aa, Homo sapiens
  heavy chain complementarity determining region 3 for antibody 30026
ARVDQGGNHFDY

SEQ ID NO: 60053 - protein, 9 aa, Homo sapiens
  light chain complementarity determining region 3 for antibody 30027
QQSYSHPWT

SEQ ID NO: 60054 - protein, 13 aa, Homo sapiens
  heavy chain complementarity determining region 3 for antibody 30027
ARGGEFLGRWFDP

SEQ ID NO: 60055 - protein, 9 aa, Homo sapiens
  light chain complementarity determining region 3 for antibody 30028
QQSYSGPPT

SEQ ID NO: 60056 - protein, 13 aa, Homo sapiens
  heavy chain complementarity determining region 3 for antibody 30028
VRHAVVRPMVVDD

SEQ ID NO: 60057 - protein, 9 aa, Homo sapiens
  light chain complementarity determining region 3 for antibody 30029
QQSYSGPPT

SEQ ID NO: 60058 - protein, 19 aa, Homo sapiens
  heavy chain complementarity determining region 3 for antibody 30029
ARPNTYYYDRSGYHYYFDL

SEQ ID NO: 60059 - protein, 9 aa, Homo sapiens
  light chain complementarity determining region 3 for antibody 30030
QQSYSGPPT

SEQ ID NO: 60060 - protein, 19 aa, Homo sapiens
  heavy chain complementarity determining region 3 for antibody 30030
AGPNTYYYDRSGYHYYFDW

SEQ ID NO: 60061 - protein, 9 aa, Homo sapiens
  light chain complementarity determining region 3 for antibody 30031
QQSYSFPRT

SEQ ID NO: 60062 - protein, 22 aa, Homo sapiens
  heavy chain complementarity determining region 3 for antibody 30031
AREMIKWRVAADGSQRDYIMDV

SEQ ID NO: 60063 - protein, 9 aa, Homo sapiens
  light chain complementarity determining region 3 for antibody 30032
QQSYSFPRT

SEQ ID NO: 60064 - protein, 22 aa, Homo sapiens
  heavy chain complementarity determining region 3 for antibody 30032
AREMIKVRVAADGSQRDYIMDV

SEQ ID NO: 60065 - protein, 9 aa, Homo sapiens
  light chain complementarity determining region 3 for antibody 30033
QQSYSFPRT

SEQ ID NO: 60066 - protein, 22 aa, Homo sapiens
  heavy chain complementarity determining region 3 for antibody 30033
AREMIKLRVAADGSPRDYIMDV

SEQ ID NO: 60067 - protein, 9 aa, Homo sapiens
  light chain complementarity determining region 3 for antibody 30034
QQSYSFPRT

SEQ ID NO: 60068 - protein, 22 aa, Homo sapiens
  heavy chain complementarity determining region 3 for antibody 30034
AREMIKLRGAADGSQRDYIMDV

SEQ ID NO: 60069 - protein, 8 aa, Homo sapiens
  light chain complementarity determining region 3 for antibody 30035
QQSYSAWP

SEQ ID NO: 60070 - protein, 14 aa, Homo sapiens
  heavy chain complementarity determining region 3 for antibody 30035
ARYCSGNSCYSMDH

SEQ ID NO: 60071 - protein, 9 aa, Homo sapiens
  light chain complementarity determining region 3 for antibody 30036
QQSYSARGA

SEQ ID NO: 60072 - protein, 20 aa, Homo sapiens
  heavy chain complementarity determining region 3 for antibody 30036
VRDGTPATHESNSVWNAFDI

SEQ ID NO: 60073 - protein, 8 aa, Homo sapiens
  light chain complementarity determining region 3 for antibody 30037
QQSYRTRP

SEQ ID NO: 60074 - protein, 19 aa, Homo sapiens
  heavy chain complementarity determining region 3 for antibody 30037
ARETYYDILSPKDYYVMDV

SEQ ID NO: 60075 - protein, 9 aa, Homo sapiens
  light chain complementarity determining region 3 for antibody 30038
QQSYRTPRT

SEQ ID NO: 60076 - protein, 21 aa, Homo sapiens
  heavy chain complementarity determining region 3 for antibody 30038
AREDALQWNDETGYSYYVMDI

SEQ ID NO: 60077 - protein, 9 aa, Homo sapiens
  light chain complementarity determining region 3 for antibody 30039
QQSYRTLFT

SEQ ID NO: 60078 - protein, 10 aa, Homo sapiens
  heavy chain complementarity determining region 3 for antibody 30039
ASLNRRTSRR

SEQ ID NO: 60079 - protein, 9 aa, Homo sapiens
  light chain complementarity determining region 3 for antibody 30040
QQSYRTAYT

SEQ ID NO: 60080 - protein, 15 aa, Homo sapiens
  heavy chain complementarity determining region 3 for antibody 30040
ARGPGGWLQFRPGDF

SEQ ID NO: 60081 - protein, 9 aa, Homo sapiens
  light chain complementarity determining region 3 for antibody 30041
QQSYRARWA

SEQ ID NO: 60082 - protein, 20 aa, Homo sapiens
  heavy chain complementarity determining region 3 for antibody 30041
VRDGTPATHESNSVWNAFDI

SEQ ID NO: 60083 - protein, 9 aa, Homo sapiens
  light chain complementarity determining region 3 for antibody 30042
QQSYQTPTT

SEQ ID NO: 60084 - protein, 15 aa, Homo sapiens
  heavy chain complementarity determining region 3 for antibody 30042
ARDQSDHYPVFNFDN

SEQ ID NO: 60085 - protein, 8 aa, Homo sapiens
  light chain complementarity determining region 3 for antibody 30043
QQSYNTWT

SEQ ID NO: 60086 - protein, 12 aa, Homo sapiens
  heavy chain complementarity determining region 3 for antibody 30043
ARALSLAGTLDY

SEQ ID NO: 60087 - protein, 9 aa, Homo sapiens
  light chain complementarity determining region 3 for antibody 30044
QQSYNTPYT

SEQ ID NO: 60088 - protein, 10 aa, Homo sapiens
  heavy chain complementarity determining region 3 for antibody 30044
ARQSVGAFDL

SEQ ID NO: 60089 - protein, 10 aa, Homo sapiens
  light chain complementarity determining region 3 for antibody 30045
QQSYNTPRLT

SEQ ID NO: 60090 - protein, 16 aa, Homo sapiens
  heavy chain complementarity determining region 3 for antibody 30045
ARPSRTFPPGYNAFDI

SEQ ID NO: 60091 - protein, 10 aa, Homo sapiens
  light chain complementarity determining region 3 for antibody 30046
QQSYNTPPNT

SEQ ID NO: 60092 - protein, 16 aa, Homo sapiens
  heavy chain complementarity determining region 3 for antibody 30046
ARVSGGEGLENDAFDI

SEQ ID NO: 60093 - protein, 9 aa, Homo sapiens
  light chain complementarity determining region 3 for antibody 30047
QQSYNSPRP

SEQ ID NO: 60094 - protein, 15 aa, Homo sapiens
  heavy chain complementarity determining region 3 for antibody 30047
ARDDRQGSRKEAFDY

SEQ ID NO: 60095 - protein, 9 aa, Homo sapiens
  light chain complementarity determining region 3 for antibody 30048
QQSYNSPGT

SEQ ID NO: 60096 - protein, 14 aa, Homo sapiens
  heavy chain complementarity determining region 3 for antibody 30048
ARFGGAYSYGYFDF

SEQ ID NO: 60097 - protein, 9 aa, Homo sapiens
  light chain complementarity determining region 3 for antibody 30049
QQSYNNSPT

SEQ ID NO: 60098 - protein, 21 aa, Homo sapiens
  heavy chain complementarity determining region 3 for antibody 30049
AKRTDHHYHSTGCQYRSVFDM

SEQ ID NO: 60099 - protein, 9 aa, Homo sapiens
  light chain complementarity determining region 3 for antibody 30050
QQSYNNSPT

SEQ ID NO: 60100 - protein, 21 aa, Homo sapiens
  heavy chain complementarity determining region 3 for antibody 30050
AKGTDHHYHSTGYQYRSVFDM

SEQ ID NO: 60101 - protein, 9 aa, Homo sapiens
  light chain complementarity determining region 3 for antibody 30051
QQSYNNMGT

SEQ ID NO: 60102 - protein, 13 aa, Homo sapiens
  heavy chain complementarity determining region 3 for antibody 30051
ARRKYGSTWYDDY

SEQ ID NO: 60103 - protein, 9 aa, Homo sapiens
  light chain complementarity determining region 3 for antibody 30052
QQSYITQAT

SEQ ID NO: 60104 - protein, 18 aa, Homo sapiens
  heavy chain complementarity determining region 3 for antibody 30052
AREQDTMVARKSYNLFDP

SEQ ID NO: 60105 - protein, 9 aa, Homo sapiens
  light chain complementarity determining region 3 for antibody 30053
QQSYITPLT

SEQ ID NO: 60106 - protein, 16 aa, Homo sapiens
  heavy chain complementarity determining region 3 for antibody 30053
VRYRPFWSAYHQWFDP

SEQ ID NO: 60107 - protein, 9 aa, Homo sapiens
  light chain complementarity determining region 3 for antibody 30054
QQSYITPLT

SEQ ID NO: 60108 - protein, 14 aa, Homo sapiens
  heavy chain complementarity determining region 3 for antibody 30054
ARGVAMFGVLHFDY

SEQ ID NO: 60109 - protein, 9 aa, Homo sapiens
  light chain complementarity determining region 3 for antibody 30055
QQSYITPIT

SEQ ID NO: 60110 - protein, 16 aa, Homo sapiens
  heavy chain complementarity determining region 3 for antibody 30055
ARDVGGSCATWDYFDN

SEQ ID NO: 60111 - protein, 9 aa, Homo sapiens
  light chain complementarity determining region 3 for antibody 30056
QQSYITKVT

SEQ ID NO: 60112 - protein, 18 aa, Homo sapiens
  heavy chain complementarity determining region 3 for antibody 30056
AREQDTMVARKSYNLFDP

SEQ ID NO: 60113 - protein, 9 aa, Homo sapiens
  light chain complementarity determining region 3 for antibody 30057
QQSYISPWT

SEQ ID NO: 60114 - protein, 13 aa, Homo sapiens
  heavy chain complementarity determining region 3 for antibody 30057
ARTPPFAWDAGRY

SEQ ID NO: 60115 - protein, 9 aa, Homo sapiens
  light chain complementarity determining region 3 for antibody 30058
QQSYIIQVT

SEQ ID NO: 60116 - protein, 18 aa, Homo sapiens
  heavy chain complementarity determining region 3 for antibody 30058
AREQDTMVARKSYNLFDP

SEQ ID NO: 60117 - protein, 10 aa, Homo sapiens
  light chain complementarity determining region 3 for antibody 30059
QQSYGTPMYP

SEQ ID NO: 60118 - protein, 15 aa, Homo sapiens
  heavy chain complementarity determining region 3 for antibody 30059
ARDGSSSGWEAKLDF

SEQ ID NO: 60119 - protein, 9 aa, Homo sapiens
  light chain complementarity determining region 3 for antibody 30060
QQSYGTPKT

SEQ ID NO: 60120 - protein, 15 aa, Homo sapiens
  heavy chain complementarity determining region 3 for antibody 30060
ARDRGQLWSEDAFDI

SEQ ID NO: 60121 - protein, 9 aa, Homo sapiens
  light chain complementarity determining region 3 for antibody 30061
QQSYGTPHT

SEQ ID NO: 60122 - protein, 11 aa, Homo sapiens
  heavy chain complementarity determining region 3 for antibody 30061
ARMLGSGWFCD

SEQ ID NO: 60123 - protein, 9 aa, Homo sapiens
  light chain complementarity determining region 3 for antibody 30062
QQSYCTPYT

SEQ ID NO: 60124 - protein, 18 aa, Homo sapiens
  heavy chain complementarity determining region 3 for antibody 30062
ARFTTGGSTGLILYFFDY

SEQ ID NO: 60125 - protein, 9 aa, Homo sapiens
  light chain complementarity determining region 3 for antibody 30063
QQSVKSPWT

SEQ ID NO: 60126 - protein, 11 aa, Homo sapiens
  heavy chain complementarity determining region 3 for antibody 30063
AREDWPDGFDI

SEQ ID NO: 60127 - protein, 9 aa, Homo sapiens
  light chain complementarity determining region 3 for antibody 30064
QQSTSFPYT

SEQ ID NO: 60128 - protein, 8 aa, Homo sapiens
  heavy chain complementarity determining region 3 for antibody 30064
LSGDSRQD

SEQ ID NO: 60129 - protein, 9 aa, Homo sapiens
  light chain complementarity determining region 3 for antibody 30065
QQSTRTPYT

SEQ ID NO: 60130 - protein, 14 aa, Homo sapiens
  heavy chain complementarity determining region 3 for antibody 30065
ATEGPSRMGKFFDS

SEQ ID NO: 60131 - protein, 9 aa, Homo sapiens
  light chain complementarity determining region 3 for antibody 30066
QQSSVVPLT

SEQ ID NO: 60132 - protein, 9 aa, Homo sapiens
  heavy chain complementarity determining region 3 for antibody 30066
VCLGVTPPV

SEQ ID NO: 60133 - protein, 9 aa, Homo sapiens
  light chain complementarity determining region 3 for antibody 30067
QQSSTTPYT

SEQ ID NO: 60134 - protein, 19 aa, Homo sapiens
  heavy chain complementarity determining region 3 for antibody 30067
ARCDPIVLGPGDYYYGMDV

SEQ ID NO: 60135 - protein, 10 aa, Homo sapiens
  light chain complementarity determining region 3 for antibody 30068
QQSSTTPRWP

SEQ ID NO: 60136 - protein, 16 aa, Homo sapiens
  heavy chain complementarity determining region 3 for antibody 30068
ARAERYSSNFYSCPDV

SEQ ID NO: 60137 - protein, 10 aa, Homo sapiens
  light chain complementarity determining region 3 for antibody 30069
QQSSTTPRRT

SEQ ID NO: 60138 - protein, 16 aa, Homo sapiens
  heavy chain complementarity determining region 3 for antibody 30069
ARAERYSSNFYSCPDV

SEQ ID NO: 60139 - protein, 9 aa, Homo sapiens
  light chain complementarity determining region 3 for antibody 30070
QQSSTIPHT

SEQ ID NO: 60140 - protein, 13 aa, Homo sapiens
  heavy chain complementarity determining region 3 for antibody 30070
AREHIAGRRVLAG

SEQ ID NO: 60141 - protein, 9 aa, Homo sapiens
  light chain complementarity determining region 3 for antibody 30071
QQSSSTFRT

SEQ ID NO: 60142 - protein, 23 aa, Homo sapiens
  heavy chain complementarity determining region 3 for antibody 30071
ARDVRLVNFDWLSQPNYYYAIDV

SEQ ID NO: 60143 - protein, 10 aa, Homo sapiens
  light chain complementarity determining region 3 for antibody 30072
QQSSSSFSIT

SEQ ID NO: 60144 - protein, 14 aa, Homo sapiens
  heavy chain complementarity determining region 3 for antibody 30072
ARDFVRGLWRSFDI

SEQ ID NO: 60145 - protein, 9 aa, Homo sapiens
  light chain complementarity determining region 3 for antibody 30073
QQSSQTPTT

SEQ ID NO: 60146 - protein, 15 aa, Homo sapiens
  heavy chain complementarity determining region 3 for antibody 30073
ARDQSDHYPVFNFDS

SEQ ID NO: 60147 - protein, 9 aa, Homo sapiens
  light chain complementarity determining region 3 for antibody 30074
QQSSQTPTT

SEQ ID NO: 60148 - protein, 15 aa, Homo sapiens
  heavy chain complementarity determining region 3 for antibody 30074
ARDQSDHCPVFNFDN

SEQ ID NO: 60149 - protein, 9 aa, Homo sapiens
  light chain complementarity determining region 3 for antibody 30075
QQSSNWPWT

SEQ ID NO: 60150 - protein, 11 aa, Homo sapiens
  heavy chain complementarity determining region 3 for antibody 30075
VHMFTDYYFES

SEQ ID NO: 60151 - protein, 8 aa, Homo sapiens
  light chain complementarity determining region 3 for antibody 30076
QQSSNWLP

SEQ ID NO: 60152 - protein, 18 aa, Homo sapiens
  heavy chain complementarity determining region 3 for antibody 30076
ARVGHYDGGGYSLDDFDI

SEQ ID NO: 60153 - protein, 9 aa, Homo sapiens
  light chain complementarity determining region 3 for antibody 30077
QQSSHTPTT

SEQ ID NO: 60154 - protein, 15 aa, Homo sapiens
  heavy chain complementarity determining region 3 for antibody 30077
ARDQSDHYPVFNFDN

SEQ ID NO: 60155 - protein, 9 aa, Homo sapiens
  light chain complementarity determining region 3 for antibody 30078
QQSSGPPLT

SEQ ID NO: 60156 - protein, 14 aa, Homo sapiens
  heavy chain complementarity determining region 3 for antibody 30078
ARDSQWLVQYGMDV

SEQ ID NO: 60157 - protein, 9 aa, Homo sapiens
  light chain complementarity determining region 3 for antibody 30079
QQSSFLPLT

SEQ ID NO: 60158 - protein, 10 aa, Homo sapiens
  heavy chain complementarity determining region 3 for antibody 30079
AGGSGWLPDH

SEQ ID NO: 60159 - protein, 8 aa, Homo sapiens
  light chain complementarity determining region 3 for antibody 30080
QQSSDWPT

SEQ ID NO: 60160 - protein, 12 aa, Homo sapiens
  heavy chain complementarity determining region 3 for antibody 30080
ARTQWHTMSIDY

SEQ ID NO: 60161 - protein, 9 aa, Homo sapiens
  light chain complementarity determining region 3 for antibody 30081
QQSSDVPLP

SEQ ID NO: 60162 - protein, 9 aa, Homo sapiens
  heavy chain complementarity determining region 3 for antibody 30081
VCLGVTPPV

SEQ ID NO: 60163 - protein, 9 aa, Homo sapiens
  light chain complementarity determining region 3 for antibody 30082
QQSSDVPFT

SEQ ID NO: 60164 - protein, 9 aa, Homo sapiens
  heavy chain complementarity determining region 3 for antibody 30082
VCLGVTPPV

SEQ ID NO: 60165 - protein, 9 aa, Homo sapiens
  light chain complementarity determining region 3 for antibody 30083
QQSPSFPYT

SEQ ID NO: 60166 - protein, 8 aa, Homo sapiens
  heavy chain complementarity determining region 3 for antibody 30083
LSGDSRPD

SEQ ID NO: 60167 - protein, 8 aa, Homo sapiens
  light chain complementarity determining region 3 for antibody 30084
QQSNYLWT

SEQ ID NO: 60168 - protein, 10 aa, Homo sapiens
  heavy chain complementarity determining region 3 for antibody 30084
ARDRRSVYDS

SEQ ID NO: 60169 - protein, 9 aa, Homo sapiens
  light chain complementarity determining region 3 for antibody 30085
QQSNTFPWT

SEQ ID NO: 60170 - protein, 12 aa, Homo sapiens
  heavy chain complementarity determining region 3 for antibody 30085
ARVHEKSRSSDS

SEQ ID NO: 60171 - protein, 9 aa, Homo sapiens
  light chain complementarity determining region 3 for antibody 30086
QQSNSYSRT

SEQ ID NO: 60172 - protein, 16 aa, Homo sapiens
  heavy chain complementarity determining region 3 for antibody 30086
AAGVGMGRGISTTFDY

SEQ ID NO: 60173 - protein, 9 aa, Homo sapiens
  light chain complementarity determining region 3 for antibody 30087
QQSNSTPFT

SEQ ID NO: 60174 - protein, 14 aa, Homo sapiens
  heavy chain complementarity determining region 3 for antibody 30087
ARSYDTSGFSALDY

SEQ ID NO: 60175 - protein, 9 aa, Homo sapiens
  light chain complementarity determining region 3 for antibody 30088
QQSNSFPLT

SEQ ID NO: 60176 - protein, 14 aa, Homo sapiens
  heavy chain complementarity determining region 3 for antibody 30088
ARDPVIGTPDWFDP

SEQ ID NO: 60177 - protein, 9 aa, Homo sapiens
  light chain complementarity determining region 3 for antibody 30089
QQSNSFPIT

SEQ ID NO: 60178 - protein, 15 aa, Homo sapiens
  heavy chain complementarity determining region 3 for antibody 30089
AREGDCLSTTCYYDY

SEQ ID NO: 60179 - protein, 9 aa, Homo sapiens
  light chain complementarity determining region 3 for antibody 30090
QQSNRTPYT

SEQ ID NO: 60180 - protein, 14 aa, Homo sapiens
  heavy chain complementarity determining region 3 for antibody 30090
ATEGPSRVGKFFDS

SEQ ID NO: 60181 - protein, 9 aa, Homo sapiens
  light chain complementarity determining region 3 for antibody 30091
QQSNRTPYT

SEQ ID NO: 60182 - protein, 14 aa, Homo sapiens
  heavy chain complementarity determining region 3 for antibody 30091
ATEGPSRMGKFFDP

SEQ ID NO: 60183 - protein, 9 aa, Homo sapiens
  light chain complementarity determining region 3 for antibody 30092
QQSNRTPYT

SEQ ID NO: 60184 - protein, 14 aa, Homo sapiens
  heavy chain complementarity determining region 3 for antibody 30092
ATEGPSRMGKFFDA

SEQ ID NO: 60185 - protein, 9 aa, Homo sapiens
  light chain complementarity determining region 3 for antibody 30093
QQSNRTPHT

SEQ ID NO: 60186 - protein, 14 aa, Homo sapiens
  heavy chain complementarity determining region 3 for antibody 30093
ATEGPSRMGKFFDS

SEQ ID NO: 60187 - protein, 9 aa, Homo sapiens
  light chain complementarity determining region 3 for antibody 30094
QQSNRNPYT

SEQ ID NO: 60188 - protein, 14 aa, Homo sapiens
  heavy chain complementarity determining region 3 for antibody 30094
ATEGPSRMGKFFDS

SEQ ID NO: 60189 - protein, 9 aa, Homo sapiens
  light chain complementarity determining region 3 for antibody 30095
QQSNNTPLT

SEQ ID NO: 60190 - protein, 22 aa, Homo sapiens
  heavy chain complementarity determining region 3 for antibody 30095
AREMFFDTGLSWRAPVRYYFDH

SEQ ID NO: 60191 - protein, 10 aa, Homo sapiens
  light chain complementarity determining region 3 for antibody 30096
QQSNGYSPFA

SEQ ID NO: 60192 - protein, 16 aa, Homo sapiens
  heavy chain complementarity determining region 3 for antibody 30096
AKDGSKMNWGHWFFDL

SEQ ID NO: 60193 - protein, 9 aa, Homo sapiens
  light chain complementarity determining region 3 for antibody 30097
QQSKSFPPT

SEQ ID NO: 60194 - protein, 14 aa, Homo sapiens
  heavy chain complementarity determining region 3 for antibody 30097
ARDPVIGTPDWFDP

SEQ ID NO: 60195 - protein, 8 aa, Homo sapiens
  light chain complementarity determining region 3 for antibody 30098
QQSIGTPT

SEQ ID NO: 60196 - protein, 14 aa, Homo sapiens
  heavy chain complementarity determining region 3 for antibody 30098
AREADTGYGYYCDL

SEQ ID NO: 60197 - protein, 9 aa, Homo sapiens
  light chain complementarity determining region 3 for antibody 30099
QQSHTTPWT

SEQ ID NO: 60198 - protein, 11 aa, Homo sapiens
  heavy chain complementarity determining region 3 for antibody 30099
ARAALPYYFDY

SEQ ID NO: 60199 - protein, 9 aa, Homo sapiens
  light chain complementarity determining region 3 for antibody 30100
QQSHSVPYT

SEQ ID NO: 60200 - protein, 17 aa, Homo sapiens
  heavy chain complementarity determining region 3 for antibody 30100
ARLILRRSLGHIGGLDP

SEQ ID NO: 60201 - protein, 9 aa, Homo sapiens
  light chain complementarity determining region 3 for antibody 30101
QQSHSVPYT

SEQ ID NO: 60202 - protein, 17 aa, Homo sapiens
  heavy chain complementarity determining region 3 for antibody 30101
ARLILRRALEHIGGLDP

SEQ ID NO: 60203 - protein, 10 aa, Homo sapiens
  light chain complementarity determining region 3 for antibody 30102
QQSHSTPMNS

SEQ ID NO: 60204 - protein, 18 aa, Homo sapiens
  heavy chain complementarity determining region 3 for antibody 30102
ARDFVAVPGYNGDEYFQH

SEQ ID NO: 60205 - protein, 9 aa, Homo sapiens
  light chain complementarity determining region 3 for antibody 30103
QQSHSTLAA

SEQ ID NO: 60206 - protein, 14 aa, Homo sapiens
  heavy chain complementarity determining region 3 for antibody 30103
ARESFHNSGYALDY

SEQ ID NO: 60207 - protein, 9 aa, Homo sapiens
  light chain complementarity determining region 3 for antibody 30104
QQSHSLPFT

SEQ ID NO: 60208 - protein, 18 aa, Homo sapiens
  heavy chain complementarity determining region 3 for antibody 30104
AKEGSGMGVAMRYWYFDV

SEQ ID NO: 60209 - protein, 9 aa, Homo sapiens
  light chain complementarity determining region 3 for antibody 30105
QQSHSHPLT

SEQ ID NO: 60210 - protein, 14 aa, Homo sapiens
  heavy chain complementarity determining region 3 for antibody 30105
ARDSQWLVQYGMDV

SEQ ID NO: 60211 - protein, 9 aa, Homo sapiens
  light chain complementarity determining region 3 for antibody 30106
QQSHSAPLT

SEQ ID NO: 60212 - protein, 16 aa, Homo sapiens
  heavy chain complementarity determining region 3 for antibody 30106
ARVYATVTSQALGVDY

SEQ ID NO: 60213 - protein, 10 aa, Homo sapiens
  light chain complementarity determining region 3 for antibody 30107
QQSHNTTPYT

SEQ ID NO: 60214 - protein, 21 aa, Homo sapiens
  heavy chain complementarity determining region 3 for antibody 30107
ARTGRHYSDSTVYYYRPRIDY

SEQ ID NO: 60215 - protein, 10 aa, Homo sapiens
  light chain complementarity determining region 3 for antibody 30108
QQSHNNTPYT

SEQ ID NO: 60216 - protein, 21 aa, Homo sapiens
  heavy chain complementarity determining region 3 for antibody 30108
ARTGRHYSGSTVYYYRPRIDY

SEQ ID NO: 60217 - protein, 9 aa, Homo sapiens
  light chain complementarity determining region 3 for antibody 30109
QQSHDFPST

SEQ ID NO: 60218 - protein, 13 aa, Homo sapiens
  heavy chain complementarity determining region 3 for antibody 30109
VRLWDIGGWPFDY

SEQ ID NO: 60219 - protein, 9 aa, Homo sapiens
  light chain complementarity determining region 3 for antibody 30110
QQSGTAPVT

SEQ ID NO: 60220 - protein, 14 aa, Homo sapiens
  heavy chain complementarity determining region 3 for antibody 30110
ARDLFRGIPDYLDY

SEQ ID NO: 60221 - protein, 9 aa, Homo sapiens
  light chain complementarity determining region 3 for antibody 30111
QQSGSTPYT

SEQ ID NO: 60222 - protein, 19 aa, Homo sapiens
  heavy chain complementarity determining region 3 for antibody 30111
AREVPYYDSSGHRMGAFDI

SEQ ID NO: 60223 - protein, 8 aa, Homo sapiens
  light chain complementarity determining region 3 for antibody 30112
QQSGSTPT

SEQ ID NO: 60224 - protein, 13 aa, Homo sapiens
  heavy chain complementarity determining region 3 for antibody 30112
ARPTSDYNWNFGY

SEQ ID NO: 60225 - protein, 9 aa, Homo sapiens
  light chain complementarity determining region 3 for antibody 30113
QQSGSTPST

SEQ ID NO: 60226 - protein, 14 aa, Homo sapiens
  heavy chain complementarity determining region 3 for antibody 30113
AREWVSTIRGWFDP

SEQ ID NO: 60227 - protein, 9 aa, Homo sapiens
  light chain complementarity determining region 3 for antibody 30114
QQSGSSPWT

SEQ ID NO: 60228 - protein, 20 aa, Homo sapiens
  heavy chain complementarity determining region 3 for antibody 30114
ARLKAASAGLPSYYYAGMDV

SEQ ID NO: 60229 - protein, 9 aa, Homo sapiens
  light chain complementarity determining region 3 for antibody 30115
QQSGSSPRT

SEQ ID NO: 60230 - protein, 14 aa, Homo sapiens
  heavy chain complementarity determining region 3 for antibody 30115
ATGFFDSSRYYLEY

SEQ ID NO: 60231 - protein, 9 aa, Homo sapiens
  light chain complementarity determining region 3 for antibody 30116
QQSGSSPRT

SEQ ID NO: 60232 - protein, 13 aa, Homo sapiens
  heavy chain complementarity determining region 3 for antibody 30116
ARGKYESSGYKEN

SEQ ID NO: 60233 - protein, 9 aa, Homo sapiens
  light chain complementarity determining region 3 for antibody 30117
QQSGSSPRT

SEQ ID NO: 60234 - protein, 15 aa, Homo sapiens
  heavy chain complementarity determining region 3 for antibody 30117
ARANGVIITTGVLRY

SEQ ID NO: 60235 - protein, 10 aa, Homo sapiens
  light chain complementarity determining region 3 for antibody 30118
QQSGSSPQLT

SEQ ID NO: 60236 - protein, 10 aa, Homo sapiens
  heavy chain complementarity determining region 3 for antibody 30118
ARGDPAPFDS

SEQ ID NO: 60237 - protein, 10 aa, Homo sapiens
  light chain complementarity determining region 3 for antibody 30119
QQSGSSPQFT

SEQ ID NO: 60238 - protein, 10 aa, Homo sapiens
  heavy chain complementarity determining region 3 for antibody 30119
ARGDPAPFDS

SEQ ID NO: 60239 - protein, 9 aa, Homo sapiens
  light chain complementarity determining region 3 for antibody 30120
QQSGSSPPT

SEQ ID NO: 60240 - protein, 17 aa, Homo sapiens
  heavy chain complementarity determining region 3 for antibody 30120
ARPYFGPVRAGTNGYDM

SEQ ID NO: 60241 - protein, 8 aa, Homo sapiens
  light chain complementarity determining region 3 for antibody 30121
QQSGSSLT

SEQ ID NO: 60242 - protein, 16 aa, Homo sapiens
  heavy chain complementarity determining region 3 for antibody 30121
VRDRPRSSSSWTSFEY

SEQ ID NO: 60243 - protein, 9 aa, Homo sapiens
  light chain complementarity determining region 3 for antibody 30122
QQSGSPWWT

SEQ ID NO: 60244 - protein, 15 aa, Homo sapiens
  heavy chain complementarity determining region 3 for antibody 30122
ARHMARDSIGYYHDF

SEQ ID NO: 60245 - protein, 9 aa, Homo sapiens
  light chain complementarity determining region 3 for antibody 30123
QQSGSLPLT

SEQ ID NO: 60246 - protein, 15 aa, Homo sapiens
  heavy chain complementarity determining region 3 for antibody 30123
AHRPNYYDKAGAFDI

SEQ ID NO: 60247 - protein, 9 aa, Homo sapiens
  light chain complementarity determining region 3 for antibody 30124
QQSGNSPWA

SEQ ID NO: 60248 - protein, 11 aa, Homo sapiens
  heavy chain complementarity determining region 3 for antibody 30124
ARKGLYAPLDV

SEQ ID NO: 60249 - protein, 9 aa, Homo sapiens
  light chain complementarity determining region 3 for antibody 30125
QQSGHSPWT

SEQ ID NO: 60250 - protein, 16 aa, Homo sapiens
  heavy chain complementarity determining region 3 for antibody 30125
AAEFSYYDVRDGYSEF

SEQ ID NO: 60251 - protein, 9 aa, Homo sapiens
  light chain complementarity determining region 3 for antibody 30126
QQSFVTPRT

SEQ ID NO: 60252 - protein, 15 aa, Homo sapiens
  heavy chain complementarity determining region 3 for antibody 30126
ASMPYNNVPVPPFDH

SEQ ID NO: 60253 - protein, 9 aa, Homo sapiens
  light chain complementarity determining region 3 for antibody 30127
QQSFVTPRT

SEQ ID NO: 60254 - protein, 15 aa, Homo sapiens
  heavy chain complementarity determining region 3 for antibody 30127
ASMPYNNVPFPPLDH

SEQ ID NO: 60255 - protein, 9 aa, Homo sapiens
  light chain complementarity determining region 3 for antibody 30128
QQSFTTPRP

SEQ ID NO: 60256 - protein, 16 aa, Homo sapiens
  heavy chain complementarity determining region 3 for antibody 30128
ARGRRAGRLLWFRIDS

SEQ ID NO: 60257 - protein, 9 aa, Homo sapiens
  light chain complementarity determining region 3 for antibody 30129
QQSFTTPPT

SEQ ID NO: 60258 - protein, 18 aa, Homo sapiens
  heavy chain complementarity determining region 3 for antibody 30129
AREMDVAVDRVMFNLLDS

SEQ ID NO: 60259 - protein, 9 aa, Homo sapiens
  light chain complementarity determining region 3 for antibody 30130
QQSFTTLVT

SEQ ID NO: 60260 - protein, 11 aa, Homo sapiens
  heavy chain complementarity determining region 3 for antibody 30130
ARGGNWNYFNH

SEQ ID NO: 60261 - protein, 9 aa, Homo sapiens
  light chain complementarity determining region 3 for antibody 30131
QQSFTSPFT

SEQ ID NO: 60262 - protein, 17 aa, Homo sapiens
  heavy chain complementarity determining region 3 for antibody 30131
ARGTRPLTSAEQNWLDP

SEQ ID NO: 60263 - protein, 9 aa, Homo sapiens
  light chain complementarity determining region 3 for antibody 30132
QQSFSTPRT

SEQ ID NO: 60264 - protein, 21 aa, Homo sapiens
  heavy chain complementarity determining region 3 for antibody 30132
TRDHAFQWNDETGYDHYGLDV

SEQ ID NO: 60265 - protein, 9 aa, Homo sapiens
  light chain complementarity determining region 3 for antibody 30133
QQSFSTPQP

SEQ ID NO: 60266 - protein, 18 aa, Homo sapiens
  heavy chain complementarity determining region 3 for antibody 30133
ARGRQAMCDLGRCDYFDY

SEQ ID NO: 60267 - protein, 9 aa, Homo sapiens
  light chain complementarity determining region 3 for antibody 30134
QQSFNTPYT

SEQ ID NO: 60268 - protein, 14 aa, Homo sapiens
  heavy chain complementarity determining region 3 for antibody 30134
ARLGTMASRHPLDY

SEQ ID NO: 60269 - protein, 9 aa, Homo sapiens
  light chain complementarity determining region 3 for antibody 30135
QQSFNTPPT

SEQ ID NO: 60270 - protein, 18 aa, Homo sapiens
  heavy chain complementarity determining region 3 for antibody 30135
VREMDVAVHRVMFNIFDS

SEQ ID NO: 60271 - protein, 9 aa, Homo sapiens
  light chain complementarity determining region 3 for antibody 30136
QQSFNNPPT

SEQ ID NO: 60272 - protein, 18 aa, Homo sapiens
  heavy chain complementarity determining region 3 for antibody 30136
VRERDVAVHRVMFNIFDS

SEQ ID NO: 60273 - protein, 9 aa, Homo sapiens
  light chain complementarity determining region 3 for antibody 30137
QQSFNNPPT

SEQ ID NO: 60274 - protein, 18 aa, Homo sapiens
  heavy chain complementarity determining region 3 for antibody 30137
VREMDVAVHRVMFNIFGS

SEQ ID NO: 60275 - protein, 8 aa, Homo sapiens
  light chain complementarity determining region 3 for antibody 30138
QQSFGSLT

SEQ ID NO: 60276 - protein, 16 aa, Homo sapiens
  heavy chain complementarity determining region 3 for antibody 30138
ARGHREWEIRRDAFHI

SEQ ID NO: 60277 - protein, 9 aa, Homo sapiens
  light chain complementarity determining region 3 for antibody 30139
QQSDTYPYT

SEQ ID NO: 60278 - protein, 6 aa, Homo sapiens
  heavy chain complementarity determining region 3 for antibody 30139
MTMGAT

SEQ ID NO: 60279 - protein, 8 aa, Homo sapiens
  light chain complementarity determining region 3 for antibody 30140
QQSDSTPT

SEQ ID NO: 60280 - protein, 13 aa, Homo sapiens
  heavy chain complementarity determining region 3 for antibody 30140
ARPTSDYNWNFDY

SEQ ID NO: 60281 - protein, 8 aa, Homo sapiens
  light chain complementarity determining region 3 for antibody 30141
QQSDSNPT

SEQ ID NO: 60282 - protein, 13 aa, Homo sapiens
  heavy chain complementarity determining region 3 for antibody 30141
ARPTSDYNWNFGY

SEQ ID NO: 60283 - protein, 9 aa, Homo sapiens
  light chain complementarity determining region 3 for antibody 30142
QQSDSLPWT

SEQ ID NO: 60284 - protein, 19 aa, Homo sapiens
  heavy chain complementarity determining region 3 for antibody 30142
ARTAIGKRYWASSGDQFDY

SEQ ID NO: 60285 - protein, 9 aa, Homo sapiens
  light chain complementarity determining region 3 for antibody 30143
QQSDRKPFP

SEQ ID NO: 60286 - protein, 14 aa, Homo sapiens
  heavy chain complementarity determining region 3 for antibody 30143
ARDNSNNWYEGMDV

SEQ ID NO: 60287 - protein, 9 aa, Homo sapiens
  light chain complementarity determining region 3 for antibody 30144
QQSDNLPPT

SEQ ID NO: 60288 - protein, 17 aa, Homo sapiens
  heavy chain complementarity determining region 3 for antibody 30144
ATSTTAREGYNVALFDY

SEQ ID NO: 60289 - protein, 9 aa, Homo sapiens
  light chain complementarity determining region 3 for antibody 30145
QQSDISPST

SEQ ID NO: 60290 - protein, 14 aa, Homo sapiens
  heavy chain complementarity determining region 3 for antibody 30145
ARGGRLRLFSFSDY

SEQ ID NO: 60291 - protein, 9 aa, Homo sapiens
  light chain complementarity determining region 3 for antibody 30146
QQSAHVPPP

SEQ ID NO: 60292 - protein, 14 aa, Homo sapiens
  heavy chain complementarity determining region 3 for antibody 30146
ARHSTGTESDHLDL

SEQ ID NO: 60293 - protein, 9 aa, Homo sapiens
  light chain complementarity determining region 3 for antibody 30147
QQSAAPPLT

SEQ ID NO: 60294 - protein, 14 aa, Homo sapiens
  heavy chain complementarity determining region 3 for antibody 30147
ARDSQWLVQYGMDV

SEQ ID NO: 60295 - protein, 10 aa, Homo sapiens
  light chain complementarity determining region 3 for antibody 30148
QQRYYTSPFT

SEQ ID NO: 60296 - protein, 16 aa, Homo sapiens
  heavy chain complementarity determining region 3 for antibody 30148
ARGGHASAGIAWYFDF

SEQ ID NO: 60297 - protein, 10 aa, Homo sapiens
  light chain complementarity determining region 3 for antibody 30149
QQRYTTLMYT

SEQ ID NO: 60298 - protein, 13 aa, Homo sapiens
  heavy chain complementarity determining region 3 for antibody 30149
ARAPGSGSWTVDY

SEQ ID NO: 60299 - protein, 9 aa, Homo sapiens
  light chain complementarity determining region 3 for antibody 30150
QQRYSYSWT

SEQ ID NO: 60300 - protein, 16 aa, Homo sapiens
  heavy chain complementarity determining region 3 for antibody 30150
ARDRDSSSWYRDAFDI

SEQ ID NO: 60301 - protein, 9 aa, Homo sapiens
  light chain complementarity determining region 3 for antibody 30151
QQRYSTSWT

SEQ ID NO: 60302 - protein, 12 aa, Homo sapiens
  heavy chain complementarity determining region 3 for antibody 30151
ARVEYGDYCVDY

SEQ ID NO: 60303 - protein, 9 aa, Homo sapiens
  light chain complementarity determining region 3 for antibody 30152
QQRYSTPYT

SEQ ID NO: 60304 - protein, 17 aa, Homo sapiens
  heavy chain complementarity determining region 3 for antibody 30152
AVYTSTDGIFNKDAFDI

SEQ ID NO: 60305 - protein, 9 aa, Homo sapiens
  light chain complementarity determining region 3 for antibody 30153
QQRYSTPWT

SEQ ID NO: 60306 - protein, 10 aa, Homo sapiens
  heavy chain complementarity determining region 3 for antibody 30153
ASLNRRTSRR

SEQ ID NO: 60307 - protein, 9 aa, Homo sapiens
  light chain complementarity determining region 3 for antibody 30154
QQRYSTPWT

SEQ ID NO: 60308 - protein, 18 aa, Homo sapiens
  heavy chain complementarity determining region 3 for antibody 30154
ARAGWAMVRGVIPYYFDY

SEQ ID NO: 60309 - protein, 9 aa, Homo sapiens
  light chain complementarity determining region 3 for antibody 30155
QQRYSTPVT

SEQ ID NO: 60310 - protein, 21 aa, Homo sapiens
  heavy chain complementarity determining region 3 for antibody 30155
ARGAYQYYYDSSGYSNDAFDI

SEQ ID NO: 60311 - protein, 9 aa, Homo sapiens
  light chain complementarity determining region 3 for antibody 30156
QQRYSTPRT

SEQ ID NO: 60312 - protein, 14 aa, Homo sapiens
  heavy chain complementarity determining region 3 for antibody 30156
ARGIEGRGQYYFDY

SEQ ID NO: 60313 - protein, 10 aa, Homo sapiens
  light chain complementarity determining region 3 for antibody 30157
QQRYSTPQYT

SEQ ID NO: 60314 - protein, 15 aa, Homo sapiens
  heavy chain complementarity determining region 3 for antibody 30157
ARQHDYGNYWRAFDI

SEQ ID NO: 60315 - protein, 9 aa, Homo sapiens
  light chain complementarity determining region 3 for antibody 30158
QQRYSTPLT

SEQ ID NO: 60316 - protein, 12 aa, Homo sapiens
  heavy chain complementarity determining region 3 for antibody 30158
ARDYVAGDAFDV

SEQ ID NO: 60317 - protein, 9 aa, Homo sapiens
  light chain complementarity determining region 3 for antibody 30159
QQRYSTPLT

SEQ ID NO: 60318 - protein, 15 aa, Homo sapiens
  heavy chain complementarity determining region 3 for antibody 30159
ARDGGGSDFGGSFDY

SEQ ID NO: 60319 - protein, 9 aa, Homo sapiens
  light chain complementarity determining region 3 for antibody 30160
QQRYSTPKT

SEQ ID NO: 60320 - protein, 15 aa, Homo sapiens
  heavy chain complementarity determining region 3 for antibody 30160
ARDRGQLWSEDAFDI

SEQ ID NO: 60321 - protein, 9 aa, Homo sapiens
  light chain complementarity determining region 3 for antibody 30161
QQRYSTPFT

SEQ ID NO: 60322 - protein, 14 aa, Homo sapiens
  heavy chain complementarity determining region 3 for antibody 30161
ARSYDTSGYSALDY

SEQ ID NO: 60323 - protein, 8 aa, Homo sapiens
  light chain complementarity determining region 3 for antibody 30162
QQRYSTNT

SEQ ID NO: 60324 - protein, 15 aa, Homo sapiens
  heavy chain complementarity determining region 3 for antibody 30162
AREGRRPSSGSYFDY

SEQ ID NO: 60325 - protein, 10 aa, Homo sapiens
  light chain complementarity determining region 3 for antibody 30163
QQRYSTLALT

SEQ ID NO: 60326 - protein, 16 aa, Homo sapiens
  heavy chain complementarity determining region 3 for antibody 30163
ARRKTVFGGAHHWFDP

SEQ ID NO: 60327 - protein, 9 aa, Homo sapiens
  light chain complementarity determining region 3 for antibody 30164
QQRYSTAYT

SEQ ID NO: 60328 - protein, 15 aa, Homo sapiens
  heavy chain complementarity determining region 3 for antibody 30164
ARGPGGWLQFRPGDF

SEQ ID NO: 60329 - protein, 8 aa, Homo sapiens
  light chain complementarity determining region 3 for antibody 30165
QQRYSSRA

SEQ ID NO: 60330 - protein, 13 aa, Homo sapiens
  heavy chain complementarity determining region 3 for antibody 30165
AMSSMGRGVSFVN

SEQ ID NO: 60331 - protein, 9 aa, Homo sapiens
  light chain complementarity determining region 3 for antibody 30166
QQRYSPPWT

SEQ ID NO: 60332 - protein, 13 aa, Homo sapiens
  heavy chain complementarity determining region 3 for antibody 30166
ARGGEFLGRWFDP

SEQ ID NO: 60333 - protein, 9 aa, Homo sapiens
  light chain complementarity determining region 3 for antibody 30167
QQRYSLPWT

SEQ ID NO: 60334 - protein, 16 aa, Homo sapiens
  heavy chain complementarity determining region 3 for antibody 30167
ARVVYSDYDWAGFVDY

SEQ ID NO: 60335 - protein, 9 aa, Homo sapiens
  light chain complementarity determining region 3 for antibody 30168
QQRYSKPVT

SEQ ID NO: 60336 - protein, 11 aa, Homo sapiens
  heavy chain complementarity determining region 3 for antibody 30168
ARGGNWEYFDY

SEQ ID NO: 60337 - protein, 9 aa, Homo sapiens
  light chain complementarity determining region 3 for antibody 30169
QQRYSIPYT

SEQ ID NO: 60338 - protein, 13 aa, Homo sapiens
  heavy chain complementarity determining region 3 for antibody 30169
ARGLRGVPHWFDP

SEQ ID NO: 60339 - protein, 9 aa, Homo sapiens
  light chain complementarity determining region 3 for antibody 30170
QQRYSIPLT

SEQ ID NO: 60340 - protein, 15 aa, Homo sapiens
  heavy chain complementarity determining region 3 for antibody 30170
ARWGGGYDYYYGIDV

SEQ ID NO: 60341 - protein, 9 aa, Homo sapiens
  light chain complementarity determining region 3 for antibody 30171
QQRYNWPWT

SEQ ID NO: 60342 - protein, 17 aa, Homo sapiens
  heavy chain complementarity determining region 3 for antibody 30171
VVPQFSRTDWPTEPSDY

SEQ ID NO: 60343 - protein, 10 aa, Homo sapiens
  light chain complementarity determining region 3 for antibody 30172
QQRYNWPPYT

SEQ ID NO: 60344 - protein, 15 aa, Homo sapiens
  heavy chain complementarity determining region 3 for antibody 30172
AREGSGYPAAPGFDI

SEQ ID NO: 60345 - protein, 10 aa, Homo sapiens
  light chain complementarity determining region 3 for antibody 30173
QQRYNWPPST

SEQ ID NO: 60346 - protein, 15 aa, Homo sapiens
  heavy chain complementarity determining region 3 for antibody 30173
AREGSGYPAATGFDI

SEQ ID NO: 60347 - protein, 10 aa, Homo sapiens
  light chain complementarity determining region 3 for antibody 30174
QQRYNWPPFT

SEQ ID NO: 60348 - protein, 15 aa, Homo sapiens
  heavy chain complementarity determining region 3 for antibody 30174
AREGSGYPAATGFDI

SEQ ID NO: 60349 - protein, 10 aa, Homo sapiens
  light chain complementarity determining region 3 for antibody 30175
QQRYNWPPDT

SEQ ID NO: 60350 - protein, 11 aa, Homo sapiens
  heavy chain complementarity determining region 3 for antibody 30175
ARGVGSYVFES

SEQ ID NO: 60351 - protein, 9 aa, Homo sapiens
  light chain complementarity determining region 3 for antibody 30176
QQRYNTPWT

SEQ ID NO: 60352 - protein, 16 aa, Homo sapiens
  heavy chain complementarity determining region 3 for antibody 30176
TTDSLTMVRGEGVFDY

SEQ ID NO: 60353 - protein, 10 aa, Homo sapiens
  light chain complementarity determining region 3 for antibody 30177
QQRYNRPPYT

SEQ ID NO: 60354 - protein, 15 aa, Homo sapiens
  heavy chain complementarity determining region 3 for antibody 30177
AREGSGYPAATGFDI

SEQ ID NO: 60355 - protein, 9 aa, Homo sapiens
  light chain complementarity determining region 3 for antibody 30178
QQRYNNSPT

SEQ ID NO: 60356 - protein, 21 aa, Homo sapiens
  heavy chain complementarity determining region 3 for antibody 30178
AKRTDHHYHSTGYQYRSVFDM

SEQ ID NO: 60357 - protein, 9 aa, Homo sapiens
  light chain complementarity determining region 3 for antibody 30179
QQRYNNSPT

SEQ ID NO: 60358 - protein, 21 aa, Homo sapiens
  heavy chain complementarity determining region 3 for antibody 30179
AKRTDHHYHSTGYQYRSVFDI

SEQ ID NO: 60359 - protein, 10 aa, Homo sapiens
  light chain complementarity determining region 3 for antibody 30180
QQRYKWPPYT

SEQ ID NO: 60360 - protein, 11 aa, Homo sapiens
  heavy chain complementarity determining region 3 for antibody 30180
ARGVGSYVFES

SEQ ID NO: 60361 - protein, 9 aa, Homo sapiens
  light chain complementarity determining region 3 for antibody 30181
QQRYKWPPT

SEQ ID NO: 60362 - protein, 19 aa, Homo sapiens
  heavy chain complementarity determining region 3 for antibody 30181
AREVSSADHYGVGKNWFDP

SEQ ID NO: 60363 - protein, 9 aa, Homo sapiens
  light chain complementarity determining region 3 for antibody 30182
QQRYKWPLT

SEQ ID NO: 60364 - protein, 18 aa, Homo sapiens
  heavy chain complementarity determining region 3 for antibody 30182
ASMRQGCSTTSCYNDMDV

SEQ ID NO: 60365 - protein, 9 aa, Homo sapiens
  light chain complementarity determining region 3 for antibody 30183
QQRYITPIT

SEQ ID NO: 60366 - protein, 16 aa, Homo sapiens
  heavy chain complementarity determining region 3 for antibody 30183
ARDVGGSYATWDYFDN

SEQ ID NO: 60367 - protein, 9 aa, Homo sapiens
  light chain complementarity determining region 3 for antibody 30184
QQRYGTPLT

SEQ ID NO: 60368 - protein, 15 aa, Homo sapiens
  heavy chain complementarity determining region 3 for antibody 30184
ARDRESGYTNYDFDS

SEQ ID NO: 60369 - protein, 9 aa, Homo sapiens
  light chain complementarity determining region 3 for antibody 30185
QQRYDNPRT

SEQ ID NO: 60370 - protein, 13 aa, Homo sapiens
  heavy chain complementarity determining region 3 for antibody 30185
ARRDAYNFSGLDY

SEQ ID NO: 60371 - protein, 9 aa, Homo sapiens
  light chain complementarity determining region 3 for antibody 30186
QQRYDNART

SEQ ID NO: 60372 - protein, 13 aa, Homo sapiens
  heavy chain complementarity determining region 3 for antibody 30186
ARRDAYNFSGLDY

SEQ ID NO: 60373 - protein, 8 aa, Homo sapiens
  light chain complementarity determining region 3 for antibody 30187
QQRWNSGA

SEQ ID NO: 60374 - protein, 14 aa, Homo sapiens
  heavy chain complementarity determining region 3 for antibody 30187
ATGIPAAFRYYLEY

SEQ ID NO: 60375 - protein, 11 aa, Homo sapiens
  light chain complementarity determining region 3 for antibody 30188
QQRTTWPPIYT

SEQ ID NO: 60376 - protein, 14 aa, Homo sapiens
  heavy chain complementarity determining region 3 for antibody 30188
ARGGLGIWGNSSDI

SEQ ID NO: 60377 - protein, 11 aa, Homo sapiens
  light chain complementarity determining region 3 for antibody 30189
QQRTTWPLSIT

SEQ ID NO: 60378 - protein, 17 aa, Homo sapiens
  heavy chain complementarity determining region 3 for antibody 30189
ARVKGYGGNSYPDAFHI

SEQ ID NO: 60379 - protein, 11 aa, Homo sapiens
  light chain complementarity determining region 3 for antibody 30190
QQRTSWPPNYP

SEQ ID NO: 60380 - protein, 14 aa, Homo sapiens
  heavy chain complementarity determining region 3 for antibody 30190
ARTVLDTAADAFDF

SEQ ID NO: 60381 - protein, 11 aa, Homo sapiens
  light chain complementarity determining region 3 for antibody 30191
QQRTSWPPMYT

SEQ ID NO: 60382 - protein, 14 aa, Homo sapiens
  heavy chain complementarity determining region 3 for antibody 30191
ARTVLDTAADAFDF

SEQ ID NO: 60383 - protein, 11 aa, Homo sapiens
  light chain complementarity determining region 3 for antibody 30192
QQRTSWPPKYT

SEQ ID NO: 60384 - protein, 14 aa, Homo sapiens
  heavy chain complementarity determining region 3 for antibody 30192
SRTVLDTAADAFDF

SEQ ID NO: 60385 - protein, 11 aa, Homo sapiens
  light chain complementarity determining region 3 for antibody 30193
QQRTSWPPKYT

SEQ ID NO: 60386 - protein, 14 aa, Homo sapiens
  heavy chain complementarity determining region 3 for antibody 30193
ARTVLGTAADAFDF

SEQ ID NO: 60387 - protein, 11 aa, Homo sapiens
  light chain complementarity determining region 3 for antibody 30194
QQRTSWPPKYT

SEQ ID NO: 60388 - protein, 14 aa, Homo sapiens
  heavy chain complementarity determining region 3 for antibody 30194
ARTVLDAAADAFDF

SEQ ID NO: 60389 - protein, 11 aa, Homo sapiens
  light chain complementarity determining region 3 for antibody 30195
QQRTNWPSIYT

SEQ ID NO: 60390 - protein, 14 aa, Homo sapiens
  heavy chain complementarity determining region 3 for antibody 30195
ARGGLGIWGNSSDI

SEQ ID NO: 60391 - protein, 11 aa, Homo sapiens
  light chain complementarity determining region 3 for antibody 30196
QQRTNWPPSIT

SEQ ID NO: 60392 - protein, 17 aa, Homo sapiens
  heavy chain complementarity determining region 3 for antibody 30196
ARVKGYGGNSYPDAFHI

SEQ ID NO: 60393 - protein, 11 aa, Homo sapiens
  light chain complementarity determining region 3 for antibody 30197
QQRTNWPPLYT

SEQ ID NO: 60394 - protein, 14 aa, Homo sapiens
  heavy chain complementarity determining region 3 for antibody 30197
ARGGLGIWGNSSDI

SEQ ID NO: 60395 - protein, 11 aa, Homo sapiens
  light chain complementarity determining region 3 for antibody 30198
QQRTNWPPIYT

SEQ ID NO: 60396 - protein, 14 aa, Homo sapiens
  heavy chain complementarity determining region 3 for antibody 30198
ARGGLGIWWNSSDI

SEQ ID NO: 60397 - protein, 10 aa, Homo sapiens
  light chain complementarity determining region 3 for antibody 30199
QQRTNWPPIT

SEQ ID NO: 60398 - protein, 9 aa, Homo sapiens
  heavy chain complementarity determining region 3 for antibody 30199
APYGSGRPY

SEQ ID NO: 60399 - protein, 11 aa, Homo sapiens
  light chain complementarity determining region 3 for antibody 30200
QQRTNWPPISP

SEQ ID NO: 60400 - protein, 14 aa, Homo sapiens
  heavy chain complementarity determining region 3 for antibody 30200
ARGGLGIWGNSSDI

SEQ ID NO: 60401 - protein, 11 aa, Homo sapiens
  light chain complementarity determining region 3 for antibody 30201
QQRTNWPPIFT

SEQ ID NO: 60402 - protein, 14 aa, Homo sapiens
  heavy chain complementarity determining region 3 for antibody 30201
ARGGLGIWGNSSDI

SEQ ID NO: 60403 - protein, 11 aa, Homo sapiens
  light chain complementarity determining region 3 for antibody 30202
QQRTNWPPFYT

SEQ ID NO: 60404 - protein, 14 aa, Homo sapiens
  heavy chain complementarity determining region 3 for antibody 30202
ARGGLGIWGNSSDI

SEQ ID NO: 60405 - protein, 11 aa, Homo sapiens
  light chain complementarity determining region 3 for antibody 30203
QQRTNWPLIYT

SEQ ID NO: 60406 - protein, 14 aa, Homo sapiens
  heavy chain complementarity determining region 3 for antibody 30203
ARGGLGIWGNSSDI

SEQ ID NO: 60407 - protein, 10 aa, Homo sapiens
  light chain complementarity determining region 3 for antibody 30204
QQRTNRPPYP

SEQ ID NO: 60408 - protein, 15 aa, Homo sapiens
  heavy chain complementarity determining region 3 for antibody 30204
ARLMGDWELPRGTDY

SEQ ID NO: 60409 - protein, 10 aa, Homo sapiens
  light chain complementarity determining region 3 for antibody 30205
QQRTDRPPTP

SEQ ID NO: 60410 - protein, 15 aa, Homo sapiens
  heavy chain complementarity determining region 3 for antibody 30205
ARLMGDWELPRGTDY

SEQ ID NO: 60411 - protein, 10 aa, Homo sapiens
  light chain complementarity determining region 3 for antibody 30206
QQRTDRPPNP

SEQ ID NO: 60412 - protein, 15 aa, Homo sapiens
  heavy chain complementarity determining region 3 for antibody 30206
ARLMGDWELPRGTDY

SEQ ID NO: 60413 - protein, 10 aa, Homo sapiens
  light chain complementarity determining region 3 for antibody 30207
QQRTDRHPYP

SEQ ID NO: 60414 - protein, 15 aa, Homo sapiens
  heavy chain complementarity determining region 3 for antibody 30207
ARLMGDWELPRGTDY

SEQ ID NO: 60415 - protein, 10 aa, Homo sapiens
  light chain complementarity determining region 3 for antibody 30208
QQRTARPPYP

SEQ ID NO: 60416 - protein, 15 aa, Homo sapiens
  heavy chain complementarity determining region 3 for antibody 30208
ARLMGDWELPRGTDY

SEQ ID NO: 60417 - protein, 10 aa, Homo sapiens
  light chain complementarity determining region 3 for antibody 30209
QQRSTWTPPT

SEQ ID NO: 60418 - protein, 9 aa, Homo sapiens
  heavy chain complementarity determining region 3 for antibody 30209
ATPFGETPF

SEQ ID NO: 60419 - protein, 9 aa, Homo sapiens
  light chain complementarity determining region 3 for antibody 30210
QQRSTWPST

SEQ ID NO: 60420 - protein, 13 aa, Homo sapiens
  heavy chain complementarity determining region 3 for antibody 30210
TTGEAYSGYDGDY

SEQ ID NO: 60421 - protein, 10 aa, Homo sapiens
  light chain complementarity determining region 3 for antibody 30211
QQRSTWPPYT

SEQ ID NO: 60422 - protein, 14 aa, Homo sapiens
  heavy chain complementarity determining region 3 for antibody 30211
ARGPSYFYEPKFDF

SEQ ID NO: 60423 - protein, 10 aa, Homo sapiens
  light chain complementarity determining region 3 for antibody 30212
QQRSTWPPIT

SEQ ID NO: 60424 - protein, 17 aa, Homo sapiens
  heavy chain complementarity determining region 3 for antibody 30212
AAGYHSGSLSADDVFDM

SEQ ID NO: 60425 - protein, 8 aa, Homo sapiens
  light chain complementarity determining region 3 for antibody 30213
QQRSTLIT

SEQ ID NO: 60426 - protein, 20 aa, Homo sapiens
  heavy chain complementarity determining region 3 for antibody 30213
ARGRIRRDRLVHYYYYGMDV

SEQ ID NO: 60427 - protein, 9 aa, Homo sapiens
  light chain complementarity determining region 3 for antibody 30214
QQRSSWPYT

SEQ ID NO: 60428 - protein, 11 aa, Homo sapiens
  heavy chain complementarity determining region 3 for antibody 30214
VRRWGGSSIDY

SEQ ID NO: 60429 - protein, 9 aa, Homo sapiens
  light chain complementarity determining region 3 for antibody 30215
QQRSSWPYT

SEQ ID NO: 60430 - protein, 11 aa, Homo sapiens
  heavy chain complementarity determining region 3 for antibody 30215
VQRWGGSSIDY

SEQ ID NO: 60431 - protein, 9 aa, Homo sapiens
  light chain complementarity determining region 3 for antibody 30216
QQRSSWPYT

SEQ ID NO: 60432 - protein, 11 aa, Homo sapiens
  heavy chain complementarity determining region 3 for antibody 30216
VKRWGGSSIDF

SEQ ID NO: 60433 - protein, 9 aa, Homo sapiens
  light chain complementarity determining region 3 for antibody 30217
QQRSSWPYT

SEQ ID NO: 60434 - protein, 11 aa, Homo sapiens
  heavy chain complementarity determining region 3 for antibody 30217
VKRWGGRSIDY

SEQ ID NO: 60435 - protein, 9 aa, Homo sapiens
  light chain complementarity determining region 3 for antibody 30218
QQRSSWPYT

SEQ ID NO: 60436 - protein, 11 aa, Homo sapiens
  heavy chain complementarity determining region 3 for antibody 30218
VKRWGGGSIDY

SEQ ID NO: 60437 - protein, 9 aa, Homo sapiens
  light chain complementarity determining region 3 for antibody 30219
QQRSSWPYT

SEQ ID NO: 60438 - protein, 11 aa, Homo sapiens
  heavy chain complementarity determining region 3 for antibody 30219
AKRWGGSSIDY

SEQ ID NO: 60439 - protein, 8 aa, Homo sapiens
  light chain complementarity determining region 3 for antibody 30220
QQRSSWPT

SEQ ID NO: 60440 - protein, 14 aa, Homo sapiens
  heavy chain complementarity determining region 3 for antibody 30220
ARVYSLGWHWYFDL

SEQ ID NO: 60441 - protein, 9 aa, Homo sapiens
  light chain complementarity determining region 3 for antibody 30221
QQRSSWPST

SEQ ID NO: 60442 - protein, 11 aa, Homo sapiens
  heavy chain complementarity determining region 3 for antibody 30221
VKRWGGSSIGY

SEQ ID NO: 60443 - protein, 10 aa, Homo sapiens
  light chain complementarity determining region 3 for antibody 30222
QQRSSWPRLP

SEQ ID NO: 60444 - protein, 14 aa, Homo sapiens
  heavy chain complementarity determining region 3 for antibody 30222
SKDAGLKGASFFDH

SEQ ID NO: 60445 - protein, 11 aa, Homo sapiens
  light chain complementarity determining region 3 for antibody 30223
QQRSSWPRAVT

SEQ ID NO: 60446 - protein, 19 aa, Homo sapiens
  heavy chain complementarity determining region 3 for antibody 30223
TRGDYYDSSGYHYEGYFDH

SEQ ID NO: 60447 - protein, 11 aa, Homo sapiens
  light chain complementarity determining region 3 for antibody 30224
QQRSSWPRALT

SEQ ID NO: 60448 - protein, 19 aa, Homo sapiens
  heavy chain complementarity determining region 3 for antibody 30224
ARGDYYDSSGYHYEGYFDH

SEQ ID NO: 60449 - protein, 11 aa, Homo sapiens
  light chain complementarity determining region 3 for antibody 30225
QQRSSWPRALP

SEQ ID NO: 60450 - protein, 19 aa, Homo sapiens
  heavy chain complementarity determining region 3 for antibody 30225
TRGDYYDSSGYHYEGYFDH

SEQ ID NO: 60451 - protein, 11 aa, Homo sapiens
  light chain complementarity determining region 3 for antibody 30226
QQRSSWPRALA

SEQ ID NO: 60452 - protein, 19 aa, Homo sapiens
  heavy chain complementarity determining region 3 for antibody 30226
TRGDYYDSSGYHYEGYFDH

SEQ ID NO: 60453 - protein, 10 aa, Homo sapiens
  light chain complementarity determining region 3 for antibody 30227
QQRSSWPPIT

SEQ ID NO: 60454 - protein, 17 aa, Homo sapiens
  heavy chain complementarity determining region 3 for antibody 30227
AGSGAGAVGGWYLYYDV

SEQ ID NO: 60455 - protein, 9 aa, Homo sapiens
  light chain complementarity determining region 3 for antibody 30228
QQRSSWPLT

SEQ ID NO: 60456 - protein, 17 aa, Homo sapiens
  heavy chain complementarity determining region 3 for antibody 30228
SRAGEYHDFWSAYYFDF

SEQ ID NO: 60457 - protein, 9 aa, Homo sapiens
  light chain complementarity determining region 3 for antibody 30229
QQRSSWPLT

SEQ ID NO: 60458 - protein, 17 aa, Homo sapiens
  heavy chain complementarity determining region 3 for antibody 30229
ARSGEYHDFWSAYYFDF

SEQ ID NO: 60459 - protein, 9 aa, Homo sapiens
  light chain complementarity determining region 3 for antibody 30230
QQRSSWPLN

SEQ ID NO: 60460 - protein, 17 aa, Homo sapiens
  heavy chain complementarity determining region 3 for antibody 30230
ARAGEYHDFWSAYYFDF

SEQ ID NO: 60461 - protein, 9 aa, Homo sapiens
  light chain complementarity determining region 3 for antibody 30231
QQRSSWPHT

SEQ ID NO: 60462 - protein, 11 aa, Homo sapiens
  heavy chain complementarity determining region 3 for antibody 30231
VKRWGGSSIDY

SEQ ID NO: 60463 - protein, 8 aa, Homo sapiens
  light chain complementarity determining region 3 for antibody 30232
QQRSSWLP

SEQ ID NO: 60464 - protein, 14 aa, Homo sapiens
  heavy chain complementarity determining region 3 for antibody 30232
ARVYSLGWHWYFDL

SEQ ID NO: 60465 - protein, 9 aa, Homo sapiens
  light chain complementarity determining region 3 for antibody 30233
QQRSSRPYT

SEQ ID NO: 60466 - protein, 11 aa, Homo sapiens
  heavy chain complementarity determining region 3 for antibody 30233
VKRWGGSSIDY

SEQ ID NO: 60467 - protein, 8 aa, Homo sapiens
  light chain complementarity determining region 3 for antibody 30234
QQRSSGYT

SEQ ID NO: 60468 - protein, 13 aa, Homo sapiens
  heavy chain complementarity determining region 3 for antibody 30234
ARNRGSYPNCFDP

SEQ ID NO: 60469 - protein, 11 aa, Homo sapiens
  light chain complementarity determining region 3 for antibody 30235
QQRSSGPRALT

SEQ ID NO: 60470 - protein, 19 aa, Homo sapiens
  heavy chain complementarity determining region 3 for antibody 30235
TRGDYYDSSGYHYEGYFDH

SEQ ID NO: 60471 - protein, 9 aa, Homo sapiens
  light chain complementarity determining region 3 for antibody 30236
QQRSSGPLT

SEQ ID NO: 60472 - protein, 17 aa, Homo sapiens
  heavy chain complementarity determining region 3 for antibody 30236
ARAGEYHDFWSAYYFDF

SEQ ID NO: 60473 - protein, 8 aa, Homo sapiens
  light chain complementarity determining region 3 for antibody 30237
QQRSSGHT

SEQ ID NO: 60474 - protein, 13 aa, Homo sapiens
  heavy chain complementarity determining region 3 for antibody 30237
ARNSGSYPNCFDP

SEQ ID NO: 60475 - protein, 9 aa, Homo sapiens
  light chain complementarity determining region 3 for antibody 30238
QQRSQWPGT

SEQ ID NO: 60476 - protein, 10 aa, Homo sapiens
  heavy chain complementarity determining region 3 for antibody 30238
ARDLGGGSDS

SEQ ID NO: 60477 - protein, 9 aa, Homo sapiens
  light chain complementarity determining region 3 for antibody 30239
QQRSQTPTT

SEQ ID NO: 60478 - protein, 15 aa, Homo sapiens
  heavy chain complementarity determining region 3 for antibody 30239
ARDQSDHYPVFNFDN

SEQ ID NO: 60479 - protein, 7 aa, Homo sapiens
  light chain complementarity determining region 3 for antibody 30240
QQRSNWR

SEQ ID NO: 60480 - protein, 19 aa, Homo sapiens
  heavy chain complementarity determining region 3 for antibody 30240
ARGVYCSCGSCYGRNWFDP

SEQ ID NO: 60481 - protein, 9 aa, Homo sapiens
  light chain complementarity determining region 3 for antibody 30241
QQRSNWPWT

SEQ ID NO: 60482 - protein, 11 aa, Homo sapiens
  heavy chain complementarity determining region 3 for antibody 30241
VHMFTDYYFDS

SEQ ID NO: 60483 - protein, 9 aa, Homo sapiens
  light chain complementarity determining region 3 for antibody 30242
QQRSNWPWT

SEQ ID NO: 60484 - protein, 14 aa, Homo sapiens
  heavy chain complementarity determining region 3 for antibody 30242
AVTHYYDSSAIGDY

SEQ ID NO: 60485 - protein, 9 aa, Homo sapiens
  light chain complementarity determining region 3 for antibody 30243
QQRSNWPWT

SEQ ID NO: 60486 - protein, 9 aa, Homo sapiens
  heavy chain complementarity determining region 3 for antibody 30243
ARVLVTGGG

SEQ ID NO: 60487 - protein, 9 aa, Homo sapiens
  light chain complementarity determining region 3 for antibody 30244
QQRSNWPWR

SEQ ID NO: 60488 - protein, 14 aa, Homo sapiens
  heavy chain complementarity determining region 3 for antibody 30244
AVTHYYDSSTIGDY

SEQ ID NO: 60489 - protein, 8 aa, Homo sapiens
  light chain complementarity determining region 3 for antibody 30245
QQRSNWPT

SEQ ID NO: 60490 - protein, 17 aa, Homo sapiens
  heavy chain complementarity determining region 3 for antibody 30245
SKDHGPYSSSPTFSFDY

SEQ ID NO: 60491 - protein, 8 aa, Homo sapiens
  light chain complementarity determining region 3 for antibody 30246
QQRSNWPT

SEQ ID NO: 60492 - protein, 17 aa, Homo sapiens
  heavy chain complementarity determining region 3 for antibody 30246
AKYHGPYSSSPTFSFDY

SEQ ID NO: 60493 - protein, 9 aa, Homo sapiens
  light chain complementarity determining region 3 for antibody 30247
QQRSNWPSP

SEQ ID NO: 60494 - protein, 13 aa, Homo sapiens
  heavy chain complementarity determining region 3 for antibody 30247
TTGEAYSGYDGDY

SEQ ID NO: 60495 - protein, 9 aa, Homo sapiens
  light chain complementarity determining region 3 for antibody 30248
QQRSNWPRT

SEQ ID NO: 60496 - protein, 14 aa, Homo sapiens
  heavy chain complementarity determining region 3 for antibody 30248
AVTHYYDSSTIGDY

SEQ ID NO: 60497 - protein, 9 aa, Homo sapiens
  light chain complementarity determining region 3 for antibody 30249
QQRSNWPRT

SEQ ID NO: 60498 - protein, 21 aa, Homo sapiens
  heavy chain complementarity determining region 3 for antibody 30249
ATDSTKPRYAYGFYYYYGIDV

SEQ ID NO: 60499 - protein, 10 aa, Homo sapiens
  light chain complementarity determining region 3 for antibody 30250
QQRSNWPRPT

SEQ ID NO: 60500 - protein, 11 aa, Homo sapiens
  heavy chain complementarity determining region 3 for antibody 30250
ARAALTYYFDY

SEQ ID NO: 60501 - protein, 9 aa, Homo sapiens
  light chain complementarity determining region 3 for antibody 30251
QQRSNWPQT

SEQ ID NO: 60502 - protein, 12 aa, Homo sapiens
  heavy chain complementarity determining region 3 for antibody 30251
AKDHGRSYFFDY

SEQ ID NO: 60503 - protein, 9 aa, Homo sapiens
  light chain complementarity determining region 3 for antibody 30252
QQRSNWPQP

SEQ ID NO: 60504 - protein, 17 aa, Homo sapiens
  heavy chain complementarity determining region 3 for antibody 30252
ARDPDEQALYYYYGMDV

SEQ ID NO: 60505 - protein, 9 aa, Homo sapiens
  light chain complementarity determining region 3 for antibody 30253
QQRSNWPQP

SEQ ID NO: 60506 - protein, 12 aa, Homo sapiens
  heavy chain complementarity determining region 3 for antibody 30253
AKDHSRSYFFDY

SEQ ID NO: 60507 - protein, 10 aa, Homo sapiens
  light chain complementarity determining region 3 for antibody 30254
QQRSNWPPYT

SEQ ID NO: 60508 - protein, 11 aa, Homo sapiens
  heavy chain complementarity determining region 3 for antibody 30254
ARGVGSYVFES

SEQ ID NO: 60509 - protein, 10 aa, Homo sapiens
  light chain complementarity determining region 3 for antibody 30255
QQRSNWPPYP

SEQ ID NO: 60510 - protein, 12 aa, Homo sapiens
  heavy chain complementarity determining region 3 for antibody 30255
VRGDPGSPRFDY

SEQ ID NO: 60511 - protein, 10 aa, Homo sapiens
  light chain complementarity determining region 3 for antibody 30256
QQRSNWPPYN

SEQ ID NO: 60512 - protein, 13 aa, Homo sapiens
  heavy chain complementarity determining region 3 for antibody 30256
ARVGQQRLRGFDI

SEQ ID NO: 60513 - protein, 10 aa, Homo sapiens
  light chain complementarity determining region 3 for antibody 30257
QQRSNWPPWT

SEQ ID NO: 60514 - protein, 20 aa, Homo sapiens
  heavy chain complementarity determining region 3 for antibody 30257
ATGYHTTMIVGHGGRWYFDL

SEQ ID NO: 60515 - protein, 10 aa, Homo sapiens
  light chain complementarity determining region 3 for antibody 30258
QQRSNWPPWT

SEQ ID NO: 60516 - protein, 18 aa, Homo sapiens
  heavy chain complementarity determining region 3 for antibody 30258
ARHDWVPADGDKPDWFDP

SEQ ID NO: 60517 - protein, 10 aa, Homo sapiens
  light chain complementarity determining region 3 for antibody 30259
QQRSNWPPWT

SEQ ID NO: 60518 - protein, 13 aa, Homo sapiens
  heavy chain complementarity determining region 3 for antibody 30259
AREACPPGGGLDY

SEQ ID NO: 60519 - protein, 10 aa, Homo sapiens
  light chain complementarity determining region 3 for antibody 30260
QQRSNWPPWS

SEQ ID NO: 60520 - protein, 13 aa, Homo sapiens
  heavy chain complementarity determining region 3 for antibody 30260
AREAFPPGGGLDY

SEQ ID NO: 60521 - protein, 10 aa, Homo sapiens
  light chain complementarity determining region 3 for antibody 30261
QQRSNWPPWP

SEQ ID NO: 60522 - protein, 13 aa, Homo sapiens
  heavy chain complementarity determining region 3 for antibody 30261
AREAFPPGGGLDY

SEQ ID NO: 60523 - protein, 9 aa, Homo sapiens
  light chain complementarity determining region 3 for antibody 30262
QQRSNWPPT

SEQ ID NO: 60524 - protein, 11 aa, Homo sapiens
  heavy chain complementarity determining region 3 for antibody 30262
ARMTRLWTFDI

SEQ ID NO: 60525 - protein, 9 aa, Homo sapiens
  light chain complementarity determining region 3 for antibody 30263
QQRSNWPPT

SEQ ID NO: 60526 - protein, 17 aa, Homo sapiens
  heavy chain complementarity determining region 3 for antibody 30263
ARLGGSGWNRGHNWFDP

SEQ ID NO: 60527 - protein, 9 aa, Homo sapiens
  light chain complementarity determining region 3 for antibody 30264
QQRSNWPPT

SEQ ID NO: 60528 - protein, 19 aa, Homo sapiens
  heavy chain complementarity determining region 3 for antibody 30264
AKTVSTTQADTAIIRGGDY

SEQ ID NO: 60529 - protein, 10 aa, Homo sapiens
  light chain complementarity determining region 3 for antibody 30265
QQRSNWPPST

SEQ ID NO: 60530 - protein, 12 aa, Homo sapiens
  heavy chain complementarity determining region 3 for antibody 30265
VRGDPGSPRFDY

SEQ ID NO: 60531 - protein, 10 aa, Homo sapiens
  light chain complementarity determining region 3 for antibody 30266
QQRSNWPPST

SEQ ID NO: 60532 - protein, 21 aa, Homo sapiens
  heavy chain complementarity determining region 3 for antibody 30266
ATMKRNNDFWTGHFGKYYFEY

SEQ ID NO: 60533 - protein, 10 aa, Homo sapiens
  light chain complementarity determining region 3 for antibody 30267
QQRSNWPPRT

SEQ ID NO: 60534 - protein, 11 aa, Homo sapiens
  heavy chain complementarity determining region 3 for antibody 30267
ARLRPWDGMDV

SEQ ID NO: 60535 - protein, 10 aa, Homo sapiens
  light chain complementarity determining region 3 for antibody 30268
QQRSNWPPRT

SEQ ID NO: 60536 - protein, 15 aa, Homo sapiens
  heavy chain complementarity determining region 3 for antibody 30268
ARLAMVTGRGTDFDY

SEQ ID NO: 60537 - protein, 10 aa, Homo sapiens
  light chain complementarity determining region 3 for antibody 30269
QQRSNWPPPT

SEQ ID NO: 60538 - protein, 15 aa, Homo sapiens
  heavy chain complementarity determining region 3 for antibody 30269
ARLAMVTGRGTDFDY

SEQ ID NO: 60539 - protein, 10 aa, Homo sapiens
  light chain complementarity determining region 3 for antibody 30270
QQRSNWPPNT

SEQ ID NO: 60540 - protein, 13 aa, Homo sapiens
  heavy chain complementarity determining region 3 for antibody 30270
ARVGQQRLRGFDI

SEQ ID NO: 60541 - protein, 10 aa, Homo sapiens
  light chain complementarity determining region 3 for antibody 30271
QQRSNWPPNT

SEQ ID NO: 60542 - protein, 10 aa, Homo sapiens
  heavy chain complementarity determining region 3 for antibody 30271
ARDSGAGVDY

SEQ ID NO: 60543 - protein, 11 aa, Homo sapiens
  light chain complementarity determining region 3 for antibody 30272
QQRSNWPPMYP

SEQ ID NO: 60544 - protein, 13 aa, Homo sapiens
  heavy chain complementarity determining region 3 for antibody 30272
ARDGLRFLEWLVN

SEQ ID NO: 60545 - protein, 11 aa, Homo sapiens
  light chain complementarity determining region 3 for antibody 30273
QQRSNWPPMVP

SEQ ID NO: 60546 - protein, 13 aa, Homo sapiens
  heavy chain complementarity determining region 3 for antibody 30273
ATDRAAGKYYFSF

SEQ ID NO: 60547 - protein, 11 aa, Homo sapiens
  light chain complementarity determining region 3 for antibody 30274
QQRSNWPPMNT

SEQ ID NO: 60548 - protein, 16 aa, Homo sapiens
  heavy chain complementarity determining region 3 for antibody 30274
ARVESRGGIAVDWFDY

SEQ ID NO: 60549 - protein, 11 aa, Homo sapiens
  light chain complementarity determining region 3 for antibody 30275
QQRSNWPPMDT

SEQ ID NO: 60550 - protein, 16 aa, Homo sapiens
  heavy chain complementarity determining region 3 for antibody 30275
ARVESRGGIAVDWFDY

SEQ ID NO: 60551 - protein, 11 aa, Homo sapiens
  light chain complementarity determining region 3 for antibody 30276
QQRSNWPPMDT

SEQ ID NO: 60552 - protein, 13 aa, Homo sapiens
  heavy chain complementarity determining region 3 for antibody 30276
ARDGLRFLEWLVN

SEQ ID NO: 60553 - protein, 11 aa, Homo sapiens
  light chain complementarity determining region 3 for antibody 30277
QQRSNWPPLVT

SEQ ID NO: 60554 - protein, 13 aa, Homo sapiens
  heavy chain complementarity determining region 3 for antibody 30277
ATDRAAGKYYFSF

SEQ ID NO: 60555 - protein, 10 aa, Homo sapiens
  light chain complementarity determining region 3 for antibody 30278
QQRSNWPPLT

SEQ ID NO: 60556 - protein, 15 aa, Homo sapiens
  heavy chain complementarity determining region 3 for antibody 30278
ASLAMVTGRGTDFDY

SEQ ID NO: 60557 - protein, 10 aa, Homo sapiens
  light chain complementarity determining region 3 for antibody 30279
QQRSNWPPLT

SEQ ID NO: 60558 - protein, 9 aa, Homo sapiens
  heavy chain complementarity determining region 3 for antibody 30279
ARVDGYFDY

SEQ ID NO: 60559 - protein, 10 aa, Homo sapiens
  light chain complementarity determining region 3 for antibody 30280
QQRSNWPPLT

SEQ ID NO: 60560 - protein, 15 aa, Homo sapiens
  heavy chain complementarity determining region 3 for antibody 30280
ARLAMVTGRGTDSDY

SEQ ID NO: 60561 - protein, 10 aa, Homo sapiens
  light chain complementarity determining region 3 for antibody 30281
QQRSNWPPLT

SEQ ID NO: 60562 - protein, 15 aa, Homo sapiens
  heavy chain complementarity determining region 3 for antibody 30281
ARLALVTGRGTDFDY

SEQ ID NO: 60563 - protein, 10 aa, Homo sapiens
  light chain complementarity determining region 3 for antibody 30282
QQRSNWPPLT

SEQ ID NO: 60564 - protein, 17 aa, Homo sapiens
  heavy chain complementarity determining region 3 for antibody 30282
AAGYHSGSLSADDVFDM

SEQ ID NO: 60565 - protein, 10 aa, Homo sapiens
  light chain complementarity determining region 3 for antibody 30283
QQRSNWPPIT

SEQ ID NO: 60566 - protein, 17 aa, Homo sapiens
  heavy chain complementarity determining region 3 for antibody 30283
AAGYHSESLSADDVFDI

SEQ ID NO: 60567 - protein, 10 aa, Homo sapiens
  light chain complementarity determining region 3 for antibody 30284
QQRSNWPPIN

SEQ ID NO: 60568 - protein, 17 aa, Homo sapiens
  heavy chain complementarity determining region 3 for antibody 30284
AAGYHSGSLSADDVFDM

SEQ ID NO: 60569 - protein, 10 aa, Homo sapiens
  light chain complementarity determining region 3 for antibody 30285
QQRSNWPPFP

SEQ ID NO: 60570 - protein, 15 aa, Homo sapiens
  heavy chain complementarity determining region 3 for antibody 30285
ARDWETATQWYYFDY

SEQ ID NO: 60571 - protein, 10 aa, Homo sapiens
  light chain complementarity determining region 3 for antibody 30286
QQRSNWPPDT

SEQ ID NO: 60572 - protein, 14 aa, Homo sapiens
  heavy chain complementarity determining region 3 for antibody 30286
ARGPSYFYETKFDF

SEQ ID NO: 60573 - protein, 10 aa, Homo sapiens
  light chain complementarity determining region 3 for antibody 30287
QQRSNWPPCT

SEQ ID NO: 60574 - protein, 13 aa, Homo sapiens
  heavy chain complementarity determining region 3 for antibody 30287
ARVGQQRLRGFDI

SEQ ID NO: 60575 - protein, 11 aa, Homo sapiens
  light chain complementarity determining region 3 for antibody 30288
QQRSNWPPAWT

SEQ ID NO: 60576 - protein, 17 aa, Homo sapiens
  heavy chain complementarity determining region 3 for antibody 30288
ARLRWTQSQDYGDAFDI

SEQ ID NO: 60577 - protein, 11 aa, Homo sapiens
  light chain complementarity determining region 3 for antibody 30289
QQRSNWPPAWP

SEQ ID NO: 60578 - protein, 17 aa, Homo sapiens
  heavy chain complementarity determining region 3 for antibody 30289
ARLRWTRSQDYGDAFDI

SEQ ID NO: 60579 - protein, 11 aa, Homo sapiens
  light chain complementarity determining region 3 for antibody 30290
QQRSNWPPAWA

SEQ ID NO: 60580 - protein, 17 aa, Homo sapiens
  heavy chain complementarity determining region 3 for antibody 30290
ARLRWTRSQDYGDAFDI

SEQ ID NO: 60581 - protein, 9 aa, Homo sapiens
  light chain complementarity determining region 3 for antibody 30291
QQRSNWPLT

SEQ ID NO: 60582 - protein, 19 aa, Homo sapiens
  heavy chain complementarity determining region 3 for antibody 30291
AKTVSTTQADTARIRGGDY

SEQ ID NO: 60583 - protein, 9 aa, Homo sapiens
  light chain complementarity determining region 3 for antibody 30292
QQRSNWPLT

SEQ ID NO: 60584 - protein, 19 aa, Homo sapiens
  heavy chain complementarity determining region 3 for antibody 30292
AKTVSTTQADTAISRGGDY

SEQ ID NO: 60585 - protein, 9 aa, Homo sapiens
  light chain complementarity determining region 3 for antibody 30293
QQRSNWPLT

SEQ ID NO: 60586 - protein, 19 aa, Homo sapiens
  heavy chain complementarity determining region 3 for antibody 30293
AKTGSTTQADTAIIRGGDY

SEQ ID NO: 60587 - protein, 9 aa, Homo sapiens
  light chain complementarity determining region 3 for antibody 30294
QQRSNWPLT

SEQ ID NO: 60588 - protein, 14 aa, Homo sapiens
  heavy chain complementarity determining region 3 for antibody 30294
AKSRGYNADDAFEI

SEQ ID NO: 60589 - protein, 9 aa, Homo sapiens
  light chain complementarity determining region 3 for antibody 30295
QQRSNWPLT

SEQ ID NO: 60590 - protein, 13 aa, Homo sapiens
  heavy chain complementarity determining region 3 for antibody 30295
AKGGMTTGSSFDY

SEQ ID NO: 60591 - protein, 9 aa, Homo sapiens
  light chain complementarity determining region 3 for antibody 30296
QQRSNWPLT

SEQ ID NO: 60592 - protein, 17 aa, Homo sapiens
  heavy chain complementarity determining region 3 for antibody 30296
AKDFSPYGDYKSDYCDH

SEQ ID NO: 60593 - protein, 9 aa, Homo sapiens
  light chain complementarity determining region 3 for antibody 30297
QQRSNWPLP

SEQ ID NO: 60594 - protein, 20 aa, Homo sapiens
  heavy chain complementarity determining region 3 for antibody 30297
AKDQTPFYSSGWKWGQYFDY

SEQ ID NO: 60595 - protein, 9 aa, Homo sapiens
  light chain complementarity determining region 3 for antibody 30298
QQRSNWPKT

SEQ ID NO: 60596 - protein, 17 aa, Homo sapiens
  heavy chain complementarity determining region 3 for antibody 30298
AREGDFWSGYQSDAFDI

SEQ ID NO: 60597 - protein, 10 aa, Homo sapiens
  light chain complementarity determining region 3 for antibody 30299
QQRSNWPIFT

SEQ ID NO: 60598 - protein, 14 aa, Homo sapiens
  heavy chain complementarity determining region 3 for antibody 30299
ARLNKVTRIRYFDS

SEQ ID NO: 60599 - protein, 10 aa, Homo sapiens
  light chain complementarity determining region 3 for antibody 30300
QQRSNWPIFT

SEQ ID NO: 60600 - protein, 14 aa, Homo sapiens
  heavy chain complementarity determining region 3 for antibody 30300
ARLNKMTRIRYFDS

SEQ ID NO: 60601 - protein, 10 aa, Homo sapiens
  light chain complementarity determining region 3 for antibody 30301
QQRSNWPIFT

SEQ ID NO: 60602 - protein, 13 aa, Homo sapiens
  heavy chain complementarity determining region 3 for antibody 30301
AHTGASVYSSSDY

SEQ ID NO: 60603 - protein, 11 aa, Homo sapiens
  light chain complementarity determining region 3 for antibody 30302
QQRSNWPHMVT

SEQ ID NO: 60604 - protein, 13 aa, Homo sapiens
  heavy chain complementarity determining region 3 for antibody 30302
ATDRAAGKYYFSF

SEQ ID NO: 60605 - protein, 9 aa, Homo sapiens
  light chain complementarity determining region 3 for antibody 30303
QQRSNWPGP

SEQ ID NO: 60606 - protein, 14 aa, Homo sapiens
  heavy chain complementarity determining region 3 for antibody 30303
AVTHYYDSSTIGDY

SEQ ID NO: 60607 - protein, 9 aa, Homo sapiens
  light chain complementarity determining region 3 for antibody 30304
QQRSNWPFT

SEQ ID NO: 60608 - protein, 13 aa, Homo sapiens
  heavy chain complementarity determining region 3 for antibody 30304
TTGEAYSGYDGDY

SEQ ID NO: 60609 - protein, 7 aa, Homo sapiens
  light chain complementarity determining region 3 for antibody 30305
QQRSNWP

SEQ ID NO: 60610 - protein, 19 aa, Homo sapiens
  heavy chain complementarity determining region 3 for antibody 30305
ARGVYCSGGSCYGRNWFDP

SEQ ID NO: 60611 - protein, 8 aa, Homo sapiens
  light chain complementarity determining region 3 for antibody 30306
QQRSNWLT

SEQ ID NO: 60612 - protein, 17 aa, Homo sapiens
  heavy chain complementarity determining region 3 for antibody 30306
ASPFRGGGVPSVWYFDL

SEQ ID NO: 60613 - protein, 10 aa, Homo sapiens
  light chain complementarity determining region 3 for antibody 30307
QQRSNWLPYT

SEQ ID NO: 60614 - protein, 12 aa, Homo sapiens
  heavy chain complementarity determining region 3 for antibody 30307
VRGDPGSPRFDY

SEQ ID NO: 60615 - protein, 10 aa, Homo sapiens
  light chain complementarity determining region 3 for antibody 30308
QQRSNWLPIT

SEQ ID NO: 60616 - protein, 11 aa, Homo sapiens
  heavy chain complementarity determining region 3 for antibody 30308
ARDWRSGGMDV

SEQ ID NO: 60617 - protein, 8 aa, Homo sapiens
  light chain complementarity determining region 3 for antibody 30309
QQRSNWLP

SEQ ID NO: 60618 - protein, 17 aa, Homo sapiens
  heavy chain complementarity determining region 3 for antibody 30309
ARPFRGGGVPSVWYFDL

SEQ ID NO: 60619 - protein, 8 aa, Homo sapiens
  light chain complementarity determining region 3 for antibody 30310
QQRSNWLP

SEQ ID NO: 60620 - protein, 13 aa, Homo sapiens
  heavy chain complementarity determining region 3 for antibody 30310
AKLLYGAHSEFDY

SEQ ID NO: 60621 - protein, 10 aa, Homo sapiens
  light chain complementarity determining region 3 for antibody 30311
QQRSNWHPIT

SEQ ID NO: 60622 - protein, 14 aa, Homo sapiens
  heavy chain complementarity determining region 3 for antibody 30311
ARDSTLIRGEHFRH

SEQ ID NO: 60623 - protein, 9 aa, Homo sapiens
  light chain complementarity determining region 3 for antibody 30312
QQRSNWHNT

SEQ ID NO: 60624 - protein, 17 aa, Homo sapiens
  heavy chain complementarity determining region 3 for antibody 30312
AREGDFWSGYQSDAFDI

SEQ ID NO: 60625 - protein, 9 aa, Homo sapiens
  light chain complementarity determining region 3 for antibody 30313
QQRSNWHKN

SEQ ID NO: 60626 - protein, 17 aa, Homo sapiens
  heavy chain complementarity determining region 3 for antibody 30313
AREGDFWSGYQSDAFDI

SEQ ID NO: 60627 - protein, 9 aa, Homo sapiens
  light chain complementarity determining region 3 for antibody 30314
QQRSNWHKI

SEQ ID NO: 60628 - protein, 17 aa, Homo sapiens
  heavy chain complementarity determining region 3 for antibody 30314
AREGDFWSGYQSDAFDI

SEQ ID NO: 60629 - protein, 10 aa, Homo sapiens
  light chain complementarity determining region 3 for antibody 30315
QQRSNRPPYT

SEQ ID NO: 60630 - protein, 13 aa, Homo sapiens
  heavy chain complementarity determining region 3 for antibody 30315
ARVGQQRLRGFDI

SEQ ID NO: 60631 - protein, 10 aa, Homo sapiens
  light chain complementarity determining region 3 for antibody 30316
QQRSNRPPWT

SEQ ID NO: 60632 - protein, 13 aa, Homo sapiens
  heavy chain complementarity determining region 3 for antibody 30316
AREAFPPGGGLDY

SEQ ID NO: 60633 - protein, 11 aa, Homo sapiens
  light chain complementarity determining region 3 for antibody 30317
QQRSNRPPMVT

SEQ ID NO: 60634 - protein, 13 aa, Homo sapiens
  heavy chain complementarity determining region 3 for antibody 30317
ATDRAAGKYYFSF

SEQ ID NO: 60635 - protein, 11 aa, Homo sapiens
  light chain complementarity determining region 3 for antibody 30318
QQRSNRPPALT

SEQ ID NO: 60636 - protein, 14 aa, Homo sapiens
  heavy chain complementarity determining region 3 for antibody 30318
AREGTAMVKDAFEI

SEQ ID NO: 60637 - protein, 10 aa, Homo sapiens
  light chain complementarity determining region 3 for antibody 30319
QQRSNLPPYT

SEQ ID NO: 60638 - protein, 13 aa, Homo sapiens
  heavy chain complementarity determining region 3 for antibody 30319
ARVGQQRLRGFDI

SEQ ID NO: 60639 - protein, 11 aa, Homo sapiens
  light chain complementarity determining region 3 for antibody 30320
QQRSNLPPSYT

SEQ ID NO: 60640 - protein, 14 aa, Homo sapiens
  heavy chain complementarity determining region 3 for antibody 30320
AKDKAVTGLYYFDY

SEQ ID NO: 60641 - protein, 9 aa, Homo sapiens
  light chain complementarity determining region 3 for antibody 30321
QQRSNLPLT

SEQ ID NO: 60642 - protein, 17 aa, Homo sapiens
  heavy chain complementarity determining region 3 for antibody 30321
AKDFSPYGDYKSDYFDH

SEQ ID NO: 60643 - protein, 8 aa, Homo sapiens
  light chain complementarity determining region 3 for antibody 30322
QQRSNLLT

SEQ ID NO: 60644 - protein, 10 aa, Homo sapiens
  heavy chain complementarity determining region 3 for antibody 30322
ARSYGPGEDY

SEQ ID NO: 60645 - protein, 8 aa, Homo sapiens
  light chain complementarity determining region 3 for antibody 30323
QQRSNLLT

SEQ ID NO: 60646 - protein, 20 aa, Homo sapiens
  heavy chain complementarity determining region 3 for antibody 30323
ARGRIRRDRLVHYYYYGMDV

SEQ ID NO: 60647 - protein, 9 aa, Homo sapiens
  light chain complementarity determining region 3 for antibody 30324
QQRSNGPST

SEQ ID NO: 60648 - protein, 14 aa, Homo sapiens
  heavy chain complementarity determining region 3 for antibody 30324
ASPYEDGSGWYFDP

SEQ ID NO: 60649 - protein, 10 aa, Homo sapiens
  light chain complementarity determining region 3 for antibody 30325
QQRSNGPPYT

SEQ ID NO: 60650 - protein, 13 aa, Homo sapiens
  heavy chain complementarity determining region 3 for antibody 30325
ARVGQQRLRGFDI

SEQ ID NO: 60651 - protein, 10 aa, Homo sapiens
  light chain complementarity determining region 3 for antibody 30326
QQRSNGPPLT

SEQ ID NO: 60652 - protein, 9 aa, Homo sapiens
  heavy chain complementarity determining region 3 for antibody 30326
ARVDGYFDY

SEQ ID NO: 60653 - protein, 10 aa, Homo sapiens
  light chain complementarity determining region 3 for antibody 30327
QQRSNGPPIT

SEQ ID NO: 60654 - protein, 11 aa, Homo sapiens
  heavy chain complementarity determining region 3 for antibody 30327
ARDWRSGGMDV

SEQ ID NO: 60655 - protein, 10 aa, Homo sapiens
  light chain complementarity determining region 3 for antibody 30328
QQRSNGPPIT

SEQ ID NO: 60656 - protein, 17 aa, Homo sapiens
  heavy chain complementarity determining region 3 for antibody 30328
AAGYHSESLSADDVFDM

SEQ ID NO: 60657 - protein, 10 aa, Homo sapiens
  light chain complementarity determining region 3 for antibody 30329
QQRSNGPPFT

SEQ ID NO: 60658 - protein, 13 aa, Homo sapiens
  heavy chain complementarity determining region 3 for antibody 30329
ARVGQQRLRGFDI

SEQ ID NO: 60659 - protein, 10 aa, Homo sapiens
  light chain complementarity determining region 3 for antibody 30330
QQRSKWPSLT

SEQ ID NO: 60660 - protein, 9 aa, Homo sapiens
  heavy chain complementarity determining region 3 for antibody 30330
ARVDGYFDY

SEQ ID NO: 60661 - protein, 10 aa, Homo sapiens
  light chain complementarity determining region 3 for antibody 30331
QQRSKWPPPT

SEQ ID NO: 60662 - protein, 9 aa, Homo sapiens
  heavy chain complementarity determining region 3 for antibody 30331
ARVDGYFDY

SEQ ID NO: 60663 - protein, 8 aa, Homo sapiens
  light chain complementarity determining region 3 for antibody 30332
QQRSKSVT

SEQ ID NO: 60664 - protein, 11 aa, Homo sapiens
  heavy chain complementarity determining region 3 for antibody 30332
GRGTSTWSDDY

SEQ ID NO: 60665 - protein, 8 aa, Homo sapiens
  light chain complementarity determining region 3 for antibody 30333
QQRSKSVT

SEQ ID NO: 60666 - protein, 11 aa, Homo sapiens
  heavy chain complementarity determining region 3 for antibody 30333
GRGTSTWPDDY

SEQ ID NO: 60667 - protein, 8 aa, Homo sapiens
  light chain complementarity determining region 3 for antibody 30334
QQRSKSVT

SEQ ID NO: 60668 - protein, 11 aa, Homo sapiens
  heavy chain complementarity determining region 3 for antibody 30334
GRGPSTWTDDY

SEQ ID NO: 60669 - protein, 8 aa, Homo sapiens
  light chain complementarity determining region 3 for antibody 30335
QQRSKSVP

SEQ ID NO: 60670 - protein, 11 aa, Homo sapiens
  heavy chain complementarity determining region 3 for antibody 30335
GRGTSTWTDDY

SEQ ID NO: 60671 - protein, 8 aa, Homo sapiens
  light chain complementarity determining region 3 for antibody 30336
QQRSKSFT

SEQ ID NO: 60672 - protein, 11 aa, Homo sapiens
  heavy chain complementarity determining region 3 for antibody 30336
GRGTSTWTDDY

SEQ ID NO: 60673 - protein, 9 aa, Homo sapiens
  light chain complementarity determining region 3 for antibody 30337
QQRSHWPPT

SEQ ID NO: 60674 - protein, 15 aa, Homo sapiens
  heavy chain complementarity determining region 3 for antibody 30337
ARTERRGNGRYLYDF

SEQ ID NO: 60675 - protein, 9 aa, Homo sapiens
  light chain complementarity determining region 3 for antibody 30338
QQRSHWPPP

SEQ ID NO: 60676 - protein, 15 aa, Homo sapiens
  heavy chain complementarity determining region 3 for antibody 30338
ARTERRGNGWYLYDF

SEQ ID NO: 60677 - protein, 10 aa, Homo sapiens
  light chain complementarity determining region 3 for antibody 30339
QQRSHWPPIT

SEQ ID NO: 60678 - protein, 12 aa, Homo sapiens
  heavy chain complementarity determining region 3 for antibody 30339
VKDWGAVAGHDY

SEQ ID NO: 60679 - protein, 11 aa, Homo sapiens
  light chain complementarity determining region 3 for antibody 30340
QQRSHWPPALT

SEQ ID NO: 60680 - protein, 14 aa, Homo sapiens
  heavy chain complementarity determining region 3 for antibody 30340
AREGTAMVKDAFEI

SEQ ID NO: 60681 - protein, 9 aa, Homo sapiens
  light chain complementarity determining region 3 for antibody 30341
QQRSGWPIT

SEQ ID NO: 60682 - protein, 20 aa, Homo sapiens
  heavy chain complementarity determining region 3 for antibody 30341
ARGGHIVVVTSIGDQAAFNV

SEQ ID NO: 60683 - protein, 9 aa, Homo sapiens
  light chain complementarity determining region 3 for antibody 30342
QQRSDWPRT

SEQ ID NO: 60684 - protein, 16 aa, Homo sapiens
  heavy chain complementarity determining region 3 for antibody 30342
ATQLHIGGPTWRYFDS

SEQ ID NO: 60685 - protein, 10 aa, Homo sapiens
  light chain complementarity determining region 3 for antibody 30343
QQRSDWPQLT

SEQ ID NO: 60686 - protein, 10 aa, Homo sapiens
  heavy chain complementarity determining region 3 for antibody 30343
ARDYTMTFDY

SEQ ID NO: 60687 - protein, 10 aa, Homo sapiens
  light chain complementarity determining region 3 for antibody 30344
QQRSDWPPYP

SEQ ID NO: 60688 - protein, 13 aa, Homo sapiens
  heavy chain complementarity determining region 3 for antibody 30344
ARETRYSWGYFDH

SEQ ID NO: 60689 - protein, 10 aa, Homo sapiens
  light chain complementarity determining region 3 for antibody 30345
QQRSDWPPLT

SEQ ID NO: 60690 - protein, 10 aa, Homo sapiens
  heavy chain complementarity determining region 3 for antibody 30345
ARDYTMAFDY

SEQ ID NO: 60691 - protein, 10 aa, Homo sapiens
  light chain complementarity determining region 3 for antibody 30346
QQRSDWPPLN

SEQ ID NO: 60692 - protein, 10 aa, Homo sapiens
  heavy chain complementarity determining region 3 for antibody 30346
ARDYTMTFDY

SEQ ID NO: 60693 - protein, 10 aa, Homo sapiens
  light chain complementarity determining region 3 for antibody 30347
QQRSDLPPYT

SEQ ID NO: 60694 - protein, 13 aa, Homo sapiens
  heavy chain complementarity determining region 3 for antibody 30347
ARETRYSWGYFDH

SEQ ID NO: 60695 - protein, 11 aa, Homo sapiens
  light chain complementarity determining region 3 for antibody 30348
QQRSDCPPVIT

SEQ ID NO: 60696 - protein, 22 aa, Homo sapiens
  heavy chain complementarity determining region 3 for antibody 30348
ARHRQAENYDSGGYSLPDGFDI

SEQ ID NO: 60697 - protein, 10 aa, Homo sapiens
  light chain complementarity determining region 3 for antibody 30349
QQRSDCPPLT

SEQ ID NO: 60698 - protein, 10 aa, Homo sapiens
  heavy chain complementarity determining region 3 for antibody 30349
ARDYTMTFDY

SEQ ID NO: 60699 - protein, 9 aa, Homo sapiens
  light chain complementarity determining region 3 for antibody 30350
QQRSAWPPT

SEQ ID NO: 60700 - protein, 7 aa, Homo sapiens
  heavy chain complementarity determining region 3 for antibody 30350
VRDEWWP

SEQ ID NO: 60701 - protein, 9 aa, Homo sapiens
  light chain complementarity determining region 3 for antibody 30351
QQRSAWPLT

SEQ ID NO: 60702 - protein, 7 aa, Homo sapiens
  heavy chain complementarity determining region 3 for antibody 30351
VRDEWCP

SEQ ID NO: 60703 - protein, 8 aa, Homo sapiens
  light chain complementarity determining region 3 for antibody 30352
QQRSALIT

SEQ ID NO: 60704 - protein, 18 aa, Homo sapiens
  heavy chain complementarity determining region 3 for antibody 30352
AKGSVRSCSSRNCYYFDS

SEQ ID NO: 60705 - protein, 9 aa, Homo sapiens
  light chain complementarity determining region 3 for antibody 30353
QQRSAGPLT

SEQ ID NO: 60706 - protein, 7 aa, Homo sapiens
  heavy chain complementarity determining region 3 for antibody 30353
VRDEWWP

SEQ ID NO: 60707 - protein, 7 aa, Homo sapiens
  light chain complementarity determining region 3 for antibody 30354
QQRRNWR

SEQ ID NO: 60708 - protein, 19 aa, Homo sapiens
  heavy chain complementarity determining region 3 for antibody 30354
ARGVYCSGGSCYGRNWFDP

SEQ ID NO: 60709 - protein, 10 aa, Homo sapiens
  light chain complementarity determining region 3 for antibody 30355
QQRRNWPPIT

SEQ ID NO: 60710 - protein, 22 aa, Homo sapiens
  heavy chain complementarity determining region 3 for antibody 30355
ARMKKSDVPLYCKGGTCHIFDY

SEQ ID NO: 60711 - protein, 11 aa, Homo sapiens
  light chain complementarity determining region 3 for antibody 30356
QQRRNWPPALT

SEQ ID NO: 60712 - protein, 14 aa, Homo sapiens
  heavy chain complementarity determining region 3 for antibody 30356
AREGTAMVKDAFEI

SEQ ID NO: 60713 - protein, 10 aa, Homo sapiens
  light chain complementarity determining region 3 for antibody 30357
QQRRKWPPLT

SEQ ID NO: 60714 - protein, 9 aa, Homo sapiens
  heavy chain complementarity determining region 3 for antibody 30357
ARVDGYFDY

SEQ ID NO: 60715 - protein, 11 aa, Homo sapiens
  light chain complementarity determining region 3 for antibody 30358
QQRQPRSNWPT

SEQ ID NO: 60716 - protein, 15 aa, Homo sapiens
  heavy chain complementarity determining region 3 for antibody 30358
ARGGYSSSWYYWFDP

SEQ ID NO: 60717 - protein, 8 aa, Homo sapiens
  light chain complementarity determining region 3 for antibody 30359
QQRPTRLS

SEQ ID NO: 60718 - protein, 11 aa, Homo sapiens
  heavy chain complementarity determining region 3 for antibody 30359
ASGSMGWVFDH

SEQ ID NO: 60719 - protein, 8 aa, Homo sapiens
  light chain complementarity determining region 3 for antibody 30360
QQRPSWPT

SEQ ID NO: 60720 - protein, 11 aa, Homo sapiens
  heavy chain complementarity determining region 3 for antibody 30360
ARDDRRELPEL

SEQ ID NO: 60721 - protein, 8 aa, Homo sapiens
  light chain complementarity determining region 3 for antibody 30361
QQRNTWPP

SEQ ID NO: 60722 - protein, 13 aa, Homo sapiens
  heavy chain complementarity determining region 3 for antibody 30361
ARVSVHQFLLIDY

SEQ ID NO: 60723 - protein, 9 aa, Homo sapiens
  light chain complementarity determining region 3 for antibody 30362
QQRNSYPLT

SEQ ID NO: 60724 - protein, 12 aa, Homo sapiens
  heavy chain complementarity determining region 3 for antibody 30362
TRGGGPNSPFHY

SEQ ID NO: 60725 - protein, 9 aa, Homo sapiens
  light chain complementarity determining region 3 for antibody 30363
QQRNSYPIT

SEQ ID NO: 60726 - protein, 22 aa, Homo sapiens
  heavy chain complementarity determining region 3 for antibody 30363
AREPHSSSSQTQHYYYYYGMDV

SEQ ID NO: 60727 - protein, 8 aa, Homo sapiens
  light chain complementarity determining region 3 for antibody 30364
QQRNSWPT

SEQ ID NO: 60728 - protein, 11 aa, Homo sapiens
  heavy chain complementarity determining region 3 for antibody 30364
ARDDRRELPEL

SEQ ID NO: 60729 - protein, 11 aa, Homo sapiens
  light chain complementarity determining region 3 for antibody 30365
QQRNSWPPKYT

SEQ ID NO: 60730 - protein, 14 aa, Homo sapiens
  heavy chain complementarity determining region 3 for antibody 30365
ARTVLDTAADAFDF

SEQ ID NO: 60731 - protein, 9 aa, Homo sapiens
  light chain complementarity determining region 3 for antibody 30366
QQRNRTPHT

SEQ ID NO: 60732 - protein, 14 aa, Homo sapiens
  heavy chain complementarity determining region 3 for antibody 30366
ATEGPSRMGKFFDS

SEQ ID NO: 60733 - protein, 10 aa, Homo sapiens
  light chain complementarity determining region 3 for antibody 30367
QQRNNWPPVI

SEQ ID NO: 60734 - protein, 12 aa, Homo sapiens
  heavy chain complementarity determining region 3 for antibody 30367
VRDGSSGWHFDY

SEQ ID NO: 60735 - protein, 9 aa, Homo sapiens
  light chain complementarity determining region 3 for antibody 30368
QQRNNWPPT

SEQ ID NO: 60736 - protein, 15 aa, Homo sapiens
  heavy chain complementarity determining region 3 for antibody 30368
ARVEIRGGSAWFPDY

SEQ ID NO: 60737 - protein, 9 aa, Homo sapiens
  light chain complementarity determining region 3 for antibody 30369
QQRNNWPPT

SEQ ID NO: 60738 - protein, 13 aa, Homo sapiens
  heavy chain complementarity determining region 3 for antibody 30369
ARDMDDSGDLFDY

SEQ ID NO: 60739 - protein, 11 aa, Homo sapiens
  light chain complementarity determining region 3 for antibody 30370
QQRNNWPPEGI

SEQ ID NO: 60740 - protein, 16 aa, Homo sapiens
  heavy chain complementarity determining region 3 for antibody 30370
ATWSYLPQRHYWYFDL

SEQ ID NO: 60741 - protein, 9 aa, Homo sapiens
  light chain complementarity determining region 3 for antibody 30371
QQRNNWPLT

SEQ ID NO: 60742 - protein, 14 aa, Homo sapiens
  heavy chain complementarity determining region 3 for antibody 30371
AKGDSYGIFSVFDF

SEQ ID NO: 60743 - protein, 9 aa, Homo sapiens
  light chain complementarity determining region 3 for antibody 30372
QQRNNWPLT

SEQ ID NO: 60744 - protein, 17 aa, Homo sapiens
  heavy chain complementarity determining region 3 for antibody 30372
AKDFSPYGDYKSDYFDH

SEQ ID NO: 60745 - protein, 10 aa, Homo sapiens
  light chain complementarity determining region 3 for antibody 30373
QQRNKWPPVM

SEQ ID NO: 60746 - protein, 12 aa, Homo sapiens
  heavy chain complementarity determining region 3 for antibody 30373
VRDGSSGWHFDY

SEQ ID NO: 60747 - protein, 10 aa, Homo sapiens
  light chain complementarity determining region 3 for antibody 30374
QQRNKWPPAI

SEQ ID NO: 60748 - protein, 12 aa, Homo sapiens
  heavy chain complementarity determining region 3 for antibody 30374
VRDGSSGWHFDY

SEQ ID NO: 60749 - protein, 8 aa, Homo sapiens
  light chain complementarity determining region 3 for antibody 30375
QQRNFRPT

SEQ ID NO: 60750 - protein, 13 aa, Homo sapiens
  heavy chain complementarity determining region 3 for antibody 30375
TTDAAFVPYYFTY

SEQ ID NO: 60751 - protein, 8 aa, Homo sapiens
  light chain complementarity determining region 3 for antibody 30376
QQRNFRLT

SEQ ID NO: 60752 - protein, 13 aa, Homo sapiens
  heavy chain complementarity determining region 3 for antibody 30376
TTDAAFVPYSFTY

SEQ ID NO: 60753 - protein, 10 aa, Homo sapiens
  light chain complementarity determining region 3 for antibody 30377
QQRINWPPFP

SEQ ID NO: 60754 - protein, 18 aa, Homo sapiens
  heavy chain complementarity determining region 3 for antibody 30377
VTIPPYRRGWDTKGYFDN

SEQ ID NO: 60755 - protein, 8 aa, Homo sapiens
  light chain complementarity determining region 3 for antibody 30378
QQRIKWLT

SEQ ID NO: 60756 - protein, 14 aa, Homo sapiens
  heavy chain complementarity determining region 3 for antibody 30378
ARVDIAATGAPFDP

SEQ ID NO: 60757 - protein, 9 aa, Homo sapiens
  light chain complementarity determining region 3 for antibody 30379
QQRIDWPGP

SEQ ID NO: 60758 - protein, 12 aa, Homo sapiens
  heavy chain complementarity determining region 3 for antibody 30379
GREDYRTGYVDS

SEQ ID NO: 60759 - protein, 9 aa, Homo sapiens
  light chain complementarity determining region 3 for antibody 30380
QQRHTWPLT

SEQ ID NO: 60760 - protein, 14 aa, Homo sapiens
  heavy chain complementarity determining region 3 for antibody 30380
AKGDSYGIFSVFDF

SEQ ID NO: 60761 - protein, 8 aa, Homo sapiens
  light chain complementarity determining region 3 for antibody 30381
QQRHTRLS

SEQ ID NO: 60762 - protein, 11 aa, Homo sapiens
  heavy chain complementarity determining region 3 for antibody 30381
ASGSVGWVFDH

SEQ ID NO: 60763 - protein, 8 aa, Homo sapiens
  light chain complementarity determining region 3 for antibody 30382
QQRHTRLP

SEQ ID NO: 60764 - protein, 11 aa, Homo sapiens
  heavy chain complementarity determining region 3 for antibody 30382
ASGSMGWVFDH

SEQ ID NO: 60765 - protein, 9 aa, Homo sapiens
  light chain complementarity determining region 3 for antibody 30383
QQRHNWPWT

SEQ ID NO: 60766 - protein, 17 aa, Homo sapiens
  heavy chain complementarity determining region 3 for antibody 30383
VVPQFSRTDWPPEPSDY

SEQ ID NO: 60767 - protein, 9 aa, Homo sapiens
  light chain complementarity determining region 3 for antibody 30384
QQRHNWPWT

SEQ ID NO: 60768 - protein, 17 aa, Homo sapiens
  heavy chain complementarity determining region 3 for antibody 30384
VVPQFARTDWPTEPSDY

SEQ ID NO: 60769 - protein, 9 aa, Homo sapiens
  light chain complementarity determining region 3 for antibody 30385
QQRHNWPLT

SEQ ID NO: 60770 - protein, 14 aa, Homo sapiens
  heavy chain complementarity determining region 3 for antibody 30385
AKGDSYGIFPVFDF

SEQ ID NO: 60771 - protein, 9 aa, Homo sapiens
  light chain complementarity determining region 3 for antibody 30386
QQRHNWPLS

SEQ ID NO: 60772 - protein, 14 aa, Homo sapiens
  heavy chain complementarity determining region 3 for antibody 30386
AKGDSYGIFSVFDF

SEQ ID NO: 60773 - protein, 9 aa, Homo sapiens
  light chain complementarity determining region 3 for antibody 30387
QQRHNWPFT

SEQ ID NO: 60774 - protein, 14 aa, Homo sapiens
  heavy chain complementarity determining region 3 for antibody 30387
AKGDSYGIFSVFDF

SEQ ID NO: 60775 - protein, 10 aa, Homo sapiens
  light chain complementarity determining region 3 for antibody 30388
QQRHNNTPYT

SEQ ID NO: 60776 - protein, 21 aa, Homo sapiens
  heavy chain complementarity determining region 3 for antibody 30388
ARTGRHYSDSTVYYYRPRIDY

SEQ ID NO: 60777 - protein, 9 aa, Homo sapiens
  light chain complementarity determining region 3 for antibody 30389
QQRHNLPWT

SEQ ID NO: 60778 - protein, 17 aa, Homo sapiens
  heavy chain complementarity determining region 3 for antibody 30389
VVPQFSRTDWPTEPSDY

SEQ ID NO: 60779 - protein, 9 aa, Homo sapiens
  light chain complementarity determining region 3 for antibody 30390
QQRGNWPLP

SEQ ID NO: 60780 - protein, 26 aa, Homo sapiens
  heavy chain complementarity determining region 3 for antibody 30390
ARDLGLRSLEWKSRNTNTNYYYGMDV

SEQ ID NO: 60781 - protein, 8 aa, Homo sapiens
  light chain complementarity determining region 3 for antibody 30391
QQRGNWPK

SEQ ID NO: 60782 - protein, 15 aa, Homo sapiens
  heavy chain complementarity determining region 3 for antibody 30391
ARVGSSWYTAGWFDP

SEQ ID NO: 60783 - protein, 10 aa, Homo sapiens
  light chain complementarity determining region 3 for antibody 30392
QQRGNWPEIT

SEQ ID NO: 60784 - protein, 14 aa, Homo sapiens
  heavy chain complementarity determining region 3 for antibody 30392
AKDHDSLVSGFGDL

SEQ ID NO: 60785 - protein, 10 aa, Homo sapiens
  light chain complementarity determining region 3 for antibody 30393
QQRGNWPEIN

SEQ ID NO: 60786 - protein, 14 aa, Homo sapiens
  heavy chain complementarity determining region 3 for antibody 30393
AKDHDSFVSGFGDL

SEQ ID NO: 60787 - protein, 9 aa, Homo sapiens
  light chain complementarity determining region 3 for antibody 30394
QQRGKWPLT

SEQ ID NO: 60788 - protein, 15 aa, Homo sapiens
  heavy chain complementarity determining region 3 for antibody 30394
ARIGGYYDSGPISDY

SEQ ID NO: 60789 - protein, 9 aa, Homo sapiens
  light chain complementarity determining region 3 for antibody 30395
QQRGKWPLT

SEQ ID NO: 60790 - protein, 15 aa, Homo sapiens
  heavy chain complementarity determining region 3 for antibody 30395
ARIGGDYDSGTISDY

SEQ ID NO: 60791 - protein, 9 aa, Homo sapiens
  light chain complementarity determining region 3 for antibody 30396
QQRGKRPLT

SEQ ID NO: 60792 - protein, 15 aa, Homo sapiens
  heavy chain complementarity determining region 3 for antibody 30396
ARIGGYYDSGTISDY

SEQ ID NO: 60793 - protein, 9 aa, Homo sapiens
  light chain complementarity determining region 3 for antibody 30397
QQRGKCPLT

SEQ ID NO: 60794 - protein, 15 aa, Homo sapiens
  heavy chain complementarity determining region 3 for antibody 30397
ARIGGYYDSGTISDY

SEQ ID NO: 60795 - protein, 6 aa, Homo sapiens
  light chain complementarity determining region 3 for antibody 30398
QQRGFT

SEQ ID NO: 60796 - protein, 13 aa, Homo sapiens
  heavy chain complementarity determining region 3 for antibody 30398
AHRDKLRGYDFDY

SEQ ID NO: 60797 - protein, 10 aa, Homo sapiens
  light chain complementarity determining region 3 for antibody 30399
QQRGDWPLYP

SEQ ID NO: 60798 - protein, 14 aa, Homo sapiens
  heavy chain complementarity determining region 3 for antibody 30399
VRRGAWPSLSHFDY

SEQ ID NO: 60799 - protein, 9 aa, Homo sapiens
  light chain complementarity determining region 3 for antibody 30400
QQRFTTPPT

SEQ ID NO: 60800 - protein, 18 aa, Homo sapiens
  heavy chain complementarity determining region 3 for antibody 30400
AREMDVAVDRVMFNILDS

SEQ ID NO: 60801 - protein, 9 aa, Homo sapiens
  light chain complementarity determining region 3 for antibody 30401
QQRFTSPIT

SEQ ID NO: 60802 - protein, 17 aa, Homo sapiens
  heavy chain complementarity determining region 3 for antibody 30401
ARGTRPLTSAEQNWLDP

SEQ ID NO: 60803 - protein, 9 aa, Homo sapiens
  light chain complementarity determining region 3 for antibody 30402
QQRFQWPPT

SEQ ID NO: 60804 - protein, 19 aa, Homo sapiens
  heavy chain complementarity determining region 3 for antibody 30402
AREVSSADHYGVGKNWFDP

SEQ ID NO: 60805 - protein, 9 aa, Homo sapiens
  light chain complementarity determining region 3 for antibody 30403
QQRFNNPPT

SEQ ID NO: 60806 - protein, 18 aa, Homo sapiens
  heavy chain complementarity determining region 3 for antibody 30403
VREMDVAVHRVMFNIFDS

SEQ ID NO: 60807 - protein, 9 aa, Homo sapiens
  light chain complementarity determining region 3 for antibody 30404
QQRFLAPLT

SEQ ID NO: 60808 - protein, 12 aa, Homo sapiens
  heavy chain complementarity determining region 3 for antibody 30404
ARFVSGYEAFDV

SEQ ID NO: 60809 - protein, 9 aa, Homo sapiens
  light chain complementarity determining region 3 for antibody 30405
QQRFKWPPT

SEQ ID NO: 60810 - protein, 19 aa, Homo sapiens
  heavy chain complementarity determining region 3 for antibody 30405
AREVSSADHYGVGKSWFDP

SEQ ID NO: 60811 - protein, 9 aa, Homo sapiens
  light chain complementarity determining region 3 for antibody 30406
QQRFKWPPT

SEQ ID NO: 60812 - protein, 19 aa, Homo sapiens
  heavy chain complementarity determining region 3 for antibody 30406
AREVSAADHYGVGKNWFDP

SEQ ID NO: 60813 - protein, 9 aa, Homo sapiens
  light chain complementarity determining region 3 for antibody 30407
QQRFKCPPT

SEQ ID NO: 60814 - protein, 19 aa, Homo sapiens
  heavy chain complementarity determining region 3 for antibody 30407
AREVSSADHYGVGKNWFDP

SEQ ID NO: 60815 - protein, 9 aa, Homo sapiens
  light chain complementarity determining region 3 for antibody 30408
QQRENWPPK

SEQ ID NO: 60816 - protein, 13 aa, Homo sapiens
  heavy chain complementarity determining region 3 for antibody 30408
ARDMDDSGDLFDY

SEQ ID NO: 60817 - protein, 8 aa, Homo sapiens
  light chain complementarity determining region 3 for antibody 30409
QQRDSTPP

SEQ ID NO: 60818 - protein, 13 aa, Homo sapiens
  heavy chain complementarity determining region 3 for antibody 30409
ARPTSDYNWNFGY

SEQ ID NO: 60819 - protein, 9 aa, Homo sapiens
  light chain complementarity determining region 3 for antibody 30410
QQRDSTPIT

SEQ ID NO: 60820 - protein, 16 aa, Homo sapiens
  heavy chain complementarity determining region 3 for antibody 30410
SRGAYYSSSWYGWFDP

SEQ ID NO: 60821 - protein, 9 aa, Homo sapiens
  light chain complementarity determining region 3 for antibody 30411
QQRDNWPPT

SEQ ID NO: 60822 - protein, 13 aa, Homo sapiens
  heavy chain complementarity determining region 3 for antibody 30411
ARDMDDSGDLFDY

SEQ ID NO: 60823 - protein, 11 aa, Homo sapiens
  light chain complementarity determining region 3 for antibody 30412
QQRCNWPPSYT

SEQ ID NO: 60824 - protein, 14 aa, Homo sapiens
  heavy chain complementarity determining region 3 for antibody 30412
AKDKAVTGLYYFDY

SEQ ID NO: 60825 - protein, 10 aa, Homo sapiens
  light chain complementarity determining region 3 for antibody 30413
QQRCNWPPIT

SEQ ID NO: 60826 - protein, 17 aa, Homo sapiens
  heavy chain complementarity determining region 3 for antibody 30413
AAGYHSESLSADDVFDM

SEQ ID NO: 60827 - protein, 8 aa, Homo sapiens
  light chain complementarity determining region 3 for antibody 30414
QQRANWVT

SEQ ID NO: 60828 - protein, 17 aa, Homo sapiens
  heavy chain complementarity determining region 3 for antibody 30414
TTDYCSGGSCYSDWFDP

SEQ ID NO: 60829 - protein, 8 aa, Homo sapiens
  light chain complementarity determining region 3 for antibody 30415
QQRANWGT

SEQ ID NO: 60830 - protein, 14 aa, Homo sapiens
  heavy chain complementarity determining region 3 for antibody 30415
ARDASRASQYYFDY

SEQ ID NO: 60831 - protein, 9 aa, Homo sapiens
  light chain complementarity determining region 3 for antibody 30416
QQRAILPPT

SEQ ID NO: 60832 - protein, 15 aa, Homo sapiens
  heavy chain complementarity determining region 3 for antibody 30416
ARRLAVPGNHDGFDL

SEQ ID NO: 60833 - protein, 8 aa, Homo sapiens
  light chain complementarity determining region 3 for antibody 30417
QQRAHWVT

SEQ ID NO: 60834 - protein, 17 aa, Homo sapiens
  heavy chain complementarity determining region 3 for antibody 30417
ATDYCSGGSCYSDWFDP

SEQ ID NO: 60835 - protein, 8 aa, Homo sapiens
  light chain complementarity determining region 3 for antibody 30418
QQRAHWVP

SEQ ID NO: 60836 - protein, 17 aa, Homo sapiens
  heavy chain complementarity determining region 3 for antibody 30418
TTDYCSGGSCYSDWFDP

SEQ ID NO: 60837 - protein, 8 aa, Homo sapiens
  light chain complementarity determining region 3 for antibody 30419
QQQRNPFT

SEQ ID NO: 60838 - protein, 15 aa, Homo sapiens
  heavy chain complementarity determining region 3 for antibody 30419
ARAWGAATTSYICDN

SEQ ID NO: 60839 - protein, 10 aa, Homo sapiens
  light chain complementarity determining region 3 for antibody 30420
QQPYSTLGYT

SEQ ID NO: 60840 - protein, 14 aa, Homo sapiens
  heavy chain complementarity determining region 3 for antibody 30420
ARDLTGYRAPYFDY

SEQ ID NO: 60841 - protein, 9 aa, Homo sapiens
  light chain complementarity determining region 3 for antibody 30421
QQPYSPPFT

SEQ ID NO: 60842 - protein, 14 aa, Homo sapiens
  heavy chain complementarity determining region 3 for antibody 30421
ARGRDTSGYSGLDH

SEQ ID NO: 60843 - protein, 9 aa, Homo sapiens
  light chain complementarity determining region 3 for antibody 30422
QQPYSIPWT

SEQ ID NO: 60844 - protein, 12 aa, Homo sapiens
  heavy chain complementarity determining region 3 for antibody 30422
ARVAKYYYGLDV

SEQ ID NO: 60845 - protein, 10 aa, Homo sapiens
  light chain complementarity determining region 3 for antibody 30423
QQPYNWPPYT

SEQ ID NO: 60846 - protein, 11 aa, Homo sapiens
  heavy chain complementarity determining region 3 for antibody 30423
ARGVGSYPFDS

SEQ ID NO: 60847 - protein, 9 aa, Homo sapiens
  light chain complementarity determining region 3 for antibody 30424
QQPSSSPPT

SEQ ID NO: 60848 - protein, 16 aa, Homo sapiens
  heavy chain complementarity determining region 3 for antibody 30424
GRDHELYGRSSGVTDY

SEQ ID NO: 60849 - protein, 8 aa, Homo sapiens
  light chain complementarity determining region 3 for antibody 30425
QQPRNPFT

SEQ ID NO: 60850 - protein, 15 aa, Homo sapiens
  heavy chain complementarity determining region 3 for antibody 30425
ARAWGAATTSYICDN

SEQ ID NO: 60851 - protein, 9 aa, Homo sapiens
  light chain complementarity determining region 3 for antibody 30426
QQPPSFPLT

SEQ ID NO: 60852 - protein, 15 aa, Homo sapiens
  heavy chain complementarity determining region 3 for antibody 30426
AKDPSCDSIWNYFDY

SEQ ID NO: 60853 - protein, 9 aa, Homo sapiens
  light chain complementarity determining region 3 for antibody 30427
QQPNTYPLT

SEQ ID NO: 60854 - protein, 8 aa, Homo sapiens
  heavy chain complementarity determining region 3 for antibody 30427
INYNTGWS

SEQ ID NO: 60855 - protein, 9 aa, Homo sapiens
  light chain complementarity determining region 3 for antibody 30428
QQPKSFPLT

SEQ ID NO: 60856 - protein, 14 aa, Homo sapiens
  heavy chain complementarity determining region 3 for antibody 30428
ARDPVIGTPDWFDP

SEQ ID NO: 60857 - protein, 9 aa, Homo sapiens
  light chain complementarity determining region 3 for antibody 30429
QQNYTSGRT

SEQ ID NO: 60858 - protein, 12 aa, Homo sapiens
  heavy chain complementarity determining region 3 for antibody 30429
VKDCGLGGSRDF

SEQ ID NO: 60859 - protein, 9 aa, Homo sapiens
  light chain complementarity determining region 3 for antibody 30430
QQNYSPPWM

SEQ ID NO: 60860 - protein, 20 aa, Homo sapiens
  heavy chain complementarity determining region 3 for antibody 30430
ARVLGYCDTITCYHKGDFDY

SEQ ID NO: 60861 - protein, 9 aa, Homo sapiens
  light chain complementarity determining region 3 for antibody 30431
QQNYRTPYT

SEQ ID NO: 60862 - protein, 15 aa, Homo sapiens
  heavy chain complementarity determining region 3 for antibody 30431
ARVGVDPNYYYGLDV

SEQ ID NO: 60863 - protein, 10 aa, Homo sapiens
  light chain complementarity determining region 3 for antibody 30432
QQNYNYPPYT

SEQ ID NO: 60864 - protein, 16 aa, Homo sapiens
  heavy chain complementarity determining region 3 for antibody 30432
ARDTAYDYVWGSPIDY

SEQ ID NO: 60865 - protein, 10 aa, Homo sapiens
  light chain complementarity determining region 3 for antibody 30433
QQNYGTPPFT

SEQ ID NO: 60866 - protein, 14 aa, Homo sapiens
  heavy chain complementarity determining region 3 for antibody 30433
AKDLLKLWGSCSGD

SEQ ID NO: 60867 - protein, 9 aa, Homo sapiens
  light chain complementarity determining region 3 for antibody 30434
QQNVHLPLT

SEQ ID NO: 60868 - protein, 13 aa, Homo sapiens
  heavy chain complementarity determining region 3 for antibody 30434
TRGEERNTGEMDF

SEQ ID NO: 60869 - protein, 9 aa, Homo sapiens
  light chain complementarity determining region 3 for antibody 30435
QQNTTYPWT

SEQ ID NO: 60870 - protein, 17 aa, Homo sapiens
  heavy chain complementarity determining region 3 for antibody 30435
AREGGYSYGLYGDAFDI

SEQ ID NO: 60871 - protein, 9 aa, Homo sapiens
  light chain complementarity determining region 3 for antibody 30436
QQNSSSPWT

SEQ ID NO: 60872 - protein, 13 aa, Homo sapiens
  heavy chain complementarity determining region 3 for antibody 30436
ARGSTNWRNWFDP

SEQ ID NO: 60873 - protein, 9 aa, Homo sapiens
  light chain complementarity determining region 3 for antibody 30437
QQNSSSLIT

SEQ ID NO: 60874 - protein, 12 aa, Homo sapiens
  heavy chain complementarity determining region 3 for antibody 30437
ARDYVAGDAFDV

SEQ ID NO: 60875 - protein, 9 aa, Homo sapiens
  light chain complementarity determining region 3 for antibody 30438
QQNSRSPVT

SEQ ID NO: 60876 - protein, 15 aa, Homo sapiens
  heavy chain complementarity determining region 3 for antibody 30438
AREPNSYGLEYYFTY

SEQ ID NO: 60877 - protein, 9 aa, Homo sapiens
  light chain complementarity determining region 3 for antibody 30439
QQNSNWPHT

SEQ ID NO: 60878 - protein, 12 aa, Homo sapiens
  heavy chain complementarity determining region 3 for antibody 30439
ATWGFSLLKEDF

SEQ ID NO: 60879 - protein, 9 aa, Homo sapiens
  light chain complementarity determining region 3 for antibody 30440
QQNSDVPLT

SEQ ID NO: 60880 - protein, 9 aa, Homo sapiens
  heavy chain complementarity determining region 3 for antibody 30440
VCLGVTPPV

SEQ ID NO: 60881 - protein, 9 aa, Homo sapiens
  light chain complementarity determining region 3 for antibody 30441
QQNRSSPWT

SEQ ID NO: 60882 - protein, 22 aa, Homo sapiens
  heavy chain complementarity determining region 3 for antibody 30441
ARAVSTNRWGRSTGDWGGAYDI

SEQ ID NO: 60883 - protein, 11 aa, Homo sapiens
  light chain complementarity determining region 3 for antibody 30442
QQNNTYSPPCT

SEQ ID NO: 60884 - protein, 15 aa, Homo sapiens
  heavy chain complementarity determining region 3 for antibody 30442
AGGPSGVWLGYYFDY

SEQ ID NO: 60885 - protein, 9 aa, Homo sapiens
  light chain complementarity determining region 3 for antibody 30443
QQNNTYPYT

SEQ ID NO: 60886 - protein, 11 aa, Homo sapiens
  heavy chain complementarity determining region 3 for antibody 30443
ARVTWLVIYDS

SEQ ID NO: 60887 - protein, 9 aa, Homo sapiens
  light chain complementarity determining region 3 for antibody 30444
QQNNTYPPT

SEQ ID NO: 60888 - protein, 15 aa, Homo sapiens
  heavy chain complementarity determining region 3 for antibody 30444
ASKGGLPVYQYGMDV

SEQ ID NO: 60889 - protein, 10 aa, Homo sapiens
  light chain complementarity determining region 3 for antibody 30445
QQNNSYSSYT

SEQ ID NO: 60890 - protein, 15 aa, Homo sapiens
  heavy chain complementarity determining region 3 for antibody 30445
ARTKLERRRDHYFDY

SEQ ID NO: 60891 - protein, 10 aa, Homo sapiens
  light chain complementarity determining region 3 for antibody 30446
QQNNSYSPYT

SEQ ID NO: 60892 - protein, 19 aa, Homo sapiens
  heavy chain complementarity determining region 3 for antibody 30446
ARSAPSLGLAPAGTRMFDF

SEQ ID NO: 60893 - protein, 9 aa, Homo sapiens
  light chain complementarity determining region 3 for antibody 30447
QQNNSYSNT

SEQ ID NO: 60894 - protein, 20 aa, Homo sapiens
  heavy chain complementarity determining region 3 for antibody 30447
ARESADSGSYTGSLGYYFDN

SEQ ID NO: 60895 - protein, 9 aa, Homo sapiens
  light chain complementarity determining region 3 for antibody 30448
QQNNSYPLT

SEQ ID NO: 60896 - protein, 12 aa, Homo sapiens
  heavy chain complementarity determining region 3 for antibody 30448
AKLVNSWYPYDY

SEQ ID NO: 60897 - protein, 9 aa, Homo sapiens
  light chain complementarity determining region 3 for antibody 30449
QQNNSYPLT

SEQ ID NO: 60898 - protein, 10 aa, Homo sapiens
  heavy chain complementarity determining region 3 for antibody 30449
AKDKIGYFDF

SEQ ID NO: 60899 - protein, 8 aa, Homo sapiens
  light chain complementarity determining region 3 for antibody 30450
QQNNSPWT

SEQ ID NO: 60900 - protein, 17 aa, Homo sapiens
  heavy chain complementarity determining region 3 for antibody 30450
AREKMWELRPGPDAFDI

SEQ ID NO: 60901 - protein, 9 aa, Homo sapiens
  light chain complementarity determining region 3 for antibody 30451
QQNNSFPLT

SEQ ID NO: 60902 - protein, 10 aa, Homo sapiens
  heavy chain complementarity determining region 3 for antibody 30451
SRYSDRSAPD

SEQ ID NO: 60903 - protein, 9 aa, Homo sapiens
  light chain complementarity determining region 3 for antibody 30452
QQNNNILRT

SEQ ID NO: 60904 - protein, 10 aa, Homo sapiens
  heavy chain complementarity determining region 3 for antibody 30452
ATSVGFGFDY

SEQ ID NO: 60905 - protein, 9 aa, Homo sapiens
  light chain complementarity determining region 3 for antibody 30453
QQNNDRPWT

SEQ ID NO: 60906 - protein, 18 aa, Homo sapiens
  heavy chain complementarity determining region 3 for antibody 30453
ARGSSSFSDSVGYYFFDR

SEQ ID NO: 60907 - protein, 9 aa, Homo sapiens
  light chain complementarity determining region 3 for antibody 30454
QQNLNLPPT

SEQ ID NO: 60908 - protein, 16 aa, Homo sapiens
  heavy chain complementarity determining region 3 for antibody 30454
ASSAAAEGTASAMFDF

SEQ ID NO: 60909 - protein, 9 aa, Homo sapiens
  light chain complementarity determining region 3 for antibody 30455
QQNKSYSYT

SEQ ID NO: 60910 - protein, 13 aa, Homo sapiens
  heavy chain complementarity determining region 3 for antibody 30455
ARARDSYNLYFDY

SEQ ID NO: 60911 - protein, 9 aa, Homo sapiens
  light chain complementarity determining region 3 for antibody 30456
QQNKSYPWT

SEQ ID NO: 60912 - protein, 13 aa, Homo sapiens
  heavy chain complementarity determining region 3 for antibody 30456
AREGTGNLGGFDS

SEQ ID NO: 60913 - protein, 8 aa, Homo sapiens
  light chain complementarity determining region 3 for antibody 30457
QQNIYWQT

SEQ ID NO: 60914 - protein, 13 aa, Homo sapiens
  heavy chain complementarity determining region 3 for antibody 30457
ARKGGGDFYYLPY

SEQ ID NO: 60915 - protein, 9 aa, Homo sapiens
  light chain complementarity determining region 3 for antibody 30458
QQNHSSSPT

SEQ ID NO: 60916 - protein, 11 aa, Homo sapiens
  heavy chain complementarity determining region 3 for antibody 30458
AKKGPGSSFDF

SEQ ID NO: 60917 - protein, 9 aa, Homo sapiens
  light chain complementarity determining region 3 for antibody 30459
QQNHDLPWT

SEQ ID NO: 60918 - protein, 18 aa, Homo sapiens
  heavy chain complementarity determining region 3 for antibody 30459
ARGSSSFSDSVGYYFFDR

SEQ ID NO: 60919 - protein, 9 aa, Homo sapiens
  light chain complementarity determining region 3 for antibody 30460
QQNHALPLT

SEQ ID NO: 60920 - protein, 13 aa, Homo sapiens
  heavy chain complementarity determining region 3 for antibody 30460
ARDGVPGKFNRAH

SEQ ID NO: 60921 - protein, 9 aa, Homo sapiens
  light chain complementarity determining region 3 for antibody 30461
QQNGTYPWT

SEQ ID NO: 60922 - protein, 11 aa, Homo sapiens
  heavy chain complementarity determining region 3 for antibody 30461
THRLVWEGVGH

SEQ ID NO: 60923 - protein, 9 aa, Homo sapiens
  light chain complementarity determining region 3 for antibody 30462
QQNGTSWYT

SEQ ID NO: 60924 - protein, 12 aa, Homo sapiens
  heavy chain complementarity determining region 3 for antibody 30462
ARESEDDDAFDI

SEQ ID NO: 60925 - protein, 9 aa, Homo sapiens
  light chain complementarity determining region 3 for antibody 30463
QQNGSTPST

SEQ ID NO: 60926 - protein, 14 aa, Homo sapiens
  heavy chain complementarity determining region 3 for antibody 30463
AREWVSTIRGWFDP

SEQ ID NO: 60927 - protein, 9 aa, Homo sapiens
  light chain complementarity determining region 3 for antibody 30464
QQNGSSWYT

SEQ ID NO: 60928 - protein, 12 aa, Homo sapiens
  heavy chain complementarity determining region 3 for antibody 30464
ARESEDDDAFDI

SEQ ID NO: 60929 - protein, 9 aa, Homo sapiens
  light chain complementarity determining region 3 for antibody 30465
QQNGSSWWT

SEQ ID NO: 60930 - protein, 15 aa, Homo sapiens
  heavy chain complementarity determining region 3 for antibody 30465
ARHVARDDIGYYHDL

SEQ ID NO: 60931 - protein, 9 aa, Homo sapiens
  light chain complementarity determining region 3 for antibody 30466
QQNGSSWVT

SEQ ID NO: 60932 - protein, 20 aa, Homo sapiens
  heavy chain complementarity determining region 3 for antibody 30466
AREGGHRQWLEIYDPGYFHH

SEQ ID NO: 60933 - protein, 9 aa, Homo sapiens
  light chain complementarity determining region 3 for antibody 30467
QQNGSSSST

SEQ ID NO: 60934 - protein, 15 aa, Homo sapiens
  heavy chain complementarity determining region 3 for antibody 30467
ARRISPYNNAWYLDY

SEQ ID NO: 60935 - protein, 9 aa, Homo sapiens
  light chain complementarity determining region 3 for antibody 30468
QQNGSSPYT

SEQ ID NO: 60936 - protein, 16 aa, Homo sapiens
  heavy chain complementarity determining region 3 for antibody 30468
ATPGQHNSGWDYRFDY

SEQ ID NO: 60937 - protein, 9 aa, Homo sapiens
  light chain complementarity determining region 3 for antibody 30469
QQNGSSPWT

SEQ ID NO: 60938 - protein, 15 aa, Homo sapiens
  heavy chain complementarity determining region 3 for antibody 30469
ARDLWELGAHSPGAH

SEQ ID NO: 60939 - protein, 9 aa, Homo sapiens
  light chain complementarity determining region 3 for antibody 30470
QQNGSSPRT

SEQ ID NO: 60940 - protein, 14 aa, Homo sapiens
  heavy chain complementarity determining region 3 for antibody 30470
ATGFFDSSRYYLEY

SEQ ID NO: 60941 - protein, 9 aa, Homo sapiens
  light chain complementarity determining region 3 for antibody 30471
QQNGSSPRT

SEQ ID NO: 60942 - protein, 15 aa, Homo sapiens
  heavy chain complementarity determining region 3 for antibody 30471
ARANGVIITTGVLRY

SEQ ID NO: 60943 - protein, 9 aa, Homo sapiens
  light chain complementarity determining region 3 for antibody 30472
QQNGSSPRT

SEQ ID NO: 60944 - protein, 15 aa, Homo sapiens
  heavy chain complementarity determining region 3 for antibody 30472
AKDGPYCGSDCYFEF

SEQ ID NO: 60945 - protein, 9 aa, Homo sapiens
  light chain complementarity determining region 3 for antibody 30473
QQNGSSPQT

SEQ ID NO: 60946 - protein, 11 aa, Homo sapiens
  heavy chain complementarity determining region 3 for antibody 30473
AKDNSNYLFDY

SEQ ID NO: 60947 - protein, 10 aa, Homo sapiens
  light chain complementarity determining region 3 for antibody 30474
QQNGSSPPYT

SEQ ID NO: 60948 - protein, 14 aa, Homo sapiens
  heavy chain complementarity determining region 3 for antibody 30474
ARHEHDGSGSVIDY

SEQ ID NO: 60949 - protein, 9 aa, Homo sapiens
  light chain complementarity determining region 3 for antibody 30475
QQNGSSPPT

SEQ ID NO: 60950 - protein, 12 aa, Homo sapiens
  heavy chain complementarity determining region 3 for antibody 30475
VVGYSSGWYEVD

SEQ ID NO: 60951 - protein, 9 aa, Homo sapiens
  light chain complementarity determining region 3 for antibody 30476
QQNGSSPLT

SEQ ID NO: 60952 - protein, 19 aa, Homo sapiens
  heavy chain complementarity determining region 3 for antibody 30476
ARGSSSSRRRAAVVGYFDL

SEQ ID NO: 60953 - protein, 9 aa, Homo sapiens
  light chain complementarity determining region 3 for antibody 30477
QQNGSSPGT

SEQ ID NO: 60954 - protein, 16 aa, Homo sapiens
  heavy chain complementarity determining region 3 for antibody 30477
ARAVWGASWSVGWFDS

SEQ ID NO: 60955 - protein, 9 aa, Homo sapiens
  light chain complementarity determining region 3 for antibody 30478
QQNGSSPGT

SEQ ID NO: 60956 - protein, 15 aa, Homo sapiens
  heavy chain complementarity determining region 3 for antibody 30478
ARANIKLRLRSPLDY

SEQ ID NO: 60957 - protein, 9 aa, Homo sapiens
  light chain complementarity determining region 3 for antibody 30479
QQNGSSPFT

SEQ ID NO: 60958 - protein, 23 aa, Homo sapiens
  heavy chain complementarity determining region 3 for antibody 30479
ARGLRSSDWSKIMDMDSYYALDV

SEQ ID NO: 60959 - protein, 9 aa, Homo sapiens
  light chain complementarity determining region 3 for antibody 30480
QQNGSLPRT

SEQ ID NO: 60960 - protein, 14 aa, Homo sapiens
  heavy chain complementarity determining region 3 for antibody 30480
AGGKFCGGDCYREY

SEQ ID NO: 60961 - protein, 9 aa, Homo sapiens
  light chain complementarity determining region 3 for antibody 30481
QQNGSLPPT

SEQ ID NO: 60962 - protein, 15 aa, Homo sapiens
  heavy chain complementarity determining region 3 for antibody 30481
AHRPNYYDKAGAFDI

SEQ ID NO: 60963 - protein, 9 aa, Homo sapiens
  light chain complementarity determining region 3 for antibody 30482
QQNGRSPYT

SEQ ID NO: 60964 - protein, 21 aa, Homo sapiens
  heavy chain complementarity determining region 3 for antibody 30482
ARVYGGYSSGWSDEYLYYFDY

SEQ ID NO: 60965 - protein, 9 aa, Homo sapiens
  light chain complementarity determining region 3 for antibody 30483
QQNGRSPWT

SEQ ID NO: 60966 - protein, 18 aa, Homo sapiens
  heavy chain complementarity determining region 3 for antibody 30483
ATMPSLAEPGRIYWYFDL

SEQ ID NO: 60967 - protein, 9 aa, Homo sapiens
  light chain complementarity determining region 3 for antibody 30484
QQNGRSLYT

SEQ ID NO: 60968 - protein, 15 aa, Homo sapiens
  heavy chain complementarity determining region 3 for antibody 30484
ARLPEYSSSWYYFDF

SEQ ID NO: 60969 - protein, 9 aa, Homo sapiens
  light chain complementarity determining region 3 for antibody 30485
QQNGRLPLT

SEQ ID NO: 60970 - protein, 15 aa, Homo sapiens
  heavy chain complementarity determining region 3 for antibody 30485
AHRPNYYDKAGAFDI

SEQ ID NO: 60971 - protein, 9 aa, Homo sapiens
  light chain complementarity determining region 3 for antibody 30486
QQNGNSPWA

SEQ ID NO: 60972 - protein, 11 aa, Homo sapiens
  heavy chain complementarity determining region 3 for antibody 30486
ARKGLYAPLDV

SEQ ID NO: 60973 - protein, 9 aa, Homo sapiens
  light chain complementarity determining region 3 for antibody 30487
QQNGNLPRT

SEQ ID NO: 60974 - protein, 13 aa, Homo sapiens
  heavy chain complementarity determining region 3 for antibody 30487
AGGNYETGRYEEY

SEQ ID NO: 60975 - protein, 11 aa, Homo sapiens
  light chain complementarity determining region 3 for antibody 30488
QQNGISPPHWA

SEQ ID NO: 60976 - protein, 12 aa, Homo sapiens
  heavy chain complementarity determining region 3 for antibody 30488
VKEKGGVRVFDF

SEQ ID NO: 60977 - protein, 9 aa, Homo sapiens
  light chain complementarity determining region 3 for antibody 30489
QQNGGSPST

SEQ ID NO: 60978 - protein, 11 aa, Homo sapiens
  heavy chain complementarity determining region 3 for antibody 30489
ARKPTGMAFDC

SEQ ID NO: 60979 - protein, 10 aa, Homo sapiens
  light chain complementarity determining region 3 for antibody 30490
QQNGGSPGGT

SEQ ID NO: 60980 - protein, 14 aa, Homo sapiens
  heavy chain complementarity determining region 3 for antibody 30490
ARHGGWRLLEPLDY

SEQ ID NO: 60981 - protein, 9 aa, Homo sapiens
  light chain complementarity determining region 3 for antibody 30491
QQNGGSGYT

SEQ ID NO: 60982 - protein, 17 aa, Homo sapiens
  heavy chain complementarity determining region 3 for antibody 30491
ARPAVTEFRGINDALDI

SEQ ID NO: 60983 - protein, 6 aa, Homo sapiens
  light chain complementarity determining region 3 for antibody 30492
QQNGET

SEQ ID NO: 60984 - protein, 12 aa, Homo sapiens
  heavy chain complementarity determining region 3 for antibody 30492
ARDHSSGWSLSN

SEQ ID NO: 60985 - protein, 10 aa, Homo sapiens
  light chain complementarity determining region 3 for antibody 30493
QQNGDSPEVT

SEQ ID NO: 60986 - protein, 16 aa, Homo sapiens
  heavy chain complementarity determining region 3 for antibody 30493
ARDATFWFGEFTFFDH

SEQ ID NO: 60987 - protein, 10 aa, Homo sapiens
  light chain complementarity determining region 3 for antibody 30494
QQNGDSPDVT

SEQ ID NO: 60988 - protein, 16 aa, Homo sapiens
  heavy chain complementarity determining region 3 for antibody 30494
ARDATFWFGEFTFFDH

SEQ ID NO: 60989 - protein, 9 aa, Homo sapiens
  light chain complementarity determining region 3 for antibody 30495
QQNFSSPPT

SEQ ID NO: 60990 - protein, 16 aa, Homo sapiens
  heavy chain complementarity determining region 3 for antibody 30495
VTYRDTVTASGYGLDD

SEQ ID NO: 60991 - protein, 9 aa, Homo sapiens
  light chain complementarity determining region 3 for antibody 30496
QQNESSPWT

SEQ ID NO: 60992 - protein, 18 aa, Homo sapiens
  heavy chain complementarity determining region 3 for antibody 30496
ARQIDYGDYASYHGYCDV

SEQ ID NO: 60993 - protein, 9 aa, Homo sapiens
  light chain complementarity determining region 3 for antibody 30497
QQNDTPPWT

SEQ ID NO: 60994 - protein, 15 aa, Homo sapiens
  heavy chain complementarity determining region 3 for antibody 30497
VHTQLWFGDQCYFDF

SEQ ID NO: 60995 - protein, 9 aa, Homo sapiens
  light chain complementarity determining region 3 for antibody 30498
QQNDSLPYT

SEQ ID NO: 60996 - protein, 17 aa, Homo sapiens
  heavy chain complementarity determining region 3 for antibody 30498
ARGKSQLLSFGAKAFDL

SEQ ID NO: 60997 - protein, 9 aa, Homo sapiens
  light chain complementarity determining region 3 for antibody 30499
QQNDNLPYT

SEQ ID NO: 60998 - protein, 13 aa, Homo sapiens
  heavy chain complementarity determining region 3 for antibody 30499
ARPYFSGSYPRDY

SEQ ID NO: 60999 - protein, 10 aa, Homo sapiens
  light chain complementarity determining region 3 for antibody 30500
QQNDNLPSVT

SEQ ID NO: 61000 - protein, 19 aa, Homo sapiens
  heavy chain complementarity determining region 3 for antibody 30500
ARDRSPCTGGNCHLGWLVF

SEQ ID NO: 61001 - protein, 9 aa, Homo sapiens
  light chain complementarity determining region 3 for antibody 30501
QQNDNFPIT

SEQ ID NO: 61002 - protein, 12 aa, Homo sapiens
  heavy chain complementarity determining region 3 for antibody 30501
AKDSEQKWELHD

SEQ ID NO: 61003 - protein, 9 aa, Homo sapiens
  light chain complementarity determining region 3 for antibody 30502
QQNDISPMT

SEQ ID NO: 61004 - protein, 16 aa, Homo sapiens
  heavy chain complementarity determining region 3 for antibody 30502
AREAKDYGDYVDAFDV

SEQ ID NO: 61005 - protein, 9 aa, Homo sapiens
  light chain complementarity determining region 3 for antibody 30503
QQNDFFRET

SEQ ID NO: 61006 - protein, 16 aa, Homo sapiens
  heavy chain complementarity determining region 3 for antibody 30503
ARWGVECSGGYCYFEY

SEQ ID NO: 61007 - protein, 9 aa, Homo sapiens
  light chain complementarity determining region 3 for antibody 30504
QQNATSPPT

SEQ ID NO: 61008 - protein, 10 aa, Homo sapiens
  heavy chain complementarity determining region 3 for antibody 30504
TTGGGWLVDY

SEQ ID NO: 61009 - protein, 8 aa, Homo sapiens
  light chain complementarity determining region 3 for antibody 30505
QQNAFSLT

SEQ ID NO: 61010 - protein, 12 aa, Homo sapiens
  heavy chain complementarity determining region 3 for antibody 30505
AGEIDTTGYFDP

SEQ ID NO: 61011 - protein, 9 aa, Homo sapiens
  light chain complementarity determining region 3 for antibody 30506
QQLYSPPPT

SEQ ID NO: 61012 - protein, 17 aa, Homo sapiens
  heavy chain complementarity determining region 3 for antibody 30506
VRDFGHDYGDPFYAFDI

SEQ ID NO: 61013 - protein, 8 aa, Homo sapiens
  light chain complementarity determining region 3 for antibody 30507
QQLYSLIT

SEQ ID NO: 61014 - protein, 20 aa, Homo sapiens
  heavy chain complementarity determining region 3 for antibody 30507
ARVSGSYDSSGVGINNAFDI

SEQ ID NO: 61015 - protein, 9 aa, Homo sapiens
  light chain complementarity determining region 3 for antibody 30508
QQLSSYPLT

SEQ ID NO: 61016 - protein, 19 aa, Homo sapiens
  heavy chain complementarity determining region 3 for antibody 30508
ARHNSKDYYSSSLLPGNDH

SEQ ID NO: 61017 - protein, 9 aa, Homo sapiens
  light chain complementarity determining region 3 for antibody 30509
QQLSNYPHT

SEQ ID NO: 61018 - protein, 26 aa, Homo sapiens
  heavy chain complementarity determining region 3 for antibody 30509
ARGSRGYKDENSSLRRLQYYQSGMDV

SEQ ID NO: 61019 - protein, 9 aa, Homo sapiens
  light chain complementarity determining region 3 for antibody 30510
QQLSNYPHT

SEQ ID NO: 61020 - protein, 26 aa, Homo sapiens
  heavy chain complementarity determining region 3 for antibody 30510
ARGSRGYKDENSSLRRLQYYQHGMDV

SEQ ID NO: 61021 - protein, 9 aa, Homo sapiens
  light chain complementarity determining region 3 for antibody 30511
QQLSNYPHT

SEQ ID NO: 61022 - protein, 26 aa, Homo sapiens
  heavy chain complementarity determining region 3 for antibody 30511
ARGPRGYKDENSSLRRLQYYQYGMDV

SEQ ID NO: 61023 - protein, 9 aa, Homo sapiens
  light chain complementarity determining region 3 for antibody 30512
QQLSNWLYT

SEQ ID NO: 61024 - protein, 11 aa, Homo sapiens
  heavy chain complementarity determining region 3 for antibody 30512
ARESLGHSFDI

SEQ ID NO: 61025 - protein, 9 aa, Homo sapiens
  light chain complementarity determining region 3 for antibody 30513
QQLSNCPHT

SEQ ID NO: 61026 - protein, 26 aa, Homo sapiens
  heavy chain complementarity determining region 3 for antibody 30513
ARGSRGYKDENSSLRRLQYYQYGMDV

SEQ ID NO: 61027 - protein, 9 aa, Homo sapiens
  light chain complementarity determining region 3 for antibody 30514
QQLNTYPLT

SEQ ID NO: 61028 - protein, 19 aa, Homo sapiens
  heavy chain complementarity determining region 3 for antibody 30514
ASGYCSAGTCYHYIPPGGY

SEQ ID NO: 61029 - protein, 9 aa, Homo sapiens
  light chain complementarity determining region 3 for antibody 30515
QQLNTYPIT

SEQ ID NO: 61030 - protein, 19 aa, Homo sapiens
  heavy chain complementarity determining region 3 for antibody 30515
TRDVIRKCGSACYFWYFDL

SEQ ID NO: 61031 - protein, 9 aa, Homo sapiens
  light chain complementarity determining region 3 for antibody 30516
QQLNTYPIT

SEQ ID NO: 61032 - protein, 19 aa, Homo sapiens
  heavy chain complementarity determining region 3 for antibody 30516
ARDVIRNCGSDCYLWYFDL

SEQ ID NO: 61033 - protein, 9 aa, Homo sapiens
  light chain complementarity determining region 3 for antibody 30517
QQLNTYPIT

SEQ ID NO: 61034 - protein, 19 aa, Homo sapiens
  heavy chain complementarity determining region 3 for antibody 30517
ARDVIRDCGSDCYFWYFDL

SEQ ID NO: 61035 - protein, 9 aa, Homo sapiens
  light chain complementarity determining region 3 for antibody 30518
QQLNTYPIP

SEQ ID NO: 61036 - protein, 19 aa, Homo sapiens
  heavy chain complementarity determining region 3 for antibody 30518
ARDVIRNCGSDCYFWYFDL

SEQ ID NO: 61037 - protein, 9 aa, Homo sapiens
  light chain complementarity determining region 3 for antibody 30519
QQLNTYPIN

SEQ ID NO: 61038 - protein, 19 aa, Homo sapiens
  heavy chain complementarity determining region 3 for antibody 30519
ARDVIRNCGSDCYFWYFDL

SEQ ID NO: 61039 - protein, 9 aa, Homo sapiens
  light chain complementarity determining region 3 for antibody 30520
QQLNTYPFT

SEQ ID NO: 61040 - protein, 19 aa, Homo sapiens
  heavy chain complementarity determining region 3 for antibody 30520
ARDVIRNCGSDCYFWYFDL

SEQ ID NO: 61041 - protein, 9 aa, Homo sapiens
  light chain complementarity determining region 3 for antibody 30521
QQLNSYPYT

SEQ ID NO: 61042 - protein, 12 aa, Homo sapiens
  heavy chain complementarity determining region 3 for antibody 30521
AIWGGAKGSLPY

SEQ ID NO: 61043 - protein, 9 aa, Homo sapiens
  light chain complementarity determining region 3 for antibody 30522
QQLNSYPYT

SEQ ID NO: 61044 - protein, 12 aa, Homo sapiens
  heavy chain complementarity determining region 3 for antibody 30522
AIWGGAKGRLPY

SEQ ID NO: 61045 - protein, 9 aa, Homo sapiens
  light chain complementarity determining region 3 for antibody 30523
QQLNSYPYT

SEQ ID NO: 61046 - protein, 12 aa, Homo sapiens
  heavy chain complementarity determining region 3 for antibody 30523
AIWGGAKGGLRY

SEQ ID NO: 61047 - protein, 9 aa, Homo sapiens
  light chain complementarity determining region 3 for antibody 30524
QQLNSYPYT

SEQ ID NO: 61048 - protein, 12 aa, Homo sapiens
  heavy chain complementarity determining region 3 for antibody 30524
AIWGGAKGDLPY

SEQ ID NO: 61049 - protein, 9 aa, Homo sapiens
  light chain complementarity determining region 3 for antibody 30525
QQLNSYPYT

SEQ ID NO: 61050 - protein, 12 aa, Homo sapiens
  heavy chain complementarity determining region 3 for antibody 30525
AIWAGAKGCLPY

SEQ ID NO: 61051 - protein, 9 aa, Homo sapiens
  light chain complementarity determining region 3 for antibody 30526
QQLNSYPYN

SEQ ID NO: 61052 - protein, 12 aa, Homo sapiens
  heavy chain complementarity determining region 3 for antibody 30526
AIWAGAKGGLPY

SEQ ID NO: 61053 - protein, 9 aa, Homo sapiens
  light chain complementarity determining region 3 for antibody 30527
QQLNSYPRP

SEQ ID NO: 61054 - protein, 17 aa, Homo sapiens
  heavy chain complementarity determining region 3 for antibody 30527
AKSPAVYTWGHLSLFDS

SEQ ID NO: 61055 - protein, 10 aa, Homo sapiens
  light chain complementarity determining region 3 for antibody 30528
QQLNSYPRLT

SEQ ID NO: 61056 - protein, 13 aa, Homo sapiens
  heavy chain complementarity determining region 3 for antibody 30528
TRAFSMMIVVPGY

SEQ ID NO: 61057 - protein, 9 aa, Homo sapiens
  light chain complementarity determining region 3 for antibody 30529
QQLNSYPPT

SEQ ID NO: 61058 - protein, 17 aa, Homo sapiens
  heavy chain complementarity determining region 3 for antibody 30529
ARGPPIAVAGTSRKFDY

SEQ ID NO: 61059 - protein, 9 aa, Homo sapiens
  light chain complementarity determining region 3 for antibody 30530
QQLNSYPPT

SEQ ID NO: 61060 - protein, 14 aa, Homo sapiens
  heavy chain complementarity determining region 3 for antibody 30530
ARENSVPAARAYDY

SEQ ID NO: 61061 - protein, 9 aa, Homo sapiens
  light chain complementarity determining region 3 for antibody 30531
QQLNSYPPT

SEQ ID NO: 61062 - protein, 15 aa, Homo sapiens
  heavy chain complementarity determining region 3 for antibody 30531
AREFYGSGSYYLIDY

SEQ ID NO: 61063 - protein, 9 aa, Homo sapiens
  light chain complementarity determining region 3 for antibody 30532
QQLNSYPNT

SEQ ID NO: 61064 - protein, 12 aa, Homo sapiens
  heavy chain complementarity determining region 3 for antibody 30532
ARTSLSHDYGYY

SEQ ID NO: 61065 - protein, 9 aa, Homo sapiens
  light chain complementarity determining region 3 for antibody 30533
QQLNSYPLT

SEQ ID NO: 61066 - protein, 13 aa, Homo sapiens
  heavy chain complementarity determining region 3 for antibody 30533
VPVMEVTLGAFAF

SEQ ID NO: 61067 - protein, 9 aa, Homo sapiens
  light chain complementarity determining region 3 for antibody 30534
QQLNSYPLT

SEQ ID NO: 61068 - protein, 15 aa, Homo sapiens
  heavy chain complementarity determining region 3 for antibody 30534
ARECYGSGSYYLIDY

SEQ ID NO: 61069 - protein, 9 aa, Homo sapiens
  light chain complementarity determining region 3 for antibody 30535
QQLNSYPLT

SEQ ID NO: 61070 - protein, 25 aa, Homo sapiens
  heavy chain complementarity determining region 3 for antibody 30535
ARDPEGGYYYDSSGYYGNYYYGMDV

SEQ ID NO: 61071 - protein, 9 aa, Homo sapiens
  light chain complementarity determining region 3 for antibody 30536
QQLNSYPLT

SEQ ID NO: 61072 - protein, 26 aa, Homo sapiens
  heavy chain complementarity determining region 3 for antibody 30536
ARDPEGGYYYDSSGYYGNYCYYGMDV

SEQ ID NO: 61073 - protein, 9 aa, Homo sapiens
  light chain complementarity determining region 3 for antibody 30537
QQLNSYPLP

SEQ ID NO: 61074 - protein, 15 aa, Homo sapiens
  heavy chain complementarity determining region 3 for antibody 30537
AREFYGSGSYYLIDY

SEQ ID NO: 61075 - protein, 9 aa, Homo sapiens
  light chain complementarity determining region 3 for antibody 30538
QQLNSYPIN

SEQ ID NO: 61076 - protein, 22 aa, Homo sapiens
  heavy chain complementarity determining region 3 for antibody 30538
AREPHSSSSQTQHYYYYYGMDV

SEQ ID NO: 61077 - protein, 9 aa, Homo sapiens
  light chain complementarity determining region 3 for antibody 30539
QQLNSYPHT

SEQ ID NO: 61078 - protein, 12 aa, Homo sapiens
  heavy chain complementarity determining region 3 for antibody 30539
ARASLSHDYGYY

SEQ ID NO: 61079 - protein, 9 aa, Homo sapiens
  light chain complementarity determining region 3 for antibody 30540
QQLNSYPHP

SEQ ID NO: 61080 - protein, 17 aa, Homo sapiens
  heavy chain complementarity determining region 3 for antibody 30540
ARGPPIAVAGTSRKFDY

SEQ ID NO: 61081 - protein, 9 aa, Homo sapiens
  light chain complementarity determining region 3 for antibody 30541
QQLNSYPDT

SEQ ID NO: 61082 - protein, 16 aa, Homo sapiens
  heavy chain complementarity determining region 3 for antibody 30541
ARDLAIVMVTVYGMDV

SEQ ID NO: 61083 - protein, 9 aa, Homo sapiens
  light chain complementarity determining region 3 for antibody 30542
QQLNSYPCT

SEQ ID NO: 61084 - protein, 12 aa, Homo sapiens
  heavy chain complementarity determining region 3 for antibody 30542
AIWAGAKGGLPY

SEQ ID NO: 61085 - protein, 9 aa, Homo sapiens
  light chain complementarity determining region 3 for antibody 30543
QQLNSSPST

SEQ ID NO: 61086 - protein, 13 aa, Homo sapiens
  heavy chain complementarity determining region 3 for antibody 30543
ARDGYSYGYESDY

SEQ ID NO: 61087 - protein, 9 aa, Homo sapiens
  light chain complementarity determining region 3 for antibody 30544
QQLNSSPQD

SEQ ID NO: 61088 - protein, 16 aa, Homo sapiens
  heavy chain complementarity determining region 3 for antibody 30544
ARIKRSLVGAQDAFDI

SEQ ID NO: 61089 - protein, 9 aa, Homo sapiens
  light chain complementarity determining region 3 for antibody 30545
QQLNSNPLT

SEQ ID NO: 61090 - protein, 15 aa, Homo sapiens
  heavy chain complementarity determining region 3 for antibody 30545
AREFYGSGSYYLIDY

SEQ ID NO: 61091 - protein, 6 aa, Homo sapiens
  light chain complementarity determining region 3 for antibody 30546
QQLNSL

SEQ ID NO: 61092 - protein, 9 aa, Homo sapiens
  heavy chain complementarity determining region 3 for antibody 30546
DVDGGDRVY

SEQ ID NO: 61093 - protein, 6 aa, Homo sapiens
  light chain complementarity determining region 3 for antibody 30547
QQLNSI

SEQ ID NO: 61094 - protein, 9 aa, Homo sapiens
  heavy chain complementarity determining region 3 for antibody 30547
DADGGDRVY

SEQ ID NO: 61095 - protein, 10 aa, Homo sapiens
  light chain complementarity determining region 3 for antibody 30548
QQLNRAFLFT

SEQ ID NO: 61096 - protein, 17 aa, Homo sapiens
  heavy chain complementarity determining region 3 for antibody 30548
ARDKLRFLEGIPYGLDV

SEQ ID NO: 61097 - protein, 12 aa, Homo sapiens
  light chain complementarity determining region 3 for antibody 30549
QQLNNYSPFRVS

SEQ ID NO: 61098 - protein, 15 aa, Homo sapiens
  heavy chain complementarity determining region 3 for antibody 30549
AGGITLGRGSWSFDY

SEQ ID NO: 61099 - protein, 12 aa, Homo sapiens
  light chain complementarity determining region 3 for antibody 30550
QQLNNYSPFRFS

SEQ ID NO: 61100 - protein, 15 aa, Homo sapiens
  heavy chain complementarity determining region 3 for antibody 30550
ARGITLGRGSWSFDY

SEQ ID NO: 61101 - protein, 12 aa, Homo sapiens
  light chain complementarity determining region 3 for antibody 30551
QQLNNYSPFRAS

SEQ ID NO: 61102 - protein, 15 aa, Homo sapiens
  heavy chain complementarity determining region 3 for antibody 30551
ARGITLGRGSWSFDY

SEQ ID NO: 61103 - protein, 9 aa, Homo sapiens
  light chain complementarity determining region 3 for antibody 30552
QQLNGTSPT

SEQ ID NO: 61104 - protein, 17 aa, Homo sapiens
  heavy chain complementarity determining region 3 for antibody 30552
ARVVLSTSGWDMIGFDI

SEQ ID NO: 61105 - protein, 9 aa, Homo sapiens
  light chain complementarity determining region 3 for antibody 30553
QQLKFYPFP

SEQ ID NO: 61106 - protein, 10 aa, Homo sapiens
  heavy chain complementarity determining region 3 for antibody 30553
ATGAGWLVDY

SEQ ID NO: 61107 - protein, 9 aa, Homo sapiens
  light chain complementarity determining region 3 for antibody 30554
QQLKFYPFN

SEQ ID NO: 61108 - protein, 10 aa, Homo sapiens
  heavy chain complementarity determining region 3 for antibody 30554
ATGAGWLVDY

SEQ ID NO: 61109 - protein, 11 aa, Homo sapiens
  light chain complementarity determining region 3 for antibody 30555
QQLKDYPRELP

SEQ ID NO: 61110 - protein, 14 aa, Homo sapiens
  heavy chain complementarity determining region 3 for antibody 30555
ARDLFGGSPGAFDS

SEQ ID NO: 61111 - protein, 11 aa, Homo sapiens
  light chain complementarity determining region 3 for antibody 30556
QQLKDYPREFT

SEQ ID NO: 61112 - protein, 14 aa, Homo sapiens
  heavy chain complementarity determining region 3 for antibody 30556
ARDLFGGSPGAFDS

SEQ ID NO: 61113 - protein, 9 aa, Homo sapiens
  light chain complementarity determining region 3 for antibody 30557
QQLKDYPLT

SEQ ID NO: 61114 - protein, 10 aa, Homo sapiens
  heavy chain complementarity determining region 3 for antibody 30557
ARDPYGRGGY

SEQ ID NO: 61115 - protein, 9 aa, Homo sapiens
  light chain complementarity determining region 3 for antibody 30558
QQLHSYPYT

SEQ ID NO: 61116 - protein, 12 aa, Homo sapiens
  heavy chain complementarity determining region 3 for antibody 30558
AIWGGAKGGLPY

SEQ ID NO: 61117 - protein, 9 aa, Homo sapiens
  light chain complementarity determining region 3 for antibody 30559
QQLHSYPLT

SEQ ID NO: 61118 - protein, 15 aa, Homo sapiens
  heavy chain complementarity determining region 3 for antibody 30559
ARESYASGSHYLLDS

SEQ ID NO: 61119 - protein, 9 aa, Homo sapiens
  light chain complementarity determining region 3 for antibody 30560
QQLHSYPLP

SEQ ID NO: 61120 - protein, 15 aa, Homo sapiens
  heavy chain complementarity determining region 3 for antibody 30560
AREFYASGSHYLLDS

SEQ ID NO: 61121 - protein, 9 aa, Homo sapiens
  light chain complementarity determining region 3 for antibody 30561
QQLHSSPLT

SEQ ID NO: 61122 - protein, 15 aa, Homo sapiens
  heavy chain complementarity determining region 3 for antibody 30561
AREFYASGSHYLLDS

SEQ ID NO: 61123 - protein, 9 aa, Homo sapiens
  light chain complementarity determining region 3 for antibody 30562
QQLHKSPGT

SEQ ID NO: 61124 - protein, 14 aa, Homo sapiens
  heavy chain complementarity determining region 3 for antibody 30562
ARAAPEYEWLVPDY

SEQ ID NO: 61125 - protein, 9 aa, Homo sapiens
  light chain complementarity determining region 3 for antibody 30563
QQLHKPPWT

SEQ ID NO: 61126 - protein, 14 aa, Homo sapiens
  heavy chain complementarity determining region 3 for antibody 30563
ARAAPEYEWLVPDY

SEQ ID NO: 61127 - protein, 9 aa, Homo sapiens
  light chain complementarity determining region 3 for antibody 30564
QQLHGNSPT

SEQ ID NO: 61128 - protein, 17 aa, Homo sapiens
  heavy chain complementarity determining region 3 for antibody 30564
ARVVLSTSGWDMIGFDI

SEQ ID NO: 61129 - protein, 11 aa, Homo sapiens
  light chain complementarity determining region 3 for antibody 30565
QQLGTSGSRYT

SEQ ID NO: 61130 - protein, 14 aa, Homo sapiens
  heavy chain complementarity determining region 3 for antibody 30565
ARHTSMAGLRGFDQ

SEQ ID NO: 61131 - protein, 9 aa, Homo sapiens
  light chain complementarity determining region 3 for antibody 30566
QQLDDSGYT

SEQ ID NO: 61132 - protein, 13 aa, Homo sapiens
  heavy chain complementarity determining region 3 for antibody 30566
VRERHPGAFYFDF

SEQ ID NO: 61133 - protein, 9 aa, Homo sapiens
  light chain complementarity determining region 3 for antibody 30567
QQIGSLPFT

SEQ ID NO: 61134 - protein, 11 aa, Homo sapiens
  heavy chain complementarity determining region 3 for antibody 30567
ARAPTNFGVDY

SEQ ID NO: 61135 - protein, 9 aa, Homo sapiens
  light chain complementarity determining region 3 for antibody 30568
QQHYTYPYT

SEQ ID NO: 61136 - protein, 15 aa, Homo sapiens
  heavy chain complementarity determining region 3 for antibody 30568
ARGQGSGTYNPYFAF

SEQ ID NO: 61137 - protein, 10 aa, Homo sapiens
  light chain complementarity determining region 3 for antibody 30569
QQHYNYPPYT

SEQ ID NO: 61138 - protein, 16 aa, Homo sapiens
  heavy chain complementarity determining region 3 for antibody 30569
ARDTAYDYVWGSPIDY

SEQ ID NO: 61139 - protein, 10 aa, Homo sapiens
  light chain complementarity determining region 3 for antibody 30570
QQHYHTPPYT

SEQ ID NO: 61140 - protein, 16 aa, Homo sapiens
  heavy chain complementarity determining region 3 for antibody 30570
ARGRRSGKDPPASFDI

SEQ ID NO: 61141 - protein, 8 aa, Homo sapiens
  light chain complementarity determining region 3 for antibody 30571
QQHWNSGA

SEQ ID NO: 61142 - protein, 14 aa, Homo sapiens
  heavy chain complementarity determining region 3 for antibody 30571
ATGIPAAFRYYFEY

SEQ ID NO: 61143 - protein, 9 aa, Homo sapiens
  light chain complementarity determining region 3 for antibody 30572
QQHVTYPIT

SEQ ID NO: 61144 - protein, 13 aa, Homo sapiens
  heavy chain complementarity determining region 3 for antibody 30572
GRGGYTSSWYWVY

SEQ ID NO: 61145 - protein, 9 aa, Homo sapiens
  light chain complementarity determining region 3 for antibody 30573
QQHSRYPRT

SEQ ID NO: 61146 - protein, 10 aa, Homo sapiens
  heavy chain complementarity determining region 3 for antibody 30573
ARDYGGNSVY

SEQ ID NO: 61147 - protein, 9 aa, Homo sapiens
  light chain complementarity determining region 3 for antibody 30574
QQHSNWLWT

SEQ ID NO: 61148 - protein, 20 aa, Homo sapiens
  heavy chain complementarity determining region 3 for antibody 30574
VYRRGYEYVGASYRYAMSDY

SEQ ID NO: 61149 - protein, 9 aa, Homo sapiens
  light chain complementarity determining region 3 for antibody 30575
QQHSNWFWT

SEQ ID NO: 61150 - protein, 20 aa, Homo sapiens
  heavy chain complementarity determining region 3 for antibody 30575
VYRRGYEYVGASYRYTMSDY

SEQ ID NO: 61151 - protein, 8 aa, Homo sapiens
  light chain complementarity determining region 3 for antibody 30576
QQHSNPFT

SEQ ID NO: 61152 - protein, 15 aa, Homo sapiens
  heavy chain complementarity determining region 3 for antibody 30576
ARAWGAATTSYICDN

SEQ ID NO: 61153 - protein, 9 aa, Homo sapiens
  light chain complementarity determining region 3 for antibody 30577
QQHSNFPFT

SEQ ID NO: 61154 - protein, 30 aa, Homo sapiens
  heavy chain complementarity determining region 3 for antibody 30577
ARDQISLPPDVGQCSAYGCYSDTYFYGLDV

SEQ ID NO: 61155 - protein, 9 aa, Homo sapiens
  light chain complementarity determining region 3 for antibody 30578
QQHSDVPLT

SEQ ID NO: 61156 - protein, 9 aa, Homo sapiens
  heavy chain complementarity determining region 3 for antibody 30578
VCLGVTPPV

SEQ ID NO: 61157 - protein, 9 aa, Homo sapiens
  light chain complementarity determining region 3 for antibody 30579
QQHRSYPRT

SEQ ID NO: 61158 - protein, 10 aa, Homo sapiens
  heavy chain complementarity determining region 3 for antibody 30579
ARGSGNYPDN

SEQ ID NO: 61159 - protein, 8 aa, Homo sapiens
  light chain complementarity determining region 3 for antibody 30580
QQHRNPST

SEQ ID NO: 61160 - protein, 15 aa, Homo sapiens
  heavy chain complementarity determining region 3 for antibody 30580
ARAWGAATTSYICDN

SEQ ID NO: 61161 - protein, 8 aa, Homo sapiens
  light chain complementarity determining region 3 for antibody 30581
QQHRNPFT

SEQ ID NO: 61162 - protein, 15 aa, Homo sapiens
  heavy chain complementarity determining region 3 for antibody 30581
ARAWGAAPTSYICDN

SEQ ID NO: 61163 - protein, 8 aa, Homo sapiens
  light chain complementarity determining region 3 for antibody 30582
QQHRNPFP

SEQ ID NO: 61164 - protein, 15 aa, Homo sapiens
  heavy chain complementarity determining region 3 for antibody 30582
ARAWGAATTSYICDN

SEQ ID NO: 61165 - protein, 9 aa, Homo sapiens
  light chain complementarity determining region 3 for antibody 30583
QQHQTYPYT

SEQ ID NO: 61166 - protein, 13 aa, Homo sapiens
  heavy chain complementarity determining region 3 for antibody 30583
AHIAYGGYAYFDH

SEQ ID NO: 61167 - protein, 8 aa, Homo sapiens
  light chain complementarity determining region 3 for antibody 30584
QQHNTYWT

SEQ ID NO: 61168 - protein, 14 aa, Homo sapiens
  heavy chain complementarity determining region 3 for antibody 30584
AVLGSNWQVYNFDY

SEQ ID NO: 61169 - protein, 9 aa, Homo sapiens
  light chain complementarity determining region 3 for antibody 30585
QQHNTYPYT

SEQ ID NO: 61170 - protein, 11 aa, Homo sapiens
  heavy chain complementarity determining region 3 for antibody 30585
ARVTWLVIYDS

SEQ ID NO: 61171 - protein, 9 aa, Homo sapiens
  light chain complementarity determining region 3 for antibody 30586
QQHNTWPPT

SEQ ID NO: 61172 - protein, 13 aa, Homo sapiens
  heavy chain complementarity determining region 3 for antibody 30586
ARVVSSQSGYGDS

SEQ ID NO: 61173 - protein, 9 aa, Homo sapiens
  light chain complementarity determining region 3 for antibody 30587
QQHNSYSWP

SEQ ID NO: 61174 - protein, 10 aa, Homo sapiens
  heavy chain complementarity determining region 3 for antibody 30587
ARVSVGGFDP

SEQ ID NO: 61175 - protein, 9 aa, Homo sapiens
  light chain complementarity determining region 3 for antibody 30588
QQHNSYSRT

SEQ ID NO: 61176 - protein, 20 aa, Homo sapiens
  heavy chain complementarity determining region 3 for antibody 30588
ARLHRYCRGGHCYSPGSFDI

SEQ ID NO: 61177 - protein, 7 aa, Homo sapiens
  light chain complementarity determining region 3 for antibody 30589
QQHNSYS

SEQ ID NO: 61178 - protein, 9 aa, Homo sapiens
  heavy chain complementarity determining region 3 for antibody 30589
ATHGDGFDY

SEQ ID NO: 61179 - protein, 9 aa, Homo sapiens
  light chain complementarity determining region 3 for antibody 30590
QQHNSYPWT

SEQ ID NO: 61180 - protein, 15 aa, Homo sapiens
  heavy chain complementarity determining region 3 for antibody 30590
AKAQVIWGQFYYFDS

SEQ ID NO: 61181 - protein, 9 aa, Homo sapiens
  light chain complementarity determining region 3 for antibody 30591
QQHNSYPLT

SEQ ID NO: 61182 - protein, 21 aa, Homo sapiens
  heavy chain complementarity determining region 3 for antibody 30591
TTDQVLTGYCSGGSCLEYFQH

SEQ ID NO: 61183 - protein, 9 aa, Homo sapiens
  light chain complementarity determining region 3 for antibody 30592
QQHNSYPLT

SEQ ID NO: 61184 - protein, 20 aa, Homo sapiens
  heavy chain complementarity determining region 3 for antibody 30592
AKERSHYDSNKFHPPFFFDY

SEQ ID NO: 61185 - protein, 9 aa, Homo sapiens
  light chain complementarity determining region 3 for antibody 30593
QQHNSYPLT

SEQ ID NO: 61186 - protein, 10 aa, Homo sapiens
  heavy chain complementarity determining region 3 for antibody 30593
AKDKIGYFDF

SEQ ID NO: 61187 - protein, 9 aa, Homo sapiens
  light chain complementarity determining region 3 for antibody 30594
QQHNSYPFT

SEQ ID NO: 61188 - protein, 13 aa, Homo sapiens
  heavy chain complementarity determining region 3 for antibody 30594
TRLPLRGSWHFQP

SEQ ID NO: 61189 - protein, 6 aa, Homo sapiens
  light chain complementarity determining region 3 for antibody 30595
QQHNRG

SEQ ID NO: 61190 - protein, 5 aa, Homo sapiens
  heavy chain complementarity determining region 3 for antibody 30595
VRDSL

SEQ ID NO: 61191 - protein, 9 aa, Homo sapiens
  light chain complementarity determining region 3 for antibody 30596
QQHNNWPWT

SEQ ID NO: 61192 - protein, 15 aa, Homo sapiens
  heavy chain complementarity determining region 3 for antibody 30596
ARDFSSLWELLPFDY

SEQ ID NO: 61193 - protein, 9 aa, Homo sapiens
  light chain complementarity determining region 3 for antibody 30597
QQHNNWPRT

SEQ ID NO: 61194 - protein, 20 aa, Homo sapiens
  heavy chain complementarity determining region 3 for antibody 30597
ARDFFPFPRGPDSFDDVFDL

SEQ ID NO: 61195 - protein, 9 aa, Homo sapiens
  light chain complementarity determining region 3 for antibody 30598
QQHNNWPPT

SEQ ID NO: 61196 - protein, 12 aa, Homo sapiens
  heavy chain complementarity determining region 3 for antibody 30598
ARTLVQALIWDY

SEQ ID NO: 61197 - protein, 9 aa, Homo sapiens
  light chain complementarity determining region 3 for antibody 30599
QQHNNFPWT

SEQ ID NO: 61198 - protein, 23 aa, Homo sapiens
  heavy chain complementarity determining region 3 for antibody 30599
TRGKFRFLQWVETSYSYYYDMDV

SEQ ID NO: 61199 - protein, 8 aa, Homo sapiens
  light chain complementarity determining region 3 for antibody 30600
QQHNIYPT

SEQ ID NO: 61200 - protein, 13 aa, Homo sapiens
  heavy chain complementarity determining region 3 for antibody 30600
ARSRAGFGEFFGY

SEQ ID NO: 61201 - protein, 8 aa, Homo sapiens
  light chain complementarity determining region 3 for antibody 30601
QQHIYWQT

SEQ ID NO: 61202 - protein, 13 aa, Homo sapiens
  heavy chain complementarity determining region 3 for antibody 30601
ARKGGGDFYYLPY

SEQ ID NO: 61203 - protein, 9 aa, Homo sapiens
  light chain complementarity determining region 3 for antibody 30602
QQHHSYPRT

SEQ ID NO: 61204 - protein, 19 aa, Homo sapiens
  heavy chain complementarity determining region 3 for antibody 30602
ATGGLLGILTQYDYNGMDA

SEQ ID NO: 61205 - protein, 10 aa, Homo sapiens
  light chain complementarity determining region 3 for antibody 30603
QQHHNWPPWT

SEQ ID NO: 61206 - protein, 21 aa, Homo sapiens
  heavy chain complementarity determining region 3 for antibody 30603
ARTGAEPNSWSSAPEDSWFDP

SEQ ID NO: 61207 - protein, 9 aa, Homo sapiens
  light chain complementarity determining region 3 for antibody 30604
QQHGTYPWT

SEQ ID NO: 61208 - protein, 11 aa, Homo sapiens
  heavy chain complementarity determining region 3 for antibody 30604
THRLVWEGVGH

SEQ ID NO: 61209 - protein, 9 aa, Homo sapiens
  light chain complementarity determining region 3 for antibody 30605
QQHGSSPYT

SEQ ID NO: 61210 - protein, 17 aa, Homo sapiens
  heavy chain complementarity determining region 3 for antibody 30605
ARGTGYNYGYGGVHFDY

SEQ ID NO: 61211 - protein, 9 aa, Homo sapiens
  light chain complementarity determining region 3 for antibody 30606
QQHGSSPRT

SEQ ID NO: 61212 - protein, 14 aa, Homo sapiens
  heavy chain complementarity determining region 3 for antibody 30606
ATGFFDSSRYYLEY

SEQ ID NO: 61213 - protein, 9 aa, Homo sapiens
  light chain complementarity determining region 3 for antibody 30607
QQHGSSPRT

SEQ ID NO: 61214 - protein, 15 aa, Homo sapiens
  heavy chain complementarity determining region 3 for antibody 30607
ARANGVIITTGVLRY

SEQ ID NO: 61215 - protein, 9 aa, Homo sapiens
  light chain complementarity determining region 3 for antibody 30608
QQHGSSPRT

SEQ ID NO: 61216 - protein, 19 aa, Homo sapiens
  heavy chain complementarity determining region 3 for antibody 30608
AKEGLTMFRGITIDDAFDI

SEQ ID NO: 61217 - protein, 9 aa, Homo sapiens
  light chain complementarity determining region 3 for antibody 30609
QQHGSSPRR

SEQ ID NO: 61218 - protein, 19 aa, Homo sapiens
  heavy chain complementarity determining region 3 for antibody 30609
AKERLTMFRGITIDDAFDI

SEQ ID NO: 61219 - protein, 9 aa, Homo sapiens
  light chain complementarity determining region 3 for antibody 30610
QQHGSSPRP

SEQ ID NO: 61220 - protein, 19 aa, Homo sapiens
  heavy chain complementarity determining region 3 for antibody 30610
AKERLTMFRGITIDDAFDI

SEQ ID NO: 61221 - protein, 10 aa, Homo sapiens
  light chain complementarity determining region 3 for antibody 30611
QQHGSSPMCS

SEQ ID NO: 61222 - protein, 18 aa, Homo sapiens
  heavy chain complementarity determining region 3 for antibody 30611
ARERGLLEWLPLHDAFDM

SEQ ID NO: 61223 - protein, 9 aa, Homo sapiens
  light chain complementarity determining region 3 for antibody 30612
QQHGSSPCT

SEQ ID NO: 61224 - protein, 16 aa, Homo sapiens
  heavy chain complementarity determining region 3 for antibody 30612
AREDNEPWGLRGRFDY

SEQ ID NO: 61225 - protein, 8 aa, Homo sapiens
  light chain complementarity determining region 3 for antibody 30613
QQHGSSLT

SEQ ID NO: 61226 - protein, 14 aa, Homo sapiens
  heavy chain complementarity determining region 3 for antibody 30613
TRDPVEGPPDYFDY

SEQ ID NO: 61227 - protein, 9 aa, Homo sapiens
  light chain complementarity determining region 3 for antibody 30614
QQHGSSLLT

SEQ ID NO: 61228 - protein, 25 aa, Homo sapiens
  heavy chain complementarity determining region 3 for antibody 30614
ARARQYSSSWYRPHGGNYYYYGMDV

SEQ ID NO: 61229 - protein, 8 aa, Homo sapiens
  light chain complementarity determining region 3 for antibody 30615
QQHGSFFT

SEQ ID NO: 61230 - protein, 14 aa, Homo sapiens
  heavy chain complementarity determining region 3 for antibody 30615
ARHGPGSPWSYFDN

SEQ ID NO: 61231 - protein, 9 aa, Homo sapiens
  light chain complementarity determining region 3 for antibody 30616
QQHGRSPRT

SEQ ID NO: 61232 - protein, 19 aa, Homo sapiens
  heavy chain complementarity determining region 3 for antibody 30616
AKERLTMFRGITIDDAFDI

SEQ ID NO: 61233 - protein, 9 aa, Homo sapiens
  light chain complementarity determining region 3 for antibody 30617
QQHGISPRT

SEQ ID NO: 61234 - protein, 13 aa, Homo sapiens
  heavy chain complementarity determining region 3 for antibody 30617
ARDVAGWPFVNNY

SEQ ID NO: 61235 - protein, 6 aa, Homo sapiens
  light chain complementarity determining region 3 for antibody 30618
QQHGGT

SEQ ID NO: 61236 - protein, 12 aa, Homo sapiens
  heavy chain complementarity determining region 3 for antibody 30618
AKLVNSWYPYDY

SEQ ID NO: 61237 - protein, 9 aa, Homo sapiens
  light chain complementarity determining region 3 for antibody 30619
QQHGGSTGT

SEQ ID NO: 61238 - protein, 15 aa, Homo sapiens
  heavy chain complementarity determining region 3 for antibody 30619
ARGGRGPGMAHCFDL

SEQ ID NO: 61239 - protein, 9 aa, Homo sapiens
  light chain complementarity determining region 3 for antibody 30620
QQHGGALFK

SEQ ID NO: 61240 - protein, 10 aa, Homo sapiens
  heavy chain complementarity determining region 3 for antibody 30620
TGGEGSKFDY

SEQ ID NO: 61241 - protein, 8 aa, Homo sapiens
  light chain complementarity determining region 3 for antibody 30621
QQHGDSMT

SEQ ID NO: 61242 - protein, 16 aa, Homo sapiens
  heavy chain complementarity determining region 3 for antibody 30621
ARGLSIIRGVMSPFDL

SEQ ID NO: 61243 - protein, 8 aa, Homo sapiens
  light chain complementarity determining region 3 for antibody 30622
QQHDYLPA

SEQ ID NO: 61244 - protein, 12 aa, Homo sapiens
  heavy chain complementarity determining region 3 for antibody 30622
ARSNWNIIAFDL

SEQ ID NO: 61245 - protein, 9 aa, Homo sapiens
  light chain complementarity determining region 3 for antibody 30623
QQHDNLSIT

SEQ ID NO: 61246 - protein, 15 aa, Homo sapiens
  heavy chain complementarity determining region 3 for antibody 30623
SRADDRSGYFGIIAY

SEQ ID NO: 61247 - protein, 8 aa, Homo sapiens
  light chain complementarity determining region 3 for antibody 30624
QQHDNLPT

SEQ ID NO: 61248 - protein, 14 aa, Homo sapiens
  heavy chain complementarity determining region 3 for antibody 30624
AKDWDSSGSNCFDP

SEQ ID NO: 61249 - protein, 9 aa, Homo sapiens
  light chain complementarity determining region 3 for antibody 30625
QQHDNLPLT

SEQ ID NO: 61250 - protein, 19 aa, Homo sapiens
  heavy chain complementarity determining region 3 for antibody 30625
AREAYYDSSGYFPSRYFDL

SEQ ID NO: 61251 - protein, 10 aa, Homo sapiens
  light chain complementarity determining region 3 for antibody 30626
QQHDNFPPGT

SEQ ID NO: 61252 - protein, 21 aa, Homo sapiens
  heavy chain complementarity determining region 3 for antibody 30626
AKEKGILRFLDRNFYNYPMDV

SEQ ID NO: 61253 - protein, 8 aa, Homo sapiens
  light chain complementarity determining region 3 for antibody 30627
QQHDGSST

SEQ ID NO: 61254 - protein, 15 aa, Homo sapiens
  heavy chain complementarity determining region 3 for antibody 30627
ARVPAPVVTAMYLDY

SEQ ID NO: 61255 - protein, 9 aa, Homo sapiens
  light chain complementarity determining region 3 for antibody 30628
QQHCNWLWT

SEQ ID NO: 61256 - protein, 20 aa, Homo sapiens
  heavy chain complementarity determining region 3 for antibody 30628
VYRRGYEYVGASYRYTMSDY

SEQ ID NO: 61257 - protein, 9 aa, Homo sapiens
  light chain complementarity determining region 3 for antibody 30629
QQHAYSPIT

SEQ ID NO: 61258 - protein, 10 aa, Homo sapiens
  heavy chain complementarity determining region 3 for antibody 30629
ATGAGWLVDY

SEQ ID NO: 61259 - protein, 9 aa, Homo sapiens
  light chain complementarity determining region 3 for antibody 30630
QQHATSPLT

SEQ ID NO: 61260 - protein, 10 aa, Homo sapiens
  heavy chain complementarity determining region 3 for antibody 30630
TTGGGWLVDY

SEQ ID NO: 61261 - protein, 9 aa, Homo sapiens
  light chain complementarity determining region 3 for antibody 30631
QQHAGAPRT

SEQ ID NO: 61262 - protein, 14 aa, Homo sapiens
  heavy chain complementarity determining region 3 for antibody 30631
TRDGDNFLWGNYHY

SEQ ID NO: 61263 - protein, 9 aa, Homo sapiens
  light chain complementarity determining region 3 for antibody 30632
QQGYTTPWT

SEQ ID NO: 61264 - protein, 18 aa, Homo sapiens
  heavy chain complementarity determining region 3 for antibody 30632
ARAYRFRATIITFDGLDM

SEQ ID NO: 61265 - protein, 9 aa, Homo sapiens
  light chain complementarity determining region 3 for antibody 30633
QQGYSTPST

SEQ ID NO: 61266 - protein, 14 aa, Homo sapiens
  heavy chain complementarity determining region 3 for antibody 30633
ARDPQLGKPDYFDY

SEQ ID NO: 61267 - protein, 9 aa, Homo sapiens
  light chain complementarity determining region 3 for antibody 30634
QQGYSTPLT

SEQ ID NO: 61268 - protein, 12 aa, Homo sapiens
  heavy chain complementarity determining region 3 for antibody 30634
ARDYVAGDAFDV

SEQ ID NO: 61269 - protein, 9 aa, Homo sapiens
  light chain complementarity determining region 3 for antibody 30635
QQGYSSPPS

SEQ ID NO: 61270 - protein, 15 aa, Homo sapiens
  heavy chain complementarity determining region 3 for antibody 30635
ARAQVIWGQLYYFDS

SEQ ID NO: 61271 - protein, 9 aa, Homo sapiens
  light chain complementarity determining region 3 for antibody 30636
QQGYSSPLS

SEQ ID NO: 61272 - protein, 15 aa, Homo sapiens
  heavy chain complementarity determining region 3 for antibody 30636
ARAQVSWGQLYYFDS

SEQ ID NO: 61273 - protein, 9 aa, Homo sapiens
  light chain complementarity determining region 3 for antibody 30637
QQGYSSPLS

SEQ ID NO: 61274 - protein, 15 aa, Homo sapiens
  heavy chain complementarity determining region 3 for antibody 30637
ARAQVMWGQLYYFDS

SEQ ID NO: 61275 - protein, 9 aa, Homo sapiens
  light chain complementarity determining region 3 for antibody 30638
QQGYSSPLS

SEQ ID NO: 61276 - protein, 15 aa, Homo sapiens
  heavy chain complementarity determining region 3 for antibody 30638
ARAQVIWGQLYSFDS

SEQ ID NO: 61277 - protein, 10 aa, Homo sapiens
  light chain complementarity determining region 3 for antibody 30639
QQGYSSPLLG

SEQ ID NO: 61278 - protein, 14 aa, Homo sapiens
  heavy chain complementarity determining region 3 for antibody 30639
ARGRYSTSGAYFDY

SEQ ID NO: 61279 - protein, 10 aa, Homo sapiens
  light chain complementarity determining region 3 for antibody 30640
QQGYSSPFLS

SEQ ID NO: 61280 - protein, 14 aa, Homo sapiens
  heavy chain complementarity determining region 3 for antibody 30640
ARGRYSTSGAYFDY

SEQ ID NO: 61281 - protein, 9 aa, Homo sapiens
  light chain complementarity determining region 3 for antibody 30641
QQGYSIPFL

SEQ ID NO: 61282 - protein, 15 aa, Homo sapiens
  heavy chain complementarity determining region 3 for antibody 30641
ARAQVIWGQLYYFDC

SEQ ID NO: 61283 - protein, 9 aa, Homo sapiens
  light chain complementarity determining region 3 for antibody 30642
QQGYSFPFT

SEQ ID NO: 61284 - protein, 15 aa, Homo sapiens
  heavy chain complementarity determining region 3 for antibody 30642
ARVLLEGQLGRALDY

SEQ ID NO: 61285 - protein, 9 aa, Homo sapiens
  light chain complementarity determining region 3 for antibody 30643
QQGYSAPFN

SEQ ID NO: 61286 - protein, 16 aa, Homo sapiens
  heavy chain complementarity determining region 3 for antibody 30643
ARGLVHDSSSWYGIDF

SEQ ID NO: 61287 - protein, 9 aa, Homo sapiens
  light chain complementarity determining region 3 for antibody 30644
QQGYRPPFI

SEQ ID NO: 61288 - protein, 15 aa, Homo sapiens
  heavy chain complementarity determining region 3 for antibody 30644
TRAQVIWGQLYSFDY

SEQ ID NO: 61289 - protein, 9 aa, Homo sapiens
  light chain complementarity determining region 3 for antibody 30645
QQGYRPHFI

SEQ ID NO: 61290 - protein, 15 aa, Homo sapiens
  heavy chain complementarity determining region 3 for antibody 30645
TRAQVIWGQLYYFDY

SEQ ID NO: 61291 - protein, 9 aa, Homo sapiens
  light chain complementarity determining region 3 for antibody 30646
QQGYMTPFP

SEQ ID NO: 61292 - protein, 15 aa, Homo sapiens
  heavy chain complementarity determining region 3 for antibody 30646
AKSQVIWGQLFYFES

SEQ ID NO: 61293 - protein, 9 aa, Homo sapiens
  light chain complementarity determining region 3 for antibody 30647
QQGVDSPWT

SEQ ID NO: 61294 - protein, 15 aa, Homo sapiens
  heavy chain complementarity determining region 3 for antibody 30647
ASPPVGDYPKGVLDI

SEQ ID NO: 61295 - protein, 9 aa, Homo sapiens
  light chain complementarity determining region 3 for antibody 30648
QQGSTYPLT

SEQ ID NO: 61296 - protein, 20 aa, Homo sapiens
  heavy chain complementarity determining region 3 for antibody 30648
ARFPRREHNPGTTGYYSFDY

SEQ ID NO: 61297 - protein, 9 aa, Homo sapiens
  light chain complementarity determining region 3 for antibody 30649
QQGSTTPRT

SEQ ID NO: 61298 - protein, 22 aa, Homo sapiens
  heavy chain complementarity determining region 3 for antibody 30649
AREGLCTSSRYDVVDHYNGMDV

SEQ ID NO: 61299 - protein, 9 aa, Homo sapiens
  light chain complementarity determining region 3 for antibody 30650
QQGSTNPLT

SEQ ID NO: 61300 - protein, 20 aa, Homo sapiens
  heavy chain complementarity determining region 3 for antibody 30650
ARYPRREHNPGTTGYYSFDY

SEQ ID NO: 61301 - protein, 9 aa, Homo sapiens
  light chain complementarity determining region 3 for antibody 30651
QQGSTFPLT

SEQ ID NO: 61302 - protein, 20 aa, Homo sapiens
  heavy chain complementarity determining region 3 for antibody 30651
ARYPRREHNPGTTGYYSFDY

SEQ ID NO: 61303 - protein, 9 aa, Homo sapiens
  light chain complementarity determining region 3 for antibody 30652
QQGSSYPLT

SEQ ID NO: 61304 - protein, 20 aa, Homo sapiens
  heavy chain complementarity determining region 3 for antibody 30652
ARYPRREHNPGTTGYYSFDY

SEQ ID NO: 61305 - protein, 9 aa, Homo sapiens
  light chain complementarity determining region 3 for antibody 30653
QQGSNWPLT

SEQ ID NO: 61306 - protein, 17 aa, Homo sapiens
  heavy chain complementarity determining region 3 for antibody 30653
AKDFSPYGDYKSDYFDH

SEQ ID NO: 61307 - protein, 9 aa, Homo sapiens
  light chain complementarity determining region 3 for antibody 30654
QQGNTFPPT

SEQ ID NO: 61308 - protein, 16 aa, Homo sapiens
  heavy chain complementarity determining region 3 for antibody 30654
ARGQSIWDDGYLGLDV

SEQ ID NO: 61309 - protein, 9 aa, Homo sapiens
  light chain complementarity determining region 3 for antibody 30655
QQGNTFPPP

SEQ ID NO: 61310 - protein, 16 aa, Homo sapiens
  heavy chain complementarity determining region 3 for antibody 30655
ARGQSIWDDGYLGLDV

SEQ ID NO: 61311 - protein, 9 aa, Homo sapiens
  light chain complementarity determining region 3 for antibody 30656
QQGNSYPFT

SEQ ID NO: 61312 - protein, 8 aa, Homo sapiens
  heavy chain complementarity determining region 3 for antibody 30656
ARGRFYYV

SEQ ID NO: 61313 - protein, 9 aa, Homo sapiens
  light chain complementarity determining region 3 for antibody 30657
QQGNSLPTT

SEQ ID NO: 61314 - protein, 20 aa, Homo sapiens
  heavy chain complementarity determining region 3 for antibody 30657
ARDPTGYGDYVPVYFYGMDV

SEQ ID NO: 61315 - protein, 9 aa, Homo sapiens
  light chain complementarity determining region 3 for antibody 30658
QQGNSLPTT

SEQ ID NO: 61316 - protein, 20 aa, Homo sapiens
  heavy chain complementarity determining region 3 for antibody 30658
ARDPTGYGDYVPLYCYGMDV

SEQ ID NO: 61317 - protein, 9 aa, Homo sapiens
  light chain complementarity determining region 3 for antibody 30659
QQGNSLPTT

SEQ ID NO: 61318 - protein, 20 aa, Homo sapiens
  heavy chain complementarity determining region 3 for antibody 30659
ARDPSGYGDYVPLYFYGMDV

SEQ ID NO: 61319 - protein, 9 aa, Homo sapiens
  light chain complementarity determining region 3 for antibody 30660
QQGNSFPTT

SEQ ID NO: 61320 - protein, 20 aa, Homo sapiens
  heavy chain complementarity determining region 3 for antibody 30660
ARDPTGYGDYVPLYFYGMDV

SEQ ID NO: 61321 - protein, 9 aa, Homo sapiens
  light chain complementarity determining region 3 for antibody 30661
QQGNSFPPT

SEQ ID NO: 61322 - protein, 20 aa, Homo sapiens
  heavy chain complementarity determining region 3 for antibody 30661
AREGWWELKEGRWKFDAFDI

SEQ ID NO: 61323 - protein, 9 aa, Homo sapiens
  light chain complementarity determining region 3 for antibody 30662
QQGNRFPLT

SEQ ID NO: 61324 - protein, 14 aa, Homo sapiens
  heavy chain complementarity determining region 3 for antibody 30662
TTDSPLRRYNYFVY

SEQ ID NO: 61325 - protein, 9 aa, Homo sapiens
  light chain complementarity determining region 3 for antibody 30663
QQGNRFPHT

SEQ ID NO: 61326 - protein, 14 aa, Homo sapiens
  heavy chain complementarity determining region 3 for antibody 30663
ARYCSGTRCYSIDY

SEQ ID NO: 61327 - protein, 9 aa, Homo sapiens
  light chain complementarity determining region 3 for antibody 30664
QQGNLFPGT

SEQ ID NO: 61328 - protein, 16 aa, Homo sapiens
  heavy chain complementarity determining region 3 for antibody 30664
ARGAMSLLEGLYALDI

SEQ ID NO: 61329 - protein, 9 aa, Homo sapiens
  light chain complementarity determining region 3 for antibody 30665
QQGNGNPYT

SEQ ID NO: 61330 - protein, 15 aa, Homo sapiens
  heavy chain complementarity determining region 3 for antibody 30665
ARDGWLPATKSFFNY

SEQ ID NO: 61331 - protein, 9 aa, Homo sapiens
  light chain complementarity determining region 3 for antibody 30666
QQGNGHPYP

SEQ ID NO: 61332 - protein, 15 aa, Homo sapiens
  heavy chain complementarity determining region 3 for antibody 30666
ARDGWLPATKSFFNY

SEQ ID NO: 61333 - protein, 9 aa, Homo sapiens
  light chain complementarity determining region 3 for antibody 30667
QQGLTTPRP

SEQ ID NO: 61334 - protein, 13 aa, Homo sapiens
  heavy chain complementarity determining region 3 for antibody 30667
TTDHHLKPNAFDF

SEQ ID NO: 61335 - protein, 9 aa, Homo sapiens
  light chain complementarity determining region 3 for antibody 30668
QQGHRYPPT

SEQ ID NO: 61336 - protein, 18 aa, Homo sapiens
  heavy chain complementarity determining region 3 for antibody 30668
AKDDIAVAFSTQPPEFDY

SEQ ID NO: 61337 - protein, 9 aa, Homo sapiens
  light chain complementarity determining region 3 for antibody 30669
QQGFSTPWT

SEQ ID NO: 61338 - protein, 12 aa, Homo sapiens
  heavy chain complementarity determining region 3 for antibody 30669
AREAYSEWFPDH

SEQ ID NO: 61339 - protein, 11 aa, Homo sapiens
  light chain complementarity determining region 3 for antibody 30670
QQGETSPPMFP

SEQ ID NO: 61340 - protein, 23 aa, Homo sapiens
  heavy chain complementarity determining region 3 for antibody 30670
ARASRGYRRSDSRMEFFFYGLDV

SEQ ID NO: 61341 - protein, 9 aa, Homo sapiens
  light chain complementarity determining region 3 for antibody 30671
QQGEDYPIT

SEQ ID NO: 61342 - protein, 16 aa, Homo sapiens
  heavy chain complementarity determining region 3 for antibody 30671
SRVVAKSILPQPPNDY

SEQ ID NO: 61343 - protein, 9 aa, Homo sapiens
  light chain complementarity determining region 3 for antibody 30672
QQGDSIPYP

SEQ ID NO: 61344 - protein, 14 aa, Homo sapiens
  heavy chain complementarity determining region 3 for antibody 30672
GTDPAPDKPDYIDY

SEQ ID NO: 61345 - protein, 9 aa, Homo sapiens
  light chain complementarity determining region 3 for antibody 30673
QQGDSIPST

SEQ ID NO: 61346 - protein, 14 aa, Homo sapiens
  heavy chain complementarity determining region 3 for antibody 30673
GTDPAPDKPDYIDY

SEQ ID NO: 61347 - protein, 9 aa, Homo sapiens
  light chain complementarity determining region 3 for antibody 30674
QQGDRIPYT

SEQ ID NO: 61348 - protein, 14 aa, Homo sapiens
  heavy chain complementarity determining region 3 for antibody 30674
GTDPAPDKPDYIDY

SEQ ID NO: 61349 - protein, 9 aa, Homo sapiens
  light chain complementarity determining region 3 for antibody 30675
QQFYTSVRT

SEQ ID NO: 61350 - protein, 12 aa, Homo sapiens
  heavy chain complementarity determining region 3 for antibody 30675
VKDCGLGGSRDF

SEQ ID NO: 61351 - protein, 9 aa, Homo sapiens
  light chain complementarity determining region 3 for antibody 30676
QQFYSSPRA

SEQ ID NO: 61352 - protein, 11 aa, Homo sapiens
  heavy chain complementarity determining region 3 for antibody 30676
GRVYSWGAVDI

SEQ ID NO: 61353 - protein, 9 aa, Homo sapiens
  light chain complementarity determining region 3 for antibody 30677
QQFYSNLRT

SEQ ID NO: 61354 - protein, 21 aa, Homo sapiens
  heavy chain complementarity determining region 3 for antibody 30677
AKDSMDSRGAVPGTVVGAFDY

SEQ ID NO: 61355 - protein, 9 aa, Homo sapiens
  light chain complementarity determining region 3 for antibody 30678
QQFYSIPPT

SEQ ID NO: 61356 - protein, 12 aa, Homo sapiens
  heavy chain complementarity determining region 3 for antibody 30678
ARSDSGGGSYDY

SEQ ID NO: 61357 - protein, 9 aa, Homo sapiens
  light chain complementarity determining region 3 for antibody 30679
QQFYSGPLA

SEQ ID NO: 61358 - protein, 11 aa, Homo sapiens
  heavy chain complementarity determining region 3 for antibody 30679
GRVYSWGAVDI

SEQ ID NO: 61359 - protein, 9 aa, Homo sapiens
  light chain complementarity determining region 3 for antibody 30680
QQFYSCPPA

SEQ ID NO: 61360 - protein, 11 aa, Homo sapiens
  heavy chain complementarity determining region 3 for antibody 30680
GRVYSWGAVDI

SEQ ID NO: 61361 - protein, 9 aa, Homo sapiens
  light chain complementarity determining region 3 for antibody 30681
QQFYNTPGT

SEQ ID NO: 61362 - protein, 15 aa, Homo sapiens
  heavy chain complementarity determining region 3 for antibody 30681
IGQSKVDANWNYPDF

SEQ ID NO: 61363 - protein, 9 aa, Homo sapiens
  light chain complementarity determining region 3 for antibody 30682
QQFVNYPLT

SEQ ID NO: 61364 - protein, 20 aa, Homo sapiens
  heavy chain complementarity determining region 3 for antibody 30682
ARDLGRSGSIGIIRNDAFNV

SEQ ID NO: 61365 - protein, 11 aa, Homo sapiens
  light chain complementarity determining region 3 for antibody 30683
QQFTNCPPLFT

SEQ ID NO: 61366 - protein, 14 aa, Homo sapiens
  heavy chain complementarity determining region 3 for antibody 30683
ARLNGIVGYYAFDM

SEQ ID NO: 61367 - protein, 9 aa, Homo sapiens
  light chain complementarity determining region 3 for antibody 30684
QQFNVFPII

SEQ ID NO: 61368 - protein, 18 aa, Homo sapiens
  heavy chain complementarity determining region 3 for antibody 30684
AKLGRYHYDSKTHDAFDL

SEQ ID NO: 61369 - protein, 10 aa, Homo sapiens
  light chain complementarity determining region 3 for antibody 30685
QQFNTYPMYT

SEQ ID NO: 61370 - protein, 16 aa, Homo sapiens
  heavy chain complementarity determining region 3 for antibody 30685
ARGYCSSTSCYNPIDI

SEQ ID NO: 61371 - protein, 9 aa, Homo sapiens
  light chain complementarity determining region 3 for antibody 30686
QQFNTYPLT

SEQ ID NO: 61372 - protein, 17 aa, Homo sapiens
  heavy chain complementarity determining region 3 for antibody 30686
AKDLSGVHYDIHHGLDV

SEQ ID NO: 61373 - protein, 9 aa, Homo sapiens
  light chain complementarity determining region 3 for antibody 30687
QQFNTWPRT

SEQ ID NO: 61374 - protein, 22 aa, Homo sapiens
  heavy chain complementarity determining region 3 for antibody 30687
AREVRASGYDDFYNYYYYGLDV

SEQ ID NO: 61375 - protein, 8 aa, Homo sapiens
  light chain complementarity determining region 3 for antibody 30688
QQFNSYRS

SEQ ID NO: 61376 - protein, 18 aa, Homo sapiens
  heavy chain complementarity determining region 3 for antibody 30688
IVDQDDSYVSGWFGYLRH

SEQ ID NO: 61377 - protein, 8 aa, Homo sapiens
  light chain complementarity determining region 3 for antibody 30689
QQFNSYPR

SEQ ID NO: 61378 - protein, 20 aa, Homo sapiens
  heavy chain complementarity determining region 3 for antibody 30689
ARDGAVIAPRTRGPGFYFDS

SEQ ID NO: 61379 - protein, 9 aa, Homo sapiens
  light chain complementarity determining region 3 for antibody 30690
QQFNSYPLT

SEQ ID NO: 61380 - protein, 19 aa, Homo sapiens
  heavy chain complementarity determining region 3 for antibody 30690
ARDGRRAARGIIIYNGVDP

SEQ ID NO: 61381 - protein, 9 aa, Homo sapiens
  light chain complementarity determining region 3 for antibody 30691
QQFNSYPLT

SEQ ID NO: 61382 - protein, 19 aa, Homo sapiens
  heavy chain complementarity determining region 3 for antibody 30691
ARDGRRAARGIIIYNCVDP

SEQ ID NO: 61383 - protein, 9 aa, Homo sapiens
  light chain complementarity determining region 3 for antibody 30692
QQFNSFPWT

SEQ ID NO: 61384 - protein, 20 aa, Homo sapiens
  heavy chain complementarity determining region 3 for antibody 30692
MSRFCIGGNCYSGARGPFDP

SEQ ID NO: 61385 - protein, 9 aa, Homo sapiens
  light chain complementarity determining region 3 for antibody 30693
QQFNSFPLT

SEQ ID NO: 61386 - protein, 10 aa, Homo sapiens
  heavy chain complementarity determining region 3 for antibody 30693
GRDLTGSKDY

SEQ ID NO: 61387 - protein, 9 aa, Homo sapiens
  light chain complementarity determining region 3 for antibody 30694
QQFNNWPRT

SEQ ID NO: 61388 - protein, 15 aa, Homo sapiens
  heavy chain complementarity determining region 3 for antibody 30694
ARAPTYSSSSGYLDN

SEQ ID NO: 61389 - protein, 9 aa, Homo sapiens
  light chain complementarity determining region 3 for antibody 30695
QQFNKWPYT

SEQ ID NO: 61390 - protein, 16 aa, Homo sapiens
  heavy chain complementarity determining region 3 for antibody 30695
ARAGVDSSGYYLPFDY

SEQ ID NO: 61391 - protein, 9 aa, Homo sapiens
  light chain complementarity determining region 3 for antibody 30696
QQFKDYPLT

SEQ ID NO: 61392 - protein, 10 aa, Homo sapiens
  heavy chain complementarity determining region 3 for antibody 30696
ARDPYGRVGY

SEQ ID NO: 61393 - protein, 9 aa, Homo sapiens
  light chain complementarity determining region 3 for antibody 30697
QQFKDYPLT

SEQ ID NO: 61394 - protein, 10 aa, Homo sapiens
  heavy chain complementarity determining region 3 for antibody 30697
ARDPYGRGDY

SEQ ID NO: 61395 - protein, 9 aa, Homo sapiens
  light chain complementarity determining region 3 for antibody 30698
QQFHTTPPP

SEQ ID NO: 61396 - protein, 15 aa, Homo sapiens
  heavy chain complementarity determining region 3 for antibody 30698
ARDRTASTSHDGFDL

SEQ ID NO: 61397 - protein, 9 aa, Homo sapiens
  light chain complementarity determining region 3 for antibody 30699
QQFHTTPLT

SEQ ID NO: 61398 - protein, 15 aa, Homo sapiens
  heavy chain complementarity determining region 3 for antibody 30699
ARDRTASASHDGFDL

SEQ ID NO: 61399 - protein, 9 aa, Homo sapiens
  light chain complementarity determining region 3 for antibody 30700
QQFHTPPLT

SEQ ID NO: 61400 - protein, 15 aa, Homo sapiens
  heavy chain complementarity determining region 3 for antibody 30700
ARDRTASTSHDGFDL

SEQ ID NO: 61401 - protein, 9 aa, Homo sapiens
  light chain complementarity determining region 3 for antibody 30701
QQFHAYPFP

SEQ ID NO: 61402 - protein, 12 aa, Homo sapiens
  heavy chain complementarity determining region 3 for antibody 30701
ARPLDGDYGFDP

SEQ ID NO: 61403 - protein, 9 aa, Homo sapiens
  light chain complementarity determining region 3 for antibody 30702
QQFHASPFT

SEQ ID NO: 61404 - protein, 12 aa, Homo sapiens
  heavy chain complementarity determining region 3 for antibody 30702
ARPLDGDYGFDP

SEQ ID NO: 61405 - protein, 10 aa, Homo sapiens
  light chain complementarity determining region 3 for antibody 30703
QQFGVSPPWG

SEQ ID NO: 61406 - protein, 12 aa, Homo sapiens
  heavy chain complementarity determining region 3 for antibody 30703
ARVPYFYYAMDV

SEQ ID NO: 61407 - protein, 9 aa, Homo sapiens
  light chain complementarity determining region 3 for antibody 30704
QQFGTSPWT

SEQ ID NO: 61408 - protein, 19 aa, Homo sapiens
  heavy chain complementarity determining region 3 for antibody 30704
AREASTTIFGVTSRGAFDA

SEQ ID NO: 61409 - protein, 7 aa, Homo sapiens
  light chain complementarity determining region 3 for antibody 30705
QQFGSWA

SEQ ID NO: 61410 - protein, 11 aa, Homo sapiens
  heavy chain complementarity determining region 3 for antibody 30705
AVVDTTLAMPK

SEQ ID NO: 61411 - protein, 9 aa, Homo sapiens
  light chain complementarity determining region 3 for antibody 30706
QQFGSSWWT

SEQ ID NO: 61412 - protein, 15 aa, Homo sapiens
  heavy chain complementarity determining region 3 for antibody 30706
ARHVARDDIGYYHDL

SEQ ID NO: 61413 - protein, 8 aa, Homo sapiens
  light chain complementarity determining region 3 for antibody 30707
QQFGSSRT

SEQ ID NO: 61414 - protein, 15 aa, Homo sapiens
  heavy chain complementarity determining region 3 for antibody 30707
ARLRDTTLGRWYFDS

SEQ ID NO: 61415 - protein, 8 aa, Homo sapiens
  light chain complementarity determining region 3 for antibody 30708
QQFGSSLT

SEQ ID NO: 61416 - protein, 15 aa, Homo sapiens
  heavy chain complementarity determining region 3 for antibody 30708
ARLRDTALGRWYFDS

SEQ ID NO: 61417 - protein, 8 aa, Homo sapiens
  light chain complementarity determining region 3 for antibody 30709
QQFGSSLT

SEQ ID NO: 61418 - protein, 15 aa, Homo sapiens
  heavy chain complementarity determining region 3 for antibody 30709
AGLRDTTLGRWYFDS

SEQ ID NO: 61419 - protein, 9 aa, Homo sapiens
  light chain complementarity determining region 3 for antibody 30710
QQFGSLPLT

SEQ ID NO: 61420 - protein, 13 aa, Homo sapiens
  heavy chain complementarity determining region 3 for antibody 30710
ARRLLLTGYRFDP

SEQ ID NO: 61421 - protein, 9 aa, Homo sapiens
  light chain complementarity determining region 3 for antibody 30711
QQFGSLPFP

SEQ ID NO: 61422 - protein, 11 aa, Homo sapiens
  heavy chain complementarity determining region 3 for antibody 30711
ARAPTNFGVDY

SEQ ID NO: 61423 - protein, 10 aa, Homo sapiens
  light chain complementarity determining region 3 for antibody 30712
QQFGNSPSYT

SEQ ID NO: 61424 - protein, 23 aa, Homo sapiens
  heavy chain complementarity determining region 3 for antibody 30712
ARGRREYFWGSYRNAPYYYGMEI

SEQ ID NO: 61425 - protein, 10 aa, Homo sapiens
  light chain complementarity determining region 3 for antibody 30713
QQFGNSPPWP

SEQ ID NO: 61426 - protein, 12 aa, Homo sapiens
  heavy chain complementarity determining region 3 for antibody 30713
AKEGLIGGYFDL

SEQ ID NO: 61427 - protein, 10 aa, Homo sapiens
  light chain complementarity determining region 3 for antibody 30714
QQFGNSPLYT

SEQ ID NO: 61428 - protein, 23 aa, Homo sapiens
  heavy chain complementarity determining region 3 for antibody 30714
ARGRREYFWGSYRNAPYYYGMDI

SEQ ID NO: 61429 - protein, 10 aa, Homo sapiens
  light chain complementarity determining region 3 for antibody 30715
QQFGNSPLYT

SEQ ID NO: 61430 - protein, 23 aa, Homo sapiens
  heavy chain complementarity determining region 3 for antibody 30715
ARGRRESFWGSYRNAPYYYGMEI

SEQ ID NO: 61431 - protein, 10 aa, Homo sapiens
  light chain complementarity determining region 3 for antibody 30716
QQFGGSPMLT

SEQ ID NO: 61432 - protein, 10 aa, Homo sapiens
  heavy chain complementarity determining region 3 for antibody 30716
ARHGDYWLDP

SEQ ID NO: 61433 - protein, 9 aa, Homo sapiens
  light chain complementarity determining region 3 for antibody 30717
QQFGGSPLT

SEQ ID NO: 61434 - protein, 11 aa, Homo sapiens
  heavy chain complementarity determining region 3 for antibody 30717
ARKGTGAPFDY

SEQ ID NO: 61435 - protein, 8 aa, Homo sapiens
  light chain complementarity determining region 3 for antibody 30718
QQFGGSLT

SEQ ID NO: 61436 - protein, 15 aa, Homo sapiens
  heavy chain complementarity determining region 3 for antibody 30718
ARLRDTTLGRWYFDS

SEQ ID NO: 61437 - protein, 9 aa, Homo sapiens
  light chain complementarity determining region 3 for antibody 30719
QQFFSSPRA

SEQ ID NO: 61438 - protein, 11 aa, Homo sapiens
  heavy chain complementarity determining region 3 for antibody 30719
GRVYSWGAVDI

SEQ ID NO: 61439 - protein, 11 aa, Homo sapiens
  light chain complementarity determining region 3 for antibody 30720
QQFDTLPPRLT

SEQ ID NO: 61440 - protein, 13 aa, Homo sapiens
  heavy chain complementarity determining region 3 for antibody 30720
ATSRTAAAFVDRP

SEQ ID NO: 61441 - protein, 11 aa, Homo sapiens
  light chain complementarity determining region 3 for antibody 30721
QQFDTLPPMLT

SEQ ID NO: 61442 - protein, 13 aa, Homo sapiens
  heavy chain complementarity determining region 3 for antibody 30721
ATSRTAAAFVDLP

SEQ ID NO: 61443 - protein, 9 aa, Homo sapiens
  light chain complementarity determining region 3 for antibody 30722
QQFDNYSLT

SEQ ID NO: 61444 - protein, 20 aa, Homo sapiens
  heavy chain complementarity determining region 3 for antibody 30722
ARDLGRSGSIGIIRNDAFNV

SEQ ID NO: 61445 - protein, 9 aa, Homo sapiens
  light chain complementarity determining region 3 for antibody 30723
QQFDNYPLT

SEQ ID NO: 61446 - protein, 20 aa, Homo sapiens
  heavy chain complementarity determining region 3 for antibody 30723
ARDLGRSGSIGVIRNDAFNV

SEQ ID NO: 61447 - protein, 9 aa, Homo sapiens
  light chain complementarity determining region 3 for antibody 30724
QQFDNYPLP

SEQ ID NO: 61448 - protein, 20 aa, Homo sapiens
  heavy chain complementarity determining region 3 for antibody 30724
ARDLGRSGSIGIIRNDAFNV

SEQ ID NO: 61449 - protein, 10 aa, Homo sapiens
  light chain complementarity determining region 3 for antibody 30725
QQFDNSPSLT

SEQ ID NO: 61450 - protein, 11 aa, Homo sapiens
  heavy chain complementarity determining region 3 for antibody 30725
ARAAGGENFDS

SEQ ID NO: 61451 - protein, 8 aa, Homo sapiens
  light chain complementarity determining region 3 for antibody 30726
QQFDILIP

SEQ ID NO: 61452 - protein, 14 aa, Homo sapiens
  heavy chain complementarity determining region 3 for antibody 30726
AREDFSDGNGYFDP

SEQ ID NO: 61453 - protein, 9 aa, Homo sapiens
  light chain complementarity determining region 3 for antibody 30727
QQFDGLPIT

SEQ ID NO: 61454 - protein, 9 aa, Homo sapiens
  heavy chain complementarity determining region 3 for antibody 30727
ARSTHPRGP

SEQ ID NO: 61455 - protein, 9 aa, Homo sapiens
  light chain complementarity determining region 3 for antibody 30728
QQFDELPIT

SEQ ID NO: 61456 - protein, 9 aa, Homo sapiens
  heavy chain complementarity determining region 3 for antibody 30728
ARSTHPRGH

SEQ ID NO: 61457 - protein, 9 aa, Homo sapiens
  light chain complementarity determining region 3 for antibody 30729
QQFDDSGYP

SEQ ID NO: 61458 - protein, 13 aa, Homo sapiens
  heavy chain complementarity determining region 3 for antibody 30729
VRERHPGAFYFDF

SEQ ID NO: 61459 - protein, 9 aa, Homo sapiens
  light chain complementarity determining region 3 for antibody 30730
QQFDDSGST

SEQ ID NO: 61460 - protein, 13 aa, Homo sapiens
  heavy chain complementarity determining region 3 for antibody 30730
VRERHPGAFYFDF

SEQ ID NO: 61461 - protein, 9 aa, Homo sapiens
  light chain complementarity determining region 3 for antibody 30731
QQFDASGYT

SEQ ID NO: 61462 - protein, 13 aa, Homo sapiens
  heavy chain complementarity determining region 3 for antibody 30731
VRERHPGAFYFDF

SEQ ID NO: 61463 - protein, 9 aa, Homo sapiens
  light chain complementarity determining region 3 for antibody 30732
QQFDAQSWT

SEQ ID NO: 61464 - protein, 11 aa, Homo sapiens
  heavy chain complementarity determining region 3 for antibody 30732
ARGWRDNSFDY

SEQ ID NO: 61465 - protein, 9 aa, Homo sapiens
  light chain complementarity determining region 3 for antibody 30733
QQFCGAPRT

SEQ ID NO: 61466 - protein, 16 aa, Homo sapiens
  heavy chain complementarity determining region 3 for antibody 30733
ARDPRGGVAVPADFNY

SEQ ID NO: 61467 - protein, 9 aa, Homo sapiens
  light chain complementarity determining region 3 for antibody 30734
QQDYTSLRT

SEQ ID NO: 61468 - protein, 12 aa, Homo sapiens
  heavy chain complementarity determining region 3 for antibody 30734
VKDCGLGGSRDS

SEQ ID NO: 61469 - protein, 10 aa, Homo sapiens
  light chain complementarity determining region 3 for antibody 30735
QQDYGTPPFT

SEQ ID NO: 61470 - protein, 14 aa, Homo sapiens
  heavy chain complementarity determining region 3 for antibody 30735
AKDLLKLWGSCSGD

SEQ ID NO: 61471 - protein, 9 aa, Homo sapiens
  light chain complementarity determining region 3 for antibody 30736
QQDVTSPWP

SEQ ID NO: 61472 - protein, 12 aa, Homo sapiens
  heavy chain complementarity determining region 3 for antibody 30736
SRGLRSGWGLDY

SEQ ID NO: 61473 - protein, 9 aa, Homo sapiens
  light chain complementarity determining region 3 for antibody 30737
QQDSRSPVT

SEQ ID NO: 61474 - protein, 15 aa, Homo sapiens
  heavy chain complementarity determining region 3 for antibody 30737
AREPNSYGLEYYFTY

SEQ ID NO: 61475 - protein, 8 aa, Homo sapiens
  light chain complementarity determining region 3 for antibody 30738
QQDSRFRT

SEQ ID NO: 61476 - protein, 19 aa, Homo sapiens
  heavy chain complementarity determining region 3 for antibody 30738
ARDGVTCSGGSCIETAVDS

SEQ ID NO: 61477 - protein, 8 aa, Homo sapiens
  light chain complementarity determining region 3 for antibody 30739
QQDNTYAT

SEQ ID NO: 61478 - protein, 17 aa, Homo sapiens
  heavy chain complementarity determining region 3 for antibody 30739
AHRLDHNGMWNEGIFDH

SEQ ID NO: 61479 - protein, 8 aa, Homo sapiens
  light chain complementarity determining region 3 for antibody 30740
QQDNSYWT

SEQ ID NO: 61480 - protein, 14 aa, Homo sapiens
  heavy chain complementarity determining region 3 for antibody 30740
ARDRVAPAGEYFQH

SEQ ID NO: 61481 - protein, 7 aa, Homo sapiens
  light chain complementarity determining region 3 for antibody 30741
QQDNSYT

SEQ ID NO: 61482 - protein, 20 aa, Homo sapiens
  heavy chain complementarity determining region 3 for antibody 30741
SRRHVLVGGDRVAAGRAADY

SEQ ID NO: 61483 - protein, 10 aa, Homo sapiens
  light chain complementarity determining region 3 for antibody 30742
QQDNSYSSYT

SEQ ID NO: 61484 - protein, 15 aa, Homo sapiens
  heavy chain complementarity determining region 3 for antibody 30742
ARTKLERRRDHYFDY

SEQ ID NO: 61485 - protein, 8 aa, Homo sapiens
  light chain complementarity determining region 3 for antibody 30743
QQDNSYPT

SEQ ID NO: 61486 - protein, 12 aa, Homo sapiens
  heavy chain complementarity determining region 3 for antibody 30743
ASTTVTTLYFQH

SEQ ID NO: 61487 - protein, 9 aa, Homo sapiens
  light chain complementarity determining region 3 for antibody 30744
QQDNSFPFT

SEQ ID NO: 61488 - protein, 12 aa, Homo sapiens
  heavy chain complementarity determining region 3 for antibody 30744
TREPKRSGSFDY

SEQ ID NO: 61489 - protein, 9 aa, Homo sapiens
  light chain complementarity determining region 3 for antibody 30745
QQDNNWPRT

SEQ ID NO: 61490 - protein, 14 aa, Homo sapiens
  heavy chain complementarity determining region 3 for antibody 30745
VKGHCSSTSCYNDY

SEQ ID NO: 61491 - protein, 9 aa, Homo sapiens
  light chain complementarity determining region 3 for antibody 30746
QQDNNWPRT

SEQ ID NO: 61492 - protein, 11 aa, Homo sapiens
  heavy chain complementarity determining region 3 for antibody 30746
ARLRYQGYFDV

SEQ ID NO: 61493 - protein, 9 aa, Homo sapiens
  light chain complementarity determining region 3 for antibody 30747
QQDNNWPPT

SEQ ID NO: 61494 - protein, 12 aa, Homo sapiens
  heavy chain complementarity determining region 3 for antibody 30747
ARTLVQALIWDY

SEQ ID NO: 61495 - protein, 9 aa, Homo sapiens
  light chain complementarity determining region 3 for antibody 30748
QQDNNWPLT

SEQ ID NO: 61496 - protein, 19 aa, Homo sapiens
  heavy chain complementarity determining region 3 for antibody 30748
AHRRGTRGIQVDGTYGVDV

SEQ ID NO: 61497 - protein, 10 aa, Homo sapiens
  light chain complementarity determining region 3 for antibody 30749
QQDNNWLGWT

SEQ ID NO: 61498 - protein, 13 aa, Homo sapiens
  heavy chain complementarity determining region 3 for antibody 30749
ARHGRRSGWYYAY

SEQ ID NO: 61499 - protein, 9 aa, Homo sapiens
  light chain complementarity determining region 3 for antibody 30750
QQDNASSWT

SEQ ID NO: 61500 - protein, 16 aa, Homo sapiens
  heavy chain complementarity determining region 3 for antibody 30750
ASLGGAHYYGSGSHYF

SEQ ID NO: 61501 - protein, 8 aa, Homo sapiens
  light chain complementarity determining region 3 for antibody 30751
QQDKSYYT

SEQ ID NO: 61502 - protein, 24 aa, Homo sapiens
  heavy chain complementarity determining region 3 for antibody 30751
TRDRPEADGSERNYKSIYFYGMDV

SEQ ID NO: 61503 - protein, 9 aa, Homo sapiens
  light chain complementarity determining region 3 for antibody 30752
QQDISYPWT

SEQ ID NO: 61504 - protein, 19 aa, Homo sapiens
  heavy chain complementarity determining region 3 for antibody 30752
ARVSARRILTAPRYPLIDS

SEQ ID NO: 61505 - protein, 9 aa, Homo sapiens
  light chain complementarity determining region 3 for antibody 30753
QQDHSFPPT

SEQ ID NO: 61506 - protein, 12 aa, Homo sapiens
  heavy chain complementarity determining region 3 for antibody 30753
ARDTDGSFGLDV

SEQ ID NO: 61507 - protein, 9 aa, Homo sapiens
  light chain complementarity determining region 3 for antibody 30754
QQDHNSRWT

SEQ ID NO: 61508 - protein, 11 aa, Homo sapiens
  heavy chain complementarity determining region 3 for antibody 30754
AQSPSANIADV

SEQ ID NO: 61509 - protein, 9 aa, Homo sapiens
  light chain complementarity determining region 3 for antibody 30755
QQDHKSPWT

SEQ ID NO: 61510 - protein, 17 aa, Homo sapiens
  heavy chain complementarity determining region 3 for antibody 30755
ARTLIYHFTWGRGAYDI

SEQ ID NO: 61511 - protein, 9 aa, Homo sapiens
  light chain complementarity determining region 3 for antibody 30756
QQDGTSPPT

SEQ ID NO: 61512 - protein, 15 aa, Homo sapiens
  heavy chain complementarity determining region 3 for antibody 30756
TRAGRGQLWLRFFDF

SEQ ID NO: 61513 - protein, 8 aa, Homo sapiens
  light chain complementarity determining region 3 for antibody 30757
QQDGSYRT

SEQ ID NO: 61514 - protein, 15 aa, Homo sapiens
  heavy chain complementarity determining region 3 for antibody 30757
AKVHSPWSSGYYFDY

SEQ ID NO: 61515 - protein, 9 aa, Homo sapiens
  light chain complementarity determining region 3 for antibody 30758
QQDGSTPST

SEQ ID NO: 61516 - protein, 14 aa, Homo sapiens
  heavy chain complementarity determining region 3 for antibody 30758
AREWVSTIRGWFDP

SEQ ID NO: 61517 - protein, 9 aa, Homo sapiens
  light chain complementarity determining region 3 for antibody 30759
QQDGSSWWT

SEQ ID NO: 61518 - protein, 15 aa, Homo sapiens
  heavy chain complementarity determining region 3 for antibody 30759
ARHVARDDIGYYHDL

SEQ ID NO: 61519 - protein, 9 aa, Homo sapiens
  light chain complementarity determining region 3 for antibody 30760
QQDGSSSST

SEQ ID NO: 61520 - protein, 15 aa, Homo sapiens
  heavy chain complementarity determining region 3 for antibody 30760
ARRISPYNNAWYLDY

SEQ ID NO: 61521 - protein, 9 aa, Homo sapiens
  light chain complementarity determining region 3 for antibody 30761
QQDGSSPWT

SEQ ID NO: 61522 - protein, 16 aa, Homo sapiens
  heavy chain complementarity determining region 3 for antibody 30761
ARLKRYSGYEDDGMDV

SEQ ID NO: 61523 - protein, 9 aa, Homo sapiens
  light chain complementarity determining region 3 for antibody 30762
QQDGSSPWT

SEQ ID NO: 61524 - protein, 14 aa, Homo sapiens
  heavy chain complementarity determining region 3 for antibody 30762
ARGQSGSLYDTFDM

SEQ ID NO: 61525 - protein, 9 aa, Homo sapiens
  light chain complementarity determining region 3 for antibody 30763
QQDGSSPWT

SEQ ID NO: 61526 - protein, 12 aa, Homo sapiens
  heavy chain complementarity determining region 3 for antibody 30763
ARGLRLGWGLDY

SEQ ID NO: 61527 - protein, 9 aa, Homo sapiens
  light chain complementarity determining region 3 for antibody 30764
QQDGSSPWT

SEQ ID NO: 61528 - protein, 15 aa, Homo sapiens
  heavy chain complementarity determining region 3 for antibody 30764
ARDLWELGAHSPGAH

SEQ ID NO: 61529 - protein, 10 aa, Homo sapiens
  light chain complementarity determining region 3 for antibody 30765
QQDGSSPTWT

SEQ ID NO: 61530 - protein, 20 aa, Homo sapiens
  heavy chain complementarity determining region 3 for antibody 30765
ATLRRRITLGRGVIPDAFDI

SEQ ID NO: 61531 - protein, 9 aa, Homo sapiens
  light chain complementarity determining region 3 for antibody 30766
QQDGSSPRT

SEQ ID NO: 61532 - protein, 13 aa, Homo sapiens
  heavy chain complementarity determining region 3 for antibody 30766
GKGYPNIYKVYDY

SEQ ID NO: 61533 - protein, 9 aa, Homo sapiens
  light chain complementarity determining region 3 for antibody 30767
QQDGSSPRT

SEQ ID NO: 61534 - protein, 13 aa, Homo sapiens
  heavy chain complementarity determining region 3 for antibody 30767
ARGKYESSGYKEN

SEQ ID NO: 61535 - protein, 9 aa, Homo sapiens
  light chain complementarity determining region 3 for antibody 30768
QQDGSSPRT

SEQ ID NO: 61536 - protein, 15 aa, Homo sapiens
  heavy chain complementarity determining region 3 for antibody 30768
AKDRSAGYTYGFSDS

SEQ ID NO: 61537 - protein, 9 aa, Homo sapiens
  light chain complementarity determining region 3 for antibody 30769
QQDGSSPRT

SEQ ID NO: 61538 - protein, 13 aa, Homo sapiens
  heavy chain complementarity determining region 3 for antibody 30769
AHINVRGVIPFDY

SEQ ID NO: 61539 - protein, 9 aa, Homo sapiens
  light chain complementarity determining region 3 for antibody 30770
QQDGSSPQT

SEQ ID NO: 61540 - protein, 11 aa, Homo sapiens
  heavy chain complementarity determining region 3 for antibody 30770
AKDNSNYLFDY

SEQ ID NO: 61541 - protein, 10 aa, Homo sapiens
  light chain complementarity determining region 3 for antibody 30771
QQDGSSPPWR

SEQ ID NO: 61542 - protein, 14 aa, Homo sapiens
  heavy chain complementarity determining region 3 for antibody 30771
ARGGIRGVIIPLLS

SEQ ID NO: 61543 - protein, 9 aa, Homo sapiens
  light chain complementarity determining region 3 for antibody 30772
QQDGSSPPT

SEQ ID NO: 61544 - protein, 23 aa, Homo sapiens
  heavy chain complementarity determining region 3 for antibody 30772
ARDGAHDYIHRLRKKHRIDAFDI

SEQ ID NO: 61545 - protein, 9 aa, Homo sapiens
  light chain complementarity determining region 3 for antibody 30773
QQDGSSPPT

SEQ ID NO: 61546 - protein, 16 aa, Homo sapiens
  heavy chain complementarity determining region 3 for antibody 30773
AKDISGGFDGWWFFDY

SEQ ID NO: 61547 - protein, 10 aa, Homo sapiens
  light chain complementarity determining region 3 for antibody 30774
QQDGSSPMYG

SEQ ID NO: 61548 - protein, 11 aa, Homo sapiens
  heavy chain complementarity determining region 3 for antibody 30774
ARGGQWGSLDY

SEQ ID NO: 61549 - protein, 10 aa, Homo sapiens
  light chain complementarity determining region 3 for antibody 30775
QQDGSSPMDS

SEQ ID NO: 61550 - protein, 11 aa, Homo sapiens
  heavy chain complementarity determining region 3 for antibody 30775
ARGGQWGSLDY

SEQ ID NO: 61551 - protein, 10 aa, Homo sapiens
  light chain complementarity determining region 3 for antibody 30776
QQDGSSPMCT

SEQ ID NO: 61552 - protein, 13 aa, Homo sapiens
  heavy chain complementarity determining region 3 for antibody 30776
ARVYSSTGYYFDY

SEQ ID NO: 61553 - protein, 9 aa, Homo sapiens
  light chain complementarity determining region 3 for antibody 30777
QQDGSSPLT

SEQ ID NO: 61554 - protein, 19 aa, Homo sapiens
  heavy chain complementarity determining region 3 for antibody 30777
ARGSSSSRRRAAVVGYFDL

SEQ ID NO: 61555 - protein, 9 aa, Homo sapiens
  light chain complementarity determining region 3 for antibody 30778
QQDGSSLYT

SEQ ID NO: 61556 - protein, 24 aa, Homo sapiens
  heavy chain complementarity determining region 3 for antibody 30778
ARASVIYYDSRDGLDMSYLYYFDS

SEQ ID NO: 61557 - protein, 8 aa, Homo sapiens
  light chain complementarity determining region 3 for antibody 30779
QQDGSSLT

SEQ ID NO: 61558 - protein, 21 aa, Homo sapiens
  heavy chain complementarity determining region 3 for antibody 30779
TTLKGPSYDFWSGYGTYYFDY

SEQ ID NO: 61559 - protein, 8 aa, Homo sapiens
  light chain complementarity determining region 3 for antibody 30780
QQDGSSLT

SEQ ID NO: 61560 - protein, 16 aa, Homo sapiens
  heavy chain complementarity determining region 3 for antibody 30780
AKANSPYSSSWYYFDY

SEQ ID NO: 61561 - protein, 10 aa, Homo sapiens
  light chain complementarity determining region 3 for antibody 30781
QQDGSSLPCT

SEQ ID NO: 61562 - protein, 23 aa, Homo sapiens
  heavy chain complementarity determining region 3 for antibody 30781
ARAQPRWGIAVAGPPGRYYGMDV

SEQ ID NO: 61563 - protein, 10 aa, Homo sapiens
  light chain complementarity determining region 3 for antibody 30782
QQDGSSLLYT

SEQ ID NO: 61564 - protein, 13 aa, Homo sapiens
  heavy chain complementarity determining region 3 for antibody 30782
ARSSWTGWDYFDY

SEQ ID NO: 61565 - protein, 9 aa, Homo sapiens
  light chain complementarity determining region 3 for antibody 30783
QQDGSSHIT

SEQ ID NO: 61566 - protein, 23 aa, Homo sapiens
  heavy chain complementarity determining region 3 for antibody 30783
AKDGLESYYDSSGTNLAYWYFDL

SEQ ID NO: 61567 - protein, 9 aa, Homo sapiens
  light chain complementarity determining region 3 for antibody 30784
QQDGSPWWT

SEQ ID NO: 61568 - protein, 15 aa, Homo sapiens
  heavy chain complementarity determining region 3 for antibody 30784
ARHMARDSIGYYHDF

SEQ ID NO: 61569 - protein, 9 aa, Homo sapiens
  light chain complementarity determining region 3 for antibody 30785
QQDGSLPLT

SEQ ID NO: 61570 - protein, 15 aa, Homo sapiens
  heavy chain complementarity determining region 3 for antibody 30785
AHRPNCYDKAGAFDI

SEQ ID NO: 61571 - protein, 9 aa, Homo sapiens
  light chain complementarity determining region 3 for antibody 30786
QQDGSFPPT

SEQ ID NO: 61572 - protein, 17 aa, Homo sapiens
  heavy chain complementarity determining region 3 for antibody 30786
ARGLMERWLVPLYYFDL

SEQ ID NO: 61573 - protein, 6 aa, Homo sapiens
  light chain complementarity determining region 3 for antibody 30787
QQDGRT

SEQ ID NO: 61574 - protein, 12 aa, Homo sapiens
  heavy chain complementarity determining region 3 for antibody 30787
ARFANSWYPYDF

SEQ ID NO: 61575 - protein, 9 aa, Homo sapiens
  light chain complementarity determining region 3 for antibody 30788
QQDGRSPST

SEQ ID NO: 61576 - protein, 17 aa, Homo sapiens
  heavy chain complementarity determining region 3 for antibody 30788
AGLSSRLGDGSPSLFDY

SEQ ID NO: 61577 - protein, 9 aa, Homo sapiens
  light chain complementarity determining region 3 for antibody 30789
QQDGRIPRT

SEQ ID NO: 61578 - protein, 14 aa, Homo sapiens
  heavy chain complementarity determining region 3 for antibody 30789
AGGKFCGGDCYREY

SEQ ID NO: 61579 - protein, 9 aa, Homo sapiens
  light chain complementarity determining region 3 for antibody 30790
QQDGNSLWT

SEQ ID NO: 61580 - protein, 15 aa, Homo sapiens
  heavy chain complementarity determining region 3 for antibody 30790
VTARIVVIIPRHFDY

SEQ ID NO: 61581 - protein, 8 aa, Homo sapiens
  light chain complementarity determining region 3 for antibody 30791
QQDGIPRT

SEQ ID NO: 61582 - protein, 15 aa, Homo sapiens
  heavy chain complementarity determining region 3 for antibody 30791
AREVTTYYIYYGLDV

SEQ ID NO: 61583 - protein, 9 aa, Homo sapiens
  light chain complementarity determining region 3 for antibody 30792
QQDGGSSST

SEQ ID NO: 61584 - protein, 16 aa, Homo sapiens
  heavy chain complementarity determining region 3 for antibody 30792
ANWFGSVGDFLGPFDY

SEQ ID NO: 61585 - protein, 10 aa, Homo sapiens
  light chain complementarity determining region 3 for antibody 30793
QQDGGSPGWT

SEQ ID NO: 61586 - protein, 14 aa, Homo sapiens
  heavy chain complementarity determining region 3 for antibody 30793
ARHGGWRLLEPLDY

SEQ ID NO: 61587 - protein, 10 aa, Homo sapiens
  light chain complementarity determining region 3 for antibody 30794
QQDGGSPAVT

SEQ ID NO: 61588 - protein, 12 aa, Homo sapiens
  heavy chain complementarity determining region 3 for antibody 30794
AKAKIRIIYFDY

SEQ ID NO: 61589 - protein, 9 aa, Homo sapiens
  light chain complementarity determining region 3 for antibody 30795
QQDGGAPRT

SEQ ID NO: 61590 - protein, 17 aa, Homo sapiens
  heavy chain complementarity determining region 3 for antibody 30795
ARASTRDWQSGGRFFDS

SEQ ID NO: 61591 - protein, 6 aa, Homo sapiens
  light chain complementarity determining region 3 for antibody 30796
QQDGET

SEQ ID NO: 61592 - protein, 12 aa, Homo sapiens
  heavy chain complementarity determining region 3 for antibody 30796
ARDHSSGWSLSN

SEQ ID NO: 61593 - protein, 11 aa, Homo sapiens
  light chain complementarity determining region 3 for antibody 30797
QQDETSPPGST

SEQ ID NO: 61594 - protein, 14 aa, Homo sapiens
  heavy chain complementarity determining region 3 for antibody 30797
ARENSISRKRSFDQ

SEQ ID NO: 61595 - protein, 9 aa, Homo sapiens
  light chain complementarity determining region 3 for antibody 30798
QQDDTYPPT

SEQ ID NO: 61596 - protein, 16 aa, Homo sapiens
  heavy chain complementarity determining region 3 for antibody 30798
ARRSSPGSLGIRWFDP

SEQ ID NO: 61597 - protein, 9 aa, Homo sapiens
  light chain complementarity determining region 3 for antibody 30799
QQDDSSPFT

SEQ ID NO: 61598 - protein, 17 aa, Homo sapiens
  heavy chain complementarity determining region 3 for antibody 30799
ARERGSSWYSGAEHFQY

SEQ ID NO: 61599 - protein, 9 aa, Homo sapiens
  light chain complementarity determining region 3 for antibody 30800
QQDDSSPFT

SEQ ID NO: 61600 - protein, 17 aa, Homo sapiens
  heavy chain complementarity determining region 3 for antibody 30800
ARDRGSSWYSCAEHFQY

SEQ ID NO: 61601 - protein, 9 aa, Homo sapiens
  light chain complementarity determining region 3 for antibody 30801
QQDDSLPYT

SEQ ID NO: 61602 - protein, 17 aa, Homo sapiens
  heavy chain complementarity determining region 3 for antibody 30801
ARSRGYSRGWYSGQFDN

SEQ ID NO: 61603 - protein, 9 aa, Homo sapiens
  light chain complementarity determining region 3 for antibody 30802
QQDDSLPIT

SEQ ID NO: 61604 - protein, 20 aa, Homo sapiens
  heavy chain complementarity determining region 3 for antibody 30802
TRGPHVVVLTSIPWRWSLGL

SEQ ID NO: 61605 - protein, 9 aa, Homo sapiens
  light chain complementarity determining region 3 for antibody 30803
QQDDSLPIT

SEQ ID NO: 61606 - protein, 20 aa, Homo sapiens
  heavy chain complementarity determining region 3 for antibody 30803
TRGPHIVVLASIPWRWSLGL

SEQ ID NO: 61607 - protein, 9 aa, Homo sapiens
  light chain complementarity determining region 3 for antibody 30804
QQDDSLPIT

SEQ ID NO: 61608 - protein, 20 aa, Homo sapiens
  heavy chain complementarity determining region 3 for antibody 30804
ARGPHIVVLTSSPWRWSFGL

SEQ ID NO: 61609 - protein, 9 aa, Homo sapiens
  light chain complementarity determining region 3 for antibody 30805
QQDDSLPIT

SEQ ID NO: 61610 - protein, 20 aa, Homo sapiens
  heavy chain complementarity determining region 3 for antibody 30805
ARGPHIVVLTSIPWRWAFGL

SEQ ID NO: 61611 - protein, 11 aa, Homo sapiens
  light chain complementarity determining region 3 for antibody 30806
QQDDRSPPGFT

SEQ ID NO: 61612 - protein, 14 aa, Homo sapiens
  heavy chain complementarity determining region 3 for antibody 30806
ARETHNSRKRSFDQ

SEQ ID NO: 61613 - protein, 9 aa, Homo sapiens
  light chain complementarity determining region 3 for antibody 30807
QQDDISPMT

SEQ ID NO: 61614 - protein, 16 aa, Homo sapiens
  heavy chain complementarity determining region 3 for antibody 30807
AREAKDYGDYVDAFDV

SEQ ID NO: 61615 - protein, 9 aa, Homo sapiens
  light chain complementarity determining region 3 for antibody 30808
QQCYSTPYT

SEQ ID NO: 61616 - protein, 12 aa, Homo sapiens
  heavy chain complementarity determining region 3 for antibody 30808
ARRLGVSGSYHN

SEQ ID NO: 61617 - protein, 9 aa, Homo sapiens
  light chain complementarity determining region 3 for antibody 30809
QQCYSTPWT

SEQ ID NO: 61618 - protein, 15 aa, Homo sapiens
  heavy chain complementarity determining region 3 for antibody 30809
ASRYSSGWYYYGMDV

SEQ ID NO: 61619 - protein, 9 aa, Homo sapiens
  light chain complementarity determining region 3 for antibody 30810
QQCYSIPRS

SEQ ID NO: 61620 - protein, 12 aa, Homo sapiens
  heavy chain complementarity determining region 3 for antibody 30810
TTLVFAESGFDY

SEQ ID NO: 61621 - protein, 10 aa, Homo sapiens
  light chain complementarity determining region 3 for antibody 30811
QQCTNSPPWT

SEQ ID NO: 61622 - protein, 14 aa, Homo sapiens
  heavy chain complementarity determining region 3 for antibody 30811
ASLAYGATQDAFDL

SEQ ID NO: 61623 - protein, 10 aa, Homo sapiens
  light chain complementarity determining region 3 for antibody 30812
QQCTNSPPWR

SEQ ID NO: 61624 - protein, 14 aa, Homo sapiens
  heavy chain complementarity determining region 3 for antibody 30812
ASLAYGANQDAFDL

SEQ ID NO: 61625 - protein, 10 aa, Homo sapiens
  light chain complementarity determining region 3 for antibody 30813
QQCTNSPPGT

SEQ ID NO: 61626 - protein, 14 aa, Homo sapiens
  heavy chain complementarity determining region 3 for antibody 30813
ASLAYGANQDAFDL

SEQ ID NO: 61627 - protein, 10 aa, Homo sapiens
  light chain complementarity determining region 3 for antibody 30814
QQCTNSPPGR

SEQ ID NO: 61628 - protein, 14 aa, Homo sapiens
  heavy chain complementarity determining region 3 for antibody 30814
ASLAYGANQDAFDL

SEQ ID NO: 61629 - protein, 9 aa, Homo sapiens
  light chain complementarity determining region 3 for antibody 30815
QQCSSSPWT

SEQ ID NO: 61630 - protein, 13 aa, Homo sapiens
  heavy chain complementarity determining region 3 for antibody 30815
ARGSTNWRNWFDP

SEQ ID NO: 61631 - protein, 9 aa, Homo sapiens
  light chain complementarity determining region 3 for antibody 30816
QQCNSLPTT

SEQ ID NO: 61632 - protein, 20 aa, Homo sapiens
  heavy chain complementarity determining region 3 for antibody 30816
ARDPTGYGDYVPLYFYGMDV

SEQ ID NO: 61633 - protein, 9 aa, Homo sapiens
  light chain complementarity determining region 3 for antibody 30817
QQCLSLPYT

SEQ ID NO: 61634 - protein, 15 aa, Homo sapiens
  heavy chain complementarity determining region 3 for antibody 30817
SRLKGSAGWYHNIDF

SEQ ID NO: 61635 - protein, 9 aa, Homo sapiens
  light chain complementarity determining region 3 for antibody 30818
QQCLSLPST

SEQ ID NO: 61636 - protein, 15 aa, Homo sapiens
  heavy chain complementarity determining region 3 for antibody 30818
SRLKGSAGWYHKIDF

SEQ ID NO: 61637 - protein, 9 aa, Homo sapiens
  light chain complementarity determining region 3 for antibody 30819
QQCLILPYT

SEQ ID NO: 61638 - protein, 15 aa, Homo sapiens
  heavy chain complementarity determining region 3 for antibody 30819
SRLKGSAGWYHKIDF

SEQ ID NO: 61639 - protein, 9 aa, Homo sapiens
  light chain complementarity determining region 3 for antibody 30820
QQCKSWPLT

SEQ ID NO: 61640 - protein, 11 aa, Homo sapiens
  heavy chain complementarity determining region 3 for antibody 30820
AAAPRWLAFDS

SEQ ID NO: 61641 - protein, 9 aa, Homo sapiens
  light chain complementarity determining region 3 for antibody 30821
QQCKSWPLS

SEQ ID NO: 61642 - protein, 11 aa, Homo sapiens
  heavy chain complementarity determining region 3 for antibody 30821
AAATRWLAFDS

SEQ ID NO: 61643 - protein, 9 aa, Homo sapiens
  light chain complementarity determining region 3 for antibody 30822
QQCKRWPLT

SEQ ID NO: 61644 - protein, 11 aa, Homo sapiens
  heavy chain complementarity determining region 3 for antibody 30822
AAATRWLAFDS

SEQ ID NO: 61645 - protein, 10 aa, Homo sapiens
  light chain complementarity determining region 3 for antibody 30823
QQCHTFSRVT

SEQ ID NO: 61646 - protein, 17 aa, Homo sapiens
  heavy chain complementarity determining region 3 for antibody 30823
ARTRVTGGHLRRGAFDI

SEQ ID NO: 61647 - protein, 9 aa, Homo sapiens
  light chain complementarity determining region 3 for antibody 30824
QQCHNWPWT

SEQ ID NO: 61648 - protein, 17 aa, Homo sapiens
  heavy chain complementarity determining region 3 for antibody 30824
VVPQFSRTDWPTEPSDY

SEQ ID NO: 61649 - protein, 9 aa, Homo sapiens
  light chain complementarity determining region 3 for antibody 30825
QQCGTIPRT

SEQ ID NO: 61650 - protein, 13 aa, Homo sapiens
  heavy chain complementarity determining region 3 for antibody 30825
AGGLFDSSGYSEF

SEQ ID NO: 61651 - protein, 9 aa, Homo sapiens
  light chain complementarity determining region 3 for antibody 30826
QQCGSTWWT

SEQ ID NO: 61652 - protein, 15 aa, Homo sapiens
  heavy chain complementarity determining region 3 for antibody 30826
ARHMARDSIGYYHDF

SEQ ID NO: 61653 - protein, 9 aa, Homo sapiens
  light chain complementarity determining region 3 for antibody 30827
QQCGSSPRT

SEQ ID NO: 61654 - protein, 15 aa, Homo sapiens
  heavy chain complementarity determining region 3 for antibody 30827
ARANGVIITTGVLRY

SEQ ID NO: 61655 - protein, 10 aa, Homo sapiens
  light chain complementarity determining region 3 for antibody 30828
QQCGSSPLFT

SEQ ID NO: 61656 - protein, 15 aa, Homo sapiens
  heavy chain complementarity determining region 3 for antibody 30828
TTAGYSYGYRFFFDY

SEQ ID NO: 61657 - protein, 9 aa, Homo sapiens
  light chain complementarity determining region 3 for antibody 30829
QQCGNLPRT

SEQ ID NO: 61658 - protein, 13 aa, Homo sapiens
  heavy chain complementarity determining region 3 for antibody 30829
AGGNFHSGGYGEY

SEQ ID NO: 61659 - protein, 9 aa, Homo sapiens
  light chain complementarity determining region 3 for antibody 30830
QQCFSLPYT

SEQ ID NO: 61660 - protein, 15 aa, Homo sapiens
  heavy chain complementarity determining region 3 for antibody 30830
SRLKGSAGWYHKIDF

SEQ ID NO: 61661 - protein, 10 aa, Homo sapiens
  light chain complementarity determining region 3 for antibody 30831
QQCFRTPGYT

SEQ ID NO: 61662 - protein, 11 aa, Homo sapiens
  heavy chain complementarity determining region 3 for antibody 30831
AKTYNSGWFDY

SEQ ID NO: 61663 - protein, 11 aa, Homo sapiens
  light chain complementarity determining region 3 for antibody 30832
QQCETSPPMYP

SEQ ID NO: 61664 - protein, 23 aa, Homo sapiens
  heavy chain complementarity determining region 3 for antibody 30832
ARASRGYRRSDSRMEFFFYGLDV

SEQ ID NO: 61665 - protein, 11 aa, Homo sapiens
  light chain complementarity determining region 3 for antibody 30833
QQCETSPPMFP

SEQ ID NO: 61666 - protein, 23 aa, Homo sapiens
  heavy chain complementarity determining region 3 for antibody 30833
ARASRGYRRSDSRMEFFFYGLDV

SEQ ID NO: 61667 - protein, 9 aa, Homo sapiens
  light chain complementarity determining region 3 for antibody 30834
QQCDTLPRT

SEQ ID NO: 61668 - protein, 19 aa, Homo sapiens
  heavy chain complementarity determining region 3 for antibody 30834
ARDIQVFLGELSYQYGIDV

SEQ ID NO: 61669 - protein, 9 aa, Homo sapiens
  light chain complementarity determining region 3 for antibody 30835
QQCATAPPT

SEQ ID NO: 61670 - protein, 10 aa, Homo sapiens
  heavy chain complementarity determining region 3 for antibody 30835
AWGFGWSSDY

SEQ ID NO: 61671 - protein, 9 aa, Homo sapiens
  light chain complementarity determining region 3 for antibody 30836
QQAYSSPFT

SEQ ID NO: 61672 - protein, 15 aa, Homo sapiens
  heavy chain complementarity determining region 3 for antibody 30836
ARVLLEGQLGRALDY

SEQ ID NO: 61673 - protein, 9 aa, Homo sapiens
  light chain complementarity determining region 3 for antibody 30837
QQAYSFPFT

SEQ ID NO: 61674 - protein, 15 aa, Homo sapiens
  heavy chain complementarity determining region 3 for antibody 30837
TRVLLEGQLGRALDY

SEQ ID NO: 61675 - protein, 9 aa, Homo sapiens
  light chain complementarity determining region 3 for antibody 30838
QQAYSFPFT

SEQ ID NO: 61676 - protein, 15 aa, Homo sapiens
  heavy chain complementarity determining region 3 for antibody 30838
ARALLEGQLGRALDY

SEQ ID NO: 61677 - protein, 9 aa, Homo sapiens
  light chain complementarity determining region 3 for antibody 30839
QQATSLPPT

SEQ ID NO: 61678 - protein, 22 aa, Homo sapiens
  heavy chain complementarity determining region 3 for antibody 30839
AKTSLEYCTGGGATCSDKWFGP

SEQ ID NO: 61679 - protein, 9 aa, Homo sapiens
  light chain complementarity determining region 3 for antibody 30840
QQASDVPLT

SEQ ID NO: 61680 - protein, 9 aa, Homo sapiens
  heavy chain complementarity determining region 3 for antibody 30840
VCLGVTPPV

SEQ ID NO: 61681 - protein, 9 aa, Homo sapiens
  light chain complementarity determining region 3 for antibody 30841
QQANTLPLT

SEQ ID NO: 61682 - protein, 20 aa, Homo sapiens
  heavy chain complementarity determining region 3 for antibody 30841
ARDSNTPTLSDYDYHYGMDV

SEQ ID NO: 61683 - protein, 9 aa, Homo sapiens
  light chain complementarity determining region 3 for antibody 30842
QQANTFPPT

SEQ ID NO: 61684 - protein, 20 aa, Homo sapiens
  heavy chain complementarity determining region 3 for antibody 30842
ARDSNTPTLSDYDYHYGMDV

SEQ ID NO: 61685 - protein, 9 aa, Homo sapiens
  light chain complementarity determining region 3 for antibody 30843
QQANTFPLT

SEQ ID NO: 61686 - protein, 20 aa, Homo sapiens
  heavy chain complementarity determining region 3 for antibody 30843
ARDSNTPTLSEYDYHYGMDV

SEQ ID NO: 61687 - protein, 9 aa, Homo sapiens
  light chain complementarity determining region 3 for antibody 30844
QQANSSPPT

SEQ ID NO: 61688 - protein, 17 aa, Homo sapiens
  heavy chain complementarity determining region 3 for antibody 30844
ARDPIVGASIPFYGMDV

SEQ ID NO: 61689 - protein, 9 aa, Homo sapiens
  light chain complementarity determining region 3 for antibody 30845
QQANSLPQT

SEQ ID NO: 61690 - protein, 15 aa, Homo sapiens
  heavy chain complementarity determining region 3 for antibody 30845
ARGGYGGSLYWYFDL

SEQ ID NO: 61691 - protein, 9 aa, Homo sapiens
  light chain complementarity determining region 3 for antibody 30846
QQANSFVFT

SEQ ID NO: 61692 - protein, 16 aa, Homo sapiens
  heavy chain complementarity determining region 3 for antibody 30846
AGDGIVVVTATPGFDY

SEQ ID NO: 61693 - protein, 9 aa, Homo sapiens
  light chain complementarity determining region 3 for antibody 30847
QQANSFPYT

SEQ ID NO: 61694 - protein, 14 aa, Homo sapiens
  heavy chain complementarity determining region 3 for antibody 30847
ATSVLTPSDNWFDP

SEQ ID NO: 61695 - protein, 9 aa, Homo sapiens
  light chain complementarity determining region 3 for antibody 30848
QQANSFPRT

SEQ ID NO: 61696 - protein, 15 aa, Homo sapiens
  heavy chain complementarity determining region 3 for antibody 30848
ARGAPHLGVWHAFDI

SEQ ID NO: 61697 - protein, 9 aa, Homo sapiens
  light chain complementarity determining region 3 for antibody 30849
QQANSFPQT

SEQ ID NO: 61698 - protein, 15 aa, Homo sapiens
  heavy chain complementarity determining region 3 for antibody 30849
ARGGYGGSLYRYFDL

SEQ ID NO: 61699 - protein, 9 aa, Homo sapiens
  light chain complementarity determining region 3 for antibody 30850
QQANSFPQT

SEQ ID NO: 61700 - protein, 15 aa, Homo sapiens
  heavy chain complementarity determining region 3 for antibody 30850
ARGGSGGSLYWYFDL

SEQ ID NO: 61701 - protein, 9 aa, Homo sapiens
  light chain complementarity determining region 3 for antibody 30851
QQANSFPQP

SEQ ID NO: 61702 - protein, 15 aa, Homo sapiens
  heavy chain complementarity determining region 3 for antibody 30851
ARGGYGGSLYWYFDL

SEQ ID NO: 61703 - protein, 9 aa, Homo sapiens
  light chain complementarity determining region 3 for antibody 30852
QQANSFPPP

SEQ ID NO: 61704 - protein, 17 aa, Homo sapiens
  heavy chain complementarity determining region 3 for antibody 30852
ARDPIVGASIPFYGMDV

SEQ ID NO: 61705 - protein, 9 aa, Homo sapiens
  light chain complementarity determining region 3 for antibody 30853
QQANSFPLT

SEQ ID NO: 61706 - protein, 15 aa, Homo sapiens
  heavy chain complementarity determining region 3 for antibody 30853
AREGDCLSTTCYYDY

SEQ ID NO: 61707 - protein, 9 aa, Homo sapiens
  light chain complementarity determining region 3 for antibody 30854
QQANSFPLT

SEQ ID NO: 61708 - protein, 13 aa, Homo sapiens
  heavy chain complementarity determining region 3 for antibody 30854
ARDRGYSGYDFGY

SEQ ID NO: 61709 - protein, 9 aa, Homo sapiens
  light chain complementarity determining region 3 for antibody 30855
QQANSFPIT

SEQ ID NO: 61710 - protein, 15 aa, Homo sapiens
  heavy chain complementarity determining region 3 for antibody 30855
VREGDCLSTTCYYDY

SEQ ID NO: 61711 - protein, 9 aa, Homo sapiens
  light chain complementarity determining region 3 for antibody 30856
QQANSFPIT

SEQ ID NO: 61712 - protein, 15 aa, Homo sapiens
  heavy chain complementarity determining region 3 for antibody 30856
AREGDCLSTPCYYDY

SEQ ID NO: 61713 - protein, 9 aa, Homo sapiens
  light chain complementarity determining region 3 for antibody 30857
QQANSFPFT

SEQ ID NO: 61714 - protein, 18 aa, Homo sapiens
  heavy chain complementarity determining region 3 for antibody 30857
AKEGSGMGLATRYWYFDV

SEQ ID NO: 61715 - protein, 9 aa, Homo sapiens
  light chain complementarity determining region 3 for antibody 30858
QQANSFLIT

SEQ ID NO: 61716 - protein, 16 aa, Homo sapiens
  heavy chain complementarity determining region 3 for antibody 30858
ARISRLDAIYYDGMDV

SEQ ID NO: 61717 - protein, 11 aa, Homo sapiens
  light chain complementarity determining region 3 for antibody 30859
QQANSFLGGLT

SEQ ID NO: 61718 - protein, 17 aa, Homo sapiens
  heavy chain complementarity determining region 3 for antibody 30859
TRDRIRAVAYYYYGMDV

SEQ ID NO: 61719 - protein, 11 aa, Homo sapiens
  light chain complementarity determining region 3 for antibody 30860
QQANSFLGGFT

SEQ ID NO: 61720 - protein, 16 aa, Homo sapiens
  heavy chain complementarity determining region 3 for antibody 30860
TRDRIRAVAYYYGMDV

SEQ ID NO: 61721 - protein, 11 aa, Homo sapiens
  light chain complementarity determining region 3 for antibody 30861
QQANSFLGGFP

SEQ ID NO: 61722 - protein, 17 aa, Homo sapiens
  heavy chain complementarity determining region 3 for antibody 30861
TRDRIRAVAYYYYGMDV

SEQ ID NO: 61723 - protein, 11 aa, Homo sapiens
  light chain complementarity determining region 3 for antibody 30862
QQANSFLGGFI

SEQ ID NO: 61724 - protein, 17 aa, Homo sapiens
  heavy chain complementarity determining region 3 for antibody 30862
TRDRIRAVAYYYYGMDV

SEQ ID NO: 61725 - protein, 9 aa, Homo sapiens
  light chain complementarity determining region 3 for antibody 30863
QQANSFLFT

SEQ ID NO: 61726 - protein, 16 aa, Homo sapiens
  heavy chain complementarity determining region 3 for antibody 30863
ARISRLDAIYYYGMDV

SEQ ID NO: 61727 - protein, 9 aa, Homo sapiens
  light chain complementarity determining region 3 for antibody 30864
QQALTFPIT

SEQ ID NO: 61728 - protein, 11 aa, Homo sapiens
  heavy chain complementarity determining region 3 for antibody 30864
ARDAPGIGIDY

SEQ ID NO: 61729 - protein, 9 aa, Homo sapiens
  light chain complementarity determining region 3 for antibody 30865
QQAHSLPQT

SEQ ID NO: 61730 - protein, 17 aa, Homo sapiens
  heavy chain complementarity determining region 3 for antibody 30865
AREDYSSYGGRFRGFDI

SEQ ID NO: 61731 - protein, 9 aa, Homo sapiens
  light chain complementarity determining region 3 for antibody 30866
QQAHSLPPT

SEQ ID NO: 61732 - protein, 17 aa, Homo sapiens
  heavy chain complementarity determining region 3 for antibody 30866
AREDYSSYGGRLRGFDI

SEQ ID NO: 61733 - protein, 9 aa, Homo sapiens
  light chain complementarity determining region 3 for antibody 30867
QQADSLPIT

SEQ ID NO: 61734 - protein, 20 aa, Homo sapiens
  heavy chain complementarity determining region 3 for antibody 30867
ARGPHIVVLTSIPWRWSFGL

SEQ ID NO: 61735 - protein, 11 aa, Homo sapiens
  light chain complementarity determining region 3 for antibody 30868
QPYYSTPTMNT

SEQ ID NO: 61736 - protein, 14 aa, Homo sapiens
  heavy chain complementarity determining region 3 for antibody 30868
ARDIVGAHPYYFDY

SEQ ID NO: 61737 - protein, 9 aa, Homo sapiens
  light chain complementarity determining region 3 for antibody 30869
QPYYSSPPT

SEQ ID NO: 61738 - protein, 13 aa, Homo sapiens
  heavy chain complementarity determining region 3 for antibody 30869
ARQAYGSGSYYNV

SEQ ID NO: 61739 - protein, 8 aa, Homo sapiens
  light chain complementarity determining region 3 for antibody 30870
QPYYSMFT

SEQ ID NO: 61740 - protein, 17 aa, Homo sapiens
  heavy chain complementarity determining region 3 for antibody 30870
ARFKSSSWYRAPYYFDY

SEQ ID NO: 61741 - protein, 9 aa, Homo sapiens
  light chain complementarity determining region 3 for antibody 30871
QPYYNIPVT

SEQ ID NO: 61742 - protein, 18 aa, Homo sapiens
  heavy chain complementarity determining region 3 for antibody 30871
ARDLGGCGGNFCSYYFDI

SEQ ID NO: 61743 - protein, 9 aa, Homo sapiens
  light chain complementarity determining region 3 for antibody 30872
QPYYITPRT

SEQ ID NO: 61744 - protein, 8 aa, Homo sapiens
  heavy chain complementarity determining region 3 for antibody 30872
ARDGAFDS

SEQ ID NO: 61745 - protein, 10 aa, Homo sapiens
  light chain complementarity determining region 3 for antibody 30873
QPYYGPPPFT

SEQ ID NO: 61746 - protein, 14 aa, Homo sapiens
  heavy chain complementarity determining region 3 for antibody 30873
AKDLLKLWGSCSGD

SEQ ID NO: 61747 - protein, 9 aa, Homo sapiens
  light chain complementarity determining region 3 for antibody 30874
QPYVTYPIT

SEQ ID NO: 61748 - protein, 13 aa, Homo sapiens
  heavy chain complementarity determining region 3 for antibody 30874
GRGGYTSSWYWVY

SEQ ID NO: 61749 - protein, 8 aa, Homo sapiens
  light chain complementarity determining region 3 for antibody 30875
QPYVRSLT

SEQ ID NO: 61750 - protein, 15 aa, Homo sapiens
  heavy chain complementarity determining region 3 for antibody 30875
ARGGLPLRRNGYFDS

SEQ ID NO: 61751 - protein, 9 aa, Homo sapiens
  light chain complementarity determining region 3 for antibody 30876
QPYSSYPKT

SEQ ID NO: 61752 - protein, 10 aa, Homo sapiens
  heavy chain complementarity determining region 3 for antibody 30876
ATSQLWFEAH

SEQ ID NO: 61753 - protein, 9 aa, Homo sapiens
  light chain complementarity determining region 3 for antibody 30877
QPYSSSLIT

SEQ ID NO: 61754 - protein, 12 aa, Homo sapiens
  heavy chain complementarity determining region 3 for antibody 30877
ARDYVAGDAFDV

SEQ ID NO: 61755 - protein, 10 aa, Homo sapiens
  light chain complementarity determining region 3 for antibody 30878
QPYSISPKWT

SEQ ID NO: 61756 - protein, 17 aa, Homo sapiens
  heavy chain complementarity determining region 3 for antibody 30878
ARDPCKKATDVVCAWDS

SEQ ID NO: 61757 - protein, 9 aa, Homo sapiens
  light chain complementarity determining region 3 for antibody 30879
QPYNTWPRT

SEQ ID NO: 61758 - protein, 22 aa, Homo sapiens
  heavy chain complementarity determining region 3 for antibody 30879
AREVRASGYDDFYNYYYYGLDV

SEQ ID NO: 61759 - protein, 8 aa, Homo sapiens
  light chain complementarity determining region 3 for antibody 30880
QPYNSYST

SEQ ID NO: 61760 - protein, 16 aa, Homo sapiens
  heavy chain complementarity determining region 3 for antibody 30880
ARDGLPLTSKPYYFDY

SEQ ID NO: 61761 - protein, 9 aa, Homo sapiens
  light chain complementarity determining region 3 for antibody 30881
QPYNSYSRT

SEQ ID NO: 61762 - protein, 16 aa, Homo sapiens
  heavy chain complementarity determining region 3 for antibody 30881
AAGVGMGRGISTTFDY

SEQ ID NO: 61763 - protein, 10 aa, Homo sapiens
  light chain complementarity determining region 3 for antibody 30882
QPYNSYSHST

SEQ ID NO: 61764 - protein, 18 aa, Homo sapiens
  heavy chain complementarity determining region 3 for antibody 30882
ARGAGTGYSSNWKIPAGW

SEQ ID NO: 61765 - protein, 8 aa, Homo sapiens
  light chain complementarity determining region 3 for antibody 30883
QPYNSPWT

SEQ ID NO: 61766 - protein, 17 aa, Homo sapiens
  heavy chain complementarity determining region 3 for antibody 30883
AREKMWELRPGPDAFDI

SEQ ID NO: 61767 - protein, 9 aa, Homo sapiens
  light chain complementarity determining region 3 for antibody 30884
QPYNSIPWT

SEQ ID NO: 61768 - protein, 14 aa, Homo sapiens
  heavy chain complementarity determining region 3 for antibody 30884
TKCAYNYGNDAFDV

SEQ ID NO: 61769 - protein, 10 aa, Homo sapiens
  light chain complementarity determining region 3 for antibody 30885
QPYNRYYPWT

SEQ ID NO: 61770 - protein, 13 aa, Homo sapiens
  heavy chain complementarity determining region 3 for antibody 30885
AAGSYVSLADFDY

SEQ ID NO: 61771 - protein, 10 aa, Homo sapiens
  light chain complementarity determining region 3 for antibody 30886
QPYNRYYPWT

SEQ ID NO: 61772 - protein, 13 aa, Homo sapiens
  heavy chain complementarity determining region 3 for antibody 30886
AADSYVSLAYFDY

SEQ ID NO: 61773 - protein, 10 aa, Homo sapiens
  light chain complementarity determining region 3 for antibody 30887
QPYNRYYPWP

SEQ ID NO: 61774 - protein, 13 aa, Homo sapiens
  heavy chain complementarity determining region 3 for antibody 30887
AADSYVSLADFDY

SEQ ID NO: 61775 - protein, 10 aa, Homo sapiens
  light chain complementarity determining region 3 for antibody 30888
QPYNRSYPWT

SEQ ID NO: 61776 - protein, 13 aa, Homo sapiens
  heavy chain complementarity determining region 3 for antibody 30888
AADSYVSLADFDY

SEQ ID NO: 61777 - protein, 9 aa, Homo sapiens
  light chain complementarity determining region 3 for antibody 30889
QPYNNWPRT

SEQ ID NO: 61778 - protein, 11 aa, Homo sapiens
  heavy chain complementarity determining region 3 for antibody 30889
ARLRYQGYFDV

SEQ ID NO: 61779 - protein, 10 aa, Homo sapiens
  light chain complementarity determining region 3 for antibody 30890
QPYNNWLGWT

SEQ ID NO: 61780 - protein, 13 aa, Homo sapiens
  heavy chain complementarity determining region 3 for antibody 30890
ARHGRRSGWYYTY

SEQ ID NO: 61781 - protein, 9 aa, Homo sapiens
  light chain complementarity determining region 3 for antibody 30891
QPYLTTPPT

SEQ ID NO: 61782 - protein, 13 aa, Homo sapiens
  heavy chain complementarity determining region 3 for antibody 30891
VKDPDFNYGSWVS

SEQ ID NO: 61783 - protein, 9 aa, Homo sapiens
  light chain complementarity determining region 3 for antibody 30892
QPYISYPWT

SEQ ID NO: 61784 - protein, 19 aa, Homo sapiens
  heavy chain complementarity determining region 3 for antibody 30892
ARVSARRILTAPRYPLIDS

SEQ ID NO: 61785 - protein, 9 aa, Homo sapiens
  light chain complementarity determining region 3 for antibody 30893
QPYGTYPWT

SEQ ID NO: 61786 - protein, 11 aa, Homo sapiens
  heavy chain complementarity determining region 3 for antibody 30893
THRLVWEGVGH

SEQ ID NO: 61787 - protein, 9 aa, Homo sapiens
  light chain complementarity determining region 3 for antibody 30894
QPYGTAPVT

SEQ ID NO: 61788 - protein, 14 aa, Homo sapiens
  heavy chain complementarity determining region 3 for antibody 30894
ARDLFRGIPDYLDY

SEQ ID NO: 61789 - protein, 7 aa, Homo sapiens
  light chain complementarity determining region 3 for antibody 30895
QPYGSWA

SEQ ID NO: 61790 - protein, 11 aa, Homo sapiens
  heavy chain complementarity determining region 3 for antibody 30895
AVVDTTLAMPK

SEQ ID NO: 61791 - protein, 9 aa, Homo sapiens
  light chain complementarity determining region 3 for antibody 30896
QPYGSTPST

SEQ ID NO: 61792 - protein, 14 aa, Homo sapiens
  heavy chain complementarity determining region 3 for antibody 30896
AREWVSTIRGWFDP

SEQ ID NO: 61793 - protein, 9 aa, Homo sapiens
  light chain complementarity determining region 3 for antibody 30897
QPYGSSPYT

SEQ ID NO: 61794 - protein, 17 aa, Homo sapiens
  heavy chain complementarity determining region 3 for antibody 30897
ARERTEVPGPMPADLDY

SEQ ID NO: 61795 - protein, 9 aa, Homo sapiens
  light chain complementarity determining region 3 for antibody 30898
QPYGSSPTT

SEQ ID NO: 61796 - protein, 17 aa, Homo sapiens
  heavy chain complementarity determining region 3 for antibody 30898
ARLGGSGWNRGHNWFDP

SEQ ID NO: 61797 - protein, 9 aa, Homo sapiens
  light chain complementarity determining region 3 for antibody 30899
QPYGSSPRT

SEQ ID NO: 61798 - protein, 13 aa, Homo sapiens
  heavy chain complementarity determining region 3 for antibody 30899
GKGYPNIYKVYDY

SEQ ID NO: 61799 - protein, 9 aa, Homo sapiens
  light chain complementarity determining region 3 for antibody 30900
QPYGSSPRT

SEQ ID NO: 61800 - protein, 25 aa, Homo sapiens
  heavy chain complementarity determining region 3 for antibody 30900
ARLRIDQLRLPGAMRGALYHCGMDV

SEQ ID NO: 61801 - protein, 9 aa, Homo sapiens
  light chain complementarity determining region 3 for antibody 30901
QPYGSSPRT

SEQ ID NO: 61802 - protein, 15 aa, Homo sapiens
  heavy chain complementarity determining region 3 for antibody 30901
AKDGPYCGSDCYFEF

SEQ ID NO: 61803 - protein, 10 aa, Homo sapiens
  light chain complementarity determining region 3 for antibody 30902
QPYGSSPPPT

SEQ ID NO: 61804 - protein, 20 aa, Homo sapiens
  heavy chain complementarity determining region 3 for antibody 30902
ARLRKQLVLSNVYYYYGMDV

SEQ ID NO: 61805 - protein, 9 aa, Homo sapiens
  light chain complementarity determining region 3 for antibody 30903
QPYGSSPLT

SEQ ID NO: 61806 - protein, 15 aa, Homo sapiens
  heavy chain complementarity determining region 3 for antibody 30903
AKDEGGWYSGDAFDI

SEQ ID NO: 61807 - protein, 9 aa, Homo sapiens
  light chain complementarity determining region 3 for antibody 30904
QPYGSSPGT

SEQ ID NO: 61808 - protein, 20 aa, Homo sapiens
  heavy chain complementarity determining region 3 for antibody 30904
ARVYKLSAFRGGGWYGAFDI

SEQ ID NO: 61809 - protein, 9 aa, Homo sapiens
  light chain complementarity determining region 3 for antibody 30905
QPYGSSPFT

SEQ ID NO: 61810 - protein, 21 aa, Homo sapiens
  heavy chain complementarity determining region 3 for antibody 30905
ARVGVERNRYGRTLPVWYFDY

SEQ ID NO: 61811 - protein, 9 aa, Homo sapiens
  light chain complementarity determining region 3 for antibody 30906
QPYGSSLYT

SEQ ID NO: 61812 - protein, 15 aa, Homo sapiens
  heavy chain complementarity determining region 3 for antibody 30906
ARLPEYSSSWYYFDF

SEQ ID NO: 61813 - protein, 9 aa, Homo sapiens
  light chain complementarity determining region 3 for antibody 30907
QPYGRSPRT

SEQ ID NO: 61814 - protein, 15 aa, Homo sapiens
  heavy chain complementarity determining region 3 for antibody 30907
AKDGEFCGSNCYFGS

SEQ ID NO: 61815 - protein, 9 aa, Homo sapiens
  light chain complementarity determining region 3 for antibody 30908
QPYGRLPIT

SEQ ID NO: 61816 - protein, 11 aa, Homo sapiens
  heavy chain complementarity determining region 3 for antibody 30908
AHRFRTYYFDF

SEQ ID NO: 61817 - protein, 9 aa, Homo sapiens
  light chain complementarity determining region 3 for antibody 30909
QPYGNSPWT

SEQ ID NO: 61818 - protein, 17 aa, Homo sapiens
  heavy chain complementarity determining region 3 for antibody 30909
ALASVAAPGRIQWYFDL

SEQ ID NO: 61819 - protein, 9 aa, Homo sapiens
  light chain complementarity determining region 3 for antibody 30910
QPYGNIPRT

SEQ ID NO: 61820 - protein, 14 aa, Homo sapiens
  heavy chain complementarity determining region 3 for antibody 30910
AGGTFDSSGYYYEY

SEQ ID NO: 61821 - protein, 6 aa, Homo sapiens
  light chain complementarity determining region 3 for antibody 30911
QPYGMT

SEQ ID NO: 61822 - protein, 12 aa, Homo sapiens
  heavy chain complementarity determining region 3 for antibody 30911
ARFANSWYPYDF

SEQ ID NO: 61823 - protein, 9 aa, Homo sapiens
  light chain complementarity determining region 3 for antibody 30912
QPYGGSTGT

SEQ ID NO: 61824 - protein, 15 aa, Homo sapiens
  heavy chain complementarity determining region 3 for antibody 30912
ARGGRGPGMAHCFDL

SEQ ID NO: 61825 - protein, 10 aa, Homo sapiens
  light chain complementarity determining region 3 for antibody 30913
QPYGDSPDVT

SEQ ID NO: 61826 - protein, 16 aa, Homo sapiens
  heavy chain complementarity determining region 3 for antibody 30913
ARDATFWFGEFTFFDH

SEQ ID NO: 61827 - protein, 9 aa, Homo sapiens
  light chain complementarity determining region 3 for antibody 30914
QPYFTSLRT

SEQ ID NO: 61828 - protein, 12 aa, Homo sapiens
  heavy chain complementarity determining region 3 for antibody 30914
VKDCGLGGSRDS

SEQ ID NO: 61829 - protein, 9 aa, Homo sapiens
  light chain complementarity determining region 3 for antibody 30915
QPYESSLWT

SEQ ID NO: 61830 - protein, 12 aa, Homo sapiens
  heavy chain complementarity determining region 3 for antibody 30915
ARDFGLYQEPDS

SEQ ID NO: 61831 - protein, 9 aa, Homo sapiens
  light chain complementarity determining region 3 for antibody 30916
QPYDLFRET

SEQ ID NO: 61832 - protein, 16 aa, Homo sapiens
  heavy chain complementarity determining region 3 for antibody 30916
ARWGVECSGGYCYFEY

SEQ ID NO: 61833 - protein, 9 aa, Homo sapiens
  light chain complementarity determining region 3 for antibody 30917
QPTYSTPLT

SEQ ID NO: 61834 - protein, 18 aa, Homo sapiens
  heavy chain complementarity determining region 3 for antibody 30917
ARSGRRDSSGFLVNWFDY

SEQ ID NO: 61835 - protein, 9 aa, Homo sapiens
  light chain complementarity determining region 3 for antibody 30918
QPSYSVPPT

SEQ ID NO: 61836 - protein, 13 aa, Homo sapiens
  heavy chain complementarity determining region 3 for antibody 30918
VRHAVVRPMVVDD

SEQ ID NO: 61837 - protein, 9 aa, Homo sapiens
  light chain complementarity determining region 3 for antibody 30919
QPSYSSVLT

SEQ ID NO: 61838 - protein, 16 aa, Homo sapiens
  heavy chain complementarity determining region 3 for antibody 30919
AREGGGTYTSSRAFDF

SEQ ID NO: 61839 - protein, 9 aa, Homo sapiens
  light chain complementarity determining region 3 for antibody 30920
QPSYSSTWT

SEQ ID NO: 61840 - protein, 6 aa, Homo sapiens
  heavy chain complementarity determining region 3 for antibody 30920
GSLFEY

SEQ ID NO: 61841 - protein, 8 aa, Homo sapiens
  light chain complementarity determining region 3 for antibody 30921
QPSYSSRA

SEQ ID NO: 61842 - protein, 13 aa, Homo sapiens
  heavy chain complementarity determining region 3 for antibody 30921
AMSSMGRGVSFVN

SEQ ID NO: 61843 - protein, 9 aa, Homo sapiens
  light chain complementarity determining region 3 for antibody 30922
QPSSDVPLT

SEQ ID NO: 61844 - protein, 9 aa, Homo sapiens
  heavy chain complementarity determining region 3 for antibody 30922
VCLGVTPPV

SEQ ID NO: 61845 - protein, 10 aa, Homo sapiens
  light chain complementarity determining region 3 for antibody 30923
QPRSNWPPYT

SEQ ID NO: 61846 - protein, 13 aa, Homo sapiens
  heavy chain complementarity determining region 3 for antibody 30923
ARVGQQRLRGFDI

SEQ ID NO: 61847 - protein, 10 aa, Homo sapiens
  light chain complementarity determining region 3 for antibody 30924
QPRSNWPPWT

SEQ ID NO: 61848 - protein, 13 aa, Homo sapiens
  heavy chain complementarity determining region 3 for antibody 30924
AREAFPPGGGLDY

SEQ ID NO: 61849 - protein, 9 aa, Homo sapiens
  light chain complementarity determining region 3 for antibody 30925
QPRSAWPLT

SEQ ID NO: 61850 - protein, 7 aa, Homo sapiens
  heavy chain complementarity determining region 3 for antibody 30925
VRDEWWP

SEQ ID NO: 61851 - protein, 9 aa, Homo sapiens
  light chain complementarity determining region 3 for antibody 30926
QPRRTWLYS

SEQ ID NO: 61852 - protein, 20 aa, Homo sapiens
  heavy chain complementarity determining region 3 for antibody 30926
ARDGSAGMAARGTPYYGLDV

SEQ ID NO: 61853 - protein, 8 aa, Homo sapiens
  light chain complementarity determining region 3 for antibody 30927
QPRHTRLS

SEQ ID NO: 61854 - protein, 11 aa, Homo sapiens
  heavy chain complementarity determining region 3 for antibody 30927
ASGSMGWVFDH

SEQ ID NO: 61855 - protein, 9 aa, Homo sapiens
  light chain complementarity determining region 3 for antibody 30928
QPRHNWPWT

SEQ ID NO: 61856 - protein, 17 aa, Homo sapiens
  heavy chain complementarity determining region 3 for antibody 30928
VVPQFSRTDWPTEPSDY

SEQ ID NO: 61857 - protein, 6 aa, Homo sapiens
  light chain complementarity determining region 3 for antibody 30929
QPNGRT

SEQ ID NO: 61858 - protein, 12 aa, Homo sapiens
  heavy chain complementarity determining region 3 for antibody 30929
AKLVNSWYPYDY

SEQ ID NO: 61859 - protein, 9 aa, Homo sapiens
  light chain complementarity determining region 3 for antibody 30930
QPLFSYPPT

SEQ ID NO: 61860 - protein, 14 aa, Homo sapiens
  heavy chain complementarity determining region 3 for antibody 30930
ARENSVTGTRAYDF

SEQ ID NO: 61861 - protein, 10 aa, Homo sapiens
  light chain complementarity determining region 3 for antibody 30931
QPGYGTPMYT

SEQ ID NO: 61862 - protein, 15 aa, Homo sapiens
  heavy chain complementarity determining region 3 for antibody 30931
ARFAESSRYYRPFDY

SEQ ID NO: 61863 - protein, 9 aa, Homo sapiens
  light chain complementarity determining region 3 for antibody 30932
QPGSTYPLT

SEQ ID NO: 61864 - protein, 20 aa, Homo sapiens
  heavy chain complementarity determining region 3 for antibody 30932
ARYPRREHNPGTTGYYSFDY

SEQ ID NO: 61865 - protein, 9 aa, Homo sapiens
  light chain complementarity determining region 3 for antibody 30933
QPGNRFPHT

SEQ ID NO: 61866 - protein, 14 aa, Homo sapiens
  heavy chain complementarity determining region 3 for antibody 30933
ARYCSGTRCYSMDY

SEQ ID NO: 61867 - protein, 9 aa, Homo sapiens
  light chain complementarity determining region 3 for antibody 30934
QPFGGSPLT

SEQ ID NO: 61868 - protein, 11 aa, Homo sapiens
  heavy chain complementarity determining region 3 for antibody 30934
ARKGTGAPFDY

SEQ ID NO: 61869 - protein, 9 aa, Homo sapiens
  light chain complementarity determining region 3 for antibody 30935
QPDVKSPWT

SEQ ID NO: 61870 - protein, 11 aa, Homo sapiens
  heavy chain complementarity determining region 3 for antibody 30935
AREDWPDGFDI

SEQ ID NO: 61871 - protein, 11 aa, Homo sapiens
  light chain complementarity determining region 3 for antibody 30936
QPANSFLGGFT

SEQ ID NO: 61872 - protein, 17 aa, Homo sapiens
  heavy chain complementarity determining region 3 for antibody 30936
TRDRIRAVAYYYYGMDV

SEQ ID NO: 61873 - protein, 10 aa, Homo sapiens
  light chain complementarity determining region 3 for antibody 30937
QNYVSPPAYT

SEQ ID NO: 61874 - protein, 12 aa, Homo sapiens
  heavy chain complementarity determining region 3 for antibody 30937
ARETTRFGELDY

SEQ ID NO: 61875 - protein, 10 aa, Homo sapiens
  light chain complementarity determining region 3 for antibody 30938
QNYNTALRFT

SEQ ID NO: 61876 - protein, 13 aa, Homo sapiens
  heavy chain complementarity determining region 3 for antibody 30938
AKVWFGESDAFDI

SEQ ID NO: 61877 - protein, 9 aa, Homo sapiens
  light chain complementarity determining region 3 for antibody 30939
QNYISYSYT

SEQ ID NO: 61878 - protein, 18 aa, Homo sapiens
  heavy chain complementarity determining region 3 for antibody 30939
ARDRYSCDSGGCFHWFDP

SEQ ID NO: 61879 - protein, 8 aa, Homo sapiens
  light chain complementarity determining region 3 for antibody 30940
QNYGSSGT

SEQ ID NO: 61880 - protein, 18 aa, Homo sapiens
  heavy chain complementarity determining region 3 for antibody 30940
TTGPPGARMVGASTPFHY

SEQ ID NO: 61881 - protein, 9 aa, Homo sapiens
  light chain complementarity determining region 3 for antibody 30941
QNYDDAPLT

SEQ ID NO: 61882 - protein, 11 aa, Homo sapiens
  heavy chain complementarity determining region 3 for antibody 30941
AKAGGSSWYHY

SEQ ID NO: 61883 - protein, 9 aa, Homo sapiens
  light chain complementarity determining region 3 for antibody 30942
QNCGSYPLA

SEQ ID NO: 61884 - protein, 11 aa, Homo sapiens
  heavy chain complementarity determining region 3 for antibody 30942
ARRGSNLHADY

SEQ ID NO: 61885 - protein, 9 aa, Homo sapiens
  light chain complementarity determining region 3 for antibody 30943
QNCGSSPLT

SEQ ID NO: 61886 - protein, 11 aa, Homo sapiens
  heavy chain complementarity determining region 3 for antibody 30943
ARRGSNLHADY

SEQ ID NO: 61887 - protein, 9 aa, Homo sapiens
  light chain complementarity determining region 3 for antibody 30944
QNCGSFPLT

SEQ ID NO: 61888 - protein, 11 aa, Homo sapiens
  heavy chain complementarity determining region 3 for antibody 30944
ARRGSNLHADY

SEQ ID NO: 61889 - protein, 9 aa, Homo sapiens
  light chain complementarity determining region 3 for antibody 30945
QLYVTSPWT

SEQ ID NO: 61890 - protein, 12 aa, Homo sapiens
  heavy chain complementarity determining region 3 for antibody 30945
SRGLRSGWGLDY

SEQ ID NO: 61891 - protein, 10 aa, Homo sapiens
  light chain complementarity determining region 3 for antibody 30946
QLYSSSPSIT

SEQ ID NO: 61892 - protein, 18 aa, Homo sapiens
  heavy chain complementarity determining region 3 for antibody 30946
ARARNPYGPNWYAYYFDL

SEQ ID NO: 61893 - protein, 10 aa, Homo sapiens
  light chain complementarity determining region 3 for antibody 30947
QLYSSSPRIT

SEQ ID NO: 61894 - protein, 18 aa, Homo sapiens
  heavy chain complementarity determining region 3 for antibody 30947
ARARNPYSPNWYAYYFDL

SEQ ID NO: 61895 - protein, 10 aa, Homo sapiens
  light chain complementarity determining region 3 for antibody 30948
QLYSRSPTWT

SEQ ID NO: 61896 - protein, 19 aa, Homo sapiens
  heavy chain complementarity determining region 3 for antibody 30948
ARESYYPDIGGYTPRAFDT

SEQ ID NO: 61897 - protein, 10 aa, Homo sapiens
  light chain complementarity determining region 3 for antibody 30949
QLYSRSPTWT

SEQ ID NO: 61898 - protein, 19 aa, Homo sapiens
  heavy chain complementarity determining region 3 for antibody 30949
ARESYYPDIGGYPPRAFDI

SEQ ID NO: 61899 - protein, 10 aa, Homo sapiens
  light chain complementarity determining region 3 for antibody 30950
QLYSRSPKWT

SEQ ID NO: 61900 - protein, 19 aa, Homo sapiens
  heavy chain complementarity determining region 3 for antibody 30950
ARESYYPDIGGYTPRAFDI

SEQ ID NO: 61901 - protein, 10 aa, Homo sapiens
  light chain complementarity determining region 3 for antibody 30951
QLYSRLPTWT

SEQ ID NO: 61902 - protein, 19 aa, Homo sapiens
  heavy chain complementarity determining region 3 for antibody 30951
ARESYYPDIGGYTPRAFDI

SEQ ID NO: 61903 - protein, 10 aa, Homo sapiens
  light chain complementarity determining region 3 for antibody 30952
QLYRRSPTWR

SEQ ID NO: 61904 - protein, 19 aa, Homo sapiens
  heavy chain complementarity determining region 3 for antibody 30952
ARESYYPDIGGYTPRAFDI

SEQ ID NO: 61905 - protein, 9 aa, Homo sapiens
  light chain complementarity determining region 3 for antibody 30953
QLYNTWPRT

SEQ ID NO: 61906 - protein, 22 aa, Homo sapiens
  heavy chain complementarity determining region 3 for antibody 30953
AREVRASGYDDFYNYYYYGLDV

SEQ ID NO: 61907 - protein, 10 aa, Homo sapiens
  light chain complementarity determining region 3 for antibody 30954
QLYNSYSLWS

SEQ ID NO: 61908 - protein, 13 aa, Homo sapiens
  heavy chain complementarity determining region 3 for antibody 30954
ARQGQWLIGGLDY

SEQ ID NO: 61909 - protein, 10 aa, Homo sapiens
  light chain complementarity determining region 3 for antibody 30955
QLYNSYSLCT

SEQ ID NO: 61910 - protein, 13 aa, Homo sapiens
  heavy chain complementarity determining region 3 for antibody 30955
ARQGQWLIGGLDY

SEQ ID NO: 61911 - protein, 9 aa, Homo sapiens
  light chain complementarity determining region 3 for antibody 30956
QLYNSDSWT

SEQ ID NO: 61912 - protein, 16 aa, Homo sapiens
  heavy chain complementarity determining region 3 for antibody 30956
AKDPFRYSRLSSYIDH

SEQ ID NO: 61913 - protein, 10 aa, Homo sapiens
  light chain complementarity determining region 3 for antibody 30957
QLYGSSPLYT

SEQ ID NO: 61914 - protein, 12 aa, Homo sapiens
  heavy chain complementarity determining region 3 for antibody 30957
ARPRYRSGFFDY

SEQ ID NO: 61915 - protein, 9 aa, Homo sapiens
  light chain complementarity determining region 3 for antibody 30958
QLYGSSLYT

SEQ ID NO: 61916 - protein, 9 aa, Homo sapiens
  heavy chain complementarity determining region 3 for antibody 30958
IYEINAFDI

SEQ ID NO: 61917 - protein, 9 aa, Homo sapiens
  light chain complementarity determining region 3 for antibody 30959
QLYGSSAGT

SEQ ID NO: 61918 - protein, 16 aa, Homo sapiens
  heavy chain complementarity determining region 3 for antibody 30959
ASGYCSSTSCHWGLDY

SEQ ID NO: 61919 - protein, 9 aa, Homo sapiens
  light chain complementarity determining region 3 for antibody 30960
QLYGSPAWT

SEQ ID NO: 61920 - protein, 16 aa, Homo sapiens
  heavy chain complementarity determining region 3 for antibody 30960
ASGYCSSTSCHWGLDY

SEQ ID NO: 61921 - protein, 9 aa, Homo sapiens
  light chain complementarity determining region 3 for antibody 30961
QLYGSLPLT

SEQ ID NO: 61922 - protein, 15 aa, Homo sapiens
  heavy chain complementarity determining region 3 for antibody 30961
AHRPNYYDKAGAFDI

SEQ ID NO: 61923 - protein, 10 aa, Homo sapiens
  light chain complementarity determining region 3 for antibody 30962
QLYGRSPTWT

SEQ ID NO: 61924 - protein, 19 aa, Homo sapiens
  heavy chain complementarity determining region 3 for antibody 30962
ARESYYPDIGGYTPRAFDI

SEQ ID NO: 61925 - protein, 11 aa, Homo sapiens
  light chain complementarity determining region 3 for antibody 30963
QLYGRSLPMYS

SEQ ID NO: 61926 - protein, 14 aa, Homo sapiens
  heavy chain complementarity determining region 3 for antibody 30963
ASHIVINGKRGFDH

SEQ ID NO: 61927 - protein, 11 aa, Homo sapiens
  light chain complementarity determining region 3 for antibody 30964
QLYETSPPGST

SEQ ID NO: 61928 - protein, 14 aa, Homo sapiens
  heavy chain complementarity determining region 3 for antibody 30964
AREHTISRKRSFDQ

SEQ ID NO: 61929 - protein, 11 aa, Homo sapiens
  light chain complementarity determining region 3 for antibody 30965
QLYETSPPGDT

SEQ ID NO: 61930 - protein, 14 aa, Homo sapiens
  heavy chain complementarity determining region 3 for antibody 30965
AREHTISRKRSFDQ

SEQ ID NO: 61931 - protein, 11 aa, Homo sapiens
  light chain complementarity determining region 3 for antibody 30966
QLYERSLPRYS

SEQ ID NO: 61932 - protein, 14 aa, Homo sapiens
  heavy chain complementarity determining region 3 for antibody 30966
ASHIVINGKRGFDH

SEQ ID NO: 61933 - protein, 11 aa, Homo sapiens
  light chain complementarity determining region 3 for antibody 30967
QLYERSLPMDS

SEQ ID NO: 61934 - protein, 14 aa, Homo sapiens
  heavy chain complementarity determining region 3 for antibody 30967
ASHIVINGKRGFDH

SEQ ID NO: 61935 - protein, 11 aa, Homo sapiens
  light chain complementarity determining region 3 for antibody 30968
QLYERSLPLYS

SEQ ID NO: 61936 - protein, 14 aa, Homo sapiens
  heavy chain complementarity determining region 3 for antibody 30968
ASHIVINGKRGFDH

SEQ ID NO: 61937 - protein, 10 aa, Homo sapiens
  light chain complementarity determining region 3 for antibody 30969
QLYDSSSPVP

SEQ ID NO: 61938 - protein, 13 aa, Homo sapiens
  heavy chain complementarity determining region 3 for antibody 30969
ATPGPILTAAYLI

SEQ ID NO: 61939 - protein, 11 aa, Homo sapiens
  light chain complementarity determining region 3 for antibody 30970
QLYDRSLPMYS

SEQ ID NO: 61940 - protein, 14 aa, Homo sapiens
  heavy chain complementarity determining region 3 for antibody 30970
ASHIVINGKRGFDH

SEQ ID NO: 61941 - protein, 11 aa, Homo sapiens
  light chain complementarity determining region 3 for antibody 30971
QLSYSNPHFFS

SEQ ID NO: 61942 - protein, 15 aa, Homo sapiens
  heavy chain complementarity determining region 3 for antibody 30971
ARASNLWEKTEAYEF

SEQ ID NO: 61943 - protein, 10 aa, Homo sapiens
  light chain complementarity determining region 3 for antibody 30972
QLRSNWPPVT

SEQ ID NO: 61944 - protein, 14 aa, Homo sapiens
  heavy chain complementarity determining region 3 for antibody 30972
ARDLSGVLIGAWSH

SEQ ID NO: 61945 - protein, 11 aa, Homo sapiens
  light chain complementarity determining region 3 for antibody 30973
QLRGNWPPTYT

SEQ ID NO: 61946 - protein, 22 aa, Homo sapiens
  heavy chain complementarity determining region 3 for antibody 30973
ATLRPRDVGFCSGGSCPCYFDY

SEQ ID NO: 61947 - protein, 11 aa, Homo sapiens
  light chain complementarity determining region 3 for antibody 30974
QLRGNWPPTNT

SEQ ID NO: 61948 - protein, 22 aa, Homo sapiens
  heavy chain complementarity determining region 3 for antibody 30974
ATLRPRDVGFCSGGSCPYYFDY

SEQ ID NO: 61949 - protein, 11 aa, Homo sapiens
  light chain complementarity determining region 3 for antibody 30975
QLRGNWPPTDT

SEQ ID NO: 61950 - protein, 22 aa, Homo sapiens
  heavy chain complementarity determining region 3 for antibody 30975
ATLRPRDVGFCSGGSCPYYFDY

SEQ ID NO: 61951 - protein, 11 aa, Homo sapiens
  light chain complementarity determining region 3 for antibody 30976
QLRGNWPPPYP

SEQ ID NO: 61952 - protein, 22 aa, Homo sapiens
  heavy chain complementarity determining region 3 for antibody 30976
ATLRPRDVGFCSGGSCPYYFDY

SEQ ID NO: 61953 - protein, 10 aa, Homo sapiens
  light chain complementarity determining region 3 for antibody 30977
QLHSRSPTWT

SEQ ID NO: 61954 - protein, 19 aa, Homo sapiens
  heavy chain complementarity determining region 3 for antibody 30977
ARESYYPDIGGYTPRAFDI

SEQ ID NO: 61955 - protein, 9 aa, Homo sapiens
  light chain complementarity determining region 3 for antibody 30978
QKYYTSVRT

SEQ ID NO: 61956 - protein, 12 aa, Homo sapiens
  heavy chain complementarity determining region 3 for antibody 30978
VKDCGLGGSRDS

SEQ ID NO: 61957 - protein, 9 aa, Homo sapiens
  light chain complementarity determining region 3 for antibody 30979
QKYYSAPLT

SEQ ID NO: 61958 - protein, 15 aa, Homo sapiens
  heavy chain complementarity determining region 3 for antibody 30979
ARDGGPYQVLLPFSD

SEQ ID NO: 61959 - protein, 11 aa, Homo sapiens
  light chain complementarity determining region 3 for antibody 30980
QKYSDWPTSFT

SEQ ID NO: 61960 - protein, 14 aa, Homo sapiens
  heavy chain complementarity determining region 3 for antibody 30980
ARASGSNVKMPFDF

SEQ ID NO: 61961 - protein, 8 aa, Homo sapiens
  light chain complementarity determining region 3 for antibody 30981
QKYRSSFP

SEQ ID NO: 61962 - protein, 13 aa, Homo sapiens
  heavy chain complementarity determining region 3 for antibody 30981
ATESGWYQGAFDI

SEQ ID NO: 61963 - protein, 9 aa, Homo sapiens
  light chain complementarity determining region 3 for antibody 30982
QKYNSVPLT

SEQ ID NO: 61964 - protein, 14 aa, Homo sapiens
  heavy chain complementarity determining region 3 for antibody 30982
ARPQTWDLLYAFDI

SEQ ID NO: 61965 - protein, 9 aa, Homo sapiens
  light chain complementarity determining region 3 for antibody 30983
QKYNSSPRT

SEQ ID NO: 61966 - protein, 10 aa, Homo sapiens
  heavy chain complementarity determining region 3 for antibody 30983
ARDRLGAFDI

SEQ ID NO: 61967 - protein, 9 aa, Homo sapiens
  light chain complementarity determining region 3 for antibody 30984
QKYNSGPLT

SEQ ID NO: 61968 - protein, 11 aa, Homo sapiens
  heavy chain complementarity determining region 3 for antibody 30984
ARLKLMSVGDY

SEQ ID NO: 61969 - protein, 9 aa, Homo sapiens
  light chain complementarity determining region 3 for antibody 30985
QKYNSDPRT

SEQ ID NO: 61970 - protein, 10 aa, Homo sapiens
  heavy chain complementarity determining region 3 for antibody 30985
ARDRLGAFDI

SEQ ID NO: 61971 - protein, 9 aa, Homo sapiens
  light chain complementarity determining region 3 for antibody 30986
QKYNSAQLT

SEQ ID NO: 61972 - protein, 17 aa, Homo sapiens
  heavy chain complementarity determining region 3 for antibody 30986
ARSDILTGFTTPGLRDV

SEQ ID NO: 61973 - protein, 9 aa, Homo sapiens
  light chain complementarity determining region 3 for antibody 30987
QKYNSAQLT

SEQ ID NO: 61974 - protein, 15 aa, Homo sapiens
  heavy chain complementarity determining region 3 for antibody 30987
ARRSNDFWSGYPPDY

SEQ ID NO: 61975 - protein, 9 aa, Homo sapiens
  light chain complementarity determining region 3 for antibody 30988
QKYNSAPWP

SEQ ID NO: 61976 - protein, 15 aa, Homo sapiens
  heavy chain complementarity determining region 3 for antibody 30988
AREGLYSNGWYYIDY

SEQ ID NO: 61977 - protein, 9 aa, Homo sapiens
  light chain complementarity determining region 3 for antibody 30989
QKYNSAPST

SEQ ID NO: 61978 - protein, 17 aa, Homo sapiens
  heavy chain complementarity determining region 3 for antibody 30989
VTNGPGPVEAPYGYFDY

SEQ ID NO: 61979 - protein, 10 aa, Homo sapiens
  light chain complementarity determining region 3 for antibody 30990
QKYNSAPPWP

SEQ ID NO: 61980 - protein, 14 aa, Homo sapiens
  heavy chain complementarity determining region 3 for antibody 30990
AKGEKWLSSGAFDI

SEQ ID NO: 61981 - protein, 9 aa, Homo sapiens
  light chain complementarity determining region 3 for antibody 30991
QKYNSAPLT

SEQ ID NO: 61982 - protein, 17 aa, Homo sapiens
  heavy chain complementarity determining region 3 for antibody 30991
ARSDILAGFTTPGLRDV

SEQ ID NO: 61983 - protein, 9 aa, Homo sapiens
  light chain complementarity determining region 3 for antibody 30992
QKYNSAPLT

SEQ ID NO: 61984 - protein, 14 aa, Homo sapiens
  heavy chain complementarity determining region 3 for antibody 30992
ARPQTWDLLYAFDM

SEQ ID NO: 61985 - protein, 9 aa, Homo sapiens
  light chain complementarity determining region 3 for antibody 30993
QKYNSAPLT

SEQ ID NO: 61986 - protein, 23 aa, Homo sapiens
  heavy chain complementarity determining region 3 for antibody 30993
ARGRTYYFPGSGYPDYSFYLMDI

SEQ ID NO: 61987 - protein, 9 aa, Homo sapiens
  light chain complementarity determining region 3 for antibody 30994
QKYNSAPLT

SEQ ID NO: 61988 - protein, 23 aa, Homo sapiens
  heavy chain complementarity determining region 3 for antibody 30994
ARGRTYYFPGSGYPDYFFYPMDI

SEQ ID NO: 61989 - protein, 9 aa, Homo sapiens
  light chain complementarity determining region 3 for antibody 30995
QKYNSAPLT

SEQ ID NO: 61990 - protein, 19 aa, Homo sapiens
  heavy chain complementarity determining region 3 for antibody 30995
ARGLHDMENGFPPHDGFDL

SEQ ID NO: 61991 - protein, 9 aa, Homo sapiens
  light chain complementarity determining region 3 for antibody 30996
QKYNSAPLP

SEQ ID NO: 61992 - protein, 17 aa, Homo sapiens
  heavy chain complementarity determining region 3 for antibody 30996
ARSDILTGFTTPGLRDV

SEQ ID NO: 61993 - protein, 9 aa, Homo sapiens
  light chain complementarity determining region 3 for antibody 30997
QKYNSAPFT

SEQ ID NO: 61994 - protein, 16 aa, Homo sapiens
  heavy chain complementarity determining region 3 for antibody 30997
AKGVAADGRKSYYFDY

SEQ ID NO: 61995 - protein, 9 aa, Homo sapiens
  light chain complementarity determining region 3 for antibody 30998
QKYNRAQLT

SEQ ID NO: 61996 - protein, 15 aa, Homo sapiens
  heavy chain complementarity determining region 3 for antibody 30998
ARRSNDFWSGYHPDY

SEQ ID NO: 61997 - protein, 9 aa, Homo sapiens
  light chain complementarity determining region 3 for antibody 30999
QKYNRAPWT

SEQ ID NO: 61998 - protein, 14 aa, Homo sapiens
  heavy chain complementarity determining region 3 for antibody 30999
AKSSGTTVTTSFDY

SEQ ID NO: 61999 - protein, 9 aa, Homo sapiens
  light chain complementarity determining region 3 for antibody 31000
QKYNNVPLT

SEQ ID NO: 62000 - protein, 14 aa, Homo sapiens
  heavy chain complementarity determining region 3 for antibody 31000
ARPQTWDLLYAFDM

SEQ ID NO: 62001 - protein, 9 aa, Homo sapiens
  light chain complementarity determining region 3 for antibody 31001
QKYNIVPLT

SEQ ID NO: 62002 - protein, 14 aa, Homo sapiens
  heavy chain complementarity determining region 3 for antibody 31001
ARPQTWDLLYAFDM

SEQ ID NO: 62003 - protein, 9 aa, Homo sapiens
  light chain complementarity determining region 3 for antibody 31002
QKYNGAPWT

SEQ ID NO: 62004 - protein, 14 aa, Homo sapiens
  heavy chain complementarity determining region 3 for antibody 31002
AKSSGTTVTTSFDY

SEQ ID NO: 62005 - protein, 9 aa, Homo sapiens
  light chain complementarity determining region 3 for antibody 31003
QKYGTSPFT

SEQ ID NO: 62006 - protein, 9 aa, Homo sapiens
  heavy chain complementarity determining region 3 for antibody 31003
ARGAGSLSY

SEQ ID NO: 62007 - protein, 9 aa, Homo sapiens
  light chain complementarity determining region 3 for antibody 31004
QKYGTAPVT

SEQ ID NO: 62008 - protein, 14 aa, Homo sapiens
  heavy chain complementarity determining region 3 for antibody 31004
ARDLFRGIPDYLDY

SEQ ID NO: 62009 - protein, 9 aa, Homo sapiens
  light chain complementarity determining region 3 for antibody 31005
QKYGSSPQT

SEQ ID NO: 62010 - protein, 11 aa, Homo sapiens
  heavy chain complementarity determining region 3 for antibody 31005
ARGDLWSAFDI

SEQ ID NO: 62011 - protein, 9 aa, Homo sapiens
  light chain complementarity determining region 3 for antibody 31006
QKYGSSPPT

SEQ ID NO: 62012 - protein, 12 aa, Homo sapiens
  heavy chain complementarity determining region 3 for antibody 31006
ARGPQLWFYFDY

SEQ ID NO: 62013 - protein, 8 aa, Homo sapiens
  light chain complementarity determining region 3 for antibody 31007
QKYGSSPP

SEQ ID NO: 62014 - protein, 14 aa, Homo sapiens
  heavy chain complementarity determining region 3 for antibody 31007
ARDMWDVGDTPPSY

SEQ ID NO: 62015 - protein, 10 aa, Homo sapiens
  light chain complementarity determining region 3 for antibody 31008
QKYGSSPMYS

SEQ ID NO: 62016 - protein, 11 aa, Homo sapiens
  heavy chain complementarity determining region 3 for antibody 31008
ARGGQWGSLDY

SEQ ID NO: 62017 - protein, 9 aa, Homo sapiens
  light chain complementarity determining region 3 for antibody 31009
QKYGRAPYT

SEQ ID NO: 62018 - protein, 13 aa, Homo sapiens
  heavy chain complementarity determining region 3 for antibody 31009
AKGLADYKDALDI

SEQ ID NO: 62019 - protein, 9 aa, Homo sapiens
  light chain complementarity determining region 3 for antibody 31010
QKYGNIPRT

SEQ ID NO: 62020 - protein, 14 aa, Homo sapiens
  heavy chain complementarity determining region 3 for antibody 31010
AGGTFDSSGYYYEY

SEQ ID NO: 62021 - protein, 9 aa, Homo sapiens
  light chain complementarity determining region 3 for antibody 31011
QKYGLSPET

SEQ ID NO: 62022 - protein, 15 aa, Homo sapiens
  heavy chain complementarity determining region 3 for antibody 31011
AFRGIQVVNGVRFDY

SEQ ID NO: 62023 - protein, 8 aa, Homo sapiens
  light chain complementarity determining region 3 for antibody 31012
QKYGGSPS

SEQ ID NO: 62024 - protein, 16 aa, Homo sapiens
  heavy chain complementarity determining region 3 for antibody 31012
ATDWGSGTQWIRAFDV

SEQ ID NO: 62025 - protein, 9 aa, Homo sapiens
  light chain complementarity determining region 3 for antibody 31013
QKYDTVPFN

SEQ ID NO: 62026 - protein, 17 aa, Homo sapiens
  heavy chain complementarity determining region 3 for antibody 31013
ARDRIYGSEDHNPPLKS

SEQ ID NO: 62027 - protein, 11 aa, Homo sapiens
  light chain complementarity determining region 3 for antibody 31014
QKYDTGPPGLP

SEQ ID NO: 62028 - protein, 11 aa, Homo sapiens
  heavy chain complementarity determining region 3 for antibody 31014
ASARGGTYFDY

SEQ ID NO: 62029 - protein, 9 aa, Homo sapiens
  light chain complementarity determining region 3 for antibody 31015
QKYDSAPLT

SEQ ID NO: 62030 - protein, 15 aa, Homo sapiens
  heavy chain complementarity determining region 3 for antibody 31015
ARDGVPYQVLLPFSD

SEQ ID NO: 62031 - protein, 9 aa, Homo sapiens
  light chain complementarity determining region 3 for antibody 31016
QKYDSAPLP

SEQ ID NO: 62032 - protein, 15 aa, Homo sapiens
  heavy chain complementarity determining region 3 for antibody 31016
ARDGGPYQVFLPFSD

SEQ ID NO: 62033 - protein, 11 aa, Homo sapiens
  light chain complementarity determining region 3 for antibody 31017
QKYDNSALEFT

SEQ ID NO: 62034 - protein, 15 aa, Homo sapiens
  heavy chain complementarity determining region 3 for antibody 31017
VREVVTMIEPGGFDV

SEQ ID NO: 62035 - protein, 9 aa, Homo sapiens
  light chain complementarity determining region 3 for antibody 31018
QKYDNFPVT

SEQ ID NO: 62036 - protein, 16 aa, Homo sapiens
  heavy chain complementarity determining region 3 for antibody 31018
ARGFYPVVVIGAILRF

SEQ ID NO: 62037 - protein, 9 aa, Homo sapiens
  light chain complementarity determining region 3 for antibody 31019
QKYDGFPPT

SEQ ID NO: 62038 - protein, 14 aa, Homo sapiens
  heavy chain complementarity determining region 3 for antibody 31019
TSPMYFYDGSGIDH

SEQ ID NO: 62039 - protein, 9 aa, Homo sapiens
  light chain complementarity determining region 3 for antibody 31020
QKYDGCPPT

SEQ ID NO: 62040 - protein, 14 aa, Homo sapiens
  heavy chain complementarity determining region 3 for antibody 31020
TSPMYFYDGSGIDH

SEQ ID NO: 62041 - protein, 9 aa, Homo sapiens
  light chain complementarity determining region 3 for antibody 31021
QKYDGAPLT

SEQ ID NO: 62042 - protein, 15 aa, Homo sapiens
  heavy chain complementarity determining region 3 for antibody 31021
ARDGGPYQVLLPFSD

SEQ ID NO: 62043 - protein, 9 aa, Homo sapiens
  light chain complementarity determining region 3 for antibody 31022
QKYAYSPIT

SEQ ID NO: 62044 - protein, 10 aa, Homo sapiens
  heavy chain complementarity determining region 3 for antibody 31022
ATGAGWLVDY

SEQ ID NO: 62045 - protein, 9 aa, Homo sapiens
  light chain complementarity determining region 3 for antibody 31023
QKYATSPLT

SEQ ID NO: 62046 - protein, 10 aa, Homo sapiens
  heavy chain complementarity determining region 3 for antibody 31023
TTGGGWLVDY

SEQ ID NO: 62047 - protein, 8 aa, Homo sapiens
  light chain complementarity determining region 3 for antibody 31024
QKVNSYPR

SEQ ID NO: 62048 - protein, 20 aa, Homo sapiens
  heavy chain complementarity determining region 3 for antibody 31024
ARDGAVIAPRTRGPGFYFDS

SEQ ID NO: 62049 - protein, 9 aa, Homo sapiens
  light chain complementarity determining region 3 for antibody 31025
QKNNSVPPT

SEQ ID NO: 62050 - protein, 14 aa, Homo sapiens
  heavy chain complementarity determining region 3 for antibody 31025
ARDPSYGGFYYFDS

SEQ ID NO: 62051 - protein, 9 aa, Homo sapiens
  light chain complementarity determining region 3 for antibody 31026
QKNNSAPWT

SEQ ID NO: 62052 - protein, 15 aa, Homo sapiens
  heavy chain complementarity determining region 3 for antibody 31026
AREGLYSNGWYYIDY

SEQ ID NO: 62053 - protein, 9 aa, Homo sapiens
  light chain complementarity determining region 3 for antibody 31027
QKNNSAPLT

SEQ ID NO: 62054 - protein, 14 aa, Homo sapiens
  heavy chain complementarity determining region 3 for antibody 31027
ARGGFIVAWGLFDY

SEQ ID NO: 62055 - protein, 9 aa, Homo sapiens
  light chain complementarity determining region 3 for antibody 31028
QKNNSAPLP

SEQ ID NO: 62056 - protein, 17 aa, Homo sapiens
  heavy chain complementarity determining region 3 for antibody 31028
ARSDILTGFTTPGLRDV

SEQ ID NO: 62057 - protein, 9 aa, Homo sapiens
  light chain complementarity determining region 3 for antibody 31029
QKNDTVPFT

SEQ ID NO: 62058 - protein, 17 aa, Homo sapiens
  heavy chain complementarity determining region 3 for antibody 31029
ARDRIYGSEDHNPPLKS

SEQ ID NO: 62059 - protein, 9 aa, Homo sapiens
  light chain complementarity determining region 3 for antibody 31030
QKLNSYPIT

SEQ ID NO: 62060 - protein, 22 aa, Homo sapiens
  heavy chain complementarity determining region 3 for antibody 31030
AREPHSSSSQTQHYYYYYGMDV

SEQ ID NO: 62061 - protein, 9 aa, Homo sapiens
  light chain complementarity determining region 3 for antibody 31031
QKHNSGPFT

SEQ ID NO: 62062 - protein, 11 aa, Homo sapiens
  heavy chain complementarity determining region 3 for antibody 31031
ARLKLMSVGDY

SEQ ID NO: 62063 - protein, 9 aa, Homo sapiens
  light chain complementarity determining region 3 for antibody 31032
QKHDTYPWT

SEQ ID NO: 62064 - protein, 17 aa, Homo sapiens
  heavy chain complementarity determining region 3 for antibody 31032
ARQRRAKWERQTEAFDI

SEQ ID NO: 62065 - protein, 9 aa, Homo sapiens
  light chain complementarity determining region 3 for antibody 31033
QKGSTYPLT

SEQ ID NO: 62066 - protein, 20 aa, Homo sapiens
  heavy chain complementarity determining region 3 for antibody 31033
ARYPRREHNPGTTGYYSFDY

SEQ ID NO: 62067 - protein, 9 aa, Homo sapiens
  light chain complementarity determining region 3 for antibody 31034
QKGNRFPHT

SEQ ID NO: 62068 - protein, 14 aa, Homo sapiens
  heavy chain complementarity determining region 3 for antibody 31034
ARYCSGTRCYSMDY

SEQ ID NO: 62069 - protein, 10 aa, Homo sapiens
  light chain complementarity determining region 3 for antibody 31035
QKFGNSPLYT

SEQ ID NO: 62070 - protein, 23 aa, Homo sapiens
  heavy chain complementarity determining region 3 for antibody 31035
ARGRREYFWGSYRNAPYYYGMEI

SEQ ID NO: 62071 - protein, 9 aa, Homo sapiens
  light chain complementarity determining region 3 for antibody 31036
QKDGSLPRP

SEQ ID NO: 62072 - protein, 13 aa, Homo sapiens
  heavy chain complementarity determining region 3 for antibody 31036
ARGEYVSGNYEEN

SEQ ID NO: 62073 - protein, 9 aa, Homo sapiens
  light chain complementarity determining region 3 for antibody 31037
QKANSFPQT

SEQ ID NO: 62074 - protein, 15 aa, Homo sapiens
  heavy chain complementarity determining region 3 for antibody 31037
ARGGYGGSLYWYFDL

SEQ ID NO: 62075 - protein, 9 aa, Homo sapiens
  light chain complementarity determining region 3 for antibody 31038
QHYYTSVRP

SEQ ID NO: 62076 - protein, 12 aa, Homo sapiens
  heavy chain complementarity determining region 3 for antibody 31038
VKDCGLGGSRDF

SEQ ID NO: 62077 - protein, 9 aa, Homo sapiens
  light chain complementarity determining region 3 for antibody 31039
QHYYTPPRT

SEQ ID NO: 62078 - protein, 8 aa, Homo sapiens
  heavy chain complementarity determining region 3 for antibody 31039
ARDGAFDS

SEQ ID NO: 62079 - protein, 9 aa, Homo sapiens
  light chain complementarity determining region 3 for antibody 31040
QHYYTFVRT

SEQ ID NO: 62080 - protein, 12 aa, Homo sapiens
  heavy chain complementarity determining region 3 for antibody 31040
VKDCGLGGSRDF

SEQ ID NO: 62081 - protein, 9 aa, Homo sapiens
  light chain complementarity determining region 3 for antibody 31041
QHYYTFLRT

SEQ ID NO: 62082 - protein, 12 aa, Homo sapiens
  heavy chain complementarity determining region 3 for antibody 31041
VKDCGLGGSRDS

SEQ ID NO: 62083 - protein, 9 aa, Homo sapiens
  light chain complementarity determining region 3 for antibody 31042
QHYYSYPWT

SEQ ID NO: 62084 - protein, 17 aa, Homo sapiens
  heavy chain complementarity determining region 3 for antibody 31042
ANFIYDGLTGHPRPCDY

SEQ ID NO: 62085 - protein, 9 aa, Homo sapiens
  light chain complementarity determining region 3 for antibody 31043
QHYYSYPWT

SEQ ID NO: 62086 - protein, 17 aa, Homo sapiens
  heavy chain complementarity determining region 3 for antibody 31043
AKFIYDGLTGHPRPWDY

SEQ ID NO: 62087 - protein, 9 aa, Homo sapiens
  light chain complementarity determining region 3 for antibody 31044
QHYYSTPWT

SEQ ID NO: 62088 - protein, 10 aa, Homo sapiens
  heavy chain complementarity determining region 3 for antibody 31044
STPSRVGAKF

SEQ ID NO: 62089 - protein, 9 aa, Homo sapiens
  light chain complementarity determining region 3 for antibody 31045
QHYYSTPWT

SEQ ID NO: 62090 - protein, 14 aa, Homo sapiens
  heavy chain complementarity determining region 3 for antibody 31045
ARGLHYDFWSGSLP

SEQ ID NO: 62091 - protein, 9 aa, Homo sapiens
  light chain complementarity determining region 3 for antibody 31046
QHYYSSPFT

SEQ ID NO: 62092 - protein, 14 aa, Homo sapiens
  heavy chain complementarity determining region 3 for antibody 31046
AMTTVTSVAWYFDL

SEQ ID NO: 62093 - protein, 9 aa, Homo sapiens
  light chain complementarity determining region 3 for antibody 31047
QHYYNYSYT

SEQ ID NO: 62094 - protein, 16 aa, Homo sapiens
  heavy chain complementarity determining region 3 for antibody 31047
ARHGARCSGGNCYFDS

SEQ ID NO: 62095 - protein, 9 aa, Homo sapiens
  light chain complementarity determining region 3 for antibody 31048
QHYYITPGT

SEQ ID NO: 62096 - protein, 10 aa, Homo sapiens
  heavy chain complementarity determining region 3 for antibody 31048
STPSRVGAKF

SEQ ID NO: 62097 - protein, 10 aa, Homo sapiens
  light chain complementarity determining region 3 for antibody 31049
QHYVSQPAYT

SEQ ID NO: 62098 - protein, 12 aa, Homo sapiens
  heavy chain complementarity determining region 3 for antibody 31049
ARETTRFGELDY

SEQ ID NO: 62099 - protein, 10 aa, Homo sapiens
  light chain complementarity determining region 3 for antibody 31050
QHYVSPPTYT

SEQ ID NO: 62100 - protein, 12 aa, Homo sapiens
  heavy chain complementarity determining region 3 for antibody 31050
ARETTRFGELDY

SEQ ID NO: 62101 - protein, 10 aa, Homo sapiens
  light chain complementarity determining region 3 for antibody 31051
QHYVSPPSYT

SEQ ID NO: 62102 - protein, 12 aa, Homo sapiens
  heavy chain complementarity determining region 3 for antibody 31051
ARETTRFGELDY

SEQ ID NO: 62103 - protein, 10 aa, Homo sapiens
  light chain complementarity determining region 3 for antibody 31052
QHYVRPPAYT

SEQ ID NO: 62104 - protein, 12 aa, Homo sapiens
  heavy chain complementarity determining region 3 for antibody 31052
ARETTRFGELDY

SEQ ID NO: 62105 - protein, 9 aa, Homo sapiens
  light chain complementarity determining region 3 for antibody 31053
QHYTTYPPT

SEQ ID NO: 62106 - protein, 15 aa, Homo sapiens
  heavy chain complementarity determining region 3 for antibody 31053
AKDYGDYVIYWYLDV

SEQ ID NO: 62107 - protein, 9 aa, Homo sapiens
  light chain complementarity determining region 3 for antibody 31054
QHYTTPMYT

SEQ ID NO: 62108 - protein, 12 aa, Homo sapiens
  heavy chain complementarity determining region 3 for antibody 31054
AREPPETCYFDY

SEQ ID NO: 62109 - protein, 9 aa, Homo sapiens
  light chain complementarity determining region 3 for antibody 31055
QHYSVIPWA

SEQ ID NO: 62110 - protein, 14 aa, Homo sapiens
  heavy chain complementarity determining region 3 for antibody 31055
AKCGHSYGNDAFDI

SEQ ID NO: 62111 - protein, 9 aa, Homo sapiens
  light chain complementarity determining region 3 for antibody 31056
QHYSTYPWT

SEQ ID NO: 62112 - protein, 16 aa, Homo sapiens
  heavy chain complementarity determining region 3 for antibody 31056
ARVRYPISADNRVVDH

SEQ ID NO: 62113 - protein, 9 aa, Homo sapiens
  light chain complementarity determining region 3 for antibody 31057
QHYSTYPWP

SEQ ID NO: 62114 - protein, 16 aa, Homo sapiens
  heavy chain complementarity determining region 3 for antibody 31057
ARVRYPISADNRVVDH

SEQ ID NO: 62115 - protein, 9 aa, Homo sapiens
  light chain complementarity determining region 3 for antibody 31058
QHYSSSHTT

SEQ ID NO: 62116 - protein, 13 aa, Homo sapiens
  heavy chain complementarity determining region 3 for antibody 31058
AKNYGPGTPYFDY

SEQ ID NO: 62117 - protein, 9 aa, Homo sapiens
  light chain complementarity determining region 3 for antibody 31059
QHYSSSHNT

SEQ ID NO: 62118 - protein, 13 aa, Homo sapiens
  heavy chain complementarity determining region 3 for antibody 31059
AKKYGPGTPYFDY

SEQ ID NO: 62119 - protein, 9 aa, Homo sapiens
  light chain complementarity determining region 3 for antibody 31060
QHYSSSHNP

SEQ ID NO: 62120 - protein, 13 aa, Homo sapiens
  heavy chain complementarity determining region 3 for antibody 31060
AKNYGPGTPYFDY

SEQ ID NO: 62121 - protein, 9 aa, Homo sapiens
  light chain complementarity determining region 3 for antibody 31061
QHYSSSHIT

SEQ ID NO: 62122 - protein, 13 aa, Homo sapiens
  heavy chain complementarity determining region 3 for antibody 31061
AKNYGPGTPYFDY

SEQ ID NO: 62123 - protein, 9 aa, Homo sapiens
  light chain complementarity determining region 3 for antibody 31062
QHYSHWPHP

SEQ ID NO: 62124 - protein, 12 aa, Homo sapiens
  heavy chain complementarity determining region 3 for antibody 31062
VRKPPGNHHYDY

SEQ ID NO: 62125 - protein, 11 aa, Homo sapiens
  light chain complementarity determining region 3 for antibody 31063
QHYSGSPPTYP

SEQ ID NO: 62126 - protein, 10 aa, Homo sapiens
  heavy chain complementarity determining region 3 for antibody 31063
ASSGWNGFDF

SEQ ID NO: 62127 - protein, 11 aa, Homo sapiens
  light chain complementarity determining region 3 for antibody 31064
QHYSGSPPTSP

SEQ ID NO: 62128 - protein, 10 aa, Homo sapiens
  heavy chain complementarity determining region 3 for antibody 31064
ASSGWNGFDF

SEQ ID NO: 62129 - protein, 11 aa, Homo sapiens
  light chain complementarity determining region 3 for antibody 31065
QHYSGSPPPYT

SEQ ID NO: 62130 - protein, 10 aa, Homo sapiens
  heavy chain complementarity determining region 3 for antibody 31065
ASSGWNGFDF

SEQ ID NO: 62131 - protein, 9 aa, Homo sapiens
  light chain complementarity determining region 3 for antibody 31066
QHYSDFPGA

SEQ ID NO: 62132 - protein, 14 aa, Homo sapiens
  heavy chain complementarity determining region 3 for antibody 31066
AKCGHSYGNDAFDI

SEQ ID NO: 62133 - protein, 9 aa, Homo sapiens
  light chain complementarity determining region 3 for antibody 31067
QHYRGDPYS

SEQ ID NO: 62134 - protein, 20 aa, Homo sapiens
  heavy chain complementarity determining region 3 for antibody 31067
ARDVDYCENGVCYSYWYFDL

SEQ ID NO: 62135 - protein, 7 aa, Homo sapiens
  light chain complementarity determining region 3 for antibody 31068
QHYQTWS

SEQ ID NO: 62136 - protein, 17 aa, Homo sapiens
  heavy chain complementarity determining region 3 for antibody 31068
ARAFLHDSSDRSGYIDY

SEQ ID NO: 62137 - protein, 9 aa, Homo sapiens
  light chain complementarity determining region 3 for antibody 31069
QHYQGYPFT

SEQ ID NO: 62138 - protein, 21 aa, Homo sapiens
  heavy chain complementarity determining region 3 for antibody 31069
VRGPGGEAPAGSETYYYPMDL

SEQ ID NO: 62139 - protein, 8 aa, Homo sapiens
  light chain complementarity determining region 3 for antibody 31070
QHYNYYYS

SEQ ID NO: 62140 - protein, 12 aa, Homo sapiens
  heavy chain complementarity determining region 3 for antibody 31070
VREQGPHKSFDY

SEQ ID NO: 62141 - protein, 8 aa, Homo sapiens
  light chain complementarity determining region 3 for antibody 31071
QHYNYSYT

SEQ ID NO: 62142 - protein, 12 aa, Homo sapiens
  heavy chain complementarity determining region 3 for antibody 31071
VREQGPHKSFDY

SEQ ID NO: 62143 - protein, 10 aa, Homo sapiens
  light chain complementarity determining region 3 for antibody 31072
QHYNSYSHST

SEQ ID NO: 62144 - protein, 18 aa, Homo sapiens
  heavy chain complementarity determining region 3 for antibody 31072
ARGAGTGYSSNWKIPAGS

SEQ ID NO: 62145 - protein, 10 aa, Homo sapiens
  light chain complementarity determining region 3 for antibody 31073
QHYNSYSHST

SEQ ID NO: 62146 - protein, 18 aa, Homo sapiens
  heavy chain complementarity determining region 3 for antibody 31073
ARGAGAGYSSNWKIPAGW

SEQ ID NO: 62147 - protein, 8 aa, Homo sapiens
  light chain complementarity determining region 3 for antibody 31074
QHYNSYRS

SEQ ID NO: 62148 - protein, 18 aa, Homo sapiens
  heavy chain complementarity determining region 3 for antibody 31074
IVDQDDSYVSGWFGYLRH

SEQ ID NO: 62149 - protein, 9 aa, Homo sapiens
  light chain complementarity determining region 3 for antibody 31075
QHYNSYPYT

SEQ ID NO: 62150 - protein, 19 aa, Homo sapiens
  heavy chain complementarity determining region 3 for antibody 31075
AKGDDDSCGYTYYCRGLDV

SEQ ID NO: 62151 - protein, 9 aa, Homo sapiens
  light chain complementarity determining region 3 for antibody 31076
QHYNSYPWT

SEQ ID NO: 62152 - protein, 16 aa, Homo sapiens
  heavy chain complementarity determining region 3 for antibody 31076
AGAPQSDASGYPVFHH

SEQ ID NO: 62153 - protein, 10 aa, Homo sapiens
  light chain complementarity determining region 3 for antibody 31077
QHYNSSSHST

SEQ ID NO: 62154 - protein, 18 aa, Homo sapiens
  heavy chain complementarity determining region 3 for antibody 31077
ARGAGTGYSSNWKIPAGW

SEQ ID NO: 62155 - protein, 8 aa, Homo sapiens
  light chain complementarity determining region 3 for antibody 31078
QHYNSPIT

SEQ ID NO: 62156 - protein, 10 aa, Homo sapiens
  heavy chain complementarity determining region 3 for antibody 31078
VRGRGWTLDH

SEQ ID NO: 62157 - protein, 9 aa, Homo sapiens
  light chain complementarity determining region 3 for antibody 31079
QHYNSIPWT

SEQ ID NO: 62158 - protein, 14 aa, Homo sapiens
  heavy chain complementarity determining region 3 for antibody 31079
TKCAYNYGNDAFDV

SEQ ID NO: 62159 - protein, 9 aa, Homo sapiens
  light chain complementarity determining region 3 for antibody 31080
QHYNSHFVT

SEQ ID NO: 62160 - protein, 10 aa, Homo sapiens
  heavy chain complementarity determining region 3 for antibody 31080
AREWDNCNDY

SEQ ID NO: 62161 - protein, 9 aa, Homo sapiens
  light chain complementarity determining region 3 for antibody 31081
QHYNSFPYT

SEQ ID NO: 62162 - protein, 9 aa, Homo sapiens
  heavy chain complementarity determining region 3 for antibody 31081
TRGPGLLWF

SEQ ID NO: 62163 - protein, 9 aa, Homo sapiens
  light chain complementarity determining region 3 for antibody 31082
QHYNNYRWS

SEQ ID NO: 62164 - protein, 12 aa, Homo sapiens
  heavy chain complementarity determining region 3 for antibody 31082
AKWGKTRVSSYN

SEQ ID NO: 62165 - protein, 8 aa, Homo sapiens
  light chain complementarity determining region 3 for antibody 31083
QHYNGYCM

SEQ ID NO: 62166 - protein, 18 aa, Homo sapiens
  heavy chain complementarity determining region 3 for antibody 31083
ARGHYYDNGGYPYDVFDT

SEQ ID NO: 62167 - protein, 10 aa, Homo sapiens
  light chain complementarity determining region 3 for antibody 31084
QHYNGWPPGT

SEQ ID NO: 62168 - protein, 14 aa, Homo sapiens
  heavy chain complementarity determining region 3 for antibody 31084
ARERTMTASGYYDF

SEQ ID NO: 62169 - protein, 9 aa, Homo sapiens
  light chain complementarity determining region 3 for antibody 31085
QHYISYSYT

SEQ ID NO: 62170 - protein, 18 aa, Homo sapiens
  heavy chain complementarity determining region 3 for antibody 31085
ARDRYSCDSGGCFRWFDP

SEQ ID NO: 62171 - protein, 9 aa, Homo sapiens
  light chain complementarity determining region 3 for antibody 31086
QHYISYSYT

SEQ ID NO: 62172 - protein, 18 aa, Homo sapiens
  heavy chain complementarity determining region 3 for antibody 31086
ARDRYSCDSGGCFPWFDP

SEQ ID NO: 62173 - protein, 9 aa, Homo sapiens
  light chain complementarity determining region 3 for antibody 31087
QHYISYSYT

SEQ ID NO: 62174 - protein, 18 aa, Homo sapiens
  heavy chain complementarity determining region 3 for antibody 31087
ARDRYSCASGGCFHWFDP

SEQ ID NO: 62175 - protein, 9 aa, Homo sapiens
  light chain complementarity determining region 3 for antibody 31088
QHYISSSYT

SEQ ID NO: 62176 - protein, 18 aa, Homo sapiens
  heavy chain complementarity determining region 3 for antibody 31088
ARDRYSCDSGGCFHWFDP

SEQ ID NO: 62177 - protein, 9 aa, Homo sapiens
  light chain complementarity determining region 3 for antibody 31089
QHYISFSYT

SEQ ID NO: 62178 - protein, 18 aa, Homo sapiens
  heavy chain complementarity determining region 3 for antibody 31089
ARDRYSCDSGGCFHWFDP

SEQ ID NO: 62179 - protein, 9 aa, Homo sapiens
  light chain complementarity determining region 3 for antibody 31090
QHYHTSPRT

SEQ ID NO: 62180 - protein, 11 aa, Homo sapiens
  heavy chain complementarity determining region 3 for antibody 31090
STWYFLSDVDV

SEQ ID NO: 62181 - protein, 9 aa, Homo sapiens
  light chain complementarity determining region 3 for antibody 31091
QHYHNWPYT

SEQ ID NO: 62182 - protein, 19 aa, Homo sapiens
  heavy chain complementarity determining region 3 for antibody 31091
ARDLWDCYGSGSCFDAFDF

SEQ ID NO: 62183 - protein, 8 aa, Homo sapiens
  light chain complementarity determining region 3 for antibody 31092
QHYHNSSA

SEQ ID NO: 62184 - protein, 14 aa, Homo sapiens
  heavy chain complementarity determining region 3 for antibody 31092
AKPRNSYWLYSFDY

SEQ ID NO: 62185 - protein, 8 aa, Homo sapiens
  light chain complementarity determining region 3 for antibody 31093
QHYHNSPA

SEQ ID NO: 62186 - protein, 14 aa, Homo sapiens
  heavy chain complementarity determining region 3 for antibody 31093
AKPRNSYWLYYFDY

SEQ ID NO: 62187 - protein, 10 aa, Homo sapiens
  light chain complementarity determining region 3 for antibody 31094
QHYHNRPPWT

SEQ ID NO: 62188 - protein, 13 aa, Homo sapiens
  heavy chain complementarity determining region 3 for antibody 31094
AKGRVRELYYFET

SEQ ID NO: 62189 - protein, 10 aa, Homo sapiens
  light chain complementarity determining region 3 for antibody 31095
QHYHNLPPWT

SEQ ID NO: 62190 - protein, 13 aa, Homo sapiens
  heavy chain complementarity determining region 3 for antibody 31095
AKGRVRELYYFET

SEQ ID NO: 62191 - protein, 9 aa, Homo sapiens
  light chain complementarity determining region 3 for antibody 31096
QHYHGYPIT

SEQ ID NO: 62192 - protein, 21 aa, Homo sapiens
  heavy chain complementarity determining region 3 for antibody 31096
VRGPGGEAPAGSETYYYPMDL

SEQ ID NO: 62193 - protein, 10 aa, Homo sapiens
  light chain complementarity determining region 3 for antibody 31097
QHYGTSSPRT

SEQ ID NO: 62194 - protein, 12 aa, Homo sapiens
  heavy chain complementarity determining region 3 for antibody 31097
TTAFGWELRRDF

SEQ ID NO: 62195 - protein, 9 aa, Homo sapiens
  light chain complementarity determining region 3 for antibody 31098
QHYGTSQDT

SEQ ID NO: 62196 - protein, 20 aa, Homo sapiens
  heavy chain complementarity determining region 3 for antibody 31098
TKDMREMAPKGNSYHYGMDV

SEQ ID NO: 62197 - protein, 11 aa, Homo sapiens
  light chain complementarity determining region 3 for antibody 31099
QHYGTSPAMYS

SEQ ID NO: 62198 - protein, 16 aa, Homo sapiens
  heavy chain complementarity determining region 3 for antibody 31099
ATPYLAVSGPLDAFDI

SEQ ID NO: 62199 - protein, 11 aa, Homo sapiens
  light chain complementarity determining region 3 for antibody 31100
QHYGTSPAMFT

SEQ ID NO: 62200 - protein, 16 aa, Homo sapiens
  heavy chain complementarity determining region 3 for antibody 31100
ATPYLAVSGPLDAFDI

SEQ ID NO: 62201 - protein, 11 aa, Homo sapiens
  light chain complementarity determining region 3 for antibody 31101
QHYGTSPAMFP

SEQ ID NO: 62202 - protein, 16 aa, Homo sapiens
  heavy chain complementarity determining region 3 for antibody 31101
ATPYLAVSGPLDAFDI

SEQ ID NO: 62203 - protein, 9 aa, Homo sapiens
  light chain complementarity determining region 3 for antibody 31102
QHYGTSLWT

SEQ ID NO: 62204 - protein, 16 aa, Homo sapiens
  heavy chain complementarity determining region 3 for antibody 31102
ARRLPAGSLTPQMIPV

SEQ ID NO: 62205 - protein, 9 aa, Homo sapiens
  light chain complementarity determining region 3 for antibody 31103
QHYGTSLWT

SEQ ID NO: 62206 - protein, 16 aa, Homo sapiens
  heavy chain complementarity determining region 3 for antibody 31103
ARLLPAGSLTPQMIHV

SEQ ID NO: 62207 - protein, 9 aa, Homo sapiens
  light chain complementarity determining region 3 for antibody 31104
QHYGTSLWT

SEQ ID NO: 62208 - protein, 16 aa, Homo sapiens
  heavy chain complementarity determining region 3 for antibody 31104
ARLLPAGSLTPQLIPV

SEQ ID NO: 62209 - protein, 9 aa, Homo sapiens
  light chain complementarity determining region 3 for antibody 31105
QHYGSSSIT

SEQ ID NO: 62210 - protein, 13 aa, Homo sapiens
  heavy chain complementarity determining region 3 for antibody 31105
VKEFFLVFDAFHM

SEQ ID NO: 62211 - protein, 9 aa, Homo sapiens
  light chain complementarity determining region 3 for antibody 31106
QHYGSSPRT

SEQ ID NO: 62212 - protein, 11 aa, Homo sapiens
  heavy chain complementarity determining region 3 for antibody 31106
TLSGYLAAFDI

SEQ ID NO: 62213 - protein, 9 aa, Homo sapiens
  light chain complementarity determining region 3 for antibody 31107
QHYGSSPPT

SEQ ID NO: 62214 - protein, 13 aa, Homo sapiens
  heavy chain complementarity determining region 3 for antibody 31107
ARGSRVTVRAFDY

SEQ ID NO: 62215 - protein, 11 aa, Homo sapiens
  light chain complementarity determining region 3 for antibody 31108
QHYGSSPPRVP

SEQ ID NO: 62216 - protein, 28 aa, Homo sapiens
  heavy chain complementarity determining region 3 for antibody 31108
ARGAKKEKLIFVRPRDRGGDTRHWYFDL

SEQ ID NO: 62217 - protein, 11 aa, Homo sapiens
  light chain complementarity determining region 3 for antibody 31109
QHYGSSPPMST

SEQ ID NO: 62218 - protein, 10 aa, Homo sapiens
  heavy chain complementarity determining region 3 for antibody 31109
VSNGYYCLEY

SEQ ID NO: 62219 - protein, 9 aa, Homo sapiens
  light chain complementarity determining region 3 for antibody 31110
QHYGSSPLP

SEQ ID NO: 62220 - protein, 13 aa, Homo sapiens
  heavy chain complementarity determining region 3 for antibody 31110
ARGSRVTVRAFDY

SEQ ID NO: 62221 - protein, 10 aa, Homo sapiens
  light chain complementarity determining region 3 for antibody 31111
QHYGSSPGLT

SEQ ID NO: 62222 - protein, 12 aa, Homo sapiens
  heavy chain complementarity determining region 3 for antibody 31111
AHSDTPLGALYP

SEQ ID NO: 62223 - protein, 9 aa, Homo sapiens
  light chain complementarity determining region 3 for antibody 31112
QHYGSSLWT

SEQ ID NO: 62224 - protein, 10 aa, Homo sapiens
  heavy chain complementarity determining region 3 for antibody 31112
ARGRSSSVAY

SEQ ID NO: 62225 - protein, 10 aa, Homo sapiens
  light chain complementarity determining region 3 for antibody 31113
QHYGSPPAVT

SEQ ID NO: 62226 - protein, 14 aa, Homo sapiens
  heavy chain complementarity determining region 3 for antibody 31113
ARHEHDGSGSVIDY

SEQ ID NO: 62227 - protein, 9 aa, Homo sapiens
  light chain complementarity determining region 3 for antibody 31114
QHYGSLPLT

SEQ ID NO: 62228 - protein, 15 aa, Homo sapiens
  heavy chain complementarity determining region 3 for antibody 31114
AHRPNYYDKAGAFDI

SEQ ID NO: 62229 - protein, 10 aa, Homo sapiens
  light chain complementarity determining region 3 for antibody 31115
QHYGPSSPRP

SEQ ID NO: 62230 - protein, 12 aa, Homo sapiens
  heavy chain complementarity determining region 3 for antibody 31115
TTAFGWELRRDF

SEQ ID NO: 62231 - protein, 9 aa, Homo sapiens
  light chain complementarity determining region 3 for antibody 31116
QHYGNVPYT

SEQ ID NO: 62232 - protein, 15 aa, Homo sapiens
  heavy chain complementarity determining region 3 for antibody 31116
VRDHSNTYYVDYYDL

SEQ ID NO: 62233 - protein, 8 aa, Homo sapiens
  light chain complementarity determining region 3 for antibody 31117
QHYGITWT

SEQ ID NO: 62234 - protein, 10 aa, Homo sapiens
  heavy chain complementarity determining region 3 for antibody 31117
AKTTDWYGHY

SEQ ID NO: 62235 - protein, 10 aa, Homo sapiens
  light chain complementarity determining region 3 for antibody 31118
QHYGISPRLP

SEQ ID NO: 62236 - protein, 12 aa, Homo sapiens
  heavy chain complementarity determining region 3 for antibody 31118
ARDVVGATASDF

SEQ ID NO: 62237 - protein, 10 aa, Homo sapiens
  light chain complementarity determining region 3 for antibody 31119
QHYGISPPFT

SEQ ID NO: 62238 - protein, 12 aa, Homo sapiens
  heavy chain complementarity determining region 3 for antibody 31119
ARDVVGATASDF

SEQ ID NO: 62239 - protein, 10 aa, Homo sapiens
  light chain complementarity determining region 3 for antibody 31120
QHYGFSPRFT

SEQ ID NO: 62240 - protein, 12 aa, Homo sapiens
  heavy chain complementarity determining region 3 for antibody 31120
ARDVVGATASDF

SEQ ID NO: 62241 - protein, 10 aa, Homo sapiens
  light chain complementarity determining region 3 for antibody 31121
QHYGASSPRT

SEQ ID NO: 62242 - protein, 12 aa, Homo sapiens
  heavy chain complementarity determining region 3 for antibody 31121
TTAFGWELRRDF

SEQ ID NO: 62243 - protein, 10 aa, Homo sapiens
  light chain complementarity determining region 3 for antibody 31122
QHYFSPPAYT

SEQ ID NO: 62244 - protein, 12 aa, Homo sapiens
  heavy chain complementarity determining region 3 for antibody 31122
ARETTRFGELDY

SEQ ID NO: 62245 - protein, 9 aa, Homo sapiens
  light chain complementarity determining region 3 for antibody 31123
QHYFIPPLT

SEQ ID NO: 62246 - protein, 18 aa, Homo sapiens
  heavy chain complementarity determining region 3 for antibody 31123
ARAAGGAGDVRFLSWIDA

SEQ ID NO: 62247 - protein, 9 aa, Homo sapiens
  light chain complementarity determining region 3 for antibody 31124
QHYDSYPYT

SEQ ID NO: 62248 - protein, 23 aa, Homo sapiens
  heavy chain complementarity determining region 3 for antibody 31124
ARPGYSNSWPIGGPDYVNYGTDV

SEQ ID NO: 62249 - protein, 9 aa, Homo sapiens
  light chain complementarity determining region 3 for antibody 31125
QHYDSLPWT

SEQ ID NO: 62250 - protein, 19 aa, Homo sapiens
  heavy chain complementarity determining region 3 for antibody 31125
ARTAIGKRYWASSGDQFDY

SEQ ID NO: 62251 - protein, 11 aa, Homo sapiens
  light chain complementarity determining region 3 for antibody 31126
QHYDNLPPMYT

SEQ ID NO: 62252 - protein, 8 aa, Homo sapiens
  heavy chain complementarity determining region 3 for antibody 31126
AGGDYTDY

SEQ ID NO: 62253 - protein, 8 aa, Homo sapiens
  light chain complementarity determining region 3 for antibody 31127
QHYDITWP

SEQ ID NO: 62254 - protein, 10 aa, Homo sapiens
  heavy chain complementarity determining region 3 for antibody 31127
AKTTDWYGHY

SEQ ID NO: 62255 - protein, 8 aa, Homo sapiens
  light chain complementarity determining region 3 for antibody 31128
QHYDISWT

SEQ ID NO: 62256 - protein, 10 aa, Homo sapiens
  heavy chain complementarity determining region 3 for antibody 31128
AKTTDWYGHY

SEQ ID NO: 62257 - protein, 10 aa, Homo sapiens
  light chain complementarity determining region 3 for antibody 31129
QHYDGYSPWT

SEQ ID NO: 62258 - protein, 12 aa, Homo sapiens
  heavy chain complementarity determining region 3 for antibody 31129
AKVYSSSWCFDY

SEQ ID NO: 62259 - protein, 10 aa, Homo sapiens
  light chain complementarity determining region 3 for antibody 31130
QHYDGYSPGT

SEQ ID NO: 62260 - protein, 12 aa, Homo sapiens
  heavy chain complementarity determining region 3 for antibody 31130
AKVYSSSWYFDY

SEQ ID NO: 62261 - protein, 10 aa, Homo sapiens
  light chain complementarity determining region 3 for antibody 31131
QHYDGYPPWT

SEQ ID NO: 62262 - protein, 12 aa, Homo sapiens
  heavy chain complementarity determining region 3 for antibody 31131
AKVYSSSWYFDY

SEQ ID NO: 62263 - protein, 9 aa, Homo sapiens
  light chain complementarity determining region 3 for antibody 31132
QHYDDSPWS

SEQ ID NO: 62264 - protein, 16 aa, Homo sapiens
  heavy chain complementarity determining region 3 for antibody 31132
AKAFTYGGVGGHLYDY

SEQ ID NO: 62265 - protein, 9 aa, Homo sapiens
  light chain complementarity determining region 3 for antibody 31133
QHYDDSPWS

SEQ ID NO: 62266 - protein, 16 aa, Homo sapiens
  heavy chain complementarity determining region 3 for antibody 31133
AKAFTFGGVGGPLYDY

SEQ ID NO: 62267 - protein, 9 aa, Homo sapiens
  light chain complementarity determining region 3 for antibody 31134
QHYDDSPWP

SEQ ID NO: 62268 - protein, 16 aa, Homo sapiens
  heavy chain complementarity determining region 3 for antibody 31134
AKAFTFGGVGGHLYDY

SEQ ID NO: 62269 - protein, 9 aa, Homo sapiens
  light chain complementarity determining region 3 for antibody 31135
QHYASSPRT

SEQ ID NO: 62270 - protein, 12 aa, Homo sapiens
  heavy chain complementarity determining region 3 for antibody 31135
ATKRGYIYGAEY

SEQ ID NO: 62271 - protein, 10 aa, Homo sapiens
  light chain complementarity determining region 3 for antibody 31136
QHWGSSPAYT

SEQ ID NO: 62272 - protein, 12 aa, Homo sapiens
  heavy chain complementarity determining region 3 for antibody 31136
ARETTRFGELDH

SEQ ID NO: 62273 - protein, 9 aa, Homo sapiens
  light chain complementarity determining region 3 for antibody 31137
QHVGGSPLT

SEQ ID NO: 62274 - protein, 11 aa, Homo sapiens
  heavy chain complementarity determining region 3 for antibody 31137
ARKGTGAPFDY

SEQ ID NO: 62275 - protein, 9 aa, Homo sapiens
  light chain complementarity determining region 3 for antibody 31138
QHTYTFPRP

SEQ ID NO: 62276 - protein, 20 aa, Homo sapiens
  heavy chain complementarity determining region 3 for antibody 31138
ARGRRIAALSTAHYYYGMDV

SEQ ID NO: 62277 - protein, 9 aa, Homo sapiens
  light chain complementarity determining region 3 for antibody 31139
QHTSTFPRT

SEQ ID NO: 62278 - protein, 20 aa, Homo sapiens
  heavy chain complementarity determining region 3 for antibody 31139
ARGRRIAALSTAHYDYGMDV

SEQ ID NO: 62279 - protein, 9 aa, Homo sapiens
  light chain complementarity determining region 3 for antibody 31140
QHTSTFHRT

SEQ ID NO: 62280 - protein, 20 aa, Homo sapiens
  heavy chain complementarity determining region 3 for antibody 31140
ARGRRIAALSTAHYYYGMDV

SEQ ID NO: 62281 - protein, 9 aa, Homo sapiens
  light chain complementarity determining region 3 for antibody 31141
QHTNNFPVS

SEQ ID NO: 62282 - protein, 25 aa, Homo sapiens
  heavy chain complementarity determining region 3 for antibody 31141
ARERHDFSSGSYTGGREYYYYGLDV

SEQ ID NO: 62283 - protein, 9 aa, Homo sapiens
  light chain complementarity determining region 3 for antibody 31142
QHTHTFPRT

SEQ ID NO: 62284 - protein, 20 aa, Homo sapiens
  heavy chain complementarity determining region 3 for antibody 31142
GRGRRIAALSTARYYYGMDV

SEQ ID NO: 62285 - protein, 9 aa, Homo sapiens
  light chain complementarity determining region 3 for antibody 31143
QHTHTFPRT

SEQ ID NO: 62286 - protein, 20 aa, Homo sapiens
  heavy chain complementarity determining region 3 for antibody 31143
GRGRRIAALSTAHYSYGMDV

SEQ ID NO: 62287 - protein, 9 aa, Homo sapiens
  light chain complementarity determining region 3 for antibody 31144
QHTHTFPRT

SEQ ID NO: 62288 - protein, 20 aa, Homo sapiens
  heavy chain complementarity determining region 3 for antibody 31144
GRGGRIAALSTAHYYYGMDV

SEQ ID NO: 62289 - protein, 9 aa, Homo sapiens
  light chain complementarity determining region 3 for antibody 31145
QHTHTFPRT

SEQ ID NO: 62290 - protein, 20 aa, Homo sapiens
  heavy chain complementarity determining region 3 for antibody 31145
ARGRRIAARSTAHYYYGMDV

SEQ ID NO: 62291 - protein, 9 aa, Homo sapiens
  light chain complementarity determining region 3 for antibody 31146
QHTHSSPFT

SEQ ID NO: 62292 - protein, 20 aa, Homo sapiens
  heavy chain complementarity determining region 3 for antibody 31146
AKGIAVAALRTVYYYYGLDV

SEQ ID NO: 62293 - protein, 9 aa, Homo sapiens
  light chain complementarity determining region 3 for antibody 31147
QHTHSCPFT

SEQ ID NO: 62294 - protein, 20 aa, Homo sapiens
  heavy chain complementarity determining region 3 for antibody 31147
AKGIAVAALRTVYYYYGLDV

SEQ ID NO: 62295 - protein, 9 aa, Homo sapiens
  light chain complementarity determining region 3 for antibody 31148
QHTHNRPFT

SEQ ID NO: 62296 - protein, 20 aa, Homo sapiens
  heavy chain complementarity determining region 3 for antibody 31148
AKGIAVAALRTVYYYYGLDV

SEQ ID NO: 62297 - protein, 10 aa, Homo sapiens
  light chain complementarity determining region 3 for antibody 31149
QHSYSSFSIT

SEQ ID NO: 62298 - protein, 14 aa, Homo sapiens
  heavy chain complementarity determining region 3 for antibody 31149
ARDFVRGLWRSFDI

SEQ ID NO: 62299 - protein, 9 aa, Homo sapiens
  light chain complementarity determining region 3 for antibody 31150
QHSYSAPYT

SEQ ID NO: 62300 - protein, 18 aa, Homo sapiens
  heavy chain complementarity determining region 3 for antibody 31150
AREREYAGEATDSEIFDY

SEQ ID NO: 62301 - protein, 9 aa, Homo sapiens
  light chain complementarity determining region 3 for antibody 31151
QHSHSRPFT

SEQ ID NO: 62302 - protein, 20 aa, Homo sapiens
  heavy chain complementarity determining region 3 for antibody 31151
AKGISVTALRTVYYYYGMDV

SEQ ID NO: 62303 - protein, 9 aa, Homo sapiens
  light chain complementarity determining region 3 for antibody 31152
QHSHSRPFT

SEQ ID NO: 62304 - protein, 20 aa, Homo sapiens
  heavy chain complementarity determining region 3 for antibody 31152
AKGISVAALRTVYYYCGMDV

SEQ ID NO: 62305 - protein, 9 aa, Homo sapiens
  light chain complementarity determining region 3 for antibody 31153
QHSHSRPFT

SEQ ID NO: 62306 - protein, 20 aa, Homo sapiens
  heavy chain complementarity determining region 3 for antibody 31153
AKGISVAALRTVYSYYGMDV

SEQ ID NO: 62307 - protein, 9 aa, Homo sapiens
  light chain complementarity determining region 3 for antibody 31154
QHSHSRPFP

SEQ ID NO: 62308 - protein, 20 aa, Homo sapiens
  heavy chain complementarity determining region 3 for antibody 31154
AKGISVAALRTVYYYYGMDV

SEQ ID NO: 62309 - protein, 9 aa, Homo sapiens
  light chain complementarity determining region 3 for antibody 31155
QHSHSRPFI

SEQ ID NO: 62310 - protein, 20 aa, Homo sapiens
  heavy chain complementarity determining region 3 for antibody 31155
AKGISVAALRTVYYYYGMDV

SEQ ID NO: 62311 - protein, 9 aa, Homo sapiens
  light chain complementarity determining region 3 for antibody 31156
QHSHSHPFT

SEQ ID NO: 62312 - protein, 20 aa, Homo sapiens
  heavy chain complementarity determining region 3 for antibody 31156
AKGISVAALRTVYYYYGMDV

SEQ ID NO: 62313 - protein, 11 aa, Homo sapiens
  light chain complementarity determining region 3 for antibody 31157
QHSGSSPPRVT

SEQ ID NO: 62314 - protein, 13 aa, Homo sapiens
  heavy chain complementarity determining region 3 for antibody 31157
VRGFGVVSPDFGY

SEQ ID NO: 62315 - protein, 9 aa, Homo sapiens
  light chain complementarity determining region 3 for antibody 31158
QHSFANPWT

SEQ ID NO: 62316 - protein, 18 aa, Homo sapiens
  heavy chain complementarity determining region 3 for antibody 31158
AKDKPQGVGEGGGYGMDV

SEQ ID NO: 62317 - protein, 9 aa, Homo sapiens
  light chain complementarity determining region 3 for antibody 31159
QHSAHVPPT

SEQ ID NO: 62318 - protein, 14 aa, Homo sapiens
  heavy chain complementarity determining region 3 for antibody 31159
ARHSTGTESDHLDL

SEQ ID NO: 62319 - protein, 11 aa, Homo sapiens
  light chain complementarity determining region 3 for antibody 31160
QHRYNWPPRIT

SEQ ID NO: 62320 - protein, 14 aa, Homo sapiens
  heavy chain complementarity determining region 3 for antibody 31160
ARVLYDSSGYEIDY

SEQ ID NO: 62321 - protein, 10 aa, Homo sapiens
  light chain complementarity determining region 3 for antibody 31161
QHRTDRPPYP

SEQ ID NO: 62322 - protein, 15 aa, Homo sapiens
  heavy chain complementarity determining region 3 for antibody 31161
ARLMGDWELPRGTDY

SEQ ID NO: 62323 - protein, 9 aa, Homo sapiens
  light chain complementarity determining region 3 for antibody 31162
QHRSYWPWT

SEQ ID NO: 62324 - protein, 17 aa, Homo sapiens
  heavy chain complementarity determining region 3 for antibody 31162
GREYYDAQSGSGNWFDP

SEQ ID NO: 62325 - protein, 9 aa, Homo sapiens
  light chain complementarity determining region 3 for antibody 31163
QHRSYWPWT

SEQ ID NO: 62326 - protein, 17 aa, Homo sapiens
  heavy chain complementarity determining region 3 for antibody 31163
GREYCDARSGSGNWFDP

SEQ ID NO: 62327 - protein, 9 aa, Homo sapiens
  light chain complementarity determining region 3 for antibody 31164
QHRSYWPWT

SEQ ID NO: 62328 - protein, 17 aa, Homo sapiens
  heavy chain complementarity determining region 3 for antibody 31164
GGEYYDARSGSGNWFDP

SEQ ID NO: 62329 - protein, 9 aa, Homo sapiens
  light chain complementarity determining region 3 for antibody 31165
QHRSYWPWP

SEQ ID NO: 62330 - protein, 17 aa, Homo sapiens
  heavy chain complementarity determining region 3 for antibody 31165
GREYYDARSGSGNWFDP

SEQ ID NO: 62331 - protein, 9 aa, Homo sapiens
  light chain complementarity determining region 3 for antibody 31166
QHRSYWPWK

SEQ ID NO: 62332 - protein, 17 aa, Homo sapiens
  heavy chain complementarity determining region 3 for antibody 31166
GREYYDARSGSGNWFDP

SEQ ID NO: 62333 - protein, 9 aa, Homo sapiens
  light chain complementarity determining region 3 for antibody 31167
QHRSYWPRT

SEQ ID NO: 62334 - protein, 17 aa, Homo sapiens
  heavy chain complementarity determining region 3 for antibody 31167
GREYYDARSGSGNWFDP

SEQ ID NO: 62335 - protein, 9 aa, Homo sapiens
  light chain complementarity determining region 3 for antibody 31168
QHRSYWPLT

SEQ ID NO: 62336 - protein, 17 aa, Homo sapiens
  heavy chain complementarity determining region 3 for antibody 31168
GREYYDARSGSGNWFDP

SEQ ID NO: 62337 - protein, 9 aa, Homo sapiens
  light chain complementarity determining region 3 for antibody 31169
QHRSYCPWT

SEQ ID NO: 62338 - protein, 17 aa, Homo sapiens
  heavy chain complementarity determining region 3 for antibody 31169
GREYYDARSGSGNWFDP

SEQ ID NO: 62339 - protein, 11 aa, Homo sapiens
  light chain complementarity determining region 3 for antibody 31170
QHRSTWPPGYT

SEQ ID NO: 62340 - protein, 14 aa, Homo sapiens
  heavy chain complementarity determining region 3 for antibody 31170
AREGSDWGLGWFDP

SEQ ID NO: 62341 - protein, 9 aa, Homo sapiens
  light chain complementarity determining region 3 for antibody 31171
QHRSNWPRT

SEQ ID NO: 62342 - protein, 17 aa, Homo sapiens
  heavy chain complementarity determining region 3 for antibody 31171
GREYYDARSGSGNWFDP

SEQ ID NO: 62343 - protein, 11 aa, Homo sapiens
  light chain complementarity determining region 3 for antibody 31172
QHRSNWPPPFT

SEQ ID NO: 62344 - protein, 18 aa, Homo sapiens
  heavy chain complementarity determining region 3 for antibody 31172
ARAVVAGTPVLYYYGMDV

SEQ ID NO: 62345 - protein, 10 aa, Homo sapiens
  light chain complementarity determining region 3 for antibody 31173
QHRSNWPLLT

SEQ ID NO: 62346 - protein, 12 aa, Homo sapiens
  heavy chain complementarity determining region 3 for antibody 31173
VKVWGQWLAFDY

SEQ ID NO: 62347 - protein, 9 aa, Homo sapiens
  light chain complementarity determining region 3 for antibody 31174
QHRSNWPGT

SEQ ID NO: 62348 - protein, 17 aa, Homo sapiens
  heavy chain complementarity determining region 3 for antibody 31174
GREYYDARSGSGNWFDP

SEQ ID NO: 62349 - protein, 10 aa, Homo sapiens
  light chain complementarity determining region 3 for antibody 31175
QHRSHRPPST

SEQ ID NO: 62350 - protein, 13 aa, Homo sapiens
  heavy chain complementarity determining region 3 for antibody 31175
ATSIFGVPNRRDY

SEQ ID NO: 62351 - protein, 9 aa, Homo sapiens
  light chain complementarity determining region 3 for antibody 31176
QHRLNWPPT

SEQ ID NO: 62352 - protein, 16 aa, Homo sapiens
  heavy chain complementarity determining region 3 for antibody 31176
VHSTFIAAGTPLYMDV

SEQ ID NO: 62353 - protein, 9 aa, Homo sapiens
  light chain complementarity determining region 3 for antibody 31177
QHRIDWPWT

SEQ ID NO: 62354 - protein, 12 aa, Homo sapiens
  heavy chain complementarity determining region 3 for antibody 31177
GREDYRTGYVDS

SEQ ID NO: 62355 - protein, 6 aa, Homo sapiens
  light chain complementarity determining region 3 for antibody 31178
QHRGRA

SEQ ID NO: 62356 - protein, 17 aa, Homo sapiens
  heavy chain complementarity determining region 3 for antibody 31178
ATFSRQVVTGYYWYFDL

SEQ ID NO: 62357 - protein, 6 aa, Homo sapiens
  light chain complementarity determining region 3 for antibody 31179
QHRGGS

SEQ ID NO: 62358 - protein, 17 aa, Homo sapiens
  heavy chain complementarity determining region 3 for antibody 31179
ATFSRQVVTGYYWYFDL

SEQ ID NO: 62359 - protein, 9 aa, Homo sapiens
  light chain complementarity determining region 3 for antibody 31180
QHRFNTPYT

SEQ ID NO: 62360 - protein, 14 aa, Homo sapiens
  heavy chain complementarity determining region 3 for antibody 31180
ARLGTMASRHPLDY

SEQ ID NO: 62361 - protein, 11 aa, Homo sapiens
  light chain complementarity determining region 3 for antibody 31181
QHRDNWPPRIT

SEQ ID NO: 62362 - protein, 12 aa, Homo sapiens
  heavy chain complementarity determining region 3 for antibody 31181
GRFGQSGYYGWS

SEQ ID NO: 62363 - protein, 9 aa, Homo sapiens
  light chain complementarity determining region 3 for antibody 31182
QHNYRPSPA

SEQ ID NO: 62364 - protein, 11 aa, Homo sapiens
  heavy chain complementarity determining region 3 for antibody 31182
TRDPPGNGMDV

SEQ ID NO: 62365 - protein, 10 aa, Homo sapiens
  light chain complementarity determining region 3 for antibody 31183
QHNVSPPAYT

SEQ ID NO: 62366 - protein, 12 aa, Homo sapiens
  heavy chain complementarity determining region 3 for antibody 31183
ARETTRFGELDY

SEQ ID NO: 62367 - protein, 9 aa, Homo sapiens
  light chain complementarity determining region 3 for antibody 31184
QHNHTFPRT

SEQ ID NO: 62368 - protein, 20 aa, Homo sapiens
  heavy chain complementarity determining region 3 for antibody 31184
GRGRRIAALSTAHYYYGMDV

SEQ ID NO: 62369 - protein, 9 aa, Homo sapiens
  light chain complementarity determining region 3 for antibody 31185
QHNHTFPRT

SEQ ID NO: 62370 - protein, 20 aa, Homo sapiens
  heavy chain complementarity determining region 3 for antibody 31185
ARGRRIAALSTAHYYYGMDV

SEQ ID NO: 62371 - protein, 9 aa, Homo sapiens
  light chain complementarity determining region 3 for antibody 31186
QHLRSYPLT

SEQ ID NO: 62372 - protein, 19 aa, Homo sapiens
  heavy chain complementarity determining region 3 for antibody 31186
ARHNSKDYYSSSLLPGNDH

SEQ ID NO: 62373 - protein, 9 aa, Homo sapiens
  light chain complementarity determining region 3 for antibody 31187
QHLNSYPYT

SEQ ID NO: 62374 - protein, 12 aa, Homo sapiens
  heavy chain complementarity determining region 3 for antibody 31187
AIWGGAKGGLPY

SEQ ID NO: 62375 - protein, 11 aa, Homo sapiens
  light chain complementarity determining region 3 for antibody 31188
QHLNSYPGALT

SEQ ID NO: 62376 - protein, 18 aa, Homo sapiens
  heavy chain complementarity determining region 3 for antibody 31188
ARDLTPIIATTGTGTFDI

SEQ ID NO: 62377 - protein, 9 aa, Homo sapiens
  light chain complementarity determining region 3 for antibody 31189
QHLFSYPPP

SEQ ID NO: 62378 - protein, 14 aa, Homo sapiens
  heavy chain complementarity determining region 3 for antibody 31189
ARENSVTGTRAYDF

SEQ ID NO: 62379 - protein, 7 aa, Homo sapiens
  light chain complementarity determining region 3 for antibody 31190
QHLEAYA

SEQ ID NO: 62380 - protein, 17 aa, Homo sapiens
  heavy chain complementarity determining region 3 for antibody 31190
AKDMGPLFGSGLDAFDV

SEQ ID NO: 62381 - protein, 9 aa, Homo sapiens
  light chain complementarity determining region 3 for antibody 31191
QHHYTSVRT

SEQ ID NO: 62382 - protein, 12 aa, Homo sapiens
  heavy chain complementarity determining region 3 for antibody 31191
VKDCGLGGSRDS

SEQ ID NO: 62383 - protein, 11 aa, Homo sapiens
  light chain complementarity determining region 3 for antibody 31192
QHHYISPPAYP

SEQ ID NO: 62384 - protein, 12 aa, Homo sapiens
  heavy chain complementarity determining region 3 for antibody 31192
ARGTTKFGELDN

SEQ ID NO: 62385 - protein, 11 aa, Homo sapiens
  light chain complementarity determining region 3 for antibody 31193
QHHYIRPPAST

SEQ ID NO: 62386 - protein, 12 aa, Homo sapiens
  heavy chain complementarity determining region 3 for antibody 31193
ARGTTKFGELDN

SEQ ID NO: 62387 - protein, 9 aa, Homo sapiens
  light chain complementarity determining region 3 for antibody 31194
QHHQTYCPT

SEQ ID NO: 62388 - protein, 12 aa, Homo sapiens
  heavy chain complementarity determining region 3 for antibody 31194
AGDPSGNSYFDY

SEQ ID NO: 62389 - protein, 9 aa, Homo sapiens
  light chain complementarity determining region 3 for antibody 31195
QHHPTYWPT

SEQ ID NO: 62390 - protein, 12 aa, Homo sapiens
  heavy chain complementarity determining region 3 for antibody 31195
AGDPSGNSYFDY

SEQ ID NO: 62391 - protein, 10 aa, Homo sapiens
  light chain complementarity determining region 3 for antibody 31196
QHGYSSPLLS

SEQ ID NO: 62392 - protein, 14 aa, Homo sapiens
  heavy chain complementarity determining region 3 for antibody 31196
ARGRYSTSGAYFDY

SEQ ID NO: 62393 - protein, 9 aa, Homo sapiens
  light chain complementarity determining region 3 for antibody 31197
QHGHSAPRT

SEQ ID NO: 62394 - protein, 14 aa, Homo sapiens
  heavy chain complementarity determining region 3 for antibody 31197
SRDRLDISGWYSDY

SEQ ID NO: 62395 - protein, 9 aa, Homo sapiens
  light chain complementarity determining region 3 for antibody 31198
QHFGGSPLT

SEQ ID NO: 62396 - protein, 11 aa, Homo sapiens
  heavy chain complementarity determining region 3 for antibody 31198
AREGTGAPFDY

SEQ ID NO: 62397 - protein, 9 aa, Homo sapiens
  light chain complementarity determining region 3 for antibody 31199
QHFGGLPLT

SEQ ID NO: 62398 - protein, 11 aa, Homo sapiens
  heavy chain complementarity determining region 3 for antibody 31199
ARKGTGAPFDY

SEQ ID NO: 62399 - protein, 9 aa, Homo sapiens
  light chain complementarity determining region 3 for antibody 31200
QHFFSPPPT

SEQ ID NO: 62400 - protein, 13 aa, Homo sapiens
  heavy chain complementarity determining region 3 for antibody 31200
AKWGFTEYNWFDP

SEQ ID NO: 62401 - protein, 10 aa, Homo sapiens
  light chain complementarity determining region 3 for antibody 31201
QHFDTSPPYM

SEQ ID NO: 62402 - protein, 13 aa, Homo sapiens
  heavy chain complementarity determining region 3 for antibody 31201
VRERSGAYPAHDY

SEQ ID NO: 62403 - protein, 10 aa, Homo sapiens
  light chain complementarity determining region 3 for antibody 31202
QHFDTSPPYL

SEQ ID NO: 62404 - protein, 13 aa, Homo sapiens
  heavy chain complementarity determining region 3 for antibody 31202
VRERSGAYPAHDY

SEQ ID NO: 62405 - protein, 9 aa, Homo sapiens
  light chain complementarity determining region 3 for antibody 31203
QHFDNSPYT

SEQ ID NO: 62406 - protein, 13 aa, Homo sapiens
  heavy chain complementarity determining region 3 for antibody 31203
VKKYTSGWLYFDF

SEQ ID NO: 62407 - protein, 10 aa, Homo sapiens
  light chain complementarity determining region 3 for antibody 31204
QHFDNLQMFT

SEQ ID NO: 62408 - protein, 16 aa, Homo sapiens
  heavy chain complementarity determining region 3 for antibody 31204
ARVPRGSYASGTLFDY

SEQ ID NO: 62409 - protein, 10 aa, Homo sapiens
  light chain complementarity determining region 3 for antibody 31205
QHFDNLPRFT

SEQ ID NO: 62410 - protein, 16 aa, Homo sapiens
  heavy chain complementarity determining region 3 for antibody 31205
ARVPRGSYASGTLFDY

SEQ ID NO: 62411 - protein, 10 aa, Homo sapiens
  light chain complementarity determining region 3 for antibody 31206
QHFDNLPMFT

SEQ ID NO: 62412 - protein, 16 aa, Homo sapiens
  heavy chain complementarity determining region 3 for antibody 31206
ARVPRGSYASGSLFDY

SEQ ID NO: 62413 - protein, 10 aa, Homo sapiens
  light chain complementarity determining region 3 for antibody 31207
QHFANLPMFT

SEQ ID NO: 62414 - protein, 16 aa, Homo sapiens
  heavy chain complementarity determining region 3 for antibody 31207
ARVPRGSYASGTLFDY

SEQ ID NO: 62415 - protein, 9 aa, Homo sapiens
  light chain complementarity determining region 3 for antibody 31208
QHDYRTPWT

SEQ ID NO: 62416 - protein, 15 aa, Homo sapiens
  heavy chain complementarity determining region 3 for antibody 31208
TKEGGHNPLGAGLDQ

SEQ ID NO: 62417 - protein, 9 aa, Homo sapiens
  light chain complementarity determining region 3 for antibody 31209
QHDYRPPWT

SEQ ID NO: 62418 - protein, 15 aa, Homo sapiens
  heavy chain complementarity determining region 3 for antibody 31209
TKEGGNNPLGAGLDQ

SEQ ID NO: 62419 - protein, 9 aa, Homo sapiens
  light chain complementarity determining region 3 for antibody 31210
QHDYRPPGT

SEQ ID NO: 62420 - protein, 15 aa, Homo sapiens
  heavy chain complementarity determining region 3 for antibody 31210
TKEGGHNPLGAGLDQ

SEQ ID NO: 62421 - protein, 9 aa, Homo sapiens
  light chain complementarity determining region 3 for antibody 31211
QHDGSSPRT

SEQ ID NO: 62422 - protein, 25 aa, Homo sapiens
  heavy chain complementarity determining region 3 for antibody 31211
ARLRIDRLRLPGAMRGPLYDCGLNV

SEQ ID NO: 62423 - protein, 9 aa, Homo sapiens
  light chain complementarity determining region 3 for antibody 31212
QHCLSLPYT

SEQ ID NO: 62424 - protein, 15 aa, Homo sapiens
  heavy chain complementarity determining region 3 for antibody 31212
SRLKGSAGWYHKIDF

SEQ ID NO: 62425 - protein, 9 aa, Homo sapiens
  light chain complementarity determining region 3 for antibody 31213
QHANGLPYT

SEQ ID NO: 62426 - protein, 17 aa, Homo sapiens
  heavy chain complementarity determining region 3 for antibody 31213
ARMGGGSSSETGYDFDS

SEQ ID NO: 62427 - protein, 9 aa, Homo sapiens
  light chain complementarity determining region 3 for antibody 31214
QHANGLPYT

SEQ ID NO: 62428 - protein, 17 aa, Homo sapiens
  heavy chain complementarity determining region 3 for antibody 31214
ARMGGGSSSETGYDFDA

SEQ ID NO: 62429 - protein, 9 aa, Homo sapiens
  light chain complementarity determining region 3 for antibody 31215
QHAHSFPRT

SEQ ID NO: 62430 - protein, 13 aa, Homo sapiens
  heavy chain complementarity determining region 3 for antibody 31215
ARDLRVGRNGLDV

SEQ ID NO: 62431 - protein, 11 aa, Homo sapiens
  light chain complementarity determining region 3 for antibody 31216
QGYGASPPMST

SEQ ID NO: 62432 - protein, 12 aa, Homo sapiens
  heavy chain complementarity determining region 3 for antibody 31216
AKDLHGSGSFDH

SEQ ID NO: 62433 - protein, 10 aa, Homo sapiens
  light chain complementarity determining region 3 for antibody 31217
QEYTSWPAFT

SEQ ID NO: 62434 - protein, 11 aa, Homo sapiens
  heavy chain complementarity determining region 3 for antibody 31217
ARRWGSAPFDH

SEQ ID NO: 62435 - protein, 10 aa, Homo sapiens
  light chain complementarity determining region 3 for antibody 31218
QEYNSWPAFT

SEQ ID NO: 62436 - protein, 11 aa, Homo sapiens
  heavy chain complementarity determining region 3 for antibody 31218
ARRWGSAPFDH

SEQ ID NO: 62437 - protein, 7 aa, Homo sapiens
  light chain complementarity determining region 3 for antibody 31219
QEYNGWP

SEQ ID NO: 62438 - protein, 10 aa, Homo sapiens
  heavy chain complementarity determining region 3 for antibody 31219
ARAGYGAFDL

SEQ ID NO: 62439 - protein, 10 aa, Homo sapiens
  light chain complementarity determining region 3 for antibody 31220
QEYKSWPAFT

SEQ ID NO: 62440 - protein, 11 aa, Homo sapiens
  heavy chain complementarity determining region 3 for antibody 31220
ASRWGSAPFDH

SEQ ID NO: 62441 - protein, 10 aa, Homo sapiens
  light chain complementarity determining region 3 for antibody 31221
QEYKSWPAFT

SEQ ID NO: 62442 - protein, 11 aa, Homo sapiens
  heavy chain complementarity determining region 3 for antibody 31221
ARRWGSAPFDR

SEQ ID NO: 62443 - protein, 10 aa, Homo sapiens
  light chain complementarity determining region 3 for antibody 31222
QEYKRWPAFP

SEQ ID NO: 62444 - protein, 11 aa, Homo sapiens
  heavy chain complementarity determining region 3 for antibody 31222
ARRWGSAPFDH

SEQ ID NO: 62445 - protein, 8 aa, Homo sapiens
  light chain complementarity determining region 3 for antibody 31223
QEYGDLLP

SEQ ID NO: 62446 - protein, 12 aa, Homo sapiens
  heavy chain complementarity determining region 3 for antibody 31223
VNWVFGHWSFDY

SEQ ID NO: 62447 - protein, 10 aa, Homo sapiens
  light chain complementarity determining region 3 for antibody 31224
QEYDSSSLWT

SEQ ID NO: 62448 - protein, 19 aa, Homo sapiens
  heavy chain complementarity determining region 3 for antibody 31224
ARESFVRKVGGQRPYYFDI

SEQ ID NO: 62449 - protein, 10 aa, Homo sapiens
  light chain complementarity determining region 3 for antibody 31225
QEYDNHPPYI

SEQ ID NO: 62450 - protein, 12 aa, Homo sapiens
  heavy chain complementarity determining region 3 for antibody 31225
ARAPRRVGYFHH

SEQ ID NO: 62451 - protein, 9 aa, Homo sapiens
  light chain complementarity determining region 3 for antibody 31226
QESYSTPRT

SEQ ID NO: 62452 - protein, 13 aa, Homo sapiens
  heavy chain complementarity determining region 3 for antibody 31226
ARDENVVAGWFDP

SEQ ID NO: 62453 - protein, 10 aa, Homo sapiens
  light chain complementarity determining region 3 for antibody 31227
QESYSTLSTT

SEQ ID NO: 62454 - protein, 16 aa, Homo sapiens
  heavy chain complementarity determining region 3 for antibody 31227
AKAKNSVTCGGVIIDH

SEQ ID NO: 62455 - protein, 10 aa, Homo sapiens
  light chain complementarity determining region 3 for antibody 31228
QESYSTLSTP

SEQ ID NO: 62456 - protein, 16 aa, Homo sapiens
  heavy chain complementarity determining region 3 for antibody 31228
AKAKNSVTFGGVIIDH

SEQ ID NO: 62457 - protein, 10 aa, Homo sapiens
  light chain complementarity determining region 3 for antibody 31229
QESYSILSTT

SEQ ID NO: 62458 - protein, 16 aa, Homo sapiens
  heavy chain complementarity determining region 3 for antibody 31229
AKAKNSVTFGGVIIDH

SEQ ID NO: 62459 - protein, 9 aa, Homo sapiens
  light chain complementarity determining region 3 for antibody 31230
QESYRTPRP

SEQ ID NO: 62460 - protein, 13 aa, Homo sapiens
  heavy chain complementarity determining region 3 for antibody 31230
ARDENVVAGWFDP

SEQ ID NO: 62461 - protein, 9 aa, Homo sapiens
  light chain complementarity determining region 3 for antibody 31231
QESHSNPFT

SEQ ID NO: 62462 - protein, 20 aa, Homo sapiens
  heavy chain complementarity determining region 3 for antibody 31231
ARHGGRFSISGVLIPYGIDV

SEQ ID NO: 62463 - protein, 9 aa, Homo sapiens
  light chain complementarity determining region 3 for antibody 31232
QESHIGSPT

SEQ ID NO: 62464 - protein, 18 aa, Homo sapiens
  heavy chain complementarity determining region 3 for antibody 31232
TQLSGYCRDAGICPPFAY

SEQ ID NO: 62465 - protein, 6 aa, Homo sapiens
  light chain complementarity determining region 3 for antibody 31233
QEHAST

SEQ ID NO: 62466 - protein, 12 aa, Homo sapiens
  heavy chain complementarity determining region 3 for antibody 31233
ARDHISGWSLSN

SEQ ID NO: 62467 - protein, 6 aa, Homo sapiens
  light chain complementarity determining region 3 for antibody 31234
QEDGGP

SEQ ID NO: 62468 - protein, 18 aa, Homo sapiens
  heavy chain complementarity determining region 3 for antibody 31234
ATTKLTFMGGFDYYGLDV

SEQ ID NO: 62469 - protein, 8 aa, Homo sapiens
  light chain complementarity determining region 3 for antibody 31235
QDYSNRPT

SEQ ID NO: 62470 - protein, 15 aa, Homo sapiens
  heavy chain complementarity determining region 3 for antibody 31235
AKEVLTRSSDWYWLD

SEQ ID NO: 62471 - protein, 9 aa, Homo sapiens
  light chain complementarity determining region 3 for antibody 31236
QDRNGFPFT

SEQ ID NO: 62472 - protein, 12 aa, Homo sapiens
  heavy chain complementarity determining region 3 for antibody 31236
AIWGGAQGGVEF

SEQ ID NO: 62473 - protein, 9 aa, Homo sapiens
  light chain complementarity determining region 3 for antibody 31237
QDLNGFPFT

SEQ ID NO: 62474 - protein, 12 aa, Homo sapiens
  heavy chain complementarity determining region 3 for antibody 31237
ASWGGAQGGVEF

SEQ ID NO: 62475 - protein, 9 aa, Homo sapiens
  light chain complementarity determining region 3 for antibody 31238
QDLNGFPFT

SEQ ID NO: 62476 - protein, 12 aa, Homo sapiens
  heavy chain complementarity determining region 3 for antibody 31238
AIWGGAQGGVDF

SEQ ID NO: 62477 - protein, 9 aa, Homo sapiens
  light chain complementarity determining region 3 for antibody 31239
QATYRIPLT

SEQ ID NO: 62478 - protein, 14 aa, Homo sapiens
  heavy chain complementarity determining region 3 for antibody 31239
VRGTWDWGGWDFVY

SEQ ID NO: 62479 - protein, 8 aa, Homo sapiens
  light chain complementarity determining region 3 for antibody 31240
PYLNGYLV

SEQ ID NO: 62480 - protein, 9 aa, Homo sapiens
  heavy chain complementarity determining region 3 for antibody 31240
ARDYLGFDS

SEQ ID NO: 62481 - protein, 9 aa, Homo sapiens
  light chain complementarity determining region 3 for antibody 31241
PQYYTTPRP

SEQ ID NO: 62482 - protein, 8 aa, Homo sapiens
  heavy chain complementarity determining region 3 for antibody 31241
ARDGAFDS

SEQ ID NO: 62483 - protein, 9 aa, Homo sapiens
  light chain complementarity determining region 3 for antibody 31242
PQYYTSVRT

SEQ ID NO: 62484 - protein, 12 aa, Homo sapiens
  heavy chain complementarity determining region 3 for antibody 31242
VKDCGLGGSRDS

SEQ ID NO: 62485 - protein, 9 aa, Homo sapiens
  light chain complementarity determining region 3 for antibody 31243
PQYYTSLRT

SEQ ID NO: 62486 - protein, 12 aa, Homo sapiens
  heavy chain complementarity determining region 3 for antibody 31243
VKDCGLGGSRDF

SEQ ID NO: 62487 - protein, 9 aa, Homo sapiens
  light chain complementarity determining region 3 for antibody 31244
PQYYTSLRT

SEQ ID NO: 62488 - protein, 12 aa, Homo sapiens
  heavy chain complementarity determining region 3 for antibody 31244
VKDCGLGGPRDY

SEQ ID NO: 62489 - protein, 9 aa, Homo sapiens
  light chain complementarity determining region 3 for antibody 31245
PQYYTSART

SEQ ID NO: 62490 - protein, 12 aa, Homo sapiens
  heavy chain complementarity determining region 3 for antibody 31245
VKDCGLGGSRDS

SEQ ID NO: 62491 - protein, 9 aa, Homo sapiens
  light chain complementarity determining region 3 for antibody 31246
PQYYTPPRT

SEQ ID NO: 62492 - protein, 8 aa, Homo sapiens
  heavy chain complementarity determining region 3 for antibody 31246
ARDGAFDS

SEQ ID NO: 62493 - protein, 9 aa, Homo sapiens
  light chain complementarity determining region 3 for antibody 31247
PQYYSTPVT

SEQ ID NO: 62494 - protein, 14 aa, Homo sapiens
  heavy chain complementarity determining region 3 for antibody 31247
ARHEHDGSGSVIDY

SEQ ID NO: 62495 - protein, 9 aa, Homo sapiens
  light chain complementarity determining region 3 for antibody 31248
PQYYSEPET

SEQ ID NO: 62496 - protein, 17 aa, Homo sapiens
  heavy chain complementarity determining region 3 for antibody 31248
ARDARSHGSGWEGGDDC

SEQ ID NO: 62497 - protein, 9 aa, Homo sapiens
  light chain complementarity determining region 3 for antibody 31249
PQYSDWPPF

SEQ ID NO: 62498 - protein, 20 aa, Homo sapiens
  heavy chain complementarity determining region 3 for antibody 31249
AREGGQGPTANGWFGGGADY

SEQ ID NO: 62499 - protein, 8 aa, Homo sapiens
  light chain complementarity determining region 3 for antibody 31250
PQYRDSFP

SEQ ID NO: 62500 - protein, 13 aa, Homo sapiens
  heavy chain complementarity determining region 3 for antibody 31250
ATESGKYQGALDF

SEQ ID NO: 62501 - protein, 9 aa, Homo sapiens
  light chain complementarity determining region 3 for antibody 31251
PQYNTWPPT

SEQ ID NO: 62502 - protein, 13 aa, Homo sapiens
  heavy chain complementarity determining region 3 for antibody 31251
ARVVSSQSGYGDS

SEQ ID NO: 62503 - protein, 9 aa, Homo sapiens
  light chain complementarity determining region 3 for antibody 31252
PQYNSYSRT

SEQ ID NO: 62504 - protein, 11 aa, Homo sapiens
  heavy chain complementarity determining region 3 for antibody 31252
SRCWDQTYFDY

SEQ ID NO: 62505 - protein, 9 aa, Homo sapiens
  light chain complementarity determining region 3 for antibody 31253
PQYNSYPLT

SEQ ID NO: 62506 - protein, 16 aa, Homo sapiens
  heavy chain complementarity determining region 3 for antibody 31253
ARDQYTSDYYIRPFDV

SEQ ID NO: 62507 - protein, 8 aa, Homo sapiens
  light chain complementarity determining region 3 for antibody 31254
PQYNSWWT

SEQ ID NO: 62508 - protein, 16 aa, Homo sapiens
  heavy chain complementarity determining region 3 for antibody 31254
ARHGWHGWGRRGWFHP

SEQ ID NO: 62509 - protein, 9 aa, Homo sapiens
  light chain complementarity determining region 3 for antibody 31255
PQYNNWPPT

SEQ ID NO: 62510 - protein, 12 aa, Homo sapiens
  heavy chain complementarity determining region 3 for antibody 31255
ARTLVQALIWDY

SEQ ID NO: 62511 - protein, 10 aa, Homo sapiens
  light chain complementarity determining region 3 for antibody 31256
PQYNNWLGWT

SEQ ID NO: 62512 - protein, 13 aa, Homo sapiens
  heavy chain complementarity determining region 3 for antibody 31256
ARHGRRSGWYYTY

SEQ ID NO: 62513 - protein, 9 aa, Homo sapiens
  light chain complementarity determining region 3 for antibody 31257
PQYNDWPFI

SEQ ID NO: 62514 - protein, 9 aa, Homo sapiens
  heavy chain complementarity determining region 3 for antibody 31257
AGWFGEFYL

SEQ ID NO: 62515 - protein, 9 aa, Homo sapiens
  light chain complementarity determining region 3 for antibody 31258
PQYNASSWT

SEQ ID NO: 62516 - protein, 16 aa, Homo sapiens
  heavy chain complementarity determining region 3 for antibody 31258
ASLGGAHYYGSGSHYF

SEQ ID NO: 62517 - protein, 8 aa, Homo sapiens
  light chain complementarity determining region 3 for antibody 31259
PQYGTSPT

SEQ ID NO: 62518 - protein, 22 aa, Homo sapiens
  heavy chain complementarity determining region 3 for antibody 31259
ARGRGTVIRGATTKSYFNVMDV

SEQ ID NO: 62519 - protein, 9 aa, Homo sapiens
  light chain complementarity determining region 3 for antibody 31260
PQYGTPPRT

SEQ ID NO: 62520 - protein, 15 aa, Homo sapiens
  heavy chain complementarity determining region 3 for antibody 31260
AHRPNYYDKAGAFDI

SEQ ID NO: 62521 - protein, 9 aa, Homo sapiens
  light chain complementarity determining region 3 for antibody 31261
PQYGTIPRT

SEQ ID NO: 62522 - protein, 13 aa, Homo sapiens
  heavy chain complementarity determining region 3 for antibody 31261
AGGLFDSSGYSEF

SEQ ID NO: 62523 - protein, 9 aa, Homo sapiens
  light chain complementarity determining region 3 for antibody 31262
PQYGSTWWT

SEQ ID NO: 62524 - protein, 15 aa, Homo sapiens
  heavy chain complementarity determining region 3 for antibody 31262
ARHMARDSIGYYHDF

SEQ ID NO: 62525 - protein, 9 aa, Homo sapiens
  light chain complementarity determining region 3 for antibody 31263
PQYGSTPST

SEQ ID NO: 62526 - protein, 14 aa, Homo sapiens
  heavy chain complementarity determining region 3 for antibody 31263
AREWVSTIRGWFDP

SEQ ID NO: 62527 - protein, 9 aa, Homo sapiens
  light chain complementarity determining region 3 for antibody 31264
PQYGSSSST

SEQ ID NO: 62528 - protein, 15 aa, Homo sapiens
  heavy chain complementarity determining region 3 for antibody 31264
ARRISPYNNAWYLDY

SEQ ID NO: 62529 - protein, 9 aa, Homo sapiens
  light chain complementarity determining region 3 for antibody 31265
PQYGSSPYA

SEQ ID NO: 62530 - protein, 13 aa, Homo sapiens
  heavy chain complementarity determining region 3 for antibody 31265
ARALQYSGRIFDY

SEQ ID NO: 62531 - protein, 9 aa, Homo sapiens
  light chain complementarity determining region 3 for antibody 31266
PQYGSSPLT

SEQ ID NO: 62532 - protein, 12 aa, Homo sapiens
  heavy chain complementarity determining region 3 for antibody 31266
ARASWFLSVFDS

SEQ ID NO: 62533 - protein, 9 aa, Homo sapiens
  light chain complementarity determining region 3 for antibody 31267
PQYGSSLYT

SEQ ID NO: 62534 - protein, 16 aa, Homo sapiens
  heavy chain complementarity determining region 3 for antibody 31267
ARAKHYGDYYYYGMDA

SEQ ID NO: 62535 - protein, 9 aa, Homo sapiens
  light chain complementarity determining region 3 for antibody 31268
PQYGSSHIP

SEQ ID NO: 62536 - protein, 23 aa, Homo sapiens
  heavy chain complementarity determining region 3 for antibody 31268
AKDGLESYYDSSGTNLAYWYFDL

SEQ ID NO: 62537 - protein, 9 aa, Homo sapiens
  light chain complementarity determining region 3 for antibody 31269
PQYGSLPRT

SEQ ID NO: 62538 - protein, 14 aa, Homo sapiens
  heavy chain complementarity determining region 3 for antibody 31269
AGGDFCGSDCYSEY

SEQ ID NO: 62539 - protein, 9 aa, Homo sapiens
  light chain complementarity determining region 3 for antibody 31270
PQYGNSPWT

SEQ ID NO: 62540 - protein, 17 aa, Homo sapiens
  heavy chain complementarity determining region 3 for antibody 31270
ALASVAAPGRIQWYFDL

SEQ ID NO: 62541 - protein, 9 aa, Homo sapiens
  light chain complementarity determining region 3 for antibody 31271
PQYDSLPWT

SEQ ID NO: 62542 - protein, 19 aa, Homo sapiens
  heavy chain complementarity determining region 3 for antibody 31271
ARTAIGKRYWASSGDQFDY

SEQ ID NO: 62543 - protein, 9 aa, Homo sapiens
  light chain complementarity determining region 3 for antibody 31272
PQYDNVPYS

SEQ ID NO: 62544 - protein, 12 aa, Homo sapiens
  heavy chain complementarity determining region 3 for antibody 31272
VREGRPSLALDI

SEQ ID NO: 62545 - protein, 9 aa, Homo sapiens
  light chain complementarity determining region 3 for antibody 31273
PQYAYSPIT

SEQ ID NO: 62546 - protein, 10 aa, Homo sapiens
  heavy chain complementarity determining region 3 for antibody 31273
ATGAGWLVDY

SEQ ID NO: 62547 - protein, 9 aa, Homo sapiens
  light chain complementarity determining region 3 for antibody 31274
PQYATSPWT

SEQ ID NO: 62548 - protein, 14 aa, Homo sapiens
  heavy chain complementarity determining region 3 for antibody 31274
ARFGWLDYYYGMDV

SEQ ID NO: 62549 - protein, 9 aa, Homo sapiens
  light chain complementarity determining region 3 for antibody 31275
PQYASSPLT

SEQ ID NO: 62550 - protein, 10 aa, Homo sapiens
  heavy chain complementarity determining region 3 for antibody 31275
AKGGGWLTDY

SEQ ID NO: 62551 - protein, 9 aa, Homo sapiens
  light chain complementarity determining region 3 for antibody 31276
PQTYSTPLT

SEQ ID NO: 62552 - protein, 18 aa, Homo sapiens
  heavy chain complementarity determining region 3 for antibody 31276
ARSGRRDSSGFLVNWFDY

SEQ ID NO: 62553 - protein, 9 aa, Homo sapiens
  light chain complementarity determining region 3 for antibody 31277
PQTYSPPFT

SEQ ID NO: 62554 - protein, 14 aa, Homo sapiens
  heavy chain complementarity determining region 3 for antibody 31277
ARGRDTSGYSGLDH

SEQ ID NO: 62555 - protein, 9 aa, Homo sapiens
  light chain complementarity determining region 3 for antibody 31278
PQTDSFPIT

SEQ ID NO: 62556 - protein, 14 aa, Homo sapiens
  heavy chain complementarity determining region 3 for antibody 31278
ARFMVRDVLYYFDL

SEQ ID NO: 62557 - protein, 9 aa, Homo sapiens
  light chain complementarity determining region 3 for antibody 31279
PQSRTFPVT

SEQ ID NO: 62558 - protein, 14 aa, Homo sapiens
  heavy chain complementarity determining region 3 for antibody 31279
IRQSKSDNWNYPDY

SEQ ID NO: 62559 - protein, 9 aa, Homo sapiens
  light chain complementarity determining region 3 for antibody 31280
PQSNRTPYT

SEQ ID NO: 62560 - protein, 14 aa, Homo sapiens
  heavy chain complementarity determining region 3 for antibody 31280
ATEGPSRMGKFFDS

SEQ ID NO: 62561 - protein, 10 aa, Homo sapiens
  light chain complementarity determining region 3 for antibody 31281
PQRYNWPPYT

SEQ ID NO: 62562 - protein, 11 aa, Homo sapiens
  heavy chain complementarity determining region 3 for antibody 31281
ARGVGSYPFDS

SEQ ID NO: 62563 - protein, 10 aa, Homo sapiens
  light chain complementarity determining region 3 for antibody 31282
PQRSTWTPLT

SEQ ID NO: 62564 - protein, 9 aa, Homo sapiens
  heavy chain complementarity determining region 3 for antibody 31282
ATPFGETPF

SEQ ID NO: 62565 - protein, 11 aa, Homo sapiens
  light chain complementarity determining region 3 for antibody 31283
PQRSNWPPALT

SEQ ID NO: 62566 - protein, 14 aa, Homo sapiens
  heavy chain complementarity determining region 3 for antibody 31283
AREGTAMVKDAFEI

SEQ ID NO: 62567 - protein, 9 aa, Homo sapiens
  light chain complementarity determining region 3 for antibody 31284
PQRSNWPIT

SEQ ID NO: 62568 - protein, 19 aa, Homo sapiens
  heavy chain complementarity determining region 3 for antibody 31284
AIHDPFYRGYSYGDDAFDI

SEQ ID NO: 62569 - protein, 8 aa, Homo sapiens
  light chain complementarity determining region 3 for antibody 31285
PQRSNWLT

SEQ ID NO: 62570 - protein, 17 aa, Homo sapiens
  heavy chain complementarity determining region 3 for antibody 31285
ARPFRGGGVPSVWYFDL

SEQ ID NO: 62571 - protein, 9 aa, Homo sapiens
  light chain complementarity determining region 3 for antibody 31286
PQRSHWPPT

SEQ ID NO: 62572 - protein, 15 aa, Homo sapiens
  heavy chain complementarity determining region 3 for antibody 31286
ARTERRGNGWYLYDF

SEQ ID NO: 62573 - protein, 10 aa, Homo sapiens
  light chain complementarity determining region 3 for antibody 31287
PQRSDWPPLT

SEQ ID NO: 62574 - protein, 10 aa, Homo sapiens
  heavy chain complementarity determining region 3 for antibody 31287
ARDYTMTFDY

SEQ ID NO: 62575 - protein, 9 aa, Homo sapiens
  light chain complementarity determining region 3 for antibody 31288
PQRSAWPLT

SEQ ID NO: 62576 - protein, 7 aa, Homo sapiens
  heavy chain complementarity determining region 3 for antibody 31288
VRDEWWP

SEQ ID NO: 62577 - protein, 10 aa, Homo sapiens
  light chain complementarity determining region 3 for antibody 31289
PQRNKWPPVI

SEQ ID NO: 62578 - protein, 12 aa, Homo sapiens
  heavy chain complementarity determining region 3 for antibody 31289
VRDGSSGWHFDY

SEQ ID NO: 62579 - protein, 9 aa, Homo sapiens
  light chain complementarity determining region 3 for antibody 31290
PQLNSYPLT

SEQ ID NO: 62580 - protein, 15 aa, Homo sapiens
  heavy chain complementarity determining region 3 for antibody 31290
AREFYGSGSYYLIDY

SEQ ID NO: 62581 - protein, 9 aa, Homo sapiens
  light chain complementarity determining region 3 for antibody 31291
PQLNRYLGT

SEQ ID NO: 62582 - protein, 18 aa, Homo sapiens
  heavy chain complementarity determining region 3 for antibody 31291
ARHSLTGFLILEHDAFDI

SEQ ID NO: 62583 - protein, 9 aa, Homo sapiens
  light chain complementarity determining region 3 for antibody 31292
PQHNSYPRT

SEQ ID NO: 62584 - protein, 15 aa, Homo sapiens
  heavy chain complementarity determining region 3 for antibody 31292
ARDSLVGATSLAFDI

SEQ ID NO: 62585 - protein, 9 aa, Homo sapiens
  light chain complementarity determining region 3 for antibody 31293
PQGNTFPLT

SEQ ID NO: 62586 - protein, 16 aa, Homo sapiens
  heavy chain complementarity determining region 3 for antibody 31293
ARGQSIWDDGYLGLDV

SEQ ID NO: 62587 - protein, 9 aa, Homo sapiens
  light chain complementarity determining region 3 for antibody 31294
PQGNSLPFT

SEQ ID NO: 62588 - protein, 15 aa, Homo sapiens
  heavy chain complementarity determining region 3 for antibody 31294
AKVATRPLRDYYFDS

SEQ ID NO: 62589 - protein, 9 aa, Homo sapiens
  light chain complementarity determining region 3 for antibody 31295
PQGHIYPFT

SEQ ID NO: 62590 - protein, 12 aa, Homo sapiens
  heavy chain complementarity determining region 3 for antibody 31295
ARPLDGDFGFDP

SEQ ID NO: 62591 - protein, 9 aa, Homo sapiens
  light chain complementarity determining region 3 for antibody 31296
PQFNTYPFT

SEQ ID NO: 62592 - protein, 15 aa, Homo sapiens
  heavy chain complementarity determining region 3 for antibody 31296
ARGLMVRGINDGVDI

SEQ ID NO: 62593 - protein, 9 aa, Homo sapiens
  light chain complementarity determining region 3 for antibody 31297
PQFNNWAGT

SEQ ID NO: 62594 - protein, 18 aa, Homo sapiens
  heavy chain complementarity determining region 3 for antibody 31297
ARAHWFGESPRYFHGLDV

SEQ ID NO: 62595 - protein, 9 aa, Homo sapiens
  light chain complementarity determining region 3 for antibody 31298
PQDGSSPRT

SEQ ID NO: 62596 - protein, 17 aa, Homo sapiens
  heavy chain complementarity determining region 3 for antibody 31298
ARDMATAPPGTTENFDH

SEQ ID NO: 62597 - protein, 9 aa, Homo sapiens
  light chain complementarity determining region 3 for antibody 31299
PQALSFPIT

SEQ ID NO: 62598 - protein, 11 aa, Homo sapiens
  heavy chain complementarity determining region 3 for antibody 31299
ATYYSGGWFDP

SEQ ID NO: 62599 - protein, 11 aa, Homo sapiens
  light chain complementarity determining region 3 for antibody 31300
PNYNTALRGLT

SEQ ID NO: 62600 - protein, 14 aa, Homo sapiens
  heavy chain complementarity determining region 3 for antibody 31300
AKPRNSYWLYYFDY

SEQ ID NO: 62601 - protein, 9 aa, Homo sapiens
  light chain complementarity determining region 3 for antibody 31301
PKYNSVPLT

SEQ ID NO: 62602 - protein, 14 aa, Homo sapiens
  heavy chain complementarity determining region 3 for antibody 31301
ARPQTWDLLYAFDM

SEQ ID NO: 62603 - protein, 9 aa, Homo sapiens
  light chain complementarity determining region 3 for antibody 31302
PKYDSAPLT

SEQ ID NO: 62604 - protein, 15 aa, Homo sapiens
  heavy chain complementarity determining region 3 for antibody 31302
ARDGGPYQVLLPFSD

SEQ ID NO: 62605 - protein, 9 aa, Homo sapiens
  light chain complementarity determining region 3 for antibody 31303
PDLNGFPFT

SEQ ID NO: 62606 - protein, 12 aa, Homo sapiens
  heavy chain complementarity determining region 3 for antibody 31303
AIWGGAQGGVEF

SEQ ID NO: 62607 - protein, 8 aa, Homo sapiens
  light chain complementarity determining region 3 for antibody 31304
MRGVGPYP

SEQ ID NO: 62608 - protein, 7 aa, Homo sapiens
  heavy chain complementarity determining region 3 for antibody 31304
ATKMGDY

SEQ ID NO: 62609 - protein, 8 aa, Homo sapiens
  light chain complementarity determining region 3 for antibody 31305
MRGVEPYL

SEQ ID NO: 62610 - protein, 7 aa, Homo sapiens
  heavy chain complementarity determining region 3 for antibody 31305
ATKMGDY

SEQ ID NO: 62611 - protein, 9 aa, Homo sapiens
  light chain complementarity determining region 3 for antibody 31306
MRGTHWPWT

SEQ ID NO: 62612 - protein, 12 aa, Homo sapiens
  heavy chain complementarity determining region 3 for antibody 31306
AKGPLITMTGMV

SEQ ID NO: 62613 - protein, 9 aa, Homo sapiens
  light chain complementarity determining region 3 for antibody 31307
MQVVRTPYI

SEQ ID NO: 62614 - protein, 17 aa, Homo sapiens
  heavy chain complementarity determining region 3 for antibody 31307
ARWYYYDSSGYYSHFDY

SEQ ID NO: 62615 - protein, 9 aa, Homo sapiens
  light chain complementarity determining region 3 for antibody 31308
MQVSPWPGT

SEQ ID NO: 62616 - protein, 10 aa, Homo sapiens
  heavy chain complementarity determining region 3 for antibody 31308
AKDYEGAGSD

SEQ ID NO: 62617 - protein, 9 aa, Homo sapiens
  light chain complementarity determining region 3 for antibody 31309
MQVRQTPLT

SEQ ID NO: 62618 - protein, 12 aa, Homo sapiens
  heavy chain complementarity determining region 3 for antibody 31309
VKDSDKKWELLD

SEQ ID NO: 62619 - protein, 9 aa, Homo sapiens
  light chain complementarity determining region 3 for antibody 31310
MQVLRTPHI

SEQ ID NO: 62620 - protein, 17 aa, Homo sapiens
  heavy chain complementarity determining region 3 for antibody 31310
ARWYYYDSSGYYSHFDY

SEQ ID NO: 62621 - protein, 9 aa, Homo sapiens
  light chain complementarity determining region 3 for antibody 31311
MQVLQTPYT

SEQ ID NO: 62622 - protein, 21 aa, Homo sapiens
  heavy chain complementarity determining region 3 for antibody 31311
ARDKNTWNSDGRYYYYWGLDV

SEQ ID NO: 62623 - protein, 8 aa, Homo sapiens
  light chain complementarity determining region 3 for antibody 31312
MQVLQTPT

SEQ ID NO: 62624 - protein, 9 aa, Homo sapiens
  heavy chain complementarity determining region 3 for antibody 31312
ARDSSAFGP

SEQ ID NO: 62625 - protein, 9 aa, Homo sapiens
  light chain complementarity determining region 3 for antibody 31313
MQVLQTPLT

SEQ ID NO: 62626 - protein, 12 aa, Homo sapiens
  heavy chain complementarity determining region 3 for antibody 31313
AKDAEQKWELHD

SEQ ID NO: 62627 - protein, 9 aa, Homo sapiens
  light chain complementarity determining region 3 for antibody 31314
MQVLQTPLP

SEQ ID NO: 62628 - protein, 12 aa, Homo sapiens
  heavy chain complementarity determining region 3 for antibody 31314
AKDSEQKWELHD

SEQ ID NO: 62629 - protein, 9 aa, Homo sapiens
  light chain complementarity determining region 3 for antibody 31315
MQVLQTPLP

SEQ ID NO: 62630 - protein, 12 aa, Homo sapiens
  heavy chain complementarity determining region 3 for antibody 31315
AKDSAKKWELLD

SEQ ID NO: 62631 - protein, 9 aa, Homo sapiens
  light chain complementarity determining region 3 for antibody 31316
MQVLQTPFT

SEQ ID NO: 62632 - protein, 12 aa, Homo sapiens
  heavy chain complementarity determining region 3 for antibody 31316
VKDSDKKWELLD

SEQ ID NO: 62633 - protein, 7 aa, Homo sapiens
  light chain complementarity determining region 3 for antibody 31317
MQVLQTL

SEQ ID NO: 62634 - protein, 15 aa, Homo sapiens
  heavy chain complementarity determining region 3 for antibody 31317
ARGGYGGSLYWYFDL

SEQ ID NO: 62635 - protein, 9 aa, Homo sapiens
  light chain complementarity determining region 3 for antibody 31318
MQVLQSPVS

SEQ ID NO: 62636 - protein, 12 aa, Homo sapiens
  heavy chain complementarity determining region 3 for antibody 31318
TRDPDSHYGMEV

SEQ ID NO: 62637 - protein, 9 aa, Homo sapiens
  light chain complementarity determining region 3 for antibody 31319
MQVLQSPLG

SEQ ID NO: 62638 - protein, 12 aa, Homo sapiens
  heavy chain complementarity determining region 3 for antibody 31319
TRDPDSHYGMEV

SEQ ID NO: 62639 - protein, 9 aa, Homo sapiens
  light chain complementarity determining region 3 for antibody 31320
MQVLQPPLT

SEQ ID NO: 62640 - protein, 12 aa, Homo sapiens
  heavy chain complementarity determining region 3 for antibody 31320
VKDSDKKWELLD

SEQ ID NO: 62641 - protein, 9 aa, Homo sapiens
  light chain complementarity determining region 3 for antibody 31321
MQVLQGPLS

SEQ ID NO: 62642 - protein, 12 aa, Homo sapiens
  heavy chain complementarity determining region 3 for antibody 31321
TRDPDSHYGMEV

SEQ ID NO: 62643 - protein, 9 aa, Homo sapiens
  light chain complementarity determining region 3 for antibody 31322
MQVLKTPPT

SEQ ID NO: 62644 - protein, 12 aa, Homo sapiens
  heavy chain complementarity determining region 3 for antibody 31322
VKDSDKKWELLD

SEQ ID NO: 62645 - protein, 9 aa, Homo sapiens
  light chain complementarity determining region 3 for antibody 31323
MQVLKSPLS

SEQ ID NO: 62646 - protein, 12 aa, Homo sapiens
  heavy chain complementarity determining region 3 for antibody 31323
TRDPDSHYGMEV

SEQ ID NO: 62647 - protein, 9 aa, Homo sapiens
  light chain complementarity determining region 3 for antibody 31324
MQVLETPLT

SEQ ID NO: 62648 - protein, 12 aa, Homo sapiens
  heavy chain complementarity determining region 3 for antibody 31324
THRLNWGSGFDY

SEQ ID NO: 62649 - protein, 9 aa, Homo sapiens
  light chain complementarity determining region 3 for antibody 31325
MQVLETPFT

SEQ ID NO: 62650 - protein, 15 aa, Homo sapiens
  heavy chain complementarity determining region 3 for antibody 31325
VRHYRELATGIEGDS

SEQ ID NO: 62651 - protein, 9 aa, Homo sapiens
  light chain complementarity determining region 3 for antibody 31326
MQTVQFVGT

SEQ ID NO: 62652 - protein, 14 aa, Homo sapiens
  heavy chain complementarity determining region 3 for antibody 31326
ARSVNTGQYYGLGY

SEQ ID NO: 62653 - protein, 9 aa, Homo sapiens
  light chain complementarity determining region 3 for antibody 31327
MQTLQTPWG

SEQ ID NO: 62654 - protein, 13 aa, Homo sapiens
  heavy chain complementarity determining region 3 for antibody 31327
AKVVSYGSGGLQY

SEQ ID NO: 62655 - protein, 9 aa, Homo sapiens
  light chain complementarity determining region 3 for antibody 31328
MQTLQTPWA

SEQ ID NO: 62656 - protein, 13 aa, Homo sapiens
  heavy chain complementarity determining region 3 for antibody 31328
AKVVSYGSGGLHY

SEQ ID NO: 62657 - protein, 9 aa, Homo sapiens
  light chain complementarity determining region 3 for antibody 31329
MQTLQTPLT

SEQ ID NO: 62658 - protein, 18 aa, Homo sapiens
  heavy chain complementarity determining region 3 for antibody 31329
ARAQGSGWELGSWGAYDS

SEQ ID NO: 62659 - protein, 9 aa, Homo sapiens
  light chain complementarity determining region 3 for antibody 31330
MQTLQTPLP

SEQ ID NO: 62660 - protein, 18 aa, Homo sapiens
  heavy chain complementarity determining region 3 for antibody 31330
ARAQGSGWELGSWGAYDF

SEQ ID NO: 62661 - protein, 9 aa, Homo sapiens
  light chain complementarity determining region 3 for antibody 31331
MQSTHWPYP

SEQ ID NO: 62662 - protein, 12 aa, Homo sapiens
  heavy chain complementarity determining region 3 for antibody 31331
ARDKSNHNPLVY

SEQ ID NO: 62663 - protein, 9 aa, Homo sapiens
  light chain complementarity determining region 3 for antibody 31332
MQSSRWPHT

SEQ ID NO: 62664 - protein, 8 aa, Homo sapiens
  heavy chain complementarity determining region 3 for antibody 31332
TAWGSSHH

SEQ ID NO: 62665 - protein, 9 aa, Homo sapiens
  light chain complementarity determining region 3 for antibody 31333
MQSRSWPPT

SEQ ID NO: 62666 - protein, 8 aa, Homo sapiens
  heavy chain complementarity determining region 3 for antibody 31333
TAWGSSQH

SEQ ID NO: 62667 - protein, 9 aa, Homo sapiens
  light chain complementarity determining region 3 for antibody 31334
MQSRRWPQP

SEQ ID NO: 62668 - protein, 8 aa, Homo sapiens
  heavy chain complementarity determining region 3 for antibody 31334
TAWGSSQH

SEQ ID NO: 62669 - protein, 9 aa, Homo sapiens
  light chain complementarity determining region 3 for antibody 31335
MQSRRWPNT

SEQ ID NO: 62670 - protein, 8 aa, Homo sapiens
  heavy chain complementarity determining region 3 for antibody 31335
TAWGSSHH

SEQ ID NO: 62671 - protein, 9 aa, Homo sapiens
  light chain complementarity determining region 3 for antibody 31336
MQSRRWPKT

SEQ ID NO: 62672 - protein, 8 aa, Homo sapiens
  heavy chain complementarity determining region 3 for antibody 31336
TAWGSSQH

SEQ ID NO: 62673 - protein, 9 aa, Homo sapiens
  light chain complementarity determining region 3 for antibody 31337
MQSRRWPHT

SEQ ID NO: 62674 - protein, 8 aa, Homo sapiens
  heavy chain complementarity determining region 3 for antibody 31337
TAWGSPQH

SEQ ID NO: 62675 - protein, 9 aa, Homo sapiens
  light chain complementarity determining region 3 for antibody 31338
MQSRRWPHN

SEQ ID NO: 62676 - protein, 8 aa, Homo sapiens
  heavy chain complementarity determining region 3 for antibody 31338
TAWGSSQH

SEQ ID NO: 62677 - protein, 9 aa, Homo sapiens
  light chain complementarity determining region 3 for antibody 31339
MQSRRWHHT

SEQ ID NO: 62678 - protein, 8 aa, Homo sapiens
  heavy chain complementarity determining region 3 for antibody 31339
TAWGSSQH

SEQ ID NO: 62679 - protein, 9 aa, Homo sapiens
  light chain complementarity determining region 3 for antibody 31340
MQSRRRPHT

SEQ ID NO: 62680 - protein, 8 aa, Homo sapiens
  heavy chain complementarity determining region 3 for antibody 31340
TAWGSSQH

SEQ ID NO: 62681 - protein, 9 aa, Homo sapiens
  light chain complementarity determining region 3 for antibody 31341
MQSRRGPHH

SEQ ID NO: 62682 - protein, 8 aa, Homo sapiens
  heavy chain complementarity determining region 3 for antibody 31341
TAWGSSHH

SEQ ID NO: 62683 - protein, 9 aa, Homo sapiens
  light chain complementarity determining region 3 for antibody 31342
MQSRQTVRT

SEQ ID NO: 62684 - protein, 18 aa, Homo sapiens
  heavy chain complementarity determining region 3 for antibody 31342
ARLDYYYGAGMPGRGFDH

SEQ ID NO: 62685 - protein, 9 aa, Homo sapiens
  light chain complementarity determining region 3 for antibody 31343
MQSRCWPHT

SEQ ID NO: 62686 - protein, 8 aa, Homo sapiens
  heavy chain complementarity determining region 3 for antibody 31343
TAWGSSQH

SEQ ID NO: 62687 - protein, 8 aa, Homo sapiens
  light chain complementarity determining region 3 for antibody 31344
MQSLQAFS

SEQ ID NO: 62688 - protein, 8 aa, Homo sapiens
  heavy chain complementarity determining region 3 for antibody 31344
VGHLRSPY

SEQ ID NO: 62689 - protein, 8 aa, Homo sapiens
  light chain complementarity determining region 3 for antibody 31345
MQSLHTLT

SEQ ID NO: 62690 - protein, 24 aa, Homo sapiens
  heavy chain complementarity determining region 3 for antibody 31345
ARVELGVTLIEDVPDYFLYYGMDV

SEQ ID NO: 62691 - protein, 8 aa, Homo sapiens
  light chain complementarity determining region 3 for antibody 31346
MQSLHTLT

SEQ ID NO: 62692 - protein, 24 aa, Homo sapiens
  heavy chain complementarity determining region 3 for antibody 31346
ARVELGVALIEDVPDYFLYYGMDV

SEQ ID NO: 62693 - protein, 8 aa, Homo sapiens
  light chain complementarity determining region 3 for antibody 31347
MQSLHTLP

SEQ ID NO: 62694 - protein, 24 aa, Homo sapiens
  heavy chain complementarity determining region 3 for antibody 31347
ARVELGVTLIEDVPDYFLYYGMDV

SEQ ID NO: 62695 - protein, 10 aa, Homo sapiens
  light chain complementarity determining region 3 for antibody 31348
MQSIQPPRWP

SEQ ID NO: 62696 - protein, 8 aa, Homo sapiens
  heavy chain complementarity determining region 3 for antibody 31348
AKGYGFDC

SEQ ID NO: 62697 - protein, 10 aa, Homo sapiens
  light chain complementarity determining region 3 for antibody 31349
MQSIQPPRLT

SEQ ID NO: 62698 - protein, 8 aa, Homo sapiens
  heavy chain complementarity determining region 3 for antibody 31349
AKGYGFDC

SEQ ID NO: 62699 - protein, 10 aa, Homo sapiens
  light chain complementarity determining region 3 for antibody 31350
MQSIQLPRWT

SEQ ID NO: 62700 - protein, 8 aa, Homo sapiens
  heavy chain complementarity determining region 3 for antibody 31350
AKGYGFDC

SEQ ID NO: 62701 - protein, 10 aa, Homo sapiens
  light chain complementarity determining region 3 for antibody 31351
MQSIKPPRWT

SEQ ID NO: 62702 - protein, 8 aa, Homo sapiens
  heavy chain complementarity determining region 3 for antibody 31351
AKGYGFDC

SEQ ID NO: 62703 - protein, 9 aa, Homo sapiens
  light chain complementarity determining region 3 for antibody 31352
MQRRRWPQT

SEQ ID NO: 62704 - protein, 8 aa, Homo sapiens
  heavy chain complementarity determining region 3 for antibody 31352
TAWGSSQH

SEQ ID NO: 62705 - protein, 9 aa, Homo sapiens
  light chain complementarity determining region 3 for antibody 31353
MQRRRGPPT

SEQ ID NO: 62706 - protein, 8 aa, Homo sapiens
  heavy chain complementarity determining region 3 for antibody 31353
TAWGSSQH

SEQ ID NO: 62707 - protein, 9 aa, Homo sapiens
  light chain complementarity determining region 3 for antibody 31354
MQRRRGPHT

SEQ ID NO: 62708 - protein, 8 aa, Homo sapiens
  heavy chain complementarity determining region 3 for antibody 31354
TAWGSSHH

SEQ ID NO: 62709 - protein, 9 aa, Homo sapiens
  light chain complementarity determining region 3 for antibody 31355
MQRRRCPHT

SEQ ID NO: 62710 - protein, 8 aa, Homo sapiens
  heavy chain complementarity determining region 3 for antibody 31355
TAWGSSQH

SEQ ID NO: 62711 - protein, 10 aa, Homo sapiens
  light chain complementarity determining region 3 for antibody 31356
MQRIQPPRRT

SEQ ID NO: 62712 - protein, 8 aa, Homo sapiens
  heavy chain complementarity determining region 3 for antibody 31356
AKGYGFDC

SEQ ID NO: 62713 - protein, 10 aa, Homo sapiens
  light chain complementarity determining region 3 for antibody 31357
MQRIQPPRGT

SEQ ID NO: 62714 - protein, 8 aa, Homo sapiens
  heavy chain complementarity determining region 3 for antibody 31357
AKGYGFDC

SEQ ID NO: 62715 - protein, 9 aa, Homo sapiens
  light chain complementarity determining region 3 for antibody 31358
MQQTHFPYT

SEQ ID NO: 62716 - protein, 14 aa, Homo sapiens
  heavy chain complementarity determining region 3 for antibody 31358
AREGGYSGYEHFDY

SEQ ID NO: 62717 - protein, 9 aa, Homo sapiens
  light chain complementarity determining region 3 for antibody 31359
MQQTHFPQT

SEQ ID NO: 62718 - protein, 14 aa, Homo sapiens
  heavy chain complementarity determining region 3 for antibody 31359
AREGGYSGYEHFDY

SEQ ID NO: 62719 - protein, 9 aa, Homo sapiens
  light chain complementarity determining region 3 for antibody 31360
MQQTHFPPT

SEQ ID NO: 62720 - protein, 14 aa, Homo sapiens
  heavy chain complementarity determining region 3 for antibody 31360
AREGGYSGYEHFDY

SEQ ID NO: 62721 - protein, 9 aa, Homo sapiens
  light chain complementarity determining region 3 for antibody 31361
MQQTHFPHT

SEQ ID NO: 62722 - protein, 14 aa, Homo sapiens
  heavy chain complementarity determining region 3 for antibody 31361
AREGGYSGYEHFDS

SEQ ID NO: 62723 - protein, 9 aa, Homo sapiens
  light chain complementarity determining region 3 for antibody 31362
MQQTHFPHT

SEQ ID NO: 62724 - protein, 14 aa, Homo sapiens
  heavy chain complementarity determining region 3 for antibody 31362
AREGGYSGSEHFDY

SEQ ID NO: 62725 - protein, 9 aa, Homo sapiens
  light chain complementarity determining region 3 for antibody 31363
MQQSHFPHT

SEQ ID NO: 62726 - protein, 14 aa, Homo sapiens
  heavy chain complementarity determining region 3 for antibody 31363
AREGGYSGYEHFDY

SEQ ID NO: 62727 - protein, 9 aa, Homo sapiens
  light chain complementarity determining region 3 for antibody 31364
MQPLQTPWA

SEQ ID NO: 62728 - protein, 13 aa, Homo sapiens
  heavy chain complementarity determining region 3 for antibody 31364
AKVVSYGSGGLQY

SEQ ID NO: 62729 - protein, 9 aa, Homo sapiens
  light chain complementarity determining region 3 for antibody 31365
MQPLHTPVT

SEQ ID NO: 62730 - protein, 18 aa, Homo sapiens
  heavy chain complementarity determining region 3 for antibody 31365
ARPFYDSYTYHYYYGLDV

SEQ ID NO: 62731 - protein, 9 aa, Homo sapiens
  light chain complementarity determining region 3 for antibody 31366
MQPLHPPIT

SEQ ID NO: 62732 - protein, 18 aa, Homo sapiens
  heavy chain complementarity determining region 3 for antibody 31366
ARPFYDSYTYHYYYGLDV

SEQ ID NO: 62733 - protein, 9 aa, Homo sapiens
  light chain complementarity determining region 3 for antibody 31367
MQNSHWPGT

SEQ ID NO: 62734 - protein, 10 aa, Homo sapiens
  heavy chain complementarity determining region 3 for antibody 31367
VCDYSGSGSD

SEQ ID NO: 62735 - protein, 9 aa, Homo sapiens
  light chain complementarity determining region 3 for antibody 31368
MQILQTPIT

SEQ ID NO: 62736 - protein, 12 aa, Homo sapiens
  heavy chain complementarity determining region 3 for antibody 31368
ARDGGSSWSEFP

SEQ ID NO: 62737 - protein, 9 aa, Homo sapiens
  light chain complementarity determining region 3 for antibody 31369
MQILQTPIP

SEQ ID NO: 62738 - protein, 12 aa, Homo sapiens
  heavy chain complementarity determining region 3 for antibody 31369
ARDGGSSWSEFT

SEQ ID NO: 62739 - protein, 9 aa, Homo sapiens
  light chain complementarity determining region 3 for antibody 31370
MQIIQTPIT

SEQ ID NO: 62740 - protein, 12 aa, Homo sapiens
  heavy chain complementarity determining region 3 for antibody 31370
ARDGGSSWSEFT

SEQ ID NO: 62741 - protein, 9 aa, Homo sapiens
  light chain complementarity determining region 3 for antibody 31371
MQGVQTPYT

SEQ ID NO: 62742 - protein, 10 aa, Homo sapiens
  heavy chain complementarity determining region 3 for antibody 31371
GRDLSGARDY

SEQ ID NO: 62743 - protein, 9 aa, Homo sapiens
  light chain complementarity determining region 3 for antibody 31372
MQGTYWPKT

SEQ ID NO: 62744 - protein, 11 aa, Homo sapiens
  heavy chain complementarity determining region 3 for antibody 31372
ARNPDWGALDY

SEQ ID NO: 62745 - protein, 9 aa, Homo sapiens
  light chain complementarity determining region 3 for antibody 31373
MQGTYWPDT

SEQ ID NO: 62746 - protein, 10 aa, Homo sapiens
  heavy chain complementarity determining region 3 for antibody 31373
VRGGGWLADY

SEQ ID NO: 62747 - protein, 9 aa, Homo sapiens
  light chain complementarity determining region 3 for antibody 31374
MQGTYGPHI

SEQ ID NO: 62748 - protein, 11 aa, Homo sapiens
  heavy chain complementarity determining region 3 for antibody 31374
ARDPFFGALDC

SEQ ID NO: 62749 - protein, 9 aa, Homo sapiens
  light chain complementarity determining region 3 for antibody 31375
MQGTRWPYP

SEQ ID NO: 62750 - protein, 10 aa, Homo sapiens
  heavy chain complementarity determining region 3 for antibody 31375
ARNSGWSVDC

SEQ ID NO: 62751 - protein, 8 aa, Homo sapiens
  light chain complementarity determining region 3 for antibody 31376
MQGTRWPT

SEQ ID NO: 62752 - protein, 21 aa, Homo sapiens
  heavy chain complementarity determining region 3 for antibody 31376
AKDRPNYYESNGQYYTPKGDL

SEQ ID NO: 62753 - protein, 9 aa, Homo sapiens
  light chain complementarity determining region 3 for antibody 31377
MQGTQWRYT

SEQ ID NO: 62754 - protein, 10 aa, Homo sapiens
  heavy chain complementarity determining region 3 for antibody 31377
ASGQFYQFDF

SEQ ID NO: 62755 - protein, 9 aa, Homo sapiens
  light chain complementarity determining region 3 for antibody 31378
MQGTQWPNT

SEQ ID NO: 62756 - protein, 10 aa, Homo sapiens
  heavy chain complementarity determining region 3 for antibody 31378
ASGQFYQFDF

SEQ ID NO: 62757 - protein, 9 aa, Homo sapiens
  light chain complementarity determining region 3 for antibody 31379
MQGTQWPDT

SEQ ID NO: 62758 - protein, 10 aa, Homo sapiens
  heavy chain complementarity determining region 3 for antibody 31379
ASGQFYQFDF

SEQ ID NO: 62759 - protein, 9 aa, Homo sapiens
  light chain complementarity determining region 3 for antibody 31380
MQGTQWPDS

SEQ ID NO: 62760 - protein, 11 aa, Homo sapiens
  heavy chain complementarity determining region 3 for antibody 31380
GRGDRAGSIDY

SEQ ID NO: 62761 - protein, 9 aa, Homo sapiens
  light chain complementarity determining region 3 for antibody 31381
MQGTPWPYT

SEQ ID NO: 62762 - protein, 11 aa, Homo sapiens
  heavy chain complementarity determining region 3 for antibody 31381
ATLRTVGAVDY

SEQ ID NO: 62763 - protein, 9 aa, Homo sapiens
  light chain complementarity determining region 3 for antibody 31382
MQGTPWPWT

SEQ ID NO: 62764 - protein, 12 aa, Homo sapiens
  heavy chain complementarity determining region 3 for antibody 31382
AKGPLITMTGMV

SEQ ID NO: 62765 - protein, 9 aa, Homo sapiens
  light chain complementarity determining region 3 for antibody 31383
MQGTPWPRE

SEQ ID NO: 62766 - protein, 18 aa, Homo sapiens
  heavy chain complementarity determining region 3 for antibody 31383
ARDERDTCRNGLCYYFDY

SEQ ID NO: 62767 - protein, 9 aa, Homo sapiens
  light chain complementarity determining region 3 for antibody 31384
MQGTPWPQT

SEQ ID NO: 62768 - protein, 11 aa, Homo sapiens
  heavy chain complementarity determining region 3 for antibody 31384
ARDPGWGARDY

SEQ ID NO: 62769 - protein, 10 aa, Homo sapiens
  light chain complementarity determining region 3 for antibody 31385
MQGTPWPPWT

SEQ ID NO: 62770 - protein, 17 aa, Homo sapiens
  heavy chain complementarity determining region 3 for antibody 31385
VRDGYTASGRRNAPGAN

SEQ ID NO: 62771 - protein, 10 aa, Homo sapiens
  light chain complementarity determining region 3 for antibody 31386
MQGTPWPPWT

SEQ ID NO: 62772 - protein, 12 aa, Homo sapiens
  heavy chain complementarity determining region 3 for antibody 31386
TTGLNWGWEPDC

SEQ ID NO: 62773 - protein, 9 aa, Homo sapiens
  light chain complementarity determining region 3 for antibody 31387
MQGTPWPPT

SEQ ID NO: 62774 - protein, 15 aa, Homo sapiens
  heavy chain complementarity determining region 3 for antibody 31387
AKSSGPNIAVAGFDC

SEQ ID NO: 62775 - protein, 9 aa, Homo sapiens
  light chain complementarity determining region 3 for antibody 31388
MQGTPWPAT

SEQ ID NO: 62776 - protein, 15 aa, Homo sapiens
  heavy chain complementarity determining region 3 for antibody 31388
VHTQLWFGDQCYFDF

SEQ ID NO: 62777 - protein, 9 aa, Homo sapiens
  light chain complementarity determining region 3 for antibody 31389
MQGTNWPYT

SEQ ID NO: 62778 - protein, 11 aa, Homo sapiens
  heavy chain complementarity determining region 3 for antibody 31389
ARDPAWGALDI

SEQ ID NO: 62779 - protein, 8 aa, Homo sapiens
  light chain complementarity determining region 3 for antibody 31390
MQGTNWPT

SEQ ID NO: 62780 - protein, 21 aa, Homo sapiens
  heavy chain complementarity determining region 3 for antibody 31390
AKDRPNYYESNGQYYTPKGDL

SEQ ID NO: 62781 - protein, 9 aa, Homo sapiens
  light chain complementarity determining region 3 for antibody 31391
MQGTNWPRT

SEQ ID NO: 62782 - protein, 12 aa, Homo sapiens
  heavy chain complementarity determining region 3 for antibody 31391
ATLSMANAKFDH

SEQ ID NO: 62783 - protein, 10 aa, Homo sapiens
  light chain complementarity determining region 3 for antibody 31392
MQGTNWPLWT

SEQ ID NO: 62784 - protein, 12 aa, Homo sapiens
  heavy chain complementarity determining region 3 for antibody 31392
TTGLNWGWEPDY

SEQ ID NO: 62785 - protein, 9 aa, Homo sapiens
  light chain complementarity determining region 3 for antibody 31393
MQGTNWPDT

SEQ ID NO: 62786 - protein, 10 aa, Homo sapiens
  heavy chain complementarity determining region 3 for antibody 31393
ARDGDFVLDY

SEQ ID NO: 62787 - protein, 9 aa, Homo sapiens
  light chain complementarity determining region 3 for antibody 31394
MQGTHWRYT

SEQ ID NO: 62788 - protein, 10 aa, Homo sapiens
  heavy chain complementarity determining region 3 for antibody 31394
ARDGDFVLDY

SEQ ID NO: 62789 - protein, 9 aa, Homo sapiens
  light chain complementarity determining region 3 for antibody 31395
MQGTHWPYT

SEQ ID NO: 62790 - protein, 18 aa, Homo sapiens
  heavy chain complementarity determining region 3 for antibody 31395
ARDPADGDNGLVWGGFDI

SEQ ID NO: 62791 - protein, 9 aa, Homo sapiens
  light chain complementarity determining region 3 for antibody 31396
MQGTHWPYT

SEQ ID NO: 62792 - protein, 11 aa, Homo sapiens
  heavy chain complementarity determining region 3 for antibody 31396
AALRTVGAVDY

SEQ ID NO: 62793 - protein, 9 aa, Homo sapiens
  light chain complementarity determining region 3 for antibody 31397
MQGTHWPYP

SEQ ID NO: 62794 - protein, 11 aa, Homo sapiens
  heavy chain complementarity determining region 3 for antibody 31397
IKDMSPGGADV

SEQ ID NO: 62795 - protein, 9 aa, Homo sapiens
  light chain complementarity determining region 3 for antibody 31398
MQGTHWPWA

SEQ ID NO: 62796 - protein, 14 aa, Homo sapiens
  heavy chain complementarity determining region 3 for antibody 31398
ARKRVLWSDGGFDS

SEQ ID NO: 62797 - protein, 8 aa, Homo sapiens
  light chain complementarity determining region 3 for antibody 31399
MQGTHWPT

SEQ ID NO: 62798 - protein, 21 aa, Homo sapiens
  heavy chain complementarity determining region 3 for antibody 31399
AKDRPNYYESNGQYYSPKGDL

SEQ ID NO: 62799 - protein, 9 aa, Homo sapiens
  light chain complementarity determining region 3 for antibody 31400
MQGTHWPSP

SEQ ID NO: 62800 - protein, 11 aa, Homo sapiens
  heavy chain complementarity determining region 3 for antibody 31400
ARDPAWGALDI

SEQ ID NO: 62801 - protein, 10 aa, Homo sapiens
  light chain complementarity determining region 3 for antibody 31401
MQGTHWPRWT

SEQ ID NO: 62802 - protein, 12 aa, Homo sapiens
  heavy chain complementarity determining region 3 for antibody 31401
TTGLNWGWEPDY

SEQ ID NO: 62803 - protein, 9 aa, Homo sapiens
  light chain complementarity determining region 3 for antibody 31402
MQGTHWPRR

SEQ ID NO: 62804 - protein, 17 aa, Homo sapiens
  heavy chain complementarity determining region 3 for antibody 31402
ARDAGSSWYLIVDAFDI

SEQ ID NO: 62805 - protein, 10 aa, Homo sapiens
  light chain complementarity determining region 3 for antibody 31403
MQGTHWPRGT

SEQ ID NO: 62806 - protein, 17 aa, Homo sapiens
  heavy chain complementarity determining region 3 for antibody 31403
VRDGYTASGRRNAPGAN

SEQ ID NO: 62807 - protein, 10 aa, Homo sapiens
  light chain complementarity determining region 3 for antibody 31404
MQGTHWPRGT

SEQ ID NO: 62808 - protein, 12 aa, Homo sapiens
  heavy chain complementarity determining region 3 for antibody 31404
TTGLNWGWEPDY

SEQ ID NO: 62809 - protein, 9 aa, Homo sapiens
  light chain complementarity determining region 3 for antibody 31405
MQGTHWPRG

SEQ ID NO: 62810 - protein, 18 aa, Homo sapiens
  heavy chain complementarity determining region 3 for antibody 31405
ARDERDTCRNGLCYYFDY

SEQ ID NO: 62811 - protein, 9 aa, Homo sapiens
  light chain complementarity determining region 3 for antibody 31406
MQGTHWPRE

SEQ ID NO: 62812 - protein, 18 aa, Homo sapiens
  heavy chain complementarity determining region 3 for antibody 31406
ARDERDTCTNGLCYYSDY

SEQ ID NO: 62813 - protein, 9 aa, Homo sapiens
  light chain complementarity determining region 3 for antibody 31407
MQGTHWPRE

SEQ ID NO: 62814 - protein, 18 aa, Homo sapiens
  heavy chain complementarity determining region 3 for antibody 31407
ARDERDTCRNGLCYYFDY

SEQ ID NO: 62815 - protein, 10 aa, Homo sapiens
  light chain complementarity determining region 3 for antibody 31408
MQGTHWPPWT

SEQ ID NO: 62816 - protein, 17 aa, Homo sapiens
  heavy chain complementarity determining region 3 for antibody 31408
VRDGYAASGRRNAPGAN

SEQ ID NO: 62817 - protein, 10 aa, Homo sapiens
  light chain complementarity determining region 3 for antibody 31409
MQGTHWPPWT

SEQ ID NO: 62818 - protein, 12 aa, Homo sapiens
  heavy chain complementarity determining region 3 for antibody 31409
ATGLNWGWEPDC

SEQ ID NO: 62819 - protein, 9 aa, Homo sapiens
  light chain complementarity determining region 3 for antibody 31410
MQGTHWPPT

SEQ ID NO: 62820 - protein, 11 aa, Homo sapiens
  heavy chain complementarity determining region 3 for antibody 31410
ARDIGWNALDL

SEQ ID NO: 62821 - protein, 9 aa, Homo sapiens
  light chain complementarity determining region 3 for antibody 31411
MQGTHWPPT

SEQ ID NO: 62822 - protein, 13 aa, Homo sapiens
  heavy chain complementarity determining region 3 for antibody 31411
AGGNGVYDYCCDY

SEQ ID NO: 62823 - protein, 9 aa, Homo sapiens
  light chain complementarity determining region 3 for antibody 31412
MQGTHWPPT

SEQ ID NO: 62824 - protein, 13 aa, Homo sapiens
  heavy chain complementarity determining region 3 for antibody 31412
AGGNGVYDSFCDY

SEQ ID NO: 62825 - protein, 10 aa, Homo sapiens
  light chain complementarity determining region 3 for antibody 31413
MQGTHWPPRT

SEQ ID NO: 62826 - protein, 17 aa, Homo sapiens
  heavy chain complementarity determining region 3 for antibody 31413
VRDGYTASGRRNAPGAN

SEQ ID NO: 62827 - protein, 10 aa, Homo sapiens
  light chain complementarity determining region 3 for antibody 31414
MQGTHWPPRR

SEQ ID NO: 62828 - protein, 12 aa, Homo sapiens
  heavy chain complementarity determining region 3 for antibody 31414
VRDPQIGDVSDY

SEQ ID NO: 62829 - protein, 9 aa, Homo sapiens
  light chain complementarity determining region 3 for antibody 31415
MQGTHWPPP

SEQ ID NO: 62830 - protein, 13 aa, Homo sapiens
  heavy chain complementarity determining region 3 for antibody 31415
AGGNGVYDYFCDY

SEQ ID NO: 62831 - protein, 10 aa, Homo sapiens
  light chain complementarity determining region 3 for antibody 31416
MQGTHWPPGT

SEQ ID NO: 62832 - protein, 17 aa, Homo sapiens
  heavy chain complementarity determining region 3 for antibody 31416
VRDGYAASGRRNAPGAN

SEQ ID NO: 62833 - protein, 10 aa, Homo sapiens
  light chain complementarity determining region 3 for antibody 31417
MQGTHWPPGT

SEQ ID NO: 62834 - protein, 12 aa, Homo sapiens
  heavy chain complementarity determining region 3 for antibody 31417
TTGLNWGWEPDC

SEQ ID NO: 62835 - protein, 8 aa, Homo sapiens
  light chain complementarity determining region 3 for antibody 31418
MQGTHWPP

SEQ ID NO: 62836 - protein, 21 aa, Homo sapiens
  heavy chain complementarity determining region 3 for antibody 31418
AKDRPNYYESNGQYDTPKGDL

SEQ ID NO: 62837 - protein, 10 aa, Homo sapiens
  light chain complementarity determining region 3 for antibody 31419
MQGTHWPLWP

SEQ ID NO: 62838 - protein, 12 aa, Homo sapiens
  heavy chain complementarity determining region 3 for antibody 31419
TTGLNWGWEPDY

SEQ ID NO: 62839 - protein, 9 aa, Homo sapiens
  light chain complementarity determining region 3 for antibody 31420
MQGTHWPLP

SEQ ID NO: 62840 - protein, 11 aa, Homo sapiens
  heavy chain complementarity determining region 3 for antibody 31420
ARDIGWNALDL

SEQ ID NO: 62841 - protein, 9 aa, Homo sapiens
  light chain complementarity determining region 3 for antibody 31421
MQGTHWPLE

SEQ ID NO: 62842 - protein, 18 aa, Homo sapiens
  heavy chain complementarity determining region 3 for antibody 31421
ARDERDTCTNGLCYCFDY

SEQ ID NO: 62843 - protein, 9 aa, Homo sapiens
  light chain complementarity determining region 3 for antibody 31422
MQGTHWPLE

SEQ ID NO: 62844 - protein, 18 aa, Homo sapiens
  heavy chain complementarity determining region 3 for antibody 31422
ARDERDTCRNGLCYHFDY

SEQ ID NO: 62845 - protein, 9 aa, Homo sapiens
  light chain complementarity determining region 3 for antibody 31423
MQGTHWPGT

SEQ ID NO: 62846 - protein, 15 aa, Homo sapiens
  heavy chain complementarity determining region 3 for antibody 31423
VRDPPSTTAANPRDY

SEQ ID NO: 62847 - protein, 9 aa, Homo sapiens
  light chain complementarity determining region 3 for antibody 31424
MQGTHWPFT

SEQ ID NO: 62848 - protein, 11 aa, Homo sapiens
  heavy chain complementarity determining region 3 for antibody 31424
ARDIGWNALDL

SEQ ID NO: 62849 - protein, 9 aa, Homo sapiens
  light chain complementarity determining region 3 for antibody 31425
MQGTHWPFT

SEQ ID NO: 62850 - protein, 10 aa, Homo sapiens
  heavy chain complementarity determining region 3 for antibody 31425
ARDGDFVLDY

SEQ ID NO: 62851 - protein, 9 aa, Homo sapiens
  light chain complementarity determining region 3 for antibody 31426
MQGTHWPFT

SEQ ID NO: 62852 - protein, 9 aa, Homo sapiens
  heavy chain complementarity determining region 3 for antibody 31426
AEDPRTFPH

SEQ ID NO: 62853 - protein, 9 aa, Homo sapiens
  light chain complementarity determining region 3 for antibody 31427
MQGTHWPDT

SEQ ID NO: 62854 - protein, 18 aa, Homo sapiens
  heavy chain complementarity determining region 3 for antibody 31427
ARDPADGDNGLVWGGFDI

SEQ ID NO: 62855 - protein, 9 aa, Homo sapiens
  light chain complementarity determining region 3 for antibody 31428
MQGTHWPAT

SEQ ID NO: 62856 - protein, 10 aa, Homo sapiens
  heavy chain complementarity determining region 3 for antibody 31428
ARDGDFVLDY

SEQ ID NO: 62857 - protein, 11 aa, Homo sapiens
  light chain complementarity determining region 3 for antibody 31429
MQGTHWLTPGG

SEQ ID NO: 62858 - protein, 19 aa, Homo sapiens
  heavy chain complementarity determining region 3 for antibody 31429
ARDGGPIVLMGFAIYGMDV

SEQ ID NO: 62859 - protein, 9 aa, Homo sapiens
  light chain complementarity determining region 3 for antibody 31430
MQGTHRPPT

SEQ ID NO: 62860 - protein, 15 aa, Homo sapiens
  heavy chain complementarity determining region 3 for antibody 31430
AKSSGPSIAVPGFDY

SEQ ID NO: 62861 - protein, 9 aa, Homo sapiens
  light chain complementarity determining region 3 for antibody 31431
MQGTHGPRT

SEQ ID NO: 62862 - protein, 23 aa, Homo sapiens
  heavy chain complementarity determining region 3 for antibody 31431
ARAQPRWGIAVAGPPGRYYGMDV

SEQ ID NO: 62863 - protein, 9 aa, Homo sapiens
  light chain complementarity determining region 3 for antibody 31432
MQGTHGPQT

SEQ ID NO: 62864 - protein, 13 aa, Homo sapiens
  heavy chain complementarity determining region 3 for antibody 31432
ARTGQWLGGQYDY

SEQ ID NO: 62865 - protein, 10 aa, Homo sapiens
  light chain complementarity determining region 3 for antibody 31433
MQGTHGPPYT

SEQ ID NO: 62866 - protein, 19 aa, Homo sapiens
  heavy chain complementarity determining region 3 for antibody 31433
ARIECMHASPGSLCDAFDV

SEQ ID NO: 62867 - protein, 9 aa, Homo sapiens
  light chain complementarity determining region 3 for antibody 31434
MQGTHGPPT

SEQ ID NO: 62868 - protein, 11 aa, Homo sapiens
  heavy chain complementarity determining region 3 for antibody 31434
TGGQQLVNFDF

SEQ ID NO: 62869 - protein, 9 aa, Homo sapiens
  light chain complementarity determining region 3 for antibody 31435
MQGTHGPPT

SEQ ID NO: 62870 - protein, 15 aa, Homo sapiens
  heavy chain complementarity determining region 3 for antibody 31435
AKSSGPSIAVTGFDY

SEQ ID NO: 62871 - protein, 9 aa, Homo sapiens
  light chain complementarity determining region 3 for antibody 31436
MQGTHGPLT

SEQ ID NO: 62872 - protein, 9 aa, Homo sapiens
  heavy chain complementarity determining region 3 for antibody 31436
ARNNWGIDY

SEQ ID NO: 62873 - protein, 9 aa, Homo sapiens
  light chain complementarity determining region 3 for antibody 31437
MQGTHGPLT

SEQ ID NO: 62874 - protein, 11 aa, Homo sapiens
  heavy chain complementarity determining region 3 for antibody 31437
ARDIGWNALDL

SEQ ID NO: 62875 - protein, 10 aa, Homo sapiens
  light chain complementarity determining region 3 for antibody 31438
MQGTHGPLGT

SEQ ID NO: 62876 - protein, 12 aa, Homo sapiens
  heavy chain complementarity determining region 3 for antibody 31438
TTGLNWGWEPDY

SEQ ID NO: 62877 - protein, 9 aa, Homo sapiens
  light chain complementarity determining region 3 for antibody 31439
MQGTHGPLG

SEQ ID NO: 62878 - protein, 18 aa, Homo sapiens
  heavy chain complementarity determining region 3 for antibody 31439
ARDERDTCRNGLCYYFDY

SEQ ID NO: 62879 - protein, 9 aa, Homo sapiens
  light chain complementarity determining region 3 for antibody 31440
MQGTHGPKT

SEQ ID NO: 62880 - protein, 9 aa, Homo sapiens
  heavy chain complementarity determining region 3 for antibody 31440
AKGYYDSSY

SEQ ID NO: 62881 - protein, 9 aa, Homo sapiens
  light chain complementarity determining region 3 for antibody 31441
MQGTHGPGT

SEQ ID NO: 62882 - protein, 15 aa, Homo sapiens
  heavy chain complementarity determining region 3 for antibody 31441
VHTQLWFGDQCYFDF

SEQ ID NO: 62883 - protein, 9 aa, Homo sapiens
  light chain complementarity determining region 3 for antibody 31442
MQGTHGPFT

SEQ ID NO: 62884 - protein, 9 aa, Homo sapiens
  heavy chain complementarity determining region 3 for antibody 31442
AEDPRTLPH

SEQ ID NO: 62885 - protein, 9 aa, Homo sapiens
  light chain complementarity determining region 3 for antibody 31443
MQGTHGPAT

SEQ ID NO: 62886 - protein, 15 aa, Homo sapiens
  heavy chain complementarity determining region 3 for antibody 31443
VHTQLWFGDQCYFDF

SEQ ID NO: 62887 - protein, 9 aa, Homo sapiens
  light chain complementarity determining region 3 for antibody 31444
MQGTHCPYT

SEQ ID NO: 62888 - protein, 11 aa, Homo sapiens
  heavy chain complementarity determining region 3 for antibody 31444
IKDMSPGGADV

SEQ ID NO: 62889 - protein, 9 aa, Homo sapiens
  light chain complementarity determining region 3 for antibody 31445
MQGTHCPYT

SEQ ID NO: 62890 - protein, 15 aa, Homo sapiens
  heavy chain complementarity determining region 3 for antibody 31445
ARDIRGSWYGTSVDY

SEQ ID NO: 62891 - protein, 9 aa, Homo sapiens
  light chain complementarity determining region 3 for antibody 31446
MQGTHCPRT

SEQ ID NO: 62892 - protein, 12 aa, Homo sapiens
  heavy chain complementarity determining region 3 for antibody 31446
ATLSMANAKFDH

SEQ ID NO: 62893 - protein, 8 aa, Homo sapiens
  light chain complementarity determining region 3 for antibody 31447
MQGTDMDT

SEQ ID NO: 62894 - protein, 14 aa, Homo sapiens
  heavy chain complementarity determining region 3 for antibody 31447
ARGSMIRGVPDIDY

SEQ ID NO: 62895 - protein, 10 aa, Homo sapiens
  light chain complementarity determining region 3 for antibody 31448
MQGSYWPRWT

SEQ ID NO: 62896 - protein, 11 aa, Homo sapiens
  heavy chain complementarity determining region 3 for antibody 31448
ARDTPGVGIDY

SEQ ID NO: 62897 - protein, 10 aa, Homo sapiens
  light chain complementarity determining region 3 for antibody 31449
MQGSYWPRWT

SEQ ID NO: 62898 - protein, 11 aa, Homo sapiens
  heavy chain complementarity determining region 3 for antibody 31449
ARDTPGIGIDY

SEQ ID NO: 62899 - protein, 10 aa, Homo sapiens
  light chain complementarity determining region 3 for antibody 31450
MQGSYWPPWT

SEQ ID NO: 62900 - protein, 11 aa, Homo sapiens
  heavy chain complementarity determining region 3 for antibody 31450
ARDTPGSGIDY

SEQ ID NO: 62901 - protein, 10 aa, Homo sapiens
  light chain complementarity determining region 3 for antibody 31451
MQGSYWPPWT

SEQ ID NO: 62902 - protein, 11 aa, Homo sapiens
  heavy chain complementarity determining region 3 for antibody 31451
ARDTPGIGIDH

SEQ ID NO: 62903 - protein, 10 aa, Homo sapiens
  light chain complementarity determining region 3 for antibody 31452
MQGSYWPPWT

SEQ ID NO: 62904 - protein, 11 aa, Homo sapiens
  heavy chain complementarity determining region 3 for antibody 31452
ARDTPGGGIDY

SEQ ID NO: 62905 - protein, 10 aa, Homo sapiens
  light chain complementarity determining region 3 for antibody 31453
MQGSYWPPWT

SEQ ID NO: 62906 - protein, 11 aa, Homo sapiens
  heavy chain complementarity determining region 3 for antibody 31453
ARDSPGVGIDY

SEQ ID NO: 62907 - protein, 10 aa, Homo sapiens
  light chain complementarity determining region 3 for antibody 31454
MQGSYWPPWT

SEQ ID NO: 62908 - protein, 11 aa, Homo sapiens
  heavy chain complementarity determining region 3 for antibody 31454
ARDAPGIGIDY

SEQ ID NO: 62909 - protein, 10 aa, Homo sapiens
  light chain complementarity determining region 3 for antibody 31455
MQGSYWPPWR

SEQ ID NO: 62910 - protein, 11 aa, Homo sapiens
  heavy chain complementarity determining region 3 for antibody 31455
ARDTPGVGIDY

SEQ ID NO: 62911 - protein, 10 aa, Homo sapiens
  light chain complementarity determining region 3 for antibody 31456
MQGSYWPPWR

SEQ ID NO: 62912 - protein, 11 aa, Homo sapiens
  heavy chain complementarity determining region 3 for antibody 31456
ARDTPGIGIDY

SEQ ID NO: 62913 - protein, 10 aa, Homo sapiens
  light chain complementarity determining region 3 for antibody 31457
MQGSYWPPWK

SEQ ID NO: 62914 - protein, 11 aa, Homo sapiens
  heavy chain complementarity determining region 3 for antibody 31457
ARDTPGIGIDY

SEQ ID NO: 62915 - protein, 10 aa, Homo sapiens
  light chain complementarity determining region 3 for antibody 31458
MQGSYWPPWA

SEQ ID NO: 62916 - protein, 11 aa, Homo sapiens
  heavy chain complementarity determining region 3 for antibody 31458
ARDTPGVGIDY

SEQ ID NO: 62917 - protein, 10 aa, Homo sapiens
  light chain complementarity determining region 3 for antibody 31459
MQGSYWPPGR

SEQ ID NO: 62918 - protein, 11 aa, Homo sapiens
  heavy chain complementarity determining region 3 for antibody 31459
ARDTPGVGIDY

SEQ ID NO: 62919 - protein, 10 aa, Homo sapiens
  light chain complementarity determining region 3 for antibody 31460
MQGSYWPPGR

SEQ ID NO: 62920 - protein, 11 aa, Homo sapiens
  heavy chain complementarity determining region 3 for antibody 31460
ARDTPGIGIDY

SEQ ID NO: 62921 - protein, 10 aa, Homo sapiens
  light chain complementarity determining region 3 for antibody 31461
MQGSYWLPWT

SEQ ID NO: 62922 - protein, 11 aa, Homo sapiens
  heavy chain complementarity determining region 3 for antibody 31461
ARDTPGVGIDY

SEQ ID NO: 62923 - protein, 9 aa, Homo sapiens
  light chain complementarity determining region 3 for antibody 31462
MQGSPWPPT

SEQ ID NO: 62924 - protein, 7 aa, Homo sapiens
  heavy chain complementarity determining region 3 for antibody 31462
ATNADYL

SEQ ID NO: 62925 - protein, 9 aa, Homo sapiens
  light chain complementarity determining region 3 for antibody 31463
MQGSNWPYT

SEQ ID NO: 62926 - protein, 10 aa, Homo sapiens
  heavy chain complementarity determining region 3 for antibody 31463
GRDNRGSIDF

SEQ ID NO: 62927 - protein, 9 aa, Homo sapiens
  light chain complementarity determining region 3 for antibody 31464
MQGSNWPPT

SEQ ID NO: 62928 - protein, 7 aa, Homo sapiens
  heavy chain complementarity determining region 3 for antibody 31464
ATNADYL

SEQ ID NO: 62929 - protein, 9 aa, Homo sapiens
  light chain complementarity determining region 3 for antibody 31465
MQGSHWRHT

SEQ ID NO: 62930 - protein, 11 aa, Homo sapiens
  heavy chain complementarity determining region 3 for antibody 31465
ARDPAWGARDY

SEQ ID NO: 62931 - protein, 9 aa, Homo sapiens
  light chain complementarity determining region 3 for antibody 31466
MQGSHWPYP

SEQ ID NO: 62932 - protein, 10 aa, Homo sapiens
  heavy chain complementarity determining region 3 for antibody 31466
GRDNHGSIDY

SEQ ID NO: 62933 - protein, 9 aa, Homo sapiens
  light chain complementarity determining region 3 for antibody 31467
MQGSHWPST

SEQ ID NO: 62934 - protein, 10 aa, Homo sapiens
  heavy chain complementarity determining region 3 for antibody 31467
GRDNRGSIDF

SEQ ID NO: 62935 - protein, 9 aa, Homo sapiens
  light chain complementarity determining region 3 for antibody 31468
MQGSHWPPP

SEQ ID NO: 62936 - protein, 7 aa, Homo sapiens
  heavy chain complementarity determining region 3 for antibody 31468
ATNADYL

SEQ ID NO: 62937 - protein, 9 aa, Homo sapiens
  light chain complementarity determining region 3 for antibody 31469
MQGSHWPNT

SEQ ID NO: 62938 - protein, 10 aa, Homo sapiens
  heavy chain complementarity determining region 3 for antibody 31469
GRDNHGSIDY

SEQ ID NO: 62939 - protein, 9 aa, Homo sapiens
  light chain complementarity determining region 3 for antibody 31470
MQGSHRPYT

SEQ ID NO: 62940 - protein, 10 aa, Homo sapiens
  heavy chain complementarity determining region 3 for antibody 31470
GRDNHGSIDY

SEQ ID NO: 62941 - protein, 9 aa, Homo sapiens
  light chain complementarity determining region 3 for antibody 31471
MQGSHGPYT

SEQ ID NO: 62942 - protein, 10 aa, Homo sapiens
  heavy chain complementarity determining region 3 for antibody 31471
GRDNRGSIDF

SEQ ID NO: 62943 - protein, 9 aa, Homo sapiens
  light chain complementarity determining region 3 for antibody 31472
MQGSHGPYT

SEQ ID NO: 62944 - protein, 10 aa, Homo sapiens
  heavy chain complementarity determining region 3 for antibody 31472
GRDNHGSIDY

SEQ ID NO: 62945 - protein, 10 aa, Homo sapiens
  light chain complementarity determining region 3 for antibody 31473
MQGSDWPPWT

SEQ ID NO: 62946 - protein, 11 aa, Homo sapiens
  heavy chain complementarity determining region 3 for antibody 31473
ARDTPGIGIDY

SEQ ID NO: 62947 - protein, 9 aa, Homo sapiens
  light chain complementarity determining region 3 for antibody 31474
MQGRRWPYT

SEQ ID NO: 62948 - protein, 10 aa, Homo sapiens
  heavy chain complementarity determining region 3 for antibody 31474
ARNSGWSVDC

SEQ ID NO: 62949 - protein, 9 aa, Homo sapiens
  light chain complementarity determining region 3 for antibody 31475
MQGRRWPPT

SEQ ID NO: 62950 - protein, 8 aa, Homo sapiens
  heavy chain complementarity determining region 3 for antibody 31475
TAWGSSQH

SEQ ID NO: 62951 - protein, 9 aa, Homo sapiens
  light chain complementarity determining region 3 for antibody 31476
MQGRRGPHT

SEQ ID NO: 62952 - protein, 8 aa, Homo sapiens
  heavy chain complementarity determining region 3 for antibody 31476
TAWGSSQH

SEQ ID NO: 62953 - protein, 9 aa, Homo sapiens
  light chain complementarity determining region 3 for antibody 31477
MQGRHWPYT

SEQ ID NO: 62954 - protein, 11 aa, Homo sapiens
  heavy chain complementarity determining region 3 for antibody 31477
ARDPAWGALDI

SEQ ID NO: 62955 - protein, 9 aa, Homo sapiens
  light chain complementarity determining region 3 for antibody 31478
MQGRHWPWR

SEQ ID NO: 62956 - protein, 10 aa, Homo sapiens
  heavy chain complementarity determining region 3 for antibody 31478
TTEIVDLFDH

SEQ ID NO: 62957 - protein, 10 aa, Homo sapiens
  light chain complementarity determining region 3 for antibody 31479
MQGRHWPPRT

SEQ ID NO: 62958 - protein, 12 aa, Homo sapiens
  heavy chain complementarity determining region 3 for antibody 31479
VRDPQIGDVSDY

SEQ ID NO: 62959 - protein, 9 aa, Homo sapiens
  light chain complementarity determining region 3 for antibody 31480
MQGRHWPGT

SEQ ID NO: 62960 - protein, 10 aa, Homo sapiens
  heavy chain complementarity determining region 3 for antibody 31480
TTEIVDLFDH

SEQ ID NO: 62961 - protein, 9 aa, Homo sapiens
  light chain complementarity determining region 3 for antibody 31481
MQGRHWPFT

SEQ ID NO: 62962 - protein, 14 aa, Homo sapiens
  heavy chain complementarity determining region 3 for antibody 31481
TTLNDCIEKRCYGP

SEQ ID NO: 62963 - protein, 9 aa, Homo sapiens
  light chain complementarity determining region 3 for antibody 31482
MQGQQTPGT

SEQ ID NO: 62964 - protein, 23 aa, Homo sapiens
  heavy chain complementarity determining region 3 for antibody 31482
AREREYASGPYYSPLYYYYGVDV

SEQ ID NO: 62965 - protein, 10 aa, Homo sapiens
  light chain complementarity determining region 3 for antibody 31483
MQGPYWPPWT

SEQ ID NO: 62966 - protein, 11 aa, Homo sapiens
  heavy chain complementarity determining region 3 for antibody 31483
ARDTPGIGIDY

SEQ ID NO: 62967 - protein, 9 aa, Homo sapiens
  light chain complementarity determining region 3 for antibody 31484
MQGPQWPWR

SEQ ID NO: 62968 - protein, 7 aa, Homo sapiens
  heavy chain complementarity determining region 3 for antibody 31484
STDFLDL

SEQ ID NO: 62969 - protein, 9 aa, Homo sapiens
  light chain complementarity determining region 3 for antibody 31485
MQGPPWPGT

SEQ ID NO: 62970 - protein, 7 aa, Homo sapiens
  heavy chain complementarity determining region 3 for antibody 31485
STDFLDL

SEQ ID NO: 62971 - protein, 9 aa, Homo sapiens
  light chain complementarity determining region 3 for antibody 31486
MQGPHWPYT

SEQ ID NO: 62972 - protein, 15 aa, Homo sapiens
  heavy chain complementarity determining region 3 for antibody 31486
ARDIRGSWYGTSVDY

SEQ ID NO: 62973 - protein, 9 aa, Homo sapiens
  light chain complementarity determining region 3 for antibody 31487
MQGPHWPFT

SEQ ID NO: 62974 - protein, 9 aa, Homo sapiens
  heavy chain complementarity determining region 3 for antibody 31487
SRDPRPLDY

SEQ ID NO: 62975 - protein, 10 aa, Homo sapiens
  light chain complementarity determining region 3 for antibody 31488
MQGLYWPPWT

SEQ ID NO: 62976 - protein, 11 aa, Homo sapiens
  heavy chain complementarity determining region 3 for antibody 31488
ARDTPGVGIDY

SEQ ID NO: 62977 - protein, 9 aa, Homo sapiens
  light chain complementarity determining region 3 for antibody 31489
MQGLRTRLT

SEQ ID NO: 62978 - protein, 23 aa, Homo sapiens
  heavy chain complementarity determining region 3 for antibody 31489
ARVSQNLGEWSGSSRYGINAFDP

SEQ ID NO: 62979 - protein, 8 aa, Homo sapiens
  light chain complementarity determining region 3 for antibody 31490
MQGLQTST

SEQ ID NO: 62980 - protein, 14 aa, Homo sapiens
  heavy chain complementarity determining region 3 for antibody 31490
ARHLELELPYGMDV

SEQ ID NO: 62981 - protein, 9 aa, Homo sapiens
  light chain complementarity determining region 3 for antibody 31491
MQGLQTPYT

SEQ ID NO: 62982 - protein, 10 aa, Homo sapiens
  heavy chain complementarity determining region 3 for antibody 31491
GRELSGARDY

SEQ ID NO: 62983 - protein, 9 aa, Homo sapiens
  light chain complementarity determining region 3 for antibody 31492
MQGLQTPYT

SEQ ID NO: 62984 - protein, 10 aa, Homo sapiens
  heavy chain complementarity determining region 3 for antibody 31492
GRDLTESKDY

SEQ ID NO: 62985 - protein, 9 aa, Homo sapiens
  light chain complementarity determining region 3 for antibody 31493
MQGLQTPYT

SEQ ID NO: 62986 - protein, 15 aa, Homo sapiens
  heavy chain complementarity determining region 3 for antibody 31493
ARDVMTTLTRGCLDP

SEQ ID NO: 62987 - protein, 9 aa, Homo sapiens
  light chain complementarity determining region 3 for antibody 31494
MQGLQTPYT

SEQ ID NO: 62988 - protein, 15 aa, Homo sapiens
  heavy chain complementarity determining region 3 for antibody 31494
ARDVMATLTRGWLDP

SEQ ID NO: 62989 - protein, 9 aa, Homo sapiens
  light chain complementarity determining region 3 for antibody 31495
MQGLQTPST

SEQ ID NO: 62990 - protein, 14 aa, Homo sapiens
  heavy chain complementarity determining region 3 for antibody 31495
AKDWDSSGSNCFDP

SEQ ID NO: 62991 - protein, 9 aa, Homo sapiens
  light chain complementarity determining region 3 for antibody 31496
MQGLQTPRT

SEQ ID NO: 62992 - protein, 13 aa, Homo sapiens
  heavy chain complementarity determining region 3 for antibody 31496
ARQHIYGDYGFDP

SEQ ID NO: 62993 - protein, 9 aa, Homo sapiens
  light chain complementarity determining region 3 for antibody 31497
MQGLQTPPT

SEQ ID NO: 62994 - protein, 14 aa, Homo sapiens
  heavy chain complementarity determining region 3 for antibody 31497
ARDNRGAYYYAMDV

SEQ ID NO: 62995 - protein, 9 aa, Homo sapiens
  light chain complementarity determining region 3 for antibody 31498
MQGLQTPNT

SEQ ID NO: 62996 - protein, 10 aa, Homo sapiens
  heavy chain complementarity determining region 3 for antibody 31498
GRDLTGSKDY

SEQ ID NO: 62997 - protein, 9 aa, Homo sapiens
  light chain complementarity determining region 3 for antibody 31499
MQGLQTPNT

SEQ ID NO: 62998 - protein, 10 aa, Homo sapiens
  heavy chain complementarity determining region 3 for antibody 31499
ARDVVGSDDQ

SEQ ID NO: 62999 - protein, 9 aa, Homo sapiens
  light chain complementarity determining region 3 for antibody 31500
MQGLQTPLT

SEQ ID NO: 63000 - protein, 12 aa, Homo sapiens
  heavy chain complementarity determining region 3 for antibody 31500
VRNDYGDYGFQY

SEQ ID NO: 63001 - protein, 9 aa, Homo sapiens
  light chain complementarity determining region 3 for antibody 31501
MQGLQTPFT

SEQ ID NO: 63002 - protein, 14 aa, Homo sapiens
  heavy chain complementarity determining region 3 for antibody 31501
ARDNRGAYYYAMDV

SEQ ID NO: 63003 - protein, 9 aa, Homo sapiens
  light chain complementarity determining region 3 for antibody 31502
MQGLQTPDT

SEQ ID NO: 63004 - protein, 10 aa, Homo sapiens
  heavy chain complementarity determining region 3 for antibody 31502
ARDVVGSDDQ

SEQ ID NO: 63005 - protein, 7 aa, Homo sapiens
  light chain complementarity determining region 3 for antibody 31503
MQGLQTL

SEQ ID NO: 63006 - protein, 15 aa, Homo sapiens
  heavy chain complementarity determining region 3 for antibody 31503
ARGGYGGSLYWYFDL

SEQ ID NO: 63007 - protein, 9 aa, Homo sapiens
  light chain complementarity determining region 3 for antibody 31504
MQGLQSLYP

SEQ ID NO: 63008 - protein, 15 aa, Homo sapiens
  heavy chain complementarity determining region 3 for antibody 31504
ARHRYYGSGNYEFDY

SEQ ID NO: 63009 - protein, 9 aa, Homo sapiens
  light chain complementarity determining region 3 for antibody 31505
MQGLQSLST

SEQ ID NO: 63010 - protein, 15 aa, Homo sapiens
  heavy chain complementarity determining region 3 for antibody 31505
ARHRYYGSGNYEFDY

SEQ ID NO: 63011 - protein, 9 aa, Homo sapiens
  light chain complementarity determining region 3 for antibody 31506
MQGLQSLNT

SEQ ID NO: 63012 - protein, 15 aa, Homo sapiens
  heavy chain complementarity determining region 3 for antibody 31506
ARHRYYGSGNYEFDY

SEQ ID NO: 63013 - protein, 9 aa, Homo sapiens
  light chain complementarity determining region 3 for antibody 31507
MQGLQNWGT

SEQ ID NO: 63014 - protein, 10 aa, Homo sapiens
  heavy chain complementarity determining region 3 for antibody 31507
ARYSWHKSDY

SEQ ID NO: 63015 - protein, 9 aa, Homo sapiens
  light chain complementarity determining region 3 for antibody 31508
MQGLQIPYT

SEQ ID NO: 63016 - protein, 10 aa, Homo sapiens
  heavy chain complementarity determining region 3 for antibody 31508
ARDVVGSDDQ

SEQ ID NO: 63017 - protein, 8 aa, Homo sapiens
  light chain complementarity determining region 3 for antibody 31509
MQGLQIPT

SEQ ID NO: 63018 - protein, 9 aa, Homo sapiens
  heavy chain complementarity determining region 3 for antibody 31509
ARDSSAFGP

SEQ ID NO: 63019 - protein, 9 aa, Homo sapiens
  light chain complementarity determining region 3 for antibody 31510
MQGLQIPPT

SEQ ID NO: 63020 - protein, 19 aa, Homo sapiens
  heavy chain complementarity determining region 3 for antibody 31510
ARVVFWRSEGRYYFHGVDV

SEQ ID NO: 63021 - protein, 9 aa, Homo sapiens
  light chain complementarity determining region 3 for antibody 31511
MQGLPTPYT

SEQ ID NO: 63022 - protein, 10 aa, Homo sapiens
  heavy chain complementarity determining region 3 for antibody 31511
ARDVVGSDDQ

SEQ ID NO: 63023 - protein, 8 aa, Homo sapiens
  light chain complementarity determining region 3 for antibody 31512
MQGLPPPL

SEQ ID NO: 63024 - protein, 17 aa, Homo sapiens
  heavy chain complementarity determining region 3 for antibody 31512
ARVDMGTSYLSYFGMDV

SEQ ID NO: 63025 - protein, 9 aa, Homo sapiens
  light chain complementarity determining region 3 for antibody 31513
MQGLKTPYT

SEQ ID NO: 63026 - protein, 10 aa, Homo sapiens
  heavy chain complementarity determining region 3 for antibody 31513
ARDVVGSDDQ

SEQ ID NO: 63027 - protein, 9 aa, Homo sapiens
  light chain complementarity determining region 3 for antibody 31514
MQGLKIPFT

SEQ ID NO: 63028 - protein, 17 aa, Homo sapiens
  heavy chain complementarity determining region 3 for antibody 31514
ARDTEKATIGAEGAFDI

SEQ ID NO: 63029 - protein, 9 aa, Homo sapiens
  light chain complementarity determining region 3 for antibody 31515
MQGLHTPYT

SEQ ID NO: 63030 - protein, 10 aa, Homo sapiens
  heavy chain complementarity determining region 3 for antibody 31515
GRDLTGSKDY

SEQ ID NO: 63031 - protein, 9 aa, Homo sapiens
  light chain complementarity determining region 3 for antibody 31516
MQGLETPFT

SEQ ID NO: 63032 - protein, 15 aa, Homo sapiens
  heavy chain complementarity determining region 3 for antibody 31516
LRHYRSLATGTEGDC

SEQ ID NO: 63033 - protein, 9 aa, Homo sapiens
  light chain complementarity determining region 3 for antibody 31517
MQGKRWPYT

SEQ ID NO: 63034 - protein, 10 aa, Homo sapiens
  heavy chain complementarity determining region 3 for antibody 31517
ARNSGWSVDC

SEQ ID NO: 63035 - protein, 9 aa, Homo sapiens
  light chain complementarity determining region 3 for antibody 31518
MQGKQWPYT

SEQ ID NO: 63036 - protein, 10 aa, Homo sapiens
  heavy chain complementarity determining region 3 for antibody 31518
ASGQFYQFDF

SEQ ID NO: 63037 - protein, 9 aa, Homo sapiens
  light chain complementarity determining region 3 for antibody 31519
MQGKPWPHT

SEQ ID NO: 63038 - protein, 11 aa, Homo sapiens
  heavy chain complementarity determining region 3 for antibody 31519
ARDPGWGARDY

SEQ ID NO: 63039 - protein, 9 aa, Homo sapiens
  light chain complementarity determining region 3 for antibody 31520
MQGKHWPYT

SEQ ID NO: 63040 - protein, 15 aa, Homo sapiens
  heavy chain complementarity determining region 3 for antibody 31520
ARDIRGSWYGTSVDY

SEQ ID NO: 63041 - protein, 9 aa, Homo sapiens
  light chain complementarity determining region 3 for antibody 31521
MQGKHWPYT

SEQ ID NO: 63042 - protein, 10 aa, Homo sapiens
  heavy chain complementarity determining region 3 for antibody 31521
ARDGDFVLDY

SEQ ID NO: 63043 - protein, 9 aa, Homo sapiens
  light chain complementarity determining region 3 for antibody 31522
MQGKHWPWT

SEQ ID NO: 63044 - protein, 13 aa, Homo sapiens
  heavy chain complementarity determining region 3 for antibody 31522
ATMLRGHHGADGD

SEQ ID NO: 63045 - protein, 9 aa, Homo sapiens
  light chain complementarity determining region 3 for antibody 31523
MQGKHWPLE

SEQ ID NO: 63046 - protein, 18 aa, Homo sapiens
  heavy chain complementarity determining region 3 for antibody 31523
ARDERDTCTNGLCYYFDY

SEQ ID NO: 63047 - protein, 9 aa, Homo sapiens
  light chain complementarity determining region 3 for antibody 31524
MQGIRWPYT

SEQ ID NO: 63048 - protein, 10 aa, Homo sapiens
  heavy chain complementarity determining region 3 for antibody 31524
ARNSGWSVDC

SEQ ID NO: 63049 - protein, 10 aa, Homo sapiens
  light chain complementarity determining region 3 for antibody 31525
MQGIQPPRWT

SEQ ID NO: 63050 - protein, 8 aa, Homo sapiens
  heavy chain complementarity determining region 3 for antibody 31525
AKGYGFDC

SEQ ID NO: 63051 - protein, 9 aa, Homo sapiens
  light chain complementarity determining region 3 for antibody 31526
MQGIPWPHT

SEQ ID NO: 63052 - protein, 11 aa, Homo sapiens
  heavy chain complementarity determining region 3 for antibody 31526
ARDPGWGARDY

SEQ ID NO: 63053 - protein, 9 aa, Homo sapiens
  light chain complementarity determining region 3 for antibody 31527
MQGINWPGT

SEQ ID NO: 63054 - protein, 6 aa, Homo sapiens
  heavy chain complementarity determining region 3 for antibody 31527
AREGSV

SEQ ID NO: 63055 - protein, 9 aa, Homo sapiens
  light chain complementarity determining region 3 for antibody 31528
MQGIHGPGR

SEQ ID NO: 63056 - protein, 6 aa, Homo sapiens
  heavy chain complementarity determining region 3 for antibody 31528
AREGSV

SEQ ID NO: 63057 - protein, 9 aa, Homo sapiens
  light chain complementarity determining region 3 for antibody 31529
MQGGHWPYT

SEQ ID NO: 63058 - protein, 11 aa, Homo sapiens
  heavy chain complementarity determining region 3 for antibody 31529
ATVRLVGAVDY

SEQ ID NO: 63059 - protein, 9 aa, Homo sapiens
  light chain complementarity determining region 3 for antibody 31530
MQGAYWPGP

SEQ ID NO: 63060 - protein, 11 aa, Homo sapiens
  heavy chain complementarity determining region 3 for antibody 31530
ARDPAWGAYDL

SEQ ID NO: 63061 - protein, 9 aa, Homo sapiens
  light chain complementarity determining region 3 for antibody 31531
MQGALWPRT

SEQ ID NO: 63062 - protein, 11 aa, Homo sapiens
  heavy chain complementarity determining region 3 for antibody 31531
ARGGFWGDAAP

SEQ ID NO: 63063 - protein, 9 aa, Homo sapiens
  light chain complementarity determining region 3 for antibody 31532
MQGALWPPT

SEQ ID NO: 63064 - protein, 11 aa, Homo sapiens
  heavy chain complementarity determining region 3 for antibody 31532
ARGGFWGDAAP

SEQ ID NO: 63065 - protein, 9 aa, Homo sapiens
  light chain complementarity determining region 3 for antibody 31533
MQGAHWPLS

SEQ ID NO: 63066 - protein, 17 aa, Homo sapiens
  heavy chain complementarity determining region 3 for antibody 31533
ARDMSSQWEVLPATIDY

SEQ ID NO: 63067 - protein, 9 aa, Homo sapiens
  light chain complementarity determining region 3 for antibody 31534
MQGAHWPHT

SEQ ID NO: 63068 - protein, 11 aa, Homo sapiens
  heavy chain complementarity determining region 3 for antibody 31534
ATVRLVGAVDY

SEQ ID NO: 63069 - protein, 9 aa, Homo sapiens
  light chain complementarity determining region 3 for antibody 31535
MQDTHWPLT

SEQ ID NO: 63070 - protein, 8 aa, Homo sapiens
  heavy chain complementarity determining region 3 for antibody 31535
ARTRPFDI

SEQ ID NO: 63071 - protein, 9 aa, Homo sapiens
  light chain complementarity determining region 3 for antibody 31536
MQDLQTPRT

SEQ ID NO: 63072 - protein, 13 aa, Homo sapiens
  heavy chain complementarity determining region 3 for antibody 31536
ARASGGDYGLPAY

SEQ ID NO: 63073 - protein, 9 aa, Homo sapiens
  light chain complementarity determining region 3 for antibody 31537
MQDLQTPLT

SEQ ID NO: 63074 - protein, 12 aa, Homo sapiens
  heavy chain complementarity determining region 3 for antibody 31537
AKDSEQKWELHD

SEQ ID NO: 63075 - protein, 8 aa, Homo sapiens
  light chain complementarity determining region 3 for antibody 31538
MQDLQTLT

SEQ ID NO: 63076 - protein, 18 aa, Homo sapiens
  heavy chain complementarity determining region 3 for antibody 31538
ARDSGGYSDTTGLSPADY

SEQ ID NO: 63077 - protein, 9 aa, Homo sapiens
  light chain complementarity determining region 3 for antibody 31539
MQDLQPPWT

SEQ ID NO: 63078 - protein, 17 aa, Homo sapiens
  heavy chain complementarity determining region 3 for antibody 31539
ARPEYYFAGSGYHAFDI

SEQ ID NO: 63079 - protein, 9 aa, Homo sapiens
  light chain complementarity determining region 3 for antibody 31540
MQDLETPLT

SEQ ID NO: 63080 - protein, 12 aa, Homo sapiens
  heavy chain complementarity determining region 3 for antibody 31540
THRLNWGSGFDY

SEQ ID NO: 63081 - protein, 9 aa, Homo sapiens
  light chain complementarity determining region 3 for antibody 31541
MQCRRWPHT

SEQ ID NO: 63082 - protein, 8 aa, Homo sapiens
  heavy chain complementarity determining region 3 for antibody 31541
TAWGSSQH

SEQ ID NO: 63083 - protein, 9 aa, Homo sapiens
  light chain complementarity determining region 3 for antibody 31542
MQCREWPGT

SEQ ID NO: 63084 - protein, 20 aa, Homo sapiens
  heavy chain complementarity determining region 3 for antibody 31542
ARDGDYGDSAWDGDRDAYGI

SEQ ID NO: 63085 - protein, 8 aa, Homo sapiens
  light chain complementarity determining region 3 for antibody 31543
MQAVQTPT

SEQ ID NO: 63086 - protein, 9 aa, Homo sapiens
  heavy chain complementarity determining region 3 for antibody 31543
ARDSSAFGP

SEQ ID NO: 63087 - protein, 9 aa, Homo sapiens
  light chain complementarity determining region 3 for antibody 31544
MQAVETPFT

SEQ ID NO: 63088 - protein, 15 aa, Homo sapiens
  heavy chain complementarity determining region 3 for antibody 31544
VRHYRETVAGIEGDS

SEQ ID NO: 63089 - protein, 9 aa, Homo sapiens
  light chain complementarity determining region 3 for antibody 31545
MQATYWPWT

SEQ ID NO: 63090 - protein, 11 aa, Homo sapiens
  heavy chain complementarity determining region 3 for antibody 31545
LSAVRGSSFDI

SEQ ID NO: 63091 - protein, 9 aa, Homo sapiens
  light chain complementarity determining region 3 for antibody 31546
MQATYWPGT

SEQ ID NO: 63092 - protein, 11 aa, Homo sapiens
  heavy chain complementarity determining region 3 for antibody 31546
LSAVRGSSFDI

SEQ ID NO: 63093 - protein, 9 aa, Homo sapiens
  light chain complementarity determining region 3 for antibody 31547
MQATPWPRT

SEQ ID NO: 63094 - protein, 8 aa, Homo sapiens
  heavy chain complementarity determining region 3 for antibody 31547
AKDWQFDY

SEQ ID NO: 63095 - protein, 9 aa, Homo sapiens
  light chain complementarity determining region 3 for antibody 31548
MQATNWPRR

SEQ ID NO: 63096 - protein, 8 aa, Homo sapiens
  heavy chain complementarity determining region 3 for antibody 31548
AKDWQFDY

SEQ ID NO: 63097 - protein, 9 aa, Homo sapiens
  light chain complementarity determining region 3 for antibody 31549
MQATHWPGT

SEQ ID NO: 63098 - protein, 8 aa, Homo sapiens
  heavy chain complementarity determining region 3 for antibody 31549
AKDWQFDY

SEQ ID NO: 63099 - protein, 9 aa, Homo sapiens
  light chain complementarity determining region 3 for antibody 31550
MQATHFPRT

SEQ ID NO: 63100 - protein, 14 aa, Homo sapiens
  heavy chain complementarity determining region 3 for antibody 31550
SKDAGLKGASFFDH

SEQ ID NO: 63101 - protein, 9 aa, Homo sapiens
  light chain complementarity determining region 3 for antibody 31551
MQARQTPWT

SEQ ID NO: 63102 - protein, 27 aa, Homo sapiens
  heavy chain complementarity determining region 3 for antibody 31551
AAALLGAYDPYGRSSSGMRGWGYGLDV

SEQ ID NO: 63103 - protein, 9 aa, Homo sapiens
  light chain complementarity determining region 3 for antibody 31552
MQARQTPGR

SEQ ID NO: 63104 - protein, 27 aa, Homo sapiens
  heavy chain complementarity determining region 3 for antibody 31552
AAALLGASDPYGRSSSGMRGWGYGLDV

SEQ ID NO: 63105 - protein, 9 aa, Homo sapiens
  light chain complementarity determining region 3 for antibody 31553
MQARHTPWT

SEQ ID NO: 63106 - protein, 27 aa, Homo sapiens
  heavy chain complementarity determining region 3 for antibody 31553
AAALLGASDPYGRSSSGMRGWGYGLDV

SEQ ID NO: 63107 - protein, 9 aa, Homo sapiens
  light chain complementarity determining region 3 for antibody 31554
MQAQQPPFT

SEQ ID NO: 63108 - protein, 9 aa, Homo sapiens
  heavy chain complementarity determining region 3 for antibody 31554
AKDLGYYDD

SEQ ID NO: 63109 - protein, 9 aa, Homo sapiens
  light chain complementarity determining region 3 for antibody 31555
MQAPHTPRA

SEQ ID NO: 63110 - protein, 14 aa, Homo sapiens
  heavy chain complementarity determining region 3 for antibody 31555
VTLDYYYGSGSNLY

SEQ ID NO: 63111 - protein, 9 aa, Homo sapiens
  light chain complementarity determining region 3 for antibody 31556
MQAPETPFT

SEQ ID NO: 63112 - protein, 15 aa, Homo sapiens
  heavy chain complementarity determining region 3 for antibody 31556
VRHYRETVAGIEGDS

SEQ ID NO: 63113 - protein, 10 aa, Homo sapiens
  light chain complementarity determining region 3 for antibody 31557
MQAMQPHRYT

SEQ ID NO: 63114 - protein, 20 aa, Homo sapiens
  heavy chain complementarity determining region 3 for antibody 31557
ARLKAASAGLPSYYYAGMDV

SEQ ID NO: 63115 - protein, 9 aa, Homo sapiens
  light chain complementarity determining region 3 for antibody 31558
MQALRTRLT

SEQ ID NO: 63116 - protein, 23 aa, Homo sapiens
  heavy chain complementarity determining region 3 for antibody 31558
ARVSQNLGEWSGSSRYGINAFAP

SEQ ID NO: 63117 - protein, 9 aa, Homo sapiens
  light chain complementarity determining region 3 for antibody 31559
MQALRTPYI

SEQ ID NO: 63118 - protein, 17 aa, Homo sapiens
  heavy chain complementarity determining region 3 for antibody 31559
ARWYYYDSSGYYSHFDY

SEQ ID NO: 63119 - protein, 9 aa, Homo sapiens
  light chain complementarity determining region 3 for antibody 31560
MQALRSRLT

SEQ ID NO: 63120 - protein, 19 aa, Homo sapiens
  heavy chain complementarity determining region 3 for antibody 31560
ARRGATVAGISGWGYGMDV

SEQ ID NO: 63121 - protein, 9 aa, Homo sapiens
  light chain complementarity determining region 3 for antibody 31561
MQALRSPWR

SEQ ID NO: 63122 - protein, 12 aa, Homo sapiens
  heavy chain complementarity determining region 3 for antibody 31561
ANNGLEGGTYDR

SEQ ID NO: 63123 - protein, 9 aa, Homo sapiens
  light chain complementarity determining region 3 for antibody 31562
MQALRSPLT

SEQ ID NO: 63124 - protein, 19 aa, Homo sapiens
  heavy chain complementarity determining region 3 for antibody 31562
ARRGATVAGSSGWGYGMDV

SEQ ID NO: 63125 - protein, 9 aa, Homo sapiens
  light chain complementarity determining region 3 for antibody 31563
MQALRSPLP

SEQ ID NO: 63126 - protein, 19 aa, Homo sapiens
  heavy chain complementarity determining region 3 for antibody 31563
ARRGATVAGISGWGYGMDV

SEQ ID NO: 63127 - protein, 9 aa, Homo sapiens
  light chain complementarity determining region 3 for antibody 31564
MQALRPPYT

SEQ ID NO: 63128 - protein, 18 aa, Homo sapiens
  heavy chain complementarity determining region 3 for antibody 31564
AVWGHIVAETAALDGFDI

SEQ ID NO: 63129 - protein, 8 aa, Homo sapiens
  light chain complementarity determining region 3 for antibody 31565
MQALRGFL

SEQ ID NO: 63130 - protein, 14 aa, Homo sapiens
  heavy chain complementarity determining region 3 for antibody 31565
AYNSPTVLTPGFDY

SEQ ID NO: 63131 - protein, 8 aa, Homo sapiens
  light chain complementarity determining region 3 for antibody 31566
MQALQTWR

SEQ ID NO: 63132 - protein, 14 aa, Homo sapiens
  heavy chain complementarity determining region 3 for antibody 31566
VTDLSVGQTYARDY

SEQ ID NO: 63133 - protein, 8 aa, Homo sapiens
  light chain complementarity determining region 3 for antibody 31567
MQALQTSP

SEQ ID NO: 63134 - protein, 14 aa, Homo sapiens
  heavy chain complementarity determining region 3 for antibody 31567
ARHLELELPYGMDV

SEQ ID NO: 63135 - protein, 9 aa, Homo sapiens
  light chain complementarity determining region 3 for antibody 31568
MQALQTRLT

SEQ ID NO: 63136 - protein, 12 aa, Homo sapiens
  heavy chain complementarity determining region 3 for antibody 31568
SKMVGWTYGMDV

SEQ ID NO: 63137 - protein, 9 aa, Homo sapiens
  light chain complementarity determining region 3 for antibody 31569
MQALQTRFT

SEQ ID NO: 63138 - protein, 12 aa, Homo sapiens
  heavy chain complementarity determining region 3 for antibody 31569
SKRVGWTYGMDV

SEQ ID NO: 63139 - protein, 9 aa, Homo sapiens
  light chain complementarity determining region 3 for antibody 31570
MQALQTPYT

SEQ ID NO: 63140 - protein, 13 aa, Homo sapiens
  heavy chain complementarity determining region 3 for antibody 31570
ARKKSRVVATIDY

SEQ ID NO: 63141 - protein, 9 aa, Homo sapiens
  light chain complementarity determining region 3 for antibody 31571
MQALQTPYT

SEQ ID NO: 63142 - protein, 20 aa, Homo sapiens
  heavy chain complementarity determining region 3 for antibody 31571
ARGRRIAALSTAHYYYGMDV

SEQ ID NO: 63143 - protein, 9 aa, Homo sapiens
  light chain complementarity determining region 3 for antibody 31572
MQALQTPWR

SEQ ID NO: 63144 - protein, 17 aa, Homo sapiens
  heavy chain complementarity determining region 3 for antibody 31572
SRRRKNGSPGRNNWFDP

SEQ ID NO: 63145 - protein, 9 aa, Homo sapiens
  light chain complementarity determining region 3 for antibody 31573
MQALQTPVT

SEQ ID NO: 63146 - protein, 20 aa, Homo sapiens
  heavy chain complementarity determining region 3 for antibody 31573
ARPRSPVSRRYLYYHYGMDV

SEQ ID NO: 63147 - protein, 9 aa, Homo sapiens
  light chain complementarity determining region 3 for antibody 31574
MQALQTPST

SEQ ID NO: 63148 - protein, 10 aa, Homo sapiens
  heavy chain complementarity determining region 3 for antibody 31574
ATGSSSWIDY

SEQ ID NO: 63149 - protein, 9 aa, Homo sapiens
  light chain complementarity determining region 3 for antibody 31575
MQALQTPST

SEQ ID NO: 63150 - protein, 19 aa, Homo sapiens
  heavy chain complementarity determining region 3 for antibody 31575
ARGEKGIATRPSGNNWFDP

SEQ ID NO: 63151 - protein, 9 aa, Homo sapiens
  light chain complementarity determining region 3 for antibody 31576
MQALQTPRT

SEQ ID NO: 63152 - protein, 19 aa, Homo sapiens
  heavy chain complementarity determining region 3 for antibody 31576
VRGFNFIRSGRIPPDAFDI

SEQ ID NO: 63153 - protein, 9 aa, Homo sapiens
  light chain complementarity determining region 3 for antibody 31577
MQALQTPRT

SEQ ID NO: 63154 - protein, 16 aa, Homo sapiens
  heavy chain complementarity determining region 3 for antibody 31577
ARVIYSDYDWAGFVDY

SEQ ID NO: 63155 - protein, 9 aa, Homo sapiens
  light chain complementarity determining region 3 for antibody 31578
MQALQTPRT

SEQ ID NO: 63156 - protein, 25 aa, Homo sapiens
  heavy chain complementarity determining region 3 for antibody 31578
ARGAGRDGVVLADARSWAYYYGMDV

SEQ ID NO: 63157 - protein, 9 aa, Homo sapiens
  light chain complementarity determining region 3 for antibody 31579
MQALQTPRR

SEQ ID NO: 63158 - protein, 13 aa, Homo sapiens
  heavy chain complementarity determining region 3 for antibody 31579
ATHPDPDLYYFDY

SEQ ID NO: 63159 - protein, 9 aa, Homo sapiens
  light chain complementarity determining region 3 for antibody 31580
MQALQTPRR

SEQ ID NO: 63160 - protein, 14 aa, Homo sapiens
  heavy chain complementarity determining region 3 for antibody 31580
ARVYGTSMSASGYY

SEQ ID NO: 63161 - protein, 9 aa, Homo sapiens
  light chain complementarity determining region 3 for antibody 31581
MQALQTPRR

SEQ ID NO: 63162 - protein, 13 aa, Homo sapiens
  heavy chain complementarity determining region 3 for antibody 31581
ARASGGDYGLPAY

SEQ ID NO: 63163 - protein, 10 aa, Homo sapiens
  light chain complementarity determining region 3 for antibody 31582
MQALQTPRGT

SEQ ID NO: 63164 - protein, 14 aa, Homo sapiens
  heavy chain complementarity determining region 3 for antibody 31582
ARAAPEYEWLVPDY

SEQ ID NO: 63165 - protein, 9 aa, Homo sapiens
  light chain complementarity determining region 3 for antibody 31583
MQALQTPRA

SEQ ID NO: 63166 - protein, 14 aa, Homo sapiens
  heavy chain complementarity determining region 3 for antibody 31583
VTLDYYYGSGSNLY

SEQ ID NO: 63167 - protein, 9 aa, Homo sapiens
  light chain complementarity determining region 3 for antibody 31584
MQALQTPQP

SEQ ID NO: 63168 - protein, 19 aa, Homo sapiens
  heavy chain complementarity determining region 3 for antibody 31584
VRGFNFIRSGRIPPDAFDI

SEQ ID NO: 63169 - protein, 10 aa, Homo sapiens
  light chain complementarity determining region 3 for antibody 31585
MQALQTPPWT

SEQ ID NO: 63170 - protein, 19 aa, Homo sapiens
  heavy chain complementarity determining region 3 for antibody 31585
ASRKEGYCTNGVCSDAFDI

SEQ ID NO: 63171 - protein, 9 aa, Homo sapiens
  light chain complementarity determining region 3 for antibody 31586
MQALQTPPT

SEQ ID NO: 63172 - protein, 13 aa, Homo sapiens
  heavy chain complementarity determining region 3 for antibody 31586
ARGEDYSYQTSDY

SEQ ID NO: 63173 - protein, 9 aa, Homo sapiens
  light chain complementarity determining region 3 for antibody 31587
MQALQTPPT

SEQ ID NO: 63174 - protein, 14 aa, Homo sapiens
  heavy chain complementarity determining region 3 for antibody 31587
AREMSSSSWYGMDV

SEQ ID NO: 63175 - protein, 9 aa, Homo sapiens
  light chain complementarity determining region 3 for antibody 31588
MQALQTPPT

SEQ ID NO: 63176 - protein, 14 aa, Homo sapiens
  heavy chain complementarity determining region 3 for antibody 31588
ARALSSAWYDWFDP

SEQ ID NO: 63177 - protein, 10 aa, Homo sapiens
  light chain complementarity determining region 3 for antibody 31589
MQALQTPPNT

SEQ ID NO: 63178 - protein, 9 aa, Homo sapiens
  heavy chain complementarity determining region 3 for antibody 31589
ATGVDADYG

SEQ ID NO: 63179 - protein, 8 aa, Homo sapiens
  light chain complementarity determining region 3 for antibody 31590
MQALQTPP

SEQ ID NO: 63180 - protein, 23 aa, Homo sapiens
  heavy chain complementarity determining region 3 for antibody 31590
ARGTYYDGSGSYRGYYYYYGMDV

SEQ ID NO: 63181 - protein, 9 aa, Homo sapiens
  light chain complementarity determining region 3 for antibody 31591
MQALQTPLT

SEQ ID NO: 63182 - protein, 20 aa, Homo sapiens
  heavy chain complementarity determining region 3 for antibody 31591
ARPRSPVSRRYLYYHYGMDV

SEQ ID NO: 63183 - protein, 9 aa, Homo sapiens
  light chain complementarity determining region 3 for antibody 31592
MQALQTPLS

SEQ ID NO: 63184 - protein, 14 aa, Homo sapiens
  heavy chain complementarity determining region 3 for antibody 31592
AKGHGVLPTLSHGS

SEQ ID NO: 63185 - protein, 9 aa, Homo sapiens
  light chain complementarity determining region 3 for antibody 31593
MQALQTPLP

SEQ ID NO: 63186 - protein, 12 aa, Homo sapiens
  heavy chain complementarity determining region 3 for antibody 31593
AKDSEQKWELRD

SEQ ID NO: 63187 - protein, 9 aa, Homo sapiens
  light chain complementarity determining region 3 for antibody 31594
MQALQTPKT

SEQ ID NO: 63188 - protein, 9 aa, Homo sapiens
  heavy chain complementarity determining region 3 for antibody 31594
ARGDGAMDV

SEQ ID NO: 63189 - protein, 9 aa, Homo sapiens
  light chain complementarity determining region 3 for antibody 31595
MQALQTPIT

SEQ ID NO: 63190 - protein, 20 aa, Homo sapiens
  heavy chain complementarity determining region 3 for antibody 31595
ARGTVYYDILTGYAYDAFDI

SEQ ID NO: 63191 - protein, 9 aa, Homo sapiens
  light chain complementarity determining region 3 for antibody 31596
MQALQTPIT

SEQ ID NO: 63192 - protein, 12 aa, Homo sapiens
  heavy chain complementarity determining region 3 for antibody 31596
AKDSRDKWELHD

SEQ ID NO: 63193 - protein, 8 aa, Homo sapiens
  light chain complementarity determining region 3 for antibody 31597
MQALQTPI

SEQ ID NO: 63194 - protein, 15 aa, Homo sapiens
  heavy chain complementarity determining region 3 for antibody 31597
ARRDYYDSSGYRLDY

SEQ ID NO: 63195 - protein, 9 aa, Homo sapiens
  light chain complementarity determining region 3 for antibody 31598
MQALQTPHT

SEQ ID NO: 63196 - protein, 17 aa, Homo sapiens
  heavy chain complementarity determining region 3 for antibody 31598
ARGTLATRYYYYYGMDV

SEQ ID NO: 63197 - protein, 9 aa, Homo sapiens
  light chain complementarity determining region 3 for antibody 31599
MQALQTPHT

SEQ ID NO: 63198 - protein, 9 aa, Homo sapiens
  heavy chain complementarity determining region 3 for antibody 31599
ARGDGAMDV

SEQ ID NO: 63199 - protein, 9 aa, Homo sapiens
  light chain complementarity determining region 3 for antibody 31600
MQALQTPHT

SEQ ID NO: 63200 - protein, 21 aa, Homo sapiens
  heavy chain complementarity determining region 3 for antibody 31600
ARDKNTWNSDGRYYYYWGLDV

SEQ ID NO: 63201 - protein, 9 aa, Homo sapiens
  light chain complementarity determining region 3 for antibody 31601
MQALQTPHP

SEQ ID NO: 63202 - protein, 14 aa, Homo sapiens
  heavy chain complementarity determining region 3 for antibody 31601
AREMSSSSWYGMDV

SEQ ID NO: 63203 - protein, 9 aa, Homo sapiens
  light chain complementarity determining region 3 for antibody 31602
MQALQTPGT

SEQ ID NO: 63204 - protein, 18 aa, Homo sapiens
  heavy chain complementarity determining region 3 for antibody 31602
ATSGCRSTSCYADYGMDV

SEQ ID NO: 63205 - protein, 10 aa, Homo sapiens
  light chain complementarity determining region 3 for antibody 31603
MQALQTPGGT

SEQ ID NO: 63206 - protein, 14 aa, Homo sapiens
  heavy chain complementarity determining region 3 for antibody 31603
ARISKGTASIGFDP

SEQ ID NO: 63207 - protein, 10 aa, Homo sapiens
  light chain complementarity determining region 3 for antibody 31604
MQALQTPGDP

SEQ ID NO: 63208 - protein, 14 aa, Homo sapiens
  heavy chain complementarity determining region 3 for antibody 31604
ARISKGTASIGFDP

SEQ ID NO: 63209 - protein, 9 aa, Homo sapiens
  light chain complementarity determining region 3 for antibody 31605
MQALQTPFT

SEQ ID NO: 63210 - protein, 20 aa, Homo sapiens
  heavy chain complementarity determining region 3 for antibody 31605
ASPRSPVSRRYLYYHYGMDV

SEQ ID NO: 63211 - protein, 9 aa, Homo sapiens
  light chain complementarity determining region 3 for antibody 31606
MQALQTPFT

SEQ ID NO: 63212 - protein, 20 aa, Homo sapiens
  heavy chain complementarity determining region 3 for antibody 31606
ARPRSPVSRRYLYSHYGMDV

SEQ ID NO: 63213 - protein, 9 aa, Homo sapiens
  light chain complementarity determining region 3 for antibody 31607
MQALQTPFT

SEQ ID NO: 63214 - protein, 20 aa, Homo sapiens
  heavy chain complementarity determining region 3 for antibody 31607
ARPRSPVSRRCLYYHYGMDV

SEQ ID NO: 63215 - protein, 9 aa, Homo sapiens
  light chain complementarity determining region 3 for antibody 31608
MQALQTPFT

SEQ ID NO: 63216 - protein, 20 aa, Homo sapiens
  heavy chain complementarity determining region 3 for antibody 31608
ARPRAPVSRRYLYYHYGMDV

SEQ ID NO: 63217 - protein, 9 aa, Homo sapiens
  light chain complementarity determining region 3 for antibody 31609
MQALQTPFT

SEQ ID NO: 63218 - protein, 12 aa, Homo sapiens
  heavy chain complementarity determining region 3 for antibody 31609
AKDSEQKWELRD

SEQ ID NO: 63219 - protein, 9 aa, Homo sapiens
  light chain complementarity determining region 3 for antibody 31610
MQALQTLYT

SEQ ID NO: 63220 - protein, 14 aa, Homo sapiens
  heavy chain complementarity determining region 3 for antibody 31610
ARPPGGSWQSGVVY

SEQ ID NO: 63221 - protein, 8 aa, Homo sapiens
  light chain complementarity determining region 3 for antibody 31611
MQALQTLP

SEQ ID NO: 63222 - protein, 18 aa, Homo sapiens
  heavy chain complementarity determining region 3 for antibody 31611
ARDSGGYSDTTGLSPADY

SEQ ID NO: 63223 - protein, 9 aa, Homo sapiens
  light chain complementarity determining region 3 for antibody 31612
MQALQTLNT

SEQ ID NO: 63224 - protein, 14 aa, Homo sapiens
  heavy chain complementarity determining region 3 for antibody 31612
ARPPGSSWQSGVVY

SEQ ID NO: 63225 - protein, 9 aa, Homo sapiens
  light chain complementarity determining region 3 for antibody 31613
MQALQTLNT

SEQ ID NO: 63226 - protein, 20 aa, Homo sapiens
  heavy chain complementarity determining region 3 for antibody 31613
AREDRETLGEVRNYYYGMDV

SEQ ID NO: 63227 - protein, 9 aa, Homo sapiens
  light chain complementarity determining region 3 for antibody 31614
MQALQTLFT

SEQ ID NO: 63228 - protein, 17 aa, Homo sapiens
  heavy chain complementarity determining region 3 for antibody 31614
ASGLNDSSIGYYTGLGY

SEQ ID NO: 63229 - protein, 8 aa, Homo sapiens
  light chain complementarity determining region 3 for antibody 31615
MQALQTLA

SEQ ID NO: 63230 - protein, 16 aa, Homo sapiens
  heavy chain complementarity determining region 3 for antibody 31615
AKAGWLVGYDLSRGCA

SEQ ID NO: 63231 - protein, 9 aa, Homo sapiens
  light chain complementarity determining region 3 for antibody 31616
MQALQTGYT

SEQ ID NO: 63232 - protein, 12 aa, Homo sapiens
  heavy chain complementarity determining region 3 for antibody 31616
SKMVGWTYGMDV

SEQ ID NO: 63233 - protein, 9 aa, Homo sapiens
  light chain complementarity determining region 3 for antibody 31617
MQALQTGFT

SEQ ID NO: 63234 - protein, 12 aa, Homo sapiens
  heavy chain complementarity determining region 3 for antibody 31617
SKMVGWTYGMDV

SEQ ID NO: 63235 - protein, 9 aa, Homo sapiens
  light chain complementarity determining region 3 for antibody 31618
MQALQTFLT

SEQ ID NO: 63236 - protein, 12 aa, Homo sapiens
  heavy chain complementarity determining region 3 for antibody 31618
ARGLNYYYGMDV

SEQ ID NO: 63237 - protein, 9 aa, Homo sapiens
  light chain complementarity determining region 3 for antibody 31619
MQALQSPLP

SEQ ID NO: 63238 - protein, 14 aa, Homo sapiens
  heavy chain complementarity determining region 3 for antibody 31619
ASGYSHDRAGAFNI

SEQ ID NO: 63239 - protein, 9 aa, Homo sapiens
  light chain complementarity determining region 3 for antibody 31620
MQALQPPWR

SEQ ID NO: 63240 - protein, 17 aa, Homo sapiens
  heavy chain complementarity determining region 3 for antibody 31620
ARPEYYFAGSGYHAFDI

SEQ ID NO: 63241 - protein, 8 aa, Homo sapiens
  light chain complementarity determining region 3 for antibody 31621
MQALQPPT

SEQ ID NO: 63242 - protein, 16 aa, Homo sapiens
  heavy chain complementarity determining region 3 for antibody 31621
AKAGWVVGYDLSRGCA

SEQ ID NO: 63243 - protein, 8 aa, Homo sapiens
  light chain complementarity determining region 3 for antibody 31622
MQALQPLT

SEQ ID NO: 63244 - protein, 16 aa, Homo sapiens
  heavy chain complementarity determining region 3 for antibody 31622
AKAGWVVGYDLSRGGA

SEQ ID NO: 63245 - protein, 8 aa, Homo sapiens
  light chain complementarity determining region 3 for antibody 31623
MQALQPLT

SEQ ID NO: 63246 - protein, 16 aa, Homo sapiens
  heavy chain complementarity determining region 3 for antibody 31623
AKAGWLVGYDLSRGCA

SEQ ID NO: 63247 - protein, 8 aa, Homo sapiens
  light chain complementarity determining region 3 for antibody 31624
MQALQPLS

SEQ ID NO: 63248 - protein, 16 aa, Homo sapiens
  heavy chain complementarity determining region 3 for antibody 31624
AKAGWVVGYDLSRGCA

SEQ ID NO: 63249 - protein, 9 aa, Homo sapiens
  light chain complementarity determining region 3 for antibody 31625
MQALQNPGT

SEQ ID NO: 63250 - protein, 13 aa, Homo sapiens
  heavy chain complementarity determining region 3 for antibody 31625
AKHSGLAGYPLDY

SEQ ID NO: 63251 - protein, 7 aa, Homo sapiens
  light chain complementarity determining region 3 for antibody 31626
MQALQNL

SEQ ID NO: 63252 - protein, 15 aa, Homo sapiens
  heavy chain complementarity determining region 3 for antibody 31626
ARGGYGGSLYWYFDL

SEQ ID NO: 63253 - protein, 9 aa, Homo sapiens
  light chain complementarity determining region 3 for antibody 31627
MQALQIPWP

SEQ ID NO: 63254 - protein, 10 aa, Homo sapiens
  heavy chain complementarity determining region 3 for antibody 31627
ARLRPWGYDS

SEQ ID NO: 63255 - protein, 8 aa, Homo sapiens
  light chain complementarity determining region 3 for antibody 31628
MQALQIPT

SEQ ID NO: 63256 - protein, 15 aa, Homo sapiens
  heavy chain complementarity determining region 3 for antibody 31628
ARRDYYDSSGYRLDY

SEQ ID NO: 63257 - protein, 9 aa, Homo sapiens
  light chain complementarity determining region 3 for antibody 31629
MQALQIPPT

SEQ ID NO: 63258 - protein, 11 aa, Homo sapiens
  heavy chain complementarity determining region 3 for antibody 31629
TRSFDRQSFDY

SEQ ID NO: 63259 - protein, 9 aa, Homo sapiens
  light chain complementarity determining region 3 for antibody 31630
MQALQIPLT

SEQ ID NO: 63260 - protein, 12 aa, Homo sapiens
  heavy chain complementarity determining region 3 for antibody 31630
AKDSEQKWELRD

SEQ ID NO: 63261 - protein, 9 aa, Homo sapiens
  light chain complementarity determining region 3 for antibody 31631
MQALQIPGT

SEQ ID NO: 63262 - protein, 10 aa, Homo sapiens
  heavy chain complementarity determining region 3 for antibody 31631
ARLRPWGYDS

SEQ ID NO: 63263 - protein, 9 aa, Homo sapiens
  light chain complementarity determining region 3 for antibody 31632
MQALQIPGT

SEQ ID NO: 63264 - protein, 16 aa, Homo sapiens
  heavy chain complementarity determining region 3 for antibody 31632
ARDLNRYTGSQGSFDI

SEQ ID NO: 63265 - protein, 9 aa, Homo sapiens
  light chain complementarity determining region 3 for antibody 31633
MQALQIPFT

SEQ ID NO: 63266 - protein, 15 aa, Homo sapiens
  heavy chain complementarity determining region 3 for antibody 31633
LRHYRALVAGTEEDY

SEQ ID NO: 63267 - protein, 9 aa, Homo sapiens
  light chain complementarity determining region 3 for antibody 31634
MQALQIPFT

SEQ ID NO: 63268 - protein, 20 aa, Homo sapiens
  heavy chain complementarity determining region 3 for antibody 31634
ARPRSPVSRRYLYYHYGMDV

SEQ ID NO: 63269 - protein, 9 aa, Homo sapiens
  light chain complementarity determining region 3 for antibody 31635
MQALPTSYT

SEQ ID NO: 63270 - protein, 19 aa, Homo sapiens
  heavy chain complementarity determining region 3 for antibody 31635
ARGDYDSGDYWSRPSWFAP

SEQ ID NO: 63271 - protein, 9 aa, Homo sapiens
  light chain complementarity determining region 3 for antibody 31636
MQALPTPRT

SEQ ID NO: 63272 - protein, 23 aa, Homo sapiens
  heavy chain complementarity determining region 3 for antibody 31636
ARHREYASGPYYSPLYYYYGVDV

SEQ ID NO: 63273 - protein, 9 aa, Homo sapiens
  light chain complementarity determining region 3 for antibody 31637
MQALPTPLT

SEQ ID NO: 63274 - protein, 12 aa, Homo sapiens
  heavy chain complementarity determining region 3 for antibody 31637
AKDSEQKWELRD

SEQ ID NO: 63275 - protein, 9 aa, Homo sapiens
  light chain complementarity determining region 3 for antibody 31638
MQALPTPFT

SEQ ID NO: 63276 - protein, 20 aa, Homo sapiens
  heavy chain complementarity determining region 3 for antibody 31638
ARPRSPVSRRYLYYHYGMDV

SEQ ID NO: 63277 - protein, 8 aa, Homo sapiens
  light chain complementarity determining region 3 for antibody 31639
MQALPTLT

SEQ ID NO: 63278 - protein, 16 aa, Homo sapiens
  heavy chain complementarity determining region 3 for antibody 31639
AKAGWLVGYDLSRGCA

SEQ ID NO: 63279 - protein, 9 aa, Homo sapiens
  light chain complementarity determining region 3 for antibody 31640
MQALPTLIT

SEQ ID NO: 63280 - protein, 15 aa, Homo sapiens
  heavy chain complementarity determining region 3 for antibody 31640
ARGVVGATTVSWFDP

SEQ ID NO: 63281 - protein, 9 aa, Homo sapiens
  light chain complementarity determining region 3 for antibody 31641
MQALKTPYT

SEQ ID NO: 63282 - protein, 9 aa, Homo sapiens
  heavy chain complementarity determining region 3 for antibody 31641
ARGDGAMDV

SEQ ID NO: 63283 - protein, 9 aa, Homo sapiens
  light chain complementarity determining region 3 for antibody 31642
MQALKTPVT

SEQ ID NO: 63284 - protein, 17 aa, Homo sapiens
  heavy chain complementarity determining region 3 for antibody 31642
ARVRYFGSGSSLYYFDY

SEQ ID NO: 63285 - protein, 9 aa, Homo sapiens
  light chain complementarity determining region 3 for antibody 31643
MQALKTPRT

SEQ ID NO: 63286 - protein, 25 aa, Homo sapiens
  heavy chain complementarity determining region 3 for antibody 31643
ARGAGRDGVVVADARSWAYYYGMDV

SEQ ID NO: 63287 - protein, 9 aa, Homo sapiens
  light chain complementarity determining region 3 for antibody 31644
MQALKTPIT

SEQ ID NO: 63288 - protein, 17 aa, Homo sapiens
  heavy chain complementarity determining region 3 for antibody 31644
TRGYCTTTSCQLNWFDP

SEQ ID NO: 63289 - protein, 8 aa, Homo sapiens
  light chain complementarity determining region 3 for antibody 31645
MQALKTLT

SEQ ID NO: 63290 - protein, 16 aa, Homo sapiens
  heavy chain complementarity determining region 3 for antibody 31645
AKAGWLVGYDLSRGCA

SEQ ID NO: 63291 - protein, 8 aa, Homo sapiens
  light chain complementarity determining region 3 for antibody 31646
MQALKPLT

SEQ ID NO: 63292 - protein, 16 aa, Homo sapiens
  heavy chain complementarity determining region 3 for antibody 31646
AKAGWVVGYDLSRGCA

SEQ ID NO: 63293 - protein, 8 aa, Homo sapiens
  light chain complementarity determining region 3 for antibody 31647
MQALKPLP

SEQ ID NO: 63294 - protein, 16 aa, Homo sapiens
  heavy chain complementarity determining region 3 for antibody 31647
AKAGWVVGYDLSRGCA

SEQ ID NO: 63295 - protein, 10 aa, Homo sapiens
  light chain complementarity determining region 3 for antibody 31648
MQALKPHRYT

SEQ ID NO: 63296 - protein, 20 aa, Homo sapiens
  heavy chain complementarity determining region 3 for antibody 31648
ARLKAASAGLPSYYYAGMDV

SEQ ID NO: 63297 - protein, 10 aa, Homo sapiens
  light chain complementarity determining region 3 for antibody 31649
MQALKPHRNT

SEQ ID NO: 63298 - protein, 20 aa, Homo sapiens
  heavy chain complementarity determining region 3 for antibody 31649
ARLKAASAGLPSYYYAGMDV

SEQ ID NO: 63299 - protein, 9 aa, Homo sapiens
  light chain complementarity determining region 3 for antibody 31650
MQALHTRFT

SEQ ID NO: 63300 - protein, 12 aa, Homo sapiens
  heavy chain complementarity determining region 3 for antibody 31650
SKMVGWTYGMDV

SEQ ID NO: 63301 - protein, 9 aa, Homo sapiens
  light chain complementarity determining region 3 for antibody 31651
MQALHTPYT

SEQ ID NO: 63302 - protein, 9 aa, Homo sapiens
  heavy chain complementarity determining region 3 for antibody 31651
ARGDGAMDV

SEQ ID NO: 63303 - protein, 9 aa, Homo sapiens
  light chain complementarity determining region 3 for antibody 31652
MQALHTPRT

SEQ ID NO: 63304 - protein, 13 aa, Homo sapiens
  heavy chain complementarity determining region 3 for antibody 31652
ARASGGDYGLPAY

SEQ ID NO: 63305 - protein, 9 aa, Homo sapiens
  light chain complementarity determining region 3 for antibody 31653
MQALHTPRA

SEQ ID NO: 63306 - protein, 14 aa, Homo sapiens
  heavy chain complementarity determining region 3 for antibody 31653
VTLDYYYGSGSNHY

SEQ ID NO: 63307 - protein, 9 aa, Homo sapiens
  light chain complementarity determining region 3 for antibody 31654
MQALHTPLT

SEQ ID NO: 63308 - protein, 12 aa, Homo sapiens
  heavy chain complementarity determining region 3 for antibody 31654
AKDSEQKWELRD

SEQ ID NO: 63309 - protein, 9 aa, Homo sapiens
  light chain complementarity determining region 3 for antibody 31655
MQALHSPLT

SEQ ID NO: 63310 - protein, 15 aa, Homo sapiens
  heavy chain complementarity determining region 3 for antibody 31655
ARHGLGSYWKWDIEL

SEQ ID NO: 63311 - protein, 9 aa, Homo sapiens
  light chain complementarity determining region 3 for antibody 31656
MQALHPPWT

SEQ ID NO: 63312 - protein, 17 aa, Homo sapiens
  heavy chain complementarity determining region 3 for antibody 31656
ARPEYYFAGSGYHAFDI

SEQ ID NO: 63313 - protein, 10 aa, Homo sapiens
  light chain complementarity determining region 3 for antibody 31657
MQALHPPLFT

SEQ ID NO: 63314 - protein, 15 aa, Homo sapiens
  heavy chain complementarity determining region 3 for antibody 31657
APYYFDTSAYYGGGY

SEQ ID NO: 63315 - protein, 10 aa, Homo sapiens
  light chain complementarity determining region 3 for antibody 31658
MQALHIPLFT

SEQ ID NO: 63316 - protein, 15 aa, Homo sapiens
  heavy chain complementarity determining region 3 for antibody 31658
APYYFDTSAYYGGGY

SEQ ID NO: 63317 - protein, 9 aa, Homo sapiens
  light chain complementarity determining region 3 for antibody 31659
MQALGTPLT

SEQ ID NO: 63318 - protein, 12 aa, Homo sapiens
  heavy chain complementarity determining region 3 for antibody 31659
THRLNWGSGFDY

SEQ ID NO: 63319 - protein, 9 aa, Homo sapiens
  light chain complementarity determining region 3 for antibody 31660
MQALGTPLT

SEQ ID NO: 63320 - protein, 24 aa, Homo sapiens
  heavy chain complementarity determining region 3 for antibody 31660
ARVGLNYFDISGYSRIYYYYGMDV

SEQ ID NO: 63321 - protein, 9 aa, Homo sapiens
  light chain complementarity determining region 3 for antibody 31661
MQALGTPFT

SEQ ID NO: 63322 - protein, 15 aa, Homo sapiens
  heavy chain complementarity determining region 3 for antibody 31661
LRHYRSLATGTEGDC

SEQ ID NO: 63323 - protein, 9 aa, Homo sapiens
  light chain complementarity determining region 3 for antibody 31662
MQALETRLT

SEQ ID NO: 63324 - protein, 19 aa, Homo sapiens
  heavy chain complementarity determining region 3 for antibody 31662
ARATSYSSPWVVFYYGVDL

SEQ ID NO: 63325 - protein, 9 aa, Homo sapiens
  light chain complementarity determining region 3 for antibody 31663
MQALETQFT

SEQ ID NO: 63326 - protein, 15 aa, Homo sapiens
  heavy chain complementarity determining region 3 for antibody 31663
VRHYRIITAPLEGDS

SEQ ID NO: 63327 - protein, 9 aa, Homo sapiens
  light chain complementarity determining region 3 for antibody 31664
MQALETQFT

SEQ ID NO: 63328 - protein, 15 aa, Homo sapiens
  heavy chain complementarity determining region 3 for antibody 31664
VRHYRETVAGIEGDS

SEQ ID NO: 63329 - protein, 9 aa, Homo sapiens
  light chain complementarity determining region 3 for antibody 31665
MQALETPRT

SEQ ID NO: 63330 - protein, 19 aa, Homo sapiens
  heavy chain complementarity determining region 3 for antibody 31665
ARATSYSSPWVVFYYGVDL

SEQ ID NO: 63331 - protein, 9 aa, Homo sapiens
  light chain complementarity determining region 3 for antibody 31666
MQALETPLT

SEQ ID NO: 63332 - protein, 15 aa, Homo sapiens
  heavy chain complementarity determining region 3 for antibody 31666
VRHYRIITAPLEGDS

SEQ ID NO: 63333 - protein, 9 aa, Homo sapiens
  light chain complementarity determining region 3 for antibody 31667
MQALETPLT

SEQ ID NO: 63334 - protein, 15 aa, Homo sapiens
  heavy chain complementarity determining region 3 for antibody 31667
VRHYRETVTGIEGDS

SEQ ID NO: 63335 - protein, 9 aa, Homo sapiens
  light chain complementarity determining region 3 for antibody 31668
MQALETPLT

SEQ ID NO: 63336 - protein, 15 aa, Homo sapiens
  heavy chain complementarity determining region 3 for antibody 31668
VRHYRELTTGIEGDS

SEQ ID NO: 63337 - protein, 9 aa, Homo sapiens
  light chain complementarity determining region 3 for antibody 31669
MQALETPLT

SEQ ID NO: 63338 - protein, 24 aa, Homo sapiens
  heavy chain complementarity determining region 3 for antibody 31669
ARDGGPLVRGIIRPSLYYYYGLDV

SEQ ID NO: 63339 - protein, 9 aa, Homo sapiens
  light chain complementarity determining region 3 for antibody 31670
MQALETPLR

SEQ ID NO: 63340 - protein, 12 aa, Homo sapiens
  heavy chain complementarity determining region 3 for antibody 31670
THRLNWGSGFDY

SEQ ID NO: 63341 - protein, 9 aa, Homo sapiens
  light chain complementarity determining region 3 for antibody 31671
MQALETPLP

SEQ ID NO: 63342 - protein, 15 aa, Homo sapiens
  heavy chain complementarity determining region 3 for antibody 31671
VRHYRETVAGIEGDS

SEQ ID NO: 63343 - protein, 9 aa, Homo sapiens
  light chain complementarity determining region 3 for antibody 31672
MQALETPFT

SEQ ID NO: 63344 - protein, 15 aa, Homo sapiens
  heavy chain complementarity determining region 3 for antibody 31672
VRHYRETVAGIEGNS

SEQ ID NO: 63345 - protein, 9 aa, Homo sapiens
  light chain complementarity determining region 3 for antibody 31673
MQALETPFT

SEQ ID NO: 63346 - protein, 15 aa, Homo sapiens
  heavy chain complementarity determining region 3 for antibody 31673
VRHYRETVAGIDGDS

SEQ ID NO: 63347 - protein, 9 aa, Homo sapiens
  light chain complementarity determining region 3 for antibody 31674
MQALETPFT

SEQ ID NO: 63348 - protein, 15 aa, Homo sapiens
  heavy chain complementarity determining region 3 for antibody 31674
VRHYRETEAGIEGDS

SEQ ID NO: 63349 - protein, 9 aa, Homo sapiens
  light chain complementarity determining region 3 for antibody 31675
MQALETPFT

SEQ ID NO: 63350 - protein, 14 aa, Homo sapiens
  heavy chain complementarity determining region 3 for antibody 31675
RHYRETVAGIEGDS

SEQ ID NO: 63351 - protein, 9 aa, Homo sapiens
  light chain complementarity determining region 3 for antibody 31676
MQALETPFT

SEQ ID NO: 63352 - protein, 15 aa, Homo sapiens
  heavy chain complementarity determining region 3 for antibody 31676
ARHYRETVAGIEGDS

SEQ ID NO: 63353 - protein, 9 aa, Homo sapiens
  light chain complementarity determining region 3 for antibody 31677
MQALETPFS

SEQ ID NO: 63354 - protein, 15 aa, Homo sapiens
  heavy chain complementarity determining region 3 for antibody 31677
VRHYRETVAGIEGDS

SEQ ID NO: 63355 - protein, 9 aa, Homo sapiens
  light chain complementarity determining region 3 for antibody 31678
MQALETPFN

SEQ ID NO: 63356 - protein, 15 aa, Homo sapiens
  heavy chain complementarity determining region 3 for antibody 31678
VRHYRETVAGIEGDS

SEQ ID NO: 63357 - protein, 9 aa, Homo sapiens
  light chain complementarity determining region 3 for antibody 31679
MQALETPFK

SEQ ID NO: 63358 - protein, 15 aa, Homo sapiens
  heavy chain complementarity determining region 3 for antibody 31679
VRHYRETVAGIEGDS

SEQ ID NO: 63359 - protein, 8 aa, Homo sapiens
  light chain complementarity determining region 3 for antibody 31680
MQALESLT

SEQ ID NO: 63360 - protein, 11 aa, Homo sapiens
  heavy chain complementarity determining region 3 for antibody 31680
AISNLRGAFDI

SEQ ID NO: 63361 - protein, 8 aa, Homo sapiens
  light chain complementarity determining region 3 for antibody 31681
MQALESFT

SEQ ID NO: 63362 - protein, 11 aa, Homo sapiens
  heavy chain complementarity determining region 3 for antibody 31681
AISNLRGAFDI

SEQ ID NO: 63363 - protein, 8 aa, Homo sapiens
  light chain complementarity determining region 3 for antibody 31682
MQALERIT

SEQ ID NO: 63364 - protein, 11 aa, Homo sapiens
  heavy chain complementarity determining region 3 for antibody 31682
AISNLRGAFDI

SEQ ID NO: 63365 - protein, 9 aa, Homo sapiens
  light chain complementarity determining region 3 for antibody 31683
MQALEIPLT

SEQ ID NO: 63366 - protein, 19 aa, Homo sapiens
  heavy chain complementarity determining region 3 for antibody 31683
ARATSYSSPWVVFYYGVDL

SEQ ID NO: 63367 - protein, 9 aa, Homo sapiens
  light chain complementarity determining region 3 for antibody 31684
MQALDTPLT

SEQ ID NO: 63368 - protein, 19 aa, Homo sapiens
  heavy chain complementarity determining region 3 for antibody 31684
ARATSYSSPWVVFYYGVDL

SEQ ID NO: 63369 - protein, 9 aa, Homo sapiens
  light chain complementarity determining region 3 for antibody 31685
MQALDTPFT

SEQ ID NO: 63370 - protein, 15 aa, Homo sapiens
  heavy chain complementarity determining region 3 for antibody 31685
LRHYRSLATGTEGDC

SEQ ID NO: 63371 - protein, 9 aa, Homo sapiens
  light chain complementarity determining region 3 for antibody 31686
MQAIETPFT

SEQ ID NO: 63372 - protein, 15 aa, Homo sapiens
  heavy chain complementarity determining region 3 for antibody 31686
LRHYRSLATGTEGDC

SEQ ID NO: 63373 - protein, 9 aa, Homo sapiens
  light chain complementarity determining region 3 for antibody 31687
MQAHQTPLT

SEQ ID NO: 63374 - protein, 15 aa, Homo sapiens
  heavy chain complementarity determining region 3 for antibody 31687
ARTGRSTWYGYGMDV

SEQ ID NO: 63375 - protein, 9 aa, Homo sapiens
  light chain complementarity determining region 3 for antibody 31688
MQAHQTPLP

SEQ ID NO: 63376 - protein, 15 aa, Homo sapiens
  heavy chain complementarity determining region 3 for antibody 31688
ARTGSSTWYGYGMDV

SEQ ID NO: 63377 - protein, 9 aa, Homo sapiens
  light chain complementarity determining region 3 for antibody 31689
MQAHKTPLT

SEQ ID NO: 63378 - protein, 15 aa, Homo sapiens
  heavy chain complementarity determining region 3 for antibody 31689
ARTGSSTWYGYGMDV

SEQ ID NO: 63379 - protein, 9 aa, Homo sapiens
  light chain complementarity determining region 3 for antibody 31690
MPVLQTPLT

SEQ ID NO: 63380 - protein, 12 aa, Homo sapiens
  heavy chain complementarity determining region 3 for antibody 31690
AKDSEQKWELHD

SEQ ID NO: 63381 - protein, 9 aa, Homo sapiens
  light chain complementarity determining region 3 for antibody 31691
MPVLQSPLS

SEQ ID NO: 63382 - protein, 12 aa, Homo sapiens
  heavy chain complementarity determining region 3 for antibody 31691
TRDPDSHYGMDV

SEQ ID NO: 63383 - protein, 9 aa, Homo sapiens
  light chain complementarity determining region 3 for antibody 31692
MPPLHTPIT

SEQ ID NO: 63384 - protein, 18 aa, Homo sapiens
  heavy chain complementarity determining region 3 for antibody 31692
ARPFYDSYTYHYYYGLDV

SEQ ID NO: 63385 - protein, 9 aa, Homo sapiens
  light chain complementarity determining region 3 for antibody 31693
MPGTHWPWT

SEQ ID NO: 63386 - protein, 13 aa, Homo sapiens
  heavy chain complementarity determining region 3 for antibody 31693
ATMLRGHHGADGD

SEQ ID NO: 63387 - protein, 9 aa, Homo sapiens
  light chain complementarity determining region 3 for antibody 31694
MPGTHWPKT

SEQ ID NO: 63388 - protein, 9 aa, Homo sapiens
  heavy chain complementarity determining region 3 for antibody 31694
AKGYYDSSY

SEQ ID NO: 63389 - protein, 10 aa, Homo sapiens
  light chain complementarity determining region 3 for antibody 31695
MPGSYWPPWT

SEQ ID NO: 63390 - protein, 11 aa, Homo sapiens
  heavy chain complementarity determining region 3 for antibody 31695
ARDTPGVGIDY

SEQ ID NO: 63391 - protein, 10 aa, Homo sapiens
  light chain complementarity determining region 3 for antibody 31696
MPGSYWPPGT

SEQ ID NO: 63392 - protein, 11 aa, Homo sapiens
  heavy chain complementarity determining region 3 for antibody 31696
ARDTPGIGIDY

SEQ ID NO: 63393 - protein, 9 aa, Homo sapiens
  light chain complementarity determining region 3 for antibody 31697
MPGLQTPYT

SEQ ID NO: 63394 - protein, 10 aa, Homo sapiens
  heavy chain complementarity determining region 3 for antibody 31697
ARDVVGSDDQ

SEQ ID NO: 63395 - protein, 9 aa, Homo sapiens
  light chain complementarity determining region 3 for antibody 31698
MPGLQIPFT

SEQ ID NO: 63396 - protein, 17 aa, Homo sapiens
  heavy chain complementarity determining region 3 for antibody 31698
ARDTEKATIGAEGAFDI

SEQ ID NO: 63397 - protein, 9 aa, Homo sapiens
  light chain complementarity determining region 3 for antibody 31699
MPALQTRFT

SEQ ID NO: 63398 - protein, 12 aa, Homo sapiens
  heavy chain complementarity determining region 3 for antibody 31699
SKMVGWTYGMDV

SEQ ID NO: 63399 - protein, 9 aa, Homo sapiens
  light chain complementarity determining region 3 for antibody 31700
MPALQTPLT

SEQ ID NO: 63400 - protein, 13 aa, Homo sapiens
  heavy chain complementarity determining region 3 for antibody 31700
ATSRGSATSYDDF

SEQ ID NO: 63401 - protein, 8 aa, Homo sapiens
  light chain complementarity determining region 3 for antibody 31701
MPALQTLT

SEQ ID NO: 63402 - protein, 16 aa, Homo sapiens
  heavy chain complementarity determining region 3 for antibody 31701
AKAGWLVGYDLSRGCA

SEQ ID NO: 63403 - protein, 9 aa, Homo sapiens
  light chain complementarity determining region 3 for antibody 31702
MPALETPFT

SEQ ID NO: 63404 - protein, 15 aa, Homo sapiens
  heavy chain complementarity determining region 3 for antibody 31702
VRHYRETVAGIEGDS

SEQ ID NO: 63405 - protein, 9 aa, Homo sapiens
  light chain complementarity determining region 3 for antibody 31703
MKSRRWPHT

SEQ ID NO: 63406 - protein, 8 aa, Homo sapiens
  heavy chain complementarity determining region 3 for antibody 31703
TAWGSSQH

SEQ ID NO: 63407 - protein, 9 aa, Homo sapiens
  light chain complementarity determining region 3 for antibody 31704
MKGTRWPYT

SEQ ID NO: 63408 - protein, 10 aa, Homo sapiens
  heavy chain complementarity determining region 3 for antibody 31704
ARNSGWSVDC

SEQ ID NO: 63409 - protein, 9 aa, Homo sapiens
  light chain complementarity determining region 3 for antibody 31705
MKGLQTPDT

SEQ ID NO: 63410 - protein, 10 aa, Homo sapiens
  heavy chain complementarity determining region 3 for antibody 31705
GRDLSGARDY

SEQ ID NO: 63411 - protein, 7 aa, Homo sapiens
  light chain complementarity determining region 3 for antibody 31706
MKALQTL

SEQ ID NO: 63412 - protein, 15 aa, Homo sapiens
  heavy chain complementarity determining region 3 for antibody 31706
ARGGYGGSLYWYFDL

SEQ ID NO: 63413 - protein, 9 aa, Homo sapiens
  light chain complementarity determining region 3 for antibody 31707
MKALETPFT

SEQ ID NO: 63414 - protein, 15 aa, Homo sapiens
  heavy chain complementarity determining region 3 for antibody 31707
VRHYRETVAGIEGDS

SEQ ID NO: 63415 - protein, 9 aa, Homo sapiens
  light chain complementarity determining region 3 for antibody 31708
MHVLQTPLT

SEQ ID NO: 63416 - protein, 12 aa, Homo sapiens
  heavy chain complementarity determining region 3 for antibody 31708
VKDSDKKWELLD

SEQ ID NO: 63417 - protein, 9 aa, Homo sapiens
  light chain complementarity determining region 3 for antibody 31709
MHSRRWPHT

SEQ ID NO: 63418 - protein, 8 aa, Homo sapiens
  heavy chain complementarity determining region 3 for antibody 31709
TAWGSSQH

SEQ ID NO: 63419 - protein, 9 aa, Homo sapiens
  light chain complementarity determining region 3 for antibody 31710
MHSRQTVRT

SEQ ID NO: 63420 - protein, 18 aa, Homo sapiens
  heavy chain complementarity determining region 3 for antibody 31710
ARLDYYYGSGMPGRGFDH

SEQ ID NO: 63421 - protein, 8 aa, Homo sapiens
  light chain complementarity determining region 3 for antibody 31711
MHSLQTPG

SEQ ID NO: 63422 - protein, 19 aa, Homo sapiens
  heavy chain complementarity determining region 3 for antibody 31711
ANFGSGNFYNVRYYYGMDV

SEQ ID NO: 63423 - protein, 8 aa, Homo sapiens
  light chain complementarity determining region 3 for antibody 31712
MHPLQTPG

SEQ ID NO: 63424 - protein, 19 aa, Homo sapiens
  heavy chain complementarity determining region 3 for antibody 31712
ANFGSGNFYNVRYYYGMDV

SEQ ID NO: 63425 - protein, 8 aa, Homo sapiens
  light chain complementarity determining region 3 for antibody 31713
MHALQTRG

SEQ ID NO: 63426 - protein, 19 aa, Homo sapiens
  heavy chain complementarity determining region 3 for antibody 31713
ANFGSGNFYNVRYYYGMDV

SEQ ID NO: 63427 - protein, 9 aa, Homo sapiens
  light chain complementarity determining region 3 for antibody 31714
MHALQTPRT

SEQ ID NO: 63428 - protein, 25 aa, Homo sapiens
  heavy chain complementarity determining region 3 for antibody 31714
ARGAGRDGVVVADARSWAYYYGMDV

SEQ ID NO: 63429 - protein, 10 aa, Homo sapiens
  light chain complementarity determining region 3 for antibody 31715
MHALQTLFFT

SEQ ID NO: 63430 - protein, 19 aa, Homo sapiens
  heavy chain complementarity determining region 3 for antibody 31715
ARGGRWELLPAVYYYGMDV

SEQ ID NO: 63431 - protein, 8 aa, Homo sapiens
  light chain complementarity determining region 3 for antibody 31716
MHALQIPT

SEQ ID NO: 63432 - protein, 21 aa, Homo sapiens
  heavy chain complementarity determining region 3 for antibody 31716
PHNYGITRIRGVGKRAYGMDV

SEQ ID NO: 63433 - protein, 9 aa, Homo sapiens
  light chain complementarity determining region 3 for antibody 31717
MHALETPFT

SEQ ID NO: 63434 - protein, 15 aa, Homo sapiens
  heavy chain complementarity determining region 3 for antibody 31717
VRHYRELATGIEGDS

SEQ ID NO: 63435 - protein, 9 aa, Homo sapiens
  light chain complementarity determining region 3 for antibody 31718
MGTLQTPPA

SEQ ID NO: 63436 - protein, 15 aa, Homo sapiens
  heavy chain complementarity determining region 3 for antibody 31718
TRDGKKDGHNDAFDV

SEQ ID NO: 63437 - protein, 9 aa, Homo sapiens
  light chain complementarity determining region 3 for antibody 31719
MGPLQTPPT

SEQ ID NO: 63438 - protein, 15 aa, Homo sapiens
  heavy chain complementarity determining region 3 for antibody 31719
TRDGKKDGHNDAFDV

SEQ ID NO: 63439 - protein, 10 aa, Homo sapiens
  light chain complementarity determining region 3 for antibody 31720
MESLQPPQHS

SEQ ID NO: 63440 - protein, 12 aa, Homo sapiens
  heavy chain complementarity determining region 3 for antibody 31720
ARLSYELFAFDI

SEQ ID NO: 63441 - protein, 9 aa, Homo sapiens
  light chain complementarity determining region 3 for antibody 31721
MEALQTPYT

SEQ ID NO: 63442 - protein, 22 aa, Homo sapiens
  heavy chain complementarity determining region 3 for antibody 31721
TRPRRDYSGSRSPYYYYYGMDV

SEQ ID NO: 63443 - protein, 8 aa, Homo sapiens
  light chain complementarity determining region 3 for antibody 31722
MEALQTLP

SEQ ID NO: 63444 - protein, 20 aa, Homo sapiens
  heavy chain complementarity determining region 3 for antibody 31722
ARVKFGGRATIKYYYYGMDV

SEQ ID NO: 63445 - protein, 9 aa, Homo sapiens
  light chain complementarity determining region 3 for antibody 31723
MEALQIPWK

SEQ ID NO: 63446 - protein, 16 aa, Homo sapiens
  heavy chain complementarity determining region 3 for antibody 31723
ARLGGAGTNYYYGMDV

SEQ ID NO: 63447 - protein, 9 aa, Homo sapiens
  light chain complementarity determining region 3 for antibody 31724
MEALKIPWT

SEQ ID NO: 63448 - protein, 16 aa, Homo sapiens
  heavy chain complementarity determining region 3 for antibody 31724
ARLGGAGTNYYYGMDV

SEQ ID NO: 63449 - protein, 11 aa, Homo sapiens
  light chain complementarity determining region 3 for antibody 31725
LVFNNSPPTGT

SEQ ID NO: 63450 - protein, 15 aa, Homo sapiens
  heavy chain complementarity determining region 3 for antibody 31725
VRDFSYGALMSYFEY

SEQ ID NO: 63451 - protein, 23 aa, Homo sapiens
  light chain complementarity determining region 3 for antibody 31726
LTVNNIESEDAAYYFFLQHDNVP

SEQ ID NO: 63452 - protein, 15 aa, Homo sapiens
  heavy chain complementarity determining region 3 for antibody 31726
ARESWDGSDRSAFDI

SEQ ID NO: 63453 - protein, 9 aa, Homo sapiens
  light chain complementarity determining region 3 for antibody 31727
LRHNSYPWT

SEQ ID NO: 63454 - protein, 6 aa, Homo sapiens
  heavy chain complementarity determining region 3 for antibody 31727
SRDGTY

SEQ ID NO: 63455 - protein, 9 aa, Homo sapiens
  light chain complementarity determining region 3 for antibody 31728
LQYYSTPWP

SEQ ID NO: 63456 - protein, 15 aa, Homo sapiens
  heavy chain complementarity determining region 3 for antibody 31728
IRQSKVDNYYNYPDF

SEQ ID NO: 63457 - protein, 9 aa, Homo sapiens
  light chain complementarity determining region 3 for antibody 31729
LQYYSPPWT

SEQ ID NO: 63458 - protein, 15 aa, Homo sapiens
  heavy chain complementarity determining region 3 for antibody 31729
IRQSKVDNYYNYPDF

SEQ ID NO: 63459 - protein, 9 aa, Homo sapiens
  light chain complementarity determining region 3 for antibody 31730
LQYYATPWT

SEQ ID NO: 63460 - protein, 15 aa, Homo sapiens
  heavy chain complementarity determining region 3 for antibody 31730
VRQSKVDNNYNSPDF

SEQ ID NO: 63461 - protein, 9 aa, Homo sapiens
  light chain complementarity determining region 3 for antibody 31731
LQYYATPWT

SEQ ID NO: 63462 - protein, 15 aa, Homo sapiens
  heavy chain complementarity determining region 3 for antibody 31731
VRQAKVDNNYNYPDF

SEQ ID NO: 63463 - protein, 9 aa, Homo sapiens
  light chain complementarity determining region 3 for antibody 31732
LQYYATPWS

SEQ ID NO: 63464 - protein, 15 aa, Homo sapiens
  heavy chain complementarity determining region 3 for antibody 31732
VRQSKVDNNYNYPDF

SEQ ID NO: 63465 - protein, 9 aa, Homo sapiens
  light chain complementarity determining region 3 for antibody 31733
LQYTSYPRT

SEQ ID NO: 63466 - protein, 9 aa, Homo sapiens
  heavy chain complementarity determining region 3 for antibody 31733
ARGGWATDY

SEQ ID NO: 63467 - protein, 6 aa, Homo sapiens
  light chain complementarity determining region 3 for antibody 31734
LQYPWT

SEQ ID NO: 63468 - protein, 24 aa, Homo sapiens
  heavy chain complementarity determining region 3 for antibody 31734
ARGSPRMYYDDSRGYNRGPYRLDV

SEQ ID NO: 63469 - protein, 9 aa, Homo sapiens
  light chain complementarity determining region 3 for antibody 31735
LQYNYYPPT

SEQ ID NO: 63470 - protein, 18 aa, Homo sapiens
  heavy chain complementarity determining region 3 for antibody 31735
ARDMSGYYGSGSYASFDY

SEQ ID NO: 63471 - protein, 9 aa, Homo sapiens
  light chain complementarity determining region 3 for antibody 31736
LQYNSYPWT

SEQ ID NO: 63472 - protein, 12 aa, Homo sapiens
  heavy chain complementarity determining region 3 for antibody 31736
ARAIAAAAVSYD

SEQ ID NO: 63473 - protein, 9 aa, Homo sapiens
  light chain complementarity determining region 3 for antibody 31737
LQYNSYPRT

SEQ ID NO: 63474 - protein, 6 aa, Homo sapiens
  heavy chain complementarity determining region 3 for antibody 31737
TRALDY

SEQ ID NO: 63475 - protein, 9 aa, Homo sapiens
  light chain complementarity determining region 3 for antibody 31738
LQYNSYPGT

SEQ ID NO: 63476 - protein, 12 aa, Homo sapiens
  heavy chain complementarity determining region 3 for antibody 31738
ARAIAAAAVSSD

SEQ ID NO: 63477 - protein, 8 aa, Homo sapiens
  light chain complementarity determining region 3 for antibody 31739
LQYNSHNT

SEQ ID NO: 63478 - protein, 21 aa, Homo sapiens
  heavy chain complementarity determining region 3 for antibody 31739
ASGPRDYCPAANCRIYNWFDP

SEQ ID NO: 63479 - protein, 9 aa, Homo sapiens
  light chain complementarity determining region 3 for antibody 31740
LQYNSFPLT

SEQ ID NO: 63480 - protein, 5 aa, Homo sapiens
  heavy chain complementarity determining region 3 for antibody 31740
ARGDY

SEQ ID NO: 63481 - protein, 9 aa, Homo sapiens
  light chain complementarity determining region 3 for antibody 31741
LQYNRYPWT

SEQ ID NO: 63482 - protein, 15 aa, Homo sapiens
  heavy chain complementarity determining region 3 for antibody 31741
VREGTSSPGWSEIEY

SEQ ID NO: 63483 - protein, 9 aa, Homo sapiens
  light chain complementarity determining region 3 for antibody 31742
LQYNRYPGT

SEQ ID NO: 63484 - protein, 15 aa, Homo sapiens
  heavy chain complementarity determining region 3 for antibody 31742
VREGTSRPGWSEIEY

SEQ ID NO: 63485 - protein, 10 aa, Homo sapiens
  light chain complementarity determining region 3 for antibody 31743
LQYNNWPPYT

SEQ ID NO: 63486 - protein, 19 aa, Homo sapiens
  heavy chain complementarity determining region 3 for antibody 31743
ATVSPHHDRGGYAPNWLDP

SEQ ID NO: 63487 - protein, 10 aa, Homo sapiens
  light chain complementarity determining region 3 for antibody 31744
LQYNNWPPYT

SEQ ID NO: 63488 - protein, 19 aa, Homo sapiens
  heavy chain complementarity determining region 3 for antibody 31744
ATVRPHHDGGGYAPNWLDP

SEQ ID NO: 63489 - protein, 10 aa, Homo sapiens
  light chain complementarity determining region 3 for antibody 31745
LQYNNWPPYT

SEQ ID NO: 63490 - protein, 19 aa, Homo sapiens
  heavy chain complementarity determining region 3 for antibody 31745
ATVNPHHDGGGYAPNWLDP

SEQ ID NO: 63491 - protein, 10 aa, Homo sapiens
  light chain complementarity determining region 3 for antibody 31746
LQYNNWPPST

SEQ ID NO: 63492 - protein, 19 aa, Homo sapiens
  heavy chain complementarity determining region 3 for antibody 31746
ATVSPHHDGGGYAPNWLDP

SEQ ID NO: 63493 - protein, 10 aa, Homo sapiens
  light chain complementarity determining region 3 for antibody 31747
LQYNNWPPDT

SEQ ID NO: 63494 - protein, 14 aa, Homo sapiens
  heavy chain complementarity determining region 3 for antibody 31747
ARGGRLRLFSFSDY

SEQ ID NO: 63495 - protein, 9 aa, Homo sapiens
  light chain complementarity determining region 3 for antibody 31748
LQYNDWPVI

SEQ ID NO: 63496 - protein, 9 aa, Homo sapiens
  heavy chain complementarity determining region 3 for antibody 31748
AGWFGEFYL

SEQ ID NO: 63497 - protein, 9 aa, Homo sapiens
  light chain complementarity determining region 3 for antibody 31749
LQYNDWPFI

SEQ ID NO: 63498 - protein, 9 aa, Homo sapiens
  heavy chain complementarity determining region 3 for antibody 31749
AGWSGEFYL

SEQ ID NO: 63499 - protein, 9 aa, Homo sapiens
  light chain complementarity determining region 3 for antibody 31750
LQYNDWPFI

SEQ ID NO: 63500 - protein, 9 aa, Homo sapiens
  heavy chain complementarity determining region 3 for antibody 31750
AGWLGEFYL

SEQ ID NO: 63501 - protein, 9 aa, Homo sapiens
  light chain complementarity determining region 3 for antibody 31751
LQYNDWPFI

SEQ ID NO: 63502 - protein, 9 aa, Homo sapiens
  heavy chain complementarity determining region 3 for antibody 31751
AGWFGEFYP

SEQ ID NO: 63503 - protein, 9 aa, Homo sapiens
  light chain complementarity determining region 3 for antibody 31752
LQYNDFPYI

SEQ ID NO: 63504 - protein, 13 aa, Homo sapiens
  heavy chain complementarity determining region 3 for antibody 31752
ARSPYSSGWYPDL

SEQ ID NO: 63505 - protein, 9 aa, Homo sapiens
  light chain complementarity determining region 3 for antibody 31753
LQYNAWPFI

SEQ ID NO: 63506 - protein, 9 aa, Homo sapiens
  heavy chain complementarity determining region 3 for antibody 31753
AGWFGEFYL

SEQ ID NO: 63507 - protein, 9 aa, Homo sapiens
  light chain complementarity determining region 3 for antibody 31754
LQYKDYPRT

SEQ ID NO: 63508 - protein, 27 aa, Homo sapiens
  heavy chain complementarity determining region 3 for antibody 31754
ATDDRSLLGGYLSWGPKEDDYFRGLDV

SEQ ID NO: 63509 - protein, 9 aa, Homo sapiens
  light chain complementarity determining region 3 for antibody 31755
LQYKDYPRT

SEQ ID NO: 63510 - protein, 27 aa, Homo sapiens
  heavy chain complementarity determining region 3 for antibody 31755
ATDDLALLGGYLSWGPKEDDYFRGLDV

SEQ ID NO: 63511 - protein, 9 aa, Homo sapiens
  light chain complementarity determining region 3 for antibody 31756
LQYGYFPYT

SEQ ID NO: 63512 - protein, 12 aa, Homo sapiens
  heavy chain complementarity determining region 3 for antibody 31756
VRPLDSSGSLGY

SEQ ID NO: 63513 - protein, 9 aa, Homo sapiens
  light chain complementarity determining region 3 for antibody 31757
LQYGYFPST

SEQ ID NO: 63514 - protein, 12 aa, Homo sapiens
  heavy chain complementarity determining region 3 for antibody 31757
VRLLDSSGSLGY

SEQ ID NO: 63515 - protein, 9 aa, Homo sapiens
  light chain complementarity determining region 3 for antibody 31758
LQYGWLPRA

SEQ ID NO: 63516 - protein, 14 aa, Homo sapiens
  heavy chain complementarity determining region 3 for antibody 31758
AKDAGAVAVHYFDH

SEQ ID NO: 63517 - protein, 9 aa, Homo sapiens
  light chain complementarity determining region 3 for antibody 31759
LQYGTSPLT

SEQ ID NO: 63518 - protein, 13 aa, Homo sapiens
  heavy chain complementarity determining region 3 for antibody 31759
ARVQWLGDDVFDL

SEQ ID NO: 63519 - protein, 8 aa, Homo sapiens
  light chain complementarity determining region 3 for antibody 31760
LQYGSSPP

SEQ ID NO: 63520 - protein, 11 aa, Homo sapiens
  heavy chain complementarity determining region 3 for antibody 31760
SMGGGIAVSHE

SEQ ID NO: 63521 - protein, 9 aa, Homo sapiens
  light chain complementarity determining region 3 for antibody 31761
LQYGSSLYT

SEQ ID NO: 63522 - protein, 9 aa, Homo sapiens
  heavy chain complementarity determining region 3 for antibody 31761
IYEINAFDI

SEQ ID NO: 63523 - protein, 9 aa, Homo sapiens
  light chain complementarity determining region 3 for antibody 31762
LQYGRSPRT

SEQ ID NO: 63524 - protein, 15 aa, Homo sapiens
  heavy chain complementarity determining region 3 for antibody 31762
AKDGEFCGSNCYFGS

SEQ ID NO: 63525 - protein, 9 aa, Homo sapiens
  light chain complementarity determining region 3 for antibody 31763
LQYGGTPLT

SEQ ID NO: 63526 - protein, 8 aa, Homo sapiens
  heavy chain complementarity determining region 3 for antibody 31763
VRMMDPGY

SEQ ID NO: 63527 - protein, 9 aa, Homo sapiens
  light chain complementarity determining region 3 for antibody 31764
LQYGGTPLT

SEQ ID NO: 63528 - protein, 8 aa, Homo sapiens
  heavy chain complementarity determining region 3 for antibody 31764
VRITDPGY

SEQ ID NO: 63529 - protein, 9 aa, Homo sapiens
  light chain complementarity determining region 3 for antibody 31765
LQYGGTPLT

SEQ ID NO: 63530 - protein, 8 aa, Homo sapiens
  heavy chain complementarity determining region 3 for antibody 31765
VGIMDPGY

SEQ ID NO: 63531 - protein, 9 aa, Homo sapiens
  light chain complementarity determining region 3 for antibody 31766
LQYGGSSYT

SEQ ID NO: 63532 - protein, 16 aa, Homo sapiens
  heavy chain complementarity determining region 3 for antibody 31766
ANWFGSVGDFLGPFDY

SEQ ID NO: 63533 - protein, 8 aa, Homo sapiens
  light chain complementarity determining region 3 for antibody 31767
LQYGGSPT

SEQ ID NO: 63534 - protein, 11 aa, Homo sapiens
  heavy chain complementarity determining region 3 for antibody 31767
SRGGGIGVSHR

SEQ ID NO: 63535 - protein, 8 aa, Homo sapiens
  light chain complementarity determining region 3 for antibody 31768
LQYGGSPT

SEQ ID NO: 63536 - protein, 11 aa, Homo sapiens
  heavy chain complementarity determining region 3 for antibody 31768
SMGRGIGVSHR

SEQ ID NO: 63537 - protein, 8 aa, Homo sapiens
  light chain complementarity determining region 3 for antibody 31769
LQYGGPPT

SEQ ID NO: 63538 - protein, 11 aa, Homo sapiens
  heavy chain complementarity determining region 3 for antibody 31769
SMGGGIGVSHR

SEQ ID NO: 63539 - protein, 9 aa, Homo sapiens
  light chain complementarity determining region 3 for antibody 31770
LQYGFAQYS

SEQ ID NO: 63540 - protein, 18 aa, Homo sapiens
  heavy chain complementarity determining region 3 for antibody 31770
TGVHGLTRLRGATKPFDF

SEQ ID NO: 63541 - protein, 9 aa, Homo sapiens
  light chain complementarity determining region 3 for antibody 31771
LQYGFAQYS

SEQ ID NO: 63542 - protein, 18 aa, Homo sapiens
  heavy chain complementarity determining region 3 for antibody 31771
TGVHGLTMLRGATNPFDF

SEQ ID NO: 63543 - protein, 9 aa, Homo sapiens
  light chain complementarity determining region 3 for antibody 31772
LQYGFAQYG

SEQ ID NO: 63544 - protein, 18 aa, Homo sapiens
  heavy chain complementarity determining region 3 for antibody 31772
TGVHGLTMLRGATKPFDF

SEQ ID NO: 63545 - protein, 9 aa, Homo sapiens
  light chain complementarity determining region 3 for antibody 31773
LQYGFAQSS

SEQ ID NO: 63546 - protein, 18 aa, Homo sapiens
  heavy chain complementarity determining region 3 for antibody 31773
TGVHGLTMLRGATKPFDF

SEQ ID NO: 63547 - protein, 9 aa, Homo sapiens
  light chain complementarity determining region 3 for antibody 31774
LQYGFAQDS

SEQ ID NO: 63548 - protein, 18 aa, Homo sapiens
  heavy chain complementarity determining region 3 for antibody 31774
TGVHGLTMLRGATKPFDF

SEQ ID NO: 63549 - protein, 9 aa, Homo sapiens
  light chain complementarity determining region 3 for antibody 31775
LQYGFAPYS

SEQ ID NO: 63550 - protein, 18 aa, Homo sapiens
  heavy chain complementarity determining region 3 for antibody 31775
TGVHGLTMLRGATKPFDF

SEQ ID NO: 63551 - protein, 9 aa, Homo sapiens
  light chain complementarity determining region 3 for antibody 31776
LQYFATPWT

SEQ ID NO: 63552 - protein, 15 aa, Homo sapiens
  heavy chain complementarity determining region 3 for antibody 31776
VRQSKVDNNYNYPDF

SEQ ID NO: 63553 - protein, 9 aa, Homo sapiens
  light chain complementarity determining region 3 for antibody 31777
LQYDTYPWT

SEQ ID NO: 63554 - protein, 17 aa, Homo sapiens
  heavy chain complementarity determining region 3 for antibody 31777
ARVKWLQLQDFYYGMDV

SEQ ID NO: 63555 - protein, 10 aa, Homo sapiens
  light chain complementarity determining region 3 for antibody 31778
LQYDTHSPWT

SEQ ID NO: 63556 - protein, 20 aa, Homo sapiens
  heavy chain complementarity determining region 3 for antibody 31778
AKPEGWWDGSGTYPTYYFDY

SEQ ID NO: 63557 - protein, 9 aa, Homo sapiens
  light chain complementarity determining region 3 for antibody 31779
LQYDLLPPT

SEQ ID NO: 63558 - protein, 21 aa, Homo sapiens
  heavy chain complementarity determining region 3 for antibody 31779
ARGLHVVVVTSILRGFWYFGL

SEQ ID NO: 63559 - protein, 9 aa, Homo sapiens
  light chain complementarity determining region 3 for antibody 31780
LQYDISPRT

SEQ ID NO: 63560 - protein, 12 aa, Homo sapiens
  heavy chain complementarity determining region 3 for antibody 31780
ATMYGFLHSIDY

SEQ ID NO: 63561 - protein, 9 aa, Homo sapiens
  light chain complementarity determining region 3 for antibody 31781
LQYDISPLT

SEQ ID NO: 63562 - protein, 12 aa, Homo sapiens
  heavy chain complementarity determining region 3 for antibody 31781
TTMYGFLHSIDY

SEQ ID NO: 63563 - protein, 9 aa, Homo sapiens
  light chain complementarity determining region 3 for antibody 31782
LQVYNYPWT

SEQ ID NO: 63564 - protein, 14 aa, Homo sapiens
  heavy chain complementarity determining region 3 for antibody 31782
ARVGGFHGSWSLDY

SEQ ID NO: 63565 - protein, 9 aa, Homo sapiens
  light chain complementarity determining region 3 for antibody 31783
LQVVSSPRP

SEQ ID NO: 63566 - protein, 8 aa, Homo sapiens
  heavy chain complementarity determining region 3 for antibody 31783
ARNSGWYD

SEQ ID NO: 63567 - protein, 9 aa, Homo sapiens
  light chain complementarity determining region 3 for antibody 31784
LQVVSLPRT

SEQ ID NO: 63568 - protein, 8 aa, Homo sapiens
  heavy chain complementarity determining region 3 for antibody 31784
ARNSGWYD

SEQ ID NO: 63569 - protein, 9 aa, Homo sapiens
  light chain complementarity determining region 3 for antibody 31785
LQVVSFPRT

SEQ ID NO: 63570 - protein, 8 aa, Homo sapiens
  heavy chain complementarity determining region 3 for antibody 31785
ARNSGWDD

SEQ ID NO: 63571 - protein, 9 aa, Homo sapiens
  light chain complementarity determining region 3 for antibody 31786
LQVVSFPRT

SEQ ID NO: 63572 - protein, 8 aa, Homo sapiens
  heavy chain complementarity determining region 3 for antibody 31786
AGNSGWYD

SEQ ID NO: 63573 - protein, 9 aa, Homo sapiens
  light chain complementarity determining region 3 for antibody 31787
LQVHIYPFT

SEQ ID NO: 63574 - protein, 12 aa, Homo sapiens
  heavy chain complementarity determining region 3 for antibody 31787
ARPLDGDFGFDP

SEQ ID NO: 63575 - protein, 9 aa, Homo sapiens
  light chain complementarity determining region 3 for antibody 31788
LQVFSFPRP

SEQ ID NO: 63576 - protein, 8 aa, Homo sapiens
  heavy chain complementarity determining region 3 for antibody 31788
ARNSGWYD

SEQ ID NO: 63577 - protein, 9 aa, Homo sapiens
  light chain complementarity determining region 3 for antibody 31789
LQVDSFPRT

SEQ ID NO: 63578 - protein, 8 aa, Homo sapiens
  heavy chain complementarity determining region 3 for antibody 31789
ARNSGWYD

SEQ ID NO: 63579 - protein, 9 aa, Homo sapiens
  light chain complementarity determining region 3 for antibody 31790
LQTLQTPWT

SEQ ID NO: 63580 - protein, 13 aa, Homo sapiens
  heavy chain complementarity determining region 3 for antibody 31790
AKVVSYGSGGLHY

SEQ ID NO: 63581 - protein, 9 aa, Homo sapiens
  light chain complementarity determining region 3 for antibody 31791
LQTLQTPWR

SEQ ID NO: 63582 - protein, 13 aa, Homo sapiens
  heavy chain complementarity determining region 3 for antibody 31791
AKVVSYGSGGLQY

SEQ ID NO: 63583 - protein, 9 aa, Homo sapiens
  light chain complementarity determining region 3 for antibody 31792
LQSYAPPWT

SEQ ID NO: 63584 - protein, 15 aa, Homo sapiens
  heavy chain complementarity determining region 3 for antibody 31792
VRQSKVDNNYNYPDF

SEQ ID NO: 63585 - protein, 9 aa, Homo sapiens
  light chain complementarity determining region 3 for antibody 31793
LQSNNYPYT

SEQ ID NO: 63586 - protein, 9 aa, Homo sapiens
  heavy chain complementarity determining region 3 for antibody 31793
GRGVRSFNP

SEQ ID NO: 63587 - protein, 9 aa, Homo sapiens
  light chain complementarity determining region 3 for antibody 31794
LQSLQCPFT

SEQ ID NO: 63588 - protein, 13 aa, Homo sapiens
  heavy chain complementarity determining region 3 for antibody 31794
ATSDVWLGELFDF

SEQ ID NO: 63589 - protein, 9 aa, Homo sapiens
  light chain complementarity determining region 3 for antibody 31795
LQSGSLPET

SEQ ID NO: 63590 - protein, 8 aa, Homo sapiens
  heavy chain complementarity determining region 3 for antibody 31795
AVYSSLDY

SEQ ID NO: 63591 - protein, 9 aa, Homo sapiens
  light chain complementarity determining region 3 for antibody 31796
LQSFNVPRT

SEQ ID NO: 63592 - protein, 15 aa, Homo sapiens
  heavy chain complementarity determining region 3 for antibody 31796
ANGDGFGELYQPFYD

SEQ ID NO: 63593 - protein, 9 aa, Homo sapiens
  light chain complementarity determining region 3 for antibody 31797
LQRTHWPPG

SEQ ID NO: 63594 - protein, 18 aa, Homo sapiens
  heavy chain complementarity determining region 3 for antibody 31797
ARGRYSCDSGGCFHWFDP

SEQ ID NO: 63595 - protein, 9 aa, Homo sapiens
  light chain complementarity determining region 3 for antibody 31798
LQRTHWPPG

SEQ ID NO: 63596 - protein, 18 aa, Homo sapiens
  heavy chain complementarity determining region 3 for antibody 31798
ARDRYSCDSGGRFHWFDP

SEQ ID NO: 63597 - protein, 9 aa, Homo sapiens
  light chain complementarity determining region 3 for antibody 31799
LQRTHWPPG

SEQ ID NO: 63598 - protein, 18 aa, Homo sapiens
  heavy chain complementarity determining region 3 for antibody 31799
ARDRYSCDSGGCFRWFDP

SEQ ID NO: 63599 - protein, 9 aa, Homo sapiens
  light chain complementarity determining region 3 for antibody 31800
LQRTHWPPG

SEQ ID NO: 63600 - protein, 18 aa, Homo sapiens
  heavy chain complementarity determining region 3 for antibody 31800
ARDRYSCDSGGCCHWFDP

SEQ ID NO: 63601 - protein, 12 aa, Homo sapiens
  light chain complementarity determining region 3 for antibody 31801
LQRSNWTSGQPT

SEQ ID NO: 63602 - protein, 13 aa, Homo sapiens
  heavy chain complementarity determining region 3 for antibody 31801
ARGLLWYSSGMDV

SEQ ID NO: 63603 - protein, 9 aa, Homo sapiens
  light chain complementarity determining region 3 for antibody 31802
LQRPHWPPG

SEQ ID NO: 63604 - protein, 18 aa, Homo sapiens
  heavy chain complementarity determining region 3 for antibody 31802
ARDRYSCDSGGCFHWFDP

SEQ ID NO: 63605 - protein, 9 aa, Homo sapiens
  light chain complementarity determining region 3 for antibody 31803
LQRNHWPPG

SEQ ID NO: 63606 - protein, 18 aa, Homo sapiens
  heavy chain complementarity determining region 3 for antibody 31803
ARDRYSCDSGGCFHWFDP

SEQ ID NO: 63607 - protein, 9 aa, Homo sapiens
  light chain complementarity determining region 3 for antibody 31804
LQRKHWPPG

SEQ ID NO: 63608 - protein, 18 aa, Homo sapiens
  heavy chain complementarity determining region 3 for antibody 31804
ARDRYSCDSGGCFHWFDP

SEQ ID NO: 63609 - protein, 9 aa, Homo sapiens
  light chain complementarity determining region 3 for antibody 31805
LQRFKWPPT

SEQ ID NO: 63610 - protein, 19 aa, Homo sapiens
  heavy chain complementarity determining region 3 for antibody 31805
AREVSSADHYGVGKNWFDP

SEQ ID NO: 63611 - protein, 10 aa, Homo sapiens
  light chain complementarity determining region 3 for antibody 31806
LQQSYFPLRP

SEQ ID NO: 63612 - protein, 14 aa, Homo sapiens
  heavy chain complementarity determining region 3 for antibody 31806
ATISGRDFYNWFDP

SEQ ID NO: 63613 - protein, 9 aa, Homo sapiens
  light chain complementarity determining region 3 for antibody 31807
LQPNSYPRT

SEQ ID NO: 63614 - protein, 11 aa, Homo sapiens
  heavy chain complementarity determining region 3 for antibody 31807
TTGLGSEGTNY

SEQ ID NO: 63615 - protein, 9 aa, Homo sapiens
  light chain complementarity determining region 3 for antibody 31808
LQPDNFPGT

SEQ ID NO: 63616 - protein, 20 aa, Homo sapiens
  heavy chain complementarity determining region 3 for antibody 31808
AREVYYDRSGYYYNHKWFDP

SEQ ID NO: 63617 - protein, 9 aa, Homo sapiens
  light chain complementarity determining region 3 for antibody 31809
LQNYTYPWT

SEQ ID NO: 63618 - protein, 16 aa, Homo sapiens
  heavy chain complementarity determining region 3 for antibody 31809
NTDFYYPSSGYSYVDF

SEQ ID NO: 63619 - protein, 9 aa, Homo sapiens
  light chain complementarity determining region 3 for antibody 31810
LQNYNYPYT

SEQ ID NO: 63620 - protein, 11 aa, Homo sapiens
  heavy chain complementarity determining region 3 for antibody 31810
TKTPVTGAFDT

SEQ ID NO: 63621 - protein, 9 aa, Homo sapiens
  light chain complementarity determining region 3 for antibody 31811
LQNYATPWT

SEQ ID NO: 63622 - protein, 15 aa, Homo sapiens
  heavy chain complementarity determining region 3 for antibody 31811
VRQSKVDNNYNYPDF

SEQ ID NO: 63623 - protein, 9 aa, Homo sapiens
  light chain complementarity determining region 3 for antibody 31812
LQNSLDPWT

SEQ ID NO: 63624 - protein, 7 aa, Homo sapiens
  heavy chain complementarity determining region 3 for antibody 31812
ARGGSDY

SEQ ID NO: 63625 - protein, 9 aa, Homo sapiens
  light chain complementarity determining region 3 for antibody 31813
LQNNNYPYT

SEQ ID NO: 63626 - protein, 9 aa, Homo sapiens
  heavy chain complementarity determining region 3 for antibody 31813
GRGVRSFNP

SEQ ID NO: 63627 - protein, 9 aa, Homo sapiens
  light chain complementarity determining region 3 for antibody 31814
LQNGYFPYT

SEQ ID NO: 63628 - protein, 12 aa, Homo sapiens
  heavy chain complementarity determining region 3 for antibody 31814
VRLLDSSGSLGY

SEQ ID NO: 63629 - protein, 9 aa, Homo sapiens
  light chain complementarity determining region 3 for antibody 31815
LQNEYWSRT

SEQ ID NO: 63630 - protein, 11 aa, Homo sapiens
  heavy chain complementarity determining region 3 for antibody 31815
VRVGGAGYFDH

SEQ ID NO: 63631 - protein, 9 aa, Homo sapiens
  light chain complementarity determining region 3 for antibody 31816
LQNEYWPRT

SEQ ID NO: 63632 - protein, 11 aa, Homo sapiens
  heavy chain complementarity determining region 3 for antibody 31816
VRVGVAGYFDH

SEQ ID NO: 63633 - protein, 9 aa, Homo sapiens
  light chain complementarity determining region 3 for antibody 31817
LQNEYWLRT

SEQ ID NO: 63634 - protein, 11 aa, Homo sapiens
  heavy chain complementarity determining region 3 for antibody 31817
VRVGGAGYFDH

SEQ ID NO: 63635 - protein, 9 aa, Homo sapiens
  light chain complementarity determining region 3 for antibody 31818
LQNEYWHRT

SEQ ID NO: 63636 - protein, 11 aa, Homo sapiens
  heavy chain complementarity determining region 3 for antibody 31818
VRVGGAGYFDH

SEQ ID NO: 63637 - protein, 9 aa, Homo sapiens
  light chain complementarity determining region 3 for antibody 31819
LQNEYCPRI

SEQ ID NO: 63638 - protein, 11 aa, Homo sapiens
  heavy chain complementarity determining region 3 for antibody 31819
VRVGGAGYFDH

SEQ ID NO: 63639 - protein, 9 aa, Homo sapiens
  light chain complementarity determining region 3 for antibody 31820
LQNESWPRT

SEQ ID NO: 63640 - protein, 11 aa, Homo sapiens
  heavy chain complementarity determining region 3 for antibody 31820
VRVGGAGYFDH

SEQ ID NO: 63641 - protein, 9 aa, Homo sapiens
  light chain complementarity determining region 3 for antibody 31821
LQNEHWPRT

SEQ ID NO: 63642 - protein, 11 aa, Homo sapiens
  heavy chain complementarity determining region 3 for antibody 31821
VRVGGAGYFDH

SEQ ID NO: 63643 - protein, 9 aa, Homo sapiens
  light chain complementarity determining region 3 for antibody 31822
LQNEFWPRT

SEQ ID NO: 63644 - protein, 11 aa, Homo sapiens
  heavy chain complementarity determining region 3 for antibody 31822
VRVGGAGYFDH

SEQ ID NO: 63645 - protein, 9 aa, Homo sapiens
  light chain complementarity determining region 3 for antibody 31823
LQNEDWPRT

SEQ ID NO: 63646 - protein, 11 aa, Homo sapiens
  heavy chain complementarity determining region 3 for antibody 31823
VRVGGAGYFDH

SEQ ID NO: 63647 - protein, 9 aa, Homo sapiens
  light chain complementarity determining region 3 for antibody 31824
LQNDYLPRT

SEQ ID NO: 63648 - protein, 11 aa, Homo sapiens
  heavy chain complementarity determining region 3 for antibody 31824
VRVGGAGYFDH

SEQ ID NO: 63649 - protein, 7 aa, Homo sapiens
  light chain complementarity determining region 3 for antibody 31825
LQNDNVP

SEQ ID NO: 63650 - protein, 15 aa, Homo sapiens
  heavy chain complementarity determining region 3 for antibody 31825
ARESWDGSDRSAFDI

SEQ ID NO: 63651 - protein, 9 aa, Homo sapiens
  light chain complementarity determining region 3 for antibody 31826
LQNDDWPRT

SEQ ID NO: 63652 - protein, 11 aa, Homo sapiens
  heavy chain complementarity determining region 3 for antibody 31826
VRVGGAGYFDH

SEQ ID NO: 63653 - protein, 9 aa, Homo sapiens
  light chain complementarity determining region 3 for antibody 31827
LQLNSYSIT

SEQ ID NO: 63654 - protein, 20 aa, Homo sapiens
  heavy chain complementarity determining region 3 for antibody 31827
ARRGAGLGLDNPESSGYADY

SEQ ID NO: 63655 - protein, 9 aa, Homo sapiens
  light chain complementarity determining region 3 for antibody 31828
LQLNSFPRT

SEQ ID NO: 63656 - protein, 16 aa, Homo sapiens
  heavy chain complementarity determining region 3 for antibody 31828
ARPGLPSSYGSSSYRH

SEQ ID NO: 63657 - protein, 9 aa, Homo sapiens
  light chain complementarity determining region 3 for antibody 31829
LQLHSYPPT

SEQ ID NO: 63658 - protein, 16 aa, Homo sapiens
  heavy chain complementarity determining region 3 for antibody 31829
ARLFYNSDWYVGYFDH

SEQ ID NO: 63659 - protein, 9 aa, Homo sapiens
  light chain complementarity determining region 3 for antibody 31830
LQLHSYPLT

SEQ ID NO: 63660 - protein, 16 aa, Homo sapiens
  heavy chain complementarity determining region 3 for antibody 31830
ASLFYNSDWYVGYFDH

SEQ ID NO: 63661 - protein, 9 aa, Homo sapiens
  light chain complementarity determining region 3 for antibody 31831
LQHYTYSWT

SEQ ID NO: 63662 - protein, 16 aa, Homo sapiens
  heavy chain complementarity determining region 3 for antibody 31831
NTDFYYPSSGYSYVDF

SEQ ID NO: 63663 - protein, 9 aa, Homo sapiens
  light chain complementarity determining region 3 for antibody 31832
LQHYTYPWT

SEQ ID NO: 63664 - protein, 16 aa, Homo sapiens
  heavy chain complementarity determining region 3 for antibody 31832
NTDVYYPSSGYSYVDF

SEQ ID NO: 63665 - protein, 9 aa, Homo sapiens
  light chain complementarity determining region 3 for antibody 31833
LQHYTYPWT

SEQ ID NO: 63666 - protein, 16 aa, Homo sapiens
  heavy chain complementarity determining region 3 for antibody 31833
NTDFDYPSSGYSYVDF

SEQ ID NO: 63667 - protein, 9 aa, Homo sapiens
  light chain complementarity determining region 3 for antibody 31834
LQHYTYPWS

SEQ ID NO: 63668 - protein, 16 aa, Homo sapiens
  heavy chain complementarity determining region 3 for antibody 31834
NTDFYYPSSGYSYVDF

SEQ ID NO: 63669 - protein, 9 aa, Homo sapiens
  light chain complementarity determining region 3 for antibody 31835
LQHYTYPRT

SEQ ID NO: 63670 - protein, 16 aa, Homo sapiens
  heavy chain complementarity determining region 3 for antibody 31835
NTDFYYPSSGYSYVDF

SEQ ID NO: 63671 - protein, 9 aa, Homo sapiens
  light chain complementarity determining region 3 for antibody 31836
LQHYTYPGT

SEQ ID NO: 63672 - protein, 16 aa, Homo sapiens
  heavy chain complementarity determining region 3 for antibody 31836
NTDFYYPSSGYSYVDF

SEQ ID NO: 63673 - protein, 9 aa, Homo sapiens
  light chain complementarity determining region 3 for antibody 31837
LQHYSYPLT

SEQ ID NO: 63674 - protein, 22 aa, Homo sapiens
  heavy chain complementarity determining region 3 for antibody 31837
AKDQASAVVVVSRPWEVSDLTF

SEQ ID NO: 63675 - protein, 9 aa, Homo sapiens
  light chain complementarity determining region 3 for antibody 31838
LQHYSYPLT

SEQ ID NO: 63676 - protein, 22 aa, Homo sapiens
  heavy chain complementarity determining region 3 for antibody 31838
AKDHASTVVVVSRPWEVSDLTF

SEQ ID NO: 63677 - protein, 9 aa, Homo sapiens
  light chain complementarity determining region 3 for antibody 31839
LQHYNYPYN

SEQ ID NO: 63678 - protein, 11 aa, Homo sapiens
  heavy chain complementarity determining region 3 for antibody 31839
TKTPVTGAFDT

SEQ ID NO: 63679 - protein, 9 aa, Homo sapiens
  light chain complementarity determining region 3 for antibody 31840
LQHYNYPWP

SEQ ID NO: 63680 - protein, 17 aa, Homo sapiens
  heavy chain complementarity determining region 3 for antibody 31840
TRAHYWQSSGYYEDFDF

SEQ ID NO: 63681 - protein, 9 aa, Homo sapiens
  light chain complementarity determining region 3 for antibody 31841
LQHYNYPGA

SEQ ID NO: 63682 - protein, 17 aa, Homo sapiens
  heavy chain complementarity determining region 3 for antibody 31841
TRAHYWQSSGYYEDFDF

SEQ ID NO: 63683 - protein, 8 aa, Homo sapiens
  light chain complementarity determining region 3 for antibody 31842
LQHYNFPF

SEQ ID NO: 63684 - protein, 16 aa, Homo sapiens
  heavy chain complementarity determining region 3 for antibody 31842
ARHSLGLEWEFQWGAY

SEQ ID NO: 63685 - protein, 9 aa, Homo sapiens
  light chain complementarity determining region 3 for antibody 31843
LQHTSYPRS

SEQ ID NO: 63686 - protein, 13 aa, Homo sapiens
  heavy chain complementarity determining region 3 for antibody 31843
AREIYSSSFSFDY

SEQ ID NO: 63687 - protein, 9 aa, Homo sapiens
  light chain complementarity determining region 3 for antibody 31844
LQHNTYPWT

SEQ ID NO: 63688 - protein, 25 aa, Homo sapiens
  heavy chain complementarity determining region 3 for antibody 31844
AKEDVDDADYVERRRIKYYYYGLDV

SEQ ID NO: 63689 - protein, 9 aa, Homo sapiens
  light chain complementarity determining region 3 for antibody 31845
LQHNTYPLT

SEQ ID NO: 63690 - protein, 17 aa, Homo sapiens
  heavy chain complementarity determining region 3 for antibody 31845
AKMRGYGVVGSEDGLDI

SEQ ID NO: 63691 - protein, 9 aa, Homo sapiens
  light chain complementarity determining region 3 for antibody 31846
LQHNTYPLP

SEQ ID NO: 63692 - protein, 21 aa, Homo sapiens
  heavy chain complementarity determining region 3 for antibody 31846
ARGEHVVVVTSFRGRSQGINS

SEQ ID NO: 63693 - protein, 9 aa, Homo sapiens
  light chain complementarity determining region 3 for antibody 31847
LQHNSYPRT

SEQ ID NO: 63694 - protein, 19 aa, Homo sapiens
  heavy chain complementarity determining region 3 for antibody 31847
ATGGLLGILTQYDYNGMDA

SEQ ID NO: 63695 - protein, 10 aa, Homo sapiens
  light chain complementarity determining region 3 for antibody 31848
LQHNSYPRIT

SEQ ID NO: 63696 - protein, 12 aa, Homo sapiens
  heavy chain complementarity determining region 3 for antibody 31848
ANLGYSTSDSDN

SEQ ID NO: 63697 - protein, 9 aa, Homo sapiens
  light chain complementarity determining region 3 for antibody 31849
LQHNSYPQT

SEQ ID NO: 63698 - protein, 9 aa, Homo sapiens
  heavy chain complementarity determining region 3 for antibody 31849
ARDGFSNDD

SEQ ID NO: 63699 - protein, 9 aa, Homo sapiens
  light chain complementarity determining region 3 for antibody 31850
LQHNSYPPT

SEQ ID NO: 63700 - protein, 9 aa, Homo sapiens
  heavy chain complementarity determining region 3 for antibody 31850
ARDGFSNYD

SEQ ID NO: 63701 - protein, 9 aa, Homo sapiens
  light chain complementarity determining region 3 for antibody 31851
LQHNSYPPT

SEQ ID NO: 63702 - protein, 18 aa, Homo sapiens
  heavy chain complementarity determining region 3 for antibody 31851
AKVDAPHSSGYYYYGMDV

SEQ ID NO: 63703 - protein, 9 aa, Homo sapiens
  light chain complementarity determining region 3 for antibody 31852
LQHNSYPPP

SEQ ID NO: 63704 - protein, 16 aa, Homo sapiens
  heavy chain complementarity determining region 3 for antibody 31852
SREKFRGQQPRDVFDI

SEQ ID NO: 63705 - protein, 9 aa, Homo sapiens
  light chain complementarity determining region 3 for antibody 31853
LQHNSYPLT

SEQ ID NO: 63706 - protein, 21 aa, Homo sapiens
  heavy chain complementarity determining region 3 for antibody 31853
TTGQVLTGYCSGGSCLEYFQH

SEQ ID NO: 63707 - protein, 9 aa, Homo sapiens
  light chain complementarity determining region 3 for antibody 31854
LQHNSYPLT

SEQ ID NO: 63708 - protein, 21 aa, Homo sapiens
  heavy chain complementarity determining region 3 for antibody 31854
TADQVLTGYCSGGSCLEYFQH

SEQ ID NO: 63709 - protein, 9 aa, Homo sapiens
  light chain complementarity determining region 3 for antibody 31855
LQHNSYPLT

SEQ ID NO: 63710 - protein, 21 aa, Homo sapiens
  heavy chain complementarity determining region 3 for antibody 31855
ATDQVLTGYCSGGSCLEYFHH

SEQ ID NO: 63711 - protein, 9 aa, Homo sapiens
  light chain complementarity determining region 3 for antibody 31856
LQHNSYPLT

SEQ ID NO: 63712 - protein, 22 aa, Homo sapiens
  heavy chain complementarity determining region 3 for antibody 31856
AKDQASTVVVVSRPWEVSDLAF

SEQ ID NO: 63713 - protein, 9 aa, Homo sapiens
  light chain complementarity determining region 3 for antibody 31857
LQHNSYPGT

SEQ ID NO: 63714 - protein, 11 aa, Homo sapiens
  heavy chain complementarity determining region 3 for antibody 31857
ARGPARGYFDY

SEQ ID NO: 63715 - protein, 9 aa, Homo sapiens
  light chain complementarity determining region 3 for antibody 31858
LQHNSYPGT

SEQ ID NO: 63716 - protein, 11 aa, Homo sapiens
  heavy chain complementarity determining region 3 for antibody 31858
ARDYDFSTMDV

SEQ ID NO: 63717 - protein, 9 aa, Homo sapiens
  light chain complementarity determining region 3 for antibody 31859
LQHNSYPFT

SEQ ID NO: 63718 - protein, 15 aa, Homo sapiens
  heavy chain complementarity determining region 3 for antibody 31859
ARDYYGSGYYNGMDV

SEQ ID NO: 63719 - protein, 9 aa, Homo sapiens
  light chain complementarity determining region 3 for antibody 31860
LQHNSYLPT

SEQ ID NO: 63720 - protein, 19 aa, Homo sapiens
  heavy chain complementarity determining region 3 for antibody 31860
ARGGATVAGISGWGYGMDV

SEQ ID NO: 63721 - protein, 9 aa, Homo sapiens
  light chain complementarity determining region 3 for antibody 31861
LQHNSYFWT

SEQ ID NO: 63722 - protein, 18 aa, Homo sapiens
  heavy chain complementarity determining region 3 for antibody 31861
TTPYYYDGSGYMEGLDDC

SEQ ID NO: 63723 - protein, 9 aa, Homo sapiens
  light chain complementarity determining region 3 for antibody 31862
LQHNSSPRT

SEQ ID NO: 63724 - protein, 11 aa, Homo sapiens
  heavy chain complementarity determining region 3 for antibody 31862
TTGLGSEGTNY

SEQ ID NO: 63725 - protein, 9 aa, Homo sapiens
  light chain complementarity determining region 3 for antibody 31863
LQHNSSPLT

SEQ ID NO: 63726 - protein, 13 aa, Homo sapiens
  heavy chain complementarity determining region 3 for antibody 31863
VRHAVVRPMVVDD

SEQ ID NO: 63727 - protein, 9 aa, Homo sapiens
  light chain complementarity determining region 3 for antibody 31864
LQHNSNLPT

SEQ ID NO: 63728 - protein, 19 aa, Homo sapiens
  heavy chain complementarity determining region 3 for antibody 31864
ARRGATVAGISGWGYGMDV

SEQ ID NO: 63729 - protein, 9 aa, Homo sapiens
  light chain complementarity determining region 3 for antibody 31865
LQHNSFPWK

SEQ ID NO: 63730 - protein, 11 aa, Homo sapiens
  heavy chain complementarity determining region 3 for antibody 31865
VRDVPTAHLDY

SEQ ID NO: 63731 - protein, 9 aa, Homo sapiens
  light chain complementarity determining region 3 for antibody 31866
LQHNSFPRT

SEQ ID NO: 63732 - protein, 16 aa, Homo sapiens
  heavy chain complementarity determining region 3 for antibody 31866
ARPGLPSAYGSSSYRH

SEQ ID NO: 63733 - protein, 9 aa, Homo sapiens
  light chain complementarity determining region 3 for antibody 31867
LQHNSFPRT

SEQ ID NO: 63734 - protein, 16 aa, Homo sapiens
  heavy chain complementarity determining region 3 for antibody 31867
ARPGLPASYGSSSYRH

SEQ ID NO: 63735 - protein, 9 aa, Homo sapiens
  light chain complementarity determining region 3 for antibody 31868
LQHNSFPGT

SEQ ID NO: 63736 - protein, 11 aa, Homo sapiens
  heavy chain complementarity determining region 3 for antibody 31868
VRDVPTAHLDY

SEQ ID NO: 63737 - protein, 9 aa, Homo sapiens
  light chain complementarity determining region 3 for antibody 31869
LQHNSFPCT

SEQ ID NO: 63738 - protein, 11 aa, Homo sapiens
  heavy chain complementarity determining region 3 for antibody 31869
VRDVPTAHLDY

SEQ ID NO: 63739 - protein, 9 aa, Homo sapiens
  light chain complementarity determining region 3 for antibody 31870
LQHNRYPWT

SEQ ID NO: 63740 - protein, 6 aa, Homo sapiens
  heavy chain complementarity determining region 3 for antibody 31870
AKGPVI

SEQ ID NO: 63741 - protein, 9 aa, Homo sapiens
  light chain complementarity determining region 3 for antibody 31871
LQHNRSPWT

SEQ ID NO: 63742 - protein, 6 aa, Homo sapiens
  heavy chain complementarity determining region 3 for antibody 31871
AKGPFI

SEQ ID NO: 63743 - protein, 9 aa, Homo sapiens
  light chain complementarity determining region 3 for antibody 31872
LQHNAFPYP

SEQ ID NO: 63744 - protein, 16 aa, Homo sapiens
  heavy chain complementarity determining region 3 for antibody 31872
TFFYSCSPTGICARNY

SEQ ID NO: 63745 - protein, 9 aa, Homo sapiens
  light chain complementarity determining region 3 for antibody 31873
LQHNAFPST

SEQ ID NO: 63746 - protein, 16 aa, Homo sapiens
  heavy chain complementarity determining region 3 for antibody 31873
TFFYSCSPTGICARNY

SEQ ID NO: 63747 - protein, 9 aa, Homo sapiens
  light chain complementarity determining region 3 for antibody 31874
LQHHSYPRT

SEQ ID NO: 63748 - protein, 19 aa, Homo sapiens
  heavy chain complementarity determining region 3 for antibody 31874
ATGGRLGILTQYDYNGMDA

SEQ ID NO: 63749 - protein, 9 aa, Homo sapiens
  light chain complementarity determining region 3 for antibody 31875
LQHHSYPRP

SEQ ID NO: 63750 - protein, 19 aa, Homo sapiens
  heavy chain complementarity determining region 3 for antibody 31875
ATGGLLGILTQYDYNGMDA

SEQ ID NO: 63751 - protein, 9 aa, Homo sapiens
  light chain complementarity determining region 3 for antibody 31876
LQHHSYPRK

SEQ ID NO: 63752 - protein, 19 aa, Homo sapiens
  heavy chain complementarity determining region 3 for antibody 31876
ATGGLLGILTQYDYNGMDA

SEQ ID NO: 63753 - protein, 7 aa, Homo sapiens
  light chain complementarity determining region 3 for antibody 31877
LQHDNVL

SEQ ID NO: 63754 - protein, 15 aa, Homo sapiens
  heavy chain complementarity determining region 3 for antibody 31877
ARESWDGSDRSAFDI

SEQ ID NO: 63755 - protein, 10 aa, Homo sapiens
  light chain complementarity determining region 3 for antibody 31878
LQHDNFPQGT

SEQ ID NO: 63756 - protein, 20 aa, Homo sapiens
  heavy chain complementarity determining region 3 for antibody 31878
ARHGPYFTMIVVVIEPDFDY

SEQ ID NO: 63757 - protein, 10 aa, Homo sapiens
  light chain complementarity determining region 3 for antibody 31879
LQHDNFPPGT

SEQ ID NO: 63758 - protein, 21 aa, Homo sapiens
  heavy chain complementarity determining region 3 for antibody 31879
AKEKGILRLLDRNFYNYPMDV

SEQ ID NO: 63759 - protein, 10 aa, Homo sapiens
  light chain complementarity determining region 3 for antibody 31880
LQHDNFPPGT

SEQ ID NO: 63760 - protein, 21 aa, Homo sapiens
  heavy chain complementarity determining region 3 for antibody 31880
AKEKGILRFLDRNFYNYPMDD

SEQ ID NO: 63761 - protein, 10 aa, Homo sapiens
  light chain complementarity determining region 3 for antibody 31881
LQHDNFPPGP

SEQ ID NO: 63762 - protein, 21 aa, Homo sapiens
  heavy chain complementarity determining region 3 for antibody 31881
AKEKGILRFLDRNFYNYPMDV

SEQ ID NO: 63763 - protein, 9 aa, Homo sapiens
  light chain complementarity determining region 3 for antibody 31882
LQHDNFPLT

SEQ ID NO: 63764 - protein, 18 aa, Homo sapiens
  heavy chain complementarity determining region 3 for antibody 31882
VKDFHYYDSSGSFDAFDI

SEQ ID NO: 63765 - protein, 9 aa, Homo sapiens
  light chain complementarity determining region 3 for antibody 31883
LQHDNFPGT

SEQ ID NO: 63766 - protein, 20 aa, Homo sapiens
  heavy chain complementarity determining region 3 for antibody 31883
AREVYYDRSGYYYTHKWFDP

SEQ ID NO: 63767 - protein, 9 aa, Homo sapiens
  light chain complementarity determining region 3 for antibody 31884
LQHDNFPGT

SEQ ID NO: 63768 - protein, 20 aa, Homo sapiens
  heavy chain complementarity determining region 3 for antibody 31884
AREVYYDRSGYYYNHKWFDH

SEQ ID NO: 63769 - protein, 9 aa, Homo sapiens
  light chain complementarity determining region 3 for antibody 31885
LQHDNFPGT

SEQ ID NO: 63770 - protein, 20 aa, Homo sapiens
  heavy chain complementarity determining region 3 for antibody 31885
AREVSYDRSGYYYNHKWFDP

SEQ ID NO: 63771 - protein, 9 aa, Homo sapiens
  light chain complementarity determining region 3 for antibody 31886
LQHDNFPGT

SEQ ID NO: 63772 - protein, 20 aa, Homo sapiens
  heavy chain complementarity determining region 3 for antibody 31886
AREVCYDRSGYYYNHKWFDP

SEQ ID NO: 63773 - protein, 9 aa, Homo sapiens
  light chain complementarity determining region 3 for antibody 31887
LQHDNFPGT

SEQ ID NO: 63774 - protein, 20 aa, Homo sapiens
  heavy chain complementarity determining region 3 for antibody 31887
AIEVYYDRSGYYYNHKWFDP

SEQ ID NO: 63775 - protein, 8 aa, Homo sapiens
  light chain complementarity determining region 3 for antibody 31888
LQHDNFPF

SEQ ID NO: 63776 - protein, 16 aa, Homo sapiens
  heavy chain complementarity determining region 3 for antibody 31888
ARHSRGLEWEFQWGAY

SEQ ID NO: 63777 - protein, 8 aa, Homo sapiens
  light chain complementarity determining region 3 for antibody 31889
LQHDNFPF

SEQ ID NO: 63778 - protein, 16 aa, Homo sapiens
  heavy chain complementarity determining region 3 for antibody 31889
ARHSLGLEWEFQCGAY

SEQ ID NO: 63779 - protein, 8 aa, Homo sapiens
  light chain complementarity determining region 3 for antibody 31890
LQHDNFPF

SEQ ID NO: 63780 - protein, 16 aa, Homo sapiens
  heavy chain complementarity determining region 3 for antibody 31890
AGHSLGLEWEFQWGAY

SEQ ID NO: 63781 - protein, 7 aa, Homo sapiens
  light chain complementarity determining region 3 for antibody 31891
LQHDNDP

SEQ ID NO: 63782 - protein, 15 aa, Homo sapiens
  heavy chain complementarity determining region 3 for antibody 31891
ARESWDGSDRSAFDI

SEQ ID NO: 63783 - protein, 7 aa, Homo sapiens
  light chain complementarity determining region 3 for antibody 31892
LQHDIVP

SEQ ID NO: 63784 - protein, 15 aa, Homo sapiens
  heavy chain complementarity determining region 3 for antibody 31892
ARESWDGSDRSAFDI

SEQ ID NO: 63785 - protein, 9 aa, Homo sapiens
  light chain complementarity determining region 3 for antibody 31893
LQGYNYPYT

SEQ ID NO: 63786 - protein, 17 aa, Homo sapiens
  heavy chain complementarity determining region 3 for antibody 31893
ASLAGIAAAGKKYYFDY

SEQ ID NO: 63787 - protein, 9 aa, Homo sapiens
  light chain complementarity determining region 3 for antibody 31894
LQGTHWPRT

SEQ ID NO: 63788 - protein, 12 aa, Homo sapiens
  heavy chain complementarity determining region 3 for antibody 31894
ATLSMANAKFDH

SEQ ID NO: 63789 - protein, 10 aa, Homo sapiens
  light chain complementarity determining region 3 for antibody 31895
LQGSYWPPWT

SEQ ID NO: 63790 - protein, 11 aa, Homo sapiens
  heavy chain complementarity determining region 3 for antibody 31895
ARDTPGVGIDY

SEQ ID NO: 63791 - protein, 9 aa, Homo sapiens
  light chain complementarity determining region 3 for antibody 31896
LQGSHWPPT

SEQ ID NO: 63792 - protein, 7 aa, Homo sapiens
  heavy chain complementarity determining region 3 for antibody 31896
ATNADYL

SEQ ID NO: 63793 - protein, 9 aa, Homo sapiens
  light chain complementarity determining region 3 for antibody 31897
LQGNRFPYT

SEQ ID NO: 63794 - protein, 14 aa, Homo sapiens
  heavy chain complementarity determining region 3 for antibody 31897
ARYCSGNSCYSMDH

SEQ ID NO: 63795 - protein, 9 aa, Homo sapiens
  light chain complementarity determining region 3 for antibody 31898
LQGLQTPYT

SEQ ID NO: 63796 - protein, 10 aa, Homo sapiens
  heavy chain complementarity determining region 3 for antibody 31898
GRDLTGSKDY

SEQ ID NO: 63797 - protein, 7 aa, Homo sapiens
  light chain complementarity determining region 3 for antibody 31899
LQGLQTP

SEQ ID NO: 63798 - protein, 15 aa, Homo sapiens
  heavy chain complementarity determining region 3 for antibody 31899
AKRTPQDLGNYYFDS

SEQ ID NO: 63799 - protein, 9 aa, Homo sapiens
  light chain complementarity determining region 3 for antibody 31900
LQGHNYPYI

SEQ ID NO: 63800 - protein, 14 aa, Homo sapiens
  heavy chain complementarity determining region 3 for antibody 31900
ARDSSTTTGTGIDY

SEQ ID NO: 63801 - protein, 9 aa, Homo sapiens
  light chain complementarity determining region 3 for antibody 31901
LQGALWPLT

SEQ ID NO: 63802 - protein, 11 aa, Homo sapiens
  heavy chain complementarity determining region 3 for antibody 31901
ARGGFWGDAAP

SEQ ID NO: 63803 - protein, 9 aa, Homo sapiens
  light chain complementarity determining region 3 for antibody 31902
LQFYATPWT

SEQ ID NO: 63804 - protein, 15 aa, Homo sapiens
  heavy chain complementarity determining region 3 for antibody 31902
VRQSKVDNNYNYPDF

SEQ ID NO: 63805 - protein, 10 aa, Homo sapiens
  light chain complementarity determining region 3 for antibody 31903
LQFNTWPPLT

SEQ ID NO: 63806 - protein, 14 aa, Homo sapiens
  heavy chain complementarity determining region 3 for antibody 31903
AGSKWEAPGTPPDY

SEQ ID NO: 63807 - protein, 10 aa, Homo sapiens
  light chain complementarity determining region 3 for antibody 31904
LQFNTWPPFT

SEQ ID NO: 63808 - protein, 14 aa, Homo sapiens
  heavy chain complementarity determining region 3 for antibody 31904
ARSKWEAPGTPPDY

SEQ ID NO: 63809 - protein, 10 aa, Homo sapiens
  light chain complementarity determining region 3 for antibody 31905
LQFNTLPPLT

SEQ ID NO: 63810 - protein, 14 aa, Homo sapiens
  heavy chain complementarity determining region 3 for antibody 31905
ARSKWEAPGTPPDY

SEQ ID NO: 63811 - protein, 9 aa, Homo sapiens
  light chain complementarity determining region 3 for antibody 31906
LQFLQSPFT

SEQ ID NO: 63812 - protein, 13 aa, Homo sapiens
  heavy chain complementarity determining region 3 for antibody 31906
ATSDVWLGELFDF

SEQ ID NO: 63813 - protein, 9 aa, Homo sapiens
  light chain complementarity determining region 3 for antibody 31907
LQFGGAPRT

SEQ ID NO: 63814 - protein, 16 aa, Homo sapiens
  heavy chain complementarity determining region 3 for antibody 31907
ARDPRGGVAVPADFNY

SEQ ID NO: 63815 - protein, 9 aa, Homo sapiens
  light chain complementarity determining region 3 for antibody 31908
LQEYTYPVR

SEQ ID NO: 63816 - protein, 15 aa, Homo sapiens
  heavy chain complementarity determining region 3 for antibody 31908
ARIRRYGSTWETLDH

SEQ ID NO: 63817 - protein, 9 aa, Homo sapiens
  light chain complementarity determining region 3 for antibody 31909
LQDYTYPRT

SEQ ID NO: 63818 - protein, 11 aa, Homo sapiens
  heavy chain complementarity determining region 3 for antibody 31909
VRGPRDDAFEI

SEQ ID NO: 63819 - protein, 9 aa, Homo sapiens
  light chain complementarity determining region 3 for antibody 31910
LQDYTYPRP

SEQ ID NO: 63820 - protein, 20 aa, Homo sapiens
  heavy chain complementarity determining region 3 for antibody 31910
ARDLNHENLGGGYYYDVFDL

SEQ ID NO: 63821 - protein, 9 aa, Homo sapiens
  light chain complementarity determining region 3 for antibody 31911
LQDYNYPWT

SEQ ID NO: 63822 - protein, 8 aa, Homo sapiens
  heavy chain complementarity determining region 3 for antibody 31911
TTGGRDDC

SEQ ID NO: 63823 - protein, 9 aa, Homo sapiens
  light chain complementarity determining region 3 for antibody 31912
LQDYNYPWM

SEQ ID NO: 63824 - protein, 14 aa, Homo sapiens
  heavy chain complementarity determining region 3 for antibody 31912
ARVGGFHGSWSLDY

SEQ ID NO: 63825 - protein, 9 aa, Homo sapiens
  light chain complementarity determining region 3 for antibody 31913
LQDYNYPVS

SEQ ID NO: 63826 - protein, 15 aa, Homo sapiens
  heavy chain complementarity determining region 3 for antibody 31913
ARVTRYGGTWETLDY

SEQ ID NO: 63827 - protein, 9 aa, Homo sapiens
  light chain complementarity determining region 3 for antibody 31914
LQDYNYPCT

SEQ ID NO: 63828 - protein, 14 aa, Homo sapiens
  heavy chain complementarity determining region 3 for antibody 31914
ARVGGFHGSWSLDY

SEQ ID NO: 63829 - protein, 9 aa, Homo sapiens
  light chain complementarity determining region 3 for antibody 31915
LQDYNSPCT

SEQ ID NO: 63830 - protein, 14 aa, Homo sapiens
  heavy chain complementarity determining region 3 for antibody 31915
ARVIVAGWTNAFDI

SEQ ID NO: 63831 - protein, 9 aa, Homo sapiens
  light chain complementarity determining region 3 for antibody 31916
LQDSKYPRT

SEQ ID NO: 63832 - protein, 18 aa, Homo sapiens
  heavy chain complementarity determining region 3 for antibody 31916
VRDTTFATSDHYYDSFDY

SEQ ID NO: 63833 - protein, 9 aa, Homo sapiens
  light chain complementarity determining region 3 for antibody 31917
LQDSKYPRT

SEQ ID NO: 63834 - protein, 12 aa, Homo sapiens
  heavy chain complementarity determining region 3 for antibody 31917
ASTTVTPLYFQH

SEQ ID NO: 63835 - protein, 9 aa, Homo sapiens
  light chain complementarity determining region 3 for antibody 31918
LQDNTYPFT

SEQ ID NO: 63836 - protein, 7 aa, Homo sapiens
  heavy chain complementarity determining region 3 for antibody 31918
TVFGLDY

SEQ ID NO: 63837 - protein, 9 aa, Homo sapiens
  light chain complementarity determining region 3 for antibody 31919
LQDNNYPLT

SEQ ID NO: 63838 - protein, 14 aa, Homo sapiens
  heavy chain complementarity determining region 3 for antibody 31919
TRGKDLRYSSPFDY

SEQ ID NO: 63839 - protein, 9 aa, Homo sapiens
  light chain complementarity determining region 3 for antibody 31920
LQDNDWPFI

SEQ ID NO: 63840 - protein, 9 aa, Homo sapiens
  heavy chain complementarity determining region 3 for antibody 31920
AGWFGTLYL

SEQ ID NO: 63841 - protein, 9 aa, Homo sapiens
  light chain complementarity determining region 3 for antibody 31921
LQDNDWPFI

SEQ ID NO: 63842 - protein, 9 aa, Homo sapiens
  heavy chain complementarity determining region 3 for antibody 31921
AGWFGEFYL

SEQ ID NO: 63843 - protein, 9 aa, Homo sapiens
  light chain complementarity determining region 3 for antibody 31922
LQDKSYPRT

SEQ ID NO: 63844 - protein, 6 aa, Homo sapiens
  heavy chain complementarity determining region 3 for antibody 31922
TRALDY

SEQ ID NO: 63845 - protein, 9 aa, Homo sapiens
  light chain complementarity determining region 3 for antibody 31923
LQDGGTPLT

SEQ ID NO: 63846 - protein, 8 aa, Homo sapiens
  heavy chain complementarity determining region 3 for antibody 31923
VRIMDPGY

SEQ ID NO: 63847 - protein, 9 aa, Homo sapiens
  light chain complementarity determining region 3 for antibody 31924
LQDFNYPWT

SEQ ID NO: 63848 - protein, 14 aa, Homo sapiens
  heavy chain complementarity determining region 3 for antibody 31924
ARVGGFHGSWSLDY

SEQ ID NO: 63849 - protein, 9 aa, Homo sapiens
  light chain complementarity determining region 3 for antibody 31925
LQDFNYPRT

SEQ ID NO: 63850 - protein, 14 aa, Homo sapiens
  heavy chain complementarity determining region 3 for antibody 31925
ARFCSTVKCFALDY

SEQ ID NO: 63851 - protein, 9 aa, Homo sapiens
  light chain complementarity determining region 3 for antibody 31926
LQCVSFPRT

SEQ ID NO: 63852 - protein, 8 aa, Homo sapiens
  heavy chain complementarity determining region 3 for antibody 31926
ARNSGWYD

SEQ ID NO: 63853 - protein, 8 aa, Homo sapiens
  light chain complementarity determining region 3 for antibody 31927
LQALQIPH

SEQ ID NO: 63854 - protein, 15 aa, Homo sapiens
  heavy chain complementarity determining region 3 for antibody 31927
ARGRGITGSTYGIDY

SEQ ID NO: 63855 - protein, 9 aa, Homo sapiens
  light chain complementarity determining region 3 for antibody 31928
LPYYATPWT

SEQ ID NO: 63856 - protein, 15 aa, Homo sapiens
  heavy chain complementarity determining region 3 for antibody 31928
VRQSKVDNNYNYPDF

SEQ ID NO: 63857 - protein, 9 aa, Homo sapiens
  light chain complementarity determining region 3 for antibody 31929
LPYYAPPWT

SEQ ID NO: 63858 - protein, 15 aa, Homo sapiens
  heavy chain complementarity determining region 3 for antibody 31929
VRQSKVDNNYNYPDF

SEQ ID NO: 63859 - protein, 9 aa, Homo sapiens
  light chain complementarity determining region 3 for antibody 31930
LPHDNFPGT

SEQ ID NO: 63860 - protein, 20 aa, Homo sapiens
  heavy chain complementarity determining region 3 for antibody 31930
AREVYYDRSGYYYNHKWFDP

SEQ ID NO: 63861 - protein, 9 aa, Homo sapiens
  light chain complementarity determining region 3 for antibody 31931
LPEYTYPVS

SEQ ID NO: 63862 - protein, 15 aa, Homo sapiens
  heavy chain complementarity determining region 3 for antibody 31931
ARIRRYGSTWETLDH

SEQ ID NO: 63863 - protein, 10 aa, Homo sapiens
  light chain complementarity determining region 3 for antibody 31932
LLYSRSPTWT

SEQ ID NO: 63864 - protein, 19 aa, Homo sapiens
  heavy chain complementarity determining region 3 for antibody 31932
ARESYYPDIGGYTPRAFDI

SEQ ID NO: 63865 - protein, 9 aa, Homo sapiens
  light chain complementarity determining region 3 for antibody 31933
LHYYSTSET

SEQ ID NO: 63866 - protein, 21 aa, Homo sapiens
  heavy chain complementarity determining region 3 for antibody 31933
ARGIIRGFSSGRYSRYDYLHH

SEQ ID NO: 63867 - protein, 8 aa, Homo sapiens
  light chain complementarity determining region 3 for antibody 31934
LHYLSSWP

SEQ ID NO: 63868 - protein, 15 aa, Homo sapiens
  heavy chain complementarity determining region 3 for antibody 31934
ARESFDISGNNWFAP

SEQ ID NO: 63869 - protein, 8 aa, Homo sapiens
  light chain complementarity determining region 3 for antibody 31935
LHYLSSRT

SEQ ID NO: 63870 - protein, 15 aa, Homo sapiens
  heavy chain complementarity determining region 3 for antibody 31935
ARESFDISGNNWFAP

SEQ ID NO: 63871 - protein, 8 aa, Homo sapiens
  light chain complementarity determining region 3 for antibody 31936
LHYGSSPT

SEQ ID NO: 63872 - protein, 11 aa, Homo sapiens
  heavy chain complementarity determining region 3 for antibody 31936
SMGGGIAVSHE

SEQ ID NO: 63873 - protein, 8 aa, Homo sapiens
  light chain complementarity determining region 3 for antibody 31937
LHYFSSWT

SEQ ID NO: 63874 - protein, 15 aa, Homo sapiens
  heavy chain complementarity determining region 3 for antibody 31937
ARESFDISGNNWFAP

SEQ ID NO: 63875 - protein, 9 aa, Homo sapiens
  light chain complementarity determining region 3 for antibody 31938
LHYDISPRP

SEQ ID NO: 63876 - protein, 12 aa, Homo sapiens
  heavy chain complementarity determining region 3 for antibody 31938
TTMYGFLHSIDY

SEQ ID NO: 63877 - protein, 9 aa, Homo sapiens
  light chain complementarity determining region 3 for antibody 31939
LHNKTFPYA

SEQ ID NO: 63878 - protein, 14 aa, Homo sapiens
  heavy chain complementarity determining region 3 for antibody 31939
TRTEWSSGWRLFDY

SEQ ID NO: 63879 - protein, 9 aa, Homo sapiens
  light chain complementarity determining region 3 for antibody 31940
LHNKNFPYA

SEQ ID NO: 63880 - protein, 14 aa, Homo sapiens
  heavy chain complementarity determining region 3 for antibody 31940
TRPEWSSGWRLFDY

SEQ ID NO: 63881 - protein, 9 aa, Homo sapiens
  light chain complementarity determining region 3 for antibody 31941
LHNKNFPSA

SEQ ID NO: 63882 - protein, 14 aa, Homo sapiens
  heavy chain complementarity determining region 3 for antibody 31941
TRTEWSSGWRLFDY

SEQ ID NO: 63883 - protein, 9 aa, Homo sapiens
  light chain complementarity determining region 3 for antibody 31942
LHNKNFPNA

SEQ ID NO: 63884 - protein, 14 aa, Homo sapiens
  heavy chain complementarity determining region 3 for antibody 31942
TRTEWSSGWRLFDY

SEQ ID NO: 63885 - protein, 9 aa, Homo sapiens
  light chain complementarity determining region 3 for antibody 31943
LHLHSFPLT

SEQ ID NO: 63886 - protein, 15 aa, Homo sapiens
  heavy chain complementarity determining region 3 for antibody 31943
ARAGAYSGGRCYFDY

SEQ ID NO: 63887 - protein, 9 aa, Homo sapiens
  light chain complementarity determining region 3 for antibody 31944
LHHYNYPWA

SEQ ID NO: 63888 - protein, 17 aa, Homo sapiens
  heavy chain complementarity determining region 3 for antibody 31944
TRAHYWQSSGYYEDFDF

SEQ ID NO: 63889 - protein, 9 aa, Homo sapiens
  light chain complementarity determining region 3 for antibody 31945
LHHNSYPQT

SEQ ID NO: 63890 - protein, 9 aa, Homo sapiens
  heavy chain complementarity determining region 3 for antibody 31945
ARDGFSNYD

SEQ ID NO: 63891 - protein, 9 aa, Homo sapiens
  light chain complementarity determining region 3 for antibody 31946
LHHNNYRWP

SEQ ID NO: 63892 - protein, 22 aa, Homo sapiens
  heavy chain complementarity determining region 3 for antibody 31946
TTDPSTQILGFLEWEYHYGTDV

SEQ ID NO: 63893 - protein, 9 aa, Homo sapiens
  light chain complementarity determining region 3 for antibody 31947
LHHNNYRGT

SEQ ID NO: 63894 - protein, 22 aa, Homo sapiens
  heavy chain complementarity determining region 3 for antibody 31947
TTDPSTQILGFLEWEYHYGTDV

SEQ ID NO: 63895 - protein, 7 aa, Homo sapiens
  light chain complementarity determining region 3 for antibody 31948
LHHDNVP

SEQ ID NO: 63896 - protein, 15 aa, Homo sapiens
  heavy chain complementarity determining region 3 for antibody 31948
ARESWDGSDRSAFDI

SEQ ID NO: 63897 - protein, 9 aa, Homo sapiens
  light chain complementarity determining region 3 for antibody 31949
LHDYNYPVS

SEQ ID NO: 63898 - protein, 15 aa, Homo sapiens
  heavy chain complementarity determining region 3 for antibody 31949
ARVTRYGGTWEPLDY

SEQ ID NO: 63899 - protein, 9 aa, Homo sapiens
  light chain complementarity determining region 3 for antibody 31950
LHDYNYPFS

SEQ ID NO: 63900 - protein, 15 aa, Homo sapiens
  heavy chain complementarity determining region 3 for antibody 31950
ARVTRYGGTWETLDY

SEQ ID NO: 63901 - protein, 9 aa, Homo sapiens
  light chain complementarity determining region 3 for antibody 31951
LHDSTFPPT

SEQ ID NO: 63902 - protein, 16 aa, Homo sapiens
  heavy chain complementarity determining region 3 for antibody 31951
ARSGFEVDVGSTVIDY

SEQ ID NO: 63903 - protein, 9 aa, Homo sapiens
  light chain complementarity determining region 3 for antibody 31952
KQYYTTPRT

SEQ ID NO: 63904 - protein, 8 aa, Homo sapiens
  heavy chain complementarity determining region 3 for antibody 31952
ARDGAFDS

SEQ ID NO: 63905 - protein, 9 aa, Homo sapiens
  light chain complementarity determining region 3 for antibody 31953
KQYYTSVRT

SEQ ID NO: 63906 - protein, 12 aa, Homo sapiens
  heavy chain complementarity determining region 3 for antibody 31953
VKDCGLGGSRDS

SEQ ID NO: 63907 - protein, 9 aa, Homo sapiens
  light chain complementarity determining region 3 for antibody 31954
KQYGSSPRT

SEQ ID NO: 63908 - protein, 15 aa, Homo sapiens
  heavy chain complementarity determining region 3 for antibody 31954
ARANGVIITTGVLRY

SEQ ID NO: 63909 - protein, 9 aa, Homo sapiens
  light chain complementarity determining region 3 for antibody 31955
KQYGNSPWT

SEQ ID NO: 63910 - protein, 16 aa, Homo sapiens
  heavy chain complementarity determining region 3 for antibody 31955
ARDKFYDSSGYHPFDY

SEQ ID NO: 63911 - protein, 10 aa, Homo sapiens
  light chain complementarity determining region 3 for antibody 31956
KQYGGSPKDS

SEQ ID NO: 63912 - protein, 15 aa, Homo sapiens
  heavy chain complementarity determining region 3 for antibody 31956
ATDGGRSQVHDGFDF

SEQ ID NO: 63913 - protein, 9 aa, Homo sapiens
  light chain complementarity determining region 3 for antibody 31957
KQYGASPRT

SEQ ID NO: 63914 - protein, 16 aa, Homo sapiens
  heavy chain complementarity determining region 3 for antibody 31957
AKSLGWDTMTTRVYDS

SEQ ID NO: 63915 - protein, 9 aa, Homo sapiens
  light chain complementarity determining region 3 for antibody 31958
KQYDTSPWT

SEQ ID NO: 63916 - protein, 16 aa, Homo sapiens
  heavy chain complementarity determining region 3 for antibody 31958
ARDKFYDSSGYHPFDY

SEQ ID NO: 63917 - protein, 9 aa, Homo sapiens
  light chain complementarity determining region 3 for antibody 31959
KQYDSSSYT

SEQ ID NO: 63918 - protein, 11 aa, Homo sapiens
  heavy chain complementarity determining region 3 for antibody 31959
ARGGFYGSFDF

SEQ ID NO: 63919 - protein, 9 aa, Homo sapiens
  light chain complementarity determining region 3 for antibody 31960
KQYDNSPWT

SEQ ID NO: 63920 - protein, 16 aa, Homo sapiens
  heavy chain complementarity determining region 3 for antibody 31960
ARDKVYDSSGYHPFDY

SEQ ID NO: 63921 - protein, 9 aa, Homo sapiens
  light chain complementarity determining region 3 for antibody 31961
KQYDNSPGT

SEQ ID NO: 63922 - protein, 16 aa, Homo sapiens
  heavy chain complementarity determining region 3 for antibody 31961
ARDKFYDSSGYHPFDY

SEQ ID NO: 63923 - protein, 9 aa, Homo sapiens
  light chain complementarity determining region 3 for antibody 31962
KQRSSWPYT

SEQ ID NO: 63924 - protein, 11 aa, Homo sapiens
  heavy chain complementarity determining region 3 for antibody 31962
VKRWGGSSIDY

SEQ ID NO: 63925 - protein, 9 aa, Homo sapiens
  light chain complementarity determining region 3 for antibody 31963
KQRHNWPWT

SEQ ID NO: 63926 - protein, 17 aa, Homo sapiens
  heavy chain complementarity determining region 3 for antibody 31963
VVPQFSRTDWPTEPSDY

SEQ ID NO: 63927 - protein, 9 aa, Homo sapiens
  light chain complementarity determining region 3 for antibody 31964
KQFKTFPLT

SEQ ID NO: 63928 - protein, 11 aa, Homo sapiens
  heavy chain complementarity determining region 3 for antibody 31964
VMDGGHWDFYF

SEQ ID NO: 63929 - protein, 10 aa, Homo sapiens
  light chain complementarity determining region 3 for antibody 31965
KQFKNWPPFT

SEQ ID NO: 63930 - protein, 13 aa, Homo sapiens
  heavy chain complementarity determining region 3 for antibody 31965
ARDDILADNGFDY

SEQ ID NO: 63931 - protein, 8 aa, Homo sapiens
  light chain complementarity determining region 3 for antibody 31966
KQFGSSLT

SEQ ID NO: 63932 - protein, 15 aa, Homo sapiens
  heavy chain complementarity determining region 3 for antibody 31966
ARLRDTTLGRWYFDS

SEQ ID NO: 63933 - protein, 9 aa, Homo sapiens
  light chain complementarity determining region 3 for antibody 31967
KQDYNYPIT

SEQ ID NO: 63934 - protein, 15 aa, Homo sapiens
  heavy chain complementarity determining region 3 for antibody 31967
ARDNREDTASRSFDI

SEQ ID NO: 63935 - protein, 9 aa, Homo sapiens
  light chain complementarity determining region 3 for antibody 31968
KQDYNYPIT

SEQ ID NO: 63936 - protein, 15 aa, Homo sapiens
  heavy chain complementarity determining region 3 for antibody 31968
ARDDREDTARRSFDI

SEQ ID NO: 63937 - protein, 9 aa, Homo sapiens
  light chain complementarity determining region 3 for antibody 31969
KQDYNYPFT

SEQ ID NO: 63938 - protein, 15 aa, Homo sapiens
  heavy chain complementarity determining region 3 for antibody 31969
ARDNREDTARRSFDI

SEQ ID NO: 63939 - protein, 9 aa, Homo sapiens
  light chain complementarity determining region 3 for antibody 31970
KHFGGSPLT

SEQ ID NO: 63940 - protein, 11 aa, Homo sapiens
  heavy chain complementarity determining region 3 for antibody 31970
ARKGTGAPFDY

SEQ ID NO: 63941 - protein, 8 aa, Homo sapiens
  light chain complementarity determining region 3 for antibody 31971
IQALQTPP

SEQ ID NO: 63942 - protein, 9 aa, Homo sapiens
  heavy chain complementarity determining region 3 for antibody 31971
ARDSSAFGP

SEQ ID NO: 63943 - protein, 10 aa, Homo sapiens
  light chain complementarity determining region 3 for antibody 31972
IQALQPHRYT

SEQ ID NO: 63944 - protein, 20 aa, Homo sapiens
  heavy chain complementarity determining region 3 for antibody 31972
ARLKAASAGLPSYYYAGMDV

SEQ ID NO: 63945 - protein, 10 aa, Homo sapiens
  light chain complementarity determining region 3 for antibody 31973
HYYGSSPGGA

SEQ ID NO: 63946 - protein, 18 aa, Homo sapiens
  heavy chain complementarity determining region 3 for antibody 31973
ARGGFGVHWRGHFYGLDV

SEQ ID NO: 63947 - protein, 9 aa, Homo sapiens
  light chain complementarity determining region 3 for antibody 31974
HRYGSSPLT

SEQ ID NO: 63948 - protein, 16 aa, Homo sapiens
  heavy chain complementarity determining region 3 for antibody 31974
TTDHDGSGHYYVAFFS

SEQ ID NO: 63949 - protein, 9 aa, Homo sapiens
  light chain complementarity determining region 3 for antibody 31975
HRSDRKPFT

SEQ ID NO: 63950 - protein, 14 aa, Homo sapiens
  heavy chain complementarity determining region 3 for antibody 31975
ARDNSNNWYEGMDV

SEQ ID NO: 63951 - protein, 9 aa, Homo sapiens
  light chain complementarity determining region 3 for antibody 31976
HQYYTTPRT

SEQ ID NO: 63952 - protein, 8 aa, Homo sapiens
  heavy chain complementarity determining region 3 for antibody 31976
ARDGAFDS

SEQ ID NO: 63953 - protein, 9 aa, Homo sapiens
  light chain complementarity determining region 3 for antibody 31977
HQYYSSPWM

SEQ ID NO: 63954 - protein, 13 aa, Homo sapiens
  heavy chain complementarity determining region 3 for antibody 31977
ARGQSGDPRTYDY

SEQ ID NO: 63955 - protein, 9 aa, Homo sapiens
  light chain complementarity determining region 3 for antibody 31978
HQYYSSPRT

SEQ ID NO: 63956 - protein, 18 aa, Homo sapiens
  heavy chain complementarity determining region 3 for antibody 31978
LRHETAITGTPNAYHIDS

SEQ ID NO: 63957 - protein, 9 aa, Homo sapiens
  light chain complementarity determining region 3 for antibody 31979
HQYYSSPRT

SEQ ID NO: 63958 - protein, 13 aa, Homo sapiens
  heavy chain complementarity determining region 3 for antibody 31979
ARGQSGDPRTYDY

SEQ ID NO: 63959 - protein, 9 aa, Homo sapiens
  light chain complementarity determining region 3 for antibody 31980
HQYYSSPRL

SEQ ID NO: 63960 - protein, 13 aa, Homo sapiens
  heavy chain complementarity determining region 3 for antibody 31980
ARGQSGDPRSYDY

SEQ ID NO: 63961 - protein, 9 aa, Homo sapiens
  light chain complementarity determining region 3 for antibody 31981
HQYYSSPRK

SEQ ID NO: 63962 - protein, 13 aa, Homo sapiens
  heavy chain complementarity determining region 3 for antibody 31981
ARGQSGDPRTYDY

SEQ ID NO: 63963 - protein, 9 aa, Homo sapiens
  light chain complementarity determining region 3 for antibody 31982
HQYYSPPRM

SEQ ID NO: 63964 - protein, 13 aa, Homo sapiens
  heavy chain complementarity determining region 3 for antibody 31982
ARGQSGDPRTYDY

SEQ ID NO: 63965 - protein, 9 aa, Homo sapiens
  light chain complementarity determining region 3 for antibody 31983
HQYYRYSHT

SEQ ID NO: 63966 - protein, 19 aa, Homo sapiens
  heavy chain complementarity determining region 3 for antibody 31983
ARDPGIGGMAAGASLAFDI

SEQ ID NO: 63967 - protein, 11 aa, Homo sapiens
  light chain complementarity determining region 3 for antibody 31984
HQYYDWPLRLI

SEQ ID NO: 63968 - protein, 18 aa, Homo sapiens
  heavy chain complementarity determining region 3 for antibody 31984
ARDAESRSHYSYYNGMDV

SEQ ID NO: 63969 - protein, 9 aa, Homo sapiens
  light chain complementarity determining region 3 for antibody 31985
HQYSTSPRT

SEQ ID NO: 63970 - protein, 17 aa, Homo sapiens
  heavy chain complementarity determining region 3 for antibody 31985
VKPRETYSSGWVDAFEM

SEQ ID NO: 63971 - protein, 9 aa, Homo sapiens
  light chain complementarity determining region 3 for antibody 31986
HQYSTSPRP

SEQ ID NO: 63972 - protein, 17 aa, Homo sapiens
  heavy chain complementarity determining region 3 for antibody 31986
VKPRETYSSGWVDAFEM

SEQ ID NO: 63973 - protein, 9 aa, Homo sapiens
  light chain complementarity determining region 3 for antibody 31987
HQYSSSPRM

SEQ ID NO: 63974 - protein, 13 aa, Homo sapiens
  heavy chain complementarity determining region 3 for antibody 31987
ARGQSGDPRTYDY

SEQ ID NO: 63975 - protein, 9 aa, Homo sapiens
  light chain complementarity determining region 3 for antibody 31988
HQYSDWPPF

SEQ ID NO: 63976 - protein, 20 aa, Homo sapiens
  heavy chain complementarity determining region 3 for antibody 31988
AREGGQGPTANGWFGGGADY

SEQ ID NO: 63977 - protein, 8 aa, Homo sapiens
  light chain complementarity determining region 3 for antibody 31989
HQYRDSFT

SEQ ID NO: 63978 - protein, 13 aa, Homo sapiens
  heavy chain complementarity determining region 3 for antibody 31989
ATESGKYQGALDF

SEQ ID NO: 63979 - protein, 9 aa, Homo sapiens
  light chain complementarity determining region 3 for antibody 31990
HQYNSYPWT

SEQ ID NO: 63980 - protein, 14 aa, Homo sapiens
  heavy chain complementarity determining region 3 for antibody 31990
VKSRTMVPGDAFDI

SEQ ID NO: 63981 - protein, 9 aa, Homo sapiens
  light chain complementarity determining region 3 for antibody 31991
HQYNSFLYT

SEQ ID NO: 63982 - protein, 14 aa, Homo sapiens
  heavy chain complementarity determining region 3 for antibody 31991
TTDPFEWQWLSFDY

SEQ ID NO: 63983 - protein, 10 aa, Homo sapiens
  light chain complementarity determining region 3 for antibody 31992
HQYNNWLGWT

SEQ ID NO: 63984 - protein, 13 aa, Homo sapiens
  heavy chain complementarity determining region 3 for antibody 31992
ARHGRRSGWYYTY

SEQ ID NO: 63985 - protein, 9 aa, Homo sapiens
  light chain complementarity determining region 3 for antibody 31993
HQYNNFPWT

SEQ ID NO: 63986 - protein, 23 aa, Homo sapiens
  heavy chain complementarity determining region 3 for antibody 31993
TRGKFRFLQWVETSYSYYYDMDV

SEQ ID NO: 63987 - protein, 9 aa, Homo sapiens
  light chain complementarity determining region 3 for antibody 31994
HQYLSSPQT

SEQ ID NO: 63988 - protein, 18 aa, Homo sapiens
  heavy chain complementarity determining region 3 for antibody 31994
AYRPPVARVGGNPEPFDP

SEQ ID NO: 63989 - protein, 8 aa, Homo sapiens
  light chain complementarity determining region 3 for antibody 31995
HQYKSYYT

SEQ ID NO: 63990 - protein, 24 aa, Homo sapiens
  heavy chain complementarity determining region 3 for antibody 31995
TRDRPEADGSERNYKSIYFYGMDV

SEQ ID NO: 63991 - protein, 9 aa, Homo sapiens
  light chain complementarity determining region 3 for antibody 31996
HQYHALPLT

SEQ ID NO: 63992 - protein, 13 aa, Homo sapiens
  heavy chain complementarity determining region 3 for antibody 31996
ARDGVPGKFNRAH

SEQ ID NO: 63993 - protein, 10 aa, Homo sapiens
  light chain complementarity determining region 3 for antibody 31997
HQYGTSSMYF

SEQ ID NO: 63994 - protein, 9 aa, Homo sapiens
  heavy chain complementarity determining region 3 for antibody 31997
ARGGGGFDY

SEQ ID NO: 63995 - protein, 9 aa, Homo sapiens
  light chain complementarity determining region 3 for antibody 31998
HQYGTSPQT

SEQ ID NO: 63996 - protein, 14 aa, Homo sapiens
  heavy chain complementarity determining region 3 for antibody 31998
ARGAPIAGRRPFDP

SEQ ID NO: 63997 - protein, 8 aa, Homo sapiens
  light chain complementarity determining region 3 for antibody 31999
HQYGTSIT

SEQ ID NO: 63998 - protein, 16 aa, Homo sapiens
  heavy chain complementarity determining region 3 for antibody 31999
ANSRYGSNIYPVPFDN

SEQ ID NO: 63999 - protein, 8 aa, Homo sapiens
  light chain complementarity determining region 3 for antibody 32000
HQYGTSIT

SEQ ID NO: 64000 - protein, 16 aa, Homo sapiens
  heavy chain complementarity determining region 3 for antibody 32000
AHSRYGSNIYPVPFDI

SEQ ID NO: 64001 - protein, 8 aa, Homo sapiens
  light chain complementarity determining region 3 for antibody 32001
HQYGTSIT

SEQ ID NO: 64002 - protein, 16 aa, Homo sapiens
  heavy chain complementarity determining region 3 for antibody 32001
AHSRYGSNIYPGPFDN

SEQ ID NO: 64003 - protein, 8 aa, Homo sapiens
  light chain complementarity determining region 3 for antibody 32002
HQYGTSIT

SEQ ID NO: 64004 - protein, 16 aa, Homo sapiens
  heavy chain complementarity determining region 3 for antibody 32002
AHRRYGSNIYPVPFDN

SEQ ID NO: 64005 - protein, 9 aa, Homo sapiens
  light chain complementarity determining region 3 for antibody 32003
HQYGSTPYN

SEQ ID NO: 64006 - protein, 18 aa, Homo sapiens
  heavy chain complementarity determining region 3 for antibody 32003
ARTGVWFGDFIVPDAFDI

SEQ ID NO: 64007 - protein, 9 aa, Homo sapiens
  light chain complementarity determining region 3 for antibody 32004
HQYGSTPDT

SEQ ID NO: 64008 - protein, 18 aa, Homo sapiens
  heavy chain complementarity determining region 3 for antibody 32004
ARTGVWFGDFIVPDAFDI

SEQ ID NO: 64009 - protein, 9 aa, Homo sapiens
  light chain complementarity determining region 3 for antibody 32005
HQYGSSPYT

SEQ ID NO: 64010 - protein, 16 aa, Homo sapiens
  heavy chain complementarity determining region 3 for antibody 32005
ATPGQHNSGWDYRFDY

SEQ ID NO: 64011 - protein, 9 aa, Homo sapiens
  light chain complementarity determining region 3 for antibody 32006
HQYGSSPYT

SEQ ID NO: 64012 - protein, 11 aa, Homo sapiens
  heavy chain complementarity determining region 3 for antibody 32006
ARGVTMAGRGY

SEQ ID NO: 64013 - protein, 9 aa, Homo sapiens
  light chain complementarity determining region 3 for antibody 32007
HQYGSSPWP

SEQ ID NO: 64014 - protein, 14 aa, Homo sapiens
  heavy chain complementarity determining region 3 for antibody 32007
ARDLSLGMPGGFDY

SEQ ID NO: 64015 - protein, 9 aa, Homo sapiens
  light chain complementarity determining region 3 for antibody 32008
HQYGSSPVT

SEQ ID NO: 64016 - protein, 20 aa, Homo sapiens
  heavy chain complementarity determining region 3 for antibody 32008
ARRTPNPAPGMRYYYYGMDV

SEQ ID NO: 64017 - protein, 9 aa, Homo sapiens
  light chain complementarity determining region 3 for antibody 32009
HQYGSSPRT

SEQ ID NO: 64018 - protein, 22 aa, Homo sapiens
  heavy chain complementarity determining region 3 for antibody 32009
ARNGHLHACIGDNCYIHDAYDM

SEQ ID NO: 64019 - protein, 9 aa, Homo sapiens
  light chain complementarity determining region 3 for antibody 32010
HQYGSSPRT

SEQ ID NO: 64020 - protein, 14 aa, Homo sapiens
  heavy chain complementarity determining region 3 for antibody 32010
ARDFGITVLDSFDP

SEQ ID NO: 64021 - protein, 9 aa, Homo sapiens
  light chain complementarity determining region 3 for antibody 32011
HQYGSSPQT

SEQ ID NO: 64022 - protein, 11 aa, Homo sapiens
  heavy chain complementarity determining region 3 for antibody 32011
ARGDLWSAFDI

SEQ ID NO: 64023 - protein, 10 aa, Homo sapiens
  light chain complementarity determining region 3 for antibody 32012
HQYGSSPPST

SEQ ID NO: 64024 - protein, 14 aa, Homo sapiens
  heavy chain complementarity determining region 3 for antibody 32012
ARRGQWLVREAIDY

SEQ ID NO: 64025 - protein, 10 aa, Homo sapiens
  light chain complementarity determining region 3 for antibody 32013
HQYGSSPPNT

SEQ ID NO: 64026 - protein, 14 aa, Homo sapiens
  heavy chain complementarity determining region 3 for antibody 32013
ARRGQWLVREAIDY

SEQ ID NO: 64027 - protein, 10 aa, Homo sapiens
  light chain complementarity determining region 3 for antibody 32014
HQYGSSPPGT

SEQ ID NO: 64028 - protein, 26 aa, Homo sapiens
  heavy chain complementarity determining region 3 for antibody 32014
ARTGRGLVFDTSGLHRFPSTRGYLQH

SEQ ID NO: 64029 - protein, 9 aa, Homo sapiens
  light chain complementarity determining region 3 for antibody 32015
HQYGSSPLT

SEQ ID NO: 64030 - protein, 16 aa, Homo sapiens
  heavy chain complementarity determining region 3 for antibody 32015
TTDHDGSGRYYVAFFS

SEQ ID NO: 64031 - protein, 9 aa, Homo sapiens
  light chain complementarity determining region 3 for antibody 32016
HQYGSSPKT

SEQ ID NO: 64032 - protein, 10 aa, Homo sapiens
  heavy chain complementarity determining region 3 for antibody 32016
SRDMIWGEDF

SEQ ID NO: 64033 - protein, 9 aa, Homo sapiens
  light chain complementarity determining region 3 for antibody 32017
HQYGSSPGT

SEQ ID NO: 64034 - protein, 20 aa, Homo sapiens
  heavy chain complementarity determining region 3 for antibody 32017
ARRTPNPAPGMRYYYYGMDV

SEQ ID NO: 64035 - protein, 9 aa, Homo sapiens
  light chain complementarity determining region 3 for antibody 32018
HQYGSSPFT

SEQ ID NO: 64036 - protein, 21 aa, Homo sapiens
  heavy chain complementarity determining region 3 for antibody 32018
ARVGVERNRYGRTLPVWYFDY

SEQ ID NO: 64037 - protein, 9 aa, Homo sapiens
  light chain complementarity determining region 3 for antibody 32019
HQYGSSPET

SEQ ID NO: 64038 - protein, 20 aa, Homo sapiens
  heavy chain complementarity determining region 3 for antibody 32019
ARRTPTPAPGMRYYYYGMDV

SEQ ID NO: 64039 - protein, 8 aa, Homo sapiens
  light chain complementarity determining region 3 for antibody 32020
HQYGSSFT

SEQ ID NO: 64040 - protein, 16 aa, Homo sapiens
  heavy chain complementarity determining region 3 for antibody 32020
ARSRYSSNIYPVPFDN

SEQ ID NO: 64041 - protein, 8 aa, Homo sapiens
  light chain complementarity determining region 3 for antibody 32021
HQYGSSFT

SEQ ID NO: 64042 - protein, 16 aa, Homo sapiens
  heavy chain complementarity determining region 3 for antibody 32021
AHSRYSSTIYPVPFDN

SEQ ID NO: 64043 - protein, 9 aa, Homo sapiens
  light chain complementarity determining region 3 for antibody 32022
HQYGSPPET

SEQ ID NO: 64044 - protein, 20 aa, Homo sapiens
  heavy chain complementarity determining region 3 for antibody 32022
ARRTPNPAPGMRYYYYGMDV

SEQ ID NO: 64045 - protein, 9 aa, Homo sapiens
  light chain complementarity determining region 3 for antibody 32023
HQYGSKPYT

SEQ ID NO: 64046 - protein, 18 aa, Homo sapiens
  heavy chain complementarity determining region 3 for antibody 32023
ARTGVWFGDFIVPDAFDI

SEQ ID NO: 64047 - protein, 9 aa, Homo sapiens
  light chain complementarity determining region 3 for antibody 32024
HQYGRTPYT

SEQ ID NO: 64048 - protein, 18 aa, Homo sapiens
  heavy chain complementarity determining region 3 for antibody 32024
ARTGVWFGDFIVPDAFDI

SEQ ID NO: 64049 - protein, 8 aa, Homo sapiens
  light chain complementarity determining region 3 for antibody 32025
HQYGRSFT

SEQ ID NO: 64050 - protein, 16 aa, Homo sapiens
  heavy chain complementarity determining region 3 for antibody 32025
AHSRYSSNIYPVPFDN

SEQ ID NO: 64051 - protein, 9 aa, Homo sapiens
  light chain complementarity determining region 3 for antibody 32026
HQYGRLPGT

SEQ ID NO: 64052 - protein, 20 aa, Homo sapiens
  heavy chain complementarity determining region 3 for antibody 32026
ARPRGVSHLATAGSPDYFDL

SEQ ID NO: 64053 - protein, 10 aa, Homo sapiens
  light chain complementarity determining region 3 for antibody 32027
HQYGPSSLYI

SEQ ID NO: 64054 - protein, 9 aa, Homo sapiens
  heavy chain complementarity determining region 3 for antibody 32027
ARGGGGFDY

SEQ ID NO: 64055 - protein, 8 aa, Homo sapiens
  light chain complementarity determining region 3 for antibody 32028
HQYGPSIT

SEQ ID NO: 64056 - protein, 16 aa, Homo sapiens
  heavy chain complementarity determining region 3 for antibody 32028
AHSRYGSNIYPVPFDN

SEQ ID NO: 64057 - protein, 9 aa, Homo sapiens
  light chain complementarity determining region 3 for antibody 32029
HQYGNSPFT

SEQ ID NO: 64058 - protein, 15 aa, Homo sapiens
  heavy chain complementarity determining region 3 for antibody 32029
ARQKGQRASAGYFDS

SEQ ID NO: 64059 - protein, 9 aa, Homo sapiens
  light chain complementarity determining region 3 for antibody 32030
HQYGISPRT

SEQ ID NO: 64060 - protein, 13 aa, Homo sapiens
  heavy chain complementarity determining region 3 for antibody 32030
ARTGRVAGVEGAS

SEQ ID NO: 64061 - protein, 9 aa, Homo sapiens
  light chain complementarity determining region 3 for antibody 32031
HQYGGSPRM

SEQ ID NO: 64062 - protein, 16 aa, Homo sapiens
  heavy chain complementarity determining region 3 for antibody 32031
AKSLGVDAMTTRVYDS

SEQ ID NO: 64063 - protein, 10 aa, Homo sapiens
  light chain complementarity determining region 3 for antibody 32032
HQYGGSPPLT

SEQ ID NO: 64064 - protein, 12 aa, Homo sapiens
  heavy chain complementarity determining region 3 for antibody 32032
ARLHYFDYYFDY

SEQ ID NO: 64065 - protein, 9 aa, Homo sapiens
  light chain complementarity determining region 3 for antibody 32033
HQYGESPRT

SEQ ID NO: 64066 - protein, 16 aa, Homo sapiens
  heavy chain complementarity determining region 3 for antibody 32033
AKSLGWDTMTTRVYDS

SEQ ID NO: 64067 - protein, 9 aa, Homo sapiens
  light chain complementarity determining region 3 for antibody 32034
HQYGESPRL

SEQ ID NO: 64068 - protein, 16 aa, Homo sapiens
  heavy chain complementarity determining region 3 for antibody 32034
AKSLGVDAMTTRVYDS

SEQ ID NO: 64069 - protein, 9 aa, Homo sapiens
  light chain complementarity determining region 3 for antibody 32035
HQYGDTPRT

SEQ ID NO: 64070 - protein, 16 aa, Homo sapiens
  heavy chain complementarity determining region 3 for antibody 32035
AGLSASGHLAPNTLDV

SEQ ID NO: 64071 - protein, 9 aa, Homo sapiens
  light chain complementarity determining region 3 for antibody 32036
HQYGDTPRT

SEQ ID NO: 64072 - protein, 16 aa, Homo sapiens
  heavy chain complementarity determining region 3 for antibody 32036
AGLSASGHLAPNAFDV

SEQ ID NO: 64073 - protein, 9 aa, Homo sapiens
  light chain complementarity determining region 3 for antibody 32037
HQYGDTPCT

SEQ ID NO: 64074 - protein, 16 aa, Homo sapiens
  heavy chain complementarity determining region 3 for antibody 32037
AGLSASGHLAPNTFDV

SEQ ID NO: 64075 - protein, 9 aa, Homo sapiens
  light chain complementarity determining region 3 for antibody 32038
HQYGDSPRT

SEQ ID NO: 64076 - protein, 18 aa, Homo sapiens
  heavy chain complementarity determining region 3 for antibody 32038
AREVPDRRGYNSNPYADY

SEQ ID NO: 64077 - protein, 9 aa, Homo sapiens
  light chain complementarity determining region 3 for antibody 32039
HQYGCSPET

SEQ ID NO: 64078 - protein, 20 aa, Homo sapiens
  heavy chain complementarity determining region 3 for antibody 32039
ARRTPNPAPGMRYYYYGMDV

SEQ ID NO: 64079 - protein, 9 aa, Homo sapiens
  light chain complementarity determining region 3 for antibody 32040
HQYGASPRR

SEQ ID NO: 64080 - protein, 16 aa, Homo sapiens
  heavy chain complementarity determining region 3 for antibody 32040
AKSLGVDAMTTRVYDS

SEQ ID NO: 64081 - protein, 9 aa, Homo sapiens
  light chain complementarity determining region 3 for antibody 32041
HQYETYPWT

SEQ ID NO: 64082 - protein, 17 aa, Homo sapiens
  heavy chain complementarity determining region 3 for antibody 32041
VRRGGGLPDDRDYGLDV

SEQ ID NO: 64083 - protein, 9 aa, Homo sapiens
  light chain complementarity determining region 3 for antibody 32042
HQYEASPYT

SEQ ID NO: 64084 - protein, 17 aa, Homo sapiens
  heavy chain complementarity determining region 3 for antibody 32042
ASLLVVPGAIYYYGMDV

SEQ ID NO: 64085 - protein, 9 aa, Homo sapiens
  light chain complementarity determining region 3 for antibody 32043
HQYDTVSHT

SEQ ID NO: 64086 - protein, 21 aa, Homo sapiens
  heavy chain complementarity determining region 3 for antibody 32043
ARLKPAYYGGSASDGYSRLDP

SEQ ID NO: 64087 - protein, 9 aa, Homo sapiens
  light chain complementarity determining region 3 for antibody 32044
HQYDNLPRP

SEQ ID NO: 64088 - protein, 18 aa, Homo sapiens
  heavy chain complementarity determining region 3 for antibody 32044
VTLPPQYCSGVNCYDVDY

SEQ ID NO: 64089 - protein, 9 aa, Homo sapiens
  light chain complementarity determining region 3 for antibody 32045
HQYDNLPRK

SEQ ID NO: 64090 - protein, 18 aa, Homo sapiens
  heavy chain complementarity determining region 3 for antibody 32045
VTLPPQYCSGVNCYDVDY

SEQ ID NO: 64091 - protein, 9 aa, Homo sapiens
  light chain complementarity determining region 3 for antibody 32046
HQYDHSPRT

SEQ ID NO: 64092 - protein, 22 aa, Homo sapiens
  heavy chain complementarity determining region 3 for antibody 32046
VRDWDRQAYCDGGGCQQDAFDI

SEQ ID NO: 64093 - protein, 9 aa, Homo sapiens
  light chain complementarity determining region 3 for antibody 32047
HQYDDSIQT

SEQ ID NO: 64094 - protein, 28 aa, Homo sapiens
  heavy chain complementarity determining region 3 for antibody 32047
ARDRTPEFHRFYGTGSFLAPRAPDALAF

SEQ ID NO: 64095 - protein, 9 aa, Homo sapiens
  light chain complementarity determining region 3 for antibody 32048
HQYAYSPIT

SEQ ID NO: 64096 - protein, 10 aa, Homo sapiens
  heavy chain complementarity determining region 3 for antibody 32048
ATGAGWLVDY

SEQ ID NO: 64097 - protein, 9 aa, Homo sapiens
  light chain complementarity determining region 3 for antibody 32049
HQYATSPWT

SEQ ID NO: 64098 - protein, 14 aa, Homo sapiens
  heavy chain complementarity determining region 3 for antibody 32049
ARVGWLDYYYGMDV

SEQ ID NO: 64099 - protein, 9 aa, Homo sapiens
  light chain complementarity determining region 3 for antibody 32050
HQYATSPRP

SEQ ID NO: 64100 - protein, 17 aa, Homo sapiens
  heavy chain complementarity determining region 3 for antibody 32050
VKPRETYSSGWVDAFDV

SEQ ID NO: 64101 - protein, 9 aa, Homo sapiens
  light chain complementarity determining region 3 for antibody 32051
HQYATSPLT

SEQ ID NO: 64102 - protein, 10 aa, Homo sapiens
  heavy chain complementarity determining region 3 for antibody 32051
TTGGGWLVDY

SEQ ID NO: 64103 - protein, 10 aa, Homo sapiens
  light chain complementarity determining region 3 for antibody 32052
HQYASSPPTT

SEQ ID NO: 64104 - protein, 18 aa, Homo sapiens
  heavy chain complementarity determining region 3 for antibody 32052
AKEGYYYNSGSYYKPLDY

SEQ ID NO: 64105 - protein, 9 aa, Homo sapiens
  light chain complementarity determining region 3 for antibody 32053
HQYASSPLT

SEQ ID NO: 64106 - protein, 10 aa, Homo sapiens
  heavy chain complementarity determining region 3 for antibody 32053
AKGGGWLPDY

SEQ ID NO: 64107 - protein, 9 aa, Homo sapiens
  light chain complementarity determining region 3 for antibody 32054
HQYASSPFT

SEQ ID NO: 64108 - protein, 10 aa, Homo sapiens
  heavy chain complementarity determining region 3 for antibody 32054
AKGGGWLTDY

SEQ ID NO: 64109 - protein, 10 aa, Homo sapiens
  light chain complementarity determining region 3 for antibody 32055
HQYASPPPTT

SEQ ID NO: 64110 - protein, 18 aa, Homo sapiens
  heavy chain complementarity determining region 3 for antibody 32055
AKEGYYYNSGSYYNPLDY

SEQ ID NO: 64111 - protein, 9 aa, Homo sapiens
  light chain complementarity determining region 3 for antibody 32056
HQYASLPLT

SEQ ID NO: 64112 - protein, 10 aa, Homo sapiens
  heavy chain complementarity determining region 3 for antibody 32056
AKGGGWLTDY

SEQ ID NO: 64113 - protein, 9 aa, Homo sapiens
  light chain complementarity determining region 3 for antibody 32057
HQYANLPRT

SEQ ID NO: 64114 - protein, 18 aa, Homo sapiens
  heavy chain complementarity determining region 3 for antibody 32057
VTLPPQYCSGVNCYDVDY

SEQ ID NO: 64115 - protein, 9 aa, Homo sapiens
  light chain complementarity determining region 3 for antibody 32058
HQVNRFPLT

SEQ ID NO: 64116 - protein, 14 aa, Homo sapiens
  heavy chain complementarity determining region 3 for antibody 32058
TTDSPLRRYNYFVY

SEQ ID NO: 64117 - protein, 9 aa, Homo sapiens
  light chain complementarity determining region 3 for antibody 32059
HQVHIYPFT

SEQ ID NO: 64118 - protein, 12 aa, Homo sapiens
  heavy chain complementarity determining region 3 for antibody 32059
ARPLDGDFGFDP

SEQ ID NO: 64119 - protein, 9 aa, Homo sapiens
  light chain complementarity determining region 3 for antibody 32060
HQTYSVLRT

SEQ ID NO: 64120 - protein, 16 aa, Homo sapiens
  heavy chain complementarity determining region 3 for antibody 32060
AVMEDSGSYIADAFDM

SEQ ID NO: 64121 - protein, 9 aa, Homo sapiens
  light chain complementarity determining region 3 for antibody 32061
HQTYDTPYP

SEQ ID NO: 64122 - protein, 14 aa, Homo sapiens
  heavy chain complementarity determining region 3 for antibody 32061
ATALTAFSGYDLEH

SEQ ID NO: 64123 - protein, 9 aa, Homo sapiens
  light chain complementarity determining region 3 for antibody 32062
HQTYDTPST

SEQ ID NO: 64124 - protein, 14 aa, Homo sapiens
  heavy chain complementarity determining region 3 for antibody 32062
ATALTAFSGYDLEH

SEQ ID NO: 64125 - protein, 9 aa, Homo sapiens
  light chain complementarity determining region 3 for antibody 32063
HQTSSFPWT

SEQ ID NO: 64126 - protein, 20 aa, Homo sapiens
  heavy chain complementarity determining region 3 for antibody 32063
TTVPDSPGGSYTGFFDALDI

SEQ ID NO: 64127 - protein, 9 aa, Homo sapiens
  light chain complementarity determining region 3 for antibody 32064
HQTSGLPWT

SEQ ID NO: 64128 - protein, 18 aa, Homo sapiens
  heavy chain complementarity determining region 3 for antibody 32064
ARAGLYSNGYYVESDFDY

SEQ ID NO: 64129 - protein, 9 aa, Homo sapiens
  light chain complementarity determining region 3 for antibody 32065
HQTIAVPHT

SEQ ID NO: 64130 - protein, 15 aa, Homo sapiens
  heavy chain complementarity determining region 3 for antibody 32065
GRDGYFYGPRWYIDL

SEQ ID NO: 64131 - protein, 9 aa, Homo sapiens
  light chain complementarity determining region 3 for antibody 32066
HQSYTTPPP

SEQ ID NO: 64132 - protein, 13 aa, Homo sapiens
  heavy chain complementarity determining region 3 for antibody 32066
ARMREYATDAFDV

SEQ ID NO: 64133 - protein, 9 aa, Homo sapiens
  light chain complementarity determining region 3 for antibody 32067
HQSYSTPYT

SEQ ID NO: 64134 - protein, 18 aa, Homo sapiens
  heavy chain complementarity determining region 3 for antibody 32067
ARFTTGGSTGLILYFFDY

SEQ ID NO: 64135 - protein, 9 aa, Homo sapiens
  light chain complementarity determining region 3 for antibody 32068
HQSYSTPWT

SEQ ID NO: 64136 - protein, 12 aa, Homo sapiens
  heavy chain complementarity determining region 3 for antibody 32068
ARAPGGWGYFDL

SEQ ID NO: 64137 - protein, 9 aa, Homo sapiens
  light chain complementarity determining region 3 for antibody 32069
HQSYSTPPA

SEQ ID NO: 64138 - protein, 16 aa, Homo sapiens
  heavy chain complementarity determining region 3 for antibody 32069
ARDKIPQLVPSYYFDY

SEQ ID NO: 64139 - protein, 9 aa, Homo sapiens
  light chain complementarity determining region 3 for antibody 32070
HQSYSTPFT

SEQ ID NO: 64140 - protein, 12 aa, Homo sapiens
  heavy chain complementarity determining region 3 for antibody 32070
ARGGSYYGVWVD

SEQ ID NO: 64141 - protein, 9 aa, Homo sapiens
  light chain complementarity determining region 3 for antibody 32071
HQSYNTGDT

SEQ ID NO: 64142 - protein, 12 aa, Homo sapiens
  heavy chain complementarity determining region 3 for antibody 32071
ARDLRPGGAFDI

SEQ ID NO: 64143 - protein, 9 aa, Homo sapiens
  light chain complementarity determining region 3 for antibody 32072
HQSSSLPST

SEQ ID NO: 64144 - protein, 15 aa, Homo sapiens
  heavy chain complementarity determining region 3 for antibody 32072
ARDRNNDFWSGYRVY

SEQ ID NO: 64145 - protein, 9 aa, Homo sapiens
  light chain complementarity determining region 3 for antibody 32073
HQSSSLPQT

SEQ ID NO: 64146 - protein, 13 aa, Homo sapiens
  heavy chain complementarity determining region 3 for antibody 32073
ARDLAFGEGYFDS

SEQ ID NO: 64147 - protein, 9 aa, Homo sapiens
  light chain complementarity determining region 3 for antibody 32074
HQSSSLPLT

SEQ ID NO: 64148 - protein, 10 aa, Homo sapiens
  heavy chain complementarity determining region 3 for antibody 32074
ARYLYDAFDM

SEQ ID NO: 64149 - protein, 9 aa, Homo sapiens
  light chain complementarity determining region 3 for antibody 32075
HQSSSLPHT

SEQ ID NO: 64150 - protein, 13 aa, Homo sapiens
  heavy chain complementarity determining region 3 for antibody 32075
ARDWAFGEGYFDS

SEQ ID NO: 64151 - protein, 9 aa, Homo sapiens
  light chain complementarity determining region 3 for antibody 32076
HQSSSLPDT

SEQ ID NO: 64152 - protein, 15 aa, Homo sapiens
  heavy chain complementarity determining region 3 for antibody 32076
ARDRNNDFWSGYRVY

SEQ ID NO: 64153 - protein, 9 aa, Homo sapiens
  light chain complementarity determining region 3 for antibody 32077
HQSSSFPQT

SEQ ID NO: 64154 - protein, 24 aa, Homo sapiens
  heavy chain complementarity determining region 3 for antibody 32077
ARGRPPSGWYRLKDRTYYYYGLDV

SEQ ID NO: 64155 - protein, 9 aa, Homo sapiens
  light chain complementarity determining region 3 for antibody 32078
HQSSGFPVP

SEQ ID NO: 64156 - protein, 19 aa, Homo sapiens
  heavy chain complementarity determining region 3 for antibody 32078
ARDAAYSSTWYLVLYGMDV

SEQ ID NO: 64157 - protein, 9 aa, Homo sapiens
  light chain complementarity determining region 3 for antibody 32079
HQSSASPRT

SEQ ID NO: 64158 - protein, 7 aa, Homo sapiens
  heavy chain complementarity determining region 3 for antibody 32079
GGRALDY

SEQ ID NO: 64159 - protein, 9 aa, Homo sapiens
  light chain complementarity determining region 3 for antibody 32080
HQSRTFPVT

SEQ ID NO: 64160 - protein, 14 aa, Homo sapiens
  heavy chain complementarity determining region 3 for antibody 32080
IRQSKSDNWNYLDY

SEQ ID NO: 64161 - protein, 9 aa, Homo sapiens
  light chain complementarity determining region 3 for antibody 32081
HQSRTFPVT

SEQ ID NO: 64162 - protein, 14 aa, Homo sapiens
  heavy chain complementarity determining region 3 for antibody 32081
IRQSKSDNWNSPDY

SEQ ID NO: 64163 - protein, 9 aa, Homo sapiens
  light chain complementarity determining region 3 for antibody 32082
HQSRTFPVT

SEQ ID NO: 64164 - protein, 14 aa, Homo sapiens
  heavy chain complementarity determining region 3 for antibody 32082
IRQSKSDNWDYPDY

SEQ ID NO: 64165 - protein, 9 aa, Homo sapiens
  light chain complementarity determining region 3 for antibody 32083
HQSRTFPVT

SEQ ID NO: 64166 - protein, 14 aa, Homo sapiens
  heavy chain complementarity determining region 3 for antibody 32083
IRQSKSDNRNYPDY

SEQ ID NO: 64167 - protein, 9 aa, Homo sapiens
  light chain complementarity determining region 3 for antibody 32084
HQSRTFPLT

SEQ ID NO: 64168 - protein, 14 aa, Homo sapiens
  heavy chain complementarity determining region 3 for antibody 32084
IRQSKSDNWNYPDY

SEQ ID NO: 64169 - protein, 9 aa, Homo sapiens
  light chain complementarity determining region 3 for antibody 32085
HQSRNLPGS

SEQ ID NO: 64170 - protein, 23 aa, Homo sapiens
  heavy chain complementarity determining region 3 for antibody 32085
ARDTMYYEESWGSDQIVLASLDS

SEQ ID NO: 64171 - protein, 9 aa, Homo sapiens
  light chain complementarity determining region 3 for antibody 32086
HQSRNFPVT

SEQ ID NO: 64172 - protein, 14 aa, Homo sapiens
  heavy chain complementarity determining region 3 for antibody 32086
IRQSKSDNWNYPDY

SEQ ID NO: 64173 - protein, 9 aa, Homo sapiens
  light chain complementarity determining region 3 for antibody 32087
HQSRASPRT

SEQ ID NO: 64174 - protein, 7 aa, Homo sapiens
  heavy chain complementarity determining region 3 for antibody 32087
GGRDLDY

SEQ ID NO: 64175 - protein, 9 aa, Homo sapiens
  light chain complementarity determining region 3 for antibody 32088
HQSLSFPIT

SEQ ID NO: 64176 - protein, 11 aa, Homo sapiens
  heavy chain complementarity determining region 3 for antibody 32088
ATYYSGGWFDP

SEQ ID NO: 64177 - protein, 9 aa, Homo sapiens
  light chain complementarity determining region 3 for antibody 32089
HQSHDFPYT

SEQ ID NO: 64178 - protein, 13 aa, Homo sapiens
  heavy chain complementarity determining region 3 for antibody 32089
VRLWDIGGWPFDY

SEQ ID NO: 64179 - protein, 9 aa, Homo sapiens
  light chain complementarity determining region 3 for antibody 32090
HQSGSLPEK

SEQ ID NO: 64180 - protein, 8 aa, Homo sapiens
  heavy chain complementarity determining region 3 for antibody 32090
AVYSSLDY

SEQ ID NO: 64181 - protein, 9 aa, Homo sapiens
  light chain complementarity determining region 3 for antibody 32091
HQSGSLPAT

SEQ ID NO: 64182 - protein, 8 aa, Homo sapiens
  heavy chain complementarity determining region 3 for antibody 32091
AVYSSLDY

SEQ ID NO: 64183 - protein, 9 aa, Homo sapiens
  light chain complementarity determining region 3 for antibody 32092
HQSGSFPGT

SEQ ID NO: 64184 - protein, 8 aa, Homo sapiens
  heavy chain complementarity determining region 3 for antibody 32092
AVYSSLDY

SEQ ID NO: 64185 - protein, 9 aa, Homo sapiens
  light chain complementarity determining region 3 for antibody 32093
HQSGRLPET

SEQ ID NO: 64186 - protein, 8 aa, Homo sapiens
  heavy chain complementarity determining region 3 for antibody 32093
AVYSSLDY

SEQ ID NO: 64187 - protein, 9 aa, Homo sapiens
  light chain complementarity determining region 3 for antibody 32094
HQSGGLPWT

SEQ ID NO: 64188 - protein, 14 aa, Homo sapiens
  heavy chain complementarity determining region 3 for antibody 32094
VRDASGNSGWYADS

SEQ ID NO: 64189 - protein, 9 aa, Homo sapiens
  light chain complementarity determining region 3 for antibody 32095
HQSGDLPWT

SEQ ID NO: 64190 - protein, 14 aa, Homo sapiens
  heavy chain complementarity determining region 3 for antibody 32095
VRDASGNSGWYADS

SEQ ID NO: 64191 - protein, 9 aa, Homo sapiens
  light chain complementarity determining region 3 for antibody 32096
HQSGDFPYT

SEQ ID NO: 64192 - protein, 12 aa, Homo sapiens
  heavy chain complementarity determining region 3 for antibody 32096
ARVDSGSYWEDY

SEQ ID NO: 64193 - protein, 9 aa, Homo sapiens
  light chain complementarity determining region 3 for antibody 32097
HQSGALPWK

SEQ ID NO: 64194 - protein, 14 aa, Homo sapiens
  heavy chain complementarity determining region 3 for antibody 32097
VRDASGNSGWYADS

SEQ ID NO: 64195 - protein, 9 aa, Homo sapiens
  light chain complementarity determining region 3 for antibody 32098
HQSGALPLT

SEQ ID NO: 64196 - protein, 14 aa, Homo sapiens
  heavy chain complementarity determining region 3 for antibody 32098
VRDASGNSGWYADS

SEQ ID NO: 64197 - protein, 9 aa, Homo sapiens
  light chain complementarity determining region 3 for antibody 32099
HQSCSPPFT

SEQ ID NO: 64198 - protein, 14 aa, Homo sapiens
  heavy chain complementarity determining region 3 for antibody 32099
ARSYDTSGYSGFDY

SEQ ID NO: 64199 - protein, 9 aa, Homo sapiens
  light chain complementarity determining region 3 for antibody 32100
HQSCALPWT

SEQ ID NO: 64200 - protein, 14 aa, Homo sapiens
  heavy chain complementarity determining region 3 for antibody 32100
VRDASGNSGWYADS

SEQ ID NO: 64201 - protein, 9 aa, Homo sapiens
  light chain complementarity determining region 3 for antibody 32101
HQRYSTPFS

SEQ ID NO: 64202 - protein, 14 aa, Homo sapiens
  heavy chain complementarity determining region 3 for antibody 32101
ATSADTSGYSNFDY

SEQ ID NO: 64203 - protein, 9 aa, Homo sapiens
  light chain complementarity determining region 3 for antibody 32102
HQRSSLPYT

SEQ ID NO: 64204 - protein, 15 aa, Homo sapiens
  heavy chain complementarity determining region 3 for antibody 32102
ARDRNNDFWSGYRVY

SEQ ID NO: 64205 - protein, 11 aa, Homo sapiens
  light chain complementarity determining region 3 for antibody 32103
HQRSNWPPSLP

SEQ ID NO: 64206 - protein, 14 aa, Homo sapiens
  heavy chain complementarity determining region 3 for antibody 32103
AREGTAMVKDAFEI

SEQ ID NO: 64207 - protein, 9 aa, Homo sapiens
  light chain complementarity determining region 3 for antibody 32104
HQRSKWPIT

SEQ ID NO: 64208 - protein, 16 aa, Homo sapiens
  heavy chain complementarity determining region 3 for antibody 32104
ARGRGRGYSSGGTFDY

SEQ ID NO: 64209 - protein, 9 aa, Homo sapiens
  light chain complementarity determining region 3 for antibody 32105
HQRSGWPET

SEQ ID NO: 64210 - protein, 9 aa, Homo sapiens
  heavy chain complementarity determining region 3 for antibody 32105
ASGDYAFDL

SEQ ID NO: 64211 - protein, 9 aa, Homo sapiens
  light chain complementarity determining region 3 for antibody 32106
HQRSAWPLT

SEQ ID NO: 64212 - protein, 7 aa, Homo sapiens
  heavy chain complementarity determining region 3 for antibody 32106
VRDEWWP

SEQ ID NO: 64213 - protein, 9 aa, Homo sapiens
  light chain complementarity determining region 3 for antibody 32107
HQRSACPET

SEQ ID NO: 64214 - protein, 9 aa, Homo sapiens
  heavy chain complementarity determining region 3 for antibody 32107
ASGDYAFDL

SEQ ID NO: 64215 - protein, 9 aa, Homo sapiens
  light chain complementarity determining region 3 for antibody 32108
HQRRNFPVT

SEQ ID NO: 64216 - protein, 14 aa, Homo sapiens
  heavy chain complementarity determining region 3 for antibody 32108
IRQSKSDNWNYPDY

SEQ ID NO: 64217 - protein, 9 aa, Homo sapiens
  light chain complementarity determining region 3 for antibody 32109
HQRGSLPGT

SEQ ID NO: 64218 - protein, 8 aa, Homo sapiens
  heavy chain complementarity determining region 3 for antibody 32109
AVYSSLDY

SEQ ID NO: 64219 - protein, 10 aa, Homo sapiens
  light chain complementarity determining region 3 for antibody 32110
HQRAGWPQGT

SEQ ID NO: 64220 - protein, 14 aa, Homo sapiens
  heavy chain complementarity determining region 3 for antibody 32110
ARDTKWGSTWFFDL

SEQ ID NO: 64221 - protein, 9 aa, Homo sapiens
  light chain complementarity determining region 3 for antibody 32111
HQNIAVPPT

SEQ ID NO: 64222 - protein, 15 aa, Homo sapiens
  heavy chain complementarity determining region 3 for antibody 32111
GRDGYFYGPHWYIDL

SEQ ID NO: 64223 - protein, 9 aa, Homo sapiens
  light chain complementarity determining region 3 for antibody 32112
HQNGSTPYT

SEQ ID NO: 64224 - protein, 18 aa, Homo sapiens
  heavy chain complementarity determining region 3 for antibody 32112
ARTGVWFGDFIVPDAFDI

SEQ ID NO: 64225 - protein, 9 aa, Homo sapiens
  light chain complementarity determining region 3 for antibody 32113
HQNDNLPRT

SEQ ID NO: 64226 - protein, 18 aa, Homo sapiens
  heavy chain complementarity determining region 3 for antibody 32113
VTLPPQYCSGVNCYDVDY

SEQ ID NO: 64227 - protein, 9 aa, Homo sapiens
  light chain complementarity determining region 3 for antibody 32114
HQLNSYPYT

SEQ ID NO: 64228 - protein, 12 aa, Homo sapiens
  heavy chain complementarity determining region 3 for antibody 32114
AIWGGAKGGLPY

SEQ ID NO: 64229 - protein, 9 aa, Homo sapiens
  light chain complementarity determining region 3 for antibody 32115
HQLNSYPHT

SEQ ID NO: 64230 - protein, 12 aa, Homo sapiens
  heavy chain complementarity determining region 3 for antibody 32115
ARTSLSHDYGYY

SEQ ID NO: 64231 - protein, 9 aa, Homo sapiens
  light chain complementarity determining region 3 for antibody 32116
HQHGDTPRT

SEQ ID NO: 64232 - protein, 16 aa, Homo sapiens
  heavy chain complementarity determining region 3 for antibody 32116
AGLSASGHLAPNTFDV

SEQ ID NO: 64233 - protein, 9 aa, Homo sapiens
  light chain complementarity determining region 3 for antibody 32117
HQHATSPWT

SEQ ID NO: 64234 - protein, 14 aa, Homo sapiens
  heavy chain complementarity determining region 3 for antibody 32117
ARFGWLDYYYGMDV

SEQ ID NO: 64235 - protein, 9 aa, Homo sapiens
  light chain complementarity determining region 3 for antibody 32118
HQHAAPPLT

SEQ ID NO: 64236 - protein, 10 aa, Homo sapiens
  heavy chain complementarity determining region 3 for antibody 32118
AHGAGWVSDY

SEQ ID NO: 64237 - protein, 9 aa, Homo sapiens
  light chain complementarity determining region 3 for antibody 32119
HQGYRTPFP

SEQ ID NO: 64238 - protein, 15 aa, Homo sapiens
  heavy chain complementarity determining region 3 for antibody 32119
AKAQVIWGQLYYFDS

SEQ ID NO: 64239 - protein, 9 aa, Homo sapiens
  light chain complementarity determining region 3 for antibody 32120
HQGSNWPLT

SEQ ID NO: 64240 - protein, 11 aa, Homo sapiens
  heavy chain complementarity determining region 3 for antibody 32120
ARGGHYDFSFS

SEQ ID NO: 64241 - protein, 9 aa, Homo sapiens
  light chain complementarity determining region 3 for antibody 32121
HQGGALPWT

SEQ ID NO: 64242 - protein, 14 aa, Homo sapiens
  heavy chain complementarity determining region 3 for antibody 32121
VRDASGNSGWYADS

SEQ ID NO: 64243 - protein, 9 aa, Homo sapiens
  light chain complementarity determining region 3 for antibody 32122
HQFYSVPWT

SEQ ID NO: 64244 - protein, 11 aa, Homo sapiens
  heavy chain complementarity determining region 3 for antibody 32122
AGGEQMCPSSR

SEQ ID NO: 64245 - protein, 9 aa, Homo sapiens
  light chain complementarity determining region 3 for antibody 32123
HQFYSSPLA

SEQ ID NO: 64246 - protein, 11 aa, Homo sapiens
  heavy chain complementarity determining region 3 for antibody 32123
GRVYSWGAVDI

SEQ ID NO: 64247 - protein, 9 aa, Homo sapiens
  light chain complementarity determining region 3 for antibody 32124
HQFGESSWT

SEQ ID NO: 64248 - protein, 12 aa, Homo sapiens
  heavy chain complementarity determining region 3 for antibody 32124
ARSHSLRSSAKN

SEQ ID NO: 64249 - protein, 11 aa, Homo sapiens
  light chain complementarity determining region 3 for antibody 32125
HQDYDWPLRLT

SEQ ID NO: 64250 - protein, 18 aa, Homo sapiens
  heavy chain complementarity determining region 3 for antibody 32125
ARDAESRSHYSYYNGMDV

SEQ ID NO: 64251 - protein, 9 aa, Homo sapiens
  light chain complementarity determining region 3 for antibody 32126
HQDGSSPRT

SEQ ID NO: 64252 - protein, 22 aa, Homo sapiens
  heavy chain complementarity determining region 3 for antibody 32126
ARLKQDVIRSWLKSTVQTGLDY

SEQ ID NO: 64253 - protein, 10 aa, Homo sapiens
  light chain complementarity determining region 3 for antibody 32127
HQDGSSPPYT

SEQ ID NO: 64254 - protein, 14 aa, Homo sapiens
  heavy chain complementarity determining region 3 for antibody 32127
ARRGQWLVREAIDY

SEQ ID NO: 64255 - protein, 9 aa, Homo sapiens
  light chain complementarity determining region 3 for antibody 32128
HQDGSSPET

SEQ ID NO: 64256 - protein, 20 aa, Homo sapiens
  heavy chain complementarity determining region 3 for antibody 32128
ARRTPNPAPGMRYYYYGMDV

SEQ ID NO: 64257 - protein, 9 aa, Homo sapiens
  light chain complementarity determining region 3 for antibody 32129
HPYGTSSGT

SEQ ID NO: 64258 - protein, 12 aa, Homo sapiens
  heavy chain complementarity determining region 3 for antibody 32129
ARDHILLGGFDL

SEQ ID NO: 64259 - protein, 10 aa, Homo sapiens
  light chain complementarity determining region 3 for antibody 32130
HPYGSSPPYT

SEQ ID NO: 64260 - protein, 14 aa, Homo sapiens
  heavy chain complementarity determining region 3 for antibody 32130
ARRGQWLVREAIDY

SEQ ID NO: 64261 - protein, 9 aa, Homo sapiens
  light chain complementarity determining region 3 for antibody 32131
HPYGDTPRT

SEQ ID NO: 64262 - protein, 16 aa, Homo sapiens
  heavy chain complementarity determining region 3 for antibody 32131
AGLSASGHLAPNTFDV

SEQ ID NO: 64263 - protein, 9 aa, Homo sapiens
  light chain complementarity determining region 3 for antibody 32132
HPTYSDLRT

SEQ ID NO: 64264 - protein, 16 aa, Homo sapiens
  heavy chain complementarity determining region 3 for antibody 32132
AVMEDSGSYIADAFDM

SEQ ID NO: 64265 - protein, 9 aa, Homo sapiens
  light chain complementarity determining region 3 for antibody 32133
HPSGALPWT

SEQ ID NO: 64266 - protein, 14 aa, Homo sapiens
  heavy chain complementarity determining region 3 for antibody 32133
VRDASGNSGWYADS

SEQ ID NO: 64267 - protein, 9 aa, Homo sapiens
  light chain complementarity determining region 3 for antibody 32134
HKYGGSPRT

SEQ ID NO: 64268 - protein, 11 aa, Homo sapiens
  heavy chain complementarity determining region 3 for antibody 32134
ARSLPYREIEF

SEQ ID NO: 64269 - protein, 9 aa, Homo sapiens
  light chain complementarity determining region 3 for antibody 32135
HKSSSLPYT

SEQ ID NO: 64270 - protein, 15 aa, Homo sapiens
  heavy chain complementarity determining region 3 for antibody 32135
ARDRNNDFWSGYRVY

SEQ ID NO: 64271 - protein, 9 aa, Homo sapiens
  light chain complementarity determining region 3 for antibody 32136
HHYWSSPRP

SEQ ID NO: 64272 - protein, 18 aa, Homo sapiens
  heavy chain complementarity determining region 3 for antibody 32136
AREVPDKRGSNSNPYADV

SEQ ID NO: 64273 - protein, 9 aa, Homo sapiens
  light chain complementarity determining region 3 for antibody 32137
HHYVRSPLS

SEQ ID NO: 64274 - protein, 14 aa, Homo sapiens
  heavy chain complementarity determining region 3 for antibody 32137
AVRIVAPTKTPFEF

SEQ ID NO: 64275 - protein, 9 aa, Homo sapiens
  light chain complementarity determining region 3 for antibody 32138
HHYVRAPLS

SEQ ID NO: 64276 - protein, 14 aa, Homo sapiens
  heavy chain complementarity determining region 3 for antibody 32138
AGRIVAPTKTPFEF

SEQ ID NO: 64277 - protein, 9 aa, Homo sapiens
  light chain complementarity determining region 3 for antibody 32139
HHYGWSPRP

SEQ ID NO: 64278 - protein, 18 aa, Homo sapiens
  heavy chain complementarity determining region 3 for antibody 32139
AREVPDKRGSNSNPYADV

SEQ ID NO: 64279 - protein, 9 aa, Homo sapiens
  light chain complementarity determining region 3 for antibody 32140
HHYGTSSWT

SEQ ID NO: 64280 - protein, 12 aa, Homo sapiens
  heavy chain complementarity determining region 3 for antibody 32140
ARDHILLGGFDL

SEQ ID NO: 64281 - protein, 9 aa, Homo sapiens
  light chain complementarity determining region 3 for antibody 32141
HHYGTSSGT

SEQ ID NO: 64282 - protein, 12 aa, Homo sapiens
  heavy chain complementarity determining region 3 for antibody 32141
AKDHILLGGFDL

SEQ ID NO: 64283 - protein, 9 aa, Homo sapiens
  light chain complementarity determining region 3 for antibody 32142
HHYGTSPRT

SEQ ID NO: 64284 - protein, 13 aa, Homo sapiens
  heavy chain complementarity determining region 3 for antibody 32142
ATESGSYYGGLDY

SEQ ID NO: 64285 - protein, 9 aa, Homo sapiens
  light chain complementarity determining region 3 for antibody 32143
HHYGTPPRP

SEQ ID NO: 64286 - protein, 13 aa, Homo sapiens
  heavy chain complementarity determining region 3 for antibody 32143
VRDYVWGSQHPDY

SEQ ID NO: 64287 - protein, 9 aa, Homo sapiens
  light chain complementarity determining region 3 for antibody 32144
HHYGTPHRP

SEQ ID NO: 64288 - protein, 13 aa, Homo sapiens
  heavy chain complementarity determining region 3 for antibody 32144
VRDCVWGSQHPDY

SEQ ID NO: 64289 - protein, 9 aa, Homo sapiens
  light chain complementarity determining region 3 for antibody 32145
HHYGSSPYT

SEQ ID NO: 64290 - protein, 18 aa, Homo sapiens
  heavy chain complementarity determining region 3 for antibody 32145
ARGFGGYSGYTGREHIDF

SEQ ID NO: 64291 - protein, 9 aa, Homo sapiens
  light chain complementarity determining region 3 for antibody 32146
HHYGSSPRP

SEQ ID NO: 64292 - protein, 18 aa, Homo sapiens
  heavy chain complementarity determining region 3 for antibody 32146
AREVPDKRGSNPNPYADV

SEQ ID NO: 64293 - protein, 9 aa, Homo sapiens
  light chain complementarity determining region 3 for antibody 32147
HHYGSSPLP

SEQ ID NO: 64294 - protein, 18 aa, Homo sapiens
  heavy chain complementarity determining region 3 for antibody 32147
AREVPDKRGSNSNPYADV

SEQ ID NO: 64295 - protein, 10 aa, Homo sapiens
  light chain complementarity determining region 3 for antibody 32148
HHYGKSPPWV

SEQ ID NO: 64296 - protein, 15 aa, Homo sapiens
  heavy chain complementarity determining region 3 for antibody 32148
ARHRAPDTRKSALGY

SEQ ID NO: 64297 - protein, 10 aa, Homo sapiens
  light chain complementarity determining region 3 for antibody 32149
HHYGKSPPWL

SEQ ID NO: 64298 - protein, 15 aa, Homo sapiens
  heavy chain complementarity determining region 3 for antibody 32149
ARHRAPDTRKSALGY

SEQ ID NO: 64299 - protein, 10 aa, Homo sapiens
  light chain complementarity determining region 3 for antibody 32150
HHYGKSPPRM

SEQ ID NO: 64300 - protein, 15 aa, Homo sapiens
  heavy chain complementarity determining region 3 for antibody 32150
ARHRAPDTRKSALGY

SEQ ID NO: 64301 - protein, 9 aa, Homo sapiens
  light chain complementarity determining region 3 for antibody 32151
HHYGGSPRT

SEQ ID NO: 64302 - protein, 11 aa, Homo sapiens
  heavy chain complementarity determining region 3 for antibody 32151
ARSLPYREIEF

SEQ ID NO: 64303 - protein, 10 aa, Homo sapiens
  light chain complementarity determining region 3 for antibody 32152
HHYDGYSPWT

SEQ ID NO: 64304 - protein, 12 aa, Homo sapiens
  heavy chain complementarity determining region 3 for antibody 32152
AKVYSSSWYFDY

SEQ ID NO: 64305 - protein, 9 aa, Homo sapiens
  light chain complementarity determining region 3 for antibody 32153
HHYDDLPIT

SEQ ID NO: 64306 - protein, 15 aa, Homo sapiens
  heavy chain complementarity determining region 3 for antibody 32153
VREPTEEHRGYDLDY

SEQ ID NO: 64307 - protein, 9 aa, Homo sapiens
  light chain complementarity determining region 3 for antibody 32154
HHYATSPWT

SEQ ID NO: 64308 - protein, 14 aa, Homo sapiens
  heavy chain complementarity determining region 3 for antibody 32154
ARFGWLDYYYGMDV

SEQ ID NO: 64309 - protein, 9 aa, Homo sapiens
  light chain complementarity determining region 3 for antibody 32155
HHTYTFPRT

SEQ ID NO: 64310 - protein, 20 aa, Homo sapiens
  heavy chain complementarity determining region 3 for antibody 32155
ARGRRIAALSTAHYYYGTDV

SEQ ID NO: 64311 - protein, 9 aa, Homo sapiens
  light chain complementarity determining region 3 for antibody 32156
HHTSTFPRT

SEQ ID NO: 64312 - protein, 20 aa, Homo sapiens
  heavy chain complementarity determining region 3 for antibody 32156
ARGSRIAALSTAHYYYGMDV

SEQ ID NO: 64313 - protein, 9 aa, Homo sapiens
  light chain complementarity determining region 3 for antibody 32157
HHTSTFPRT

SEQ ID NO: 64314 - protein, 20 aa, Homo sapiens
  heavy chain complementarity determining region 3 for antibody 32157
ARGRRIAALSTAHSYYGMDV

SEQ ID NO: 64315 - protein, 9 aa, Homo sapiens
  light chain complementarity determining region 3 for antibody 32158
HHTSTFPRS

SEQ ID NO: 64316 - protein, 20 aa, Homo sapiens
  heavy chain complementarity determining region 3 for antibody 32158
ARGRRIAALSTAHYYYGMDV

SEQ ID NO: 64317 - protein, 9 aa, Homo sapiens
  light chain complementarity determining region 3 for antibody 32159
HHTSTFPPT

SEQ ID NO: 64318 - protein, 20 aa, Homo sapiens
  heavy chain complementarity determining region 3 for antibody 32159
ARGRRIAALSTAHYYYGMDV

SEQ ID NO: 64319 - protein, 10 aa, Homo sapiens
  light chain complementarity determining region 3 for antibody 32160
HHSGPSALIT

SEQ ID NO: 64320 - protein, 16 aa, Homo sapiens
  heavy chain complementarity determining region 3 for antibody 32160
IAIGTVSPWVYYALDV

SEQ ID NO: 64321 - protein, 9 aa, Homo sapiens
  light chain complementarity determining region 3 for antibody 32161
HHNSTFPRT

SEQ ID NO: 64322 - protein, 20 aa, Homo sapiens
  heavy chain complementarity determining region 3 for antibody 32161
ARGRRIAALSTAHYYYGMDV

SEQ ID NO: 64323 - protein, 9 aa, Homo sapiens
  light chain complementarity determining region 3 for antibody 32162
HHHGSSPRP

SEQ ID NO: 64324 - protein, 18 aa, Homo sapiens
  heavy chain complementarity determining region 3 for antibody 32162
AREVPDKRGSNSNPYADV

SEQ ID NO: 64325 - protein, 9 aa, Homo sapiens
  light chain complementarity determining region 3 for antibody 32163
GQYNSYPRT

SEQ ID NO: 64326 - protein, 6 aa, Homo sapiens
  heavy chain complementarity determining region 3 for antibody 32163
TRALDY

SEQ ID NO: 64327 - protein, 9 aa, Homo sapiens
  light chain complementarity determining region 3 for antibody 32164
GQYNRNPRT

SEQ ID NO: 64328 - protein, 6 aa, Homo sapiens
  heavy chain complementarity determining region 3 for antibody 32164
TRALDY

SEQ ID NO: 64329 - protein, 9 aa, Homo sapiens
  light chain complementarity determining region 3 for antibody 32165
GQNNRYPRT

SEQ ID NO: 64330 - protein, 6 aa, Homo sapiens
  heavy chain complementarity determining region 3 for antibody 32165
TRALDY

SEQ ID NO: 64331 - protein, 9 aa, Homo sapiens
  light chain complementarity determining region 3 for antibody 32166
FQYGWSPRA

SEQ ID NO: 64332 - protein, 14 aa, Homo sapiens
  heavy chain complementarity determining region 3 for antibody 32166
AKDAGAVAVHYFDH

SEQ ID NO: 64333 - protein, 9 aa, Homo sapiens
  light chain complementarity determining region 3 for antibody 32167
FQDGWSPRA

SEQ ID NO: 64334 - protein, 14 aa, Homo sapiens
  heavy chain complementarity determining region 3 for antibody 32167
AKDAGAVAVHYFDH

SEQ ID NO: 64335 - protein, 9 aa, Homo sapiens
  light chain complementarity determining region 3 for antibody 32168
EQYGSPPLT

SEQ ID NO: 64336 - protein, 13 aa, Homo sapiens
  heavy chain complementarity determining region 3 for antibody 32168
ASHSRGWYRVFDL

SEQ ID NO: 64337 - protein, 9 aa, Homo sapiens
  light chain complementarity determining region 3 for antibody 32169
EQYGSLPLT

SEQ ID NO: 64338 - protein, 15 aa, Homo sapiens
  heavy chain complementarity determining region 3 for antibody 32169
AHRPNYYDKAGAFDI

SEQ ID NO: 64339 - protein, 9 aa, Homo sapiens
  light chain complementarity determining region 3 for antibody 32170
AQNNRYPRT

SEQ ID NO: 64340 - protein, 6 aa, Homo sapiens
  heavy chain complementarity determining region 3 for antibody 32170
TRALDY

SEQ ID NO: 64341 - protein, 8 aa, Homo sapiens
  light chain complementarity determining region 3 for antibody 32171
QQYGGSPS

SEQ ID NO: 64342 - protein, 16 aa, Homo sapiens
  heavy chain complementarity determining region 3 for antibody 32171
ATDWGSGTQWIRAFDV

SEQ ID NO: 64343 - protein, 9 aa, Homo sapiens
  light chain complementarity determining region 3 for antibody 32172
QQYGSSPRT

SEQ ID NO: 64344 - protein, 25 aa, Homo sapiens
  heavy chain complementarity determining region 3 for antibody 32172
ARLRIDRLRLPGAMRGPLYDCGLNV

SEQ ID NO: 64345 - protein, 9 aa, Homo sapiens
  light chain complementarity determining region 3 for antibody 32173
QHSHSRPFT

SEQ ID NO: 64346 - protein, 20 aa, Homo sapiens
  heavy chain complementarity determining region 3 for antibody 32173
AKGIAVAALRTVYYYYGMDV

SEQ ID NO: 64347 - protein, 10 aa, Homo sapiens
  light chain complementarity determining region 3 for antibody 32174
QQRYKWPPYT

SEQ ID NO: 64348 - protein, 11 aa, Homo sapiens
  heavy chain complementarity determining region 3 for antibody 32174
ARGVGSYVFES

SEQ ID NO: 64349 - protein, 9 aa, Homo sapiens
  light chain complementarity determining region 3 for antibody 32175
LQHSISPRT

SEQ ID NO: 64350 - protein, 11 aa, Homo sapiens
  heavy chain complementarity determining region 3 for antibody 32175
TTGLGSGGINW

SEQ ID NO: 64351 - protein, 10 aa, Homo sapiens
  light chain complementarity determining region 3 for antibody 32176
QHWVSSPAYT

SEQ ID NO: 64352 - protein, 12 aa, Homo sapiens
  heavy chain complementarity determining region 3 for antibody 32176
ARETTQFGELDN

SEQ ID NO: 64353 - protein, 9 aa, Homo sapiens
  light chain complementarity determining region 3 for antibody 32177
MQALETPFT

SEQ ID NO: 64354 - protein, 15 aa, Homo sapiens
  heavy chain complementarity determining region 3 for antibody 32177
VRHYRETVAGIEGDS

SEQ ID NO: 64355 - protein, 9 aa, Homo sapiens
  light chain complementarity determining region 3 for antibody 32178
QQYGSSPRT

SEQ ID NO: 64356 - protein, 17 aa, Homo sapiens
  heavy chain complementarity determining region 3 for antibody 32178
ARALDIVVVVDAIWFDP

SEQ ID NO: 64357 - protein, 8 aa, Homo sapiens
  light chain complementarity determining region 3 for antibody 32179
QQYNSLYT

SEQ ID NO: 64358 - protein, 14 aa, Homo sapiens
  heavy chain complementarity determining region 3 for antibody 32179
ARENSISRKRSFDQ

SEQ ID NO: 64359 - protein, 9 aa, Homo sapiens
  light chain complementarity determining region 3 for antibody 32180
QQYGTSPLN

SEQ ID NO: 64360 - protein, 13 aa, Homo sapiens
  heavy chain complementarity determining region 3 for antibody 32180
ASISVGTVAAGKG

SEQ ID NO: 64361 - protein, 9 aa, Homo sapiens
  light chain complementarity determining region 3 for antibody 32181
QQSYSSLLT

SEQ ID NO: 64362 - protein, 16 aa, Homo sapiens
  heavy chain complementarity determining region 3 for antibody 32181
AREGGSTYTTKRAFDS

SEQ ID NO: 64363 - protein, 9 aa, Homo sapiens
  light chain complementarity determining region 3 for antibody 32182
QQYNSYSVT

SEQ ID NO: 64364 - protein, 17 aa, Homo sapiens
  heavy chain complementarity determining region 3 for antibody 32182
VKESWQWLVDYYYGMDV

SEQ ID NO: 64365 - protein, 9 aa, Homo sapiens
  light chain complementarity determining region 3 for antibody 32183
MQGLQTPYT

SEQ ID NO: 64366 - protein, 10 aa, Homo sapiens
  heavy chain complementarity determining region 3 for antibody 32183
ARDVVGSDDQ

SEQ ID NO: 64367 - protein, 9 aa, Homo sapiens
  light chain complementarity determining region 3 for antibody 32184
QHTHTFPRT

SEQ ID NO: 64368 - protein, 20 aa, Homo sapiens
  heavy chain complementarity determining region 3 for antibody 32184
GRGRRIAALSTAHYYYGMDV

SEQ ID NO: 64369 - protein, 9 aa, Homo sapiens
  light chain complementarity determining region 3 for antibody 32185
LQHNSYPLT

SEQ ID NO: 64370 - protein, 17 aa, Homo sapiens
  heavy chain complementarity determining region 3 for antibody 32185
ARGTRRGYCSAGSCYGY

SEQ ID NO: 64371 - protein, 9 aa, Homo sapiens
  light chain complementarity determining region 3 for antibody 32186
QQYNGYSRT

SEQ ID NO: 64372 - protein, 18 aa, Homo sapiens
  heavy chain complementarity determining region 3 for antibody 32186
ARDFGGRAYTKVENAFDI

SEQ ID NO: 64373 - protein, 9 aa, Homo sapiens
  light chain complementarity determining region 3 for antibody 32187
LQHYNFPWT

SEQ ID NO: 64374 - protein, 12 aa, Homo sapiens
  heavy chain complementarity determining region 3 for antibody 32187
ARHLRVPERLDS

SEQ ID NO: 64375 - protein, 9 aa, Homo sapiens
  light chain complementarity determining region 3 for antibody 32188
LQDYDYPLT

SEQ ID NO: 64376 - protein, 18 aa, Homo sapiens
  heavy chain complementarity determining region 3 for antibody 32188
ARSLYHSVSGAYYDAFDI

SEQ ID NO: 64377 - protein, 10 aa, Homo sapiens
  light chain complementarity determining region 3 for antibody 32189
QQYGSSPMYS

SEQ ID NO: 64378 - protein, 11 aa, Homo sapiens
  heavy chain complementarity determining region 3 for antibody 32189
ARGGQWGSLDY

SEQ ID NO: 64379 - protein, 9 aa, Homo sapiens
  light chain complementarity determining region 3 for antibody 32190
MQALQTPYT

SEQ ID NO: 64380 - protein, 21 aa, Homo sapiens
  heavy chain complementarity determining region 3 for antibody 32190
ARDAPVSRPYSSGWYSSAFDY

SEQ ID NO: 64381 - protein, 10 aa, Homo sapiens
  light chain complementarity determining region 3 for antibody 32191
QQYGSSPPLT

SEQ ID NO: 64382 - protein, 18 aa, Homo sapiens
  heavy chain complementarity determining region 3 for antibody 32191
ARGGYDYGWGSYGVYFDY

SEQ ID NO: 64383 - protein, 9 aa, Homo sapiens
  light chain complementarity determining region 3 for antibody 32192
QQYGSLPLT

SEQ ID NO: 64384 - protein, 15 aa, Homo sapiens
  heavy chain complementarity determining region 3 for antibody 32192
AHRPNYYDKAGAFDI

SEQ ID NO: 64385 - protein, 9 aa, Homo sapiens
  light chain complementarity determining region 3 for antibody 32193
QQYDNLPVT

SEQ ID NO: 64386 - protein, 10 aa, Homo sapiens
  heavy chain complementarity determining region 3 for antibody 32193
ASGGGHTYGY

SEQ ID NO: 64387 - protein, 9 aa, Homo sapiens
  light chain complementarity determining region 3 for antibody 32194
VQYNRYPRT

SEQ ID NO: 64388 - protein, 6 aa, Homo sapiens
  heavy chain complementarity determining region 3 for antibody 32194
TRALDY

SEQ ID NO: 64389 - protein, 9 aa, Homo sapiens
  light chain complementarity determining region 3 for antibody 32195
QQSYTSPYT

SEQ ID NO: 64390 - protein, 16 aa, Homo sapiens
  heavy chain complementarity determining region 3 for antibody 32195
ATDWGSGTQWIRAFDV

SEQ ID NO: 64391 - protein, 9 aa, Homo sapiens
  light chain complementarity determining region 3 for antibody 32196
MQGLQTPYT

SEQ ID NO: 64392 - protein, 10 aa, Homo sapiens
  heavy chain complementarity determining region 3 for antibody 32196
GRDLSGARDY

SEQ ID NO: 64393 - protein, 10 aa, Homo sapiens
  light chain complementarity determining region 3 for antibody 32197
QQRYNWPPYT

SEQ ID NO: 64394 - protein, 11 aa, Homo sapiens
  heavy chain complementarity determining region 3 for antibody 32197
ARGVGSYVFES

SEQ ID NO: 64395 - protein, 9 aa, Homo sapiens
  light chain complementarity determining region 3 for antibody 32198
QQYGTSPFT

SEQ ID NO: 64396 - protein, 14 aa, Homo sapiens
  heavy chain complementarity determining region 3 for antibody 32198
ARGGPAATSSSWLY

SEQ ID NO: 64397 - protein, 9 aa, Homo sapiens
  light chain complementarity determining region 3 for antibody 32199
QHYNIYSET

SEQ ID NO: 64398 - protein, 8 aa, Homo sapiens
  heavy chain complementarity determining region 3 for antibody 32199
ATSPQRGS

SEQ ID NO: 64399 - protein, 9 aa, Homo sapiens
  light chain complementarity determining region 3 for antibody 32200
QQRSSWPYT

SEQ ID NO: 64400 - protein, 11 aa, Homo sapiens
  heavy chain complementarity determining region 3 for antibody 32200
VKRWGGSSIDY

SEQ ID NO: 64401 - protein, 9 aa, Homo sapiens
  light chain complementarity determining region 3 for antibody 32201
QQYSSSPPS

SEQ ID NO: 64402 - protein, 19 aa, Homo sapiens
  heavy chain complementarity determining region 3 for antibody 32201
ARAGGNYYDRTSYYGPFDY

SEQ ID NO: 64403 - protein, 9 aa, Homo sapiens
  light chain complementarity determining region 3 for antibody 32202
LQVVSFPRT

SEQ ID NO: 64404 - protein, 8 aa, Homo sapiens
  heavy chain complementarity determining region 3 for antibody 32202
ARNSGWYD

SEQ ID NO: 64405 - protein, 9 aa, Homo sapiens
  light chain complementarity determining region 3 for antibody 32203
QQYYTSLRT

SEQ ID NO: 64406 - protein, 12 aa, Homo sapiens
  heavy chain complementarity determining region 3 for antibody 32203
VKDCGLGGSRDS

SEQ ID NO: 64407 - protein, 9 aa, Homo sapiens
  light chain complementarity determining region 3 for antibody 32204
QQYFSHVYT

SEQ ID NO: 64408 - protein, 18 aa, Homo sapiens
  heavy chain complementarity determining region 3 for antibody 32204
AQERDGYCDSHACYGLDV

SEQ ID NO: 64409 - protein, 9 aa, Homo sapiens
  light chain complementarity determining region 3 for antibody 32205
MQALETPFT

SEQ ID NO: 64410 - protein, 15 aa, Homo sapiens
  heavy chain complementarity determining region 3 for antibody 32205
VRHYRIITAPLEGDS

SEQ ID NO: 64411 - protein, 8 aa, Homo sapiens
  light chain complementarity determining region 3 for antibody 32206
QQSYSALT

SEQ ID NO: 64412 - protein, 24 aa, Homo sapiens
  heavy chain complementarity determining region 3 for antibody 32206
ARGRPPSGWYRLKDRTYYYYGLDV

SEQ ID NO: 64413 - protein, 10 aa, Homo sapiens
  light chain complementarity determining region 3 for antibody 32207
QHYGSSLMYT

SEQ ID NO: 64414 - protein, 14 aa, Homo sapiens
  heavy chain complementarity determining region 3 for antibody 32207
TTDRPLTGMVTFDF

SEQ ID NO: 64415 - protein, 9 aa, Homo sapiens
  light chain complementarity determining region 3 for antibody 32208
MQGTHWPLT

SEQ ID NO: 64416 - protein, 19 aa, Homo sapiens
  heavy chain complementarity determining region 3 for antibody 32208
VRDDRDHCSGGSCEGYFDD

SEQ ID NO: 64417 - protein, 9 aa, Homo sapiens
  light chain complementarity determining region 3 for antibody 32209
QQYGTSPFT

SEQ ID NO: 64418 - protein, 15 aa, Homo sapiens
  heavy chain complementarity determining region 3 for antibody 32209
ARQNDFLSGPGEFDP

SEQ ID NO: 64419 - protein, 9 aa, Homo sapiens
  light chain complementarity determining region 3 for antibody 32210
QQYGNSPRT

SEQ ID NO: 64420 - protein, 16 aa, Homo sapiens
  heavy chain complementarity determining region 3 for antibody 32210
ARGTFYQGSSDNYHEN

SEQ ID NO: 64421 - protein, 9 aa, Homo sapiens
  light chain complementarity determining region 3 for antibody 32211
KQYYTTPLT

SEQ ID NO: 64422 - protein, 14 aa, Homo sapiens
  heavy chain complementarity determining region 3 for antibody 32211
AKDRIAVGISVWEY

SEQ ID NO: 64423 - protein, 9 aa, Homo sapiens
  light chain complementarity determining region 3 for antibody 32212
QQYYTTPRT

SEQ ID NO: 64424 - protein, 8 aa, Homo sapiens
  heavy chain complementarity determining region 3 for antibody 32212
ARDGAFDS

SEQ ID NO: 64425 - protein, 9 aa, Homo sapiens
  light chain complementarity determining region 3 for antibody 32213
QQYGNSPFT

SEQ ID NO: 64426 - protein, 15 aa, Homo sapiens
  heavy chain complementarity determining region 3 for antibody 32213
ARQKGQRASAGYFDS

SEQ ID NO: 64427 - protein, 9 aa, Homo sapiens
  light chain complementarity determining region 3 for antibody 32214
QQYGRTPRT

SEQ ID NO: 64428 - protein, 14 aa, Homo sapiens
  heavy chain complementarity determining region 3 for antibody 32214
AGGDFCGADCYSEY

SEQ ID NO: 64429 - protein, 9 aa, Homo sapiens
  light chain complementarity determining region 3 for antibody 32215
QQYRRSPST

SEQ ID NO: 64430 - protein, 17 aa, Homo sapiens
  heavy chain complementarity determining region 3 for antibody 32215
AGLSSRLGDGSPSLFDY

SEQ ID NO: 64431 - protein, 10 aa, Homo sapiens
  light chain complementarity determining region 3 for antibody 32216
QQYGNSPPFT

SEQ ID NO: 64432 - protein, 13 aa, Homo sapiens
  heavy chain complementarity determining region 3 for antibody 32216
ASWSHSDLDAFDI

SEQ ID NO: 64433 - protein, 9 aa, Homo sapiens
  light chain complementarity determining region 3 for antibody 32217
MQALQTPFT

SEQ ID NO: 64434 - protein, 13 aa, Homo sapiens
  heavy chain complementarity determining region 3 for antibody 32217
ARAITKAGSGFDY

SEQ ID NO: 64435 - protein, 9 aa, Homo sapiens
  light chain complementarity determining region 3 for antibody 32218
QQYGTPPRT

SEQ ID NO: 64436 - protein, 25 aa, Homo sapiens
  heavy chain complementarity determining region 3 for antibody 32218
ARLRVDRLRLPGAMRGPLYDRGLNV

SEQ ID NO: 64437 - protein, 8 aa, Homo sapiens
  light chain complementarity determining region 3 for antibody 32219
QQRSNWPA

SEQ ID NO: 64438 - protein, 20 aa, Homo sapiens
  heavy chain complementarity determining region 3 for antibody 32219
ARVWFGERTRGYYYYYGMDV

SEQ ID NO: 64439 - protein, 8 aa, Homo sapiens
  light chain complementarity determining region 3 for antibody 32220
QQYNSYSS

SEQ ID NO: 64440 - protein, 18 aa, Homo sapiens
  heavy chain complementarity determining region 3 for antibody 32220
ARSWKVVVASGAVRYFDY

SEQ ID NO: 64441 - protein, 9 aa, Homo sapiens
  light chain complementarity determining region 3 for antibody 32221
QQSFSPPWT

SEQ ID NO: 64442 - protein, 13 aa, Homo sapiens
  heavy chain complementarity determining region 3 for antibody 32221
ARVVSAAVDFFDF

SEQ ID NO: 64443 - protein, 9 aa, Homo sapiens
  light chain complementarity determining region 3 for antibody 32222
QQYGNLPRT

SEQ ID NO: 64444 - protein, 13 aa, Homo sapiens
  heavy chain complementarity determining region 3 for antibody 32222
AGGNFHSGGYGEY

SEQ ID NO: 64445 - protein, 10 aa, Homo sapiens
  light chain complementarity determining region 3 for antibody 32223
QQYNNWPPLT

SEQ ID NO: 64446 - protein, 15 aa, Homo sapiens
  heavy chain complementarity determining region 3 for antibody 32223
ARYYYDSSGYYVFDY

SEQ ID NO: 64447 - protein, 10 aa, Homo sapiens
  light chain complementarity determining region 3 for antibody 32224
QQYGSSSMYT

SEQ ID NO: 64448 - protein, 19 aa, Homo sapiens
  heavy chain complementarity determining region 3 for antibody 32224
AKDQLMFYYDNSGYPGADY

SEQ ID NO: 64449 - protein, 9 aa, Homo sapiens
  light chain complementarity determining region 3 for antibody 32225
HHTSTFPRT

SEQ ID NO: 64450 - protein, 20 aa, Homo sapiens
  heavy chain complementarity determining region 3 for antibody 32225
ARGRRIAALSTAHYYYGMDV

SEQ ID NO: 64451 - protein, 9 aa, Homo sapiens
  light chain complementarity determining region 3 for antibody 32226
QQGYSPPFI

SEQ ID NO: 64452 - protein, 15 aa, Homo sapiens
  heavy chain complementarity determining region 3 for antibody 32226
ARAQVIWGQLYYFDS

SEQ ID NO: 64453 - protein, 10 aa, Homo sapiens
  light chain complementarity determining region 3 for antibody 32227
QHFDNLPMFT

SEQ ID NO: 64454 - protein, 16 aa, Homo sapiens
  heavy chain complementarity determining region 3 for antibody 32227
ARVPRGSYASGTLFDY

SEQ ID NO: 64455 - protein, 9 aa, Homo sapiens
  light chain complementarity determining region 3 for antibody 32228
QQYHSHPRT

SEQ ID NO: 64456 - protein, 18 aa, Homo sapiens
  heavy chain complementarity determining region 3 for antibody 32228
AREFLRYFDSSKAYNFDD

SEQ ID NO: 64457 - protein, 10 aa, Homo sapiens
  light chain complementarity determining region 3 for antibody 32229
QCRDEWPPVI

SEQ ID NO: 64458 - protein, 12 aa, Homo sapiens
  heavy chain complementarity determining region 3 for antibody 32229
VRDHITGWKFDY

SEQ ID NO: 64459 - protein, 9 aa, Homo sapiens
  light chain complementarity determining region 3 for antibody 32230
QQYNSYRRT

SEQ ID NO: 64460 - protein, 9 aa, Homo sapiens
  heavy chain complementarity determining region 3 for antibody 32230
AKGSSALEY

SEQ ID NO: 64461 - protein, 9 aa, Homo sapiens
  light chain complementarity determining region 3 for antibody 32231
LQNEYWPRT

SEQ ID NO: 64462 - protein, 11 aa, Homo sapiens
  heavy chain complementarity determining region 3 for antibody 32231
VRVGGAGYFDH

SEQ ID NO: 64463 - protein, 9 aa, Homo sapiens
  light chain complementarity determining region 3 for antibody 32232
QQYGTSPLT

SEQ ID NO: 64464 - protein, 14 aa, Homo sapiens
  heavy chain complementarity determining region 3 for antibody 32232
ARDMFRGVPDYLDY

SEQ ID NO: 64465 - protein, 8 aa, Homo sapiens
  light chain complementarity determining region 3 for antibody 32233
QQYDNSRT

SEQ ID NO: 64466 - protein, 15 aa, Homo sapiens
  heavy chain complementarity determining region 3 for antibody 32233
AKTDYCSAGNCPFDS

SEQ ID NO: 64467 - protein, 9 aa, Homo sapiens
  light chain complementarity determining region 3 for antibody 32234
QQHNFYPIT

SEQ ID NO: 64468 - protein, 11 aa, Homo sapiens
  heavy chain complementarity determining region 3 for antibody 32234
ARGGSRREIDY

SEQ ID NO: 64469 - protein, 9 aa, Homo sapiens
  light chain complementarity determining region 3 for antibody 32235
QQVISYPFT

SEQ ID NO: 64470 - protein, 12 aa, Homo sapiens
  heavy chain complementarity determining region 3 for antibody 32235
ARPLDGDHGFDP

SEQ ID NO: 64471 - protein, 8 aa, Homo sapiens
  light chain complementarity determining region 3 for antibody 32236
QQYSDFNT

SEQ ID NO: 64472 - protein, 17 aa, Homo sapiens
  heavy chain complementarity determining region 3 for antibody 32236
AHRRYYNGNWNGATFDV

SEQ ID NO: 64473 - protein, 8 aa, Homo sapiens
  light chain complementarity determining region 3 for antibody 32237
QQYGGSPR

SEQ ID NO: 64474 - protein, 16 aa, Homo sapiens
  heavy chain complementarity determining region 3 for antibody 32237
ATDWGSGTQWIRAFDV

SEQ ID NO: 64475 - protein, 8 aa, Homo sapiens
  light chain complementarity determining region 3 for antibody 32238
QQSHSART

SEQ ID NO: 64476 - protein, 19 aa, Homo sapiens
  heavy chain complementarity determining region 3 for antibody 32238
AREGARGGGTTTPHWYFDL

SEQ ID NO: 64477 - protein, 9 aa, Homo sapiens
  light chain complementarity determining region 3 for antibody 32239
QQSNRTPYT

SEQ ID NO: 64478 - protein, 14 aa, Homo sapiens
  heavy chain complementarity determining region 3 for antibody 32239
ATEGPSRMGKFFDS

SEQ ID NO: 64479 - protein, 9 aa, Homo sapiens
  light chain complementarity determining region 3 for antibody 32240
QQYGRSSLT

SEQ ID NO: 64480 - protein, 19 aa, Homo sapiens
  heavy chain complementarity determining region 3 for antibody 32240
ARDRIVVGATFYSYSGMDV

SEQ ID NO: 64481 - protein, 9 aa, Homo sapiens
  light chain complementarity determining region 3 for antibody 32241
QQYGSIPRS

SEQ ID NO: 64482 - protein, 13 aa, Homo sapiens
  heavy chain complementarity determining region 3 for antibody 32241
AGGTWHSGIYYES

SEQ ID NO: 64483 - protein, 9 aa, Homo sapiens
  light chain complementarity determining region 3 for antibody 32242
QQYGRSPRT

SEQ ID NO: 64484 - protein, 15 aa, Homo sapiens
  heavy chain complementarity determining region 3 for antibody 32242
AKDGPYCGGDCYFDS

SEQ ID NO: 64485 - protein, 8 aa, Homo sapiens
  light chain complementarity determining region 3 for antibody 32243
QQGYNWVI

SEQ ID NO: 64486 - protein, 21 aa, Homo sapiens
  heavy chain complementarity determining region 3 for antibody 32243
ARNDPDNTQGGHTSGNKYLDQ

SEQ ID NO: 64487 - protein, 9 aa, Homo sapiens
  light chain complementarity determining region 3 for antibody 32244
QQYGSPPRT

SEQ ID NO: 64488 - protein, 14 aa, Homo sapiens
  heavy chain complementarity determining region 3 for antibody 32244
AGGNFCGYDCYSEY

SEQ ID NO: 64489 - protein, 8 aa, Homo sapiens
  light chain complementarity determining region 3 for antibody 32245
QQYNNWWT

SEQ ID NO: 64490 - protein, 10 aa, Homo sapiens
  heavy chain complementarity determining region 3 for antibody 32245
ARAGFGAFDI

SEQ ID NO: 64491 - protein, 9 aa, Homo sapiens
  light chain complementarity determining region 3 for antibody 32246
QKYNSAPLT

SEQ ID NO: 64492 - protein, 20 aa, Homo sapiens
  heavy chain complementarity determining region 3 for antibody 32246
ATVLRGRGSSVYYVGGAFDI

SEQ ID NO: 64493 - protein, 9 aa, Homo sapiens
  light chain complementarity determining region 3 for antibody 32247
LQHDNFPRT

SEQ ID NO: 64494 - protein, 17 aa, Homo sapiens
  heavy chain complementarity determining region 3 for antibody 32247
ARGSAARHLVHYNWFDP

SEQ ID NO: 64495 - protein, 9 aa, Homo sapiens
  light chain complementarity determining region 3 for antibody 32248
QQYGGSPRT

SEQ ID NO: 64496 - protein, 13 aa, Homo sapiens
  heavy chain complementarity determining region 3 for antibody 32248
ASGYFDSGAYYEF

SEQ ID NO: 64497 - protein, 9 aa, Homo sapiens
  light chain complementarity determining region 3 for antibody 32249
QQYNNWPFT

SEQ ID NO: 64498 - protein, 13 aa, Homo sapiens
  heavy chain complementarity determining region 3 for antibody 32249
ARAGWEFFTWFDS

SEQ ID NO: 64499 - protein, 9 aa, Homo sapiens
  light chain complementarity determining region 3 for antibody 32250
QQGYSSPLI

SEQ ID NO: 64500 - protein, 15 aa, Homo sapiens
  heavy chain complementarity determining region 3 for antibody 32250
ARAQVIWGQLYYFDY

SEQ ID NO: 64501 - protein, 9 aa, Homo sapiens
  light chain complementarity determining region 3 for antibody 32251
QQYHALPLT

SEQ ID NO: 64502 - protein, 13 aa, Homo sapiens
  heavy chain complementarity determining region 3 for antibody 32251
ARDGVPGKFNRAH

SEQ ID NO: 64503 - protein, 9 aa, Homo sapiens
  light chain complementarity determining region 3 for antibody 32252
QQYGTIPRT

SEQ ID NO: 64504 - protein, 13 aa, Homo sapiens
  heavy chain complementarity determining region 3 for antibody 32252
AGGNFHRSGYAEY

SEQ ID NO: 64505 - protein, 9 aa, Homo sapiens
  light chain complementarity determining region 3 for antibody 32253
QQSYSSLYT

SEQ ID NO: 64506 - protein, 15 aa, Homo sapiens
  heavy chain complementarity determining region 3 for antibody 32253
TRGNSGNYLVRAFDI

SEQ ID NO: 64507 - protein, 9 aa, Homo sapiens
  light chain complementarity determining region 3 for antibody 32254
QQYAYSPIT

SEQ ID NO: 64508 - protein, 10 aa, Homo sapiens
  heavy chain complementarity determining region 3 for antibody 32254
ATGAGWLVDY

SEQ ID NO: 64509 - protein, 9 aa, Homo sapiens
  light chain complementarity determining region 3 for antibody 32255
LQYKSYPRT

SEQ ID NO: 64510 - protein, 6 aa, Homo sapiens
  heavy chain complementarity determining region 3 for antibody 32255
SRALDY

SEQ ID NO: 64511 - protein, 9 aa, Homo sapiens
  light chain complementarity determining region 3 for antibody 32256
HQYGSSPWT

SEQ ID NO: 64512 - protein, 9 aa, Homo sapiens
  heavy chain complementarity determining region 3 for antibody 32256
ARAYGPADY

SEQ ID NO: 64513 - protein, 9 aa, Homo sapiens
  light chain complementarity determining region 3 for antibody 32257
QQYGSSPTT

SEQ ID NO: 64514 - protein, 17 aa, Homo sapiens
  heavy chain complementarity determining region 3 for antibody 32257
ARDLGTYDATRHWYFDL

SEQ ID NO: 64515 - protein, 9 aa, Homo sapiens
  light chain complementarity determining region 3 for antibody 32258
QKYNSAPLT

SEQ ID NO: 64516 - protein, 11 aa, Homo sapiens
  heavy chain complementarity determining region 3 for antibody 32258
ATKFKGAPLDY

SEQ ID NO: 64517 - protein, 9 aa, Homo sapiens
  light chain complementarity determining region 3 for antibody 32259
MQGTHWPWT

SEQ ID NO: 64518 - protein, 10 aa, Homo sapiens
  heavy chain complementarity determining region 3 for antibody 32259
ARETHWGPDY

SEQ ID NO: 64519 - protein, 8 aa, Homo sapiens
  light chain complementarity determining region 3 for antibody 32260
QQYGTSRM

SEQ ID NO: 64520 - protein, 13 aa, Homo sapiens
  heavy chain complementarity determining region 3 for antibody 32260
ARGQFVGSAYYEN

SEQ ID NO: 64521 - protein, 8 aa, Homo sapiens
  light chain complementarity determining region 3 for antibody 32261
QQRSNWLS

SEQ ID NO: 64522 - protein, 13 aa, Homo sapiens
  heavy chain complementarity determining region 3 for antibody 32261
AKERLRSQSDLDY

SEQ ID NO: 64523 - protein, 9 aa, Homo sapiens
  light chain complementarity determining region 3 for antibody 32262
QQYATSLGT

SEQ ID NO: 64524 - protein, 15 aa, Homo sapiens
  heavy chain complementarity determining region 3 for antibody 32262
ARQKVRGRMRDHFDM

SEQ ID NO: 64525 - protein, 11 aa, Homo sapiens
  light chain complementarity determining region 3 for antibody 32263
QKYGTAPPGIA

SEQ ID NO: 64526 - protein, 12 aa, Homo sapiens
  heavy chain complementarity determining region 3 for antibody 32263
AKKIGNFDVLDV

SEQ ID NO: 64527 - protein, 9 aa, Homo sapiens
  light chain complementarity determining region 3 for antibody 32264
QQYDTPPWT

SEQ ID NO: 64528 - protein, 13 aa, Homo sapiens
  heavy chain complementarity determining region 3 for antibody 32264
ARETRIHLPAFEY

SEQ ID NO: 64529 - protein, 10 aa, Homo sapiens
  light chain complementarity determining region 3 for antibody 32265
QQYDDLLPIT

SEQ ID NO: 64530 - protein, 12 aa, Homo sapiens
  heavy chain complementarity determining region 3 for antibody 32265
ARDVTGTRLFDF

SEQ ID NO: 64531 - protein, 9 aa, Homo sapiens
  light chain complementarity determining region 3 for antibody 32266
QQGYRPPFI

SEQ ID NO: 64532 - protein, 15 aa, Homo sapiens
  heavy chain complementarity determining region 3 for antibody 32266
TRAQVIWGQLYYFDY

SEQ ID NO: 64533 - protein, 9 aa, Homo sapiens
  light chain complementarity determining region 3 for antibody 32267
QQYGNLPRT

SEQ ID NO: 64534 - protein, 13 aa, Homo sapiens
  heavy chain complementarity determining region 3 for antibody 32267
AGGDFHSGGYSEF

SEQ ID NO: 64535 - protein, 9 aa, Homo sapiens
  light chain complementarity determining region 3 for antibody 32268
LHLHSFPLT

SEQ ID NO: 64536 - protein, 15 aa, Homo sapiens
  heavy chain complementarity determining region 3 for antibody 32268
ARAGAYSGGRYYFDY

SEQ ID NO: 64537 - protein, 9 aa, Homo sapiens
  light chain complementarity determining region 3 for antibody 32269
QQYAKSPWT

SEQ ID NO: 64538 - protein, 13 aa, Homo sapiens
  heavy chain complementarity determining region 3 for antibody 32269
ARDSADYGDPLDY

SEQ ID NO: 64539 - protein, 8 aa, Homo sapiens
  light chain complementarity determining region 3 for antibody 32270
QKYGSSPL

SEQ ID NO: 64540 - protein, 14 aa, Homo sapiens
  heavy chain complementarity determining region 3 for antibody 32270
ARDMWDVGDTPPSY

SEQ ID NO: 64541 - protein, 9 aa, Homo sapiens
  light chain complementarity determining region 3 for antibody 32271
MQATHWPWT

SEQ ID NO: 64542 - protein, 12 aa, Homo sapiens
  heavy chain complementarity determining region 3 for antibody 32271
AADCSSASCPGY

SEQ ID NO: 64543 - protein, 8 aa, Homo sapiens
  light chain complementarity determining region 3 for antibody 32272
QQHVSSVS

SEQ ID NO: 64544 - protein, 13 aa, Homo sapiens
  heavy chain complementarity determining region 3 for antibody 32272
VRTWFGELSHFDY

SEQ ID NO: 64545 - protein, 9 aa, Homo sapiens
  light chain complementarity determining region 3 for antibody 32273
QHRRTWLYS

SEQ ID NO: 64546 - protein, 20 aa, Homo sapiens
  heavy chain complementarity determining region 3 for antibody 32273
ARDGSAGMAARGTPYYGLDV

SEQ ID NO: 64547 - protein, 9 aa, Homo sapiens
  light chain complementarity determining region 3 for antibody 32274
HQYGESPRM

SEQ ID NO: 64548 - protein, 16 aa, Homo sapiens
  heavy chain complementarity determining region 3 for antibody 32274
AKSLGVDAMTTRVYDS

SEQ ID NO: 64549 - protein, 10 aa, Homo sapiens
  light chain complementarity determining region 3 for antibody 32275
QQRYNWPPFT

SEQ ID NO: 64550 - protein, 11 aa, Homo sapiens
  heavy chain complementarity determining region 3 for antibody 32275
ARGVGSYPFDS

SEQ ID NO: 64551 - protein, 9 aa, Homo sapiens
  light chain complementarity determining region 3 for antibody 32276
QQFDELPIT

SEQ ID NO: 64552 - protein, 9 aa, Homo sapiens
  heavy chain complementarity determining region 3 for antibody 32276
ARSTHPRGP

SEQ ID NO: 64553 - protein, 9 aa, Homo sapiens
  light chain complementarity determining region 3 for antibody 32277
HQRSDWPET

SEQ ID NO: 64554 - protein, 9 aa, Homo sapiens
  heavy chain complementarity determining region 3 for antibody 32277
ASGDYAFDL

SEQ ID NO: 64555 - protein, 9 aa, Homo sapiens
  light chain complementarity determining region 3 for antibody 32278
QQRLNWPLT

SEQ ID NO: 64556 - protein, 11 aa, Homo sapiens
  heavy chain complementarity determining region 3 for antibody 32278
ARNILGGHTDF

SEQ ID NO: 64557 - protein, 9 aa, Homo sapiens
  light chain complementarity determining region 3 for antibody 32279
MQHTHWPWT

SEQ ID NO: 64558 - protein, 12 aa, Homo sapiens
  heavy chain complementarity determining region 3 for antibody 32279
ATSPHRDSRSSY

SEQ ID NO: 64559 - protein, 9 aa, Homo sapiens
  light chain complementarity determining region 3 for antibody 32280
QQRSNWPWT

SEQ ID NO: 64560 - protein, 20 aa, Homo sapiens
  heavy chain complementarity determining region 3 for antibody 32280
ARASPVYCSGGSCYYYGMDV

SEQ ID NO: 64561 - protein, 8 aa, Homo sapiens
  light chain complementarity determining region 3 for antibody 32281
QQYGTSWT

SEQ ID NO: 64562 - protein, 21 aa, Homo sapiens
  heavy chain complementarity determining region 3 for antibody 32281
GRQRNFEGDSGFKFPEGYFDL

SEQ ID NO: 64563 - protein, 9 aa, Homo sapiens
  light chain complementarity determining region 3 for antibody 32282
MQGTHWPLT

SEQ ID NO: 64564 - protein, 17 aa, Homo sapiens
  heavy chain complementarity determining region 3 for antibody 32282
ARDDRAAAAGGEYYFDL

SEQ ID NO: 64565 - protein, 8 aa, Homo sapiens
  light chain complementarity determining region 3 for antibody 32283
QHYDGPWT

SEQ ID NO: 64566 - protein, 11 aa, Homo sapiens
  heavy chain complementarity determining region 3 for antibody 32283
AASSYYGVFHY

SEQ ID NO: 64567 - protein, 10 aa, Homo sapiens
  light chain complementarity determining region 3 for antibody 32284
QQYNNWPRYT

SEQ ID NO: 64568 - protein, 14 aa, Homo sapiens
  heavy chain complementarity determining region 3 for antibody 32284
ARLGEGYSYGPSDY

SEQ ID NO: 64569 - protein, 9 aa, Homo sapiens
  light chain complementarity determining region 3 for antibody 32285
QKYNSVPPT

SEQ ID NO: 64570 - protein, 14 aa, Homo sapiens
  heavy chain complementarity determining region 3 for antibody 32285
ARDPSYGGFYYFDS

SEQ ID NO: 64571 - protein, 9 aa, Homo sapiens
  light chain complementarity determining region 3 for antibody 32286
QQHNDYPWT

SEQ ID NO: 64572 - protein, 10 aa, Homo sapiens
  heavy chain complementarity determining region 3 for antibody 32286
ARDYEAALDY

SEQ ID NO: 64573 - protein, 9 aa, Homo sapiens
  light chain complementarity determining region 3 for antibody 32287
QQRTNWRFT

SEQ ID NO: 64574 - protein, 16 aa, Homo sapiens
  heavy chain complementarity determining region 3 for antibody 32287
ARDQGYCLGTNCYLLH

SEQ ID NO: 64575 - protein, 10 aa, Homo sapiens
  light chain complementarity determining region 3 for antibody 32288
MQGTHWPPWT

SEQ ID NO: 64576 - protein, 7 aa, Homo sapiens
  heavy chain complementarity determining region 3 for antibody 32288
VRGTFDI

SEQ ID NO: 64577 - protein, 9 aa, Homo sapiens
  light chain complementarity determining region 3 for antibody 32289
QQYGTSPLT

SEQ ID NO: 64578 - protein, 14 aa, Homo sapiens
  heavy chain complementarity determining region 3 for antibody 32289
AHRSYNSGRGAFDI

SEQ ID NO: 64579 - protein, 9 aa, Homo sapiens
  light chain complementarity determining region 3 for antibody 32290
QQLKSYPPT

SEQ ID NO: 64580 - protein, 14 aa, Homo sapiens
  heavy chain complementarity determining region 3 for antibody 32290
ARENSVAAARAYDY

SEQ ID NO: 64581 - protein, 9 aa, Homo sapiens
  light chain complementarity determining region 3 for antibody 32291
QHYHNWPRT

SEQ ID NO: 64582 - protein, 16 aa, Homo sapiens
  heavy chain complementarity determining region 3 for antibody 32291
AKDGGDYYDSFEYFQY

SEQ ID NO: 64583 - protein, 9 aa, Homo sapiens
  light chain complementarity determining region 3 for antibody 32292
MQGTHRPPT

SEQ ID NO: 64584 - protein, 16 aa, Homo sapiens
  heavy chain complementarity determining region 3 for antibody 32292
ATDWGSGTQWIRAFDV

SEQ ID NO: 64585 - protein, 9 aa, Homo sapiens
  light chain complementarity determining region 3 for antibody 32293
MQGLQTPYT

SEQ ID NO: 64586 - protein, 10 aa, Homo sapiens
  heavy chain complementarity determining region 3 for antibody 32293
GSDLTGARDH

SEQ ID NO: 64587 - protein, 8 aa, Homo sapiens
  light chain complementarity determining region 3 for antibody 32294
QQRDDWVT

SEQ ID NO: 64588 - protein, 14 aa, Homo sapiens
  heavy chain complementarity determining region 3 for antibody 32294
ARETSNYGGYVLHF

SEQ ID NO: 64589 - protein, 9 aa, Homo sapiens
  light chain complementarity determining region 3 for antibody 32295
QQCVASPWT

SEQ ID NO: 64590 - protein, 15 aa, Homo sapiens
  heavy chain complementarity determining region 3 for antibody 32295
ASPPVGDVPNGVFDI

SEQ ID NO: 64591 - protein, 9 aa, Homo sapiens
  light chain complementarity determining region 3 for antibody 32296
MQGTYWPHI

SEQ ID NO: 64592 - protein, 11 aa, Homo sapiens
  heavy chain complementarity determining region 3 for antibody 32296
ARDPFFGALDC

SEQ ID NO: 64593 - protein, 9 aa, Homo sapiens
  light chain complementarity determining region 3 for antibody 32297
MQGTHWPKT

SEQ ID NO: 64594 - protein, 9 aa, Homo sapiens
  heavy chain complementarity determining region 3 for antibody 32297
AKGYYDSSY

SEQ ID NO: 64595 - protein, 9 aa, Homo sapiens
  light chain complementarity determining region 3 for antibody 32298
MQALETPFT

SEQ ID NO: 64596 - protein, 15 aa, Homo sapiens
  heavy chain complementarity determining region 3 for antibody 32298
VRHYRELTTGIEGDS

SEQ ID NO: 64597 - protein, 9 aa, Homo sapiens
  light chain complementarity determining region 3 for antibody 32299
QQFNIYPPT

SEQ ID NO: 64598 - protein, 15 aa, Homo sapiens
  heavy chain complementarity determining region 3 for antibody 32299
VRDSGIRVRQDYFDY

SEQ ID NO: 64599 - protein, 9 aa, Homo sapiens
  light chain complementarity determining region 3 for antibody 32300
LQTYNIPIT

SEQ ID NO: 64600 - protein, 14 aa, Homo sapiens
  heavy chain complementarity determining region 3 for antibody 32300
VKFPRGDSSFLQDF

SEQ ID NO: 64601 - protein, 9 aa, Homo sapiens
  light chain complementarity determining region 3 for antibody 32301
QQYGSSPWT

SEQ ID NO: 64602 - protein, 14 aa, Homo sapiens
  heavy chain complementarity determining region 3 for antibody 32301
ARDSSSTSWGPIDY

SEQ ID NO: 64603 - protein, 9 aa, Homo sapiens
  light chain complementarity determining region 3 for antibody 32302
QQYGNLPRT

SEQ ID NO: 64604 - protein, 13 aa, Homo sapiens
  heavy chain complementarity determining region 3 for antibody 32302
AGGQFHSSGYSEF

SEQ ID NO: 64605 - protein, 9 aa, Homo sapiens
  light chain complementarity determining region 3 for antibody 32303
QQSYSSPRT

SEQ ID NO: 64606 - protein, 10 aa, Homo sapiens
  heavy chain complementarity determining region 3 for antibody 32303
AGGDFRKFDY

SEQ ID NO: 64607 - protein, 9 aa, Homo sapiens
  light chain complementarity determining region 3 for antibody 32304
MQSLQAPIT

SEQ ID NO: 64608 - protein, 12 aa, Homo sapiens
  heavy chain complementarity determining region 3 for antibody 32304
TRDPPTRWGMEV

SEQ ID NO: 64609 - protein, 9 aa, Homo sapiens
  light chain complementarity determining region 3 for antibody 32305
QQYGSSPWT

SEQ ID NO: 64610 - protein, 15 aa, Homo sapiens
  heavy chain complementarity determining region 3 for antibody 32305
AREAFDIAGHYRADY

SEQ ID NO: 64611 - protein, 10 aa, Homo sapiens
  light chain complementarity determining region 3 for antibody 32306
QQRYKWPPYT

SEQ ID NO: 64612 - protein, 11 aa, Homo sapiens
  heavy chain complementarity determining region 3 for antibody 32306
ARGVGSYVFDS

SEQ ID NO: 64613 - protein, 9 aa, Homo sapiens
  light chain complementarity determining region 3 for antibody 32307
QQRTNWRFT

SEQ ID NO: 64614 - protein, 16 aa, Homo sapiens
  heavy chain complementarity determining region 3 for antibody 32307
ARDQGFCRGPNCYMLF

SEQ ID NO: 64615 - protein, 10 aa, Homo sapiens
  light chain complementarity determining region 3 for antibody 32308
QQRSDWPPLT

SEQ ID NO: 64616 - protein, 10 aa, Homo sapiens
  heavy chain complementarity determining region 3 for antibody 32308
ARDYSMTFDY

SEQ ID NO: 64617 - protein, 9 aa, Homo sapiens
  light chain complementarity determining region 3 for antibody 32309
LQHDNFPLT

SEQ ID NO: 64618 - protein, 14 aa, Homo sapiens
  heavy chain complementarity determining region 3 for antibody 32309
ARDRRFWANWYFDL

SEQ ID NO: 64619 - protein, 8 aa, Homo sapiens
  light chain complementarity determining region 3 for antibody 32310
MQGTHMYT

SEQ ID NO: 64620 - protein, 15 aa, Homo sapiens
  heavy chain complementarity determining region 3 for antibody 32310
ARCGANSCPQSAMDV

SEQ ID NO: 64621 - protein, 9 aa, Homo sapiens
  light chain complementarity determining region 3 for antibody 32311
QQYGSSPWT

SEQ ID NO: 64622 - protein, 15 aa, Homo sapiens
  heavy chain complementarity determining region 3 for antibody 32311
ARRTSSWYADWYFDL

SEQ ID NO: 64623 - protein, 11 aa, Homo sapiens
  light chain complementarity determining region 3 for antibody 32312
QQYDNLPPAYT

SEQ ID NO: 64624 - protein, 9 aa, Homo sapiens
  heavy chain complementarity determining region 3 for antibody 32312
ASGFTAFDY

SEQ ID NO: 64625 - protein, 9 aa, Homo sapiens
  light chain complementarity determining region 3 for antibody 32313
QQYAGSPGT

SEQ ID NO: 64626 - protein, 8 aa, Homo sapiens
  heavy chain complementarity determining region 3 for antibody 32313
ARGLSLDS

SEQ ID NO: 64627 - protein, 9 aa, Homo sapiens
  light chain complementarity determining region 3 for antibody 32314
QQSYRILWT

SEQ ID NO: 64628 - protein, 13 aa, Homo sapiens
  heavy chain complementarity determining region 3 for antibody 32314
VTRAFRFGKVMDV

SEQ ID NO: 64629 - protein, 9 aa, Homo sapiens
  light chain complementarity determining region 3 for antibody 32315
QQYNSYGLT

SEQ ID NO: 64630 - protein, 11 aa, Homo sapiens
  heavy chain complementarity determining region 3 for antibody 32315
VTGYTSHFGSR

SEQ ID NO: 64631 - protein, 9 aa, Homo sapiens
  light chain complementarity determining region 3 for antibody 32316
QQYGGSPRT

SEQ ID NO: 64632 - protein, 13 aa, Homo sapiens
  heavy chain complementarity determining region 3 for antibody 32316
ASGYFDRSGYYEF

SEQ ID NO: 64633 - protein, 9 aa, Homo sapiens
  light chain complementarity determining region 3 for antibody 32317
QQRSNWPLT

SEQ ID NO: 64634 - protein, 15 aa, Homo sapiens
  heavy chain complementarity determining region 3 for antibody 32317
ARDLSYFGSRRGFDP

SEQ ID NO: 64635 - protein, 6 aa, Homo sapiens
  light chain complementarity determining region 3 for antibody 32318
QEYGST

SEQ ID NO: 64636 - protein, 12 aa, Homo sapiens
  heavy chain complementarity determining region 3 for antibody 32318
ARDHISGWSLSN

SEQ ID NO: 64637 - protein, 8 aa, Homo sapiens
  light chain complementarity determining region 3 for antibody 32319
QQSYGSPT

SEQ ID NO: 64638 - protein, 13 aa, Homo sapiens
  heavy chain complementarity determining region 3 for antibody 32319
ARDRPGTYYAFDI

SEQ ID NO: 64639 - protein, 10 aa, Homo sapiens
  light chain complementarity determining region 3 for antibody 32320
QQFGTSSRFT

SEQ ID NO: 64640 - protein, 9 aa, Homo sapiens
  heavy chain complementarity determining region 3 for antibody 32320
ARGYQELDY

SEQ ID NO: 64641 - protein, 9 aa, Homo sapiens
  light chain complementarity determining region 3 for antibody 32321
QLSYTLLST

SEQ ID NO: 64642 - protein, 12 aa, Homo sapiens
  heavy chain complementarity determining region 3 for antibody 32321
ARWDYVTNAHVY

SEQ ID NO: 64643 - protein, 9 aa, Homo sapiens
  light chain complementarity determining region 3 for antibody 32322
MQGLQTPYT

SEQ ID NO: 64644 - protein, 10 aa, Homo sapiens
  heavy chain complementarity determining region 3 for antibody 32322
GSDLSGARDY

SEQ ID NO: 64645 - protein, 9 aa, Homo sapiens
  light chain complementarity determining region 3 for antibody 32323
LQHNSYPLT

SEQ ID NO: 64646 - protein, 13 aa, Homo sapiens
  heavy chain complementarity determining region 3 for antibody 32323
ARHMVRGGMVVDD

SEQ ID NO: 64647 - protein, 9 aa, Homo sapiens
  light chain complementarity determining region 3 for antibody 32324
QQYGSSPQT

SEQ ID NO: 64648 - protein, 19 aa, Homo sapiens
  heavy chain complementarity determining region 3 for antibody 32324
ARVFRGLRSRSYFGYGMDL

SEQ ID NO: 64649 - protein, 9 aa, Homo sapiens
  light chain complementarity determining region 3 for antibody 32325
QQRFDWPLT

SEQ ID NO: 64650 - protein, 12 aa, Homo sapiens
  heavy chain complementarity determining region 3 for antibody 32325
ARDLYDNNQSDY

SEQ ID NO: 64651 - protein, 10 aa, Homo sapiens
  light chain complementarity determining region 3 for antibody 32326
QHYGISPRFT

SEQ ID NO: 64652 - protein, 12 aa, Homo sapiens
  heavy chain complementarity determining region 3 for antibody 32326
ARDVVGATASDF

SEQ ID NO: 64653 - protein, 9 aa, Homo sapiens
  light chain complementarity determining region 3 for antibody 32327
MASRHWPLS

SEQ ID NO: 64654 - protein, 8 aa, Homo sapiens
  heavy chain complementarity determining region 3 for antibody 32327
ARGRSMSE

SEQ ID NO: 64655 - protein, 9 aa, Homo sapiens
  light chain complementarity determining region 3 for antibody 32328
LQAHNFPRT

SEQ ID NO: 64656 - protein, 8 aa, Homo sapiens
  heavy chain complementarity determining region 3 for antibody 32328
ARNSGWYD

SEQ ID NO: 64657 - protein, 9 aa, Homo sapiens
  light chain complementarity determining region 3 for antibody 32329
QQYGSSPGT

SEQ ID NO: 64658 - protein, 14 aa, Homo sapiens
  heavy chain complementarity determining region 3 for antibody 32329
VRDRYDGGNSPFDY

SEQ ID NO: 64659 - protein, 9 aa, Homo sapiens
  light chain complementarity determining region 3 for antibody 32330
QQYGSSLYT

SEQ ID NO: 64660 - protein, 16 aa, Homo sapiens
  heavy chain complementarity determining region 3 for antibody 32330
ARAKHYGDYYYYGMDA

SEQ ID NO: 64661 - protein, 11 aa, Homo sapiens
  light chain complementarity determining region 3 for antibody 32331
QQRVNWPPSVT

SEQ ID NO: 64662 - protein, 15 aa, Homo sapiens
  heavy chain complementarity determining region 3 for antibody 32331
ARDRDGMYSAHAFDI

SEQ ID NO: 64663 - protein, 9 aa, Homo sapiens
  light chain complementarity determining region 3 for antibody 32332
LQHNSYPLT

SEQ ID NO: 64664 - protein, 13 aa, Homo sapiens
  heavy chain complementarity determining region 3 for antibody 32332
VRHGVVRPMVVDD

SEQ ID NO: 64665 - protein, 9 aa, Homo sapiens
  light chain complementarity determining region 3 for antibody 32333
QQYQSWPYT

SEQ ID NO: 64666 - protein, 11 aa, Homo sapiens
  heavy chain complementarity determining region 3 for antibody 32333
GGFYHGGPCGY

SEQ ID NO: 64667 - protein, 9 aa, Homo sapiens
  light chain complementarity determining region 3 for antibody 32334
QQYGGSQGT

SEQ ID NO: 64668 - protein, 13 aa, Homo sapiens
  heavy chain complementarity determining region 3 for antibody 32334
TKEIPEAGHPGGS

SEQ ID NO: 64669 - protein, 9 aa, Homo sapiens
  light chain complementarity determining region 3 for antibody 32335
QQFDDLPYT

SEQ ID NO: 64670 - protein, 14 aa, Homo sapiens
  heavy chain complementarity determining region 3 for antibody 32335
VRGSADFWSGRMDY

SEQ ID NO: 64671 - protein, 9 aa, Homo sapiens
  light chain complementarity determining region 3 for antibody 32336
MQSRRWPHT

SEQ ID NO: 64672 - protein, 8 aa, Homo sapiens
  heavy chain complementarity determining region 3 for antibody 32336
TAWGSSQH

SEQ ID NO: 64673 - protein, 9 aa, Homo sapiens
  light chain complementarity determining region 3 for antibody 32337
LHDASYPLS

SEQ ID NO: 64674 - protein, 18 aa, Homo sapiens
  heavy chain complementarity determining region 3 for antibody 32337
AKDRRTVYDSSDYLGFDH

SEQ ID NO: 64675 - protein, 10 aa, Homo sapiens
  light chain complementarity determining region 3 for antibody 32338
QQYVGSPPFT

SEQ ID NO: 64676 - protein, 13 aa, Homo sapiens
  heavy chain complementarity determining region 3 for antibody 32338
ARVAVAGRGYFQH

SEQ ID NO: 64677 - protein, 8 aa, Homo sapiens
  light chain complementarity determining region 3 for antibody 32339
QQYNTYAT

SEQ ID NO: 64678 - protein, 16 aa, Homo sapiens
  heavy chain complementarity determining region 3 for antibody 32339
ATELYYGSPTHTGFAI

SEQ ID NO: 64679 - protein, 9 aa, Homo sapiens
  light chain complementarity determining region 3 for antibody 32340
QQYDSSPRT

SEQ ID NO: 64680 - protein, 13 aa, Homo sapiens
  heavy chain complementarity determining region 3 for antibody 32340
AKSVLTVPRVYDY

SEQ ID NO: 64681 - protein, 11 aa, Homo sapiens
  light chain complementarity determining region 3 for antibody 32341
LQHDNFPVTWT

SEQ ID NO: 64682 - protein, 16 aa, Homo sapiens
  heavy chain complementarity determining region 3 for antibody 32341
ARVVWGASWYVGWFDP

SEQ ID NO: 64683 - protein, 9 aa, Homo sapiens
  light chain complementarity determining region 3 for antibody 32342
HQRSNWPFT

SEQ ID NO: 64684 - protein, 16 aa, Homo sapiens
  heavy chain complementarity determining region 3 for antibody 32342
AGATSSDWYGGVLHDY

SEQ ID NO: 64685 - protein, 9 aa, Homo sapiens
  light chain complementarity determining region 3 for antibody 32343
QQSHGFPYT

SEQ ID NO: 64686 - protein, 13 aa, Homo sapiens
  heavy chain complementarity determining region 3 for antibody 32343
VRLNDVNGWPFDH

SEQ ID NO: 64687 - protein, 9 aa, Homo sapiens
  light chain complementarity determining region 3 for antibody 32344
LQFDSLPLT

SEQ ID NO: 64688 - protein, 16 aa, Homo sapiens
  heavy chain complementarity determining region 3 for antibody 32344
GRSHHPQGDKVIRLDY

SEQ ID NO: 64689 - protein, 10 aa, Homo sapiens
  light chain complementarity determining region 3 for antibody 32345
QQYNNWLGWT

SEQ ID NO: 64690 - protein, 13 aa, Homo sapiens
  heavy chain complementarity determining region 3 for antibody 32345
ARHGRRSGWYYTY

SEQ ID NO: 64691 - protein, 9 aa, Homo sapiens
  light chain complementarity determining region 3 for antibody 32346
QQYIGWPRT

SEQ ID NO: 64692 - protein, 6 aa, Homo sapiens
  heavy chain complementarity determining region 3 for antibody 32346
GSVFEY

SEQ ID NO: 64693 - protein, 9 aa, Homo sapiens
  light chain complementarity determining region 3 for antibody 32347
QQYYTSVRT

SEQ ID NO: 64694 - protein, 12 aa, Homo sapiens
  heavy chain complementarity determining region 3 for antibody 32347
VKDCGLGGSRDF

SEQ ID NO: 64695 - protein, 9 aa, Homo sapiens
  light chain complementarity determining region 3 for antibody 32348
MQALETPFT

SEQ ID NO: 64696 - protein, 15 aa, Homo sapiens
  heavy chain complementarity determining region 3 for antibody 32348
VRHYRELATGIEGDS

SEQ ID NO: 64697 - protein, 9 aa, Homo sapiens
  light chain complementarity determining region 3 for antibody 32349
HQYHTFPYT

SEQ ID NO: 64698 - protein, 13 aa, Homo sapiens
  heavy chain complementarity determining region 3 for antibody 32349
ARFCGGDCSPFDY

SEQ ID NO: 64699 - protein, 10 aa, Homo sapiens
  light chain complementarity determining region 3 for antibody 32350
QQYGSSPLYT

SEQ ID NO: 64700 - protein, 18 aa, Homo sapiens
  heavy chain complementarity determining region 3 for antibody 32350
ARVLGGQYYYDSSGWVDY

SEQ ID NO: 64701 - protein, 9 aa, Homo sapiens
  light chain complementarity determining region 3 for antibody 32351
QQYGGSSRT

SEQ ID NO: 64702 - protein, 11 aa, Homo sapiens
  heavy chain complementarity determining region 3 for antibody 32351
ARGRWAGAFDI

SEQ ID NO: 64703 - protein, 9 aa, Homo sapiens
  light chain complementarity determining region 3 for antibody 32352
QHRNIWRVT

SEQ ID NO: 64704 - protein, 7 aa, Homo sapiens
  heavy chain complementarity determining region 3 for antibody 32352
TLSSFDY

SEQ ID NO: 64705 - protein, 9 aa, Homo sapiens
  light chain complementarity determining region 3 for antibody 32353
HQYGRSPYT

SEQ ID NO: 64706 - protein, 11 aa, Homo sapiens
  heavy chain complementarity determining region 3 for antibody 32353
ATWAFYHGVDV

SEQ ID NO: 64707 - protein, 9 aa, Homo sapiens
  light chain complementarity determining region 3 for antibody 32354
QQYGSSLRT

SEQ ID NO: 64708 - protein, 21 aa, Homo sapiens
  heavy chain complementarity determining region 3 for antibody 32354
ARGPTTKYVFGSGSYGKYLDS

SEQ ID NO: 64709 - protein, 9 aa, Homo sapiens
  light chain complementarity determining region 3 for antibody 32355
QQFDNYPLT

SEQ ID NO: 64710 - protein, 20 aa, Homo sapiens
  heavy chain complementarity determining region 3 for antibody 32355
ARDLGRSGSIGIIRNDAFNV

SEQ ID NO: 64711 - protein, 9 aa, Homo sapiens
  light chain complementarity determining region 3 for antibody 32356
MQVLQTPLT

SEQ ID NO: 64712 - protein, 12 aa, Homo sapiens
  heavy chain complementarity determining region 3 for antibody 32356
AKDSAKKWELLD

SEQ ID NO: 64713 - protein, 9 aa, Homo sapiens
  light chain complementarity determining region 3 for antibody 32357
MQGSHWPPT

SEQ ID NO: 64714 - protein, 13 aa, Homo sapiens
  heavy chain complementarity determining region 3 for antibody 32357
VRNLGDGYNSIDY

SEQ ID NO: 64715 - protein, 6 aa, Homo sapiens
  light chain complementarity determining region 3 for antibody 32358
HQNGDS

SEQ ID NO: 64716 - protein, 11 aa, Homo sapiens
  heavy chain complementarity determining region 3 for antibody 32358
ARSGYPGAFDI

SEQ ID NO: 64717 - protein, 9 aa, Homo sapiens
  light chain complementarity determining region 3 for antibody 32359
QQYDRSPET

SEQ ID NO: 64718 - protein, 12 aa, Homo sapiens
  heavy chain complementarity determining region 3 for antibody 32359
ARPLYNSGFFEY

SEQ ID NO: 64719 - protein, 9 aa, Homo sapiens
  light chain complementarity determining region 3 for antibody 32360
QHNYNPPFT

SEQ ID NO: 64720 - protein, 13 aa, Homo sapiens
  heavy chain complementarity determining region 3 for antibody 32360
VRGRNYDRDGFDP

SEQ ID NO: 64721 - protein, 8 aa, Homo sapiens
  light chain complementarity determining region 3 for antibody 32361
QQRSNWYT

SEQ ID NO: 64722 - protein, 15 aa, Homo sapiens
  heavy chain complementarity determining region 3 for antibody 32361
ARDLEQWLLDNWFDP

SEQ ID NO: 64723 - protein, 9 aa, Homo sapiens
  light chain complementarity determining region 3 for antibody 32362
QQLNSYPLT

SEQ ID NO: 64724 - protein, 16 aa, Homo sapiens
  heavy chain complementarity determining region 3 for antibody 32362
VRRDEVTVFWGGPLDF

SEQ ID NO: 64725 - protein, 8 aa, Homo sapiens
  light chain complementarity determining region 3 for antibody 32363
MQALHTWT

SEQ ID NO: 64726 - protein, 18 aa, Homo sapiens
  heavy chain complementarity determining region 3 for antibody 32363
ARSRPYGGDANPARHFDY

SEQ ID NO: 64727 - protein, 9 aa, Homo sapiens
  light chain complementarity determining region 3 for antibody 32364
QQYNRWPAT

SEQ ID NO: 64728 - protein, 20 aa, Homo sapiens
  heavy chain complementarity determining region 3 for antibody 32364
ARDPREYYDLRNYYVYYFDS

SEQ ID NO: 64729 - protein, 8 aa, Homo sapiens
  light chain complementarity determining region 3 for antibody 32365
QQYGSSPT

SEQ ID NO: 64730 - protein, 11 aa, Homo sapiens
  heavy chain complementarity determining region 3 for antibody 32365
VRNGVRGANDY

SEQ ID NO: 64731 - protein, 9 aa, Homo sapiens
  light chain complementarity determining region 3 for antibody 32366
QQYGSSIVT

SEQ ID NO: 64732 - protein, 16 aa, Homo sapiens
  heavy chain complementarity determining region 3 for antibody 32366
TTDWGSGYYWIRAFDL

SEQ ID NO: 64733 - protein, 9 aa, Homo sapiens
  light chain complementarity determining region 3 for antibody 32367
QQRSKWPLT

SEQ ID NO: 64734 - protein, 18 aa, Homo sapiens
  heavy chain complementarity determining region 3 for antibody 32367
ARRGSRGVEAAQYNWFDP

SEQ ID NO: 64735 - protein, 9 aa, Homo sapiens
  light chain complementarity determining region 3 for antibody 32368
QQYSGSPRT

SEQ ID NO: 64736 - protein, 14 aa, Homo sapiens
  heavy chain complementarity determining region 3 for antibody 32368
ATGWYDSSGHYLEY

SEQ ID NO: 64737 - protein, 10 aa, Homo sapiens
  light chain complementarity determining region 3 for antibody 32369
QQYGSSPPWT

SEQ ID NO: 64738 - protein, 13 aa, Homo sapiens
  heavy chain complementarity determining region 3 for antibody 32369
ARSGGSYYYAFDI

SEQ ID NO: 64739 - protein, 9 aa, Homo sapiens
  light chain complementarity determining region 3 for antibody 32370
QQRSNWPQT

SEQ ID NO: 64740 - protein, 12 aa, Homo sapiens
  heavy chain complementarity determining region 3 for antibody 32370
AKDHSRSYFFDY

SEQ ID NO: 64741 - protein, 9 aa, Homo sapiens
  light chain complementarity determining region 3 for antibody 32371
QQYGSSPET

SEQ ID NO: 64742 - protein, 12 aa, Homo sapiens
  heavy chain complementarity determining region 3 for antibody 32371
ARGYGWCSCPEY

SEQ ID NO: 64743 - protein, 9 aa, Homo sapiens
  light chain complementarity determining region 3 for antibody 32372
QQRTNWPRT

SEQ ID NO: 64744 - protein, 12 aa, Homo sapiens
  heavy chain complementarity determining region 3 for antibody 32372
AKEWANWGVFDY

SEQ ID NO: 64745 - protein, 9 aa, Homo sapiens
  light chain complementarity determining region 3 for antibody 32373
QQRSNWPLT

SEQ ID NO: 64746 - protein, 11 aa, Homo sapiens
  heavy chain complementarity determining region 3 for antibody 32373
ALGQWLAPFDY

SEQ ID NO: 64747 - protein, 10 aa, Homo sapiens
  light chain complementarity determining region 3 for antibody 32374
QQFNNYRALT

SEQ ID NO: 64748 - protein, 10 aa, Homo sapiens
  heavy chain complementarity determining region 3 for antibody 32374
ARATARAFDI

SEQ ID NO: 64749 - protein, 9 aa, Homo sapiens
  light chain complementarity determining region 3 for antibody 32375
QHTYTFPRT

SEQ ID NO: 64750 - protein, 20 aa, Homo sapiens
  heavy chain complementarity determining region 3 for antibody 32375
ARGRRIAALSTAHYYYGMDV

SEQ ID NO: 64751 - protein, 9 aa, Homo sapiens
  light chain complementarity determining region 3 for antibody 32376
MQALQTPIT

SEQ ID NO: 64752 - protein, 13 aa, Homo sapiens
  heavy chain complementarity determining region 3 for antibody 32376
TMVVDYGDYGFDC

SEQ ID NO: 64753 - protein, 9 aa, Homo sapiens
  light chain complementarity determining region 3 for antibody 32377
LQANSFPLI

SEQ ID NO: 64754 - protein, 19 aa, Homo sapiens
  heavy chain complementarity determining region 3 for antibody 32377
ARGQYNDGSKNYIGGRIDY

SEQ ID NO: 64755 - protein, 9 aa, Homo sapiens
  light chain complementarity determining region 3 for antibody 32378
QQYNSYSYT

SEQ ID NO: 64756 - protein, 12 aa, Homo sapiens
  heavy chain complementarity determining region 3 for antibody 32378
ARGEGFGELSDY

SEQ ID NO: 64757 - protein, 9 aa, Homo sapiens
  light chain complementarity determining region 3 for antibody 32379
QQYGSSPST

SEQ ID NO: 64758 - protein, 13 aa, Homo sapiens
  heavy chain complementarity determining region 3 for antibody 32379
ARDGQWLVRYFDY

SEQ ID NO: 64759 - protein, 9 aa, Homo sapiens
  light chain complementarity determining region 3 for antibody 32380
MQALQTPRT

SEQ ID NO: 64760 - protein, 6 aa, Homo sapiens
  heavy chain complementarity determining region 3 for antibody 32380
TRALDY

SEQ ID NO: 64761 - protein, 9 aa, Homo sapiens
  light chain complementarity determining region 3 for antibody 32381
QQSYSTPYT

SEQ ID NO: 64762 - protein, 17 aa, Homo sapiens
  heavy chain complementarity determining region 3 for antibody 32381
SSGGVSDYRSHYYGMDV

SEQ ID NO: 64763 - protein, 9 aa, Homo sapiens
  light chain complementarity determining region 3 for antibody 32382
MQGLQTPYT

SEQ ID NO: 64764 - protein, 10 aa, Homo sapiens
  heavy chain complementarity determining region 3 for antibody 32382
GRDLTGSKDY

SEQ ID NO: 64765 - protein, 8 aa, Homo sapiens
  light chain complementarity determining region 3 for antibody 32383
MKGTQGRP

SEQ ID NO: 64766 - protein, 15 aa, Homo sapiens
  heavy chain complementarity determining region 3 for antibody 32383
ATDWSFQMIEGNFHH

SEQ ID NO: 64767 - protein, 9 aa, Homo sapiens
  light chain complementarity determining region 3 for antibody 32384
LQSYSCPYT

SEQ ID NO: 64768 - protein, 11 aa, Homo sapiens
  heavy chain complementarity determining region 3 for antibody 32384
ATMAPWRQTPP

SEQ ID NO: 64769 - protein, 9 aa, Homo sapiens
  light chain complementarity determining region 3 for antibody 32385
LQLNSYPIT

SEQ ID NO: 64770 - protein, 20 aa, Homo sapiens
  heavy chain complementarity determining region 3 for antibody 32385
ARRGVGKGEDYFDSSGYADY

SEQ ID NO: 64771 - protein, 9 aa, Homo sapiens
  light chain complementarity determining region 3 for antibody 32386
LQDYSYPYT

SEQ ID NO: 64772 - protein, 20 aa, Homo sapiens
  heavy chain complementarity determining region 3 for antibody 32386
AKDLREDYKGFSFYYYGMDV

SEQ ID NO: 64773 - protein, 9 aa, Homo sapiens
  light chain complementarity determining region 3 for antibody 32387
QQYYNYPVT

SEQ ID NO: 64774 - protein, 15 aa, Homo sapiens
  heavy chain complementarity determining region 3 for antibody 32387
ASGGVGASNRGAFDI

SEQ ID NO: 64775 - protein, 9 aa, Homo sapiens
  light chain complementarity determining region 3 for antibody 32388
QQSSSIPLT

SEQ ID NO: 64776 - protein, 16 aa, Homo sapiens
  heavy chain complementarity determining region 3 for antibody 32388
ARGRALRMVFANWFDP

SEQ ID NO: 64777 - protein, 8 aa, Homo sapiens
  light chain complementarity determining region 3 for antibody 32389
MQALQTPT

SEQ ID NO: 64778 - protein, 15 aa, Homo sapiens
  heavy chain complementarity determining region 3 for antibody 32389
TADRGDSSRWYGMAV

SEQ ID NO: 64779 - protein, 9 aa, Homo sapiens
  light chain complementarity determining region 3 for antibody 32390
HHYGDSART

SEQ ID NO: 64780 - protein, 13 aa, Homo sapiens
  heavy chain complementarity determining region 3 for antibody 32390
AKARYDAPRCYES

SEQ ID NO: 64781 - protein, 9 aa, Homo sapiens
  light chain complementarity determining region 3 for antibody 32391
QQYGTSSFT

SEQ ID NO: 64782 - protein, 21 aa, Homo sapiens
  heavy chain complementarity determining region 3 for antibody 32391
ARMSAGSYYDSSGSYLYYFDN

SEQ ID NO: 64783 - protein, 9 aa, Homo sapiens
  light chain complementarity determining region 3 for antibody 32392
QQYGSSPQT

SEQ ID NO: 64784 - protein, 15 aa, Homo sapiens
  heavy chain complementarity determining region 3 for antibody 32392
ARRRIRFLEWRPFDY

SEQ ID NO: 64785 - protein, 9 aa, Homo sapiens
  light chain complementarity determining region 3 for antibody 32393
QQYGHIPRT

SEQ ID NO: 64786 - protein, 15 aa, Homo sapiens
  heavy chain complementarity determining region 3 for antibody 32393
ARGEFYVSGSYYRED

SEQ ID NO: 64787 - protein, 9 aa, Homo sapiens
  light chain complementarity determining region 3 for antibody 32394
LQHYTYPIT

SEQ ID NO: 64788 - protein, 20 aa, Homo sapiens
  heavy chain complementarity determining region 3 for antibody 32394
ARGAHVVVVTSFRGSQGINS

SEQ ID NO: 64789 - protein, 9 aa, Homo sapiens
  light chain complementarity determining region 3 for antibody 32395
HQYGTSPRT

SEQ ID NO: 64790 - protein, 13 aa, Homo sapiens
  heavy chain complementarity determining region 3 for antibody 32395
ATESGSYYGGLDY

SEQ ID NO: 64791 - protein, 10 aa, Homo sapiens
  light chain complementarity determining region 3 for antibody 32396
QQYNSYSPYT

SEQ ID NO: 64792 - protein, 14 aa, Homo sapiens
  heavy chain complementarity determining region 3 for antibody 32396
ARDQRTGSGVVILD

SEQ ID NO: 64793 - protein, 10 aa, Homo sapiens
  light chain complementarity determining region 3 for antibody 32397
QQYGRSPWGA

SEQ ID NO: 64794 - protein, 17 aa, Homo sapiens
  heavy chain complementarity determining region 3 for antibody 32397
AKDYGTVTKDLVGYLDY

SEQ ID NO: 64795 - protein, 8 aa, Homo sapiens
  light chain complementarity determining region 3 for antibody 32398
QQYENLWT

SEQ ID NO: 64796 - protein, 25 aa, Homo sapiens
  heavy chain complementarity determining region 3 for antibody 32398
ARVRRGFHSDSSGYYHMEGDDSFDI

SEQ ID NO: 64797 - protein, 9 aa, Homo sapiens
  light chain complementarity determining region 3 for antibody 32399
QHTHSRPFT

SEQ ID NO: 64798 - protein, 20 aa, Homo sapiens
  heavy chain complementarity determining region 3 for antibody 32399
AKGIAVAALRTVYYYYGLDV

SEQ ID NO: 64799 - protein, 9 aa, Homo sapiens
  light chain complementarity determining region 3 for antibody 32400
QHRNNWPLT

SEQ ID NO: 64800 - protein, 13 aa, Homo sapiens
  heavy chain complementarity determining region 3 for antibody 32400
ARGNIAAPGRLEC

SEQ ID NO: 64801 - protein, 9 aa, Homo sapiens
  light chain complementarity determining region 3 for antibody 32401
LQGNRFPHT

SEQ ID NO: 64802 - protein, 14 aa, Homo sapiens
  heavy chain complementarity determining region 3 for antibody 32401
ARYCSGSSCYSMDY

SEQ ID NO: 64803 - protein, 11 aa, Homo sapiens
  light chain complementarity determining region 3 for antibody 32402
QQYDRSPPGFT

SEQ ID NO: 64804 - protein, 14 aa, Homo sapiens
  heavy chain complementarity determining region 3 for antibody 32402
ARETHNSRKRSFDQ

SEQ ID NO: 64805 - protein, 10 aa, Homo sapiens
  light chain complementarity determining region 3 for antibody 32403
QQSHNNTPYT

SEQ ID NO: 64806 - protein, 21 aa, Homo sapiens
  heavy chain complementarity determining region 3 for antibody 32403
ARTGRHYSDSTVYYYRPRIDY

SEQ ID NO: 64807 - protein, 8 aa, Homo sapiens
  light chain complementarity determining region 3 for antibody 32404
MQGTSGRT

SEQ ID NO: 64808 - protein, 17 aa, Homo sapiens
  heavy chain complementarity determining region 3 for antibody 32404
AHRRYYNGNWNGATFDV

SEQ ID NO: 64809 - protein, 10 aa, Homo sapiens
  light chain complementarity determining region 3 for antibody 32405
QQYNSYSPWT

SEQ ID NO: 64810 - protein, 20 aa, Homo sapiens
  heavy chain complementarity determining region 3 for antibody 32405
ATVLRGRGSSVYYVGGAFDI

SEQ ID NO: 64811 - protein, 9 aa, Homo sapiens
  light chain complementarity determining region 3 for antibody 32406
QQYGSSPYT

SEQ ID NO: 64812 - protein, 14 aa, Homo sapiens
  heavy chain complementarity determining region 3 for antibody 32406
ARHSGYHYGSNLDY

SEQ ID NO: 64813 - protein, 9 aa, Homo sapiens
  light chain complementarity determining region 3 for antibody 32407
QQYGSSPGT

SEQ ID NO: 64814 - protein, 10 aa, Homo sapiens
  heavy chain complementarity determining region 3 for antibody 32407
GGGGGWYSPN

SEQ ID NO: 64815 - protein, 9 aa, Homo sapiens
  light chain complementarity determining region 3 for antibody 32408
QQYASAPIT

SEQ ID NO: 64816 - protein, 10 aa, Homo sapiens
  heavy chain complementarity determining region 3 for antibody 32408
ARMNGWLIDY

SEQ ID NO: 64817 - protein, 10 aa, Homo sapiens
  light chain complementarity determining region 3 for antibody 32409
QQRYSWPPLT

SEQ ID NO: 64818 - protein, 14 aa, Homo sapiens
  heavy chain complementarity determining region 3 for antibody 32409
AKGANLHHPYYFDY

SEQ ID NO: 64819 - protein, 9 aa, Homo sapiens
  light chain complementarity determining region 3 for antibody 32410
QQFGSSPRT

SEQ ID NO: 64820 - protein, 16 aa, Homo sapiens
  heavy chain complementarity determining region 3 for antibody 32410
AKLRRRDYSGRDAFDI

SEQ ID NO: 64821 - protein, 8 aa, Homo sapiens
  light chain complementarity determining region 3 for antibody 32411
MQALQTPT

SEQ ID NO: 64822 - protein, 15 aa, Homo sapiens
  heavy chain complementarity determining region 3 for antibody 32411
ARRDYYDSSGYRLDY

SEQ ID NO: 64823 - protein, 10 aa, Homo sapiens
  light chain complementarity determining region 3 for antibody 32412
QQYNSWPLYT

SEQ ID NO: 64824 - protein, 14 aa, Homo sapiens
  heavy chain complementarity determining region 3 for antibody 32412
ARSGDGINLGFFDY

SEQ ID NO: 64825 - protein, 8 aa, Homo sapiens
  light chain complementarity determining region 3 for antibody 32413
QQYGTSLT

SEQ ID NO: 64826 - protein, 17 aa, Homo sapiens
  heavy chain complementarity determining region 3 for antibody 32413
SRQAHDSDISGFYPYDY

SEQ ID NO: 64827 - protein, 8 aa, Homo sapiens
  light chain complementarity determining region 3 for antibody 32414
QQYDYLWT

SEQ ID NO: 64828 - protein, 10 aa, Homo sapiens
  heavy chain complementarity determining region 3 for antibody 32414
AGREVSGSPF

SEQ ID NO: 64829 - protein, 9 aa, Homo sapiens
  light chain complementarity determining region 3 for antibody 32415
QQYDSSSYT

SEQ ID NO: 64830 - protein, 11 aa, Homo sapiens
  heavy chain complementarity determining region 3 for antibody 32415
ARGGFYGSFDY

SEQ ID NO: 64831 - protein, 8 aa, Homo sapiens
  light chain complementarity determining region 3 for antibody 32416
QQRSRWLS

SEQ ID NO: 64832 - protein, 12 aa, Homo sapiens
  heavy chain complementarity determining region 3 for antibody 32416
ARDASAVSEHTP

SEQ ID NO: 64833 - protein, 8 aa, Homo sapiens
  light chain complementarity determining region 3 for antibody 32417
QQRSNWLT

SEQ ID NO: 64834 - protein, 15 aa, Homo sapiens
  heavy chain complementarity determining region 3 for antibody 32417
AHRPNYYDKAGAFDI

SEQ ID NO: 64835 - protein, 10 aa, Homo sapiens
  light chain complementarity determining region 3 for antibody 32418
QQRSDWPPLT

SEQ ID NO: 64836 - protein, 10 aa, Homo sapiens
  heavy chain complementarity determining region 3 for antibody 32418
ARDYTMTFDY

SEQ ID NO: 64837 - protein, 6 aa, Homo sapiens
  light chain complementarity determining region 3 for antibody 32419
QQRGNL

SEQ ID NO: 64838 - protein, 12 aa, Homo sapiens
  heavy chain complementarity determining region 3 for antibody 32419
ARGVDWASAFDI

SEQ ID NO: 64839 - protein, 9 aa, Homo sapiens
  light chain complementarity determining region 3 for antibody 32420
QHRNSWPYT

SEQ ID NO: 64840 - protein, 15 aa, Homo sapiens
  heavy chain complementarity determining region 3 for antibody 32420
AKEGYYADGSGYCPN

SEQ ID NO: 64841 - protein, 11 aa, Homo sapiens
  light chain complementarity determining region 3 for antibody 32421
QHRINWPPSIT

SEQ ID NO: 64842 - protein, 15 aa, Homo sapiens
  heavy chain complementarity determining region 3 for antibody 32421
ARDRDVMYSVHAFDI

SEQ ID NO: 64843 - protein, 9 aa, Homo sapiens
  light chain complementarity determining region 3 for antibody 32422
HQTRGLPLT

SEQ ID NO: 64844 - protein, 14 aa, Homo sapiens
  heavy chain complementarity determining region 3 for antibody 32422
ARYVDWDDSDPHDY

SEQ ID NO: 64845 - protein, 9 aa, Homo sapiens
  light chain complementarity determining region 3 for antibody 32423
QQYGSSPFA

SEQ ID NO: 64846 - protein, 18 aa, Homo sapiens
  heavy chain complementarity determining region 3 for antibody 32423
VRGGRHDSSGYYYVPFDY

SEQ ID NO: 64847 - protein, 9 aa, Homo sapiens
  light chain complementarity determining region 3 for antibody 32424
QQSYSSQLT

SEQ ID NO: 64848 - protein, 16 aa, Homo sapiens
  heavy chain complementarity determining region 3 for antibody 32424
AREEGSTYTSNRAFDS

SEQ ID NO: 64849 - protein, 9 aa, Homo sapiens
  light chain complementarity determining region 3 for antibody 32425
QQSDSVPQT

SEQ ID NO: 64850 - protein, 18 aa, Homo sapiens
  heavy chain complementarity determining region 3 for antibody 32425
ARHLGHGGYSYSSDAFNI

SEQ ID NO: 64851 - protein, 8 aa, Homo sapiens
  light chain complementarity determining region 3 for antibody 32426
QQRSTGLT

SEQ ID NO: 64852 - protein, 13 aa, Homo sapiens
  heavy chain complementarity determining region 3 for antibody 32426
AREPNGPLNAFDL

SEQ ID NO: 64853 - protein, 10 aa, Homo sapiens
  light chain complementarity determining region 3 for antibody 32427
QQRGKWPEIS

SEQ ID NO: 64854 - protein, 14 aa, Homo sapiens
  heavy chain complementarity determining region 3 for antibody 32427
AKDHDSNISGFGEL

SEQ ID NO: 64855 - protein, 10 aa, Homo sapiens
  light chain complementarity determining region 3 for antibody 32428
QHYNNWPSFT

SEQ ID NO: 64856 - protein, 11 aa, Homo sapiens
  heavy chain complementarity determining region 3 for antibody 32428
TRDDYGGGADY

SEQ ID NO: 64857 - protein, 9 aa, Homo sapiens
  light chain complementarity determining region 3 for antibody 32429
HQYGNSPRT

SEQ ID NO: 64858 - protein, 13 aa, Homo sapiens
  heavy chain complementarity determining region 3 for antibody 32429
ARTGRVAGVEGAH

SEQ ID NO: 64859 - protein, 9 aa, Homo sapiens
  light chain complementarity determining region 3 for antibody 32430
QQYNNPPTT

SEQ ID NO: 64860 - protein, 11 aa, Homo sapiens
  heavy chain complementarity determining region 3 for antibody 32430
ASGRSWRRLDY

SEQ ID NO: 64861 - protein, 8 aa, Homo sapiens
  light chain complementarity determining region 3 for antibody 32431
QQYLLYWT

SEQ ID NO: 64862 - protein, 19 aa, Homo sapiens
  heavy chain complementarity determining region 3 for antibody 32431
AKEGLSYDINDSKRGYFDS

SEQ ID NO: 64863 - protein, 10 aa, Homo sapiens
  light chain complementarity determining region 3 for antibody 32432
QQYKDLPPWT

SEQ ID NO: 64864 - protein, 16 aa, Homo sapiens
  heavy chain complementarity determining region 3 for antibody 32432
ASQADTSVYYPRVFDY

SEQ ID NO: 64865 - protein, 9 aa, Homo sapiens
  light chain complementarity determining region 3 for antibody 32433
QQYGSSAIT

SEQ ID NO: 64866 - protein, 14 aa, Homo sapiens
  heavy chain complementarity determining region 3 for antibody 32433
GARQDVGDGALREF

SEQ ID NO: 64867 - protein, 10 aa, Homo sapiens
  light chain complementarity determining region 3 for antibody 32434
QQYDNWPPLT

SEQ ID NO: 64868 - protein, 16 aa, Homo sapiens
  heavy chain complementarity determining region 3 for antibody 32434
ARDRVSHYAESGTFEF

SEQ ID NO: 64869 - protein, 9 aa, Homo sapiens
  light chain complementarity determining region 3 for antibody 32435
QQSYRTPRT

SEQ ID NO: 64870 - protein, 15 aa, Homo sapiens
  heavy chain complementarity determining region 3 for antibody 32435
ARDRGAAALFYGVDV

SEQ ID NO: 64871 - protein, 9 aa, Homo sapiens
  light chain complementarity determining region 3 for antibody 32436
QKYNTAPYT

SEQ ID NO: 64872 - protein, 13 aa, Homo sapiens
  heavy chain complementarity determining region 3 for antibody 32436
ARLPYWELYYDDY

SEQ ID NO: 64873 - protein, 9 aa, Homo sapiens
  light chain complementarity determining region 3 for antibody 32437
MQGTHWPRT

SEQ ID NO: 64874 - protein, 10 aa, Homo sapiens
  heavy chain complementarity determining region 3 for antibody 32437
ARVSLGGFDP

SEQ ID NO: 64875 - protein, 9 aa, Homo sapiens
  light chain complementarity determining region 3 for antibody 32438
MQCTYWPGT

SEQ ID NO: 64876 - protein, 11 aa, Homo sapiens
  heavy chain complementarity determining region 3 for antibody 32438
ATGGLRVVFGP

SEQ ID NO: 64877 - protein, 9 aa, Homo sapiens
  light chain complementarity determining region 3 for antibody 32439
QQYGTLPWT

SEQ ID NO: 64878 - protein, 13 aa, Homo sapiens
  heavy chain complementarity determining region 3 for antibody 32439
VRDQAAYINWFDP

SEQ ID NO: 64879 - protein, 9 aa, Homo sapiens
  light chain complementarity determining region 3 for antibody 32440
QQYGSSFYS

SEQ ID NO: 64880 - protein, 14 aa, Homo sapiens
  heavy chain complementarity determining region 3 for antibody 32440
ARVGTYSYGEMFDY

SEQ ID NO: 64881 - protein, 8 aa, Homo sapiens
  light chain complementarity determining region 3 for antibody 32441
QQYDNLPT

SEQ ID NO: 64882 - protein, 25 aa, Homo sapiens
  heavy chain complementarity determining region 3 for antibody 32441
ARDRTRAPLGYCGGGSCPTSNWFDP

SEQ ID NO: 64883 - protein, 9 aa, Homo sapiens
  light chain complementarity determining region 3 for antibody 32442
QQYANLPWT

SEQ ID NO: 64884 - protein, 11 aa, Homo sapiens
  heavy chain complementarity determining region 3 for antibody 32442
ATWAFRHGVDV

SEQ ID NO: 64885 - protein, 9 aa, Homo sapiens
  light chain complementarity determining region 3 for antibody 32443
QQSYSTPYT

SEQ ID NO: 64886 - protein, 14 aa, Homo sapiens
  heavy chain complementarity determining region 3 for antibody 32443
ARGGGVATSYGMDV

SEQ ID NO: 64887 - protein, 9 aa, Homo sapiens
  light chain complementarity determining region 3 for antibody 32444
QQSYRTPYT

SEQ ID NO: 64888 - protein, 12 aa, Homo sapiens
  heavy chain complementarity determining region 3 for antibody 32444
AREYGAPGAFDI

SEQ ID NO: 64889 - protein, 9 aa, Homo sapiens
  light chain complementarity determining region 3 for antibody 32445
QQRDNWPPL

SEQ ID NO: 64890 - protein, 16 aa, Homo sapiens
  heavy chain complementarity determining region 3 for antibody 32445
ARLLDPDGYNFWYFDY

SEQ ID NO: 64891 - protein, 10 aa, Homo sapiens
  light chain complementarity determining region 3 for antibody 32446
QQNDSSAMFT

SEQ ID NO: 64892 - protein, 13 aa, Homo sapiens
  heavy chain complementarity determining region 3 for antibody 32446
ARVSGWSRGGFDY

SEQ ID NO: 64893 - protein, 9 aa, Homo sapiens
  light chain complementarity determining region 3 for antibody 32447
QQLKSYPLT

SEQ ID NO: 64894 - protein, 13 aa, Homo sapiens
  heavy chain complementarity determining region 3 for antibody 32447
VPVMEVTLGAFAF

SEQ ID NO: 64895 - protein, 10 aa, Homo sapiens
  light chain complementarity determining region 3 for antibody 32448
QQFDSSPRWT

SEQ ID NO: 64896 - protein, 16 aa, Homo sapiens
  heavy chain complementarity determining region 3 for antibody 32448
ARDSSIVVIPGGFLDL

SEQ ID NO: 64897 - protein, 9 aa, Homo sapiens
  light chain complementarity determining region 3 for antibody 32449
MQALQSPIT

SEQ ID NO: 64898 - protein, 12 aa, Homo sapiens
  heavy chain complementarity determining region 3 for antibody 32449
ARDGGKSWSELT

SEQ ID NO: 64899 - protein, 9 aa, Homo sapiens
  light chain complementarity determining region 3 for antibody 32450
LQHDSFPYT

SEQ ID NO: 64900 - protein, 15 aa, Homo sapiens
  heavy chain complementarity determining region 3 for antibody 32450
ARTSVRGADSYYFDY

SEQ ID NO: 64901 - protein, 9 aa, Homo sapiens
  light chain complementarity determining region 3 for antibody 32451
LQHDNFPLT

SEQ ID NO: 64902 - protein, 28 aa, Homo sapiens
  heavy chain complementarity determining region 3 for antibody 32451
ARDRSKSDYGSGSYLPGKVLYYYYGMDV

SEQ ID NO: 64903 - protein, 9 aa, Homo sapiens
  light chain complementarity determining region 3 for antibody 32452
LHDYTYPRT

SEQ ID NO: 64904 - protein, 18 aa, Homo sapiens
  heavy chain complementarity determining region 3 for antibody 32452
ARDLDIEISPNYYDAYDI

SEQ ID NO: 64905 - protein, 9 aa, Homo sapiens
  light chain complementarity determining region 3 for antibody 32453
HQFGSLPRT

SEQ ID NO: 64906 - protein, 17 aa, Homo sapiens
  heavy chain complementarity determining region 3 for antibody 32453
ARVGPWLQYSGYDYPDY

SEQ ID NO: 64907 - protein, 9 aa, Homo sapiens
  light chain complementarity determining region 3 for antibody 32454
HHTYTFPRT

SEQ ID NO: 64908 - protein, 20 aa, Homo sapiens
  heavy chain complementarity determining region 3 for antibody 32454
ARGRRIAALSTAHYYYGMDV

SEQ ID NO: 64909 - protein, 9 aa, Homo sapiens
  light chain complementarity determining region 3 for antibody 32455
VQAELFPLT

SEQ ID NO: 64910 - protein, 14 aa, Homo sapiens
  heavy chain complementarity determining region 3 for antibody 32455
VRDADSGGPNDMDV

SEQ ID NO: 64911 - protein, 9 aa, Homo sapiens
  light chain complementarity determining region 3 for antibody 32456
QQYSDSPLT

SEQ ID NO: 64912 - protein, 11 aa, Homo sapiens
  heavy chain complementarity determining region 3 for antibody 32456
VRLLVVAGTGV

SEQ ID NO: 64913 - protein, 8 aa, Homo sapiens
  light chain complementarity determining region 3 for antibody 32457
QQYNNWPT

SEQ ID NO: 64914 - protein, 12 aa, Homo sapiens
  heavy chain complementarity determining region 3 for antibody 32457
AKPLPASAYFDS

SEQ ID NO: 64915 - protein, 9 aa, Homo sapiens
  light chain complementarity determining region 3 for antibody 32458
QQYGNSPRT

SEQ ID NO: 64916 - protein, 15 aa, Homo sapiens
  heavy chain complementarity determining region 3 for antibody 32458
ARGNYYGSGSYYRED

SEQ ID NO: 64917 - protein, 10 aa, Homo sapiens
  light chain complementarity determining region 3 for antibody 32459
QQYGGSPSFT

SEQ ID NO: 64918 - protein, 14 aa, Homo sapiens
  heavy chain complementarity determining region 3 for antibody 32459
ARRDYIGTLHYFDP

SEQ ID NO: 64919 - protein, 9 aa, Homo sapiens
  light chain complementarity determining region 3 for antibody 32460
QQYANPPYT

SEQ ID NO: 64920 - protein, 10 aa, Homo sapiens
  heavy chain complementarity determining region 3 for antibody 32460
ARVGKRWGDY

SEQ ID NO: 64921 - protein, 10 aa, Homo sapiens
  light chain complementarity determining region 3 for antibody 32461
QQSHHWPPWT

SEQ ID NO: 64922 - protein, 18 aa, Homo sapiens
  heavy chain complementarity determining region 3 for antibody 32461
ARGVPPFWAPGGVGPFDF

SEQ ID NO: 64923 - protein, 9 aa, Homo sapiens
  light chain complementarity determining region 3 for antibody 32462
QQHGSSPLT

SEQ ID NO: 64924 - protein, 18 aa, Homo sapiens
  heavy chain complementarity determining region 3 for antibody 32462
ASTNTGPVKWGPENYFDY

SEQ ID NO: 64925 - protein, 9 aa, Homo sapiens
  light chain complementarity determining region 3 for antibody 32463
QQCAVSPLT

SEQ ID NO: 64926 - protein, 10 aa, Homo sapiens
  heavy chain complementarity determining region 3 for antibody 32463
SSGSGWTSED

SEQ ID NO: 64927 - protein, 9 aa, Homo sapiens
  light chain complementarity determining region 3 for antibody 32464
LQDFNYPRT

SEQ ID NO: 64928 - protein, 18 aa, Homo sapiens
  heavy chain complementarity determining region 3 for antibody 32464
ARDLSPSGYGYGIDAFDF

SEQ ID NO: 64929 - protein, 10 aa, Homo sapiens
  light chain complementarity determining region 3 for antibody 32465
QQYNSYSPLT

SEQ ID NO: 64930 - protein, 12 aa, Homo sapiens
  heavy chain complementarity determining region 3 for antibody 32465
THFNWDRGTFDY

SEQ ID NO: 64931 - protein, 9 aa, Homo sapiens
  light chain complementarity determining region 3 for antibody 32466
QQYGSIPRT

SEQ ID NO: 64932 - protein, 13 aa, Homo sapiens
  heavy chain complementarity determining region 3 for antibody 32466
ALGHYHTTGYSEF

SEQ ID NO: 64933 - protein, 9 aa, Homo sapiens
  light chain complementarity determining region 3 for antibody 32467
QQGYSSPYT

SEQ ID NO: 64934 - protein, 14 aa, Homo sapiens
  heavy chain complementarity determining region 3 for antibody 32467
ARDPQKGKPDYFDY

SEQ ID NO: 64935 - protein, 9 aa, Homo sapiens
  light chain complementarity determining region 3 for antibody 32468
QQANSFLIT

SEQ ID NO: 64936 - protein, 10 aa, Homo sapiens
  heavy chain complementarity determining region 3 for antibody 32468
ARRSVGAFDL

SEQ ID NO: 64937 - protein, 9 aa, Homo sapiens
  light chain complementarity determining region 3 for antibody 32469
QHLNSYPLA

SEQ ID NO: 64938 - protein, 16 aa, Homo sapiens
  heavy chain complementarity determining region 3 for antibody 32469
ARKMTPGNPGKNYFDP

SEQ ID NO: 64939 - protein, 9 aa, Homo sapiens
  light chain complementarity determining region 3 for antibody 32470
MQDYRFPYS

SEQ ID NO: 64940 - protein, 16 aa, Homo sapiens
  heavy chain complementarity determining region 3 for antibody 32470
ARDGLGSEAMEVGFDV

SEQ ID NO: 64941 - protein, 9 aa, Homo sapiens
  light chain complementarity determining region 3 for antibody 32471
LQHNSYPRS

SEQ ID NO: 64942 - protein, 13 aa, Homo sapiens
  heavy chain complementarity determining region 3 for antibody 32471
AREIYSSSFSFDY

SEQ ID NO: 64943 - protein, 9 aa, Homo sapiens
  light chain complementarity determining region 3 for antibody 32472
HQYGSIPLT

SEQ ID NO: 64944 - protein, 14 aa, Homo sapiens
  heavy chain complementarity determining region 3 for antibody 32472
ARGGRYTSSWYLDH

SEQ ID NO: 64945 - protein, 9 aa, Homo sapiens
  light chain complementarity determining region 3 for antibody 32473
HQTYSTPYT

SEQ ID NO: 64946 - protein, 7 aa, Homo sapiens
  heavy chain complementarity determining region 3 for antibody 32473
ASTRGGY

SEQ ID NO: 64947 - protein, 9 aa, Homo sapiens
  light chain complementarity determining region 3 for antibody 32474
QQYYGYPHT

SEQ ID NO: 64948 - protein, 12 aa, Homo sapiens
  heavy chain complementarity determining region 3 for antibody 32474
ARTYGSGSYVDY

SEQ ID NO: 64949 - protein, 11 aa, Homo sapiens
  light chain complementarity determining region 3 for antibody 32475
QQYVSSPPGFT

SEQ ID NO: 64950 - protein, 18 aa, Homo sapiens
  heavy chain complementarity determining region 3 for antibody 32475
AKVSRGLNHGSGSYYFDF

SEQ ID NO: 64951 - protein, 10 aa, Homo sapiens
  light chain complementarity determining region 3 for antibody 32476
QQYSGSPALT

SEQ ID NO: 64952 - protein, 15 aa, Homo sapiens
  heavy chain complementarity determining region 3 for antibody 32476
AKDAWYSSGWYFFDQ

SEQ ID NO: 64953 - protein, 10 aa, Homo sapiens
  light chain complementarity determining region 3 for antibody 32477
QQYGGTPPFS

SEQ ID NO: 64954 - protein, 12 aa, Homo sapiens
  heavy chain complementarity determining region 3 for antibody 32477
ARETGGSYYMDA

SEQ ID NO: 64955 - protein, 9 aa, Homo sapiens
  light chain complementarity determining region 3 for antibody 32478
QQSYSSPLT

SEQ ID NO: 64956 - protein, 16 aa, Homo sapiens
  heavy chain complementarity determining region 3 for antibody 32478
AREGGSTYTTKRAFDS

SEQ ID NO: 64957 - protein, 9 aa, Homo sapiens
  light chain complementarity determining region 3 for antibody 32479
QQSYKTPWT

SEQ ID NO: 64958 - protein, 18 aa, Homo sapiens
  heavy chain complementarity determining region 3 for antibody 32479
ARATAWELLFQYYYAMDV

SEQ ID NO: 64959 - protein, 9 aa, Homo sapiens
  light chain complementarity determining region 3 for antibody 32480
QQRSNWPST

SEQ ID NO: 64960 - protein, 19 aa, Homo sapiens
  heavy chain complementarity determining region 3 for antibody 32480
ARDPQHYSNSSGYYYEPDH

SEQ ID NO: 64961 - protein, 9 aa, Homo sapiens
  light chain complementarity determining region 3 for antibody 32481
QQFYTYPLT

SEQ ID NO: 64962 - protein, 12 aa, Homo sapiens
  heavy chain complementarity determining region 3 for antibody 32481
TRVLSSAIGEWD

SEQ ID NO: 64963 - protein, 9 aa, Homo sapiens
  light chain complementarity determining region 3 for antibody 32482
QQAYSSPYT

SEQ ID NO: 64964 - protein, 14 aa, Homo sapiens
  heavy chain complementarity determining region 3 for antibody 32482
ARDPQRGKPDYFDY

SEQ ID NO: 64965 - protein, 11 aa, Homo sapiens
  light chain complementarity determining region 3 for antibody 32483
QHATNWPPGVT

SEQ ID NO: 64966 - protein, 13 aa, Homo sapiens
  heavy chain complementarity determining region 3 for antibody 32483
ATNTPGSTADFTY

SEQ ID NO: 64967 - protein, 9 aa, Homo sapiens
  light chain complementarity determining region 3 for antibody 32484
MGTLQTPPT

SEQ ID NO: 64968 - protein, 15 aa, Homo sapiens
  heavy chain complementarity determining region 3 for antibody 32484
TRDGKKDGHNDAFDI

SEQ ID NO: 64969 - protein, 10 aa, Homo sapiens
  light chain complementarity determining region 3 for antibody 32485
QQYSSSISYT

SEQ ID NO: 64970 - protein, 15 aa, Homo sapiens
  heavy chain complementarity determining region 3 for antibody 32485
ARGRYDSGGWGYFQL

SEQ ID NO: 64971 - protein, 8 aa, Homo sapiens
  light chain complementarity determining region 3 for antibody 32486
QQYNNWPT

SEQ ID NO: 64972 - protein, 16 aa, Homo sapiens
  heavy chain complementarity determining region 3 for antibody 32486
AREGMTTDPSRAAFDL

SEQ ID NO: 64973 - protein, 8 aa, Homo sapiens
  light chain complementarity determining region 3 for antibody 32487
QQYGTSYT

SEQ ID NO: 64974 - protein, 17 aa, Homo sapiens
  heavy chain complementarity determining region 3 for antibody 32487
ARHPGYYDSSGSDAFDI

SEQ ID NO: 64975 - protein, 9 aa, Homo sapiens
  light chain complementarity determining region 3 for antibody 32488
QQYATSPLT

SEQ ID NO: 64976 - protein, 10 aa, Homo sapiens
  heavy chain complementarity determining region 3 for antibody 32488
VAGAGWLPDY

SEQ ID NO: 64977 - protein, 8 aa, Homo sapiens
  light chain complementarity determining region 3 for antibody 32489
QQYASSHT

SEQ ID NO: 64978 - protein, 17 aa, Homo sapiens
  heavy chain complementarity determining region 3 for antibody 32489
ATVKSDYGMGTLGRLDD

SEQ ID NO: 64979 - protein, 9 aa, Homo sapiens
  light chain complementarity determining region 3 for antibody 32490
QQSYTTPQP

SEQ ID NO: 64980 - protein, 11 aa, Homo sapiens
  heavy chain complementarity determining region 3 for antibody 32490
ARDGPTSAFDI

SEQ ID NO: 64981 - protein, 9 aa, Homo sapiens
  light chain complementarity determining region 3 for antibody 32491
QQSYSLPRT

SEQ ID NO: 64982 - protein, 13 aa, Homo sapiens
  heavy chain complementarity determining region 3 for antibody 32491
VYCSTDKCYAFDN

SEQ ID NO: 64983 - protein, 9 aa, Homo sapiens
  light chain complementarity determining region 3 for antibody 32492
QQRSNWPQT

SEQ ID NO: 64984 - protein, 20 aa, Homo sapiens
  heavy chain complementarity determining region 3 for antibody 32492
ARLPPVAARKRSYYYYGMDV

SEQ ID NO: 64985 - protein, 9 aa, Homo sapiens
  light chain complementarity determining region 3 for antibody 32493
QHYRRAPYT

SEQ ID NO: 64986 - protein, 16 aa, Homo sapiens
  heavy chain complementarity determining region 3 for antibody 32493
ARDQGFCRGPNCYMLF

SEQ ID NO: 64987 - protein, 9 aa, Homo sapiens
  light chain complementarity determining region 3 for antibody 32494
MQGTHTPPT

SEQ ID NO: 64988 - protein, 12 aa, Homo sapiens
  heavy chain complementarity determining region 3 for antibody 32494
VKVWGWLNDGGY

SEQ ID NO: 64989 - protein, 8 aa, Homo sapiens
  light chain complementarity determining region 3 for antibody 32495
QQYNTWLS

SEQ ID NO: 64990 - protein, 12 aa, Homo sapiens
  heavy chain complementarity determining region 3 for antibody 32495
ARLLWDSYYFDS

SEQ ID NO: 64991 - protein, 9 aa, Homo sapiens
  light chain complementarity determining region 3 for antibody 32496
QQYNNYPLT

SEQ ID NO: 64992 - protein, 12 aa, Homo sapiens
  heavy chain complementarity determining region 3 for antibody 32496
ATYRHYPDYSDF

SEQ ID NO: 64993 - protein, 9 aa, Homo sapiens
  light chain complementarity determining region 3 for antibody 32497
QQYGSSPTT

SEQ ID NO: 64994 - protein, 15 aa, Homo sapiens
  heavy chain complementarity determining region 3 for antibody 32497
SRDLLWFGPTSAFDF

SEQ ID NO: 64995 - protein, 9 aa, Homo sapiens
  light chain complementarity determining region 3 for antibody 32498
QQYDTTPWT

SEQ ID NO: 64996 - protein, 20 aa, Homo sapiens
  heavy chain complementarity determining region 3 for antibody 32498
ATDKKGVYYDGSEYYWGFDY

SEQ ID NO: 64997 - protein, 9 aa, Homo sapiens
  light chain complementarity determining region 3 for antibody 32499
QQSYSTQWT

SEQ ID NO: 64998 - protein, 10 aa, Homo sapiens
  heavy chain complementarity determining region 3 for antibody 32499
AREKWAGPDY

SEQ ID NO: 64999 - protein, 9 aa, Homo sapiens
  light chain complementarity determining region 3 for antibody 32500
MQRVQTPGT

SEQ ID NO: 65000 - protein, 17 aa, Homo sapiens
  heavy chain complementarity determining region 3 for antibody 32500
IPVMLVRFLEDLQLFNY

SEQ ID NO: 65001 - protein, 9 aa, Homo sapiens
  light chain complementarity determining region 3 for antibody 32501
MQALETPFT

SEQ ID NO: 65002 - protein, 15 aa, Homo sapiens
  heavy chain complementarity determining region 3 for antibody 32501
VRHYRITVAAVEGDS

SEQ ID NO: 65003 - protein, 9 aa, Homo sapiens
  light chain complementarity determining region 3 for antibody 32502
LQYGFAQYS

SEQ ID NO: 65004 - protein, 18 aa, Homo sapiens
  heavy chain complementarity determining region 3 for antibody 32502
TGVHGLTMLRGATKPFDF

SEQ ID NO: 65005 - protein, 9 aa, Homo sapiens
  light chain complementarity determining region 3 for antibody 32503
LQHHLFPWT

SEQ ID NO: 65006 - protein, 11 aa, Homo sapiens
  heavy chain complementarity determining region 3 for antibody 32503
VRDVPTAHLDY

SEQ ID NO: 65007 - protein, 9 aa, Homo sapiens
  light chain complementarity determining region 3 for antibody 32504
QQYYTYPLT

SEQ ID NO: 65008 - protein, 15 aa, Homo sapiens
  heavy chain complementarity determining region 3 for antibody 32504
AHGAWVRGVTSRFDY

SEQ ID NO: 65009 - protein, 9 aa, Homo sapiens
  light chain complementarity determining region 3 for antibody 32505
QQYYSYPYT

SEQ ID NO: 65010 - protein, 16 aa, Homo sapiens
  heavy chain complementarity determining region 3 for antibody 32505
ARDAAHRRDGYNAIDY

SEQ ID NO: 65011 - protein, 9 aa, Homo sapiens
  light chain complementarity determining region 3 for antibody 32506
QQYGNSPRT

SEQ ID NO: 65012 - protein, 15 aa, Homo sapiens
  heavy chain complementarity determining region 3 for antibody 32506
ARGVGTTGIFGYLDN

SEQ ID NO: 65013 - protein, 9 aa, Homo sapiens
  light chain complementarity determining region 3 for antibody 32507
QQYGDSPYT

SEQ ID NO: 65014 - protein, 22 aa, Homo sapiens
  heavy chain complementarity determining region 3 for antibody 32507
TRRRPTGRTSLRRGGRQGAFDI

SEQ ID NO: 65015 - protein, 9 aa, Homo sapiens
  light chain complementarity determining region 3 for antibody 32508
QQYAYSPLT

SEQ ID NO: 65016 - protein, 10 aa, Homo sapiens
  heavy chain complementarity determining region 3 for antibody 32508
ATGAGWLVDY

SEQ ID NO: 65017 - protein, 8 aa, Homo sapiens
  light chain complementarity determining region 3 for antibody 32509
QQSYSNPI

SEQ ID NO: 65018 - protein, 18 aa, Homo sapiens
  heavy chain complementarity determining region 3 for antibody 32509
AKDRQGGLYRYGDYEFDY

SEQ ID NO: 65019 - protein, 8 aa, Homo sapiens
  light chain complementarity determining region 3 for antibody 32510
QQRSNWYT

SEQ ID NO: 65020 - protein, 13 aa, Homo sapiens
  heavy chain complementarity determining region 3 for antibody 32510
ARDGVPGKFSRAY

SEQ ID NO: 65021 - protein, 9 aa, Homo sapiens
  light chain complementarity determining region 3 for antibody 32511
QQNDRLPPT

SEQ ID NO: 65022 - protein, 16 aa, Homo sapiens
  heavy chain complementarity determining region 3 for antibody 32511
ARLSFRRHDGRGSFGH

SEQ ID NO: 65023 - protein, 9 aa, Homo sapiens
  light chain complementarity determining region 3 for antibody 32512
QHSHSRPFT

SEQ ID NO: 65024 - protein, 20 aa, Homo sapiens
  heavy chain complementarity determining region 3 for antibody 32512
AKGISVAALRTVYYYYGMDV

SEQ ID NO: 65025 - protein, 9 aa, Homo sapiens
  light chain complementarity determining region 3 for antibody 32513
MQALQTPPT

SEQ ID NO: 65026 - protein, 15 aa, Homo sapiens
  heavy chain complementarity determining region 3 for antibody 32513
ARDGLRDGFSDAFDI

SEQ ID NO: 65027 - protein, 9 aa, Homo sapiens
  light chain complementarity determining region 3 for antibody 32514
MQALDTPFT

SEQ ID NO: 65028 - protein, 15 aa, Homo sapiens
  heavy chain complementarity determining region 3 for antibody 32514
VRHYRELATGIEGDS

SEQ ID NO: 65029 - protein, 9 aa, Homo sapiens
  light chain complementarity determining region 3 for antibody 32515
LQHNSFPWT

SEQ ID NO: 65030 - protein, 11 aa, Homo sapiens
  heavy chain complementarity determining region 3 for antibody 32515
VRDVPTAHFDY

SEQ ID NO: 65031 - protein, 9 aa, Homo sapiens
  light chain complementarity determining region 3 for antibody 32516
HQTSSLPQT

SEQ ID NO: 65032 - protein, 9 aa, Homo sapiens
  heavy chain complementarity determining region 3 for antibody 32516
ARGLWAMDV

SEQ ID NO: 65033 - protein, 8 aa, Homo sapiens
  light chain complementarity determining region 3 for antibody 32517
QQYNVFWT

SEQ ID NO: 65034 - protein, 10 aa, Homo sapiens
  heavy chain complementarity determining region 3 for antibody 32517
ATDRRSVLSY

SEQ ID NO: 65035 - protein, 8 aa, Homo sapiens
  light chain complementarity determining region 3 for antibody 32518
QQYNRYLT

SEQ ID NO: 65036 - protein, 15 aa, Homo sapiens
  heavy chain complementarity determining region 3 for antibody 32518
AKSTVTTMSGGHVDS

SEQ ID NO: 65037 - protein, 9 aa, Homo sapiens
  light chain complementarity determining region 3 for antibody 32519
QQYGSSPGT

SEQ ID NO: 65038 - protein, 18 aa, Homo sapiens
  heavy chain complementarity determining region 3 for antibody 32519
SRIDYYDTNGWSLDAFHI

SEQ ID NO: 65039 - protein, 9 aa, Homo sapiens
  light chain complementarity determining region 3 for antibody 32520
QQRSNWPPT

SEQ ID NO: 65040 - protein, 15 aa, Homo sapiens
  heavy chain complementarity determining region 3 for antibody 32520
ARAGDLIAAAGLMDV

SEQ ID NO: 65041 - protein, 10 aa, Homo sapiens
  light chain complementarity determining region 3 for antibody 32521
QQRSNWPPIT

SEQ ID NO: 65042 - protein, 14 aa, Homo sapiens
  heavy chain complementarity determining region 3 for antibody 32521
ARDDSSGHPDAFDI

SEQ ID NO: 65043 - protein, 9 aa, Homo sapiens
  light chain complementarity determining region 3 for antibody 32522
QQNNDIPRT

SEQ ID NO: 65044 - protein, 10 aa, Homo sapiens
  heavy chain complementarity determining region 3 for antibody 32522
ATSVGFGFDY

SEQ ID NO: 65045 - protein, 9 aa, Homo sapiens
  light chain complementarity determining region 3 for antibody 32523
QQGYSPPFT

SEQ ID NO: 65046 - protein, 15 aa, Homo sapiens
  heavy chain complementarity determining region 3 for antibody 32523
AKAQVIWGQLYYFES

SEQ ID NO: 65047 - protein, 9 aa, Homo sapiens
  light chain complementarity determining region 3 for antibody 32524
QQFNNYSWT

SEQ ID NO: 65048 - protein, 17 aa, Homo sapiens
  heavy chain complementarity determining region 3 for antibody 32524
VRGIDYYGSGGHHWFDP

SEQ ID NO: 65049 - protein, 9 aa, Homo sapiens
  light chain complementarity determining region 3 for antibody 32525
QQANSFPFT

SEQ ID NO: 65050 - protein, 18 aa, Homo sapiens
  heavy chain complementarity determining region 3 for antibody 32525
ARAGYCSGGSCYSGFFDY

SEQ ID NO: 65051 - protein, 8 aa, Homo sapiens
  light chain complementarity determining region 3 for antibody 32526
QLSCTTPT

SEQ ID NO: 65052 - protein, 14 aa, Homo sapiens
  heavy chain complementarity determining region 3 for antibody 32526
TRRQGGGSLDAFDI

SEQ ID NO: 65053 - protein, 8 aa, Homo sapiens
  light chain complementarity determining region 3 for antibody 32527
QHRSDWPT

SEQ ID NO: 65054 - protein, 12 aa, Homo sapiens
  heavy chain complementarity determining region 3 for antibody 32527
VRQSPQNWFYDL

SEQ ID NO: 65055 - protein, 10 aa, Homo sapiens
  light chain complementarity determining region 3 for antibody 32528
QEYNNLGIFT

SEQ ID NO: 65056 - protein, 18 aa, Homo sapiens
  heavy chain complementarity determining region 3 for antibody 32528
ARVPTYYYGWGGSGWFDP

SEQ ID NO: 65057 - protein, 9 aa, Homo sapiens
  light chain complementarity determining region 3 for antibody 32529
LQDYNYPWT

SEQ ID NO: 65058 - protein, 14 aa, Homo sapiens
  heavy chain complementarity determining region 3 for antibody 32529
ARLLDVEARGAFEN

SEQ ID NO: 65059 - protein, 9 aa, Homo sapiens
  light chain complementarity determining region 3 for antibody 32530
HQSSSLQET

SEQ ID NO: 65060 - protein, 12 aa, Homo sapiens
  heavy chain complementarity determining region 3 for antibody 32530
VKDCGLGGSRDF

SEQ ID NO: 65061 - protein, 9 aa, Homo sapiens
  light chain complementarity determining region 3 for antibody 32531
QQYGTIPRT

SEQ ID NO: 65062 - protein, 13 aa, Homo sapiens
  heavy chain complementarity determining region 3 for antibody 32531
AGGIFHSRGYGEY

SEQ ID NO: 65063 - protein, 9 aa, Homo sapiens
  light chain complementarity determining region 3 for antibody 32532
QQYGSSPRT

SEQ ID NO: 65064 - protein, 9 aa, Homo sapiens
  heavy chain complementarity determining region 3 for antibody 32532
ARRSYGRDY

SEQ ID NO: 65065 - protein, 9 aa, Homo sapiens
  light chain complementarity determining region 3 for antibody 32533
QQSYSIPRT

SEQ ID NO: 65066 - protein, 12 aa, Homo sapiens
  heavy chain complementarity determining region 3 for antibody 32533
ARNGAGSYGMDV

SEQ ID NO: 65067 - protein, 8 aa, Homo sapiens
  light chain complementarity determining region 3 for antibody 32534
QQRSTLYS

SEQ ID NO: 65068 - protein, 17 aa, Homo sapiens
  heavy chain complementarity determining region 3 for antibody 32534
ARRYWNPSSGWFQDFDY

SEQ ID NO: 65069 - protein, 8 aa, Homo sapiens
  light chain complementarity determining region 3 for antibody 32535
QQRSNLLT

SEQ ID NO: 65070 - protein, 21 aa, Homo sapiens
  heavy chain complementarity determining region 3 for antibody 32535
NTYVEWRSNNWFAYFYYGMDV

SEQ ID NO: 65071 - protein, 9 aa, Homo sapiens
  light chain complementarity determining region 3 for antibody 32536
QNYNSDPFT

SEQ ID NO: 65072 - protein, 8 aa, Homo sapiens
  heavy chain complementarity determining region 3 for antibody 32536
VRGQYFDL

SEQ ID NO: 65073 - protein, 9 aa, Homo sapiens
  light chain complementarity determining region 3 for antibody 32537
QKYNSAPQT

SEQ ID NO: 65074 - protein, 13 aa, Homo sapiens
  heavy chain complementarity determining region 3 for antibody 32537
ARDRLVGKALLDY

SEQ ID NO: 65075 - protein, 11 aa, Homo sapiens
  light chain complementarity determining region 3 for antibody 32538
QHYSTSSLALT

SEQ ID NO: 65076 - protein, 16 aa, Homo sapiens
  heavy chain complementarity determining region 3 for antibody 32538
ARFFLAGYSWYEGVDY

SEQ ID NO: 65077 - protein, 9 aa, Homo sapiens
  light chain complementarity determining region 3 for antibody 32539
QEYSTSRGT

SEQ ID NO: 65078 - protein, 15 aa, Homo sapiens
  heavy chain complementarity determining region 3 for antibody 32539
ARNLMLNTKGYWVDF

SEQ ID NO: 65079 - protein, 9 aa, Homo sapiens
  light chain complementarity determining region 3 for antibody 32540
MQSTHWPWT

SEQ ID NO: 65080 - protein, 10 aa, Homo sapiens
  heavy chain complementarity determining region 3 for antibody 32540
VQDHRYGSGN

SEQ ID NO: 65081 - protein, 9 aa, Homo sapiens
  light chain complementarity determining region 3 for antibody 32541
LQHSTSPRT

SEQ ID NO: 65082 - protein, 11 aa, Homo sapiens
  heavy chain complementarity determining region 3 for antibody 32541
TTGLGSGGINW

SEQ ID NO: 65083 - protein, 9 aa, Homo sapiens
  light chain complementarity determining region 3 for antibody 32542
LQDFTYPFT

SEQ ID NO: 65084 - protein, 10 aa, Homo sapiens
  heavy chain complementarity determining region 3 for antibody 32542
AKERAGEPDY

SEQ ID NO: 65085 - protein, 10 aa, Homo sapiens
  light chain complementarity determining region 3 for antibody 32543
QQYNNWPPRT

SEQ ID NO: 65086 - protein, 12 aa, Homo sapiens
  heavy chain complementarity determining region 3 for antibody 32543
ARDLIYSSGFDY

SEQ ID NO: 65087 - protein, 9 aa, Homo sapiens
  light chain complementarity determining region 3 for antibody 32544
QQYNGYLWT

SEQ ID NO: 65088 - protein, 14 aa, Homo sapiens
  heavy chain complementarity determining region 3 for antibody 32544
MIRGHSYDFDPRPF

SEQ ID NO: 65089 - protein, 9 aa, Homo sapiens
  light chain complementarity determining region 3 for antibody 32545
QQYGSSPQT

SEQ ID NO: 65090 - protein, 14 aa, Homo sapiens
  heavy chain complementarity determining region 3 for antibody 32545
TRDPIPYSSWYFDL

SEQ ID NO: 65091 - protein, 10 aa, Homo sapiens
  light chain complementarity determining region 3 for antibody 32546
QQYGGSLPWT

SEQ ID NO: 65092 - protein, 16 aa, Homo sapiens
  heavy chain complementarity determining region 3 for antibody 32546
ARWIATPLVPRGPMDV

SEQ ID NO: 65093 - protein, 9 aa, Homo sapiens
  light chain complementarity determining region 3 for antibody 32547
QQSYSTPRT

SEQ ID NO: 65094 - protein, 19 aa, Homo sapiens
  heavy chain complementarity determining region 3 for antibody 32547
ARDWMAWFGAQRRENAFDI

SEQ ID NO: 65095 - protein, 9 aa, Homo sapiens
  light chain complementarity determining region 3 for antibody 32548
QQSYSSPFT

SEQ ID NO: 65096 - protein, 13 aa, Homo sapiens
  heavy chain complementarity determining region 3 for antibody 32548
ARKGDYYYYGMDV

SEQ ID NO: 65097 - protein, 9 aa, Homo sapiens
  light chain complementarity determining region 3 for antibody 32549
QQSYSDPWT

SEQ ID NO: 65098 - protein, 12 aa, Homo sapiens
  heavy chain complementarity determining region 3 for antibody 32549
ARGGVVAGRNDY

SEQ ID NO: 65099 - protein, 10 aa, Homo sapiens
  light chain complementarity determining region 3 for antibody 32550
QQRSKWPPLT

SEQ ID NO: 65100 - protein, 9 aa, Homo sapiens
  heavy chain complementarity determining region 3 for antibody 32550
ARVDGYFDY

SEQ ID NO: 65101 - protein, 10 aa, Homo sapiens
  light chain complementarity determining region 3 for antibody 32551
QQRSDWPPYT

SEQ ID NO: 65102 - protein, 18 aa, Homo sapiens
  heavy chain complementarity determining region 3 for antibody 32551
AREGRSGYRIPAAYGMDV

SEQ ID NO: 65103 - protein, 8 aa, Homo sapiens
  light chain complementarity determining region 3 for antibody 32552
QQNESLIT

SEQ ID NO: 65104 - protein, 19 aa, Homo sapiens
  heavy chain complementarity determining region 3 for antibody 32552
ARHGKNAYSSGSRWGAFDI

SEQ ID NO: 65105 - protein, 9 aa, Homo sapiens
  light chain complementarity determining region 3 for antibody 32553
QQANSFPRT

SEQ ID NO: 65106 - protein, 15 aa, Homo sapiens
  heavy chain complementarity determining region 3 for antibody 32553
ARGVPHLGVWHAFDI

SEQ ID NO: 65107 - protein, 10 aa, Homo sapiens
  light chain complementarity determining region 3 for antibody 32554
QEYGNLPLVT

SEQ ID NO: 65108 - protein, 15 aa, Homo sapiens
  heavy chain complementarity determining region 3 for antibody 32554
AVWGPGSDWWPLYDY

SEQ ID NO: 65109 - protein, 9 aa, Homo sapiens
  light chain complementarity determining region 3 for antibody 32555
MQVLQAPLS

SEQ ID NO: 65110 - protein, 18 aa, Homo sapiens
  heavy chain complementarity determining region 3 for antibody 32555
ARPKVGATDYHYYFGMDV

SEQ ID NO: 65111 - protein, 9 aa, Homo sapiens
  light chain complementarity determining region 3 for antibody 32556
MQALETPFT

SEQ ID NO: 65112 - protein, 15 aa, Homo sapiens
  heavy chain complementarity determining region 3 for antibody 32556
LRHYRSLATGTEEDC

SEQ ID NO: 65113 - protein, 9 aa, Homo sapiens
  light chain complementarity determining region 3 for antibody 32557
HQHYTTPHT

SEQ ID NO: 65114 - protein, 10 aa, Homo sapiens
  heavy chain complementarity determining region 3 for antibody 32557
ARGSYNSVWA

SEQ ID NO: 65115 - protein, 9 aa, Homo sapiens
  light chain complementarity determining region 3 for antibody 32558
QQYVSSPDT

SEQ ID NO: 65116 - protein, 14 aa, Homo sapiens
  heavy chain complementarity determining region 3 for antibody 32558
ARGGNYGSGSYLHY

SEQ ID NO: 65117 - protein, 9 aa, Homo sapiens
  light chain complementarity determining region 3 for antibody 32559
QQYVRAPWT

SEQ ID NO: 65118 - protein, 12 aa, Homo sapiens
  heavy chain complementarity determining region 3 for antibody 32559
LGSTGSDYYFDY

SEQ ID NO: 65119 - protein, 9 aa, Homo sapiens
  light chain complementarity determining region 3 for antibody 32560
QQYHDRPET

SEQ ID NO: 65120 - protein, 20 aa, Homo sapiens
  heavy chain complementarity determining region 3 for antibody 32560
SRRHLLVGGDRVAAGRAADY

SEQ ID NO: 65121 - protein, 9 aa, Homo sapiens
  light chain complementarity determining region 3 for antibody 32561
QQYGSAPDT

SEQ ID NO: 65122 - protein, 9 aa, Homo sapiens
  heavy chain complementarity determining region 3 for antibody 32561
ASDAGIDHH

SEQ ID NO: 65123 - protein, 9 aa, Homo sapiens
  light chain complementarity determining region 3 for antibody 32562
QQYGGSPNT

SEQ ID NO: 65124 - protein, 14 aa, Homo sapiens
  heavy chain complementarity determining region 3 for antibody 32562
ARATFMIVDYAFDI

SEQ ID NO: 65125 - protein, 9 aa, Homo sapiens
  light chain complementarity determining region 3 for antibody 32563
QQYATSPLT

SEQ ID NO: 65126 - protein, 8 aa, Homo sapiens
  heavy chain complementarity determining region 3 for antibody 32563
VWLFPPGC

SEQ ID NO: 65127 - protein, 9 aa, Homo sapiens
  light chain complementarity determining region 3 for antibody 32564
QQSYNTPRT

SEQ ID NO: 65128 - protein, 18 aa, Homo sapiens
  heavy chain complementarity determining region 3 for antibody 32564
ARGRNYYDGSGRDVYFDY

SEQ ID NO: 65129 - protein, 9 aa, Homo sapiens
  light chain complementarity determining region 3 for antibody 32565
QQSFNTLYT

SEQ ID NO: 65130 - protein, 14 aa, Homo sapiens
  heavy chain complementarity determining region 3 for antibody 32565
ARDVLQYGHRLFDS

SEQ ID NO: 65131 - protein, 9 aa, Homo sapiens
  light chain complementarity determining region 3 for antibody 32566
QQRSNWPWT

SEQ ID NO: 65132 - protein, 10 aa, Homo sapiens
  heavy chain complementarity determining region 3 for antibody 32566
ARIAARRVDY

SEQ ID NO: 65133 - protein, 10 aa, Homo sapiens
  light chain complementarity determining region 3 for antibody 32567
QQRSNWPPWT

SEQ ID NO: 65134 - protein, 16 aa, Homo sapiens
  heavy chain complementarity determining region 3 for antibody 32567
ARDVLRFLEWSPHFDY

SEQ ID NO: 65135 - protein, 9 aa, Homo sapiens
  light chain complementarity determining region 3 for antibody 32568
QQGHSIPWT

SEQ ID NO: 65136 - protein, 16 aa, Homo sapiens
  heavy chain complementarity determining region 3 for antibody 32568
ARLLSGYSGYVPEGDY

SEQ ID NO: 65137 - protein, 10 aa, Homo sapiens
  light chain complementarity determining region 3 for antibody 32569
MQGLLTPGNT

SEQ ID NO: 65138 - protein, 15 aa, Homo sapiens
  heavy chain complementarity determining region 3 for antibody 32569
ATAHPLLGRWHQLDP

SEQ ID NO: 65139 - protein, 9 aa, Homo sapiens
  light chain complementarity determining region 3 for antibody 32570
LQTYIYPRT

SEQ ID NO: 65140 - protein, 9 aa, Homo sapiens
  heavy chain complementarity determining region 3 for antibody 32570
SRGHSGWGY

SEQ ID NO: 65141 - protein, 9 aa, Homo sapiens
  light chain complementarity determining region 3 for antibody 32571
HQYGTSPWV

SEQ ID NO: 65142 - protein, 13 aa, Homo sapiens
  heavy chain complementarity determining region 3 for antibody 32571
VRGGRQFVHDLQD

SEQ ID NO: 65143 - protein, 8 aa, Homo sapiens
  light chain complementarity determining region 3 for antibody 32572
QQYLLYWT

SEQ ID NO: 65144 - protein, 19 aa, Homo sapiens
  heavy chain complementarity determining region 3 for antibody 32572
AKEGLSYDIDDSKRGYFDS

SEQ ID NO: 65145 - protein, 9 aa, Homo sapiens
  light chain complementarity determining region 3 for antibody 32573
QQYGTSPWT

SEQ ID NO: 65146 - protein, 16 aa, Homo sapiens
  heavy chain complementarity determining region 3 for antibody 32573
ASSITIFGVVLRPLDY

SEQ ID NO: 65147 - protein, 9 aa, Homo sapiens
  light chain complementarity determining region 3 for antibody 32574
QQYGSSPNT

SEQ ID NO: 65148 - protein, 22 aa, Homo sapiens
  heavy chain complementarity determining region 3 for antibody 32574
ARHSRNPSPRIGDVMIYYYFDL

SEQ ID NO: 65149 - protein, 9 aa, Homo sapiens
  light chain complementarity determining region 3 for antibody 32575
QQYGSSLWT

SEQ ID NO: 65150 - protein, 17 aa, Homo sapiens
  heavy chain complementarity determining region 3 for antibody 32575
ARDGWYDSSMWFDGFDI

SEQ ID NO: 65151 - protein, 10 aa, Homo sapiens
  light chain complementarity determining region 3 for antibody 32576
QQYGRSPPWT

SEQ ID NO: 65152 - protein, 14 aa, Homo sapiens
  heavy chain complementarity determining region 3 for antibody 32576
ARGGSSGYNHQFDY

SEQ ID NO: 65153 - protein, 10 aa, Homo sapiens
  light chain complementarity determining region 3 for antibody 32577
QQYDNLPPYT

SEQ ID NO: 65154 - protein, 15 aa, Homo sapiens
  heavy chain complementarity determining region 3 for antibody 32577
VRDPGTAGSDWYFDL

SEQ ID NO: 65155 - protein, 9 aa, Homo sapiens
  light chain complementarity determining region 3 for antibody 32578
QQYADSPLT

SEQ ID NO: 65156 - protein, 14 aa, Homo sapiens
  heavy chain complementarity determining region 3 for antibody 32578
AKALFALGWNAFDI

SEQ ID NO: 65157 - protein, 9 aa, Homo sapiens
  light chain complementarity determining region 3 for antibody 32579
QQRSNWPPT

SEQ ID NO: 65158 - protein, 16 aa, Homo sapiens
  heavy chain complementarity determining region 3 for antibody 32579
AKDSGPGDYYHSGMDV

SEQ ID NO: 65159 - protein, 9 aa, Homo sapiens
  light chain complementarity determining region 3 for antibody 32580
QQLSNYPHT

SEQ ID NO: 65160 - protein, 26 aa, Homo sapiens
  heavy chain complementarity determining region 3 for antibody 32580
ARGSRGYKDENSSLRRLQYYQYGMDV

SEQ ID NO: 65161 - protein, 9 aa, Homo sapiens
  light chain complementarity determining region 3 for antibody 32581
QQFDSFPLT

SEQ ID NO: 65162 - protein, 10 aa, Homo sapiens
  heavy chain complementarity determining region 3 for antibody 32581
ARVTFYGMDV

SEQ ID NO: 65163 - protein, 9 aa, Homo sapiens
  light chain complementarity determining region 3 for antibody 32582
QQAHSFPNT

SEQ ID NO: 65164 - protein, 14 aa, Homo sapiens
  heavy chain complementarity determining region 3 for antibody 32582
AREDVALTLYGMGV

SEQ ID NO: 65165 - protein, 9 aa, Homo sapiens
  light chain complementarity determining region 3 for antibody 32583
MQGTHWPWT

SEQ ID NO: 65166 - protein, 12 aa, Homo sapiens
  heavy chain complementarity determining region 3 for antibody 32583
AKGPLIAMTGMI

SEQ ID NO: 65167 - protein, 11 aa, Homo sapiens
  light chain complementarity determining region 3 for antibody 32584
MQGTHWPPMYT

SEQ ID NO: 65168 - protein, 17 aa, Homo sapiens
  heavy chain complementarity determining region 3 for antibody 32584
ARGGSGYYQEGDDTFGF

SEQ ID NO: 65169 - protein, 10 aa, Homo sapiens
  light chain complementarity determining region 3 for antibody 32585
MQATHWPGFT

SEQ ID NO: 65170 - protein, 10 aa, Homo sapiens
  heavy chain complementarity determining region 3 for antibody 32585
ATSQLSTTDY

SEQ ID NO: 65171 - protein, 9 aa, Homo sapiens
  light chain complementarity determining region 3 for antibody 32586
LQYSSYPYT

SEQ ID NO: 65172 - protein, 13 aa, Homo sapiens
  heavy chain complementarity determining region 3 for antibody 32586
SRQHKYNWNDFDY

SEQ ID NO: 65173 - protein, 9 aa, Homo sapiens
  light chain complementarity determining region 3 for antibody 32587
QYYGSAPRT

SEQ ID NO: 65174 - protein, 18 aa, Homo sapiens
  heavy chain complementarity determining region 3 for antibody 32587
AKNRNLPGSNWLHDAFDI

SEQ ID NO: 65175 - protein, 9 aa, Homo sapiens
  light chain complementarity determining region 3 for antibody 32588
QQYNSYPYT

SEQ ID NO: 65176 - protein, 15 aa, Homo sapiens
  heavy chain complementarity determining region 3 for antibody 32588
ARMHATGSYNGAFDV

SEQ ID NO: 65177 - protein, 10 aa, Homo sapiens
  light chain complementarity determining region 3 for antibody 32589
QQYNNWPWYT

SEQ ID NO: 65178 - protein, 17 aa, Homo sapiens
  heavy chain complementarity determining region 3 for antibody 32589
ARHRQQVVSPAYWYFDF

SEQ ID NO: 65179 - protein, 9 aa, Homo sapiens
  light chain complementarity determining region 3 for antibody 32590
QQYGTWPPT

SEQ ID NO: 65180 - protein, 21 aa, Homo sapiens
  heavy chain complementarity determining region 3 for antibody 32590
ARGGGPFYFDHSGFRLYYFHI

SEQ ID NO: 65181 - protein, 10 aa, Homo sapiens
  light chain complementarity determining region 3 for antibody 32591
QQSYRTPMYT

SEQ ID NO: 65182 - protein, 20 aa, Homo sapiens
  heavy chain complementarity determining region 3 for antibody 32591
ARVLTRGGYSYGRGYDVFDI

SEQ ID NO: 65183 - protein, 9 aa, Homo sapiens
  light chain complementarity determining region 3 for antibody 32592
QQSFNTRIT

SEQ ID NO: 65184 - protein, 12 aa, Homo sapiens
  heavy chain complementarity determining region 3 for antibody 32592
ARDFHSGYFFDL

SEQ ID NO: 65185 - protein, 9 aa, Homo sapiens
  light chain complementarity determining region 3 for antibody 32593
QKYYSALLT

SEQ ID NO: 65186 - protein, 17 aa, Homo sapiens
  heavy chain complementarity determining region 3 for antibody 32593
ARDRHYYGSGNYYPFDY

SEQ ID NO: 65187 - protein, 9 aa, Homo sapiens
  light chain complementarity determining region 3 for antibody 32594
MHALQAPRA

SEQ ID NO: 65188 - protein, 13 aa, Homo sapiens
  heavy chain complementarity determining region 3 for antibody 32594
ARPNNALGRAFDI

SEQ ID NO: 65189 - protein, 9 aa, Homo sapiens
  light chain complementarity determining region 3 for antibody 32595
HQSSSLPIT

SEQ ID NO: 65190 - protein, 6 aa, Homo sapiens
  heavy chain complementarity determining region 3 for antibody 32595
ATVFEY

SEQ ID NO: 65191 - protein, 8 aa, Homo sapiens
  light chain complementarity determining region 3 for antibody 32596
QQYNSYWT

SEQ ID NO: 65192 - protein, 12 aa, Homo sapiens
  heavy chain complementarity determining region 3 for antibody 32596
VKDCGLGGSRDF

SEQ ID NO: 65193 - protein, 10 aa, Homo sapiens
  light chain complementarity determining region 3 for antibody 32597
QQYNNWPPYT

SEQ ID NO: 65194 - protein, 14 aa, Homo sapiens
  heavy chain complementarity determining region 3 for antibody 32597
GRWTYSGNDVGLSH

SEQ ID NO: 65195 - protein, 9 aa, Homo sapiens
  light chain complementarity determining region 3 for antibody 32598
QQYGSSPPT

SEQ ID NO: 65196 - protein, 11 aa, Homo sapiens
  heavy chain complementarity determining region 3 for antibody 32598
ARTPLWFGPYF

SEQ ID NO: 65197 - protein, 10 aa, Homo sapiens
  light chain complementarity determining region 3 for antibody 32599
QQYGESPLYT

SEQ ID NO: 65198 - protein, 12 aa, Homo sapiens
  heavy chain complementarity determining region 3 for antibody 32599
ARHKRGTNAFDI

SEQ ID NO: 65199 - protein, 9 aa, Homo sapiens
  light chain complementarity determining region 3 for antibody 32600
QQYESLPLT

SEQ ID NO: 65200 - protein, 11 aa, Homo sapiens
  heavy chain complementarity determining region 3 for antibody 32600
ASQRIHDAFDT

SEQ ID NO: 65201 - protein, 9 aa, Homo sapiens
  light chain complementarity determining region 3 for antibody 32601
QQSYSTLLT

SEQ ID NO: 65202 - protein, 16 aa, Homo sapiens
  heavy chain complementarity determining region 3 for antibody 32601
AREGGGTYTSNRAFDY

SEQ ID NO: 65203 - protein, 9 aa, Homo sapiens
  light chain complementarity determining region 3 for antibody 32602
QQRSNWPYT

SEQ ID NO: 65204 - protein, 11 aa, Homo sapiens
  heavy chain complementarity determining region 3 for antibody 32602
VRRWGGDEVDY

SEQ ID NO: 65205 - protein, 9 aa, Homo sapiens
  light chain complementarity determining region 3 for antibody 32603
QQNNNYPPT

SEQ ID NO: 65206 - protein, 16 aa, Homo sapiens
  heavy chain complementarity determining region 3 for antibody 32603
TLQYHNEFTGYYLFDY

SEQ ID NO: 65207 - protein, 10 aa, Homo sapiens
  light chain complementarity determining region 3 for antibody 32604
QHYHNWPPWT

SEQ ID NO: 65208 - protein, 13 aa, Homo sapiens
  heavy chain complementarity determining region 3 for antibody 32604
AKGRVRELYYFET

SEQ ID NO: 65209 - protein, 9 aa, Homo sapiens
  light chain complementarity determining region 3 for antibody 32605
MQHTHWPGT

SEQ ID NO: 65210 - protein, 12 aa, Homo sapiens
  heavy chain complementarity determining region 3 for antibody 32605
ATSPHRDSRSSY

SEQ ID NO: 65211 - protein, 9 aa, Homo sapiens
  light chain complementarity determining region 3 for antibody 32606
LHDYNYPRT

SEQ ID NO: 65212 - protein, 18 aa, Homo sapiens
  heavy chain complementarity determining region 3 for antibody 32606
VRDDDVVVNYITWDRYDY

SEQ ID NO: 65213 - protein, 10 aa, Homo sapiens
  light chain complementarity determining region 3 for antibody 32607
QQYNSYSEST

SEQ ID NO: 65214 - protein, 12 aa, Homo sapiens
  heavy chain complementarity determining region 3 for antibody 32607
ARADGDYACFDH

SEQ ID NO: 65215 - protein, 11 aa, Homo sapiens
  light chain complementarity determining region 3 for antibody 32608
QQYLNWPPAWT

SEQ ID NO: 65216 - protein, 14 aa, Homo sapiens
  heavy chain complementarity determining region 3 for antibody 32608
ARPQPGDYYHGMDV

SEQ ID NO: 65217 - protein, 9 aa, Homo sapiens
  light chain complementarity determining region 3 for antibody 32609
QQYGRLPQT

SEQ ID NO: 65218 - protein, 13 aa, Homo sapiens
  heavy chain complementarity determining region 3 for antibody 32609
ARRLVIGRNAFDI

SEQ ID NO: 65219 - protein, 9 aa, Homo sapiens
  light chain complementarity determining region 3 for antibody 32610
QQYDSYPYT

SEQ ID NO: 65220 - protein, 15 aa, Homo sapiens
  heavy chain complementarity determining region 3 for antibody 32610
VKDRSSGWPGDWFDP

SEQ ID NO: 65221 - protein, 11 aa, Homo sapiens
  light chain complementarity determining region 3 for antibody 32611
QQYDNSALEFT

SEQ ID NO: 65222 - protein, 15 aa, Homo sapiens
  heavy chain complementarity determining region 3 for antibody 32611
VREVVTMIEPGGFDV

SEQ ID NO: 65223 - protein, 9 aa, Homo sapiens
  light chain complementarity determining region 3 for antibody 32612
QQSYSTSWT

SEQ ID NO: 65224 - protein, 13 aa, Homo sapiens
  heavy chain complementarity determining region 3 for antibody 32612
ARVLSRFAAGLDY

SEQ ID NO: 65225 - protein, 9 aa, Homo sapiens
  light chain complementarity determining region 3 for antibody 32613
QQSYSTPYT

SEQ ID NO: 65226 - protein, 15 aa, Homo sapiens
  heavy chain complementarity determining region 3 for antibody 32613
TRDHQRGTYLYSFDS

SEQ ID NO: 65227 - protein, 9 aa, Homo sapiens
  light chain complementarity determining region 3 for antibody 32614
QQSYSFPWT

SEQ ID NO: 65228 - protein, 16 aa, Homo sapiens
  heavy chain complementarity determining region 3 for antibody 32614
ARDPGLGPTTVYGMDV

SEQ ID NO: 65229 - protein, 8 aa, Homo sapiens
  light chain complementarity determining region 3 for antibody 32615
QQRTNWPS

SEQ ID NO: 65230 - protein, 12 aa, Homo sapiens
  heavy chain complementarity determining region 3 for antibody 32615
ARDRGGTYWLDY

SEQ ID NO: 65231 - protein, 9 aa, Homo sapiens
  light chain complementarity determining region 3 for antibody 32616
QQLNSYPPT

SEQ ID NO: 65232 - protein, 14 aa, Homo sapiens
  heavy chain complementarity determining region 3 for antibody 32616
ARENSVAGTRSYDY

SEQ ID NO: 65233 - protein, 9 aa, Homo sapiens
  light chain complementarity determining region 3 for antibody 32617
QQGNSFPFT

SEQ ID NO: 65234 - protein, 14 aa, Homo sapiens
  heavy chain complementarity determining region 3 for antibody 32617
ARVRYASGTYYTES

SEQ ID NO: 65235 - protein, 9 aa, Homo sapiens
  light chain complementarity determining region 3 for antibody 32618
QQFDRYPLT

SEQ ID NO: 65236 - protein, 19 aa, Homo sapiens
  heavy chain complementarity determining region 3 for antibody 32618
ARDSRRMVRGLIVYNWFDP

SEQ ID NO: 65237 - protein, 8 aa, Homo sapiens
  light chain complementarity determining region 3 for antibody 32619
QHYDNSRA

SEQ ID NO: 65238 - protein, 13 aa, Homo sapiens
  heavy chain complementarity determining region 3 for antibody 32619
AISRGSLTTYEDY

SEQ ID NO: 65239 - protein, 9 aa, Homo sapiens
  light chain complementarity determining region 3 for antibody 32620
QHGYRTPFT

SEQ ID NO: 65240 - protein, 15 aa, Homo sapiens
  heavy chain complementarity determining region 3 for antibody 32620
AKAQVIWGQLYYFES

SEQ ID NO: 65241 - protein, 9 aa, Homo sapiens
  light chain complementarity determining region 3 for antibody 32621
MQGTHWPPT

SEQ ID NO: 65242 - protein, 15 aa, Homo sapiens
  heavy chain complementarity determining region 3 for antibody 32621
AKSSGQNIAVAGFDC

SEQ ID NO: 65243 - protein, 9 aa, Homo sapiens
  light chain complementarity determining region 3 for antibody 32622
MQALQTPQT

SEQ ID NO: 65244 - protein, 13 aa, Homo sapiens
  heavy chain complementarity determining region 3 for antibody 32622
ARFQGAAAGLGLH

SEQ ID NO: 65245 - protein, 9 aa, Homo sapiens
  light chain complementarity determining region 3 for antibody 32623
LQATHWPWT

SEQ ID NO: 65246 - protein, 12 aa, Homo sapiens
  heavy chain complementarity determining region 3 for antibody 32623
ARGANPFDAFDI

SEQ ID NO: 65247 - protein, 9 aa, Homo sapiens
  light chain complementarity determining region 3 for antibody 32624
QQYGSSPWT

SEQ ID NO: 65248 - protein, 14 aa, Homo sapiens
  heavy chain complementarity determining region 3 for antibody 32624
ARGGQSYPNGYFDL

SEQ ID NO: 65249 - protein, 9 aa, Homo sapiens
  light chain complementarity determining region 3 for antibody 32625
QQYGSSPLT

SEQ ID NO: 65250 - protein, 15 aa, Homo sapiens
  heavy chain complementarity determining region 3 for antibody 32625
ARRRSNILVGYGMDV

SEQ ID NO: 65251 - protein, 9 aa, Homo sapiens
  light chain complementarity determining region 3 for antibody 32626
QQYGDSPLT

SEQ ID NO: 65252 - protein, 15 aa, Homo sapiens
  heavy chain complementarity determining region 3 for antibody 32626
AKGRRGSYSHDAFDV

SEQ ID NO: 65253 - protein, 10 aa, Homo sapiens
  light chain complementarity determining region 3 for antibody 32627
QQYDDWPPIT

SEQ ID NO: 65254 - protein, 21 aa, Homo sapiens
  heavy chain complementarity determining region 3 for antibody 32627
ARHFLQYFDDGSYYPEGLFDL

SEQ ID NO: 65255 - protein, 9 aa, Homo sapiens
  light chain complementarity determining region 3 for antibody 32628
QQINSYPPT

SEQ ID NO: 65256 - protein, 16 aa, Homo sapiens
  heavy chain complementarity determining region 3 for antibody 32628
ARVRSGLMVYTQPLGY

SEQ ID NO: 65257 - protein, 8 aa, Homo sapiens
  light chain complementarity determining region 3 for antibody 32629
QQDGGSPS

SEQ ID NO: 65258 - protein, 16 aa, Homo sapiens
  heavy chain complementarity determining region 3 for antibody 32629
ATDWGSGTQWIRAFDV

SEQ ID NO: 65259 - protein, 10 aa, Homo sapiens
  light chain complementarity determining region 3 for antibody 32630
QHRTDWLPLT

SEQ ID NO: 65260 - protein, 15 aa, Homo sapiens
  heavy chain complementarity determining region 3 for antibody 32630
ARDVGIDYNEGDRDY

SEQ ID NO: 65261 - protein, 9 aa, Homo sapiens
  light chain complementarity determining region 3 for antibody 32631
QHFNSYPLT

SEQ ID NO: 65262 - protein, 14 aa, Homo sapiens
  heavy chain complementarity determining region 3 for antibody 32631
VRAMAVAGYWFFHL

SEQ ID NO: 65263 - protein, 9 aa, Homo sapiens
  light chain complementarity determining region 3 for antibody 32632
QHFHSYPWT

SEQ ID NO: 65264 - protein, 12 aa, Homo sapiens
  heavy chain complementarity determining region 3 for antibody 32632
AKHIGPYRMWDI

SEQ ID NO: 65265 - protein, 9 aa, Homo sapiens
  light chain complementarity determining region 3 for antibody 32633
QDLNGFPFT

SEQ ID NO: 65266 - protein, 12 aa, Homo sapiens
  heavy chain complementarity determining region 3 for antibody 32633
AIWGGAQGAIEF

SEQ ID NO: 65267 - protein, 9 aa, Homo sapiens
  light chain complementarity determining region 3 for antibody 32634
MQNTQWPLT

SEQ ID NO: 65268 - protein, 8 aa, Homo sapiens
  heavy chain complementarity determining region 3 for antibody 32634
ALGQDMIY

SEQ ID NO: 65269 - protein, 9 aa, Homo sapiens
  light chain complementarity determining region 3 for antibody 32635
LQANSFPRT

SEQ ID NO: 65270 - protein, 8 aa, Homo sapiens
  heavy chain complementarity determining region 3 for antibody 32635
ARNSGWYD

SEQ ID NO: 65271 - protein, 9 aa, Homo sapiens
  light chain complementarity determining region 3 for antibody 32636
HQSYNTWYT

SEQ ID NO: 65272 - protein, 12 aa, Homo sapiens
  heavy chain complementarity determining region 3 for antibody 32636
ARDLRPGGAFDI

SEQ ID NO: 65273 - protein, 9 aa, Homo sapiens
  light chain complementarity determining region 3 for antibody 32637
QQYNSYPWT

SEQ ID NO: 65274 - protein, 15 aa, Homo sapiens
  heavy chain complementarity determining region 3 for antibody 32637
ARDQDRVGTYSAAGS

SEQ ID NO: 65275 - protein, 9 aa, Homo sapiens
  light chain complementarity determining region 3 for antibody 32638
QQYNNWLIT

SEQ ID NO: 65276 - protein, 10 aa, Homo sapiens
  heavy chain complementarity determining region 3 for antibody 32638
TRGSSGRFDY

SEQ ID NO: 65277 - protein, 8 aa, Homo sapiens
  light chain complementarity determining region 3 for antibody 32639
QQYGSSPS

SEQ ID NO: 65278 - protein, 17 aa, Homo sapiens
  heavy chain complementarity determining region 3 for antibody 32639
ARGTGFCSSPTCYGLHY

SEQ ID NO: 65279 - protein, 10 aa, Homo sapiens
  light chain complementarity determining region 3 for antibody 32640
QQYGSSPLYT

SEQ ID NO: 65280 - protein, 12 aa, Homo sapiens
  heavy chain complementarity determining region 3 for antibody 32640
ARHKRGTNAFDI

SEQ ID NO: 65281 - protein, 9 aa, Homo sapiens
  light chain complementarity determining region 3 for antibody 32641
QQYGNIPRT

SEQ ID NO: 65282 - protein, 13 aa, Homo sapiens
  heavy chain complementarity determining region 3 for antibody 32641
AGGLFHTSGYSEF

SEQ ID NO: 65283 - protein, 9 aa, Homo sapiens
  light chain complementarity determining region 3 for antibody 32642
QQYGNIPRT

SEQ ID NO: 65284 - protein, 13 aa, Homo sapiens
  heavy chain complementarity determining region 3 for antibody 32642
AGGKFDSTGYGEY

SEQ ID NO: 65285 - protein, 9 aa, Homo sapiens
  light chain complementarity determining region 3 for antibody 32643
QQYDRYPIT

SEQ ID NO: 65286 - protein, 11 aa, Homo sapiens
  heavy chain complementarity determining region 3 for antibody 32643
ARVSELTAEDF

SEQ ID NO: 65287 - protein, 9 aa, Homo sapiens
  light chain complementarity determining region 3 for antibody 32644
QQYDHNPPT

SEQ ID NO: 65288 - protein, 20 aa, Homo sapiens
  heavy chain complementarity determining region 3 for antibody 32644
AKDKLRSVVRGVILGCYFAP

SEQ ID NO: 65289 - protein, 9 aa, Homo sapiens
  light chain complementarity determining region 3 for antibody 32645
QQSYTSPYN

SEQ ID NO: 65290 - protein, 15 aa, Homo sapiens
  heavy chain complementarity determining region 3 for antibody 32645
ARLSIQLWQKTWFDP

SEQ ID NO: 65291 - protein, 9 aa, Homo sapiens
  light chain complementarity determining region 3 for antibody 32646
QQSYSTPRT

SEQ ID NO: 65292 - protein, 12 aa, Homo sapiens
  heavy chain complementarity determining region 3 for antibody 32646
ARGWQLANAFDI

SEQ ID NO: 65293 - protein, 9 aa, Homo sapiens
  light chain complementarity determining region 3 for antibody 32647
QQSFNPPFT

SEQ ID NO: 65294 - protein, 17 aa, Homo sapiens
  heavy chain complementarity determining region 3 for antibody 32647
ARGSTYYFDSSGYYFHY

SEQ ID NO: 65295 - protein, 9 aa, Homo sapiens
  light chain complementarity determining region 3 for antibody 32648
QQRSNWPRT

SEQ ID NO: 65296 - protein, 16 aa, Homo sapiens
  heavy chain complementarity determining region 3 for antibody 32648
ARDRPLRGSYYGWSDS

SEQ ID NO: 65297 - protein, 9 aa, Homo sapiens
  light chain complementarity determining region 3 for antibody 32649
QQCATAPRT

SEQ ID NO: 65298 - protein, 14 aa, Homo sapiens
  heavy chain complementarity determining region 3 for antibody 32649
AKDPTGDGGGYFDY

SEQ ID NO: 65299 - protein, 11 aa, Homo sapiens
  light chain complementarity determining region 3 for antibody 32650
QKYDTGPPGLT

SEQ ID NO: 65300 - protein, 11 aa, Homo sapiens
  heavy chain complementarity determining region 3 for antibody 32650
VSARGGNYFDY

SEQ ID NO: 65301 - protein, 8 aa, Homo sapiens
  light chain complementarity determining region 3 for antibody 32651
QHCGSTRT

SEQ ID NO: 65302 - protein, 15 aa, Homo sapiens
  heavy chain complementarity determining region 3 for antibody 32651
AREVTNPNKYYGLDV

SEQ ID NO: 65303 - protein, 9 aa, Homo sapiens
  light chain complementarity determining region 3 for antibody 32652
LQHHLFPWT

SEQ ID NO: 65304 - protein, 9 aa, Homo sapiens
  heavy chain complementarity determining region 3 for antibody 32652
AKGYYDSSY

SEQ ID NO: 65305 - protein, 9 aa, Homo sapiens
  light chain complementarity determining region 3 for antibody 32653
KQYYTTPPT

SEQ ID NO: 65306 - protein, 14 aa, Homo sapiens
  heavy chain complementarity determining region 3 for antibody 32653
AKDRIAVGISVWEY

SEQ ID NO: 65307 - protein, 9 aa, Homo sapiens
  light chain complementarity determining region 3 for antibody 32654
QQYVTTPLT

SEQ ID NO: 65308 - protein, 8 aa, Homo sapiens
  heavy chain complementarity determining region 3 for antibody 32654
VRMSDYIL

SEQ ID NO: 65309 - protein, 9 aa, Homo sapiens
  light chain complementarity determining region 3 for antibody 32655
QQYSSLSRT

SEQ ID NO: 65310 - protein, 17 aa, Homo sapiens
  heavy chain complementarity determining region 3 for antibody 32655
VREDGCRGGSCRLYFDL

SEQ ID NO: 65311 - protein, 9 aa, Homo sapiens
  light chain complementarity determining region 3 for antibody 32656
QQYRTYSRT

SEQ ID NO: 65312 - protein, 14 aa, Homo sapiens
  heavy chain complementarity determining region 3 for antibody 32656
ARDRESSWYPHLDS

SEQ ID NO: 65313 - protein, 9 aa, Homo sapiens
  light chain complementarity determining region 3 for antibody 32657
QQYNSYQYT

SEQ ID NO: 65314 - protein, 9 aa, Homo sapiens
  heavy chain complementarity determining region 3 for antibody 32657
VREDWYFDQ

SEQ ID NO: 65315 - protein, 9 aa, Homo sapiens
  light chain complementarity determining region 3 for antibody 32658
QQYNSYPLT

SEQ ID NO: 65316 - protein, 19 aa, Homo sapiens
  heavy chain complementarity determining region 3 for antibody 32658
ARDITYGDYPEDYYYAMDV

SEQ ID NO: 65317 - protein, 9 aa, Homo sapiens
  light chain complementarity determining region 3 for antibody 32659
QQYNSHLIT

SEQ ID NO: 65318 - protein, 14 aa, Homo sapiens
  heavy chain complementarity determining region 3 for antibody 32659
ARIMVDTATDAFDI

SEQ ID NO: 65319 - protein, 8 aa, Homo sapiens
  light chain complementarity determining region 3 for antibody 32660
QQYGSSYT

SEQ ID NO: 65320 - protein, 20 aa, Homo sapiens
  heavy chain complementarity determining region 3 for antibody 32660
ARDLRVRGVIGPSIRGSFDI

SEQ ID NO: 65321 - protein, 10 aa, Homo sapiens
  light chain complementarity determining region 3 for antibody 32661
QQYGSSPTWT

SEQ ID NO: 65322 - protein, 15 aa, Homo sapiens
  heavy chain complementarity determining region 3 for antibody 32661
TRDLLDSGGAYFADH

SEQ ID NO: 65323 - protein, 9 aa, Homo sapiens
  light chain complementarity determining region 3 for antibody 32662
QQYGSSPRT

SEQ ID NO: 65324 - protein, 14 aa, Homo sapiens
  heavy chain complementarity determining region 3 for antibody 32662
ARGQGLLAGDVFDV

SEQ ID NO: 65325 - protein, 9 aa, Homo sapiens
  light chain complementarity determining region 3 for antibody 32663
QQYGSSPRT

SEQ ID NO: 65326 - protein, 19 aa, Homo sapiens
  heavy chain complementarity determining region 3 for antibody 32663
AKEHSPFSLIAVEGFDFDY

SEQ ID NO: 65327 - protein, 8 aa, Homo sapiens
  light chain complementarity determining region 3 for antibody 32664
QQYGSSPL

SEQ ID NO: 65328 - protein, 16 aa, Homo sapiens
  heavy chain complementarity determining region 3 for antibody 32664
ARRALLWFGELGWFDP

SEQ ID NO: 65329 - protein, 10 aa, Homo sapiens
  light chain complementarity determining region 3 for antibody 32665
QQYGSLPAWT

SEQ ID NO: 65330 - protein, 19 aa, Homo sapiens
  heavy chain complementarity determining region 3 for antibody 32665
ARGDGVRSGEFYYYQGLDV

SEQ ID NO: 65331 - protein, 9 aa, Homo sapiens
  light chain complementarity determining region 3 for antibody 32666
QQYGNSPRT

SEQ ID NO: 65332 - protein, 13 aa, Homo sapiens
  heavy chain complementarity determining region 3 for antibody 32666
ARTGRVAGVEGAH

SEQ ID NO: 65333 - protein, 9 aa, Homo sapiens
  light chain complementarity determining region 3 for antibody 32667
QQYDNRPFT

SEQ ID NO: 65334 - protein, 13 aa, Homo sapiens
  heavy chain complementarity determining region 3 for antibody 32667
ARDLVIGGGAFDY

SEQ ID NO: 65335 - protein, 8 aa, Homo sapiens
  light chain complementarity determining region 3 for antibody 32668
QQSYSTPL

SEQ ID NO: 65336 - protein, 13 aa, Homo sapiens
  heavy chain complementarity determining region 3 for antibody 32668
SRDKELGFGVLDY

SEQ ID NO: 65337 - protein, 9 aa, Homo sapiens
  light chain complementarity determining region 3 for antibody 32669
QQSSSTVYT

SEQ ID NO: 65338 - protein, 15 aa, Homo sapiens
  heavy chain complementarity determining region 3 for antibody 32669
ARQFTSGWYGYWFDP

SEQ ID NO: 65339 - protein, 9 aa, Homo sapiens
  light chain complementarity determining region 3 for antibody 32670
QQSFTIPRT

SEQ ID NO: 65340 - protein, 14 aa, Homo sapiens
  heavy chain complementarity determining region 3 for antibody 32670
ATESSLSNGVSFDY

SEQ ID NO: 65341 - protein, 9 aa, Homo sapiens
  light chain complementarity determining region 3 for antibody 32671
QQRTNWRFT

SEQ ID NO: 65342 - protein, 16 aa, Homo sapiens
  heavy chain complementarity determining region 3 for antibody 32671
ARDQGFCRGPNCYMLY

SEQ ID NO: 65343 - protein, 9 aa, Homo sapiens
  light chain complementarity determining region 3 for antibody 32672
QQRSAWPLT

SEQ ID NO: 65344 - protein, 7 aa, Homo sapiens
  heavy chain complementarity determining region 3 for antibody 32672
VRDEWWP

SEQ ID NO: 65345 - protein, 10 aa, Homo sapiens
  light chain complementarity determining region 3 for antibody 32673
QQRNHWPPWT

SEQ ID NO: 65346 - protein, 13 aa, Homo sapiens
  heavy chain complementarity determining region 3 for antibody 32673
HTTGWLEGKWFDP

SEQ ID NO: 65347 - protein, 9 aa, Homo sapiens
  light chain complementarity determining region 3 for antibody 32674
QQNYITPQT

SEQ ID NO: 65348 - protein, 17 aa, Homo sapiens
  heavy chain complementarity determining region 3 for antibody 32674
TTDHTYYDFLSDYPVGC

SEQ ID NO: 65349 - protein, 9 aa, Homo sapiens
  light chain complementarity determining region 3 for antibody 32675
QQLDSYPIT

SEQ ID NO: 65350 - protein, 13 aa, Homo sapiens
  heavy chain complementarity determining region 3 for antibody 32675
ARGHLGLELLSDY

SEQ ID NO: 65351 - protein, 9 aa, Homo sapiens
  light chain complementarity determining region 3 for antibody 32676
QQGNTFPLT

SEQ ID NO: 65352 - protein, 16 aa, Homo sapiens
  heavy chain complementarity determining region 3 for antibody 32676
ARGQSNWDDGYLGLDV

SEQ ID NO: 65353 - protein, 10 aa, Homo sapiens
  light chain complementarity determining region 3 for antibody 32677
MQSIQPPRWT

SEQ ID NO: 65354 - protein, 8 aa, Homo sapiens
  heavy chain complementarity determining region 3 for antibody 32677
AKGYGFDC

SEQ ID NO: 65355 - protein, 9 aa, Homo sapiens
  light chain complementarity determining region 3 for antibody 32678
MQALQTPFT

SEQ ID NO: 65356 - protein, 12 aa, Homo sapiens
  heavy chain complementarity determining region 3 for antibody 32678
ARGIVGGNSFDY

SEQ ID NO: 65357 - protein, 8 aa, Homo sapiens
  light chain complementarity determining region 3 for antibody 32679
HQYRDSFP

SEQ ID NO: 65358 - protein, 13 aa, Homo sapiens
  heavy chain complementarity determining region 3 for antibody 32679
ATESGKYQGALDF

SEQ ID NO: 65359 - protein, 9 aa, Homo sapiens
  light chain complementarity determining region 3 for antibody 32680
AQYGSRPRT

SEQ ID NO: 65360 - protein, 9 aa, Homo sapiens
  heavy chain complementarity determining region 3 for antibody 32680
AREWSAFDF

SEQ ID NO: 65361 - protein, 10 aa, Homo sapiens
  light chain complementarity determining region 3 for antibody 32681
QYYDDSPGYT

SEQ ID NO: 65362 - protein, 12 aa, Homo sapiens
  heavy chain complementarity determining region 3 for antibody 32681
ARETTNIGELDY

SEQ ID NO: 65363 - protein, 9 aa, Homo sapiens
  light chain complementarity determining region 3 for antibody 32682
QQYKKWPLT

SEQ ID NO: 65364 - protein, 17 aa, Homo sapiens
  heavy chain complementarity determining region 3 for antibody 32682
TRDMRFSDYTLGYGMDV

SEQ ID NO: 65365 - protein, 10 aa, Homo sapiens
  light chain complementarity determining region 3 for antibody 32683
QQYGSSPPFT

SEQ ID NO: 65366 - protein, 12 aa, Homo sapiens
  heavy chain complementarity determining region 3 for antibody 32683
ARERGRGFGLDI

SEQ ID NO: 65367 - protein, 10 aa, Homo sapiens
  light chain complementarity determining region 3 for antibody 32684
QQYDNLPAGS

SEQ ID NO: 65368 - protein, 14 aa, Homo sapiens
  heavy chain complementarity determining region 3 for antibody 32684
ARGQNIAAAGVFDY

SEQ ID NO: 65369 - protein, 9 aa, Homo sapiens
  light chain complementarity determining region 3 for antibody 32685
QQYDDLPWT

SEQ ID NO: 65370 - protein, 13 aa, Homo sapiens
  heavy chain complementarity determining region 3 for antibody 32685
VRDDYGTNGGLDY

SEQ ID NO: 65371 - protein, 8 aa, Homo sapiens
  light chain complementarity determining region 3 for antibody 32686
QQLNSYPT

SEQ ID NO: 65372 - protein, 13 aa, Homo sapiens
  heavy chain complementarity determining region 3 for antibody 32686
ARHVYTMVTPFDY

SEQ ID NO: 65373 - protein, 9 aa, Homo sapiens
  light chain complementarity determining region 3 for antibody 32687
QQHNSYPLT

SEQ ID NO: 65374 - protein, 15 aa, Homo sapiens
  heavy chain complementarity determining region 3 for antibody 32687
TGAENDYFYFYGMDV

SEQ ID NO: 65375 - protein, 9 aa, Homo sapiens
  light chain complementarity determining region 3 for antibody 32688
QHYDNLSRT

SEQ ID NO: 65376 - protein, 18 aa, Homo sapiens
  heavy chain complementarity determining region 3 for antibody 32688
TRDLSPQMAPFRDDASDI

SEQ ID NO: 65377 - protein, 9 aa, Homo sapiens
  light chain complementarity determining region 3 for antibody 32689
MQYRYWPHT

SEQ ID NO: 65378 - protein, 8 aa, Homo sapiens
  heavy chain complementarity determining region 3 for antibody 32689
VCWGTFHL

SEQ ID NO: 65379 - protein, 9 aa, Homo sapiens
  light chain complementarity determining region 3 for antibody 32690
MQALQIPRT

SEQ ID NO: 65380 - protein, 18 aa, Homo sapiens
  heavy chain complementarity determining region 3 for antibody 32690
ARGGTMVRGSDYYFGMHV

SEQ ID NO: 65381 - protein, 9 aa, Homo sapiens
  light chain complementarity determining region 3 for antibody 32691
LQGNRFPHT

SEQ ID NO: 65382 - protein, 14 aa, Homo sapiens
  heavy chain complementarity determining region 3 for antibody 32691
ARDRFGDSRISFDY

SEQ ID NO: 65383 - protein, 9 aa, Homo sapiens
  light chain complementarity determining region 3 for antibody 32692
QQYYTSPRT

SEQ ID NO: 65384 - protein, 18 aa, Homo sapiens
  heavy chain complementarity determining region 3 for antibody 32692
AREGWGSGLRGQRPGFDY

SEQ ID NO: 65385 - protein, 9 aa, Homo sapiens
  light chain complementarity determining region 3 for antibody 32693
QQYNNWPRT

SEQ ID NO: 65386 - protein, 14 aa, Homo sapiens
  heavy chain complementarity determining region 3 for antibody 32693
ATSSSTVTMTWFDP

SEQ ID NO: 65387 - protein, 11 aa, Homo sapiens
  light chain complementarity determining region 3 for antibody 32694
QQYNNWPLPLT

SEQ ID NO: 65388 - protein, 17 aa, Homo sapiens
  heavy chain complementarity determining region 3 for antibody 32694
AREGMVRGVTYPPYFDY

SEQ ID NO: 65389 - protein, 9 aa, Homo sapiens
  light chain complementarity determining region 3 for antibody 32695
QQYGSSPYT

SEQ ID NO: 65390 - protein, 14 aa, Homo sapiens
  heavy chain complementarity determining region 3 for antibody 32695
ASAYGSGSYYPFDY

SEQ ID NO: 65391 - protein, 9 aa, Homo sapiens
  light chain complementarity determining region 3 for antibody 32696
QQYGSSPRT

SEQ ID NO: 65392 - protein, 11 aa, Homo sapiens
  heavy chain complementarity determining region 3 for antibody 32696
AREAVARPPDY

SEQ ID NO: 65393 - protein, 8 aa, Homo sapiens
  light chain complementarity determining region 3 for antibody 32697
QQYGRSPT

SEQ ID NO: 65394 - protein, 21 aa, Homo sapiens
  heavy chain complementarity determining region 3 for antibody 32697
ARERERYFDWSHRDYYYALDV

SEQ ID NO: 65395 - protein, 8 aa, Homo sapiens
  light chain complementarity determining region 3 for antibody 32698
QQYDNLAT

SEQ ID NO: 65396 - protein, 13 aa, Homo sapiens
  heavy chain complementarity determining region 3 for antibody 32698
ARGDLLAAAGTDF

SEQ ID NO: 65397 - protein, 8 aa, Homo sapiens
  light chain complementarity determining region 3 for antibody 32699
QQYDDLRA

SEQ ID NO: 65398 - protein, 19 aa, Homo sapiens
  heavy chain complementarity determining region 3 for antibody 32699
ARDPSYYYDSSGSPRYFQH

SEQ ID NO: 65399 - protein, 9 aa, Homo sapiens
  light chain complementarity determining region 3 for antibody 32700
QQTYSTLLT

SEQ ID NO: 65400 - protein, 14 aa, Homo sapiens
  heavy chain complementarity determining region 3 for antibody 32700
ASCSSTSCYRGFDS

SEQ ID NO: 65401 - protein, 9 aa, Homo sapiens
  light chain complementarity determining region 3 for antibody 32701
QQSYSTPYT

SEQ ID NO: 65402 - protein, 24 aa, Homo sapiens
  heavy chain complementarity determining region 3 for antibody 32701
ARGQLYDSRGYYSFSGNTRHWFDP

SEQ ID NO: 65403 - protein, 10 aa, Homo sapiens
  light chain complementarity determining region 3 for antibody 32702
QQRSNWPPNT

SEQ ID NO: 65404 - protein, 16 aa, Homo sapiens
  heavy chain complementarity determining region 3 for antibody 32702
AAGYKSGWFIGYYFDF

SEQ ID NO: 65405 - protein, 9 aa, Homo sapiens
  light chain complementarity determining region 3 for antibody 32703
QQNFNTPRT

SEQ ID NO: 65406 - protein, 15 aa, Homo sapiens
  heavy chain complementarity determining region 3 for antibody 32703
ARDFEVEWEVATFDL

SEQ ID NO: 65407 - protein, 9 aa, Homo sapiens
  light chain complementarity determining region 3 for antibody 32704
QQLNSYPYT

SEQ ID NO: 65408 - protein, 12 aa, Homo sapiens
  heavy chain complementarity determining region 3 for antibody 32704
AIWGGAKGGLPY

SEQ ID NO: 65409 - protein, 9 aa, Homo sapiens
  light chain complementarity determining region 3 for antibody 32705
QQLLSYPRT

SEQ ID NO: 65410 - protein, 14 aa, Homo sapiens
  heavy chain complementarity determining region 3 for antibody 32705
AKESDDFWSGYLDF

SEQ ID NO: 65411 - protein, 9 aa, Homo sapiens
  light chain complementarity determining region 3 for antibody 32706
QQGDSFPET

SEQ ID NO: 65412 - protein, 15 aa, Homo sapiens
  heavy chain complementarity determining region 3 for antibody 32706
ARDLGRQKSGAYMAY

SEQ ID NO: 65413 - protein, 9 aa, Homo sapiens
  light chain complementarity determining region 3 for antibody 32707
QQAYSSPYT

SEQ ID NO: 65414 - protein, 14 aa, Homo sapiens
  heavy chain complementarity determining region 3 for antibody 32707
ARDPQRGRPDYFDY

SEQ ID NO: 65415 - protein, 9 aa, Homo sapiens
  light chain complementarity determining region 3 for antibody 32708
QKYDGAPWT

SEQ ID NO: 65416 - protein, 9 aa, Homo sapiens
  heavy chain complementarity determining region 3 for antibody 32708
MGRNGGTVD

SEQ ID NO: 65417 - protein, 9 aa, Homo sapiens
  light chain complementarity determining region 3 for antibody 32709
QHYNNWPYT

SEQ ID NO: 65418 - protein, 15 aa, Homo sapiens
  heavy chain complementarity determining region 3 for antibody 32709
KRGGTSGSPGVPFDL

SEQ ID NO: 65419 - protein, 10 aa, Homo sapiens
  light chain complementarity determining region 3 for antibody 32710
MQGTHWPPWT

SEQ ID NO: 65420 - protein, 11 aa, Homo sapiens
  heavy chain complementarity determining region 3 for antibody 32710
ARDHPGIGIDY

SEQ ID NO: 65421 - protein, 9 aa, Homo sapiens
  light chain complementarity determining region 3 for antibody 32711
MQALGTPPT

SEQ ID NO: 65422 - protein, 12 aa, Homo sapiens
  heavy chain complementarity determining region 3 for antibody 32711
AKDLVGGARGGN

SEQ ID NO: 65423 - protein, 10 aa, Homo sapiens
  light chain complementarity determining region 3 for antibody 32712
LQYNIWPPGT

SEQ ID NO: 65424 - protein, 12 aa, Homo sapiens
  heavy chain complementarity determining region 3 for antibody 32712
ARTHSNGGLYDY

SEQ ID NO: 65425 - protein, 9 aa, Homo sapiens
  light chain complementarity determining region 3 for antibody 32713
LQHNTYPWT

SEQ ID NO: 65426 - protein, 13 aa, Homo sapiens
  heavy chain complementarity determining region 3 for antibody 32713
ARAEYSSGWSIVC

SEQ ID NO: 65427 - protein, 9 aa, Homo sapiens
  light chain complementarity determining region 3 for antibody 32714
LQDFHYPRT

SEQ ID NO: 65428 - protein, 17 aa, Homo sapiens
  heavy chain complementarity determining region 3 for antibody 32714
VRDDRPICSGGTCYPDV

SEQ ID NO: 65429 - protein, 9 aa, Homo sapiens
  light chain complementarity determining region 3 for antibody 32715
HQTGTLPWT

SEQ ID NO: 65430 - protein, 14 aa, Homo sapiens
  heavy chain complementarity determining region 3 for antibody 32715
VRDASGTDGWYADS

SEQ ID NO: 65431 - protein, 9 aa, Homo sapiens
  light chain complementarity determining region 3 for antibody 32716
HQRSNWPRT

SEQ ID NO: 65432 - protein, 9 aa, Homo sapiens
  heavy chain complementarity determining region 3 for antibody 32716
AREWYENDY

SEQ ID NO: 65433 - protein, 9 aa, Homo sapiens
  light chain complementarity determining region 3 for antibody 32717
QVYGDSPKT

SEQ ID NO: 65434 - protein, 10 aa, Homo sapiens
  heavy chain complementarity determining region 3 for antibody 32717
AREGLGGFDN

SEQ ID NO: 65435 - protein, 10 aa, Homo sapiens
  light chain complementarity determining region 3 for antibody 32718
QQYNNRPRNT

SEQ ID NO: 65436 - protein, 12 aa, Homo sapiens
  heavy chain complementarity determining region 3 for antibody 32718
AKMMPRHDVFDL

SEQ ID NO: 65437 - protein, 10 aa, Homo sapiens
  light chain complementarity determining region 3 for antibody 32719
QQYHNRPPDT

SEQ ID NO: 65438 - protein, 14 aa, Homo sapiens
  heavy chain complementarity determining region 3 for antibody 32719
ARDPPGIALAGNSG

SEQ ID NO: 65439 - protein, 9 aa, Homo sapiens
  light chain complementarity determining region 3 for antibody 32720
QQYGTSYRT

SEQ ID NO: 65440 - protein, 12 aa, Homo sapiens
  heavy chain complementarity determining region 3 for antibody 32720
ARDSGSGWYFKY

SEQ ID NO: 65441 - protein, 9 aa, Homo sapiens
  light chain complementarity determining region 3 for antibody 32721
QQYGTSPLN

SEQ ID NO: 65442 - protein, 13 aa, Homo sapiens
  heavy chain complementarity determining region 3 for antibody 32721
ASISVGTVAAGNG

SEQ ID NO: 65443 - protein, 10 aa, Homo sapiens
  light chain complementarity determining region 3 for antibody 32722
QQYGSSPLFT

SEQ ID NO: 65444 - protein, 14 aa, Homo sapiens
  heavy chain complementarity determining region 3 for antibody 32722
VRPRHVVVNWYIDS

SEQ ID NO: 65445 - protein, 9 aa, Homo sapiens
  light chain complementarity determining region 3 for antibody 32723
QQYGSSLIT

SEQ ID NO: 65446 - protein, 13 aa, Homo sapiens
  heavy chain complementarity determining region 3 for antibody 32723
ARGSGSHQDEFDY

SEQ ID NO: 65447 - protein, 9 aa, Homo sapiens
  light chain complementarity determining region 3 for antibody 32724
QQYGSFPPT

SEQ ID NO: 65448 - protein, 17 aa, Homo sapiens
  heavy chain complementarity determining region 3 for antibody 32724
ARGLMERWLVPLYYFDL

SEQ ID NO: 65449 - protein, 9 aa, Homo sapiens
  light chain complementarity determining region 3 for antibody 32725
QQYGRSPWT

SEQ ID NO: 65450 - protein, 19 aa, Homo sapiens
  heavy chain complementarity determining region 3 for antibody 32725
VRERYYYDSRGKRNGGMDV

SEQ ID NO: 65451 - protein, 9 aa, Homo sapiens
  light chain complementarity determining region 3 for antibody 32726
QQYDTSPWT

SEQ ID NO: 65452 - protein, 15 aa, Homo sapiens
  heavy chain complementarity determining region 3 for antibody 32726
VHTQLWFGDQCYFDF

SEQ ID NO: 65453 - protein, 12 aa, Homo sapiens
  light chain complementarity determining region 3 for antibody 32727
QQYDNLPRTLLA

SEQ ID NO: 65454 - protein, 12 aa, Homo sapiens
  heavy chain complementarity determining region 3 for antibody 32727
EMTPRGGYLFDY

SEQ ID NO: 65455 - protein, 9 aa, Homo sapiens
  light chain complementarity determining region 3 for antibody 32728
QQYDDWPLT

SEQ ID NO: 65456 - protein, 15 aa, Homo sapiens
  heavy chain complementarity determining region 3 for antibody 32728
ARTKEWFGEIDPFDS

SEQ ID NO: 65457 - protein, 9 aa, Homo sapiens
  light chain complementarity determining region 3 for antibody 32729
QQYASSPFT

SEQ ID NO: 65458 - protein, 18 aa, Homo sapiens
  heavy chain complementarity determining region 3 for antibody 32729
AARGANCGGDCYYWYFDL

SEQ ID NO: 65459 - protein, 9 aa, Homo sapiens
  light chain complementarity determining region 3 for antibody 32730
QQSYTSPYA

SEQ ID NO: 65460 - protein, 5 aa, Homo sapiens
  heavy chain complementarity determining region 3 for antibody 32730
GTREF

SEQ ID NO: 65461 - protein, 9 aa, Homo sapiens
  light chain complementarity determining region 3 for antibody 32731
QQSYSTPRT

SEQ ID NO: 65462 - protein, 12 aa, Homo sapiens
  heavy chain complementarity determining region 3 for antibody 32731
ARSPYSGIDFDS

SEQ ID NO: 65463 - protein, 9 aa, Homo sapiens
  light chain complementarity determining region 3 for antibody 32732
QQSYSTPRT

SEQ ID NO: 65464 - protein, 15 aa, Homo sapiens
  heavy chain complementarity determining region 3 for antibody 32732
AREGPETGAFDAFDI

SEQ ID NO: 65465 - protein, 10 aa, Homo sapiens
  light chain complementarity determining region 3 for antibody 32733
QQSYSTPPYT

SEQ ID NO: 65466 - protein, 12 aa, Homo sapiens
  heavy chain complementarity determining region 3 for antibody 32733
ARPFDDYGENDY

SEQ ID NO: 65467 - protein, 9 aa, Homo sapiens
  light chain complementarity determining region 3 for antibody 32734
QQSRFTPFT

SEQ ID NO: 65468 - protein, 17 aa, Homo sapiens
  heavy chain complementarity determining region 3 for antibody 32734
ARLMVSPSKWIQYGFDV

SEQ ID NO: 65469 - protein, 9 aa, Homo sapiens
  light chain complementarity determining region 3 for antibody 32735
QQSFNTPRT

SEQ ID NO: 65470 - protein, 14 aa, Homo sapiens
  heavy chain complementarity determining region 3 for antibody 32735
ARDWGVGAGAFLDL

SEQ ID NO: 65471 - protein, 10 aa, Homo sapiens
  light chain complementarity determining region 3 for antibody 32736
QHYGRSPPYS

SEQ ID NO: 65472 - protein, 23 aa, Homo sapiens
  heavy chain complementarity determining region 3 for antibody 32736
ARGLRSSDWSKIMEMDSYYGLDV

SEQ ID NO: 65473 - protein, 10 aa, Homo sapiens
  light chain complementarity determining region 3 for antibody 32737
QHYDASPMYT

SEQ ID NO: 65474 - protein, 11 aa, Homo sapiens
  heavy chain complementarity determining region 3 for antibody 32737
MRGPAHGAFDI

SEQ ID NO: 65475 - protein, 11 aa, Homo sapiens
  light chain complementarity determining region 3 for antibody 32738
QHRSNWPPGFT

SEQ ID NO: 65476 - protein, 13 aa, Homo sapiens
  heavy chain complementarity determining region 3 for antibody 32738
ACALAQPGDYFDF

SEQ ID NO: 65477 - protein, 11 aa, Homo sapiens
  light chain complementarity determining region 3 for antibody 32739
QFYGASPPVYG

SEQ ID NO: 65478 - protein, 14 aa, Homo sapiens
  heavy chain complementarity determining region 3 for antibody 32739
AKHMPVPGTRGFDA

SEQ ID NO: 65479 - protein, 9 aa, Homo sapiens
  light chain complementarity determining region 3 for antibody 32740
MQALETPFT

SEQ ID NO: 65480 - protein, 15 aa, Homo sapiens
  heavy chain complementarity determining region 3 for antibody 32740
VRHYRETVAGIEGDC

SEQ ID NO: 65481 - protein, 9 aa, Homo sapiens
  light chain complementarity determining region 3 for antibody 32741
LQYNSYPRT

SEQ ID NO: 65482 - protein, 9 aa, Homo sapiens
  heavy chain complementarity determining region 3 for antibody 32741
ARGGWATDY

SEQ ID NO: 65483 - protein, 9 aa, Homo sapiens
  light chain complementarity determining region 3 for antibody 32742
LQYGGTPLT

SEQ ID NO: 65484 - protein, 8 aa, Homo sapiens
  heavy chain complementarity determining region 3 for antibody 32742
VRIMDPGY

SEQ ID NO: 65485 - protein, 8 aa, Homo sapiens
  light chain complementarity determining region 3 for antibody 32743
QQYYNWWT

SEQ ID NO: 65486 - protein, 14 aa, Homo sapiens
  heavy chain complementarity determining region 3 for antibody 32743
AKINWNYGRYGSDS

SEQ ID NO: 65487 - protein, 9 aa, Homo sapiens
  light chain complementarity determining region 3 for antibody 32744
QQYWDSPGT

SEQ ID NO: 65488 - protein, 22 aa, Homo sapiens
  heavy chain complementarity determining region 3 for antibody 32744
ARPKTQGGYFDGSGYERGAFDI

SEQ ID NO: 65489 - protein, 9 aa, Homo sapiens
  light chain complementarity determining region 3 for antibody 32745
QQYNLYPHT

SEQ ID NO: 65490 - protein, 16 aa, Homo sapiens
  heavy chain complementarity determining region 3 for antibody 32745
ARETDHGSYGSGSYDY

SEQ ID NO: 65491 - protein, 10 aa, Homo sapiens
  light chain complementarity determining region 3 for antibody 32746
QQYNKWPPLT

SEQ ID NO: 65492 - protein, 13 aa, Homo sapiens
  heavy chain complementarity determining region 3 for antibody 32746
GKDMYRVSSIINY

SEQ ID NO: 65493 - protein, 10 aa, Homo sapiens
  light chain complementarity determining region 3 for antibody 32747
QQYGTAPPYT

SEQ ID NO: 65494 - protein, 10 aa, Homo sapiens
  heavy chain complementarity determining region 3 for antibody 32747
GGGPGWLTYA

SEQ ID NO: 65495 - protein, 9 aa, Homo sapiens
  light chain complementarity determining region 3 for antibody 32748
QQYGSSPRT

SEQ ID NO: 65496 - protein, 12 aa, Homo sapiens
  heavy chain complementarity determining region 3 for antibody 32748
VKDCGLGGSRDS

SEQ ID NO: 65497 - protein, 9 aa, Homo sapiens
  light chain complementarity determining region 3 for antibody 32749
QQYGSIPRT

SEQ ID NO: 65498 - protein, 14 aa, Homo sapiens
  heavy chain complementarity determining region 3 for antibody 32749
AGGDFCGSDCYSEY

SEQ ID NO: 65499 - protein, 8 aa, Homo sapiens
  light chain complementarity determining region 3 for antibody 32750
QQYGRSLT

SEQ ID NO: 65500 - protein, 17 aa, Homo sapiens
  heavy chain complementarity determining region 3 for antibody 32750
ARGYDSSGYYYENAFDI

SEQ ID NO: 65501 - protein, 9 aa, Homo sapiens
  light chain complementarity determining region 3 for antibody 32751
QQYGNLPRT

SEQ ID NO: 65502 - protein, 13 aa, Homo sapiens
  heavy chain complementarity determining region 3 for antibody 32751
AGGDFHRGGYSEY

SEQ ID NO: 65503 - protein, 9 aa, Homo sapiens
  light chain complementarity determining region 3 for antibody 32752
QQTYIIRQT

SEQ ID NO: 65504 - protein, 24 aa, Homo sapiens
  heavy chain complementarity determining region 3 for antibody 32752
ARGNQEYYYDGSDYYYAPGDAYDV

SEQ ID NO: 65505 - protein, 10 aa, Homo sapiens
  light chain complementarity determining region 3 for antibody 32753
QQSYSTPMYT

SEQ ID NO: 65506 - protein, 12 aa, Homo sapiens
  heavy chain complementarity determining region 3 for antibody 32753
AREPTFNPHFDY

SEQ ID NO: 65507 - protein, 9 aa, Homo sapiens
  light chain complementarity determining region 3 for antibody 32754
QQSYSPLFT

SEQ ID NO: 65508 - protein, 16 aa, Homo sapiens
  heavy chain complementarity determining region 3 for antibody 32754
ARGREYGDSLYWYFDL

SEQ ID NO: 65509 - protein, 9 aa, Homo sapiens
  light chain complementarity determining region 3 for antibody 32755
QQRSSWPRT

SEQ ID NO: 65510 - protein, 11 aa, Homo sapiens
  heavy chain complementarity determining region 3 for antibody 32755
ATEIEPEAFDY

SEQ ID NO: 65511 - protein, 9 aa, Homo sapiens
  light chain complementarity determining region 3 for antibody 32756
QQRRNWPLT

SEQ ID NO: 65512 - protein, 10 aa, Homo sapiens
  heavy chain complementarity determining region 3 for antibody 32756
ATPTAAPVDY

SEQ ID NO: 65513 - protein, 9 aa, Homo sapiens
  light chain complementarity determining region 3 for antibody 32757
QQRGDWPLT

SEQ ID NO: 65514 - protein, 22 aa, Homo sapiens
  heavy chain complementarity determining region 3 for antibody 32757
ARVLFYSDPSDQFSLTSEFFQH

SEQ ID NO: 65515 - protein, 9 aa, Homo sapiens
  light chain complementarity determining region 3 for antibody 32758
QQGYSTPFT

SEQ ID NO: 65516 - protein, 15 aa, Homo sapiens
  heavy chain complementarity determining region 3 for antibody 32758
AKSQIIWGQLYYFDS

SEQ ID NO: 65517 - protein, 9 aa, Homo sapiens
  light chain complementarity determining region 3 for antibody 32759
QHYNNIYGT

SEQ ID NO: 65518 - protein, 21 aa, Homo sapiens
  heavy chain complementarity determining region 3 for antibody 32759
ARDAPVSRPYSSGWYSSAFDY

SEQ ID NO: 65519 - protein, 9 aa, Homo sapiens
  light chain complementarity determining region 3 for antibody 32760
QHSANWPLT

SEQ ID NO: 65520 - protein, 19 aa, Homo sapiens
  heavy chain complementarity determining region 3 for antibody 32760
ARDYHAGSGAYWAYNRFDP

SEQ ID NO: 65521 - protein, 9 aa, Homo sapiens
  light chain complementarity determining region 3 for antibody 32761
MQVQQTRFT

SEQ ID NO: 65522 - protein, 20 aa, Homo sapiens
  heavy chain complementarity determining region 3 for antibody 32761
AREGHRATARNRYYYNGIDV

SEQ ID NO: 65523 - protein, 9 aa, Homo sapiens
  light chain complementarity determining region 3 for antibody 32762
LQHKTYPRT

SEQ ID NO: 65524 - protein, 8 aa, Homo sapiens
  heavy chain complementarity determining region 3 for antibody 32762
TTGGRDGC

SEQ ID NO: 65525 - protein, 10 aa, Homo sapiens
  light chain complementarity determining region 3 for antibody 32763
LQHENFPLFT

SEQ ID NO: 65526 - protein, 16 aa, Homo sapiens
  heavy chain complementarity determining region 3 for antibody 32763
SRGAYYSSSWYGWFDP

SEQ ID NO: 65527 - protein, 9 aa, Homo sapiens
  light chain complementarity determining region 3 for antibody 32764
LQGNRFPHT

SEQ ID NO: 65528 - protein, 14 aa, Homo sapiens
  heavy chain complementarity determining region 3 for antibody 32764
ARYCSGNSCYSMDH

SEQ ID NO: 65529 - protein, 9 aa, Homo sapiens
  light chain complementarity determining region 3 for antibody 32765
HQSGTLPWT

SEQ ID NO: 65530 - protein, 14 aa, Homo sapiens
  heavy chain complementarity determining region 3 for antibody 32765
IMDASGTGGWYADS

SEQ ID NO: 65531 - protein, 9 aa, Homo sapiens
  light chain complementarity determining region 3 for antibody 32766
QQYYSSPYT

SEQ ID NO: 65532 - protein, 23 aa, Homo sapiens
  heavy chain complementarity determining region 3 for antibody 32766
ARGVTDCSGRNCYGGEVINAFDV

SEQ ID NO: 65533 - protein, 9 aa, Homo sapiens
  light chain complementarity determining region 3 for antibody 32767
QQYSDYPVT

SEQ ID NO: 65534 - protein, 15 aa, Homo sapiens
  heavy chain complementarity determining region 3 for antibody 32767
ARGRTEPGAGYYFDF

SEQ ID NO: 65535 - protein, 9 aa, Homo sapiens
  light chain complementarity determining region 3 for antibody 32768
QQYNTYPLT

SEQ ID NO: 65536 - protein, 18 aa, Homo sapiens
  heavy chain complementarity determining region 3 for antibody 32768
AKGLHYYYFQSDGSMFDF

SEQ ID NO: 65537 - protein, 10 aa, Homo sapiens
  light chain complementarity determining region 3 for antibody 32769
QQYNNWPPLT

SEQ ID NO: 65538 - protein, 15 aa, Homo sapiens
  heavy chain complementarity determining region 3 for antibody 32769
AKEPDCGRNCLFFDS

SEQ ID NO: 65539 - protein, 11 aa, Homo sapiens
  light chain complementarity determining region 3 for antibody 32770
QQYKDWPPALT

SEQ ID NO: 65540 - protein, 12 aa, Homo sapiens
  heavy chain complementarity determining region 3 for antibody 32770
SSSSSGWTWLYY

SEQ ID NO: 65541 - protein, 9 aa, Homo sapiens
  light chain complementarity determining region 3 for antibody 32771
QQYGSSPWT

SEQ ID NO: 65542 - protein, 21 aa, Homo sapiens
  heavy chain complementarity determining region 3 for antibody 32771
ARDAPVSRPYSSGWYSSAFDY

SEQ ID NO: 65543 - protein, 10 aa, Homo sapiens
  light chain complementarity determining region 3 for antibody 32772
QQYGSSPPLT

SEQ ID NO: 65544 - protein, 12 aa, Homo sapiens
  heavy chain complementarity determining region 3 for antibody 32772
ARLHYFDYYFDY

SEQ ID NO: 65545 - protein, 9 aa, Homo sapiens
  light chain complementarity determining region 3 for antibody 32773
QQYDTYPWT

SEQ ID NO: 65546 - protein, 11 aa, Homo sapiens
  heavy chain complementarity determining region 3 for antibody 32773
ARGTYGQAFDI

SEQ ID NO: 65547 - protein, 9 aa, Homo sapiens
  light chain complementarity determining region 3 for antibody 32774
QQYDSYSGT

SEQ ID NO: 65548 - protein, 15 aa, Homo sapiens
  heavy chain complementarity determining region 3 for antibody 32774
VKDKVELATITAFEI

SEQ ID NO: 65549 - protein, 9 aa, Homo sapiens
  light chain complementarity determining region 3 for antibody 32775
QQYDSAPDT

SEQ ID NO: 65550 - protein, 11 aa, Homo sapiens
  heavy chain complementarity determining region 3 for antibody 32775
AKDPSSGPSDY

SEQ ID NO: 65551 - protein, 8 aa, Homo sapiens
  light chain complementarity determining region 3 for antibody 32776
QQYDNLYT

SEQ ID NO: 65552 - protein, 18 aa, Homo sapiens
  heavy chain complementarity determining region 3 for antibody 32776
ARVFCDGGVCFQGDAFDI

SEQ ID NO: 65553 - protein, 9 aa, Homo sapiens
  light chain complementarity determining region 3 for antibody 32777
QQYDNLPLT

SEQ ID NO: 65554 - protein, 19 aa, Homo sapiens
  heavy chain complementarity determining region 3 for antibody 32777
ASPMVRGIHKSPKMYYFDY

SEQ ID NO: 65555 - protein, 9 aa, Homo sapiens
  light chain complementarity determining region 3 for antibody 32778
QQTTNFPLT

SEQ ID NO: 65556 - protein, 12 aa, Homo sapiens
  heavy chain complementarity determining region 3 for antibody 32778
ARDQGGGAAPDY

SEQ ID NO: 65557 - protein, 9 aa, Homo sapiens
  light chain complementarity determining region 3 for antibody 32779
QQSYTNPPT

SEQ ID NO: 65558 - protein, 16 aa, Homo sapiens
  heavy chain complementarity determining region 3 for antibody 32779
ARDLQLYSTSSGVFGS

SEQ ID NO: 65559 - protein, 8 aa, Homo sapiens
  light chain complementarity determining region 3 for antibody 32780
QQSYSART

SEQ ID NO: 65560 - protein, 13 aa, Homo sapiens
  heavy chain complementarity determining region 3 for antibody 32780
ARSGFGGGVYFDY

SEQ ID NO: 65561 - protein, 9 aa, Homo sapiens
  light chain complementarity determining region 3 for antibody 32781
QQSITIPLT

SEQ ID NO: 65562 - protein, 8 aa, Homo sapiens
  heavy chain complementarity determining region 3 for antibody 32781
LIYSSGWN

SEQ ID NO: 65563 - protein, 9 aa, Homo sapiens
  light chain complementarity determining region 3 for antibody 32782
QQNYRTPPT

SEQ ID NO: 65564 - protein, 21 aa, Homo sapiens
  heavy chain complementarity determining region 3 for antibody 32782
TRRNLAGPMVRGAIVAYGFDI

SEQ ID NO: 65565 - protein, 9 aa, Homo sapiens
  light chain complementarity determining region 3 for antibody 32783
QHYNSYPYT

SEQ ID NO: 65566 - protein, 14 aa, Homo sapiens
  heavy chain complementarity determining region 3 for antibody 32783
AKDHPSSGWPAFDY

SEQ ID NO: 65567 - protein, 9 aa, Homo sapiens
  light chain complementarity determining region 3 for antibody 32784
MQPLQTPYT

SEQ ID NO: 65568 - protein, 13 aa, Homo sapiens
  heavy chain complementarity determining region 3 for antibody 32784
AHWGHTNGWHFDY

SEQ ID NO: 65569 - protein, 9 aa, Homo sapiens
  light chain complementarity determining region 3 for antibody 32785
MQALRSPLT

SEQ ID NO: 65570 - protein, 19 aa, Homo sapiens
  heavy chain complementarity determining region 3 for antibody 32785
ARRGATVAGISGWGYGMDV

SEQ ID NO: 65571 - protein, 9 aa, Homo sapiens
  light chain complementarity determining region 3 for antibody 32786
LQHKSYPHT

SEQ ID NO: 65572 - protein, 15 aa, Homo sapiens
  heavy chain complementarity determining region 3 for antibody 32786
GRSKFYYDTISQFDY

SEQ ID NO: 65573 - protein, 9 aa, Homo sapiens
  light chain complementarity determining region 3 for antibody 32787
HQYNTYPWT

SEQ ID NO: 65574 - protein, 12 aa, Homo sapiens
  heavy chain complementarity determining region 3 for antibody 32787
VPPVSSYITLDS

SEQ ID NO: 65575 - protein, 8 aa, Homo sapiens
  light chain complementarity determining region 3 for antibody 32788
QQYSSYPT

SEQ ID NO: 65576 - protein, 17 aa, Homo sapiens
  heavy chain complementarity determining region 3 for antibody 32788
ARRLLYSRYDGGYFFAS

SEQ ID NO: 65577 - protein, 10 aa, Homo sapiens
  light chain complementarity determining region 3 for antibody 32789
QQYNSYSKYT

SEQ ID NO: 65578 - protein, 9 aa, Homo sapiens
  heavy chain complementarity determining region 3 for antibody 32789
ARIWAYIDY

SEQ ID NO: 65579 - protein, 9 aa, Homo sapiens
  light chain complementarity determining region 3 for antibody 32790
QQYNRYPWT

SEQ ID NO: 65580 - protein, 14 aa, Homo sapiens
  heavy chain complementarity determining region 3 for antibody 32790
VRETNIGYYRTSDF

SEQ ID NO: 65581 - protein, 10 aa, Homo sapiens
  light chain complementarity determining region 3 for antibody 32791
QQYGSSPPWT

SEQ ID NO: 65582 - protein, 16 aa, Homo sapiens
  heavy chain complementarity determining region 3 for antibody 32791
ARVQWVRGVLRGGLDY

SEQ ID NO: 65583 - protein, 9 aa, Homo sapiens
  light chain complementarity determining region 3 for antibody 32792
QQYGSIPRT

SEQ ID NO: 65584 - protein, 13 aa, Homo sapiens
  heavy chain complementarity determining region 3 for antibody 32792
AGGIFDSSGYGEY

SEQ ID NO: 65585 - protein, 9 aa, Homo sapiens
  light chain complementarity determining region 3 for antibody 32793
QQYGNLPRT

SEQ ID NO: 65586 - protein, 13 aa, Homo sapiens
  heavy chain complementarity determining region 3 for antibody 32793
AGGDFHRGGYSEF

SEQ ID NO: 65587 - protein, 8 aa, Homo sapiens
  light chain complementarity determining region 3 for antibody 32794
QQYDSYWT

SEQ ID NO: 65588 - protein, 17 aa, Homo sapiens
  heavy chain complementarity determining region 3 for antibody 32794
AKDPGGRGPGPYWFFDL

SEQ ID NO: 65589 - protein, 9 aa, Homo sapiens
  light chain complementarity determining region 3 for antibody 32795
QQYDNLPYT

SEQ ID NO: 65590 - protein, 14 aa, Homo sapiens
  heavy chain complementarity determining region 3 for antibody 32795
ARTVDWDGPKYFDS

SEQ ID NO: 65591 - protein, 9 aa, Homo sapiens
  light chain complementarity determining region 3 for antibody 32796
QQSYSTSYT

SEQ ID NO: 65592 - protein, 12 aa, Homo sapiens
  heavy chain complementarity determining region 3 for antibody 32796
ASDPGHSGNYYR

SEQ ID NO: 65593 - protein, 9 aa, Homo sapiens
  light chain complementarity determining region 3 for antibody 32797
QQSYSTPLT

SEQ ID NO: 65594 - protein, 13 aa, Homo sapiens
  heavy chain complementarity determining region 3 for antibody 32797
ARHLPKSRNSYDY

SEQ ID NO: 65595 - protein, 9 aa, Homo sapiens
  light chain complementarity determining region 3 for antibody 32798
QQSYNTPWT

SEQ ID NO: 65596 - protein, 15 aa, Homo sapiens
  heavy chain complementarity determining region 3 for antibody 32798
TTEMWFGELSVTAHY

SEQ ID NO: 65597 - protein, 9 aa, Homo sapiens
  light chain complementarity determining region 3 for antibody 32799
QQSYNTPFT

SEQ ID NO: 65598 - protein, 11 aa, Homo sapiens
  heavy chain complementarity determining region 3 for antibody 32799
ARARGRDGMDV

SEQ ID NO: 65599 - protein, 9 aa, Homo sapiens
  light chain complementarity determining region 3 for antibody 32800
QQSYGTPLT

SEQ ID NO: 65600 - protein, 15 aa, Homo sapiens
  heavy chain complementarity determining region 3 for antibody 32800
ARDRESGYTNYDFDS

SEQ ID NO: 65601 - protein, 10 aa, Homo sapiens
  light chain complementarity determining region 3 for antibody 32801
QQSFSTSLLT

SEQ ID NO: 65602 - protein, 14 aa, Homo sapiens
  heavy chain complementarity determining region 3 for antibody 32801
AKDRYGQGRSGLDS

SEQ ID NO: 65603 - protein, 9 aa, Homo sapiens
  light chain complementarity determining region 3 for antibody 32802
QQRSNWPWT

SEQ ID NO: 65604 - protein, 17 aa, Homo sapiens
  heavy chain complementarity determining region 3 for antibody 32802
AREDGGSSYNPYWYFDL

SEQ ID NO: 65605 - protein, 9 aa, Homo sapiens
  light chain complementarity determining region 3 for antibody 32803
QQLSGFPLT

SEQ ID NO: 65606 - protein, 21 aa, Homo sapiens
  heavy chain complementarity determining region 3 for antibody 32803
AKGANYHYVSGSYYPGHWFPS

SEQ ID NO: 65607 - protein, 9 aa, Homo sapiens
  light chain complementarity determining region 3 for antibody 32804
QQLNTYPPT

SEQ ID NO: 65608 - protein, 16 aa, Homo sapiens
  heavy chain complementarity determining region 3 for antibody 32804
ARVRSALQVYFNPLGY

SEQ ID NO: 65609 - protein, 9 aa, Homo sapiens
  light chain complementarity determining region 3 for antibody 32805
QQANSFPLT

SEQ ID NO: 65610 - protein, 21 aa, Homo sapiens
  heavy chain complementarity determining region 3 for antibody 32805
ARKEAAELRLWFGESQSPLDS

SEQ ID NO: 65611 - protein, 9 aa, Homo sapiens
  light chain complementarity determining region 3 for antibody 32806
QKYTSAPFT

SEQ ID NO: 65612 - protein, 20 aa, Homo sapiens
  heavy chain complementarity determining region 3 for antibody 32806
AKDGYCSSGSCSILVYGMDV

SEQ ID NO: 65613 - protein, 8 aa, Homo sapiens
  light chain complementarity determining region 3 for antibody 32807
QHYGTSAT

SEQ ID NO: 65614 - protein, 18 aa, Homo sapiens
  heavy chain complementarity determining region 3 for antibody 32807
ARWGGYCSSSSCYWLFDY

SEQ ID NO: 65615 - protein, 9 aa, Homo sapiens
  light chain complementarity determining region 3 for antibody 32808
QHYGSSPLT

SEQ ID NO: 65616 - protein, 12 aa, Homo sapiens
  heavy chain complementarity determining region 3 for antibody 32808
ARDTGDFEVQVS

SEQ ID NO: 65617 - protein, 11 aa, Homo sapiens
  light chain complementarity determining region 3 for antibody 32809
QHYDNSPIMYT

SEQ ID NO: 65618 - protein, 12 aa, Homo sapiens
  heavy chain complementarity determining region 3 for antibody 32809
ARHIAGSNAFDY

SEQ ID NO: 65619 - protein, 9 aa, Homo sapiens
  light chain complementarity determining region 3 for antibody 32810
MQGSHWPPT

SEQ ID NO: 65620 - protein, 13 aa, Homo sapiens
  heavy chain complementarity determining region 3 for antibody 32810
ARDLGDGYNSIDY

SEQ ID NO: 65621 - protein, 9 aa, Homo sapiens
  light chain complementarity determining region 3 for antibody 32811
MQATYWPWT

SEQ ID NO: 65622 - protein, 11 aa, Homo sapiens
  heavy chain complementarity determining region 3 for antibody 32811
LSAVRGSSFDI

SEQ ID NO: 65623 - protein, 9 aa, Homo sapiens
  light chain complementarity determining region 3 for antibody 32812
LQDYTYPRT

SEQ ID NO: 65624 - protein, 18 aa, Homo sapiens
  heavy chain complementarity determining region 3 for antibody 32812
ARDSSPSVARIGYDAYDI

SEQ ID NO: 65625 - protein, 9 aa, Homo sapiens
  light chain complementarity determining region 3 for antibody 32813
HQYNTYSVM

SEQ ID NO: 65626 - protein, 19 aa, Homo sapiens
  heavy chain complementarity determining region 3 for antibody 32813
ARAQVLWFGGLAERGALDI

SEQ ID NO: 65627 - protein, 9 aa, Homo sapiens
  light chain complementarity determining region 3 for antibody 32814
VQVLQTPLT

SEQ ID NO: 65628 - protein, 12 aa, Homo sapiens
  heavy chain complementarity determining region 3 for antibody 32814
VRDGELNWGTWH

SEQ ID NO: 65629 - protein, 9 aa, Homo sapiens
  light chain complementarity determining region 3 for antibody 32815
RQSYTTPWT

SEQ ID NO: 65630 - protein, 12 aa, Homo sapiens
  heavy chain complementarity determining region 3 for antibody 32815
TRDPLSSNGPDY

SEQ ID NO: 65631 - protein, 9 aa, Homo sapiens
  light chain complementarity determining region 3 for antibody 32816
QQYNSYSYT

SEQ ID NO: 65632 - protein, 14 aa, Homo sapiens
  heavy chain complementarity determining region 3 for antibody 32816
AKAHSMVRRYYFDY

SEQ ID NO: 65633 - protein, 9 aa, Homo sapiens
  light chain complementarity determining region 3 for antibody 32817
QQYDNLPLT

SEQ ID NO: 65634 - protein, 13 aa, Homo sapiens
  heavy chain complementarity determining region 3 for antibody 32817
AKEGDSSGDYFDY

SEQ ID NO: 65635 - protein, 9 aa, Homo sapiens
  light chain complementarity determining region 3 for antibody 32818
QQSYSTPYT

SEQ ID NO: 65636 - protein, 13 aa, Homo sapiens
  heavy chain complementarity determining region 3 for antibody 32818
ARHLVRGGLVVDD

SEQ ID NO: 65637 - protein, 10 aa, Homo sapiens
  light chain complementarity determining region 3 for antibody 32819
QQSYSTPPYT

SEQ ID NO: 65638 - protein, 21 aa, Homo sapiens
  heavy chain complementarity determining region 3 for antibody 32819
ARDAPVSRPYSSGWYSSAFDY

SEQ ID NO: 65639 - protein, 8 aa, Homo sapiens
  light chain complementarity determining region 3 for antibody 32820
QQSYSRRT

SEQ ID NO: 65640 - protein, 11 aa, Homo sapiens
  heavy chain complementarity determining region 3 for antibody 32820
AREGGCDCFDS

SEQ ID NO: 65641 - protein, 9 aa, Homo sapiens
  light chain complementarity determining region 3 for antibody 32821
QQSYNIPLT

SEQ ID NO: 65642 - protein, 14 aa, Homo sapiens
  heavy chain complementarity determining region 3 for antibody 32821
AKVYDGFGNLGIDY

SEQ ID NO: 65643 - protein, 9 aa, Homo sapiens
  light chain complementarity determining region 3 for antibody 32822
QQSHTTPFS

SEQ ID NO: 65644 - protein, 11 aa, Homo sapiens
  heavy chain complementarity determining region 3 for antibody 32822
ARVGFGADFDY

SEQ ID NO: 65645 - protein, 9 aa, Homo sapiens
  light chain complementarity determining region 3 for antibody 32823
QQSHDFPYT

SEQ ID NO: 65646 - protein, 13 aa, Homo sapiens
  heavy chain complementarity determining region 3 for antibody 32823
ARLKDINGWPFDY

SEQ ID NO: 65647 - protein, 10 aa, Homo sapiens
  light chain complementarity determining region 3 for antibody 32824
QQRSNWPPVT

SEQ ID NO: 65648 - protein, 14 aa, Homo sapiens
  heavy chain complementarity determining region 3 for antibody 32824
ARGGRWLQFADFDY

SEQ ID NO: 65649 - protein, 10 aa, Homo sapiens
  light chain complementarity determining region 3 for antibody 32825
QQRSNWPPLT

SEQ ID NO: 65650 - protein, 17 aa, Homo sapiens
  heavy chain complementarity determining region 3 for antibody 32825
MRGVENYFDLTTGDFDL

SEQ ID NO: 65651 - protein, 9 aa, Homo sapiens
  light chain complementarity determining region 3 for antibody 32826
QQGYNPPFI

SEQ ID NO: 65652 - protein, 15 aa, Homo sapiens
  heavy chain complementarity determining region 3 for antibody 32826
ARAQVIWGQLYYFDS

SEQ ID NO: 65653 - protein, 9 aa, Homo sapiens
  light chain complementarity determining region 3 for antibody 32827
QQGKIFPYT

SEQ ID NO: 65654 - protein, 16 aa, Homo sapiens
  heavy chain complementarity determining region 3 for antibody 32827
ARDRRGMRDYYYGMDV

SEQ ID NO: 65655 - protein, 9 aa, Homo sapiens
  light chain complementarity determining region 3 for antibody 32828
QQANSFPRT

SEQ ID NO: 65656 - protein, 15 aa, Homo sapiens
  heavy chain complementarity determining region 3 for antibody 32828
VRDLGDYAGNDWFDP

SEQ ID NO: 65657 - protein, 11 aa, Homo sapiens
  light chain complementarity determining region 3 for antibody 32829
QLRSNWPPGLS

SEQ ID NO: 65658 - protein, 19 aa, Homo sapiens
  heavy chain complementarity determining region 3 for antibody 32829
ATDLMRDAAVVGMGTYFDF

SEQ ID NO: 65659 - protein, 9 aa, Homo sapiens
  light chain complementarity determining region 3 for antibody 32830
QKYNSAPRT

SEQ ID NO: 65660 - protein, 11 aa, Homo sapiens
  heavy chain complementarity determining region 3 for antibody 32830
ARDAAYSCFDY

SEQ ID NO: 65661 - protein, 9 aa, Homo sapiens
  light chain complementarity determining region 3 for antibody 32831
MQATHWPWM

SEQ ID NO: 65662 - protein, 15 aa, Homo sapiens
  heavy chain complementarity determining region 3 for antibody 32831
ARDSPPRASGYDYVP

SEQ ID NO: 65663 - protein, 9 aa, Homo sapiens
  light chain complementarity determining region 3 for antibody 32832
MQALLTPRT

SEQ ID NO: 65664 - protein, 13 aa, Homo sapiens
  heavy chain complementarity determining region 3 for antibody 32832
ARDQHAGHYGLDA

SEQ ID NO: 65665 - protein, 9 aa, Homo sapiens
  light chain complementarity determining region 3 for antibody 32833
QQYYSTAYT

SEQ ID NO: 65666 - protein, 14 aa, Homo sapiens
  heavy chain complementarity determining region 3 for antibody 32833
ARLRSGGDFTPFDF

SEQ ID NO: 65667 - protein, 9 aa, Homo sapiens
  light chain complementarity determining region 3 for antibody 32834
QQYSNSLFT

SEQ ID NO: 65668 - protein, 10 aa, Homo sapiens
  heavy chain complementarity determining region 3 for antibody 32834
AREAARALLL

SEQ ID NO: 65669 - protein, 8 aa, Homo sapiens
  light chain complementarity determining region 3 for antibody 32835
QQYNVLWT

SEQ ID NO: 65670 - protein, 10 aa, Homo sapiens
  heavy chain complementarity determining region 3 for antibody 32835
ARDRRSLLDY

SEQ ID NO: 65671 - protein, 9 aa, Homo sapiens
  light chain complementarity determining region 3 for antibody 32836
QQYNSYPYT

SEQ ID NO: 65672 - protein, 15 aa, Homo sapiens
  heavy chain complementarity determining region 3 for antibody 32836
GPSPTWWDHPYYFDY

SEQ ID NO: 65673 - protein, 9 aa, Homo sapiens
  light chain complementarity determining region 3 for antibody 32837
QQYNSYEYT

SEQ ID NO: 65674 - protein, 11 aa, Homo sapiens
  heavy chain complementarity determining region 3 for antibody 32837
ARDSGHGDYVS

SEQ ID NO: 65675 - protein, 10 aa, Homo sapiens
  light chain complementarity determining region 3 for antibody 32838
QQYNNRPPWT

SEQ ID NO: 65676 - protein, 17 aa, Homo sapiens
  heavy chain complementarity determining region 3 for antibody 32838
ATRTRQLGEDTYWYFDL

SEQ ID NO: 65677 - protein, 10 aa, Homo sapiens
  light chain complementarity determining region 3 for antibody 32839
QQYHHWPPWT

SEQ ID NO: 65678 - protein, 16 aa, Homo sapiens
  heavy chain complementarity determining region 3 for antibody 32839
ARVDDFGSGNQGTFDP

SEQ ID NO: 65679 - protein, 9 aa, Homo sapiens
  light chain complementarity determining region 3 for antibody 32840
QQYGSSPRT

SEQ ID NO: 65680 - protein, 10 aa, Homo sapiens
  heavy chain complementarity determining region 3 for antibody 32840
TKDENGGFDP

SEQ ID NO: 65681 - protein, 10 aa, Homo sapiens
  light chain complementarity determining region 3 for antibody 32841
QQYGSSPPVT

SEQ ID NO: 65682 - protein, 17 aa, Homo sapiens
  heavy chain complementarity determining region 3 for antibody 32841
ARDPLRSGWFYNDAFDI

SEQ ID NO: 65683 - protein, 10 aa, Homo sapiens
  light chain complementarity determining region 3 for antibody 32842
QQYGSSPPLT

SEQ ID NO: 65684 - protein, 19 aa, Homo sapiens
  heavy chain complementarity determining region 3 for antibody 32842
AREPVFGVVTTYYYYGMDV

SEQ ID NO: 65685 - protein, 9 aa, Homo sapiens
  light chain complementarity determining region 3 for antibody 32843
QQYDSLLYT

SEQ ID NO: 65686 - protein, 13 aa, Homo sapiens
  heavy chain complementarity determining region 3 for antibody 32843
AREPRSLTGYIDY

SEQ ID NO: 65687 - protein, 9 aa, Homo sapiens
  light chain complementarity determining region 3 for antibody 32844
QQYDNLPYT

SEQ ID NO: 65688 - protein, 16 aa, Homo sapiens
  heavy chain complementarity determining region 3 for antibody 32844
GTRQYLYDTSGYSFDS

SEQ ID NO: 65689 - protein, 10 aa, Homo sapiens
  light chain complementarity determining region 3 for antibody 32845
QQYDNLPPYT

SEQ ID NO: 65690 - protein, 23 aa, Homo sapiens
  heavy chain complementarity determining region 3 for antibody 32845
ARSPRGLDDVRSPQNPPNYYFDS

SEQ ID NO: 65691 - protein, 9 aa, Homo sapiens
  light chain complementarity determining region 3 for antibody 32846
QQTYRTPYT

SEQ ID NO: 65692 - protein, 17 aa, Homo sapiens
  heavy chain complementarity determining region 3 for antibody 32846
ARDLKISDMAAPGTFDY

SEQ ID NO: 65693 - protein, 9 aa, Homo sapiens
  light chain complementarity determining region 3 for antibody 32847
QQSYTAPDT

SEQ ID NO: 65694 - protein, 15 aa, Homo sapiens
  heavy chain complementarity determining region 3 for antibody 32847
ARGAGYSYGPGYFDY

SEQ ID NO: 65695 - protein, 9 aa, Homo sapiens
  light chain complementarity determining region 3 for antibody 32848
QQSYSTRWT

SEQ ID NO: 65696 - protein, 13 aa, Homo sapiens
  heavy chain complementarity determining region 3 for antibody 32848
ARENDYSSSWLDY

SEQ ID NO: 65697 - protein, 10 aa, Homo sapiens
  light chain complementarity determining region 3 for antibody 32849
QQSYSTPPYT

SEQ ID NO: 65698 - protein, 15 aa, Homo sapiens
  heavy chain complementarity determining region 3 for antibody 32849
VRTKEWFGKIDPFDY

SEQ ID NO: 65699 - protein, 9 aa, Homo sapiens
  light chain complementarity determining region 3 for antibody 32850
QQSYFTPWT

SEQ ID NO: 65700 - protein, 13 aa, Homo sapiens
  heavy chain complementarity determining region 3 for antibody 32850
ARAGMTGPNWFDP

SEQ ID NO: 65701 - protein, 9 aa, Homo sapiens
  light chain complementarity determining region 3 for antibody 32851
QQSFNTPWT

SEQ ID NO: 65702 - protein, 14 aa, Homo sapiens
  heavy chain complementarity determining region 3 for antibody 32851
VRAFPLTVTTAFDI

SEQ ID NO: 65703 - protein, 10 aa, Homo sapiens
  light chain complementarity determining region 3 for antibody 32852
QQRSNWPRLT

SEQ ID NO: 65704 - protein, 17 aa, Homo sapiens
  heavy chain complementarity determining region 3 for antibody 32852
AREYCGGDYPCGDPFDF

SEQ ID NO: 65705 - protein, 12 aa, Homo sapiens
  light chain complementarity determining region 3 for antibody 32853
QQRSNWPPGGVT

SEQ ID NO: 65706 - protein, 13 aa, Homo sapiens
  heavy chain complementarity determining region 3 for antibody 32853
ARGYGWYGDYFDY

SEQ ID NO: 65707 - protein, 9 aa, Homo sapiens
  light chain complementarity determining region 3 for antibody 32854
QQLNSYPLT

SEQ ID NO: 65708 - protein, 18 aa, Homo sapiens
  heavy chain complementarity determining region 3 for antibody 32854
ARGGYSGDALRAHDAFDI

SEQ ID NO: 65709 - protein, 10 aa, Homo sapiens
  light chain complementarity determining region 3 for antibody 32855
QQANSFPPFT

SEQ ID NO: 65710 - protein, 12 aa, Homo sapiens
  heavy chain complementarity determining region 3 for antibody 32855
ARDYDEVGAFNY

SEQ ID NO: 65711 - protein, 9 aa, Homo sapiens
  light chain complementarity determining region 3 for antibody 32856
QKYDSAPFT

SEQ ID NO: 65712 - protein, 15 aa, Homo sapiens
  heavy chain complementarity determining region 3 for antibody 32856
ARDNPPPFLDDLYNY

SEQ ID NO: 65713 - protein, 9 aa, Homo sapiens
  light chain complementarity determining region 3 for antibody 32857
NQCSNWPVT

SEQ ID NO: 65714 - protein, 14 aa, Homo sapiens
  heavy chain complementarity determining region 3 for antibody 32857
ARGVAAPIPRYFHH

SEQ ID NO: 65715 - protein, 9 aa, Homo sapiens
  light chain complementarity determining region 3 for antibody 32858
MQALETPFT

SEQ ID NO: 65716 - protein, 15 aa, Homo sapiens
  heavy chain complementarity determining region 3 for antibody 32858
VRHYRVLAAGIEGDS

SEQ ID NO: 65717 - protein, 9 aa, Homo sapiens
  light chain complementarity determining region 3 for antibody 32859
LQHSISPRT

SEQ ID NO: 65718 - protein, 11 aa, Homo sapiens
  heavy chain complementarity determining region 3 for antibody 32859
TTGLGSGGINC

SEQ ID NO: 65719 - protein, 10 aa, Homo sapiens
  light chain complementarity determining region 3 for antibody 32860
QQYRKWLMYS

SEQ ID NO: 65720 - protein, 11 aa, Homo sapiens
  heavy chain complementarity determining region 3 for antibody 32860
VRVAVAGAADY

SEQ ID NO: 65721 - protein, 8 aa, Homo sapiens
  light chain complementarity determining region 3 for antibody 32861
QQYNSYWT

SEQ ID NO: 65722 - protein, 15 aa, Homo sapiens
  heavy chain complementarity determining region 3 for antibody 32861
VRVPQKVPVASEFDS

SEQ ID NO: 65723 - protein, 11 aa, Homo sapiens
  light chain complementarity determining region 3 for antibody 32862
QQYNSYSPMYT

SEQ ID NO: 65724 - protein, 19 aa, Homo sapiens
  heavy chain complementarity determining region 3 for antibody 32862
ARAGGNYYDRTSYYGPFDY

SEQ ID NO: 65725 - protein, 10 aa, Homo sapiens
  light chain complementarity determining region 3 for antibody 32863
QQYNHWPPVT

SEQ ID NO: 65726 - protein, 12 aa, Homo sapiens
  heavy chain complementarity determining region 3 for antibody 32863
VKPAYSSGWYDF

SEQ ID NO: 65727 - protein, 9 aa, Homo sapiens
  light chain complementarity determining region 3 for antibody 32864
QQYGSTTLT

SEQ ID NO: 65728 - protein, 15 aa, Homo sapiens
  heavy chain complementarity determining region 3 for antibody 32864
ARGPHPPYYGGFFHR

SEQ ID NO: 65729 - protein, 9 aa, Homo sapiens
  light chain complementarity determining region 3 for antibody 32865
QQYGSSPTT

SEQ ID NO: 65730 - protein, 17 aa, Homo sapiens
  heavy chain complementarity determining region 3 for antibody 32865
ARLGGSGWNRGHNWFDP

SEQ ID NO: 65731 - protein, 11 aa, Homo sapiens
  light chain complementarity determining region 3 for antibody 32866
QQYGSSPPMYT

SEQ ID NO: 65732 - protein, 17 aa, Homo sapiens
  heavy chain complementarity determining region 3 for antibody 32866
ARILGGQKYYFYYGMDV

SEQ ID NO: 65733 - protein, 8 aa, Homo sapiens
  light chain complementarity determining region 3 for antibody 32867
QQYGSSLT

SEQ ID NO: 65734 - protein, 13 aa, Homo sapiens
  heavy chain complementarity determining region 3 for antibody 32867
ARVHYSSREAVDY

SEQ ID NO: 65735 - protein, 8 aa, Homo sapiens
  light chain complementarity determining region 3 for antibody 32868
QQYGSSFT

SEQ ID NO: 65736 - protein, 16 aa, Homo sapiens
  heavy chain complementarity determining region 3 for antibody 32868
ARGPGVEVAGATYCDS

SEQ ID NO: 65737 - protein, 9 aa, Homo sapiens
  light chain complementarity determining region 3 for antibody 32869
QQYGSSAYT

SEQ ID NO: 65738 - protein, 17 aa, Homo sapiens
  heavy chain complementarity determining region 3 for antibody 32869
ARGVWAGVNLPEGYFDY

SEQ ID NO: 65739 - protein, 9 aa, Homo sapiens
  light chain complementarity determining region 3 for antibody 32870
QQYDSLPFT

SEQ ID NO: 65740 - protein, 15 aa, Homo sapiens
  heavy chain complementarity determining region 3 for antibody 32870
ARAPLMVWSGPTFDY

SEQ ID NO: 65741 - protein, 9 aa, Homo sapiens
  light chain complementarity determining region 3 for antibody 32871
QQYDNLPLT

SEQ ID NO: 65742 - protein, 20 aa, Homo sapiens
  heavy chain complementarity determining region 3 for antibody 32871
ASATNAQDQPDTGLLDGMDV

SEQ ID NO: 65743 - protein, 9 aa, Homo sapiens
  light chain complementarity determining region 3 for antibody 32872
QQYDGYSVS

SEQ ID NO: 65744 - protein, 11 aa, Homo sapiens
  heavy chain complementarity determining region 3 for antibody 32872
ARGNSGYHIEY

SEQ ID NO: 65745 - protein, 9 aa, Homo sapiens
  light chain complementarity determining region 3 for antibody 32873
QQSYSTPWT

SEQ ID NO: 65746 - protein, 13 aa, Homo sapiens
  heavy chain complementarity determining region 3 for antibody 32873
VNVSQWLDDAFNF

SEQ ID NO: 65747 - protein, 9 aa, Homo sapiens
  light chain complementarity determining region 3 for antibody 32874
QQSYSTPLT

SEQ ID NO: 65748 - protein, 15 aa, Homo sapiens
  heavy chain complementarity determining region 3 for antibody 32874
ATPPVGDYPKGVLHI

SEQ ID NO: 65749 - protein, 10 aa, Homo sapiens
  light chain complementarity determining region 3 for antibody 32875
QQSYNTPPWT

SEQ ID NO: 65750 - protein, 12 aa, Homo sapiens
  heavy chain complementarity determining region 3 for antibody 32875
ARVSPVRGVIEY

SEQ ID NO: 65751 - protein, 10 aa, Homo sapiens
  light chain complementarity determining region 3 for antibody 32876
QQRSNWPPLT

SEQ ID NO: 65752 - protein, 14 aa, Homo sapiens
  heavy chain complementarity determining region 3 for antibody 32876
AKNRDSGWLDAFDI

SEQ ID NO: 65753 - protein, 9 aa, Homo sapiens
  light chain complementarity determining region 3 for antibody 32877
QQFGASPWT

SEQ ID NO: 65754 - protein, 24 aa, Homo sapiens
  heavy chain complementarity determining region 3 for antibody 32877
AGIPITLIRGVDVDVNYDYYGMAV

SEQ ID NO: 65755 - protein, 9 aa, Homo sapiens
  light chain complementarity determining region 3 for antibody 32878
MQVLQTPLT

SEQ ID NO: 65756 - protein, 12 aa, Homo sapiens
  heavy chain complementarity determining region 3 for antibody 32878
AKDSEQKWELHD

SEQ ID NO: 65757 - protein, 9 aa, Homo sapiens
  light chain complementarity determining region 3 for antibody 32879
MQGTHWPWT

SEQ ID NO: 65758 - protein, 19 aa, Homo sapiens
  heavy chain complementarity determining region 3 for antibody 32879
ARGPPRLFSVYWYSNGMDF

SEQ ID NO: 65759 - protein, 9 aa, Homo sapiens
  light chain complementarity determining region 3 for antibody 32880
MQGLQPPYS

SEQ ID NO: 65760 - protein, 11 aa, Homo sapiens
  heavy chain complementarity determining region 3 for antibody 32880
ARPGEESQFDY

SEQ ID NO: 65761 - protein, 9 aa, Homo sapiens
  light chain complementarity determining region 3 for antibody 32881
MQALQTPLT

SEQ ID NO: 65762 - protein, 14 aa, Homo sapiens
  heavy chain complementarity determining region 3 for antibody 32881
ARGLAARPLWRFDY

SEQ ID NO: 65763 - protein, 8 aa, Homo sapiens
  light chain complementarity determining region 3 for antibody 32882
MQALHHLT

SEQ ID NO: 65764 - protein, 16 aa, Homo sapiens
  heavy chain complementarity determining region 3 for antibody 32882
AKWGGVAMAGHYYFDY

SEQ ID NO: 65765 - protein, 9 aa, Homo sapiens
  light chain complementarity determining region 3 for antibody 32883
MQALETPFT

SEQ ID NO: 65766 - protein, 15 aa, Homo sapiens
  heavy chain complementarity determining region 3 for antibody 32883
VRHYRITVAGIEGDS

SEQ ID NO: 65767 - protein, 9 aa, Homo sapiens
  light chain complementarity determining region 3 for antibody 32884
LQDYNYPRT

SEQ ID NO: 65768 - protein, 13 aa, Homo sapiens
  heavy chain complementarity determining region 3 for antibody 32884
AREGYGDYAPFDY

SEQ ID NO: 65769 - protein, 9 aa, Homo sapiens
  light chain complementarity determining region 3 for antibody 32885
FQGTLWPDT

SEQ ID NO: 65770 - protein, 10 aa, Homo sapiens
  heavy chain complementarity determining region 3 for antibody 32885
ARDFYGSIDY

SEQ ID NO: 65771 - protein, 9 aa, Homo sapiens
  light chain complementarity determining region 3 for antibody 32886
QQYYTSVRT

SEQ ID NO: 65772 - protein, 12 aa, Homo sapiens
  heavy chain complementarity determining region 3 for antibody 32886
VKDCGLGGPRDY

SEQ ID NO: 65773 - protein, 8 aa, Homo sapiens
  light chain complementarity determining region 3 for antibody 32887
QQYSTYYS

SEQ ID NO: 65774 - protein, 14 aa, Homo sapiens
  heavy chain complementarity determining region 3 for antibody 32887
ARHTEVTGLRGFDR

SEQ ID NO: 65775 - protein, 9 aa, Homo sapiens
  light chain complementarity determining region 3 for antibody 32888
QQYNSYSWT

SEQ ID NO: 65776 - protein, 24 aa, Homo sapiens
  heavy chain complementarity determining region 3 for antibody 32888
ARDFYPSYTYSSSWGLYYYYGMDV

SEQ ID NO: 65777 - protein, 8 aa, Homo sapiens
  light chain complementarity determining region 3 for antibody 32889
QQYNSYST

SEQ ID NO: 65778 - protein, 19 aa, Homo sapiens
  heavy chain complementarity determining region 3 for antibody 32889
VRQGYCSSSDCSVGWYIDL

SEQ ID NO: 65779 - protein, 8 aa, Homo sapiens
  light chain complementarity determining region 3 for antibody 32890
QQYNDWPS

SEQ ID NO: 65780 - protein, 14 aa, Homo sapiens
  heavy chain complementarity determining region 3 for antibody 32890
ARTVYSFGSYYFDF

SEQ ID NO: 65781 - protein, 9 aa, Homo sapiens
  light chain complementarity determining region 3 for antibody 32891
QQYINSPST

SEQ ID NO: 65782 - protein, 15 aa, Homo sapiens
  heavy chain complementarity determining region 3 for antibody 32891
ARPRWRYETENAFDV

SEQ ID NO: 65783 - protein, 9 aa, Homo sapiens
  light chain complementarity determining region 3 for antibody 32892
QQYGTSSYT

SEQ ID NO: 65784 - protein, 14 aa, Homo sapiens
  heavy chain complementarity determining region 3 for antibody 32892
ARDYRDRNGYYFNH

SEQ ID NO: 65785 - protein, 10 aa, Homo sapiens
  light chain complementarity determining region 3 for antibody 32893
QQYGTSPRWT

SEQ ID NO: 65786 - protein, 18 aa, Homo sapiens
  heavy chain complementarity determining region 3 for antibody 32893
VRDLPIDTLLVTVGGGDF

SEQ ID NO: 65787 - protein, 10 aa, Homo sapiens
  light chain complementarity determining region 3 for antibody 32894
QQYGTSPPWT

SEQ ID NO: 65788 - protein, 12 aa, Homo sapiens
  heavy chain complementarity determining region 3 for antibody 32894
ARGGSSGYQFDY

SEQ ID NO: 65789 - protein, 9 aa, Homo sapiens
  light chain complementarity determining region 3 for antibody 32895
QQYGSSPLT

SEQ ID NO: 65790 - protein, 19 aa, Homo sapiens
  heavy chain complementarity determining region 3 for antibody 32895
ARGSNSSRRRAAVVGDFDL

SEQ ID NO: 65791 - protein, 9 aa, Homo sapiens
  light chain complementarity determining region 3 for antibody 32896
QQYGSSPCT

SEQ ID NO: 65792 - protein, 18 aa, Homo sapiens
  heavy chain complementarity determining region 3 for antibody 32896
ARSPLFNGRNPRYWHFDL

SEQ ID NO: 65793 - protein, 9 aa, Homo sapiens
  light chain complementarity determining region 3 for antibody 32897
QQYGNSPRT

SEQ ID NO: 65794 - protein, 15 aa, Homo sapiens
  heavy chain complementarity determining region 3 for antibody 32897
AGGWFNYYSSGYYET

SEQ ID NO: 65795 - protein, 9 aa, Homo sapiens
  light chain complementarity determining region 3 for antibody 32898
QQYGGLPRT

SEQ ID NO: 65796 - protein, 13 aa, Homo sapiens
  heavy chain complementarity determining region 3 for antibody 32898
ARGPEGLGGDYPL

SEQ ID NO: 65797 - protein, 9 aa, Homo sapiens
  light chain complementarity determining region 3 for antibody 32899
QQYERSPRM

SEQ ID NO: 65798 - protein, 15 aa, Homo sapiens
  heavy chain complementarity determining region 3 for antibody 32899
ARDGNVLSTGYPLDS

SEQ ID NO: 65799 - protein, 8 aa, Homo sapiens
  light chain complementarity determining region 3 for antibody 32900
QQYDSYST

SEQ ID NO: 65800 - protein, 16 aa, Homo sapiens
  heavy chain complementarity determining region 3 for antibody 32900
AKDALALTSKPYYFDF

SEQ ID NO: 65801 - protein, 9 aa, Homo sapiens
  light chain complementarity determining region 3 for antibody 32901
QQVSSFPLT

SEQ ID NO: 65802 - protein, 13 aa, Homo sapiens
  heavy chain complementarity determining region 3 for antibody 32901
ARDSSNWYNWFDS

SEQ ID NO: 65803 - protein, 9 aa, Homo sapiens
  light chain complementarity determining region 3 for antibody 32902
QQTYSMPLT

SEQ ID NO: 65804 - protein, 14 aa, Homo sapiens
  heavy chain complementarity determining region 3 for antibody 32902
ARGRDTSGYSGLDY

SEQ ID NO: 65805 - protein, 10 aa, Homo sapiens
  light chain complementarity determining region 3 for antibody 32903
QQTDSTPPYT

SEQ ID NO: 65806 - protein, 18 aa, Homo sapiens
  heavy chain complementarity determining region 3 for antibody 32903
AREGYYYGSGSYHDAFDI

SEQ ID NO: 65807 - protein, 11 aa, Homo sapiens
  light chain complementarity determining region 3 for antibody 32904
QQSYSTPQALT

SEQ ID NO: 65808 - protein, 15 aa, Homo sapiens
  heavy chain complementarity determining region 3 for antibody 32904
ARQFIGSFGETMFDY

SEQ ID NO: 65809 - protein, 9 aa, Homo sapiens
  light chain complementarity determining region 3 for antibody 32905
QQSYSSPYT

SEQ ID NO: 65810 - protein, 18 aa, Homo sapiens
  heavy chain complementarity determining region 3 for antibody 32905
VRVVYYTSGIYWRPIFDS

SEQ ID NO: 65811 - protein, 9 aa, Homo sapiens
  light chain complementarity determining region 3 for antibody 32906
QQSYNTPLT

SEQ ID NO: 65812 - protein, 14 aa, Homo sapiens
  heavy chain complementarity determining region 3 for antibody 32906
TTSSVFVTVDAFDF

SEQ ID NO: 65813 - protein, 9 aa, Homo sapiens
  light chain complementarity determining region 3 for antibody 32907
QQRNNWPST

SEQ ID NO: 65814 - protein, 15 aa, Homo sapiens
  heavy chain complementarity determining region 3 for antibody 32907
AREFAGYSSGWLFDF

SEQ ID NO: 65815 - protein, 9 aa, Homo sapiens
  light chain complementarity determining region 3 for antibody 32908
QQLNSFPYT

SEQ ID NO: 65816 - protein, 12 aa, Homo sapiens
  heavy chain complementarity determining region 3 for antibody 32908
AIWAGAQGGIPF

SEQ ID NO: 65817 - protein, 9 aa, Homo sapiens
  light chain complementarity determining region 3 for antibody 32909
QQLDGYPVT

SEQ ID NO: 65818 - protein, 16 aa, Homo sapiens
  heavy chain complementarity determining region 3 for antibody 32909
AAALPRYTRGLNPSDY

SEQ ID NO: 65819 - protein, 9 aa, Homo sapiens
  light chain complementarity determining region 3 for antibody 32910
QQFNSYPIT

SEQ ID NO: 65820 - protein, 13 aa, Homo sapiens
  heavy chain complementarity determining region 3 for antibody 32910
ARTKDGGFFAFDF

SEQ ID NO: 65821 - protein, 9 aa, Homo sapiens
  light chain complementarity determining region 3 for antibody 32911
QHYNSVPLT

SEQ ID NO: 65822 - protein, 10 aa, Homo sapiens
  heavy chain complementarity determining region 3 for antibody 32911
ARDVVGSDDQ

SEQ ID NO: 65823 - protein, 9 aa, Homo sapiens
  light chain complementarity determining region 3 for antibody 32912
QHTSTFPRT

SEQ ID NO: 65824 - protein, 20 aa, Homo sapiens
  heavy chain complementarity determining region 3 for antibody 32912
ARGRRIAALSTAHYYYGMDV

SEQ ID NO: 65825 - protein, 8 aa, Homo sapiens
  light chain complementarity determining region 3 for antibody 32913
MQGTYWPT

SEQ ID NO: 65826 - protein, 17 aa, Homo sapiens
  heavy chain complementarity determining region 3 for antibody 32913
SIYWYDGNYANPDYFDY

SEQ ID NO: 65827 - protein, 9 aa, Homo sapiens
  light chain complementarity determining region 3 for antibody 32914
MQGTHWPRT

SEQ ID NO: 65828 - protein, 12 aa, Homo sapiens
  heavy chain complementarity determining region 3 for antibody 32914
ARGSHLIMFGGL

SEQ ID NO: 65829 - protein, 8 aa, Homo sapiens
  light chain complementarity determining region 3 for antibody 32915
MQALQTPT

SEQ ID NO: 65830 - protein, 12 aa, Homo sapiens
  heavy chain complementarity determining region 3 for antibody 32915
AKDVAAAESFDY

SEQ ID NO: 65831 - protein, 9 aa, Homo sapiens
  light chain complementarity determining region 3 for antibody 32916
QQYSSSPLT

SEQ ID NO: 65832 - protein, 15 aa, Homo sapiens
  heavy chain complementarity determining region 3 for antibody 32916
ATGRIVAAKNVHFDY

SEQ ID NO: 65833 - protein, 9 aa, Homo sapiens
  light chain complementarity determining region 3 for antibody 32917
QQYNTYSET

SEQ ID NO: 65834 - protein, 8 aa, Homo sapiens
  heavy chain complementarity determining region 3 for antibody 32917
ATSPQRGY

SEQ ID NO: 65835 - protein, 9 aa, Homo sapiens
  light chain complementarity determining region 3 for antibody 32918
QQYNTYPWT

SEQ ID NO: 65836 - protein, 17 aa, Homo sapiens
  heavy chain complementarity determining region 3 for antibody 32918
ARTIYDTSWSSLGYFDY

SEQ ID NO: 65837 - protein, 10 aa, Homo sapiens
  light chain complementarity determining region 3 for antibody 32919
QQYNSYPPIT

SEQ ID NO: 65838 - protein, 15 aa, Homo sapiens
  heavy chain complementarity determining region 3 for antibody 32919
ARVRRHYSNYDGLDY

SEQ ID NO: 65839 - protein, 9 aa, Homo sapiens
  light chain complementarity determining region 3 for antibody 32920
QQYHRVPYT

SEQ ID NO: 65840 - protein, 11 aa, Homo sapiens
  heavy chain complementarity determining region 3 for antibody 32920
VRDIALGVFDF

SEQ ID NO: 65841 - protein, 9 aa, Homo sapiens
  light chain complementarity determining region 3 for antibody 32921
QQYGSSPTT

SEQ ID NO: 65842 - protein, 15 aa, Homo sapiens
  heavy chain complementarity determining region 3 for antibody 32921
ARDLGDDFFHYGMDV

SEQ ID NO: 65843 - protein, 8 aa, Homo sapiens
  light chain complementarity determining region 3 for antibody 32922
QQYGSSPS

SEQ ID NO: 65844 - protein, 20 aa, Homo sapiens
  heavy chain complementarity determining region 3 for antibody 32922
ARDQAYFYALGSSGVDWLDP

SEQ ID NO: 65845 - protein, 10 aa, Homo sapiens
  light chain complementarity determining region 3 for antibody 32923
QQYGSSPIFT

SEQ ID NO: 65846 - protein, 19 aa, Homo sapiens
  heavy chain complementarity determining region 3 for antibody 32923
ARDLVGVFGDEIDSSPFDH

SEQ ID NO: 65847 - protein, 9 aa, Homo sapiens
  light chain complementarity determining region 3 for antibody 32924
QQYESYPLT

SEQ ID NO: 65848 - protein, 17 aa, Homo sapiens
  heavy chain complementarity determining region 3 for antibody 32924
ARGVGRGLEASPGIFDY

SEQ ID NO: 65849 - protein, 9 aa, Homo sapiens
  light chain complementarity determining region 3 for antibody 32925
QQYDSYSWT

SEQ ID NO: 65850 - protein, 12 aa, Homo sapiens
  heavy chain complementarity determining region 3 for antibody 32925
ARGRFGDLVYDY

SEQ ID NO: 65851 - protein, 9 aa, Homo sapiens
  light chain complementarity determining region 3 for antibody 32926
QQYDNLPVT

SEQ ID NO: 65852 - protein, 10 aa, Homo sapiens
  heavy chain complementarity determining region 3 for antibody 32926
AGGGGWLTHC

SEQ ID NO: 65853 - protein, 9 aa, Homo sapiens
  light chain complementarity determining region 3 for antibody 32927
QQYDNLPRT

SEQ ID NO: 65854 - protein, 20 aa, Homo sapiens
  heavy chain complementarity determining region 3 for antibody 32927
ARDQAYYYGSGSSGVDWLDP

SEQ ID NO: 65855 - protein, 9 aa, Homo sapiens
  light chain complementarity determining region 3 for antibody 32928
QQYDNLPPT

SEQ ID NO: 65856 - protein, 17 aa, Homo sapiens
  heavy chain complementarity determining region 3 for antibody 32928
ARVPYYYDSSGYNVRDY

SEQ ID NO: 65857 - protein, 9 aa, Homo sapiens
  light chain complementarity determining region 3 for antibody 32929
QQTYSSPLT

SEQ ID NO: 65858 - protein, 17 aa, Homo sapiens
  heavy chain complementarity determining region 3 for antibody 32929
ARGAVAGFQWFGDHFDY

SEQ ID NO: 65859 - protein, 9 aa, Homo sapiens
  light chain complementarity determining region 3 for antibody 32930
QQSYSTPPT

SEQ ID NO: 65860 - protein, 18 aa, Homo sapiens
  heavy chain complementarity determining region 3 for antibody 32930
AKDRSYFDYVSGSYRFDY

SEQ ID NO: 65861 - protein, 9 aa, Homo sapiens
  light chain complementarity determining region 3 for antibody 32931
QQSYSTPPT

SEQ ID NO: 65862 - protein, 15 aa, Homo sapiens
  heavy chain complementarity determining region 3 for antibody 32931
AHNEGYSYGYLSFGY

SEQ ID NO: 65863 - protein, 10 aa, Homo sapiens
  light chain complementarity determining region 3 for antibody 32932
QQSYSTPPIT

SEQ ID NO: 65864 - protein, 18 aa, Homo sapiens
  heavy chain complementarity determining region 3 for antibody 32932
TRITKELTIFGVVQYFQH

SEQ ID NO: 65865 - protein, 9 aa, Homo sapiens
  light chain complementarity determining region 3 for antibody 32933
QQSYSTPFT

SEQ ID NO: 65866 - protein, 15 aa, Homo sapiens
  heavy chain complementarity determining region 3 for antibody 32933
ARSRRSGLHYYGMDV

SEQ ID NO: 65867 - protein, 10 aa, Homo sapiens
  light chain complementarity determining region 3 for antibody 32934
QQSYSLPPLS

SEQ ID NO: 65868 - protein, 15 aa, Homo sapiens
  heavy chain complementarity determining region 3 for antibody 32934
VSDRNISGFRGAFDI

SEQ ID NO: 65869 - protein, 9 aa, Homo sapiens
  light chain complementarity determining region 3 for antibody 32935
QQSYSAPWT

SEQ ID NO: 65870 - protein, 13 aa, Homo sapiens
  heavy chain complementarity determining region 3 for antibody 32935
ARQDESTSYYFDL

SEQ ID NO: 65871 - protein, 9 aa, Homo sapiens
  light chain complementarity determining region 3 for antibody 32936
QQSETIPYT

SEQ ID NO: 65872 - protein, 14 aa, Homo sapiens
  heavy chain complementarity determining region 3 for antibody 32936
ARGGESRGWYGFDF

SEQ ID NO: 65873 - protein, 10 aa, Homo sapiens
  light chain complementarity determining region 3 for antibody 32937
QQRSNWPPIT

SEQ ID NO: 65874 - protein, 17 aa, Homo sapiens
  heavy chain complementarity determining region 3 for antibody 32937
AAGYHSESLSADEVFDI

SEQ ID NO: 65875 - protein, 10 aa, Homo sapiens
  light chain complementarity determining region 3 for antibody 32938
QHYGSSPRFT

SEQ ID NO: 65876 - protein, 21 aa, Homo sapiens
  heavy chain complementarity determining region 3 for antibody 32938
VRDGGENSAWSSRLYYYGMDV

SEQ ID NO: 65877 - protein, 10 aa, Homo sapiens
  light chain complementarity determining region 3 for antibody 32939
QHWGSSPAYT

SEQ ID NO: 65878 - protein, 12 aa, Homo sapiens
  heavy chain complementarity determining region 3 for antibody 32939
ARETTQFGELDN

SEQ ID NO: 65879 - protein, 9 aa, Homo sapiens
  light chain complementarity determining region 3 for antibody 32940
MQGLQTPWT

SEQ ID NO: 65880 - protein, 15 aa, Homo sapiens
  heavy chain complementarity determining region 3 for antibody 32940
ASWVHEYGDFNAFDL

SEQ ID NO: 65881 - protein, 9 aa, Homo sapiens
  light chain complementarity determining region 3 for antibody 32941
MQALQTLFT

SEQ ID NO: 65882 - protein, 15 aa, Homo sapiens
  heavy chain complementarity determining region 3 for antibody 32941
TYSSSWLGYYYGMDV

SEQ ID NO: 65883 - protein, 9 aa, Homo sapiens
  light chain complementarity determining region 3 for antibody 32942
MQALHTPRT

SEQ ID NO: 65884 - protein, 15 aa, Homo sapiens
  heavy chain complementarity determining region 3 for antibody 32942
AKDLHRDNGMRQFEN

SEQ ID NO: 65885 - protein, 9 aa, Homo sapiens
  light chain complementarity determining region 3 for antibody 32943
LQHKSYPLT

SEQ ID NO: 65886 - protein, 13 aa, Homo sapiens
  heavy chain complementarity determining region 3 for antibody 32943
ARHLVRGVMVVDY

SEQ ID NO: 65887 - protein, 9 aa, Homo sapiens
  light chain complementarity determining region 3 for antibody 32944
IQHSDYPLT

SEQ ID NO: 65888 - protein, 18 aa, Homo sapiens
  heavy chain complementarity determining region 3 for antibody 32944
ARVECSGGDCFSARYFDL

SEQ ID NO: 65889 - protein, 9 aa, Homo sapiens
  light chain complementarity determining region 3 for antibody 32945
HQYSTSPRT

SEQ ID NO: 65890 - protein, 16 aa, Homo sapiens
  heavy chain complementarity determining region 3 for antibody 32945
ARGPPPRFSTSWYGEY

SEQ ID NO: 65891 - protein, 9 aa, Homo sapiens
  light chain complementarity determining region 3 for antibody 32946
HCYVASPLS

SEQ ID NO: 65892 - protein, 15 aa, Homo sapiens
  heavy chain complementarity determining region 3 for antibody 32946
ASRIVASSHKTPFDP

SEQ ID NO: 65893 - protein, 8 aa, Homo sapiens
  light chain complementarity determining region 3 for antibody 32947
QQYYSLWT

SEQ ID NO: 65894 - protein, 14 aa, Homo sapiens
  heavy chain complementarity determining region 3 for antibody 32947
ASGLNRDGYKYFNF

SEQ ID NO: 65895 - protein, 9 aa, Homo sapiens
  light chain complementarity determining region 3 for antibody 32948
QQYRSSPWT

SEQ ID NO: 65896 - protein, 22 aa, Homo sapiens
  heavy chain complementarity determining region 3 for antibody 32948
ARAVATTRWGRSGGDWGAPFDI

SEQ ID NO: 65897 - protein, 9 aa, Homo sapiens
  light chain complementarity determining region 3 for antibody 32949
QQYQTAPWT

SEQ ID NO: 65898 - protein, 17 aa, Homo sapiens
  heavy chain complementarity determining region 3 for antibody 32949
ARIEGFTWDWLLGGFDV

SEQ ID NO: 65899 - protein, 8 aa, Homo sapiens
  light chain complementarity determining region 3 for antibody 32950
QQYNSYST

SEQ ID NO: 65900 - protein, 12 aa, Homo sapiens
  heavy chain complementarity determining region 3 for antibody 32950
VKDCGLGGSRDF

SEQ ID NO: 65901 - protein, 8 aa, Homo sapiens
  light chain complementarity determining region 3 for antibody 32951
QQYNSYST

SEQ ID NO: 65902 - protein, 10 aa, Homo sapiens
  heavy chain complementarity determining region 3 for antibody 32951
ARDVVGSDDQ

SEQ ID NO: 65903 - protein, 9 aa, Homo sapiens
  light chain complementarity determining region 3 for antibody 32952
QQYNSYPLT

SEQ ID NO: 65904 - protein, 14 aa, Homo sapiens
  heavy chain complementarity determining region 3 for antibody 32952
ARVAPLDGDYALAY

SEQ ID NO: 65905 - protein, 9 aa, Homo sapiens
  light chain complementarity determining region 3 for antibody 32953
QQYNSHPPT

SEQ ID NO: 65906 - protein, 19 aa, Homo sapiens
  heavy chain complementarity determining region 3 for antibody 32953
ARDLHYGSGGYYKPYYFDH

SEQ ID NO: 65907 - protein, 9 aa, Homo sapiens
  light chain complementarity determining region 3 for antibody 32954
QQYNSFAWT

SEQ ID NO: 65908 - protein, 12 aa, Homo sapiens
  heavy chain complementarity determining region 3 for antibody 32954
VRDSREAYAMDV

SEQ ID NO: 65909 - protein, 9 aa, Homo sapiens
  light chain complementarity determining region 3 for antibody 32955
QQYHTYSWT

SEQ ID NO: 65910 - protein, 11 aa, Homo sapiens
  heavy chain complementarity determining region 3 for antibody 32955
AGSSGHDAFDM

SEQ ID NO: 65911 - protein, 9 aa, Homo sapiens
  light chain complementarity determining region 3 for antibody 32956
QQYGSSPWA

SEQ ID NO: 65912 - protein, 22 aa, Homo sapiens
  heavy chain complementarity determining region 3 for antibody 32956
TRVSIGIYDTVNGYYHPGPMDS

SEQ ID NO: 65913 - protein, 10 aa, Homo sapiens
  light chain complementarity determining region 3 for antibody 32957
QQYGSSPIFT

SEQ ID NO: 65914 - protein, 11 aa, Homo sapiens
  heavy chain complementarity determining region 3 for antibody 32957
ARYGSEVAFDI

SEQ ID NO: 65915 - protein, 9 aa, Homo sapiens
  light chain complementarity determining region 3 for antibody 32958
QQYGSSPFT

SEQ ID NO: 65916 - protein, 17 aa, Homo sapiens
  heavy chain complementarity determining region 3 for antibody 32958
AKSSVWLNNYYYYGLDL

SEQ ID NO: 65917 - protein, 8 aa, Homo sapiens
  light chain complementarity determining region 3 for antibody 32959
QQYGSSIT

SEQ ID NO: 65918 - protein, 17 aa, Homo sapiens
  heavy chain complementarity determining region 3 for antibody 32959
ARDVHVFGQVKYYGMDV

SEQ ID NO: 65919 - protein, 9 aa, Homo sapiens
  light chain complementarity determining region 3 for antibody 32960
QQYDTYPLT

SEQ ID NO: 65920 - protein, 16 aa, Homo sapiens
  heavy chain complementarity determining region 3 for antibody 32960
VRDAWRESGRNAPGAN

SEQ ID NO: 65921 - protein, 9 aa, Homo sapiens
  light chain complementarity determining region 3 for antibody 32961
QQYDSYPWT

SEQ ID NO: 65922 - protein, 11 aa, Homo sapiens
  heavy chain complementarity determining region 3 for antibody 32961
ARLAGDKAFDL

SEQ ID NO: 65923 - protein, 11 aa, Homo sapiens
  light chain complementarity determining region 3 for antibody 32962
QQSYGAPPMYT

SEQ ID NO: 65924 - protein, 12 aa, Homo sapiens
  heavy chain complementarity determining region 3 for antibody 32962
AKNSGVRRAFDI

SEQ ID NO: 65925 - protein, 9 aa, Homo sapiens
  light chain complementarity determining region 3 for antibody 32963
QQSHGTPPT

SEQ ID NO: 65926 - protein, 11 aa, Homo sapiens
  heavy chain complementarity determining region 3 for antibody 32963
TREAAGTTVDY

SEQ ID NO: 65927 - protein, 10 aa, Homo sapiens
  light chain complementarity determining region 3 for antibody 32964
QQRYNWPPYT

SEQ ID NO: 65928 - protein, 15 aa, Homo sapiens
  heavy chain complementarity determining region 3 for antibody 32964
ARGATSGRQEYYFDY

SEQ ID NO: 65929 - protein, 9 aa, Homo sapiens
  light chain complementarity determining region 3 for antibody 32965
QQRSNWPLT

SEQ ID NO: 65930 - protein, 9 aa, Homo sapiens
  heavy chain complementarity determining region 3 for antibody 32965
AAMQDAFDF

SEQ ID NO: 65931 - protein, 11 aa, Homo sapiens
  light chain complementarity determining region 3 for antibody 32966
QQRGNWPPIFT

SEQ ID NO: 65932 - protein, 16 aa, Homo sapiens
  heavy chain complementarity determining region 3 for antibody 32966
ARGRLSASGTWGCHDY

SEQ ID NO: 65933 - protein, 9 aa, Homo sapiens
  light chain complementarity determining region 3 for antibody 32967
QQLNSYRLT

SEQ ID NO: 65934 - protein, 10 aa, Homo sapiens
  heavy chain complementarity determining region 3 for antibody 32967
ATSSYGIFDY

SEQ ID NO: 65935 - protein, 9 aa, Homo sapiens
  light chain complementarity determining region 3 for antibody 32968
QQGYDTPRT

SEQ ID NO: 65936 - protein, 12 aa, Homo sapiens
  heavy chain complementarity determining region 3 for antibody 32968
ASGGSRVTTLRY

SEQ ID NO: 65937 - protein, 9 aa, Homo sapiens
  light chain complementarity determining region 3 for antibody 32969
QQGNRFPHT

SEQ ID NO: 65938 - protein, 14 aa, Homo sapiens
  heavy chain complementarity determining region 3 for antibody 32969
ARYCSGTRCYSMDY

SEQ ID NO: 65939 - protein, 9 aa, Homo sapiens
  light chain complementarity determining region 3 for antibody 32970
QQFKNYPLT

SEQ ID NO: 65940 - protein, 13 aa, Homo sapiens
  heavy chain complementarity determining region 3 for antibody 32970
ATSGSGANHALDF

SEQ ID NO: 65941 - protein, 9 aa, Homo sapiens
  light chain complementarity determining region 3 for antibody 32971
QQCSHSPLT

SEQ ID NO: 65942 - protein, 10 aa, Homo sapiens
  heavy chain complementarity determining region 3 for antibody 32971
ASGSGWLTDS

SEQ ID NO: 65943 - protein, 9 aa, Homo sapiens
  light chain complementarity determining region 3 for antibody 32972
QQCNSYSIT

SEQ ID NO: 65944 - protein, 14 aa, Homo sapiens
  heavy chain complementarity determining region 3 for antibody 32972
ATEGPSRMGKFFDS

SEQ ID NO: 65945 - protein, 9 aa, Homo sapiens
  light chain complementarity determining region 3 for antibody 32973
QQANNFPLT

SEQ ID NO: 65946 - protein, 13 aa, Homo sapiens
  heavy chain complementarity determining region 3 for antibody 32973
ASSIVGATFYFDY

SEQ ID NO: 65947 - protein, 9 aa, Homo sapiens
  light chain complementarity determining region 3 for antibody 32974
QNYHRAPRT

SEQ ID NO: 65948 - protein, 7 aa, Homo sapiens
  heavy chain complementarity determining region 3 for antibody 32974
ALPAVDY

SEQ ID NO: 65949 - protein, 10 aa, Homo sapiens
  light chain complementarity determining region 3 for antibody 32975
QLYSRSPTWT

SEQ ID NO: 65950 - protein, 19 aa, Homo sapiens
  heavy chain complementarity determining region 3 for antibody 32975
ARESYYPDIGGYTPRAFDI

SEQ ID NO: 65951 - protein, 9 aa, Homo sapiens
  light chain complementarity determining region 3 for antibody 32976
QHYISYPPT

SEQ ID NO: 65952 - protein, 15 aa, Homo sapiens
  heavy chain complementarity determining region 3 for antibody 32976
AKEGQLWSSLDAFDI

SEQ ID NO: 65953 - protein, 10 aa, Homo sapiens
  light chain complementarity determining region 3 for antibody 32977
QHYDNFPPFT

SEQ ID NO: 65954 - protein, 16 aa, Homo sapiens
  heavy chain complementarity determining region 3 for antibody 32977
ARARGRWLQAGAAFDC

SEQ ID NO: 65955 - protein, 9 aa, Homo sapiens
  light chain complementarity determining region 3 for antibody 32978
QGYDFFLYA

SEQ ID NO: 65956 - protein, 11 aa, Homo sapiens
  heavy chain complementarity determining region 3 for antibody 32978
ARVDERDLHDT

SEQ ID NO: 65957 - protein, 9 aa, Homo sapiens
  light chain complementarity determining region 3 for antibody 32979
MQSRRWPHT

SEQ ID NO: 65958 - protein, 8 aa, Homo sapiens
  heavy chain complementarity determining region 3 for antibody 32979
TAWGSSHH

SEQ ID NO: 65959 - protein, 9 aa, Homo sapiens
  light chain complementarity determining region 3 for antibody 32980
MQGTHWPRT

SEQ ID NO: 65960 - protein, 10 aa, Homo sapiens
  heavy chain complementarity determining region 3 for antibody 32980
ARDWGLGSGN

SEQ ID NO: 65961 - protein, 9 aa, Homo sapiens
  light chain complementarity determining region 3 for antibody 32981
LQYGYFPYT

SEQ ID NO: 65962 - protein, 12 aa, Homo sapiens
  heavy chain complementarity determining region 3 for antibody 32981
VRLLDSSGSLGY

SEQ ID NO: 65963 - protein, 9 aa, Homo sapiens
  light chain complementarity determining region 3 for antibody 32982
LQYGSSPRT

SEQ ID NO: 65964 - protein, 17 aa, Homo sapiens
  heavy chain complementarity determining region 3 for antibody 32982
ARDPYSTPWFGPEPLDH

SEQ ID NO: 65965 - protein, 9 aa, Homo sapiens
  light chain complementarity determining region 3 for antibody 32983
LQHNSYPRT

SEQ ID NO: 65966 - protein, 11 aa, Homo sapiens
  heavy chain complementarity determining region 3 for antibody 32983
AMLGRGHDNDF

SEQ ID NO: 65967 - protein, 9 aa, Homo sapiens
  light chain complementarity determining region 3 for antibody 32984
LQHNSYPRS

SEQ ID NO: 65968 - protein, 13 aa, Homo sapiens
  heavy chain complementarity determining region 3 for antibody 32984
AREIHSTSFSFDY

SEQ ID NO: 65969 - protein, 9 aa, Homo sapiens
  light chain complementarity determining region 3 for antibody 32985
LQDYSYPLT

SEQ ID NO: 65970 - protein, 16 aa, Homo sapiens
  heavy chain complementarity determining region 3 for antibody 32985
ARYVKTLTVNYWYFDL

SEQ ID NO: 65971 - protein, 9 aa, Homo sapiens
  light chain complementarity determining region 3 for antibody 32986
LQDNNYPRT

SEQ ID NO: 65972 - protein, 18 aa, Homo sapiens
  heavy chain complementarity determining region 3 for antibody 32986
VRDTTFANSGTYYDSYDY

SEQ ID NO: 65973 - protein, 9 aa, Homo sapiens
  light chain complementarity determining region 3 for antibody 32987
LHHYNYRWT

SEQ ID NO: 65974 - protein, 13 aa, Homo sapiens
  heavy chain complementarity determining region 3 for antibody 32987
AKGEPWLSHRLDS

SEQ ID NO: 65975 - protein, 11 aa, Homo sapiens
  light chain complementarity determining region 3 for antibody 32988
HQVYTTPRGLT

SEQ ID NO: 65976 - protein, 12 aa, Homo sapiens
  heavy chain complementarity determining region 3 for antibody 32988
AKESRGLHAFDL

SEQ ID NO: 65977 - protein, 9 aa, Homo sapiens
  light chain complementarity determining region 3 for antibody 32989
HQRSIWPLT

SEQ ID NO: 65978 - protein, 15 aa, Homo sapiens
  heavy chain complementarity determining region 3 for antibody 32989
ARTKGGRCHSTAIDL

SEQ ID NO: 65979 - protein, 9 aa, Homo sapiens
  light chain complementarity determining region 3 for antibody 32990
QQYYTSVRT

SEQ ID NO: 65980 - protein, 12 aa, Homo sapiens
  heavy chain complementarity determining region 3 for antibody 32990
VKDCGLGGSRDS

SEQ ID NO: 65981 - protein, 9 aa, Homo sapiens
  light chain complementarity determining region 3 for antibody 32991
QQYSSHPLT

SEQ ID NO: 65982 - protein, 8 aa, Homo sapiens
  heavy chain complementarity determining region 3 for antibody 32991
ARYAISVC

SEQ ID NO: 65983 - protein, 11 aa, Homo sapiens
  light chain complementarity determining region 3 for antibody 32992
QQYNSSPPGFT

SEQ ID NO: 65984 - protein, 14 aa, Homo sapiens
  heavy chain complementarity determining region 3 for antibody 32992
ATSARSSRKRSFDQ

SEQ ID NO: 65985 - protein, 9 aa, Homo sapiens
  light chain complementarity determining region 3 for antibody 32993
QQYNNWPLT

SEQ ID NO: 65986 - protein, 18 aa, Homo sapiens
  heavy chain complementarity determining region 3 for antibody 32993
ARGGIQLWKRRGTYYFDY

SEQ ID NO: 65987 - protein, 9 aa, Homo sapiens
  light chain complementarity determining region 3 for antibody 32994
QQYNKWPRT

SEQ ID NO: 65988 - protein, 13 aa, Homo sapiens
  heavy chain complementarity determining region 3 for antibody 32994
ARLGSAIIGYFDV

SEQ ID NO: 65989 - protein, 9 aa, Homo sapiens
  light chain complementarity determining region 3 for antibody 32995
QQYNDWPYT

SEQ ID NO: 65990 - protein, 8 aa, Homo sapiens
  heavy chain complementarity determining region 3 for antibody 32995
ARRYYFDY

SEQ ID NO: 65991 - protein, 10 aa, Homo sapiens
  light chain complementarity determining region 3 for antibody 32996
QQYNDWPVFT

SEQ ID NO: 65992 - protein, 15 aa, Homo sapiens
  heavy chain complementarity determining region 3 for antibody 32996
ARTLSINGFYSGSDL

SEQ ID NO: 65993 - protein, 9 aa, Homo sapiens
  light chain complementarity determining region 3 for antibody 32997
QQYKTYYRT

SEQ ID NO: 65994 - protein, 16 aa, Homo sapiens
  heavy chain complementarity determining region 3 for antibody 32997
GRLYHYDSGSYSPSDY

SEQ ID NO: 65995 - protein, 9 aa, Homo sapiens
  light chain complementarity determining region 3 for antibody 32998
QQYIIYPLT

SEQ ID NO: 65996 - protein, 14 aa, Homo sapiens
  heavy chain complementarity determining region 3 for antibody 32998
ARDLGFHTGGNFDY

SEQ ID NO: 65997 - protein, 10 aa, Homo sapiens
  light chain complementarity determining region 3 for antibody 32999
QQYGSSTGYT

SEQ ID NO: 65998 - protein, 11 aa, Homo sapiens
  heavy chain complementarity determining region 3 for antibody 32999
ASDHSGWSLYY

SEQ ID NO: 65999 - protein, 9 aa, Homo sapiens
  light chain complementarity determining region 3 for antibody 33000
QQYGSSPWT

SEQ ID NO: 66000 - protein, 16 aa, Homo sapiens
  heavy chain complementarity determining region 3 for antibody 33000
ATPLWYGGSSAWYFDL

SEQ ID NO: 66001 - protein, 9 aa, Homo sapiens
  light chain complementarity determining region 3 for antibody 33001
QQYGSSPLT

SEQ ID NO: 66002 - protein, 20 aa, Homo sapiens
  heavy chain complementarity determining region 3 for antibody 33001
ARGVGLGYCSSTSCPYYFDY

SEQ ID NO: 66003 - protein, 9 aa, Homo sapiens
  light chain complementarity determining region 3 for antibody 33002
QQYETLPIT

SEQ ID NO: 66004 - protein, 15 aa, Homo sapiens
  heavy chain complementarity determining region 3 for antibody 33002
AKDTAVPATESTFDY

SEQ ID NO: 66005 - protein, 9 aa, Homo sapiens
  light chain complementarity determining region 3 for antibody 33003
QQYESLPPT

SEQ ID NO: 66006 - protein, 12 aa, Homo sapiens
  heavy chain complementarity determining region 3 for antibody 33003
VRDRVAGDAFDT

SEQ ID NO: 66007 - protein, 9 aa, Homo sapiens
  light chain complementarity determining region 3 for antibody 33004
QQYDSLPLT

SEQ ID NO: 66008 - protein, 13 aa, Homo sapiens
  heavy chain complementarity determining region 3 for antibody 33004
ARDGVPGKFSRAY

SEQ ID NO: 66009 - protein, 9 aa, Homo sapiens
  light chain complementarity determining region 3 for antibody 33005
QQYDRYPIT

SEQ ID NO: 66010 - protein, 12 aa, Homo sapiens
  heavy chain complementarity determining region 3 for antibody 33005
ARQLGPRGSFDY

SEQ ID NO: 66011 - protein, 8 aa, Homo sapiens
  light chain complementarity determining region 3 for antibody 33006
QQYDNLPL

SEQ ID NO: 66012 - protein, 16 aa, Homo sapiens
  heavy chain complementarity determining region 3 for antibody 33006
ARDRSPYYYYYYGMDV

SEQ ID NO: 66013 - protein, 9 aa, Homo sapiens
  light chain complementarity determining region 3 for antibody 33007
QQYDLLPPS

SEQ ID NO: 66014 - protein, 21 aa, Homo sapiens
  heavy chain complementarity determining region 3 for antibody 33007
ARGLHIVVVTSILRGFWYFGL

SEQ ID NO: 66015 - protein, 9 aa, Homo sapiens
  light chain complementarity determining region 3 for antibody 33008
QQYDLLPFT

SEQ ID NO: 66016 - protein, 13 aa, Homo sapiens
  heavy chain complementarity determining region 3 for antibody 33008
AKGSGRGFGVLDD

SEQ ID NO: 66017 - protein, 9 aa, Homo sapiens
  light chain complementarity determining region 3 for antibody 33009
QQYATSPRT

SEQ ID NO: 66018 - protein, 15 aa, Homo sapiens
  heavy chain complementarity determining region 3 for antibody 33009
ARDGNVLATGYPLDY

SEQ ID NO: 66019 - protein, 9 aa, Homo sapiens
  light chain complementarity determining region 3 for antibody 33010
QQTDSFPLT

SEQ ID NO: 66020 - protein, 17 aa, Homo sapiens
  heavy chain complementarity determining region 3 for antibody 33010
ARPGSSIAAAGSLYFDL

SEQ ID NO: 66021 - protein, 10 aa, Homo sapiens
  light chain complementarity determining region 3 for antibody 33011
QQSYSTPSIT

SEQ ID NO: 66022 - protein, 20 aa, Homo sapiens
  heavy chain complementarity determining region 3 for antibody 33011
VRDSVPHNTGHRPGIIINGY

SEQ ID NO: 66023 - protein, 9 aa, Homo sapiens
  light chain complementarity determining region 3 for antibody 33012
QQSYSTPRT

SEQ ID NO: 66024 - protein, 18 aa, Homo sapiens
  heavy chain complementarity determining region 3 for antibody 33012
ARGLGRGYSYGSQSPFDY

SEQ ID NO: 66025 - protein, 11 aa, Homo sapiens
  light chain complementarity determining region 3 for antibody 33013
QQSYSTPPMYT

SEQ ID NO: 66026 - protein, 14 aa, Homo sapiens
  heavy chain complementarity determining region 3 for antibody 33013
AKDRYSRRVYYFDY

SEQ ID NO: 66027 - protein, 9 aa, Homo sapiens
  light chain complementarity determining region 3 for antibody 33014
QQSYSDPPT

SEQ ID NO: 66028 - protein, 16 aa, Homo sapiens
  heavy chain complementarity determining region 3 for antibody 33014
ARHLQIHSTSSGVFGI

SEQ ID NO: 66029 - protein, 10 aa, Homo sapiens
  light chain complementarity determining region 3 for antibody 33015
QQSYSAPPYT

SEQ ID NO: 66030 - protein, 13 aa, Homo sapiens
  heavy chain complementarity determining region 3 for antibody 33015
TTIGAFLDDAFEF

SEQ ID NO: 66031 - protein, 9 aa, Homo sapiens
  light chain complementarity determining region 3 for antibody 33016
QQSHDFPYT

SEQ ID NO: 66032 - protein, 13 aa, Homo sapiens
  heavy chain complementarity determining region 3 for antibody 33016
VRLNDIHGWPFDS

SEQ ID NO: 66033 - protein, 10 aa, Homo sapiens
  light chain complementarity determining region 3 for antibody 33017
QQRYNLPPIT

SEQ ID NO: 66034 - protein, 12 aa, Homo sapiens
  heavy chain complementarity determining region 3 for antibody 33017
ARGETFSSGFDY

SEQ ID NO: 66035 - protein, 9 aa, Homo sapiens
  light chain complementarity determining region 3 for antibody 33018
QQLNSYPLT

SEQ ID NO: 66036 - protein, 15 aa, Homo sapiens
  heavy chain complementarity determining region 3 for antibody 33018
AREFYGSGSYYLIDY

SEQ ID NO: 66037 - protein, 9 aa, Homo sapiens
  light chain complementarity determining region 3 for antibody 33019
QQADRIPLT

SEQ ID NO: 66038 - protein, 16 aa, Homo sapiens
  heavy chain complementarity determining region 3 for antibody 33019
ARDAGNYNDDWYYFDL

SEQ ID NO: 66039 - protein, 9 aa, Homo sapiens
  light chain complementarity determining region 3 for antibody 33020
QKYNSVPLT

SEQ ID NO: 66040 - protein, 11 aa, Homo sapiens
  heavy chain complementarity determining region 3 for antibody 33020
ARKGTGNAMDI

SEQ ID NO: 66041 - protein, 9 aa, Homo sapiens
  light chain complementarity determining region 3 for antibody 33021
QHYHNWPYT

SEQ ID NO: 66042 - protein, 19 aa, Homo sapiens
  heavy chain complementarity determining region 3 for antibody 33021
ARDLWDCYGSGSCFDAFDF

SEQ ID NO: 66043 - protein, 9 aa, Homo sapiens
  light chain complementarity determining region 3 for antibody 33022
QHTHTFPRT

SEQ ID NO: 66044 - protein, 20 aa, Homo sapiens
  heavy chain complementarity determining region 3 for antibody 33022
ARGRRIAALSTAHYYYGMDV

SEQ ID NO: 66045 - protein, 10 aa, Homo sapiens
  light chain complementarity determining region 3 for antibody 33023
QDYHSYFFYT

SEQ ID NO: 66046 - protein, 12 aa, Homo sapiens
  heavy chain complementarity determining region 3 for antibody 33023
ARGHGDYKGHGD

SEQ ID NO: 66047 - protein, 9 aa, Homo sapiens
  light chain complementarity determining region 3 for antibody 33024
MQGTHWPWT

SEQ ID NO: 66048 - protein, 15 aa, Homo sapiens
  heavy chain complementarity determining region 3 for antibody 33024
ALGDTSRGNQYQKDV

SEQ ID NO: 66049 - protein, 9 aa, Homo sapiens
  light chain complementarity determining region 3 for antibody 33025
MQGTHRPFT

SEQ ID NO: 66050 - protein, 21 aa, Homo sapiens
  heavy chain complementarity determining region 3 for antibody 33025
ARGGDYGDYWVRYYYYYGMDV

SEQ ID NO: 66051 - protein, 9 aa, Homo sapiens
  light chain complementarity determining region 3 for antibody 33026
LQHNSYPLT

SEQ ID NO: 66052 - protein, 15 aa, Homo sapiens
  heavy chain complementarity determining region 3 for antibody 33026
ARRNQEFRDSGAFDV

SEQ ID NO: 66053 - protein, 9 aa, Homo sapiens
  light chain complementarity determining region 3 for antibody 33027
HQYDNLPLT

SEQ ID NO: 66054 - protein, 15 aa, Homo sapiens
  heavy chain complementarity determining region 3 for antibody 33027
ARGPRGYYFPGGPDY

SEQ ID NO: 66055 - protein, 9 aa, Homo sapiens
  light chain complementarity determining region 3 for antibody 33028
HQYDNDPPS

SEQ ID NO: 66056 - protein, 14 aa, Homo sapiens
  heavy chain complementarity determining region 3 for antibody 33028
GRQRFGGNSGIIAY

SEQ ID NO: 66057 - protein, 9 aa, Homo sapiens
  light chain complementarity determining region 3 for antibody 33029
QQYYSIPWT

SEQ ID NO: 66058 - protein, 14 aa, Homo sapiens
  heavy chain complementarity determining region 3 for antibody 33029
TRDRLAGSYSGYDY

SEQ ID NO: 66059 - protein, 8 aa, Homo sapiens
  light chain complementarity determining region 3 for antibody 33030
QQYRNGET

SEQ ID NO: 66060 - protein, 10 aa, Homo sapiens
  heavy chain complementarity determining region 3 for antibody 33030
ARDLAFGIDY

SEQ ID NO: 66061 - protein, 8 aa, Homo sapiens
  light chain complementarity determining region 3 for antibody 33031
QQYNTYWT

SEQ ID NO: 66062 - protein, 14 aa, Homo sapiens
  heavy chain complementarity determining region 3 for antibody 33031
ARGGSSGYYHHFDS

SEQ ID NO: 66063 - protein, 8 aa, Homo sapiens
  light chain complementarity determining region 3 for antibody 33032
QQYNSYPT

SEQ ID NO: 66064 - protein, 18 aa, Homo sapiens
  heavy chain complementarity determining region 3 for antibody 33032
ARTYSDLLTGYIGPYFDS

SEQ ID NO: 66065 - protein, 8 aa, Homo sapiens
  light chain complementarity determining region 3 for antibody 33033
QQYNSYFT

SEQ ID NO: 66066 - protein, 14 aa, Homo sapiens
  heavy chain complementarity determining region 3 for antibody 33033
ARDTPLSSSWSFDY

SEQ ID NO: 66067 - protein, 9 aa, Homo sapiens
  light chain complementarity determining region 3 for antibody 33034
QQYKSYSYT

SEQ ID NO: 66068 - protein, 13 aa, Homo sapiens
  heavy chain complementarity determining region 3 for antibody 33034
ARARDSYNLYFDY

SEQ ID NO: 66069 - protein, 9 aa, Homo sapiens
  light chain complementarity determining region 3 for antibody 33035
QQYKNYPFT

SEQ ID NO: 66070 - protein, 14 aa, Homo sapiens
  heavy chain complementarity determining region 3 for antibody 33035
AKAKDSSGYDLFDF

SEQ ID NO: 66071 - protein, 10 aa, Homo sapiens
  light chain complementarity determining region 3 for antibody 33036
QQYGSSPPIT

SEQ ID NO: 66072 - protein, 15 aa, Homo sapiens
  heavy chain complementarity determining region 3 for antibody 33036
ASRPPDEHTVLVFNY

SEQ ID NO: 66073 - protein, 10 aa, Homo sapiens
  light chain complementarity determining region 3 for antibody 33037
QQYGSSPLYS

SEQ ID NO: 66074 - protein, 15 aa, Homo sapiens
  heavy chain complementarity determining region 3 for antibody 33037
ARCGGGDCYWKDFDY

SEQ ID NO: 66075 - protein, 9 aa, Homo sapiens
  light chain complementarity determining region 3 for antibody 33038
QQYGSSPLT

SEQ ID NO: 66076 - protein, 19 aa, Homo sapiens
  heavy chain complementarity determining region 3 for antibody 33038
ARGSSSSRRRAAVVGYFDL

SEQ ID NO: 66077 - protein, 9 aa, Homo sapiens
  light chain complementarity determining region 3 for antibody 33039
QQYGRIPRT

SEQ ID NO: 66078 - protein, 13 aa, Homo sapiens
  heavy chain complementarity determining region 3 for antibody 33039
AGGLYDSSGYSEF

SEQ ID NO: 66079 - protein, 9 aa, Homo sapiens
  light chain complementarity determining region 3 for antibody 33040
QQYGDSPGT

SEQ ID NO: 66080 - protein, 21 aa, Homo sapiens
  heavy chain complementarity determining region 3 for antibody 33040
ARNRGGFSNFNQLLAHHWFDP

SEQ ID NO: 66081 - protein, 10 aa, Homo sapiens
  light chain complementarity determining region 3 for antibody 33041
QQYDNLPRYT

SEQ ID NO: 66082 - protein, 19 aa, Homo sapiens
  heavy chain complementarity determining region 3 for antibody 33041
ARDRYYYEHSGYVIDPFDV

SEQ ID NO: 66083 - protein, 10 aa, Homo sapiens
  light chain complementarity determining region 3 for antibody 33042
QQYATSPPWT

SEQ ID NO: 66084 - protein, 11 aa, Homo sapiens
  heavy chain complementarity determining region 3 for antibody 33042
ARSSGWWSFDY

SEQ ID NO: 66085 - protein, 9 aa, Homo sapiens
  light chain complementarity determining region 3 for antibody 33043
QQSYTTVWT

SEQ ID NO: 66086 - protein, 16 aa, Homo sapiens
  heavy chain complementarity determining region 3 for antibody 33043
ARYDGGTVTNPRWLDP

SEQ ID NO: 66087 - protein, 9 aa, Homo sapiens
  light chain complementarity determining region 3 for antibody 33044
QQSYSTLRT

SEQ ID NO: 66088 - protein, 16 aa, Homo sapiens
  heavy chain complementarity determining region 3 for antibody 33044
AHRLGGSGSYEDAFDI

SEQ ID NO: 66089 - protein, 9 aa, Homo sapiens
  light chain complementarity determining region 3 for antibody 33045
QQSYSSLLT

SEQ ID NO: 66090 - protein, 16 aa, Homo sapiens
  heavy chain complementarity determining region 3 for antibody 33045
AREGGSTYTSKRAFDS

SEQ ID NO: 66091 - protein, 10 aa, Homo sapiens
  light chain complementarity determining region 3 for antibody 33046
QQRYNWPPYT

SEQ ID NO: 66092 - protein, 11 aa, Homo sapiens
  heavy chain complementarity determining region 3 for antibody 33046
TRGVGSYPFDQ

SEQ ID NO: 66093 - protein, 9 aa, Homo sapiens
  light chain complementarity determining region 3 for antibody 33047
QQRSSWPIT

SEQ ID NO: 66094 - protein, 15 aa, Homo sapiens
  heavy chain complementarity determining region 3 for antibody 33047
ARELPVTNVYHYYDY

SEQ ID NO: 66095 - protein, 9 aa, Homo sapiens
  light chain complementarity determining region 3 for antibody 33048
QQRSNWRYT

SEQ ID NO: 66096 - protein, 12 aa, Homo sapiens
  heavy chain complementarity determining region 3 for antibody 33048
VKDCGLGGSRDS

SEQ ID NO: 66097 - protein, 11 aa, Homo sapiens
  light chain complementarity determining region 3 for antibody 33049
QQRSNWPPMYT

SEQ ID NO: 66098 - protein, 15 aa, Homo sapiens
  heavy chain complementarity determining region 3 for antibody 33049
ARDGYCSGGSCSFDY

SEQ ID NO: 66099 - protein, 9 aa, Homo sapiens
  light chain complementarity determining region 3 for antibody 33050
QQLNSYLVT

SEQ ID NO: 66100 - protein, 14 aa, Homo sapiens
  heavy chain complementarity determining region 3 for antibody 33050
TADTFDSRRWCNDY

SEQ ID NO: 66101 - protein, 9 aa, Homo sapiens
  light chain complementarity determining region 3 for antibody 33051
QQHDIWPLT

SEQ ID NO: 66102 - protein, 14 aa, Homo sapiens
  heavy chain complementarity determining region 3 for antibody 33051
AGISSMWELRLLDY

SEQ ID NO: 66103 - protein, 9 aa, Homo sapiens
  light chain complementarity determining region 3 for antibody 33052
QQANSFPPT

SEQ ID NO: 66104 - protein, 10 aa, Homo sapiens
  heavy chain complementarity determining region 3 for antibody 33052
ARSGGYGWDS

SEQ ID NO: 66105 - protein, 9 aa, Homo sapiens
  light chain complementarity determining region 3 for antibody 33053
QQAKTFPLT

SEQ ID NO: 66106 - protein, 14 aa, Homo sapiens
  heavy chain complementarity determining region 3 for antibody 33053
ARVGIGMAARQFDY

SEQ ID NO: 66107 - protein, 8 aa, Homo sapiens
  light chain complementarity determining region 3 for antibody 33054
QEYNSNWT

SEQ ID NO: 66108 - protein, 14 aa, Homo sapiens
  heavy chain complementarity determining region 3 for antibody 33054
ARDRRKGGGDAFDV

SEQ ID NO: 66109 - protein, 9 aa, Homo sapiens
  light chain complementarity determining region 3 for antibody 33055
MQGTHWPKT

SEQ ID NO: 66110 - protein, 12 aa, Homo sapiens
  heavy chain complementarity determining region 3 for antibody 33055
AKDQGVGATPDS

SEQ ID NO: 66111 - protein, 9 aa, Homo sapiens
  light chain complementarity determining region 3 for antibody 33056
LQYYRTPFT

SEQ ID NO: 66112 - protein, 10 aa, Homo sapiens
  heavy chain complementarity determining region 3 for antibody 33056
GGGWGSHPEH

SEQ ID NO: 66113 - protein, 9 aa, Homo sapiens
  light chain complementarity determining region 3 for antibody 33057
LQYYATPWT

SEQ ID NO: 66114 - protein, 15 aa, Homo sapiens
  heavy chain complementarity determining region 3 for antibody 33057
VRQSKVDNNYNYPDF

SEQ ID NO: 66115 - protein, 9 aa, Homo sapiens
  light chain complementarity determining region 3 for antibody 33058
LQYNEFPYI

SEQ ID NO: 66116 - protein, 13 aa, Homo sapiens
  heavy chain complementarity determining region 3 for antibody 33058
ARSPYSSGWYPDL

SEQ ID NO: 66117 - protein, 8 aa, Homo sapiens
  light chain complementarity determining region 3 for antibody 33059
KQYSSCCT

SEQ ID NO: 66118 - protein, 11 aa, Homo sapiens
  heavy chain complementarity determining region 3 for antibody 33059
VKRWGGSSIDY

SEQ ID NO: 66119 - protein, 11 aa, Homo sapiens
  light chain complementarity determining region 3 for antibody 33060
QSYNSYSASWT

SEQ ID NO: 66120 - protein, 15 aa, Homo sapiens
  heavy chain complementarity determining region 3 for antibody 33060
ARRYFYGSRNYLYDD

SEQ ID NO: 66121 - protein, 9 aa, Homo sapiens
  light chain complementarity determining region 3 for antibody 33061
QQYSSYPLT

SEQ ID NO: 66122 - protein, 12 aa, Homo sapiens
  heavy chain complementarity determining region 3 for antibody 33061
ARMLGFGSGLAY

SEQ ID NO: 66123 - protein, 9 aa, Homo sapiens
  light chain complementarity determining region 3 for antibody 33062
QQYNSYSRT

SEQ ID NO: 66124 - protein, 10 aa, Homo sapiens
  heavy chain complementarity determining region 3 for antibody 33062
ARAQRHWFDP

SEQ ID NO: 66125 - protein, 10 aa, Homo sapiens
  light chain complementarity determining region 3 for antibody 33063
QQYNSYSPYT

SEQ ID NO: 66126 - protein, 16 aa, Homo sapiens
  heavy chain complementarity determining region 3 for antibody 33063
ARVAYSSGWVPLYFAY

SEQ ID NO: 66127 - protein, 9 aa, Homo sapiens
  light chain complementarity determining region 3 for antibody 33064
QQYNSYPPT

SEQ ID NO: 66128 - protein, 15 aa, Homo sapiens
  heavy chain complementarity determining region 3 for antibody 33064
AKGGQLWSSLDAFDI

SEQ ID NO: 66129 - protein, 9 aa, Homo sapiens
  light chain complementarity determining region 3 for antibody 33065
QQYGTSTIT

SEQ ID NO: 66130 - protein, 16 aa, Homo sapiens
  heavy chain complementarity determining region 3 for antibody 33065
SRDQQLHGGSSGVFGY

SEQ ID NO: 66131 - protein, 9 aa, Homo sapiens
  light chain complementarity determining region 3 for antibody 33066
QQYGSSPYT

SEQ ID NO: 66132 - protein, 21 aa, Homo sapiens
  heavy chain complementarity determining region 3 for antibody 33066
ARQGSRYHCSGGSCYLGLTDY

SEQ ID NO: 66133 - protein, 10 aa, Homo sapiens
  light chain complementarity determining region 3 for antibody 33067
QQYGSSPPYT

SEQ ID NO: 66134 - protein, 18 aa, Homo sapiens
  heavy chain complementarity determining region 3 for antibody 33067
ATGKWFGDFNFYYYAMDV

SEQ ID NO: 66135 - protein, 9 aa, Homo sapiens
  light chain complementarity determining region 3 for antibody 33068
QQYGSSPGT

SEQ ID NO: 66136 - protein, 16 aa, Homo sapiens
  heavy chain complementarity determining region 3 for antibody 33068
ARVVWGGSWYVGWFDT

SEQ ID NO: 66137 - protein, 9 aa, Homo sapiens
  light chain complementarity determining region 3 for antibody 33069
QQYGSPPRT

SEQ ID NO: 66138 - protein, 6 aa, Homo sapiens
  heavy chain complementarity determining region 3 for antibody 33069
ADIFAF

SEQ ID NO: 66139 - protein, 9 aa, Homo sapiens
  light chain complementarity determining region 3 for antibody 33070
QQYGGSPWT

SEQ ID NO: 66140 - protein, 15 aa, Homo sapiens
  heavy chain complementarity determining region 3 for antibody 33070
ARPTAIYYSHYAIDV

SEQ ID NO: 66141 - protein, 9 aa, Homo sapiens
  light chain complementarity determining region 3 for antibody 33071
QQYESLPVT

SEQ ID NO: 66142 - protein, 14 aa, Homo sapiens
  heavy chain complementarity determining region 3 for antibody 33071
ARTRSSVVRGPFDS

SEQ ID NO: 66143 - protein, 9 aa, Homo sapiens
  light chain complementarity determining region 3 for antibody 33072
QQYDRYPWT

SEQ ID NO: 66144 - protein, 17 aa, Homo sapiens
  heavy chain complementarity determining region 3 for antibody 33072
ARDPGVIGGRTYWYFNL

SEQ ID NO: 66145 - protein, 9 aa, Homo sapiens
  light chain complementarity determining region 3 for antibody 33073
QQYDNWPRT

SEQ ID NO: 66146 - protein, 20 aa, Homo sapiens
  heavy chain complementarity determining region 3 for antibody 33073
ARLPDFFHGGLHYVNCHYDS

SEQ ID NO: 66147 - protein, 8 aa, Homo sapiens
  light chain complementarity determining region 3 for antibody 33074
QQTYSTPA

SEQ ID NO: 66148 - protein, 12 aa, Homo sapiens
  heavy chain complementarity determining region 3 for antibody 33074
ARAVGTTCALDI

SEQ ID NO: 66149 - protein, 9 aa, Homo sapiens
  light chain complementarity determining region 3 for antibody 33075
QQTYIPPRT

SEQ ID NO: 66150 - protein, 21 aa, Homo sapiens
  heavy chain complementarity determining region 3 for antibody 33075
AKLAVAVPSTTGFGEYYGLDV

SEQ ID NO: 66151 - protein, 9 aa, Homo sapiens
  light chain complementarity determining region 3 for antibody 33076
QQTHSYPLT

SEQ ID NO: 66152 - protein, 20 aa, Homo sapiens
  heavy chain complementarity determining region 3 for antibody 33076
AHRRVRDTARGNYYSYGTDV

SEQ ID NO: 66153 - protein, 9 aa, Homo sapiens
  light chain complementarity determining region 3 for antibody 33077
QQSYSTPIT

SEQ ID NO: 66154 - protein, 8 aa, Homo sapiens
  heavy chain complementarity determining region 3 for antibody 33077
ARGRRLST

SEQ ID NO: 66155 - protein, 9 aa, Homo sapiens
  light chain complementarity determining region 3 for antibody 33078
QQSYRTPLT

SEQ ID NO: 66156 - protein, 22 aa, Homo sapiens
  heavy chain complementarity determining region 3 for antibody 33078
ARDGGAGSSWLFSDYGSSPLDY

SEQ ID NO: 66157 - protein, 9 aa, Homo sapiens
  light chain complementarity determining region 3 for antibody 33079
QQSYDIPRT

SEQ ID NO: 66158 - protein, 19 aa, Homo sapiens
  heavy chain complementarity determining region 3 for antibody 33079
ARQRGYCNIINCRQSGMDV

SEQ ID NO: 66159 - protein, 9 aa, Homo sapiens
  light chain complementarity determining region 3 for antibody 33080
QQSSSTPPT

SEQ ID NO: 66160 - protein, 11 aa, Homo sapiens
  heavy chain complementarity determining region 3 for antibody 33080
TGERAGTIVDY

SEQ ID NO: 66161 - protein, 11 aa, Homo sapiens
  light chain complementarity determining region 3 for antibody 33081
QQRSNWPPELT

SEQ ID NO: 66162 - protein, 11 aa, Homo sapiens
  heavy chain complementarity determining region 3 for antibody 33081
PIFMVRGDKDY

SEQ ID NO: 66163 - protein, 8 aa, Homo sapiens
  light chain complementarity determining region 3 for antibody 33082
QQLNSYPL

SEQ ID NO: 66164 - protein, 20 aa, Homo sapiens
  heavy chain complementarity determining region 3 for antibody 33082
ARGYRSLNRYAPGYYYGMDV

SEQ ID NO: 66165 - protein, 9 aa, Homo sapiens
  light chain complementarity determining region 3 for antibody 33083
QKYNSAPFT

SEQ ID NO: 66166 - protein, 16 aa, Homo sapiens
  heavy chain complementarity determining region 3 for antibody 33083
ARVWLGGYNYGHHFDY

SEQ ID NO: 66167 - protein, 9 aa, Homo sapiens
  light chain complementarity determining region 3 for antibody 33084
QKYDSAPYT

SEQ ID NO: 66168 - protein, 9 aa, Homo sapiens
  heavy chain complementarity determining region 3 for antibody 33084
ARSSTWFDY

SEQ ID NO: 66169 - protein, 8 aa, Homo sapiens
  light chain complementarity determining region 3 for antibody 33085
QHYGTTGT

SEQ ID NO: 66170 - protein, 15 aa, Homo sapiens
  heavy chain complementarity determining region 3 for antibody 33085
ARGEYNFIYYFAMDV

SEQ ID NO: 66171 - protein, 9 aa, Homo sapiens
  light chain complementarity determining region 3 for antibody 33086
MQGTHWPLT

SEQ ID NO: 66172 - protein, 18 aa, Homo sapiens
  heavy chain complementarity determining region 3 for antibody 33086
AKDLRAFIMRVESDNFQV

SEQ ID NO: 66173 - protein, 9 aa, Homo sapiens
  light chain complementarity determining region 3 for antibody 33087
MQALQTPRT

SEQ ID NO: 66174 - protein, 22 aa, Homo sapiens
  heavy chain complementarity determining region 3 for antibody 33087
ARHDGVIAVAGNTHYYYYGMDV

SEQ ID NO: 66175 - protein, 10 aa, Homo sapiens
  light chain complementarity determining region 3 for antibody 33088
MQALHTPPWT

SEQ ID NO: 66176 - protein, 17 aa, Homo sapiens
  heavy chain complementarity determining region 3 for antibody 33088
TSLGYSFGSVYYYGLDV

SEQ ID NO: 66177 - protein, 9 aa, Homo sapiens
  light chain complementarity determining region 3 for antibody 33089
LQHSGDSWT

SEQ ID NO: 66178 - protein, 20 aa, Homo sapiens
  heavy chain complementarity determining region 3 for antibody 33089
ARAREILQFMPGLAAGSPDC

SEQ ID NO: 66179 - protein, 9 aa, Homo sapiens
  light chain complementarity determining region 3 for antibody 33090
LQHNGFPWS

SEQ ID NO: 66180 - protein, 21 aa, Homo sapiens
  heavy chain complementarity determining region 3 for antibody 33090
AASPGGSGYDVGGSFYSGMDV

SEQ ID NO: 66181 - protein, 9 aa, Homo sapiens
  light chain complementarity determining region 3 for antibody 33091
LQDYNYPRT

SEQ ID NO: 66182 - protein, 19 aa, Homo sapiens
  heavy chain complementarity determining region 3 for antibody 33091
ARDVTPSGGSTIYYDAFDI

SEQ ID NO: 66183 - protein, 9 aa, Homo sapiens
  light chain complementarity determining region 3 for antibody 33092
LQDFNYPRT

SEQ ID NO: 66184 - protein, 18 aa, Homo sapiens
  heavy chain complementarity determining region 3 for antibody 33092
GRDSTYANSDYYYDRFDY

SEQ ID NO: 66185 - protein, 9 aa, Homo sapiens
  light chain complementarity determining region 3 for antibody 33093
HQFDKSPQT

SEQ ID NO: 66186 - protein, 17 aa, Homo sapiens
  heavy chain complementarity determining region 3 for antibody 33093
ARRPYLWGSYRPGAFDI

SEQ ID NO: 66187 - protein, 9 aa, Homo sapiens
  light chain complementarity determining region 3 for antibody 33094
EQRLDWPLT

SEQ ID NO: 66188 - protein, 11 aa, Homo sapiens
  heavy chain complementarity determining region 3 for antibody 33094
ARNILGGHTDF

SEQ ID NO: 66189 - protein, 9 aa, Homo sapiens
  light chain complementarity determining region 3 for antibody 33095
QQYYSTPLT

SEQ ID NO: 66190 - protein, 20 aa, Homo sapiens
  heavy chain complementarity determining region 3 for antibody 33095
ARDQAYYYGSGSSGVDWFDP

SEQ ID NO: 66191 - protein, 10 aa, Homo sapiens
  light chain complementarity determining region 3 for antibody 33096
QQYSNFSPWT

SEQ ID NO: 66192 - protein, 11 aa, Homo sapiens
  heavy chain complementarity determining region 3 for antibody 33096
ARDGSARPAEY

SEQ ID NO: 66193 - protein, 9 aa, Homo sapiens
  light chain complementarity determining region 3 for antibody 33097
QQYNNWPWT

SEQ ID NO: 66194 - protein, 13 aa, Homo sapiens
  heavy chain complementarity determining region 3 for antibody 33097
TTGRLVIREVADS

SEQ ID NO: 66195 - protein, 10 aa, Homo sapiens
  light chain complementarity determining region 3 for antibody 33098
QQYGTSLPWT

SEQ ID NO: 66196 - protein, 16 aa, Homo sapiens
  heavy chain complementarity determining region 3 for antibody 33098
TKDRDYDDYEWCAFDT

SEQ ID NO: 66197 - protein, 8 aa, Homo sapiens
  light chain complementarity determining region 3 for antibody 33099
QQYGSSPT

SEQ ID NO: 66198 - protein, 23 aa, Homo sapiens
  heavy chain complementarity determining region 3 for antibody 33099
ARPKRHYYDSSGYYSSALDAFDI

SEQ ID NO: 66199 - protein, 9 aa, Homo sapiens
  light chain complementarity determining region 3 for antibody 33100
QQYGSSPFT

SEQ ID NO: 66200 - protein, 19 aa, Homo sapiens
  heavy chain complementarity determining region 3 for antibody 33100
ARSPSWFGEHRGRGNWFDP

SEQ ID NO: 66201 - protein, 9 aa, Homo sapiens
  light chain complementarity determining region 3 for antibody 33101
QQYDIFPLT

SEQ ID NO: 66202 - protein, 12 aa, Homo sapiens
  heavy chain complementarity determining region 3 for antibody 33101
TTDRSYGYYFPY

SEQ ID NO: 66203 - protein, 9 aa, Homo sapiens
  light chain complementarity determining region 3 for antibody 33102
QQYDGYPLT

SEQ ID NO: 66204 - protein, 12 aa, Homo sapiens
  heavy chain complementarity determining region 3 for antibody 33102
AKDQGVGATPDS

SEQ ID NO: 66205 - protein, 10 aa, Homo sapiens
  light chain complementarity determining region 3 for antibody 33103
QQTDSTPPYT

SEQ ID NO: 66206 - protein, 8 aa, Homo sapiens
  heavy chain complementarity determining region 3 for antibody 33103
LPLRFTDY

SEQ ID NO: 66207 - protein, 9 aa, Homo sapiens
  light chain complementarity determining region 3 for antibody 33104
QQSYTTPFT

SEQ ID NO: 66208 - protein, 16 aa, Homo sapiens
  heavy chain complementarity determining region 3 for antibody 33104
ARAFYGSGSYSHWFDP

SEQ ID NO: 66209 - protein, 9 aa, Homo sapiens
  light chain complementarity determining region 3 for antibody 33105
QQSYSTPFT

SEQ ID NO: 66210 - protein, 14 aa, Homo sapiens
  heavy chain complementarity determining region 3 for antibody 33105
AKAVTTMVRGVIDY

SEQ ID NO: 66211 - protein, 10 aa, Homo sapiens
  light chain complementarity determining region 3 for antibody 33106
QQSYSTPALT

SEQ ID NO: 66212 - protein, 19 aa, Homo sapiens
  heavy chain complementarity determining region 3 for antibody 33106
AKPNRGQWLPMGPQYYFDS

SEQ ID NO: 66213 - protein, 10 aa, Homo sapiens
  light chain complementarity determining region 3 for antibody 33107
QQSYSTFLWT

SEQ ID NO: 66214 - protein, 14 aa, Homo sapiens
  heavy chain complementarity determining region 3 for antibody 33107
ARVGYSSGGDWFDP

SEQ ID NO: 66215 - protein, 9 aa, Homo sapiens
  light chain complementarity determining region 3 for antibody 33108
QQSYSPLFT

SEQ ID NO: 66216 - protein, 16 aa, Homo sapiens
  heavy chain complementarity determining region 3 for antibody 33108
ARGREYGGSLYWYFDL

SEQ ID NO: 66217 - protein, 10 aa, Homo sapiens
  light chain complementarity determining region 3 for antibody 33109
QQSYNIPRIT

SEQ ID NO: 66218 - protein, 13 aa, Homo sapiens
  heavy chain complementarity determining region 3 for antibody 33109
ASGWVLRGRQFDY

SEQ ID NO: 66219 - protein, 10 aa, Homo sapiens
  light chain complementarity determining region 3 for antibody 33110
QQRTNWPPST

SEQ ID NO: 66220 - protein, 18 aa, Homo sapiens
  heavy chain complementarity determining region 3 for antibody 33110
ARDRTNSGWFNVGRYFDY

SEQ ID NO: 66221 - protein, 10 aa, Homo sapiens
  light chain complementarity determining region 3 for antibody 33111
QQRSNWPPIT

SEQ ID NO: 66222 - protein, 22 aa, Homo sapiens
  heavy chain complementarity determining region 3 for antibody 33111
ATDRDFSRGNITSTYYPGVLIE

SEQ ID NO: 66223 - protein, 9 aa, Homo sapiens
  light chain complementarity determining region 3 for antibody 33112
QQRRTWPQT

SEQ ID NO: 66224 - protein, 16 aa, Homo sapiens
  heavy chain complementarity determining region 3 for antibody 33112
ARDGASSWYFKHGLDV

SEQ ID NO: 66225 - protein, 9 aa, Homo sapiens
  light chain complementarity determining region 3 for antibody 33113
QQRFNWPQT

SEQ ID NO: 66226 - protein, 14 aa, Homo sapiens
  heavy chain complementarity determining region 3 for antibody 33113
ITDNYQSGTYQGLH

SEQ ID NO: 66227 - protein, 11 aa, Homo sapiens
  light chain complementarity determining region 3 for antibody 33114
QQRASWPPGVT

SEQ ID NO: 66228 - protein, 18 aa, Homo sapiens
  heavy chain complementarity determining region 3 for antibody 33114
ARVYCSGGSCYSGDFFDI

SEQ ID NO: 66229 - protein, 10 aa, Homo sapiens
  light chain complementarity determining region 3 for antibody 33115
QQLNSYPPWT

SEQ ID NO: 66230 - protein, 20 aa, Homo sapiens
  heavy chain complementarity determining region 3 for antibody 33115
ARDSPWEVKWPRPVPRGMDV

SEQ ID NO: 66231 - protein, 9 aa, Homo sapiens
  light chain complementarity determining region 3 for antibody 33116
QQHSNWPLT

SEQ ID NO: 66232 - protein, 14 aa, Homo sapiens
  heavy chain complementarity determining region 3 for antibody 33116
AKHRYDSSGYYFDY

SEQ ID NO: 66233 - protein, 9 aa, Homo sapiens
  light chain complementarity determining region 3 for antibody 33117
QQGNGLPIT

SEQ ID NO: 66234 - protein, 13 aa, Homo sapiens
  heavy chain complementarity determining region 3 for antibody 33117
ASVSYYGSNAFDI

SEQ ID NO: 66235 - protein, 9 aa, Homo sapiens
  light chain complementarity determining region 3 for antibody 33118
QQANSFSWT

SEQ ID NO: 66236 - protein, 11 aa, Homo sapiens
  heavy chain complementarity determining region 3 for antibody 33118
ARDHSQRCFDY

SEQ ID NO: 66237 - protein, 10 aa, Homo sapiens
  light chain complementarity determining region 3 for antibody 33119
QQANSFPPIT

SEQ ID NO: 66238 - protein, 11 aa, Homo sapiens
  heavy chain complementarity determining region 3 for antibody 33119
ARGRDSWKAGY

SEQ ID NO: 66239 - protein, 10 aa, Homo sapiens
  light chain complementarity determining region 3 for antibody 33120
QKYNSDPPQT

SEQ ID NO: 66240 - protein, 14 aa, Homo sapiens
  heavy chain complementarity determining region 3 for antibody 33120
ARVSQKRSTFPFDY

SEQ ID NO: 66241 - protein, 9 aa, Homo sapiens
  light chain complementarity determining region 3 for antibody 33121
QKYNSAPLT

SEQ ID NO: 66242 - protein, 11 aa, Homo sapiens
  heavy chain complementarity determining region 3 for antibody 33121
ATKFKGAPLEY

SEQ ID NO: 66243 - protein, 9 aa, Homo sapiens
  light chain complementarity determining region 3 for antibody 33122
QKYNSAPLT

SEQ ID NO: 66244 - protein, 13 aa, Homo sapiens
  heavy chain complementarity determining region 3 for antibody 33122
AKDITPQLRILDY

SEQ ID NO: 66245 - protein, 10 aa, Homo sapiens
  light chain complementarity determining region 3 for antibody 33123
QHYTDNLILT

SEQ ID NO: 66246 - protein, 10 aa, Homo sapiens
  heavy chain complementarity determining region 3 for antibody 33123
AKDGGGTVDY

SEQ ID NO: 66247 - protein, 10 aa, Homo sapiens
  light chain complementarity determining region 3 for antibody 33124
QHWVSSPAYT

SEQ ID NO: 66248 - protein, 12 aa, Homo sapiens
  heavy chain complementarity determining region 3 for antibody 33124
ARETTRFGELDH

SEQ ID NO: 66249 - protein, 9 aa, Homo sapiens
  light chain complementarity determining region 3 for antibody 33125
QHTHTFPRT

SEQ ID NO: 66250 - protein, 10 aa, Homo sapiens
  heavy chain complementarity determining region 3 for antibody 33125
ARSGGYGWDS

SEQ ID NO: 66251 - protein, 9 aa, Homo sapiens
  light chain complementarity determining region 3 for antibody 33126
MQTLQTPGT

SEQ ID NO: 66252 - protein, 15 aa, Homo sapiens
  heavy chain complementarity determining region 3 for antibody 33126
ARAQVIWGQLYYFDC

SEQ ID NO: 66253 - protein, 8 aa, Homo sapiens
  light chain complementarity determining region 3 for antibody 33127
MQGTHWPT

SEQ ID NO: 66254 - protein, 21 aa, Homo sapiens
  heavy chain complementarity determining region 3 for antibody 33127
AKDRPNYYESNGQYYTPKGDL

SEQ ID NO: 66255 - protein, 10 aa, Homo sapiens
  light chain complementarity determining region 3 for antibody 33128
MQGTHWPPYT

SEQ ID NO: 66256 - protein, 11 aa, Homo sapiens
  heavy chain complementarity determining region 3 for antibody 33128
VRVGGAGYFDH

SEQ ID NO: 66257 - protein, 9 aa, Homo sapiens
  light chain complementarity determining region 3 for antibody 33129
MQGTHWPPM

SEQ ID NO: 66258 - protein, 14 aa, Homo sapiens
  heavy chain complementarity determining region 3 for antibody 33129
VRDADSGGPNDMDV

SEQ ID NO: 66259 - protein, 9 aa, Homo sapiens
  light chain complementarity determining region 3 for antibody 33130
MQALQVPYT

SEQ ID NO: 66260 - protein, 12 aa, Homo sapiens
  heavy chain complementarity determining region 3 for antibody 33130
ARARGVAGKLDS

SEQ ID NO: 66261 - protein, 9 aa, Homo sapiens
  light chain complementarity determining region 3 for antibody 33131
MHALQAPRA

SEQ ID NO: 66262 - protein, 13 aa, Homo sapiens
  heavy chain complementarity determining region 3 for antibody 33131
ARPNNQLGRAFDV

SEQ ID NO: 66263 - protein, 9 aa, Homo sapiens
  light chain complementarity determining region 3 for antibody 33132
LQHNTYPLT

SEQ ID NO: 66264 - protein, 13 aa, Homo sapiens
  heavy chain complementarity determining region 3 for antibody 33132
ARRGTQLWFNFDQ

SEQ ID NO: 66265 - protein, 9 aa, Homo sapiens
  light chain complementarity determining region 3 for antibody 33133
LQHNSYPYT

SEQ ID NO: 66266 - protein, 18 aa, Homo sapiens
  heavy chain complementarity determining region 3 for antibody 33133
ATVRRGGFPLYEYFGMDV

SEQ ID NO: 66267 - protein, 9 aa, Homo sapiens
  light chain complementarity determining region 3 for antibody 33134
LQHNSYPLT

SEQ ID NO: 66268 - protein, 9 aa, Homo sapiens
  heavy chain complementarity determining region 3 for antibody 33134
AREALATDY

SEQ ID NO: 66269 - protein, 9 aa, Homo sapiens
  light chain complementarity determining region 3 for antibody 33135
LQGTHWPPT

SEQ ID NO: 66270 - protein, 12 aa, Homo sapiens
  heavy chain complementarity determining region 3 for antibody 33135
ATDYGPIVTLAH

SEQ ID NO: 66271 - protein, 9 aa, Homo sapiens
  light chain complementarity determining region 3 for antibody 33136
LQANTFPLT

SEQ ID NO: 66272 - protein, 9 aa, Homo sapiens
  heavy chain complementarity determining region 3 for antibody 33136
ARDLRIGGY

SEQ ID NO: 66273 - protein, 9 aa, Homo sapiens
  light chain complementarity determining region 3 for antibody 33137
HQYATSPRT

SEQ ID NO: 66274 - protein, 11 aa, Homo sapiens
  heavy chain complementarity determining region 3 for antibody 33137
AHSGSGWLLDY

SEQ ID NO: 66275 - protein, 8 aa, Homo sapiens
  light chain complementarity determining region 3 for antibody 33138
QQYSRSRT

SEQ ID NO: 66276 - protein, 19 aa, Homo sapiens
  heavy chain complementarity determining region 3 for antibody 33138
ARDGVACSGDSCYQTEVDS

SEQ ID NO: 66277 - protein, 9 aa, Homo sapiens
  light chain complementarity determining region 3 for antibody 33139
QQYNSYSWT

SEQ ID NO: 66278 - protein, 17 aa, Homo sapiens
  heavy chain complementarity determining region 3 for antibody 33139
ARLGSSGWYDYRYGMDV

SEQ ID NO: 66279 - protein, 9 aa, Homo sapiens
  light chain complementarity determining region 3 for antibody 33140
QQYNSYSRT

SEQ ID NO: 66280 - protein, 16 aa, Homo sapiens
  heavy chain complementarity determining region 3 for antibody 33140
AGFLPKYDNGWYYFDY

SEQ ID NO: 66281 - protein, 9 aa, Homo sapiens
  light chain complementarity determining region 3 for antibody 33141
QQYNNWPLT

SEQ ID NO: 66282 - protein, 16 aa, Homo sapiens
  heavy chain complementarity determining region 3 for antibody 33141
AKRVWFGDLASAVFDG

SEQ ID NO: 66283 - protein, 9 aa, Homo sapiens
  light chain complementarity determining region 3 for antibody 33142
QQYNGESRT

SEQ ID NO: 66284 - protein, 18 aa, Homo sapiens
  heavy chain complementarity determining region 3 for antibody 33142
ARGRTFDWLSHRGGGFDS

SEQ ID NO: 66285 - protein, 10 aa, Homo sapiens
  light chain complementarity determining region 3 for antibody 33143
QQYGSSPGFT

SEQ ID NO: 66286 - protein, 11 aa, Homo sapiens
  heavy chain complementarity determining region 3 for antibody 33143
VRERAGGFFDY

SEQ ID NO: 66287 - protein, 9 aa, Homo sapiens
  light chain complementarity determining region 3 for antibody 33144
QQYGGSPFT

SEQ ID NO: 66288 - protein, 25 aa, Homo sapiens
  heavy chain complementarity determining region 3 for antibody 33144
ARDSHLGEYDDSGYYFPHNYFGMDV

SEQ ID NO: 66289 - protein, 9 aa, Homo sapiens
  light chain complementarity determining region 3 for antibody 33145
QQYDTFPLT

SEQ ID NO: 66290 - protein, 14 aa, Homo sapiens
  heavy chain complementarity determining region 3 for antibody 33145
AKAFGRTPADFFDY

SEQ ID NO: 66291 - protein, 9 aa, Homo sapiens
  light chain complementarity determining region 3 for antibody 33146
QQYDNLSLT

SEQ ID NO: 66292 - protein, 15 aa, Homo sapiens
  heavy chain complementarity determining region 3 for antibody 33146
ARVAFGTAAPPYFDY

SEQ ID NO: 66293 - protein, 11 aa, Homo sapiens
  light chain complementarity determining region 3 for antibody 33147
QQVNGYPPMYT

SEQ ID NO: 66294 - protein, 19 aa, Homo sapiens
  heavy chain complementarity determining region 3 for antibody 33147
ARGFREVVSATDAYNWFDP

SEQ ID NO: 66295 - protein, 10 aa, Homo sapiens
  light chain complementarity determining region 3 for antibody 33148
QQSYSTPEIT

SEQ ID NO: 66296 - protein, 14 aa, Homo sapiens
  heavy chain complementarity determining region 3 for antibody 33148
AKDHDSYVSGFGDL

SEQ ID NO: 66297 - protein, 9 aa, Homo sapiens
  light chain complementarity determining region 3 for antibody 33149
QQSYSTPDT

SEQ ID NO: 66298 - protein, 12 aa, Homo sapiens
  heavy chain complementarity determining region 3 for antibody 33149
ARKDWGLNAFDI

SEQ ID NO: 66299 - protein, 9 aa, Homo sapiens
  light chain complementarity determining region 3 for antibody 33150
QQSYSTLFT

SEQ ID NO: 66300 - protein, 11 aa, Homo sapiens
  heavy chain complementarity determining region 3 for antibody 33150
ARGGQWGSLDY

SEQ ID NO: 66301 - protein, 9 aa, Homo sapiens
  light chain complementarity determining region 3 for antibody 33151
QQSYSSPWT

SEQ ID NO: 66302 - protein, 16 aa, Homo sapiens
  heavy chain complementarity determining region 3 for antibody 33151
AREGAVGVTTSGIFDI

SEQ ID NO: 66303 - protein, 9 aa, Homo sapiens
  light chain complementarity determining region 3 for antibody 33152
QQSYSPPRT

SEQ ID NO: 66304 - protein, 21 aa, Homo sapiens
  heavy chain complementarity determining region 3 for antibody 33152
ARVTVRVPSTTGFGEYYGLDV

SEQ ID NO: 66305 - protein, 9 aa, Homo sapiens
  light chain complementarity determining region 3 for antibody 33153
QQSFYTPRT

SEQ ID NO: 66306 - protein, 14 aa, Homo sapiens
  heavy chain complementarity determining region 3 for antibody 33153
ARRFLEWQGGWFDP

SEQ ID NO: 66307 - protein, 10 aa, Homo sapiens
  light chain complementarity determining region 3 for antibody 33154
QQRYLWPPLT

SEQ ID NO: 66308 - protein, 15 aa, Homo sapiens
  heavy chain complementarity determining region 3 for antibody 33154
ARVQTAMSIDMFWDY

SEQ ID NO: 66309 - protein, 10 aa, Homo sapiens
  light chain complementarity determining region 3 for antibody 33155
QQRYKWPPYP

SEQ ID NO: 66310 - protein, 11 aa, Homo sapiens
  heavy chain complementarity determining region 3 for antibody 33155
ARGVGSYVFES

SEQ ID NO: 66311 - protein, 9 aa, Homo sapiens
  light chain complementarity determining region 3 for antibody 33156
QQRSSWPYT

SEQ ID NO: 66312 - protein, 22 aa, Homo sapiens
  heavy chain complementarity determining region 3 for antibody 33156
ARIPPRHCGGDCYYKFPYYFDY

SEQ ID NO: 66313 - protein, 9 aa, Homo sapiens
  light chain complementarity determining region 3 for antibody 33157
QQCFNLPYT

SEQ ID NO: 66314 - protein, 13 aa, Homo sapiens
  heavy chain complementarity determining region 3 for antibody 33157
ATTNSSDYYALSF

SEQ ID NO: 66315 - protein, 9 aa, Homo sapiens
  light chain complementarity determining region 3 for antibody 33158
QQANSFPPT

SEQ ID NO: 66316 - protein, 16 aa, Homo sapiens
  heavy chain complementarity determining region 3 for antibody 33158
ARVSSGRGVAPNWFDP

SEQ ID NO: 66317 - protein, 9 aa, Homo sapiens
  light chain complementarity determining region 3 for antibody 33159
QNYNSAPLT

SEQ ID NO: 66318 - protein, 20 aa, Homo sapiens
  heavy chain complementarity determining region 3 for antibody 33159
AAVLRGLGNSAYYVGSAFDI

SEQ ID NO: 66319 - protein, 9 aa, Homo sapiens
  light chain complementarity determining region 3 for antibody 33160
QHYNGDPWT

SEQ ID NO: 66320 - protein, 12 aa, Homo sapiens
  heavy chain complementarity determining region 3 for antibody 33160
VRTVTAHDVFDM

SEQ ID NO: 66321 - protein, 10 aa, Homo sapiens
  light chain complementarity determining region 3 for antibody 33161
QHYGSSPPYT

SEQ ID NO: 66322 - protein, 10 aa, Homo sapiens
  heavy chain complementarity determining region 3 for antibody 33161
ARDWRYNIYD

SEQ ID NO: 66323 - protein, 9 aa, Homo sapiens
  light chain complementarity determining region 3 for antibody 33162
QHYGRSPQT

SEQ ID NO: 66324 - protein, 19 aa, Homo sapiens
  heavy chain complementarity determining region 3 for antibody 33162
AKAFSPHFVSITASGPFDF

SEQ ID NO: 66325 - protein, 8 aa, Homo sapiens
  light chain complementarity determining region 3 for antibody 33163
MQALQTPL

SEQ ID NO: 66326 - protein, 18 aa, Homo sapiens
  heavy chain complementarity determining region 3 for antibody 33163
ASGTKKSGYTSSLGAFDI

SEQ ID NO: 66327 - protein, 9 aa, Homo sapiens
  light chain complementarity determining region 3 for antibody 33164
LQLNSYPIT

SEQ ID NO: 66328 - protein, 14 aa, Homo sapiens
  heavy chain complementarity determining region 3 for antibody 33164
ARDSDSGGPNDLDV

SEQ ID NO: 66329 - protein, 9 aa, Homo sapiens
  light chain complementarity determining region 3 for antibody 33165
LQHFSYPWT

SEQ ID NO: 66330 - protein, 15 aa, Homo sapiens
  heavy chain complementarity determining region 3 for antibody 33165
AKDASRIATQRGPDD

SEQ ID NO: 66331 - protein, 9 aa, Homo sapiens
  light chain complementarity determining region 3 for antibody 33166
HQYGTSPRT

SEQ ID NO: 66332 - protein, 13 aa, Homo sapiens
  heavy chain complementarity determining region 3 for antibody 33166
ATESGKYQGGLDY

SEQ ID NO: 66333 - protein, 10 aa, Homo sapiens
  light chain complementarity determining region 3 for antibody 33167
HQYGGSPVWT

SEQ ID NO: 66334 - protein, 10 aa, Homo sapiens
  heavy chain complementarity determining region 3 for antibody 33167
AGDNRLDQAT

SEQ ID NO: 66335 - protein, 9 aa, Homo sapiens
  light chain complementarity determining region 3 for antibody 33168
HQYDDLPYS

SEQ ID NO: 66336 - protein, 9 aa, Homo sapiens
  heavy chain complementarity determining region 3 for antibody 33168
AVQQENFDY

SEQ ID NO: 66337 - protein, 9 aa, Homo sapiens
  light chain complementarity determining region 3 for antibody 33169
QQYNSYSRT

SEQ ID NO: 66338 - protein, 18 aa, Homo sapiens
  heavy chain complementarity determining region 3 for antibody 33169
ARGGPYSRGWYAAEYFQH

SEQ ID NO: 66339 - protein, 9 aa, Homo sapiens
  light chain complementarity determining region 3 for antibody 33170
QQYNSFPFT

SEQ ID NO: 66340 - protein, 16 aa, Homo sapiens
  heavy chain complementarity determining region 3 for antibody 33170
ARIKRGSWYQHWYFDL

SEQ ID NO: 66341 - protein, 8 aa, Homo sapiens
  light chain complementarity determining region 3 for antibody 33171
QQYNFLWT

SEQ ID NO: 66342 - protein, 10 aa, Homo sapiens
  heavy chain complementarity determining region 3 for antibody 33171
ARDRRSVLSD

SEQ ID NO: 66343 - protein, 10 aa, Homo sapiens
  light chain complementarity determining region 3 for antibody 33172
QQYGSSPSLT

SEQ ID NO: 66344 - protein, 17 aa, Homo sapiens
  heavy chain complementarity determining region 3 for antibody 33172
ARVYYYGSGSYLSGPGY

SEQ ID NO: 66345 - protein, 9 aa, Homo sapiens
  light chain complementarity determining region 3 for antibody 33173
QQYGSSPRT

SEQ ID NO: 66346 - protein, 17 aa, Homo sapiens
  heavy chain complementarity determining region 3 for antibody 33173
ARGAYYYSGSSRYYDEN

SEQ ID NO: 66347 - protein, 10 aa, Homo sapiens
  light chain complementarity determining region 3 for antibody 33174
QQYGSSPRFT

SEQ ID NO: 66348 - protein, 14 aa, Homo sapiens
  heavy chain complementarity determining region 3 for antibody 33174
ARWYYYDGSGLGDY

SEQ ID NO: 66349 - protein, 9 aa, Homo sapiens
  light chain complementarity determining region 3 for antibody 33175
QQYGSSPLT

SEQ ID NO: 66350 - protein, 13 aa, Homo sapiens
  heavy chain complementarity determining region 3 for antibody 33175
ARHLGSDQYYLEY

SEQ ID NO: 66351 - protein, 8 aa, Homo sapiens
  light chain complementarity determining region 3 for antibody 33176
QQYGSLYT

SEQ ID NO: 66352 - protein, 18 aa, Homo sapiens
  heavy chain complementarity determining region 3 for antibody 33176
AKEETPIWVGELLSPFDY

SEQ ID NO: 66353 - protein, 10 aa, Homo sapiens
  light chain complementarity determining region 3 for antibody 33177
QQYGISPKWT

SEQ ID NO: 66354 - protein, 17 aa, Homo sapiens
  heavy chain complementarity determining region 3 for antibody 33177
ARDPCKKATDVVCAWDS

SEQ ID NO: 66355 - protein, 9 aa, Homo sapiens
  light chain complementarity determining region 3 for antibody 33178
QQYGGSPWT

SEQ ID NO: 66356 - protein, 18 aa, Homo sapiens
  heavy chain complementarity determining region 3 for antibody 33178
ATNPSIAEPGKIYYYFDL

SEQ ID NO: 66357 - protein, 9 aa, Homo sapiens
  light chain complementarity determining region 3 for antibody 33179
QQYFISPYT

SEQ ID NO: 66358 - protein, 12 aa, Homo sapiens
  heavy chain complementarity determining region 3 for antibody 33179
VRPYYYDSSDDH

SEQ ID NO: 66359 - protein, 9 aa, Homo sapiens
  light chain complementarity determining region 3 for antibody 33180
QQYDNYPIT

SEQ ID NO: 66360 - protein, 19 aa, Homo sapiens
  heavy chain complementarity determining region 3 for antibody 33180
ARAGSFTGISMIGEDAFDF

SEQ ID NO: 66361 - protein, 10 aa, Homo sapiens
  light chain complementarity determining region 3 for antibody 33181
QQYDNLLVFT

SEQ ID NO: 66362 - protein, 16 aa, Homo sapiens
  heavy chain complementarity determining region 3 for antibody 33181
ARLITRGIPADPRFDP

SEQ ID NO: 66363 - protein, 9 aa, Homo sapiens
  light chain complementarity determining region 3 for antibody 33182
QQYDIFPLT

SEQ ID NO: 66364 - protein, 17 aa, Homo sapiens
  heavy chain complementarity determining region 3 for antibody 33182
ARALYGDYVLEHGYFDL

SEQ ID NO: 66365 - protein, 10 aa, Homo sapiens
  light chain complementarity determining region 3 for antibody 33183
QQYANQPPIT

SEQ ID NO: 66366 - protein, 12 aa, Homo sapiens
  heavy chain complementarity determining region 3 for antibody 33183
ARVLDSLSPAFH

SEQ ID NO: 66367 - protein, 9 aa, Homo sapiens
  light chain complementarity determining region 3 for antibody 33184
QQSFSAPLT

SEQ ID NO: 66368 - protein, 13 aa, Homo sapiens
  heavy chain complementarity determining region 3 for antibody 33184
ARSISGELSWFDP

SEQ ID NO: 66369 - protein, 9 aa, Homo sapiens
  light chain complementarity determining region 3 for antibody 33185
QQRSNWPLT

SEQ ID NO: 66370 - protein, 12 aa, Homo sapiens
  heavy chain complementarity determining region 3 for antibody 33185
TKTIAVTDKGDY

SEQ ID NO: 66371 - protein, 9 aa, Homo sapiens
  light chain complementarity determining region 3 for antibody 33186
QQLNSYPYT

SEQ ID NO: 66372 - protein, 18 aa, Homo sapiens
  heavy chain complementarity determining region 3 for antibody 33186
ARGGQYCSSITCYALLDY

SEQ ID NO: 66373 - protein, 9 aa, Homo sapiens
  light chain complementarity determining region 3 for antibody 33187
QQLNSYPFT

SEQ ID NO: 66374 - protein, 13 aa, Homo sapiens
  heavy chain complementarity determining region 3 for antibody 33187
ARGLHSGYYGMDV

SEQ ID NO: 66375 - protein, 9 aa, Homo sapiens
  light chain complementarity determining region 3 for antibody 33188
QQGYSTPFT

SEQ ID NO: 66376 - protein, 15 aa, Homo sapiens
  heavy chain complementarity determining region 3 for antibody 33188
VRAQVIWGQLYYFDS

SEQ ID NO: 66377 - protein, 9 aa, Homo sapiens
  light chain complementarity determining region 3 for antibody 33189
QQANSFPLT

SEQ ID NO: 66378 - protein, 17 aa, Homo sapiens
  heavy chain complementarity determining region 3 for antibody 33189
AKERGLFIAEAGTPSDS

SEQ ID NO: 66379 - protein, 9 aa, Homo sapiens
  light chain complementarity determining region 3 for antibody 33190
QQADSFPQT

SEQ ID NO: 66380 - protein, 13 aa, Homo sapiens
  heavy chain complementarity determining region 3 for antibody 33190
ARDSVQNRDTFDV

SEQ ID NO: 66381 - protein, 9 aa, Homo sapiens
  light chain complementarity determining region 3 for antibody 33191
QKYNSGPRT

SEQ ID NO: 66382 - protein, 15 aa, Homo sapiens
  heavy chain complementarity determining region 3 for antibody 33191
ARARLFGVVAYYCDS

SEQ ID NO: 66383 - protein, 9 aa, Homo sapiens
  light chain complementarity determining region 3 for antibody 33192
QKYNSAPWT

SEQ ID NO: 66384 - protein, 16 aa, Homo sapiens
  heavy chain complementarity determining region 3 for antibody 33192
ARGGRVGASYYYGMDV

SEQ ID NO: 66385 - protein, 9 aa, Homo sapiens
  light chain complementarity determining region 3 for antibody 33193
QKYHTAPLT

SEQ ID NO: 66386 - protein, 18 aa, Homo sapiens
  heavy chain complementarity determining region 3 for antibody 33193
ARDVGDDSTGYNYGYFDL

SEQ ID NO: 66387 - protein, 9 aa, Homo sapiens
  light chain complementarity determining region 3 for antibody 33194
QHYNSYLFT

SEQ ID NO: 66388 - protein, 19 aa, Homo sapiens
  heavy chain complementarity determining region 3 for antibody 33194
ARVGLTYYYESSGSGYFDL

SEQ ID NO: 66389 - protein, 9 aa, Homo sapiens
  light chain complementarity determining region 3 for antibody 33195
QHSKSFPLS

SEQ ID NO: 66390 - protein, 13 aa, Homo sapiens
  heavy chain complementarity determining region 3 for antibody 33195
ARDLRSSGAYFDH

SEQ ID NO: 66391 - protein, 9 aa, Homo sapiens
  light chain complementarity determining region 3 for antibody 33196
QHRTYWPWT

SEQ ID NO: 66392 - protein, 17 aa, Homo sapiens
  heavy chain complementarity determining region 3 for antibody 33196
GREYYDARSGSGNWFDP

SEQ ID NO: 66393 - protein, 9 aa, Homo sapiens
  light chain complementarity determining region 3 for antibody 33197
MQGTRWPYT

SEQ ID NO: 66394 - protein, 19 aa, Homo sapiens
  heavy chain complementarity determining region 3 for antibody 33197
ARDWGTEVTAGVWIGWFDP

SEQ ID NO: 66395 - protein, 9 aa, Homo sapiens
  light chain complementarity determining region 3 for antibody 33198
MQGTHWPLT

SEQ ID NO: 66396 - protein, 10 aa, Homo sapiens
  heavy chain complementarity determining region 3 for antibody 33198
ASLNRRTSRR

SEQ ID NO: 66397 - protein, 9 aa, Homo sapiens
  light chain complementarity determining region 3 for antibody 33199
MQALQTPFT

SEQ ID NO: 66398 - protein, 16 aa, Homo sapiens
  heavy chain complementarity determining region 3 for antibody 33199
ARLRAAGYSYGYGFDF

SEQ ID NO: 66399 - protein, 9 aa, Homo sapiens
  light chain complementarity determining region 3 for antibody 33200
MQALQTLFT

SEQ ID NO: 66400 - protein, 21 aa, Homo sapiens
  heavy chain complementarity determining region 3 for antibody 33200
ANEGSRVGGSTNRYYYSGVDV

SEQ ID NO: 66401 - protein, 9 aa, Homo sapiens
  light chain complementarity determining region 3 for antibody 33201
LQHNSYPWT

SEQ ID NO: 66402 - protein, 16 aa, Homo sapiens
  heavy chain complementarity determining region 3 for antibody 33201
ARGGRVGASYYYGMDV

SEQ ID NO: 66403 - protein, 9 aa, Homo sapiens
  light chain complementarity determining region 3 for antibody 33202
LQDYNYPRT

SEQ ID NO: 66404 - protein, 14 aa, Homo sapiens
  heavy chain complementarity determining region 3 for antibody 33202
ARYCSGNSCYSMDH

SEQ ID NO: 66405 - protein, 9 aa, Homo sapiens
  light chain complementarity determining region 3 for antibody 33203
LQDYNYPRT

SEQ ID NO: 66406 - protein, 15 aa, Homo sapiens
  heavy chain complementarity determining region 3 for antibody 33203
ARDLSYFGSRRGFDP

SEQ ID NO: 66407 - protein, 9 aa, Homo sapiens
  light chain complementarity determining region 3 for antibody 33204
LQAYNFPWT

SEQ ID NO: 66408 - protein, 18 aa, Homo sapiens
  heavy chain complementarity determining region 3 for antibody 33204
ARAGDSGSFSFSYSGMDI

SEQ ID NO: 66409 - protein, 9 aa, Homo sapiens
  light chain complementarity determining region 3 for antibody 33205
HYYDTSPWT

SEQ ID NO: 66410 - protein, 9 aa, Homo sapiens
  heavy chain complementarity determining region 3 for antibody 33205
ASILHDRIL

SEQ ID NO: 66411 - protein, 10 aa, Homo sapiens
  light chain complementarity determining region 3 for antibody 33206
HQYVNWPPWT

SEQ ID NO: 66412 - protein, 12 aa, Homo sapiens
  heavy chain complementarity determining region 3 for antibody 33206
ARDRGAAGPLLY

SEQ ID NO: 66413 - protein, 9 aa, Homo sapiens
  light chain complementarity determining region 3 for antibody 33207
QRYSSSSGT

SEQ ID NO: 66414 - protein, 12 aa, Homo sapiens
  heavy chain complementarity determining region 3 for antibody 33207
ARDSLGGSFNDN

SEQ ID NO: 66415 - protein, 9 aa, Homo sapiens
  light chain complementarity determining region 3 for antibody 33208
QQYYSYPLT

SEQ ID NO: 66416 - protein, 19 aa, Homo sapiens
  heavy chain complementarity determining region 3 for antibody 33208
AKDWGRAYCGGDCYARTDS

SEQ ID NO: 66417 - protein, 10 aa, Homo sapiens
  light chain complementarity determining region 3 for antibody 33209
QQYSSWRALT

SEQ ID NO: 66418 - protein, 14 aa, Homo sapiens
  heavy chain complementarity determining region 3 for antibody 33209
ATDPITGDYDVLDY

SEQ ID NO: 66419 - protein, 9 aa, Homo sapiens
  light chain complementarity determining region 3 for antibody 33210
QQYSNWPYT

SEQ ID NO: 66420 - protein, 18 aa, Homo sapiens
  heavy chain complementarity determining region 3 for antibody 33210
AKDRRRSTFFPVLGALDV

SEQ ID NO: 66421 - protein, 9 aa, Homo sapiens
  light chain complementarity determining region 3 for antibody 33211
QQYSNWPQT

SEQ ID NO: 66422 - protein, 15 aa, Homo sapiens
  heavy chain complementarity determining region 3 for antibody 33211
ARHNSYGYRRVWFDP

SEQ ID NO: 66423 - protein, 8 aa, Homo sapiens
  light chain complementarity determining region 3 for antibody 33212
QQYNTYWT

SEQ ID NO: 66424 - protein, 14 aa, Homo sapiens
  heavy chain complementarity determining region 3 for antibody 33212
AVLGSNWQVYNFDY

SEQ ID NO: 66425 - protein, 10 aa, Homo sapiens
  light chain complementarity determining region 3 for antibody 33213
QQYNSYSLYS

SEQ ID NO: 66426 - protein, 20 aa, Homo sapiens
  heavy chain complementarity determining region 3 for antibody 33213
GKDLWDGGYCSRTSCHGIDS

SEQ ID NO: 66427 - protein, 9 aa, Homo sapiens
  light chain complementarity determining region 3 for antibody 33214
QQYNSYPYT

SEQ ID NO: 66428 - protein, 19 aa, Homo sapiens
  heavy chain complementarity determining region 3 for antibody 33214
VRRPRPYSSDTSAYYYLDF

SEQ ID NO: 66429 - protein, 9 aa, Homo sapiens
  light chain complementarity determining region 3 for antibody 33215
QQYNSYPYT

SEQ ID NO: 66430 - protein, 21 aa, Homo sapiens
  heavy chain complementarity determining region 3 for antibody 33215
ARDVKHYDSSGSYWPLDMFDM

SEQ ID NO: 66431 - protein, 10 aa, Homo sapiens
  light chain complementarity determining region 3 for antibody 33216
QQYGTSRLYT

SEQ ID NO: 66432 - protein, 14 aa, Homo sapiens
  heavy chain complementarity determining region 3 for antibody 33216
AKRRRIVGAYYFES

SEQ ID NO: 66433 - protein, 9 aa, Homo sapiens
  light chain complementarity determining region 3 for antibody 33217
QQYGSSWVT

SEQ ID NO: 66434 - protein, 20 aa, Homo sapiens
  heavy chain complementarity determining region 3 for antibody 33217
AREGGHRQWLEIYDPGYFHH

SEQ ID NO: 66435 - protein, 9 aa, Homo sapiens
  light chain complementarity determining region 3 for antibody 33218
QQYGSSPQT

SEQ ID NO: 66436 - protein, 11 aa, Homo sapiens
  heavy chain complementarity determining region 3 for antibody 33218
ARPGREGGFDY

SEQ ID NO: 66437 - protein, 9 aa, Homo sapiens
  light chain complementarity determining region 3 for antibody 33219
QQYGSSPNT

SEQ ID NO: 66438 - protein, 21 aa, Homo sapiens
  heavy chain complementarity determining region 3 for antibody 33219
ARQALRRGYDSWSGYSYYFDS

SEQ ID NO: 66439 - protein, 9 aa, Homo sapiens
  light chain complementarity determining region 3 for antibody 33220
QQYGSSPHT

SEQ ID NO: 66440 - protein, 14 aa, Homo sapiens
  heavy chain complementarity determining region 3 for antibody 33220
ARDRRLGGYRLLDH

SEQ ID NO: 66441 - protein, 11 aa, Homo sapiens
  light chain complementarity determining region 3 for antibody 33221
QQYETSPPGYT

SEQ ID NO: 66442 - protein, 14 aa, Homo sapiens
  heavy chain complementarity determining region 3 for antibody 33221
ARENSISRKRSFDQ

SEQ ID NO: 66443 - protein, 11 aa, Homo sapiens
  light chain complementarity determining region 3 for antibody 33222
QQYDRSPPGFP

SEQ ID NO: 66444 - protein, 14 aa, Homo sapiens
  heavy chain complementarity determining region 3 for antibody 33222
ARETHNSRKRSFDQ

SEQ ID NO: 66445 - protein, 9 aa, Homo sapiens
  light chain complementarity determining region 3 for antibody 33223
QQYDNLPFT

SEQ ID NO: 66446 - protein, 12 aa, Homo sapiens
  heavy chain complementarity determining region 3 for antibody 33223
AREEVARWCFDY

SEQ ID NO: 66447 - protein, 9 aa, Homo sapiens
  light chain complementarity determining region 3 for antibody 33224
QQYDGYPWT

SEQ ID NO: 66448 - protein, 17 aa, Homo sapiens
  heavy chain complementarity determining region 3 for antibody 33224
AREGVYDSSGYNDALDL

SEQ ID NO: 66449 - protein, 9 aa, Homo sapiens
  light chain complementarity determining region 3 for antibody 33225
QQTHTAPYT

SEQ ID NO: 66450 - protein, 13 aa, Homo sapiens
  heavy chain complementarity determining region 3 for antibody 33225
ARARNYDRISLDF

SEQ ID NO: 66451 - protein, 9 aa, Homo sapiens
  light chain complementarity determining region 3 for antibody 33226
QQSYSTPWT

SEQ ID NO: 66452 - protein, 15 aa, Homo sapiens
  heavy chain complementarity determining region 3 for antibody 33226
ASRYSSGWYYYGMDV

SEQ ID NO: 66453 - protein, 9 aa, Homo sapiens
  light chain complementarity determining region 3 for antibody 33227
QQSYSGPRT

SEQ ID NO: 66454 - protein, 17 aa, Homo sapiens
  heavy chain complementarity determining region 3 for antibody 33227
AKAPTSTYSGKYGGFDY

SEQ ID NO: 66455 - protein, 9 aa, Homo sapiens
  light chain complementarity determining region 3 for antibody 33228
QQSYMTPIT

SEQ ID NO: 66456 - protein, 18 aa, Homo sapiens
  heavy chain complementarity determining region 3 for antibody 33228
AKDTEYYDFTGYPGDFQY

SEQ ID NO: 66457 - protein, 9 aa, Homo sapiens
  light chain complementarity determining region 3 for antibody 33229
QQSHSSLYT

SEQ ID NO: 66458 - protein, 12 aa, Homo sapiens
  heavy chain complementarity determining region 3 for antibody 33229
ARLHYGPSFFDY

SEQ ID NO: 66459 - protein, 9 aa, Homo sapiens
  light chain complementarity determining region 3 for antibody 33230
QQRSNWPLT

SEQ ID NO: 66460 - protein, 14 aa, Homo sapiens
  heavy chain complementarity determining region 3 for antibody 33230
ARGEDYPDSGRFDY

SEQ ID NO: 66461 - protein, 10 aa, Homo sapiens
  light chain complementarity determining region 3 for antibody 33231
QQRSNWPLIT

SEQ ID NO: 66462 - protein, 17 aa, Homo sapiens
  heavy chain complementarity determining region 3 for antibody 33231
ARAPNYGDFAAPDGLDL

SEQ ID NO: 66463 - protein, 9 aa, Homo sapiens
  light chain complementarity determining region 3 for antibody 33232
QQNYSTPPT

SEQ ID NO: 66464 - protein, 16 aa, Homo sapiens
  heavy chain complementarity determining region 3 for antibody 33232
AVGADTAMVTFGNFDY

SEQ ID NO: 66465 - protein, 8 aa, Homo sapiens
  light chain complementarity determining region 3 for antibody 33233
QQNGGSPS

SEQ ID NO: 66466 - protein, 16 aa, Homo sapiens
  heavy chain complementarity determining region 3 for antibody 33233
ATDWGSGTQWIRAFDV

SEQ ID NO: 66467 - protein, 9 aa, Homo sapiens
  light chain complementarity determining region 3 for antibody 33234
QQLSAYPIT

SEQ ID NO: 66468 - protein, 13 aa, Homo sapiens
  heavy chain complementarity determining region 3 for antibody 33234
GRRTAAAGGPFDH

SEQ ID NO: 66469 - protein, 9 aa, Homo sapiens
  light chain complementarity determining region 3 for antibody 33235
QQLNTYPPT

SEQ ID NO: 66470 - protein, 14 aa, Homo sapiens
  heavy chain complementarity determining region 3 for antibody 33235
ARENSVAATRAYDY

SEQ ID NO: 66471 - protein, 9 aa, Homo sapiens
  light chain complementarity determining region 3 for antibody 33236
QQFNTYPFT

SEQ ID NO: 66472 - protein, 15 aa, Homo sapiens
  heavy chain complementarity determining region 3 for antibody 33236
ARGLMVRGINDGVDI

SEQ ID NO: 66473 - protein, 9 aa, Homo sapiens
  light chain complementarity determining region 3 for antibody 33237
QQCSNWPRT

SEQ ID NO: 66474 - protein, 17 aa, Homo sapiens
  heavy chain complementarity determining region 3 for antibody 33237
ARVPYRVRGVQRPGIDY

SEQ ID NO: 66475 - protein, 9 aa, Homo sapiens
  light chain complementarity determining region 3 for antibody 33238
QQCNSYSLT

SEQ ID NO: 66476 - protein, 15 aa, Homo sapiens
  heavy chain complementarity determining region 3 for antibody 33238
TGKHITTSGVVKADY

SEQ ID NO: 66477 - protein, 9 aa, Homo sapiens
  light chain complementarity determining region 3 for antibody 33239
QQCGTPPWT

SEQ ID NO: 66478 - protein, 13 aa, Homo sapiens
  heavy chain complementarity determining region 3 for antibody 33239
AREVYMKTPAFGL

SEQ ID NO: 66479 - protein, 9 aa, Homo sapiens
  light chain complementarity determining region 3 for antibody 33240
QQANSFPLT

SEQ ID NO: 66480 - protein, 13 aa, Homo sapiens
  heavy chain complementarity determining region 3 for antibody 33240
ARGLDRSRHWFDP

SEQ ID NO: 66481 - protein, 10 aa, Homo sapiens
  light chain complementarity determining region 3 for antibody 33241
QHYVDSPLFT

SEQ ID NO: 66482 - protein, 13 aa, Homo sapiens
  heavy chain complementarity determining region 3 for antibody 33241
ARGAKFSGWYGDY

SEQ ID NO: 66483 - protein, 9 aa, Homo sapiens
  light chain complementarity determining region 3 for antibody 33242
QHRSNWPLT

SEQ ID NO: 66484 - protein, 15 aa, Homo sapiens
  heavy chain complementarity determining region 3 for antibody 33242
ASGLRYSDWSSFFDY

SEQ ID NO: 66485 - protein, 9 aa, Homo sapiens
  light chain complementarity determining region 3 for antibody 33243
MQNTQWPLT

SEQ ID NO: 66486 - protein, 8 aa, Homo sapiens
  heavy chain complementarity determining region 3 for antibody 33243
ALGQDMGR

SEQ ID NO: 66487 - protein, 9 aa, Homo sapiens
  light chain complementarity determining region 3 for antibody 33244
MQGTHWPGT

SEQ ID NO: 66488 - protein, 19 aa, Homo sapiens
  heavy chain complementarity determining region 3 for antibody 33244
ARGPPRLFSVYWYSNGMDF

SEQ ID NO: 66489 - protein, 9 aa, Homo sapiens
  light chain complementarity determining region 3 for antibody 33245
MQGAYWPPT

SEQ ID NO: 66490 - protein, 14 aa, Homo sapiens
  heavy chain complementarity determining region 3 for antibody 33245
ARDSDSGGPNDLDV

SEQ ID NO: 66491 - protein, 8 aa, Homo sapiens
  light chain complementarity determining region 3 for antibody 33246
MQALQTPG

SEQ ID NO: 66492 - protein, 19 aa, Homo sapiens
  heavy chain complementarity determining region 3 for antibody 33246
ANFGSGNFYNVRYYYGMDV

SEQ ID NO: 66493 - protein, 9 aa, Homo sapiens
  light chain complementarity determining region 3 for antibody 33247
MEALRAPLT

SEQ ID NO: 66494 - protein, 19 aa, Homo sapiens
  heavy chain complementarity determining region 3 for antibody 33247
ANRKSLIQNLVGWGWAMGY

SEQ ID NO: 66495 - protein, 11 aa, Homo sapiens
  light chain complementarity determining region 3 for antibody 33248
RQYSTSPIMYT

SEQ ID NO: 66496 - protein, 13 aa, Homo sapiens
  heavy chain complementarity determining region 3 for antibody 33248
ARDRGEFTYAHDY

SEQ ID NO: 66497 - protein, 8 aa, Homo sapiens
  light chain complementarity determining region 3 for antibody 33249
QYLNGYLV

SEQ ID NO: 66498 - protein, 12 aa, Homo sapiens
  heavy chain complementarity determining region 3 for antibody 33249
ARGANPYDAFDI

SEQ ID NO: 66499 - protein, 8 aa, Homo sapiens
  light chain complementarity determining region 3 for antibody 33250
QQYYTHNT

SEQ ID NO: 66500 - protein, 22 aa, Homo sapiens
  heavy chain complementarity determining region 3 for antibody 33250
AREDGWVAAAGGPRPDYWYFDL

SEQ ID NO: 66501 - protein, 9 aa, Homo sapiens
  light chain complementarity determining region 3 for antibody 33251
QQYVTYPIT

SEQ ID NO: 66502 - protein, 13 aa, Homo sapiens
  heavy chain complementarity determining region 3 for antibody 33251
GRGGYTSSWYWVY

SEQ ID NO: 66503 - protein, 9 aa, Homo sapiens
  light chain complementarity determining region 3 for antibody 33252
QQYVTPPRT

SEQ ID NO: 66504 - protein, 16 aa, Homo sapiens
  heavy chain complementarity determining region 3 for antibody 33252
VRDTGGGWGEDNYFDP

SEQ ID NO: 66505 - protein, 9 aa, Homo sapiens
  light chain complementarity determining region 3 for antibody 33253
QQYTTSPLT

SEQ ID NO: 66506 - protein, 11 aa, Homo sapiens
  heavy chain complementarity determining region 3 for antibody 33253
VREEFGWEMTY

SEQ ID NO: 66507 - protein, 9 aa, Homo sapiens
  light chain complementarity determining region 3 for antibody 33254
QQYSTYPVT

SEQ ID NO: 66508 - protein, 14 aa, Homo sapiens
  heavy chain complementarity determining region 3 for antibody 33254
AKDWSGGDSGYIDS

SEQ ID NO: 66509 - protein, 9 aa, Homo sapiens
  light chain complementarity determining region 3 for antibody 33255
QQYNSYSRT

SEQ ID NO: 66510 - protein, 17 aa, Homo sapiens
  heavy chain complementarity determining region 3 for antibody 33255
ARDKARDYNSSPRACDQ

SEQ ID NO: 66511 - protein, 8 aa, Homo sapiens
  light chain complementarity determining region 3 for antibody 33256
QQYNSLYT

SEQ ID NO: 66512 - protein, 14 aa, Homo sapiens
  heavy chain complementarity determining region 3 for antibody 33256
ARENSISRKRSFDH

SEQ ID NO: 66513 - protein, 9 aa, Homo sapiens
  light chain complementarity determining region 3 for antibody 33257
QQYNSHLRT

SEQ ID NO: 66514 - protein, 13 aa, Homo sapiens
  heavy chain complementarity determining region 3 for antibody 33257
SRMTWHTPLMFDY

SEQ ID NO: 66515 - protein, 9 aa, Homo sapiens
  light chain complementarity determining region 3 for antibody 33258
QQYNSFPWT

SEQ ID NO: 66516 - protein, 18 aa, Homo sapiens
  heavy chain complementarity determining region 3 for antibody 33258
ARQYSSKWTDDYYYGMDV

SEQ ID NO: 66517 - protein, 9 aa, Homo sapiens
  light chain complementarity determining region 3 for antibody 33259
QQYNRYPYT

SEQ ID NO: 66518 - protein, 11 aa, Homo sapiens
  heavy chain complementarity determining region 3 for antibody 33259
ARQTRGNTIST

SEQ ID NO: 66519 - protein, 9 aa, Homo sapiens
  light chain complementarity determining region 3 for antibody 33260
QQYNNWPQT

SEQ ID NO: 66520 - protein, 11 aa, Homo sapiens
  heavy chain complementarity determining region 3 for antibody 33260
ARGTNWELLHY

SEQ ID NO: 66521 - protein, 10 aa, Homo sapiens
  light chain complementarity determining region 3 for antibody 33261
QQYISYSPYT

SEQ ID NO: 66522 - protein, 15 aa, Homo sapiens
  heavy chain complementarity determining region 3 for antibody 33261
ALSCGGDCSSVPGRY

SEQ ID NO: 66523 - protein, 9 aa, Homo sapiens
  light chain complementarity determining region 3 for antibody 33262
QQYGSSPYT

SEQ ID NO: 66524 - protein, 15 aa, Homo sapiens
  heavy chain complementarity determining region 3 for antibody 33262
AKYRGIHYNVYHFDN

SEQ ID NO: 66525 - protein, 9 aa, Homo sapiens
  light chain complementarity determining region 3 for antibody 33263
QQYGSSPLT

SEQ ID NO: 66526 - protein, 12 aa, Homo sapiens
  heavy chain complementarity determining region 3 for antibody 33263
ARSPYSGIDFDS

SEQ ID NO: 66527 - protein, 8 aa, Homo sapiens
  light chain complementarity determining region 3 for antibody 33264
QQYGSSLT

SEQ ID NO: 66528 - protein, 21 aa, Homo sapiens
  heavy chain complementarity determining region 3 for antibody 33264
ARSATYYDNSGSYGPSEYLQH

SEQ ID NO: 66529 - protein, 10 aa, Homo sapiens
  light chain complementarity determining region 3 for antibody 33265
QQYDSLSPLT

SEQ ID NO: 66530 - protein, 18 aa, Homo sapiens
  heavy chain complementarity determining region 3 for antibody 33265
ARLMTSSRPDYYYYGLDV

SEQ ID NO: 66531 - protein, 10 aa, Homo sapiens
  light chain complementarity determining region 3 for antibody 33266
QQYDNLPPLT

SEQ ID NO: 66532 - protein, 17 aa, Homo sapiens
  heavy chain complementarity determining region 3 for antibody 33266
ARHHGRYNWNDGYYFDY

SEQ ID NO: 66533 - protein, 8 aa, Homo sapiens
  light chain complementarity determining region 3 for antibody 33267
QQYDNLLL

SEQ ID NO: 66534 - protein, 20 aa, Homo sapiens
  heavy chain complementarity determining region 3 for antibody 33267
ARHLKRTEPKGRSGYYLTDY

SEQ ID NO: 66535 - protein, 9 aa, Homo sapiens
  light chain complementarity determining region 3 for antibody 33268
QQSYSTPWT

SEQ ID NO: 66536 - protein, 13 aa, Homo sapiens
  heavy chain complementarity determining region 3 for antibody 33268
ARQSVYGQSGLDL

SEQ ID NO: 66537 - protein, 9 aa, Homo sapiens
  light chain complementarity determining region 3 for antibody 33269
QQSYSTPLT

SEQ ID NO: 66538 - protein, 17 aa, Homo sapiens
  heavy chain complementarity determining region 3 for antibody 33269
GRDGLGVSVNGPQRTAY

SEQ ID NO: 66539 - protein, 9 aa, Homo sapiens
  light chain complementarity determining region 3 for antibody 33270
QQSYSPPFT

SEQ ID NO: 66540 - protein, 14 aa, Homo sapiens
  heavy chain complementarity determining region 3 for antibody 33270
GRSGDTSGYSKIEN

SEQ ID NO: 66541 - protein, 10 aa, Homo sapiens
  light chain complementarity determining region 3 for antibody 33271
QQSYDTPIFT

SEQ ID NO: 66542 - protein, 17 aa, Homo sapiens
  heavy chain complementarity determining region 3 for antibody 33271
TRVGPEKWLAQDNWFDP

SEQ ID NO: 66543 - protein, 10 aa, Homo sapiens
  light chain complementarity determining region 3 for antibody 33272
QQRYKWPPST

SEQ ID NO: 66544 - protein, 11 aa, Homo sapiens
  heavy chain complementarity determining region 3 for antibody 33272
ARGVGSYVFES

SEQ ID NO: 66545 - protein, 9 aa, Homo sapiens
  light chain complementarity determining region 3 for antibody 33273
QQRSNWPLT

SEQ ID NO: 66546 - protein, 14 aa, Homo sapiens
  heavy chain complementarity determining region 3 for antibody 33273
VKGKNSGWYGALDI

SEQ ID NO: 66547 - protein, 9 aa, Homo sapiens
  light chain complementarity determining region 3 for antibody 33274
QQRHKWPRT

SEQ ID NO: 66548 - protein, 15 aa, Homo sapiens
  heavy chain complementarity determining region 3 for antibody 33274
ARDCYGGSCQYYSDY

SEQ ID NO: 66549 - protein, 11 aa, Homo sapiens
  light chain complementarity determining region 3 for antibody 33275
QQLKDYPRELT

SEQ ID NO: 66550 - protein, 14 aa, Homo sapiens
  heavy chain complementarity determining region 3 for antibody 33275
ARDLFGGSPGAFDS

SEQ ID NO: 66551 - protein, 9 aa, Homo sapiens
  light chain complementarity determining region 3 for antibody 33276
QQGHDFPPT

SEQ ID NO: 66552 - protein, 16 aa, Homo sapiens
  heavy chain complementarity determining region 3 for antibody 33276
ASNPCVGGGCYQTFDN

SEQ ID NO: 66553 - protein, 8 aa, Homo sapiens
  light chain complementarity determining region 3 for antibody 33277
QQFGTSAT

SEQ ID NO: 66554 - protein, 15 aa, Homo sapiens
  heavy chain complementarity determining region 3 for antibody 33277
ARIRDITVARWYFDL

SEQ ID NO: 66555 - protein, 9 aa, Homo sapiens
  light chain complementarity determining region 3 for antibody 33278
QQATSFPWT

SEQ ID NO: 66556 - protein, 12 aa, Homo sapiens
  heavy chain complementarity determining region 3 for antibody 33278
ARVHDYRNSSDS

SEQ ID NO: 66557 - protein, 9 aa, Homo sapiens
  light chain complementarity determining region 3 for antibody 33279
QQANSFPIT

SEQ ID NO: 66558 - protein, 18 aa, Homo sapiens
  heavy chain complementarity determining region 3 for antibody 33279
AREGYYSDSSGRYWYFDL

SEQ ID NO: 66559 - protein, 9 aa, Homo sapiens
  light chain complementarity determining region 3 for antibody 33280
MQGTHWSYT

SEQ ID NO: 66560 - protein, 11 aa, Homo sapiens
  heavy chain complementarity determining region 3 for antibody 33280
ASVRLGGPGAY

SEQ ID NO: 66561 - protein, 9 aa, Homo sapiens
  light chain complementarity determining region 3 for antibody 33281
MQGTHWPLA

SEQ ID NO: 66562 - protein, 16 aa, Homo sapiens
  heavy chain complementarity determining region 3 for antibody 33281
ARDERGDHGDYGYFDL

SEQ ID NO: 66563 - protein, 9 aa, Homo sapiens
  light chain complementarity determining region 3 for antibody 33282
MQARDWPPT

SEQ ID NO: 66564 - protein, 18 aa, Homo sapiens
  heavy chain complementarity determining region 3 for antibody 33282
LRGGTIEWELRQSSLIDC

SEQ ID NO: 66565 - protein, 9 aa, Homo sapiens
  light chain complementarity determining region 3 for antibody 33283
MQALQTAQT

SEQ ID NO: 66566 - protein, 22 aa, Homo sapiens
  heavy chain complementarity determining region 3 for antibody 33283
ARSMGCISTSCYAGWSYYGMDV

SEQ ID NO: 66567 - protein, 9 aa, Homo sapiens
  light chain complementarity determining region 3 for antibody 33284
MHALEPPYI

SEQ ID NO: 66568 - protein, 10 aa, Homo sapiens
  heavy chain complementarity determining region 3 for antibody 33284
ARDLSGGNDY

SEQ ID NO: 66569 - protein, 9 aa, Homo sapiens
  light chain complementarity determining region 3 for antibody 33285
LQSIHWPWT

SEQ ID NO: 66570 - protein, 11 aa, Homo sapiens
  heavy chain complementarity determining region 3 for antibody 33285
ARFERRKPGPD

SEQ ID NO: 66571 - protein, 9 aa, Homo sapiens
  light chain complementarity determining region 3 for antibody 33286
LQHNSYPWT

SEQ ID NO: 66572 - protein, 6 aa, Homo sapiens
  heavy chain complementarity determining region 3 for antibody 33286
SRDGTY

SEQ ID NO: 66573 - protein, 9 aa, Homo sapiens
  light chain complementarity determining region 3 for antibody 33287
LQHNSYPPT

SEQ ID NO: 66574 - protein, 16 aa, Homo sapiens
  heavy chain complementarity determining region 3 for antibody 33287
SREKFRGQQPRDVFDI

SEQ ID NO: 66575 - protein, 9 aa, Homo sapiens
  light chain complementarity determining region 3 for antibody 33288
LQHNSYPLT

SEQ ID NO: 66576 - protein, 22 aa, Homo sapiens
  heavy chain complementarity determining region 3 for antibody 33288
AKDQASTVVVVSRPWEVSDLTF

SEQ ID NO: 66577 - protein, 9 aa, Homo sapiens
  light chain complementarity determining region 3 for antibody 33289
HQRSNWPGT

SEQ ID NO: 66578 - protein, 6 aa, Homo sapiens
  heavy chain complementarity determining region 3 for antibody 33289
TTVFEY

SEQ ID NO: 66579 - protein, 9 aa, Homo sapiens
  light chain complementarity determining region 3 for antibody 33290
QQYYSIPLT

SEQ ID NO: 66580 - protein, 5 aa, Homo sapiens
  heavy chain complementarity determining region 3 for antibody 33290
GPPPY

SEQ ID NO: 66581 - protein, 8 aa, Homo sapiens
  light chain complementarity determining region 3 for antibody 33291
QQYVSYST

SEQ ID NO: 66582 - protein, 17 aa, Homo sapiens
  heavy chain complementarity determining region 3 for antibody 33291
ARRYGLLANYPWSPFEF

SEQ ID NO: 66583 - protein, 9 aa, Homo sapiens
  light chain complementarity determining region 3 for antibody 33292
QQYRTYSRT

SEQ ID NO: 66584 - protein, 14 aa, Homo sapiens
  heavy chain complementarity determining region 3 for antibody 33292
ARDRESSWYPYLDS

SEQ ID NO: 66585 - protein, 8 aa, Homo sapiens
  light chain complementarity determining region 3 for antibody 33293
QQYRSSFP

SEQ ID NO: 66586 - protein, 13 aa, Homo sapiens
  heavy chain complementarity determining region 3 for antibody 33293
ATESGWYQGAFDI

SEQ ID NO: 66587 - protein, 9 aa, Homo sapiens
  light chain complementarity determining region 3 for antibody 33294
QQYNSYSWT

SEQ ID NO: 66588 - protein, 12 aa, Homo sapiens
  heavy chain complementarity determining region 3 for antibody 33294
ARGRFGDLVYDY

SEQ ID NO: 66589 - protein, 9 aa, Homo sapiens
  light chain complementarity determining region 3 for antibody 33295
QQYNSYSWT

SEQ ID NO: 66590 - protein, 14 aa, Homo sapiens
  heavy chain complementarity determining region 3 for antibody 33295
ARGAGADYQPPLTD

SEQ ID NO: 66591 - protein, 9 aa, Homo sapiens
  light chain complementarity determining region 3 for antibody 33296
QQYNSYPFT

SEQ ID NO: 66592 - protein, 15 aa, Homo sapiens
  heavy chain complementarity determining region 3 for antibody 33296
ARERDSSGWDGVVDY

SEQ ID NO: 66593 - protein, 8 aa, Homo sapiens
  light chain complementarity determining region 3 for antibody 33297
QQYNSYLT

SEQ ID NO: 66594 - protein, 14 aa, Homo sapiens
  heavy chain complementarity determining region 3 for antibody 33297
ARNSEGSGWFPCDY

SEQ ID NO: 66595 - protein, 9 aa, Homo sapiens
  light chain complementarity determining region 3 for antibody 33298
QQYNSHSYT

SEQ ID NO: 66596 - protein, 18 aa, Homo sapiens
  heavy chain complementarity determining region 3 for antibody 33298
ARDMTAYSGYEQHDPFDV

SEQ ID NO: 66597 - protein, 9 aa, Homo sapiens
  light chain complementarity determining region 3 for antibody 33299
QQYNNWPLT

SEQ ID NO: 66598 - protein, 18 aa, Homo sapiens
  heavy chain complementarity determining region 3 for antibody 33299
ARDFRPFGGITPFGWFDP

SEQ ID NO: 66599 - protein, 9 aa, Homo sapiens
  light chain complementarity determining region 3 for antibody 33300
QQYNKWPFA

SEQ ID NO: 66600 - protein, 12 aa, Homo sapiens
  heavy chain complementarity determining region 3 for antibody 33300
ARESTADDYTDQ

SEQ ID NO: 66601 - protein, 9 aa, Homo sapiens
  light chain complementarity determining region 3 for antibody 33301
QQYNKNLET

SEQ ID NO: 66602 - protein, 9 aa, Homo sapiens
  heavy chain complementarity determining region 3 for antibody 33301
ARGGTYGGY

SEQ ID NO: 66603 - protein, 9 aa, Homo sapiens
  light chain complementarity determining region 3 for antibody 33302
QQYGSSPRT

SEQ ID NO: 66604 - protein, 22 aa, Homo sapiens
  heavy chain complementarity determining region 3 for antibody 33302
ARVLGTCTNDICYSYHGDAFGT

SEQ ID NO: 66605 - protein, 10 aa, Homo sapiens
  light chain complementarity determining region 3 for antibody 33303
QQYGSSPPYT

SEQ ID NO: 66606 - protein, 23 aa, Homo sapiens
  heavy chain complementarity determining region 3 for antibody 33303
ARDYLRHYSFDSSDYPPLKTFYM

SEQ ID NO: 66607 - protein, 10 aa, Homo sapiens
  light chain complementarity determining region 3 for antibody 33304
QQYGSSPPWT

SEQ ID NO: 66608 - protein, 14 aa, Homo sapiens
  heavy chain complementarity determining region 3 for antibody 33304
ARGASSSFYHPFDS

SEQ ID NO: 66609 - protein, 10 aa, Homo sapiens
  light chain complementarity determining region 3 for antibody 33305
QQYGSSPPLT

SEQ ID NO: 66610 - protein, 20 aa, Homo sapiens
  heavy chain complementarity determining region 3 for antibody 33305
ARESVIMFGGVIVIRGAFDI

SEQ ID NO: 66611 - protein, 10 aa, Homo sapiens
  light chain complementarity determining region 3 for antibody 33306
QQYGSSPMYT

SEQ ID NO: 66612 - protein, 22 aa, Homo sapiens
  heavy chain complementarity determining region 3 for antibody 33306
TTGDLWWFGELSYSPSDSYNDI

SEQ ID NO: 66613 - protein, 9 aa, Homo sapiens
  light chain complementarity determining region 3 for antibody 33307
QQYGSSPLT

SEQ ID NO: 66614 - protein, 14 aa, Homo sapiens
  heavy chain complementarity determining region 3 for antibody 33307
ARGLRGLKNWYFDL

SEQ ID NO: 66615 - protein, 9 aa, Homo sapiens
  light chain complementarity determining region 3 for antibody 33308
QQYGRLPIT

SEQ ID NO: 66616 - protein, 11 aa, Homo sapiens
  heavy chain complementarity determining region 3 for antibody 33308
AHRFRTYYFDH

SEQ ID NO: 66617 - protein, 9 aa, Homo sapiens
  light chain complementarity determining region 3 for antibody 33309
QQYEDLPIT

SEQ ID NO: 66618 - protein, 12 aa, Homo sapiens
  heavy chain complementarity determining region 3 for antibody 33309
TTFYPGAGYFQH

SEQ ID NO: 66619 - protein, 9 aa, Homo sapiens
  light chain complementarity determining region 3 for antibody 33310
QQYDSYFET

SEQ ID NO: 66620 - protein, 18 aa, Homo sapiens
  heavy chain complementarity determining region 3 for antibody 33310
ARPPGGISESGGYYYFVY

SEQ ID NO: 66621 - protein, 10 aa, Homo sapiens
  light chain complementarity determining region 3 for antibody 33311
QQYDNLPPYT

SEQ ID NO: 66622 - protein, 18 aa, Homo sapiens
  heavy chain complementarity determining region 3 for antibody 33311
ARDAGILSSSSWYVGFDI

SEQ ID NO: 66623 - protein, 10 aa, Homo sapiens
  light chain complementarity determining region 3 for antibody 33312
QQYDNLPPLT

SEQ ID NO: 66624 - protein, 14 aa, Homo sapiens
  heavy chain complementarity determining region 3 for antibody 33312
ATDLAHRSHWRNVN

SEQ ID NO: 66625 - protein, 9 aa, Homo sapiens
  light chain complementarity determining region 3 for antibody 33313
QQYDNLPLT

SEQ ID NO: 66626 - protein, 16 aa, Homo sapiens
  heavy chain complementarity determining region 3 for antibody 33313
ARDRRGSYYGSNGMDV

SEQ ID NO: 66627 - protein, 9 aa, Homo sapiens
  light chain complementarity determining region 3 for antibody 33314
QQYDNLPFT

SEQ ID NO: 66628 - protein, 15 aa, Homo sapiens
  heavy chain complementarity determining region 3 for antibody 33314
ARHDRLRSTGTYFDY

SEQ ID NO: 66629 - protein, 9 aa, Homo sapiens
  light chain complementarity determining region 3 for antibody 33315
QQYDIVPLT

SEQ ID NO: 66630 - protein, 14 aa, Homo sapiens
  heavy chain complementarity determining region 3 for antibody 33315
AKDFNEQYFSGLDY

SEQ ID NO: 66631 - protein, 9 aa, Homo sapiens
  light chain complementarity determining region 3 for antibody 33316
QQTYSTPPT

SEQ ID NO: 66632 - protein, 14 aa, Homo sapiens
  heavy chain complementarity determining region 3 for antibody 33316
AKDRVGLANYDMDA

SEQ ID NO: 66633 - protein, 9 aa, Homo sapiens
  light chain complementarity determining region 3 for antibody 33317
QQSYSTPKT

SEQ ID NO: 66634 - protein, 13 aa, Homo sapiens
  heavy chain complementarity determining region 3 for antibody 33317
AGGQFDNTGYREY

SEQ ID NO: 66635 - protein, 9 aa, Homo sapiens
  light chain complementarity determining region 3 for antibody 33318
QQSYSTPHT

SEQ ID NO: 66636 - protein, 14 aa, Homo sapiens
  heavy chain complementarity determining region 3 for antibody 33318
AKDIWRYSSGSFDY

SEQ ID NO: 66637 - protein, 9 aa, Homo sapiens
  light chain complementarity determining region 3 for antibody 33319
QQSYKTPHT

SEQ ID NO: 66638 - protein, 15 aa, Homo sapiens
  heavy chain complementarity determining region 3 for antibody 33319
AKGLKGPVVGTPIGN

SEQ ID NO: 66639 - protein, 9 aa, Homo sapiens
  light chain complementarity determining region 3 for antibody 33320
QQSSSIPPT

SEQ ID NO: 66640 - protein, 13 aa, Homo sapiens
  heavy chain complementarity determining region 3 for antibody 33320
ARGSHLRYRAFDI

SEQ ID NO: 66641 - protein, 9 aa, Homo sapiens
  light chain complementarity determining region 3 for antibody 33321
QQSFSVPYS

SEQ ID NO: 66642 - protein, 15 aa, Homo sapiens
  heavy chain complementarity determining region 3 for antibody 33321
VRERGYSYGLGLFDS

SEQ ID NO: 66643 - protein, 9 aa, Homo sapiens
  light chain complementarity determining region 3 for antibody 33322
QQRSNWPLT

SEQ ID NO: 66644 - protein, 15 aa, Homo sapiens
  heavy chain complementarity determining region 3 for antibody 33322
ARLGPRGNSYGHFDF

SEQ ID NO: 66645 - protein, 8 aa, Homo sapiens
  light chain complementarity determining region 3 for antibody 33323
QQNNWPPT

SEQ ID NO: 66646 - protein, 15 aa, Homo sapiens
  heavy chain complementarity determining region 3 for antibody 33323
ARRCDNSGLFWFFDL

SEQ ID NO: 66647 - protein, 9 aa, Homo sapiens
  light chain complementarity determining region 3 for antibody 33324
QQLDSYPLT

SEQ ID NO: 66648 - protein, 11 aa, Homo sapiens
  heavy chain complementarity determining region 3 for antibody 33324
ARQTGYTDFDY

SEQ ID NO: 66649 - protein, 9 aa, Homo sapiens
  light chain complementarity determining region 3 for antibody 33325
QQGMSFPLT

SEQ ID NO: 66650 - protein, 16 aa, Homo sapiens
  heavy chain complementarity determining region 3 for antibody 33325
ARGQSQWNDGYFGLDV

SEQ ID NO: 66651 - protein, 9 aa, Homo sapiens
  light chain complementarity determining region 3 for antibody 33326
QQANSFPPT

SEQ ID NO: 66652 - protein, 12 aa, Homo sapiens
  heavy chain complementarity determining region 3 for antibody 33326
ATDVDRKFYFDN

SEQ ID NO: 66653 - protein, 9 aa, Homo sapiens
  light chain complementarity determining region 3 for antibody 33327
QQANSFPLT

SEQ ID NO: 66654 - protein, 18 aa, Homo sapiens
  heavy chain complementarity determining region 3 for antibody 33327
VLMGHYYNSGSPNWYFDL

SEQ ID NO: 66655 - protein, 9 aa, Homo sapiens
  light chain complementarity determining region 3 for antibody 33328
QKYVSTPRP

SEQ ID NO: 66656 - protein, 18 aa, Homo sapiens
  heavy chain complementarity determining region 3 for antibody 33328
AHERWEKNPSYKYYGMDL

SEQ ID NO: 66657 - protein, 9 aa, Homo sapiens
  light chain complementarity determining region 3 for antibody 33329
QKYNSAPFT

SEQ ID NO: 66658 - protein, 19 aa, Homo sapiens
  heavy chain complementarity determining region 3 for antibody 33329
ARLPGPAAAANHPPYNFDY

SEQ ID NO: 66659 - protein, 9 aa, Homo sapiens
  light chain complementarity determining region 3 for antibody 33330
QKYNDAPWT

SEQ ID NO: 66660 - protein, 16 aa, Homo sapiens
  heavy chain complementarity determining region 3 for antibody 33330
AKKGGHVAATGNYFDL

SEQ ID NO: 66661 - protein, 8 aa, Homo sapiens
  light chain complementarity determining region 3 for antibody 33331
QHYNKWPS

SEQ ID NO: 66662 - protein, 16 aa, Homo sapiens
  heavy chain complementarity determining region 3 for antibody 33331
ARIYDNSGPLLGCFNI

SEQ ID NO: 66663 - protein, 11 aa, Homo sapiens
  light chain complementarity determining region 3 for antibody 33332
QHFDTSPPRWT

SEQ ID NO: 66664 - protein, 18 aa, Homo sapiens
  heavy chain complementarity determining region 3 for antibody 33332
ARGLRLRELSFLLLFFDY

SEQ ID NO: 66665 - protein, 9 aa, Homo sapiens
  light chain complementarity determining region 3 for antibody 33333
MQGVAWPWT

SEQ ID NO: 66666 - protein, 11 aa, Homo sapiens
  heavy chain complementarity determining region 3 for antibody 33333
WAGYKYGTGDY

SEQ ID NO: 66667 - protein, 7 aa, Homo sapiens
  light chain complementarity determining region 3 for antibody 33334
MQGTHWP

SEQ ID NO: 66668 - protein, 17 aa, Homo sapiens
  heavy chain complementarity determining region 3 for antibody 33334
ARVPYYYDSSGYNVRDY

SEQ ID NO: 66669 - protein, 10 aa, Homo sapiens
  light chain complementarity determining region 3 for antibody 33335
MQATHWPPKT

SEQ ID NO: 66670 - protein, 11 aa, Homo sapiens
  heavy chain complementarity determining region 3 for antibody 33335
ARDPGRSGWDS

SEQ ID NO: 66671 - protein, 8 aa, Homo sapiens
  light chain complementarity determining region 3 for antibody 33336
MQALQTRT

SEQ ID NO: 66672 - protein, 13 aa, Homo sapiens
  heavy chain complementarity determining region 3 for antibody 33336
ARDESYGDYGMDV

SEQ ID NO: 66673 - protein, 9 aa, Homo sapiens
  light chain complementarity determining region 3 for antibody 33337
MQALQTPDT

SEQ ID NO: 66674 - protein, 21 aa, Homo sapiens
  heavy chain complementarity determining region 3 for antibody 33337
ARDAPVSRPYSSGWYSSAFDY

SEQ ID NO: 66675 - protein, 9 aa, Homo sapiens
  light chain complementarity determining region 3 for antibody 33338
MQALETPFT

SEQ ID NO: 66676 - protein, 15 aa, Homo sapiens
  heavy chain complementarity determining region 3 for antibody 33338
IRHYRVAVAGIEGDY

SEQ ID NO: 66677 - protein, 9 aa, Homo sapiens
  light chain complementarity determining region 3 for antibody 33339
LQHSISPRT

SEQ ID NO: 66678 - protein, 11 aa, Homo sapiens
  heavy chain complementarity determining region 3 for antibody 33339
TTGLGSGGINL

SEQ ID NO: 66679 - protein, 9 aa, Homo sapiens
  light chain complementarity determining region 3 for antibody 33340
LQGNRFPHT

SEQ ID NO: 66680 - protein, 14 aa, Homo sapiens
  heavy chain complementarity determining region 3 for antibody 33340
ARYCSGTSCYSMDY

SEQ ID NO: 66681 - protein, 9 aa, Homo sapiens
  light chain complementarity determining region 3 for antibody 33341
LQFQNVPLT

SEQ ID NO: 66682 - protein, 8 aa, Homo sapiens
  heavy chain complementarity determining region 3 for antibody 33341
ARGFPAGS

SEQ ID NO: 66683 - protein, 9 aa, Homo sapiens
  light chain complementarity determining region 3 for antibody 33342
QQYSSPPWT

SEQ ID NO: 66684 - protein, 17 aa, Homo sapiens
  heavy chain complementarity determining region 3 for antibody 33342
ARDMLTSKRWPDNFFDV

SEQ ID NO: 66685 - protein, 9 aa, Homo sapiens
  light chain complementarity determining region 3 for antibody 33343
QQYNSYSWT

SEQ ID NO: 66686 - protein, 19 aa, Homo sapiens
  heavy chain complementarity determining region 3 for antibody 33343
ARAPALLWLGDHMYNYFDP

SEQ ID NO: 66687 - protein, 9 aa, Homo sapiens
  light chain complementarity determining region 3 for antibody 33344
QQYNSYPWT

SEQ ID NO: 66688 - protein, 14 aa, Homo sapiens
  heavy chain complementarity determining region 3 for antibody 33344
ARQHFGDNSGKYDS

SEQ ID NO: 66689 - protein, 9 aa, Homo sapiens
  light chain complementarity determining region 3 for antibody 33345
QQYNSYPLT

SEQ ID NO: 66690 - protein, 15 aa, Homo sapiens
  heavy chain complementarity determining region 3 for antibody 33345
ARERAGGYILMGWDF

SEQ ID NO: 66691 - protein, 9 aa, Homo sapiens
  light chain complementarity determining region 3 for antibody 33346
QQYNSWPYT

SEQ ID NO: 66692 - protein, 18 aa, Homo sapiens
  heavy chain complementarity determining region 3 for antibody 33346
VRGGTDLTGVAGMAPFQN

SEQ ID NO: 66693 - protein, 9 aa, Homo sapiens
  light chain complementarity determining region 3 for antibody 33347
QQYGVSPFF

SEQ ID NO: 66694 - protein, 12 aa, Homo sapiens
  heavy chain complementarity determining region 3 for antibody 33347
ARGWNELDYFDY

SEQ ID NO: 66695 - protein, 10 aa, Homo sapiens
  light chain complementarity determining region 3 for antibody 33348
QQYGSSPPPT

SEQ ID NO: 66696 - protein, 18 aa, Homo sapiens
  heavy chain complementarity determining region 3 for antibody 33348
ARGGYDYGWGSYGVYFDY

SEQ ID NO: 66697 - protein, 10 aa, Homo sapiens
  light chain complementarity determining region 3 for antibody 33349
QQYGSSPLFT

SEQ ID NO: 66698 - protein, 19 aa, Homo sapiens
  heavy chain complementarity determining region 3 for antibody 33349
ARGFREVVSATDAYNWFDP

SEQ ID NO: 66699 - protein, 9 aa, Homo sapiens
  light chain complementarity determining region 3 for antibody 33350
QQYDNLPLT

SEQ ID NO: 66700 - protein, 12 aa, Homo sapiens
  heavy chain complementarity determining region 3 for antibody 33350
VKDCGLGGPRDY

SEQ ID NO: 66701 - protein, 8 aa, Homo sapiens
  light chain complementarity determining region 3 for antibody 33351
QQTYTAPA

SEQ ID NO: 66702 - protein, 15 aa, Homo sapiens
  heavy chain complementarity determining region 3 for antibody 33351
ARDRDYFDSFEDLDY

SEQ ID NO: 66703 - protein, 9 aa, Homo sapiens
  light chain complementarity determining region 3 for antibody 33352
QQTYSGLYT

SEQ ID NO: 66704 - protein, 13 aa, Homo sapiens
  heavy chain complementarity determining region 3 for antibody 33352
TRGGITARPSHDS

SEQ ID NO: 66705 - protein, 9 aa, Homo sapiens
  light chain complementarity determining region 3 for antibody 33353
QQTNSFPLT

SEQ ID NO: 66706 - protein, 18 aa, Homo sapiens
  heavy chain complementarity determining region 3 for antibody 33353
ASGTMVRGVTGYYYGMDV

SEQ ID NO: 66707 - protein, 9 aa, Homo sapiens
  light chain complementarity determining region 3 for antibody 33354
QQSYTTPQT

SEQ ID NO: 66708 - protein, 21 aa, Homo sapiens
  heavy chain complementarity determining region 3 for antibody 33354
ARDLKLTSYYYDSSDDHYFDY

SEQ ID NO: 66709 - protein, 9 aa, Homo sapiens
  light chain complementarity determining region 3 for antibody 33355
QQSYSTPRT

SEQ ID NO: 66710 - protein, 12 aa, Homo sapiens
  heavy chain complementarity determining region 3 for antibody 33355
ALSFGGIEYFDY

SEQ ID NO: 66711 - protein, 10 aa, Homo sapiens
  light chain complementarity determining region 3 for antibody 33356
QQSYSTPPYT

SEQ ID NO: 66712 - protein, 15 aa, Homo sapiens
  heavy chain complementarity determining region 3 for antibody 33356
ARDSLIGHGSTGYVY

SEQ ID NO: 66713 - protein, 8 aa, Homo sapiens
  light chain complementarity determining region 3 for antibody 33357
QQSNRTPF

SEQ ID NO: 66714 - protein, 13 aa, Homo sapiens
  heavy chain complementarity determining region 3 for antibody 33357
ARSEGAYVVTFDY

SEQ ID NO: 66715 - protein, 9 aa, Homo sapiens
  light chain complementarity determining region 3 for antibody 33358
QQSHSPPFT

SEQ ID NO: 66716 - protein, 8 aa, Homo sapiens
  heavy chain complementarity determining region 3 for antibody 33358
ARDGAFDS

SEQ ID NO: 66717 - protein, 9 aa, Homo sapiens
  light chain complementarity determining region 3 for antibody 33359
QQSATKPFT

SEQ ID NO: 66718 - protein, 14 aa, Homo sapiens
  heavy chain complementarity determining region 3 for antibody 33359
ARDCSSDWYEGMDV

SEQ ID NO: 66719 - protein, 10 aa, Homo sapiens
  light chain complementarity determining region 3 for antibody 33360
QQRGTWPPIT

SEQ ID NO: 66720 - protein, 18 aa, Homo sapiens
  heavy chain complementarity determining region 3 for antibody 33360
ATGKWFGDFNFYYYAMDV

SEQ ID NO: 66721 - protein, 10 aa, Homo sapiens
  light chain complementarity determining region 3 for antibody 33361
QQRGKWPEIS

SEQ ID NO: 66722 - protein, 14 aa, Homo sapiens
  heavy chain complementarity determining region 3 for antibody 33361
AKDHDSNISGFGDL

SEQ ID NO: 66723 - protein, 8 aa, Homo sapiens
  light chain complementarity determining region 3 for antibody 33362
QQLNSPLT

SEQ ID NO: 66724 - protein, 18 aa, Homo sapiens
  heavy chain complementarity determining region 3 for antibody 33362
ARDGGYYVSGSYYTFFDY

SEQ ID NO: 66725 - protein, 8 aa, Homo sapiens
  light chain complementarity determining region 3 for antibody 33363
QQLHSYPS

SEQ ID NO: 66726 - protein, 15 aa, Homo sapiens
  heavy chain complementarity determining region 3 for antibody 33363
ARRLDGSGDDDVFDI

SEQ ID NO: 66727 - protein, 9 aa, Homo sapiens
  light chain complementarity determining region 3 for antibody 33364
QQFSSYPLT

SEQ ID NO: 66728 - protein, 25 aa, Homo sapiens
  heavy chain complementarity determining region 3 for antibody 33364
ARRGVSRLVFAPAAVPRGGNYGMDV

SEQ ID NO: 66729 - protein, 9 aa, Homo sapiens
  light chain complementarity determining region 3 for antibody 33365
QQDGSSPRT

SEQ ID NO: 66730 - protein, 17 aa, Homo sapiens
  heavy chain complementarity determining region 3 for antibody 33365
ARALDIVVVVDAIWFDP

SEQ ID NO: 66731 - protein, 9 aa, Homo sapiens
  light chain complementarity determining region 3 for antibody 33366
QKYSSAPLT

SEQ ID NO: 66732 - protein, 14 aa, Homo sapiens
  heavy chain complementarity determining region 3 for antibody 33366
ARERGVMTTLLLVY

SEQ ID NO: 66733 - protein, 8 aa, Homo sapiens
  light chain complementarity determining region 3 for antibody 33367
MQSTQWPT

SEQ ID NO: 66734 - protein, 21 aa, Homo sapiens
  heavy chain complementarity determining region 3 for antibody 33367
AKDRPNYYGTNAGYYTPGGDL

SEQ ID NO: 66735 - protein, 8 aa, Homo sapiens
  light chain complementarity determining region 3 for antibody 33368
MQALQTPT

SEQ ID NO: 66736 - protein, 16 aa, Homo sapiens
  heavy chain complementarity determining region 3 for antibody 33368
ARAFWSGYLRSGGMDV

SEQ ID NO: 66737 - protein, 9 aa, Homo sapiens
  light chain complementarity determining region 3 for antibody 33369
LQFESVPLT

SEQ ID NO: 66738 - protein, 18 aa, Homo sapiens
  heavy chain complementarity determining region 3 for antibody 33369
VRGGRDSQGPLGYYGLGV

SEQ ID NO: 66739 - protein, 9 aa, Homo sapiens
  light chain complementarity determining region 3 for antibody 33370
HSYHSDRFS

SEQ ID NO: 66740 - protein, 13 aa, Homo sapiens
  heavy chain complementarity determining region 3 for antibody 33370
ARAPDTADDPFDI

SEQ ID NO: 66741 - protein, 9 aa, Homo sapiens
  light chain complementarity determining region 3 for antibody 33371
HQYATSPLT

SEQ ID NO: 66742 - protein, 10 aa, Homo sapiens
  heavy chain complementarity determining region 3 for antibody 33371
AGGGGWLTHC

SEQ ID NO: 66743 - protein, 9 aa, Homo sapiens
  light chain complementarity determining region 3 for antibody 33372
QQYYRTPYT

SEQ ID NO: 66744 - protein, 15 aa, Homo sapiens
  heavy chain complementarity determining region 3 for antibody 33372
VRDAGGWGYDWHFDL

SEQ ID NO: 66745 - protein, 9 aa, Homo sapiens
  light chain complementarity determining region 3 for antibody 33373
QQYNTFPWT

SEQ ID NO: 66746 - protein, 13 aa, Homo sapiens
  heavy chain complementarity determining region 3 for antibody 33373
ATGEFGDERSLDY

SEQ ID NO: 66747 - protein, 9 aa, Homo sapiens
  light chain complementarity determining region 3 for antibody 33374
QQYNSYSRT

SEQ ID NO: 66748 - protein, 18 aa, Homo sapiens
  heavy chain complementarity determining region 3 for antibody 33374
ARIRGWGFGGKVYYGMDV

SEQ ID NO: 66749 - protein, 9 aa, Homo sapiens
  light chain complementarity determining region 3 for antibody 33375
QQYNSYSQT

SEQ ID NO: 66750 - protein, 14 aa, Homo sapiens
  heavy chain complementarity determining region 3 for antibody 33375
TTHLDYCPSSSCVY

SEQ ID NO: 66751 - protein, 8 aa, Homo sapiens
  light chain complementarity determining region 3 for antibody 33376
QQYNSYRT

SEQ ID NO: 66752 - protein, 14 aa, Homo sapiens
  heavy chain complementarity determining region 3 for antibody 33376
ARLGCFRDHHGMDV

SEQ ID NO: 66753 - protein, 9 aa, Homo sapiens
  light chain complementarity determining region 3 for antibody 33377
QQYNSYPYT

SEQ ID NO: 66754 - protein, 14 aa, Homo sapiens
  heavy chain complementarity determining region 3 for antibody 33377
IGQDCSGRACDYPR

SEQ ID NO: 66755 - protein, 9 aa, Homo sapiens
  light chain complementarity determining region 3 for antibody 33378
QQYNSYPLT

SEQ ID NO: 66756 - protein, 18 aa, Homo sapiens
  heavy chain complementarity determining region 3 for antibody 33378
AKEYSSGCYPPFGYGMDV

SEQ ID NO: 66757 - protein, 9 aa, Homo sapiens
  light chain complementarity determining region 3 for antibody 33379
QQYNNWPRT

SEQ ID NO: 66758 - protein, 13 aa, Homo sapiens
  heavy chain complementarity determining region 3 for antibody 33379
AKAGGWGGGVLDY

SEQ ID NO: 66759 - protein, 10 aa, Homo sapiens
  light chain complementarity determining region 3 for antibody 33380
QQYNNWPPGT

SEQ ID NO: 66760 - protein, 14 aa, Homo sapiens
  heavy chain complementarity determining region 3 for antibody 33380
AKGIGYGDYVPFDY

SEQ ID NO: 66761 - protein, 10 aa, Homo sapiens
  light chain complementarity determining region 3 for antibody 33381
QQYNNPLGVT

SEQ ID NO: 66762 - protein, 16 aa, Homo sapiens
  heavy chain complementarity determining region 3 for antibody 33381
ARDRGSVLEPQHVYDV

SEQ ID NO: 66763 - protein, 9 aa, Homo sapiens
  light chain complementarity determining region 3 for antibody 33382
QQYGTSPLN

SEQ ID NO: 66764 - protein, 13 aa, Homo sapiens
  heavy chain complementarity determining region 3 for antibody 33382
ASISVGTVAAGKV

SEQ ID NO: 66765 - protein, 9 aa, Homo sapiens
  light chain complementarity determining region 3 for antibody 33383
QQYGSSSIT

SEQ ID NO: 66766 - protein, 13 aa, Homo sapiens
  heavy chain complementarity determining region 3 for antibody 33383
VKEFFMVFDAFHM

SEQ ID NO: 66767 - protein, 8 aa, Homo sapiens
  light chain complementarity determining region 3 for antibody 33384
QQYGSSPS

SEQ ID NO: 66768 - protein, 14 aa, Homo sapiens
  heavy chain complementarity determining region 3 for antibody 33384
ARGGSSGYNHQFDY

SEQ ID NO: 66769 - protein, 9 aa, Homo sapiens
  light chain complementarity determining region 3 for antibody 33385
QQYGSSPRT

SEQ ID NO: 66770 - protein, 19 aa, Homo sapiens
  heavy chain complementarity determining region 3 for antibody 33385
ARDLSGRGDGYSNGWYPHI

SEQ ID NO: 66771 - protein, 10 aa, Homo sapiens
  light chain complementarity determining region 3 for antibody 33386
QQYGSSPPLT

SEQ ID NO: 66772 - protein, 17 aa, Homo sapiens
  heavy chain complementarity determining region 3 for antibody 33386
ARGPCSTTCARAVDFDY

SEQ ID NO: 66773 - protein, 9 aa, Homo sapiens
  light chain complementarity determining region 3 for antibody 33387
QQYGDSPYT

SEQ ID NO: 66774 - protein, 22 aa, Homo sapiens
  heavy chain complementarity determining region 3 for antibody 33387
ARNTIQWSGAFSRKKKSYGLDV

SEQ ID NO: 66775 - protein, 9 aa, Homo sapiens
  light chain complementarity determining region 3 for antibody 33388
QQYDSYPLS

SEQ ID NO: 66776 - protein, 14 aa, Homo sapiens
  heavy chain complementarity determining region 3 for antibody 33388
ARLGCFRDHYGMDV

SEQ ID NO: 66777 - protein, 9 aa, Homo sapiens
  light chain complementarity determining region 3 for antibody 33389
QQTYSTPGT

SEQ ID NO: 66778 - protein, 14 aa, Homo sapiens
  heavy chain complementarity determining region 3 for antibody 33389
VRLTLAEEGHALDS

SEQ ID NO: 66779 - protein, 9 aa, Homo sapiens
  light chain complementarity determining region 3 for antibody 33390
QQSYSTQWT

SEQ ID NO: 66780 - protein, 23 aa, Homo sapiens
  heavy chain complementarity determining region 3 for antibody 33390
ARLSRDPIAVRTAPLNYYFAMDV

SEQ ID NO: 66781 - protein, 9 aa, Homo sapiens
  light chain complementarity determining region 3 for antibody 33391
QQSYSTPYT

SEQ ID NO: 66782 - protein, 17 aa, Homo sapiens
  heavy chain complementarity determining region 3 for antibody 33391
TTEQISNDYYDSGAFDY

SEQ ID NO: 66783 - protein, 9 aa, Homo sapiens
  light chain complementarity determining region 3 for antibody 33392
QQSYSTPYT

SEQ ID NO: 66784 - protein, 14 aa, Homo sapiens
  heavy chain complementarity determining region 3 for antibody 33392
ATNGLLWSEGTGDF

SEQ ID NO: 66785 - protein, 9 aa, Homo sapiens
  light chain complementarity determining region 3 for antibody 33393
QQSYSTPWT

SEQ ID NO: 66786 - protein, 20 aa, Homo sapiens
  heavy chain complementarity determining region 3 for antibody 33393
ARPWSVAAAGHSLAIDAFDI

SEQ ID NO: 66787 - protein, 9 aa, Homo sapiens
  light chain complementarity determining region 3 for antibody 33394
QQSYSTPRT

SEQ ID NO: 66788 - protein, 22 aa, Homo sapiens
  heavy chain complementarity determining region 3 for antibody 33394
ARDHKLRLGELSLYAHYYGMDV

SEQ ID NO: 66789 - protein, 9 aa, Homo sapiens
  light chain complementarity determining region 3 for antibody 33395
QQSYSTPQT

SEQ ID NO: 66790 - protein, 19 aa, Homo sapiens
  heavy chain complementarity determining region 3 for antibody 33395
AKEHSPFSLIAVEGFDFDY

SEQ ID NO: 66791 - protein, 10 aa, Homo sapiens
  light chain complementarity determining region 3 for antibody 33396
QQSYSTPMVT

SEQ ID NO: 66792 - protein, 9 aa, Homo sapiens
  heavy chain complementarity determining region 3 for antibody 33396
ARGHNGWGD

SEQ ID NO: 66793 - protein, 9 aa, Homo sapiens
  light chain complementarity determining region 3 for antibody 33397
QQSYSTPFT

SEQ ID NO: 66794 - protein, 14 aa, Homo sapiens
  heavy chain complementarity determining region 3 for antibody 33397
AKSLMSISVAATDY

SEQ ID NO: 66795 - protein, 9 aa, Homo sapiens
  light chain complementarity determining region 3 for antibody 33398
QQSYSIPFT

SEQ ID NO: 66796 - protein, 15 aa, Homo sapiens
  heavy chain complementarity determining region 3 for antibody 33398
ARGGDSSGYHAPSDY

SEQ ID NO: 66797 - protein, 9 aa, Homo sapiens
  light chain complementarity determining region 3 for antibody 33399
QQSFSTPWT

SEQ ID NO: 66798 - protein, 18 aa, Homo sapiens
  heavy chain complementarity determining region 3 for antibody 33399
ARLNENYHDSGGYYSFDS

SEQ ID NO: 66799 - protein, 9 aa, Homo sapiens
  light chain complementarity determining region 3 for antibody 33400
QQSATSPPT

SEQ ID NO: 66800 - protein, 8 aa, Homo sapiens
  heavy chain complementarity determining region 3 for antibody 33400
ARDSPPGI

SEQ ID NO: 66801 - protein, 11 aa, Homo sapiens
  light chain complementarity determining region 3 for antibody 33401
QQRSTWPPAFT

SEQ ID NO: 66802 - protein, 13 aa, Homo sapiens
  heavy chain complementarity determining region 3 for antibody 33401
AHRRLVQLGAFDI

SEQ ID NO: 66803 - protein, 10 aa, Homo sapiens
  light chain complementarity determining region 3 for antibody 33402
QQRSNWTGIT

SEQ ID NO: 66804 - protein, 14 aa, Homo sapiens
  heavy chain complementarity determining region 3 for antibody 33402
VRDSSSWYVKYFQH

SEQ ID NO: 66805 - protein, 8 aa, Homo sapiens
  light chain complementarity determining region 3 for antibody 33403
QQRSNWLT

SEQ ID NO: 66806 - protein, 13 aa, Homo sapiens
  heavy chain complementarity determining region 3 for antibody 33403
ATLVIHPTPFSDY

SEQ ID NO: 66807 - protein, 9 aa, Homo sapiens
  light chain complementarity determining region 3 for antibody 33404
QQLKSYPRT

SEQ ID NO: 66808 - protein, 19 aa, Homo sapiens
  heavy chain complementarity determining region 3 for antibody 33404
ARDWGTEVTAGVWIGWFDP

SEQ ID NO: 66809 - protein, 9 aa, Homo sapiens
  light chain complementarity determining region 3 for antibody 33405
QQHFTTPPT

SEQ ID NO: 66810 - protein, 18 aa, Homo sapiens
  heavy chain complementarity determining region 3 for antibody 33405
ARMRVSMVRGVISAWFDS

SEQ ID NO: 66811 - protein, 9 aa, Homo sapiens
  light chain complementarity determining region 3 for antibody 33406
QQFKDYPLT

SEQ ID NO: 66812 - protein, 10 aa, Homo sapiens
  heavy chain complementarity determining region 3 for antibody 33406
ARDPYGRGGY

SEQ ID NO: 66813 - protein, 10 aa, Homo sapiens
  light chain complementarity determining region 3 for antibody 33407
QQDGSSPMYS

SEQ ID NO: 66814 - protein, 11 aa, Homo sapiens
  heavy chain complementarity determining region 3 for antibody 33407
ARGGQWGSLDY

SEQ ID NO: 66815 - protein, 9 aa, Homo sapiens
  light chain complementarity determining region 3 for antibody 33408
QKYNSAPRT

SEQ ID NO: 66816 - protein, 13 aa, Homo sapiens
  heavy chain complementarity determining region 3 for antibody 33408
ARDLGDHRGAFDI

SEQ ID NO: 66817 - protein, 9 aa, Homo sapiens
  light chain complementarity determining region 3 for antibody 33409
QKYNSAPLT

SEQ ID NO: 66818 - protein, 17 aa, Homo sapiens
  heavy chain complementarity determining region 3 for antibody 33409
IPVMLVRFLEDLQLFNY

SEQ ID NO: 66819 - protein, 9 aa, Homo sapiens
  light chain complementarity determining region 3 for antibody 33410
QHYYERPLT

SEQ ID NO: 66820 - protein, 15 aa, Homo sapiens
  heavy chain complementarity determining region 3 for antibody 33410
AREVIAVGDSDAFDI

SEQ ID NO: 66821 - protein, 10 aa, Homo sapiens
  light chain complementarity determining region 3 for antibody 33411
QHYGDAPTWT

SEQ ID NO: 66822 - protein, 18 aa, Homo sapiens
  heavy chain complementarity determining region 3 for antibody 33411
ARGGQYMVRGAIIETGDY

SEQ ID NO: 66823 - protein, 10 aa, Homo sapiens
  light chain complementarity determining region 3 for antibody 33412
QHWVSSPAYP

SEQ ID NO: 66824 - protein, 12 aa, Homo sapiens
  heavy chain complementarity determining region 3 for antibody 33412
ARETTQFGELDN

SEQ ID NO: 66825 - protein, 9 aa, Homo sapiens
  light chain complementarity determining region 3 for antibody 33413
MQSLQTPRT

SEQ ID NO: 66826 - protein, 30 aa, Homo sapiens
  heavy chain complementarity determining region 3 for antibody 33413
ARGRTRTLPFIDKFGSGTNKPQPEVEWFDP

SEQ ID NO: 66827 - protein, 9 aa, Homo sapiens
  light chain complementarity determining region 3 for antibody 33414
MQGLQTPDT

SEQ ID NO: 66828 - protein, 10 aa, Homo sapiens
  heavy chain complementarity determining region 3 for antibody 33414
ARDVVGSDDQ

SEQ ID NO: 66829 - protein, 9 aa, Homo sapiens
  light chain complementarity determining region 3 for antibody 33415
MQGAHWPPT

SEQ ID NO: 66830 - protein, 13 aa, Homo sapiens
  heavy chain complementarity determining region 3 for antibody 33415
LRASRDGYNSIDY

SEQ ID NO: 66831 - protein, 9 aa, Homo sapiens
  light chain complementarity determining region 3 for antibody 33416
MQALQTPLT

SEQ ID NO: 66832 - protein, 14 aa, Homo sapiens
  heavy chain complementarity determining region 3 for antibody 33416
VKTLSPGGAYFFDS

SEQ ID NO: 66833 - protein, 9 aa, Homo sapiens
  light chain complementarity determining region 3 for antibody 33417
LQGNRFPHT

SEQ ID NO: 66834 - protein, 14 aa, Homo sapiens
  heavy chain complementarity determining region 3 for antibody 33417
ARYCSGSSCYSMDH

SEQ ID NO: 66835 - protein, 9 aa, Homo sapiens
  light chain complementarity determining region 3 for antibody 33418
LHDYGYPRT

SEQ ID NO: 66836 - protein, 12 aa, Homo sapiens
  heavy chain complementarity determining region 3 for antibody 33418
ATVHISGYFFDF

SEQ ID NO: 66837 - protein, 9 aa, Homo sapiens
  light chain complementarity determining region 3 for antibody 33419
HQYGSSPRT

SEQ ID NO: 66838 - protein, 18 aa, Homo sapiens
  heavy chain complementarity determining region 3 for antibody 33419
AKGAIWIEEGRRDYGMDV

SEQ ID NO: 66839 - protein, 8 aa, Homo sapiens
  light chain complementarity determining region 3 for antibody 33420
HEYGSSRT

SEQ ID NO: 66840 - protein, 20 aa, Homo sapiens
  heavy chain complementarity determining region 3 for antibody 33420
ARDRRDCSGGSCYSEWYFDL

SEQ ID NO: 66841 - protein, 11 aa, Homo sapiens
  light chain complementarity determining region 3 for antibody 33421
RKYGTAPPGIA

SEQ ID NO: 66842 - protein, 12 aa, Homo sapiens
  heavy chain complementarity determining region 3 for antibody 33421
AKKIGNFDVFDV

SEQ ID NO: 66843 - protein, 8 aa, Homo sapiens
  light chain complementarity determining region 3 for antibody 33422
QYRRSPST

SEQ ID NO: 66844 - protein, 17 aa, Homo sapiens
  heavy chain complementarity determining region 3 for antibody 33422
AGLSSRLGDGSPSLFDY

SEQ ID NO: 66845 - protein, 9 aa, Homo sapiens
  light chain complementarity determining region 3 for antibody 33423
QTYNTAPFT

SEQ ID NO: 66846 - protein, 15 aa, Homo sapiens
  heavy chain complementarity determining region 3 for antibody 33423
ARDQGPYSSDWSFDQ

SEQ ID NO: 66847 - protein, 9 aa, Homo sapiens
  light chain complementarity determining region 3 for antibody 33424
QQYYSPSKT

SEQ ID NO: 66848 - protein, 16 aa, Homo sapiens
  heavy chain complementarity determining region 3 for antibody 33424
ARDLRGQWLGGDVFDV

SEQ ID NO: 66849 - protein, 9 aa, Homo sapiens
  light chain complementarity determining region 3 for antibody 33425
QQYRGDPYS

SEQ ID NO: 66850 - protein, 20 aa, Homo sapiens
  heavy chain complementarity determining region 3 for antibody 33425
ARDVDYCENGVCYSYWYFDL

SEQ ID NO: 66851 - protein, 9 aa, Homo sapiens
  light chain complementarity determining region 3 for antibody 33426
QQYNYYPFT

SEQ ID NO: 66852 - protein, 11 aa, Homo sapiens
  heavy chain complementarity determining region 3 for antibody 33426
AQGRLVFLTDY

SEQ ID NO: 66853 - protein, 9 aa, Homo sapiens
  light chain complementarity determining region 3 for antibody 33427
QQYNSFPWT

SEQ ID NO: 66854 - protein, 12 aa, Homo sapiens
  heavy chain complementarity determining region 3 for antibody 33427
VRHGVVTAEHDS

SEQ ID NO: 66855 - protein, 10 aa, Homo sapiens
  light chain complementarity determining region 3 for antibody 33428
QQYNNWPRPT

SEQ ID NO: 66856 - protein, 16 aa, Homo sapiens
  heavy chain complementarity determining region 3 for antibody 33428
ARGYCSGRSCYKAFDI

SEQ ID NO: 66857 - protein, 12 aa, Homo sapiens
  light chain complementarity determining region 3 for antibody 33429
QQYNNWPPRPLT

SEQ ID NO: 66858 - protein, 13 aa, Homo sapiens
  heavy chain complementarity determining region 3 for antibody 33429
ASRPSGTYGPFNY

SEQ ID NO: 66859 - protein, 9 aa, Homo sapiens
  light chain complementarity determining region 3 for antibody 33430
QQYNNWPLT

SEQ ID NO: 66860 - protein, 13 aa, Homo sapiens
  heavy chain complementarity determining region 3 for antibody 33430
ARDSTAVSGTFDS

SEQ ID NO: 66861 - protein, 9 aa, Homo sapiens
  light chain complementarity determining region 3 for antibody 33431
QQYNNWPLT

SEQ ID NO: 66862 - protein, 15 aa, Homo sapiens
  heavy chain complementarity determining region 3 for antibody 33431
AHRAAETNPWYGMDV

SEQ ID NO: 66863 - protein, 10 aa, Homo sapiens
  light chain complementarity determining region 3 for antibody 33432
QQYNNRPPWT

SEQ ID NO: 66864 - protein, 12 aa, Homo sapiens
  heavy chain complementarity determining region 3 for antibody 33432
ARHRGMDDALDL

SEQ ID NO: 66865 - protein, 10 aa, Homo sapiens
  light chain complementarity determining region 3 for antibody 33433
QQYNIWPPFT

SEQ ID NO: 66866 - protein, 17 aa, Homo sapiens
  heavy chain complementarity determining region 3 for antibody 33433
ASRRYCSTTRCWRAFDY

SEQ ID NO: 66867 - protein, 9 aa, Homo sapiens
  light chain complementarity determining region 3 for antibody 33434
QQYLTYSRT

SEQ ID NO: 66868 - protein, 11 aa, Homo sapiens
  heavy chain complementarity determining region 3 for antibody 33434
ARAAFSWYFDL

SEQ ID NO: 66869 - protein, 9 aa, Homo sapiens
  light chain complementarity determining region 3 for antibody 33435
QQYGSSPRT

SEQ ID NO: 66870 - protein, 16 aa, Homo sapiens
  heavy chain complementarity determining region 3 for antibody 33435
ARDRGSSGWHWGFFDS

SEQ ID NO: 66871 - protein, 10 aa, Homo sapiens
  light chain complementarity determining region 3 for antibody 33436
QQYGSSPPYT

SEQ ID NO: 66872 - protein, 13 aa, Homo sapiens
  heavy chain complementarity determining region 3 for antibody 33436
ATSGSGANHALDF

SEQ ID NO: 66873 - protein, 9 aa, Homo sapiens
  light chain complementarity determining region 3 for antibody 33437
QQYGRSPLT

SEQ ID NO: 66874 - protein, 14 aa, Homo sapiens
  heavy chain complementarity determining region 3 for antibody 33437
AKDRRVAGDWYFDL

SEQ ID NO: 66875 - protein, 9 aa, Homo sapiens
  light chain complementarity determining region 3 for antibody 33438
QQYDSWPYT

SEQ ID NO: 66876 - protein, 13 aa, Homo sapiens
  heavy chain complementarity determining region 3 for antibody 33438
ARGNGGSDGSDWL

SEQ ID NO: 66877 - protein, 11 aa, Homo sapiens
  light chain complementarity determining region 3 for antibody 33439
QQYDNLPPMYT

SEQ ID NO: 66878 - protein, 10 aa, Homo sapiens
  heavy chain complementarity determining region 3 for antibody 33439
ARASRGWLDP

SEQ ID NO: 66879 - protein, 9 aa, Homo sapiens
  light chain complementarity determining region 3 for antibody 33440
QQYDNLPLT

SEQ ID NO: 66880 - protein, 15 aa, Homo sapiens
  heavy chain complementarity determining region 3 for antibody 33440
ARDRKDADYDDAFDV

SEQ ID NO: 66881 - protein, 9 aa, Homo sapiens
  light chain complementarity determining region 3 for antibody 33441
QQYDNALFT

SEQ ID NO: 66882 - protein, 17 aa, Homo sapiens
  heavy chain complementarity determining region 3 for antibody 33441
TTDRDCSSTNCPGAFEF

SEQ ID NO: 66883 - protein, 9 aa, Homo sapiens
  light chain complementarity determining region 3 for antibody 33442
QQTFTTPLT

SEQ ID NO: 66884 - protein, 18 aa, Homo sapiens
  heavy chain complementarity determining region 3 for antibody 33442
ARDREHSGSRYQPGVVDI

SEQ ID NO: 66885 - protein, 9 aa, Homo sapiens
  light chain complementarity determining region 3 for antibody 33443
QQSYSTPRT

SEQ ID NO: 66886 - protein, 20 aa, Homo sapiens
  heavy chain complementarity determining region 3 for antibody 33443
ARPRGVSHLATAGSPDYFDL

SEQ ID NO: 66887 - protein, 9 aa, Homo sapiens
  light chain complementarity determining region 3 for antibody 33444
QQSYSDFYT

SEQ ID NO: 66888 - protein, 18 aa, Homo sapiens
  heavy chain complementarity determining region 3 for antibody 33444
AREVHGSGSHVTADYFQH

SEQ ID NO: 66889 - protein, 9 aa, Homo sapiens
  light chain complementarity determining region 3 for antibody 33445
QQSYNSPFT

SEQ ID NO: 66890 - protein, 15 aa, Homo sapiens
  heavy chain complementarity determining region 3 for antibody 33445
ARDSTEEGATPRLDQ

SEQ ID NO: 66891 - protein, 8 aa, Homo sapiens
  light chain complementarity determining region 3 for antibody 33446
QQSHNSYT

SEQ ID NO: 66892 - protein, 15 aa, Homo sapiens
  heavy chain complementarity determining region 3 for antibody 33446
AKDQLCSGGSCPFDY

SEQ ID NO: 66893 - protein, 9 aa, Homo sapiens
  light chain complementarity determining region 3 for antibody 33447
QQRGNWPIT

SEQ ID NO: 66894 - protein, 15 aa, Homo sapiens
  heavy chain complementarity determining region 3 for antibody 33447
ARDQYRIGESNYFDF

SEQ ID NO: 66895 - protein, 10 aa, Homo sapiens
  light chain complementarity determining region 3 for antibody 33448
QQNVNFVAYT

SEQ ID NO: 66896 - protein, 12 aa, Homo sapiens
  heavy chain complementarity determining region 3 for antibody 33448
AREMTNLGELDY

SEQ ID NO: 66897 - protein, 9 aa, Homo sapiens
  light chain complementarity determining region 3 for antibody 33449
QHSNSRPFT

SEQ ID NO: 66898 - protein, 20 aa, Homo sapiens
  heavy chain complementarity determining region 3 for antibody 33449
AKGIAVAALRTVYYYYGMDV

SEQ ID NO: 66899 - protein, 9 aa, Homo sapiens
  light chain complementarity determining region 3 for antibody 33450
QHFTHFPYG

SEQ ID NO: 66900 - protein, 13 aa, Homo sapiens
  heavy chain complementarity determining region 3 for antibody 33450
AGGLRTGYYGLDA

SEQ ID NO: 66901 - protein, 9 aa, Homo sapiens
  light chain complementarity determining region 3 for antibody 33451
MQGLQTPYT

SEQ ID NO: 66902 - protein, 10 aa, Homo sapiens
  heavy chain complementarity determining region 3 for antibody 33451
ARDVVGSDDH

SEQ ID NO: 66903 - protein, 8 aa, Homo sapiens
  light chain complementarity determining region 3 for antibody 33452
MQALQTPP

SEQ ID NO: 66904 - protein, 15 aa, Homo sapiens
  heavy chain complementarity determining region 3 for antibody 33452
TADRGDSSRWYGMAV

SEQ ID NO: 66905 - protein, 9 aa, Homo sapiens
  light chain complementarity determining region 3 for antibody 33453
LQYYNYPIT

SEQ ID NO: 66906 - protein, 19 aa, Homo sapiens
  heavy chain complementarity determining region 3 for antibody 33453
ARQGVAAGLKFYYYYAMDV

SEQ ID NO: 66907 - protein, 9 aa, Homo sapiens
  light chain complementarity determining region 3 for antibody 33454
LQYKSYPRT

SEQ ID NO: 66908 - protein, 6 aa, Homo sapiens
  heavy chain complementarity determining region 3 for antibody 33454
TRALDY

SEQ ID NO: 66909 - protein, 9 aa, Homo sapiens
  light chain complementarity determining region 3 for antibody 33455
LQSIHWPWT

SEQ ID NO: 66910 - protein, 11 aa, Homo sapiens
  heavy chain complementarity determining region 3 for antibody 33455
ARFERRKPGPH

SEQ ID NO: 66911 - protein, 9 aa, Homo sapiens
  light chain complementarity determining region 3 for antibody 33456
HQYGTSPWG

SEQ ID NO: 66912 - protein, 13 aa, Homo sapiens
  heavy chain complementarity determining region 3 for antibody 33456
VRGGRQFVHDLQD

SEQ ID NO: 66913 - protein, 9 aa, Homo sapiens
  light chain complementarity determining region 3 for antibody 33457
HQSYSTPWT

SEQ ID NO: 66914 - protein, 8 aa, Homo sapiens
  heavy chain complementarity determining region 3 for antibody 33457
ARRYYFDY

SEQ ID NO: 66915 - protein, 9 aa, Homo sapiens
  light chain complementarity determining region 3 for antibody 33458
FQALQTGFT

SEQ ID NO: 66916 - protein, 12 aa, Homo sapiens
  heavy chain complementarity determining region 3 for antibody 33458
ARLQTGSLGMDV

SEQ ID NO: 66917 - protein, 9 aa, Homo sapiens
  light chain complementarity determining region 3 for antibody 33459
EQYHNWPPT

SEQ ID NO: 66918 - protein, 19 aa, Homo sapiens
  heavy chain complementarity determining region 3 for antibody 33459
TKNRAPSSFWSGLGDAFDT

SEQ ID NO: 66919 - protein, 9 aa, Homo sapiens
  light chain complementarity determining region 3 for antibody 33460
QQYYTTPRP

SEQ ID NO: 66920 - protein, 8 aa, Homo sapiens
  heavy chain complementarity determining region 3 for antibody 33460
ARDGAFDS

SEQ ID NO: 66921 - protein, 9 aa, Homo sapiens
  light chain complementarity determining region 3 for antibody 33461
QQYYRYPVT

SEQ ID NO: 66922 - protein, 15 aa, Homo sapiens
  heavy chain complementarity determining region 3 for antibody 33461
AHGQHTTTVTSYFNF

SEQ ID NO: 66923 - protein, 9 aa, Homo sapiens
  light chain complementarity determining region 3 for antibody 33462
QQYYRAPIT

SEQ ID NO: 66924 - protein, 21 aa, Homo sapiens
  heavy chain complementarity determining region 3 for antibody 33462
ARDRVAFPTGAWYEKLDCLDY

SEQ ID NO: 66925 - protein, 9 aa, Homo sapiens
  light chain complementarity determining region 3 for antibody 33463
QQYVSSPYT

SEQ ID NO: 66926 - protein, 14 aa, Homo sapiens
  heavy chain complementarity determining region 3 for antibody 33463
ARVGLYSSGEIFDY

SEQ ID NO: 66927 - protein, 9 aa, Homo sapiens
  light chain complementarity determining region 3 for antibody 33464
QQYSNSPLT

SEQ ID NO: 66928 - protein, 19 aa, Homo sapiens
  heavy chain complementarity determining region 3 for antibody 33464
ARQGVAAGLKFYYYYAMDV

SEQ ID NO: 66929 - protein, 9 aa, Homo sapiens
  light chain complementarity determining region 3 for antibody 33465
QQYNSYSYT

SEQ ID NO: 66930 - protein, 13 aa, Homo sapiens
  heavy chain complementarity determining region 3 for antibody 33465
ARISSTWPPLFDY

SEQ ID NO: 66931 - protein, 9 aa, Homo sapiens
  light chain complementarity determining region 3 for antibody 33466
QQYNSYPYT

SEQ ID NO: 66932 - protein, 16 aa, Homo sapiens
  heavy chain complementarity determining region 3 for antibody 33466
ARSRGSSGYQWGAFDL

SEQ ID NO: 66933 - protein, 9 aa, Homo sapiens
  light chain complementarity determining region 3 for antibody 33467
QQYKSYPVT

SEQ ID NO: 66934 - protein, 12 aa, Homo sapiens
  heavy chain complementarity determining region 3 for antibody 33467
VRVKMQLWFLDY

SEQ ID NO: 66935 - protein, 9 aa, Homo sapiens
  light chain complementarity determining region 3 for antibody 33468
QQYGTSPWT

SEQ ID NO: 66936 - protein, 19 aa, Homo sapiens
  heavy chain complementarity determining region 3 for antibody 33468
VRDAGKWSSRYYFRNYFDF

SEQ ID NO: 66937 - protein, 9 aa, Homo sapiens
  light chain complementarity determining region 3 for antibody 33469
QQYGSSPYT

SEQ ID NO: 66938 - protein, 15 aa, Homo sapiens
  heavy chain complementarity determining region 3 for antibody 33469
ATSGTGSTINWYFDL

SEQ ID NO: 66939 - protein, 9 aa, Homo sapiens
  light chain complementarity determining region 3 for antibody 33470
QQYGSSPRT

SEQ ID NO: 66940 - protein, 13 aa, Homo sapiens
  heavy chain complementarity determining region 3 for antibody 33470
AGGQYLDWAPFAD

SEQ ID NO: 66941 - protein, 10 aa, Homo sapiens
  light chain complementarity determining region 3 for antibody 33471
QQYGGSPPIT

SEQ ID NO: 66942 - protein, 18 aa, Homo sapiens
  heavy chain complementarity determining region 3 for antibody 33471
ARGRKSHFGNVGYFSFQH

SEQ ID NO: 66943 - protein, 8 aa, Homo sapiens
  light chain complementarity determining region 3 for antibody 33472
QQYGGPPS

SEQ ID NO: 66944 - protein, 16 aa, Homo sapiens
  heavy chain complementarity determining region 3 for antibody 33472
ATDWGSGTQWIRAFDV

SEQ ID NO: 66945 - protein, 9 aa, Homo sapiens
  light chain complementarity determining region 3 for antibody 33473
QQYDRWPTT

SEQ ID NO: 66946 - protein, 15 aa, Homo sapiens
  heavy chain complementarity determining region 3 for antibody 33473
VRRLAAAGLHRGFDL

SEQ ID NO: 66947 - protein, 9 aa, Homo sapiens
  light chain complementarity determining region 3 for antibody 33474
QQYDNSLGT

SEQ ID NO: 66948 - protein, 11 aa, Homo sapiens
  heavy chain complementarity determining region 3 for antibody 33474
ARVGRVGFEFR

SEQ ID NO: 66949 - protein, 11 aa, Homo sapiens
  light chain complementarity determining region 3 for antibody 33475
QQYDKSRRGYT

SEQ ID NO: 66950 - protein, 14 aa, Homo sapiens
  heavy chain complementarity determining region 3 for antibody 33475
ARLRWLVDAQFFDF

SEQ ID NO: 66951 - protein, 9 aa, Homo sapiens
  light chain complementarity determining region 3 for antibody 33476
QQTYTTPWT

SEQ ID NO: 66952 - protein, 20 aa, Homo sapiens
  heavy chain complementarity determining region 3 for antibody 33476
ARSSNRDGLPVAGDPYYCDI

SEQ ID NO: 66953 - protein, 9 aa, Homo sapiens
  light chain complementarity determining region 3 for antibody 33477
QQSYSTPHT

SEQ ID NO: 66954 - protein, 23 aa, Homo sapiens
  heavy chain complementarity determining region 3 for antibody 33477
ARIESDATMVRGVIITKGNWFDP

SEQ ID NO: 66955 - protein, 9 aa, Homo sapiens
  light chain complementarity determining region 3 for antibody 33478
QQSYSRPIT

SEQ ID NO: 66956 - protein, 11 aa, Homo sapiens
  heavy chain complementarity determining region 3 for antibody 33478
ASLDFGESVDN

SEQ ID NO: 66957 - protein, 9 aa, Homo sapiens
  light chain complementarity determining region 3 for antibody 33479
QQSYSRFPT

SEQ ID NO: 66958 - protein, 18 aa, Homo sapiens
  heavy chain complementarity determining region 3 for antibody 33479
ARGYGSGSYFNYYYGMDV

SEQ ID NO: 66959 - protein, 9 aa, Homo sapiens
  light chain complementarity determining region 3 for antibody 33480
QQSYSLPLT

SEQ ID NO: 66960 - protein, 13 aa, Homo sapiens
  heavy chain complementarity determining region 3 for antibody 33480
AKARTGDSHHFDS

SEQ ID NO: 66961 - protein, 10 aa, Homo sapiens
  light chain complementarity determining region 3 for antibody 33481
QQSYSDLPFT

SEQ ID NO: 66962 - protein, 21 aa, Homo sapiens
  heavy chain complementarity determining region 3 for antibody 33481
ARDVKHYDSSGSYWPLDMFDM

SEQ ID NO: 66963 - protein, 10 aa, Homo sapiens
  light chain complementarity determining region 3 for antibody 33482
QQSYNTPPIT

SEQ ID NO: 66964 - protein, 24 aa, Homo sapiens
  heavy chain complementarity determining region 3 for antibody 33482
ARGRPPSGWYRLKDRTYYYYGLDV

SEQ ID NO: 66965 - protein, 8 aa, Homo sapiens
  light chain complementarity determining region 3 for antibody 33483
QQRSSWPT

SEQ ID NO: 66966 - protein, 26 aa, Homo sapiens
  heavy chain complementarity determining region 3 for antibody 33483
ARGVGARYYDLTASNPASRVYWFFDV

SEQ ID NO: 66967 - protein, 8 aa, Homo sapiens
  light chain complementarity determining region 3 for antibody 33484
QQRSDLIT

SEQ ID NO: 66968 - protein, 18 aa, Homo sapiens
  heavy chain complementarity determining region 3 for antibody 33484
GKASLGHCSGRNCYYLDS

SEQ ID NO: 66969 - protein, 9 aa, Homo sapiens
  light chain complementarity determining region 3 for antibody 33485
QQRKNWRIT

SEQ ID NO: 66970 - protein, 13 aa, Homo sapiens
  heavy chain complementarity determining region 3 for antibody 33485
ATDNFQGFGDFDS

SEQ ID NO: 66971 - protein, 9 aa, Homo sapiens
  light chain complementarity determining region 3 for antibody 33486
QQHYSIPRT

SEQ ID NO: 66972 - protein, 10 aa, Homo sapiens
  heavy chain complementarity determining region 3 for antibody 33486
AKDKTGYFDS

SEQ ID NO: 66973 - protein, 8 aa, Homo sapiens
  light chain complementarity determining region 3 for antibody 33487
QQHNDGWT

SEQ ID NO: 66974 - protein, 11 aa, Homo sapiens
  heavy chain complementarity determining region 3 for antibody 33487
AKESSTSVAEW

SEQ ID NO: 66975 - protein, 9 aa, Homo sapiens
  light chain complementarity determining region 3 for antibody 33488
QQAHSFPLT

SEQ ID NO: 66976 - protein, 19 aa, Homo sapiens
  heavy chain complementarity determining region 3 for antibody 33488
ARGGPVRFCVGVSCYLADY

SEQ ID NO: 66977 - protein, 9 aa, Homo sapiens
  light chain complementarity determining region 3 for antibody 33489
QKYNSGPLT

SEQ ID NO: 66978 - protein, 17 aa, Homo sapiens
  heavy chain complementarity determining region 3 for antibody 33489
ARERFYYGSGNYHPSDS

SEQ ID NO: 66979 - protein, 9 aa, Homo sapiens
  light chain complementarity determining region 3 for antibody 33490
QKYNSAPHT

SEQ ID NO: 66980 - protein, 15 aa, Homo sapiens
  heavy chain complementarity determining region 3 for antibody 33490
ARTMFQWFGAYGMDV

SEQ ID NO: 66981 - protein, 9 aa, Homo sapiens
  light chain complementarity determining region 3 for antibody 33491
QKYNIAPWT

SEQ ID NO: 66982 - protein, 8 aa, Homo sapiens
  heavy chain complementarity determining region 3 for antibody 33491
TSGHYGQY

SEQ ID NO: 66983 - protein, 10 aa, Homo sapiens
  light chain complementarity determining region 3 for antibody 33492
QHWVSSPANT

SEQ ID NO: 66984 - protein, 12 aa, Homo sapiens
  heavy chain complementarity determining region 3 for antibody 33492
ARETTQFGELDN

SEQ ID NO: 66985 - protein, 9 aa, Homo sapiens
  light chain complementarity determining region 3 for antibody 33493
MQVLHSPRT

SEQ ID NO: 66986 - protein, 11 aa, Homo sapiens
  heavy chain complementarity determining region 3 for antibody 33493
TRLIDRGSSDR

SEQ ID NO: 66987 - protein, 8 aa, Homo sapiens
  light chain complementarity determining region 3 for antibody 33494
MQSLQTLT

SEQ ID NO: 66988 - protein, 15 aa, Homo sapiens
  heavy chain complementarity determining region 3 for antibody 33494
STEYYDPLTGFWPPN

SEQ ID NO: 66989 - protein, 9 aa, Homo sapiens
  light chain complementarity determining region 3 for antibody 33495
MQGTVWPPT

SEQ ID NO: 66990 - protein, 13 aa, Homo sapiens
  heavy chain complementarity determining region 3 for antibody 33495
ARDPDRWHGSFDS

SEQ ID NO: 66991 - protein, 9 aa, Homo sapiens
  light chain complementarity determining region 3 for antibody 33496
MQGTHWPQT

SEQ ID NO: 66992 - protein, 18 aa, Homo sapiens
  heavy chain complementarity determining region 3 for antibody 33496
TRDLRIAMAGTDDNGMDA

SEQ ID NO: 66993 - protein, 9 aa, Homo sapiens
  light chain complementarity determining region 3 for antibody 33497
MQATYWPGT

SEQ ID NO: 66994 - protein, 11 aa, Homo sapiens
  heavy chain complementarity determining region 3 for antibody 33497
LSAVRGSSFDI

SEQ ID NO: 66995 - protein, 9 aa, Homo sapiens
  light chain complementarity determining region 3 for antibody 33498
MQALQTRLT

SEQ ID NO: 66996 - protein, 23 aa, Homo sapiens
  heavy chain complementarity determining region 3 for antibody 33498
VRVSQNLGECSGTSCYGINAFDP

SEQ ID NO: 66997 - protein, 9 aa, Homo sapiens
  light chain complementarity determining region 3 for antibody 33499
MQALQTPWT

SEQ ID NO: 66998 - protein, 11 aa, Homo sapiens
  heavy chain complementarity determining region 3 for antibody 33499
AQGRLVFLTDY

SEQ ID NO: 66999 - protein, 9 aa, Homo sapiens
  light chain complementarity determining region 3 for antibody 33500
MQALETPRT

SEQ ID NO: 67000 - protein, 12 aa, Homo sapiens
  heavy chain complementarity determining region 3 for antibody 33500
ARDVPTISRFDH

SEQ ID NO: 67001 - protein, 9 aa, Homo sapiens
  light chain complementarity determining region 3 for antibody 33501
LQNDYWPRT

SEQ ID NO: 67002 - protein, 11 aa, Homo sapiens
  heavy chain complementarity determining region 3 for antibody 33501
VRVGGAGYFDH

SEQ ID NO: 67003 - protein, 9 aa, Homo sapiens
  light chain complementarity determining region 3 for antibody 33502
LQHSISPRT

SEQ ID NO: 67004 - protein, 11 aa, Homo sapiens
  heavy chain complementarity determining region 3 for antibody 33502
TTGLGSGGINS

SEQ ID NO: 67005 - protein, 9 aa, Homo sapiens
  light chain complementarity determining region 3 for antibody 33503
LQHNSYPWT

SEQ ID NO: 67006 - protein, 25 aa, Homo sapiens
  heavy chain complementarity determining region 3 for antibody 33503
AGGQVRRPRLRDYDFWSVTSVAMDV

SEQ ID NO: 67007 - protein, 9 aa, Homo sapiens
  light chain complementarity determining region 3 for antibody 33504
LQHNSYPRT

SEQ ID NO: 67008 - protein, 24 aa, Homo sapiens
  heavy chain complementarity determining region 3 for antibody 33504
ARGRPPSGWYRLKDRTYYYYGLDV

SEQ ID NO: 67009 - protein, 9 aa, Homo sapiens
  light chain complementarity determining region 3 for antibody 33505
LQFDSLPLT

SEQ ID NO: 67010 - protein, 16 aa, Homo sapiens
  heavy chain complementarity determining region 3 for antibody 33505
AKGHHPQGEKVIRLDY

SEQ ID NO: 67011 - protein, 9 aa, Homo sapiens
  light chain complementarity determining region 3 for antibody 33506
QQYYSTPWT

SEQ ID NO: 67012 - protein, 15 aa, Homo sapiens
  heavy chain complementarity determining region 3 for antibody 33506
IRQSKVDGNYNYPDF

SEQ ID NO: 67013 - protein, 9 aa, Homo sapiens
  light chain complementarity determining region 3 for antibody 33507
QQYYSAPWT

SEQ ID NO: 67014 - protein, 17 aa, Homo sapiens
  heavy chain complementarity determining region 3 for antibody 33507
VKESWQWLVDYYYGMDV

SEQ ID NO: 67015 - protein, 9 aa, Homo sapiens
  light chain complementarity determining region 3 for antibody 33508
QQYNSYPWT

SEQ ID NO: 67016 - protein, 10 aa, Homo sapiens
  heavy chain complementarity determining region 3 for antibody 33508
ARYGDSGFDY

SEQ ID NO: 67017 - protein, 8 aa, Homo sapiens
  light chain complementarity determining region 3 for antibody 33509
QQYNNWLT

SEQ ID NO: 67018 - protein, 16 aa, Homo sapiens
  heavy chain complementarity determining region 3 for antibody 33509
ARGVTGYGYGHYYFDY

SEQ ID NO: 67019 - protein, 9 aa, Homo sapiens
  light chain complementarity determining region 3 for antibody 33510
QQYHSDPLT

SEQ ID NO: 67020 - protein, 10 aa, Homo sapiens
  heavy chain complementarity determining region 3 for antibody 33510
AGGTGWILDT

SEQ ID NO: 67021 - protein, 9 aa, Homo sapiens
  light chain complementarity determining region 3 for antibody 33511
QQYGTPPRT

SEQ ID NO: 67022 - protein, 16 aa, Homo sapiens
  heavy chain complementarity determining region 3 for antibody 33511
ARDTGGGWGEDNYFDP

SEQ ID NO: 67023 - protein, 8 aa, Homo sapiens
  light chain complementarity determining region 3 for antibody 33512
QQYGSSPT

SEQ ID NO: 67024 - protein, 25 aa, Homo sapiens
  heavy chain complementarity determining region 3 for antibody 33512
AWGGYCSGGSCYSGQRAYYYYGMDV

SEQ ID NO: 67025 - protein, 9 aa, Homo sapiens
  light chain complementarity determining region 3 for antibody 33513
QQYGSSPRT

SEQ ID NO: 67026 - protein, 17 aa, Homo sapiens
  heavy chain complementarity determining region 3 for antibody 33513
AGGPGNDYPYYYYGMDV

SEQ ID NO: 67027 - protein, 9 aa, Homo sapiens
  light chain complementarity determining region 3 for antibody 33514
QQYGRSPWT

SEQ ID NO: 67028 - protein, 18 aa, Homo sapiens
  heavy chain complementarity determining region 3 for antibody 33514
AKNKFIYDSSGYRGAFDI

SEQ ID NO: 67029 - protein, 9 aa, Homo sapiens
  light chain complementarity determining region 3 for antibody 33515
QQYDNLPPT

SEQ ID NO: 67030 - protein, 20 aa, Homo sapiens
  heavy chain complementarity determining region 3 for antibody 33515
AKVLDRVVVVPVSAAYVFDI

SEQ ID NO: 67031 - protein, 9 aa, Homo sapiens
  light chain complementarity determining region 3 for antibody 33516
QQTYTTPRT

SEQ ID NO: 67032 - protein, 15 aa, Homo sapiens
  heavy chain complementarity determining region 3 for antibody 33516
TNGETQTTYRDAFDI

SEQ ID NO: 67033 - protein, 9 aa, Homo sapiens
  light chain complementarity determining region 3 for antibody 33517
QQSYSTPWT

SEQ ID NO: 67034 - protein, 21 aa, Homo sapiens
  heavy chain complementarity determining region 3 for antibody 33517
ARARIMTMARGPVDHYFAMDV

SEQ ID NO: 67035 - protein, 10 aa, Homo sapiens
  light chain complementarity determining region 3 for antibody 33518
QQSYSTPQYT

SEQ ID NO: 67036 - protein, 7 aa, Homo sapiens
  heavy chain complementarity determining region 3 for antibody 33518
ADPPSDF

SEQ ID NO: 67037 - protein, 9 aa, Homo sapiens
  light chain complementarity determining region 3 for antibody 33519
QQSYSTPLT

SEQ ID NO: 67038 - protein, 12 aa, Homo sapiens
  heavy chain complementarity determining region 3 for antibody 33519
VRGAARPRWFDP

SEQ ID NO: 67039 - protein, 10 aa, Homo sapiens
  light chain complementarity determining region 3 for antibody 33520
QQSYNTVALT

SEQ ID NO: 67040 - protein, 14 aa, Homo sapiens
  heavy chain complementarity determining region 3 for antibody 33520
ARDPHWLVDYYFDY

SEQ ID NO: 67041 - protein, 10 aa, Homo sapiens
  light chain complementarity determining region 3 for antibody 33521
QQRYNWPPYP

SEQ ID NO: 67042 - protein, 11 aa, Homo sapiens
  heavy chain complementarity determining region 3 for antibody 33521
ARGVGSYVFES

SEQ ID NO: 67043 - protein, 11 aa, Homo sapiens
  light chain complementarity determining region 3 for antibody 33522
QQRTNWPPSVT

SEQ ID NO: 67044 - protein, 14 aa, Homo sapiens
  heavy chain complementarity determining region 3 for antibody 33522
AGTSNTGWSLGWGY

SEQ ID NO: 67045 - protein, 10 aa, Homo sapiens
  light chain complementarity determining region 3 for antibody 33523
QQRSNWPQFT

SEQ ID NO: 67046 - protein, 19 aa, Homo sapiens
  heavy chain complementarity determining region 3 for antibody 33523
AGVGTTYVRDDYYYFGMDV

SEQ ID NO: 67047 - protein, 10 aa, Homo sapiens
  light chain complementarity determining region 3 for antibody 33524
QQRSNWPPWT

SEQ ID NO: 67048 - protein, 13 aa, Homo sapiens
  heavy chain complementarity determining region 3 for antibody 33524
VRDQAAAINWFDP

SEQ ID NO: 67049 - protein, 9 aa, Homo sapiens
  light chain complementarity determining region 3 for antibody 33525
QQRANWQLT

SEQ ID NO: 67050 - protein, 16 aa, Homo sapiens
  heavy chain complementarity determining region 3 for antibody 33525
ASEPGGWPAVYYGMDV

SEQ ID NO: 67051 - protein, 10 aa, Homo sapiens
  light chain complementarity determining region 3 for antibody 33526
QQFGSSPRYS

SEQ ID NO: 67052 - protein, 20 aa, Homo sapiens
  heavy chain complementarity determining region 3 for antibody 33526
ARTTYYYDTSGYQGRGGFDY

SEQ ID NO: 67053 - protein, 9 aa, Homo sapiens
  light chain complementarity determining region 3 for antibody 33527
QQANSFPLT

SEQ ID NO: 67054 - protein, 20 aa, Homo sapiens
  heavy chain complementarity determining region 3 for antibody 33527
ARVAPPHVDIVATIKMGWVY

SEQ ID NO: 67055 - protein, 9 aa, Homo sapiens
  light chain complementarity determining region 3 for antibody 33528
QKYYNALLT

SEQ ID NO: 67056 - protein, 15 aa, Homo sapiens
  heavy chain complementarity determining region 3 for antibody 33528
TTGPLIDESGSVVDY

SEQ ID NO: 67057 - protein, 9 aa, Homo sapiens
  light chain complementarity determining region 3 for antibody 33529
QHRSNWLFT

SEQ ID NO: 67058 - protein, 15 aa, Homo sapiens
  heavy chain complementarity determining region 3 for antibody 33529
ARGQGGRRGRGFFDY

SEQ ID NO: 67059 - protein, 9 aa, Homo sapiens
  light chain complementarity determining region 3 for antibody 33530
MQSTQWLWT

SEQ ID NO: 67060 - protein, 16 aa, Homo sapiens
  heavy chain complementarity determining region 3 for antibody 33530
GTRQYLYDTSGYSFDS

SEQ ID NO: 67061 - protein, 8 aa, Homo sapiens
  light chain complementarity determining region 3 for antibody 33531
MQGTSGRA

SEQ ID NO: 67062 - protein, 17 aa, Homo sapiens
  heavy chain complementarity determining region 3 for antibody 33531
AHRRYYNGNWNGATFDV

SEQ ID NO: 67063 - protein, 9 aa, Homo sapiens
  light chain complementarity determining region 3 for antibody 33532
MQGTHWPRT

SEQ ID NO: 67064 - protein, 9 aa, Homo sapiens
  heavy chain complementarity determining region 3 for antibody 33532
AKGFYDSGG

SEQ ID NO: 67065 - protein, 9 aa, Homo sapiens
  light chain complementarity determining region 3 for antibody 33533
MQGTHWPLT

SEQ ID NO: 67066 - protein, 18 aa, Homo sapiens
  heavy chain complementarity determining region 3 for antibody 33533
ARDRISVSVIHTYYSVDI

SEQ ID NO: 67067 - protein, 9 aa, Homo sapiens
  light chain complementarity determining region 3 for antibody 33534
MQGLQTPYT

SEQ ID NO: 67068 - protein, 10 aa, Homo sapiens
  heavy chain complementarity determining region 3 for antibody 33534
ARDVVGSDGQ

SEQ ID NO: 67069 - protein, 9 aa, Homo sapiens
  light chain complementarity determining region 3 for antibody 33535
MQDFRFPYS

SEQ ID NO: 67070 - protein, 16 aa, Homo sapiens
  heavy chain complementarity determining region 3 for antibody 33535
ARDGLGSEAMEVGFDV

SEQ ID NO: 67071 - protein, 9 aa, Homo sapiens
  light chain complementarity determining region 3 for antibody 33536
MQALQTSWT

SEQ ID NO: 67072 - protein, 21 aa, Homo sapiens
  heavy chain complementarity determining region 3 for antibody 33536
AKDAPVVRPYSSGWYSSAFDS

SEQ ID NO: 67073 - protein, 9 aa, Homo sapiens
  light chain complementarity determining region 3 for antibody 33537
LQHNSYPLT

SEQ ID NO: 67074 - protein, 13 aa, Homo sapiens
  heavy chain complementarity determining region 3 for antibody 33537
VRHAVVRPMVVDD

SEQ ID NO: 67075 - protein, 9 aa, Homo sapiens
  light chain complementarity determining region 3 for antibody 33538
LQHNAYPLT

SEQ ID NO: 67076 - protein, 12 aa, Homo sapiens
  heavy chain complementarity determining region 3 for antibody 33538
ARDLSSGWLGDH

SEQ ID NO: 67077 - protein, 9 aa, Homo sapiens
  light chain complementarity determining region 3 for antibody 33539
LQDYNYPHT

SEQ ID NO: 67078 - protein, 10 aa, Homo sapiens
  heavy chain complementarity determining region 3 for antibody 33539
ARRGLFFGES

SEQ ID NO: 67079 - protein, 9 aa, Homo sapiens
  light chain complementarity determining region 3 for antibody 33540
HQYYTIPLT

SEQ ID NO: 67080 - protein, 21 aa, Homo sapiens
  heavy chain complementarity determining region 3 for antibody 33540
ATHPFYCGGGTCYLTGFYFDH

SEQ ID NO: 67081 - protein, 9 aa, Homo sapiens
  light chain complementarity determining region 3 for antibody 33541
HQYYSSPRM

SEQ ID NO: 67082 - protein, 16 aa, Homo sapiens
  heavy chain complementarity determining region 3 for antibody 33541
ARVTLDDDGNPDAFDV

SEQ ID NO: 67083 - protein, 9 aa, Homo sapiens
  light chain complementarity determining region 3 for antibody 33542
HQYNSAPAT

SEQ ID NO: 67084 - protein, 11 aa, Homo sapiens
  heavy chain complementarity determining region 3 for antibody 33542
AREAAKGALDY

SEQ ID NO: 67085 - protein, 9 aa, Homo sapiens
  light chain complementarity determining region 3 for antibody 33543
HQYGRSPDT

SEQ ID NO: 67086 - protein, 14 aa, Homo sapiens
  heavy chain complementarity determining region 3 for antibody 33543
ARGGYYGSGSYLTN

SEQ ID NO: 67087 - protein, 9 aa, Homo sapiens
  light chain complementarity determining region 3 for antibody 33544
QQYYSIPFT

SEQ ID NO: 67088 - protein, 17 aa, Homo sapiens
  heavy chain complementarity determining region 3 for antibody 33544
AHVGNFENFRSGLHFDY

SEQ ID NO: 67089 - protein, 9 aa, Homo sapiens
  light chain complementarity determining region 3 for antibody 33545
QQYVSSPWT

SEQ ID NO: 67090 - protein, 13 aa, Homo sapiens
  heavy chain complementarity determining region 3 for antibody 33545
ARAESWSGRLFDY

SEQ ID NO: 67091 - protein, 9 aa, Homo sapiens
  light chain complementarity determining region 3 for antibody 33546
QQYNTYPRT

SEQ ID NO: 67092 - protein, 17 aa, Homo sapiens
  heavy chain complementarity determining region 3 for antibody 33546
ARDPYLDTDGRYYEGTY

SEQ ID NO: 67093 - protein, 9 aa, Homo sapiens
  light chain complementarity determining region 3 for antibody 33547
QQYNTYLYT

SEQ ID NO: 67094 - protein, 15 aa, Homo sapiens
  heavy chain complementarity determining region 3 for antibody 33547
ARSSYSNGYYWYFDL

SEQ ID NO: 67095 - protein, 9 aa, Homo sapiens
  light chain complementarity determining region 3 for antibody 33548
QQYNSYPYT

SEQ ID NO: 67096 - protein, 12 aa, Homo sapiens
  heavy chain complementarity determining region 3 for antibody 33548
ARHPLYAQHIDY

SEQ ID NO: 67097 - protein, 9 aa, Homo sapiens
  light chain complementarity determining region 3 for antibody 33549
QQYNSHPYT

SEQ ID NO: 67098 - protein, 15 aa, Homo sapiens
  heavy chain complementarity determining region 3 for antibody 33549
AREREDKFMPRLIDY

SEQ ID NO: 67099 - protein, 10 aa, Homo sapiens
  light chain complementarity determining region 3 for antibody 33550
QQYNNWPPYT

SEQ ID NO: 67100 - protein, 20 aa, Homo sapiens
  heavy chain complementarity determining region 3 for antibody 33550
ARHGQAAAGWTQYYYYGMDV

SEQ ID NO: 67101 - protein, 9 aa, Homo sapiens
  light chain complementarity determining region 3 for antibody 33551
QQYNFYPRT

SEQ ID NO: 67102 - protein, 10 aa, Homo sapiens
  heavy chain complementarity determining region 3 for antibody 33551
CRGPGGYPDS

SEQ ID NO: 67103 - protein, 10 aa, Homo sapiens
  light chain complementarity determining region 3 for antibody 33552
QQYGSSPRYT

SEQ ID NO: 67104 - protein, 17 aa, Homo sapiens
  heavy chain complementarity determining region 3 for antibody 33552
ARISVWTVYTGSYHFDY

SEQ ID NO: 67105 - protein, 9 aa, Homo sapiens
  light chain complementarity determining region 3 for antibody 33553
QQYGSSPRP

SEQ ID NO: 67106 - protein, 25 aa, Homo sapiens
  heavy chain complementarity determining region 3 for antibody 33553
ARLRIDRLRLPGAMRGPLYDCGLNV

SEQ ID NO: 67107 - protein, 10 aa, Homo sapiens
  light chain complementarity determining region 3 for antibody 33554
QQYGSSPPYT

SEQ ID NO: 67108 - protein, 12 aa, Homo sapiens
  heavy chain complementarity determining region 3 for antibody 33554
ARVSYGYNSLGY

SEQ ID NO: 67109 - protein, 10 aa, Homo sapiens
  light chain complementarity determining region 3 for antibody 33555
QQYGSSPPWT

SEQ ID NO: 67110 - protein, 13 aa, Homo sapiens
  heavy chain complementarity determining region 3 for antibody 33555
ARIPDISGWPFDL

SEQ ID NO: 67111 - protein, 9 aa, Homo sapiens
  light chain complementarity determining region 3 for antibody 33556
QQYGSIPRT

SEQ ID NO: 67112 - protein, 13 aa, Homo sapiens
  heavy chain complementarity determining region 3 for antibody 33556
AGGSFSGRNYKED

SEQ ID NO: 67113 - protein, 9 aa, Homo sapiens
  light chain complementarity determining region 3 for antibody 33557
QQYGGSPRT

SEQ ID NO: 67114 - protein, 13 aa, Homo sapiens
  heavy chain complementarity determining region 3 for antibody 33557
AAGFYTRGSYFEY

SEQ ID NO: 67115 - protein, 6 aa, Homo sapiens
  light chain complementarity determining region 3 for antibody 33558
QQYGET

SEQ ID NO: 67116 - protein, 12 aa, Homo sapiens
  heavy chain complementarity determining region 3 for antibody 33558
ARDHSSGWSLSN

SEQ ID NO: 67117 - protein, 8 aa, Homo sapiens
  light chain complementarity determining region 3 for antibody 33559
QQYGCSPS

SEQ ID NO: 67118 - protein, 16 aa, Homo sapiens
  heavy chain complementarity determining region 3 for antibody 33559
ATDWGSGTQWIRAFDV

SEQ ID NO: 67119 - protein, 8 aa, Homo sapiens
  light chain complementarity determining region 3 for antibody 33560
QQYFTYWT

SEQ ID NO: 67120 - protein, 18 aa, Homo sapiens
  heavy chain complementarity determining region 3 for antibody 33560
ARRGYDTLTGLPAGWFDL

SEQ ID NO: 67121 - protein, 9 aa, Homo sapiens
  light chain complementarity determining region 3 for antibody 33561
QQYDTSPWT

SEQ ID NO: 67122 - protein, 14 aa, Homo sapiens
  heavy chain complementarity determining region 3 for antibody 33561
ATCDLAFRGVAFDI

SEQ ID NO: 67123 - protein, 9 aa, Homo sapiens
  light chain complementarity determining region 3 for antibody 33562
QQYDSLPLT

SEQ ID NO: 67124 - protein, 11 aa, Homo sapiens
  heavy chain complementarity determining region 3 for antibody 33562
ASQRIHDAFDT

SEQ ID NO: 67125 - protein, 8 aa, Homo sapiens
  light chain complementarity determining region 3 for antibody 33563
QQYDKPFT

SEQ ID NO: 67126 - protein, 14 aa, Homo sapiens
  heavy chain complementarity determining region 3 for antibody 33563
ARDLGHNFGSGMDV

SEQ ID NO: 67127 - protein, 11 aa, Homo sapiens
  light chain complementarity determining region 3 for antibody 33564
QQYAPSPEKYT

SEQ ID NO: 67128 - protein, 13 aa, Homo sapiens
  heavy chain complementarity determining region 3 for antibody 33564
AREEMIGGSPFDF

SEQ ID NO: 67129 - protein, 9 aa, Homo sapiens
  light chain complementarity determining region 3 for antibody 33565
QQSYSTPYT

SEQ ID NO: 67130 - protein, 18 aa, Homo sapiens
  heavy chain complementarity determining region 3 for antibody 33565
ARDAGLYSSGWYSEGFDY

SEQ ID NO: 67131 - protein, 8 aa, Homo sapiens
  light chain complementarity determining region 3 for antibody 33566
QQSYSALT

SEQ ID NO: 67132 - protein, 18 aa, Homo sapiens
  heavy chain complementarity determining region 3 for antibody 33566
ASLVTAIPVAPYYYGMDV

SEQ ID NO: 67133 - protein, 9 aa, Homo sapiens
  light chain complementarity determining region 3 for antibody 33567
QQSYRTPQT

SEQ ID NO: 67134 - protein, 14 aa, Homo sapiens
  heavy chain complementarity determining region 3 for antibody 33567
ARDGHTKTWYALDH

SEQ ID NO: 67135 - protein, 9 aa, Homo sapiens
  light chain complementarity determining region 3 for antibody 33568
QQSYRLPYT

SEQ ID NO: 67136 - protein, 14 aa, Homo sapiens
  heavy chain complementarity determining region 3 for antibody 33568
AREEIWGTIRGFDM

SEQ ID NO: 67137 - protein, 10 aa, Homo sapiens
  light chain complementarity determining region 3 for antibody 33569
QQRYNWPPST

SEQ ID NO: 67138 - protein, 11 aa, Homo sapiens
  heavy chain complementarity determining region 3 for antibody 33569
ARGVGSYVFES

SEQ ID NO: 67139 - protein, 10 aa, Homo sapiens
  light chain complementarity determining region 3 for antibody 33570
QQRYKGPPYT

SEQ ID NO: 67140 - protein, 11 aa, Homo sapiens
  heavy chain complementarity determining region 3 for antibody 33570
ARGVGSYVFES

SEQ ID NO: 67141 - protein, 9 aa, Homo sapiens
  light chain complementarity determining region 3 for antibody 33571
QQRSNWRFT

SEQ ID NO: 67142 - protein, 13 aa, Homo sapiens
  heavy chain complementarity determining region 3 for antibody 33571
AKSYTTGVGAFHF

SEQ ID NO: 67143 - protein, 10 aa, Homo sapiens
  light chain complementarity determining region 3 for antibody 33572
QQRSNWPPYT

SEQ ID NO: 67144 - protein, 17 aa, Homo sapiens
  heavy chain complementarity determining region 3 for antibody 33572
ARDMGDYASGRYYGMDV

SEQ ID NO: 67145 - protein, 10 aa, Homo sapiens
  light chain complementarity determining region 3 for antibody 33573
QQRSNWPPLT

SEQ ID NO: 67146 - protein, 16 aa, Homo sapiens
  heavy chain complementarity determining region 3 for antibody 33573
ARKGLLWFGESPYFDY

SEQ ID NO: 67147 - protein, 10 aa, Homo sapiens
  light chain complementarity determining region 3 for antibody 33574
QQRFNWPPIT

SEQ ID NO: 67148 - protein, 12 aa, Homo sapiens
  heavy chain complementarity determining region 3 for antibody 33574
VKDCGLGGPRDY

SEQ ID NO: 67149 - protein, 9 aa, Homo sapiens
  light chain complementarity determining region 3 for antibody 33575
QQHSSWPLT

SEQ ID NO: 67150 - protein, 18 aa, Homo sapiens
  heavy chain complementarity determining region 3 for antibody 33575
AKEDLIAPDDLLMNWFDP

SEQ ID NO: 67151 - protein, 9 aa, Homo sapiens
  light chain complementarity determining region 3 for antibody 33576
QQGYSIPFT

SEQ ID NO: 67152 - protein, 13 aa, Homo sapiens
  heavy chain complementarity determining region 3 for antibody 33576
ATREHGSGRFLDF

SEQ ID NO: 67153 - protein, 11 aa, Homo sapiens
  light chain complementarity determining region 3 for antibody 33577
QQFNNYPRELT

SEQ ID NO: 67154 - protein, 14 aa, Homo sapiens
  heavy chain complementarity determining region 3 for antibody 33577
ARDLFGGSPGAYDY

SEQ ID NO: 67155 - protein, 9 aa, Homo sapiens
  light chain complementarity determining region 3 for antibody 33578
QQANSFPWT

SEQ ID NO: 67156 - protein, 16 aa, Homo sapiens
  heavy chain complementarity determining region 3 for antibody 33578
ARDGVGTINGGDAFDI

SEQ ID NO: 67157 - protein, 10 aa, Homo sapiens
  light chain complementarity determining region 3 for antibody 33579
QQANSFPPNT

SEQ ID NO: 67158 - protein, 17 aa, Homo sapiens
  heavy chain complementarity determining region 3 for antibody 33579
AREGIYDFDGYNDGLDI

SEQ ID NO: 67159 - protein, 9 aa, Homo sapiens
  light chain complementarity determining region 3 for antibody 33580
QQANSFPLT

SEQ ID NO: 67160 - protein, 17 aa, Homo sapiens
  heavy chain complementarity determining region 3 for antibody 33580
ATRTRQLGEDTYWYFDL

SEQ ID NO: 67161 - protein, 9 aa, Homo sapiens
  light chain complementarity determining region 3 for antibody 33581
QQAKTFPLT

SEQ ID NO: 67162 - protein, 21 aa, Homo sapiens
  heavy chain complementarity determining region 3 for antibody 33581
GRQSLGYCSDGSCPVVNWFDH

SEQ ID NO: 67163 - protein, 9 aa, Homo sapiens
  light chain complementarity determining region 3 for antibody 33582
QKYNSYSET

SEQ ID NO: 67164 - protein, 8 aa, Homo sapiens
  heavy chain complementarity determining region 3 for antibody 33582
ATSPTLGY

SEQ ID NO: 67165 - protein, 8 aa, Homo sapiens
  light chain complementarity determining region 3 for antibody 33583
QHYGSSRT

SEQ ID NO: 67166 - protein, 15 aa, Homo sapiens
  heavy chain complementarity determining region 3 for antibody 33583
AREVTSPSQSYPLDV

SEQ ID NO: 67167 - protein, 9 aa, Homo sapiens
  light chain complementarity determining region 3 for antibody 33584
QHSHSRPFT

SEQ ID NO: 67168 - protein, 20 aa, Homo sapiens
  heavy chain complementarity determining region 3 for antibody 33584
ARGIAVAALRTVYYYYGMDV

SEQ ID NO: 67169 - protein, 10 aa, Homo sapiens
  light chain complementarity determining region 3 for antibody 33585
QHRGKWPPHT

SEQ ID NO: 67170 - protein, 15 aa, Homo sapiens
  heavy chain complementarity determining region 3 for antibody 33585
VRLGVGFDDSSDDDY

SEQ ID NO: 67171 - protein, 9 aa, Homo sapiens
  light chain complementarity determining region 3 for antibody 33586
QEYDTLSFT

SEQ ID NO: 67172 - protein, 14 aa, Homo sapiens
  heavy chain complementarity determining region 3 for antibody 33586
VRDRETSILGDFDY

SEQ ID NO: 67173 - protein, 9 aa, Homo sapiens
  light chain complementarity determining region 3 for antibody 33587
QETYSYPFT

SEQ ID NO: 67174 - protein, 22 aa, Homo sapiens
  heavy chain complementarity determining region 3 for antibody 33587
VRVRFSMVRGVGGTFPYYDMDV

SEQ ID NO: 67175 - protein, 9 aa, Homo sapiens
  light chain complementarity determining region 3 for antibody 33588
QESYSVRFT

SEQ ID NO: 67176 - protein, 22 aa, Homo sapiens
  heavy chain complementarity determining region 3 for antibody 33588
AKETEYDFSDMSTQYYGHLFDQ

SEQ ID NO: 67177 - protein, 8 aa, Homo sapiens
  light chain complementarity determining region 3 for antibody 33589
MQSTQWPT

SEQ ID NO: 67178 - protein, 21 aa, Homo sapiens
  heavy chain complementarity determining region 3 for antibody 33589
AKDRPNYYGSNAGYYTPGGDR

SEQ ID NO: 67179 - protein, 9 aa, Homo sapiens
  light chain complementarity determining region 3 for antibody 33590
MQGTHWPWT

SEQ ID NO: 67180 - protein, 16 aa, Homo sapiens
  heavy chain complementarity determining region 3 for antibody 33590
TGDQRDRIFGVLDLPT

SEQ ID NO: 67181 - protein, 9 aa, Homo sapiens
  light chain complementarity determining region 3 for antibody 33591
MQGTHWPHT

SEQ ID NO: 67182 - protein, 17 aa, Homo sapiens
  heavy chain complementarity determining region 3 for antibody 33591
AREPQAHNDLYSGYEKN

SEQ ID NO: 67183 - protein, 9 aa, Homo sapiens
  light chain complementarity determining region 3 for antibody 33592
MQGTHGPLT

SEQ ID NO: 67184 - protein, 19 aa, Homo sapiens
  heavy chain complementarity determining region 3 for antibody 33592
VRDDRDHCSGGSCEGYFDD

SEQ ID NO: 67185 - protein, 9 aa, Homo sapiens
  light chain complementarity determining region 3 for antibody 33593
MQDTHWPHT

SEQ ID NO: 67186 - protein, 14 aa, Homo sapiens
  heavy chain complementarity determining region 3 for antibody 33593
ARFMVRDVLYFFDF

SEQ ID NO: 67187 - protein, 9 aa, Homo sapiens
  light chain complementarity determining region 3 for antibody 33594
MQALQTPWT

SEQ ID NO: 67188 - protein, 13 aa, Homo sapiens
  heavy chain complementarity determining region 3 for antibody 33594
ARGSRGRAHAFDI

SEQ ID NO: 67189 - protein, 9 aa, Homo sapiens
  light chain complementarity determining region 3 for antibody 33595
MQALETPPA

SEQ ID NO: 67190 - protein, 14 aa, Homo sapiens
  heavy chain complementarity determining region 3 for antibody 33595
ARNRAAYDSGGPDY

SEQ ID NO: 67191 - protein, 9 aa, Homo sapiens
  light chain complementarity determining region 3 for antibody 33596
MGTLQTPPA

SEQ ID NO: 67192 - protein, 15 aa, Homo sapiens
  heavy chain complementarity determining region 3 for antibody 33596
TRDGKKDGHNDAFDS

SEQ ID NO: 67193 - protein, 9 aa, Homo sapiens
  light chain complementarity determining region 3 for antibody 33597
LQYNSYVWT

SEQ ID NO: 67194 - protein, 19 aa, Homo sapiens
  heavy chain complementarity determining region 3 for antibody 33597
IGDVVVPAGIPYYYDSMDV

SEQ ID NO: 67195 - protein, 9 aa, Homo sapiens
  light chain complementarity determining region 3 for antibody 33598
LQDYTYPLT

SEQ ID NO: 67196 - protein, 19 aa, Homo sapiens
  heavy chain complementarity determining region 3 for antibody 33598
AKKIIYYSDSGTYYSPFDY

SEQ ID NO: 67197 - protein, 9 aa, Homo sapiens
  light chain complementarity determining region 3 for antibody 33599
LHNKNFPYA

SEQ ID NO: 67198 - protein, 14 aa, Homo sapiens
  heavy chain complementarity determining region 3 for antibody 33599
TRTEWSSGWRLFDY

SEQ ID NO: 67199 - protein, 9 aa, Homo sapiens
  light chain complementarity determining region 3 for antibody 33600
HQSSSLPFT

SEQ ID NO: 67200 - protein, 19 aa, Homo sapiens
  heavy chain complementarity determining region 3 for antibody 33600
ARDSSPNTAFYYYYYGMDV

SEQ ID NO: 67201 - protein, 9 aa, Homo sapiens
  light chain complementarity determining region 3 for antibody 33601
HQSGVLPWT

SEQ ID NO: 67202 - protein, 14 aa, Homo sapiens
  heavy chain complementarity determining region 3 for antibody 33601
VRDASGNSGWYAAS

SEQ ID NO: 67203 - protein, 9 aa, Homo sapiens
  light chain complementarity determining region 3 for antibody 33602
HHTSTFPRP

SEQ ID NO: 67204 - protein, 20 aa, Homo sapiens
  heavy chain complementarity determining region 3 for antibody 33602
ARGRRIAALSTAHYYYGMDV

SEQ ID NO: 67205 - protein, 9 aa, Homo sapiens
  light chain complementarity determining region 3 for antibody 33603
RQSYSTPRT

SEQ ID NO: 67206 - protein, 21 aa, Homo sapiens
  heavy chain complementarity determining region 3 for antibody 33603
ARDAPVSRPYSSGWYSSAFDY

SEQ ID NO: 67207 - protein, 11 aa, Homo sapiens
  light chain complementarity determining region 3 for antibody 33604
QQYYTTPPMYT

SEQ ID NO: 67208 - protein, 16 aa, Homo sapiens
  heavy chain complementarity determining region 3 for antibody 33604
ARDPDTSGWYLHAFDI

SEQ ID NO: 67209 - protein, 9 aa, Homo sapiens
  light chain complementarity determining region 3 for antibody 33605
QQYYSTPWT

SEQ ID NO: 67210 - protein, 15 aa, Homo sapiens
  heavy chain complementarity determining region 3 for antibody 33605
IRQSKVDNNYNYPDF

SEQ ID NO: 67211 - protein, 9 aa, Homo sapiens
  light chain complementarity determining region 3 for antibody 33606
QQYVSSPYT

SEQ ID NO: 67212 - protein, 14 aa, Homo sapiens
  heavy chain complementarity determining region 3 for antibody 33606
ARVGPYSSGEIFDY

SEQ ID NO: 67213 - protein, 11 aa, Homo sapiens
  light chain complementarity determining region 3 for antibody 33607
QQYVSSPPGFP

SEQ ID NO: 67214 - protein, 18 aa, Homo sapiens
  heavy chain complementarity determining region 3 for antibody 33607
AKVSRGLNHGSGSYYFDF

SEQ ID NO: 67215 - protein, 8 aa, Homo sapiens
  light chain complementarity determining region 3 for antibody 33608
QQYSTYRT

SEQ ID NO: 67216 - protein, 21 aa, Homo sapiens
  heavy chain complementarity determining region 3 for antibody 33608
ARDNPGDSSSDWSTRTSAFDM

SEQ ID NO: 67217 - protein, 9 aa, Homo sapiens
  light chain complementarity determining region 3 for antibody 33609
QQYSNWPKT

SEQ ID NO: 67218 - protein, 18 aa, Homo sapiens
  heavy chain complementarity determining region 3 for antibody 33609
AKEGAPYSGSYRSVAFDI

SEQ ID NO: 67219 - protein, 9 aa, Homo sapiens
  light chain complementarity determining region 3 for antibody 33610
QQYNTWPRT

SEQ ID NO: 67220 - protein, 22 aa, Homo sapiens
  heavy chain complementarity determining region 3 for antibody 33610
AREVRASGYDDFYNYYYYGLDV

SEQ ID NO: 67221 - protein, 9 aa, Homo sapiens
  light chain complementarity determining region 3 for antibody 33611
QQYNSYSWT

SEQ ID NO: 67222 - protein, 28 aa, Homo sapiens
  heavy chain complementarity determining region 3 for antibody 33611
GRVLRLSNLDFWRGNDPQRKYHYYSMDV

SEQ ID NO: 67223 - protein, 9 aa, Homo sapiens
  light chain complementarity determining region 3 for antibody 33612
QQYNSYSGT

SEQ ID NO: 67224 - protein, 15 aa, Homo sapiens
  heavy chain complementarity determining region 3 for antibody 33612
AKEPDCGRNCLFFDS

SEQ ID NO: 67225 - protein, 9 aa, Homo sapiens
  light chain complementarity determining region 3 for antibody 33613
QQYNSYPIT

SEQ ID NO: 67226 - protein, 5 aa, Homo sapiens
  heavy chain complementarity determining region 3 for antibody 33613
SGWLA

SEQ ID NO: 67227 - protein, 8 aa, Homo sapiens
  light chain complementarity determining region 3 for antibody 33614
QQYNSWLT

SEQ ID NO: 67228 - protein, 10 aa, Homo sapiens
  heavy chain complementarity determining region 3 for antibody 33614
VKNKFNYGDF

SEQ ID NO: 67229 - protein, 9 aa, Homo sapiens
  light chain complementarity determining region 3 for antibody 33615
QQYNSIPWT

SEQ ID NO: 67230 - protein, 14 aa, Homo sapiens
  heavy chain complementarity determining region 3 for antibody 33615
ARESGAGSYQGFDY

SEQ ID NO: 67231 - protein, 10 aa, Homo sapiens
  light chain complementarity determining region 3 for antibody 33616
QQYNKWPPYT

SEQ ID NO: 67232 - protein, 17 aa, Homo sapiens
  heavy chain complementarity determining region 3 for antibody 33616
AKEVAVGGHPPGGAFGC

SEQ ID NO: 67233 - protein, 9 aa, Homo sapiens
  light chain complementarity determining region 3 for antibody 33617
QQYNDWPRT

SEQ ID NO: 67234 - protein, 16 aa, Homo sapiens
  heavy chain complementarity determining region 3 for antibody 33617
ARGIIVTGYFSTTLDS

SEQ ID NO: 67235 - protein, 9 aa, Homo sapiens
  light chain complementarity determining region 3 for antibody 33618
QQYGTSPFT

SEQ ID NO: 67236 - protein, 14 aa, Homo sapiens
  heavy chain complementarity determining region 3 for antibody 33618
ARGGPAATSSSWFY

SEQ ID NO: 67237 - protein, 9 aa, Homo sapiens
  light chain complementarity determining region 3 for antibody 33619
QQYGSSRGT

SEQ ID NO: 67238 - protein, 12 aa, Homo sapiens
  heavy chain complementarity determining region 3 for antibody 33619
SRGQGQWLVPAF

SEQ ID NO: 67239 - protein, 9 aa, Homo sapiens
  light chain complementarity determining region 3 for antibody 33620
QQYGSSPST

SEQ ID NO: 67240 - protein, 16 aa, Homo sapiens
  heavy chain complementarity determining region 3 for antibody 33620
AATRRRREGYRVVLDY

SEQ ID NO: 67241 - protein, 9 aa, Homo sapiens
  light chain complementarity determining region 3 for antibody 33621
QQYGSSPLT

SEQ ID NO: 67242 - protein, 10 aa, Homo sapiens
  heavy chain complementarity determining region 3 for antibody 33621
ARDRFWAFDS

SEQ ID NO: 67243 - protein, 9 aa, Homo sapiens
  light chain complementarity determining region 3 for antibody 33622
QQYGSSPGT

SEQ ID NO: 67244 - protein, 15 aa, Homo sapiens
  heavy chain complementarity determining region 3 for antibody 33622
ASGSFDTLTGSYSEV

SEQ ID NO: 67245 - protein, 8 aa, Homo sapiens
  light chain complementarity determining region 3 for antibody 33623
QQYGGSPS

SEQ ID NO: 67246 - protein, 16 aa, Homo sapiens
  heavy chain complementarity determining region 3 for antibody 33623
ATGWGSGTQWIRAFDV

SEQ ID NO: 67247 - protein, 10 aa, Homo sapiens
  light chain complementarity determining region 3 for antibody 33624
QQYGGSPLVT

SEQ ID NO: 67248 - protein, 16 aa, Homo sapiens
  heavy chain complementarity determining region 3 for antibody 33624
ARESGGIVARRNYFDH

SEQ ID NO: 67249 - protein, 9 aa, Homo sapiens
  light chain complementarity determining region 3 for antibody 33625
QQYDRLPLT

SEQ ID NO: 67250 - protein, 19 aa, Homo sapiens
  heavy chain complementarity determining region 3 for antibody 33625
ARSPGGGIAVAGSWAYFDS

SEQ ID NO: 67251 - protein, 9 aa, Homo sapiens
  light chain complementarity determining region 3 for antibody 33626
QQYDHLPLT

SEQ ID NO: 67252 - protein, 13 aa, Homo sapiens
  heavy chain complementarity determining region 3 for antibody 33626
VKDTTRYYCAYSD

SEQ ID NO: 67253 - protein, 9 aa, Homo sapiens
  light chain complementarity determining region 3 for antibody 33627
QQSYSTYLS

SEQ ID NO: 67254 - protein, 16 aa, Homo sapiens
  heavy chain complementarity determining region 3 for antibody 33627
ARRDYDVLTGYSYFDH

SEQ ID NO: 67255 - protein, 9 aa, Homo sapiens
  light chain complementarity determining region 3 for antibody 33628
QQSYSTPRT

SEQ ID NO: 67256 - protein, 23 aa, Homo sapiens
  heavy chain complementarity determining region 3 for antibody 33628
TTDWDTMIGGVIEGINYYYGMDV

SEQ ID NO: 67257 - protein, 9 aa, Homo sapiens
  light chain complementarity determining region 3 for antibody 33629
QQSYSTPQT

SEQ ID NO: 67258 - protein, 17 aa, Homo sapiens
  heavy chain complementarity determining region 3 for antibody 33629
AKAKSSSWYEVGSAFDI

SEQ ID NO: 67259 - protein, 9 aa, Homo sapiens
  light chain complementarity determining region 3 for antibody 33630
QQSYSPPPT

SEQ ID NO: 67260 - protein, 20 aa, Homo sapiens
  heavy chain complementarity determining region 3 for antibody 33630
AKDVTPDYFYGSGSSLYFDY

SEQ ID NO: 67261 - protein, 9 aa, Homo sapiens
  light chain complementarity determining region 3 for antibody 33631
QQSNNWPFT

SEQ ID NO: 67262 - protein, 12 aa, Homo sapiens
  heavy chain complementarity determining region 3 for antibody 33631
AKDVTYNYAFDL

SEQ ID NO: 67263 - protein, 10 aa, Homo sapiens
  light chain complementarity determining region 3 for antibody 33632
QQRNLWPPVI

SEQ ID NO: 67264 - protein, 12 aa, Homo sapiens
  heavy chain complementarity determining region 3 for antibody 33632
VRDGTSGWYFDF

SEQ ID NO: 67265 - protein, 9 aa, Homo sapiens
  light chain complementarity determining region 3 for antibody 33633
QQLNTYPLT

SEQ ID NO: 67266 - protein, 16 aa, Homo sapiens
  heavy chain complementarity determining region 3 for antibody 33633
ARGDKRSSWTTEKLDY

SEQ ID NO: 67267 - protein, 9 aa, Homo sapiens
  light chain complementarity determining region 3 for antibody 33634
QQFKSYPLT

SEQ ID NO: 67268 - protein, 15 aa, Homo sapiens
  heavy chain complementarity determining region 3 for antibody 33634
ARTSYTFSGHWYFDL

SEQ ID NO: 67269 - protein, 9 aa, Homo sapiens
  light chain complementarity determining region 3 for antibody 33635
QQDGSSPRT

SEQ ID NO: 67270 - protein, 25 aa, Homo sapiens
  heavy chain complementarity determining region 3 for antibody 33635
ARLRIDRLRLPGAMRGPLYDCGLNV

SEQ ID NO: 67271 - protein, 9 aa, Homo sapiens
  light chain complementarity determining region 3 for antibody 33636
QQANSFPPT

SEQ ID NO: 67272 - protein, 11 aa, Homo sapiens
  heavy chain complementarity determining region 3 for antibody 33636
ARHSSGWGLDY

SEQ ID NO: 67273 - protein, 9 aa, Homo sapiens
  light chain complementarity determining region 3 for antibody 33637
QQANSFPLT

SEQ ID NO: 67274 - protein, 11 aa, Homo sapiens
  heavy chain complementarity determining region 3 for antibody 33637
ARESTADAFDI

SEQ ID NO: 67275 - protein, 9 aa, Homo sapiens
  light chain complementarity determining region 3 for antibody 33638
QHYNNLPYT

SEQ ID NO: 67276 - protein, 13 aa, Homo sapiens
  heavy chain complementarity determining region 3 for antibody 33638
ARERSGASNWFDP

SEQ ID NO: 67277 - protein, 9 aa, Homo sapiens
  light chain complementarity determining region 3 for antibody 33639
QHYDNLPYT

SEQ ID NO: 67278 - protein, 10 aa, Homo sapiens
  heavy chain complementarity determining region 3 for antibody 33639
AGGTGWILDT

SEQ ID NO: 67279 - protein, 11 aa, Homo sapiens
  light chain complementarity determining region 3 for antibody 33640
QHRSNWPPALI

SEQ ID NO: 67280 - protein, 15 aa, Homo sapiens
  heavy chain complementarity determining region 3 for antibody 33640
VREPRELPTGEVVDY

SEQ ID NO: 67281 - protein, 9 aa, Homo sapiens
  light chain complementarity determining region 3 for antibody 33641
MQTVQFVWT

SEQ ID NO: 67282 - protein, 14 aa, Homo sapiens
  heavy chain complementarity determining region 3 for antibody 33641
ARSVNTGQYYGLGY

SEQ ID NO: 67283 - protein, 8 aa, Homo sapiens
  light chain complementarity determining region 3 for antibody 33642
MQSLQRLT

SEQ ID NO: 67284 - protein, 12 aa, Homo sapiens
  heavy chain complementarity determining region 3 for antibody 33642
VKDCGLGGSRDF

SEQ ID NO: 67285 - protein, 9 aa, Homo sapiens
  light chain complementarity determining region 3 for antibody 33643
MQARQTPYT

SEQ ID NO: 67286 - protein, 13 aa, Homo sapiens
  heavy chain complementarity determining region 3 for antibody 33643
AKSYSSGLGAFHI

SEQ ID NO: 67287 - protein, 9 aa, Homo sapiens
  light chain complementarity determining region 3 for antibody 33644
MQALETPFP

SEQ ID NO: 67288 - protein, 15 aa, Homo sapiens
  heavy chain complementarity determining region 3 for antibody 33644
VRHYRETVAGIEGDS

SEQ ID NO: 67289 - protein, 9 aa, Homo sapiens
  light chain complementarity determining region 3 for antibody 33645
LQHTGYSWT

SEQ ID NO: 67290 - protein, 13 aa, Homo sapiens
  heavy chain complementarity determining region 3 for antibody 33645
ARSGVVVTAILDY

SEQ ID NO: 67291 - protein, 9 aa, Homo sapiens
  light chain complementarity determining region 3 for antibody 33646
LQDYNYPPT

SEQ ID NO: 67292 - protein, 11 aa, Homo sapiens
  heavy chain complementarity determining region 3 for antibody 33646
ASDRVYYGLDV

SEQ ID NO: 67293 - protein, 9 aa, Homo sapiens
  light chain complementarity determining region 3 for antibody 33647
HQYYSAPLT

SEQ ID NO: 67294 - protein, 21 aa, Homo sapiens
  heavy chain complementarity determining region 3 for antibody 33647
AKDEGLSVFRSFDGLFDAFDI

SEQ ID NO: 67295 - protein, 9 aa, Homo sapiens
  light chain complementarity determining region 3 for antibody 33648
HQYGSSPRA

SEQ ID NO: 67296 - protein, 18 aa, Homo sapiens
  heavy chain complementarity determining region 3 for antibody 33648
ARGAIFGLPRYRYSAMDV

SEQ ID NO: 67297 - protein, 10 aa, Homo sapiens
  light chain complementarity determining region 3 for antibody 33649
VQTLQSPPWT

SEQ ID NO: 67298 - protein, 16 aa, Homo sapiens
  heavy chain complementarity determining region 3 for antibody 33649
ARDLAVDNYYYYGMDV

SEQ ID NO: 67299 - protein, 8 aa, Homo sapiens
  light chain complementarity determining region 3 for antibody 33650
QQYSDFNT

SEQ ID NO: 67300 - protein, 17 aa, Homo sapiens
  heavy chain complementarity determining region 3 for antibody 33650
AHRRYYNGNWNGATCDV

SEQ ID NO: 67301 - protein, 9 aa, Homo sapiens
  light chain complementarity determining region 3 for antibody 33651
QQYQSWPYT

SEQ ID NO: 67302 - protein, 10 aa, Homo sapiens
  heavy chain complementarity determining region 3 for antibody 33651
GFYHGGPCGY

SEQ ID NO: 67303 - protein, 9 aa, Homo sapiens
  light chain complementarity determining region 3 for antibody 33652
QQYNSYSYT

SEQ ID NO: 67304 - protein, 13 aa, Homo sapiens
  heavy chain complementarity determining region 3 for antibody 33652
ARGTYTYYYGMDV

SEQ ID NO: 67305 - protein, 9 aa, Homo sapiens
  light chain complementarity determining region 3 for antibody 33653
QQYNSFLTT

SEQ ID NO: 67306 - protein, 21 aa, Homo sapiens
  heavy chain complementarity determining region 3 for antibody 33653
AKDAPVFRPYSSGWYSSAFDS

SEQ ID NO: 67307 - protein, 10 aa, Homo sapiens
  light chain complementarity determining region 3 for antibody 33654
QQYNNWPLLT

SEQ ID NO: 67308 - protein, 14 aa, Homo sapiens
  heavy chain complementarity determining region 3 for antibody 33654
ARSVGSYLVGDFDN

SEQ ID NO: 67309 - protein, 10 aa, Homo sapiens
  light chain complementarity determining region 3 for antibody 33655
QQYGTSLPWT

SEQ ID NO: 67310 - protein, 14 aa, Homo sapiens
  heavy chain complementarity determining region 3 for antibody 33655
ARGGSSGYDSQLDF

SEQ ID NO: 67311 - protein, 9 aa, Homo sapiens
  light chain complementarity determining region 3 for antibody 33656
QQYGTPPRT

SEQ ID NO: 67312 - protein, 25 aa, Homo sapiens
  heavy chain complementarity determining region 3 for antibody 33656
ASLRVDRLRLPGAMRGPLYDRGLNV

SEQ ID NO: 67313 - protein, 6 aa, Homo sapiens
  light chain complementarity determining region 3 for antibody 33657
QQYGST

SEQ ID NO: 67314 - protein, 15 aa, Homo sapiens
  heavy chain complementarity determining region 3 for antibody 33657
ARGGLDGDYEDAFDI

SEQ ID NO: 67315 - protein, 10 aa, Homo sapiens
  light chain complementarity determining region 3 for antibody 33658
QQYGSSPQLT

SEQ ID NO: 67316 - protein, 18 aa, Homo sapiens
  heavy chain complementarity determining region 3 for antibody 33658
AASGRYFFQDSGPLGFAY

SEQ ID NO: 67317 - protein, 9 aa, Homo sapiens
  light chain complementarity determining region 3 for antibody 33659
QQYGRTPRT

SEQ ID NO: 67318 - protein, 14 aa, Homo sapiens
  heavy chain complementarity determining region 3 for antibody 33659
AGGDFCGADCYSDY

SEQ ID NO: 67319 - protein, 11 aa, Homo sapiens
  light chain complementarity determining region 3 for antibody 33660
QQYGGSPPGIT

SEQ ID NO: 67320 - protein, 13 aa, Homo sapiens
  heavy chain complementarity determining region 3 for antibody 33660
AKYRGGYTYAIES

SEQ ID NO: 67321 - protein, 9 aa, Homo sapiens
  light chain complementarity determining region 3 for antibody 33661
QQSYSTPWT

SEQ ID NO: 67322 - protein, 12 aa, Homo sapiens
  heavy chain complementarity determining region 3 for antibody 33661
GRAVAVSGHFDI

SEQ ID NO: 67323 - protein, 9 aa, Homo sapiens
  light chain complementarity determining region 3 for antibody 33662
QQSYSTPWT

SEQ ID NO: 67324 - protein, 11 aa, Homo sapiens
  heavy chain complementarity determining region 3 for antibody 33662
ARGRYLAPYDF

SEQ ID NO: 67325 - protein, 9 aa, Homo sapiens
  light chain complementarity determining region 3 for antibody 33663
QQSYSTPLT

SEQ ID NO: 67326 - protein, 22 aa, Homo sapiens
  heavy chain complementarity determining region 3 for antibody 33663
AKPGYYGSGRDLQIYYYHGMDV

SEQ ID NO: 67327 - protein, 10 aa, Homo sapiens
  light chain complementarity determining region 3 for antibody 33664
QQSYSTPLFT

SEQ ID NO: 67328 - protein, 10 aa, Homo sapiens
  heavy chain complementarity determining region 3 for antibody 33664
TTSRWGPFDY

SEQ ID NO: 67329 - protein, 9 aa, Homo sapiens
  light chain complementarity determining region 3 for antibody 33665
QQSYSSPRT

SEQ ID NO: 67330 - protein, 22 aa, Homo sapiens
  heavy chain complementarity determining region 3 for antibody 33665
AREPAPYYDILIVDDYYYGMDV

SEQ ID NO: 67331 - protein, 8 aa, Homo sapiens
  light chain complementarity determining region 3 for antibody 33666
QQSYSGHA

SEQ ID NO: 67332 - protein, 12 aa, Homo sapiens
  heavy chain complementarity determining region 3 for antibody 33666
ARDLGRSTPLDP

SEQ ID NO: 67333 - protein, 9 aa, Homo sapiens
  light chain complementarity determining region 3 for antibody 33667
QQRSNWPLT

SEQ ID NO: 67334 - protein, 22 aa, Homo sapiens
  heavy chain complementarity determining region 3 for antibody 33667
ARVPYYYDSSGYYYDYYYGMDV

SEQ ID NO: 67335 - protein, 10 aa, Homo sapiens
  light chain complementarity determining region 3 for antibody 33668
QQGSNWPPLT

SEQ ID NO: 67336 - protein, 14 aa, Homo sapiens
  heavy chain complementarity determining region 3 for antibody 33668
ANGSTNKSLWYFDL

SEQ ID NO: 67337 - protein, 11 aa, Homo sapiens
  light chain complementarity determining region 3 for antibody 33669
QQFNYYPHEIT

SEQ ID NO: 67338 - protein, 18 aa, Homo sapiens
  heavy chain complementarity determining region 3 for antibody 33669
ASNWYYYDRNGPAEYFHH

SEQ ID NO: 67339 - protein, 9 aa, Homo sapiens
  light chain complementarity determining region 3 for antibody 33670
QQAHSLPFT

SEQ ID NO: 67340 - protein, 18 aa, Homo sapiens
  heavy chain complementarity determining region 3 for antibody 33670
AKDGSGMVVATRYWYFDV

SEQ ID NO: 67341 - protein, 9 aa, Homo sapiens
  light chain complementarity determining region 3 for antibody 33671
QHYNSLPLT

SEQ ID NO: 67342 - protein, 17 aa, Homo sapiens
  heavy chain complementarity determining region 3 for antibody 33671
ARVSYSHSGTYYHFFDS

SEQ ID NO: 67343 - protein, 9 aa, Homo sapiens
  light chain complementarity determining region 3 for antibody 33672
QHYNGLWWP

SEQ ID NO: 67344 - protein, 13 aa, Homo sapiens
  heavy chain complementarity determining region 3 for antibody 33672
ARGQSGDPRTYDY

SEQ ID NO: 67345 - protein, 11 aa, Homo sapiens
  light chain complementarity determining region 3 for antibody 33673
QHYGSSPPRVT

SEQ ID NO: 67346 - protein, 28 aa, Homo sapiens
  heavy chain complementarity determining region 3 for antibody 33673
ARGAKKEKLIFVRPRDRGGDTRHWYFDL

SEQ ID NO: 67347 - protein, 9 aa, Homo sapiens
  light chain complementarity determining region 3 for antibody 33674
QHTHTFPRT

SEQ ID NO: 67348 - protein, 20 aa, Homo sapiens
  heavy chain complementarity determining region 3 for antibody 33674
GRGRRIAALSTAHYYYGMGV

SEQ ID NO: 67349 - protein, 11 aa, Homo sapiens
  light chain complementarity determining region 3 for antibody 33675
QHFDTSPPRGT

SEQ ID NO: 67350 - protein, 18 aa, Homo sapiens
  heavy chain complementarity determining region 3 for antibody 33675
ARGLRLRELSFLLLFFDY

SEQ ID NO: 67351 - protein, 10 aa, Homo sapiens
  light chain complementarity determining region 3 for antibody 33676
QHCVSSPAYT

SEQ ID NO: 67352 - protein, 12 aa, Homo sapiens
  heavy chain complementarity determining region 3 for antibody 33676
ARETTQFGELDN

SEQ ID NO: 67353 - protein, 8 aa, Homo sapiens
  light chain complementarity determining region 3 for antibody 33677
MQTLQGFT

SEQ ID NO: 67354 - protein, 12 aa, Homo sapiens
  heavy chain complementarity determining region 3 for antibody 33677
VRGAPDYGVFDF

SEQ ID NO: 67355 - protein, 10 aa, Homo sapiens
  light chain complementarity determining region 3 for antibody 33678
MQSIQPPRGT

SEQ ID NO: 67356 - protein, 8 aa, Homo sapiens
  heavy chain complementarity determining region 3 for antibody 33678
AKGYGFDC

SEQ ID NO: 67357 - protein, 10 aa, Homo sapiens
  light chain complementarity determining region 3 for antibody 33679
MQGTHWPPGT

SEQ ID NO: 67358 - protein, 7 aa, Homo sapiens
  heavy chain complementarity determining region 3 for antibody 33679
VRGTFDI

SEQ ID NO: 67359 - protein, 9 aa, Homo sapiens
  light chain complementarity determining region 3 for antibody 33680
MQGLQTPLT

SEQ ID NO: 67360 - protein, 14 aa, Homo sapiens
  heavy chain complementarity determining region 3 for antibody 33680
ARGRSELVAGYFDY

SEQ ID NO: 67361 - protein, 9 aa, Homo sapiens
  light chain complementarity determining region 3 for antibody 33681
MQGLQSPHT

SEQ ID NO: 67362 - protein, 15 aa, Homo sapiens
  heavy chain complementarity determining region 3 for antibody 33681
ARDYLSGTPGVAFDM

SEQ ID NO: 67363 - protein, 9 aa, Homo sapiens
  light chain complementarity determining region 3 for antibody 33682
MQGLHWPPT

SEQ ID NO: 67364 - protein, 10 aa, Homo sapiens
  heavy chain complementarity determining region 3 for antibody 33682
CRGPGGYPDS

SEQ ID NO: 67365 - protein, 9 aa, Homo sapiens
  light chain complementarity determining region 3 for antibody 33683
MQDTHWPLT

SEQ ID NO: 67366 - protein, 8 aa, Homo sapiens
  heavy chain complementarity determining region 3 for antibody 33683
ARTRTFDI

SEQ ID NO: 67367 - protein, 9 aa, Homo sapiens
  light chain complementarity determining region 3 for antibody 33684
MGTLQTPPT

SEQ ID NO: 67368 - protein, 12 aa, Homo sapiens
  heavy chain complementarity determining region 3 for antibody 33684
ARDLGYTSGWRL

SEQ ID NO: 67369 - protein, 8 aa, Homo sapiens
  light chain complementarity determining region 3 for antibody 33685
MAALPPFT

SEQ ID NO: 67370 - protein, 25 aa, Homo sapiens
  heavy chain complementarity determining region 3 for antibody 33685
ARAGDCSGGTCQGSEGYYYYSGMDV

SEQ ID NO: 67371 - protein, 9 aa, Homo sapiens
  light chain complementarity determining region 3 for antibody 33686
LQDYNYPYT

SEQ ID NO: 67372 - protein, 12 aa, Homo sapiens
  heavy chain complementarity determining region 3 for antibody 33686
VKDCGLGGPRDY

SEQ ID NO: 67373 - protein, 9 aa, Homo sapiens
  light chain complementarity determining region 3 for antibody 33687
HQYGSSPRT

SEQ ID NO: 67374 - protein, 17 aa, Homo sapiens
  heavy chain complementarity determining region 3 for antibody 33687
TTDPQWLAPPPFVTNDY

SEQ ID NO: 67375 - protein, 9 aa, Homo sapiens
  light chain complementarity determining region 3 for antibody 33688
HQYGSSPNT

SEQ ID NO: 67376 - protein, 18 aa, Homo sapiens
  heavy chain complementarity determining region 3 for antibody 33688
ARQLRHYDDIGFPTEFDH

SEQ ID NO: 67377 - protein, 9 aa, Homo sapiens
  light chain complementarity determining region 3 for antibody 33689
HQSGTLPWT

SEQ ID NO: 67378 - protein, 14 aa, Homo sapiens
  heavy chain complementarity determining region 3 for antibody 33689
VRDASGTGGWYADS

SEQ ID NO: 67379 - protein, 9 aa, Homo sapiens
  light chain complementarity determining region 3 for antibody 33690
EQSRSYPFT

SEQ ID NO: 67380 - protein, 15 aa, Homo sapiens
  heavy chain complementarity determining region 3 for antibody 33690
ARSSTISTATGYFDL

SEQ ID NO: 67381 - protein, 10 aa, Homo sapiens
  light chain complementarity determining region 3 for antibody 33691
QQYYTTPPWT

SEQ ID NO: 67382 - protein, 14 aa, Homo sapiens
  heavy chain complementarity determining region 3 for antibody 33691
AKIQALGDTWAFDL

SEQ ID NO: 67383 - protein, 9 aa, Homo sapiens
  light chain complementarity determining region 3 for antibody 33692
QQYYSTPFT

SEQ ID NO: 67384 - protein, 11 aa, Homo sapiens
  heavy chain complementarity determining region 3 for antibody 33692
ANSFYYDFCVY

SEQ ID NO: 67385 - protein, 9 aa, Homo sapiens
  light chain complementarity determining region 3 for antibody 33693
QQYYSSPIT

SEQ ID NO: 67386 - protein, 21 aa, Homo sapiens
  heavy chain complementarity determining region 3 for antibody 33693
AKDAGLSIFRYFDGLFDAFHI

SEQ ID NO: 67387 - protein, 9 aa, Homo sapiens
  light chain complementarity determining region 3 for antibody 33694
QQYYSFPFT

SEQ ID NO: 67388 - protein, 13 aa, Homo sapiens
  heavy chain complementarity determining region 3 for antibody 33694
TTVGGAVARGFDY

SEQ ID NO: 67389 - protein, 9 aa, Homo sapiens
  light chain complementarity determining region 3 for antibody 33695
QQYYNVPPT

SEQ ID NO: 67390 - protein, 20 aa, Homo sapiens
  heavy chain complementarity determining region 3 for antibody 33695
VRDSVPHTTGHRPGITINGY

SEQ ID NO: 67391 - protein, 9 aa, Homo sapiens
  light chain complementarity determining region 3 for antibody 33696
QQYYNPPYT

SEQ ID NO: 67392 - protein, 12 aa, Homo sapiens
  heavy chain complementarity determining region 3 for antibody 33696
ARGGPSSRYFDY

SEQ ID NO: 67393 - protein, 8 aa, Homo sapiens
  light chain complementarity determining region 3 for antibody 33697
QQYYNLLS

SEQ ID NO: 67394 - protein, 5 aa, Homo sapiens
  heavy chain complementarity determining region 3 for antibody 33697
ASSRL

SEQ ID NO: 67395 - protein, 9 aa, Homo sapiens
  light chain complementarity determining region 3 for antibody 33698
QQYTNWSFT

SEQ ID NO: 67396 - protein, 20 aa, Homo sapiens
  heavy chain complementarity determining region 3 for antibody 33698
ARAGMVGDYDFWSGHGGFDP

SEQ ID NO: 67397 - protein, 8 aa, Homo sapiens
  light chain complementarity determining region 3 for antibody 33699
QQYNYWWT

SEQ ID NO: 67398 - protein, 16 aa, Homo sapiens
  heavy chain complementarity determining region 3 for antibody 33699
ARHGWDNWGRRGWFDP

SEQ ID NO: 67399 - protein, 8 aa, Homo sapiens
  light chain complementarity determining region 3 for antibody 33700
QQYNSYSA

SEQ ID NO: 67400 - protein, 17 aa, Homo sapiens
  heavy chain complementarity determining region 3 for antibody 33700
AKARFGSGWYFGDYFDY

SEQ ID NO: 67401 - protein, 9 aa, Homo sapiens
  light chain complementarity determining region 3 for antibody 33701
QQYNSYPWT

SEQ ID NO: 67402 - protein, 16 aa, Homo sapiens
  heavy chain complementarity determining region 3 for antibody 33701
ARGWLPYGDPKGAFDI

SEQ ID NO: 67403 - protein, 9 aa, Homo sapiens
  light chain complementarity determining region 3 for antibody 33702
QQYNNWPRT

SEQ ID NO: 67404 - protein, 12 aa, Homo sapiens
  heavy chain complementarity determining region 3 for antibody 33702
ATWGWFLLKEDY

SEQ ID NO: 67405 - protein, 11 aa, Homo sapiens
  light chain complementarity determining region 3 for antibody 33703
QQYNNWPPVYT

SEQ ID NO: 67406 - protein, 15 aa, Homo sapiens
  heavy chain complementarity determining region 3 for antibody 33703
ASAHLSSSFHRYFDF

SEQ ID NO: 67407 - protein, 10 aa, Homo sapiens
  light chain complementarity determining region 3 for antibody 33704
QQYKNWPTWT

SEQ ID NO: 67408 - protein, 20 aa, Homo sapiens
  heavy chain complementarity determining region 3 for antibody 33704
ARGDMVRGALAFYRYYALDV

SEQ ID NO: 67409 - protein, 9 aa, Homo sapiens
  light chain complementarity determining region 3 for antibody 33705
QQYKHWPQP

SEQ ID NO: 67410 - protein, 11 aa, Homo sapiens
  heavy chain complementarity determining region 3 for antibody 33705
ARGFFGESIDY

SEQ ID NO: 67411 - protein, 8 aa, Homo sapiens
  light chain complementarity determining region 3 for antibody 33706
QQYHYWWA

SEQ ID NO: 67412 - protein, 10 aa, Homo sapiens
  heavy chain complementarity determining region 3 for antibody 33706
AARPSGSYPR

SEQ ID NO: 67413 - protein, 9 aa, Homo sapiens
  light chain complementarity determining region 3 for antibody 33707
QQYGTSPPN

SEQ ID NO: 67414 - protein, 13 aa, Homo sapiens
  heavy chain complementarity determining region 3 for antibody 33707
ASISVGTVAAGKG

SEQ ID NO: 67415 - protein, 9 aa, Homo sapiens
  light chain complementarity determining region 3 for antibody 33708
QQYGSSPWT

SEQ ID NO: 67416 - protein, 11 aa, Homo sapiens
  heavy chain complementarity determining region 3 for antibody 33708
AREGWLGSFDY

SEQ ID NO: 67417 - protein, 9 aa, Homo sapiens
  light chain complementarity determining region 3 for antibody 33709
QQYGSSPVT

SEQ ID NO: 67418 - protein, 26 aa, Homo sapiens
  heavy chain complementarity determining region 3 for antibody 33709
AREPHTYYYGSGSYSRRLYYYYGMDV

SEQ ID NO: 67419 - protein, 10 aa, Homo sapiens
  light chain complementarity determining region 3 for antibody 33710
QQYGSSPTWT

SEQ ID NO: 67420 - protein, 12 aa, Homo sapiens
  heavy chain complementarity determining region 3 for antibody 33710
AKFVGQQLVLDY

SEQ ID NO: 67421 - protein, 9 aa, Homo sapiens
  light chain complementarity determining region 3 for antibody 33711
QQYGRSPLT

SEQ ID NO: 67422 - protein, 12 aa, Homo sapiens
  heavy chain complementarity determining region 3 for antibody 33711
ARAQLWSNDIDY

SEQ ID NO: 67423 - protein, 9 aa, Homo sapiens
  light chain complementarity determining region 3 for antibody 33712
QQYGRIPRS

SEQ ID NO: 67424 - protein, 13 aa, Homo sapiens
  heavy chain complementarity determining region 3 for antibody 33712
AGGTWHSGIYYES

SEQ ID NO: 67425 - protein, 9 aa, Homo sapiens
  light chain complementarity determining region 3 for antibody 33713
QQYGNSPWT

SEQ ID NO: 67426 - protein, 18 aa, Homo sapiens
  heavy chain complementarity determining region 3 for antibody 33713
ARVSGLRSNGDYVFAFEI

SEQ ID NO: 67427 - protein, 10 aa, Homo sapiens
  light chain complementarity determining region 3 for antibody 33714
QQYGNSPPFP

SEQ ID NO: 67428 - protein, 13 aa, Homo sapiens
  heavy chain complementarity determining region 3 for antibody 33714
ASWSHSDLDAFDI

SEQ ID NO: 67429 - protein, 9 aa, Homo sapiens
  light chain complementarity determining region 3 for antibody 33715
QQYDYLPFT

SEQ ID NO: 67430 - protein, 27 aa, Homo sapiens
  heavy chain complementarity determining region 3 for antibody 33715
ARGANCSGGGCYLGGTGTYTYYYGMGV

SEQ ID NO: 67431 - protein, 9 aa, Homo sapiens
  light chain complementarity determining region 3 for antibody 33716
QQYDNLLLT

SEQ ID NO: 67432 - protein, 12 aa, Homo sapiens
  heavy chain complementarity determining region 3 for antibody 33716
ARELGRDGGFDY

SEQ ID NO: 67433 - protein, 8 aa, Homo sapiens
  light chain complementarity determining region 3 for antibody 33717
QQTGPSWT

SEQ ID NO: 67434 - protein, 14 aa, Homo sapiens
  heavy chain complementarity determining region 3 for antibody 33717
ARGLQGNGWEPFEF

SEQ ID NO: 67435 - protein, 10 aa, Homo sapiens
  light chain complementarity determining region 3 for antibody 33718
QQSYSTPPYT

SEQ ID NO: 67436 - protein, 18 aa, Homo sapiens
  heavy chain complementarity determining region 3 for antibody 33718
ARSPYCEGDCFSRAQLDY

SEQ ID NO: 67437 - protein, 9 aa, Homo sapiens
  light chain complementarity determining region 3 for antibody 33719
QQSYSTPPT

SEQ ID NO: 67438 - protein, 11 aa, Homo sapiens
  heavy chain complementarity determining region 3 for antibody 33719
TGERAGTIVDY

SEQ ID NO: 67439 - protein, 10 aa, Homo sapiens
  light chain complementarity determining region 3 for antibody 33720
QQSYSTFSWT

SEQ ID NO: 67440 - protein, 14 aa, Homo sapiens
  heavy chain complementarity determining region 3 for antibody 33720
ARVDTSGGKNCFDP

SEQ ID NO: 67441 - protein, 8 aa, Homo sapiens
  light chain complementarity determining region 3 for antibody 33721
QQSYSIYT

SEQ ID NO: 67442 - protein, 17 aa, Homo sapiens
  heavy chain complementarity determining region 3 for antibody 33721
ARGDRDSGWYLLNAFDI

SEQ ID NO: 67443 - protein, 9 aa, Homo sapiens
  light chain complementarity determining region 3 for antibody 33722
QQSYSIPYT

SEQ ID NO: 67444 - protein, 15 aa, Homo sapiens
  heavy chain complementarity determining region 3 for antibody 33722
TTAPGAIWLGELKDS

SEQ ID NO: 67445 - protein, 9 aa, Homo sapiens
  light chain complementarity determining region 3 for antibody 33723
QQSYRTPRT

SEQ ID NO: 67446 - protein, 17 aa, Homo sapiens
  heavy chain complementarity determining region 3 for antibody 33723
ARVHYDSSGYYYDAFDI

SEQ ID NO: 67447 - protein, 8 aa, Homo sapiens
  light chain complementarity determining region 3 for antibody 33724
QQRSSWPT

SEQ ID NO: 67448 - protein, 26 aa, Homo sapiens
  heavy chain complementarity determining region 3 for antibody 33724
ARGVGATYYDLSASNPASRVYWFFDV

SEQ ID NO: 67449 - protein, 8 aa, Homo sapiens
  light chain complementarity determining region 3 for antibody 33725
QQRSNPFT

SEQ ID NO: 67450 - protein, 9 aa, Homo sapiens
  heavy chain complementarity determining region 3 for antibody 33725
AREWRGFDY

SEQ ID NO: 67451 - protein, 9 aa, Homo sapiens
  light chain complementarity determining region 3 for antibody 33726
QQLNSYPLT

SEQ ID NO: 67452 - protein, 10 aa, Homo sapiens
  heavy chain complementarity determining region 3 for antibody 33726
ATDRRSVLSY

SEQ ID NO: 67453 - protein, 8 aa, Homo sapiens
  light chain complementarity determining region 3 for antibody 33727
QQLNSLPT

SEQ ID NO: 67454 - protein, 12 aa, Homo sapiens
  heavy chain complementarity determining region 3 for antibody 33727
ARGYSAAWYFAF

SEQ ID NO: 67455 - protein, 8 aa, Homo sapiens
  light chain complementarity determining region 3 for antibody 33728
QQHVSSGS

SEQ ID NO: 67456 - protein, 13 aa, Homo sapiens
  heavy chain complementarity determining region 3 for antibody 33728
VRTWFGELSHFDY

SEQ ID NO: 67457 - protein, 9 aa, Homo sapiens
  light chain complementarity determining region 3 for antibody 33729
QQHTTYPFT

SEQ ID NO: 67458 - protein, 14 aa, Homo sapiens
  heavy chain complementarity determining region 3 for antibody 33729
ARGGPIRLHSYFQH

SEQ ID NO: 67459 - protein, 11 aa, Homo sapiens
  light chain complementarity determining region 3 for antibody 33730
QLYGSSPPMYT

SEQ ID NO: 67460 - protein, 10 aa, Homo sapiens
  heavy chain complementarity determining region 3 for antibody 33730
ISNGYYCLEY

SEQ ID NO: 67461 - protein, 9 aa, Homo sapiens
  light chain complementarity determining region 3 for antibody 33731
QHYGSSPFP

SEQ ID NO: 67462 - protein, 18 aa, Homo sapiens
  heavy chain complementarity determining region 3 for antibody 33731
ARRANYCTNGFCFRVFDY

SEQ ID NO: 67463 - protein, 9 aa, Homo sapiens
  light chain complementarity determining region 3 for antibody 33732
QHYGGSPYT

SEQ ID NO: 67464 - protein, 18 aa, Homo sapiens
  heavy chain complementarity determining region 3 for antibody 33732
ARTRWDSYGFGRGWYFDL

SEQ ID NO: 67465 - protein, 9 aa, Homo sapiens
  light chain complementarity determining region 3 for antibody 33733
QHSHSRPFT

SEQ ID NO: 67466 - protein, 20 aa, Homo sapiens
  heavy chain complementarity determining region 3 for antibody 33733
AKGVSVAALRTVYYYYGLDV

SEQ ID NO: 67467 - protein, 10 aa, Homo sapiens
  light chain complementarity determining region 3 for antibody 33734
QCRDTWPPVI

SEQ ID NO: 67468 - protein, 12 aa, Homo sapiens
  heavy chain complementarity determining region 3 for antibody 33734
VRDHIAGWKFDY

SEQ ID NO: 67469 - protein, 9 aa, Homo sapiens
  light chain complementarity determining region 3 for antibody 33735
MQTLHTPWT

SEQ ID NO: 67470 - protein, 16 aa, Homo sapiens
  heavy chain complementarity determining region 3 for antibody 33735
ARVQTAAVIHVYGLDV

SEQ ID NO: 67471 - protein, 9 aa, Homo sapiens
  light chain complementarity determining region 3 for antibody 33736
MQSRRGPHT

SEQ ID NO: 67472 - protein, 8 aa, Homo sapiens
  heavy chain complementarity determining region 3 for antibody 33736
TAWGSSQH

SEQ ID NO: 67473 - protein, 10 aa, Homo sapiens
  light chain complementarity determining region 3 for antibody 33737
MQGTHWPPYT

SEQ ID NO: 67474 - protein, 15 aa, Homo sapiens
  heavy chain complementarity determining region 3 for antibody 33737
AKSTVTTMSGGHVDS

SEQ ID NO: 67475 - protein, 9 aa, Homo sapiens
  light chain complementarity determining region 3 for antibody 33738
MQGLQTPYT

SEQ ID NO: 67476 - protein, 10 aa, Homo sapiens
  heavy chain complementarity determining region 3 for antibody 33738
VGELVGSRDS

SEQ ID NO: 67477 - protein, 9 aa, Homo sapiens
  light chain complementarity determining region 3 for antibody 33739
MQGLQTPDT

SEQ ID NO: 67478 - protein, 10 aa, Homo sapiens
  heavy chain complementarity determining region 3 for antibody 33739
GRDLSGARDY

SEQ ID NO: 67479 - protein, 8 aa, Homo sapiens
  light chain complementarity determining region 3 for antibody 33740
MQGLESPT

SEQ ID NO: 67480 - protein, 12 aa, Homo sapiens
  heavy chain complementarity determining region 3 for antibody 33740
GRHDQWLVRMGN

SEQ ID NO: 67481 - protein, 9 aa, Homo sapiens
  light chain complementarity determining region 3 for antibody 33741
MQALQTPLT

SEQ ID NO: 67482 - protein, 15 aa, Homo sapiens
  heavy chain complementarity determining region 3 for antibody 33741
ARYRDRGSGYGALDM

SEQ ID NO: 67483 - protein, 9 aa, Homo sapiens
  light chain complementarity determining region 3 for antibody 33742
MQALEIPFT

SEQ ID NO: 67484 - protein, 15 aa, Homo sapiens
  heavy chain complementarity determining region 3 for antibody 33742
VRHYRETVAGIEGDS

SEQ ID NO: 67485 - protein, 9 aa, Homo sapiens
  light chain complementarity determining region 3 for antibody 33743
LQHFTFPLT

SEQ ID NO: 67486 - protein, 18 aa, Homo sapiens
  heavy chain complementarity determining region 3 for antibody 33743
ARVFEWFGEIRGDGCSDY

SEQ ID NO: 67487 - protein, 9 aa, Homo sapiens
  light chain complementarity determining region 3 for antibody 33744
KQYYTTPLP

SEQ ID NO: 67488 - protein, 14 aa, Homo sapiens
  heavy chain complementarity determining region 3 for antibody 33744
AKDRIAVGISVWEY

SEQ ID NO: 67489 - protein, 9 aa, Homo sapiens
  light chain complementarity determining region 3 for antibody 33745
KQYYTNPLT

SEQ ID NO: 67490 - protein, 14 aa, Homo sapiens
  heavy chain complementarity determining region 3 for antibody 33745
AKDRIAVGISVWEY

SEQ ID NO: 67491 - protein, 10 aa, Homo sapiens
  light chain complementarity determining region 3 for antibody 33746
QRTYNAPPFT

SEQ ID NO: 67492 - protein, 17 aa, Homo sapiens
  heavy chain complementarity determining region 3 for antibody 33746
TTEQISNDYYDSGAFDY

SEQ ID NO: 67493 - protein, 9 aa, Homo sapiens
  light chain complementarity determining region 3 for antibody 33747
QQYYNIPYT

SEQ ID NO: 67494 - protein, 17 aa, Homo sapiens
  heavy chain complementarity determining region 3 for antibody 33747
ARDDTAMAKVAYWYFNV

SEQ ID NO: 67495 - protein, 9 aa, Homo sapiens
  light chain complementarity determining region 3 for antibody 33748
QQYNTWPVA

SEQ ID NO: 67496 - protein, 17 aa, Homo sapiens
  heavy chain complementarity determining region 3 for antibody 33748
ARAPSDDLVVVVAAFDS

SEQ ID NO: 67497 - protein, 9 aa, Homo sapiens
  light chain complementarity determining region 3 for antibody 33749
QQYNSFPWT

SEQ ID NO: 67498 - protein, 11 aa, Homo sapiens
  heavy chain complementarity determining region 3 for antibody 33749
VRRVYNDFFGD

SEQ ID NO: 67499 - protein, 10 aa, Homo sapiens
  light chain complementarity determining region 3 for antibody 33750
QQYHHLPPCT

SEQ ID NO: 67500 - protein, 11 aa, Homo sapiens
  heavy chain complementarity determining region 3 for antibody 33750
ARGLSSGLYDF

SEQ ID NO: 67501 - protein, 9 aa, Homo sapiens
  light chain complementarity determining region 3 for antibody 33751
QQYGTIPRT

SEQ ID NO: 67502 - protein, 13 aa, Homo sapiens
  heavy chain complementarity determining region 3 for antibody 33751
AGGNFHRSGYADY

SEQ ID NO: 67503 - protein, 9 aa, Homo sapiens
  light chain complementarity determining region 3 for antibody 33752
QQYGSSPRT

SEQ ID NO: 67504 - protein, 17 aa, Homo sapiens
  heavy chain complementarity determining region 3 for antibody 33752
TTDPQWLEPPPFVTNDY

SEQ ID NO: 67505 - protein, 9 aa, Homo sapiens
  light chain complementarity determining region 3 for antibody 33753
QQYGSSPRT

SEQ ID NO: 67506 - protein, 16 aa, Homo sapiens
  heavy chain complementarity determining region 3 for antibody 33753
ATSPGIREASGYYFDY

SEQ ID NO: 67507 - protein, 10 aa, Homo sapiens
  light chain complementarity determining region 3 for antibody 33754
QQYGSSPPWT

SEQ ID NO: 67508 - protein, 28 aa, Homo sapiens
  heavy chain complementarity determining region 3 for antibody 33754
ARVKRGSGGWYSPRAEIKKHYYYYAMDV

SEQ ID NO: 67509 - protein, 10 aa, Homo sapiens
  light chain complementarity determining region 3 for antibody 33755
QQYGSSPPLP

SEQ ID NO: 67510 - protein, 18 aa, Homo sapiens
  heavy chain complementarity determining region 3 for antibody 33755
ARGGYDYGWGSYGVYFDY

SEQ ID NO: 67511 - protein, 10 aa, Homo sapiens
  light chain complementarity determining region 3 for antibody 33756
QQYGSSPPDT

SEQ ID NO: 67512 - protein, 17 aa, Homo sapiens
  heavy chain complementarity determining region 3 for antibody 33756
ARDRGYSYGPLYGYFDH

SEQ ID NO: 67513 - protein, 9 aa, Homo sapiens
  light chain complementarity determining region 3 for antibody 33757
QQYGSSPFT

SEQ ID NO: 67514 - protein, 14 aa, Homo sapiens
  heavy chain complementarity determining region 3 for antibody 33757
ARDAYIGNWRHFDS

SEQ ID NO: 67515 - protein, 9 aa, Homo sapiens
  light chain complementarity determining region 3 for antibody 33758
QQYGHLPRT

SEQ ID NO: 67516 - protein, 13 aa, Homo sapiens
  heavy chain complementarity determining region 3 for antibody 33758
AGGDFHRGGYSEY

SEQ ID NO: 67517 - protein, 8 aa, Homo sapiens
  light chain complementarity determining region 3 for antibody 33759
QQYGGSPG

SEQ ID NO: 67518 - protein, 16 aa, Homo sapiens
  heavy chain complementarity determining region 3 for antibody 33759
ATDWGSGTQWIRAFDV

SEQ ID NO: 67519 - protein, 8 aa, Homo sapiens
  light chain complementarity determining region 3 for antibody 33760
QQYGGLPS

SEQ ID NO: 67520 - protein, 16 aa, Homo sapiens
  heavy chain complementarity determining region 3 for antibody 33760
ATDWGSGTQWIRAFDV

SEQ ID NO: 67521 - protein, 11 aa, Homo sapiens
  light chain complementarity determining region 3 for antibody 33761
QQYDRSQPMYT

SEQ ID NO: 67522 - protein, 14 aa, Homo sapiens
  heavy chain complementarity determining region 3 for antibody 33761
ARHMTLSGTRGFDY

SEQ ID NO: 67523 - protein, 10 aa, Homo sapiens
  light chain complementarity determining region 3 for antibody 33762
QQTYSTPRDT

SEQ ID NO: 67524 - protein, 14 aa, Homo sapiens
  heavy chain complementarity determining region 3 for antibody 33762
ARDRFGDSRISFDS

SEQ ID NO: 67525 - protein, 10 aa, Homo sapiens
  light chain complementarity determining region 3 for antibody 33763
QQTFSPLALT

SEQ ID NO: 67526 - protein, 23 aa, Homo sapiens
  heavy chain complementarity determining region 3 for antibody 33763
ARTPPFGDLSSVTFYQFFYGMDV

SEQ ID NO: 67527 - protein, 9 aa, Homo sapiens
  light chain complementarity determining region 3 for antibody 33764
QQSYSTSIT

SEQ ID NO: 67528 - protein, 18 aa, Homo sapiens
  heavy chain complementarity determining region 3 for antibody 33764
ARDISSGWLDYSYYGMDV

SEQ ID NO: 67529 - protein, 9 aa, Homo sapiens
  light chain complementarity determining region 3 for antibody 33765
QQSYSTPYT

SEQ ID NO: 67530 - protein, 15 aa, Homo sapiens
  heavy chain complementarity determining region 3 for antibody 33765
ARDTSGLWGSGYFHH

SEQ ID NO: 67531 - protein, 9 aa, Homo sapiens
  light chain complementarity determining region 3 for antibody 33766
QQSYSTPVT

SEQ ID NO: 67532 - protein, 16 aa, Homo sapiens
  heavy chain complementarity determining region 3 for antibody 33766
ARTVGITMIERHVFDL

SEQ ID NO: 67533 - protein, 9 aa, Homo sapiens
  light chain complementarity determining region 3 for antibody 33767
QQSYSTPRT

SEQ ID NO: 67534 - protein, 13 aa, Homo sapiens
  heavy chain complementarity determining region 3 for antibody 33767
ARDLHTSSWEFDY

SEQ ID NO: 67535 - protein, 9 aa, Homo sapiens
  light chain complementarity determining region 3 for antibody 33768
QQSYSTPLT

SEQ ID NO: 67536 - protein, 17 aa, Homo sapiens
  heavy chain complementarity determining region 3 for antibody 33768
ARSLYKVGASMAEYFQY

SEQ ID NO: 67537 - protein, 9 aa, Homo sapiens
  light chain complementarity determining region 3 for antibody 33769
QQSYSSLLT

SEQ ID NO: 67538 - protein, 16 aa, Homo sapiens
  heavy chain complementarity determining region 3 for antibody 33769
AREGGSTYPTKRAFDS

SEQ ID NO: 67539 - protein, 9 aa, Homo sapiens
  light chain complementarity determining region 3 for antibody 33770
QQSYNPLYT

SEQ ID NO: 67540 - protein, 16 aa, Homo sapiens
  heavy chain complementarity determining region 3 for antibody 33770
ARGGRVGASYYYGMDV

SEQ ID NO: 67541 - protein, 9 aa, Homo sapiens
  light chain complementarity determining region 3 for antibody 33771
QQSHSTPRT

SEQ ID NO: 67542 - protein, 12 aa, Homo sapiens
  heavy chain complementarity determining region 3 for antibody 33771
AKSSHRMGAFDI

SEQ ID NO: 67543 - protein, 10 aa, Homo sapiens
  light chain complementarity determining region 3 for antibody 33772
QQSFTTPTWT

SEQ ID NO: 67544 - protein, 19 aa, Homo sapiens
  heavy chain complementarity determining region 3 for antibody 33772
ARQGDDVVVLAASPSSFDV

SEQ ID NO: 67545 - protein, 9 aa, Homo sapiens
  light chain complementarity determining region 3 for antibody 33773
QQSDSTPIT

SEQ ID NO: 67546 - protein, 16 aa, Homo sapiens
  heavy chain complementarity determining region 3 for antibody 33773
SRGAYYSSSWYGWFDP

SEQ ID NO: 67547 - protein, 10 aa, Homo sapiens
  light chain complementarity determining region 3 for antibody 33774
QQRYNWPPYT

SEQ ID NO: 67548 - protein, 11 aa, Homo sapiens
  heavy chain complementarity determining region 3 for antibody 33774
ARGVGSYVFDS

SEQ ID NO: 67549 - protein, 9 aa, Homo sapiens
  light chain complementarity determining region 3 for antibody 33775
QQRSNWPIT

SEQ ID NO: 67550 - protein, 25 aa, Homo sapiens
  heavy chain complementarity determining region 3 for antibody 33775
TTLPNYFGSESYHQMSSDYYYGMDV

SEQ ID NO: 67551 - protein, 9 aa, Homo sapiens
  light chain complementarity determining region 3 for antibody 33776
QQRRDWRVT

SEQ ID NO: 67552 - protein, 17 aa, Homo sapiens
  heavy chain complementarity determining region 3 for antibody 33776
AKPINIYDRSGSYSFDY

SEQ ID NO: 67553 - protein, 9 aa, Homo sapiens
  light chain complementarity determining region 3 for antibody 33777
QQRHTVPYD

SEQ ID NO: 67554 - protein, 16 aa, Homo sapiens
  heavy chain complementarity determining region 3 for antibody 33777
ARDGPPTRYSSSWLVY

SEQ ID NO: 67555 - protein, 9 aa, Homo sapiens
  light chain complementarity determining region 3 for antibody 33778
QQRFNWPIA

SEQ ID NO: 67556 - protein, 8 aa, Homo sapiens
  heavy chain complementarity determining region 3 for antibody 33778
ARWDNFDS

SEQ ID NO: 67557 - protein, 9 aa, Homo sapiens
  light chain complementarity determining region 3 for antibody 33779
QQGSNWPWT

SEQ ID NO: 67558 - protein, 9 aa, Homo sapiens
  heavy chain complementarity determining region 3 for antibody 33779
ARVLVTEGG

SEQ ID NO: 67559 - protein, 9 aa, Homo sapiens
  light chain complementarity determining region 3 for antibody 33780
QQFNTYPIT

SEQ ID NO: 67560 - protein, 18 aa, Homo sapiens
  heavy chain complementarity determining region 3 for antibody 33780
ARGPYCSGEICYSQYFDS

SEQ ID NO: 67561 - protein, 10 aa, Homo sapiens
  light chain complementarity determining region 3 for antibody 33781
QQFDSSPRGT

SEQ ID NO: 67562 - protein, 16 aa, Homo sapiens
  heavy chain complementarity determining region 3 for antibody 33781
ARDSSIVVIPGGFLDL

SEQ ID NO: 67563 - protein, 10 aa, Homo sapiens
  light chain complementarity determining region 3 for antibody 33782
QQANSVLSVS

SEQ ID NO: 67564 - protein, 12 aa, Homo sapiens
  heavy chain complementarity determining region 3 for antibody 33782
ARRKLRMRSFDV

SEQ ID NO: 67565 - protein, 8 aa, Homo sapiens
  light chain complementarity determining region 3 for antibody 33783
QKYNSAPL

SEQ ID NO: 67566 - protein, 15 aa, Homo sapiens
  heavy chain complementarity determining region 3 for antibody 33783
VRHYRETVAGIEGDS

SEQ ID NO: 67567 - protein, 9 aa, Homo sapiens
  light chain complementarity determining region 3 for antibody 33784
QKYDSVPLT

SEQ ID NO: 67568 - protein, 16 aa, Homo sapiens
  heavy chain complementarity determining region 3 for antibody 33784
ARKPAPDTSGSYPLDY

SEQ ID NO: 67569 - protein, 11 aa, Homo sapiens
  light chain complementarity determining region 3 for antibody 33785
QHYNNWPPVLT

SEQ ID NO: 67570 - protein, 11 aa, Homo sapiens
  heavy chain complementarity determining region 3 for antibody 33785
ARFLANSGLDY

SEQ ID NO: 67571 - protein, 9 aa, Homo sapiens
  light chain complementarity determining region 3 for antibody 33786
QHYNNIYGT

SEQ ID NO: 67572 - protein, 14 aa, Homo sapiens
  heavy chain complementarity determining region 3 for antibody 33786
VRASGSNLQTPFDF

SEQ ID NO: 67573 - protein, 9 aa, Homo sapiens
  light chain complementarity determining region 3 for antibody 33787
QHYNASSWT

SEQ ID NO: 67574 - protein, 16 aa, Homo sapiens
  heavy chain complementarity determining region 3 for antibody 33787
ASLGGAHYYGPGSHYF

SEQ ID NO: 67575 - protein, 10 aa, Homo sapiens
  light chain complementarity determining region 3 for antibody 33788
QHYGPSPGNP

SEQ ID NO: 67576 - protein, 21 aa, Homo sapiens
  heavy chain complementarity determining region 3 for antibody 33788
ARDAPVSRPYSSGWYSSAFDY

SEQ ID NO: 67577 - protein, 9 aa, Homo sapiens
  light chain complementarity determining region 3 for antibody 33789
QHTHTFPRP

SEQ ID NO: 67578 - protein, 20 aa, Homo sapiens
  heavy chain complementarity determining region 3 for antibody 33789
GRGRRIAALSTAHYYYGMDV

SEQ ID NO: 67579 - protein, 10 aa, Homo sapiens
  light chain complementarity determining region 3 for antibody 33790
QHNYWSSPLT

SEQ ID NO: 67580 - protein, 13 aa, Homo sapiens
  heavy chain complementarity determining region 3 for antibody 33790
VRGRNYDRDGFDP

SEQ ID NO: 67581 - protein, 9 aa, Homo sapiens
  light chain complementarity determining region 3 for antibody 33791
QEYNSFYRT

SEQ ID NO: 67582 - protein, 16 aa, Homo sapiens
  heavy chain complementarity determining region 3 for antibody 33791
ANVVGNVAAAGEYCQH

SEQ ID NO: 67583 - protein, 9 aa, Homo sapiens
  light chain complementarity determining region 3 for antibody 33792
QESYSTQWT

SEQ ID NO: 67584 - protein, 23 aa, Homo sapiens
  heavy chain complementarity determining region 3 for antibody 33792
ARLSRDPIAVRTLPLDYYFGMDV

SEQ ID NO: 67585 - protein, 9 aa, Homo sapiens
  light chain complementarity determining region 3 for antibody 33793
QANENFPYA

SEQ ID NO: 67586 - protein, 12 aa, Homo sapiens
  heavy chain complementarity determining region 3 for antibody 33793
ATEPPATGGADF

SEQ ID NO: 67587 - protein, 10 aa, Homo sapiens
  light chain complementarity determining region 3 for antibody 33794
MQSTHWPRIT

SEQ ID NO: 67588 - protein, 16 aa, Homo sapiens
  heavy chain complementarity determining region 3 for antibody 33794
VKDALTSYYDSSGYYH

SEQ ID NO: 67589 - protein, 9 aa, Homo sapiens
  light chain complementarity determining region 3 for antibody 33795
MQGTYGPHI

SEQ ID NO: 67590 - protein, 11 aa, Homo sapiens
  heavy chain complementarity determining region 3 for antibody 33795
ARDPFFGALDC

SEQ ID NO: 67591 - protein, 8 aa, Homo sapiens
  light chain complementarity determining region 3 for antibody 33796
MQGTHMYP

SEQ ID NO: 67592 - protein, 15 aa, Homo sapiens
  heavy chain complementarity determining region 3 for antibody 33796
ARCGANSCPQSAMDV

SEQ ID NO: 67593 - protein, 9 aa, Homo sapiens
  light chain complementarity determining region 3 for antibody 33797
MQGLQTPYT

SEQ ID NO: 67594 - protein, 10 aa, Homo sapiens
  heavy chain complementarity determining region 3 for antibody 33797
GRDLSGASDY

SEQ ID NO: 67595 - protein, 10 aa, Homo sapiens
  light chain complementarity determining region 3 for antibody 33798
MQGAHWLPWT

SEQ ID NO: 67596 - protein, 13 aa, Homo sapiens
  heavy chain complementarity determining region 3 for antibody 33798
NVGMVGHTSPVDH

SEQ ID NO: 67597 - protein, 9 aa, Homo sapiens
  light chain complementarity determining region 3 for antibody 33799
MQALQTPST

SEQ ID NO: 67598 - protein, 21 aa, Homo sapiens
  heavy chain complementarity determining region 3 for antibody 33799
ARDAPVSRPYSSGWYSSAFDY

SEQ ID NO: 67599 - protein, 9 aa, Homo sapiens
  light chain complementarity determining region 3 for antibody 33800
MQALQTPLT

SEQ ID NO: 67600 - protein, 13 aa, Homo sapiens
  heavy chain complementarity determining region 3 for antibody 33800
ARGRYSRDWLPEY

SEQ ID NO: 67601 - protein, 9 aa, Homo sapiens
  light chain complementarity determining region 3 for antibody 33801
MQALQTPIT

SEQ ID NO: 67602 - protein, 10 aa, Homo sapiens
  heavy chain complementarity determining region 3 for antibody 33801
GMSIAVAASK

SEQ ID NO: 67603 - protein, 8 aa, Homo sapiens
  light chain complementarity determining region 3 for antibody 33802
LQYSSFWT

SEQ ID NO: 67604 - protein, 14 aa, Homo sapiens
  heavy chain complementarity determining region 3 for antibody 33802
ARDHPDYDVSACDH

SEQ ID NO: 67605 - protein, 8 aa, Homo sapiens
  light chain complementarity determining region 3 for antibody 33803
LQYNNVWT

SEQ ID NO: 67606 - protein, 8 aa, Homo sapiens
  heavy chain complementarity determining region 3 for antibody 33803
ASNVDQGY

SEQ ID NO: 67607 - protein, 9 aa, Homo sapiens
  light chain complementarity determining region 3 for antibody 33804
LQSYSCPYT

SEQ ID NO: 67608 - protein, 11 aa, Homo sapiens
  heavy chain complementarity determining region 3 for antibody 33804
ATMAPWRQPPP

SEQ ID NO: 67609 - protein, 9 aa, Homo sapiens
  light chain complementarity determining region 3 for antibody 33805
LQHNSYPWT

SEQ ID NO: 67610 - protein, 13 aa, Homo sapiens
  heavy chain complementarity determining region 3 for antibody 33805
ARGAGDYINPFDY

SEQ ID NO: 67611 - protein, 9 aa, Homo sapiens
  light chain complementarity determining region 3 for antibody 33806
HQYSSPLRS

SEQ ID NO: 67612 - protein, 14 aa, Homo sapiens
  heavy chain complementarity determining region 3 for antibody 33806
AKNQGHDYGDYLAY

SEQ ID NO: 67613 - protein, 9 aa, Homo sapiens
  light chain complementarity determining region 3 for antibody 33807
HQTYTVPRT

SEQ ID NO: 67614 - protein, 12 aa, Homo sapiens
  heavy chain complementarity determining region 3 for antibody 33807
VKDCGLGGSRDS

SEQ ID NO: 67615 - protein, 9 aa, Homo sapiens
  light chain complementarity determining region 3 for antibody 33808
HQTYNTLYT

SEQ ID NO: 67616 - protein, 14 aa, Homo sapiens
  heavy chain complementarity determining region 3 for antibody 33808
ARDVLMSGHRLFDH

SEQ ID NO: 67617 - protein, 9 aa, Homo sapiens
  light chain complementarity determining region 3 for antibody 33809
HQRSNWPGT

SEQ ID NO: 67618 - protein, 6 aa, Homo sapiens
  heavy chain complementarity determining region 3 for antibody 33809
TPVFEY

SEQ ID NO: 67619 - protein, 9 aa, Homo sapiens
  light chain complementarity determining region 3 for antibody 33810
QQYYTYPLT

SEQ ID NO: 67620 - protein, 15 aa, Homo sapiens
  heavy chain complementarity determining region 3 for antibody 33810
AHGVWVRGVTSRFDY

SEQ ID NO: 67621 - protein, 9 aa, Homo sapiens
  light chain complementarity determining region 3 for antibody 33811
QQYYSTPRT

SEQ ID NO: 67622 - protein, 11 aa, Homo sapiens
  heavy chain complementarity determining region 3 for antibody 33811
VRGHDYAKQGY

SEQ ID NO: 67623 - protein, 9 aa, Homo sapiens
  light chain complementarity determining region 3 for antibody 33812
QQYYSSPLT

SEQ ID NO: 67624 - protein, 14 aa, Homo sapiens
  heavy chain complementarity determining region 3 for antibody 33812
ARDQHSGNYYPFDY

SEQ ID NO: 67625 - protein, 9 aa, Homo sapiens
  light chain complementarity determining region 3 for antibody 33813
QQYYSRPFT

SEQ ID NO: 67626 - protein, 16 aa, Homo sapiens
  heavy chain complementarity determining region 3 for antibody 33813
ARVEYDSSGYSPTFDD

SEQ ID NO: 67627 - protein, 9 aa, Homo sapiens
  light chain complementarity determining region 3 for antibody 33814
QQYYSLPLT

SEQ ID NO: 67628 - protein, 10 aa, Homo sapiens
  heavy chain complementarity determining region 3 for antibody 33814
ARGREKHLDI

SEQ ID NO: 67629 - protein, 9 aa, Homo sapiens
  light chain complementarity determining region 3 for antibody 33815
QQYYSFPYT

SEQ ID NO: 67630 - protein, 21 aa, Homo sapiens
  heavy chain complementarity determining region 3 for antibody 33815
AKDLVSGYYDSRGYYWGAFDI

SEQ ID NO: 67631 - protein, 10 aa, Homo sapiens
  light chain complementarity determining region 3 for antibody 33816
QQYYNWPPWT

SEQ ID NO: 67632 - protein, 21 aa, Homo sapiens
  heavy chain complementarity determining region 3 for antibody 33816
ARETMGLGTSGGIIVRGHFDY

SEQ ID NO: 67633 - protein, 10 aa, Homo sapiens
  light chain complementarity determining region 3 for antibody 33817
QQYSTSPPYT

SEQ ID NO: 67634 - protein, 16 aa, Homo sapiens
  heavy chain complementarity determining region 3 for antibody 33817
ARDGYRSGYYAHEFDF

SEQ ID NO: 67635 - protein, 10 aa, Homo sapiens
  light chain complementarity determining region 3 for antibody 33818
QQYNSYSRIT

SEQ ID NO: 67636 - protein, 21 aa, Homo sapiens
  heavy chain complementarity determining region 3 for antibody 33818
ARDHPRANYDILTGYVYYFDY

SEQ ID NO: 67637 - protein, 9 aa, Homo sapiens
  light chain complementarity determining region 3 for antibody 33819
QQYNSYSLT

SEQ ID NO: 67638 - protein, 20 aa, Homo sapiens
  heavy chain complementarity determining region 3 for antibody 33819
ARDFFPFPRGPESFDDVFDI

SEQ ID NO: 67639 - protein, 9 aa, Homo sapiens
  light chain complementarity determining region 3 for antibody 33820
QQYNSYPYT

SEQ ID NO: 67640 - protein, 22 aa, Homo sapiens
  heavy chain complementarity determining region 3 for antibody 33820
ARGGYRSGWDAVDSNYYYGMDV

SEQ ID NO: 67641 - protein, 9 aa, Homo sapiens
  light chain complementarity determining region 3 for antibody 33821
QQYNNYPHT

SEQ ID NO: 67642 - protein, 13 aa, Homo sapiens
  heavy chain complementarity determining region 3 for antibody 33821
ARERSGASNWFDP

SEQ ID NO: 67643 - protein, 10 aa, Homo sapiens
  light chain complementarity determining region 3 for antibody 33822
QQYNNWPPVT

SEQ ID NO: 67644 - protein, 16 aa, Homo sapiens
  heavy chain complementarity determining region 3 for antibody 33822
STAVIGSGRSTFGMDV

SEQ ID NO: 67645 - protein, 10 aa, Homo sapiens
  light chain complementarity determining region 3 for antibody 33823
QQYNNWPMYT

SEQ ID NO: 67646 - protein, 14 aa, Homo sapiens
  heavy chain complementarity determining region 3 for antibody 33823
ARDRSGWYLESLDY

SEQ ID NO: 67647 - protein, 11 aa, Homo sapiens
  light chain complementarity determining region 3 for antibody 33824
QQYNDWPPGST

SEQ ID NO: 67648 - protein, 20 aa, Homo sapiens
  heavy chain complementarity determining region 3 for antibody 33824
ARSRPLFLFGELSQQSHFDF

SEQ ID NO: 67649 - protein, 8 aa, Homo sapiens
  light chain complementarity determining region 3 for antibody 33825
QQYLSTPT

SEQ ID NO: 67650 - protein, 16 aa, Homo sapiens
  heavy chain complementarity determining region 3 for antibody 33825
VRRLNDYGDPDPHFDS

SEQ ID NO: 67651 - protein, 8 aa, Homo sapiens
  light chain complementarity determining region 3 for antibody 33826
QQYISYCT

SEQ ID NO: 67652 - protein, 19 aa, Homo sapiens
  heavy chain complementarity determining region 3 for antibody 33826
ATPGLGDFWSGSKYYAMDV

SEQ ID NO: 67653 - protein, 9 aa, Homo sapiens
  light chain complementarity determining region 3 for antibody 33827
QQYGTSPRT

SEQ ID NO: 67654 - protein, 16 aa, Homo sapiens
  heavy chain complementarity determining region 3 for antibody 33827
ARVKGFLGGSGSYYAY

SEQ ID NO: 67655 - protein, 9 aa, Homo sapiens
  light chain complementarity determining region 3 for antibody 33828
QQYGSSVLT

SEQ ID NO: 67656 - protein, 17 aa, Homo sapiens
  heavy chain complementarity determining region 3 for antibody 33828
ARHSALWPLELPGPIDH

SEQ ID NO: 67657 - protein, 9 aa, Homo sapiens
  light chain complementarity determining region 3 for antibody 33829
QQYGSSPRT

SEQ ID NO: 67658 - protein, 18 aa, Homo sapiens
  heavy chain complementarity determining region 3 for antibody 33829
ATAFWVGLGVPPPGFFEY

SEQ ID NO: 67659 - protein, 9 aa, Homo sapiens
  light chain complementarity determining region 3 for antibody 33830
QQYGSSPRT

SEQ ID NO: 67660 - protein, 25 aa, Homo sapiens
  heavy chain complementarity determining region 3 for antibody 33830
ASLRIDRLRLPGAMRGPLYDCGLNV

SEQ ID NO: 67661 - protein, 9 aa, Homo sapiens
  light chain complementarity determining region 3 for antibody 33831
QQYGSSPLT

SEQ ID NO: 67662 - protein, 14 aa, Homo sapiens
  heavy chain complementarity determining region 3 for antibody 33831
ARYSSSSKVSPTAY

SEQ ID NO: 67663 - protein, 9 aa, Homo sapiens
  light chain complementarity determining region 3 for antibody 33832
QQYGRPPRT

SEQ ID NO: 67664 - protein, 14 aa, Homo sapiens
  heavy chain complementarity determining region 3 for antibody 33832
AGGDFCGADCYSEY

SEQ ID NO: 67665 - protein, 11 aa, Homo sapiens
  light chain complementarity determining region 3 for antibody 33833
QQYGGSPPGIT

SEQ ID NO: 67666 - protein, 13 aa, Homo sapiens
  heavy chain complementarity determining region 3 for antibody 33833
AKHRGGYTYAIES

SEQ ID NO: 67667 - protein, 10 aa, Homo sapiens
  light chain complementarity determining region 3 for antibody 33834
QQYDNLPSYT

SEQ ID NO: 67668 - protein, 18 aa, Homo sapiens
  heavy chain complementarity determining region 3 for antibody 33834
ARDSGYSDYDSTNHYLDY

SEQ ID NO: 67669 - protein, 8 aa, Homo sapiens
  light chain complementarity determining region 3 for antibody 33835
QQYDNLLT

SEQ ID NO: 67670 - protein, 15 aa, Homo sapiens
  heavy chain complementarity determining region 3 for antibody 33835
VRHYRETVAGIEGDS

SEQ ID NO: 67671 - protein, 11 aa, Homo sapiens
  light chain complementarity determining region 3 for antibody 33836
QQYDKNVFRLT

SEQ ID NO: 67672 - protein, 15 aa, Homo sapiens
  heavy chain complementarity determining region 3 for antibody 33836
AKEMTYSGRFTTFDN

SEQ ID NO: 67673 - protein, 9 aa, Homo sapiens
  light chain complementarity determining region 3 for antibody 33837
QQYATSPYS

SEQ ID NO: 67674 - protein, 12 aa, Homo sapiens
  heavy chain complementarity determining region 3 for antibody 33837
AREPAEDYYLDF

SEQ ID NO: 67675 - protein, 9 aa, Homo sapiens
  light chain complementarity determining region 3 for antibody 33838
QQSYTTPLT

SEQ ID NO: 67676 - protein, 16 aa, Homo sapiens
  heavy chain complementarity determining region 3 for antibody 33838
AREEVLWFGEKTHLDY

SEQ ID NO: 67677 - protein, 9 aa, Homo sapiens
  light chain complementarity determining region 3 for antibody 33839
QQSYSTPRT

SEQ ID NO: 67678 - protein, 13 aa, Homo sapiens
  heavy chain complementarity determining region 3 for antibody 33839
ARPSGSYLNGMDV

SEQ ID NO: 67679 - protein, 10 aa, Homo sapiens
  light chain complementarity determining region 3 for antibody 33840
QQSYNTSLYT

SEQ ID NO: 67680 - protein, 28 aa, Homo sapiens
  heavy chain complementarity determining region 3 for antibody 33840
AREPPPAKKVDCGYASCSVFYEHYGLDV

SEQ ID NO: 67681 - protein, 8 aa, Homo sapiens
  light chain complementarity determining region 3 for antibody 33841
QQSGGSPS

SEQ ID NO: 67682 - protein, 16 aa, Homo sapiens
  heavy chain complementarity determining region 3 for antibody 33841
ATDWGSGTQWIRAFDV

SEQ ID NO: 67683 - protein, 9 aa, Homo sapiens
  light chain complementarity determining region 3 for antibody 33842
QQRYKWPLT

SEQ ID NO: 67684 - protein, 15 aa, Homo sapiens
  heavy chain complementarity determining region 3 for antibody 33842
ARRFCGGGICYYFDS

SEQ ID NO: 67685 - protein, 8 aa, Homo sapiens
  light chain complementarity determining region 3 for antibody 33843
QQRSNWPT

SEQ ID NO: 67686 - protein, 21 aa, Homo sapiens
  heavy chain complementarity determining region 3 for antibody 33843
ARLRFGRWAGGYQRGGNWFDP

SEQ ID NO: 67687 - protein, 10 aa, Homo sapiens
  light chain complementarity determining region 3 for antibody 33844
QQRSNWPPIT

SEQ ID NO: 67688 - protein, 17 aa, Homo sapiens
  heavy chain complementarity determining region 3 for antibody 33844
AKAKSSSWYEVGSAFDI

SEQ ID NO: 67689 - protein, 9 aa, Homo sapiens
  light chain complementarity determining region 3 for antibody 33845
QQRSNWPLT

SEQ ID NO: 67690 - protein, 15 aa, Homo sapiens
  heavy chain complementarity determining region 3 for antibody 33845
ARESFDISGNNWFAP

SEQ ID NO: 67691 - protein, 10 aa, Homo sapiens
  light chain complementarity determining region 3 for antibody 33846
QQRSDWPPLP

SEQ ID NO: 67692 - protein, 10 aa, Homo sapiens
  heavy chain complementarity determining region 3 for antibody 33846
ARDYTMTFDY

SEQ ID NO: 67693 - protein, 9 aa, Homo sapiens
  light chain complementarity determining region 3 for antibody 33847
QQGYDNLPT

SEQ ID NO: 67694 - protein, 15 aa, Homo sapiens
  heavy chain complementarity determining region 3 for antibody 33847
ARAMTPKWELAFYDY

SEQ ID NO: 67695 - protein, 9 aa, Homo sapiens
  light chain complementarity determining region 3 for antibody 33848
QQDGTSPLN

SEQ ID NO: 67696 - protein, 13 aa, Homo sapiens
  heavy chain complementarity determining region 3 for antibody 33848
ASISVGTVAAGKG

SEQ ID NO: 67697 - protein, 9 aa, Homo sapiens
  light chain complementarity determining region 3 for antibody 33849
QQCATSPVT

SEQ ID NO: 67698 - protein, 19 aa, Homo sapiens
  heavy chain complementarity determining region 3 for antibody 33849
AKNINPVRHDYGDRVLPGD

SEQ ID NO: 67699 - protein, 9 aa, Homo sapiens
  light chain complementarity determining region 3 for antibody 33850
QQADSFPPT

SEQ ID NO: 67700 - protein, 20 aa, Homo sapiens
  heavy chain complementarity determining region 3 for antibody 33850
ARDPSNCISTSCRGGSTVDY

SEQ ID NO: 67701 - protein, 11 aa, Homo sapiens
  light chain complementarity determining region 3 for antibody 33851
QLYETSPPGYT

SEQ ID NO: 67702 - protein, 14 aa, Homo sapiens
  heavy chain complementarity determining region 3 for antibody 33851
AREISISRKRSFDQ

SEQ ID NO: 67703 - protein, 9 aa, Homo sapiens
  light chain complementarity determining region 3 for antibody 33852
QHYNNWPRT

SEQ ID NO: 67704 - protein, 13 aa, Homo sapiens
  heavy chain complementarity determining region 3 for antibody 33852
ARGRAAAGTYFDY

SEQ ID NO: 67705 - protein, 9 aa, Homo sapiens
  light chain complementarity determining region 3 for antibody 33853
MQVLQTPLT

SEQ ID NO: 67706 - protein, 12 aa, Homo sapiens
  heavy chain complementarity determining region 3 for antibody 33853
VKDGEANWGSWH

SEQ ID NO: 67707 - protein, 9 aa, Homo sapiens
  light chain complementarity determining region 3 for antibody 33854
MQGVAWPGT

SEQ ID NO: 67708 - protein, 11 aa, Homo sapiens
  heavy chain complementarity determining region 3 for antibody 33854
WAGYKYGTGDY

SEQ ID NO: 67709 - protein, 9 aa, Homo sapiens
  light chain complementarity determining region 3 for antibody 33855
MQGTHRPLT

SEQ ID NO: 67710 - protein, 18 aa, Homo sapiens
  heavy chain complementarity determining region 3 for antibody 33855
ARDMTAYSGYEQHDPFDV

SEQ ID NO: 67711 - protein, 9 aa, Homo sapiens
  light chain complementarity determining region 3 for antibody 33856
MQGLQTPNT

SEQ ID NO: 67712 - protein, 10 aa, Homo sapiens
  heavy chain complementarity determining region 3 for antibody 33856
ARDVVGSDDQ

SEQ ID NO: 67713 - protein, 9 aa, Homo sapiens
  light chain complementarity determining region 3 for antibody 33857
MQATHWPPV

SEQ ID NO: 67714 - protein, 18 aa, Homo sapiens
  heavy chain complementarity determining region 3 for antibody 33857
VRGGTIDWEKRQASLIDY

SEQ ID NO: 67715 - protein, 8 aa, Homo sapiens
  light chain complementarity determining region 3 for antibody 33858
MQALQTPV

SEQ ID NO: 67716 - protein, 19 aa, Homo sapiens
  heavy chain complementarity determining region 3 for antibody 33858
ARAHAYNSPFRVVPDAFDI

SEQ ID NO: 67717 - protein, 10 aa, Homo sapiens
  light chain complementarity determining region 3 for antibody 33859
LQHDNFPTWT

SEQ ID NO: 67718 - protein, 10 aa, Homo sapiens
  heavy chain complementarity determining region 3 for antibody 33859
VRDYYGSLDY

SEQ ID NO: 67719 - protein, 9 aa, Homo sapiens
  light chain complementarity determining region 3 for antibody 33860
LQGTHWPYT

SEQ ID NO: 67720 - protein, 14 aa, Homo sapiens
  heavy chain complementarity determining region 3 for antibody 33860
AKDFNEQYFSGLDY

SEQ ID NO: 67721 - protein, 9 aa, Homo sapiens
  light chain complementarity determining region 3 for antibody 33861
LQGNRFPHT

SEQ ID NO: 67722 - protein, 14 aa, Homo sapiens
  heavy chain complementarity determining region 3 for antibody 33861
ARYCSGNACYSMDH

SEQ ID NO: 67723 - protein, 9 aa, Homo sapiens
  light chain complementarity determining region 3 for antibody 33862
HQYYSSPLT

SEQ ID NO: 67724 - protein, 5 aa, Homo sapiens
  heavy chain complementarity determining region 3 for antibody 33862
GTREF

SEQ ID NO: 67725 - protein, 9 aa, Homo sapiens
  light chain complementarity determining region 3 for antibody 33863
HQYASAPLT

SEQ ID NO: 67726 - protein, 16 aa, Homo sapiens
  heavy chain complementarity determining region 3 for antibody 33863
ARGPRFPLVATSSVDY

SEQ ID NO: 67727 - protein, 11 aa, Homo sapiens
  light chain complementarity determining region 3 for antibody 33864
QRWSTSGSRYI

SEQ ID NO: 67728 - protein, 14 aa, Homo sapiens
  heavy chain complementarity determining region 3 for antibody 33864
ARHTEVTGLRGFDR

SEQ ID NO: 67729 - protein, 9 aa, Homo sapiens
  light chain complementarity determining region 3 for antibody 33865
QQYYTTRIT

SEQ ID NO: 67730 - protein, 15 aa, Homo sapiens
  heavy chain complementarity determining region 3 for antibody 33865
ARGPAHGLPNNWFDP

SEQ ID NO: 67731 - protein, 9 aa, Homo sapiens
  light chain complementarity determining region 3 for antibody 33866
QQYYTSPRT

SEQ ID NO: 67732 - protein, 12 aa, Homo sapiens
  heavy chain complementarity determining region 3 for antibody 33866
VKDCGLGGSRDS

SEQ ID NO: 67733 - protein, 9 aa, Homo sapiens
  light chain complementarity determining region 3 for antibody 33867
QQYYTPPRT

SEQ ID NO: 67734 - protein, 8 aa, Homo sapiens
  heavy chain complementarity determining region 3 for antibody 33867
ARDGAFDS

SEQ ID NO: 67735 - protein, 9 aa, Homo sapiens
  light chain complementarity determining region 3 for antibody 33868
QQYYSYPYT

SEQ ID NO: 67736 - protein, 14 aa, Homo sapiens
  heavy chain complementarity determining region 3 for antibody 33868
AKIQALGDTWAFDL

SEQ ID NO: 67737 - protein, 9 aa, Homo sapiens
  light chain complementarity determining region 3 for antibody 33869
QQYVSSPLT

SEQ ID NO: 67738 - protein, 8 aa, Homo sapiens
  heavy chain complementarity determining region 3 for antibody 33869
VRIKDPGA

SEQ ID NO: 67739 - protein, 9 aa, Homo sapiens
  light chain complementarity determining region 3 for antibody 33870
QQYSSPPWT

SEQ ID NO: 67740 - protein, 19 aa, Homo sapiens
  heavy chain complementarity determining region 3 for antibody 33870
ARGSSLVEHFGGAYYFFDY

SEQ ID NO: 67741 - protein, 9 aa, Homo sapiens
  light chain complementarity determining region 3 for antibody 33871
QQYSATPYS

SEQ ID NO: 67742 - protein, 13 aa, Homo sapiens
  heavy chain complementarity determining region 3 for antibody 33871
AKSIADTGFYYDY

SEQ ID NO: 67743 - protein, 9 aa, Homo sapiens
  light chain complementarity determining region 3 for antibody 33872
QQYNSYSGT

SEQ ID NO: 67744 - protein, 17 aa, Homo sapiens
  heavy chain complementarity determining region 3 for antibody 33872
VKESWQWLVDYYYGMDV

SEQ ID NO: 67745 - protein, 9 aa, Homo sapiens
  light chain complementarity determining region 3 for antibody 33873
QQYNSYPRT

SEQ ID NO: 67746 - protein, 19 aa, Homo sapiens
  heavy chain complementarity determining region 3 for antibody 33873
TRELYLHYYDTTGRGVFDY

SEQ ID NO: 67747 - protein, 9 aa, Homo sapiens
  light chain complementarity determining region 3 for antibody 33874
QQYNSYLNS

SEQ ID NO: 67748 - protein, 18 aa, Homo sapiens
  heavy chain complementarity determining region 3 for antibody 33874
ARDRRFGELLADYQGMDV

SEQ ID NO: 67749 - protein, 9 aa, Homo sapiens
  light chain complementarity determining region 3 for antibody 33875
QQYNSYLGT

SEQ ID NO: 67750 - protein, 18 aa, Homo sapiens
  heavy chain complementarity determining region 3 for antibody 33875
ARGYYDLLTGYYVKGVDY

SEQ ID NO: 67751 - protein, 8 aa, Homo sapiens
  light chain complementarity determining region 3 for antibody 33876
QQYNSWPV

SEQ ID NO: 67752 - protein, 15 aa, Homo sapiens
  heavy chain complementarity determining region 3 for antibody 33876
AKGLFGYQSGDSFDS

SEQ ID NO: 67753 - protein, 10 aa, Homo sapiens
  light chain complementarity determining region 3 for antibody 33877
QQYNNWPLYT

SEQ ID NO: 67754 - protein, 15 aa, Homo sapiens
  heavy chain complementarity determining region 3 for antibody 33877
ARAQVIWGQLYYFDS

SEQ ID NO: 67755 - protein, 8 aa, Homo sapiens
  light chain complementarity determining region 3 for antibody 33878
QQYNNGAT

SEQ ID NO: 67756 - protein, 13 aa, Homo sapiens
  heavy chain complementarity determining region 3 for antibody 33878
ATILYRGNWFFDY

SEQ ID NO: 67757 - protein, 10 aa, Homo sapiens
  light chain complementarity determining region 3 for antibody 33879
QQYNDWPPRT

SEQ ID NO: 67758 - protein, 16 aa, Homo sapiens
  heavy chain complementarity determining region 3 for antibody 33879
ARDGAHRIQNWFPIDS

SEQ ID NO: 67759 - protein, 9 aa, Homo sapiens
  light chain complementarity determining region 3 for antibody 33880
QQYGYSARP

SEQ ID NO: 67760 - protein, 13 aa, Homo sapiens
  heavy chain complementarity determining region 3 for antibody 33880
ARGYFYSDGYIED

SEQ ID NO: 67761 - protein, 9 aa, Homo sapiens
  light chain complementarity determining region 3 for antibody 33881
QQYGSSPQT

SEQ ID NO: 67762 - protein, 19 aa, Homo sapiens
  heavy chain complementarity determining region 3 for antibody 33881
ARAYYFDSSGYFYDSPNDY

SEQ ID NO: 67763 - protein, 9 aa, Homo sapiens
  light chain complementarity determining region 3 for antibody 33882
QQYGSSPLT

SEQ ID NO: 67764 - protein, 12 aa, Homo sapiens
  heavy chain complementarity determining region 3 for antibody 33882
ASPDVGTTYFGF

SEQ ID NO: 67765 - protein, 8 aa, Homo sapiens
  light chain complementarity determining region 3 for antibody 33883
QQYGSSLT

SEQ ID NO: 67766 - protein, 13 aa, Homo sapiens
  heavy chain complementarity determining region 3 for antibody 33883
ARVHYSSREAVGY

SEQ ID NO: 67767 - protein, 9 aa, Homo sapiens
  light chain complementarity determining region 3 for antibody 33884
QQYGNSPFT

SEQ ID NO: 67768 - protein, 25 aa, Homo sapiens
  heavy chain complementarity determining region 3 for antibody 33884
ARDSYLGYYDDDGYYFPFNYFGMDV

SEQ ID NO: 67769 - protein, 9 aa, Homo sapiens
  light chain complementarity determining region 3 for antibody 33885
QQYGNIPRT

SEQ ID NO: 67770 - protein, 13 aa, Homo sapiens
  heavy chain complementarity determining region 3 for antibody 33885
AGGLYDRSGYSEY

SEQ ID NO: 67771 - protein, 8 aa, Homo sapiens
  light chain complementarity determining region 3 for antibody 33886
QQYGGSPS

SEQ ID NO: 67772 - protein, 16 aa, Homo sapiens
  heavy chain complementarity determining region 3 for antibody 33886
ATDWGSGTQGIRAFDV

SEQ ID NO: 67773 - protein, 9 aa, Homo sapiens
  light chain complementarity determining region 3 for antibody 33887
QQYDTSPGT

SEQ ID NO: 67774 - protein, 16 aa, Homo sapiens
  heavy chain complementarity determining region 3 for antibody 33887
ARLSGDWGSAPHFFDT

SEQ ID NO: 67775 - protein, 9 aa, Homo sapiens
  light chain complementarity determining region 3 for antibody 33888
QQYDSSTYT

SEQ ID NO: 67776 - protein, 14 aa, Homo sapiens
  heavy chain complementarity determining region 3 for antibody 33888
AREGARYSSSWFDS

SEQ ID NO: 67777 - protein, 9 aa, Homo sapiens
  light chain complementarity determining region 3 for antibody 33889
QQYDDAPRT

SEQ ID NO: 67778 - protein, 5 aa, Homo sapiens
  heavy chain complementarity determining region 3 for antibody 33889
TTDFI

SEQ ID NO: 67779 - protein, 9 aa, Homo sapiens
  light chain complementarity determining region 3 for antibody 33890
QQSYSTPLT

SEQ ID NO: 67780 - protein, 15 aa, Homo sapiens
  heavy chain complementarity determining region 3 for antibody 33890
AKDGGTYIGIWYRHF

SEQ ID NO: 67781 - protein, 9 aa, Homo sapiens
  light chain complementarity determining region 3 for antibody 33891
QQSYSTPDT

SEQ ID NO: 67782 - protein, 15 aa, Homo sapiens
  heavy chain complementarity determining region 3 for antibody 33891
ARDWHWSGHPFGMDV

SEQ ID NO: 67783 - protein, 11 aa, Homo sapiens
  light chain complementarity determining region 3 for antibody 33892
QQSYSSPPFYS

SEQ ID NO: 67784 - protein, 17 aa, Homo sapiens
  heavy chain complementarity determining region 3 for antibody 33892
ARSVCATGNYYYYGMDV

SEQ ID NO: 67785 - protein, 10 aa, Homo sapiens
  light chain complementarity determining region 3 for antibody 33893
QQSYSDLPFT

SEQ ID NO: 67786 - protein, 21 aa, Homo sapiens
  heavy chain complementarity determining region 3 for antibody 33893
ARDVKHYDSSGSYWPLDVFDI

SEQ ID NO: 67787 - protein, 9 aa, Homo sapiens
  light chain complementarity determining region 3 for antibody 33894
QQSLSSPYT

SEQ ID NO: 67788 - protein, 12 aa, Homo sapiens
  heavy chain complementarity determining region 3 for antibody 33894
ARLLWDSYYFDS

SEQ ID NO: 67789 - protein, 10 aa, Homo sapiens
  light chain complementarity determining region 3 for antibody 33895
QQRYKWPSYT

SEQ ID NO: 67790 - protein, 11 aa, Homo sapiens
  heavy chain complementarity determining region 3 for antibody 33895
ARGVGSYVFES

SEQ ID NO: 67791 - protein, 10 aa, Homo sapiens
  light chain complementarity determining region 3 for antibody 33896
QQRYKWPPFT

SEQ ID NO: 67792 - protein, 11 aa, Homo sapiens
  heavy chain complementarity determining region 3 for antibody 33896
ARGVGSYVFES

SEQ ID NO: 67793 - protein, 9 aa, Homo sapiens
  light chain complementarity determining region 3 for antibody 33897
QQRRDWRGT

SEQ ID NO: 67794 - protein, 17 aa, Homo sapiens
  heavy chain complementarity determining region 3 for antibody 33897
AKPINIYDRSGSYSFDY

SEQ ID NO: 67795 - protein, 10 aa, Homo sapiens
  light chain complementarity determining region 3 for antibody 33898
QQRGIWPEMS

SEQ ID NO: 67796 - protein, 14 aa, Homo sapiens
  heavy chain complementarity determining region 3 for antibody 33898
AKDHDSNISGFGEL

SEQ ID NO: 67797 - protein, 9 aa, Homo sapiens
  light chain complementarity determining region 3 for antibody 33899
QQNYRSPQT

SEQ ID NO: 67798 - protein, 12 aa, Homo sapiens
  heavy chain complementarity determining region 3 for antibody 33899
ARWRWRQSELDY

SEQ ID NO: 67799 - protein, 10 aa, Homo sapiens
  light chain complementarity determining region 3 for antibody 33900
QQLNSYPPYT

SEQ ID NO: 67800 - protein, 21 aa, Homo sapiens
  heavy chain complementarity determining region 3 for antibody 33900
TTDQAYYGSGNYYSSLPVFDY

SEQ ID NO: 67801 - protein, 10 aa, Homo sapiens
  light chain complementarity determining region 3 for antibody 33901
QQLNSYLPFT

SEQ ID NO: 67802 - protein, 17 aa, Homo sapiens
  heavy chain complementarity determining region 3 for antibody 33901
ATEGKHDSSGYYEPFDY

SEQ ID NO: 67803 - protein, 9 aa, Homo sapiens
  light chain complementarity determining region 3 for antibody 33902
QQHGSSPRT

SEQ ID NO: 67804 - protein, 25 aa, Homo sapiens
  heavy chain complementarity determining region 3 for antibody 33902
ARLRIDRLRLPGAMRGPLYDCGLNV

SEQ ID NO: 67805 - protein, 8 aa, Homo sapiens
  light chain complementarity determining region 3 for antibody 33903
QQGSNWWT

SEQ ID NO: 67806 - protein, 11 aa, Homo sapiens
  heavy chain complementarity determining region 3 for antibody 33903
ARARGGWNFDY

SEQ ID NO: 67807 - protein, 9 aa, Homo sapiens
  light chain complementarity determining region 3 for antibody 33904
QQFYSTPLT

SEQ ID NO: 67808 - protein, 14 aa, Homo sapiens
  heavy chain complementarity determining region 3 for antibody 33904
ARHKSEGEFMSCDY

SEQ ID NO: 67809 - protein, 10 aa, Homo sapiens
  light chain complementarity determining region 3 for antibody 33905
QQDGSSPPLT

SEQ ID NO: 67810 - protein, 18 aa, Homo sapiens
  heavy chain complementarity determining region 3 for antibody 33905
ARGGYDYGWGSYGVYFDY

SEQ ID NO: 67811 - protein, 9 aa, Homo sapiens
  light chain complementarity determining region 3 for antibody 33906
QQAYSPPRT

SEQ ID NO: 67812 - protein, 14 aa, Homo sapiens
  heavy chain complementarity determining region 3 for antibody 33906
ARAISRAAVSRFDF

SEQ ID NO: 67813 - protein, 9 aa, Homo sapiens
  light chain complementarity determining region 3 for antibody 33907
QKYNSAPFT

SEQ ID NO: 67814 - protein, 10 aa, Homo sapiens
  heavy chain complementarity determining region 3 for antibody 33907
ARPSNLGFDV

SEQ ID NO: 67815 - protein, 8 aa, Homo sapiens
  light chain complementarity determining region 3 for antibody 33908
QKYGGSPS

SEQ ID NO: 67816 - protein, 16 aa, Homo sapiens
  heavy chain complementarity determining region 3 for antibody 33908
ATDWGSGTQWIRAFDV

SEQ ID NO: 67817 - protein, 9 aa, Homo sapiens
  light chain complementarity determining region 3 for antibody 33909
QHYYNTPQT

SEQ ID NO: 67818 - protein, 14 aa, Homo sapiens
  heavy chain complementarity determining region 3 for antibody 33909
TRQTYYDFWSAYDY

SEQ ID NO: 67819 - protein, 9 aa, Homo sapiens
  light chain complementarity determining region 3 for antibody 33910
QHYNGDPWT

SEQ ID NO: 67820 - protein, 12 aa, Homo sapiens
  heavy chain complementarity determining region 3 for antibody 33910
AADCSSASCPGY

SEQ ID NO: 67821 - protein, 10 aa, Homo sapiens
  light chain complementarity determining region 3 for antibody 33911
QHYHNLSPLT

SEQ ID NO: 67822 - protein, 15 aa, Homo sapiens
  heavy chain complementarity determining region 3 for antibody 33911
ARDWHWSGHPFGMDV

SEQ ID NO: 67823 - protein, 8 aa, Homo sapiens
  light chain complementarity determining region 3 for antibody 33912
QHYAPPYT

SEQ ID NO: 67824 - protein, 13 aa, Homo sapiens
  heavy chain complementarity determining region 3 for antibody 33912
ARNQWLSLDVFNE

SEQ ID NO: 67825 - protein, 10 aa, Homo sapiens
  light chain complementarity determining region 3 for antibody 33913
QHWVSSPAYT

SEQ ID NO: 67826 - protein, 12 aa, Homo sapiens
  heavy chain complementarity determining region 3 for antibody 33913
ARETTQFGEFDN

SEQ ID NO: 67827 - protein, 9 aa, Homo sapiens
  light chain complementarity determining region 3 for antibody 33914
QDSFNVPLT

SEQ ID NO: 67828 - protein, 14 aa, Homo sapiens
  heavy chain complementarity determining region 3 for antibody 33914
ARGTWDWGGWNFDY

SEQ ID NO: 67829 - protein, 8 aa, Homo sapiens
  light chain complementarity determining region 3 for antibody 33915
PQYGGSPS

SEQ ID NO: 67830 - protein, 16 aa, Homo sapiens
  heavy chain complementarity determining region 3 for antibody 33915
ATDWGSGTQWIRAFDV

SEQ ID NO: 67831 - protein, 8 aa, Homo sapiens
  light chain complementarity determining region 3 for antibody 33916
MQGTSGRT

SEQ ID NO: 67832 - protein, 17 aa, Homo sapiens
  heavy chain complementarity determining region 3 for antibody 33916
AHRRYYNGNWNGATCDV

SEQ ID NO: 67833 - protein, 9 aa, Homo sapiens
  light chain complementarity determining region 3 for antibody 33917
MQGTQWPPT

SEQ ID NO: 67834 - protein, 12 aa, Homo sapiens
  heavy chain complementarity determining region 3 for antibody 33917
AKEDGGYSQVDH

SEQ ID NO: 67835 - protein, 10 aa, Homo sapiens
  light chain complementarity determining region 3 for antibody 33918
MQGTHWPPYT

SEQ ID NO: 67836 - protein, 19 aa, Homo sapiens
  heavy chain complementarity determining region 3 for antibody 33918
ARIDCTKASPGSLCDAFDI

SEQ ID NO: 67837 - protein, 10 aa, Homo sapiens
  light chain complementarity determining region 3 for antibody 33919
MQGTHWPPYT

SEQ ID NO: 67838 - protein, 16 aa, Homo sapiens
  heavy chain complementarity determining region 3 for antibody 33919
ARHFAQWFGELGPLNY

SEQ ID NO: 67839 - protein, 9 aa, Homo sapiens
  light chain complementarity determining region 3 for antibody 33920
MQGTHWPPT

SEQ ID NO: 67840 - protein, 19 aa, Homo sapiens
  heavy chain complementarity determining region 3 for antibody 33920
VRDDRDHCSGGSCEGYFDD

SEQ ID NO: 67841 - protein, 9 aa, Homo sapiens
  light chain complementarity determining region 3 for antibody 33921
MQGTHWPPT

SEQ ID NO: 67842 - protein, 20 aa, Homo sapiens
  heavy chain complementarity determining region 3 for antibody 33921
ARGRQRTGYSSSWYLGHFDY

SEQ ID NO: 67843 - protein, 9 aa, Homo sapiens
  light chain complementarity determining region 3 for antibody 33922
MQGTHWPGT

SEQ ID NO: 67844 - protein, 10 aa, Homo sapiens
  heavy chain complementarity determining region 3 for antibody 33922
ARETHWGPDY

SEQ ID NO: 67845 - protein, 9 aa, Homo sapiens
  light chain complementarity determining region 3 for antibody 33923
MQGLQTPYP

SEQ ID NO: 67846 - protein, 10 aa, Homo sapiens
  heavy chain complementarity determining region 3 for antibody 33923
ARDVVGSDDQ

SEQ ID NO: 67847 - protein, 9 aa, Homo sapiens
  light chain complementarity determining region 3 for antibody 33924
MQGLQTPWT

SEQ ID NO: 67848 - protein, 11 aa, Homo sapiens
  heavy chain complementarity determining region 3 for antibody 33924
ASALDYGGIDY

SEQ ID NO: 67849 - protein, 9 aa, Homo sapiens
  light chain complementarity determining region 3 for antibody 33925
MQGLQTPWT

SEQ ID NO: 67850 - protein, 12 aa, Homo sapiens
  heavy chain complementarity determining region 3 for antibody 33925
ARDLGYTSGWRL

SEQ ID NO: 67851 - protein, 9 aa, Homo sapiens
  light chain complementarity determining region 3 for antibody 33926
MQGLQTPST

SEQ ID NO: 67852 - protein, 10 aa, Homo sapiens
  heavy chain complementarity determining region 3 for antibody 33926
ARDVVGSDDQ

SEQ ID NO: 67853 - protein, 8 aa, Homo sapiens
  light chain complementarity determining region 3 for antibody 33927
MQALQTPP

SEQ ID NO: 67854 - protein, 15 aa, Homo sapiens
  heavy chain complementarity determining region 3 for antibody 33927
ARRDYYDSSGYRLDY

SEQ ID NO: 67855 - protein, 9 aa, Homo sapiens
  light chain complementarity determining region 3 for antibody 33928
MQALQTPNT

SEQ ID NO: 67856 - protein, 21 aa, Homo sapiens
  heavy chain complementarity determining region 3 for antibody 33928
ARDAPVSRPYSSGWYSSAFDY

SEQ ID NO: 67857 - protein, 9 aa, Homo sapiens
  light chain complementarity determining region 3 for antibody 33929
MQALQTALT

SEQ ID NO: 67858 - protein, 21 aa, Homo sapiens
  heavy chain complementarity determining region 3 for antibody 33929
ARGICSSTSCYHSLNYYGMDV

SEQ ID NO: 67859 - protein, 9 aa, Homo sapiens
  light chain complementarity determining region 3 for antibody 33930
MQALETPFT

SEQ ID NO: 67860 - protein, 16 aa, Homo sapiens
  heavy chain complementarity determining region 3 for antibody 33930
AKKGGPVTATGNYFDL

SEQ ID NO: 67861 - protein, 9 aa, Homo sapiens
  light chain complementarity determining region 3 for antibody 33931
MQAAHWPHT

SEQ ID NO: 67862 - protein, 12 aa, Homo sapiens
  heavy chain complementarity determining region 3 for antibody 33931
ARGARDSSGVDY

SEQ ID NO: 67863 - protein, 9 aa, Homo sapiens
  light chain complementarity determining region 3 for antibody 33932
LQDYNYPYT

SEQ ID NO: 67864 - protein, 22 aa, Homo sapiens
  heavy chain complementarity determining region 3 for antibody 33932
ARKRQWLTRGKSGDYYYYGMDV

SEQ ID NO: 67865 - protein, 10 aa, Homo sapiens
  light chain complementarity determining region 3 for antibody 33933
LHYNRSPMYT

SEQ ID NO: 67866 - protein, 16 aa, Homo sapiens
  heavy chain complementarity determining region 3 for antibody 33933
ARREKTYDVHELALYF

SEQ ID NO: 67867 - protein, 9 aa, Homo sapiens
  light chain complementarity determining region 3 for antibody 33934
KQYYTPPLT

SEQ ID NO: 67868 - protein, 14 aa, Homo sapiens
  heavy chain complementarity determining region 3 for antibody 33934
AKDRIAVGISVWEY

SEQ ID NO: 67869 - protein, 9 aa, Homo sapiens
  light chain complementarity determining region 3 for antibody 33935
HQYGTSPHT

SEQ ID NO: 67870 - protein, 18 aa, Homo sapiens
  heavy chain complementarity determining region 3 for antibody 33935
AKNKFIYDSSGYRGAFDI

SEQ ID NO: 67871 - protein, 7 aa, Homo sapiens
  light chain complementarity determining region 3 for antibody 33936
HQYGEAT

SEQ ID NO: 67872 - protein, 12 aa, Homo sapiens
  heavy chain complementarity determining region 3 for antibody 33936
ARDRGAWYAFDR

SEQ ID NO: 67873 - protein, 10 aa, Homo sapiens
  light chain complementarity determining region 3 for antibody 33937
HQFGSSPRAT

SEQ ID NO: 67874 - protein, 19 aa, Homo sapiens
  heavy chain complementarity determining region 3 for antibody 33937
ARFVGGFGESGFYYYGMDV

SEQ ID NO: 67875 - protein, 9 aa, Homo sapiens
  light chain complementarity determining region 3 for antibody 33938
GQYNRYPRT

SEQ ID NO: 67876 - protein, 6 aa, Homo sapiens
  heavy chain complementarity determining region 3 for antibody 33938
TRALDY

SEQ ID NO: 67877 - protein, 8 aa, Homo sapiens
  light chain complementarity determining region 3 for antibody 33939
QRYGGSPS

SEQ ID NO: 67878 - protein, 16 aa, Homo sapiens
  heavy chain complementarity determining region 3 for antibody 33939
ATDWGSGTQWIRAFDV

SEQ ID NO: 67879 - protein, 9 aa, Homo sapiens
  light chain complementarity determining region 3 for antibody 33940
QRLNSAPLT

SEQ ID NO: 67880 - protein, 20 aa, Homo sapiens
  heavy chain complementarity determining region 3 for antibody 33940
ARPYHDYSVDRLEWINAFKI

SEQ ID NO: 67881 - protein, 9 aa, Homo sapiens
  light chain complementarity determining region 3 for antibody 33941
QQYYTSLRP

SEQ ID NO: 67882 - protein, 12 aa, Homo sapiens
  heavy chain complementarity determining region 3 for antibody 33941
VKDCGLGGSRDS

SEQ ID NO: 67883 - protein, 10 aa, Homo sapiens
  light chain complementarity determining region 3 for antibody 33942
QQYYSSLALT

SEQ ID NO: 67884 - protein, 16 aa, Homo sapiens
  heavy chain complementarity determining region 3 for antibody 33942
ARSARAAARPMLWCDF

SEQ ID NO: 67885 - protein, 8 aa, Homo sapiens
  light chain complementarity determining region 3 for antibody 33943
QQYSGFWT

SEQ ID NO: 67886 - protein, 21 aa, Homo sapiens
  heavy chain complementarity determining region 3 for antibody 33943
ARQHTYFGNSGFKFPEGYFDL

SEQ ID NO: 67887 - protein, 10 aa, Homo sapiens
  light chain complementarity determining region 3 for antibody 33944
QQYNSYSELT

SEQ ID NO: 67888 - protein, 18 aa, Homo sapiens
  heavy chain complementarity determining region 3 for antibody 33944
ARERGSSSWSSSSQAFHI

SEQ ID NO: 67889 - protein, 9 aa, Homo sapiens
  light chain complementarity determining region 3 for antibody 33945
QQYNSYPWT

SEQ ID NO: 67890 - protein, 19 aa, Homo sapiens
  heavy chain complementarity determining region 3 for antibody 33945
ARGPSVPTRNLYYYHGMDV

SEQ ID NO: 67891 - protein, 9 aa, Homo sapiens
  light chain complementarity determining region 3 for antibody 33946
QQYNSNPST

SEQ ID NO: 67892 - protein, 14 aa, Homo sapiens
  heavy chain complementarity determining region 3 for antibody 33946
ARQDSGSYLGAFHI

SEQ ID NO: 67893 - protein, 9 aa, Homo sapiens
  light chain complementarity determining region 3 for antibody 33947
QQYNNYPYT

SEQ ID NO: 67894 - protein, 16 aa, Homo sapiens
  heavy chain complementarity determining region 3 for antibody 33947
ARDSPRYSYGQKAFDI

SEQ ID NO: 67895 - protein, 11 aa, Homo sapiens
  light chain complementarity determining region 3 for antibody 33948
QQYNNWPPIFT

SEQ ID NO: 67896 - protein, 13 aa, Homo sapiens
  heavy chain complementarity determining region 3 for antibody 33948
ARGTTVGMVILDY

SEQ ID NO: 67897 - protein, 9 aa, Homo sapiens
  light chain complementarity determining region 3 for antibody 33949
QQYKAYPWT

SEQ ID NO: 67898 - protein, 13 aa, Homo sapiens
  heavy chain complementarity determining region 3 for antibody 33949
AKVHFAEFNYFDY

SEQ ID NO: 67899 - protein, 10 aa, Homo sapiens
  light chain complementarity determining region 3 for antibody 33950
QQYHDWPPNT

SEQ ID NO: 67900 - protein, 19 aa, Homo sapiens
  heavy chain complementarity determining region 3 for antibody 33950
ASAPTAYDSKGYNRGWFHP

SEQ ID NO: 67901 - protein, 9 aa, Homo sapiens
  light chain complementarity determining region 3 for antibody 33951
QQYGSSPYT

SEQ ID NO: 67902 - protein, 14 aa, Homo sapiens
  heavy chain complementarity determining region 3 for antibody 33951
LQIGTVVAGTGPDV

SEQ ID NO: 67903 - protein, 9 aa, Homo sapiens
  light chain complementarity determining region 3 for antibody 33952
QQYGSSPRT

SEQ ID NO: 67904 - protein, 25 aa, Homo sapiens
  heavy chain complementarity determining region 3 for antibody 33952
ARLRIDRLRLPGAMRGPLYDCGLDV

SEQ ID NO: 67905 - protein, 9 aa, Homo sapiens
  light chain complementarity determining region 3 for antibody 33953
QQYGSSPRT

SEQ ID NO: 67906 - protein, 17 aa, Homo sapiens
  heavy chain complementarity determining region 3 for antibody 33953
ARALDIVVVVDASWFDP

SEQ ID NO: 67907 - protein, 9 aa, Homo sapiens
  light chain complementarity determining region 3 for antibody 33954
QQYGSSPRP

SEQ ID NO: 67908 - protein, 17 aa, Homo sapiens
  heavy chain complementarity determining region 3 for antibody 33954
ARALDIVVVVDAIWFDP

SEQ ID NO: 67909 - protein, 9 aa, Homo sapiens
  light chain complementarity determining region 3 for antibody 33955
QQYGSSPPT

SEQ ID NO: 67910 - protein, 16 aa, Homo sapiens
  heavy chain complementarity determining region 3 for antibody 33955
ARDFHPMAASDTAYDY

SEQ ID NO: 67911 - protein, 10 aa, Homo sapiens
  light chain complementarity determining region 3 for antibody 33956
QQYGSSPMYR

SEQ ID NO: 67912 - protein, 11 aa, Homo sapiens
  heavy chain complementarity determining region 3 for antibody 33956
ARGGQWGSLDY

SEQ ID NO: 67913 - protein, 8 aa, Homo sapiens
  light chain complementarity determining region 3 for antibody 33957
QQYGSSPL

SEQ ID NO: 67914 - protein, 12 aa, Homo sapiens
  heavy chain complementarity determining region 3 for antibody 33957
VRDSREAYAMDV

SEQ ID NO: 67915 - protein, 9 aa, Homo sapiens
  light chain complementarity determining region 3 for antibody 33958
QQYGSLPRT

SEQ ID NO: 67916 - protein, 13 aa, Homo sapiens
  heavy chain complementarity determining region 3 for antibody 33958
AGGQFDNTGYREY

SEQ ID NO: 67917 - protein, 10 aa, Homo sapiens
  light chain complementarity determining region 3 for antibody 33959
QQYGRSPPGT

SEQ ID NO: 67918 - protein, 14 aa, Homo sapiens
  heavy chain complementarity determining region 3 for antibody 33959
ARGGSSGYNHQFDY

SEQ ID NO: 67919 - protein, 8 aa, Homo sapiens
  light chain complementarity determining region 3 for antibody 33960
QQYGGSPS

SEQ ID NO: 67920 - protein, 16 aa, Homo sapiens
  heavy chain complementarity determining region 3 for antibody 33960
ATDWGSGTQWTRAFDV

SEQ ID NO: 67921 - protein, 9 aa, Homo sapiens
  light chain complementarity determining region 3 for antibody 33961
QQYFSHLYT

SEQ ID NO: 67922 - protein, 18 aa, Homo sapiens
  heavy chain complementarity determining region 3 for antibody 33961
AQERDGYCDSHACYGLDV

SEQ ID NO: 67923 - protein, 9 aa, Homo sapiens
  light chain complementarity determining region 3 for antibody 33962
QQYDNYGLT

SEQ ID NO: 67924 - protein, 15 aa, Homo sapiens
  heavy chain complementarity determining region 3 for antibody 33962
STGVMVRTILETSDS

SEQ ID NO: 67925 - protein, 10 aa, Homo sapiens
  light chain complementarity determining region 3 for antibody 33963
QQYDGWPPIT

SEQ ID NO: 67926 - protein, 12 aa, Homo sapiens
  heavy chain complementarity determining region 3 for antibody 33963
VRHGVVTAEHDS

SEQ ID NO: 67927 - protein, 10 aa, Homo sapiens
  light chain complementarity determining region 3 for antibody 33964
QQVNSHGGFT

SEQ ID NO: 67928 - protein, 19 aa, Homo sapiens
  heavy chain complementarity determining region 3 for antibody 33964
ARLTFDCSGGSCYHGAFDI

SEQ ID NO: 67929 - protein, 9 aa, Homo sapiens
  light chain complementarity determining region 3 for antibody 33965
QQSYSVPPT

SEQ ID NO: 67930 - protein, 10 aa, Homo sapiens
  heavy chain complementarity determining region 3 for antibody 33965
ARDLRGYDSF

SEQ ID NO: 67931 - protein, 9 aa, Homo sapiens
  light chain complementarity determining region 3 for antibody 33966
QQSYSTPYT

SEQ ID NO: 67932 - protein, 12 aa, Homo sapiens
  heavy chain complementarity determining region 3 for antibody 33966
AKEDGGYSQVDH

SEQ ID NO: 67933 - protein, 10 aa, Homo sapiens
  light chain complementarity determining region 3 for antibody 33967
QQSYSTPQYT

SEQ ID NO: 67934 - protein, 13 aa, Homo sapiens
  heavy chain complementarity determining region 3 for antibody 33967
ARPTGYSYGYVDY

SEQ ID NO: 67935 - protein, 9 aa, Homo sapiens
  light chain complementarity determining region 3 for antibody 33968
QQSNRTPYT

SEQ ID NO: 67936 - protein, 14 aa, Homo sapiens
  heavy chain complementarity determining region 3 for antibody 33968
ATKGPSRMGKFFDS

SEQ ID NO: 67937 - protein, 9 aa, Homo sapiens
  light chain complementarity determining region 3 for antibody 33969
QQRSSWPWT

SEQ ID NO: 67938 - protein, 21 aa, Homo sapiens
  heavy chain complementarity determining region 3 for antibody 33969
HIRKDYYYDNRGYYEVHFFDY

SEQ ID NO: 67939 - protein, 8 aa, Homo sapiens
  light chain complementarity determining region 3 for antibody 33970
QQRSNWPR

SEQ ID NO: 67940 - protein, 11 aa, Homo sapiens
  heavy chain complementarity determining region 3 for antibody 33970
PIFMVRGDKDY

SEQ ID NO: 67941 - protein, 9 aa, Homo sapiens
  light chain complementarity determining region 3 for antibody 33971
QQRSNWPGT

SEQ ID NO: 67942 - protein, 20 aa, Homo sapiens
  heavy chain complementarity determining region 3 for antibody 33971
ARASPVYCSGGSCYYYGMDV

SEQ ID NO: 67943 - protein, 8 aa, Homo sapiens
  light chain complementarity determining region 3 for antibody 33972
QQRLKMYT

SEQ ID NO: 67944 - protein, 17 aa, Homo sapiens
  heavy chain complementarity determining region 3 for antibody 33972
ARDRGYSYDFRSDAFDI

SEQ ID NO: 67945 - protein, 10 aa, Homo sapiens
  light chain complementarity determining region 3 for antibody 33973
QQRGNWPPLT

SEQ ID NO: 67946 - protein, 15 aa, Homo sapiens
  heavy chain complementarity determining region 3 for antibody 33973
ATSAGSNYGGYYFDY

SEQ ID NO: 67947 - protein, 9 aa, Homo sapiens
  light chain complementarity determining region 3 for antibody 33974
QQHSRWPIT

SEQ ID NO: 67948 - protein, 15 aa, Homo sapiens
  heavy chain complementarity determining region 3 for antibody 33974
ARDWGSSGWYNWFHP

SEQ ID NO: 67949 - protein, 11 aa, Homo sapiens
  light chain complementarity determining region 3 for antibody 33975
QQHGTSPPHWA

SEQ ID NO: 67950 - protein, 12 aa, Homo sapiens
  heavy chain complementarity determining region 3 for antibody 33975
VKEKGGVRVFDF

SEQ ID NO: 67951 - protein, 9 aa, Homo sapiens
  light chain complementarity determining region 3 for antibody 33976
QQFYSAPLT

SEQ ID NO: 67952 - protein, 21 aa, Homo sapiens
  heavy chain complementarity determining region 3 for antibody 33976
ARIPHVYYLSGDYYADVWFDS

SEQ ID NO: 67953 - protein, 9 aa, Homo sapiens
  light chain complementarity determining region 3 for antibody 33977
QQDYSTLIT

SEQ ID NO: 67954 - protein, 18 aa, Homo sapiens
  heavy chain complementarity determining region 3 for antibody 33977
ARSTAGYCSGSTCYVFDS

SEQ ID NO: 67955 - protein, 10 aa, Homo sapiens
  light chain complementarity determining region 3 for antibody 33978
QQDGSSSMYT

SEQ ID NO: 67956 - protein, 19 aa, Homo sapiens
  heavy chain complementarity determining region 3 for antibody 33978
AKDQLMFYYDNSGYPGADY

SEQ ID NO: 67957 - protein, 9 aa, Homo sapiens
  light chain complementarity determining region 3 for antibody 33979
QQANTFPLT

SEQ ID NO: 67958 - protein, 21 aa, Homo sapiens
  heavy chain complementarity determining region 3 for antibody 33979
AREGGLRGNRYGYARGNGMDV

SEQ ID NO: 67959 - protein, 9 aa, Homo sapiens
  light chain complementarity determining region 3 for antibody 33980
QQAKVFPLT

SEQ ID NO: 67960 - protein, 12 aa, Homo sapiens
  heavy chain complementarity determining region 3 for antibody 33980
ARLLWDSYYFDS

SEQ ID NO: 67961 - protein, 9 aa, Homo sapiens
  light chain complementarity determining region 3 for antibody 33981
QKYNSAPFT

SEQ ID NO: 67962 - protein, 19 aa, Homo sapiens
  heavy chain complementarity determining region 3 for antibody 33981
AADSGGGYSFLNYYYGMDV

SEQ ID NO: 67963 - protein, 9 aa, Homo sapiens
  light chain complementarity determining region 3 for antibody 33982
QHYSSSPPS

SEQ ID NO: 67964 - protein, 19 aa, Homo sapiens
  heavy chain complementarity determining region 3 for antibody 33982
ARAGGNYYDRTSYYGPFDY

SEQ ID NO: 67965 - protein, 10 aa, Homo sapiens
  light chain complementarity determining region 3 for antibody 33983
QHYHNWPPWT

SEQ ID NO: 67966 - protein, 13 aa, Homo sapiens
  heavy chain complementarity determining region 3 for antibody 33983
AKGRVRELYYFEP

SEQ ID NO: 67967 - protein, 10 aa, Homo sapiens
  light chain complementarity determining region 3 for antibody 33984
QHYGSSLMYT

SEQ ID NO: 67968 - protein, 14 aa, Homo sapiens
  heavy chain complementarity determining region 3 for antibody 33984
TTDRPLTGMVPFDF

SEQ ID NO: 67969 - protein, 9 aa, Homo sapiens
  light chain complementarity determining region 3 for antibody 33985
QHIHSRPFT

SEQ ID NO: 67970 - protein, 20 aa, Homo sapiens
  heavy chain complementarity determining region 3 for antibody 33985
AKGIAVAALRTVYYYYGMDV

SEQ ID NO: 67971 - protein, 9 aa, Homo sapiens
  light chain complementarity determining region 3 for antibody 33986
MQTLQSPYT

SEQ ID NO: 67972 - protein, 12 aa, Homo sapiens
  heavy chain complementarity determining region 3 for antibody 33986
ARPLYNSGFFEY

SEQ ID NO: 67973 - protein, 9 aa, Homo sapiens
  light chain complementarity determining region 3 for antibody 33987
MQGVHWPFT

SEQ ID NO: 67974 - protein, 10 aa, Homo sapiens
  heavy chain complementarity determining region 3 for antibody 33987
VGYNWGRSDY

SEQ ID NO: 67975 - protein, 8 aa, Homo sapiens
  light chain complementarity determining region 3 for antibody 33988
MQGTHRYT

SEQ ID NO: 67976 - protein, 19 aa, Homo sapiens
  heavy chain complementarity determining region 3 for antibody 33988
ARDSFYSGSGTYFNDVFDV

SEQ ID NO: 67977 - protein, 9 aa, Homo sapiens
  light chain complementarity determining region 3 for antibody 33989
MQGSHWPPT

SEQ ID NO: 67978 - protein, 13 aa, Homo sapiens
  heavy chain complementarity determining region 3 for antibody 33989
VRDDIEGYNNLDY

SEQ ID NO: 67979 - protein, 8 aa, Homo sapiens
  light chain complementarity determining region 3 for antibody 33990
MQGLQTPS

SEQ ID NO: 67980 - protein, 22 aa, Homo sapiens
  heavy chain complementarity determining region 3 for antibody 33990
ARGGPPYYYDSSGIRQGNPFDL

SEQ ID NO: 67981 - protein, 9 aa, Homo sapiens
  light chain complementarity determining region 3 for antibody 33991
MQGLQTPRT

SEQ ID NO: 67982 - protein, 12 aa, Homo sapiens
  heavy chain complementarity determining region 3 for antibody 33991
ARDVPNISRFDH

SEQ ID NO: 67983 - protein, 9 aa, Homo sapiens
  light chain complementarity determining region 3 for antibody 33992
MQGAHWPVT

SEQ ID NO: 67984 - protein, 19 aa, Homo sapiens
  heavy chain complementarity determining region 3 for antibody 33992
ARAPALLWLGDHMYNYFDP

SEQ ID NO: 67985 - protein, 9 aa, Homo sapiens
  light chain complementarity determining region 3 for antibody 33993
MQATQYPYT

SEQ ID NO: 67986 - protein, 13 aa, Homo sapiens
  heavy chain complementarity determining region 3 for antibody 33993
TRLPARGSWPFQP

SEQ ID NO: 67987 - protein, 9 aa, Homo sapiens
  light chain complementarity determining region 3 for antibody 33994
MQALQTPRT

SEQ ID NO: 67988 - protein, 18 aa, Homo sapiens
  heavy chain complementarity determining region 3 for antibody 33994
ARTQYVEMHIYYFYGLDV

SEQ ID NO: 67989 - protein, 9 aa, Homo sapiens
  light chain complementarity determining region 3 for antibody 33995
MQALQTPLT

SEQ ID NO: 67990 - protein, 20 aa, Homo sapiens
  heavy chain complementarity determining region 3 for antibody 33995
AREDIYGSGPAWRASFLGQH

SEQ ID NO: 67991 - protein, 9 aa, Homo sapiens
  light chain complementarity determining region 3 for antibody 33996
MQALQARLT

SEQ ID NO: 67992 - protein, 22 aa, Homo sapiens
  heavy chain complementarity determining region 3 for antibody 33996
ARISGVITLSGSYFYYYYGLDV

SEQ ID NO: 67993 - protein, 9 aa, Homo sapiens
  light chain complementarity determining region 3 for antibody 33997
LQTYSTPWT

SEQ ID NO: 67994 - protein, 18 aa, Homo sapiens
  heavy chain complementarity determining region 3 for antibody 33997
AREDGAAATKRRKFYFDL

SEQ ID NO: 67995 - protein, 9 aa, Homo sapiens
  light chain complementarity determining region 3 for antibody 33998
LQSIHWPGT

SEQ ID NO: 67996 - protein, 11 aa, Homo sapiens
  heavy chain complementarity determining region 3 for antibody 33998
ARFERRKPGPD

SEQ ID NO: 67997 - protein, 9 aa, Homo sapiens
  light chain complementarity determining region 3 for antibody 33999
LQLHSYPLT

SEQ ID NO: 67998 - protein, 16 aa, Homo sapiens
  heavy chain complementarity determining region 3 for antibody 33999
ARDGVGTINGGDAFDI

SEQ ID NO: 67999 - protein, 9 aa, Homo sapiens
  light chain complementarity determining region 3 for antibody 34000
LQHNRYPWT

SEQ ID NO: 68000 - protein, 10 aa, Homo sapiens
  heavy chain complementarity determining region 3 for antibody 34000
AKGLNWSEYS

SEQ ID NO: 68001 - protein, 9 aa, Homo sapiens
  light chain complementarity determining region 3 for antibody 34001
LQDYDYPLP

SEQ ID NO: 68002 - protein, 18 aa, Homo sapiens
  heavy chain complementarity determining region 3 for antibody 34001
ARSLYHSVSGAYYDAFDI

SEQ ID NO: 68003 - protein, 11 aa, Homo sapiens
  light chain complementarity determining region 3 for antibody 34002
HQYDASPPMYS

SEQ ID NO: 68004 - protein, 14 aa, Homo sapiens
  heavy chain complementarity determining region 3 for antibody 34002
ARHKQIPGTRGFDS

SEQ ID NO: 68005 - protein, 8 aa, Homo sapiens
  light chain complementarity determining region 3 for antibody 34003
HQSYDSET

SEQ ID NO: 68006 - protein, 12 aa, Homo sapiens
  heavy chain complementarity determining region 3 for antibody 34003
VRRGDVAGMFDY

SEQ ID NO: 68007 - protein, 9 aa, Homo sapiens
  light chain complementarity determining region 3 for antibody 34004
HQSSSLPHT

SEQ ID NO: 68008 - protein, 23 aa, Homo sapiens
  heavy chain complementarity determining region 3 for antibody 34004
ATLYYDFWSTYYISDPRPDYFDS

SEQ ID NO: 68009 - protein, 9 aa, Homo sapiens
  light chain complementarity determining region 3 for antibody 34005
FQGTHWPRA

SEQ ID NO: 68010 - protein, 18 aa, Homo sapiens
  heavy chain complementarity determining region 3 for antibody 34005
TRDGDERGSREVGRPLSY

SEQ ID NO: 68011 - protein, 9 aa, Homo sapiens
  light chain complementarity determining region 3 for antibody 34006
QYYGASPCT

SEQ ID NO: 68012 - protein, 11 aa, Homo sapiens
  heavy chain complementarity determining region 3 for antibody 34006
ARGEVGYAFDI

SEQ ID NO: 68013 - protein, 9 aa, Homo sapiens
  light chain complementarity determining region 3 for antibody 34007
QQYYSPPHT

SEQ ID NO: 68014 - protein, 10 aa, Homo sapiens
  heavy chain complementarity determining region 3 for antibody 34007
ALRQGNSGWF

SEQ ID NO: 68015 - protein, 9 aa, Homo sapiens
  light chain complementarity determining region 3 for antibody 34008
QQYYSIPLT

SEQ ID NO: 68016 - protein, 18 aa, Homo sapiens
  heavy chain complementarity determining region 3 for antibody 34008
AKARDSRRDDYNHPPFDM

SEQ ID NO: 68017 - protein, 9 aa, Homo sapiens
  light chain complementarity determining region 3 for antibody 34009
QQYYDIPYT

SEQ ID NO: 68018 - protein, 13 aa, Homo sapiens
  heavy chain complementarity determining region 3 for antibody 34009
TTELRWGGVNFDY

SEQ ID NO: 68019 - protein, 9 aa, Homo sapiens
  light chain complementarity determining region 3 for antibody 34010
QQYVSSPDT

SEQ ID NO: 68020 - protein, 14 aa, Homo sapiens
  heavy chain complementarity determining region 3 for antibody 34010
ARGGNYGSGSYFHY

SEQ ID NO: 68021 - protein, 8 aa, Homo sapiens
  light chain complementarity determining region 3 for antibody 34011
QQYVSPFT

SEQ ID NO: 68022 - protein, 12 aa, Homo sapiens
  heavy chain complementarity determining region 3 for antibody 34011
ARAYSSSWYAGY

SEQ ID NO: 68023 - protein, 9 aa, Homo sapiens
  light chain complementarity determining region 3 for antibody 34012
QQYSYSPPT

SEQ ID NO: 68024 - protein, 10 aa, Homo sapiens
  heavy chain complementarity determining region 3 for antibody 34012
VRGTRNAFDI

SEQ ID NO: 68025 - protein, 9 aa, Homo sapiens
  light chain complementarity determining region 3 for antibody 34013
QQYSVAPRT

SEQ ID NO: 68026 - protein, 20 aa, Homo sapiens
  heavy chain complementarity determining region 3 for antibody 34013
ARGLRGPGQYDSSGSDYFDY

SEQ ID NO: 68027 - protein, 9 aa, Homo sapiens
  light chain complementarity determining region 3 for antibody 34014
QQYSTSFRT

SEQ ID NO: 68028 - protein, 17 aa, Homo sapiens
  heavy chain complementarity determining region 3 for antibody 34014
AKGPTIAVAVPPYYFDY

SEQ ID NO: 68029 - protein, 10 aa, Homo sapiens
  light chain complementarity determining region 3 for antibody 34015
QQYSNWPPLT

SEQ ID NO: 68030 - protein, 15 aa, Homo sapiens
  heavy chain complementarity determining region 3 for antibody 34015
AKEPDCGRNCLYFDS

SEQ ID NO: 68031 - protein, 9 aa, Homo sapiens
  light chain complementarity determining region 3 for antibody 34016
QQYSNLPFT

SEQ ID NO: 68032 - protein, 18 aa, Homo sapiens
  heavy chain complementarity determining region 3 for antibody 34016
ATRGANCGGDCYYWYFDL

SEQ ID NO: 68033 - protein, 9 aa, Homo sapiens
  light chain complementarity determining region 3 for antibody 34017
QQYRRSPRT

SEQ ID NO: 68034 - protein, 17 aa, Homo sapiens
  heavy chain complementarity determining region 3 for antibody 34017
AGLSSRLGDGSPSLFDY

SEQ ID NO: 68035 - protein, 9 aa, Homo sapiens
  light chain complementarity determining region 3 for antibody 34018
QQYQSYPLT

SEQ ID NO: 68036 - protein, 18 aa, Homo sapiens
  heavy chain complementarity determining region 3 for antibody 34018
ARSKTRVGVDSYYYGLDV

SEQ ID NO: 68037 - protein, 9 aa, Homo sapiens
  light chain complementarity determining region 3 for antibody 34019
QQYNSYWWT

SEQ ID NO: 68038 - protein, 6 aa, Homo sapiens
  heavy chain complementarity determining region 3 for antibody 34019
SRDGTY

SEQ ID NO: 68039 - protein, 9 aa, Homo sapiens
  light chain complementarity determining region 3 for antibody 34020
QQYNSYPLT

SEQ ID NO: 68040 - protein, 19 aa, Homo sapiens
  heavy chain complementarity determining region 3 for antibody 34020
ARGPPGFFWSGSIPYYFDY

SEQ ID NO: 68041 - protein, 9 aa, Homo sapiens
  light chain complementarity determining region 3 for antibody 34021
QQYNSYPLT

SEQ ID NO: 68042 - protein, 21 aa, Homo sapiens
  heavy chain complementarity determining region 3 for antibody 34021
ARDAPVSRPYSSGWYSSAFDY

SEQ ID NO: 68043 - protein, 11 aa, Homo sapiens
  light chain complementarity determining region 3 for antibody 34022
QQYNSSPPGFP

SEQ ID NO: 68044 - protein, 14 aa, Homo sapiens
  heavy chain complementarity determining region 3 for antibody 34022
ATSARSSRKRSFDQ

SEQ ID NO: 68045 - protein, 9 aa, Homo sapiens
  light chain complementarity determining region 3 for antibody 34023
QQYNNYPLT

SEQ ID NO: 68046 - protein, 18 aa, Homo sapiens
  heavy chain complementarity determining region 3 for antibody 34023
ARGRVYDDPWGYYPTFDS

SEQ ID NO: 68047 - protein, 10 aa, Homo sapiens [sequence omitted]

SEQ ID NO: 68048 - protein, 15 aa, Homo sapiens
  heavy chain complementarity determining region 3 for antibody 34024
ARDSAVAGIYWYFDL

SEQ ID NO: 68049 - protein, 10 aa, Homo sapiens
  light chain complementarity determining region 3 for antibody 34025
QQYNNWPGYT

SEQ ID NO: 68050 - protein, 23 aa, Homo sapiens
  heavy chain complementarity determining region 3 for antibody 34025
VKDHRYSGSLPGKRNQSLRDMDV

SEQ ID NO: 68051 - protein, 8 aa, Homo sapiens
  light chain complementarity determining region 3 for antibody 34026
QQYNNWLT

SEQ ID NO: 68052 - protein, 16 aa, Homo sapiens
  heavy chain complementarity determining region 3 for antibody 34026
ARGVTGYSYGHYYFDY

SEQ ID NO: 68053 - protein, 9 aa, Homo sapiens
  light chain complementarity determining region 3 for antibody 34027
QQYNKWPYT

SEQ ID NO: 68054 - protein, 17 aa, Homo sapiens
  heavy chain complementarity determining region 3 for antibody 34027
AKNTAMTGSSYYRGMDV

SEQ ID NO: 68055 - protein, 9 aa, Homo sapiens
  light chain complementarity determining region 3 for antibody 34028
QQYNGYSRT

SEQ ID NO: 68056 - protein, 18 aa, Homo sapiens
  heavy chain complementarity determining region 3 for antibody 34028
ARDFGGRAYTKVENAFGI

SEQ ID NO: 68057 - protein, 9 aa, Homo sapiens
  light chain complementarity determining region 3 for antibody 34029
QQYLNERVT

SEQ ID NO: 68058 - protein, 11 aa, Homo sapiens
  heavy chain complementarity determining region 3 for antibody 34029
ARIMVRGAYDN

SEQ ID NO: 68059 - protein, 9 aa, Homo sapiens
  light chain complementarity determining region 3 for antibody 34030
QQYISYPLT

SEQ ID NO: 68060 - protein, 17 aa, Homo sapiens
  heavy chain complementarity determining region 3 for antibody 34030
ARLIAPSPAYQEDAFDI

SEQ ID NO: 68061 - protein, 9 aa, Homo sapiens
  light chain complementarity determining region 3 for antibody 34031
QQYISAPYT

SEQ ID NO: 68062 - protein, 24 aa, Homo sapiens
  heavy chain complementarity determining region 3 for antibody 34031
ARVLDYDSGSGTYSKPLIWYAFDI

SEQ ID NO: 68063 - protein, 9 aa, Homo sapiens
  light chain complementarity determining region 3 for antibody 34032
QQYGYSPYT

SEQ ID NO: 68064 - protein, 17 aa, Homo sapiens
  heavy chain complementarity determining region 3 for antibody 34032
ARDALRYYGGMGALLDY

SEQ ID NO: 68065 - protein, 9 aa, Homo sapiens
  light chain complementarity determining region 3 for antibody 34033
QQYGSSWGT

SEQ ID NO: 68066 - protein, 20 aa, Homo sapiens
  heavy chain complementarity determining region 3 for antibody 34033
AREGGHRQWLEIYDPGYFHH

SEQ ID NO: 68067 - protein, 9 aa, Homo sapiens
  light chain complementarity determining region 3 for antibody 34034
QQYGSSPRT

SEQ ID NO: 68068 - protein, 17 aa, Homo sapiens
  heavy chain complementarity determining region 3 for antibody 34034
TTDPQWLEPPPFLTNNY

SEQ ID NO: 68069 - protein, 9 aa, Homo sapiens
  light chain complementarity determining region 3 for antibody 34035
QQYGSSPRT

SEQ ID NO: 68070 - protein, 14 aa, Homo sapiens
  heavy chain complementarity determining region 3 for antibody 34035
ATVGVQFRNGYFQH

SEQ ID NO: 68071 - protein, 10 aa, Homo sapiens
  light chain complementarity determining region 3 for antibody 34036
QQYGSSPPWT

SEQ ID NO: 68072 - protein, 18 aa, Homo sapiens
  heavy chain complementarity determining region 3 for antibody 34036
AREYYDFWKPPPRAWFDP

SEQ ID NO: 68073 - protein, 10 aa, Homo sapiens
  light chain complementarity determining region 3 for antibody 34037
QQYGSSPLYS

SEQ ID NO: 68074 - protein, 11 aa, Homo sapiens
  heavy chain complementarity determining region 3 for antibody 34037
ARGGQWGSLDY

SEQ ID NO: 68075 - protein, 9 aa, Homo sapiens
  light chain complementarity determining region 3 for antibody 34038
QQYGSSPLT

SEQ ID NO: 68076 - protein, 15 aa, Homo sapiens
  heavy chain complementarity determining region 3 for antibody 34038
ARNNYYYDSSGFLDY

SEQ ID NO: 68077 - protein, 9 aa, Homo sapiens
  light chain complementarity determining region 3 for antibody 34039
QQYGSSPIT

SEQ ID NO: 68078 - protein, 12 aa, Homo sapiens
  heavy chain complementarity determining region 3 for antibody 34039
AKWDGNNWHWDF

SEQ ID NO: 68079 - protein, 10 aa, Homo sapiens
  light chain complementarity determining region 3 for antibody 34040
QQYGSSPGGT

SEQ ID NO: 68080 - protein, 20 aa, Homo sapiens
  heavy chain complementarity determining region 3 for antibody 34040
TRSDGSGYPGYHYSYYGVDV

SEQ ID NO: 68081 - protein, 9 aa, Homo sapiens
  light chain complementarity determining region 3 for antibody 34041
QQYGSIPRP

SEQ ID NO: 68082 - protein, 13 aa, Homo sapiens
  heavy chain complementarity determining region 3 for antibody 34041
AGGTWHSGIYYES

SEQ ID NO: 68083 - protein, 9 aa, Homo sapiens
  light chain complementarity determining region 3 for antibody 34042
QQYGNSPRT

SEQ ID NO: 68084 - protein, 15 aa, Homo sapiens
  heavy chain complementarity determining region 3 for antibody 34042
AGGWFNYYSSGYYEP

SEQ ID NO: 68085 - protein, 10 aa, Homo sapiens
  light chain complementarity determining region 3 for antibody 34043
QQYGNSPPNT

SEQ ID NO: 68086 - protein, 15 aa, Homo sapiens
  heavy chain complementarity determining region 3 for antibody 34043
ARHAPGGHSYGYFDH

SEQ ID NO: 68087 - protein, 9 aa, Homo sapiens
  light chain complementarity determining region 3 for antibody 34044
QQYGNLPRT

SEQ ID NO: 68088 - protein, 13 aa, Homo sapiens
  heavy chain complementarity determining region 3 for antibody 34044
AGGNFHSGGYGDY

SEQ ID NO: 68089 - protein, 9 aa, Homo sapiens
  light chain complementarity determining region 3 for antibody 34045
QQYGGSPRT

SEQ ID NO: 68090 - protein, 13 aa, Homo sapiens
  heavy chain complementarity determining region 3 for antibody 34045
ASGYFDSGAYYDF

SEQ ID NO: 68091 - protein, 8 aa, Homo sapiens
  light chain complementarity determining region 3 for antibody 34046
QQYGGSPC

SEQ ID NO: 68092 - protein, 16 aa, Homo sapiens
  heavy chain complementarity determining region 3 for antibody 34046
ATDWGSGTQWIRAFDV

SEQ ID NO: 68093 - protein, 9 aa, Homo sapiens
  light chain complementarity determining region 3 for antibody 34047
QQYDNVPRT

SEQ ID NO: 68094 - protein, 19 aa, Homo sapiens
  heavy chain complementarity determining region 3 for antibody 34047
TTDGGLIMFGGIVVSESTH

SEQ ID NO: 68095 - protein, 9 aa, Homo sapiens
  light chain complementarity determining region 3 for antibody 34048
QQYATSPLT

SEQ ID NO: 68096 - protein, 8 aa, Homo sapiens
  heavy chain complementarity determining region 3 for antibody 34048
ALGQDMGR

SEQ ID NO: 68097 - protein, 8 aa, Homo sapiens
  light chain complementarity determining region 3 for antibody 34049
QQYANSLT

SEQ ID NO: 68098 - protein, 20 aa, Homo sapiens
  heavy chain complementarity determining region 3 for antibody 34049
ARERDLLTGYTEEGYFGVDV

SEQ ID NO: 68099 - protein, 9 aa, Homo sapiens
  light chain complementarity determining region 3 for antibody 34050
QQYAGSPLT

SEQ ID NO: 68100 - protein, 15 aa, Homo sapiens
  heavy chain complementarity determining region 3 for antibody 34050
ARGLSAGWPRNWFAP

SEQ ID NO: 68101 - protein, 9 aa, Homo sapiens
  light chain complementarity determining region 3 for antibody 34051
QQSYTSPPT

SEQ ID NO: 68102 - protein, 16 aa, Homo sapiens
  heavy chain complementarity determining region 3 for antibody 34051
ARGFFDSSGYKNGFDL

SEQ ID NO: 68103 - protein, 9 aa, Homo sapiens
  light chain complementarity determining region 3 for antibody 34052
QQSYSTPYT

SEQ ID NO: 68104 - protein, 14 aa, Homo sapiens
  heavy chain complementarity determining region 3 for antibody 34052
ARDCSSDWYEGMDV

SEQ ID NO: 68105 - protein, 9 aa, Homo sapiens
  light chain complementarity determining region 3 for antibody 34053
QQSYSTPRT

SEQ ID NO: 68106 - protein, 12 aa, Homo sapiens
  heavy chain complementarity determining region 3 for antibody 34053
TVSGFIWFGKHY

SEQ ID NO: 68107 - protein, 9 aa, Homo sapiens
  light chain complementarity determining region 3 for antibody 34054
QQSYSTPRT

SEQ ID NO: 68108 - protein, 16 aa, Homo sapiens
  heavy chain complementarity determining region 3 for antibody 34054
ASYGYSSSWYIRFFDY

SEQ ID NO: 68109 - protein, 9 aa, Homo sapiens
  light chain complementarity determining region 3 for antibody 34055
QQSYSTPQT

SEQ ID NO: 68110 - protein, 16 aa, Homo sapiens
  heavy chain complementarity determining region 3 for antibody 34055
ARSLGVAVEGTNWFDP

SEQ ID NO: 68111 - protein, 9 aa, Homo sapiens
  light chain complementarity determining region 3 for antibody 34056
QQSYSTPLT

SEQ ID NO: 68112 - protein, 16 aa, Homo sapiens
  heavy chain complementarity determining region 3 for antibody 34056
ATPLWYGGSSAWYFDL

SEQ ID NO: 68113 - protein, 8 aa, Homo sapiens
  light chain complementarity determining region 3 for antibody 34057
QQSYSTLT

SEQ ID NO: 68114 - protein, 17 aa, Homo sapiens
  heavy chain complementarity determining region 3 for antibody 34057
ATSSTIFGAVIADAFDF

SEQ ID NO: 68115 - protein, 9 aa, Homo sapiens
  light chain complementarity determining region 3 for antibody 34058
QQSYSSPYT

SEQ ID NO: 68116 - protein, 11 aa, Homo sapiens
  heavy chain complementarity determining region 3 for antibody 34058
TTSLLAIWGIY

SEQ ID NO: 68117 - protein, 9 aa, Homo sapiens
  light chain complementarity determining region 3 for antibody 34059
QQSYSDPWT

SEQ ID NO: 68118 - protein, 14 aa, Homo sapiens
  heavy chain complementarity determining region 3 for antibody 34059
ARDLSSSTYRRFDP

SEQ ID NO: 68119 - protein, 9 aa, Homo sapiens
  light chain complementarity determining region 3 for antibody 34060
QQSFSSPRT

SEQ ID NO: 68120 - protein, 21 aa, Homo sapiens
  heavy chain complementarity determining region 3 for antibody 34060
ARWGDCTGRNCYRYYYYGLDV

SEQ ID NO: 68121 - protein, 9 aa, Homo sapiens
  light chain complementarity determining region 3 for antibody 34061
QQSDSIPYT

SEQ ID NO: 68122 - protein, 12 aa, Homo sapiens
  heavy chain complementarity determining region 3 for antibody 34061
ARANPLVSGFDY

SEQ ID NO: 68123 - protein, 10 aa, Homo sapiens
  light chain complementarity determining region 3 for antibody 34062
QQRYTWPPYT

SEQ ID NO: 68124 - protein, 11 aa, Homo sapiens
  heavy chain complementarity determining region 3 for antibody 34062
ARGVGSYVFES

SEQ ID NO: 68125 - protein, 11 aa, Homo sapiens
  light chain complementarity determining region 3 for antibody 34063
QQRSNWPPMYT

SEQ ID NO: 68126 - protein, 25 aa, Homo sapiens
  heavy chain complementarity determining region 3 for antibody 34063
ARASCITTVCYKSYCSNDVCQYFDS

SEQ ID NO: 68127 - protein, 9 aa, Homo sapiens
  light chain complementarity determining region 3 for antibody 34064
QQRSAWPLT

SEQ ID NO: 68128 - protein, 7 aa, Homo sapiens
  heavy chain complementarity determining region 3 for antibody 34064
VRDEWCP

SEQ ID NO: 68129 - protein, 9 aa, Homo sapiens
  light chain complementarity determining region 3 for antibody 34065
QQRNNWPLT

SEQ ID NO: 68130 - protein, 12 aa, Homo sapiens
  heavy chain complementarity determining region 3 for antibody 34065
AKARTGFDWFDP

SEQ ID NO: 68131 - protein, 10 aa, Homo sapiens
  light chain complementarity determining region 3 for antibody 34066
QQRLHWPPIT

SEQ ID NO: 68132 - protein, 14 aa, Homo sapiens
  heavy chain complementarity determining region 3 for antibody 34066
ARAGQTGADNWFDP

SEQ ID NO: 68133 - protein, 11 aa, Homo sapiens
  light chain complementarity determining region 3 for antibody 34067
QQRASWPPGGT

SEQ ID NO: 68134 - protein, 18 aa, Homo sapiens
  heavy chain complementarity determining region 3 for antibody 34067
ARVYCSGGSCYSGDFFDI

SEQ ID NO: 68135 - protein, 8 aa, Homo sapiens
  light chain complementarity determining region 3 for antibody 34068
QQRANALT

SEQ ID NO: 68136 - protein, 13 aa, Homo sapiens
  heavy chain complementarity determining region 3 for antibody 34068
GGGDIEAIPTSDY

SEQ ID NO: 68137 - protein, 9 aa, Homo sapiens
  light chain complementarity determining region 3 for antibody 34069
QQLNSYPRT

SEQ ID NO: 68138 - protein, 21 aa, Homo sapiens
  heavy chain complementarity determining region 3 for antibody 34069
ARTLGGRYIFGYGITSQAMDV

SEQ ID NO: 68139 - protein, 8 aa, Homo sapiens
  light chain complementarity determining region 3 for antibody 34070
QQHNSLYT

SEQ ID NO: 68140 - protein, 14 aa, Homo sapiens
  heavy chain complementarity determining region 3 for antibody 34070
ARENSISRKRSFDQ

SEQ ID NO: 68141 - protein, 8 aa, Homo sapiens
  light chain complementarity determining region 3 for antibody 34071
QQHGGSPS

SEQ ID NO: 68142 - protein, 16 aa, Homo sapiens
  heavy chain complementarity determining region 3 for antibody 34071
ATDWGSGTQWIRAFDV

SEQ ID NO: 68143 - protein, 11 aa, Homo sapiens
  light chain complementarity determining region 3 for antibody 34072
QQHETSPPMYT

SEQ ID NO: 68144 - protein, 23 aa, Homo sapiens
  heavy chain complementarity determining region 3 for antibody 34072
ARARRGYRRTNSRMDFVFYGMDV

SEQ ID NO: 68145 - protein, 9 aa, Homo sapiens
  light chain complementarity determining region 3 for antibody 34073
QQGYSTPFT

SEQ ID NO: 68146 - protein, 15 aa, Homo sapiens
  heavy chain complementarity determining region 3 for antibody 34073
ARAQVIWGQLYYFDL

SEQ ID NO: 68147 - protein, 9 aa, Homo sapiens
  light chain complementarity determining region 3 for antibody 34074
QQGGSFPFT

SEQ ID NO: 68148 - protein, 18 aa, Homo sapiens
  heavy chain complementarity determining region 3 for antibody 34074
TTEFTGAAGTTYYSYFDY

SEQ ID NO: 68149 - protein, 9 aa, Homo sapiens
  light chain complementarity determining region 3 for antibody 34075
QQFYTYPLT

SEQ ID NO: 68150 - protein, 12 aa, Homo sapiens
  heavy chain complementarity determining region 3 for antibody 34075
TRVLSSAIGECD

SEQ ID NO: 68151 - protein, 9 aa, Homo sapiens
  light chain complementarity determining region 3 for antibody 34076
QQFSSYSYT

SEQ ID NO: 68152 - protein, 22 aa, Homo sapiens
  heavy chain complementarity determining region 3 for antibody 34076
ARISGVITLSGSYFYYYYGLDV

SEQ ID NO: 68153 - protein, 10 aa, Homo sapiens
  light chain complementarity determining region 3 for antibody 34077
QQFNNWPPWT

SEQ ID NO: 68154 - protein, 12 aa, Homo sapiens
  heavy chain complementarity determining region 3 for antibody 34077
AKTVRERKELDH

SEQ ID NO: 68155 - protein, 10 aa, Homo sapiens
  light chain complementarity determining region 3 for antibody 34078
QQDGNSPPFT

SEQ ID NO: 68156 - protein, 13 aa, Homo sapiens
  heavy chain complementarity determining region 3 for antibody 34078
ASWSHSDLDAFDI

SEQ ID NO: 68157 - protein, 10 aa, Homo sapiens
  light chain complementarity determining region 3 for antibody 34079
QQCFSTPGYT

SEQ ID NO: 68158 - protein, 11 aa, Homo sapiens
  heavy chain complementarity determining region 3 for antibody 34079
AKTYNSGWFDY

SEQ ID NO: 68159 - protein, 9 aa, Homo sapiens
  light chain complementarity determining region 3 for antibody 34080
QQANSFPRT

SEQ ID NO: 68160 - protein, 14 aa, Homo sapiens
  heavy chain complementarity determining region 3 for antibody 34080
ARHMTLSGTRGFDY

SEQ ID NO: 68161 - protein, 9 aa, Homo sapiens
  light chain complementarity determining region 3 for antibody 34081
QNYDGAPWT

SEQ ID NO: 68162 - protein, 16 aa, Homo sapiens
  heavy chain complementarity determining region 3 for antibody 34081
AKKGGPVTATGNYFDL

SEQ ID NO: 68163 - protein, 9 aa, Homo sapiens
  light chain complementarity determining region 3 for antibody 34082
QKYNSGPLT

SEQ ID NO: 68164 - protein, 12 aa, Homo sapiens
  heavy chain complementarity determining region 3 for antibody 34082
AKGPDYNWNGGG

SEQ ID NO: 68165 - protein, 9 aa, Homo sapiens
  light chain complementarity determining region 3 for antibody 34083
QHYHYLPIT

SEQ ID NO: 68166 - protein, 24 aa, Homo sapiens
  heavy chain complementarity determining region 3 for antibody 34083
AASKIITITYGRLTVHGQSDSLDI

SEQ ID NO: 68167 - protein, 10 aa, Homo sapiens
  light chain complementarity determining region 3 for antibody 34084
QHYGSSLMYP

SEQ ID NO: 68168 - protein, 14 aa, Homo sapiens
  heavy chain complementarity determining region 3 for antibody 34084
TTDRPLTGMVTFDF

SEQ ID NO: 68169 - protein, 10 aa, Homo sapiens
  light chain complementarity determining region 3 for antibody 34085
QHYGSSLLYT

SEQ ID NO: 68170 - protein, 14 aa, Homo sapiens
  heavy chain complementarity determining region 3 for antibody 34085
TTDRPLTGMVTFDF

SEQ ID NO: 68171 - protein, 9 aa, Homo sapiens
  light chain complementarity determining region 3 for antibody 34086
QHYGRSPWT

SEQ ID NO: 68172 - protein, 13 aa, Homo sapiens
  heavy chain complementarity determining region 3 for antibody 34086
AGGQFDNTGYREY

SEQ ID NO: 68173 - protein, 10 aa, Homo sapiens
  light chain complementarity determining region 3 for antibody 34087
QHWASSPAYT

SEQ ID NO: 68174 - protein, 12 aa, Homo sapiens
  heavy chain complementarity determining region 3 for antibody 34087
ARETTQFGELDN

SEQ ID NO: 68175 - protein, 9 aa, Homo sapiens
  light chain complementarity determining region 3 for antibody 34088
QHTHTFPRT

SEQ ID NO: 68176 - protein, 4 aa, Homo sapiens
  heavy chain complementarity determining region 3 for antibody 34088
GMDV

SEQ ID NO: 68177 - protein, 10 aa, Homo sapiens
  light chain complementarity determining region 3 for antibody 34089
QGRDEWPPVI

SEQ ID NO: 68178 - protein, 12 aa, Homo sapiens
  heavy chain complementarity determining region 3 for antibody 34089
VRDHITGWKFDY

SEQ ID NO: 68179 - protein, 9 aa, Homo sapiens
  light chain complementarity determining region 3 for antibody 34090
MQYRYGPHT

SEQ ID NO: 68180 - protein, 8 aa, Homo sapiens
  heavy chain complementarity determining region 3 for antibody 34090
VCWGTFHL

SEQ ID NO: 68181 - protein, 8 aa, Homo sapiens
  light chain complementarity determining region 3 for antibody 34091
MQGTSGRR

SEQ ID NO: 68182 - protein, 17 aa, Homo sapiens
  heavy chain complementarity determining region 3 for antibody 34091
AHRRYYNGNWNGATFDV

SEQ ID NO: 68183 - protein, 10 aa, Homo sapiens
  light chain complementarity determining region 3 for antibody 34092
MQGTHWPPWT

SEQ ID NO: 68184 - protein, 12 aa, Homo sapiens
  heavy chain complementarity determining region 3 for antibody 34092
AREFSLQDAFDI

SEQ ID NO: 68185 - protein, 9 aa, Homo sapiens
  light chain complementarity determining region 3 for antibody 34093
MQGTHGPPT

SEQ ID NO: 68186 - protein, 15 aa, Homo sapiens
  heavy chain complementarity determining region 3 for antibody 34093
AKSSGQNIAVAGFDC

SEQ ID NO: 68187 - protein, 10 aa, Homo sapiens
  light chain complementarity determining region 3 for antibody 34094
MQALQTPPWT

SEQ ID NO: 68188 - protein, 13 aa, Homo sapiens
  heavy chain complementarity determining region 3 for antibody 34094
ARNYDILVGDFDY

SEQ ID NO: 68189 - protein, 9 aa, Homo sapiens
  light chain complementarity determining region 3 for antibody 34095
MQALKTPYT

SEQ ID NO: 68190 - protein, 21 aa, Homo sapiens
  heavy chain complementarity determining region 3 for antibody 34095
ARDAPVSRPYSSGWYSSAFDY

SEQ ID NO: 68191 - protein, 9 aa, Homo sapiens
  light chain complementarity determining region 3 for antibody 34096
MQALEPPFT

SEQ ID NO: 68192 - protein, 15 aa, Homo sapiens
  heavy chain complementarity determining region 3 for antibody 34096
VRHYRETVAGIEGDS

SEQ ID NO: 68193 - protein, 9 aa, Homo sapiens
  light chain complementarity determining region 3 for antibody 34097
MQALDTPFT

SEQ ID NO: 68194 - protein, 15 aa, Homo sapiens
  heavy chain complementarity determining region 3 for antibody 34097
VRHYRETVAGIEGDS

SEQ ID NO: 68195 - protein, 9 aa, Homo sapiens
  light chain complementarity determining region 3 for antibody 34098
LQYNTYPFT

SEQ ID NO: 68196 - protein, 7 aa, Homo sapiens
  heavy chain complementarity determining region 3 for antibody 34098
TVFGLDY

SEQ ID NO: 68197 - protein, 9 aa, Homo sapiens
  light chain complementarity determining region 3 for antibody 34099
HQYGGSPRT

SEQ ID NO: 68198 - protein, 17 aa, Homo sapiens
  heavy chain complementarity determining region 3 for antibody 34099
TTDPQWLEPPPFVTNDY

SEQ ID NO: 68199 - protein, 8 aa, Homo sapiens
  light chain complementarity determining region 3 for antibody 34100
HQRSNWPP

SEQ ID NO: 68200 - protein, 16 aa, Homo sapiens
  heavy chain complementarity determining region 3 for antibody 34100
ARGYSSSSLQGYYFDY

SEQ ID NO: 68201 - protein, 9 aa, Homo sapiens
  light chain complementarity determining region 3 for antibody 34101
VQYNRDPRT

SEQ ID NO: 68202 - protein, 6 aa, Homo sapiens
  heavy chain complementarity determining region 3 for antibody 34101
TRALDY

SEQ ID NO: 68203 - protein, 9 aa, Homo sapiens
  light chain complementarity determining region 3 for antibody 34102
RQALETPFT

SEQ ID NO: 68204 - protein, 15 aa, Homo sapiens
  heavy chain complementarity determining region 3 for antibody 34102
VRHYRETVAGIEGDS

SEQ ID NO: 68205 - protein, 9 aa, Homo sapiens
  light chain complementarity determining region 3 for antibody 34103
QQYYSIPPT

SEQ ID NO: 68206 - protein, 5 aa, Homo sapiens
  heavy chain complementarity determining region 3 for antibody 34103
GPPPY

SEQ ID NO: 68207 - protein, 9 aa, Homo sapiens
  light chain complementarity determining region 3 for antibody 34104
QQYYSHPLT

SEQ ID NO: 68208 - protein, 14 aa, Homo sapiens
  heavy chain complementarity determining region 3 for antibody 34104
AKAKAETTDNGHDQ

SEQ ID NO: 68209 - protein, 9 aa, Homo sapiens
  light chain complementarity determining region 3 for antibody 34105
QQYYRTPYT

SEQ ID NO: 68210 - protein, 17 aa, Homo sapiens
  heavy chain complementarity determining region 3 for antibody 34105
ARGQRGSTPWPNWYFDL

SEQ ID NO: 68211 - protein, 9 aa, Homo sapiens
  light chain complementarity determining region 3 for antibody 34106
QQYYRAPLT

SEQ ID NO: 68212 - protein, 15 aa, Homo sapiens
  heavy chain complementarity determining region 3 for antibody 34106
AKGCRSGTNCFLIDY

SEQ ID NO: 68213 - protein, 9 aa, Homo sapiens
  light chain complementarity determining region 3 for antibody 34107
QQYSSYPLT

SEQ ID NO: 68214 - protein, 19 aa, Homo sapiens
  heavy chain complementarity determining region 3 for antibody 34107
ARLSPAFFGGNLGRYFFDY

SEQ ID NO: 68215 - protein, 9 aa, Homo sapiens
  light chain complementarity determining region 3 for antibody 34108
QQYNSYSWT

SEQ ID NO: 68216 - protein, 18 aa, Homo sapiens
  heavy chain complementarity determining region 3 for antibody 34108
ARDQPVRGVIFDYYGMDV

SEQ ID NO: 68217 - protein, 10 aa, Homo sapiens
  light chain complementarity determining region 3 for antibody 34109
QQYNSYSPYT

SEQ ID NO: 68218 - protein, 20 aa, Homo sapiens
  heavy chain complementarity determining region 3 for antibody 34109
ARGVGLGYCSSTSCPYYFDY

SEQ ID NO: 68219 - protein, 9 aa, Homo sapiens
  light chain complementarity determining region 3 for antibody 34110
QQYNSYPLT

SEQ ID NO: 68220 - protein, 20 aa, Homo sapiens
  heavy chain complementarity determining region 3 for antibody 34110
AKERSHYDSNKFHPPFFFDY

SEQ ID NO: 68221 - protein, 10 aa, Homo sapiens
  light chain complementarity determining region 3 for antibody 34111
QQYNNYLPYT

SEQ ID NO: 68222 - protein, 19 aa, Homo sapiens
  heavy chain complementarity determining region 3 for antibody 34111
TRQSRNTIFGLVVPGNFDL

SEQ ID NO: 68223 - protein, 10 aa, Homo sapiens
  light chain complementarity determining region 3 for antibody 34112
QQYNNWPPYT

SEQ ID NO: 68224 - protein, 18 aa, Homo sapiens
  heavy chain complementarity determining region 3 for antibody 34112
ARGNVYYYDTSDYIYFDQ

SEQ ID NO: 68225 - protein, 8 aa, Homo sapiens
  light chain complementarity determining region 3 for antibody 34113
QQYNNHRT

SEQ ID NO: 68226 - protein, 17 aa, Homo sapiens
  heavy chain complementarity determining region 3 for antibody 34113
ARRLGIRGVQGLGWFDS

SEQ ID NO: 68227 - protein, 9 aa, Homo sapiens
  light chain complementarity determining region 3 for antibody 34114
QQYNGYSFI

SEQ ID NO: 68228 - protein, 18 aa, Homo sapiens
  heavy chain complementarity determining region 3 for antibody 34114
ARLRGRGIAVVTAPRFDP

SEQ ID NO: 68229 - protein, 11 aa, Homo sapiens
  light chain complementarity determining region 3 for antibody 34115
QQYINSPPMYI

SEQ ID NO: 68230 - protein, 14 aa, Homo sapiens
  heavy chain complementarity determining region 3 for antibody 34115
AGHVVVTGTRGFDY

SEQ ID NO: 68231 - protein, 9 aa, Homo sapiens
  light chain complementarity determining region 3 for antibody 34116
QQYIGWPRT

SEQ ID NO: 68232 - protein, 6 aa, Homo sapiens
  heavy chain complementarity determining region 3 for antibody 34116
GSVFDY

SEQ ID NO: 68233 - protein, 10 aa, Homo sapiens
  light chain complementarity determining region 3 for antibody 34117
QQYGSSTRYT

SEQ ID NO: 68234 - protein, 19 aa, Homo sapiens
  heavy chain complementarity determining region 3 for antibody 34117
ARGSSLVEHFGGAYYFFDY

SEQ ID NO: 68235 - protein, 9 aa, Homo sapiens
  light chain complementarity determining region 3 for antibody 34118
QQYGSSSLT

SEQ ID NO: 68236 - protein, 18 aa, Homo sapiens
  heavy chain complementarity determining region 3 for antibody 34118
ARKSSGWYSLSAYWYFDL

SEQ ID NO: 68237 - protein, 9 aa, Homo sapiens
  light chain complementarity determining region 3 for antibody 34119
QQYGSSPYT

SEQ ID NO: 68238 - protein, 15 aa, Homo sapiens
  heavy chain complementarity determining region 3 for antibody 34119
ATGGTGSTINWYFDL

SEQ ID NO: 68239 - protein, 9 aa, Homo sapiens
  light chain complementarity determining region 3 for antibody 34120
QQYGSSPRS

SEQ ID NO: 68240 - protein, 25 aa, Homo sapiens
  heavy chain complementarity determining region 3 for antibody 34120
ARLRIDRLRLPGAMRGPLYDCGLNV

SEQ ID NO: 68241 - protein, 8 aa, Homo sapiens
  light chain complementarity determining region 3 for antibody 34121
QQYGSSLT

SEQ ID NO: 68242 - protein, 21 aa, Homo sapiens
  heavy chain complementarity determining region 3 for antibody 34121
ARSATYYDNSGSYGPSEYLHH

SEQ ID NO: 68243 - protein, 9 aa, Homo sapiens
  light chain complementarity determining region 3 for antibody 34122
QQYGSPPRT

SEQ ID NO: 68244 - protein, 14 aa, Homo sapiens
  heavy chain complementarity determining region 3 for antibody 34122
AGGNFCGYDCYSDY

SEQ ID NO: 68245 - protein, 9 aa, Homo sapiens
  light chain complementarity determining region 3 for antibody 34123
QQYGRSPGT

SEQ ID NO: 68246 - protein, 22 aa, Homo sapiens
  heavy chain complementarity determining region 3 for antibody 34123
ARGDYSYEGDDYLWLTAEYFQH

SEQ ID NO: 68247 - protein, 9 aa, Homo sapiens
  light chain complementarity determining region 3 for antibody 34124
QQYGNLPRT

SEQ ID NO: 68248 - protein, 13 aa, Homo sapiens
  heavy chain complementarity determining region 3 for antibody 34124
AGGDFHSGGYSDF

SEQ ID NO: 68249 - protein, 10 aa, Homo sapiens
  light chain complementarity determining region 3 for antibody 34125
QQYGGSPPIT

SEQ ID NO: 68250 - protein, 18 aa, Homo sapiens
  heavy chain complementarity determining region 3 for antibody 34125
ARGRKSHFGNVGYFSFHH

SEQ ID NO: 68251 - protein, 10 aa, Homo sapiens
  light chain complementarity determining region 3 for antibody 34126
QQYGGPPPFS

SEQ ID NO: 68252 - protein, 12 aa, Homo sapiens
  heavy chain complementarity determining region 3 for antibody 34126
ARETGGSYYMDA

SEQ ID NO: 68253 - protein, 9 aa, Homo sapiens
  light chain complementarity determining region 3 for antibody 34127
QQYFTTPIT

SEQ ID NO: 68254 - protein, 10 aa, Homo sapiens
  heavy chain complementarity determining region 3 for antibody 34127
ARSGGYGWDS

SEQ ID NO: 68255 - protein, 11 aa, Homo sapiens
  light chain complementarity determining region 3 for antibody 34128
QQYETSPPGYT

SEQ ID NO: 68256 - protein, 14 aa, Homo sapiens
  heavy chain complementarity determining region 3 for antibody 34128
ARENTISRKRYFDQ

SEQ ID NO: 68257 - protein, 9 aa, Homo sapiens
  light chain complementarity determining region 3 for antibody 34129
QQYDTPPWT

SEQ ID NO: 68258 - protein, 13 aa, Homo sapiens
  heavy chain complementarity determining region 3 for antibody 34129
ARETRIHFPAFEY

SEQ ID NO: 68259 - protein, 9 aa, Homo sapiens
  light chain complementarity determining region 3 for antibody 34130
QQYDSYSGT

SEQ ID NO: 68260 - protein, 15 aa, Homo sapiens
  heavy chain complementarity determining region 3 for antibody 34130
VKDKVELATITAFDI

SEQ ID NO: 68261 - protein, 9 aa, Homo sapiens
  light chain complementarity determining region 3 for antibody 34131
QQYDSSPWT

SEQ ID NO: 68262 - protein, 14 aa, Homo sapiens
  heavy chain complementarity determining region 3 for antibody 34131
ARFMVRDVLYFFDF

SEQ ID NO: 68263 - protein, 9 aa, Homo sapiens
  light chain complementarity determining region 3 for antibody 34132
QQYDRSPRT

SEQ ID NO: 68264 - protein, 15 aa, Homo sapiens
  heavy chain complementarity determining region 3 for antibody 34132
ARDADLYSSSWFFDH

SEQ ID NO: 68265 - protein, 9 aa, Homo sapiens
  light chain complementarity determining region 3 for antibody 34133
QQYDNLPYT

SEQ ID NO: 68266 - protein, 15 aa, Homo sapiens
  heavy chain complementarity determining region 3 for antibody 34133
ARDRGAAALFYGVDV

SEQ ID NO: 68267 - protein, 9 aa, Homo sapiens
  light chain complementarity determining region 3 for antibody 34134
QQYDNLPPT

SEQ ID NO: 68268 - protein, 19 aa, Homo sapiens
  heavy chain complementarity determining region 3 for antibody 34134
ARDPFRTGNYWEGYDVFDI

SEQ ID NO: 68269 - protein, 9 aa, Homo sapiens
  light chain complementarity determining region 3 for antibody 34135
QQSYTTPRT

SEQ ID NO: 68270 - protein, 14 aa, Homo sapiens
  heavy chain complementarity determining region 3 for antibody 34135
ARDWGVGVGAFLES

SEQ ID NO: 68271 - protein, 9 aa, Homo sapiens
  light chain complementarity determining region 3 for antibody 34136
QQSYTSPST

SEQ ID NO: 68272 - protein, 16 aa, Homo sapiens
  heavy chain complementarity determining region 3 for antibody 34136
ATDWGSGTQWIRAFDV

SEQ ID NO: 68273 - protein, 9 aa, Homo sapiens
  light chain complementarity determining region 3 for antibody 34137
QQSYSTPRT

SEQ ID NO: 68274 - protein, 16 aa, Homo sapiens
  heavy chain complementarity determining region 3 for antibody 34137
ARDLSTVVTPADHFDY

SEQ ID NO: 68275 - protein, 9 aa, Homo sapiens
  light chain complementarity determining region 3 for antibody 34138
QQSYSTALT

SEQ ID NO: 68276 - protein, 16 aa, Homo sapiens
  heavy chain complementarity determining region 3 for antibody 34138
AREGGGTYTSSRAFDH

SEQ ID NO: 68277 - protein, 9 aa, Homo sapiens
  light chain complementarity determining region 3 for antibody 34139
QQSYSRPYT

SEQ ID NO: 68278 - protein, 20 aa, Homo sapiens
  heavy chain complementarity determining region 3 for antibody 34139
ARSGGEDYYDSSGYYPKFDY

SEQ ID NO: 68279 - protein, 9 aa, Homo sapiens
  light chain complementarity determining region 3 for antibody 34140
QQSYGTPQT

SEQ ID NO: 68280 - protein, 11 aa, Homo sapiens
  heavy chain complementarity determining region 3 for antibody 34140
VREVDSGHIDY

SEQ ID NO: 68281 - protein, 9 aa, Homo sapiens
  light chain complementarity determining region 3 for antibody 34141
QQRYSSLLT

SEQ ID NO: 68282 - protein, 16 aa, Homo sapiens
  heavy chain complementarity determining region 3 for antibody 34141
AREGGSTYTTKRAFDS

SEQ ID NO: 68283 - protein, 9 aa, Homo sapiens
  light chain complementarity determining region 3 for antibody 34142
QQRTNWRFT

SEQ ID NO: 68284 - protein, 16 aa, Homo sapiens
  heavy chain complementarity determining region 3 for antibody 34142
ARDQGYCLGTNCYLRH

SEQ ID NO: 68285 - protein, 9 aa, Homo sapiens
  light chain complementarity determining region 3 for antibody 34143
QQRSNWPPT

SEQ ID NO: 68286 - protein, 15 aa, Homo sapiens
  heavy chain complementarity determining region 3 for antibody 34143
AKDRYYYDNSGYCDY

SEQ ID NO: 68287 - protein, 12 aa, Homo sapiens
  light chain complementarity determining region 3 for antibody 34144
QQRSNWPPGGVP

SEQ ID NO: 68288 - protein, 13 aa, Homo sapiens
  heavy chain complementarity determining region 3 for antibody 34144
ARGYGWYGDYFDY

SEQ ID NO: 68289 - protein, 9 aa, Homo sapiens
  light chain complementarity determining region 3 for antibody 34145
QQRSNWPIT

SEQ ID NO: 68290 - protein, 13 aa, Homo sapiens
  heavy chain complementarity determining region 3 for antibody 34145
AREASSGGGVFEI

SEQ ID NO: 68291 - protein, 9 aa, Homo sapiens
  light chain complementarity determining region 3 for antibody 34146
QQRSDWPRT

SEQ ID NO: 68292 - protein, 14 aa, Homo sapiens
  heavy chain complementarity determining region 3 for antibody 34146
ARGQELAEKVDEDY

SEQ ID NO: 68293 - protein, 9 aa, Homo sapiens
  light chain complementarity determining region 3 for antibody 34147
QQRINWPVT

SEQ ID NO: 68294 - protein, 21 aa, Homo sapiens
  heavy chain complementarity determining region 3 for antibody 34147
AIDLLAPRSGHPNFYYYAMDV

SEQ ID NO: 68295 - protein, 11 aa, Homo sapiens
  light chain complementarity determining region 3 for antibody 34148
QQLKDYPRELT

SEQ ID NO: 68296 - protein, 14 aa, Homo sapiens
  heavy chain complementarity determining region 3 for antibody 34148
ARDLFGGGPGAFDS

SEQ ID NO: 68297 - protein, 9 aa, Homo sapiens
  light chain complementarity determining region 3 for antibody 34149
QQLDSSPFT

SEQ ID NO: 68298 - protein, 14 aa, Homo sapiens
  heavy chain complementarity determining region 3 for antibody 34149
ARHTEVTGLRGFDR

SEQ ID NO: 68299 - protein, 9 aa, Homo sapiens
  light chain complementarity determining region 3 for antibody 34150
QQDGRSPRT

SEQ ID NO: 68300 - protein, 15 aa, Homo sapiens
  heavy chain complementarity determining region 3 for antibody 34150
AKDGPYCGGDCYFDS

SEQ ID NO: 68301 - protein, 9 aa, Homo sapiens
  light chain complementarity determining region 3 for antibody 34151
QQCYSTPFT

SEQ ID NO: 68302 - protein, 14 aa, Homo sapiens
  heavy chain complementarity determining region 3 for antibody 34151
ARTVDWDGPKYFDS

SEQ ID NO: 68303 - protein, 9 aa, Homo sapiens
  light chain complementarity determining region 3 for antibody 34152
QQCYSSPLT

SEQ ID NO: 68304 - protein, 12 aa, Homo sapiens
  heavy chain complementarity determining region 3 for antibody 34152
ASGLIAAVGVDS

SEQ ID NO: 68305 - protein, 9 aa, Homo sapiens
  light chain complementarity determining region 3 for antibody 34153
QQANSFPWT

SEQ ID NO: 68306 - protein, 21 aa, Homo sapiens
  heavy chain complementarity determining region 3 for antibody 34153
ARDAPVSRPYSSGWYSSAFDY

SEQ ID NO: 68307 - protein, 9 aa, Homo sapiens
  light chain complementarity determining region 3 for antibody 34154
QPYYTSLRT

SEQ ID NO: 68308 - protein, 12 aa, Homo sapiens
  heavy chain complementarity determining region 3 for antibody 34154
VKDCGLGGSRDS

SEQ ID NO: 68309 - protein, 9 aa, Homo sapiens
  light chain complementarity determining region 3 for antibody 34155
QLLYSYPLT

SEQ ID NO: 68310 - protein, 14 aa, Homo sapiens
  heavy chain complementarity determining region 3 for antibody 34155
ARHHHGAGTPIIDH

SEQ ID NO: 68311 - protein, 9 aa, Homo sapiens
  light chain complementarity determining region 3 for antibody 34156
QKYSRAPLT

SEQ ID NO: 68312 - protein, 14 aa, Homo sapiens
  heavy chain complementarity determining region 3 for antibody 34156
ARTAGQWLMFPFDY

SEQ ID NO: 68313 - protein, 10 aa, Homo sapiens
  light chain complementarity determining region 3 for antibody 34157
QKYNSAPPLT

SEQ ID NO: 68314 - protein, 21 aa, Homo sapiens
  heavy chain complementarity determining region 3 for antibody 34157
TAPSGANDYGDDYGDYVLPDH

SEQ ID NO: 68315 - protein, 9 aa, Homo sapiens
  light chain complementarity determining region 3 for antibody 34158
QKGDGLPFT

SEQ ID NO: 68316 - protein, 15 aa, Homo sapiens
  heavy chain complementarity determining region 3 for antibody 34158
AREAFDIAGHYRADY

SEQ ID NO: 68317 - protein, 9 aa, Homo sapiens
  light chain complementarity determining region 3 for antibody 34159
QHYYTSLRT

SEQ ID NO: 68318 - protein, 12 aa, Homo sapiens
  heavy chain complementarity determining region 3 for antibody 34159
VKDCGLGGSRDS

SEQ ID NO: 68319 - protein, 9 aa, Homo sapiens
  light chain complementarity determining region 3 for antibody 34160
QHYGTSPFT

SEQ ID NO: 68320 - protein, 15 aa, Homo sapiens
  heavy chain complementarity determining region 3 for antibody 34160
ARQNDFLSGPGEFDP

SEQ ID NO: 68321 - protein, 10 aa, Homo sapiens
  light chain complementarity determining region 3 for antibody 34161
QHWVSSPADT

SEQ ID NO: 68322 - protein, 12 aa, Homo sapiens
  heavy chain complementarity determining region 3 for antibody 34161
ARETTQFGELDN

SEQ ID NO: 68323 - protein, 9 aa, Homo sapiens
  light chain complementarity determining region 3 for antibody 34162
QHTSTFPRT

SEQ ID NO: 68324 - protein, 4 aa, Homo sapiens
  heavy chain complementarity determining region 3 for antibody 34162
GMDV

SEQ ID NO: 68325 - protein, 9 aa, Homo sapiens
  light chain complementarity determining region 3 for antibody 34163
QHSHSRPFP

SEQ ID NO: 68326 - protein, 20 aa, Homo sapiens
  heavy chain complementarity determining region 3 for antibody 34163
AKGIAVAALRTVYYYYGMDV

SEQ ID NO: 68327 - protein, 11 aa, Homo sapiens
  light chain complementarity determining region 3 for antibody 34164
QHRNNWPPLYT

SEQ ID NO: 68328 - protein, 14 aa, Homo sapiens
  heavy chain complementarity determining region 3 for antibody 34164
ARGEMGTVSFYFDH

SEQ ID NO: 68329 - protein, 10 aa, Homo sapiens
  light chain complementarity determining region 3 for antibody 34165
QEYSTYSRRA

SEQ ID NO: 68330 - protein, 16 aa, Homo sapiens
  heavy chain complementarity determining region 3 for antibody 34165
ARGLSAAGRKTGALEI

SEQ ID NO: 68331 - protein, 9 aa, Homo sapiens
  light chain complementarity determining region 3 for antibody 34166
MQPLHTPIT

SEQ ID NO: 68332 - protein, 18 aa, Homo sapiens
  heavy chain complementarity determining region 3 for antibody 34166
ARPFYDSYTYHYYYGLDV

SEQ ID NO: 68333 - protein, 8 aa, Homo sapiens
  light chain complementarity determining region 3 for antibody 34167
MQGTSGRP

SEQ ID NO: 68334 - protein, 17 aa, Homo sapiens
  heavy chain complementarity determining region 3 for antibody 34167
AHRRYYNGNWNGATFDV

SEQ ID NO: 68335 - protein, 8 aa, Homo sapiens
  light chain complementarity determining region 3 for antibody 34168
MQGTQWRT

SEQ ID NO: 68336 - protein, 15 aa, Homo sapiens
  heavy chain complementarity determining region 3 for antibody 34168
VRDWAITRLLGNFDC

SEQ ID NO: 68337 - protein, 9 aa, Homo sapiens
  light chain complementarity determining region 3 for antibody 34169
MQGTHWPRT

SEQ ID NO: 68338 - protein, 10 aa, Homo sapiens
  heavy chain complementarity determining region 3 for antibody 34169
VLTGDSWGDR

SEQ ID NO: 68339 - protein, 10 aa, Homo sapiens
  light chain complementarity determining region 3 for antibody 34170
MQGTHWPPWT

SEQ ID NO: 68340 - protein, 17 aa, Homo sapiens
  heavy chain complementarity determining region 3 for antibody 34170
VRDDYSASGRRNAPGAD

SEQ ID NO: 68341 - protein, 11 aa, Homo sapiens
  light chain complementarity determining region 3 for antibody 34171
MQGTHWPPKGT

SEQ ID NO: 68342 - protein, 21 aa, Homo sapiens
  heavy chain complementarity determining region 3 for antibody 34171
ARDAPVSRPYSSGWYSSAFDY

SEQ ID NO: 68343 - protein, 9 aa, Homo sapiens
  light chain complementarity determining region 3 for antibody 34172
MQGTHGPKT

SEQ ID NO: 68344 - protein, 9 aa, Homo sapiens
  heavy chain complementarity determining region 3 for antibody 34172
AKGYYDSSY

SEQ ID NO: 68345 - protein, 9 aa, Homo sapiens
  light chain complementarity determining region 3 for antibody 34173
MQGRQTPIT

SEQ ID NO: 68346 - protein, 15 aa, Homo sapiens
  heavy chain complementarity determining region 3 for antibody 34173
ARDVGFGSVPYYFDS

SEQ ID NO: 68347 - protein, 9 aa, Homo sapiens
  light chain complementarity determining region 3 for antibody 34174
MQGLQTPYT

SEQ ID NO: 68348 - protein, 10 aa, Homo sapiens
  heavy chain complementarity determining region 3 for antibody 34174
GSDLSGASDY

SEQ ID NO: 68349 - protein, 9 aa, Homo sapiens
  light chain complementarity determining region 3 for antibody 34175
MQGLKTPYT

SEQ ID NO: 68350 - protein, 10 aa, Homo sapiens
  heavy chain complementarity determining region 3 for antibody 34175
GRDLSGARDY

SEQ ID NO: 68351 - protein, 9 aa, Homo sapiens
  light chain complementarity determining region 3 for antibody 34176
MQALQTPVT

SEQ ID NO: 68352 - protein, 13 aa, Homo sapiens
  heavy chain complementarity determining region 3 for antibody 34176
TMVVDYGDYGFDC

SEQ ID NO: 68353 - protein, 9 aa, Homo sapiens
  light chain complementarity determining region 3 for antibody 34177
MQALQTPPT

SEQ ID NO: 68354 - protein, 25 aa, Homo sapiens
  heavy chain complementarity determining region 3 for antibody 34177
ARNKEFGRKDYLGSGVGYYYHTMDV

SEQ ID NO: 68355 - protein, 9 aa, Homo sapiens
  light chain complementarity determining region 3 for antibody 34178
MQALQTPLT

SEQ ID NO: 68356 - protein, 24 aa, Homo sapiens
  heavy chain complementarity determining region 3 for antibody 34178
ARDRRASFYDIWTGYTETWDAFDI

SEQ ID NO: 68357 - protein, 9 aa, Homo sapiens
  light chain complementarity determining region 3 for antibody 34179
MQALQPPYT

SEQ ID NO: 68358 - protein, 21 aa, Homo sapiens
  heavy chain complementarity determining region 3 for antibody 34179
ARDAPVSRPYSSGWYSSAFDY

SEQ ID NO: 68359 - protein, 8 aa, Homo sapiens
  light chain complementarity determining region 3 for antibody 34180
MQALHHLP

SEQ ID NO: 68360 - protein, 16 aa, Homo sapiens
  heavy chain complementarity determining region 3 for antibody 34180
AKWGGVAMAGHYYFDY

SEQ ID NO: 68361 - protein, 8 aa, Homo sapiens
  light chain complementarity determining region 3 for antibody 34181
MKGTQGGP

SEQ ID NO: 68362 - protein, 15 aa, Homo sapiens
  heavy chain complementarity determining region 3 for antibody 34181
ATDWSFQMIEGNFHH

SEQ ID NO: 68363 - protein, 9 aa, Homo sapiens
  light chain complementarity determining region 3 for antibody 34182
LRFDDIPLT

SEQ ID NO: 68364 - protein, 15 aa, Homo sapiens
  heavy chain complementarity determining region 3 for antibody 34182
TTAPGAIWLGELKDS

SEQ ID NO: 68365 - protein, 9 aa, Homo sapiens
  light chain complementarity determining region 3 for antibody 34183
LQHYNFPWT

SEQ ID NO: 68366 - protein, 12 aa, Homo sapiens
  heavy chain complementarity determining region 3 for antibody 34183
ARRLRVPERLDS

SEQ ID NO: 68367 - protein, 9 aa, Homo sapiens
  light chain complementarity determining region 3 for antibody 34184
LQHYNFPGT

SEQ ID NO: 68368 - protein, 12 aa, Homo sapiens
  heavy chain complementarity determining region 3 for antibody 34184
ARHLRVPERLDS

SEQ ID NO: 68369 - protein, 9 aa, Homo sapiens
  light chain complementarity determining region 3 for antibody 34185
LQHSISPRT

SEQ ID NO: 68370 - protein, 11 aa, Homo sapiens
  heavy chain complementarity determining region 3 for antibody 34185
TAGLGSGGINW

SEQ ID NO: 68371 - protein, 9 aa, Homo sapiens
  light chain complementarity determining region 3 for antibody 34186
LQHNSYPWT

SEQ ID NO: 68372 - protein, 15 aa, Homo sapiens
  heavy chain complementarity determining region 3 for antibody 34186
GRDDLYDYGDNHLDY

SEQ ID NO: 68373 - protein, 9 aa, Homo sapiens
  light chain complementarity determining region 3 for antibody 34187
LQHNSYPWT

SEQ ID NO: 68374 - protein, 16 aa, Homo sapiens
  heavy chain complementarity determining region 3 for antibody 34187
ARVGISVIAAGGSLDN

SEQ ID NO: 68375 - protein, 11 aa, Homo sapiens
  light chain complementarity determining region 3 for antibody 34188
LQHDNFPYMYT

SEQ ID NO: 68376 - protein, 21 aa, Homo sapiens
  heavy chain complementarity determining region 3 for antibody 34188
ARELSSSSAKNHYYYYYGMDV

SEQ ID NO: 68377 - protein, 9 aa, Homo sapiens
  light chain complementarity determining region 3 for antibody 34189
LQDYSFPPT

SEQ ID NO: 68378 - protein, 17 aa, Homo sapiens
  heavy chain complementarity determining region 3 for antibody 34189
ARGAEHRRVRRYYGLDV

SEQ ID NO: 68379 - protein, 9 aa, Homo sapiens
  light chain complementarity determining region 3 for antibody 34190
HQSYSSPQT

SEQ ID NO: 68380 - protein, 12 aa, Homo sapiens
  heavy chain complementarity determining region 3 for antibody 34190
VKDCGLGGSRDS

SEQ ID NO: 68381 - protein, 9 aa, Homo sapiens
  light chain complementarity determining region 3 for antibody 34191
EQYYTTPVT

SEQ ID NO: 68382 - protein, 17 aa, Homo sapiens
  heavy chain complementarity determining region 3 for antibody 34191
ARQFRWGSGSSWYVFGY

SEQ ID NO: 68383 - protein, 11 aa, Homo sapiens
  light chain complementarity determining region 3 for antibody 34192
QYYNKWPPMYT

SEQ ID NO: 68384 - protein, 23 aa, Homo sapiens
  heavy chain complementarity determining region 3 for antibody 34192
ARDPSNRVDHDVLTGYQRGAFDI

SEQ ID NO: 68385 - protein, 9 aa, Homo sapiens
  light chain complementarity determining region 3 for antibody 34193
QQYYTVPHT

SEQ ID NO: 68386 - protein, 13 aa, Homo sapiens
  heavy chain complementarity determining region 3 for antibody 34193
AREMDSKGGGFDV

SEQ ID NO: 68387 - protein, 9 aa, Homo sapiens
  light chain complementarity determining region 3 for antibody 34194
QQYYTSFRT

SEQ ID NO: 68388 - protein, 12 aa, Homo sapiens
  heavy chain complementarity determining region 3 for antibody 34194
VKDCGLGGSRDS

SEQ ID NO: 68389 - protein, 9 aa, Homo sapiens
  light chain complementarity determining region 3 for antibody 34195
QQYYSTPQT

SEQ ID NO: 68390 - protein, 18 aa, Homo sapiens
  heavy chain complementarity determining region 3 for antibody 34195
ARERFGDYPGGSDTVSDF

SEQ ID NO: 68391 - protein, 10 aa, Homo sapiens
  light chain complementarity determining region 3 for antibody 34196
QQYYRSPPWT

SEQ ID NO: 68392 - protein, 12 aa, Homo sapiens
  heavy chain complementarity determining region 3 for antibody 34196
ARGDDGAKVGDS

SEQ ID NO: 68393 - protein, 9 aa, Homo sapiens
  light chain complementarity determining region 3 for antibody 34197
QQYYITPRT

SEQ ID NO: 68394 - protein, 8 aa, Homo sapiens
  heavy chain complementarity determining region 3 for antibody 34197
ARDGAFDS

SEQ ID NO: 68395 - protein, 10 aa, Homo sapiens
  light chain complementarity determining region 3 for antibody 34198
QQYVNSSPIT

SEQ ID NO: 68396 - protein, 15 aa, Homo sapiens
  heavy chain complementarity determining region 3 for antibody 34198
ARDVTTFIDPDAFDL

SEQ ID NO: 68397 - protein, 8 aa, Homo sapiens
  light chain complementarity determining region 3 for antibody 34199
QQYSDFNT

SEQ ID NO: 68398 - protein, 17 aa, Homo sapiens
  heavy chain complementarity determining region 3 for antibody 34199
AHRRYYNGNWNGAAFDV

SEQ ID NO: 68399 - protein, 9 aa, Homo sapiens
  light chain complementarity determining region 3 for antibody 34200
QQYNSYSYT

SEQ ID NO: 68400 - protein, 10 aa, Homo sapiens
  heavy chain complementarity determining region 3 for antibody 34200
AREGDSSGHF

SEQ ID NO: 68401 - protein, 9 aa, Homo sapiens
  light chain complementarity determining region 3 for antibody 34201
QQYNSYRRT

SEQ ID NO: 68402 - protein, 9 aa, Homo sapiens
  heavy chain complementarity determining region 3 for antibody 34201
AKGSSALDY

SEQ ID NO: 68403 - protein, 8 aa, Homo sapiens
  light chain complementarity determining region 3 for antibody 34202
QQYNRPYT

SEQ ID NO: 68404 - protein, 24 aa, Homo sapiens
  heavy chain complementarity determining region 3 for antibody 34202
ARGRPPSGWYRLKDRTYYYYGLDV

SEQ ID NO: 68405 - protein, 9 aa, Homo sapiens
  light chain complementarity determining region 3 for antibody 34203
QQYNRGPAT

SEQ ID NO: 68406 - protein, 20 aa, Homo sapiens
  heavy chain complementarity determining region 3 for antibody 34203
ARDPREYYDLRNYYVYYFDS

SEQ ID NO: 68407 - protein, 10 aa, Homo sapiens [sequence omitted]

SEQ ID NO: 68408 - protein, 15 aa, Homo sapiens
  heavy chain complementarity determining region 3 for antibody 34204
ARIRGSGYYLGAFEL

SEQ ID NO: 68409 - protein, 11 aa, Homo sapiens
  light chain complementarity determining region 3 for antibody 34205
QQYNNWPPELT

SEQ ID NO: 68410 - protein, 18 aa, Homo sapiens
  heavy chain complementarity determining region 3 for antibody 34205
ARVGWRFGVGAAGYYFDF

SEQ ID NO: 68411 - protein, 9 aa, Homo sapiens
  light chain complementarity determining region 3 for antibody 34206
QQYNIYSET

SEQ ID NO: 68412 - protein, 8 aa, Homo sapiens
  heavy chain complementarity determining region 3 for antibody 34206
ATSPQRGY

SEQ ID NO: 68413 - protein, 9 aa, Homo sapiens
  light chain complementarity determining region 3 for antibody 34207
QQYNASSWT

SEQ ID NO: 68414 - protein, 16 aa, Homo sapiens
  heavy chain complementarity determining region 3 for antibody 34207
ASLGGAHYYGSGSHYF

SEQ ID NO: 68415 - protein, 11 aa, Homo sapiens
  light chain complementarity determining region 3 for antibody 34208
QQYKSYIPGLT

SEQ ID NO: 68416 - protein, 12 aa, Homo sapiens
  heavy chain complementarity determining region 3 for antibody 34208
ARPLPASAYFDY

SEQ ID NO: 68417 - protein, 9 aa, Homo sapiens
  light chain complementarity determining region 3 for antibody 34209
QQYHTTPNT

SEQ ID NO: 68418 - protein, 9 aa, Homo sapiens
  heavy chain complementarity determining region 3 for antibody 34209
ARDRDAADS

SEQ ID NO: 68419 - protein, 9 aa, Homo sapiens
  light chain complementarity determining region 3 for antibody 34210
QQYGTTPLT

SEQ ID NO: 68420 - protein, 21 aa, Homo sapiens
  heavy chain complementarity determining region 3 for antibody 34210
ASTPGYCSATSCYAIYWYFEL

SEQ ID NO: 68421 - protein, 9 aa, Homo sapiens
  light chain complementarity determining region 3 for antibody 34211
QQYGTSPLP

SEQ ID NO: 68422 - protein, 14 aa, Homo sapiens
  heavy chain complementarity determining region 3 for antibody 34211
ARDMFRGVPDYLDY

SEQ ID NO: 68423 - protein, 10 aa, Homo sapiens
  light chain complementarity determining region 3 for antibody 34212
QQYGTSLPWT

SEQ ID NO: 68424 - protein, 14 aa, Homo sapiens
  heavy chain complementarity determining region 3 for antibody 34212
ARGGSSGFDSQLDF

SEQ ID NO: 68425 - protein, 9 aa, Homo sapiens
  light chain complementarity determining region 3 for antibody 34213
QQYGSTPLT

SEQ ID NO: 68426 - protein, 26 aa, Homo sapiens
  heavy chain complementarity determining region 3 for antibody 34213
AQDGDRSRIAQKYGSGASDPPHYFAS

SEQ ID NO: 68427 - protein, 9 aa, Homo sapiens
  light chain complementarity determining region 3 for antibody 34214
QQYGSSPRT

SEQ ID NO: 68428 - protein, 25 aa, Homo sapiens
  heavy chain complementarity determining region 3 for antibody 34214
ARLRIDRLRLPGAMRGPLYDCGLSV

SEQ ID NO: 68429 - protein, 9 aa, Homo sapiens
  light chain complementarity determining region 3 for antibody 34215
QQYGSSPRT

SEQ ID NO: 68430 - protein, 25 aa, Homo sapiens
  heavy chain complementarity determining region 3 for antibody 34215
ARLRIARLRLPGAMRGPLYDCGLNV

SEQ ID NO: 68431 - protein, 9 aa, Homo sapiens
  light chain complementarity determining region 3 for antibody 34216
QQYGSSPRT

SEQ ID NO: 68432 - protein, 27 aa, Homo sapiens
  heavy chain complementarity determining region 3 for antibody 34216
ARGVGSCTSFLCRRGRDPHYQKRGFDY

SEQ ID NO: 68433 - protein, 9 aa, Homo sapiens
  light chain complementarity determining region 3 for antibody 34217
QQYGSSPRT

SEQ ID NO: 68434 - protein, 17 aa, Homo sapiens
  heavy chain complementarity determining region 3 for antibody 34217
ARALDSVVVVDAIWFDP

SEQ ID NO: 68435 - protein, 9 aa, Homo sapiens
  light chain complementarity determining region 3 for antibody 34218
QQYGSSPRT

SEQ ID NO: 68436 - protein, 25 aa, Homo sapiens
  heavy chain complementarity determining region 3 for antibody 34218
AGLRIDRLRLPGAMRGPLYDCGLNV

SEQ ID NO: 68437 - protein, 10 aa, Homo sapiens
  light chain complementarity determining region 3 for antibody 34219
QQYGSSPPYT

SEQ ID NO: 68438 - protein, 13 aa, Homo sapiens
  heavy chain complementarity determining region 3 for antibody 34219
ARSKVDYGGYFDY

SEQ ID NO: 68439 - protein, 10 aa, Homo sapiens
  light chain complementarity determining region 3 for antibody 34220
QQYGSSPPWT

SEQ ID NO: 68440 - protein, 15 aa, Homo sapiens
  heavy chain complementarity determining region 3 for antibody 34220
TGAENDYFYFYGMDV

SEQ ID NO: 68441 - protein, 10 aa, Homo sapiens
  light chain complementarity determining region 3 for antibody 34221
QQYGSSPMDS

SEQ ID NO: 68442 - protein, 11 aa, Homo sapiens
  heavy chain complementarity determining region 3 for antibody 34221
ARGGQWGSLDY

SEQ ID NO: 68443 - protein, 10 aa, Homo sapiens
  light chain complementarity determining region 3 for antibody 34222
QQYGSSPLYP

SEQ ID NO: 68444 - protein, 18 aa, Homo sapiens
  heavy chain complementarity determining region 3 for antibody 34222
ARVLGGQYYYDSSGWVDY

SEQ ID NO: 68445 - protein, 9 aa, Homo sapiens
  light chain complementarity determining region 3 for antibody 34223
QQYGSSPLT

SEQ ID NO: 68446 - protein, 12 aa, Homo sapiens
  heavy chain complementarity determining region 3 for antibody 34223
ARDPMTTVITDY

SEQ ID NO: 68447 - protein, 9 aa, Homo sapiens
  light chain complementarity determining region 3 for antibody 34224
QQYGSLPLP

SEQ ID NO: 68448 - protein, 15 aa, Homo sapiens
  heavy chain complementarity determining region 3 for antibody 34224
AHRPNYYDKAGAFDI

SEQ ID NO: 68449 - protein, 10 aa, Homo sapiens
  light chain complementarity determining region 3 for antibody 34225
QQYGNWPPFT

SEQ ID NO: 68450 - protein, 14 aa, Homo sapiens
  heavy chain complementarity determining region 3 for antibody 34225
ARDQTPRAMAVFDY

SEQ ID NO: 68451 - protein, 8 aa, Homo sapiens
  light chain complementarity determining region 3 for antibody 34226
QQYGGSPS

SEQ ID NO: 68452 - protein, 16 aa, Homo sapiens
  heavy chain complementarity determining region 3 for antibody 34226
ATDWGSGAQWIRAFDV

SEQ ID NO: 68453 - protein, 9 aa, Homo sapiens
  light chain complementarity determining region 3 for antibody 34227
QQYGGSPRT

SEQ ID NO: 68454 - protein, 13 aa, Homo sapiens
  heavy chain complementarity determining region 3 for antibody 34227
ASGYFDRSGYYDF

SEQ ID NO: 68455 - protein, 9 aa, Homo sapiens
  light chain complementarity determining region 3 for antibody 34228
QQYFTSLRT

SEQ ID NO: 68456 - protein, 12 aa, Homo sapiens
  heavy chain complementarity determining region 3 for antibody 34228
VKDCGLGGSRDS

SEQ ID NO: 68457 - protein, 10 aa, Homo sapiens
  light chain complementarity determining region 3 for antibody 34229
QQYDYRPTIT

SEQ ID NO: 68458 - protein, 15 aa, Homo sapiens
  heavy chain complementarity determining region 3 for antibody 34229
VRDIYRILGPTRFDN

SEQ ID NO: 68459 - protein, 9 aa, Homo sapiens
  light chain complementarity determining region 3 for antibody 34230
QQYDTYPLT

SEQ ID NO: 68460 - protein, 19 aa, Homo sapiens
  heavy chain complementarity determining region 3 for antibody 34230
ARESERLAWGKVTYNHFDP

SEQ ID NO: 68461 - protein, 11 aa, Homo sapiens
  light chain complementarity determining region 3 for antibody 34231
QQYDTSPPGYT

SEQ ID NO: 68462 - protein, 14 aa, Homo sapiens
  heavy chain complementarity determining region 3 for antibody 34231
ARETSNSRKRSFDQ

SEQ ID NO: 68463 - protein, 9 aa, Homo sapiens
  light chain complementarity determining region 3 for antibody 34232
QQYDRWPTT

SEQ ID NO: 68464 - protein, 15 aa, Homo sapiens
  heavy chain complementarity determining region 3 for antibody 34232
ARDRGESRPRVRGDS

SEQ ID NO: 68465 - protein, 10 aa, Homo sapiens
  light chain complementarity determining region 3 for antibody 34233
QQYDNWPPLT

SEQ ID NO: 68466 - protein, 18 aa, Homo sapiens
  heavy chain complementarity determining region 3 for antibody 34233
ARSYCRTGSCYSVKHFDL

SEQ ID NO: 68467 - protein, 11 aa, Homo sapiens
  light chain complementarity determining region 3 for antibody 34234
QQYDKSRRGDT

SEQ ID NO: 68468 - protein, 14 aa, Homo sapiens
  heavy chain complementarity determining region 3 for antibody 34234
ARLRWLVDAQFFDF

SEQ ID NO: 68469 - protein, 9 aa, Homo sapiens
  light chain complementarity determining region 3 for antibody 34235
QQYDHFPRT

SEQ ID NO: 68470 - protein, 18 aa, Homo sapiens
  heavy chain complementarity determining region 3 for antibody 34235
AQERDGYCDSHACYGLDV

SEQ ID NO: 68471 - protein, 9 aa, Homo sapiens
  light chain complementarity determining region 3 for antibody 34236
QQSYTPFYT

SEQ ID NO: 68472 - protein, 15 aa, Homo sapiens
  heavy chain complementarity determining region 3 for antibody 34236
ASDLIGHGEGIWDDY

SEQ ID NO: 68473 - protein, 9 aa, Homo sapiens
  light chain complementarity determining region 3 for antibody 34237
QQSYSTPYT

SEQ ID NO: 68474 - protein, 8 aa, Homo sapiens
  heavy chain complementarity determining region 3 for antibody 34237
ARDGAFDS

SEQ ID NO: 68475 - protein, 8 aa, Homo sapiens
  light chain complementarity determining region 3 for antibody 34238
QQSYSTPT

SEQ ID NO: 68476 - protein, 10 aa, Homo sapiens
  heavy chain complementarity determining region 3 for antibody 34238
ARRSVGAFDL

SEQ ID NO: 68477 - protein, 9 aa, Homo sapiens
  light chain complementarity determining region 3 for antibody 34239
QQSYSSLLP

SEQ ID NO: 68478 - protein, 16 aa, Homo sapiens
  heavy chain complementarity determining region 3 for antibody 34239
AREGGSTYTTKRAFDS

SEQ ID NO: 68479 - protein, 10 aa, Homo sapiens
  light chain complementarity determining region 3 for antibody 34240
QQSYITPPFT

SEQ ID NO: 68480 - protein, 18 aa, Homo sapiens
  heavy chain complementarity determining region 3 for antibody 34240
AREAMIRTVIVTYNCLDP

SEQ ID NO: 68481 - protein, 9 aa, Homo sapiens
  light chain complementarity determining region 3 for antibody 34241
QQSYGTPFT

SEQ ID NO: 68482 - protein, 16 aa, Homo sapiens
  heavy chain complementarity determining region 3 for antibody 34241
ATEDYSTSGTYGALGH

SEQ ID NO: 68483 - protein, 9 aa, Homo sapiens
  light chain complementarity determining region 3 for antibody 34242
QQSNSFPLT

SEQ ID NO: 68484 - protein, 13 aa, Homo sapiens
  heavy chain complementarity determining region 3 for antibody 34242
AGGVFDSSGYHEY

SEQ ID NO: 68485 - protein, 9 aa, Homo sapiens
  light chain complementarity determining region 3 for antibody 34243
QQSKSFPYT

SEQ ID NO: 68486 - protein, 12 aa, Homo sapiens
  heavy chain complementarity determining region 3 for antibody 34243
AIYDFWNNWFDP

SEQ ID NO: 68487 - protein, 9 aa, Homo sapiens
  light chain complementarity determining region 3 for antibody 34244
QQSHSVPYI

SEQ ID NO: 68488 - protein, 16 aa, Homo sapiens
  heavy chain complementarity determining region 3 for antibody 34244
VTPVSPWMTATGPFDY

SEQ ID NO: 68489 - protein, 9 aa, Homo sapiens
  light chain complementarity determining region 3 for antibody 34245
QQRYTSPYT

SEQ ID NO: 68490 - protein, 16 aa, Homo sapiens
  heavy chain complementarity determining region 3 for antibody 34245
ATDWGSGTQWIRAFDV

SEQ ID NO: 68491 - protein, 10 aa, Homo sapiens
  light chain complementarity determining region 3 for antibody 34246
QQRYKWPPDT

SEQ ID NO: 68492 - protein, 11 aa, Homo sapiens
  heavy chain complementarity determining region 3 for antibody 34246
ARGVGSYVFES

SEQ ID NO: 68493 - protein, 8 aa, Homo sapiens
  light chain complementarity determining region 3 for antibody 34247
QQRTNWLS

SEQ ID NO: 68494 - protein, 14 aa, Homo sapiens
  heavy chain complementarity determining region 3 for antibody 34247
ARVDIAAGGAPFDP

SEQ ID NO: 68495 - protein, 9 aa, Homo sapiens
  light chain complementarity determining region 3 for antibody 34248
QQRSSWPRT

SEQ ID NO: 68496 - protein, 12 aa, Homo sapiens
  heavy chain complementarity determining region 3 for antibody 34248
AKFPRGRFDDDY

SEQ ID NO: 68497 - protein, 10 aa, Homo sapiens
  light chain complementarity determining region 3 for antibody 34249
QQRSNWPPIT

SEQ ID NO: 68498 - protein, 18 aa, Homo sapiens
  heavy chain complementarity determining region 3 for antibody 34249
AREKDSSGYFLRPHWFDP

SEQ ID NO: 68499 - protein, 10 aa, Homo sapiens
  light chain complementarity determining region 3 for antibody 34250
QQRSNWPPGT

SEQ ID NO: 68500 - protein, 14 aa, Homo sapiens
  heavy chain complementarity determining region 3 for antibody 34250
ARDRTTVTTGYLHR

SEQ ID NO: 68501 - protein, 9 aa, Homo sapiens
  light chain complementarity determining region 3 for antibody 34251
QQRSNWLLS

SEQ ID NO: 68502 - protein, 16 aa, Homo sapiens
  heavy chain complementarity determining region 3 for antibody 34251
ARQAPTKAKSIGIFDN

SEQ ID NO: 68503 - protein, 11 aa, Homo sapiens
  light chain complementarity determining region 3 for antibody 34252
QQRFNWPPTIT

SEQ ID NO: 68504 - protein, 12 aa, Homo sapiens
  heavy chain complementarity determining region 3 for antibody 34252
ALSFGGIEYFDY

SEQ ID NO: 68505 - protein, 9 aa, Homo sapiens
  light chain complementarity determining region 3 for antibody 34253
QQLSNYPHT

SEQ ID NO: 68506 - protein, 26 aa, Homo sapiens
  heavy chain complementarity determining region 3 for antibody 34253
ARGSRGYKSENSSLRRLQYYQYGMDV

SEQ ID NO: 68507 - protein, 9 aa, Homo sapiens
  light chain complementarity determining region 3 for antibody 34254
QQLNSYLLT

SEQ ID NO: 68508 - protein, 19 aa, Homo sapiens
  heavy chain complementarity determining region 3 for antibody 34254
AKDRGPYYYGSGSKHGMDV

SEQ ID NO: 68509 - protein, 9 aa, Homo sapiens
  light chain complementarity determining region 3 for antibody 34255
QQGYSSPLI

SEQ ID NO: 68510 - protein, 12 aa, Homo sapiens
  heavy chain complementarity determining region 3 for antibody 34255
ARLLWDSYYFDS

SEQ ID NO: 68511 - protein, 9 aa, Homo sapiens
  light chain complementarity determining region 3 for antibody 34256
QQFNTYPLT

SEQ ID NO: 68512 - protein, 25 aa, Homo sapiens
  heavy chain complementarity determining region 3 for antibody 34256
ARRGVSRLVFAPAATSRGGNYGMDV

SEQ ID NO: 68513 - protein, 9 aa, Homo sapiens
  light chain complementarity determining region 3 for antibody 34257
QQFHDWPFA

SEQ ID NO: 68514 - protein, 16 aa, Homo sapiens
  heavy chain complementarity determining region 3 for antibody 34257
ARDRGGSYNTRSALDV

SEQ ID NO: 68515 - protein, 9 aa, Homo sapiens
  light chain complementarity determining region 3 for antibody 34258
QQANSYPWT

SEQ ID NO: 68516 - protein, 13 aa, Homo sapiens
  heavy chain complementarity determining region 3 for antibody 34258
ARESDSGQGQFDY

SEQ ID NO: 68517 - protein, 9 aa, Homo sapiens
  light chain complementarity determining region 3 for antibody 34259
QQANSFPLT

SEQ ID NO: 68518 - protein, 20 aa, Homo sapiens
  heavy chain complementarity determining region 3 for antibody 34259
ARDSMVRGVIMWYYYYGMDV

SEQ ID NO: 68519 - protein, 8 aa, Homo sapiens
  light chain complementarity determining region 3 for antibody 34260
QPYGGSPS

SEQ ID NO: 68520 - protein, 16 aa, Homo sapiens
  heavy chain complementarity determining region 3 for antibody 34260
ATDWGSGTQWIRAFDV

SEQ ID NO: 68521 - protein, 12 aa, Homo sapiens
  light chain complementarity determining region 3 for antibody 34261
QKYNSAPREWRT

SEQ ID NO: 68522 - protein, 20 aa, Homo sapiens
  heavy chain complementarity determining region 3 for antibody 34261
ARDEGYCSGGNCYCLGKFGY

SEQ ID NO: 68523 - protein, 9 aa, Homo sapiens
  light chain complementarity determining region 3 for antibody 34262
QKYNSAPLT

SEQ ID NO: 68524 - protein, 15 aa, Homo sapiens
  heavy chain complementarity determining region 3 for antibody 34262
ARDRGVIISPDAFDI

SEQ ID NO: 68525 - protein, 11 aa, Homo sapiens
  light chain complementarity determining region 3 for antibody 34263
QKYDSVPHGVT

SEQ ID NO: 68526 - protein, 15 aa, Homo sapiens
  heavy chain complementarity determining region 3 for antibody 34263
ARGGYSSGWYYWFDP

SEQ ID NO: 68527 - protein, 9 aa, Homo sapiens
  light chain complementarity determining region 3 for antibody 34264
QKYDSAPPT

SEQ ID NO: 68528 - protein, 16 aa, Homo sapiens
  heavy chain complementarity determining region 3 for antibody 34264
AKSHPTTGTGPHFCDY

SEQ ID NO: 68529 - protein, 11 aa, Homo sapiens
  light chain complementarity determining region 3 for antibody 34265
QHYSTSSLALP

SEQ ID NO: 68530 - protein, 16 aa, Homo sapiens
  heavy chain complementarity determining region 3 for antibody 34265
ARFFLAGYSWYEGVDY

SEQ ID NO: 68531 - protein, 10 aa, Homo sapiens
  light chain complementarity determining region 3 for antibody 34266
QHWVSSPPYT

SEQ ID NO: 68532 - protein, 12 aa, Homo sapiens
  heavy chain complementarity determining region 3 for antibody 34266
ARETTQFGELDN

SEQ ID NO: 68533 - protein, 10 aa, Homo sapiens
  light chain complementarity determining region 3 for antibody 34267
QHWVSSPAST

SEQ ID NO: 68534 - protein, 12 aa, Homo sapiens
  heavy chain complementarity determining region 3 for antibody 34267
ARETTQFGELDN

SEQ ID NO: 68535 - protein, 11 aa, Homo sapiens
  light chain complementarity determining region 3 for antibody 34268
QHATNWPPGGT

SEQ ID NO: 68536 - protein, 13 aa, Homo sapiens
  heavy chain complementarity determining region 3 for antibody 34268
ATNTPGSTADFTY

SEQ ID NO: 68537 - protein, 8 aa, Homo sapiens
  light chain complementarity determining region 3 for antibody 34269
QATHWPWT

SEQ ID NO: 68538 - protein, 12 aa, Homo sapiens
  heavy chain complementarity determining region 3 for antibody 34269
ARGANPFDAFDI

SEQ ID NO: 68539 - protein, 9 aa, Homo sapiens
  light chain complementarity determining region 3 for antibody 34270
MQVLQTPIT

SEQ ID NO: 68540 - protein, 12 aa, Homo sapiens
  heavy chain complementarity determining region 3 for antibody 34270
TRDGGKSWSEFT

SEQ ID NO: 68541 - protein, 9 aa, Homo sapiens
  light chain complementarity determining region 3 for antibody 34271
MQTLQTPIT

SEQ ID NO: 68542 - protein, 17 aa, Homo sapiens
  heavy chain complementarity determining region 3 for antibody 34271
ARVGPWLQYSGYDYPDY

SEQ ID NO: 68543 - protein, 9 aa, Homo sapiens
  light chain complementarity determining region 3 for antibody 34272
MQTLQTLYT

SEQ ID NO: 68544 - protein, 18 aa, Homo sapiens
  heavy chain complementarity determining region 3 for antibody 34272
AKDGYHGSESYPAPRIVN

SEQ ID NO: 68545 - protein, 8 aa, Homo sapiens
  light chain complementarity determining region 3 for antibody 34273
MQSTQGPT

SEQ ID NO: 68546 - protein, 21 aa, Homo sapiens
  heavy chain complementarity determining region 3 for antibody 34273
AKDRPNYYGTNAGYYTPGGDL

SEQ ID NO: 68547 - protein, 9 aa, Homo sapiens
  light chain complementarity determining region 3 for antibody 34274
MQSRRGPHT

SEQ ID NO: 68548 - protein, 8 aa, Homo sapiens
  heavy chain complementarity determining region 3 for antibody 34274
TAWGSSHH

SEQ ID NO: 68549 - protein, 9 aa, Homo sapiens
  light chain complementarity determining region 3 for antibody 34275
MQGLQTPDT

SEQ ID NO: 68550 - protein, 10 aa, Homo sapiens
  heavy chain complementarity determining region 3 for antibody 34275
GSDLSGARDY

SEQ ID NO: 68551 - protein, 9 aa, Homo sapiens
  light chain complementarity determining region 3 for antibody 34276
MQGLLTPYT

SEQ ID NO: 68552 - protein, 10 aa, Homo sapiens
  heavy chain complementarity determining region 3 for antibody 34276
GSDLTGSRDF

SEQ ID NO: 68553 - protein, 9 aa, Homo sapiens
  light chain complementarity determining region 3 for antibody 34277
MQGLETPFT

SEQ ID NO: 68554 - protein, 15 aa, Homo sapiens
  heavy chain complementarity determining region 3 for antibody 34277
VRHYRETVAGIEGDS

SEQ ID NO: 68555 - protein, 9 aa, Homo sapiens
  light chain complementarity determining region 3 for antibody 34278
MQGAHWPYT

SEQ ID NO: 68556 - protein, 10 aa, Homo sapiens
  heavy chain complementarity determining region 3 for antibody 34278
VRDYYGSLDY

SEQ ID NO: 68557 - protein, 9 aa, Homo sapiens
  light chain complementarity determining region 3 for antibody 34279
MQDLETPFT

SEQ ID NO: 68558 - protein, 15 aa, Homo sapiens
  heavy chain complementarity determining region 3 for antibody 34279
VRHYRETVAGIEGDS

SEQ ID NO: 68559 - protein, 9 aa, Homo sapiens
  light chain complementarity determining region 3 for antibody 34280
MQATHGPWT

SEQ ID NO: 68560 - protein, 12 aa, Homo sapiens
  heavy chain complementarity determining region 3 for antibody 34280
AADCSSASCPGY

SEQ ID NO: 68561 - protein, 8 aa, Homo sapiens
  light chain complementarity determining region 3 for antibody 34281
MQALQTRT

SEQ ID NO: 68562 - protein, 23 aa, Homo sapiens
  heavy chain complementarity determining region 3 for antibody 34281
ARVDCSGGKCYSVDDFYYSGMDV

SEQ ID NO: 68563 - protein, 9 aa, Homo sapiens
  light chain complementarity determining region 3 for antibody 34282
MQALQTPYT

SEQ ID NO: 68564 - protein, 12 aa, Homo sapiens
  heavy chain complementarity determining region 3 for antibody 34282
ATSLWFGIHPEY

SEQ ID NO: 68565 - protein, 9 aa, Homo sapiens
  light chain complementarity determining region 3 for antibody 34283
MQALQTPRT

SEQ ID NO: 68566 - protein, 18 aa, Homo sapiens
  heavy chain complementarity determining region 3 for antibody 34283
AREKGVAVVGGRVVSIDP

SEQ ID NO: 68567 - protein, 8 aa, Homo sapiens
  light chain complementarity determining region 3 for antibody 34284
MQALQTPP

SEQ ID NO: 68568 - protein, 12 aa, Homo sapiens
  heavy chain complementarity determining region 3 for antibody 34284
AKDVAAAESFDY

SEQ ID NO: 68569 - protein, 9 aa, Homo sapiens
  light chain complementarity determining region 3 for antibody 34285
MQALQAPIT

SEQ ID NO: 68570 - protein, 13 aa, Homo sapiens
  heavy chain complementarity determining region 3 for antibody 34285
TMVVDYGDYGFDC

SEQ ID NO: 68571 - protein, 9 aa, Homo sapiens
  light chain complementarity determining region 3 for antibody 34286
MQALETPFT

SEQ ID NO: 68572 - protein, 15 aa, Homo sapiens
  heavy chain complementarity determining region 3 for antibody 34286
VRHYRETVAGSEGDS

SEQ ID NO: 68573 - protein, 9 aa, Homo sapiens
  light chain complementarity determining region 3 for antibody 34287
MPALETPFT

SEQ ID NO: 68574 - protein, 15 aa, Homo sapiens
  heavy chain complementarity determining region 3 for antibody 34287
VRHYRETVAGIEGDS

SEQ ID NO: 68575 - protein, 9 aa, Homo sapiens
  light chain complementarity determining region 3 for antibody 34288
MHGLQTPYT

SEQ ID NO: 68576 - protein, 10 aa, Homo sapiens
  heavy chain complementarity determining region 3 for antibody 34288
ARDVVGSDDQ

SEQ ID NO: 68577 - protein, 9 aa, Homo sapiens
  light chain complementarity determining region 3 for antibody 34289
MGTLQTPPT

SEQ ID NO: 68578 - protein, 15 aa, Homo sapiens
  heavy chain complementarity determining region 3 for antibody 34289
TRDGKKDGHNDAFDF

SEQ ID NO: 68579 - protein, 9 aa, Homo sapiens
  light chain complementarity determining region 3 for antibody 34290
MGTLQTPPT

SEQ ID NO: 68580 - protein, 10 aa, Homo sapiens
  heavy chain complementarity determining region 3 for antibody 34290
ASGGGHTYGY

SEQ ID NO: 68581 - protein, 9 aa, Homo sapiens
  light chain complementarity determining region 3 for antibody 34291
LQYGGAPNS

SEQ ID NO: 68582 - protein, 18 aa, Homo sapiens
  heavy chain complementarity determining region 3 for antibody 34291
ARGTKLMLRGIASFGLDA

SEQ ID NO: 68583 - protein, 9 aa, Homo sapiens
  light chain complementarity determining region 3 for antibody 34292
LQHNSYLLT

SEQ ID NO: 68584 - protein, 14 aa, Homo sapiens
  heavy chain complementarity determining region 3 for antibody 34292
ARVDDYYGSGSFDI

SEQ ID NO: 68585 - protein, 9 aa, Homo sapiens
  light chain complementarity determining region 3 for antibody 34293
LQHNRYPFT

SEQ ID NO: 68586 - protein, 19 aa, Homo sapiens
  heavy chain complementarity determining region 3 for antibody 34293
VRGWGGTDYNLMVVEVFDS

SEQ ID NO: 68587 - protein, 9 aa, Homo sapiens
  light chain complementarity determining region 3 for antibody 34294
LQDYNYPRT

SEQ ID NO: 68588 - protein, 21 aa, Homo sapiens
  heavy chain complementarity determining region 3 for antibody 34294
ARDAPVSRPYSSGWYSSAFDY

SEQ ID NO: 68589 - protein, 9 aa, Homo sapiens
  light chain complementarity determining region 3 for antibody 34295
KQYYTSPLT

SEQ ID NO: 68590 - protein, 14 aa, Homo sapiens
  heavy chain complementarity determining region 3 for antibody 34295
AKDRIAVGISVWEY

SEQ ID NO: 68591 - protein, 9 aa, Homo sapiens
  light chain complementarity determining region 3 for antibody 34296
HQYGSSPRT

SEQ ID NO: 68592 - protein, 9 aa, Homo sapiens
  heavy chain complementarity determining region 3 for antibody 34296
ARAYGPADY

SEQ ID NO: 68593 - protein, 9 aa, Homo sapiens
  light chain complementarity determining region 3 for antibody 34297
HQYATSPWT

SEQ ID NO: 68594 - protein, 14 aa, Homo sapiens
  heavy chain complementarity determining region 3 for antibody 34297
VHRSGLIFGMLIER

SEQ ID NO: 68595 - protein, 8 aa, Homo sapiens
  light chain complementarity determining region 3 for antibody 34298
HQSYDSET

SEQ ID NO: 68596 - protein, 12 aa, Homo sapiens
  heavy chain complementarity determining region 3 for antibody 34298
VRRGAVAGMFDY

SEQ ID NO: 68597 - protein, 9 aa, Homo sapiens
  light chain complementarity determining region 3 for antibody 34299
ERHDVALGT

SEQ ID NO: 68598 - protein, 15 aa, Homo sapiens
  heavy chain complementarity determining region 3 for antibody 34299
VRAITVVRGIRELDY

SEQ ID NO: 68599 - protein, 9 aa, Homo sapiens
  light chain complementarity determining region 3 for antibody 34300
VQYNRYPRP

SEQ ID NO: 68600 - protein, 6 aa, Homo sapiens
  heavy chain complementarity determining region 3 for antibody 34300
TRALDY

SEQ ID NO: 68601 - protein, 9 aa, Homo sapiens
  light chain complementarity determining region 3 for antibody 34301
VQHNRYPRT

SEQ ID NO: 68602 - protein, 6 aa, Homo sapiens
  heavy chain complementarity determining region 3 for antibody 34301
TRALDY

SEQ ID NO: 68603 - protein, 10 aa, Homo sapiens
  light chain complementarity determining region 3 for antibody 34302
VQDTHWPPCT

SEQ ID NO: 68604 - protein, 16 aa, Homo sapiens
  heavy chain complementarity determining region 3 for antibody 34302
AKRVWFGELASAVFDG

SEQ ID NO: 68605 - protein, 9 aa, Homo sapiens
  light chain complementarity determining region 3 for antibody 34303
RQGLQTPYT

SEQ ID NO: 68606 - protein, 10 aa, Homo sapiens
  heavy chain complementarity determining region 3 for antibody 34303
ARDVVGSDDQ

SEQ ID NO: 68607 - protein, 9 aa, Homo sapiens
  light chain complementarity determining region 3 for antibody 34304
RQDYDYPFT

SEQ ID NO: 68608 - protein, 16 aa, Homo sapiens
  heavy chain complementarity determining region 3 for antibody 34304
ARDVKKTKDYEDALDI

SEQ ID NO: 68609 - protein, 9 aa, Homo sapiens
  light chain complementarity determining region 3 for antibody 34305
QQYYTSPRT

SEQ ID NO: 68610 - protein, 14 aa, Homo sapiens
  heavy chain complementarity determining region 3 for antibody 34305
TADTDTSDTQAYEF

SEQ ID NO: 68611 - protein, 9 aa, Homo sapiens
  light chain complementarity determining region 3 for antibody 34306
QQYYSTPWT

SEQ ID NO: 68612 - protein, 18 aa, Homo sapiens
  heavy chain complementarity determining region 3 for antibody 34306
AREGTYYYDSSGLQGLGY

SEQ ID NO: 68613 - protein, 9 aa, Homo sapiens
  light chain complementarity determining region 3 for antibody 34307
QQYYSTPLT

SEQ ID NO: 68614 - protein, 20 aa, Homo sapiens
  heavy chain complementarity determining region 3 for antibody 34307
ARDQAYYLASGSSGVDWFDP

SEQ ID NO: 68615 - protein, 9 aa, Homo sapiens
  light chain complementarity determining region 3 for antibody 34308
QQYYSTPHT

SEQ ID NO: 68616 - protein, 22 aa, Homo sapiens
  heavy chain complementarity determining region 3 for antibody 34308
ATPKDPYYDSSGYYYGSGSFNI

SEQ ID NO: 68617 - protein, 9 aa, Homo sapiens
  light chain complementarity determining region 3 for antibody 34309
QQYYSTPGT

SEQ ID NO: 68618 - protein, 15 aa, Homo sapiens
  heavy chain complementarity determining region 3 for antibody 34309
ARGSESSGFFWYFDL

SEQ ID NO: 68619 - protein, 9 aa, Homo sapiens
  light chain complementarity determining region 3 for antibody 34310
QQYYSSPRT

SEQ ID NO: 68620 - protein, 12 aa, Homo sapiens
  heavy chain complementarity determining region 3 for antibody 34310
ARDLGYTSGWRL

SEQ ID NO: 68621 - protein, 9 aa, Homo sapiens
  light chain complementarity determining region 3 for antibody 34311
QQYYKTPLT

SEQ ID NO: 68622 - protein, 11 aa, Homo sapiens
  heavy chain complementarity determining region 3 for antibody 34311
ARSGDSGYFDV

SEQ ID NO: 68623 - protein, 9 aa, Homo sapiens
  light chain complementarity determining region 3 for antibody 34312
QQYYDVPFT

SEQ ID NO: 68624 - protein, 14 aa, Homo sapiens
  heavy chain complementarity determining region 3 for antibody 34312
AKCELNYGNDALDM

SEQ ID NO: 68625 - protein, 9 aa, Homo sapiens
  light chain complementarity determining region 3 for antibody 34313
QQYYATPWT

SEQ ID NO: 68626 - protein, 15 aa, Homo sapiens
  heavy chain complementarity determining region 3 for antibody 34313
IRQSKVDNNYNYPDF

SEQ ID NO: 68627 - protein, 9 aa, Homo sapiens
  light chain complementarity determining region 3 for antibody 34314
QQYNTYSRT

SEQ ID NO: 68628 - protein, 16 aa, Homo sapiens
  heavy chain complementarity determining region 3 for antibody 34314
AAGVGLGRAITTTFDL

SEQ ID NO: 68629 - protein, 9 aa, Homo sapiens
  light chain complementarity determining region 3 for antibody 34315
QQYNTWPRT

SEQ ID NO: 68630 - protein, 22 aa, Homo sapiens
  heavy chain complementarity determining region 3 for antibody 34315
ARGVRASGYDDFYNYYYYGLDV

SEQ ID NO: 68631 - protein, 10 aa, Homo sapiens
  light chain complementarity determining region 3 for antibody 34316
QQYNTWPRGT

SEQ ID NO: 68632 - protein, 13 aa, Homo sapiens
  heavy chain complementarity determining region 3 for antibody 34316
VRDDDRAYNFLDF

SEQ ID NO: 68633 - protein, 9 aa, Homo sapiens
  light chain complementarity determining region 3 for antibody 34317
QQYNSYSYT

SEQ ID NO: 68634 - protein, 12 aa, Homo sapiens
  heavy chain complementarity determining region 3 for antibody 34317
AALRYFDWYFNS

SEQ ID NO: 68635 - protein, 9 aa, Homo sapiens
  light chain complementarity determining region 3 for antibody 34318
QQYNSYSLT

SEQ ID NO: 68636 - protein, 17 aa, Homo sapiens
  heavy chain complementarity determining region 3 for antibody 34318
VKESWQWLVDYYYGMDV

SEQ ID NO: 68637 - protein, 9 aa, Homo sapiens
  light chain complementarity determining region 3 for antibody 34319
QQYNSYPYT

SEQ ID NO: 68638 - protein, 14 aa, Homo sapiens
  heavy chain complementarity determining region 3 for antibody 34319
VREGGTYSSGWWDY

SEQ ID NO: 68639 - protein, 10 aa, Homo sapiens
  light chain complementarity determining region 3 for antibody 34320
QQYNSYFTWT

SEQ ID NO: 68640 - protein, 16 aa, Homo sapiens
  heavy chain complementarity determining region 3 for antibody 34320
ARDHSTAAVDAWWFDP

SEQ ID NO: 68641 - protein, 10 aa, Homo sapiens
  light chain complementarity determining region 3 for antibody 34321
QQYNNWPSYT

SEQ ID NO: 68642 - protein, 17 aa, Homo sapiens
  heavy chain complementarity determining region 3 for antibody 34321
AVTPAVAEWDISWYFDV

SEQ ID NO: 68643 - protein, 10 aa, Homo sapiens
  light chain complementarity determining region 3 for antibody 34322
QQYNNWPRYT

SEQ ID NO: 68644 - protein, 14 aa, Homo sapiens
  heavy chain complementarity determining region 3 for antibody 34322
ARRGEGYSYGPSDY

SEQ ID NO: 68645 - protein, 12 aa, Homo sapiens
  light chain complementarity determining region 3 for antibody 34323
QQYNNWPPRPLP

SEQ ID NO: 68646 - protein, 13 aa, Homo sapiens
  heavy chain complementarity determining region 3 for antibody 34323
ASRPSGTYGPFNY

SEQ ID NO: 68647 - protein, 10 aa, Homo sapiens
  light chain complementarity determining region 3 for antibody 34324
QQYNIWPPIT

SEQ ID NO: 68648 - protein, 12 aa, Homo sapiens
  heavy chain complementarity determining region 3 for antibody 34324
TRDRAGDYAFEI

SEQ ID NO: 68649 - protein, 9 aa, Homo sapiens
  light chain complementarity determining region 3 for antibody 34325
QQYLSLPLT

SEQ ID NO: 68650 - protein, 16 aa, Homo sapiens
  heavy chain complementarity determining region 3 for antibody 34325
ARDRPLRGSYYGWSDS

SEQ ID NO: 68651 - protein, 8 aa, Homo sapiens
  light chain complementarity determining region 3 for antibody 34326
QQYGTSRM

SEQ ID NO: 68652 - protein, 13 aa, Homo sapiens
  heavy chain complementarity determining region 3 for antibody 34326
ARGQFVGSAYYDN

SEQ ID NO: 68653 - protein, 9 aa, Homo sapiens
  light chain complementarity determining region 3 for antibody 34327
QQYGTSPLN

SEQ ID NO: 68654 - protein, 13 aa, Homo sapiens
  heavy chain complementarity determining region 3 for antibody 34327
ASISVGAVAAGKG

SEQ ID NO: 68655 - protein, 9 aa, Homo sapiens
  light chain complementarity determining region 3 for antibody 34328
QQYGTSPFT

SEQ ID NO: 68656 - protein, 15 aa, Homo sapiens
  heavy chain complementarity determining region 3 for antibody 34328
ARQNDCLSGPGEFDP

SEQ ID NO: 68657 - protein, 9 aa, Homo sapiens
  light chain complementarity determining region 3 for antibody 34329
QQYGTSPFT

SEQ ID NO: 68658 - protein, 14 aa, Homo sapiens
  heavy chain complementarity determining region 3 for antibody 34329
ARGGPAATSSSWVY

SEQ ID NO: 68659 - protein, 9 aa, Homo sapiens
  light chain complementarity determining region 3 for antibody 34330
QQYGTPPRT

SEQ ID NO: 68660 - protein, 25 aa, Homo sapiens
  heavy chain complementarity determining region 3 for antibody 34330
ARLGVDRLRLPGAMRGPLYDRGLNV

SEQ ID NO: 68661 - protein, 10 aa, Homo sapiens
  light chain complementarity determining region 3 for antibody 34331
QQYGSSSMDT

SEQ ID NO: 68662 - protein, 19 aa, Homo sapiens
  heavy chain complementarity determining region 3 for antibody 34331
AKDQLMFYYDNSGYPGADY

SEQ ID NO: 68663 - protein, 9 aa, Homo sapiens
  light chain complementarity determining region 3 for antibody 34332
QQYGSSPYT

SEQ ID NO: 68664 - protein, 20 aa, Homo sapiens
  heavy chain complementarity determining region 3 for antibody 34332
ARDSPWEVKWPRPVPRGMDV

SEQ ID NO: 68665 - protein, 9 aa, Homo sapiens
  light chain complementarity determining region 3 for antibody 34333
QQYGSSPWT

SEQ ID NO: 68666 - protein, 24 aa, Homo sapiens
  heavy chain complementarity determining region 3 for antibody 34333
ARDVHIAVVGPRKTEIYHYYALDV

SEQ ID NO: 68667 - protein, 9 aa, Homo sapiens
  light chain complementarity determining region 3 for antibody 34334
QQYGSSPRT

SEQ ID NO: 68668 - protein, 13 aa, Homo sapiens
  heavy chain complementarity determining region 3 for antibody 34334
ARGSGIFGGFFDY

SEQ ID NO: 68669 - protein, 11 aa, Homo sapiens
  light chain complementarity determining region 3 for antibody 34335
QQYGSSPPMYP

SEQ ID NO: 68670 - protein, 17 aa, Homo sapiens
  heavy chain complementarity determining region 3 for antibody 34335
ARILGGQKYYFYYGMDV

SEQ ID NO: 68671 - protein, 10 aa, Homo sapiens
  light chain complementarity determining region 3 for antibody 34336
QQYGSSPMNS

SEQ ID NO: 68672 - protein, 11 aa, Homo sapiens
  heavy chain complementarity determining region 3 for antibody 34336
ARGGQWGSLDY

SEQ ID NO: 68673 - protein, 9 aa, Homo sapiens
  light chain complementarity determining region 3 for antibody 34337
QQYGSSPGT

SEQ ID NO: 68674 - protein, 16 aa, Homo sapiens
  heavy chain complementarity determining region 3 for antibody 34337
ARVVWGGSWYVGWFDP

SEQ ID NO: 68675 - protein, 8 aa, Homo sapiens
  light chain complementarity determining region 3 for antibody 34338
QQYGSSPG

SEQ ID NO: 68676 - protein, 17 aa, Homo sapiens
  heavy chain complementarity determining region 3 for antibody 34338
ARASGSSWYRPYWYFDL

SEQ ID NO: 68677 - protein, 9 aa, Homo sapiens
  light chain complementarity determining region 3 for antibody 34339
QQYGSSLWT

SEQ ID NO: 68678 - protein, 25 aa, Homo sapiens
  heavy chain complementarity determining region 3 for antibody 34339
ARVLQPGSDFWSGSMPLRYYYGMDV

SEQ ID NO: 68679 - protein, 9 aa, Homo sapiens
  light chain complementarity determining region 3 for antibody 34340
QQYGSLPRT

SEQ ID NO: 68680 - protein, 25 aa, Homo sapiens
  heavy chain complementarity determining region 3 for antibody 34340
ARLRIDRLRLPGAMRGPLYDCGLNV

SEQ ID NO: 68681 - protein, 9 aa, Homo sapiens
  light chain complementarity determining region 3 for antibody 34341
QQYGSLPRS

SEQ ID NO: 68682 - protein, 13 aa, Homo sapiens
  heavy chain complementarity determining region 3 for antibody 34341
AGGTWHSGIYYES

SEQ ID NO: 68683 - protein, 9 aa, Homo sapiens
  light chain complementarity determining region 3 for antibody 34342
QQYGSIPRA

SEQ ID NO: 68684 - protein, 13 aa, Homo sapiens
  heavy chain complementarity determining region 3 for antibody 34342
AGGTWHSGIYYES

SEQ ID NO: 68685 - protein, 9 aa, Homo sapiens
  light chain complementarity determining region 3 for antibody 34343
QQYGRLPLT

SEQ ID NO: 68686 - protein, 15 aa, Homo sapiens
  heavy chain complementarity determining region 3 for antibody 34343
AHRPNYYDKAGAFDI

SEQ ID NO: 68687 - protein, 9 aa, Homo sapiens
  light chain complementarity determining region 3 for antibody 34344
QQYGNLPRT

SEQ ID NO: 68688 - protein, 13 aa, Homo sapiens
  heavy chain complementarity determining region 3 for antibody 34344
AGGEFHRGGYSEF

SEQ ID NO: 68689 - protein, 9 aa, Homo sapiens
  light chain complementarity determining region 3 for antibody 34345
QQYGNLPRP

SEQ ID NO: 68690 - protein, 13 aa, Homo sapiens
  heavy chain complementarity determining region 3 for antibody 34345
AGGDFHSGGYSEF

SEQ ID NO: 68691 - protein, 10 aa, Homo sapiens
  light chain complementarity determining region 3 for antibody 34346
QQYGLSPPAT

SEQ ID NO: 68692 - protein, 12 aa, Homo sapiens
  heavy chain complementarity determining region 3 for antibody 34346
VRTVTAHDVFDM

SEQ ID NO: 68693 - protein, 8 aa, Homo sapiens
  light chain complementarity determining region 3 for antibody 34347
QQYGGSPS

SEQ ID NO: 68694 - protein, 16 aa, Homo sapiens
  heavy chain complementarity determining region 3 for antibody 34347
AADWGSGTQWIRAFDV

SEQ ID NO: 68695 - protein, 9 aa, Homo sapiens
  light chain complementarity determining region 3 for antibody 34348
QQYFSSPWT

SEQ ID NO: 68696 - protein, 13 aa, Homo sapiens
  heavy chain complementarity determining region 3 for antibody 34348
ARGSGSHYAPFDH

SEQ ID NO: 68697 - protein, 9 aa, Homo sapiens
  light chain complementarity determining region 3 for antibody 34349
QQYDTTPWT

SEQ ID NO: 68698 - protein, 17 aa, Homo sapiens
  heavy chain complementarity determining region 3 for antibody 34349
AREGMVRGVTYPPYFDY

SEQ ID NO: 68699 - protein, 9 aa, Homo sapiens
  light chain complementarity determining region 3 for antibody 34350
QQYDSLPFT

SEQ ID NO: 68700 - protein, 14 aa, Homo sapiens
  heavy chain complementarity determining region 3 for antibody 34350
ARRRDFFGSGTLHD

SEQ ID NO: 68701 - protein, 9 aa, Homo sapiens
  light chain complementarity determining region 3 for antibody 34351
QQYDGYSVS

SEQ ID NO: 68702 - protein, 11 aa, Homo sapiens
  heavy chain complementarity determining region 3 for antibody 34351
ARGNSGYHIDY

SEQ ID NO: 68703 - protein, 11 aa, Homo sapiens
  light chain complementarity determining region 3 for antibody 34352
QQYAPSPEKNT

SEQ ID NO: 68704 - protein, 13 aa, Homo sapiens
  heavy chain complementarity determining region 3 for antibody 34352
AREEMIGGSPFDF

SEQ ID NO: 68705 - protein, 9 aa, Homo sapiens
  light chain complementarity determining region 3 for antibody 34353
QQSYTTVWT

SEQ ID NO: 68706 - protein, 16 aa, Homo sapiens
  heavy chain complementarity determining region 3 for antibody 34353
ARYDGGTVTYPRWLDP

SEQ ID NO: 68707 - protein, 10 aa, Homo sapiens
  light chain complementarity determining region 3 for antibody 34354
QQSYSTPMYT

SEQ ID NO: 68708 - protein, 18 aa, Homo sapiens
  heavy chain complementarity determining region 3 for antibody 34354
ARGRDAYNFRLRNNWFDY

SEQ ID NO: 68709 - protein, 8 aa, Homo sapiens
  light chain complementarity determining region 3 for antibody 34355
QQSYSTHT

SEQ ID NO: 68710 - protein, 15 aa, Homo sapiens
  heavy chain complementarity determining region 3 for antibody 34355
ARQNDFLSGPGEFDP

SEQ ID NO: 68711 - protein, 9 aa, Homo sapiens
  light chain complementarity determining region 3 for antibody 34356
QQSYNTLFS

SEQ ID NO: 68712 - protein, 12 aa, Homo sapiens
  heavy chain complementarity determining region 3 for antibody 34356
ARVGEQHLSFDY

SEQ ID NO: 68713 - protein, 9 aa, Homo sapiens
  light chain complementarity determining region 3 for antibody 34357
QQSYNSPFT

SEQ ID NO: 68714 - protein, 15 aa, Homo sapiens
  heavy chain complementarity determining region 3 for antibody 34357
ARDSTEEGATPRLDH

SEQ ID NO: 68715 - protein, 9 aa, Homo sapiens
  light chain complementarity determining region 3 for antibody 34358
QQSYIPPYT

SEQ ID NO: 68716 - protein, 19 aa, Homo sapiens
  heavy chain complementarity determining region 3 for antibody 34358
ATGRPPPMRLRDNYYGMDA

SEQ ID NO: 68717 - protein, 10 aa, Homo sapiens
  light chain complementarity determining region 3 for antibody 34359
QQRYNRPPYT

SEQ ID NO: 68718 - protein, 11 aa, Homo sapiens
  heavy chain complementarity determining region 3 for antibody 34359
ARGVGSYVFES

SEQ ID NO: 68719 - protein, 10 aa, Homo sapiens
  light chain complementarity determining region 3 for antibody 34360
QQRYNGPPYT

SEQ ID NO: 68720 - protein, 11 aa, Homo sapiens
  heavy chain complementarity determining region 3 for antibody 34360
ARGVGSYVFES

SEQ ID NO: 68721 - protein, 10 aa, Homo sapiens
  light chain complementarity determining region 3 for antibody 34361
QQRYKWPPYT

SEQ ID NO: 68722 - protein, 11 aa, Homo sapiens
  heavy chain complementarity determining region 3 for antibody 34361
ARGVGSYVFGS

SEQ ID NO: 68723 - protein, 10 aa, Homo sapiens
  light chain complementarity determining region 3 for antibody 34362
QQRYKWPPHT

SEQ ID NO: 68724 - protein, 11 aa, Homo sapiens
  heavy chain complementarity determining region 3 for antibody 34362
ARGVGSYVFES

SEQ ID NO: 68725 - protein, 10 aa, Homo sapiens
  light chain complementarity determining region 3 for antibody 34363
QQRSNWTGIT

SEQ ID NO: 68726 - protein, 14 aa, Homo sapiens
  heavy chain complementarity determining region 3 for antibody 34363
VRDSSSWYVKYFHH

SEQ ID NO: 68727 - protein, 8 aa, Homo sapiens
  light chain complementarity determining region 3 for antibody 34364
QQRSNWPS

SEQ ID NO: 68728 - protein, 13 aa, Homo sapiens
  heavy chain complementarity determining region 3 for antibody 34364
AKERLRSQSDLDY

SEQ ID NO: 68729 - protein, 10 aa, Homo sapiens
  light chain complementarity determining region 3 for antibody 34365
QQRSNWPPYT

SEQ ID NO: 68730 - protein, 16 aa, Homo sapiens
  heavy chain complementarity determining region 3 for antibody 34365
ARDAGIAVASLGYFDY

SEQ ID NO: 68731 - protein, 12 aa, Homo sapiens
  light chain complementarity determining region 3 for antibody 34366
QQRSNWPPGGGT

SEQ ID NO: 68732 - protein, 13 aa, Homo sapiens
  heavy chain complementarity determining region 3 for antibody 34366
ARGYGWYGDYFDY

SEQ ID NO: 68733 - protein, 11 aa, Homo sapiens
  light chain complementarity determining region 3 for antibody 34367
QQRSNWPPAGT

SEQ ID NO: 68734 - protein, 16 aa, Homo sapiens
  heavy chain complementarity determining region 3 for antibody 34367
ARQTMVRGVIVCGMDV

SEQ ID NO: 68735 - protein, 9 aa, Homo sapiens
  light chain complementarity determining region 3 for antibody 34368
QQRSNWPLT

SEQ ID NO: 68736 - protein, 17 aa, Homo sapiens
  heavy chain complementarity determining region 3 for antibody 34368
TRMDGWSHYRSYFGMDV

SEQ ID NO: 68737 - protein, 9 aa, Homo sapiens
  light chain complementarity determining region 3 for antibody 34369
QQRSNWPLT

SEQ ID NO: 68738 - protein, 10 aa, Homo sapiens
  heavy chain complementarity determining region 3 for antibody 34369
GSDLSGARDY

SEQ ID NO: 68739 - protein, 8 aa, Homo sapiens
  light chain complementarity determining region 3 for antibody 34370
QQRDDWVP

SEQ ID NO: 68740 - protein, 14 aa, Homo sapiens
  heavy chain complementarity determining region 3 for antibody 34370
ARETSNYGGYVLHF

SEQ ID NO: 68741 - protein, 9 aa, Homo sapiens
  light chain complementarity determining region 3 for antibody 34371
QQLNSYPFS

SEQ ID NO: 68742 - protein, 17 aa, Homo sapiens
  heavy chain complementarity determining region 3 for antibody 34371
ARDIGSGSGGYFNGMDF

SEQ ID NO: 68743 - protein, 9 aa, Homo sapiens
  light chain complementarity determining region 3 for antibody 34372
QQHSSWPLT

SEQ ID NO: 68744 - protein, 18 aa, Homo sapiens
  heavy chain complementarity determining region 3 for antibody 34372
AKEDLIAADDMLMNWFDP

SEQ ID NO: 68745 - protein, 8 aa, Homo sapiens
  light chain complementarity determining region 3 for antibody 34373
QQHGSSVS

SEQ ID NO: 68746 - protein, 13 aa, Homo sapiens
  heavy chain complementarity determining region 3 for antibody 34373
VRTWFGELSHFDY

SEQ ID NO: 68747 - protein, 8 aa, Homo sapiens
  light chain complementarity determining region 3 for antibody 34374
QQGYNWGI

SEQ ID NO: 68748 - protein, 21 aa, Homo sapiens
  heavy chain complementarity determining region 3 for antibody 34374
ARNDPDNTQGGHTSGNKYLDQ

SEQ ID NO: 68749 - protein, 9 aa, Homo sapiens
  light chain complementarity determining region 3 for antibody 34375
QQGYNTPLT

SEQ ID NO: 68750 - protein, 15 aa, Homo sapiens
  heavy chain complementarity determining region 3 for antibody 34375
VRAQVIWGQLYYFDF

SEQ ID NO: 68751 - protein, 9 aa, Homo sapiens
  light chain complementarity determining region 3 for antibody 34376
QQGHSIPWT

SEQ ID NO: 68752 - protein, 10 aa, Homo sapiens
  heavy chain complementarity determining region 3 for antibody 34376
ARDNYDNSNP

SEQ ID NO: 68753 - protein, 9 aa, Homo sapiens
  light chain complementarity determining region 3 for antibody 34377
QQFNIYPPP

SEQ ID NO: 68754 - protein, 15 aa, Homo sapiens
  heavy chain complementarity determining region 3 for antibody 34377
VRDSGIRVRQDYFDY

SEQ ID NO: 68755 - protein, 10 aa, Homo sapiens
  light chain complementarity determining region 3 for antibody 34378
QQFGTSSRFP

SEQ ID NO: 68756 - protein, 9 aa, Homo sapiens
  heavy chain complementarity determining region 3 for antibody 34378
ARGYQELDY

SEQ ID NO: 68757 - protein, 9 aa, Homo sapiens
  light chain complementarity determining region 3 for antibody 34379
QQFDDSGYT

SEQ ID NO: 68758 - protein, 13 aa, Homo sapiens
  heavy chain complementarity determining region 3 for antibody 34379
VRERHPGAFYFDF

SEQ ID NO: 68759 - protein, 8 aa, Homo sapiens
  light chain complementarity determining region 3 for antibody 34380
QQDNSLYT

SEQ ID NO: 68760 - protein, 14 aa, Homo sapiens
  heavy chain complementarity determining region 3 for antibody 34380
ARENSISRKRSFDQ

SEQ ID NO: 68761 - protein, 8 aa, Homo sapiens
  light chain complementarity determining region 3 for antibody 34381
QQDGTSWT

SEQ ID NO: 68762 - protein, 21 aa, Homo sapiens
  heavy chain complementarity determining region 3 for antibody 34381
GRQRNFEGDSGFKFPEGYFDL

SEQ ID NO: 68763 - protein, 9 aa, Homo sapiens
  light chain complementarity determining region 3 for antibody 34382
QQDGSSPWT

SEQ ID NO: 68764 - protein, 14 aa, Homo sapiens
  heavy chain complementarity determining region 3 for antibody 34382
ARDSSSTSWGPIDY

SEQ ID NO: 68765 - protein, 9 aa, Homo sapiens
  light chain complementarity determining region 3 for antibody 34383
QQDGSSPQT

SEQ ID NO: 68766 - protein, 15 aa, Homo sapiens
  heavy chain complementarity determining region 3 for antibody 34383
ARRRIRFLEWRPFDY

SEQ ID NO: 68767 - protein, 9 aa, Homo sapiens
  light chain complementarity determining region 3 for antibody 34384
QQDGSLPLT

SEQ ID NO: 68768 - protein, 15 aa, Homo sapiens
  heavy chain complementarity determining region 3 for antibody 34384
AHRPNYYDKAGAFDI

SEQ ID NO: 68769 - protein, 9 aa, Homo sapiens
  light chain complementarity determining region 3 for antibody 34385
QQDGNSPFT

SEQ ID NO: 68770 - protein, 15 aa, Homo sapiens
  heavy chain complementarity determining region 3 for antibody 34385
ARQKGQRASAGYFDS

SEQ ID NO: 68771 - protein, 9 aa, Homo sapiens
  light chain complementarity determining region 3 for antibody 34386
QQDGNLPRT

SEQ ID NO: 68772 - protein, 13 aa, Homo sapiens
  heavy chain complementarity determining region 3 for antibody 34386
AGGDFHSGGYSEF

SEQ ID NO: 68773 - protein, 10 aa, Homo sapiens
  light chain complementarity determining region 3 for antibody 34387
QQDGGTPPFS

SEQ ID NO: 68774 - protein, 12 aa, Homo sapiens
  heavy chain complementarity determining region 3 for antibody 34387
ARETGGSYYMDA

SEQ ID NO: 68775 - protein, 10 aa, Homo sapiens
  light chain complementarity determining region 3 for antibody 34388
QQCGGSPLFT

SEQ ID NO: 68776 - protein, 14 aa, Homo sapiens
  heavy chain complementarity determining region 3 for antibody 34388
VRPRHVAVNWYIDS

SEQ ID NO: 68777 - protein, 9 aa, Homo sapiens
  light chain complementarity determining region 3 for antibody 34389
QQCATAPRP

SEQ ID NO: 68778 - protein, 14 aa, Homo sapiens
  heavy chain complementarity determining region 3 for antibody 34389
AKDPTGDGGGYFDY

SEQ ID NO: 68779 - protein, 9 aa, Homo sapiens
  light chain complementarity determining region 3 for antibody 34390
QQANSFPLT

SEQ ID NO: 68780 - protein, 14 aa, Homo sapiens
  heavy chain complementarity determining region 3 for antibody 34390
ARKYNSGWDDAFDI

SEQ ID NO: 68781 - protein, 9 aa, Homo sapiens
  light chain complementarity determining region 3 for antibody 34391
QQANSFPIT

SEQ ID NO: 68782 - protein, 18 aa, Homo sapiens
  heavy chain complementarity determining region 3 for antibody 34391
ARDRLFYFDTVGYYFFDH

SEQ ID NO: 68783 - protein, 9 aa, Homo sapiens
  light chain complementarity determining region 3 for antibody 34392
QPYGSSPRT

SEQ ID NO: 68784 - protein, 25 aa, Homo sapiens
  heavy chain complementarity determining region 3 for antibody 34392
ARLRIDRLRLPGAMRGPLYDCGLNV

SEQ ID NO: 68785 - protein, 9 aa, Homo sapiens
  light chain complementarity determining region 3 for antibody 34393
QNYDTAPVT

SEQ ID NO: 68786 - protein, 9 aa, Homo sapiens
  heavy chain complementarity determining region 3 for antibody 34393
AAVGGWLAS

SEQ ID NO: 68787 - protein, 10 aa, Homo sapiens
  light chain complementarity determining region 3 for antibody 34394
QLYGSSPPWT

SEQ ID NO: 68788 - protein, 15 aa, Homo sapiens
  heavy chain complementarity determining region 3 for antibody 34394
ARCQRARSWYPALDL

SEQ ID NO: 68789 - protein, 8 aa, Homo sapiens
  light chain complementarity determining region 3 for antibody 34395
QKYNVPFT

SEQ ID NO: 68790 - protein, 13 aa, Homo sapiens
  heavy chain complementarity determining region 3 for antibody 34395
AGGDFHRGGYSEY

SEQ ID NO: 68791 - protein, 9 aa, Homo sapiens
  light chain complementarity determining region 3 for antibody 34396
QKYNSAPFT

SEQ ID NO: 68792 - protein, 13 aa, Homo sapiens
  heavy chain complementarity determining region 3 for antibody 34396
ARGEYVSGNYEEN

SEQ ID NO: 68793 - protein, 9 aa, Homo sapiens
  light chain complementarity determining region 3 for antibody 34397
QKYNGAPLT

SEQ ID NO: 68794 - protein, 20 aa, Homo sapiens
  heavy chain complementarity determining region 3 for antibody 34397
ATVLRGRGSSVYYVGGAFDI

SEQ ID NO: 68795 - protein, 9 aa, Homo sapiens
  light chain complementarity determining region 3 for antibody 34398
QKYKSAPQT

SEQ ID NO: 68796 - protein, 13 aa, Homo sapiens
  heavy chain complementarity determining region 3 for antibody 34398
ARDKLVGKAVLDY

SEQ ID NO: 68797 - protein, 9 aa, Homo sapiens
  light chain complementarity determining region 3 for antibody 34399
QHYNNIYGT

SEQ ID NO: 68798 - protein, 12 aa, Homo sapiens
  heavy chain complementarity determining region 3 for antibody 34399
ARHRGRVAGHDS

SEQ ID NO: 68799 - protein, 9 aa, Homo sapiens
  light chain complementarity determining region 3 for antibody 34400
QHTHSRPFP

SEQ ID NO: 68800 - protein, 20 aa, Homo sapiens
  heavy chain complementarity determining region 3 for antibody 34400
AKGIAVAALRTVYYYYGLDV

SEQ ID NO: 68801 - protein, 9 aa, Homo sapiens
  light chain complementarity determining region 3 for antibody 34401
QHSHSRPFT

SEQ ID NO: 68802 - protein, 20 aa, Homo sapiens
  heavy chain complementarity determining region 3 for antibody 34401
AKGIAVAARRTVYYYYGMDV

SEQ ID NO: 68803 - protein, 9 aa, Homo sapiens
  light chain complementarity determining region 3 for antibody 34402
QHNHTFPRT

SEQ ID NO: 68804 - protein, 20 aa, Homo sapiens
  heavy chain complementarity determining region 3 for antibody 34402
GRGRRIAALSTAHYYYGMDV

SEQ ID NO: 68805 - protein, 9 aa, Homo sapiens
  light chain complementarity determining region 3 for antibody 34403
QESYSTPWT

SEQ ID NO: 68806 - protein, 16 aa, Homo sapiens
  heavy chain complementarity determining region 3 for antibody 34403
ARGLYGSGGHSNPFDC

SEQ ID NO: 68807 - protein, 9 aa, Homo sapiens
  light chain complementarity determining region 3 for antibody 34404
PQYYTSLRT

SEQ ID NO: 68808 - protein, 12 aa, Homo sapiens
  heavy chain complementarity determining region 3 for antibody 34404
VKDCGLGGSRDS

SEQ ID NO: 68809 - protein, 9 aa, Homo sapiens
  light chain complementarity determining region 3 for antibody 34405
MQVSHWPGT

SEQ ID NO: 68810 - protein, 10 aa, Homo sapiens
  heavy chain complementarity determining region 3 for antibody 34405
AKDYEGAGSD

SEQ ID NO: 68811 - protein, 9 aa, Homo sapiens
  light chain complementarity determining region 3 for antibody 34406
MQTLQIPHT

SEQ ID NO: 68812 - protein, 19 aa, Homo sapiens
  heavy chain complementarity determining region 3 for antibody 34406
ARGSSLVEHFGGAYYFFDY

SEQ ID NO: 68813 - protein, 9 aa, Homo sapiens
  light chain complementarity determining region 3 for antibody 34407
MQNTQGPLT

SEQ ID NO: 68814 - protein, 8 aa, Homo sapiens
  heavy chain complementarity determining region 3 for antibody 34407
ALGQDMIY

SEQ ID NO: 68815 - protein, 9 aa, Homo sapiens
  light chain complementarity determining region 3 for antibody 34408
MQGTYWPPI

SEQ ID NO: 68816 - protein, 11 aa, Homo sapiens
  heavy chain complementarity determining region 3 for antibody 34408
ARDPFFGALDC

SEQ ID NO: 68817 - protein, 9 aa, Homo sapiens
  light chain complementarity determining region 3 for antibody 34409
MQGTQWPWT

SEQ ID NO: 68818 - protein, 15 aa, Homo sapiens
  heavy chain complementarity determining region 3 for antibody 34409
VRFPPDLDIVGMIDY

SEQ ID NO: 68819 - protein, 9 aa, Homo sapiens
  light chain complementarity determining region 3 for antibody 34410
MQGTHWRLT

SEQ ID NO: 68820 - protein, 19 aa, Homo sapiens
  heavy chain complementarity determining region 3 for antibody 34410
VRDDRDHCSGGSCEGYFDD

SEQ ID NO: 68821 - protein, 9 aa, Homo sapiens
  light chain complementarity determining region 3 for antibody 34411
MQGTHWPYT

SEQ ID NO: 68822 - protein, 11 aa, Homo sapiens
  heavy chain complementarity determining region 3 for antibody 34411
IKELLPGGADV

SEQ ID NO: 68823 - protein, 9 aa, Homo sapiens
  light chain complementarity determining region 3 for antibody 34412
MQGLQTPWT

SEQ ID NO: 68824 - protein, 13 aa, Homo sapiens
  heavy chain complementarity determining region 3 for antibody 34412
AKVVNTGPGGLQS

SEQ ID NO: 68825 - protein, 9 aa, Homo sapiens
  light chain complementarity determining region 3 for antibody 34413
MQGLHTPYT

SEQ ID NO: 68826 - protein, 10 aa, Homo sapiens
  heavy chain complementarity determining region 3 for antibody 34413
ARDVVGSDDQ

SEQ ID NO: 68827 - protein, 9 aa, Homo sapiens
  light chain complementarity determining region 3 for antibody 34414
MQALRTRLT

SEQ ID NO: 68828 - protein, 23 aa, Homo sapiens
  heavy chain complementarity determining region 3 for antibody 34414
ARPSQNLGECSVPGCYGINAFDP

SEQ ID NO: 68829 - protein, 9 aa, Homo sapiens
  light chain complementarity determining region 3 for antibody 34415
MQALQTSGT

SEQ ID NO: 68830 - protein, 21 aa, Homo sapiens
  heavy chain complementarity determining region 3 for antibody 34415
AKDAPVVRPYSSGWYSSAFDS

SEQ ID NO: 68831 - protein, 9 aa, Homo sapiens
  light chain complementarity determining region 3 for antibody 34416
MQALQTPYT

SEQ ID NO: 68832 - protein, 21 aa, Homo sapiens
  heavy chain complementarity determining region 3 for antibody 34416
ARETNTWTYNGRYYYYCGLDV

SEQ ID NO: 68833 - protein, 7 aa, Homo sapiens
  light chain complementarity determining region 3 for antibody 34417
MQALQTP

SEQ ID NO: 68834 - protein, 13 aa, Homo sapiens
  heavy chain complementarity determining region 3 for antibody 34417
ARTVPSEAGGMDV

SEQ ID NO: 68835 - protein, 8 aa, Homo sapiens
  light chain complementarity determining region 3 for antibody 34418
MQALQTFT

SEQ ID NO: 68836 - protein, 25 aa, Homo sapiens
  heavy chain complementarity determining region 3 for antibody 34418
ARATRTTHTIFAMDLRDMGEYGMDV

SEQ ID NO: 68837 - protein, 9 aa, Homo sapiens
  light chain complementarity determining region 3 for antibody 34419
MQALKTPFT

SEQ ID NO: 68838 - protein, 13 aa, Homo sapiens
  heavy chain complementarity determining region 3 for antibody 34419
ARAITKAGSGFDY

SEQ ID NO: 68839 - protein, 8 aa, Homo sapiens
  light chain complementarity determining region 3 for antibody 34420
MQALHTWR

SEQ ID NO: 68840 - protein, 18 aa, Homo sapiens
  heavy chain complementarity determining region 3 for antibody 34420
ARSRPYGGDANPARHFDY

SEQ ID NO: 68841 - protein, 9 aa, Homo sapiens
  light chain complementarity determining region 3 for antibody 34421
MQALGTPFT

SEQ ID NO: 68842 - protein, 15 aa, Homo sapiens
  heavy chain complementarity determining region 3 for antibody 34421
VRHYRETVAGIEGDS

SEQ ID NO: 68843 - protein, 9 aa, Homo sapiens
  light chain complementarity determining region 3 for antibody 34422
MQALETPST

SEQ ID NO: 68844 - protein, 15 aa, Homo sapiens
  heavy chain complementarity determining region 3 for antibody 34422
VRHYRETVAGIEGDS

SEQ ID NO: 68845 - protein, 9 aa, Homo sapiens
  light chain complementarity determining region 3 for antibody 34423
MGTLQTPPP

SEQ ID NO: 68846 - protein, 15 aa, Homo sapiens
  heavy chain complementarity determining region 3 for antibody 34423
TRDGKKDGHNDAFDI

SEQ ID NO: 68847 - protein, 9 aa, Homo sapiens
  light chain complementarity determining region 3 for antibody 34424
LQHRISPRT

SEQ ID NO: 68848 - protein, 11 aa, Homo sapiens
  heavy chain complementarity determining region 3 for antibody 34424
TTGLGSGGINW

SEQ ID NO: 68849 - protein, 9 aa, Homo sapiens
  light chain complementarity determining region 3 for antibody 34425
LQFSTTPPT

SEQ ID NO: 68850 - protein, 14 aa, Homo sapiens
  heavy chain complementarity determining region 3 for antibody 34425
AKATHASGQYYFDF

SEQ ID NO: 68851 - protein, 9 aa, Homo sapiens
  light chain complementarity determining region 3 for antibody 34426
LQALETPFT

SEQ ID NO: 68852 - protein, 15 aa, Homo sapiens
  heavy chain complementarity determining region 3 for antibody 34426
VRHYRETVAGIEGDS

SEQ ID NO: 68853 - protein, 9 aa, Homo sapiens
  light chain complementarity determining region 3 for antibody 34427
HQYGNLPRT

SEQ ID NO: 68854 - protein, 13 aa, Homo sapiens
  heavy chain complementarity determining region 3 for antibody 34427
AGGDFHSGGYSEF

SEQ ID NO: 68855 - protein, 9 aa, Homo sapiens
  light chain complementarity determining region 3 for antibody 34428
HQFYSYPPT

SEQ ID NO: 68856 - protein, 17 aa, Homo sapiens
  heavy chain complementarity determining region 3 for antibody 34428
ARVYDSSGLYQFMAYDF

SEQ ID NO: 68857 - protein, 9 aa, Homo sapiens
  light chain complementarity determining region 3 for antibody 34429
HHYNSFSYT

SEQ ID NO: 68858 - protein, 21 aa, Homo sapiens
  heavy chain complementarity determining region 3 for antibody 34429
ARIASYHYDGSGSYIARELDF

SEQ ID NO: 68859 - protein, 9 aa, Homo sapiens
  light chain complementarity determining region 3 for antibody 34430
VQYNRNPRT

SEQ ID NO: 68860 - protein, 6 aa, Homo sapiens
  heavy chain complementarity determining region 3 for antibody 34430
TRALDY

SEQ ID NO: 68861 - protein, 9 aa, Homo sapiens
  light chain complementarity determining region 3 for antibody 34431
VQDNRYPRT

SEQ ID NO: 68862 - protein, 6 aa, Homo sapiens
  heavy chain complementarity determining region 3 for antibody 34431
TRALDY

SEQ ID NO: 68863 - protein, 10 aa, Homo sapiens
  light chain complementarity determining region 3 for antibody 34432
QRRDEWPPVI

SEQ ID NO: 68864 - protein, 12 aa, Homo sapiens
  heavy chain complementarity determining region 3 for antibody 34432
VRDHITGWKFDY

SEQ ID NO: 68865 - protein, 9 aa, Homo sapiens
  light chain complementarity determining region 3 for antibody 34433
QQYYTYPYT

SEQ ID NO: 68866 - protein, 15 aa, Homo sapiens
  heavy chain complementarity determining region 3 for antibody 34433
ARGQGSGTYNPYFAF

SEQ ID NO: 68867 - protein, 9 aa, Homo sapiens
  light chain complementarity determining region 3 for antibody 34434
QQYYTSVRT

SEQ ID NO: 68868 - protein, 12 aa, Homo sapiens
  heavy chain complementarity determining region 3 for antibody 34434
VKDCGLGGPRDS

SEQ ID NO: 68869 - protein, 9 aa, Homo sapiens
  light chain complementarity determining region 3 for antibody 34435
QQYYTSIFA

SEQ ID NO: 68870 - protein, 7 aa, Homo sapiens
  heavy chain complementarity determining region 3 for antibody 34435
TRGWGDH

SEQ ID NO: 68871 - protein, 8 aa, Homo sapiens
  light chain complementarity determining region 3 for antibody 34436
QQYYSTPS

SEQ ID NO: 68872 - protein, 16 aa, Homo sapiens
  heavy chain complementarity determining region 3 for antibody 34436
ARRGMWELSDADAFDV

SEQ ID NO: 68873 - protein, 9 aa, Homo sapiens
  light chain complementarity determining region 3 for antibody 34437
QQYYNWPYT

SEQ ID NO: 68874 - protein, 9 aa, Homo sapiens
  heavy chain complementarity determining region 3 for antibody 34437
SRGAGSLDS

SEQ ID NO: 68875 - protein, 8 aa, Homo sapiens
  light chain complementarity determining region 3 for antibody 34438
QQYYNWPR

SEQ ID NO: 68876 - protein, 18 aa, Homo sapiens
  heavy chain complementarity determining region 3 for antibody 34438
AITYYDGSGNYGYYGLDV

SEQ ID NO: 68877 - protein, 9 aa, Homo sapiens
  light chain complementarity determining region 3 for antibody 34439
QQYYNTPRT

SEQ ID NO: 68878 - protein, 18 aa, Homo sapiens
  heavy chain complementarity determining region 3 for antibody 34439
AREQGTPDSSGDDWYFDL

SEQ ID NO: 68879 - protein, 8 aa, Homo sapiens
  light chain complementarity determining region 3 for antibody 34440
QQYSDFNT

SEQ ID NO: 68880 - protein, 17 aa, Homo sapiens
  heavy chain complementarity determining region 3 for antibody 34440
AHRRYYNGNWNGATVDV

SEQ ID NO: 68881 - protein, 9 aa, Homo sapiens
  light chain complementarity determining region 3 for antibody 34441
QQYNSYSWT

SEQ ID NO: 68882 - protein, 13 aa, Homo sapiens
  heavy chain complementarity determining region 3 for antibody 34441
ATPQYRYRPAFDY

SEQ ID NO: 68883 - protein, 9 aa, Homo sapiens
  light chain complementarity determining region 3 for antibody 34442
QQYNSYSWT

SEQ ID NO: 68884 - protein, 25 aa, Homo sapiens
  heavy chain complementarity determining region 3 for antibody 34442
ARLRVDRLRLPGAMRGPLYDRGLNV

SEQ ID NO: 68885 - protein, 9 aa, Homo sapiens
  light chain complementarity determining region 3 for antibody 34443
QQYNSYPYT

SEQ ID NO: 68886 - protein, 16 aa, Homo sapiens
  heavy chain complementarity determining region 3 for antibody 34443
AKAHHPQGEKVIRLDY

SEQ ID NO: 68887 - protein, 9 aa, Homo sapiens
  light chain complementarity determining region 3 for antibody 34444
QQYNSYPWT

SEQ ID NO: 68888 - protein, 10 aa, Homo sapiens
  heavy chain complementarity determining region 3 for antibody 34444
VKMNWELAGV

SEQ ID NO: 68889 - protein, 9 aa, Homo sapiens
  light chain complementarity determining region 3 for antibody 34445
QQYNSYPWT

SEQ ID NO: 68890 - protein, 12 aa, Homo sapiens
  heavy chain complementarity determining region 3 for antibody 34445
ARIRYFDWFLDS

SEQ ID NO: 68891 - protein, 9 aa, Homo sapiens
  light chain complementarity determining region 3 for antibody 34446
QQYNSYPWT

SEQ ID NO: 68892 - protein, 12 aa, Homo sapiens
  heavy chain complementarity determining region 3 for antibody 34446
ARGGSGWSAFDI

SEQ ID NO: 68893 - protein, 10 aa, Homo sapiens
  light chain complementarity determining region 3 for antibody 34447
QQYNNWPPYT

SEQ ID NO: 68894 - protein, 18 aa, Homo sapiens
  heavy chain complementarity determining region 3 for antibody 34447
ARTYSDLLTGYIGPYFDS

SEQ ID NO: 68895 - protein, 10 aa, Homo sapiens
  light chain complementarity determining region 3 for antibody 34448
QQYNNWPPLP

SEQ ID NO: 68896 - protein, 15 aa, Homo sapiens
  heavy chain complementarity determining region 3 for antibody 34448
ARYYYDSSGYYVFDY

SEQ ID NO: 68897 - protein, 10 aa, Homo sapiens
  light chain complementarity determining region 3 for antibody 34449
QQYNNWPPIT

SEQ ID NO: 68898 - protein, 20 aa, Homo sapiens
  heavy chain complementarity determining region 3 for antibody 34449
AREFHYYEDNGDLGNDAFEI

SEQ ID NO: 68899 - protein, 11 aa, Homo sapiens
  light chain complementarity determining region 3 for antibody 34450
QQYNNWPLPLP

SEQ ID NO: 68900 - protein, 17 aa, Homo sapiens
  heavy chain complementarity determining region 3 for antibody 34450
AREGMVRGVTYPPYFDY

SEQ ID NO: 68901 - protein, 8 aa, Homo sapiens
  light chain complementarity determining region 3 for antibody 34451
QQYNNWGT

SEQ ID NO: 68902 - protein, 10 aa, Homo sapiens
  heavy chain complementarity determining region 3 for antibody 34451
ARAGFGAFDI

SEQ ID NO: 68903 - protein, 9 aa, Homo sapiens
  light chain complementarity determining region 3 for antibody 34452
QQYNDWPYT

SEQ ID NO: 68904 - protein, 18 aa, Homo sapiens
  heavy chain complementarity determining region 3 for antibody 34452
ARAGCGADCFSARVAYDF

SEQ ID NO: 68905 - protein, 9 aa, Homo sapiens
  light chain complementarity determining region 3 for antibody 34453
QQYHSDPPT

SEQ ID NO: 68906 - protein, 10 aa, Homo sapiens
  heavy chain complementarity determining region 3 for antibody 34453
AGGTGWILDT

SEQ ID NO: 68907 - protein, 9 aa, Homo sapiens
  light chain complementarity determining region 3 for antibody 34454
QQYGTSPLN

SEQ ID NO: 68908 - protein, 13 aa, Homo sapiens
  heavy chain complementarity determining region 3 for antibody 34454
ASISVGTVAAGKA

SEQ ID NO: 68909 - protein, 9 aa, Homo sapiens
  light chain complementarity determining region 3 for antibody 34455
QQYGTSPFP

SEQ ID NO: 68910 - protein, 15 aa, Homo sapiens
  heavy chain complementarity determining region 3 for antibody 34455
ARQNDFLSGPGEFDP

SEQ ID NO: 68911 - protein, 9 aa, Homo sapiens
  light chain complementarity determining region 3 for antibody 34456
QQYGTSPFN

SEQ ID NO: 68912 - protein, 13 aa, Homo sapiens
  heavy chain complementarity determining region 3 for antibody 34456
ASISVGTVAAGKG

SEQ ID NO: 68913 - protein, 9 aa, Homo sapiens
  light chain complementarity determining region 3 for antibody 34457
QQYGTLPRT

SEQ ID NO: 68914 - protein, 13 aa, Homo sapiens
  heavy chain complementarity determining region 3 for antibody 34457
AGGNFHRSGYAEY

SEQ ID NO: 68915 - protein, 9 aa, Homo sapiens
  light chain complementarity determining region 3 for antibody 34458
QQYGSVPRT

SEQ ID NO: 68916 - protein, 13 aa, Homo sapiens
  heavy chain complementarity determining region 3 for antibody 34458
ALGHYHTTGYSEF

SEQ ID NO: 68917 - protein, 10 aa, Homo sapiens
  light chain complementarity determining region 3 for antibody 34459
QQYGSSSMYP

SEQ ID NO: 68918 - protein, 19 aa, Homo sapiens
  heavy chain complementarity determining region 3 for antibody 34459
AKDQLMFYYDNSGYPGADY

SEQ ID NO: 68919 - protein, 9 aa, Homo sapiens
  light chain complementarity determining region 3 for antibody 34460
QQYGSSPYT

SEQ ID NO: 68920 - protein, 12 aa, Homo sapiens
  heavy chain complementarity determining region 3 for antibody 34460
VREGDGYKYFDY

SEQ ID NO: 68921 - protein, 9 aa, Homo sapiens
  light chain complementarity determining region 3 for antibody 34461
QQYGSSPYT

SEQ ID NO: 68922 - protein, 20 aa, Homo sapiens
  heavy chain complementarity determining region 3 for antibody 34461
ARDGSAGMAARGTPYYGLDV

SEQ ID NO: 68923 - protein, 9 aa, Homo sapiens
  light chain complementarity determining region 3 for antibody 34462
QQYGSSPTT

SEQ ID NO: 68924 - protein, 17 aa, Homo sapiens
  heavy chain complementarity determining region 3 for antibody 34462
ARDLGAYDATRHWYFDL

SEQ ID NO: 68925 - protein, 10 aa, Homo sapiens
  light chain complementarity determining region 3 for antibody 34463
QQYGSSPTGT

SEQ ID NO: 68926 - protein, 15 aa, Homo sapiens
  heavy chain complementarity determining region 3 for antibody 34463
TRDLLDSGGAYFADH

SEQ ID NO: 68927 - protein, 9 aa, Homo sapiens
  light chain complementarity determining region 3 for antibody 34464
QQYGSSPRT

SEQ ID NO: 68928 - protein, 22 aa, Homo sapiens
  heavy chain complementarity determining region 3 for antibody 34464
GRGFRHYERSSYFSWGGEYYQD

SEQ ID NO: 68929 - protein, 9 aa, Homo sapiens
  light chain complementarity determining region 3 for antibody 34465
QQYGSSPRT

SEQ ID NO: 68930 - protein, 21 aa, Homo sapiens
  heavy chain complementarity determining region 3 for antibody 34465
ARDAPVSRPYSSGWYSSAFDY

SEQ ID NO: 68931 - protein, 9 aa, Homo sapiens
  light chain complementarity determining region 3 for antibody 34466
QQYGSSPRT

SEQ ID NO: 68932 - protein, 17 aa, Homo sapiens
  heavy chain complementarity determining region 3 for antibody 34466
ARAVDIVVVVDAIWFDP

SEQ ID NO: 68933 - protein, 9 aa, Homo sapiens
  light chain complementarity determining region 3 for antibody 34467
QQYGSSPPT

SEQ ID NO: 68934 - protein, 16 aa, Homo sapiens
  heavy chain complementarity determining region 3 for antibody 34467
ARDFHPMAASDTAHDY

SEQ ID NO: 68935 - protein, 9 aa, Homo sapiens
  light chain complementarity determining region 3 for antibody 34468
QQYGSSPLT

SEQ ID NO: 68936 - protein, 13 aa, Homo sapiens
  heavy chain complementarity determining region 3 for antibody 34468
ARSQGLAEDVFND

SEQ ID NO: 68937 - protein, 10 aa, Homo sapiens
  light chain complementarity determining region 3 for antibody 34469
QQYGSSPLRT

SEQ ID NO: 68938 - protein, 22 aa, Homo sapiens
  heavy chain complementarity determining region 3 for antibody 34469
ARDPPLQWFGGPPATDEDGLDV

SEQ ID NO: 68939 - protein, 9 aa, Homo sapiens
  light chain complementarity determining region 3 for antibody 34470
QQYGSSPFT

SEQ ID NO: 68940 - protein, 17 aa, Homo sapiens
  heavy chain complementarity determining region 3 for antibody 34470
AKSSVWLNNYYYYSLDL

SEQ ID NO: 68941 - protein, 9 aa, Homo sapiens
  light chain complementarity determining region 3 for antibody 34471
QQYGSSLFT

SEQ ID NO: 68942 - protein, 19 aa, Homo sapiens
  heavy chain complementarity determining region 3 for antibody 34471
ARIGAIFGGYYYYYYGMDV

SEQ ID NO: 68943 - protein, 9 aa, Homo sapiens
  light chain complementarity determining region 3 for antibody 34472
QQYGSSIVT

SEQ ID NO: 68944 - protein, 16 aa, Homo sapiens
  heavy chain complementarity determining region 3 for antibody 34472
TTDWGSGYYWIRAFDF

SEQ ID NO: 68945 - protein, 9 aa, Homo sapiens
  light chain complementarity determining region 3 for antibody 34473
QQYGSPPRT

SEQ ID NO: 68946 - protein, 14 aa, Homo sapiens
  heavy chain complementarity determining region 3 for antibody 34473
AGGVFSTDWNYSEY

SEQ ID NO: 68947 - protein, 9 aa, Homo sapiens
  light chain complementarity determining region 3 for antibody 34474
QQYGSIPRT

SEQ ID NO: 68948 - protein, 13 aa, Homo sapiens
  heavy chain complementarity determining region 3 for antibody 34474
ALGHYHTTGYSDF

SEQ ID NO: 68949 - protein, 9 aa, Homo sapiens
  light chain complementarity determining region 3 for antibody 34475
QQYGPSPLN

SEQ ID NO: 68950 - protein, 13 aa, Homo sapiens
  heavy chain complementarity determining region 3 for antibody 34475
ASISVGTVAAGKG

SEQ ID NO: 68951 - protein, 9 aa, Homo sapiens
  light chain complementarity determining region 3 for antibody 34476
QQYGNSPRT

SEQ ID NO: 68952 - protein, 16 aa, Homo sapiens
  heavy chain complementarity determining region 3 for antibody 34476
VRGTFYQGSSDNYHEN

SEQ ID NO: 68953 - protein, 9 aa, Homo sapiens
  light chain complementarity determining region 3 for antibody 34477
QQYGNSPRP

SEQ ID NO: 68954 - protein, 16 aa, Homo sapiens
  heavy chain complementarity determining region 3 for antibody 34477
ARGTFYQGSSDNYHEN

SEQ ID NO: 68955 - protein, 8 aa, Homo sapiens
  light chain complementarity determining region 3 for antibody 34478
QQYGGSTS

SEQ ID NO: 68956 - protein, 16 aa, Homo sapiens
  heavy chain complementarity determining region 3 for antibody 34478
ATDWGSGTQWIRAFDV

SEQ ID NO: 68957 - protein, 8 aa, Homo sapiens
  light chain complementarity determining region 3 for antibody 34479
QQYGGSSS

SEQ ID NO: 68958 - protein, 16 aa, Homo sapiens
  heavy chain complementarity determining region 3 for antibody 34479
ATDWGSGTQWIRAFDV

SEQ ID NO: 68959 - protein, 8 aa, Homo sapiens
  light chain complementarity determining region 3 for antibody 34480
QQYGGSPS

SEQ ID NO: 68960 - protein, 16 aa, Homo sapiens
  heavy chain complementarity determining region 3 for antibody 34480
ATDWGSGTQWSRAFDV

SEQ ID NO: 68961 - protein, 8 aa, Homo sapiens
  light chain complementarity determining region 3 for antibody 34481
QQYGGSPS

SEQ ID NO: 68962 - protein, 16 aa, Homo sapiens
  heavy chain complementarity determining region 3 for antibody 34481
ATDWGSGTHWIRAFDV

SEQ ID NO: 68963 - protein, 8 aa, Homo sapiens
  light chain complementarity determining region 3 for antibody 34482
QQYGGSPS

SEQ ID NO: 68964 - protein, 16 aa, Homo sapiens
  heavy chain complementarity determining region 3 for antibody 34482
ASDWGSGTQWIRAFDV

SEQ ID NO: 68965 - protein, 9 aa, Homo sapiens
  light chain complementarity determining region 3 for antibody 34483
QQYGDSPIT

SEQ ID NO: 68966 - protein, 13 aa, Homo sapiens
  heavy chain complementarity determining region 3 for antibody 34483
ASGNSGWYYYFDY

SEQ ID NO: 68967 - protein, 11 aa, Homo sapiens
  light chain complementarity determining region 3 for antibody 34484
QQYETSPPGYP

SEQ ID NO: 68968 - protein, 14 aa, Homo sapiens
  heavy chain complementarity determining region 3 for antibody 34484
ARENSISRKRSFDQ

SEQ ID NO: 68969 - protein, 9 aa, Homo sapiens
  light chain complementarity determining region 3 for antibody 34485
QQYDSLPVT

SEQ ID NO: 68970 - protein, 14 aa, Homo sapiens
  heavy chain complementarity determining region 3 for antibody 34485
AKDVEEWPIYYFDY

SEQ ID NO: 68971 - protein, 10 aa, Homo sapiens
  light chain complementarity determining region 3 for antibody 34486
QQYDRSTGYT

SEQ ID NO: 68972 - protein, 21 aa, Homo sapiens
  heavy chain complementarity determining region 3 for antibody 34486
ARAGEYSELLTGHYNGYNFDY

SEQ ID NO: 68973 - protein, 10 aa, Homo sapiens
  light chain complementarity determining region 3 for antibody 34487
QQYATSPPGT

SEQ ID NO: 68974 - protein, 11 aa, Homo sapiens
  heavy chain complementarity determining region 3 for antibody 34487
ARSSGWWSFDY

SEQ ID NO: 68975 - protein, 9 aa, Homo sapiens
  light chain complementarity determining region 3 for antibody 34488
QQTHTFPRT

SEQ ID NO: 68976 - protein, 20 aa, Homo sapiens
  heavy chain complementarity determining region 3 for antibody 34488
GRGRRIAALSTAHYYYGMDV

SEQ ID NO: 68977 - protein, 8 aa, Homo sapiens
  light chain complementarity determining region 3 for antibody 34489
QQSYSTPT

SEQ ID NO: 68978 - protein, 16 aa, Homo sapiens
  heavy chain complementarity determining region 3 for antibody 34489
GRDLGRGFWSGYYIDY

SEQ ID NO: 68979 - protein, 9 aa, Homo sapiens
  light chain complementarity determining region 3 for antibody 34490
QQSYSTPRT

SEQ ID NO: 68980 - protein, 21 aa, Homo sapiens
  heavy chain complementarity determining region 3 for antibody 34490
ARDAPVSRPYSSGWYSSAFDY

SEQ ID NO: 68981 - protein, 9 aa, Homo sapiens
  light chain complementarity determining region 3 for antibody 34491
QQSYSTPLT

SEQ ID NO: 68982 - protein, 13 aa, Homo sapiens
  heavy chain complementarity determining region 3 for antibody 34491
ARTGRVAGVEGAH

SEQ ID NO: 68983 - protein, 9 aa, Homo sapiens
  light chain complementarity determining region 3 for antibody 34492
QQSYSSPLT

SEQ ID NO: 68984 - protein, 14 aa, Homo sapiens
  heavy chain complementarity determining region 3 for antibody 34492
AKSRDTSGYSAFDY

SEQ ID NO: 68985 - protein, 9 aa, Homo sapiens
  light chain complementarity determining region 3 for antibody 34493
QQSYSNPPT

SEQ ID NO: 68986 - protein, 18 aa, Homo sapiens
  heavy chain complementarity determining region 3 for antibody 34493
AREADLVVVKTIYNVFDI

SEQ ID NO: 68987 - protein, 9 aa, Homo sapiens
  light chain complementarity determining region 3 for antibody 34494
QQSYRIPYT

SEQ ID NO: 68988 - protein, 14 aa, Homo sapiens
  heavy chain complementarity determining region 3 for antibody 34494
VRGAAVTPSRVFGF

SEQ ID NO: 68989 - protein, 9 aa, Homo sapiens
  light chain complementarity determining region 3 for antibody 34495
QQSYNMPFT

SEQ ID NO: 68990 - protein, 17 aa, Homo sapiens
  heavy chain complementarity determining region 3 for antibody 34495
ARKARDSTWNDGTYFAP

SEQ ID NO: 68991 - protein, 9 aa, Homo sapiens
  light chain complementarity determining region 3 for antibody 34496
QQSRDFPYT

SEQ ID NO: 68992 - protein, 13 aa, Homo sapiens
  heavy chain complementarity determining region 3 for antibody 34496
ARLPDISGWPFDL

SEQ ID NO: 68993 - protein, 9 aa, Homo sapiens
  light chain complementarity determining region 3 for antibody 34497
QQSITIPLT

SEQ ID NO: 68994 - protein, 7 aa, Homo sapiens
  heavy chain complementarity determining region 3 for antibody 34497
LYSSGWN

SEQ ID NO: 68995 - protein, 10 aa, Homo sapiens
  light chain complementarity determining region 3 for antibody 34498
QQSHTTPMYT

SEQ ID NO: 68996 - protein, 18 aa, Homo sapiens
  heavy chain complementarity determining region 3 for antibody 34498
ARDFVAVPGYNGDEYFQY

SEQ ID NO: 68997 - protein, 10 aa, Homo sapiens
  light chain complementarity determining region 3 for antibody 34499
QQSHSTPMYS

SEQ ID NO: 68998 - protein, 18 aa, Homo sapiens
  heavy chain complementarity determining region 3 for antibody 34499
ARDFVAVPGYNGDEYFQH

SEQ ID NO: 68999 - protein, 8 aa, Homo sapiens
  light chain complementarity determining region 3 for antibody 34500
QQSHSART

SEQ ID NO: 69000 - protein, 19 aa, Homo sapiens
  heavy chain complementarity determining region 3 for antibody 34500
AREGARGGGTTPPHWYFDL

SEQ ID NO: 69001 - protein, 8 aa, Homo sapiens
  light chain complementarity determining region 3 for antibody 34501
QQSGSSFT

SEQ ID NO: 69002 - protein, 19 aa, Homo sapiens
  heavy chain complementarity determining region 3 for antibody 34501
ARDSFYSGSGTYFNDVFDV

SEQ ID NO: 69003 - protein, 9 aa, Homo sapiens
  light chain complementarity determining region 3 for antibody 34502
QQSDNFPFT

SEQ ID NO: 69004 - protein, 20 aa, Homo sapiens
  heavy chain complementarity determining region 3 for antibody 34502
ARARITKIVVLIKPNWNFDV

SEQ ID NO: 69005 - protein, 9 aa, Homo sapiens
  light chain complementarity determining region 3 for antibody 34503
QQSCSTPRT

SEQ ID NO: 69006 - protein, 18 aa, Homo sapiens
  heavy chain complementarity determining region 3 for antibody 34503
ARGLGRGYSYGSQSPFDY

SEQ ID NO: 69007 - protein, 10 aa, Homo sapiens
  light chain complementarity determining region 3 for antibody 34504
QQRYKWPPST

SEQ ID NO: 69008 - protein, 11 aa, Homo sapiens
  heavy chain complementarity determining region 3 for antibody 34504
ARGVGSYVFDS

SEQ ID NO: 69009 - protein, 10 aa, Homo sapiens
  light chain complementarity determining region 3 for antibody 34505
QQRYKRPPYT

SEQ ID NO: 69010 - protein, 11 aa, Homo sapiens
  heavy chain complementarity determining region 3 for antibody 34505
ARGVGSYVFES

SEQ ID NO: 69011 - protein, 8 aa, Homo sapiens
  light chain complementarity determining region 3 for antibody 34506
QQRSRGLS

SEQ ID NO: 69012 - protein, 12 aa, Homo sapiens
  heavy chain complementarity determining region 3 for antibody 34506
ARDASAVSEHTP

SEQ ID NO: 69013 - protein, 9 aa, Homo sapiens
  light chain complementarity determining region 3 for antibody 34507
QQRSNWPYT

SEQ ID NO: 69014 - protein, 9 aa, Homo sapiens
  heavy chain complementarity determining region 3 for antibody 34507
AREALATDY

SEQ ID NO: 69015 - protein, 11 aa, Homo sapiens
  light chain complementarity determining region 3 for antibody 34508
QQRSNWPPFLT

SEQ ID NO: 69016 - protein, 12 aa, Homo sapiens
  heavy chain complementarity determining region 3 for antibody 34508
GRAVAVSGHFDI

SEQ ID NO: 69017 - protein, 8 aa, Homo sapiens
  light chain complementarity determining region 3 for antibody 34509
QQRSNWPA

SEQ ID NO: 69018 - protein, 20 aa, Homo sapiens
  heavy chain complementarity determining region 3 for antibody 34509
ARVWCGERTRGYYYYYGMDV

SEQ ID NO: 69019 - protein, 8 aa, Homo sapiens
  light chain complementarity determining region 3 for antibody 34510
QQRSNWLT

SEQ ID NO: 69020 - protein, 13 aa, Homo sapiens
  heavy chain complementarity determining region 3 for antibody 34510
AKDLPKSMGAAGD

SEQ ID NO: 69021 - protein, 9 aa, Homo sapiens
  light chain complementarity determining region 3 for antibody 34511
QQRSNWEWT

SEQ ID NO: 69022 - protein, 15 aa, Homo sapiens
  heavy chain complementarity determining region 3 for antibody 34511
AALMAPAGTGNWFDP

SEQ ID NO: 69023 - protein, 10 aa, Homo sapiens
  light chain complementarity determining region 3 for antibody 34512
QQRRNWPPLT

SEQ ID NO: 69024 - protein, 20 aa, Homo sapiens
  heavy chain complementarity determining region 3 for antibody 34512
VKDMLPSTRGDDQPLLLFDL

SEQ ID NO: 69025 - protein, 9 aa, Homo sapiens
  light chain complementarity determining region 3 for antibody 34513
QQRFDWPLP

SEQ ID NO: 69026 - protein, 12 aa, Homo sapiens
  heavy chain complementarity determining region 3 for antibody 34513
ARDLYDNNQSDY

SEQ ID NO: 69027 - protein, 9 aa, Homo sapiens
  light chain complementarity determining region 3 for antibody 34514
QQNGSSPRT

SEQ ID NO: 69028 - protein, 25 aa, Homo sapiens
  heavy chain complementarity determining region 3 for antibody 34514
ARLRIDRLRLPGAMRGPLYDCGLNV

SEQ ID NO: 69029 - protein, 9 aa, Homo sapiens
  light chain complementarity determining region 3 for antibody 34515
QQNGSSPRT

SEQ ID NO: 69030 - protein, 17 aa, Homo sapiens
  heavy chain complementarity determining region 3 for antibody 34515
ARALDIVVVVDAIWFDP

SEQ ID NO: 69031 - protein, 8 aa, Homo sapiens
  light chain complementarity determining region 3 for antibody 34516
QQHNDGGT

SEQ ID NO: 69032 - protein, 11 aa, Homo sapiens
  heavy chain complementarity determining region 3 for antibody 34516
AKESSTSVAEW

SEQ ID NO: 69033 - protein, 8 aa, Homo sapiens
  light chain complementarity determining region 3 for antibody 34517
QQHDDLPT

SEQ ID NO: 69034 - protein, 16 aa, Homo sapiens
  heavy chain complementarity determining region 3 for antibody 34517
ARARERATWFGEAFDI

SEQ ID NO: 69035 - protein, 9 aa, Homo sapiens
  light chain complementarity determining region 3 for antibody 34518
QQGYNNPLT

SEQ ID NO: 69036 - protein, 15 aa, Homo sapiens
  heavy chain complementarity determining region 3 for antibody 34518
ARAQVIWGQLYYFDS

SEQ ID NO: 69037 - protein, 9 aa, Homo sapiens
  light chain complementarity determining region 3 for antibody 34519
QQGVASPWT

SEQ ID NO: 69038 - protein, 15 aa, Homo sapiens
  heavy chain complementarity determining region 3 for antibody 34519
ASPPVGDVPNGVFDI

SEQ ID NO: 69039 - protein, 9 aa, Homo sapiens
  light chain complementarity determining region 3 for antibody 34520
QQDTTSPLT

SEQ ID NO: 69040 - protein, 11 aa, Homo sapiens
  heavy chain complementarity determining region 3 for antibody 34520
VREEFGWEMTY

SEQ ID NO: 69041 - protein, 9 aa, Homo sapiens
  light chain complementarity determining region 3 for antibody 34521
QQDGTSPLT

SEQ ID NO: 69042 - protein, 14 aa, Homo sapiens
  heavy chain complementarity determining region 3 for antibody 34521
ARDMFRGVPDYLDY

SEQ ID NO: 69043 - protein, 9 aa, Homo sapiens
  light chain complementarity determining region 3 for antibody 34522
QQDGSPPRT

SEQ ID NO: 69044 - protein, 14 aa, Homo sapiens
  heavy chain complementarity determining region 3 for antibody 34522
AGGNFCGYDCYSEY

SEQ ID NO: 69045 - protein, 9 aa, Homo sapiens
  light chain complementarity determining region 3 for antibody 34523
QQDGNSPRT

SEQ ID NO: 69046 - protein, 16 aa, Homo sapiens
  heavy chain complementarity determining region 3 for antibody 34523
ARGTFYQGSSDNYHEN

SEQ ID NO: 69047 - protein, 9 aa, Homo sapiens
  light chain complementarity determining region 3 for antibody 34524
QQDGNLPRT

SEQ ID NO: 69048 - protein, 13 aa, Homo sapiens
  heavy chain complementarity determining region 3 for antibody 34524
AGGNFHSGGYGEY

SEQ ID NO: 69049 - protein, 9 aa, Homo sapiens
  light chain complementarity determining region 3 for antibody 34525
QQDGGSPRT

SEQ ID NO: 69050 - protein, 13 aa, Homo sapiens
  heavy chain complementarity determining region 3 for antibody 34525
ASGYFDSGAYYEF

SEQ ID NO: 69051 - protein, 8 aa, Homo sapiens
  light chain complementarity determining region 3 for antibody 34526
QQDDNSRT

SEQ ID NO: 69052 - protein, 15 aa, Homo sapiens
  heavy chain complementarity determining region 3 for antibody 34526
AKTDYCSAGNCPFDS

SEQ ID NO: 69053 - protein, 9 aa, Homo sapiens
  light chain complementarity determining region 3 for antibody 34527
QQDATSLGT

SEQ ID NO: 69054 - protein, 15 aa, Homo sapiens
  heavy chain complementarity determining region 3 for antibody 34527
ARQKVRGRMRDHFDM

SEQ ID NO: 69055 - protein, 9 aa, Homo sapiens
  light chain complementarity determining region 3 for antibody 34528
QNYYSWTFT

SEQ ID NO: 69056 - protein, 13 aa, Homo sapiens
  heavy chain complementarity determining region 3 for antibody 34528
ARGAVTTTYSFGY

SEQ ID NO: 69057 - protein, 11 aa, Homo sapiens
  light chain complementarity determining region 3 for antibody 34529
QLRQEGTNWLT

SEQ ID NO: 69058 - protein, 15 aa, Homo sapiens
  heavy chain complementarity determining region 3 for antibody 34529
ARGGYSSGWYYWFDP

SEQ ID NO: 69059 - protein, 9 aa, Homo sapiens
  light chain complementarity determining region 3 for antibody 34530
QHYNARPLT

SEQ ID NO: 69060 - protein, 15 aa, Homo sapiens
  heavy chain complementarity determining region 3 for antibody 34530
AREVIEPTTSDGFDM

SEQ ID NO: 69061 - protein, 10 aa, Homo sapiens
  light chain complementarity determining region 3 for antibody 34531
QHWVSSPAHT

SEQ ID NO: 69062 - protein, 12 aa, Homo sapiens
  heavy chain complementarity determining region 3 for antibody 34531
ARETTQFGELDN

SEQ ID NO: 69063 - protein, 9 aa, Homo sapiens
  light chain complementarity determining region 3 for antibody 34532
QHTHTFPRT

SEQ ID NO: 69064 - protein, 20 aa, Homo sapiens
  heavy chain complementarity determining region 3 for antibody 34532
GRGRRIAARSTAHYYYGMDV

SEQ ID NO: 69065 - protein, 9 aa, Homo sapiens
  light chain complementarity determining region 3 for antibody 34533
QHSHSSPFT

SEQ ID NO: 69066 - protein, 20 aa, Homo sapiens
  heavy chain complementarity determining region 3 for antibody 34533
AKGIAVAALRTVYYYYGMDV

SEQ ID NO: 69067 - protein, 9 aa, Homo sapiens
  light chain complementarity determining region 3 for antibody 34534
QHSHSRPLT

SEQ ID NO: 69068 - protein, 20 aa, Homo sapiens
  heavy chain complementarity determining region 3 for antibody 34534
AKGIAVAALRTVYYYYGMDV

SEQ ID NO: 69069 - protein, 9 aa, Homo sapiens
  light chain complementarity determining region 3 for antibody 34535
QHRRTWLSS

SEQ ID NO: 69070 - protein, 20 aa, Homo sapiens
  heavy chain complementarity determining region 3 for antibody 34535
ARDGSAGMAARGTPYYGLDV

SEQ ID NO: 69071 - protein, 9 aa, Homo sapiens
  light chain complementarity determining region 3 for antibody 34536
QHNHSRPFT

SEQ ID NO: 69072 - protein, 20 aa, Homo sapiens
  heavy chain complementarity determining region 3 for antibody 34536
AKGIAVAALRTVYYYYGMDV

SEQ ID NO: 69073 - protein, 10 aa, Homo sapiens
  light chain complementarity determining region 3 for antibody 34537
QEYGNLPLGT

SEQ ID NO: 69074 - protein, 15 aa, Homo sapiens
  heavy chain complementarity determining region 3 for antibody 34537
AVWGPGSDWWPLYDY

SEQ ID NO: 69075 - protein, 10 aa, Homo sapiens
  light chain complementarity determining region 3 for antibody 34538
QESYSTPRWT

SEQ ID NO: 69076 - protein, 16 aa, Homo sapiens
  heavy chain complementarity determining region 3 for antibody 34538
ARADRDSSNFYSCPDV

SEQ ID NO: 69077 - protein, 9 aa, Homo sapiens
  light chain complementarity determining region 3 for antibody 34539
QEGYSTTPT

SEQ ID NO: 69078 - protein, 12 aa, Homo sapiens
  heavy chain complementarity determining region 3 for antibody 34539
VRGVHWSVFLDT

SEQ ID NO: 69079 - protein, 9 aa, Homo sapiens
  light chain complementarity determining region 3 for antibody 34540
PQYYTTPRT

SEQ ID NO: 69080 - protein, 8 aa, Homo sapiens
  heavy chain complementarity determining region 3 for antibody 34540
ARDGAFDS

SEQ ID NO: 69081 - protein, 9 aa, Homo sapiens
  light chain complementarity determining region 3 for antibody 34541
MRGTHWPKT

SEQ ID NO: 69082 - protein, 9 aa, Homo sapiens
  heavy chain complementarity determining region 3 for antibody 34541
AKGYYDSSY

SEQ ID NO: 69083 - protein, 9 aa, Homo sapiens
  light chain complementarity determining region 3 for antibody 34542
MQVLQTPRT

SEQ ID NO: 69084 - protein, 20 aa, Homo sapiens
  heavy chain complementarity determining region 3 for antibody 34542
TTGTKLFISGTIYHYYAMDV

SEQ ID NO: 69085 - protein, 9 aa, Homo sapiens
  light chain complementarity determining region 3 for antibody 34543
MQTLQTPGT

SEQ ID NO: 69086 - protein, 18 aa, Homo sapiens
  heavy chain complementarity determining region 3 for antibody 34543
AASGRYFFQDSGPLGFAY

SEQ ID NO: 69087 - protein, 8 aa, Homo sapiens
  light chain complementarity determining region 3 for antibody 34544
MQTLESYT

SEQ ID NO: 69088 - protein, 14 aa, Homo sapiens
  heavy chain complementarity determining region 3 for antibody 34544
ARGSRFNASSGWHH

SEQ ID NO: 69089 - protein, 9 aa, Homo sapiens
  light chain complementarity determining region 3 for antibody 34545
MQSTHWPGT

SEQ ID NO: 69090 - protein, 10 aa, Homo sapiens
  heavy chain complementarity determining region 3 for antibody 34545
VQDHRYGSGN

SEQ ID NO: 69091 - protein, 9 aa, Homo sapiens
  light chain complementarity determining region 3 for antibody 34546
MQSLQIPRT

SEQ ID NO: 69092 - protein, 17 aa, Homo sapiens
  heavy chain complementarity determining region 3 for antibody 34546
VRDAGGYDYGYGYYFDL

SEQ ID NO: 69093 - protein, 9 aa, Homo sapiens
  light chain complementarity determining region 3 for antibody 34547
MQSLQAPFT

SEQ ID NO: 69094 - protein, 12 aa, Homo sapiens
  heavy chain complementarity determining region 3 for antibody 34547
TRDPPTRWGMEV

SEQ ID NO: 69095 - protein, 8 aa, Homo sapiens
  light chain complementarity determining region 3 for antibody 34548
MQSLQALT

SEQ ID NO: 69096 - protein, 8 aa, Homo sapiens
  heavy chain complementarity determining region 3 for antibody 34548
VSQMRSPY

SEQ ID NO: 69097 - protein, 10 aa, Homo sapiens
  light chain complementarity determining region 3 for antibody 34549
MQGTQWPPWT

SEQ ID NO: 69098 - protein, 5 aa, Homo sapiens
  heavy chain complementarity determining region 3 for antibody 34549
VRWDY

SEQ ID NO: 69099 - protein, 9 aa, Homo sapiens
  light chain complementarity determining region 3 for antibody 34550
MQGTQGPPT

SEQ ID NO: 69100 - protein, 12 aa, Homo sapiens
  heavy chain complementarity determining region 3 for antibody 34550
AKEDGGYSQVDH

SEQ ID NO: 69101 - protein, 9 aa, Homo sapiens
  light chain complementarity determining region 3 for antibody 34551
MQGTHWPWT

SEQ ID NO: 69102 - protein, 15 aa, Homo sapiens
  heavy chain complementarity determining region 3 for antibody 34551
ARDAFRGDYGGKAEY

SEQ ID NO: 69103 - protein, 8 aa, Homo sapiens
  light chain complementarity determining region 3 for antibody 34552
MQGTHWPT

SEQ ID NO: 69104 - protein, 15 aa, Homo sapiens
  heavy chain complementarity determining region 3 for antibody 34552
TREGYYLGAYWYFDF

SEQ ID NO: 69105 - protein, 10 aa, Homo sapiens
  light chain complementarity determining region 3 for antibody 34553
MQGTHWPRLT

SEQ ID NO: 69106 - protein, 12 aa, Homo sapiens
  heavy chain complementarity determining region 3 for antibody 34553
VPFRRNNWYEGI

SEQ ID NO: 69107 - protein, 10 aa, Homo sapiens
  light chain complementarity determining region 3 for antibody 34554
MQGTHWPPGT

SEQ ID NO: 69108 - protein, 11 aa, Homo sapiens
  heavy chain complementarity determining region 3 for antibody 34554
ARDHPGIGIDY

SEQ ID NO: 69109 - protein, 9 aa, Homo sapiens
  light chain complementarity determining region 3 for antibody 34555
MQGTHWPGT

SEQ ID NO: 69110 - protein, 16 aa, Homo sapiens
  heavy chain complementarity determining region 3 for antibody 34555
TGDQRDRIFGVLDLPT

SEQ ID NO: 69111 - protein, 9 aa, Homo sapiens
  light chain complementarity determining region 3 for antibody 34556
MQGLQTPYP

SEQ ID NO: 69112 - protein, 10 aa, Homo sapiens
  heavy chain complementarity determining region 3 for antibody 34556
GRDLSGARDY

SEQ ID NO: 69113 - protein, 9 aa, Homo sapiens
  light chain complementarity determining region 3 for antibody 34557
MQGLQPPYT

SEQ ID NO: 69114 - protein, 10 aa, Homo sapiens
  heavy chain complementarity determining region 3 for antibody 34557
ARDVVGSDDQ

SEQ ID NO: 69115 - protein, 8 aa, Homo sapiens
  light chain complementarity determining region 3 for antibody 34558
MQALQTWT

SEQ ID NO: 69116 - protein, 10 aa, Homo sapiens
  heavy chain complementarity determining region 3 for antibody 34558
ARDLLWSFDH

SEQ ID NO: 69117 - protein, 9 aa, Homo sapiens
  light chain complementarity determining region 3 for antibody 34559
MQALQTPYT

SEQ ID NO: 69118 - protein, 13 aa, Homo sapiens
  heavy chain complementarity determining region 3 for antibody 34559
ARDDGEYYSALDP

SEQ ID NO: 69119 - protein, 9 aa, Homo sapiens
  light chain complementarity determining region 3 for antibody 34560
MQALQTPYP

SEQ ID NO: 69120 - protein, 21 aa, Homo sapiens
  heavy chain complementarity determining region 3 for antibody 34560
ARDAPVSRPYSSGWYSSAFDY

SEQ ID NO: 69121 - protein, 9 aa, Homo sapiens
  light chain complementarity determining region 3 for antibody 34561
MQALQTPWT

SEQ ID NO: 69122 - protein, 17 aa, Homo sapiens
  heavy chain complementarity determining region 3 for antibody 34561
SRRRKNGSPGRNNWFDP

SEQ ID NO: 69123 - protein, 9 aa, Homo sapiens
  light chain complementarity determining region 3 for antibody 34562
MQALQTPRT

SEQ ID NO: 69124 - protein, 9 aa, Homo sapiens
  heavy chain complementarity determining region 3 for antibody 34562
AKGKDAFGV

SEQ ID NO: 69125 - protein, 8 aa, Homo sapiens
  light chain complementarity determining region 3 for antibody 34563
MQALQTPG

SEQ ID NO: 69126 - protein, 16 aa, Homo sapiens
  heavy chain complementarity determining region 3 for antibody 34563
ARRALRGHYYGNHFDP

SEQ ID NO: 69127 - protein, 9 aa, Homo sapiens
  light chain complementarity determining region 3 for antibody 34564
MQALQTPFT

SEQ ID NO: 69128 - protein, 13 aa, Homo sapiens
  heavy chain complementarity determining region 3 for antibody 34564
TMVVDYGDYGFDC

SEQ ID NO: 69129 - protein, 9 aa, Homo sapiens
  light chain complementarity determining region 3 for antibody 34565
MQALQSPIT

SEQ ID NO: 69130 - protein, 12 aa, Homo sapiens
  heavy chain complementarity determining region 3 for antibody 34565
ARDGGKSWSERT

SEQ ID NO: 69131 - protein, 9 aa, Homo sapiens
  light chain complementarity determining region 3 for antibody 34566
MQALQAPLT

SEQ ID NO: 69132 - protein, 19 aa, Homo sapiens
  heavy chain complementarity determining region 3 for antibody 34566
ARRQSLIEGLAGWGWAIGS

SEQ ID NO: 69133 - protein, 10 aa, Homo sapiens
  light chain complementarity determining region 3 for antibody 34567
MQALHTPPGT

SEQ ID NO: 69134 - protein, 17 aa, Homo sapiens
  heavy chain complementarity determining region 3 for antibody 34567
TSLGYSFGSVYYYGLDV

SEQ ID NO: 69135 - protein, 9 aa, Homo sapiens
  light chain complementarity determining region 3 for antibody 34568
MQALETPLT

SEQ ID NO: 69136 - protein, 15 aa, Homo sapiens
  heavy chain complementarity determining region 3 for antibody 34568
VRHYRIITAPLEGDS

SEQ ID NO: 69137 - protein, 9 aa, Homo sapiens
  light chain complementarity determining region 3 for antibody 34569
MQALETPLT

SEQ ID NO: 69138 - protein, 15 aa, Homo sapiens
  heavy chain complementarity determining region 3 for antibody 34569
VRHYRETVAGIEGDS

SEQ ID NO: 69139 - protein, 9 aa, Homo sapiens
  light chain complementarity determining region 3 for antibody 34570
MQALETPFT

SEQ ID NO: 69140 - protein, 15 aa, Homo sapiens
  heavy chain complementarity determining region 3 for antibody 34570
VSHYRETVAGIEGDS

SEQ ID NO: 69141 - protein, 9 aa, Homo sapiens
  light chain complementarity determining region 3 for antibody 34571
MQALETPFT

SEQ ID NO: 69142 - protein, 15 aa, Homo sapiens
  heavy chain complementarity determining region 3 for antibody 34571
VRHYRLTVAGIEGDS

SEQ ID NO: 69143 - protein, 9 aa, Homo sapiens
  light chain complementarity determining region 3 for antibody 34572
LQYYATPGT

SEQ ID NO: 69144 - protein, 15 aa, Homo sapiens
  heavy chain complementarity determining region 3 for antibody 34572
VRQSKVDNNYNYPDF

SEQ ID NO: 69145 - protein, 9 aa, Homo sapiens
  light chain complementarity determining region 3 for antibody 34573
LQYNSYPRT

SEQ ID NO: 69146 - protein, 6 aa, Homo sapiens
  heavy chain complementarity determining region 3 for antibody 34573
SRALDY

SEQ ID NO: 69147 - protein, 9 aa, Homo sapiens
  light chain complementarity determining region 3 for antibody 34574
LQYKIYPYT

SEQ ID NO: 69148 - protein, 12 aa, Homo sapiens
  heavy chain complementarity determining region 3 for antibody 34574
TRTIAGATILDF

SEQ ID NO: 69149 - protein, 9 aa, Homo sapiens
  light chain complementarity determining region 3 for antibody 34575
LQSHSTPLT

SEQ ID NO: 69150 - protein, 16 aa, Homo sapiens
  heavy chain complementarity determining region 3 for antibody 34575
AKGDGRFYLDSSGPAR

SEQ ID NO: 69151 - protein, 9 aa, Homo sapiens
  light chain complementarity determining region 3 for antibody 34576
LQRYNFPWT

SEQ ID NO: 69152 - protein, 12 aa, Homo sapiens
  heavy chain complementarity determining region 3 for antibody 34576
ARHLRVPERLDS

SEQ ID NO: 69153 - protein, 9 aa, Homo sapiens
  light chain complementarity determining region 3 for antibody 34577
LQHSISPRP

SEQ ID NO: 69154 - protein, 11 aa, Homo sapiens
  heavy chain complementarity determining region 3 for antibody 34577
TTGLGSGGINW

SEQ ID NO: 69155 - protein, 9 aa, Homo sapiens
  light chain complementarity determining region 3 for antibody 34578
LQHNSYPLT

SEQ ID NO: 69156 - protein, 17 aa, Homo sapiens
  heavy chain complementarity determining region 3 for antibody 34578
ARGTRRGYCSAGSCFGY

SEQ ID NO: 69157 - protein, 9 aa, Homo sapiens
  light chain complementarity determining region 3 for antibody 34579
LQDYNYPRT

SEQ ID NO: 69158 - protein, 19 aa, Homo sapiens
  heavy chain complementarity determining region 3 for antibody 34579
ARDDSHQDSSGYWYDALDF

SEQ ID NO: 69159 - protein, 9 aa, Homo sapiens
  light chain complementarity determining region 3 for antibody 34580
LQAYDYPLT

SEQ ID NO: 69160 - protein, 18 aa, Homo sapiens
  heavy chain complementarity determining region 3 for antibody 34580
ARSLYHSVSGAYYDAFDI

SEQ ID NO: 69161 - protein, 9 aa, Homo sapiens
  light chain complementarity determining region 3 for antibody 34581
KQYYTTPLT

SEQ ID NO: 69162 - protein, 14 aa, Homo sapiens
  heavy chain complementarity determining region 3 for antibody 34581
AKDRIAVGISVWDY

SEQ ID NO: 69163 - protein, 8 aa, Homo sapiens
  light chain complementarity determining region 3 for antibody 34582
KQYGGSPS

SEQ ID NO: 69164 - protein, 16 aa, Homo sapiens
  heavy chain complementarity determining region 3 for antibody 34582
ATDWGSGTQWIRAFDV

SEQ ID NO: 69165 - protein, 9 aa, Homo sapiens
  light chain complementarity determining region 3 for antibody 34583
KQYFTTPLT

SEQ ID NO: 69166 - protein, 14 aa, Homo sapiens
  heavy chain complementarity determining region 3 for antibody 34583
AKDRIAVGISVWEY

SEQ ID NO: 69167 - protein, 9 aa, Homo sapiens
  light chain complementarity determining region 3 for antibody 34584
HQYNTYPWT

SEQ ID NO: 69168 - protein, 12 aa, Homo sapiens
  heavy chain complementarity determining region 3 for antibody 34584
VPPVSSYIPLDS

SEQ ID NO: 69169 - protein, 9 aa, Homo sapiens
  light chain complementarity determining region 3 for antibody 34585
HQYNRYSYT

SEQ ID NO: 69170 - protein, 15 aa, Homo sapiens
  heavy chain complementarity determining region 3 for antibody 34585
ARENDSGGSERAFDI

SEQ ID NO: 69171 - protein, 11 aa, Homo sapiens
  light chain complementarity determining region 3 for antibody 34586
RQYSTSPIMYP

SEQ ID NO: 69172 - protein, 13 aa, Homo sapiens
  heavy chain complementarity determining region 3 for antibody 34586
ARDRGEFTYAHDY

SEQ ID NO: 69173 - protein, 9 aa, Homo sapiens
  light chain complementarity determining region 3 for antibody 34587
RQHSISPRT

SEQ ID NO: 69174 - protein, 11 aa, Homo sapiens
  heavy chain complementarity determining region 3 for antibody 34587
TTGLGSGGINW

SEQ ID NO: 69175 - protein, 9 aa, Homo sapiens
  light chain complementarity determining region 3 for antibody 34588
RQALQTPYT

SEQ ID NO: 69176 - protein, 21 aa, Homo sapiens
  heavy chain complementarity determining region 3 for antibody 34588
ARDAPVSRPYSSGWYSSAFDY

SEQ ID NO: 69177 - protein, 9 aa, Homo sapiens
  light chain complementarity determining region 3 for antibody 34589
RQALQTPFT

SEQ ID NO: 69178 - protein, 13 aa, Homo sapiens
  heavy chain complementarity determining region 3 for antibody 34589
ARAITKAGSGFDY

SEQ ID NO: 69179 - protein, 9 aa, Homo sapiens
  light chain complementarity determining region 3 for antibody 34590
QQYYTVPPT

SEQ ID NO: 69180 - protein, 13 aa, Homo sapiens
  heavy chain complementarity determining region 3 for antibody 34590
AREMDSKGGGFDV

SEQ ID NO: 69181 - protein, 9 aa, Homo sapiens
  light chain complementarity determining region 3 for antibody 34591
QQYYTTPLT

SEQ ID NO: 69182 - protein, 14 aa, Homo sapiens
  heavy chain complementarity determining region 3 for antibody 34591
AKDRIAVGISVWEY

SEQ ID NO: 69183 - protein, 9 aa, Homo sapiens
  light chain complementarity determining region 3 for antibody 34592
QQYYSTPGT

SEQ ID NO: 69184 - protein, 15 aa, Homo sapiens
  heavy chain complementarity determining region 3 for antibody 34592
IRQSKVDGNYNYPDF

SEQ ID NO: 69185 - protein, 9 aa, Homo sapiens
  light chain complementarity determining region 3 for antibody 34593
QQYYSAPYT

SEQ ID NO: 69186 - protein, 11 aa, Homo sapiens
  heavy chain complementarity determining region 3 for antibody 34593
TLGPGTTSFDY

SEQ ID NO: 69187 - protein, 9 aa, Homo sapiens
  light chain complementarity determining region 3 for antibody 34594
QQYYRGPPT

SEQ ID NO: 69188 - protein, 16 aa, Homo sapiens
  heavy chain complementarity determining region 3 for antibody 34594
TTERAWDWDDAKYFDV

SEQ ID NO: 69189 - protein, 10 aa, Homo sapiens
  light chain complementarity determining region 3 for antibody 34595
QQYSGSPALT

SEQ ID NO: 69190 - protein, 15 aa, Homo sapiens
  heavy chain complementarity determining region 3 for antibody 34595
AKDAWYSSGWYFFDH

SEQ ID NO: 69191 - protein, 9 aa, Homo sapiens
  light chain complementarity determining region 3 for antibody 34596
QQYSATPYT

SEQ ID NO: 69192 - protein, 13 aa, Homo sapiens
  heavy chain complementarity determining region 3 for antibody 34596
VRGGDYMPKGLDY

SEQ ID NO: 69193 - protein, 9 aa, Homo sapiens
  light chain complementarity determining region 3 for antibody 34597
QQYRGDPNS

SEQ ID NO: 69194 - protein, 20 aa, Homo sapiens
  heavy chain complementarity determining region 3 for antibody 34597
ARDVDYCENGVCYSYWYFDL

SEQ ID NO: 69195 - protein, 9 aa, Homo sapiens
  light chain complementarity determining region 3 for antibody 34598
QQYQLIPLT

SEQ ID NO: 69196 - protein, 8 aa, Homo sapiens
  heavy chain complementarity determining region 3 for antibody 34598
ASGWGLAS

SEQ ID NO: 69197 - protein, 9 aa, Homo sapiens
  light chain complementarity determining region 3 for antibody 34599
QQYNSYSRT

SEQ ID NO: 69198 - protein, 17 aa, Homo sapiens
  heavy chain complementarity determining region 3 for antibody 34599
ARDKARDYNSSPRACDH

SEQ ID NO: 69199 - protein, 10 aa, Homo sapiens
  light chain complementarity determining region 3 for antibody 34600
QQYNSYSEST

SEQ ID NO: 69200 - protein, 12 aa, Homo sapiens
  heavy chain complementarity determining region 3 for antibody 34600
AKADGDYACFDH

SEQ ID NO: 69201 - protein, 9 aa, Homo sapiens
  light chain complementarity determining region 3 for antibody 34601
QQYNNWPYT

SEQ ID NO: 69202 - protein, 16 aa, Homo sapiens
  heavy chain complementarity determining region 3 for antibody 34601
AKYVVAGQNYYFGMDV

SEQ ID NO: 69203 - protein, 10 aa, Homo sapiens
  light chain complementarity determining region 3 for antibody 34602
QQYNDWPPLT

SEQ ID NO: 69204 - protein, 14 aa, Homo sapiens
  heavy chain complementarity determining region 3 for antibody 34602
AGGENRGLFWFFGL

SEQ ID NO: 69205 - protein, 9 aa, Homo sapiens
  light chain complementarity determining region 3 for antibody 34603
QQYLVLPLT

SEQ ID NO: 69206 - protein, 15 aa, Homo sapiens
  heavy chain complementarity determining region 3 for antibody 34603
AKDGGPYINRWYRNE

SEQ ID NO: 69207 - protein, 9 aa, Homo sapiens
  light chain complementarity determining region 3 for antibody 34604
QQYISSPQT

SEQ ID NO: 69208 - protein, 11 aa, Homo sapiens
  heavy chain complementarity determining region 3 for antibody 34604
ARKPTGMALDY

SEQ ID NO: 69209 - protein, 9 aa, Homo sapiens
  light chain complementarity determining region 3 for antibody 34605
QQYHSWPYT

SEQ ID NO: 69210 - protein, 11 aa, Homo sapiens
  heavy chain complementarity determining region 3 for antibody 34605
GGFYHGGPCGY

SEQ ID NO: 69211 - protein, 10 aa, Homo sapiens
  light chain complementarity determining region 3 for antibody 34606
QQYHDWPPPT

SEQ ID NO: 69212 - protein, 14 aa, Homo sapiens
  heavy chain complementarity determining region 3 for antibody 34606
SSVRTWQLGGTFDI

SEQ ID NO: 69213 - protein, 9 aa, Homo sapiens
  light chain complementarity determining region 3 for antibody 34607
QQYGTPPRT

SEQ ID NO: 69214 - protein, 25 aa, Homo sapiens
  heavy chain complementarity determining region 3 for antibody 34607
ARRRVDRLRLPGAMRGPLYDRGLNV

SEQ ID NO: 69215 - protein, 9 aa, Homo sapiens
  light chain complementarity determining region 3 for antibody 34608
QQYGTPPLN

SEQ ID NO: 69216 - protein, 13 aa, Homo sapiens
  heavy chain complementarity determining region 3 for antibody 34608
ASISVGTVAAGKG

SEQ ID NO: 69217 - protein, 9 aa, Homo sapiens
  light chain complementarity determining region 3 for antibody 34609
QQYGTIPRT

SEQ ID NO: 69218 - protein, 13 aa, Homo sapiens
  heavy chain complementarity determining region 3 for antibody 34609
AGGIFHSRGYGDY

SEQ ID NO: 69219 - protein, 10 aa, Homo sapiens
  light chain complementarity determining region 3 for antibody 34610
QQYGSSTGDT

SEQ ID NO: 69220 - protein, 11 aa, Homo sapiens
  heavy chain complementarity determining region 3 for antibody 34610
ASDHSGWSLYY

SEQ ID NO: 69221 - protein, 9 aa, Homo sapiens
  light chain complementarity determining region 3 for antibody 34611
QQYGSSPWT

SEQ ID NO: 69222 - protein, 22 aa, Homo sapiens
  heavy chain complementarity determining region 3 for antibody 34611
ARAPAGTTIFGVVMGEIEYFQH

SEQ ID NO: 69223 - protein, 9 aa, Homo sapiens
  light chain complementarity determining region 3 for antibody 34612
QQYGSSPWT

SEQ ID NO: 69224 - protein, 17 aa, Homo sapiens
  heavy chain complementarity determining region 3 for antibody 34612
ARALDIVVVVDAIWFDP

SEQ ID NO: 69225 - protein, 9 aa, Homo sapiens
  light chain complementarity determining region 3 for antibody 34613
QQYGSSPTP

SEQ ID NO: 69226 - protein, 17 aa, Homo sapiens
  heavy chain complementarity determining region 3 for antibody 34613
ARDLGTYDATRHWYFDL

SEQ ID NO: 69227 - protein, 10 aa, Homo sapiens
  light chain complementarity determining region 3 for antibody 34614
QQYGSSPRYS

SEQ ID NO: 69228 - protein, 11 aa, Homo sapiens
  heavy chain complementarity determining region 3 for antibody 34614
ARGGQWGSLDY

SEQ ID NO: 69229 - protein, 9 aa, Homo sapiens
  light chain complementarity determining region 3 for antibody 34615
QQYGSSPRT

SEQ ID NO: 69230 - protein, 15 aa, Homo sapiens
  heavy chain complementarity determining region 3 for antibody 34615
VRHYRETVAGIEGDS

SEQ ID NO: 69231 - protein, 9 aa, Homo sapiens
  light chain complementarity determining region 3 for antibody 34616
QQYGSSPRT

SEQ ID NO: 69232 - protein, 18 aa, Homo sapiens
  heavy chain complementarity determining region 3 for antibody 34616
ATAFWVGMGVPPPGFFEY

SEQ ID NO: 69233 - protein, 9 aa, Homo sapiens
  light chain complementarity determining region 3 for antibody 34617
QQYGSSPRT

SEQ ID NO: 69234 - protein, 25 aa, Homo sapiens
  heavy chain complementarity determining region 3 for antibody 34617
ARLRIDRLRLPGAMRGPLYDCGLHV

SEQ ID NO: 69235 - protein, 9 aa, Homo sapiens
  light chain complementarity determining region 3 for antibody 34618
QQYGSSPRT

SEQ ID NO: 69236 - protein, 17 aa, Homo sapiens
  heavy chain complementarity determining region 3 for antibody 34618
ARDRAGSGSYGYYGMDV

SEQ ID NO: 69237 - protein, 9 aa, Homo sapiens
  light chain complementarity determining region 3 for antibody 34619
QQYGSSPRT

SEQ ID NO: 69238 - protein, 17 aa, Homo sapiens
  heavy chain complementarity determining region 3 for antibody 34619
ARALDIVVVVDAIWCDP

SEQ ID NO: 69239 - protein, 9 aa, Homo sapiens
  light chain complementarity determining region 3 for antibody 34620
QQYGSSPRT

SEQ ID NO: 69240 - protein, 17 aa, Homo sapiens
  heavy chain complementarity determining region 3 for antibody 34620
AGALDIVVVVDAIWFDP

SEQ ID NO: 69241 - protein, 9 aa, Homo sapiens
  light chain complementarity determining region 3 for antibody 34621
QQYGSSPLT

SEQ ID NO: 69242 - protein, 20 aa, Homo sapiens
  heavy chain complementarity determining region 3 for antibody 34621
AKAKTQLVLADGQRAYYFDS

SEQ ID NO: 69243 - protein, 10 aa, Homo sapiens
  light chain complementarity determining region 3 for antibody 34622
QQYGSPSMYT

SEQ ID NO: 69244 - protein, 19 aa, Homo sapiens
  heavy chain complementarity determining region 3 for antibody 34622
AKDQLMFYYDNSGYPGADY

SEQ ID NO: 69245 - protein, 9 aa, Homo sapiens
  light chain complementarity determining region 3 for antibody 34623
QQYGSLPRT

SEQ ID NO: 69246 - protein, 13 aa, Homo sapiens
  heavy chain complementarity determining region 3 for antibody 34623
ALGHYHTTGYSEF

SEQ ID NO: 69247 - protein, 9 aa, Homo sapiens
  light chain complementarity determining region 3 for antibody 34624
QQYGSLPRT

SEQ ID NO: 69248 - protein, 13 aa, Homo sapiens
  heavy chain complementarity determining region 3 for antibody 34624
AGGIFDSSGYGEY

SEQ ID NO: 69249 - protein, 9 aa, Homo sapiens
  light chain complementarity determining region 3 for antibody 34625
QQYGSIPRT

SEQ ID NO: 69250 - protein, 9 aa, Homo sapiens
  heavy chain complementarity determining region 3 for antibody 34625
AREYSASDY

SEQ ID NO: 69251 - protein, 9 aa, Homo sapiens
  light chain complementarity determining region 3 for antibody 34626
QQYGSAPRT

SEQ ID NO: 69252 - protein, 25 aa, Homo sapiens
  heavy chain complementarity determining region 3 for antibody 34626
ARLRIDRLRLPGAMRGPLYDCGLNV

SEQ ID NO: 69253 - protein, 9 aa, Homo sapiens
  light chain complementarity determining region 3 for antibody 34627
QQYGRSSLT

SEQ ID NO: 69254 - protein, 19 aa, Homo sapiens
  heavy chain complementarity determining region 3 for antibody 34627
ARDRIVVGATFYAYSGMDV

SEQ ID NO: 69255 - protein, 9 aa, Homo sapiens
  light chain complementarity determining region 3 for antibody 34628
QQYGRSPRT

SEQ ID NO: 69256 - protein, 17 aa, Homo sapiens
  heavy chain complementarity determining region 3 for antibody 34628
ARALDIVVVVDAIWFDP

SEQ ID NO: 69257 - protein, 9 aa, Homo sapiens
  light chain complementarity determining region 3 for antibody 34629
QQYGNSPFP

SEQ ID NO: 69258 - protein, 15 aa, Homo sapiens
  heavy chain complementarity determining region 3 for antibody 34629
ARQKGQRASAGYFDS

SEQ ID NO: 69259 - protein, 9 aa, Homo sapiens
  light chain complementarity determining region 3 for antibody 34630
QQYGGSPWT

SEQ ID NO: 69260 - protein, 15 aa, Homo sapiens
  heavy chain complementarity determining region 3 for antibody 34630
ARPTGIYYSHYAIDV

SEQ ID NO: 69261 - protein, 8 aa, Homo sapiens
  light chain complementarity determining region 3 for antibody 34631
QQYGGSPS

SEQ ID NO: 69262 - protein, 16 aa, Homo sapiens
  heavy chain complementarity determining region 3 for antibody 34631
ATDWGSGTQWMRAFDV

SEQ ID NO: 69263 - protein, 8 aa, Homo sapiens
  light chain complementarity determining region 3 for antibody 34632
QQYGGSPS

SEQ ID NO: 69264 - protein, 16 aa, Homo sapiens
  heavy chain complementarity determining region 3 for antibody 34632
ATDWGGGTQWIRAFDV

SEQ ID NO: 69265 - protein, 9 aa, Homo sapiens
  light chain complementarity determining region 3 for antibody 34633
QQYGGSPRT

SEQ ID NO: 69266 - protein, 13 aa, Homo sapiens
  heavy chain complementarity determining region 3 for antibody 34633
ASGYFDSGAYFEF

SEQ ID NO: 69267 - protein, 9 aa, Homo sapiens
  light chain complementarity determining region 3 for antibody 34634
QQYGGSPQT

SEQ ID NO: 69268 - protein, 15 aa, Homo sapiens
  heavy chain complementarity determining region 3 for antibody 34634
ATNPTFYESSGYIPY

SEQ ID NO: 69269 - protein, 11 aa, Homo sapiens
  light chain complementarity determining region 3 for antibody 34635
QQYGGSPPGIP

SEQ ID NO: 69270 - protein, 13 aa, Homo sapiens
  heavy chain complementarity determining region 3 for antibody 34635
AKYRGGYTYAIES

SEQ ID NO: 69271 - protein, 9 aa, Homo sapiens
  light chain complementarity determining region 3 for antibody 34636
QQYGGLPRT

SEQ ID NO: 69272 - protein, 13 aa, Homo sapiens
  heavy chain complementarity determining region 3 for antibody 34636
ASGYFDSGAYYEF

SEQ ID NO: 69273 - protein, 9 aa, Homo sapiens
  light chain complementarity determining region 3 for antibody 34637
QQYGGLPRT

SEQ ID NO: 69274 - protein, 12 aa, Homo sapiens
  heavy chain complementarity determining region 3 for antibody 34637
AALRYFDWYFNS

SEQ ID NO: 69275 - protein, 9 aa, Homo sapiens
  light chain complementarity determining region 3 for antibody 34638
QQYFTTPRT

SEQ ID NO: 69276 - protein, 8 aa, Homo sapiens
  heavy chain complementarity determining region 3 for antibody 34638
ARDGAFDS

SEQ ID NO: 69277 - protein, 9 aa, Homo sapiens
  light chain complementarity determining region 3 for antibody 34639
QQYEAYPLT

SEQ ID NO: 69278 - protein, 18 aa, Homo sapiens
  heavy chain complementarity determining region 3 for antibody 34639
AQERDGYCDSHACYGLDV

SEQ ID NO: 69279 - protein, 9 aa, Homo sapiens
  light chain complementarity determining region 3 for antibody 34640
QQYDTSPWT

SEQ ID NO: 69280 - protein, 9 aa, Homo sapiens
  heavy chain complementarity determining region 3 for antibody 34640
ATGGGSYSH

SEQ ID NO: 69281 - protein, 9 aa, Homo sapiens
  light chain complementarity determining region 3 for antibody 34641
QQYDSYPWT

SEQ ID NO: 69282 - protein, 11 aa, Homo sapiens
  heavy chain complementarity determining region 3 for antibody 34641
ARDASSRSFYY

SEQ ID NO: 69283 - protein, 9 aa, Homo sapiens
  light chain complementarity determining region 3 for antibody 34642
QQYDSYLLS

SEQ ID NO: 69284 - protein, 14 aa, Homo sapiens
  heavy chain complementarity determining region 3 for antibody 34642
ARLGCFRDHYGMDV

SEQ ID NO: 69285 - protein, 9 aa, Homo sapiens
  light chain complementarity determining region 3 for antibody 34643
QQYDRSPGT

SEQ ID NO: 69286 - protein, 12 aa, Homo sapiens
  heavy chain complementarity determining region 3 for antibody 34643
ARPLYNSGFFEY

SEQ ID NO: 69287 - protein, 9 aa, Homo sapiens
  light chain complementarity determining region 3 for antibody 34644
QQYDNWPRT

SEQ ID NO: 69288 - protein, 15 aa, Homo sapiens
  heavy chain complementarity determining region 3 for antibody 34644
AKEGQLWSSLDAFDI

SEQ ID NO: 69289 - protein, 10 aa, Homo sapiens
  light chain complementarity determining region 3 for antibody 34645
QQYDNWPPWT

SEQ ID NO: 69290 - protein, 6 aa, Homo sapiens
  heavy chain complementarity determining region 3 for antibody 34645
TTIYEF

SEQ ID NO: 69291 - protein, 11 aa, Homo sapiens
  light chain complementarity determining region 3 for antibody 34646
QQYDNSALEFP

SEQ ID NO: 69292 - protein, 15 aa, Homo sapiens
  heavy chain complementarity determining region 3 for antibody 34646
VREVVTMIEPGGFDV

SEQ ID NO: 69293 - protein, 9 aa, Homo sapiens
  light chain complementarity determining region 3 for antibody 34647
QQYDILPWT

SEQ ID NO: 69294 - protein, 12 aa, Homo sapiens
  heavy chain complementarity determining region 3 for antibody 34647
ARGLSSGWALDY

SEQ ID NO: 69295 - protein, 8 aa, Homo sapiens
  light chain complementarity determining region 3 for antibody 34648
QQYCGSPS

SEQ ID NO: 69296 - protein, 16 aa, Homo sapiens
  heavy chain complementarity determining region 3 for antibody 34648
ATDWGSGTQWIRAFDV

SEQ ID NO: 69297 - protein, 11 aa, Homo sapiens
  light chain complementarity determining region 3 for antibody 34649
QQYAPSPEKYP

SEQ ID NO: 69298 - protein, 13 aa, Homo sapiens
  heavy chain complementarity determining region 3 for antibody 34649
AREEMIGGSPFDF

SEQ ID NO: 69299 - protein, 9 aa, Homo sapiens
  light chain complementarity determining region 3 for antibody 34650
QQYANTPWT

SEQ ID NO: 69300 - protein, 11 aa, Homo sapiens
  heavy chain complementarity determining region 3 for antibody 34650
ATWAFRHGVDV

SEQ ID NO: 69301 - protein, 9 aa, Homo sapiens
  light chain complementarity determining region 3 for antibody 34651
QQYAKSPRT

SEQ ID NO: 69302 - protein, 13 aa, Homo sapiens
  heavy chain complementarity determining region 3 for antibody 34651
ARDSADYGDPLDY

SEQ ID NO: 69303 - protein, 9 aa, Homo sapiens
  light chain complementarity determining region 3 for antibody 34652
QQSYTSPYP

SEQ ID NO: 69304 - protein, 16 aa, Homo sapiens
  heavy chain complementarity determining region 3 for antibody 34652
ATDWGSGTQWIRAFDV

SEQ ID NO: 69305 - protein, 9 aa, Homo sapiens
  light chain complementarity determining region 3 for antibody 34653
QQSYSYLLT

SEQ ID NO: 69306 - protein, 16 aa, Homo sapiens
  heavy chain complementarity determining region 3 for antibody 34653
AREGGSTYTTKRAFDS

SEQ ID NO: 69307 - protein, 9 aa, Homo sapiens
  light chain complementarity determining region 3 for antibody 34654
QQSYSTPRT

SEQ ID NO: 69308 - protein, 12 aa, Homo sapiens
  heavy chain complementarity determining region 3 for antibody 34654
ARPPYSGIDFDS

SEQ ID NO: 69309 - protein, 9 aa, Homo sapiens
  light chain complementarity determining region 3 for antibody 34655
QQSYSTPRT

SEQ ID NO: 69310 - protein, 20 aa, Homo sapiens
  heavy chain complementarity determining region 3 for antibody 34655
ARESGVFPFFDWLPHTWFDP

SEQ ID NO: 69311 - protein, 8 aa, Homo sapiens
  light chain complementarity determining region 3 for antibody 34656
QQSYSTPA

SEQ ID NO: 69312 - protein, 11 aa, Homo sapiens
  heavy chain complementarity determining region 3 for antibody 34656
TRLIDRGSSDR

SEQ ID NO: 69313 - protein, 9 aa, Homo sapiens
  light chain complementarity determining region 3 for antibody 34657
QQSYSSLLT

SEQ ID NO: 69314 - protein, 16 aa, Homo sapiens
  heavy chain complementarity determining region 3 for antibody 34657
AREGGSTYTAKRAFDS

SEQ ID NO: 69315 - protein, 9 aa, Homo sapiens
  light chain complementarity determining region 3 for antibody 34658
QQSYSIPIT

SEQ ID NO: 69316 - protein, 16 aa, Homo sapiens
  heavy chain complementarity determining region 3 for antibody 34658
TTDWGTGTHNVNAFDI

SEQ ID NO: 69317 - protein, 8 aa, Homo sapiens
  light chain complementarity determining region 3 for antibody 34659
QQSYSALP

SEQ ID NO: 69318 - protein, 24 aa, Homo sapiens
  heavy chain complementarity determining region 3 for antibody 34659
ARGRPPSGWYRLKDRTYYYYGLDV

SEQ ID NO: 69319 - protein, 9 aa, Homo sapiens
  light chain complementarity determining region 3 for antibody 34660
QQSNRTPYT

SEQ ID NO: 69320 - protein, 13 aa, Homo sapiens
  heavy chain complementarity determining region 3 for antibody 34660
AKGYTAWAFYFDF

SEQ ID NO: 69321 - protein, 8 aa, Homo sapiens
  light chain complementarity determining region 3 for antibody 34661
QQSIGTRT

SEQ ID NO: 69322 - protein, 14 aa, Homo sapiens
  heavy chain complementarity determining region 3 for antibody 34661
AREADTGYGYYCDL

SEQ ID NO: 69323 - protein, 9 aa, Homo sapiens
  light chain complementarity determining region 3 for antibody 34662
QQSFTTLVT

SEQ ID NO: 69324 - protein, 11 aa, Homo sapiens
  heavy chain complementarity determining region 3 for antibody 34662
ARGGNWNYFNQ

SEQ ID NO: 69325 - protein, 10 aa, Homo sapiens
  light chain complementarity determining region 3 for antibody 34663
QQRYSWPPLP

SEQ ID NO: 69326 - protein, 14 aa, Homo sapiens
  heavy chain complementarity determining region 3 for antibody 34663
AKGANLHHPYYFDY

SEQ ID NO: 69327 - protein, 10 aa, Homo sapiens
  light chain complementarity determining region 3 for antibody 34664
QQRYNWPPFT

SEQ ID NO: 69328 - protein, 11 aa, Homo sapiens
  heavy chain complementarity determining region 3 for antibody 34664
ARGVGSYVFES

SEQ ID NO: 69329 - protein, 10 aa, Homo sapiens
  light chain complementarity determining region 3 for antibody 34665
QQRYKWPPYP

SEQ ID NO: 69330 - protein, 11 aa, Homo sapiens
  heavy chain complementarity determining region 3 for antibody 34665
ARGVGSYVFDS

SEQ ID NO: 69331 - protein, 10 aa, Homo sapiens
  light chain complementarity determining region 3 for antibody 34666
QQRYKWHPYT

SEQ ID NO: 69332 - protein, 11 aa, Homo sapiens
  heavy chain complementarity determining region 3 for antibody 34666
ARGVGSYVFES

SEQ ID NO: 69333 - protein, 9 aa, Homo sapiens
  light chain complementarity determining region 3 for antibody 34667
QQRTNWRFT

SEQ ID NO: 69334 - protein, 16 aa, Homo sapiens
  heavy chain complementarity determining region 3 for antibody 34667
ARDQGFCRGPNCYMRF

SEQ ID NO: 69335 - protein, 8 aa, Homo sapiens
  light chain complementarity determining region 3 for antibody 34668
QQRTNWLT

SEQ ID NO: 69336 - protein, 21 aa, Homo sapiens
  heavy chain complementarity determining region 3 for antibody 34668
SRVWVRAAAGPRNYYYYGLDV

SEQ ID NO: 69337 - protein, 9 aa, Homo sapiens
  light chain complementarity determining region 3 for antibody 34669
QQRSNWRDT

SEQ ID NO: 69338 - protein, 12 aa, Homo sapiens
  heavy chain complementarity determining region 3 for antibody 34669
VKDCGLGGSRDS

SEQ ID NO: 69339 - protein, 9 aa, Homo sapiens
  light chain complementarity determining region 3 for antibody 34670
QQRSNWPQT

SEQ ID NO: 69340 - protein, 23 aa, Homo sapiens
  heavy chain complementarity determining region 3 for antibody 34670
ARGHTFYDYVWGSYRSSLNYFDY

SEQ ID NO: 69341 - protein, 9 aa, Homo sapiens
  light chain complementarity determining region 3 for antibody 34671
QQRSNWPPT

SEQ ID NO: 69342 - protein, 20 aa, Homo sapiens
  heavy chain complementarity determining region 3 for antibody 34671
ARLPPVAARKRSYYYYGMDV

SEQ ID NO: 69343 - protein, 9 aa, Homo sapiens
  light chain complementarity determining region 3 for antibody 34672
QQRSNWLWT

SEQ ID NO: 69344 - protein, 18 aa, Homo sapiens
  heavy chain complementarity determining region 3 for antibody 34672
AKEIGYCSGGSCYGGADY

SEQ ID NO: 69345 - protein, 10 aa, Homo sapiens
  light chain complementarity determining region 3 for antibody 34673
QQRSKWPPYT

SEQ ID NO: 69346 - protein, 11 aa, Homo sapiens
  heavy chain complementarity determining region 3 for antibody 34673
ARGVGSYVFES

SEQ ID NO: 69347 - protein, 10 aa, Homo sapiens
  light chain complementarity determining region 3 for antibody 34674
QQRSDWPPST

SEQ ID NO: 69348 - protein, 18 aa, Homo sapiens
  heavy chain complementarity determining region 3 for antibody 34674
AREGRSGYRIPAAYGMDV

SEQ ID NO: 69349 - protein, 10 aa, Homo sapiens
  light chain complementarity determining region 3 for antibody 34675
QQRSDWPPLP

SEQ ID NO: 69350 - protein, 10 aa, Homo sapiens
  heavy chain complementarity determining region 3 for antibody 34675
ARDYSMTFDY

SEQ ID NO: 69351 - protein, 9 aa, Homo sapiens
  light chain complementarity determining region 3 for antibody 34676
QQRNRTPYT

SEQ ID NO: 69352 - protein, 14 aa, Homo sapiens
  heavy chain complementarity determining region 3 for antibody 34676
ATEGPSRMGKFFDS

SEQ ID NO: 69353 - protein, 9 aa, Homo sapiens
  light chain complementarity determining region 3 for antibody 34677
QQRLNWPLT

SEQ ID NO: 69354 - protein, 11 aa, Homo sapiens
  heavy chain complementarity determining region 3 for antibody 34677
ARNILGGHPDF

SEQ ID NO: 69355 - protein, 11 aa, Homo sapiens
  light chain complementarity determining region 3 for antibody 34678
QQRGNWPPKVT

SEQ ID NO: 69356 - protein, 17 aa, Homo sapiens
  heavy chain complementarity determining region 3 for antibody 34678
ATARPDYYDSSGSSFDY

SEQ ID NO: 69357 - protein, 10 aa, Homo sapiens
  light chain complementarity determining region 3 for antibody 34679
QQRGIWPEMS

SEQ ID NO: 69358 - protein, 14 aa, Homo sapiens
  heavy chain complementarity determining region 3 for antibody 34679
AKDHDSNISGFGDL

SEQ ID NO: 69359 - protein, 8 aa, Homo sapiens
  light chain complementarity determining region 3 for antibody 34680
QQNNSLYT

SEQ ID NO: 69360 - protein, 14 aa, Homo sapiens
  heavy chain complementarity determining region 3 for antibody 34680
ARENSISRKRSFDQ

SEQ ID NO: 69361 - protein, 9 aa, Homo sapiens
  light chain complementarity determining region 3 for antibody 34681
QQNGSSPTT

SEQ ID NO: 69362 - protein, 17 aa, Homo sapiens
  heavy chain complementarity determining region 3 for antibody 34681
ARDLGTYDATRHWYFDL

SEQ ID NO: 69363 - protein, 8 aa, Homo sapiens
  light chain complementarity determining region 3 for antibody 34682
QQNGGSPR

SEQ ID NO: 69364 - protein, 16 aa, Homo sapiens
  heavy chain complementarity determining region 3 for antibody 34682
ATDWGSGTQWIRAFDV

SEQ ID NO: 69365 - protein, 9 aa, Homo sapiens
  light chain complementarity determining region 3 for antibody 34683
QQNFNTPRT

SEQ ID NO: 69366 - protein, 15 aa, Homo sapiens
  heavy chain complementarity determining region 3 for antibody 34683
ARDFEVEWEVAPFDL

SEQ ID NO: 69367 - protein, 8 aa, Homo sapiens
  light chain complementarity determining region 3 for antibody 34684
QQHYNSWT

SEQ ID NO: 69368 - protein, 17 aa, Homo sapiens
  heavy chain complementarity determining region 3 for antibody 34684
VKDRGYSGYDSLGFFDD

SEQ ID NO: 69369 - protein, 8 aa, Homo sapiens
  light chain complementarity determining region 3 for antibody 34685
QQHSDLIT

SEQ ID NO: 69370 - protein, 18 aa, Homo sapiens
  heavy chain complementarity determining region 3 for antibody 34685
ASGRNPHSSAWFAYYFDL

SEQ ID NO: 69371 - protein, 9 aa, Homo sapiens
  light chain complementarity determining region 3 for antibody 34686
QQHNFYPFT

SEQ ID NO: 69372 - protein, 11 aa, Homo sapiens
  heavy chain complementarity determining region 3 for antibody 34686
ARGGSRREIDY

SEQ ID NO: 69373 - protein, 9 aa, Homo sapiens
  light chain complementarity determining region 3 for antibody 34687
QQHGTPPRT

SEQ ID NO: 69374 - protein, 25 aa, Homo sapiens
  heavy chain complementarity determining region 3 for antibody 34687
ARLRVDRLRLPGAMRGPLYDRGLNV

SEQ ID NO: 69375 - protein, 9 aa, Homo sapiens
  light chain complementarity determining region 3 for antibody 34688
QQHGSSPRT

SEQ ID NO: 69376 - protein, 17 aa, Homo sapiens
  heavy chain complementarity determining region 3 for antibody 34688
ARALDIVVVVDAIWFDP

SEQ ID NO: 69377 - protein, 9 aa, Homo sapiens
  light chain complementarity determining region 3 for antibody 34689
QQGYSSPLI

SEQ ID NO: 69378 - protein, 15 aa, Homo sapiens
  heavy chain complementarity determining region 3 for antibody 34689
ARAQVIWGQLYYFDC

SEQ ID NO: 69379 - protein, 9 aa, Homo sapiens
  light chain complementarity determining region 3 for antibody 34690
QQGYSNPLT

SEQ ID NO: 69380 - protein, 16 aa, Homo sapiens
  heavy chain complementarity determining region 3 for antibody 34690
ARGTFYQGSSDNYHEN

SEQ ID NO: 69381 - protein, 8 aa, Homo sapiens
  light chain complementarity determining region 3 for antibody 34691
QQGYNWFI

SEQ ID NO: 69382 - protein, 21 aa, Homo sapiens
  heavy chain complementarity determining region 3 for antibody 34691
ARNDPDNTQGGHTSGNKYLDQ

SEQ ID NO: 69383 - protein, 11 aa, Homo sapiens
  light chain complementarity determining region 3 for antibody 34692
QQFNNYPRELT

SEQ ID NO: 69384 - protein, 14 aa, Homo sapiens
  heavy chain complementarity determining region 3 for antibody 34692
ARDLFGGRPGAYDY

SEQ ID NO: 69385 - protein, 9 aa, Homo sapiens
  light chain complementarity determining region 3 for antibody 34693
QQDYSSPYT

SEQ ID NO: 69386 - protein, 23 aa, Homo sapiens
  heavy chain complementarity determining region 3 for antibody 34693
ARGVTDCSGRNCYGGEVINAFDV

SEQ ID NO: 69387 - protein, 11 aa, Homo sapiens
  light chain complementarity determining region 3 for antibody 34694
QQDVSSPPGFT

SEQ ID NO: 69388 - protein, 18 aa, Homo sapiens
  heavy chain complementarity determining region 3 for antibody 34694
AKVSRGLNHGSGSYYFDF

SEQ ID NO: 69389 - protein, 9 aa, Homo sapiens
  light chain complementarity determining region 3 for antibody 34695
QQDGTSPFT

SEQ ID NO: 69390 - protein, 14 aa, Homo sapiens
  heavy chain complementarity determining region 3 for antibody 34695
ARGGPAATSSSWLY

SEQ ID NO: 69391 - protein, 9 aa, Homo sapiens
  light chain complementarity determining region 3 for antibody 34696
QQDGSSFYS

SEQ ID NO: 69392 - protein, 14 aa, Homo sapiens
  heavy chain complementarity determining region 3 for antibody 34696
ARVGTYSYGEMFDY

SEQ ID NO: 69393 - protein, 8 aa, Homo sapiens
  light chain complementarity determining region 3 for antibody 34697
QQDGSSFT

SEQ ID NO: 69394 - protein, 16 aa, Homo sapiens
  heavy chain complementarity determining region 3 for antibody 34697
ARGPGVEVAGATYCDS

SEQ ID NO: 69395 - protein, 9 aa, Homo sapiens
  light chain complementarity determining region 3 for antibody 34698
QQDGSIPRT

SEQ ID NO: 69396 - protein, 13 aa, Homo sapiens
  heavy chain complementarity determining region 3 for antibody 34698
ALGHYHTTGYSEF

SEQ ID NO: 69397 - protein, 9 aa, Homo sapiens
  light chain complementarity determining region 3 for antibody 34699
QQANSFPLT

SEQ ID NO: 69398 - protein, 17 aa, Homo sapiens
  heavy chain complementarity determining region 3 for antibody 34699
AKAPYYDSSGYYCFPDY

SEQ ID NO: 69399 - protein, 9 aa, Homo sapiens
  light chain complementarity determining region 3 for antibody 34700
QQAHSFPRT

SEQ ID NO: 69400 - protein, 12 aa, Homo sapiens
  heavy chain complementarity determining region 3 for antibody 34700
ARESTADDYTDQ

SEQ ID NO: 69401 - protein, 9 aa, Homo sapiens
  light chain complementarity determining region 3 for antibody 34701
QPYNSYSVT

SEQ ID NO: 69402 - protein, 17 aa, Homo sapiens
  heavy chain complementarity determining region 3 for antibody 34701
VKESWQWLVDYYYGMDV

SEQ ID NO: 69403 - protein, 10 aa, Homo sapiens
  light chain complementarity determining region 3 for antibody 34702
QPYHNWPPWT

SEQ ID NO: 69404 - protein, 13 aa, Homo sapiens
  heavy chain complementarity determining region 3 for antibody 34702
AKGRVRELYYFET

SEQ ID NO: 69405 - protein, 10 aa, Homo sapiens
  light chain complementarity determining region 3 for antibody 34703
QLYSRSPTGT

SEQ ID NO: 69406 - protein, 19 aa, Homo sapiens
  heavy chain complementarity determining region 3 for antibody 34703
ARESYYPDIGGYTPRAFDI

SEQ ID NO: 69407 - protein, 9 aa, Homo sapiens
  light chain complementarity determining region 3 for antibody 34704
QKYNSAPPT

SEQ ID NO: 69408 - protein, 20 aa, Homo sapiens
  heavy chain complementarity determining region 3 for antibody 34704
ATVLRGRGSSVYYVGGAFDI

SEQ ID NO: 69409 - protein, 9 aa, Homo sapiens
  light chain complementarity determining region 3 for antibody 34705
QKYGSSPRT

SEQ ID NO: 69410 - protein, 17 aa, Homo sapiens
  heavy chain complementarity determining region 3 for antibody 34705
ARALDIVVVVDAIWFDP

SEQ ID NO: 69411 - protein, 11 aa, Homo sapiens
  light chain complementarity determining region 3 for antibody 34706
QKDGTAPPGIA

SEQ ID NO: 69412 - protein, 12 aa, Homo sapiens
  heavy chain complementarity determining region 3 for antibody 34706
AKKIGNFDVLDV

SEQ ID NO: 69413 - protein, 10 aa, Homo sapiens
  light chain complementarity determining region 3 for antibody 34707
QHYGSSPRFP

SEQ ID NO: 69414 - protein, 21 aa, Homo sapiens
  heavy chain complementarity determining region 3 for antibody 34707
VRDGGENSAWSSRLYYYGMDV

SEQ ID NO: 69415 - protein, 11 aa, Homo sapiens
  light chain complementarity determining region 3 for antibody 34708
QHYGSSPPGIT

SEQ ID NO: 69416 - protein, 11 aa, Homo sapiens
  heavy chain complementarity determining region 3 for antibody 34708
ARLPSGYRVTD

SEQ ID NO: 69417 - protein, 10 aa, Homo sapiens
  light chain complementarity determining region 3 for antibody 34709
QHYGSSLMDT

SEQ ID NO: 69418 - protein, 14 aa, Homo sapiens
  heavy chain complementarity determining region 3 for antibody 34709
TTDRPLTGMVTFDF

SEQ ID NO: 69419 - protein, 11 aa, Homo sapiens
  light chain complementarity determining region 3 for antibody 34710
QHYDNSPIMYP

SEQ ID NO: 69420 - protein, 12 aa, Homo sapiens
  heavy chain complementarity determining region 3 for antibody 34710
ARHIAGSNAFDY

SEQ ID NO: 69421 - protein, 10 aa, Homo sapiens
  light chain complementarity determining region 3 for antibody 34711
QHWVSSPAYT

SEQ ID NO: 69422 - protein, 12 aa, Homo sapiens
  heavy chain complementarity determining region 3 for antibody 34711
ARETAQFGELDN

SEQ ID NO: 69423 - protein, 9 aa, Homo sapiens
  light chain complementarity determining region 3 for antibody 34712
QHSHSRPFT

SEQ ID NO: 69424 - protein, 20 aa, Homo sapiens
  heavy chain complementarity determining region 3 for antibody 34712
AKGSAVAALRTVYYYYGMDV

SEQ ID NO: 69425 - protein, 9 aa, Homo sapiens
  light chain complementarity determining region 3 for antibody 34713
QHSHSRPFT

SEQ ID NO: 69426 - protein, 20 aa, Homo sapiens
  heavy chain complementarity determining region 3 for antibody 34713
AKGIAVAALRTVYYYCGMDV

SEQ ID NO: 69427 - protein, 9 aa, Homo sapiens
  light chain complementarity determining region 3 for antibody 34714
QHSHSRPFT

SEQ ID NO: 69428 - protein, 20 aa, Homo sapiens
  heavy chain complementarity determining region 3 for antibody 34714
AKGIAGAALRTVYYYYGMDV

SEQ ID NO: 69429 - protein, 10 aa, Homo sapiens
  light chain complementarity determining region 3 for antibody 34715
QHRYKWPPYT

SEQ ID NO: 69430 - protein, 11 aa, Homo sapiens
  heavy chain complementarity determining region 3 for antibody 34715
ARGVGSYVFES

SEQ ID NO: 69431 - protein, 11 aa, Homo sapiens
  light chain complementarity determining region 3 for antibody 34716
QHRSNWPPGFP

SEQ ID NO: 69432 - protein, 13 aa, Homo sapiens
  heavy chain complementarity determining region 3 for antibody 34716
ACALAQPGDYFDF

SEQ ID NO: 69433 - protein, 9 aa, Homo sapiens
  light chain complementarity determining region 3 for antibody 34717
QHNHSRPFT

SEQ ID NO: 69434 - protein, 20 aa, Homo sapiens
  heavy chain complementarity determining region 3 for antibody 34717
AKGIAVAALRTVYYYYGLDV

SEQ ID NO: 69435 - protein, 6 aa, Homo sapiens
  light chain complementarity determining region 3 for antibody 34718
QHHGTT

SEQ ID NO: 69436 - protein, 12 aa, Homo sapiens
  heavy chain complementarity determining region 3 for antibody 34718
ARFLNSWYPYDY

SEQ ID NO: 69437 - protein, 11 aa, Homo sapiens
  light chain complementarity determining region 3 for antibody 34719
QHATNWPPGVP

SEQ ID NO: 69438 - protein, 13 aa, Homo sapiens
  heavy chain complementarity determining region 3 for antibody 34719
ATNTPGSTADFTY

SEQ ID NO: 69439 - protein, 11 aa, Homo sapiens
  light chain complementarity determining region 3 for antibody 34720
QEYNTWPPSLT

SEQ ID NO: 69440 - protein, 17 aa, Homo sapiens
  heavy chain complementarity determining region 3 for antibody 34720
ARVSGGGYYKLYYGMDV

SEQ ID NO: 69441 - protein, 10 aa, Homo sapiens
  light chain complementarity determining region 3 for antibody 34721
QEYGNLPLVP

SEQ ID NO: 69442 - protein, 15 aa, Homo sapiens
  heavy chain complementarity determining region 3 for antibody 34721
AVWGPGSDWWPLYDY

SEQ ID NO: 69443 - protein, 10 aa, Homo sapiens
  light chain complementarity determining region 3 for antibody 34722
QDYGNLPLVT

SEQ ID NO: 69444 - protein, 15 aa, Homo sapiens
  heavy chain complementarity determining region 3 for antibody 34722
AVWGPGSDWWPLYDY

SEQ ID NO: 69445 - protein, 10 aa, Homo sapiens
  light chain complementarity determining region 3 for antibody 34723
QCRDEWPPVI

SEQ ID NO: 69446 - protein, 12 aa, Homo sapiens
  heavy chain complementarity determining region 3 for antibody 34723
VRDHTTGWKFDY

SEQ ID NO: 69447 - protein, 9 aa, Homo sapiens
  light chain complementarity determining region 3 for antibody 34724
PQYGSSPRT

SEQ ID NO: 69448 - protein, 25 aa, Homo sapiens
  heavy chain complementarity determining region 3 for antibody 34724
ARLRIDRLRLPGAMRGPLYDCGLNV

SEQ ID NO: 69449 - protein, 9 aa, Homo sapiens
  light chain complementarity determining region 3 for antibody 34725
PHTSTFPRT

SEQ ID NO: 69450 - protein, 20 aa, Homo sapiens
  heavy chain complementarity determining region 3 for antibody 34725
ARGRRIAALSTAHYYYGMDV

SEQ ID NO: 69451 - protein, 9 aa, Homo sapiens
  light chain complementarity determining region 3 for antibody 34726
MQVLETPFT

SEQ ID NO: 69452 - protein, 15 aa, Homo sapiens
  heavy chain complementarity determining region 3 for antibody 34726
VRHYRETVAGIEGDS

SEQ ID NO: 69453 - protein, 9 aa, Homo sapiens
  light chain complementarity determining region 3 for antibody 34727
MQSRRWPPT

SEQ ID NO: 69454 - protein, 8 aa, Homo sapiens
  heavy chain complementarity determining region 3 for antibody 34727
TAWGSSQH

SEQ ID NO: 69455 - protein, 8 aa, Homo sapiens
  light chain complementarity determining region 3 for antibody 34728
MQSLQTLP

SEQ ID NO: 69456 - protein, 15 aa, Homo sapiens
  heavy chain complementarity determining region 3 for antibody 34728
STEYYDPLTGFWPPN

SEQ ID NO: 69457 - protein, 9 aa, Homo sapiens
  light chain complementarity determining region 3 for antibody 34729
MQSLQAPVT

SEQ ID NO: 69458 - protein, 12 aa, Homo sapiens
  heavy chain complementarity determining region 3 for antibody 34729
TRDPPTRWGMEV

SEQ ID NO: 69459 - protein, 9 aa, Homo sapiens
  light chain complementarity determining region 3 for antibody 34730
MQSLQAPLT

SEQ ID NO: 69460 - protein, 12 aa, Homo sapiens
  heavy chain complementarity determining region 3 for antibody 34730
TRDPPTRWGMEV

SEQ ID NO: 69461 - protein, 9 aa, Homo sapiens
  light chain complementarity determining region 3 for antibody 34731
MQHTHGPGT

SEQ ID NO: 69462 - protein, 12 aa, Homo sapiens
  heavy chain complementarity determining region 3 for antibody 34731
ATSPHRDSRSSY

SEQ ID NO: 69463 - protein, 8 aa, Homo sapiens
  light chain complementarity determining region 3 for antibody 34732
MQGTSGGA

SEQ ID NO: 69464 - protein, 17 aa, Homo sapiens
  heavy chain complementarity determining region 3 for antibody 34732
AHRRYYNGNWNGATFDV

SEQ ID NO: 69465 - protein, 9 aa, Homo sapiens
  light chain complementarity determining region 3 for antibody 34733
MQGTHWPPT

SEQ ID NO: 69466 - protein, 10 aa, Homo sapiens
  heavy chain complementarity determining region 3 for antibody 34733
ASLNRRTSRR

SEQ ID NO: 69467 - protein, 9 aa, Homo sapiens
  light chain complementarity determining region 3 for antibody 34734
MQGTHWPLP

SEQ ID NO: 69468 - protein, 19 aa, Homo sapiens
  heavy chain complementarity determining region 3 for antibody 34734
VRDDRDHCSGGSCEGYFDD

SEQ ID NO: 69469 - protein, 9 aa, Homo sapiens
  light chain complementarity determining region 3 for antibody 34735
MQGTHWPGT

SEQ ID NO: 69470 - protein, 15 aa, Homo sapiens
  heavy chain complementarity determining region 3 for antibody 34735
ARDAFRGDYGGKAEY

SEQ ID NO: 69471 - protein, 9 aa, Homo sapiens
  light chain complementarity determining region 3 for antibody 34736
MQGTHGPRT

SEQ ID NO: 69472 - protein, 10 aa, Homo sapiens
  heavy chain complementarity determining region 3 for antibody 34736
ARVSLGGFDP

SEQ ID NO: 69473 - protein, 9 aa, Homo sapiens
  light chain complementarity determining region 3 for antibody 34737
MQGTHGPLT

SEQ ID NO: 69474 - protein, 17 aa, Homo sapiens
  heavy chain complementarity determining region 3 for antibody 34737
ARDDRAAAAGGEYYFDL

SEQ ID NO: 69475 - protein, 9 aa, Homo sapiens
  light chain complementarity determining region 3 for antibody 34738
MQGLQTPNT

SEQ ID NO: 69476 - protein, 10 aa, Homo sapiens
  heavy chain complementarity determining region 3 for antibody 34738
GRDLSGARDY

SEQ ID NO: 69477 - protein, 9 aa, Homo sapiens
  light chain complementarity determining region 3 for antibody 34739
MQGLQSPDT

SEQ ID NO: 69478 - protein, 14 aa, Homo sapiens
  heavy chain complementarity determining region 3 for antibody 34739
ARAFTPSSYYGMDV

SEQ ID NO: 69479 - protein, 9 aa, Homo sapiens
  light chain complementarity determining region 3 for antibody 34740
MQGLPTPYT

SEQ ID NO: 69480 - protein, 10 aa, Homo sapiens
  heavy chain complementarity determining region 3 for antibody 34740
GRDLSGARDY

SEQ ID NO: 69481 - protein, 9 aa, Homo sapiens
  light chain complementarity determining region 3 for antibody 34741
MQGLKTPYT

SEQ ID NO: 69482 - protein, 10 aa, Homo sapiens
  heavy chain complementarity determining region 3 for antibody 34741
ARDVVGSDDQ

SEQ ID NO: 69483 - protein, 9 aa, Homo sapiens
  light chain complementarity determining region 3 for antibody 34742
MQDYSFPYS

SEQ ID NO: 69484 - protein, 16 aa, Homo sapiens
  heavy chain complementarity determining region 3 for antibody 34742
ARDGLGSEAMEVGFDV

SEQ ID NO: 69485 - protein, 9 aa, Homo sapiens
  light chain complementarity determining region 3 for antibody 34743
MQCTYGPGT

SEQ ID NO: 69486 - protein, 11 aa, Homo sapiens
  heavy chain complementarity determining region 3 for antibody 34743
ATGGLRVVFGP

SEQ ID NO: 69487 - protein, 9 aa, Homo sapiens
  light chain complementarity determining region 3 for antibody 34744
MQATPWPWT

SEQ ID NO: 69488 - protein, 12 aa, Homo sapiens
  heavy chain complementarity determining region 3 for antibody 34744
AADCSSASCPGY

SEQ ID NO: 69489 - protein, 9 aa, Homo sapiens
  light chain complementarity determining region 3 for antibody 34745
MQATHWPWR

SEQ ID NO: 69490 - protein, 15 aa, Homo sapiens
  heavy chain complementarity determining region 3 for antibody 34745
ARDSPPRASGYDYVP

SEQ ID NO: 69491 - protein, 9 aa, Homo sapiens
  light chain complementarity determining region 3 for antibody 34746
MQATHWPGT

SEQ ID NO: 69492 - protein, 12 aa, Homo sapiens
  heavy chain complementarity determining region 3 for antibody 34746
AADCSSASCPGY

SEQ ID NO: 69493 - protein, 11 aa, Homo sapiens
  light chain complementarity determining region 3 for antibody 34747
MQAQQTPRGFT

SEQ ID NO: 69494 - protein, 18 aa, Homo sapiens
  heavy chain complementarity determining region 3 for antibody 34747
ATAFWVGLGVPPPGFFEY

SEQ ID NO: 69495 - protein, 9 aa, Homo sapiens
  light chain complementarity determining region 3 for antibody 34748
MQALRSPPT

SEQ ID NO: 69496 - protein, 19 aa, Homo sapiens
  heavy chain complementarity determining region 3 for antibody 34748
ARRGATVAGISGWGYGMDV

SEQ ID NO: 69497 - protein, 9 aa, Homo sapiens
  light chain complementarity determining region 3 for antibody 34749
MQALQTPLT

SEQ ID NO: 69498 - protein, 13 aa, Homo sapiens
  heavy chain complementarity determining region 3 for antibody 34749
TMVVDYGDYGFDC

SEQ ID NO: 69499 - protein, 9 aa, Homo sapiens
  light chain complementarity determining region 3 for antibody 34750
MQALQTPGT

SEQ ID NO: 69500 - protein, 6 aa, Homo sapiens
  heavy chain complementarity determining region 3 for antibody 34750
TRALDY

SEQ ID NO: 69501 - protein, 9 aa, Homo sapiens
  light chain complementarity determining region 3 for antibody 34751
MQALQTPGT

SEQ ID NO: 69502 - protein, 13 aa, Homo sapiens
  heavy chain complementarity determining region 3 for antibody 34751
ARGSRGRAHAFDI

SEQ ID NO: 69503 - protein, 9 aa, Homo sapiens
  light chain complementarity determining region 3 for antibody 34752
MQALQSPIT

SEQ ID NO: 69504 - protein, 12 aa, Homo sapiens
  heavy chain complementarity determining region 3 for antibody 34752
ARDGGKSWSDLT

SEQ ID NO: 69505 - protein, 9 aa, Homo sapiens
  light chain complementarity determining region 3 for antibody 34753
MQALQSPFT

SEQ ID NO: 69506 - protein, 12 aa, Homo sapiens
  heavy chain complementarity determining region 3 for antibody 34753
ARDGGKSWSELT

SEQ ID NO: 69507 - protein, 9 aa, Homo sapiens
  light chain complementarity determining region 3 for antibody 34754
MQALPTPYT

SEQ ID NO: 69508 - protein, 21 aa, Homo sapiens
  heavy chain complementarity determining region 3 for antibody 34754
ARDAPVSRPYSSGWYSSAFDY

SEQ ID NO: 69509 - protein, 9 aa, Homo sapiens
  light chain complementarity determining region 3 for antibody 34755
MQALHTPYT

SEQ ID NO: 69510 - protein, 21 aa, Homo sapiens
  heavy chain complementarity determining region 3 for antibody 34755
ARDAPVSRPYSSGWYSSAFDY

SEQ ID NO: 69511 - protein, 9 aa, Homo sapiens
  light chain complementarity determining region 3 for antibody 34756
MQALETPFT

SEQ ID NO: 69512 - protein, 15 aa, Homo sapiens
  heavy chain complementarity determining region 3 for antibody 34756
VRQYRETVAGIEGDS

SEQ ID NO: 69513 - protein, 9 aa, Homo sapiens
  light chain complementarity determining region 3 for antibody 34757
MHTLQAPYT

SEQ ID NO: 69514 - protein, 19 aa, Homo sapiens
  heavy chain complementarity determining region 3 for antibody 34757
VKGRRGSCIGGNCPHYYDS

SEQ ID NO: 69515 - protein, 9 aa, Homo sapiens
  light chain complementarity determining region 3 for antibody 34758
MGTLQTPPR

SEQ ID NO: 69516 - protein, 15 aa, Homo sapiens
  heavy chain complementarity determining region 3 for antibody 34758
TRDGKKDGHNDAFDI

SEQ ID NO: 69517 - protein, 10 aa, Homo sapiens
  light chain complementarity determining region 3 for antibody 34759
MEGISWSAGA

SEQ ID NO: 69518 - protein, 13 aa, Homo sapiens
  heavy chain complementarity determining region 3 for antibody 34759
ATLVIHATPYPDY

SEQ ID NO: 69519 - protein, 9 aa, Homo sapiens
  light chain complementarity determining region 3 for antibody 34760
MASRHWPLS

SEQ ID NO: 69520 - protein, 8 aa, Homo sapiens
  heavy chain complementarity determining region 3 for antibody 34760
ARGRSMSD

SEQ ID NO: 69521 - protein, 9 aa, Homo sapiens
  light chain complementarity determining region 3 for antibody 34761
LQVVSFPRP

SEQ ID NO: 69522 - protein, 8 aa, Homo sapiens
  heavy chain complementarity determining region 3 for antibody 34761
ARNSGWYD

SEQ ID NO: 69523 - protein, 9 aa, Homo sapiens
  light chain complementarity determining region 3 for antibody 34762
LQSIHWPGT

SEQ ID NO: 69524 - protein, 11 aa, Homo sapiens
  heavy chain complementarity determining region 3 for antibody 34762
ARFERRKPGPH

SEQ ID NO: 69525 - protein, 9 aa, Homo sapiens
  light chain complementarity determining region 3 for antibody 34763
LQPYNFPWT

SEQ ID NO: 69526 - protein, 12 aa, Homo sapiens
  heavy chain complementarity determining region 3 for antibody 34763
ARHLRVPERLDS

SEQ ID NO: 69527 - protein, 9 aa, Homo sapiens
  light chain complementarity determining region 3 for antibody 34764
LQNEYWPRT

SEQ ID NO: 69528 - protein, 11 aa, Homo sapiens
  heavy chain complementarity determining region 3 for antibody 34764
VRVGGAGYFNH

SEQ ID NO: 69529 - protein, 9 aa, Homo sapiens
  light chain complementarity determining region 3 for antibody 34765
LQHYNFPWT

SEQ ID NO: 69530 - protein, 12 aa, Homo sapiens
  heavy chain complementarity determining region 3 for antibody 34765
ARHLRVPESLDS

SEQ ID NO: 69531 - protein, 9 aa, Homo sapiens
  light chain complementarity determining region 3 for antibody 34766
LQHYNFPRT

SEQ ID NO: 69532 - protein, 12 aa, Homo sapiens
  heavy chain complementarity determining region 3 for antibody 34766
ARHLRVPERLDS

SEQ ID NO: 69533 - protein, 9 aa, Homo sapiens
  light chain complementarity determining region 3 for antibody 34767
LQHSISPRT

SEQ ID NO: 69534 - protein, 11 aa, Homo sapiens
  heavy chain complementarity determining region 3 for antibody 34767
ATGLGSGGINW

SEQ ID NO: 69535 - protein, 9 aa, Homo sapiens
  light chain complementarity determining region 3 for antibody 34768
LQHNSYPLP

SEQ ID NO: 69536 - protein, 17 aa, Homo sapiens
  heavy chain complementarity determining region 3 for antibody 34768
ARGTRRGYCSAGSCYGY

SEQ ID NO: 69537 - protein, 9 aa, Homo sapiens
  light chain complementarity determining region 3 for antibody 34769
LQGLQTPYT

SEQ ID NO: 69538 - protein, 10 aa, Homo sapiens
  heavy chain complementarity determining region 3 for antibody 34769
GRDLSGARDY

SEQ ID NO: 69539 - protein, 9 aa, Homo sapiens
  light chain complementarity determining region 3 for antibody 34770
LQFVSFPRT

SEQ ID NO: 69540 - protein, 8 aa, Homo sapiens
  heavy chain complementarity determining region 3 for antibody 34770
ARNSGWYD

SEQ ID NO: 69541 - protein, 9 aa, Homo sapiens
  light chain complementarity determining region 3 for antibody 34771
LQDYDYPWT

SEQ ID NO: 69542 - protein, 14 aa, Homo sapiens
  heavy chain complementarity determining region 3 for antibody 34771
ARDRSVAETASFDY

SEQ ID NO: 69543 - protein, 9 aa, Homo sapiens
  light chain complementarity determining region 3 for antibody 34772
LQDVSFPRT

SEQ ID NO: 69544 - protein, 8 aa, Homo sapiens
  heavy chain complementarity determining region 3 for antibody 34772
ARNSGWYD

SEQ ID NO: 69545 - protein, 9 aa, Homo sapiens
  light chain complementarity determining region 3 for antibody 34773
KPYYTTPLT

SEQ ID NO: 69546 - protein, 14 aa, Homo sapiens
  heavy chain complementarity determining region 3 for antibody 34773
AKDRIAVGISVWEY

SEQ ID NO: 69547 - protein, 9 aa, Homo sapiens
  light chain complementarity determining region 3 for antibody 34774
KHYYTTPLT

SEQ ID NO: 69548 - protein, 14 aa, Homo sapiens
  heavy chain complementarity determining region 3 for antibody 34774
AKDRIAVGISVWEY

SEQ ID NO: 69549 - protein, 9 aa, Homo sapiens
  light chain complementarity determining region 3 for antibody 34775
HQYYSAPPT

SEQ ID NO: 69550 - protein, 21 aa, Homo sapiens
  heavy chain complementarity determining region 3 for antibody 34775
AKDEGLSVFRSFDGLFDAFDI

SEQ ID NO: 69551 - protein, 9 aa, Homo sapiens
  light chain complementarity determining region 3 for antibody 34776
HQYGSSPWP

SEQ ID NO: 69552 - protein, 9 aa, Homo sapiens
  heavy chain complementarity determining region 3 for antibody 34776
ARAYGPADY

SEQ ID NO: 69553 - protein, 9 aa, Homo sapiens
  light chain complementarity determining region 3 for antibody 34777
HQYGSSPGT

SEQ ID NO: 69554 - protein, 9 aa, Homo sapiens
  heavy chain complementarity determining region 3 for antibody 34777
ARAYGPADY

SEQ ID NO: 69555 - protein, 9 aa, Homo sapiens
  light chain complementarity determining region 3 for antibody 34778
HQRSDWPGT

SEQ ID NO: 69556 - protein, 9 aa, Homo sapiens
  heavy chain complementarity determining region 3 for antibody 34778
ASGDYAFDL

SEQ ID NO: 69557 - protein, 9 aa, Homo sapiens
  light chain complementarity determining region 3 for antibody 34779
HQRGTLPWT

SEQ ID NO: 69558 - protein, 14 aa, Homo sapiens
  heavy chain complementarity determining region 3 for antibody 34779
IMDASGTGGWYADS

SEQ ID NO: 69559 - protein, 9 aa, Homo sapiens
  light chain complementarity determining region 3 for antibody 34780
HQHYTTPPT

SEQ ID NO: 69560 - protein, 10 aa, Homo sapiens
  heavy chain complementarity determining region 3 for antibody 34780
ARGSYNSVWA

SEQ ID NO: 69561 - protein, 9 aa, Homo sapiens
  light chain complementarity determining region 3 for antibody 34781
HQFYSPPPT

SEQ ID NO: 69562 - protein, 23 aa, Homo sapiens
  heavy chain complementarity determining region 3 for antibody 34781
ARGSQYYDYIWGSSRPSIPPIDF

SEQ ID NO: 69563 - protein, 9 aa, Homo sapiens
  light chain complementarity determining region 3 for antibody 34782
HQFYSPPLT

SEQ ID NO: 69564 - protein, 23 aa, Homo sapiens
  heavy chain complementarity determining region 3 for antibody 34782
ARGSQYYDYIWGSSRPSIPPIDF

SEQ ID NO: 69565 - protein, 10 aa, Homo sapiens
  light chain complementarity determining region 3 for antibody 34783
HHWVSSPAYT

SEQ ID NO: 69566 - protein, 12 aa, Homo sapiens
  heavy chain complementarity determining region 3 for antibody 34783
ARETTQFGELDN

SEQ ID NO: 69567 - protein, 9 aa, Homo sapiens
  light chain complementarity determining region 3 for antibody 34784
HHTSTFPRS

SEQ ID NO: 69568 - protein, 20 aa, Homo sapiens
  heavy chain complementarity determining region 3 for antibody 34784
ARGRRIAALSTAHYYYGMDV

SEQ ID NO: 69569 - protein, 10 aa, Homo sapiens
  light chain complementarity determining region 3 for antibody 34785
GQTLQSPPWT

SEQ ID NO: 69570 - protein, 16 aa, Homo sapiens
  heavy chain complementarity determining region 3 for antibody 34785
ARDLAVDNYYYYGMDV

SEQ ID NO: 69571 - protein, 9 aa, Homo sapiens
  light chain complementarity determining region 3 for antibody 34786
VQYNRYPRT

SEQ ID NO: 69572 - protein, 6 aa, Homo sapiens
  heavy chain complementarity determining region 3 for antibody 34786
MRALDY

SEQ ID NO: 69573 - protein, 9 aa, Homo sapiens
  light chain complementarity determining region 3 for antibody 34787
VQAEFFPLT

SEQ ID NO: 69574 - protein, 14 aa, Homo sapiens
  heavy chain complementarity determining region 3 for antibody 34787
VRDADSGGPNDMDV

SEQ ID NO: 69575 - protein, 8 aa, Homo sapiens
  light chain complementarity determining region 3 for antibody 34788
RQYGSSLT

SEQ ID NO: 69576 - protein, 13 aa, Homo sapiens
  heavy chain complementarity determining region 3 for antibody 34788
ARVHYSSREAVDY

SEQ ID NO: 69577 - protein, 8 aa, Homo sapiens
  light chain complementarity determining region 3 for antibody 34789
RQYGGSPS

SEQ ID NO: 69578 - protein, 16 aa, Homo sapiens
  heavy chain complementarity determining region 3 for antibody 34789
ATDWGSGTQWIRAFDV

SEQ ID NO: 69579 - protein, 9 aa, Homo sapiens
  light chain complementarity determining region 3 for antibody 34790
RQGLQTPYT

SEQ ID NO: 69580 - protein, 10 aa, Homo sapiens
  heavy chain complementarity determining region 3 for antibody 34790
GRDLSGARDY

SEQ ID NO: 69581 - protein, 9 aa, Homo sapiens
  light chain complementarity determining region 3 for antibody 34791
RQDYDYPLT

SEQ ID NO: 69582 - protein, 18 aa, Homo sapiens
  heavy chain complementarity determining region 3 for antibody 34791
ARSLYHSVSGAYYDAFDI

SEQ ID NO: 69583 - protein, 6 aa, Homo sapiens
  light chain complementarity determining region 3 for antibody 34792
QRYGET

SEQ ID NO: 69584 - protein, 12 aa, Homo sapiens
  heavy chain complementarity determining region 3 for antibody 34792
ARDHSSGWSLSN

SEQ ID NO: 69585 - protein, 9 aa, Homo sapiens
  light chain complementarity determining region 3 for antibody 34793
QQYYTTPRT

SEQ ID NO: 69586 - protein, 8 aa, Homo sapiens
  heavy chain complementarity determining region 3 for antibody 34793
ARDGASDS

SEQ ID NO: 69587 - protein, 9 aa, Homo sapiens
  light chain complementarity determining region 3 for antibody 34794
QQYYTSVRP

SEQ ID NO: 69588 - protein, 12 aa, Homo sapiens
  heavy chain complementarity determining region 3 for antibody 34794
VKDCGLGGSRDF

SEQ ID NO: 69589 - protein, 9 aa, Homo sapiens
  light chain complementarity determining region 3 for antibody 34795
QQYYTSLRT

SEQ ID NO: 69590 - protein, 12 aa, Homo sapiens
  heavy chain complementarity determining region 3 for antibody 34795
VKDCGLGGPRDY

SEQ ID NO: 69591 - protein, 9 aa, Homo sapiens
  light chain complementarity determining region 3 for antibody 34796
QQYYTSFRT

SEQ ID NO: 69592 - protein, 12 aa, Homo sapiens
  heavy chain complementarity determining region 3 for antibody 34796
VKDCGLGGSRDF

SEQ ID NO: 69593 - protein, 9 aa, Homo sapiens
  light chain complementarity determining region 3 for antibody 34797
QQYYTFPRT

SEQ ID NO: 69594 - protein, 18 aa, Homo sapiens
  heavy chain complementarity determining region 3 for antibody 34797
AREGWGSGLRGQRPGFDY

SEQ ID NO: 69595 - protein, 9 aa, Homo sapiens
  light chain complementarity determining region 3 for antibody 34798
QQYYTFLRT

SEQ ID NO: 69596 - protein, 12 aa, Homo sapiens
  heavy chain complementarity determining region 3 for antibody 34798
VKDCGLGGSRDS

SEQ ID NO: 69597 - protein, 9 aa, Homo sapiens
  light chain complementarity determining region 3 for antibody 34799
QQYYSTPWT

SEQ ID NO: 69598 - protein, 13 aa, Homo sapiens
  heavy chain complementarity determining region 3 for antibody 34799
ARLPTGFPNWFDR

SEQ ID NO: 69599 - protein, 9 aa, Homo sapiens
  light chain complementarity determining region 3 for antibody 34800
QQYYSTPWT

SEQ ID NO: 69600 - protein, 18 aa, Homo sapiens
  heavy chain complementarity determining region 3 for antibody 34800
AGRPCSGGSCYAGGWFDP

SEQ ID NO: 69601 - protein, 9 aa, Homo sapiens
  light chain complementarity determining region 3 for antibody 34801
QQYYSTPPT

SEQ ID NO: 69602 - protein, 20 aa, Homo sapiens
  heavy chain complementarity determining region 3 for antibody 34801
ARDQAYYYGSGSSGVDWFDP

SEQ ID NO: 69603 - protein, 9 aa, Homo sapiens
  light chain complementarity determining region 3 for antibody 34802
QQYYSTPLT

SEQ ID NO: 69604 - protein, 15 aa, Homo sapiens
  heavy chain complementarity determining region 3 for antibody 34802
AKDTRYGLGEYYFDY

SEQ ID NO: 69605 - protein, 9 aa, Homo sapiens
  light chain complementarity determining region 3 for antibody 34803
QQYYSHPPT

SEQ ID NO: 69606 - protein, 14 aa, Homo sapiens
  heavy chain complementarity determining region 3 for antibody 34803
AKAKAETTDNGHDQ

SEQ ID NO: 69607 - protein, 9 aa, Homo sapiens
  light chain complementarity determining region 3 for antibody 34804
QQYYSFPFT

SEQ ID NO: 69608 - protein, 16 aa, Homo sapiens
  heavy chain complementarity determining region 3 for antibody 34804
ARDRPRESSPYSSFFF

SEQ ID NO: 69609 - protein, 9 aa, Homo sapiens
  light chain complementarity determining region 3 for antibody 34805
QQYYSAPYS

SEQ ID NO: 69610 - protein, 21 aa, Homo sapiens
  heavy chain complementarity determining region 3 for antibody 34805
ARSFTYFHNSTSFETITAFHI

SEQ ID NO: 69611 - protein, 9 aa, Homo sapiens
  light chain complementarity determining region 3 for antibody 34806
QQYYSAPGT

SEQ ID NO: 69612 - protein, 17 aa, Homo sapiens
  heavy chain complementarity determining region 3 for antibody 34806
VKESWQWLVDYYYGMDV

SEQ ID NO: 69613 - protein, 9 aa, Homo sapiens
  light chain complementarity determining region 3 for antibody 34807
QQYYRSPPT

SEQ ID NO: 69614 - protein, 19 aa, Homo sapiens
  heavy chain complementarity determining region 3 for antibody 34807
VKGRRGSCIGGNCPHYYDS

SEQ ID NO: 69615 - protein, 9 aa, Homo sapiens
  light chain complementarity determining region 3 for antibody 34808
QQYYNTPRT

SEQ ID NO: 69616 - protein, 18 aa, Homo sapiens
  heavy chain complementarity determining region 3 for antibody 34808
AREPGKPDSSGDDWYFDL

SEQ ID NO: 69617 - protein, 9 aa, Homo sapiens
  light chain complementarity determining region 3 for antibody 34809
QQYYISLRT

SEQ ID NO: 69618 - protein, 12 aa, Homo sapiens
  heavy chain complementarity determining region 3 for antibody 34809
VKDCGLGGSRDS

SEQ ID NO: 69619 - protein, 9 aa, Homo sapiens
  light chain complementarity determining region 3 for antibody 34810
QQYYDTPYT

SEQ ID NO: 69620 - protein, 12 aa, Homo sapiens
  heavy chain complementarity determining region 3 for antibody 34810
ARPRTGMIDWDY

SEQ ID NO: 69621 - protein, 9 aa, Homo sapiens
  light chain complementarity determining region 3 for antibody 34811
QQYVTSPWT

SEQ ID NO: 69622 - protein, 15 aa, Homo sapiens
  heavy chain complementarity determining region 3 for antibody 34811
VHTQLWFGDQCYFDF

SEQ ID NO: 69623 - protein, 9 aa, Homo sapiens
  light chain complementarity determining region 3 for antibody 34812
QQYVTPPLT

SEQ ID NO: 69624 - protein, 8 aa, Homo sapiens
  heavy chain complementarity determining region 3 for antibody 34812
VRMSDYIL

SEQ ID NO: 69625 - protein, 9 aa, Homo sapiens
  light chain complementarity determining region 3 for antibody 34813
QQYTSYSVT

SEQ ID NO: 69626 - protein, 17 aa, Homo sapiens
  heavy chain complementarity determining region 3 for antibody 34813
VKESWQWLVDYYYGMDV

SEQ ID NO: 69627 - protein, 9 aa, Homo sapiens
  light chain complementarity determining region 3 for antibody 34814
QQYSSSPPS

SEQ ID NO: 69628 - protein, 19 aa, Homo sapiens
  heavy chain complementarity determining region 3 for antibody 34814
ARAGGNYYDRTSYHGPFDY

SEQ ID NO: 69629 - protein, 9 aa, Homo sapiens
  light chain complementarity determining region 3 for antibody 34815
QQYSSSPPS

SEQ ID NO: 69630 - protein, 19 aa, Homo sapiens
  heavy chain complementarity determining region 3 for antibody 34815
ARAGGNYYDRTSDYGPFDY

SEQ ID NO: 69631 - protein, 9 aa, Homo sapiens
  light chain complementarity determining region 3 for antibody 34816
QQYSGSPRT

SEQ ID NO: 69632 - protein, 14 aa, Homo sapiens
  heavy chain complementarity determining region 3 for antibody 34816
ATGWYDSSGHYLDY

SEQ ID NO: 69633 - protein, 9 aa, Homo sapiens
  light chain complementarity determining region 3 for antibody 34817
QQYRNTPFT

SEQ ID NO: 69634 - protein, 13 aa, Homo sapiens
  heavy chain complementarity determining region 3 for antibody 34817
ARGGSDTAMAHDY

SEQ ID NO: 69635 - protein, 9 aa, Homo sapiens
  light chain complementarity determining region 3 for antibody 34818
QQYNSYWRT

SEQ ID NO: 69636 - protein, 9 aa, Homo sapiens
  heavy chain complementarity determining region 3 for antibody 34818
AKGSSALEY

SEQ ID NO: 69637 - protein, 9 aa, Homo sapiens
  light chain complementarity determining region 3 for antibody 34819
QQYNSYSVT

SEQ ID NO: 69638 - protein, 17 aa, Homo sapiens
  heavy chain complementarity determining region 3 for antibody 34819
VKEGWQWLVDYYYGMDV

SEQ ID NO: 69639 - protein, 10 aa, Homo sapiens
  light chain complementarity determining region 3 for antibody 34820
QQYNSYSSYT

SEQ ID NO: 69640 - protein, 16 aa, Homo sapiens
  heavy chain complementarity determining region 3 for antibody 34820
AHRLGGSGSYEDAFDI

SEQ ID NO: 69641 - protein, 9 aa, Homo sapiens
  light chain complementarity determining region 3 for antibody 34821
QQYNSYSLT

SEQ ID NO: 69642 - protein, 16 aa, Homo sapiens
  heavy chain complementarity determining region 3 for antibody 34821
TRDRSLTMVRGVIPDY

SEQ ID NO: 69643 - protein, 9 aa, Homo sapiens
  light chain complementarity determining region 3 for antibody 34822
QQYNSYPYT

SEQ ID NO: 69644 - protein, 21 aa, Homo sapiens
  heavy chain complementarity determining region 3 for antibody 34822
ARDVKHYDSSGSYWPLDMFDI

SEQ ID NO: 69645 - protein, 9 aa, Homo sapiens
  light chain complementarity determining region 3 for antibody 34823
QQYNSYFVT

SEQ ID NO: 69646 - protein, 17 aa, Homo sapiens
  heavy chain complementarity determining region 3 for antibody 34823
VKESWQWLVDYYYGMDV

SEQ ID NO: 69647 - protein, 8 aa, Homo sapiens
  light chain complementarity determining region 3 for antibody 34824
QQYNSWPG

SEQ ID NO: 69648 - protein, 15 aa, Homo sapiens
  heavy chain complementarity determining region 3 for antibody 34824
AKGLFGYQSGDSFDS

SEQ ID NO: 69649 - protein, 9 aa, Homo sapiens
  light chain complementarity determining region 3 for antibody 34825
QQYNSVPPT

SEQ ID NO: 69650 - protein, 14 aa, Homo sapiens
  heavy chain complementarity determining region 3 for antibody 34825
ARDPSYGGFYYFDS

SEQ ID NO: 69651 - protein, 9 aa, Homo sapiens
  light chain complementarity determining region 3 for antibody 34826
QQYNSIPGT

SEQ ID NO: 69652 - protein, 14 aa, Homo sapiens
  heavy chain complementarity determining region 3 for antibody 34826
ARESGAGSYQGFDY

SEQ ID NO: 69653 - protein, 9 aa, Homo sapiens
  light chain complementarity determining region 3 for antibody 34827
QQYNSHVYS

SEQ ID NO: 69654 - protein, 18 aa, Homo sapiens
  heavy chain complementarity determining region 3 for antibody 34827
AQERDGYCHTHACYGLDV

SEQ ID NO: 69655 - protein, 9 aa, Homo sapiens
  light chain complementarity determining region 3 for antibody 34828
QQYNSFSVT

SEQ ID NO: 69656 - protein, 17 aa, Homo sapiens
  heavy chain complementarity determining region 3 for antibody 34828
VKESWQWLVDYYYGMDV

SEQ ID NO: 69657 - protein, 9 aa, Homo sapiens
  light chain complementarity determining region 3 for antibody 34829
QQYNSAPLT

SEQ ID NO: 69658 - protein, 20 aa, Homo sapiens
  heavy chain complementarity determining region 3 for antibody 34829
ATVLRGRGSSVYYVGGAFDI

SEQ ID NO: 69659 - protein, 9 aa, Homo sapiens
  light chain complementarity determining region 3 for antibody 34830
QQYNSAPHT

SEQ ID NO: 69660 - protein, 15 aa, Homo sapiens
  heavy chain complementarity determining region 3 for antibody 34830
ARTMFQWFGAYGMDV

SEQ ID NO: 69661 - protein, 9 aa, Homo sapiens
  light chain complementarity determining region 3 for antibody 34831
QQYNRYSVT

SEQ ID NO: 69662 - protein, 17 aa, Homo sapiens
  heavy chain complementarity determining region 3 for antibody 34831
VKESWQWLVDYYYGMDV

SEQ ID NO: 69663 - protein, 9 aa, Homo sapiens
  light chain complementarity determining region 3 for antibody 34832
QQYNNWPYT

SEQ ID NO: 69664 - protein, 17 aa, Homo sapiens
  heavy chain complementarity determining region 3 for antibody 34832
ARNAAVAGSSDYHGMDV

SEQ ID NO: 69665 - protein, 10 aa, Homo sapiens
  light chain complementarity determining region 3 for antibody 34833
QQYNNWPPYT

SEQ ID NO: 69666 - protein, 18 aa, Homo sapiens
  heavy chain complementarity determining region 3 for antibody 34833
ARGNVYYYDTSDYIYFDH

SEQ ID NO: 69667 - protein, 10 aa, Homo sapiens
  light chain complementarity determining region 3 for antibody 34834
QQYNNWPPLP

SEQ ID NO: 69668 - protein, 15 aa, Homo sapiens
  heavy chain complementarity determining region 3 for antibody 34834
AKEPDCGRNCLFFDS

SEQ ID NO: 69669 - protein, 10 aa, Homo sapiens
  light chain complementarity determining region 3 for antibody 34835
QQYNNWPPIT

SEQ ID NO: 69670 - protein, 15 aa, Homo sapiens
  heavy chain complementarity determining region 3 for antibody 34835
ARLRGPTVAQNWLDP

SEQ ID NO: 69671 - protein, 9 aa, Homo sapiens
  light chain complementarity determining region 3 for antibody 34836
QQYNGYSPT

SEQ ID NO: 69672 - protein, 13 aa, Homo sapiens
  heavy chain complementarity determining region 3 for antibody 34836
ARGLDDNMFPFDL

SEQ ID NO: 69673 - protein, 10 aa, Homo sapiens
  light chain complementarity determining region 3 for antibody 34837
QQYNDLPPWT

SEQ ID NO: 69674 - protein, 16 aa, Homo sapiens
  heavy chain complementarity determining region 3 for antibody 34837
ASQADTSVYYPRVFDY

SEQ ID NO: 69675 - protein, 9 aa, Homo sapiens
  light chain complementarity determining region 3 for antibody 34838
QQYLNSPLT

SEQ ID NO: 69676 - protein, 13 aa, Homo sapiens
  heavy chain complementarity determining region 3 for antibody 34838
AKDPSGNYGSWVH

SEQ ID NO: 69677 - protein, 9 aa, Homo sapiens
  light chain complementarity determining region 3 for antibody 34839
QQYHHWPRS

SEQ ID NO: 69678 - protein, 16 aa, Homo sapiens
  heavy chain complementarity determining region 3 for antibody 34839
AREVGPTTYFYSGLDV

SEQ ID NO: 69679 - protein, 8 aa, Homo sapiens
  light chain complementarity determining region 3 for antibody 34840
QQYHDWPT

SEQ ID NO: 69680 - protein, 12 aa, Homo sapiens
  heavy chain complementarity determining region 3 for antibody 34840
AERSGWHTGFDY

SEQ ID NO: 69681 - protein, 9 aa, Homo sapiens
  light chain complementarity determining region 3 for antibody 34841
QQYHALPLT

SEQ ID NO: 69682 - protein, 13 aa, Homo sapiens
  heavy chain complementarity determining region 3 for antibody 34841
ARDGVPGKCNRAH

SEQ ID NO: 69683 - protein, 9 aa, Homo sapiens
  light chain complementarity determining region 3 for antibody 34842
QQYGTSPLT

SEQ ID NO: 69684 - protein, 14 aa, Homo sapiens
  heavy chain complementarity determining region 3 for antibody 34842
ARGGPAATSSSWLY

SEQ ID NO: 69685 - protein, 9 aa, Homo sapiens
  light chain complementarity determining region 3 for antibody 34843
QQYGTSPLN

SEQ ID NO: 69686 - protein, 13 aa, Homo sapiens
  heavy chain complementarity determining region 3 for antibody 34843
ASISVGTVAAGEG

SEQ ID NO: 69687 - protein, 9 aa, Homo sapiens
  light chain complementarity determining region 3 for antibody 34844
QQYGTSPLN

SEQ ID NO: 69688 - protein, 13 aa, Homo sapiens
  heavy chain complementarity determining region 3 for antibody 34844
ASIAVGTVAAGKG

SEQ ID NO: 69689 - protein, 9 aa, Homo sapiens
  light chain complementarity determining region 3 for antibody 34845
QQYGTSPIT

SEQ ID NO: 69690 - protein, 13 aa, Homo sapiens
  heavy chain complementarity determining region 3 for antibody 34845
ARNQWLSLDVFNE

SEQ ID NO: 69691 - protein, 9 aa, Homo sapiens
  light chain complementarity determining region 3 for antibody 34846
QQYGTSPFT

SEQ ID NO: 69692 - protein, 15 aa, Homo sapiens
  heavy chain complementarity determining region 3 for antibody 34846
ARQNGFLSGPGEFDP

SEQ ID NO: 69693 - protein, 9 aa, Homo sapiens
  light chain complementarity determining region 3 for antibody 34847
QQYGTSPFT

SEQ ID NO: 69694 - protein, 14 aa, Homo sapiens
  heavy chain complementarity determining region 3 for antibody 34847
ARGGPAAASSSWLY

SEQ ID NO: 69695 - protein, 9 aa, Homo sapiens
  light chain complementarity determining region 3 for antibody 34848
QQYGTLPRT

SEQ ID NO: 69696 - protein, 13 aa, Homo sapiens
  heavy chain complementarity determining region 3 for antibody 34848
AGGIFHSRGYGEY

SEQ ID NO: 69697 - protein, 10 aa, Homo sapiens
  light chain complementarity determining region 3 for antibody 34849
QQYGSSTGYT

SEQ ID NO: 69698 - protein, 11 aa, Homo sapiens
  heavy chain complementarity determining region 3 for antibody 34849
ASDHSGWSLDY

SEQ ID NO: 69699 - protein, 10 aa, Homo sapiens
  light chain complementarity determining region 3 for antibody 34850
QQYGSSSMYT

SEQ ID NO: 69700 - protein, 19 aa, Homo sapiens
  heavy chain complementarity determining region 3 for antibody 34850
AKDQLMFCYDNSGYPGADY

SEQ ID NO: 69701 - protein, 10 aa, Homo sapiens
  light chain complementarity determining region 3 for antibody 34851
QQYGSSSMST

SEQ ID NO: 69702 - protein, 19 aa, Homo sapiens
  heavy chain complementarity determining region 3 for antibody 34851
AKDQLMFYYDNSGYPGADY

SEQ ID NO: 69703 - protein, 10 aa, Homo sapiens
  light chain complementarity determining region 3 for antibody 34852
QQYGSSSLYT

SEQ ID NO: 69704 - protein, 19 aa, Homo sapiens
  heavy chain complementarity determining region 3 for antibody 34852
AKDQLMFYYDNSGYPGADY

SEQ ID NO: 69705 - protein, 9 aa, Homo sapiens
  light chain complementarity determining region 3 for antibody 34853
QQYGSSPWT

SEQ ID NO: 69706 - protein, 20 aa, Homo sapiens
  heavy chain complementarity determining region 3 for antibody 34853
AKGVSVAALRTVYYYYGLDV

SEQ ID NO: 69707 - protein, 9 aa, Homo sapiens
  light chain complementarity determining region 3 for antibody 34854
QQYGSSPRT

SEQ ID NO: 69708 - protein, 14 aa, Homo sapiens
  heavy chain complementarity determining region 3 for antibody 34854
ATVGVQFRNGYFHH

SEQ ID NO: 69709 - protein, 9 aa, Homo sapiens
  light chain complementarity determining region 3 for antibody 34855
QQYGSSPRT

SEQ ID NO: 69710 - protein, 25 aa, Homo sapiens
  heavy chain complementarity determining region 3 for antibody 34855
ARLRSDRLRLPGAMRGPLYDCGLNV

SEQ ID NO: 69711 - protein, 9 aa, Homo sapiens
  light chain complementarity determining region 3 for antibody 34856
QQYGSSPRT

SEQ ID NO: 69712 - protein, 25 aa, Homo sapiens
  heavy chain complementarity determining region 3 for antibody 34856
ARLRIDRLRLPGARRGPLYDCGLNV

SEQ ID NO: 69713 - protein, 9 aa, Homo sapiens
  light chain complementarity determining region 3 for antibody 34857
QQYGSSPRT

SEQ ID NO: 69714 - protein, 25 aa, Homo sapiens
  heavy chain complementarity determining region 3 for antibody 34857
ARLRIDRLRLAGAMRGPLYDCGLNV

SEQ ID NO: 69715 - protein, 9 aa, Homo sapiens
  light chain complementarity determining region 3 for antibody 34858
QQYGSSPRK

SEQ ID NO: 69716 - protein, 25 aa, Homo sapiens
  heavy chain complementarity determining region 3 for antibody 34858
ARLRIDRLRLPGAMRGPLYDCGLNV

SEQ ID NO: 69717 - protein, 9 aa, Homo sapiens
  light chain complementarity determining region 3 for antibody 34859
QQYGSSPQT

SEQ ID NO: 69718 - protein, 14 aa, Homo sapiens
  heavy chain complementarity determining region 3 for antibody 34859
TRDPIPYSGWYFDL

SEQ ID NO: 69719 - protein, 9 aa, Homo sapiens
  light chain complementarity determining region 3 for antibody 34860
QQYGSSPPT

SEQ ID NO: 69720 - protein, 17 aa, Homo sapiens
  heavy chain complementarity determining region 3 for antibody 34860
ARDLGTYDATRHWYFDL

SEQ ID NO: 69721 - protein, 9 aa, Homo sapiens
  light chain complementarity determining region 3 for antibody 34861
QQYGSSPPT

SEQ ID NO: 69722 - protein, 16 aa, Homo sapiens
  heavy chain complementarity determining region 3 for antibody 34861
ARDFHPRAASDTAYDY

SEQ ID NO: 69723 - protein, 10 aa, Homo sapiens
  light chain complementarity determining region 3 for antibody 34862
QQYGSSPPLT

SEQ ID NO: 69724 - protein, 18 aa, Homo sapiens
  heavy chain complementarity determining region 3 for antibody 34862
ARGGYEYGWGSYGVYFDY

SEQ ID NO: 69725 - protein, 10 aa, Homo sapiens
  light chain complementarity determining region 3 for antibody 34863
QQYGSSPPGT

SEQ ID NO: 69726 - protein, 16 aa, Homo sapiens
  heavy chain complementarity determining region 3 for antibody 34863
ARVQWVRGVLRGGLDY

SEQ ID NO: 69727 - protein, 10 aa, Homo sapiens
  light chain complementarity determining region 3 for antibody 34864
QQYGSSPMYG

SEQ ID NO: 69728 - protein, 11 aa, Homo sapiens
  heavy chain complementarity determining region 3 for antibody 34864
ARGGQWGSLDY

SEQ ID NO: 69729 - protein, 10 aa, Homo sapiens
  light chain complementarity determining region 3 for antibody 34865
QQYGSSPMSS

SEQ ID NO: 69730 - protein, 11 aa, Homo sapiens
  heavy chain complementarity determining region 3 for antibody 34865
ARGGQWGSLDY

SEQ ID NO: 69731 - protein, 9 aa, Homo sapiens
  light chain complementarity determining region 3 for antibody 34866
QQYGSSPLN

SEQ ID NO: 69732 - protein, 13 aa, Homo sapiens
  heavy chain complementarity determining region 3 for antibody 34866
ASISVGTVAAGKG

SEQ ID NO: 69733 - protein, 10 aa, Homo sapiens
  light chain complementarity determining region 3 for antibody 34867
QQYGSSPKYT

SEQ ID NO: 69734 - protein, 16 aa, Homo sapiens
  heavy chain complementarity determining region 3 for antibody 34867
AREGAVGMTTSGIFDM

SEQ ID NO: 69735 - protein, 9 aa, Homo sapiens
  light chain complementarity determining region 3 for antibody 34868
QQYGSSLGT

SEQ ID NO: 69736 - protein, 17 aa, Homo sapiens
  heavy chain complementarity determining region 3 for antibody 34868
ARDGWYDSSMWFDGFDI

SEQ ID NO: 69737 - protein, 9 aa, Homo sapiens
  light chain complementarity determining region 3 for antibody 34869
QQYGSLPRT

SEQ ID NO: 69738 - protein, 17 aa, Homo sapiens
  heavy chain complementarity determining region 3 for antibody 34869
ARALDIVVVVDAIWFDP

SEQ ID NO: 69739 - protein, 9 aa, Homo sapiens
  light chain complementarity determining region 3 for antibody 34870
QQYGSLPPT

SEQ ID NO: 69740 - protein, 15 aa, Homo sapiens
  heavy chain complementarity determining region 3 for antibody 34870
AHRPNYYDKAGAFDI

SEQ ID NO: 69741 - protein, 9 aa, Homo sapiens
  light chain complementarity determining region 3 for antibody 34871
QQYGSFPPP

SEQ ID NO: 69742 - protein, 17 aa, Homo sapiens
  heavy chain complementarity determining region 3 for antibody 34871
ARGLMERWLVPLYYFDL

SEQ ID NO: 69743 - protein, 9 aa, Homo sapiens
  light chain complementarity determining region 3 for antibody 34872
QQYGRSSLP

SEQ ID NO: 69744 - protein, 19 aa, Homo sapiens
  heavy chain complementarity determining region 3 for antibody 34872
ARDRIVVGATFYSYSGMDV

SEQ ID NO: 69745 - protein, 10 aa, Homo sapiens
  light chain complementarity determining region 3 for antibody 34873
QQYGRSPWGA

SEQ ID NO: 69746 - protein, 17 aa, Homo sapiens
  heavy chain complementarity determining region 3 for antibody 34873
AKDYGTVTKELVGYLDY

SEQ ID NO: 69747 - protein, 9 aa, Homo sapiens
  light chain complementarity determining region 3 for antibody 34874
QQYGNLPWT

SEQ ID NO: 69748 - protein, 13 aa, Homo sapiens
  heavy chain complementarity determining region 3 for antibody 34874
AGGNFHSGGYGEY

SEQ ID NO: 69749 - protein, 9 aa, Homo sapiens
  light chain complementarity determining region 3 for antibody 34875
QQYGNLPRT

SEQ ID NO: 69750 - protein, 13 aa, Homo sapiens
  heavy chain complementarity determining region 3 for antibody 34875
AGGQFHSSGYSDF

SEQ ID NO: 69751 - protein, 9 aa, Homo sapiens
  light chain complementarity determining region 3 for antibody 34876
QQYGNLPRP

SEQ ID NO: 69752 - protein, 13 aa, Homo sapiens
  heavy chain complementarity determining region 3 for antibody 34876
AGGNFHSGGYGEY

SEQ ID NO: 69753 - protein, 9 aa, Homo sapiens
  light chain complementarity determining region 3 for antibody 34877
QQYGNIPRT

SEQ ID NO: 69754 - protein, 13 aa, Homo sapiens
  heavy chain complementarity determining region 3 for antibody 34877
AGGKFDSTGYGDY

SEQ ID NO: 69755 - protein, 9 aa, Homo sapiens
  light chain complementarity determining region 3 for antibody 34878
QQYGMSPLT

SEQ ID NO: 69756 - protein, 17 aa, Homo sapiens
  heavy chain complementarity determining region 3 for antibody 34878
ARGLLTGLLDFWSAFDI

SEQ ID NO: 69757 - protein, 10 aa, Homo sapiens
  light chain complementarity determining region 3 for antibody 34879
QQYGGTPPFR

SEQ ID NO: 69758 - protein, 12 aa, Homo sapiens
  heavy chain complementarity determining region 3 for antibody 34879
ARETGGSYYMDA

SEQ ID NO: 69759 - protein, 9 aa, Homo sapiens
  light chain complementarity determining region 3 for antibody 34880
QQYGGSPTT

SEQ ID NO: 69760 - protein, 14 aa, Homo sapiens
  heavy chain complementarity determining region 3 for antibody 34880
ARATFMIVDYAFDI

SEQ ID NO: 69761 - protein, 8 aa, Homo sapiens
  light chain complementarity determining region 3 for antibody 34881
QQYGGSPS

SEQ ID NO: 69762 - protein, 16 aa, Homo sapiens
  heavy chain complementarity determining region 3 for antibody 34881
ATDWGRGTQWIRAFDV

SEQ ID NO: 69763 - protein, 10 aa, Homo sapiens
  light chain complementarity determining region 3 for antibody 34882
QQYGGSPLFT

SEQ ID NO: 69764 - protein, 16 aa, Homo sapiens
  heavy chain complementarity determining region 3 for antibody 34882
ARDPRYYGAGSNGMDV

SEQ ID NO: 69765 - protein, 11 aa, Homo sapiens
  light chain complementarity determining region 3 for antibody 34883
QQYETSPPGDT

SEQ ID NO: 69766 - protein, 14 aa, Homo sapiens
  heavy chain complementarity determining region 3 for antibody 34883
ARENSISRKRSFDQ

SEQ ID NO: 69767 - protein, 9 aa, Homo sapiens
  light chain complementarity determining region 3 for antibody 34884
QQYESVPVT

SEQ ID NO: 69768 - protein, 18 aa, Homo sapiens
  heavy chain complementarity determining region 3 for antibody 34884
AKDRSYFDYVSGSYRFDY

SEQ ID NO: 69769 - protein, 9 aa, Homo sapiens
  light chain complementarity determining region 3 for antibody 34885
QQYDTYPGT

SEQ ID NO: 69770 - protein, 11 aa, Homo sapiens
  heavy chain complementarity determining region 3 for antibody 34885
ARGTYGQAFDI

SEQ ID NO: 69771 - protein, 8 aa, Homo sapiens
  light chain complementarity determining region 3 for antibody 34886
QQYDTSRT

SEQ ID NO: 69772 - protein, 15 aa, Homo sapiens
  heavy chain complementarity determining region 3 for antibody 34886
AKTDYCSAGNCPFDS

SEQ ID NO: 69773 - protein, 9 aa, Homo sapiens
  light chain complementarity determining region 3 for antibody 34887
QQYDTPPWT

SEQ ID NO: 69774 - protein, 15 aa, Homo sapiens
  heavy chain complementarity determining region 3 for antibody 34887
VHTQLWFGDQCYFDF

SEQ ID NO: 69775 - protein, 9 aa, Homo sapiens
  light chain complementarity determining region 3 for antibody 34888
QQYDTPPRT

SEQ ID NO: 69776 - protein, 13 aa, Homo sapiens
  heavy chain complementarity determining region 3 for antibody 34888
ARETRIHLPAFEY

SEQ ID NO: 69777 - protein, 9 aa, Homo sapiens
  light chain complementarity determining region 3 for antibody 34889
QQYDSYSWT

SEQ ID NO: 69778 - protein, 12 aa, Homo sapiens
  heavy chain complementarity determining region 3 for antibody 34889
AGGRFGDLVYDY

SEQ ID NO: 69779 - protein, 11 aa, Homo sapiens
  light chain complementarity determining region 3 for antibody 34890
QQYDRSQPMYP

SEQ ID NO: 69780 - protein, 14 aa, Homo sapiens
  heavy chain complementarity determining region 3 for antibody 34890
ARHMTLSGTRGFDY

SEQ ID NO: 69781 - protein, 11 aa, Homo sapiens
  light chain complementarity determining region 3 for antibody 34891
QQYDRSPPGFA

SEQ ID NO: 69782 - protein, 14 aa, Homo sapiens
  heavy chain complementarity determining region 3 for antibody 34891
ARETHNSRKRSFDQ

SEQ ID NO: 69783 - protein, 8 aa, Homo sapiens
  light chain complementarity determining region 3 for antibody 34892
QQYDNYST

SEQ ID NO: 69784 - protein, 16 aa, Homo sapiens
  heavy chain complementarity determining region 3 for antibody 34892
AKDALALTSKPYYFDF

SEQ ID NO: 69785 - protein, 11 aa, Homo sapiens
  light chain complementarity determining region 3 for antibody 34893
QQYDNSALEFT

SEQ ID NO: 69786 - protein, 15 aa, Homo sapiens
  heavy chain complementarity determining region 3 for antibody 34893
VREVVTMIDPGGFDV

SEQ ID NO: 69787 - protein, 10 aa, Homo sapiens
  light chain complementarity determining region 3 for antibody 34894
QQYDNLPPLT

SEQ ID NO: 69788 - protein, 8 aa, Homo sapiens
  heavy chain complementarity determining region 3 for antibody 34894
ARGRVFDP

SEQ ID NO: 69789 - protein, 11 aa, Homo sapiens
  light chain complementarity determining region 3 for antibody 34895
QQYDNLPPAYP

SEQ ID NO: 69790 - protein, 9 aa, Homo sapiens
  heavy chain complementarity determining region 3 for antibody 34895
ASGFTAFDY

SEQ ID NO: 69791 - protein, 11 aa, Homo sapiens
  light chain complementarity determining region 3 for antibody 34896
QQYDNLPPAST

SEQ ID NO: 69792 - protein, 9 aa, Homo sapiens
  heavy chain complementarity determining region 3 for antibody 34896
ASGFTAFDY

SEQ ID NO: 69793 - protein, 8 aa, Homo sapiens
  light chain complementarity determining region 3 for antibody 34897
QQYDNLPH

SEQ ID NO: 69794 - protein, 12 aa, Homo sapiens
  heavy chain complementarity determining region 3 for antibody 34897
AKFAGSSDGFDI

SEQ ID NO: 69795 - protein, 9 aa, Homo sapiens
  light chain complementarity determining region 3 for antibody 34898
QQYDNLPFT

SEQ ID NO: 69796 - protein, 13 aa, Homo sapiens
  heavy chain complementarity determining region 3 for antibody 34898
AHRPVPRGPFFDY

SEQ ID NO: 69797 - protein, 8 aa, Homo sapiens
  light chain complementarity determining region 3 for antibody 34899
QQYDNLLL

SEQ ID NO: 69798 - protein, 20 aa, Homo sapiens
  heavy chain complementarity determining region 3 for antibody 34899
ARHLMRTEPKGRSGYYLTDY

SEQ ID NO: 69799 - protein, 9 aa, Homo sapiens
  light chain complementarity determining region 3 for antibody 34900
QQYDNIPVT

SEQ ID NO: 69800 - protein, 10 aa, Homo sapiens
  heavy chain complementarity determining region 3 for antibody 34900
ASGGGHTYGY

SEQ ID NO: 69801 - protein, 9 aa, Homo sapiens
  light chain complementarity determining region 3 for antibody 34901
QQYDGYPLT

SEQ ID NO: 69802 - protein, 12 aa, Homo sapiens
  heavy chain complementarity determining region 3 for antibody 34901
AKDQGVGAPPDS

SEQ ID NO: 69803 - protein, 10 aa, Homo sapiens
  light chain complementarity determining region 3 for antibody 34902
QQYDGWPPIT

SEQ ID NO: 69804 - protein, 12 aa, Homo sapiens
  heavy chain complementarity determining region 3 for antibody 34902
VRHGVVMAEHDS

SEQ ID NO: 69805 - protein, 10 aa, Homo sapiens
  light chain complementarity determining region 3 for antibody 34903
QQVDSSPRWT

SEQ ID NO: 69806 - protein, 16 aa, Homo sapiens
  heavy chain complementarity determining region 3 for antibody 34903
ARDSSIVVIPGGFLDL

SEQ ID NO: 69807 - protein, 9 aa, Homo sapiens
  light chain complementarity determining region 3 for antibody 34904
QQSYTTPWT

SEQ ID NO: 69808 - protein, 16 aa, Homo sapiens
  heavy chain complementarity determining region 3 for antibody 34904
TTDSITMVRGEGVFDY

SEQ ID NO: 69809 - protein, 9 aa, Homo sapiens
  light chain complementarity determining region 3 for antibody 34905
QQSYTTPRT

SEQ ID NO: 69810 - protein, 8 aa, Homo sapiens
  heavy chain complementarity determining region 3 for antibody 34905
ARDGAFDS

SEQ ID NO: 69811 - protein, 9 aa, Homo sapiens
  light chain complementarity determining region 3 for antibody 34906
QQSYTSPYT

SEQ ID NO: 69812 - protein, 16 aa, Homo sapiens
  heavy chain complementarity determining region 3 for antibody 34906
ATDWGSGTQWSRAFDV

SEQ ID NO: 69813 - protein, 9 aa, Homo sapiens
  light chain complementarity determining region 3 for antibody 34907
QQSYSTPRT

SEQ ID NO: 69814 - protein, 15 aa, Homo sapiens
  heavy chain complementarity determining region 3 for antibody 34907
VKDKVELATITAFEI

SEQ ID NO: 69815 - protein, 9 aa, Homo sapiens
  light chain complementarity determining region 3 for antibody 34908
QQSYSTPGT

SEQ ID NO: 69816 - protein, 16 aa, Homo sapiens
  heavy chain complementarity determining region 3 for antibody 34908
AKVPIPNTAMVNHLDY

SEQ ID NO: 69817 - protein, 9 aa, Homo sapiens
  light chain complementarity determining region 3 for antibody 34909
QQSYSSLPT

SEQ ID NO: 69818 - protein, 16 aa, Homo sapiens
  heavy chain complementarity determining region 3 for antibody 34909
AREGGSTYTTKRAFDS

SEQ ID NO: 69819 - protein, 9 aa, Homo sapiens
  light chain complementarity determining region 3 for antibody 34910
QQSYSILWT

SEQ ID NO: 69820 - protein, 13 aa, Homo sapiens
  heavy chain complementarity determining region 3 for antibody 34910
VTRAFRFGKVMDV

SEQ ID NO: 69821 - protein, 9 aa, Homo sapiens
  light chain complementarity determining region 3 for antibody 34911
QQSDYAPLT

SEQ ID NO: 69822 - protein, 10 aa, Homo sapiens
  heavy chain complementarity determining region 3 for antibody 34911
ASGEGWESGF

SEQ ID NO: 69823 - protein, 10 aa, Homo sapiens
  light chain complementarity determining region 3 for antibody 34912
QQRYSWPPLT

SEQ ID NO: 69824 - protein, 14 aa, Homo sapiens
  heavy chain complementarity determining region 3 for antibody 34912
AKGANLPHPYYFDY

SEQ ID NO: 69825 - protein, 8 aa, Homo sapiens
  light chain complementarity determining region 3 for antibody 34913
QQRYSALT

SEQ ID NO: 69826 - protein, 24 aa, Homo sapiens
  heavy chain complementarity determining region 3 for antibody 34913
ARGRPPSGWYRLKDRTYYYYGLDV

SEQ ID NO: 69827 - protein, 10 aa, Homo sapiens
  light chain complementarity determining region 3 for antibody 34914
QQRYQWPPYT

SEQ ID NO: 69828 - protein, 11 aa, Homo sapiens
  heavy chain complementarity determining region 3 for antibody 34914
ARGVGSYVFES

SEQ ID NO: 69829 - protein, 10 aa, Homo sapiens
  light chain complementarity determining region 3 for antibody 34915
QQRYNWPPSP

SEQ ID NO: 69830 - protein, 11 aa, Homo sapiens
  heavy chain complementarity determining region 3 for antibody 34915
ARGVGSYVFES

SEQ ID NO: 69831 - protein, 10 aa, Homo sapiens
  light chain complementarity determining region 3 for antibody 34916
QQRYNWPPNT

SEQ ID NO: 69832 - protein, 11 aa, Homo sapiens
  heavy chain complementarity determining region 3 for antibody 34916
ARGVGSYVFES

SEQ ID NO: 69833 - protein, 10 aa, Homo sapiens
  light chain complementarity determining region 3 for antibody 34917
QQRYNWPPLT

SEQ ID NO: 69834 - protein, 11 aa, Homo sapiens
  heavy chain complementarity determining region 3 for antibody 34917
ARGVGSYPFDS

SEQ ID NO: 69835 - protein, 10 aa, Homo sapiens
  light chain complementarity determining region 3 for antibody 34918
QQRYNWPPHT

SEQ ID NO: 69836 - protein, 11 aa, Homo sapiens
  heavy chain complementarity determining region 3 for antibody 34918
ARGVGSYVFES

SEQ ID NO: 69837 - protein, 10 aa, Homo sapiens
  light chain complementarity determining region 3 for antibody 34919
QQRYNWPPFP

SEQ ID NO: 69838 - protein, 11 aa, Homo sapiens
  heavy chain complementarity determining region 3 for antibody 34919
ARGVGSYPFDS

SEQ ID NO: 69839 - protein, 10 aa, Homo sapiens
  light chain complementarity determining region 3 for antibody 34920
QQRYKWPPCT

SEQ ID NO: 69840 - protein, 11 aa, Homo sapiens
  heavy chain complementarity determining region 3 for antibody 34920
ARGVGSYVFES

SEQ ID NO: 69841 - protein, 11 aa, Homo sapiens
  light chain complementarity determining region 3 for antibody 34921
QQRTDWPPVFS

SEQ ID NO: 69842 - protein, 14 aa, Homo sapiens
  heavy chain complementarity determining region 3 for antibody 34921
ATPDSGNYFDPLYI

SEQ ID NO: 69843 - protein, 9 aa, Homo sapiens
  light chain complementarity determining region 3 for antibody 34922
QQRSSRPYT

SEQ ID NO: 69844 - protein, 11 aa, Homo sapiens
  heavy chain complementarity determining region 3 for antibody 34922
VKRWGGSSIDY

SEQ ID NO: 69845 - protein, 8 aa, Homo sapiens
  light chain complementarity determining region 3 for antibody 34923
QQRSRWLS

SEQ ID NO: 69846 - protein, 12 aa, Homo sapiens
  heavy chain complementarity determining region 3 for antibody 34923
ARDASAVSEHAP

SEQ ID NO: 69847 - protein, 9 aa, Homo sapiens
  light chain complementarity determining region 3 for antibody 34924
QQRSNWPST

SEQ ID NO: 69848 - protein, 19 aa, Homo sapiens
  heavy chain complementarity determining region 3 for antibody 34924
ARDPQHYSNSSGYYYDPDH

SEQ ID NO: 69849 - protein, 9 aa, Homo sapiens
  light chain complementarity determining region 3 for antibody 34925
QQRSNWPRT

SEQ ID NO: 69850 - protein, 20 aa, Homo sapiens
  heavy chain complementarity determining region 3 for antibody 34925
ARASPVYCSGGSCYYYGMDV

SEQ ID NO: 69851 - protein, 10 aa, Homo sapiens
  light chain complementarity determining region 3 for antibody 34926
QQRSNWPPLP

SEQ ID NO: 69852 - protein, 16 aa, Homo sapiens
  heavy chain complementarity determining region 3 for antibody 34926
ARKGLLWFGESPYFDY

SEQ ID NO: 69853 - protein, 10 aa, Homo sapiens
  light chain complementarity determining region 3 for antibody 34927
QQRSNWPPIT

SEQ ID NO: 69854 - protein, 12 aa, Homo sapiens
  heavy chain complementarity determining region 3 for antibody 34927
ARDTGDFEVQVS

SEQ ID NO: 69855 - protein, 10 aa, Homo sapiens
  light chain complementarity determining region 3 for antibody 34928
QQRSNWPPFT

SEQ ID NO: 69856 - protein, 16 aa, Homo sapiens
  heavy chain complementarity determining region 3 for antibody 34928
ARPWGSGWYRNLGFDF

SEQ ID NO: 69857 - protein, 9 aa, Homo sapiens
  light chain complementarity determining region 3 for antibody 34929
QQRSNWPLP

SEQ ID NO: 69858 - protein, 11 aa, Homo sapiens
  heavy chain complementarity determining region 3 for antibody 34929
ALGQWLAPFDY

SEQ ID NO: 69859 - protein, 8 aa, Homo sapiens
  light chain complementarity determining region 3 for antibody 34930
QQRSNWPA

SEQ ID NO: 69860 - protein, 20 aa, Homo sapiens
  heavy chain complementarity determining region 3 for antibody 34930
ARVWFGERARGYYYYYGMDV

SEQ ID NO: 69861 - protein, 9 aa, Homo sapiens
  light chain complementarity determining region 3 for antibody 34931
QQRSKGPLT

SEQ ID NO: 69862 - protein, 18 aa, Homo sapiens
  heavy chain complementarity determining region 3 for antibody 34931
ARRGSRGVEAAQYNWFDP

SEQ ID NO: 69863 - protein, 9 aa, Homo sapiens
  light chain complementarity determining region 3 for antibody 34932
QQRRDWRGP

SEQ ID NO: 69864 - protein, 17 aa, Homo sapiens
  heavy chain complementarity determining region 3 for antibody 34932
AKPINIYDRSGSYSFDY

SEQ ID NO: 69865 - protein, 9 aa, Homo sapiens
  light chain complementarity determining region 3 for antibody 34933
QQRLNWPLT

SEQ ID NO: 69866 - protein, 11 aa, Homo sapiens
  heavy chain complementarity determining region 3 for antibody 34933
ARNIRGGHTDF

SEQ ID NO: 69867 - protein, 10 aa, Homo sapiens
  light chain complementarity determining region 3 for antibody 34934
QQRKNWRMYT

SEQ ID NO: 69868 - protein, 16 aa, Homo sapiens
  heavy chain complementarity determining region 3 for antibody 34934
ARDSSTYGDDFHGLDV

SEQ ID NO: 69869 - protein, 11 aa, Homo sapiens
  light chain complementarity determining region 3 for antibody 34935
QQRGSWPPIFT

SEQ ID NO: 69870 - protein, 16 aa, Homo sapiens
  heavy chain complementarity determining region 3 for antibody 34935
ARGRLTSTGTWNFPDY

SEQ ID NO: 69871 - protein, 11 aa, Homo sapiens
  light chain complementarity determining region 3 for antibody 34936
QQREEGTNWLT

SEQ ID NO: 69872 - protein, 15 aa, Homo sapiens
  heavy chain complementarity determining region 3 for antibody 34936
ARGGYSSNWYWWFDP

SEQ ID NO: 69873 - protein, 8 aa, Homo sapiens
  light chain complementarity determining region 3 for antibody 34937
QQRDDWAT

SEQ ID NO: 69874 - protein, 14 aa, Homo sapiens
  heavy chain complementarity determining region 3 for antibody 34937
ARETSNYGGYVLHF

SEQ ID NO: 69875 - protein, 9 aa, Homo sapiens
  light chain complementarity determining region 3 for antibody 34938
QQNYNTPFT

SEQ ID NO: 69876 - protein, 13 aa, Homo sapiens
  heavy chain complementarity determining region 3 for antibody 34938
VRGRNYDRDGFDP

SEQ ID NO: 69877 - protein, 9 aa, Homo sapiens
  light chain complementarity determining region 3 for antibody 34939
QQNGTSPLN

SEQ ID NO: 69878 - protein, 13 aa, Homo sapiens
  heavy chain complementarity determining region 3 for antibody 34939
ASISVGTVAAGKG

SEQ ID NO: 69879 - protein, 9 aa, Homo sapiens
  light chain complementarity determining region 3 for antibody 34940
QQNGTIPRT

SEQ ID NO: 69880 - protein, 13 aa, Homo sapiens
  heavy chain complementarity determining region 3 for antibody 34940
AGGNFHRSGYAEY

SEQ ID NO: 69881 - protein, 9 aa, Homo sapiens
  light chain complementarity determining region 3 for antibody 34941
QQNGSSPRT

SEQ ID NO: 69882 - protein, 14 aa, Homo sapiens
  heavy chain complementarity determining region 3 for antibody 34941
ARGQGLLAGDVFDV

SEQ ID NO: 69883 - protein, 10 aa, Homo sapiens
  light chain complementarity determining region 3 for antibody 34942
QQNGNSPPFT

SEQ ID NO: 69884 - protein, 13 aa, Homo sapiens
  heavy chain complementarity determining region 3 for antibody 34942
ASWSHSDLDAFDI

SEQ ID NO: 69885 - protein, 10 aa, Homo sapiens
  light chain complementarity determining region 3 for antibody 34943
QQNDSSAMFP

SEQ ID NO: 69886 - protein, 13 aa, Homo sapiens
  heavy chain complementarity determining region 3 for antibody 34943
ARVSGWSRGGFDY

SEQ ID NO: 69887 - protein, 9 aa, Homo sapiens
  light chain complementarity determining region 3 for antibody 34944
QQLNSYRLT

SEQ ID NO: 69888 - protein, 10 aa, Homo sapiens
  heavy chain complementarity determining region 3 for antibody 34944
ATSSYGIYDY

SEQ ID NO: 69889 - protein, 9 aa, Homo sapiens
  light chain complementarity determining region 3 for antibody 34945
QQHYTTPHT

SEQ ID NO: 69890 - protein, 15 aa, Homo sapiens
  heavy chain complementarity determining region 3 for antibody 34945
ARDQVPVPATAFSCH

SEQ ID NO: 69891 - protein, 8 aa, Homo sapiens
  light chain complementarity determining region 3 for antibody 34946
QQHVSSVP

SEQ ID NO: 69892 - protein, 13 aa, Homo sapiens
  heavy chain complementarity determining region 3 for antibody 34946
VRTWFGELSHFDY

SEQ ID NO: 69893 - protein, 9 aa, Homo sapiens
  light chain complementarity determining region 3 for antibody 34947
QQHNSYSVT

SEQ ID NO: 69894 - protein, 17 aa, Homo sapiens
  heavy chain complementarity determining region 3 for antibody 34947
VKESWQWLVDYYYGMDV

SEQ ID NO: 69895 - protein, 8 aa, Homo sapiens
  light chain complementarity determining region 3 for antibody 34948
QQHNSYSS

SEQ ID NO: 69896 - protein, 18 aa, Homo sapiens
  heavy chain complementarity determining region 3 for antibody 34948
ARSWKVVVASGAVRYFDY

SEQ ID NO: 69897 - protein, 9 aa, Homo sapiens
  light chain complementarity determining region 3 for antibody 34949
QQHDRFSLT

SEQ ID NO: 69898 - protein, 16 aa, Homo sapiens
  heavy chain complementarity determining region 3 for antibody 34949
ARQRWLQSEKFAYFDY

SEQ ID NO: 69899 - protein, 9 aa, Homo sapiens
  light chain complementarity determining region 3 for antibody 34950
QQHDIFPLT

SEQ ID NO: 69900 - protein, 12 aa, Homo sapiens
  heavy chain complementarity determining region 3 for antibody 34950
TTDRSYGYYFPY

SEQ ID NO: 69901 - protein, 9 aa, Homo sapiens
  light chain complementarity determining region 3 for antibody 34951
QQGYSSPFT

SEQ ID NO: 69902 - protein, 15 aa, Homo sapiens
  heavy chain complementarity determining region 3 for antibody 34951
SKAQIIWGQLYYFQS

SEQ ID NO: 69903 - protein, 9 aa, Homo sapiens
  light chain complementarity determining region 3 for antibody 34952
QQGYSPPFI

SEQ ID NO: 69904 - protein, 15 aa, Homo sapiens
  heavy chain complementarity determining region 3 for antibody 34952
TRAQVIWGQLYYFDY

SEQ ID NO: 69905 - protein, 9 aa, Homo sapiens
  light chain complementarity determining region 3 for antibody 34953
QQGHDFPPT

SEQ ID NO: 69906 - protein, 16 aa, Homo sapiens
  heavy chain complementarity determining region 3 for antibody 34953
ASNPCVGGGCYQPFDN

SEQ ID NO: 69907 - protein, 9 aa, Homo sapiens
  light chain complementarity determining region 3 for antibody 34954
QQGAVSPLT

SEQ ID NO: 69908 - protein, 10 aa, Homo sapiens
  heavy chain complementarity determining region 3 for antibody 34954
SSGSGWTSED

SEQ ID NO: 69909 - protein, 9 aa, Homo sapiens
  light chain complementarity determining region 3 for antibody 34955
QQFYNNPFT

SEQ ID NO: 69910 - protein, 14 aa, Homo sapiens
  heavy chain complementarity determining region 3 for antibody 34955
ARQEHSDIWHAVDH

SEQ ID NO: 69911 - protein, 9 aa, Homo sapiens
  light chain complementarity determining region 3 for antibody 34956
QQFNTYPLT

SEQ ID NO: 69912 - protein, 25 aa, Homo sapiens
  heavy chain complementarity determining region 3 for antibody 34956
ASRGVSRLVFAPAATSRGGNYGMDV

SEQ ID NO: 69913 - protein, 10 aa, Homo sapiens
  light chain complementarity determining region 3 for antibody 34957
QQFGGSPPYS

SEQ ID NO: 69914 - protein, 15 aa, Homo sapiens
  heavy chain complementarity determining region 3 for antibody 34957
AREGIWTGYPYGMDV

SEQ ID NO: 69915 - protein, 11 aa, Homo sapiens
  light chain complementarity determining region 3 for antibody 34958
QQFAGSPPGGT

SEQ ID NO: 69916 - protein, 15 aa, Homo sapiens
  heavy chain complementarity determining region 3 for antibody 34958
AKTQTPYGDYGSVDY

SEQ ID NO: 69917 - protein, 10 aa, Homo sapiens
  light chain complementarity determining region 3 for antibody 34959
QQDGTAPPYT

SEQ ID NO: 69918 - protein, 10 aa, Homo sapiens
  heavy chain complementarity determining region 3 for antibody 34959
GGGPGWLTYA

SEQ ID NO: 69919 - protein, 9 aa, Homo sapiens
  light chain complementarity determining region 3 for antibody 34960
QQDGSSPGT

SEQ ID NO: 69920 - protein, 14 aa, Homo sapiens
  heavy chain complementarity determining region 3 for antibody 34960
VRDRYDGGNSPFDY

SEQ ID NO: 69921 - protein, 9 aa, Homo sapiens
  light chain complementarity determining region 3 for antibody 34961
QQDGSSAIT

SEQ ID NO: 69922 - protein, 14 aa, Homo sapiens
  heavy chain complementarity determining region 3 for antibody 34961
GARQDVGDGALREF

SEQ ID NO: 69923 - protein, 9 aa, Homo sapiens
  light chain complementarity determining region 3 for antibody 34962
QQDAKSPWT

SEQ ID NO: 69924 - protein, 13 aa, Homo sapiens
  heavy chain complementarity determining region 3 for antibody 34962
ARDSADYGDPLDY

SEQ ID NO: 69925 - protein, 9 aa, Homo sapiens
  light chain complementarity determining region 3 for antibody 34963
QQCVASPGT

SEQ ID NO: 69926 - protein, 15 aa, Homo sapiens
  heavy chain complementarity determining region 3 for antibody 34963
ASPPVGDVPNGVFDI

SEQ ID NO: 69927 - protein, 9 aa, Homo sapiens
  light chain complementarity determining region 3 for antibody 34964
QQARFFPLS

SEQ ID NO: 69928 - protein, 16 aa, Homo sapiens
  heavy chain complementarity determining region 3 for antibody 34964
AKDPRERTFGPFFFDY

SEQ ID NO: 69929 - protein, 9 aa, Homo sapiens
  light chain complementarity determining region 3 for antibody 34965
QQANNFPLP

SEQ ID NO: 69930 - protein, 13 aa, Homo sapiens
  heavy chain complementarity determining region 3 for antibody 34965
ASSIVGATFYFDY

SEQ ID NO: 69931 - protein, 9 aa, Homo sapiens
  light chain complementarity determining region 3 for antibody 34966
QPYGSSPRT

SEQ ID NO: 69932 - protein, 17 aa, Homo sapiens
  heavy chain complementarity determining region 3 for antibody 34966
ARALDIVVVVDAIWFDP

SEQ ID NO: 69933 - protein, 9 aa, Homo sapiens
  light chain complementarity determining region 3 for antibody 34967
QPYAGSPGT

SEQ ID NO: 69934 - protein, 8 aa, Homo sapiens
  heavy chain complementarity determining region 3 for antibody 34967
ARGLSLDS

SEQ ID NO: 69935 - protein, 9 aa, Homo sapiens
  light chain complementarity determining region 3 for antibody 34968
QPRSSWPYT

SEQ ID NO: 69936 - protein, 11 aa, Homo sapiens
  heavy chain complementarity determining region 3 for antibody 34968
VKRWGGSSIDY

SEQ ID NO: 69937 - protein, 10 aa, Homo sapiens
  light chain complementarity determining region 3 for antibody 34969
QLYSRSPTWR

SEQ ID NO: 69938 - protein, 19 aa, Homo sapiens
  heavy chain complementarity determining region 3 for antibody 34969
ARESYYPDIGGYTPRAFDI

SEQ ID NO: 69939 - protein, 9 aa, Homo sapiens
  light chain complementarity determining region 3 for antibody 34970
QKYSGAPLT

SEQ ID NO: 69940 - protein, 14 aa, Homo sapiens
  heavy chain complementarity determining region 3 for antibody 34970
ARERGVMTTLLLVY

SEQ ID NO: 69941 - protein, 9 aa, Homo sapiens
  light chain complementarity determining region 3 for antibody 34971
QKYNSAPRT

SEQ ID NO: 69942 - protein, 14 aa, Homo sapiens
  heavy chain complementarity determining region 3 for antibody 34971
ARDDGGSTSYDLDY

SEQ ID NO: 69943 - protein, 9 aa, Homo sapiens
  light chain complementarity determining region 3 for antibody 34972
QKYNSAPLT

SEQ ID NO: 69944 - protein, 20 aa, Homo sapiens
  heavy chain complementarity determining region 3 for antibody 34972
ATVRRGRGSSVYYVGGAFDI

SEQ ID NO: 69945 - protein, 9 aa, Homo sapiens
  light chain complementarity determining region 3 for antibody 34973
QKYNSAPLT

SEQ ID NO: 69946 - protein, 20 aa, Homo sapiens
  heavy chain complementarity determining region 3 for antibody 34973
AAVLRGRGSSVYYVGGAFDI

SEQ ID NO: 69947 - protein, 9 aa, Homo sapiens
  light chain complementarity determining region 3 for antibody 34974
QKYNSAPLP

SEQ ID NO: 69948 - protein, 11 aa, Homo sapiens
  heavy chain complementarity determining region 3 for antibody 34974
ATKFKGAPLDY

SEQ ID NO: 69949 - protein, 8 aa, Homo sapiens
  light chain complementarity determining region 3 for antibody 34975
QKYGSSPL

SEQ ID NO: 69950 - protein, 14 aa, Homo sapiens
  heavy chain complementarity determining region 3 for antibody 34975
ARDMWDVGDTPPAY

SEQ ID NO: 69951 - protein, 11 aa, Homo sapiens
  light chain complementarity determining region 3 for antibody 34976
QKYDTGPPGLP

SEQ ID NO: 69952 - protein, 11 aa, Homo sapiens
  heavy chain complementarity determining region 3 for antibody 34976
VSARGGNYFDY

SEQ ID NO: 69953 - protein, 9 aa, Homo sapiens
  light chain complementarity determining region 3 for antibody 34977
QKYDTAPWT

SEQ ID NO: 69954 - protein, 15 aa, Homo sapiens
  heavy chain complementarity determining region 3 for antibody 34977
LRDIKGPSAGIPYDS

SEQ ID NO: 69955 - protein, 11 aa, Homo sapiens
  light chain complementarity determining region 3 for antibody 34978
QKNGTAPPGIA

SEQ ID NO: 69956 - protein, 12 aa, Homo sapiens
  heavy chain complementarity determining region 3 for antibody 34978
AKKIGNFDVLDV

SEQ ID NO: 69957 - protein, 9 aa, Homo sapiens
  light chain complementarity determining region 3 for antibody 34979
QHYKSYPLT

SEQ ID NO: 69958 - protein, 12 aa, Homo sapiens
  heavy chain complementarity determining region 3 for antibody 34979
TVGLSGIYSLDY

SEQ ID NO: 69959 - protein, 10 aa, Homo sapiens
  light chain complementarity determining region 3 for antibody 34980
QHYHNWPPGT

SEQ ID NO: 69960 - protein, 13 aa, Homo sapiens
  heavy chain complementarity determining region 3 for antibody 34980
AKGRVRELYYFET

SEQ ID NO: 69961 - protein, 10 aa, Homo sapiens
  light chain complementarity determining region 3 for antibody 34981
QHYHNRPPWT

SEQ ID NO: 69962 - protein, 13 aa, Homo sapiens
  heavy chain complementarity determining region 3 for antibody 34981
AKGRVRELYYFET

SEQ ID NO: 69963 - protein, 10 aa, Homo sapiens
  light chain complementarity determining region 3 for antibody 34982
QHYGISPRFT

SEQ ID NO: 69964 - protein, 12 aa, Homo sapiens
  heavy chain complementarity determining region 3 for antibody 34982
ARGVVGATASDF

SEQ ID NO: 69965 - protein, 10 aa, Homo sapiens
  light chain complementarity determining region 3 for antibody 34983
QHYGISPRFP

SEQ ID NO: 69966 - protein, 12 aa, Homo sapiens
  heavy chain complementarity determining region 3 for antibody 34983
ARDVVGATASDF

SEQ ID NO: 69967 - protein, 9 aa, Homo sapiens
  light chain complementarity determining region 3 for antibody 34984
QHYDSLSLT

SEQ ID NO: 69968 - protein, 12 aa, Homo sapiens
  heavy chain complementarity determining region 3 for antibody 34984
ATDIGGSDGLDF

SEQ ID NO: 69969 - protein, 9 aa, Homo sapiens
  light chain complementarity determining region 3 for antibody 34985
QHTNTFPRT

SEQ ID NO: 69970 - protein, 20 aa, Homo sapiens
  heavy chain complementarity determining region 3 for antibody 34985
GRGRRIAALSTAHYYYGMDV

SEQ ID NO: 69971 - protein, 9 aa, Homo sapiens
  light chain complementarity determining region 3 for antibody 34986
QHTHTFPRT

SEQ ID NO: 69972 - protein, 20 aa, Homo sapiens
  heavy chain complementarity determining region 3 for antibody 34986
GRGRRIAALSTAHDYYGMDV

SEQ ID NO: 69973 - protein, 9 aa, Homo sapiens
  light chain complementarity determining region 3 for antibody 34987
QHSHSRPFT

SEQ ID NO: 69974 - protein, 20 aa, Homo sapiens
  heavy chain complementarity determining region 3 for antibody 34987
AKGIAVAALRTVYYYYGMDA

SEQ ID NO: 69975 - protein, 9 aa, Homo sapiens
  light chain complementarity determining region 3 for antibody 34988
QHSHSRPFT

SEQ ID NO: 69976 - protein, 20 aa, Homo sapiens
  heavy chain complementarity determining region 3 for antibody 34988
AKGIAVAALRTVYDYYGMDV

SEQ ID NO: 69977 - protein, 10 aa, Homo sapiens
  light chain complementarity determining region 3 for antibody 34989
QHRTDWLPLP

SEQ ID NO: 69978 - protein, 15 aa, Homo sapiens
  heavy chain complementarity determining region 3 for antibody 34989
ARDVGIDYNEGDRDY

SEQ ID NO: 69979 - protein, 8 aa, Homo sapiens
  light chain complementarity determining region 3 for antibody 34990
QHRSDWPP

SEQ ID NO: 69980 - protein, 12 aa, Homo sapiens
  heavy chain complementarity determining region 3 for antibody 34990
VRQSPQNWFYDL

SEQ ID NO: 69981 - protein, 9 aa, Homo sapiens
  light chain complementarity determining region 3 for antibody 34991
QHRRTWLYR

SEQ ID NO: 69982 - protein, 20 aa, Homo sapiens
  heavy chain complementarity determining region 3 for antibody 34991
ARDGSAGMAARGTPYYGLDV

SEQ ID NO: 69983 - protein, 10 aa, Homo sapiens
  light chain complementarity determining region 3 for antibody 34992
QHHHNWPPWT

SEQ ID NO: 69984 - protein, 13 aa, Homo sapiens
  heavy chain complementarity determining region 3 for antibody 34992
AKGRVRELYYFET

SEQ ID NO: 69985 - protein, 9 aa, Homo sapiens
  light chain complementarity determining region 3 for antibody 34993
QHGYRTPFT

SEQ ID NO: 69986 - protein, 15 aa, Homo sapiens
  heavy chain complementarity determining region 3 for antibody 34993
AKAQVIWGQLYYFDS

SEQ ID NO: 69987 - protein, 11 aa, Homo sapiens
  light chain complementarity determining region 3 for antibody 34994
QFYGASPPVSG

SEQ ID NO: 69988 - protein, 14 aa, Homo sapiens
  heavy chain complementarity determining region 3 for antibody 34994
AKHMPVPGTRGFDA

SEQ ID NO: 69989 - protein, 10 aa, Homo sapiens
  light chain complementarity determining region 3 for antibody 34995
QEYTTYSRRA

SEQ ID NO: 69990 - protein, 16 aa, Homo sapiens
  heavy chain complementarity determining region 3 for antibody 34995
ARGLSAAGRKSGALEI

SEQ ID NO: 69991 - protein, 6 aa, Homo sapiens
  light chain complementarity determining region 3 for antibody 34996
QEYGST

SEQ ID NO: 69992 - protein, 12 aa, Homo sapiens
  heavy chain complementarity determining region 3 for antibody 34996
ARDHISGWSLAN

SEQ ID NO: 69993 - protein, 11 aa, Homo sapiens
  light chain complementarity determining region 3 for antibody 34997
QERSSWPPIFT

SEQ ID NO: 69994 - protein, 11 aa, Homo sapiens
  heavy chain complementarity determining region 3 for antibody 34997
GSWSYSGNGDY

SEQ ID NO: 69995 - protein, 10 aa, Homo sapiens
  light chain complementarity determining region 3 for antibody 34998
QCRDEWPPVL

SEQ ID NO: 69996 - protein, 12 aa, Homo sapiens
  heavy chain complementarity determining region 3 for antibody 34998
VRDHITGWKFDY

SEQ ID NO: 69997 - protein, 10 aa, Homo sapiens
  light chain complementarity determining region 3 for antibody 34999
QCRDEWPPGI

SEQ ID NO: 69998 - protein, 12 aa, Homo sapiens
  heavy chain complementarity determining region 3 for antibody 34999
VRDHITGWKFDY

SEQ ID NO: 69999 - protein, 10 aa, Homo sapiens
  light chain complementarity determining region 3 for antibody 35000
QCRDEGPPVI

SEQ ID NO: 70000 - protein, 12 aa, Homo sapiens
  heavy chain complementarity determining region 3 for antibody 35000
VRDHITGWKFDY

SEQ ID NO: 70001 - protein, 10 aa, Homo sapiens
  light chain complementarity determining region 3 for antibody 35001
QCRDDWPPVI

SEQ ID NO: 70002 - protein, 12 aa, Homo sapiens
  heavy chain complementarity determining region 3 for antibody 35001
VRDHITGWKFDY

SEQ ID NO: 70003 - protein, 9 aa, Homo sapiens
  light chain complementarity determining region 3 for antibody 35002
PHYNASSWT

SEQ ID NO: 70004 - protein, 16 aa, Homo sapiens
  heavy chain complementarity determining region 3 for antibody 35002
ASLGGAHYYGPGSHYF

SEQ ID NO: 70005 - protein, 9 aa, Homo sapiens
  light chain complementarity determining region 3 for antibody 35003
MQTVQFVGT

SEQ ID NO: 70006 - protein, 14 aa, Homo sapiens
  heavy chain complementarity determining region 3 for antibody 35003
ARSVNTGQYYGLGY

SEQ ID NO: 70007 - protein, 9 aa, Homo sapiens
  light chain complementarity determining region 3 for antibody 35004
MQTLHTPWT

SEQ ID NO: 70008 - protein, 16 aa, Homo sapiens
  heavy chain complementarity determining region 3 for antibody 35004
AGVQTAAVIHVYGLDV

SEQ ID NO: 70009 - protein, 10 aa, Homo sapiens
  light chain complementarity determining region 3 for antibody 35005
MQTAHWPPPT

SEQ ID NO: 70010 - protein, 14 aa, Homo sapiens
  heavy chain complementarity determining region 3 for antibody 35005
ATEVLKWVAELSDF

SEQ ID NO: 70011 - protein, 9 aa, Homo sapiens
  light chain complementarity determining region 3 for antibody 35006
MQRRRWPHT

SEQ ID NO: 70012 - protein, 8 aa, Homo sapiens
  heavy chain complementarity determining region 3 for antibody 35006
TAWGSSQH

SEQ ID NO: 70013 - protein, 10 aa, Homo sapiens
  light chain complementarity determining region 3 for antibody 35007
MQRIQPPRGT

SEQ ID NO: 70014 - protein, 8 aa, Homo sapiens
  heavy chain complementarity determining region 3 for antibody 35007
AKGYGFDC

SEQ ID NO: 70015 - protein, 9 aa, Homo sapiens
  light chain complementarity determining region 3 for antibody 35008
MQHTHWPWT

SEQ ID NO: 70016 - protein, 12 aa, Homo sapiens
  heavy chain complementarity determining region 3 for antibody 35008
ATSPHRDSRSAY

SEQ ID NO: 70017 - protein, 9 aa, Homo sapiens
  light chain complementarity determining region 3 for antibody 35009
MQHTHGPWT

SEQ ID NO: 70018 - protein, 12 aa, Homo sapiens
  heavy chain complementarity determining region 3 for antibody 35009
ATSPHRDSRSSY

SEQ ID NO: 70019 - protein, 8 aa, Homo sapiens
  light chain complementarity determining region 3 for antibody 35010
MQGTYGPT

SEQ ID NO: 70020 - protein, 17 aa, Homo sapiens
  heavy chain complementarity determining region 3 for antibody 35010
SIYWYDGNYANPDYFDY

SEQ ID NO: 70021 - protein, 8 aa, Homo sapiens
  light chain complementarity determining region 3 for antibody 35011
MQGTSGRT

SEQ ID NO: 70022 - protein, 17 aa, Homo sapiens
  heavy chain complementarity determining region 3 for antibody 35011
AHRRYYNGNWNGATVDV

SEQ ID NO: 70023 - protein, 8 aa, Homo sapiens
  light chain complementarity determining region 3 for antibody 35012
MQGTSGRA

SEQ ID NO: 70024 - protein, 17 aa, Homo sapiens
  heavy chain complementarity determining region 3 for antibody 35012
AHRRYYNGNWNGATCDV

SEQ ID NO: 70025 - protein, 8 aa, Homo sapiens
  light chain complementarity determining region 3 for antibody 35013
MQGTSGGT

SEQ ID NO: 70026 - protein, 17 aa, Homo sapiens
  heavy chain complementarity determining region 3 for antibody 35013
AHRRYYNGNWNGATFDV

SEQ ID NO: 70027 - protein, 9 aa, Homo sapiens
  light chain complementarity determining region 3 for antibody 35014
MQGTRGPYT

SEQ ID NO: 70028 - protein, 19 aa, Homo sapiens
  heavy chain complementarity determining region 3 for antibody 35014
ARDWGTEVTAGVWIGWFDP

SEQ ID NO: 70029 - protein, 10 aa, Homo sapiens
  light chain complementarity determining region 3 for antibody 35015
MQGTPWPPWT

SEQ ID NO: 70030 - protein, 7 aa, Homo sapiens
  heavy chain complementarity determining region 3 for antibody 35015
VRGTFDI

SEQ ID NO: 70031 - protein, 9 aa, Homo sapiens
  light chain complementarity determining region 3 for antibody 35016
MQGTNWPWT

SEQ ID NO: 70032 - protein, 10 aa, Homo sapiens
  heavy chain complementarity determining region 3 for antibody 35016
ARETHWGPDY

SEQ ID NO: 70033 - protein, 8 aa, Homo sapiens
  light chain complementarity determining region 3 for antibody 35017
MQGTHWVT

SEQ ID NO: 70034 - protein, 15 aa, Homo sapiens
  heavy chain complementarity determining region 3 for antibody 35017
AKAPPGGTWGPSFDC

SEQ ID NO: 70035 - protein, 10 aa, Homo sapiens
  light chain complementarity determining region 3 for antibody 35018
MQGTHWPRPT

SEQ ID NO: 70036 - protein, 12 aa, Homo sapiens
  heavy chain complementarity determining region 3 for antibody 35018
VPFRRNNWYEGI

SEQ ID NO: 70037 - protein, 10 aa, Homo sapiens
  light chain complementarity determining region 3 for antibody 35019
MQGTHWPPYT

SEQ ID NO: 70038 - protein, 16 aa, Homo sapiens
  heavy chain complementarity determining region 3 for antibody 35019
ARPVPTYYYDSSGPDY

SEQ ID NO: 70039 - protein, 10 aa, Homo sapiens
  light chain complementarity determining region 3 for antibody 35020
MQGTHWPPPT

SEQ ID NO: 70040 - protein, 18 aa, Homo sapiens
  heavy chain complementarity determining region 3 for antibody 35020
ARKSSGWYSLSAYWYFDL

SEQ ID NO: 70041 - protein, 11 aa, Homo sapiens
  light chain complementarity determining region 3 for antibody 35021
MQGTHWPPMYP

SEQ ID NO: 70042 - protein, 17 aa, Homo sapiens
  heavy chain complementarity determining region 3 for antibody 35021
ARGGSGYYQEGDDTFGF

SEQ ID NO: 70043 - protein, 10 aa, Homo sapiens
  light chain complementarity determining region 3 for antibody 35022
MQGTHWPPLT

SEQ ID NO: 70044 - protein, 18 aa, Homo sapiens
  heavy chain complementarity determining region 3 for antibody 35022
ARKSSGWYSLSAYWYFDL

SEQ ID NO: 70045 - protein, 9 aa, Homo sapiens
  light chain complementarity determining region 3 for antibody 35023
MQGTHWPGT

SEQ ID NO: 70046 - protein, 10 aa, Homo sapiens
  heavy chain complementarity determining region 3 for antibody 35023
ARVSLGGFDP

SEQ ID NO: 70047 - protein, 9 aa, Homo sapiens
  light chain complementarity determining region 3 for antibody 35024
MQGTHWPGT

SEQ ID NO: 70048 - protein, 10 aa, Homo sapiens
  heavy chain complementarity determining region 3 for antibody 35024
ARDWGLGSGN

SEQ ID NO: 70049 - protein, 9 aa, Homo sapiens
  light chain complementarity determining region 3 for antibody 35025
MQGTHWPGT

SEQ ID NO: 70050 - protein, 12 aa, Homo sapiens
  heavy chain complementarity determining region 3 for antibody 35025
AKGPLIAMTGMI

SEQ ID NO: 70051 - protein, 9 aa, Homo sapiens
  light chain complementarity determining region 3 for antibody 35026
MQGTHGPWT

SEQ ID NO: 70052 - protein, 10 aa, Homo sapiens
  heavy chain complementarity determining region 3 for antibody 35026
ARETHWGPDY

SEQ ID NO: 70053 - protein, 10 aa, Homo sapiens
  light chain complementarity determining region 3 for antibody 35027
MQGTHGPPWT

SEQ ID NO: 70054 - protein, 7 aa, Homo sapiens
  heavy chain complementarity determining region 3 for antibody 35027
VRGTFDI

SEQ ID NO: 70055 - protein, 9 aa, Homo sapiens
  light chain complementarity determining region 3 for antibody 35028
MQGTHGPLT

SEQ ID NO: 70056 - protein, 10 aa, Homo sapiens
  heavy chain complementarity determining region 3 for antibody 35028
ASLNRRTSRR

SEQ ID NO: 70057 - protein, 9 aa, Homo sapiens
  light chain complementarity determining region 3 for antibody 35029
MQGTHGPLT

SEQ ID NO: 70058 - protein, 18 aa, Homo sapiens
  heavy chain complementarity determining region 3 for antibody 35029
AKDLRAFIMRVESDNFQV

SEQ ID NO: 70059 - protein, 9 aa, Homo sapiens
  light chain complementarity determining region 3 for antibody 35030
MQGTHGPHT

SEQ ID NO: 70060 - protein, 17 aa, Homo sapiens
  heavy chain complementarity determining region 3 for antibody 35030
AREPQAHNDLYSGYEKN

SEQ ID NO: 70061 - protein, 9 aa, Homo sapiens
  light chain complementarity determining region 3 for antibody 35031
MQGSHWPPP

SEQ ID NO: 70062 - protein, 13 aa, Homo sapiens
  heavy chain complementarity determining region 3 for antibody 35031
VRNLGDGYNSIDY

SEQ ID NO: 70063 - protein, 9 aa, Homo sapiens
  light chain complementarity determining region 3 for antibody 35032
MQGSHGPPT

SEQ ID NO: 70064 - protein, 13 aa, Homo sapiens
  heavy chain complementarity determining region 3 for antibody 35032
ARDLGDGYNSIDY

SEQ ID NO: 70065 - protein, 9 aa, Homo sapiens
  light chain complementarity determining region 3 for antibody 35033
MQGRRWPHT

SEQ ID NO: 70066 - protein, 8 aa, Homo sapiens
  heavy chain complementarity determining region 3 for antibody 35033
TAWGSSQH

SEQ ID NO: 70067 - protein, 9 aa, Homo sapiens
  light chain complementarity determining region 3 for antibody 35034
MQGQQTRFT

SEQ ID NO: 70068 - protein, 20 aa, Homo sapiens
  heavy chain complementarity determining region 3 for antibody 35034
AREGHRATARNRYYYNGIDV

SEQ ID NO: 70069 - protein, 9 aa, Homo sapiens
  light chain complementarity determining region 3 for antibody 35035
MQGLQTPYT

SEQ ID NO: 70070 - protein, 10 aa, Homo sapiens
  heavy chain complementarity determining region 3 for antibody 35035
GSDLTGASDH

SEQ ID NO: 70071 - protein, 9 aa, Homo sapiens
  light chain complementarity determining region 3 for antibody 35036
MQGLQTPST

SEQ ID NO: 70072 - protein, 10 aa, Homo sapiens
  heavy chain complementarity determining region 3 for antibody 35036
GRDLSGARDY

SEQ ID NO: 70073 - protein, 9 aa, Homo sapiens
  light chain complementarity determining region 3 for antibody 35037
MQGLQTPNT

SEQ ID NO: 70074 - protein, 10 aa, Homo sapiens
  heavy chain complementarity determining region 3 for antibody 35037
GSDLTGARDH

SEQ ID NO: 70075 - protein, 9 aa, Homo sapiens
  light chain complementarity determining region 3 for antibody 35038
MQGLQTPGT

SEQ ID NO: 70076 - protein, 13 aa, Homo sapiens
  heavy chain complementarity determining region 3 for antibody 35038
AKVVNTGPGGLQS

SEQ ID NO: 70077 - protein, 9 aa, Homo sapiens
  light chain complementarity determining region 3 for antibody 35039
MQGLKTPYT

SEQ ID NO: 70078 - protein, 10 aa, Homo sapiens
  heavy chain complementarity determining region 3 for antibody 35039
GSDLSGARDY

SEQ ID NO: 70079 - protein, 9 aa, Homo sapiens
  light chain complementarity determining region 3 for antibody 35040
MQDTHWPPT

SEQ ID NO: 70080 - protein, 14 aa, Homo sapiens
  heavy chain complementarity determining region 3 for antibody 35040
ARFMVRDVLYFFDF

SEQ ID NO: 70081 - protein, 10 aa, Homo sapiens
  light chain complementarity determining region 3 for antibody 35041
MQATHWPGVT

SEQ ID NO: 70082 - protein, 10 aa, Homo sapiens
  heavy chain complementarity determining region 3 for antibody 35041
ATSQLSTTDY

SEQ ID NO: 70083 - protein, 8 aa, Homo sapiens
  light chain complementarity determining region 3 for antibody 35042
MQALQTRT

SEQ ID NO: 70084 - protein, 13 aa, Homo sapiens
  heavy chain complementarity determining region 3 for antibody 35042
ARDESYGGYGMDV

SEQ ID NO: 70085 - protein, 9 aa, Homo sapiens
  light chain complementarity determining region 3 for antibody 35043
MQALQTPYT

SEQ ID NO: 70086 - protein, 12 aa, Homo sapiens
  heavy chain complementarity determining region 3 for antibody 35043
ARARGVAGKLDY

SEQ ID NO: 70087 - protein, 9 aa, Homo sapiens
  light chain complementarity determining region 3 for antibody 35044
MQALQTPPT

SEQ ID NO: 70088 - protein, 11 aa, Homo sapiens
  heavy chain complementarity determining region 3 for antibody 35044
VREEFGWEMTY

SEQ ID NO: 70089 - protein, 9 aa, Homo sapiens
  light chain complementarity determining region 3 for antibody 35045
MQALQTPPT

SEQ ID NO: 70090 - protein, 23 aa, Homo sapiens
  heavy chain complementarity determining region 3 for antibody 35045
ARGGPLGFCTEDACYGGEHPFDV

SEQ ID NO: 70091 - protein, 9 aa, Homo sapiens
  light chain complementarity determining region 3 for antibody 35046
MQALQTPHT

SEQ ID NO: 70092 - protein, 12 aa, Homo sapiens
  heavy chain complementarity determining region 3 for antibody 35046
ATAVSGWYRLDY

SEQ ID NO: 70093 - protein, 9 aa, Homo sapiens
  light chain complementarity determining region 3 for antibody 35047
MQALQTPGT

SEQ ID NO: 70094 - protein, 11 aa, Homo sapiens
  heavy chain complementarity determining region 3 for antibody 35047
AQGRLVFLTDY

SEQ ID NO: 70095 - protein, 9 aa, Homo sapiens
  light chain complementarity determining region 3 for antibody 35048
MQALQFPIT

SEQ ID NO: 70096 - protein, 12 aa, Homo sapiens
  heavy chain complementarity determining region 3 for antibody 35048
ARDGGKSWSELT

SEQ ID NO: 70097 - protein, 9 aa, Homo sapiens
  light chain complementarity determining region 3 for antibody 35049
MQALQAPFT

SEQ ID NO: 70098 - protein, 13 aa, Homo sapiens
  heavy chain complementarity determining region 3 for antibody 35049
TMVVDYGDYGFDC

SEQ ID NO: 70099 - protein, 8 aa, Homo sapiens
  light chain complementarity determining region 3 for antibody 35050
MQALHTWP

SEQ ID NO: 70100 - protein, 18 aa, Homo sapiens
  heavy chain complementarity determining region 3 for antibody 35050
ARSRPYGGDANPARHFDY

SEQ ID NO: 70101 - protein, 9 aa, Homo sapiens
  light chain complementarity determining region 3 for antibody 35051
MQALGTPFT

SEQ ID NO: 70102 - protein, 15 aa, Homo sapiens
  heavy chain complementarity determining region 3 for antibody 35051
VRHYRELTTGIEGDS

SEQ ID NO: 70103 - protein, 9 aa, Homo sapiens
  light chain complementarity determining region 3 for antibody 35052
MQALETPFT

SEQ ID NO: 70104 - protein, 15 aa, Homo sapiens
  heavy chain complementarity determining region 3 for antibody 35052
VRHYRETVAGIGGDS

SEQ ID NO: 70105 - protein, 9 aa, Homo sapiens
  light chain complementarity determining region 3 for antibody 35053
MQALETPFS

SEQ ID NO: 70106 - protein, 15 aa, Homo sapiens
  heavy chain complementarity determining region 3 for antibody 35053
VRHYRETVAGIEGDC

SEQ ID NO: 70107 - protein, 9 aa, Homo sapiens
  light chain complementarity determining region 3 for antibody 35054
MQALETPFP

SEQ ID NO: 70108 - protein, 15 aa, Homo sapiens
  heavy chain complementarity determining region 3 for antibody 35054
VRHYRIITAPLEGDS

SEQ ID NO: 70109 - protein, 9 aa, Homo sapiens
  light chain complementarity determining region 3 for antibody 35055
MQALEPPFT

SEQ ID NO: 70110 - protein, 15 aa, Homo sapiens
  heavy chain complementarity determining region 3 for antibody 35055
VRHYRITVAAVEGDS

SEQ ID NO: 70111 - protein, 9 aa, Homo sapiens
  light chain complementarity determining region 3 for antibody 35056
MQALDTPFT

SEQ ID NO: 70112 - protein, 15 aa, Homo sapiens
  heavy chain complementarity determining region 3 for antibody 35056
VRHYRIITAPLEGDS

SEQ ID NO: 70113 - protein, 9 aa, Homo sapiens
  light chain complementarity determining region 3 for antibody 35057
MQALATPFT

SEQ ID NO: 70114 - protein, 15 aa, Homo sapiens
  heavy chain complementarity determining region 3 for antibody 35057
VRHYRELATGIEGDS

SEQ ID NO: 70115 - protein, 9 aa, Homo sapiens
  light chain complementarity determining region 3 for antibody 35058
MQAIETPFT

SEQ ID NO: 70116 - protein, 15 aa, Homo sapiens
  heavy chain complementarity determining region 3 for antibody 35058
VRHYRETVAGIEGDS

SEQ ID NO: 70117 - protein, 9 aa, Homo sapiens
  light chain complementarity determining region 3 for antibody 35059
MPGTHWPWT

SEQ ID NO: 70118 - protein, 10 aa, Homo sapiens
  heavy chain complementarity determining region 3 for antibody 35059
ARETHWGPDY

SEQ ID NO: 70119 - protein, 9 aa, Homo sapiens
  light chain complementarity determining region 3 for antibody 35060
MHALETPFT

SEQ ID NO: 70120 - protein, 15 aa, Homo sapiens
  heavy chain complementarity determining region 3 for antibody 35060
VRHYRETVAGIEGDS

SEQ ID NO: 70121 - protein, 9 aa, Homo sapiens
  light chain complementarity determining region 3 for antibody 35061
MGTLQTPPA

SEQ ID NO: 70122 - protein, 15 aa, Homo sapiens
  heavy chain complementarity determining region 3 for antibody 35061
TRDGKKDGHNDAFDI

SEQ ID NO: 70123 - protein, 9 aa, Homo sapiens
  light chain complementarity determining region 3 for antibody 35062
MGPLQTPPT

SEQ ID NO: 70124 - protein, 15 aa, Homo sapiens
  heavy chain complementarity determining region 3 for antibody 35062
TRDGKKDGHNDAFDI

SEQ ID NO: 70125 - protein, 9 aa, Homo sapiens
  light chain complementarity determining region 3 for antibody 35063
MASRHGPLS

SEQ ID NO: 70126 - protein, 8 aa, Homo sapiens
  heavy chain complementarity determining region 3 for antibody 35063
ARGRSMSE

SEQ ID NO: 70127 - protein, 9 aa, Homo sapiens
  light chain complementarity determining region 3 for antibody 35064
LQYYSTPWT

SEQ ID NO: 70128 - protein, 15 aa, Homo sapiens
  heavy chain complementarity determining region 3 for antibody 35064
IRQSKVDNYYNYPDF

SEQ ID NO: 70129 - protein, 9 aa, Homo sapiens
  light chain complementarity determining region 3 for antibody 35065
LQHYNFSWT

SEQ ID NO: 70130 - protein, 12 aa, Homo sapiens
  heavy chain complementarity determining region 3 for antibody 35065
ARHLRVPERLDS

SEQ ID NO: 70131 - protein, 9 aa, Homo sapiens
  light chain complementarity determining region 3 for antibody 35066
LQHSTSPRT

SEQ ID NO: 70132 - protein, 11 aa, Homo sapiens
  heavy chain complementarity determining region 3 for antibody 35066
TTGLGSGGINC

SEQ ID NO: 70133 - protein, 9 aa, Homo sapiens
  light chain complementarity determining region 3 for antibody 35067
LQHSISPRT

SEQ ID NO: 70134 - protein, 11 aa, Homo sapiens
  heavy chain complementarity determining region 3 for antibody 35067
TTGLGSGGISW

SEQ ID NO: 70135 - protein, 9 aa, Homo sapiens
  light chain complementarity determining region 3 for antibody 35068
LQHSFSPRT

SEQ ID NO: 70136 - protein, 11 aa, Homo sapiens
  heavy chain complementarity determining region 3 for antibody 35068
TTGLGSGGINW

SEQ ID NO: 70137 - protein, 9 aa, Homo sapiens
  light chain complementarity determining region 3 for antibody 35069
LQHSDYPLT

SEQ ID NO: 70138 - protein, 18 aa, Homo sapiens
  heavy chain complementarity determining region 3 for antibody 35069
ARVECSGGDCFSARYFDL

SEQ ID NO: 70139 - protein, 9 aa, Homo sapiens
  light chain complementarity determining region 3 for antibody 35070
LQHNTFPLT

SEQ ID NO: 70140 - protein, 19 aa, Homo sapiens
  heavy chain complementarity determining region 3 for antibody 35070
TRQGGYENIGYYYYYGLDV

SEQ ID NO: 70141 - protein, 9 aa, Homo sapiens
  light chain complementarity determining region 3 for antibody 35071
LQHNSYPWT

SEQ ID NO: 70142 - protein, 13 aa, Homo sapiens
  heavy chain complementarity determining region 3 for antibody 35071
ARGAGDYISPFDY

SEQ ID NO: 70143 - protein, 9 aa, Homo sapiens
  light chain complementarity determining region 3 for antibody 35072
LQHNSYPRP

SEQ ID NO: 70144 - protein, 13 aa, Homo sapiens
  heavy chain complementarity determining region 3 for antibody 35072
AREIYSSSFSFDY

SEQ ID NO: 70145 - protein, 9 aa, Homo sapiens
  light chain complementarity determining region 3 for antibody 35073
LQHDNFPLA

SEQ ID NO: 70146 - protein, 28 aa, Homo sapiens
  heavy chain complementarity determining region 3 for antibody 35073
ARDRSKSDYGSGSYLPGKVLYYYYGMDV

SEQ ID NO: 70147 - protein, 9 aa, Homo sapiens
  light chain complementarity determining region 3 for antibody 35074
LQGSHWPPT

SEQ ID NO: 70148 - protein, 13 aa, Homo sapiens
  heavy chain complementarity determining region 3 for antibody 35074
VRNLGDGYNSIDY

SEQ ID NO: 70149 - protein, 9 aa, Homo sapiens
  light chain complementarity determining region 3 for antibody 35075
LQFDSLPPT

SEQ ID NO: 70150 - protein, 16 aa, Homo sapiens
  heavy chain complementarity determining region 3 for antibody 35075
AKGHHPQGEKVIRLDY

SEQ ID NO: 70151 - protein, 9 aa, Homo sapiens
  light chain complementarity determining region 3 for antibody 35076
LQFDSLPLT

SEQ ID NO: 70152 - protein, 16 aa, Homo sapiens
  heavy chain complementarity determining region 3 for antibody 35076
GRSHRPQGDKVIRLDY

SEQ ID NO: 70153 - protein, 10 aa, Homo sapiens
  light chain complementarity determining region 3 for antibody 35077
LQDYNYSALT

SEQ ID NO: 70154 - protein, 14 aa, Homo sapiens
  heavy chain complementarity determining region 3 for antibody 35077
ARARDTSGYSGLDY

SEQ ID NO: 70155 - protein, 9 aa, Homo sapiens
  light chain complementarity determining region 3 for antibody 35078
LQDYDYPFT

SEQ ID NO: 70156 - protein, 18 aa, Homo sapiens
  heavy chain complementarity determining region 3 for antibody 35078
ARSLYHSVSGAYYDAFDI

SEQ ID NO: 70157 - protein, 9 aa, Homo sapiens
  light chain complementarity determining region 3 for antibody 35079
LQDHDFPYT

SEQ ID NO: 70158 - protein, 18 aa, Homo sapiens
  heavy chain complementarity determining region 3 for antibody 35079
TRGPMYYSELGTYSTFDY

SEQ ID NO: 70159 - protein, 9 aa, Homo sapiens
  light chain complementarity determining region 3 for antibody 35080
KQYYTPPPT

SEQ ID NO: 70160 - protein, 14 aa, Homo sapiens
  heavy chain complementarity determining region 3 for antibody 35080
AKDRIAVGISVWEY

SEQ ID NO: 70161 - protein, 9 aa, Homo sapiens
  light chain complementarity determining region 3 for antibody 35081
HYYHAAPFT

SEQ ID NO: 70162 - protein, 10 aa, Homo sapiens
  heavy chain complementarity determining region 3 for antibody 35081
ARDNYDNSNP

SEQ ID NO: 70163 - protein, 9 aa, Homo sapiens
  light chain complementarity determining region 3 for antibody 35082
HQYYTTPWT

SEQ ID NO: 70164 - protein, 8 aa, Homo sapiens
  heavy chain complementarity determining region 3 for antibody 35082
ARGPSGHY

SEQ ID NO: 70165 - protein, 9 aa, Homo sapiens
  light chain complementarity determining region 3 for antibody 35083
HQYYSTPHT

SEQ ID NO: 70166 - protein, 11 aa, Homo sapiens
  heavy chain complementarity determining region 3 for antibody 35083
TLGRLDEELTY

SEQ ID NO: 70167 - protein, 9 aa, Homo sapiens
  light chain complementarity determining region 3 for antibody 35084
HQYGSSPRT

SEQ ID NO: 70168 - protein, 25 aa, Homo sapiens
  heavy chain complementarity determining region 3 for antibody 35084
ARLRIDRLRLPGAMRGPLYDCGLNV

SEQ ID NO: 70169 - protein, 9 aa, Homo sapiens
  light chain complementarity determining region 3 for antibody 35085
HQYGSLPLT

SEQ ID NO: 70170 - protein, 14 aa, Homo sapiens
  heavy chain complementarity determining region 3 for antibody 35085
ARGGRYTSSWYLDH

SEQ ID NO: 70171 - protein, 8 aa, Homo sapiens
  light chain complementarity determining region 3 for antibody 35086
HQYGGSPS

SEQ ID NO: 70172 - protein, 16 aa, Homo sapiens
  heavy chain complementarity determining region 3 for antibody 35086
ATDWGSGTQWIRAFDV

SEQ ID NO: 70173 - protein, 9 aa, Homo sapiens
  light chain complementarity determining region 3 for antibody 35087
HQYGGSPRT

SEQ ID NO: 70174 - protein, 17 aa, Homo sapiens
  heavy chain complementarity determining region 3 for antibody 35087
TADPQWLEPPPFVTNDY

SEQ ID NO: 70175 - protein, 9 aa, Homo sapiens
  light chain complementarity determining region 3 for antibody 35088
HQYAGSPGT

SEQ ID NO: 70176 - protein, 17 aa, Homo sapiens
  heavy chain complementarity determining region 3 for antibody 35088
TKTYFYDSSGPNYYFDV

SEQ ID NO: 70177 - protein, 9 aa, Homo sapiens
  light chain complementarity determining region 3 for antibody 35089
HQTSSLPQT

SEQ ID NO: 70178 - protein, 7 aa, Homo sapiens
  heavy chain complementarity determining region 3 for antibody 35089
TTEAYDI

SEQ ID NO: 70179 - protein, 9 aa, Homo sapiens
  light chain complementarity determining region 3 for antibody 35090
HQTSSFPQT

SEQ ID NO: 70180 - protein, 9 aa, Homo sapiens
  heavy chain complementarity determining region 3 for antibody 35090
ARGLWAMDV

SEQ ID NO: 70181 - protein, 10 aa, Homo sapiens
  light chain complementarity determining region 3 for antibody 35091
HQSYTPPMYS

SEQ ID NO: 70182 - protein, 13 aa, Homo sapiens
  heavy chain complementarity determining region 3 for antibody 35091
VPADAFRDDAFHL

SEQ ID NO: 70183 - protein, 9 aa, Homo sapiens
  light chain complementarity determining region 3 for antibody 35092
HQSSSFQET

SEQ ID NO: 70184 - protein, 12 aa, Homo sapiens
  heavy chain complementarity determining region 3 for antibody 35092
VKDCGLGGSRDF

SEQ ID NO: 70185 - protein, 9 aa, Homo sapiens
  light chain complementarity determining region 3 for antibody 35093
HQHYTTPHT

SEQ ID NO: 70186 - protein, 10 aa, Homo sapiens
  heavy chain complementarity determining region 3 for antibody 35093
ARGSYNSVCA

SEQ ID NO: 70187 - protein, 9 aa, Homo sapiens
  light chain complementarity determining region 3 for antibody 35094
HQDGESPRM

SEQ ID NO: 70188 - protein, 16 aa, Homo sapiens
  heavy chain complementarity determining region 3 for antibody 35094
AKSLGVDAMTTRVYDS

SEQ ID NO: 70189 - protein, 9 aa, Homo sapiens
  light chain complementarity determining region 3 for antibody 35095
HHTSTFPRT

SEQ ID NO: 70190 - protein, 15 aa, Homo sapiens
  heavy chain complementarity determining region 3 for antibody 35095
IRQSKVDGNYNYPDF

SEQ ID NO: 70191 - protein, 9 aa, Homo sapiens
  light chain complementarity determining region 3 for antibody 35096
GQVLQTPLT

SEQ ID NO: 70192 - protein, 12 aa, Homo sapiens
  heavy chain complementarity determining region 3 for antibody 35096
VRDGELNWGTWH

SEQ ID NO: 70193 - protein, 9 aa, Homo sapiens
  light chain complementarity determining region 3 for antibody 35097
FQALQTGFT

SEQ ID NO: 70194 - protein, 14 aa, Homo sapiens
  heavy chain complementarity determining region 3 for antibody 35097
AREILTYGDFGIDF

SEQ ID NO: 70195 - protein, 9 aa, Homo sapiens
  light chain complementarity determining region 3 for antibody 35098
EQYYTTPGT

SEQ ID NO: 70196 - protein, 17 aa, Homo sapiens
  heavy chain complementarity determining region 3 for antibody 35098
ARQFRWGSGSSWYVFGY

SEQ ID NO: 70197 - protein, 9 aa, Homo sapiens
  light chain complementarity determining region 3 for antibody 35099
VQSNRYPRT

SEQ ID NO: 70198 - protein, 6 aa, Homo sapiens
  heavy chain complementarity determining region 3 for antibody 35099
TRALDY

SEQ ID NO: 70199 - protein, 9 aa, Homo sapiens
  light chain complementarity determining region 3 for antibody 35100
RQYNGESRT

SEQ ID NO: 70200 - protein, 18 aa, Homo sapiens
  heavy chain complementarity determining region 3 for antibody 35100
ARGRTFDWLSHRGGGFDS

SEQ ID NO: 70201 - protein, 8 aa, Homo sapiens
  light chain complementarity determining region 3 for antibody 35101
RQALHHLT

SEQ ID NO: 70202 - protein, 16 aa, Homo sapiens
  heavy chain complementarity determining region 3 for antibody 35101
AKWGGVAMAGHYYFDY

SEQ ID NO: 70203 - protein, 9 aa, Homo sapiens
  light chain complementarity determining region 3 for antibody 35102
RGTLQTPPT

SEQ ID NO: 70204 - protein, 15 aa, Homo sapiens
  heavy chain complementarity determining region 3 for antibody 35102
TRDGKKDGHNDAFDI

SEQ ID NO: 70205 - protein, 9 aa, Homo sapiens
  light chain complementarity determining region 3 for antibody 35103
QVYGDSPKP

SEQ ID NO: 70206 - protein, 10 aa, Homo sapiens
  heavy chain complementarity determining region 3 for antibody 35103
AREGLGGFDN

SEQ ID NO: 70207 - protein, 9 aa, Homo sapiens
  light chain complementarity determining region 3 for antibody 35104
QQYYTSART

SEQ ID NO: 70208 - protein, 12 aa, Homo sapiens
  heavy chain complementarity determining region 3 for antibody 35104
VKDCGLGGSRDF

SEQ ID NO: 70209 - protein, 9 aa, Homo sapiens
  light chain complementarity determining region 3 for antibody 35105
QQYYTNPRT

SEQ ID NO: 70210 - protein, 8 aa, Homo sapiens
  heavy chain complementarity determining region 3 for antibody 35105
ARDGAFDS

SEQ ID NO: 70211 - protein, 9 aa, Homo sapiens
  light chain complementarity determining region 3 for antibody 35106
QQYYSTPLT

SEQ ID NO: 70212 - protein, 7 aa, Homo sapiens
  heavy chain complementarity determining region 3 for antibody 35106
SRGHSSS

SEQ ID NO: 70213 - protein, 9 aa, Homo sapiens
  light chain complementarity determining region 3 for antibody 35107
QQYYSNPPT

SEQ ID NO: 70214 - protein, 20 aa, Homo sapiens
  heavy chain complementarity determining region 3 for antibody 35107
ARGKTIGGSGWSTPINAFDL

SEQ ID NO: 70215 - protein, 9 aa, Homo sapiens
  light chain complementarity determining region 3 for antibody 35108
QQYYSHMMT

SEQ ID NO: 70216 - protein, 13 aa, Homo sapiens
  heavy chain complementarity determining region 3 for antibody 35108
ARHPTGFPNWFGP

SEQ ID NO: 70217 - protein, 9 aa, Homo sapiens
  light chain complementarity determining region 3 for antibody 35109
QQYYPTPRT

SEQ ID NO: 70218 - protein, 8 aa, Homo sapiens
  heavy chain complementarity determining region 3 for antibody 35109
ARDGAFDS

SEQ ID NO: 70219 - protein, 9 aa, Homo sapiens
  light chain complementarity determining region 3 for antibody 35110
QQYYPSLRT

SEQ ID NO: 70220 - protein, 12 aa, Homo sapiens
  heavy chain complementarity determining region 3 for antibody 35110
VKDCGLGGSRDS

SEQ ID NO: 70221 - protein, 10 aa, Homo sapiens
  light chain complementarity determining region 3 for antibody 35111
QQYYGTPPYT

SEQ ID NO: 70222 - protein, 17 aa, Homo sapiens
  heavy chain complementarity determining region 3 for antibody 35111
ARGVSFDNGWTDWYFGL

SEQ ID NO: 70223 - protein, 9 aa, Homo sapiens
  light chain complementarity determining region 3 for antibody 35112
QQYYFSSYA

SEQ ID NO: 70224 - protein, 8 aa, Homo sapiens
  heavy chain complementarity determining region 3 for antibody 35112
ARDGAFDS

SEQ ID NO: 70225 - protein, 9 aa, Homo sapiens
  light chain complementarity determining region 3 for antibody 35113
QQYYDTPVT

SEQ ID NO: 70226 - protein, 12 aa, Homo sapiens
  heavy chain complementarity determining region 3 for antibody 35113
ARALSSGPYFDY

SEQ ID NO: 70227 - protein, 9 aa, Homo sapiens
  light chain complementarity determining region 3 for antibody 35114
QQYYDLPWT

SEQ ID NO: 70228 - protein, 14 aa, Homo sapiens
  heavy chain complementarity determining region 3 for antibody 35114
AKCSSSYGNDAFNI

SEQ ID NO: 70229 - protein, 9 aa, Homo sapiens
  light chain complementarity determining region 3 for antibody 35115
QQYYATPGT

SEQ ID NO: 70230 - protein, 15 aa, Homo sapiens
  heavy chain complementarity determining region 3 for antibody 35115
IRQSKVDNNYNYPDF

SEQ ID NO: 70231 - protein, 9 aa, Homo sapiens
  light chain complementarity determining region 3 for antibody 35116
QQYVTSPLN

SEQ ID NO: 70232 - protein, 13 aa, Homo sapiens
  heavy chain complementarity determining region 3 for antibody 35116
ASISVGTVAAGKG

SEQ ID NO: 70233 - protein, 9 aa, Homo sapiens
  light chain complementarity determining region 3 for antibody 35117
QQYTSAPFT

SEQ ID NO: 70234 - protein, 20 aa, Homo sapiens
  heavy chain complementarity determining region 3 for antibody 35117
AKDGYCSSGSCSILVYGMDV

SEQ ID NO: 70235 - protein, 9 aa, Homo sapiens
  light chain complementarity determining region 3 for antibody 35118
QQYTGYSRT

SEQ ID NO: 70236 - protein, 18 aa, Homo sapiens
  heavy chain complementarity determining region 3 for antibody 35118
ARDFGGRAYTKVENAFDI

SEQ ID NO: 70237 - protein, 9 aa, Homo sapiens
  light chain complementarity determining region 3 for antibody 35119
QQYSSSPPP

SEQ ID NO: 70238 - protein, 19 aa, Homo sapiens
  heavy chain complementarity determining region 3 for antibody 35119
ARAGGNYYDRTSYYGPFDY

SEQ ID NO: 70239 - protein, 9 aa, Homo sapiens
  light chain complementarity determining region 3 for antibody 35120
QQYSSPPPS

SEQ ID NO: 70240 - protein, 19 aa, Homo sapiens
  heavy chain complementarity determining region 3 for antibody 35120
ARAGGNYYDRTSYYGPFDY

SEQ ID NO: 70241 - protein, 9 aa, Homo sapiens
  light chain complementarity determining region 3 for antibody 35121
QQYSSIPYT

SEQ ID NO: 70242 - protein, 19 aa, Homo sapiens
  heavy chain complementarity determining region 3 for antibody 35121
ARVNEVGFGLLIFRNGMDV

SEQ ID NO: 70243 - protein, 9 aa, Homo sapiens
  light chain complementarity determining region 3 for antibody 35122
QQYSSFPYT

SEQ ID NO: 70244 - protein, 15 aa, Homo sapiens
  heavy chain complementarity determining region 3 for antibody 35122
ARRRIAGITADAFDI

SEQ ID NO: 70245 - protein, 8 aa, Homo sapiens
  light chain complementarity determining region 3 for antibody 35123
QQYSSCCT

SEQ ID NO: 70246 - protein, 11 aa, Homo sapiens
  heavy chain complementarity determining region 3 for antibody 35123
VKRWGGSSIDY

SEQ ID NO: 70247 - protein, 10 aa, Homo sapiens
  light chain complementarity determining region 3 for antibody 35124
QQYSGSPAPT

SEQ ID NO: 70248 - protein, 15 aa, Homo sapiens
  heavy chain complementarity determining region 3 for antibody 35124
AKDAWYSSGWYFFDQ

SEQ ID NO: 70249 - protein, 10 aa, Homo sapiens
  light chain complementarity determining region 3 for antibody 35125
QQYSGSPALP

SEQ ID NO: 70250 - protein, 15 aa, Homo sapiens
  heavy chain complementarity determining region 3 for antibody 35125
AKDAWYSSGWYFFDQ

SEQ ID NO: 70251 - protein, 9 aa, Homo sapiens
  light chain complementarity determining region 3 for antibody 35126
QQYSDWPLT

SEQ ID NO: 70252 - protein, 14 aa, Homo sapiens
  heavy chain complementarity determining region 3 for antibody 35126
ALAGDLRFRGYFDY

SEQ ID NO: 70253 - protein, 8 aa, Homo sapiens
  light chain complementarity determining region 3 for antibody 35127
QQYSDFNT

SEQ ID NO: 70254 - protein, 17 aa, Homo sapiens
  heavy chain complementarity determining region 3 for antibody 35127
AHRRYYNGNWNGATYDV

SEQ ID NO: 70255 - protein, 8 aa, Homo sapiens
  light chain complementarity determining region 3 for antibody 35128
QQYSDFKT

SEQ ID NO: 70256 - protein, 17 aa, Homo sapiens
  heavy chain complementarity determining region 3 for antibody 35128
AHRRYYNGNWNGATFDV

SEQ ID NO: 70257 - protein, 9 aa, Homo sapiens
  light chain complementarity determining region 3 for antibody 35129
QQYSAPPYS

SEQ ID NO: 70258 - protein, 13 aa, Homo sapiens
  heavy chain complementarity determining region 3 for antibody 35129
AKSIADTGFYYDY

SEQ ID NO: 70259 - protein, 9 aa, Homo sapiens
  light chain complementarity determining region 3 for antibody 35130
QQYRGSPRT

SEQ ID NO: 70260 - protein, 14 aa, Homo sapiens
  heavy chain complementarity determining region 3 for antibody 35130
ATGWYDSSGHYLEY

SEQ ID NO: 70261 - protein, 9 aa, Homo sapiens
  light chain complementarity determining region 3 for antibody 35131
QQYQSWPYT

SEQ ID NO: 70262 - protein, 11 aa, Homo sapiens
  heavy chain complementarity determining region 3 for antibody 35131
GGFSHGGPCGY

SEQ ID NO: 70263 - protein, 8 aa, Homo sapiens
  light chain complementarity determining region 3 for antibody 35132
QQYNTYST

SEQ ID NO: 70264 - protein, 16 aa, Homo sapiens
  heavy chain complementarity determining region 3 for antibody 35132
ATELYYGSPTHTGFAI

SEQ ID NO: 70265 - protein, 9 aa, Homo sapiens
  light chain complementarity determining region 3 for antibody 35133
QQYNSYSYA

SEQ ID NO: 70266 - protein, 14 aa, Homo sapiens
  heavy chain complementarity determining region 3 for antibody 35133
AKAHSMVRRYYFDY

SEQ ID NO: 70267 - protein, 9 aa, Homo sapiens
  light chain complementarity determining region 3 for antibody 35134
QQYNSYSWT

SEQ ID NO: 70268 - protein, 14 aa, Homo sapiens
  heavy chain complementarity determining region 3 for antibody 35134
AREGTAGTTTYFDF

SEQ ID NO: 70269 - protein, 9 aa, Homo sapiens
  light chain complementarity determining region 3 for antibody 35135
QQYNSYSVT

SEQ ID NO: 70270 - protein, 17 aa, Homo sapiens
  heavy chain complementarity determining region 3 for antibody 35135
VKESWQWRVDYYYGMDV

SEQ ID NO: 70271 - protein, 9 aa, Homo sapiens
  light chain complementarity determining region 3 for antibody 35136
QQYNSYSVT

SEQ ID NO: 70272 - protein, 17 aa, Homo sapiens
  heavy chain complementarity determining region 3 for antibody 35136
VKESWQWLVDYYCGMDV

SEQ ID NO: 70273 - protein, 9 aa, Homo sapiens
  light chain complementarity determining region 3 for antibody 35137
QQYNSYSET

SEQ ID NO: 70274 - protein, 8 aa, Homo sapiens
  heavy chain complementarity determining region 3 for antibody 35137
ATSPTLGY

SEQ ID NO: 70275 - protein, 9 aa, Homo sapiens
  light chain complementarity determining region 3 for antibody 35138
QQYNSYPYT

SEQ ID NO: 70276 - protein, 14 aa, Homo sapiens
  heavy chain complementarity determining region 3 for antibody 35138
IGQDCSGRACDYPS

SEQ ID NO: 70277 - protein, 8 aa, Homo sapiens
  light chain complementarity determining region 3 for antibody 35139
QQYNSLYP

SEQ ID NO: 70278 - protein, 14 aa, Homo sapiens
  heavy chain complementarity determining region 3 for antibody 35139
ARENSISRKRSFDQ

SEQ ID NO: 70279 - protein, 8 aa, Homo sapiens
  light chain complementarity determining region 3 for antibody 35140
QQYNSLYN

SEQ ID NO: 70280 - protein, 14 aa, Homo sapiens
  heavy chain complementarity determining region 3 for antibody 35140
ARENSISRKRSFDQ

SEQ ID NO: 70281 - protein, 9 aa, Homo sapiens
  light chain complementarity determining region 3 for antibody 35141
QQYNSIPRT

SEQ ID NO: 70282 - protein, 14 aa, Homo sapiens
  heavy chain complementarity determining region 3 for antibody 35141
ARESGAGSYQGFDY

SEQ ID NO: 70283 - protein, 9 aa, Homo sapiens
  light chain complementarity determining region 3 for antibody 35142
QQYNSFPYT

SEQ ID NO: 70284 - protein, 13 aa, Homo sapiens
  heavy chain complementarity determining region 3 for antibody 35142
AKGTGFWSGSFDY

SEQ ID NO: 70285 - protein, 8 aa, Homo sapiens
  light chain complementarity determining region 3 for antibody 35143
QQYNRLYT

SEQ ID NO: 70286 - protein, 14 aa, Homo sapiens
  heavy chain complementarity determining region 3 for antibody 35143
ARENSISRKRSFDQ

SEQ ID NO: 70287 - protein, 8 aa, Homo sapiens
  light chain complementarity determining region 3 for antibody 35144
QQYNRDLT

SEQ ID NO: 70288 - protein, 15 aa, Homo sapiens
  heavy chain complementarity determining region 3 for antibody 35144
AKSTVTTMSGGHVDS

SEQ ID NO: 70289 - protein, 9 aa, Homo sapiens
  light chain complementarity determining region 3 for antibody 35145
QQYNNYPFT

SEQ ID NO: 70290 - protein, 14 aa, Homo sapiens
  heavy chain complementarity determining region 3 for antibody 35145
AKAKDSSGYDLFDF

SEQ ID NO: 70291 - protein, 10 aa, Homo sapiens
  light chain complementarity determining region 3 for antibody 35146
QQYNNWTPDT

SEQ ID NO: 70292 - protein, 13 aa, Homo sapiens
  heavy chain complementarity determining region 3 for antibody 35146
NTDVPYTGGALAY

SEQ ID NO: 70293 - protein, 9 aa, Homo sapiens
  light chain complementarity determining region 3 for antibody 35147
QQYNNWPWT

SEQ ID NO: 70294 - protein, 11 aa, Homo sapiens
  heavy chain complementarity determining region 3 for antibody 35147
ARDRFVGRVGY

SEQ ID NO: 70295 - protein, 10 aa, Homo sapiens
  light chain complementarity determining region 3 for antibody 35148
QQYNNWPPYT

SEQ ID NO: 70296 - protein, 18 aa, Homo sapiens
  heavy chain complementarity determining region 3 for antibody 35148
ARDGGYCGGDCFNDAFDI

SEQ ID NO: 70297 - protein, 11 aa, Homo sapiens
  light chain complementarity determining region 3 for antibody 35149
QQYNNWPPGYT

SEQ ID NO: 70298 - protein, 15 aa, Homo sapiens
  heavy chain complementarity determining region 3 for antibody 35149
ASAHLSSSFHRYFDF

SEQ ID NO: 70299 - protein, 9 aa, Homo sapiens
  light chain complementarity determining region 3 for antibody 35150
QQYNNWPGG

SEQ ID NO: 70300 - protein, 12 aa, Homo sapiens
  heavy chain complementarity determining region 3 for antibody 35150
ARDDGTGSHFDY

SEQ ID NO: 70301 - protein, 10 aa, Homo sapiens
  light chain complementarity determining region 3 for antibody 35151
QQYNNRPRDT

SEQ ID NO: 70302 - protein, 12 aa, Homo sapiens
  heavy chain complementarity determining region 3 for antibody 35151
AKMMPRHDVFDL

SEQ ID NO: 70303 - protein, 9 aa, Homo sapiens
  light chain complementarity determining region 3 for antibody 35152
QQYNGYSRT

SEQ ID NO: 70304 - protein, 18 aa, Homo sapiens
  heavy chain complementarity determining region 3 for antibody 35152
ARDCGGRAYTKVENAFDI

SEQ ID NO: 70305 - protein, 8 aa, Homo sapiens
  light chain complementarity determining region 3 for antibody 35153
QQYLLNWT

SEQ ID NO: 70306 - protein, 19 aa, Homo sapiens
  heavy chain complementarity determining region 3 for antibody 35153
AKEGLSYDINDSKRGYFDS

SEQ ID NO: 70307 - protein, 10 aa, Homo sapiens
  light chain complementarity determining region 3 for antibody 35154
QQYKNWFVHS

SEQ ID NO: 70308 - protein, 10 aa, Homo sapiens
  heavy chain complementarity determining region 3 for antibody 35154
ARDRLGLGDY

SEQ ID NO: 70309 - protein, 9 aa, Homo sapiens
  light chain complementarity determining region 3 for antibody 35155
QQYKGYSRT

SEQ ID NO: 70310 - protein, 18 aa, Homo sapiens
  heavy chain complementarity determining region 3 for antibody 35155
ARDFGGRAYTKVENAFDI

SEQ ID NO: 70311 - protein, 9 aa, Homo sapiens
  light chain complementarity determining region 3 for antibody 35156
QQYIGWPWT

SEQ ID NO: 70312 - protein, 6 aa, Homo sapiens
  heavy chain complementarity determining region 3 for antibody 35156
GSVFEY

SEQ ID NO: 70313 - protein, 9 aa, Homo sapiens
  light chain complementarity determining region 3 for antibody 35157
QQYHRDPLT

SEQ ID NO: 70314 - protein, 10 aa, Homo sapiens
  heavy chain complementarity determining region 3 for antibody 35157
AGGTGWILDT

SEQ ID NO: 70315 - protein, 9 aa, Homo sapiens
  light chain complementarity determining region 3 for antibody 35158
QQYHDYPYT

SEQ ID NO: 70316 - protein, 10 aa, Homo sapiens
  heavy chain complementarity determining region 3 for antibody 35158
TTSRWGPFDY

SEQ ID NO: 70317 - protein, 9 aa, Homo sapiens
  light chain complementarity determining region 3 for antibody 35159
QQYHALPLP

SEQ ID NO: 70318 - protein, 13 aa, Homo sapiens
  heavy chain complementarity determining region 3 for antibody 35159
ARDGVPGKFNRAH

SEQ ID NO: 70319 - protein, 9 aa, Homo sapiens
  light chain complementarity determining region 3 for antibody 35160
QQYGTTPLT

SEQ ID NO: 70320 - protein, 8 aa, Homo sapiens
  heavy chain complementarity determining region 3 for antibody 35160
VRMSDYIL

SEQ ID NO: 70321 - protein, 8 aa, Homo sapiens
  light chain complementarity determining region 3 for antibody 35161
QQYGTSYT

SEQ ID NO: 70322 - protein, 17 aa, Homo sapiens
  heavy chain complementarity determining region 3 for antibody 35161
ARLPGYYDSSGSDAFDI

SEQ ID NO: 70323 - protein, 9 aa, Homo sapiens
  light chain complementarity determining region 3 for antibody 35162
QQYGTSYRT

SEQ ID NO: 70324 - protein, 12 aa, Homo sapiens
  heavy chain complementarity determining region 3 for antibody 35162
ARDSGSGWYFNY

SEQ ID NO: 70325 - protein, 9 aa, Homo sapiens
  light chain complementarity determining region 3 for antibody 35163
QQYGTSSYT

SEQ ID NO: 70326 - protein, 14 aa, Homo sapiens
  heavy chain complementarity determining region 3 for antibody 35163
ARDHRDRNGYYFNH

SEQ ID NO: 70327 - protein, 8 aa, Homo sapiens
  light chain complementarity determining region 3 for antibody 35164
QQYGTSRL

SEQ ID NO: 70328 - protein, 13 aa, Homo sapiens
  heavy chain complementarity determining region 3 for antibody 35164
ARGQFVGSAYYEN

SEQ ID NO: 70329 - protein, 9 aa, Homo sapiens
  light chain complementarity determining region 3 for antibody 35165
QQYGTSPRT

SEQ ID NO: 70330 - protein, 16 aa, Homo sapiens
  heavy chain complementarity determining region 3 for antibody 35165
ASSITIFGVVLRPLDY

SEQ ID NO: 70331 - protein, 9 aa, Homo sapiens
  light chain complementarity determining region 3 for antibody 35166
QQYGTSPPT

SEQ ID NO: 70332 - protein, 14 aa, Homo sapiens
  heavy chain complementarity determining region 3 for antibody 35166
AHRSYNSGRGAFDI

SEQ ID NO: 70333 - protein, 9 aa, Homo sapiens
  light chain complementarity determining region 3 for antibody 35167
QQYGTSPLP

SEQ ID NO: 70334 - protein, 14 aa, Homo sapiens
  heavy chain complementarity determining region 3 for antibody 35167
AHRSYNSGRGAFDI

SEQ ID NO: 70335 - protein, 9 aa, Homo sapiens
  light chain complementarity determining region 3 for antibody 35168
QQYGTSPLN

SEQ ID NO: 70336 - protein, 13 aa, Homo sapiens
  heavy chain complementarity determining region 3 for antibody 35168
ASISVGTVAAGNV

SEQ ID NO: 70337 - protein, 9 aa, Homo sapiens
  light chain complementarity determining region 3 for antibody 35169
QQYGTSPLN

SEQ ID NO: 70338 - protein, 13 aa, Homo sapiens
  heavy chain complementarity determining region 3 for antibody 35169
ASIAVGTVAAGNG

SEQ ID NO: 70339 - protein, 9 aa, Homo sapiens
  light chain complementarity determining region 3 for antibody 35170
QQYGTSPFT

SEQ ID NO: 70340 - protein, 15 aa, Homo sapiens
  heavy chain complementarity determining region 3 for antibody 35170
ARTKGGRCHSTAIDL

SEQ ID NO: 70341 - protein, 9 aa, Homo sapiens
  light chain complementarity determining region 3 for antibody 35171
QQYGTSPFT

SEQ ID NO: 70342 - protein, 15 aa, Homo sapiens
  heavy chain complementarity determining region 3 for antibody 35171
ARQKGQRASAGYFDS

SEQ ID NO: 70343 - protein, 9 aa, Homo sapiens
  light chain complementarity determining region 3 for antibody 35172
QQYGTSPFT

SEQ ID NO: 70344 - protein, 14 aa, Homo sapiens
  heavy chain complementarity determining region 3 for antibody 35172
ARGGAAATSSSWLY

SEQ ID NO: 70345 - protein, 9 aa, Homo sapiens
  light chain complementarity determining region 3 for antibody 35173
QQYGTSPFP

SEQ ID NO: 70346 - protein, 14 aa, Homo sapiens
  heavy chain complementarity determining region 3 for antibody 35173
ARGGPAATSSSWLY

SEQ ID NO: 70347 - protein, 10 aa, Homo sapiens
  light chain complementarity determining region 3 for antibody 35174
QQYGTSLPWT

SEQ ID NO: 70348 - protein, 16 aa, Homo sapiens
  heavy chain complementarity determining region 3 for antibody 35174
TKDRDYDDYEWCAFDP

SEQ ID NO: 70349 - protein, 9 aa, Homo sapiens
  light chain complementarity determining region 3 for antibody 35175
QQYGTPPRT

SEQ ID NO: 70350 - protein, 25 aa, Homo sapiens
  heavy chain complementarity determining region 3 for antibody 35175
AGLRVDRLRLPGAMRGPLYDRGLNV

SEQ ID NO: 70351 - protein, 9 aa, Homo sapiens
  light chain complementarity determining region 3 for antibody 35176
QQYGTLPWP

SEQ ID NO: 70352 - protein, 13 aa, Homo sapiens
  heavy chain complementarity determining region 3 for antibody 35176
VRDQAAYINWFDP

SEQ ID NO: 70353 - protein, 9 aa, Homo sapiens
  light chain complementarity determining region 3 for antibody 35177
QQYGSYPRT

SEQ ID NO: 70354 - protein, 25 aa, Homo sapiens
  heavy chain complementarity determining region 3 for antibody 35177
ARLRIDRLRLPGAMRGPLYDCGLNV

SEQ ID NO: 70355 - protein, 10 aa, Homo sapiens
  light chain complementarity determining region 3 for antibody 35178
QQYGSSSMYT

SEQ ID NO: 70356 - protein, 19 aa, Homo sapiens
  heavy chain complementarity determining region 3 for antibody 35178
AKDQLMLYYDNSGYPGADY

SEQ ID NO: 70357 - protein, 9 aa, Homo sapiens
  light chain complementarity determining region 3 for antibody 35179
QQYGSSPYT

SEQ ID NO: 70358 - protein, 16 aa, Homo sapiens
  heavy chain complementarity determining region 3 for antibody 35179
ARDPATLWFGEPTPDC

SEQ ID NO: 70359 - protein, 9 aa, Homo sapiens
  light chain complementarity determining region 3 for antibody 35180
QQYGSSPWP

SEQ ID NO: 70360 - protein, 15 aa, Homo sapiens
  heavy chain complementarity determining region 3 for antibody 35180
AREAFDIAGHYRADY

SEQ ID NO: 70361 - protein, 10 aa, Homo sapiens
  light chain complementarity determining region 3 for antibody 35181
QQYGSSPSYT

SEQ ID NO: 70362 - protein, 13 aa, Homo sapiens
  heavy chain complementarity determining region 3 for antibody 35181
ARGQGVRGAHFDY

SEQ ID NO: 70363 - protein, 9 aa, Homo sapiens
  light chain complementarity determining region 3 for antibody 35182
QQYGSSPRT

SEQ ID NO: 70364 - protein, 25 aa, Homo sapiens
  heavy chain complementarity determining region 3 for antibody 35182
ARLRIDRLRLPGAMRGPPYDCGLNV

SEQ ID NO: 70365 - protein, 9 aa, Homo sapiens
  light chain complementarity determining region 3 for antibody 35183
QQYGSSPRT

SEQ ID NO: 70366 - protein, 25 aa, Homo sapiens
  heavy chain complementarity determining region 3 for antibody 35183
ARLGIDRLRLPGAMRGPLYDCGLNV

SEQ ID NO: 70367 - protein, 9 aa, Homo sapiens
  light chain complementarity determining region 3 for antibody 35184
QQYGSSPRT

SEQ ID NO: 70368 - protein, 17 aa, Homo sapiens
  heavy chain complementarity determining region 3 for antibody 35184
ARGAYYYSGSSRYYDDN

SEQ ID NO: 70369 - protein, 9 aa, Homo sapiens
  light chain complementarity determining region 3 for antibody 35185
QQYGSSPRT

SEQ ID NO: 70370 - protein, 14 aa, Homo sapiens
  heavy chain complementarity determining region 3 for antibody 35185
ARDSSSTSWGPIDY

SEQ ID NO: 70371 - protein, 9 aa, Homo sapiens
  light chain complementarity determining region 3 for antibody 35186
QQYGSSPRT

SEQ ID NO: 70372 - protein, 17 aa, Homo sapiens
  heavy chain complementarity determining region 3 for antibody 35186
ARALDIVVVVDATWFDP

SEQ ID NO: 70373 - protein, 9 aa, Homo sapiens
  light chain complementarity determining region 3 for antibody 35187
QQYGSSPRT

SEQ ID NO: 70374 - protein, 17 aa, Homo sapiens
  heavy chain complementarity determining region 3 for antibody 35187
ARALDIVVVVDAICFDP

SEQ ID NO: 70375 - protein, 10 aa, Homo sapiens
  light chain complementarity determining region 3 for antibody 35188
QQYGSSPPYP

SEQ ID NO: 70376 - protein, 12 aa, Homo sapiens
  heavy chain complementarity determining region 3 for antibody 35188
ARVSYGYNSLGY

SEQ ID NO: 70377 - protein, 11 aa, Homo sapiens
  light chain complementarity determining region 3 for antibody 35189
QQYGSSPPVYT

SEQ ID NO: 70378 - protein, 17 aa, Homo sapiens
  heavy chain complementarity determining region 3 for antibody 35189
AKDCLPMIRGLSAEACY

SEQ ID NO: 70379 - protein, 10 aa, Homo sapiens
  light chain complementarity determining region 3 for antibody 35190
QQYGSSPPLT

SEQ ID NO: 70380 - protein, 18 aa, Homo sapiens
  heavy chain complementarity determining region 3 for antibody 35190
ARGGYDYGWGSDGVYFDY

SEQ ID NO: 70381 - protein, 10 aa, Homo sapiens
  light chain complementarity determining region 3 for antibody 35191
QQYGSSPPLT

SEQ ID NO: 70382 - protein, 18 aa, Homo sapiens
  heavy chain complementarity determining region 3 for antibody 35191
ARGGYDYGGGSYGVYFDY

SEQ ID NO: 70383 - protein, 10 aa, Homo sapiens
  light chain complementarity determining region 3 for antibody 35192
QQYGSSPPLT

SEQ ID NO: 70384 - protein, 18 aa, Homo sapiens
  heavy chain complementarity determining region 3 for antibody 35192
ARGGYDDGWGSYGVYFDY

SEQ ID NO: 70385 - protein, 10 aa, Homo sapiens
  light chain complementarity determining region 3 for antibody 35193
QQYGSSPPLT

SEQ ID NO: 70386 - protein, 18 aa, Homo sapiens
  heavy chain complementarity determining region 3 for antibody 35193
ARGGYDCGWGSYGVYFDY

SEQ ID NO: 70387 - protein, 10 aa, Homo sapiens
  light chain complementarity determining region 3 for antibody 35194
QQYGSSPPIP

SEQ ID NO: 70388 - protein, 15 aa, Homo sapiens
  heavy chain complementarity determining region 3 for antibody 35194
ASRPPDEHTVLVFNY

SEQ ID NO: 70389 - protein, 9 aa, Homo sapiens
  light chain complementarity determining region 3 for antibody 35195
QQYGSSPLT

SEQ ID NO: 70390 - protein, 12 aa, Homo sapiens
  heavy chain complementarity determining region 3 for antibody 35195
ARGRAYNPDMDV

SEQ ID NO: 70391 - protein, 9 aa, Homo sapiens
  light chain complementarity determining region 3 for antibody 35196
QQYGSSPLT

SEQ ID NO: 70392 - protein, 16 aa, Homo sapiens
  heavy chain complementarity determining region 3 for antibody 35196
ARDGIYFDSKGGGNDL

SEQ ID NO: 70393 - protein, 9 aa, Homo sapiens
  light chain complementarity determining region 3 for antibody 35197
QQYGSSPLP

SEQ ID NO: 70394 - protein, 20 aa, Homo sapiens
  heavy chain complementarity determining region 3 for antibody 35197
ARGVGLGYCSSTSCPYYFDY

SEQ ID NO: 70395 - protein, 9 aa, Homo sapiens
  light chain complementarity determining region 3 for antibody 35198
QQYGSSPKT

SEQ ID NO: 70396 - protein, 19 aa, Homo sapiens
  heavy chain complementarity determining region 3 for antibody 35198
AKNINPVRHDYGDRVLPGD

SEQ ID NO: 70397 - protein, 10 aa, Homo sapiens
  light chain complementarity determining region 3 for antibody 35199
QQYGSSPFFT

SEQ ID NO: 70398 - protein, 14 aa, Homo sapiens
  heavy chain complementarity determining region 3 for antibody 35199
VRPRHVVVNWYIDS

SEQ ID NO: 70399 - protein, 9 aa, Homo sapiens
  light chain complementarity determining region 3 for antibody 35200
QQYGSSLST

SEQ ID NO: 70400 - protein, 16 aa, Homo sapiens
  heavy chain complementarity determining region 3 for antibody 35200
ARAKHYGDYYYYGMDA

SEQ ID NO: 70401 - protein, 9 aa, Homo sapiens
  light chain complementarity determining region 3 for antibody 35201
QQYGSSLRT

SEQ ID NO: 70402 - protein, 21 aa, Homo sapiens
  heavy chain complementarity determining region 3 for antibody 35201
ARGTTTKYVFGSGSYGKYLDS

SEQ ID NO: 70403 - protein, 10 aa, Homo sapiens
  light chain complementarity determining region 3 for antibody 35202
QQYGSSAMYT

SEQ ID NO: 70404 - protein, 19 aa, Homo sapiens
  heavy chain complementarity determining region 3 for antibody 35202
AKDQLMFYYDNSGYPGADY

SEQ ID NO: 70405 - protein, 8 aa, Homo sapiens
  light chain complementarity determining region 3 for antibody 35203
QQYGSPYT

SEQ ID NO: 70406 - protein, 20 aa, Homo sapiens
  heavy chain complementarity determining region 3 for antibody 35203
ARDLRVRGVIGPSIRGSFDI

SEQ ID NO: 70407 - protein, 9 aa, Homo sapiens
  light chain complementarity determining region 3 for antibody 35204
QQYGSPPRT

SEQ ID NO: 70408 - protein, 17 aa, Homo sapiens
  heavy chain complementarity determining region 3 for antibody 35204
ARALDIVVVVDAIWFDP

SEQ ID NO: 70409 - protein, 9 aa, Homo sapiens
  light chain complementarity determining region 3 for antibody 35205
QQYGSLPRT

SEQ ID NO: 70410 - protein, 15 aa, Homo sapiens
  heavy chain complementarity determining region 3 for antibody 35205
AHRPNYYDKAGAFDI

SEQ ID NO: 70411 - protein, 9 aa, Homo sapiens
  light chain complementarity determining region 3 for antibody 35206
QQYGSLPLT

SEQ ID NO: 70412 - protein, 15 aa, Homo sapiens
  heavy chain complementarity determining region 3 for antibody 35206
AHRPNYDDKAGAFDI

SEQ ID NO: 70413 - protein, 9 aa, Homo sapiens
  light chain complementarity determining region 3 for antibody 35207
QQYGSLPLT

SEQ ID NO: 70414 - protein, 15 aa, Homo sapiens
  heavy chain complementarity determining region 3 for antibody 35207
AHRPNYCDKAGAFDI

SEQ ID NO: 70415 - protein, 9 aa, Homo sapiens
  light chain complementarity determining region 3 for antibody 35208
QQYGSLPIT

SEQ ID NO: 70416 - protein, 15 aa, Homo sapiens
  heavy chain complementarity determining region 3 for antibody 35208
AHRPNYYDKAGAFDI

SEQ ID NO: 70417 - protein, 9 aa, Homo sapiens
  light chain complementarity determining region 3 for antibody 35209
QQYGSIPRT

SEQ ID NO: 70418 - protein, 13 aa, Homo sapiens
  heavy chain complementarity determining region 3 for antibody 35209
AGGTWHSGIYYES

SEQ ID NO: 70419 - protein, 9 aa, Homo sapiens
  light chain complementarity determining region 3 for antibody 35210
QQYGSAPDP

SEQ ID NO: 70420 - protein, 9 aa, Homo sapiens
  heavy chain complementarity determining region 3 for antibody 35210
ASDAGIDHH

SEQ ID NO: 70421 - protein, 9 aa, Homo sapiens
  light chain complementarity determining region 3 for antibody 35211
QQYGRSSLT

SEQ ID NO: 70422 - protein, 19 aa, Homo sapiens
  heavy chain complementarity determining region 3 for antibody 35211
ARDRIVVGATFYSYPGMDV

SEQ ID NO: 70423 - protein, 9 aa, Homo sapiens
  light chain complementarity determining region 3 for antibody 35212
QQYGRSPST

SEQ ID NO: 70424 - protein, 17 aa, Homo sapiens
  heavy chain complementarity determining region 3 for antibody 35212
AGLSSRLGDGSPSLFDY

SEQ ID NO: 70425 - protein, 9 aa, Homo sapiens
  light chain complementarity determining region 3 for antibody 35213
QQYGRSPRT

SEQ ID NO: 70426 - protein, 25 aa, Homo sapiens
  heavy chain complementarity determining region 3 for antibody 35213
ARLRIDRLRLPGAMRGPLYDCGLNV

SEQ ID NO: 70427 - protein, 8 aa, Homo sapiens
  light chain complementarity determining region 3 for antibody 35214
QQYGRSLT

SEQ ID NO: 70428 - protein, 17 aa, Homo sapiens
  heavy chain complementarity determining region 3 for antibody 35214
ASIYDSTGYYYGGYFQH

SEQ ID NO: 70429 - protein, 9 aa, Homo sapiens
  light chain complementarity determining region 3 for antibody 35215
QQYGRPPRT

SEQ ID NO: 70430 - protein, 14 aa, Homo sapiens
  heavy chain complementarity determining region 3 for antibody 35215
AGGDFCGADCYSDY

SEQ ID NO: 70431 - protein, 9 aa, Homo sapiens
  light chain complementarity determining region 3 for antibody 35216
QQYGRAPRT

SEQ ID NO: 70432 - protein, 15 aa, Homo sapiens
  heavy chain complementarity determining region 3 for antibody 35216
AKDGPYCGGDCYFDS

SEQ ID NO: 70433 - protein, 8 aa, Homo sapiens
  light chain complementarity determining region 3 for antibody 35217
QQYGNSRT

SEQ ID NO: 70434 - protein, 15 aa, Homo sapiens
  heavy chain complementarity determining region 3 for antibody 35217
AKTDYCSAGNCPFDS

SEQ ID NO: 70435 - protein, 9 aa, Homo sapiens
  light chain complementarity determining region 3 for antibody 35218
QQYGNSPRT

SEQ ID NO: 70436 - protein, 16 aa, Homo sapiens
  heavy chain complementarity determining region 3 for antibody 35218
ARGTFYQGSSDNYHDN

SEQ ID NO: 70437 - protein, 9 aa, Homo sapiens
  light chain complementarity determining region 3 for antibody 35219
QQYGNSPRK

SEQ ID NO: 70438 - protein, 16 aa, Homo sapiens
  heavy chain complementarity determining region 3 for antibody 35219
ARGTFYQGSSDNYHEN

SEQ ID NO: 70439 - protein, 10 aa, Homo sapiens
  light chain complementarity determining region 3 for antibody 35220
QQYGNSPPVT

SEQ ID NO: 70440 - protein, 13 aa, Homo sapiens
  heavy chain complementarity determining region 3 for antibody 35220
ASWSHSDLDAFDI

SEQ ID NO: 70441 - protein, 10 aa, Homo sapiens
  light chain complementarity determining region 3 for antibody 35221
QQYGNSPPFI

SEQ ID NO: 70442 - protein, 13 aa, Homo sapiens
  heavy chain complementarity determining region 3 for antibody 35221
ASWSHSDLDAFDI

SEQ ID NO: 70443 - protein, 9 aa, Homo sapiens
  light chain complementarity determining region 3 for antibody 35222
QQYGNIPRT

SEQ ID NO: 70444 - protein, 13 aa, Homo sapiens
  heavy chain complementarity determining region 3 for antibody 35222
AGGLFHTSGYSDF

SEQ ID NO: 70445 - protein, 9 aa, Homo sapiens
  light chain complementarity determining region 3 for antibody 35223
QQYGHSPFT

SEQ ID NO: 70446 - protein, 15 aa, Homo sapiens
  heavy chain complementarity determining region 3 for antibody 35223
ARQKGQRASAGYFDS

SEQ ID NO: 70447 - protein, 8 aa, Homo sapiens
  light chain complementarity determining region 3 for antibody 35224
QQYGGSPS

SEQ ID NO: 70448 - protein, 16 aa, Homo sapiens
  heavy chain complementarity determining region 3 for antibody 35224
STDWGSGTQWIRAFDV

SEQ ID NO: 70449 - protein, 10 aa, Homo sapiens
  light chain complementarity determining region 3 for antibody 35225
QQYGGSPSFP

SEQ ID NO: 70450 - protein, 14 aa, Homo sapiens
  heavy chain complementarity determining region 3 for antibody 35225
ARRDYIGTLHYFDP

SEQ ID NO: 70451 - protein, 8 aa, Homo sapiens
  light chain complementarity determining region 3 for antibody 35226
QQYGGSPS

SEQ ID NO: 70452 - protein, 16 aa, Homo sapiens
  heavy chain complementarity determining region 3 for antibody 35226
ATDWGSGTQWIRDFDV

SEQ ID NO: 70453 - protein, 8 aa, Homo sapiens
  light chain complementarity determining region 3 for antibody 35227
QQYGGSPS

SEQ ID NO: 70454 - protein, 16 aa, Homo sapiens
  heavy chain complementarity determining region 3 for antibody 35227
ATDWGSGTQWIRAFDA

SEQ ID NO: 70455 - protein, 8 aa, Homo sapiens
  light chain complementarity determining region 3 for antibody 35228
QQYGGSPS

SEQ ID NO: 70456 - protein, 16 aa, Homo sapiens
  heavy chain complementarity determining region 3 for antibody 35228
ATDWGSGNQWIRAFDV

SEQ ID NO: 70457 - protein, 8 aa, Homo sapiens
  light chain complementarity determining region 3 for antibody 35229
QQYGGSPS

SEQ ID NO: 70458 - protein, 16 aa, Homo sapiens
  heavy chain complementarity determining region 3 for antibody 35229
ATDGGSGTQWIRAFDV

SEQ ID NO: 70459 - protein, 9 aa, Homo sapiens
  light chain complementarity determining region 3 for antibody 35230
QQYGGSPRT

SEQ ID NO: 70460 - protein, 25 aa, Homo sapiens
  heavy chain complementarity determining region 3 for antibody 35230
ARLRIDRLRLPGAMRGPLYDCGLNV

SEQ ID NO: 70461 - protein, 10 aa, Homo sapiens
  light chain complementarity determining region 3 for antibody 35231
QQYGGSPLYT

SEQ ID NO: 70462 - protein, 12 aa, Homo sapiens
  heavy chain complementarity determining region 3 for antibody 35231
ARHKRGTNAFDI

SEQ ID NO: 70463 - protein, 9 aa, Homo sapiens
  light chain complementarity determining region 3 for antibody 35232
QQYGGSPGT

SEQ ID NO: 70464 - protein, 13 aa, Homo sapiens
  heavy chain complementarity determining region 3 for antibody 35232
TKEIPEAGHPGGS

SEQ ID NO: 70465 - protein, 10 aa, Homo sapiens
  light chain complementarity determining region 3 for antibody 35233
QQYGGSLPGT

SEQ ID NO: 70466 - protein, 16 aa, Homo sapiens
  heavy chain complementarity determining region 3 for antibody 35233
ARWIATPLVPRGPMDV

SEQ ID NO: 70467 - protein, 8 aa, Homo sapiens
  light chain complementarity determining region 3 for antibody 35234
QQYGGSAS

SEQ ID NO: 70468 - protein, 16 aa, Homo sapiens
  heavy chain complementarity determining region 3 for antibody 35234
ATDWGSGTQWIRAFDV

SEQ ID NO: 70469 - protein, 8 aa, Homo sapiens
  light chain complementarity determining region 3 for antibody 35235
QQYGGAPS

SEQ ID NO: 70470 - protein, 16 aa, Homo sapiens
  heavy chain complementarity determining region 3 for antibody 35235
ATDWGSGTQWIRAFDV

SEQ ID NO: 70471 - protein, 9 aa, Homo sapiens
  light chain complementarity determining region 3 for antibody 35236
QQYFSQVYT

SEQ ID NO: 70472 - protein, 18 aa, Homo sapiens
  heavy chain complementarity determining region 3 for antibody 35236
AQERDGYCDSHACYGLDV

SEQ ID NO: 70473 - protein, 9 aa, Homo sapiens
  light chain complementarity determining region 3 for antibody 35237
QQYFSHVST

SEQ ID NO: 70474 - protein, 18 aa, Homo sapiens
  heavy chain complementarity determining region 3 for antibody 35237
AQERDGYCDSHACYGLDV

SEQ ID NO: 70475 - protein, 9 aa, Homo sapiens
  light chain complementarity determining region 3 for antibody 35238
QQYFSHGYT

SEQ ID NO: 70476 - protein, 18 aa, Homo sapiens
  heavy chain complementarity determining region 3 for antibody 35238
AQERDGYCDSHACYGLDV

SEQ ID NO: 70477 - protein, 9 aa, Homo sapiens
  light chain complementarity determining region 3 for antibody 35239
QQYETSPYT

SEQ ID NO: 70478 - protein, 17 aa, Homo sapiens
  heavy chain complementarity determining region 3 for antibody 35239
AKAYYGWGSYYTLASDY

SEQ ID NO: 70479 - protein, 11 aa, Homo sapiens
  light chain complementarity determining region 3 for antibody 35240
QQYETSPPGNT

SEQ ID NO: 70480 - protein, 14 aa, Homo sapiens
  heavy chain complementarity determining region 3 for antibody 35240
ARENSISRKRSFDQ

SEQ ID NO: 70481 - protein, 9 aa, Homo sapiens
  light chain complementarity determining region 3 for antibody 35241
QQYENLPTT

SEQ ID NO: 70482 - protein, 20 aa, Homo sapiens
  heavy chain complementarity determining region 3 for antibody 35241
AKGASFYDFRGYSGRSCFDS

SEQ ID NO: 70483 - protein, 9 aa, Homo sapiens
  light chain complementarity determining region 3 for antibody 35242
QQYDTYPLP

SEQ ID NO: 70484 - protein, 16 aa, Homo sapiens
  heavy chain complementarity determining region 3 for antibody 35242
VRDAWRESGRNAPGAN

SEQ ID NO: 70485 - protein, 9 aa, Homo sapiens
  light chain complementarity determining region 3 for antibody 35243
QQYDTPPGT

SEQ ID NO: 70486 - protein, 13 aa, Homo sapiens
  heavy chain complementarity determining region 3 for antibody 35243
ARETRIHLPAFEY

SEQ ID NO: 70487 - protein, 9 aa, Homo sapiens
  light chain complementarity determining region 3 for antibody 35244
QQYDSWPYT

SEQ ID NO: 70488 - protein, 13 aa, Homo sapiens
  heavy chain complementarity determining region 3 for antibody 35244
ARGNGGSDGSDCL

SEQ ID NO: 70489 - protein, 9 aa, Homo sapiens
  light chain complementarity determining region 3 for antibody 35245
QQYDSSSYP

SEQ ID NO: 70490 - protein, 11 aa, Homo sapiens
  heavy chain complementarity determining region 3 for antibody 35245
ARGGFYGSFDY

SEQ ID NO: 70491 - protein, 9 aa, Homo sapiens
  light chain complementarity determining region 3 for antibody 35246
QQYDRSPEK

SEQ ID NO: 70492 - protein, 12 aa, Homo sapiens
  heavy chain complementarity determining region 3 for antibody 35246
ARPLYNSGFFEY

SEQ ID NO: 70493 - protein, 8 aa, Homo sapiens
  light chain complementarity determining region 3 for antibody 35247
QQYDNSRK

SEQ ID NO: 70494 - protein, 15 aa, Homo sapiens
  heavy chain complementarity determining region 3 for antibody 35247
AKTDYCSAGNCPFDS

SEQ ID NO: 70495 - protein, 9 aa, Homo sapiens
  light chain complementarity determining region 3 for antibody 35248
QQYDNLPFT

SEQ ID NO: 70496 - protein, 14 aa, Homo sapiens
  heavy chain complementarity determining region 3 for antibody 35248
AGGDFCGSDCYSEY

SEQ ID NO: 70497 - protein, 11 aa, Homo sapiens
  light chain complementarity determining region 3 for antibody 35249
QQYDKSRRGYP

SEQ ID NO: 70498 - protein, 14 aa, Homo sapiens
  heavy chain complementarity determining region 3 for antibody 35249
ARLRWLVDAQFFDF

SEQ ID NO: 70499 - protein, 11 aa, Homo sapiens
  light chain complementarity determining region 3 for antibody 35250
QQYDKSRRGST

SEQ ID NO: 70500 - protein, 14 aa, Homo sapiens
  heavy chain complementarity determining region 3 for antibody 35250
ARLRWLVDAQFFDF

SEQ ID NO: 70501 - protein, 9 aa, Homo sapiens
  light chain complementarity determining region 3 for antibody 35251
QQYDHLPLT

SEQ ID NO: 70502 - protein, 11 aa, Homo sapiens
  heavy chain complementarity determining region 3 for antibody 35251
VKDTTRYAYSD

SEQ ID NO: 70503 - protein, 9 aa, Homo sapiens
  light chain complementarity determining region 3 for antibody 35252
QQYDHLPLT

SEQ ID NO: 70504 - protein, 4 aa, Homo sapiens
  heavy chain complementarity determining region 3 for antibody 35252
AYSD

SEQ ID NO: 70505 - protein, 9 aa, Homo sapiens
  light chain complementarity determining region 3 for antibody 35253
QQYATSPVT

SEQ ID NO: 70506 - protein, 15 aa, Homo sapiens
  heavy chain complementarity determining region 3 for antibody 35253
ARAPSWVDYKAPSDC

SEQ ID NO: 70507 - protein, 9 aa, Homo sapiens
  light chain complementarity determining region 3 for antibody 35254
QQYASAPIP

SEQ ID NO: 70508 - protein, 10 aa, Homo sapiens
  heavy chain complementarity determining region 3 for antibody 35254
ARMNGWLIDY

SEQ ID NO: 70509 - protein, 9 aa, Homo sapiens
  light chain complementarity determining region 3 for antibody 35255
QQYADSPLP

SEQ ID NO: 70510 - protein, 14 aa, Homo sapiens
  heavy chain complementarity determining region 3 for antibody 35255
AKALFALGWNAFDI

SEQ ID NO: 70511 - protein, 9 aa, Homo sapiens
  light chain complementarity determining region 3 for antibody 35256
QQVFSYPFT

SEQ ID NO: 70512 - protein, 12 aa, Homo sapiens
  heavy chain complementarity determining region 3 for antibody 35256
ARPLDGDHGFDP

SEQ ID NO: 70513 - protein, 9 aa, Homo sapiens
  light chain complementarity determining region 3 for antibody 35257
QQTYTTPRT

SEQ ID NO: 70514 - protein, 20 aa, Homo sapiens
  heavy chain complementarity determining region 3 for antibody 35257
ARSSNRDGLPVAGDPYYCDI

SEQ ID NO: 70515 - protein, 9 aa, Homo sapiens
  light chain complementarity determining region 3 for antibody 35258
QQTNGIPWT

SEQ ID NO: 70516 - protein, 18 aa, Homo sapiens
  heavy chain complementarity determining region 3 for antibody 35258
AKDRGLPGRLERMGSFDS

SEQ ID NO: 70517 - protein, 9 aa, Homo sapiens
  light chain complementarity determining region 3 for antibody 35259
QQSYTYPYT

SEQ ID NO: 70518 - protein, 16 aa, Homo sapiens
  heavy chain complementarity determining region 3 for antibody 35259
ATDWGSGTQWIRAFDV

SEQ ID NO: 70519 - protein, 9 aa, Homo sapiens
  light chain complementarity determining region 3 for antibody 35260
QQSYTSPYT

SEQ ID NO: 70520 - protein, 16 aa, Homo sapiens
  heavy chain complementarity determining region 3 for antibody 35260
ASDWGSGTQWIRAFDV

SEQ ID NO: 70521 - protein, 9 aa, Homo sapiens
  light chain complementarity determining region 3 for antibody 35261
QQSYSTPYT

SEQ ID NO: 70522 - protein, 17 aa, Homo sapiens
  heavy chain complementarity determining region 3 for antibody 35261
SSGGVSDCRSHYYGMDV

SEQ ID NO: 70523 - protein, 9 aa, Homo sapiens
  light chain complementarity determining region 3 for antibody 35262
QQSYSTPYT

SEQ ID NO: 70524 - protein, 19 aa, Homo sapiens
  heavy chain complementarity determining region 3 for antibody 35262
ARDLSPKCGDDCWLDAFDI

SEQ ID NO: 70525 - protein, 10 aa, Homo sapiens
  light chain complementarity determining region 3 for antibody 35263
QQSYSTPPWT

SEQ ID NO: 70526 - protein, 10 aa, Homo sapiens
  heavy chain complementarity determining region 3 for antibody 35263
ARATARAFDI

SEQ ID NO: 70527 - protein, 9 aa, Homo sapiens
  light chain complementarity determining region 3 for antibody 35264
QQSYSTPPT

SEQ ID NO: 70528 - protein, 17 aa, Homo sapiens
  heavy chain complementarity determining region 3 for antibody 35264
TRDRIRAVAYYYYGMDV

SEQ ID NO: 70529 - protein, 11 aa, Homo sapiens
  light chain complementarity determining region 3 for antibody 35265
QQSYSTPPMYP

SEQ ID NO: 70530 - protein, 14 aa, Homo sapiens
  heavy chain complementarity determining region 3 for antibody 35265
AKDRYSRRVYYFDY

SEQ ID NO: 70531 - protein, 9 aa, Homo sapiens
  light chain complementarity determining region 3 for antibody 35266
QQSYSTPPH

SEQ ID NO: 70532 - protein, 18 aa, Homo sapiens
  heavy chain complementarity determining region 3 for antibody 35266
AKNKFIYDSSGYRGAFDI

SEQ ID NO: 70533 - protein, 10 aa, Homo sapiens
  light chain complementarity determining region 3 for antibody 35267
QQSYSTPMFT

SEQ ID NO: 70534 - protein, 9 aa, Homo sapiens
  heavy chain complementarity determining region 3 for antibody 35267
ARGHNGWGD

SEQ ID NO: 70535 - protein, 9 aa, Homo sapiens
  light chain complementarity determining region 3 for antibody 35268
QQSYSTPLT

SEQ ID NO: 70536 - protein, 17 aa, Homo sapiens
  heavy chain complementarity determining region 3 for antibody 35268
ERDGLGVSVNGPQRTAY

SEQ ID NO: 70537 - protein, 8 aa, Homo sapiens
  light chain complementarity determining region 3 for antibody 35269
QQSYSTPL

SEQ ID NO: 70538 - protein, 13 aa, Homo sapiens
  heavy chain complementarity determining region 3 for antibody 35269
SRDKELGFGVFDY

SEQ ID NO: 70539 - protein, 9 aa, Homo sapiens
  light chain complementarity determining region 3 for antibody 35270
QQSYSSPFT

SEQ ID NO: 70540 - protein, 13 aa, Homo sapiens
  heavy chain complementarity determining region 3 for antibody 35270
ARKGDYYYYSMDV

SEQ ID NO: 70541 - protein, 9 aa, Homo sapiens
  light chain complementarity determining region 3 for antibody 35271
QQSYSSLYP

SEQ ID NO: 70542 - protein, 15 aa, Homo sapiens
  heavy chain complementarity determining region 3 for antibody 35271
TRGNSGNYLVRAFDI

SEQ ID NO: 70543 - protein, 9 aa, Homo sapiens
  light chain complementarity determining region 3 for antibody 35272
QQSYSSLHT

SEQ ID NO: 70544 - protein, 16 aa, Homo sapiens
  heavy chain complementarity determining region 3 for antibody 35272
AREGGSTYTTKRAFDS

SEQ ID NO: 70545 - protein, 8 aa, Homo sapiens
  light chain complementarity determining region 3 for antibody 35273
QQSYSAPT

SEQ ID NO: 70546 - protein, 24 aa, Homo sapiens
  heavy chain complementarity determining region 3 for antibody 35273
ARGRPPSGWYRLKDRTYYYYGLDV

SEQ ID NO: 70547 - protein, 8 aa, Homo sapiens
  light chain complementarity determining region 3 for antibody 35274
QQSYSALT

SEQ ID NO: 70548 - protein, 24 aa, Homo sapiens
  heavy chain complementarity determining region 3 for antibody 35274
ARGRPPSGWYRLKDRAYYYYGLDV

SEQ ID NO: 70549 - protein, 8 aa, Homo sapiens
  light chain complementarity determining region 3 for antibody 35275
QQSYSAFT

SEQ ID NO: 70550 - protein, 24 aa, Homo sapiens
  heavy chain complementarity determining region 3 for antibody 35275
ARGRPPSGWYRLKDRTYYYYGLDV

SEQ ID NO: 70551 - protein, 9 aa, Homo sapiens
  light chain complementarity determining region 3 for antibody 35276
QQSYRTPRP

SEQ ID NO: 70552 - protein, 15 aa, Homo sapiens
  heavy chain complementarity determining region 3 for antibody 35276
ARDRGAAALFYGVDV

SEQ ID NO: 70553 - protein, 10 aa, Homo sapiens
  light chain complementarity determining region 3 for antibody 35277
QQSYNTLALT

SEQ ID NO: 70554 - protein, 14 aa, Homo sapiens
  heavy chain complementarity determining region 3 for antibody 35277
ARGVASRPGPLFDF

SEQ ID NO: 70555 - protein, 9 aa, Homo sapiens
  light chain complementarity determining region 3 for antibody 35278
QQSYFTPGT

SEQ ID NO: 70556 - protein, 13 aa, Homo sapiens
  heavy chain complementarity determining region 3 for antibody 35278
ARAGMTGPNWFDP

SEQ ID NO: 70557 - protein, 9 aa, Homo sapiens
  light chain complementarity determining region 3 for antibody 35279
QQSSSSPPT

SEQ ID NO: 70558 - protein, 16 aa, Homo sapiens
  heavy chain complementarity determining region 3 for antibody 35279
AREHELYSRSSGVFGY

SEQ ID NO: 70559 - protein, 9 aa, Homo sapiens
  light chain complementarity determining region 3 for antibody 35280
QQSSFSPLT

SEQ ID NO: 70560 - protein, 10 aa, Homo sapiens
  heavy chain complementarity determining region 3 for antibody 35280
ASGTGWLPDH

SEQ ID NO: 70561 - protein, 9 aa, Homo sapiens
  light chain complementarity determining region 3 for antibody 35281
QQSNSFPPT

SEQ ID NO: 70562 - protein, 10 aa, Homo sapiens
  heavy chain complementarity determining region 3 for antibody 35281
ARSGGYGWDS

SEQ ID NO: 70563 - protein, 8 aa, Homo sapiens
  light chain complementarity determining region 3 for antibody 35282
QQSNSART

SEQ ID NO: 70564 - protein, 19 aa, Homo sapiens
  heavy chain complementarity determining region 3 for antibody 35282
AREGARGGGTTTPHWYFDL

SEQ ID NO: 70565 - protein, 10 aa, Homo sapiens
  light chain complementarity determining region 3 for antibody 35283
QQSNNNTPYT

SEQ ID NO: 70566 - protein, 21 aa, Homo sapiens
  heavy chain complementarity determining region 3 for antibody 35283
ARTGRHYSDSTVYYYRPRIDY

SEQ ID NO: 70567 - protein, 9 aa, Homo sapiens
  light chain complementarity determining region 3 for antibody 35284
QQSHSFPPT

SEQ ID NO: 70568 - protein, 15 aa, Homo sapiens
  heavy chain complementarity determining region 3 for antibody 35284
VRLLRYFDRFRYFDL

SEQ ID NO: 70569 - protein, 10 aa, Homo sapiens
  light chain complementarity determining region 3 for antibody 35285
QQSHNNTPST

SEQ ID NO: 70570 - protein, 21 aa, Homo sapiens
  heavy chain complementarity determining region 3 for antibody 35285
ARTGRHYSDSTVYYYRPRIDY

SEQ ID NO: 70571 - protein, 9 aa, Homo sapiens
  light chain complementarity determining region 3 for antibody 35286
QQSFSTPYT

SEQ ID NO: 70572 - protein, 15 aa, Homo sapiens
  heavy chain complementarity determining region 3 for antibody 35286
ARDAAPISEKNWYDP

SEQ ID NO: 70573 - protein, 9 aa, Homo sapiens
  light chain complementarity determining region 3 for antibody 35287
QQSFSPPWP

SEQ ID NO: 70574 - protein, 13 aa, Homo sapiens
  heavy chain complementarity determining region 3 for antibody 35287
ARVVSAAVDFFDF

SEQ ID NO: 70575 - protein, 9 aa, Homo sapiens
  light chain complementarity determining region 3 for antibody 35288
QQRYSTLLT

SEQ ID NO: 70576 - protein, 16 aa, Homo sapiens
  heavy chain complementarity determining region 3 for antibody 35288
AREGGGTYTSNRAFDY

SEQ ID NO: 70577 - protein, 9 aa, Homo sapiens
  light chain complementarity determining region 3 for antibody 35289
QQRYSSLYT

SEQ ID NO: 70578 - protein, 15 aa, Homo sapiens
  heavy chain complementarity determining region 3 for antibody 35289
TRGNSGNYLVRAFDI

SEQ ID NO: 70579 - protein, 10 aa, Homo sapiens
  light chain complementarity determining region 3 for antibody 35290
QQRYKWPPYT

SEQ ID NO: 70580 - protein, 11 aa, Homo sapiens
  heavy chain complementarity determining region 3 for antibody 35290
ARGVGSYVLES

SEQ ID NO: 70581 - protein, 10 aa, Homo sapiens
  light chain complementarity determining region 3 for antibody 35291
QQRYKWPPYN

SEQ ID NO: 70582 - protein, 11 aa, Homo sapiens
  heavy chain complementarity determining region 3 for antibody 35291
ARGVGSYVFES

SEQ ID NO: 70583 - protein, 10 aa, Homo sapiens
  light chain complementarity determining region 3 for antibody 35292
QQRYKWPPSP

SEQ ID NO: 70584 - protein, 11 aa, Homo sapiens
  heavy chain complementarity determining region 3 for antibody 35292
ARGVGSYVFES

SEQ ID NO: 70585 - protein, 8 aa, Homo sapiens
  light chain complementarity determining region 3 for antibody 35293
QQRSTLSS

SEQ ID NO: 70586 - protein, 17 aa, Homo sapiens
  heavy chain complementarity determining region 3 for antibody 35293
ARRYWNPSSGWFQDFDY

SEQ ID NO: 70587 - protein, 8 aa, Homo sapiens
  light chain complementarity determining region 3 for antibody 35294
QQRSTGLP

SEQ ID NO: 70588 - protein, 13 aa, Homo sapiens
  heavy chain complementarity determining region 3 for antibody 35294
AREPNGPLNAFDL

SEQ ID NO: 70589 - protein, 9 aa, Homo sapiens
  light chain complementarity determining region 3 for antibody 35295
QQRSSWPST

SEQ ID NO: 70590 - protein, 11 aa, Homo sapiens
  heavy chain complementarity determining region 3 for antibody 35295
VKRWGGSSIDY

SEQ ID NO: 70591 - protein, 10 aa, Homo sapiens
  light chain complementarity determining region 3 for antibody 35296
QQRSNWPPLT

SEQ ID NO: 70592 - protein, 16 aa, Homo sapiens
  heavy chain complementarity determining region 3 for antibody 35296
ASLGGAHYYGSGSHYF

SEQ ID NO: 70593 - protein, 10 aa, Homo sapiens
  light chain complementarity determining region 3 for antibody 35297
QQRSNWPPIT

SEQ ID NO: 70594 - protein, 15 aa, Homo sapiens
  heavy chain complementarity determining region 3 for antibody 35297
VRWGGSSSLPVPFDY

SEQ ID NO: 70595 - protein, 12 aa, Homo sapiens
  light chain complementarity determining region 3 for antibody 35298
QQRSNWPPGGAT

SEQ ID NO: 70596 - protein, 13 aa, Homo sapiens
  heavy chain complementarity determining region 3 for antibody 35298
ARGYGWYGDYFDY

SEQ ID NO: 70597 - protein, 10 aa, Homo sapiens
  light chain complementarity determining region 3 for antibody 35299
QQRSNWPPET

SEQ ID NO: 70598 - protein, 24 aa, Homo sapiens
  heavy chain complementarity determining region 3 for antibody 35299
ARGRPPSGWYRLKDRTYYYYGLDV

SEQ ID NO: 70599 - protein, 10 aa, Homo sapiens
  light chain complementarity determining region 3 for antibody 35300
QQRSNWPLLT

SEQ ID NO: 70600 - protein, 16 aa, Homo sapiens
  heavy chain complementarity determining region 3 for antibody 35300
ARDRQQWPYYYYGMDV

SEQ ID NO: 70601 - protein, 8 aa, Homo sapiens
  light chain complementarity determining region 3 for antibody 35301
QQRSNWLP

SEQ ID NO: 70602 - protein, 13 aa, Homo sapiens
  heavy chain complementarity determining region 3 for antibody 35301
AKERLRSQSDLDY

SEQ ID NO: 70603 - protein, 8 aa, Homo sapiens
  light chain complementarity determining region 3 for antibody 35302
QQRSNLPT

SEQ ID NO: 70604 - protein, 21 aa, Homo sapiens
  heavy chain complementarity determining region 3 for antibody 35302
NTYVEWRSNNWFAYFYYGMDV

SEQ ID NO: 70605 - protein, 10 aa, Homo sapiens
  light chain complementarity determining region 3 for antibody 35303
QQRSDWPPLT

SEQ ID NO: 70606 - protein, 10 aa, Homo sapiens
  heavy chain complementarity determining region 3 for antibody 35303
ARDYTMPFDY

SEQ ID NO: 70607 - protein, 9 aa, Homo sapiens
  light chain complementarity determining region 3 for antibody 35304
QQRRTWPPT

SEQ ID NO: 70608 - protein, 16 aa, Homo sapiens
  heavy chain complementarity determining region 3 for antibody 35304
ARDGASSWYFKHGLDV

SEQ ID NO: 70609 - protein, 10 aa, Homo sapiens
  light chain complementarity determining region 3 for antibody 35305
QQRNHWPPWP

SEQ ID NO: 70610 - protein, 13 aa, Homo sapiens
  heavy chain complementarity determining region 3 for antibody 35305
HTTGWLEGKWFDP

SEQ ID NO: 70611 - protein, 10 aa, Homo sapiens
  light chain complementarity determining region 3 for antibody 35306
QQRNHWPPGT

SEQ ID NO: 70612 - protein, 13 aa, Homo sapiens
  heavy chain complementarity determining region 3 for antibody 35306
HTTGWLEGKWFDP

SEQ ID NO: 70613 - protein, 9 aa, Homo sapiens
  light chain complementarity determining region 3 for antibody 35307
QQRHTTPFS

SEQ ID NO: 70614 - protein, 11 aa, Homo sapiens
  heavy chain complementarity determining region 3 for antibody 35307
ARVGFGADFDY

SEQ ID NO: 70615 - protein, 9 aa, Homo sapiens
  light chain complementarity determining region 3 for antibody 35308
QQRHSVPYI

SEQ ID NO: 70616 - protein, 16 aa, Homo sapiens
  heavy chain complementarity determining region 3 for antibody 35308
VTPVSPWMTATGPFDY

SEQ ID NO: 70617 - protein, 10 aa, Homo sapiens
  light chain complementarity determining region 3 for antibody 35309
QQRGNWPPLP

SEQ ID NO: 70618 - protein, 15 aa, Homo sapiens
  heavy chain complementarity determining region 3 for antibody 35309
ATSAGSNYGGYYFDY

SEQ ID NO: 70619 - protein, 9 aa, Homo sapiens
  light chain complementarity determining region 3 for antibody 35310
QQNNSYSVT

SEQ ID NO: 70620 - protein, 17 aa, Homo sapiens
  heavy chain complementarity determining region 3 for antibody 35310
VKESWQWLVDYYYGMDV

SEQ ID NO: 70621 - protein, 8 aa, Homo sapiens
  light chain complementarity determining region 3 for antibody 35311
QQNNSYSS

SEQ ID NO: 70622 - protein, 18 aa, Homo sapiens
  heavy chain complementarity determining region 3 for antibody 35311
ARSWKVVVASGAVRYFDY

SEQ ID NO: 70623 - protein, 9 aa, Homo sapiens
  light chain complementarity determining region 3 for antibody 35312
QQNNGYSRT

SEQ ID NO: 70624 - protein, 18 aa, Homo sapiens
  heavy chain complementarity determining region 3 for antibody 35312
ARDFGGRAYTKVENAFDI

SEQ ID NO: 70625 - protein, 9 aa, Homo sapiens
  light chain complementarity determining region 3 for antibody 35313
QQNIGWPRT

SEQ ID NO: 70626 - protein, 6 aa, Homo sapiens
  heavy chain complementarity determining region 3 for antibody 35313
GSVFEY

SEQ ID NO: 70627 - protein, 9 aa, Homo sapiens
  light chain complementarity determining region 3 for antibody 35314
QQNGSLPLT

SEQ ID NO: 70628 - protein, 15 aa, Homo sapiens
  heavy chain complementarity determining region 3 for antibody 35314
AHRPNYYDKAGAFDI

SEQ ID NO: 70629 - protein, 9 aa, Homo sapiens
  light chain complementarity determining region 3 for antibody 35315
QQNGNLPRT

SEQ ID NO: 70630 - protein, 13 aa, Homo sapiens
  heavy chain complementarity determining region 3 for antibody 35315
AGGNFHSGGYGEY

SEQ ID NO: 70631 - protein, 8 aa, Homo sapiens
  light chain complementarity determining region 3 for antibody 35316
QQNDNSRT

SEQ ID NO: 70632 - protein, 15 aa, Homo sapiens
  heavy chain complementarity determining region 3 for antibody 35316
AKTDYCSAGNCPFDS

SEQ ID NO: 70633 - protein, 9 aa, Homo sapiens
  light chain complementarity determining region 3 for antibody 35317
QQNDNLPVT

SEQ ID NO: 70634 - protein, 10 aa, Homo sapiens
  heavy chain complementarity determining region 3 for antibody 35317
ASGGGHTYGY

SEQ ID NO: 70635 - protein, 9 aa, Homo sapiens
  light chain complementarity determining region 3 for antibody 35318
QQLNSHPLT

SEQ ID NO: 70636 - protein, 16 aa, Homo sapiens
  heavy chain complementarity determining region 3 for antibody 35318
VRRDEVTVFWGGPLDF

SEQ ID NO: 70637 - protein, 8 aa, Homo sapiens
  light chain complementarity determining region 3 for antibody 35319
QQHYNSGT

SEQ ID NO: 70638 - protein, 17 aa, Homo sapiens
  heavy chain complementarity determining region 3 for antibody 35319
VKDRGYSGYDSLGFFDD

SEQ ID NO: 70639 - protein, 9 aa, Homo sapiens
  light chain complementarity determining region 3 for antibody 35320
QQHWDSPGT

SEQ ID NO: 70640 - protein, 22 aa, Homo sapiens
  heavy chain complementarity determining region 3 for antibody 35320
ARPKTQGGYFDGSGYERGAFDI

SEQ ID NO: 70641 - protein, 8 aa, Homo sapiens
  light chain complementarity determining region 3 for antibody 35321
QQHVRSVS

SEQ ID NO: 70642 - protein, 13 aa, Homo sapiens
  heavy chain complementarity determining region 3 for antibody 35321
VRTWFGELSHFDY

SEQ ID NO: 70643 - protein, 9 aa, Homo sapiens
  light chain complementarity determining region 3 for antibody 35322
QQHSNWPPT

SEQ ID NO: 70644 - protein, 14 aa, Homo sapiens
  heavy chain complementarity determining region 3 for antibody 35322
AKHRYDSSGYYFDY

SEQ ID NO: 70645 - protein, 9 aa, Homo sapiens
  light chain complementarity determining region 3 for antibody 35323
QQHSDWPYT

SEQ ID NO: 70646 - protein, 11 aa, Homo sapiens
  heavy chain complementarity determining region 3 for antibody 35323
TLGRLDEELTY

SEQ ID NO: 70647 - protein, 9 aa, Homo sapiens
  light chain complementarity determining region 3 for antibody 35324
QQHSDWPYT

SEQ ID NO: 70648 - protein, 11 aa, Homo sapiens
  heavy chain complementarity determining region 3 for antibody 35324
TLGRLDEELAY

SEQ ID NO: 70649 - protein, 9 aa, Homo sapiens
  light chain complementarity determining region 3 for antibody 35325
QQHNGYSRT

SEQ ID NO: 70650 - protein, 18 aa, Homo sapiens
  heavy chain complementarity determining region 3 for antibody 35325
ARDFGGRAYTKVENAFDI

SEQ ID NO: 70651 - protein, 9 aa, Homo sapiens
  light chain complementarity determining region 3 for antibody 35326
QQHNDYPWT

SEQ ID NO: 70652 - protein, 10 aa, Homo sapiens
  heavy chain complementarity determining region 3 for antibody 35326
ARDYDAALDY

SEQ ID NO: 70653 - protein, 10 aa, Homo sapiens
  light chain complementarity determining region 3 for antibody 35327
QQHGSSPPLT

SEQ ID NO: 70654 - protein, 18 aa, Homo sapiens
  heavy chain complementarity determining region 3 for antibody 35327
ARGGYDYGWGSYGVYFDY

SEQ ID NO: 70655 - protein, 11 aa, Homo sapiens
  light chain complementarity determining region 3 for antibody 35328
QQHETSPPMYP

SEQ ID NO: 70656 - protein, 23 aa, Homo sapiens
  heavy chain complementarity determining region 3 for antibody 35328
ARARRGYRRTNSRMDFVFYGMDV

SEQ ID NO: 70657 - protein, 9 aa, Homo sapiens
  light chain complementarity determining region 3 for antibody 35329
QQGYSPPFI

SEQ ID NO: 70658 - protein, 15 aa, Homo sapiens
  heavy chain complementarity determining region 3 for antibody 35329
TRAQVIWGQLYYFDN

SEQ ID NO: 70659 - protein, 9 aa, Homo sapiens
  light chain complementarity determining region 3 for antibody 35330
QQGYRSPLI

SEQ ID NO: 70660 - protein, 15 aa, Homo sapiens
  heavy chain complementarity determining region 3 for antibody 35330
ARAQVIWGQLYYFDY

SEQ ID NO: 70661 - protein, 9 aa, Homo sapiens
  light chain complementarity determining region 3 for antibody 35331
QQGYRPPFI

SEQ ID NO: 70662 - protein, 15 aa, Homo sapiens
  heavy chain complementarity determining region 3 for antibody 35331
TRAQVSWGQLYYFDY

SEQ ID NO: 70663 - protein, 9 aa, Homo sapiens
  light chain complementarity determining region 3 for antibody 35332
QQGYRPPFI

SEQ ID NO: 70664 - protein, 15 aa, Homo sapiens
  heavy chain complementarity determining region 3 for antibody 35332
ARAQVIWGQLYYFDS

SEQ ID NO: 70665 - protein, 8 aa, Homo sapiens
  light chain complementarity determining region 3 for antibody 35333
QQGYNWVI

SEQ ID NO: 70666 - protein, 21 aa, Homo sapiens
  heavy chain complementarity determining region 3 for antibody 35333
ARNDPDNTQGGHTSGNKYLDH

SEQ ID NO: 70667 - protein, 9 aa, Homo sapiens
  light chain complementarity determining region 3 for antibody 35334
QQGYNPPFI

SEQ ID NO: 70668 - protein, 15 aa, Homo sapiens
  heavy chain complementarity determining region 3 for antibody 35334
ARAQVSWGQLYYFDS

SEQ ID NO: 70669 - protein, 9 aa, Homo sapiens
  light chain complementarity determining region 3 for antibody 35335
QQGYMTPFT

SEQ ID NO: 70670 - protein, 15 aa, Homo sapiens
  heavy chain complementarity determining region 3 for antibody 35335
AKSQVIWGQLFYFES

SEQ ID NO: 70671 - protein, 8 aa, Homo sapiens
  light chain complementarity determining region 3 for antibody 35336
QQGSNWGT

SEQ ID NO: 70672 - protein, 11 aa, Homo sapiens
  heavy chain complementarity determining region 3 for antibody 35336
ARARGGWNFDY

SEQ ID NO: 70673 - protein, 9 aa, Homo sapiens
  light chain complementarity determining region 3 for antibody 35337
QQGHDFPPP

SEQ ID NO: 70674 - protein, 16 aa, Homo sapiens
  heavy chain complementarity determining region 3 for antibody 35337
ASNPCVGGGCYQTFDN

SEQ ID NO: 70675 - protein, 9 aa, Homo sapiens
  light chain complementarity determining region 3 for antibody 35338
QQFYSAPPT

SEQ ID NO: 70676 - protein, 21 aa, Homo sapiens
  heavy chain complementarity determining region 3 for antibody 35338
ARIPHVYYLSGDYYADVWFDS

SEQ ID NO: 70677 - protein, 9 aa, Homo sapiens
  light chain complementarity determining region 3 for antibody 35339
QQFYNTPWT

SEQ ID NO: 70678 - protein, 15 aa, Homo sapiens
  heavy chain complementarity determining region 3 for antibody 35339
IGQSKVDANWNYPDF

SEQ ID NO: 70679 - protein, 9 aa, Homo sapiens
  light chain complementarity determining region 3 for antibody 35340
QQFNIYPPT

SEQ ID NO: 70680 - protein, 15 aa, Homo sapiens
  heavy chain complementarity determining region 3 for antibody 35340
VRDAGIRVRQDYFDY

SEQ ID NO: 70681 - protein, 9 aa, Homo sapiens
  light chain complementarity determining region 3 for antibody 35341
QQFLSSPWT

SEQ ID NO: 70682 - protein, 14 aa, Homo sapiens
  heavy chain complementarity determining region 3 for antibody 35341
ARLGEAYTVGGFDS

SEQ ID NO: 70683 - protein, 9 aa, Homo sapiens
  light chain complementarity determining region 3 for antibody 35342
QQFGGSPRT

SEQ ID NO: 70684 - protein, 16 aa, Homo sapiens
  heavy chain complementarity determining region 3 for antibody 35342
AKLRRRDYSGRDAFDI

SEQ ID NO: 70685 - protein, 11 aa, Homo sapiens
  light chain complementarity determining region 3 for antibody 35343
QQFGGSGQGYT

SEQ ID NO: 70686 - protein, 12 aa, Homo sapiens
  heavy chain complementarity determining region 3 for antibody 35343
AREAPNTFNFDY

SEQ ID NO: 70687 - protein, 9 aa, Homo sapiens
  light chain complementarity determining region 3 for antibody 35344
QQDVTTPLT

SEQ ID NO: 70688 - protein, 8 aa, Homo sapiens
  heavy chain complementarity determining region 3 for antibody 35344
VRMSDYIL

SEQ ID NO: 70689 - protein, 9 aa, Homo sapiens
  light chain complementarity determining region 3 for antibody 35345
QQDRRSPST

SEQ ID NO: 70690 - protein, 17 aa, Homo sapiens
  heavy chain complementarity determining region 3 for antibody 35345
AGLSSRLGDGSPSLFDY

SEQ ID NO: 70691 - protein, 9 aa, Homo sapiens
  light chain complementarity determining region 3 for antibody 35346
QQDNSYSVT

SEQ ID NO: 70692 - protein, 17 aa, Homo sapiens
  heavy chain complementarity determining region 3 for antibody 35346
VKESWQWLVDYYYGMDV

SEQ ID NO: 70693 - protein, 8 aa, Homo sapiens
  light chain complementarity determining region 3 for antibody 35347
QQDGTSRM

SEQ ID NO: 70694 - protein, 13 aa, Homo sapiens
  heavy chain complementarity determining region 3 for antibody 35347
ARGQFVGSAYYEN

SEQ ID NO: 70695 - protein, 9 aa, Homo sapiens
  light chain complementarity determining region 3 for antibody 35348
QQDGTIPRT

SEQ ID NO: 70696 - protein, 13 aa, Homo sapiens
  heavy chain complementarity determining region 3 for antibody 35348
AGGNFHRSGYAEY

SEQ ID NO: 70697 - protein, 9 aa, Homo sapiens
  light chain complementarity determining region 3 for antibody 35349
QQDGSSSIT

SEQ ID NO: 70698 - protein, 13 aa, Homo sapiens
  heavy chain complementarity determining region 3 for antibody 35349
VKEFFMVFDAFHM

SEQ ID NO: 70699 - protein, 9 aa, Homo sapiens
  light chain complementarity determining region 3 for antibody 35350
QQDGSSPWT

SEQ ID NO: 70700 - protein, 21 aa, Homo sapiens
  heavy chain complementarity determining region 3 for antibody 35350
ARDAPVSRPYSSGWYSSAFDY

SEQ ID NO: 70701 - protein, 10 aa, Homo sapiens
  light chain complementarity determining region 3 for antibody 35351
QQDGSSPTWT

SEQ ID NO: 70702 - protein, 15 aa, Homo sapiens
  heavy chain complementarity determining region 3 for antibody 35351
TRDLLDSGGAYFADH

SEQ ID NO: 70703 - protein, 9 aa, Homo sapiens
  light chain complementarity determining region 3 for antibody 35352
QQDGSSPTT

SEQ ID NO: 70704 - protein, 17 aa, Homo sapiens
  heavy chain complementarity determining region 3 for antibody 35352
ARDLGTYDATRHWYFDL

SEQ ID NO: 70705 - protein, 9 aa, Homo sapiens
  light chain complementarity determining region 3 for antibody 35353
QQDGSSPRT

SEQ ID NO: 70706 - protein, 12 aa, Homo sapiens
  heavy chain complementarity determining region 3 for antibody 35353
VKDCGLGGSRDS

SEQ ID NO: 70707 - protein, 9 aa, Homo sapiens
  light chain complementarity determining region 3 for antibody 35354
QQDGSSPRT

SEQ ID NO: 70708 - protein, 16 aa, Homo sapiens
  heavy chain complementarity determining region 3 for antibody 35354
ARDRGSSGWHWGFFDS

SEQ ID NO: 70709 - protein, 8 aa, Homo sapiens
  light chain complementarity determining region 3 for antibody 35355
QQDGSSPL

SEQ ID NO: 70710 - protein, 16 aa, Homo sapiens
  heavy chain complementarity determining region 3 for antibody 35355
ARRALLWFGELGWFDP

SEQ ID NO: 70711 - protein, 9 aa, Homo sapiens
  light chain complementarity determining region 3 for antibody 35356
QQDGSSPGT

SEQ ID NO: 70712 - protein, 18 aa, Homo sapiens
  heavy chain complementarity determining region 3 for antibody 35356
SRIDYYDTNGWSLDAFHI

SEQ ID NO: 70713 - protein, 9 aa, Homo sapiens
  light chain complementarity determining region 3 for antibody 35357
QQDGSSPFA

SEQ ID NO: 70714 - protein, 18 aa, Homo sapiens
  heavy chain complementarity determining region 3 for antibody 35357
VRGGRHDSSGYYYVPFDY

SEQ ID NO: 70715 - protein, 8 aa, Homo sapiens
  light chain complementarity determining region 3 for antibody 35358
QQDGSSLT

SEQ ID NO: 70716 - protein, 13 aa, Homo sapiens
  heavy chain complementarity determining region 3 for antibody 35358
ARVHYSSREAVDY

SEQ ID NO: 70717 - protein, 9 aa, Homo sapiens
  light chain complementarity determining region 3 for antibody 35359
QQDGSSIVT

SEQ ID NO: 70718 - protein, 16 aa, Homo sapiens
  heavy chain complementarity determining region 3 for antibody 35359
TTDWGSGYYWIRAFDL

SEQ ID NO: 70719 - protein, 9 aa, Homo sapiens
  light chain complementarity determining region 3 for antibody 35360
QQDGSSAYT

SEQ ID NO: 70720 - protein, 17 aa, Homo sapiens
  heavy chain complementarity determining region 3 for antibody 35360
ARGVWAGVNLPEGYFDY

SEQ ID NO: 70721 - protein, 9 aa, Homo sapiens
  light chain complementarity determining region 3 for antibody 35361
QQDGSAPDT

SEQ ID NO: 70722 - protein, 9 aa, Homo sapiens
  heavy chain complementarity determining region 3 for antibody 35361
ASDAGIDHH

SEQ ID NO: 70723 - protein, 9 aa, Homo sapiens
  light chain complementarity determining region 3 for antibody 35362
QQDGRTPRT

SEQ ID NO: 70724 - protein, 14 aa, Homo sapiens
  heavy chain complementarity determining region 3 for antibody 35362
AGGDFCGADCYSEY

SEQ ID NO: 70725 - protein, 10 aa, Homo sapiens
  light chain complementarity determining region 3 for antibody 35363
QQDGRSPWGA

SEQ ID NO: 70726 - protein, 17 aa, Homo sapiens
  heavy chain complementarity determining region 3 for antibody 35363
AKDYGTVTKDLVGYLDY

SEQ ID NO: 70727 - protein, 9 aa, Homo sapiens
  light chain complementarity determining region 3 for antibody 35364
QQDGRSPLT

SEQ ID NO: 70728 - protein, 14 aa, Homo sapiens
  heavy chain complementarity determining region 3 for antibody 35364
AKDRRVAGDWYFDL

SEQ ID NO: 70729 - protein, 8 aa, Homo sapiens
  light chain complementarity determining region 3 for antibody 35365
QQDGGSPR

SEQ ID NO: 70730 - protein, 16 aa, Homo sapiens
  heavy chain complementarity determining region 3 for antibody 35365
ATDWGSGTQWIRAFDV

SEQ ID NO: 70731 - protein, 8 aa, Homo sapiens
  light chain complementarity determining region 3 for antibody 35366
QQDGGPPS

SEQ ID NO: 70732 - protein, 16 aa, Homo sapiens
  heavy chain complementarity determining region 3 for antibody 35366
ATDWGSGTQWIRAFDV

SEQ ID NO: 70733 - protein, 8 aa, Homo sapiens
  light chain complementarity determining region 3 for antibody 35367
QQDENLWT

SEQ ID NO: 70734 - protein, 25 aa, Homo sapiens
  heavy chain complementarity determining region 3 for antibody 35367
ARVRRGFHSDSSGYYHMEGDDSFDI

SEQ ID NO: 70735 - protein, 9 aa, Homo sapiens
  light chain complementarity determining region 3 for antibody 35368
QQDDTPPWT

SEQ ID NO: 70736 - protein, 13 aa, Homo sapiens
  heavy chain complementarity determining region 3 for antibody 35368
ARETRIHLPAFEY

SEQ ID NO: 70737 - protein, 9 aa, Homo sapiens
  light chain complementarity determining region 3 for antibody 35369
QQDASAPIT

SEQ ID NO: 70738 - protein, 10 aa, Homo sapiens
  heavy chain complementarity determining region 3 for antibody 35369
ARMNGWLIDY

SEQ ID NO: 70739 - protein, 9 aa, Homo sapiens
  light chain complementarity determining region 3 for antibody 35370
QQCGTAPRT

SEQ ID NO: 70740 - protein, 14 aa, Homo sapiens
  heavy chain complementarity determining region 3 for antibody 35370
AKDPTGDGGGYFDY

SEQ ID NO: 70741 - protein, 9 aa, Homo sapiens
  light chain complementarity determining region 3 for antibody 35371
QQCAGSPLT

SEQ ID NO: 70742 - protein, 10 aa, Homo sapiens
  heavy chain complementarity determining region 3 for antibody 35371
SSGSGWTSED

SEQ ID NO: 70743 - protein, 10 aa, Homo sapiens
  light chain complementarity determining region 3 for antibody 35372
QQAYSTPQLT

SEQ ID NO: 70744 - protein, 11 aa, Homo sapiens
  heavy chain complementarity determining region 3 for antibody 35372
CRDLGDHVLDF

SEQ ID NO: 70745 - protein, 9 aa, Homo sapiens
  light chain complementarity determining region 3 for antibody 35373
QQAYSSPYP

SEQ ID NO: 70746 - protein, 14 aa, Homo sapiens
  heavy chain complementarity determining region 3 for antibody 35373
ARDPQRGKPDYFDY

SEQ ID NO: 70747 - protein, 9 aa, Homo sapiens
  light chain complementarity determining region 3 for antibody 35374
QQANSFPLT

SEQ ID NO: 70748 - protein, 20 aa, Homo sapiens
  heavy chain complementarity determining region 3 for antibody 35374
ARDSRSTSGESLYYYYGMDV

SEQ ID NO: 70749 - protein, 9 aa, Homo sapiens
  light chain complementarity determining region 3 for antibody 35375
QQANSFPLT

SEQ ID NO: 70750 - protein, 12 aa, Homo sapiens
  heavy chain complementarity determining region 3 for antibody 35375
AKARDGGTSPDY

SEQ ID NO: 70751 - protein, 9 aa, Homo sapiens
  light chain complementarity determining region 3 for antibody 35376
QQAKTFPLT

SEQ ID NO: 70752 - protein, 20 aa, Homo sapiens
  heavy chain complementarity determining region 3 for antibody 35376
RQSLGYCSDGSCPVVNWFDH

SEQ ID NO: 70753 - protein, 9 aa, Homo sapiens
  light chain complementarity determining region 3 for antibody 35377
QPYYTSVRT

SEQ ID NO: 70754 - protein, 12 aa, Homo sapiens
  heavy chain complementarity determining region 3 for antibody 35377
VKDCGLGGSRDS

SEQ ID NO: 70755 - protein, 11 aa, Homo sapiens
  light chain complementarity determining region 3 for antibody 35378
QPYNSYSASWT

SEQ ID NO: 70756 - protein, 15 aa, Homo sapiens
  heavy chain complementarity determining region 3 for antibody 35378
ARRYFYGSRNYLYDD

SEQ ID NO: 70757 - protein, 8 aa, Homo sapiens
  light chain complementarity determining region 3 for antibody 35379
QPYNSLYT

SEQ ID NO: 70758 - protein, 14 aa, Homo sapiens
  heavy chain complementarity determining region 3 for antibody 35379
ARENSISRKRSFDQ

SEQ ID NO: 70759 - protein, 9 aa, Homo sapiens
  light chain complementarity determining region 3 for antibody 35380
QPYGSLPLT

SEQ ID NO: 70760 - protein, 15 aa, Homo sapiens
  heavy chain complementarity determining region 3 for antibody 35380
AHRPNYYDKAGAFDI

SEQ ID NO: 70761 - protein, 9 aa, Homo sapiens
  light chain complementarity determining region 3 for antibody 35381
QPSYTSPYT

SEQ ID NO: 70762 - protein, 16 aa, Homo sapiens
  heavy chain complementarity determining region 3 for antibody 35381
ATDWGSGTQWIRAFDV

SEQ ID NO: 70763 - protein, 9 aa, Homo sapiens
  light chain complementarity determining region 3 for antibody 35382
QPSYSSLLT

SEQ ID NO: 70764 - protein, 16 aa, Homo sapiens
  heavy chain complementarity determining region 3 for antibody 35382
AREGGSTYTTKRAFDS

SEQ ID NO: 70765 - protein, 9 aa, Homo sapiens
  light chain complementarity determining region 3 for antibody 35383
QNYNSDPFT

SEQ ID NO: 70766 - protein, 8 aa, Homo sapiens
  heavy chain complementarity determining region 3 for antibody 35383
ARGMYFDL

SEQ ID NO: 70767 - protein, 8 aa, Homo sapiens
  light chain complementarity determining region 3 for antibody 35384
QLYGGSPS

SEQ ID NO: 70768 - protein, 16 aa, Homo sapiens
  heavy chain complementarity determining region 3 for antibody 35384
ATDWGSGTQWIRAFDV

SEQ ID NO: 70769 - protein, 9 aa, Homo sapiens
  light chain complementarity determining region 3 for antibody 35385
QLRYTLLST

SEQ ID NO: 70770 - protein, 12 aa, Homo sapiens
  heavy chain complementarity determining region 3 for antibody 35385
ARWDYVTNAHVY

SEQ ID NO: 70771 - protein, 10 aa, Homo sapiens
  light chain complementarity determining region 3 for antibody 35386
QKYNSDPPPT

SEQ ID NO: 70772 - protein, 14 aa, Homo sapiens
  heavy chain complementarity determining region 3 for antibody 35386
ARVSQKRSTFPFDY

SEQ ID NO: 70773 - protein, 9 aa, Homo sapiens
  light chain complementarity determining region 3 for antibody 35387
QKYNSAPPT

SEQ ID NO: 70774 - protein, 15 aa, Homo sapiens
  heavy chain complementarity determining region 3 for antibody 35387
ARTMFQWFGAYGMDV

SEQ ID NO: 70775 - protein, 9 aa, Homo sapiens
  light chain complementarity determining region 3 for antibody 35388
QKYNSAPLT

SEQ ID NO: 70776 - protein, 20 aa, Homo sapiens
  heavy chain complementarity determining region 3 for antibody 35388
ATVLRGRGSSVYYGGGAFDI

SEQ ID NO: 70777 - protein, 11 aa, Homo sapiens
  light chain complementarity determining region 3 for antibody 35389
QKYGTEPPGIA

SEQ ID NO: 70778 - protein, 12 aa, Homo sapiens
  heavy chain complementarity determining region 3 for antibody 35389
AKKIGNFDVLDV

SEQ ID NO: 70779 - protein, 11 aa, Homo sapiens
  light chain complementarity determining region 3 for antibody 35390
QKYGTAPPGIA

SEQ ID NO: 70780 - protein, 12 aa, Homo sapiens
  heavy chain complementarity determining region 3 for antibody 35390
AKKIGNFDVFDV

SEQ ID NO: 70781 - protein, 9 aa, Homo sapiens
  light chain complementarity determining region 3 for antibody 35391
QKYDGAPGT

SEQ ID NO: 70782 - protein, 9 aa, Homo sapiens
  heavy chain complementarity determining region 3 for antibody 35391
MGRNGGTVD

SEQ ID NO: 70783 - protein, 9 aa, Homo sapiens
  light chain complementarity determining region 3 for antibody 35392
QKNNSVPPT

SEQ ID NO: 70784 - protein, 14 aa, Homo sapiens
  heavy chain complementarity determining region 3 for antibody 35392
ARDPSYGGFYYFDS

SEQ ID NO: 70785 - protein, 9 aa, Homo sapiens
  light chain complementarity determining region 3 for antibody 35393
QKNNSAPRT

SEQ ID NO: 70786 - protein, 13 aa, Homo sapiens
  heavy chain complementarity determining region 3 for antibody 35393
ARDLGDHRGAFDI

SEQ ID NO: 70787 - protein, 9 aa, Homo sapiens
  light chain complementarity determining region 3 for antibody 35394
QKHYSALLT

SEQ ID NO: 70788 - protein, 17 aa, Homo sapiens
  heavy chain complementarity determining region 3 for antibody 35394
ARDRHYYGSGNYYPFDY

SEQ ID NO: 70789 - protein, 9 aa, Homo sapiens
  light chain complementarity determining region 3 for antibody 35395
QKHNSAPLT

SEQ ID NO: 70790 - protein, 11 aa, Homo sapiens
  heavy chain complementarity determining region 3 for antibody 35395
ATKFKGAPLDY

SEQ ID NO: 70791 - protein, 9 aa, Homo sapiens
  light chain complementarity determining region 3 for antibody 35396
QHYYTTPRT

SEQ ID NO: 70792 - protein, 8 aa, Homo sapiens
  heavy chain complementarity determining region 3 for antibody 35396
ARDGAFDS

SEQ ID NO: 70793 - protein, 9 aa, Homo sapiens
  light chain complementarity determining region 3 for antibody 35397
QHYYHVPLT

SEQ ID NO: 70794 - protein, 10 aa, Homo sapiens
  heavy chain complementarity determining region 3 for antibody 35397
TRGNNRAFDI

SEQ ID NO: 70795 - protein, 9 aa, Homo sapiens
  light chain complementarity determining region 3 for antibody 35398
QHYNSVPLT

SEQ ID NO: 70796 - protein, 10 aa, Homo sapiens
  heavy chain complementarity determining region 3 for antibody 35398
ARDVVGSDDH

SEQ ID NO: 70797 - protein, 9 aa, Homo sapiens
  light chain complementarity determining region 3 for antibody 35399
QHYNASSLT

SEQ ID NO: 70798 - protein, 16 aa, Homo sapiens
  heavy chain complementarity determining region 3 for antibody 35399
ASLGGAHYYGPGSHYF

SEQ ID NO: 70799 - protein, 9 aa, Homo sapiens
  light chain complementarity determining region 3 for antibody 35400
QHYNASSCT

SEQ ID NO: 70800 - protein, 16 aa, Homo sapiens
  heavy chain complementarity determining region 3 for antibody 35400
ASLGGAHYYGPGSHYF

SEQ ID NO: 70801 - protein, 8 aa, Homo sapiens
  light chain complementarity determining region 3 for antibody 35401
QHYLLYWT

SEQ ID NO: 70802 - protein, 19 aa, Homo sapiens
  heavy chain complementarity determining region 3 for antibody 35401
AKEGLSYDINDSKRGYFDS

SEQ ID NO: 70803 - protein, 9 aa, Homo sapiens
  light chain complementarity determining region 3 for antibody 35402
QHYKSYSGT

SEQ ID NO: 70804 - protein, 14 aa, Homo sapiens
  heavy chain complementarity determining region 3 for antibody 35402
ATEGPSRMGKFFDS

SEQ ID NO: 70805 - protein, 9 aa, Homo sapiens
  light chain complementarity determining region 3 for antibody 35403
QHYKSYSGT

SEQ ID NO: 70806 - protein, 13 aa, Homo sapiens
  heavy chain complementarity determining region 3 for antibody 35403
AKGYTAWAFYFDF

SEQ ID NO: 70807 - protein, 10 aa, Homo sapiens
  light chain complementarity determining region 3 for antibody 35404
QHYHNWPPWT

SEQ ID NO: 70808 - protein, 13 aa, Homo sapiens
  heavy chain complementarity determining region 3 for antibody 35404
AKGRVRELYYFDT

SEQ ID NO: 70809 - protein, 9 aa, Homo sapiens
  light chain complementarity determining region 3 for antibody 35405
QHYGTSSFT

SEQ ID NO: 70810 - protein, 21 aa, Homo sapiens
  heavy chain complementarity determining region 3 for antibody 35405
ARMSAGSYYDSSGSYLYYFDN

SEQ ID NO: 70811 - protein, 8 aa, Homo sapiens
  light chain complementarity determining region 3 for antibody 35406
QHYGTPGT

SEQ ID NO: 70812 - protein, 15 aa, Homo sapiens
  heavy chain complementarity determining region 3 for antibody 35406
ARGEYNFIYYFAMDV

SEQ ID NO: 70813 - protein, 11 aa, Homo sapiens
  light chain complementarity determining region 3 for antibody 35407
QHYGSSPPRVP

SEQ ID NO: 70814 - protein, 28 aa, Homo sapiens
  heavy chain complementarity determining region 3 for antibody 35407
ARGAKKEKLIFVRPRDRGGDTRHWYFDL

SEQ ID NO: 70815 - protein, 10 aa, Homo sapiens
  light chain complementarity determining region 3 for antibody 35408
QHYGSSLMNT

SEQ ID NO: 70816 - protein, 14 aa, Homo sapiens
  heavy chain complementarity determining region 3 for antibody 35408
TTDRPLTGMVTFDF

SEQ ID NO: 70817 - protein, 10 aa, Homo sapiens
  light chain complementarity determining region 3 for antibody 35409
QHYGSSLMFT

SEQ ID NO: 70818 - protein, 14 aa, Homo sapiens
  heavy chain complementarity determining region 3 for antibody 35409
TTDRPLTGMVTFDF

SEQ ID NO: 70819 - protein, 8 aa, Homo sapiens
  light chain complementarity determining region 3 for antibody 35410
QHYGKAFT

SEQ ID NO: 70820 - protein, 19 aa, Homo sapiens
  heavy chain complementarity determining region 3 for antibody 35410
ARGAWEYVGETQHYYGMDV

SEQ ID NO: 70821 - protein, 11 aa, Homo sapiens
  light chain complementarity determining region 3 for antibody 35411
QHYDNSPIMFT

SEQ ID NO: 70822 - protein, 12 aa, Homo sapiens
  heavy chain complementarity determining region 3 for antibody 35411
ARHIAGSNAFDY

SEQ ID NO: 70823 - protein, 10 aa, Homo sapiens
  light chain complementarity determining region 3 for antibody 35412
QHWDSSPAYT

SEQ ID NO: 70824 - protein, 12 aa, Homo sapiens
  heavy chain complementarity determining region 3 for antibody 35412
ARETTQFGELDN

SEQ ID NO: 70825 - protein, 9 aa, Homo sapiens
  light chain complementarity determining region 3 for antibody 35413
QHTYTFPRP

SEQ ID NO: 70826 - protein, 20 aa, Homo sapiens
  heavy chain complementarity determining region 3 for antibody 35413
ARGRRIAALSTAHYYYGMDV

SEQ ID NO: 70827 - protein, 9 aa, Homo sapiens
  light chain complementarity determining region 3 for antibody 35414
QHTHTFPRT

SEQ ID NO: 70828 - protein, 20 aa, Homo sapiens
  heavy chain complementarity determining region 3 for antibody 35414
GRGRRIAALSAAHYYYGMDV

SEQ ID NO: 70829 - protein, 9 aa, Homo sapiens
  light chain complementarity determining region 3 for antibody 35415
QHTHTFPRT

SEQ ID NO: 70830 - protein, 20 aa, Homo sapiens
  heavy chain complementarity determining region 3 for antibody 35415
GRGRRIAALATAHYYYGMDV

SEQ ID NO: 70831 - protein, 9 aa, Homo sapiens
  light chain complementarity determining region 3 for antibody 35416
QHTHTFPRA

SEQ ID NO: 70832 - protein, 20 aa, Homo sapiens
  heavy chain complementarity determining region 3 for antibody 35416
GRGRRIAALSTAHYYYGMDV

SEQ ID NO: 70833 - protein, 9 aa, Homo sapiens
  light chain complementarity determining region 3 for antibody 35417
QHSYSRPFT

SEQ ID NO: 70834 - protein, 20 aa, Homo sapiens
  heavy chain complementarity determining region 3 for antibody 35417
AKGIAVAALRTVYYYYGMDV

SEQ ID NO: 70835 - protein, 9 aa, Homo sapiens
  light chain complementarity determining region 3 for antibody 35418
QHSHSRPFT

SEQ ID NO: 70836 - protein, 20 aa, Homo sapiens
  heavy chain complementarity determining region 3 for antibody 35418
SKGIAVAALRTVYYYYGMDV

SEQ ID NO: 70837 - protein, 9 aa, Homo sapiens
  light chain complementarity determining region 3 for antibody 35419
QHSHSRPFT

SEQ ID NO: 70838 - protein, 20 aa, Homo sapiens
  heavy chain complementarity determining region 3 for antibody 35419
AKGMAVAALRTVYYYYGMDV

SEQ ID NO: 70839 - protein, 9 aa, Homo sapiens
  light chain complementarity determining region 3 for antibody 35420
QHSHSRPFT

SEQ ID NO: 70840 - protein, 20 aa, Homo sapiens
  heavy chain complementarity determining region 3 for antibody 35420
AKGIAVAALRTVYYYYGMVV

SEQ ID NO: 70841 - protein, 9 aa, Homo sapiens
  light chain complementarity determining region 3 for antibody 35421
QHSHSRPFT

SEQ ID NO: 70842 - protein, 20 aa, Homo sapiens
  heavy chain complementarity determining region 3 for antibody 35421
AKGIAVAALRTGYYYYGMDV

SEQ ID NO: 70843 - protein, 9 aa, Homo sapiens
  light chain complementarity determining region 3 for antibody 35422
QHSHIRPFT

SEQ ID NO: 70844 - protein, 20 aa, Homo sapiens
  heavy chain complementarity determining region 3 for antibody 35422
AKGIAVAALRTVYYYYGMDV

SEQ ID NO: 70845 - protein, 10 aa, Homo sapiens
  light chain complementarity determining region 3 for antibody 35423
QHRSDWLPLT

SEQ ID NO: 70846 - protein, 15 aa, Homo sapiens
  heavy chain complementarity determining region 3 for antibody 35423
ARDIGIDYNEADRDY

SEQ ID NO: 70847 - protein, 9 aa, Homo sapiens
  light chain complementarity determining region 3 for antibody 35424
QHRRTWLDS

SEQ ID NO: 70848 - protein, 20 aa, Homo sapiens
  heavy chain complementarity determining region 3 for antibody 35424
ARDGSAGMAARGTPYYGLDV

SEQ ID NO: 70849 - protein, 9 aa, Homo sapiens
  light chain complementarity determining region 3 for antibody 35425
QHRNIWRGT

SEQ ID NO: 70850 - protein, 7 aa, Homo sapiens
  heavy chain complementarity determining region 3 for antibody 35425
TLSSFDY

SEQ ID NO: 70851 - protein, 9 aa, Homo sapiens
  light chain complementarity determining region 3 for antibody 35426
QHPHTFPRT

SEQ ID NO: 70852 - protein, 20 aa, Homo sapiens
  heavy chain complementarity determining region 3 for antibody 35426
GRGRRIAALSTAHYYYGMDV

SEQ ID NO: 70853 - protein, 10 aa, Homo sapiens
  light chain complementarity determining region 3 for antibody 35427
QHFDNLPLFT

SEQ ID NO: 70854 - protein, 16 aa, Homo sapiens
  heavy chain complementarity determining region 3 for antibody 35427
ARVPRGSYASGTLFDY

SEQ ID NO: 70855 - protein, 8 aa, Homo sapiens
  light chain complementarity determining region 3 for antibody 35428
QHCGSPRT

SEQ ID NO: 70856 - protein, 15 aa, Homo sapiens
  heavy chain complementarity determining region 3 for antibody 35428
AREVTNPNKYYGLDV

SEQ ID NO: 70857 - protein, 10 aa, Homo sapiens
  light chain complementarity determining region 3 for antibody 35429
QFRDEWPPVI

SEQ ID NO: 70858 - protein, 12 aa, Homo sapiens
  heavy chain complementarity determining region 3 for antibody 35429
VRDHITGWKFDY

SEQ ID NO: 70859 - protein, 10 aa, Homo sapiens
  light chain complementarity determining region 3 for antibody 35430
QEYNDWPPWT

SEQ ID NO: 70860 - protein, 22 aa, Homo sapiens
  heavy chain complementarity determining region 3 for antibody 35430
ARSSTGAVAGPWVPTTHRDFDI

SEQ ID NO: 70861 - protein, 9 aa, Homo sapiens
  light chain complementarity determining region 3 for antibody 35431
QESYSVRFT

SEQ ID NO: 70862 - protein, 22 aa, Homo sapiens
  heavy chain complementarity determining region 3 for antibody 35431
AKETEYDFSDMSTQYYGHLFDH

SEQ ID NO: 70863 - protein, 9 aa, Homo sapiens
  light chain complementarity determining region 3 for antibody 35432
QELKSFPPS

SEQ ID NO: 70864 - protein, 17 aa, Homo sapiens
  heavy chain complementarity determining region 3 for antibody 35432
LSRWAQYNSSPNDVFDI

SEQ ID NO: 70865 - protein, 6 aa, Homo sapiens
  light chain complementarity determining region 3 for antibody 35433
QEHGST

SEQ ID NO: 70866 - protein, 12 aa, Homo sapiens
  heavy chain complementarity determining region 3 for antibody 35433
ARDHISGWSLSN

SEQ ID NO: 70867 - protein, 10 aa, Homo sapiens
  light chain complementarity determining region 3 for antibody 35434
QCRDEWPPVI

SEQ ID NO: 70868 - protein, 12 aa, Homo sapiens
  heavy chain complementarity determining region 3 for antibody 35434
VRDHIAGWKFDY

SEQ ID NO: 70869 - protein, 10 aa, Homo sapiens
  light chain complementarity determining region 3 for antibody 35435
QCRDEWPPAI

SEQ ID NO: 70870 - protein, 12 aa, Homo sapiens
  heavy chain complementarity determining region 3 for antibody 35435
VRDHITGWKFDY

SEQ ID NO: 70871 - protein, 9 aa, Homo sapiens
  light chain complementarity determining region 3 for antibody 35436
PQYFSHVYT

SEQ ID NO: 70872 - protein, 18 aa, Homo sapiens
  heavy chain complementarity determining region 3 for antibody 35436
AQERDGYCDSHACYGLDV

SEQ ID NO: 70873 - protein, 10 aa, Homo sapiens
  light chain complementarity determining region 3 for antibody 35437
PHYHNWPPWT

SEQ ID NO: 70874 - protein, 13 aa, Homo sapiens
  heavy chain complementarity determining region 3 for antibody 35437
AKGRVRELYYFET

SEQ ID NO: 70875 - protein, 9 aa, Homo sapiens
  light chain complementarity determining region 3 for antibody 35438
PHTYTFPRT

SEQ ID NO: 70876 - protein, 20 aa, Homo sapiens
  heavy chain complementarity determining region 3 for antibody 35438
ARGRRIAALSTAHYYYGMDV

SEQ ID NO: 70877 - protein, 9 aa, Homo sapiens
  light chain complementarity determining region 3 for antibody 35439
MQTLHTPWT

SEQ ID NO: 70878 - protein, 16 aa, Homo sapiens
  heavy chain complementarity determining region 3 for antibody 35439
ARVKTAAVIHVYGLDV

SEQ ID NO: 70879 - protein, 10 aa, Homo sapiens
  light chain complementarity determining region 3 for antibody 35440
MQTLHLPRFT

SEQ ID NO: 70880 - protein, 11 aa, Homo sapiens
  heavy chain complementarity determining region 3 for antibody 35440
AAYSNYISFDI

SEQ ID NO: 70881 - protein, 9 aa, Homo sapiens
  light chain complementarity determining region 3 for antibody 35441
MQSLQAPIT

SEQ ID NO: 70882 - protein, 12 aa, Homo sapiens
  heavy chain complementarity determining region 3 for antibody 35441
TRDPPTRWGMDV

SEQ ID NO: 70883 - protein, 10 aa, Homo sapiens
  light chain complementarity determining region 3 for antibody 35442
MQSIQPPRWT

SEQ ID NO: 70884 - protein, 14 aa, Homo sapiens
  heavy chain complementarity determining region 3 for antibody 35442
AVEMGDYGAPYFDY

SEQ ID NO: 70885 - protein, 9 aa, Homo sapiens
  light chain complementarity determining region 3 for antibody 35443
MQRRRWPHT

SEQ ID NO: 70886 - protein, 8 aa, Homo sapiens
  heavy chain complementarity determining region 3 for antibody 35443
TAWGSSHH

SEQ ID NO: 70887 - protein, 9 aa, Homo sapiens
  light chain complementarity determining region 3 for antibody 35444
MQRGQTPGT

SEQ ID NO: 70888 - protein, 17 aa, Homo sapiens
  heavy chain complementarity determining region 3 for antibody 35444
IPVMLVRFLEDLQLFNY

SEQ ID NO: 70889 - protein, 9 aa, Homo sapiens
  light chain complementarity determining region 3 for antibody 35445
MQHTPWPGT

SEQ ID NO: 70890 - protein, 12 aa, Homo sapiens
  heavy chain complementarity determining region 3 for antibody 35445
ATSPHRDSRSSY

SEQ ID NO: 70891 - protein, 9 aa, Homo sapiens
  light chain complementarity determining region 3 for antibody 35446
MQHTHWRGT

SEQ ID NO: 70892 - protein, 12 aa, Homo sapiens
  heavy chain complementarity determining region 3 for antibody 35446
ATSPHRDSRSSY

SEQ ID NO: 70893 - protein, 8 aa, Homo sapiens
  light chain complementarity determining region 3 for antibody 35447
MQGTSGRG

SEQ ID NO: 70894 - protein, 17 aa, Homo sapiens
  heavy chain complementarity determining region 3 for antibody 35447
AHRRYYNGNWNGATFDV

SEQ ID NO: 70895 - protein, 8 aa, Homo sapiens
  light chain complementarity determining region 3 for antibody 35448
MQGTSGGR

SEQ ID NO: 70896 - protein, 17 aa, Homo sapiens
  heavy chain complementarity determining region 3 for antibody 35448
AHRRYYNGNWNGATFDV

SEQ ID NO: 70897 - protein, 8 aa, Homo sapiens
  light chain complementarity determining region 3 for antibody 35449
MQGTSGGG

SEQ ID NO: 70898 - protein, 17 aa, Homo sapiens
  heavy chain complementarity determining region 3 for antibody 35449
AHRRYYNGNWNGATFDV

SEQ ID NO: 70899 - protein, 9 aa, Homo sapiens
  light chain complementarity determining region 3 for antibody 35450
MQGTRWPYT

SEQ ID NO: 70900 - protein, 10 aa, Homo sapiens
  heavy chain complementarity determining region 3 for antibody 35450
ASGQFYHFDY

SEQ ID NO: 70901 - protein, 9 aa, Homo sapiens
  light chain complementarity determining region 3 for antibody 35451
MQGTPWPPT

SEQ ID NO: 70902 - protein, 19 aa, Homo sapiens
  heavy chain complementarity determining region 3 for antibody 35451
VRDDRDHCSGGSCEGYFDD

SEQ ID NO: 70903 - protein, 9 aa, Homo sapiens
  light chain complementarity determining region 3 for antibody 35452
MQGTPWPLT

SEQ ID NO: 70904 - protein, 19 aa, Homo sapiens
  heavy chain complementarity determining region 3 for antibody 35452
VRDDRDHCSGGSCEGYFDD

SEQ ID NO: 70905 - protein, 9 aa, Homo sapiens
  light chain complementarity determining region 3 for antibody 35453
MQGTNWPRT

SEQ ID NO: 70906 - protein, 12 aa, Homo sapiens
  heavy chain complementarity determining region 3 for antibody 35453
ARGSHLIMFGGL

SEQ ID NO: 70907 - protein, 9 aa, Homo sapiens
  light chain complementarity determining region 3 for antibody 35454
MQGTNWPLT

SEQ ID NO: 70908 - protein, 19 aa, Homo sapiens
  heavy chain complementarity determining region 3 for antibody 35454
VRDDRDHCSGGSCEGYFDD

SEQ ID NO: 70909 - protein, 8 aa, Homo sapiens
  light chain complementarity determining region 3 for antibody 35455
MQGTNMYT

SEQ ID NO: 70910 - protein, 15 aa, Homo sapiens
  heavy chain complementarity determining region 3 for antibody 35455
ARCGANSCPQSAMDV

SEQ ID NO: 70911 - protein, 8 aa, Homo sapiens
  light chain complementarity determining region 3 for antibody 35456
MQGTHWVT

SEQ ID NO: 70912 - protein, 14 aa, Homo sapiens
  heavy chain complementarity determining region 3 for antibody 35456
GKDLNTVATAPYDY

SEQ ID NO: 70913 - protein, 9 aa, Homo sapiens
  light chain complementarity determining region 3 for antibody 35457
MQGTHWPWT

SEQ ID NO: 70914 - protein, 18 aa, Homo sapiens
  heavy chain complementarity determining region 3 for antibody 35457
VKDLGGCGGDYCSYYFDV

SEQ ID NO: 70915 - protein, 9 aa, Homo sapiens
  light chain complementarity determining region 3 for antibody 35458
MQGTHWPWT

SEQ ID NO: 70916 - protein, 12 aa, Homo sapiens
  heavy chain complementarity determining region 3 for antibody 35458
AKGPLIAMTGII

SEQ ID NO: 70917 - protein, 9 aa, Homo sapiens
  light chain complementarity determining region 3 for antibody 35459
MQGTHWPRR

SEQ ID NO: 70918 - protein, 10 aa, Homo sapiens
  heavy chain complementarity determining region 3 for antibody 35459
ARVSLGGFDP

SEQ ID NO: 70919 - protein, 8 aa, Homo sapiens
  light chain complementarity determining region 3 for antibody 35460
MQGTHWPR

SEQ ID NO: 70920 - protein, 21 aa, Homo sapiens
  heavy chain complementarity determining region 3 for antibody 35460
AKDRPNYYESNGQYYTPKGDL

SEQ ID NO: 70921 - protein, 9 aa, Homo sapiens
  light chain complementarity determining region 3 for antibody 35461
MQGTHWPPT

SEQ ID NO: 70922 - protein, 17 aa, Homo sapiens
  heavy chain complementarity determining region 3 for antibody 35461
ARDDRAAAAGGEYYFDL

SEQ ID NO: 70923 - protein, 10 aa, Homo sapiens
  light chain complementarity determining region 3 for antibody 35462
MQGTHWPPGT

SEQ ID NO: 70924 - protein, 20 aa, Homo sapiens
  heavy chain complementarity determining region 3 for antibody 35462
ATDKKGVYYDGSEYYWGFDY

SEQ ID NO: 70925 - protein, 9 aa, Homo sapiens
  light chain complementarity determining region 3 for antibody 35463
MQGTHWPLT

SEQ ID NO: 70926 - protein, 19 aa, Homo sapiens
  heavy chain complementarity determining region 3 for antibody 35463
VRGDRDHCSGGSCEGYFDD

SEQ ID NO: 70927 - protein, 9 aa, Homo sapiens
  light chain complementarity determining region 3 for antibody 35464
MQGTHWPLT

SEQ ID NO: 70928 - protein, 19 aa, Homo sapiens
  heavy chain complementarity determining region 3 for antibody 35464
VRDDRDHCSGGSCDGYFDD

SEQ ID NO: 70929 - protein, 9 aa, Homo sapiens
  light chain complementarity determining region 3 for antibody 35465
MQGTHWPLP

SEQ ID NO: 70930 - protein, 17 aa, Homo sapiens
  heavy chain complementarity determining region 3 for antibody 35465
ARDDRAAAAGGEYYFDL

SEQ ID NO: 70931 - protein, 9 aa, Homo sapiens
  light chain complementarity determining region 3 for antibody 35466
MQGTHWPGT

SEQ ID NO: 70932 - protein, 12 aa, Homo sapiens
  heavy chain complementarity determining region 3 for antibody 35466
ARGSHLIMFGGL

SEQ ID NO: 70933 - protein, 8 aa, Homo sapiens
  light chain complementarity determining region 3 for antibody 35467
MQGTHRYT

SEQ ID NO: 70934 - protein, 15 aa, Homo sapiens
  heavy chain complementarity determining region 3 for antibody 35467
ARCGANSCPQSAMDV

SEQ ID NO: 70935 - protein, 9 aa, Homo sapiens
  light chain complementarity determining region 3 for antibody 35468
MQGTHRPLT

SEQ ID NO: 70936 - protein, 18 aa, Homo sapiens
  heavy chain complementarity determining region 3 for antibody 35468
AKEGPPGEDRLVIKWFDA

SEQ ID NO: 70937 - protein, 9 aa, Homo sapiens
  light chain complementarity determining region 3 for antibody 35469
MQGTHGSYT

SEQ ID NO: 70938 - protein, 11 aa, Homo sapiens
  heavy chain complementarity determining region 3 for antibody 35469
ASVRLGGPGAY

SEQ ID NO: 70939 - protein, 9 aa, Homo sapiens
  light chain complementarity determining region 3 for antibody 35470
MQGTHGPWT

SEQ ID NO: 70940 - protein, 15 aa, Homo sapiens
  heavy chain complementarity determining region 3 for antibody 35470
ALGDTSRGNQYQKDV

SEQ ID NO: 70941 - protein, 9 aa, Homo sapiens
  light chain complementarity determining region 3 for antibody 35471
MQGTHGPPT

SEQ ID NO: 70942 - protein, 19 aa, Homo sapiens
  heavy chain complementarity determining region 3 for antibody 35471
VRDDRDHCSGGSCEGYFDD

SEQ ID NO: 70943 - protein, 9 aa, Homo sapiens
  light chain complementarity determining region 3 for antibody 35472
MQGTHGPPM

SEQ ID NO: 70944 - protein, 14 aa, Homo sapiens
  heavy chain complementarity determining region 3 for antibody 35472
VRDADSGGPNDMDV

SEQ ID NO: 70945 - protein, 9 aa, Homo sapiens
  light chain complementarity determining region 3 for antibody 35473
MQGTHGPGT

SEQ ID NO: 70946 - protein, 10 aa, Homo sapiens
  heavy chain complementarity determining region 3 for antibody 35473
ARETHWGPDY

SEQ ID NO: 70947 - protein, 7 aa, Homo sapiens
  light chain complementarity determining region 3 for antibody 35474
MQGTHGP

SEQ ID NO: 70948 - protein, 17 aa, Homo sapiens
  heavy chain complementarity determining region 3 for antibody 35474
ARVPYYYDSSGYNVRDY

SEQ ID NO: 70949 - protein, 9 aa, Homo sapiens
  light chain complementarity determining region 3 for antibody 35475
MQGSNWPPT

SEQ ID NO: 70950 - protein, 13 aa, Homo sapiens
  heavy chain complementarity determining region 3 for antibody 35475
VRNLGDGYNSIDY

SEQ ID NO: 70951 - protein, 9 aa, Homo sapiens
  light chain complementarity determining region 3 for antibody 35476
MQGPHWPLT

SEQ ID NO: 70952 - protein, 19 aa, Homo sapiens
  heavy chain complementarity determining region 3 for antibody 35476
VRDDRDHCSGGSCEGYFDD

SEQ ID NO: 70953 - protein, 9 aa, Homo sapiens
  light chain complementarity determining region 3 for antibody 35477
MQGLQTRYT

SEQ ID NO: 70954 - protein, 10 aa, Homo sapiens
  heavy chain complementarity determining region 3 for antibody 35477
GRDLSGARDY

SEQ ID NO: 70955 - protein, 9 aa, Homo sapiens
  light chain complementarity determining region 3 for antibody 35478
MQGLQTPYT

SEQ ID NO: 70956 - protein, 21 aa, Homo sapiens
  heavy chain complementarity determining region 3 for antibody 35478
ARDAPVSRPYSSGWYSSAFDY

SEQ ID NO: 70957 - protein, 9 aa, Homo sapiens
  light chain complementarity determining region 3 for antibody 35479
MQGLQTPLT

SEQ ID NO: 70958 - protein, 12 aa, Homo sapiens
  heavy chain complementarity determining region 3 for antibody 35479
VKDGEANWGSWH

SEQ ID NO: 70959 - protein, 9 aa, Homo sapiens
  light chain complementarity determining region 3 for antibody 35480
MQGLQTPIT

SEQ ID NO: 70960 - protein, 12 aa, Homo sapiens
  heavy chain complementarity determining region 3 for antibody 35480
TRDGGKSWSEFT

SEQ ID NO: 70961 - protein, 9 aa, Homo sapiens
  light chain complementarity determining region 3 for antibody 35481
MQGLQTPGT

SEQ ID NO: 70962 - protein, 15 aa, Homo sapiens
  heavy chain complementarity determining region 3 for antibody 35481
ASWVHEYGDFNAFDL

SEQ ID NO: 70963 - protein, 9 aa, Homo sapiens
  light chain complementarity determining region 3 for antibody 35482
MQGLQTPET

SEQ ID NO: 70964 - protein, 10 aa, Homo sapiens
  heavy chain complementarity determining region 3 for antibody 35482
GRDLSGARDY

SEQ ID NO: 70965 - protein, 9 aa, Homo sapiens
  light chain complementarity determining region 3 for antibody 35483
MQGLQTPDT

SEQ ID NO: 70966 - protein, 10 aa, Homo sapiens
  heavy chain complementarity determining region 3 for antibody 35483
GSDLTGARDH

SEQ ID NO: 70967 - protein, 9 aa, Homo sapiens
  light chain complementarity determining region 3 for antibody 35484
MQGLQIPYT

SEQ ID NO: 70968 - protein, 10 aa, Homo sapiens
  heavy chain complementarity determining region 3 for antibody 35484
ARDVVGSDDQ

SEQ ID NO: 70969 - protein, 9 aa, Homo sapiens
  light chain complementarity determining region 3 for antibody 35485
MQGLHTPYT

SEQ ID NO: 70970 - protein, 10 aa, Homo sapiens
  heavy chain complementarity determining region 3 for antibody 35485
GSDLTGARDH

SEQ ID NO: 70971 - protein, 9 aa, Homo sapiens
  light chain complementarity determining region 3 for antibody 35486
MQDLETPFT

SEQ ID NO: 70972 - protein, 15 aa, Homo sapiens
  heavy chain complementarity determining region 3 for antibody 35486
VRHYRIITAPLEGDS

SEQ ID NO: 70973 - protein, 9 aa, Homo sapiens
  light chain complementarity determining region 3 for antibody 35487
MQCTYWPGK

SEQ ID NO: 70974 - protein, 11 aa, Homo sapiens
  heavy chain complementarity determining region 3 for antibody 35487
ATGGLRVVFGP

SEQ ID NO: 70975 - protein, 9 aa, Homo sapiens
  light chain complementarity determining region 3 for antibody 35488
MQATYGPGT

SEQ ID NO: 70976 - protein, 11 aa, Homo sapiens
  heavy chain complementarity determining region 3 for antibody 35488
LSAVRGSSFDI

SEQ ID NO: 70977 - protein, 10 aa, Homo sapiens
  light chain complementarity determining region 3 for antibody 35489
MQATNWPGFT

SEQ ID NO: 70978 - protein, 10 aa, Homo sapiens
  heavy chain complementarity determining region 3 for antibody 35489
ATSQLSTTDY

SEQ ID NO: 70979 - protein, 10 aa, Homo sapiens
  light chain complementarity determining region 3 for antibody 35490
MQATHWPPKT

SEQ ID NO: 70980 - protein, 19 aa, Homo sapiens
  heavy chain complementarity determining region 3 for antibody 35490
ARLLSDSGGWFAGSYYFDH

SEQ ID NO: 70981 - protein, 10 aa, Homo sapiens
  light chain complementarity determining region 3 for antibody 35491
MQATHWPGCT

SEQ ID NO: 70982 - protein, 10 aa, Homo sapiens
  heavy chain complementarity determining region 3 for antibody 35491
ATSQLSTTDY

SEQ ID NO: 70983 - protein, 9 aa, Homo sapiens
  light chain complementarity determining region 3 for antibody 35492
MQARQTPYT

SEQ ID NO: 70984 - protein, 21 aa, Homo sapiens
  heavy chain complementarity determining region 3 for antibody 35492
ARDAPVSRPYSSGWYSSAFDY

SEQ ID NO: 70985 - protein, 9 aa, Homo sapiens
  light chain complementarity determining region 3 for antibody 35493
MQALQTRYT

SEQ ID NO: 70986 - protein, 21 aa, Homo sapiens
  heavy chain complementarity determining region 3 for antibody 35493
ARDAPVSRPYSSGWYSSAFDY

SEQ ID NO: 70987 - protein, 8 aa, Homo sapiens
  light chain complementarity determining region 3 for antibody 35494
MQALQTRG

SEQ ID NO: 70988 - protein, 19 aa, Homo sapiens
  heavy chain complementarity determining region 3 for antibody 35494
ANFGSGNFYNVRYYYGMDV

SEQ ID NO: 70989 - protein, 9 aa, Homo sapiens
  light chain complementarity determining region 3 for antibody 35495
MQALQTPYT

SEQ ID NO: 70990 - protein, 16 aa, Homo sapiens
  heavy chain complementarity determining region 3 for antibody 35495
ARHRAAGGNYYYGMDV

SEQ ID NO: 70991 - protein, 9 aa, Homo sapiens
  light chain complementarity determining region 3 for antibody 35496
MQALQTPST

SEQ ID NO: 70992 - protein, 13 aa, Homo sapiens
  heavy chain complementarity determining region 3 for antibody 35496
ARAITKAGSGFDY

SEQ ID NO: 70993 - protein, 9 aa, Homo sapiens
  light chain complementarity determining region 3 for antibody 35497
MQALQTPRP

SEQ ID NO: 70994 - protein, 6 aa, Homo sapiens
  heavy chain complementarity determining region 3 for antibody 35497
TRALDY

SEQ ID NO: 70995 - protein, 9 aa, Homo sapiens
  light chain complementarity determining region 3 for antibody 35498
MQALQTPPT

SEQ ID NO: 70996 - protein, 14 aa, Homo sapiens
  heavy chain complementarity determining region 3 for antibody 35498
ARGLAARPLWRFDY

SEQ ID NO: 70997 - protein, 9 aa, Homo sapiens
  light chain complementarity determining region 3 for antibody 35499
MQALQTPLT

SEQ ID NO: 70998 - protein, 19 aa, Homo sapiens
  heavy chain complementarity determining region 3 for antibody 35499
ARGPPRLFSVYWYSNGMDF

SEQ ID NO: 70999 - protein, 9 aa, Homo sapiens
  light chain complementarity determining region 3 for antibody 35500
MQALQTPFP

SEQ ID NO: 71000 - protein, 13 aa, Homo sapiens
  heavy chain complementarity determining region 3 for antibody 35500
ARAITKAGSGFDY

SEQ ID NO: 71001 - protein, 9 aa, Homo sapiens
  light chain complementarity determining region 3 for antibody 35501
MQALQTPET

SEQ ID NO: 71002 - protein, 21 aa, Homo sapiens
  heavy chain complementarity determining region 3 for antibody 35501
ARDAPVSRPYSSGWYSSAFDY

SEQ ID NO: 71003 - protein, 7 aa, Homo sapiens
  light chain complementarity determining region 3 for antibody 35502
MQALQTP

SEQ ID NO: 71004 - protein, 17 aa, Homo sapiens
  heavy chain complementarity determining region 3 for antibody 35502
ARGAEQWLVQIDWYFDL

SEQ ID NO: 71005 - protein, 9 aa, Homo sapiens
  light chain complementarity determining region 3 for antibody 35503
MQALQSPIT

SEQ ID NO: 71006 - protein, 12 aa, Homo sapiens
  heavy chain complementarity determining region 3 for antibody 35503
ARDGGKSWSELP

SEQ ID NO: 71007 - protein, 8 aa, Homo sapiens
  light chain complementarity determining region 3 for antibody 35504
MQALQMWT

SEQ ID NO: 71008 - protein, 20 aa, Homo sapiens
  heavy chain complementarity determining region 3 for antibody 35504
ATESYYFDVGGYYVTVGFDP

SEQ ID NO: 71009 - protein, 8 aa, Homo sapiens
  light chain complementarity determining region 3 for antibody 35505
MQALQMGT

SEQ ID NO: 71010 - protein, 20 aa, Homo sapiens
  heavy chain complementarity determining region 3 for antibody 35505
ATESYYFDVGGYYVTVGFDP

SEQ ID NO: 71011 - protein, 9 aa, Homo sapiens
  light chain complementarity determining region 3 for antibody 35506
MQALQIPRT

SEQ ID NO: 71012 - protein, 18 aa, Homo sapiens
  heavy chain complementarity determining region 3 for antibody 35506
ARGGTMVRGSDYYCGMHV

SEQ ID NO: 71013 - protein, 8 aa, Homo sapiens
  light chain complementarity determining region 3 for antibody 35507
MQALQALT

SEQ ID NO: 71014 - protein, 16 aa, Homo sapiens
  heavy chain complementarity determining region 3 for antibody 35507
AKAGWLVGYDLSRGCA

SEQ ID NO: 71015 - protein, 9 aa, Homo sapiens
  light chain complementarity determining region 3 for antibody 35508
MQALKTPRT

SEQ ID NO: 71016 - protein, 6 aa, Homo sapiens
  heavy chain complementarity determining region 3 for antibody 35508
TRALDY

SEQ ID NO: 71017 - protein, 10 aa, Homo sapiens
  light chain complementarity determining region 3 for antibody 35509
MQALHTPPWP

SEQ ID NO: 71018 - protein, 17 aa, Homo sapiens
  heavy chain complementarity determining region 3 for antibody 35509
TSLGYSFGSVYYYGLDV

SEQ ID NO: 71019 - protein, 10 aa, Homo sapiens
  light chain complementarity determining region 3 for antibody 35510
MQALHTPPRT

SEQ ID NO: 71020 - protein, 17 aa, Homo sapiens
  heavy chain complementarity determining region 3 for antibody 35510
TSLGYSFGSVYYYGLDV

SEQ ID NO: 71021 - protein, 8 aa, Homo sapiens
  light chain complementarity determining region 3 for antibody 35511
MQALHPWT

SEQ ID NO: 71022 - protein, 18 aa, Homo sapiens
  heavy chain complementarity determining region 3 for antibody 35511
ARSRPYGGDANPARHFDY

SEQ ID NO: 71023 - protein, 8 aa, Homo sapiens
  light chain complementarity determining region 3 for antibody 35512
MQALHPLT

SEQ ID NO: 71024 - protein, 16 aa, Homo sapiens
  heavy chain complementarity determining region 3 for antibody 35512
AKWGGVAMAGHYYFDY

SEQ ID NO: 71025 - protein, 8 aa, Homo sapiens
  light chain complementarity determining region 3 for antibody 35513
MQALHIWT

SEQ ID NO: 71026 - protein, 18 aa, Homo sapiens
  heavy chain complementarity determining region 3 for antibody 35513
ARSRPYGGDANPARHFDY

SEQ ID NO: 71027 - protein, 9 aa, Homo sapiens
  light chain complementarity determining region 3 for antibody 35514
MQALETPLT

SEQ ID NO: 71028 - protein, 15 aa, Homo sapiens
  heavy chain complementarity determining region 3 for antibody 35514
VRHYRVLAAGIEGDS

SEQ ID NO: 71029 - protein, 9 aa, Homo sapiens
  light chain complementarity determining region 3 for antibody 35515
MQALETPFT

SEQ ID NO: 71030 - protein, 15 aa, Homo sapiens
  heavy chain complementarity determining region 3 for antibody 35515
VRHYRIITAPLDGDS

SEQ ID NO: 71031 - protein, 9 aa, Homo sapiens
  light chain complementarity determining region 3 for antibody 35516
MQALETPFT

SEQ ID NO: 71032 - protein, 15 aa, Homo sapiens
  heavy chain complementarity determining region 3 for antibody 35516
VRHYRETVAGREGDS

SEQ ID NO: 71033 - protein, 9 aa, Homo sapiens
  light chain complementarity determining region 3 for antibody 35517
MQALETPFT

SEQ ID NO: 71034 - protein, 15 aa, Homo sapiens
  heavy chain complementarity determining region 3 for antibody 35517
VRHYRETVAGIEVDS

SEQ ID NO: 71035 - protein, 9 aa, Homo sapiens
  light chain complementarity determining region 3 for antibody 35518
MQALETPFT

SEQ ID NO: 71036 - protein, 15 aa, Homo sapiens
  heavy chain complementarity determining region 3 for antibody 35518
VRHYRETVAGIDGDS

SEQ ID NO: 71037 - protein, 9 aa, Homo sapiens
  light chain complementarity determining region 3 for antibody 35519
MQALETPFT

SEQ ID NO: 71038 - protein, 15 aa, Homo sapiens
  heavy chain complementarity determining region 3 for antibody 35519
VRHCRETVAGIEGDS

SEQ ID NO: 71039 - protein, 9 aa, Homo sapiens
  light chain complementarity determining region 3 for antibody 35520
MASRHWPLP

SEQ ID NO: 71040 - protein, 8 aa, Homo sapiens
  heavy chain complementarity determining region 3 for antibody 35520
ARGRSMSE

SEQ ID NO: 71041 - protein, 8 aa, Homo sapiens
  light chain complementarity determining region 3 for antibody 35521
MAALPPFP

SEQ ID NO: 71042 - protein, 25 aa, Homo sapiens
  heavy chain complementarity determining region 3 for antibody 35521
ARAGDCSGGTCQGSEGYYYYSGMDV

SEQ ID NO: 71043 - protein, 9 aa, Homo sapiens
  light chain complementarity determining region 3 for antibody 35522
LQYVTPPRT

SEQ ID NO: 71044 - protein, 16 aa, Homo sapiens
  heavy chain complementarity determining region 3 for antibody 35522
VRDTGGGWGEDNYFDP

SEQ ID NO: 71045 - protein, 9 aa, Homo sapiens
  light chain complementarity determining region 3 for antibody 35523
LQYKSYPRT

SEQ ID NO: 71046 - protein, 6 aa, Homo sapiens
  heavy chain complementarity determining region 3 for antibody 35523
SRAFDY

SEQ ID NO: 71047 - protein, 9 aa, Homo sapiens
  light chain complementarity determining region 3 for antibody 35524
LQVYGDRLT

SEQ ID NO: 71048 - protein, 16 aa, Homo sapiens
  heavy chain complementarity determining region 3 for antibody 35524
VRDSGSGSRHSYLLDY

SEQ ID NO: 71049 - protein, 9 aa, Homo sapiens
  light chain complementarity determining region 3 for antibody 35525
LQSTHWPWT

SEQ ID NO: 71050 - protein, 10 aa, Homo sapiens
  heavy chain complementarity determining region 3 for antibody 35525
VQDHRYGSGN

SEQ ID NO: 71051 - protein, 9 aa, Homo sapiens
  light chain complementarity determining region 3 for antibody 35526
LQSIHWPWT

SEQ ID NO: 71052 - protein, 11 aa, Homo sapiens
  heavy chain complementarity determining region 3 for antibody 35526
ARFGRRKPGPD

SEQ ID NO: 71053 - protein, 9 aa, Homo sapiens
  light chain complementarity determining region 3 for antibody 35527
LQHYTYPIT

SEQ ID NO: 71054 - protein, 20 aa, Homo sapiens
  heavy chain complementarity determining region 3 for antibody 35527
ARGAHVVVVTSFRGSQGINP

SEQ ID NO: 71055 - protein, 9 aa, Homo sapiens
  light chain complementarity determining region 3 for antibody 35528
LQHYNFQWT

SEQ ID NO: 71056 - protein, 12 aa, Homo sapiens
  heavy chain complementarity determining region 3 for antibody 35528
ARHLRVPERLDS

SEQ ID NO: 71057 - protein, 9 aa, Homo sapiens
  light chain complementarity determining region 3 for antibody 35529
LQHSTSPRT

SEQ ID NO: 71058 - protein, 11 aa, Homo sapiens
  heavy chain complementarity determining region 3 for antibody 35529
TTGLGSGGINL

SEQ ID NO: 71059 - protein, 9 aa, Homo sapiens
  light chain complementarity determining region 3 for antibody 35530
LQHSTSPRT

SEQ ID NO: 71060 - protein, 20 aa, Homo sapiens
  heavy chain complementarity determining region 3 for antibody 35530
AKVLDRVVVVPVSAAYVFDI

SEQ ID NO: 71061 - protein, 9 aa, Homo sapiens
  light chain complementarity determining region 3 for antibody 35531
LQHSIYPRT

SEQ ID NO: 71062 - protein, 11 aa, Homo sapiens
  heavy chain complementarity determining region 3 for antibody 35531
TTGLGSGGINW

SEQ ID NO: 71063 - protein, 9 aa, Homo sapiens
  light chain complementarity determining region 3 for antibody 35532
LQHSISPRT

SEQ ID NO: 71064 - protein, 11 aa, Homo sapiens
  heavy chain complementarity determining region 3 for antibody 35532
PTGLGSGGINW

SEQ ID NO: 71065 - protein, 9 aa, Homo sapiens
  light chain complementarity determining region 3 for antibody 35533
LQHSISPRT

SEQ ID NO: 71066 - protein, 11 aa, Homo sapiens
  heavy chain complementarity determining region 3 for antibody 35533
PTGLGSGGINC

SEQ ID NO: 71067 - protein, 9 aa, Homo sapiens
  light chain complementarity determining region 3 for antibody 35534
LQHSISLRT

SEQ ID NO: 71068 - protein, 11 aa, Homo sapiens
  heavy chain complementarity determining region 3 for antibody 35534
TTGLGSGGINW

SEQ ID NO: 71069 - protein, 9 aa, Homo sapiens
  light chain complementarity determining region 3 for antibody 35535
LQHSIPPRT

SEQ ID NO: 71070 - protein, 11 aa, Homo sapiens
  heavy chain complementarity determining region 3 for antibody 35535
TTGLGSGGINW

SEQ ID NO: 71071 - protein, 9 aa, Homo sapiens
  light chain complementarity determining region 3 for antibody 35536
LQHKSYPHT

SEQ ID NO: 71072 - protein, 15 aa, Homo sapiens
  heavy chain complementarity determining region 3 for antibody 35536
GRSKFYYDAISQFDY

SEQ ID NO: 71073 - protein, 9 aa, Homo sapiens
  light chain complementarity determining region 3 for antibody 35537
LQHEYWPRT

SEQ ID NO: 71074 - protein, 11 aa, Homo sapiens
  heavy chain complementarity determining region 3 for antibody 35537
VRVGGAGYFDH

SEQ ID NO: 71075 - protein, 11 aa, Homo sapiens
  light chain complementarity determining region 3 for antibody 35538
LQHDNFPVTWP

SEQ ID NO: 71076 - protein, 16 aa, Homo sapiens
  heavy chain complementarity determining region 3 for antibody 35538
ARVVWGASWYVGWFDP

SEQ ID NO: 71077 - protein, 9 aa, Homo sapiens
  light chain complementarity determining region 3 for antibody 35539
LQGNSFPHT

SEQ ID NO: 71078 - protein, 14 aa, Homo sapiens
  heavy chain complementarity determining region 3 for antibody 35539
ARDRFGDSRISFDY

SEQ ID NO: 71079 - protein, 9 aa, Homo sapiens
  light chain complementarity determining region 3 for antibody 35540
LQGNRFPHT

SEQ ID NO: 71080 - protein, 14 aa, Homo sapiens
  heavy chain complementarity determining region 3 for antibody 35540
ARYCSGNACYSRDH

SEQ ID NO: 71081 - protein, 9 aa, Homo sapiens
  light chain complementarity determining region 3 for antibody 35541
LQDYNYPWT

SEQ ID NO: 71082 - protein, 14 aa, Homo sapiens
  heavy chain complementarity determining region 3 for antibody 35541
ARLLDVEARGAFDN

SEQ ID NO: 71083 - protein, 9 aa, Homo sapiens
  light chain complementarity determining region 3 for antibody 35542
LQDYNYPHT

SEQ ID NO: 71084 - protein, 10 aa, Homo sapiens
  heavy chain complementarity determining region 3 for antibody 35542
ARRGLFFGDS

SEQ ID NO: 71085 - protein, 9 aa, Homo sapiens
  light chain complementarity determining region 3 for antibody 35543
LQDYGYPLT

SEQ ID NO: 71086 - protein, 18 aa, Homo sapiens
  heavy chain complementarity determining region 3 for antibody 35543
ARSLYHSVSGAYYDAFDI

SEQ ID NO: 71087 - protein, 9 aa, Homo sapiens
  light chain complementarity determining region 3 for antibody 35544
LQDYDYPRT

SEQ ID NO: 71088 - protein, 18 aa, Homo sapiens
  heavy chain complementarity determining region 3 for antibody 35544
ARSLYHSVSGAYYDAFDI

SEQ ID NO: 71089 - protein, 9 aa, Homo sapiens
  light chain complementarity determining region 3 for antibody 35545
LQDYDYPPT

SEQ ID NO: 71090 - protein, 18 aa, Homo sapiens
  heavy chain complementarity determining region 3 for antibody 35545
ARSLYHSVSGAYYDAFDI

SEQ ID NO: 71091 - protein, 9 aa, Homo sapiens
  light chain complementarity determining region 3 for antibody 35546
LQDYDYPLT

SEQ ID NO: 71092 - protein, 18 aa, Homo sapiens
  heavy chain complementarity determining region 3 for antibody 35546
ARSLYRSVSGAYYDAFDI

SEQ ID NO: 71093 - protein, 9 aa, Homo sapiens
  light chain complementarity determining region 3 for antibody 35547
LQATNWPWT

SEQ ID NO: 71094 - protein, 12 aa, Homo sapiens
  heavy chain complementarity determining region 3 for antibody 35547
ARGANPFDAFDI

SEQ ID NO: 71095 - protein, 9 aa, Homo sapiens
  light chain complementarity determining region 3 for antibody 35548
LHHYNFPWT

SEQ ID NO: 71096 - protein, 12 aa, Homo sapiens
  heavy chain complementarity determining region 3 for antibody 35548
ARHLRVPERLDS

SEQ ID NO: 71097 - protein, 9 aa, Homo sapiens
  light chain complementarity determining region 3 for antibody 35549
KQYYTTPPP

SEQ ID NO: 71098 - protein, 14 aa, Homo sapiens
  heavy chain complementarity determining region 3 for antibody 35549
AKDRIAVGISVWEY

SEQ ID NO: 71099 - protein, 9 aa, Homo sapiens
  light chain complementarity determining region 3 for antibody 35550
KQYYTTLLT

SEQ ID NO: 71100 - protein, 14 aa, Homo sapiens
  heavy chain complementarity determining region 3 for antibody 35550
AKDRIAVGISVWEY

SEQ ID NO: 71101 - protein, 9 aa, Homo sapiens
  light chain complementarity determining region 3 for antibody 35551
KQYYITPLT

SEQ ID NO: 71102 - protein, 14 aa, Homo sapiens
  heavy chain complementarity determining region 3 for antibody 35551
AKDRIAVGISVWEY

SEQ ID NO: 71103 - protein, 9 aa, Homo sapiens
  light chain complementarity determining region 3 for antibody 35552
KQDYTTPLT

SEQ ID NO: 71104 - protein, 14 aa, Homo sapiens
  heavy chain complementarity determining region 3 for antibody 35552
AKDRIAVGISVWEY

SEQ ID NO: 71105 - protein, 9 aa, Homo sapiens
  light chain complementarity determining region 3 for antibody 35553
HQYYSTPRT

SEQ ID NO: 71106 - protein, 12 aa, Homo sapiens
  heavy chain complementarity determining region 3 for antibody 35553
ARDRSQGGPPVY

SEQ ID NO: 71107 - protein, 10 aa, Homo sapiens
  light chain complementarity determining region 3 for antibody 35554
HQYVNWPPWT

SEQ ID NO: 71108 - protein, 12 aa, Homo sapiens
  heavy chain complementarity determining region 3 for antibody 35554
AGDRGAAGPLLY

SEQ ID NO: 71109 - protein, 9 aa, Homo sapiens
  light chain complementarity determining region 3 for antibody 35555
HQYSTSPRT

SEQ ID NO: 71110 - protein, 16 aa, Homo sapiens
  heavy chain complementarity determining region 3 for antibody 35555
ARGPPPRFSTSWYGDY

SEQ ID NO: 71111 - protein, 9 aa, Homo sapiens
  light chain complementarity determining region 3 for antibody 35556
HQYSSWPLT

SEQ ID NO: 71112 - protein, 11 aa, Homo sapiens
  heavy chain complementarity determining region 3 for antibody 35556
VRVGAWLRFDS

SEQ ID NO: 71113 - protein, 9 aa, Homo sapiens
  light chain complementarity determining region 3 for antibody 35557
HQYGESPRM

SEQ ID NO: 71114 - protein, 16 aa, Homo sapiens
  heavy chain complementarity determining region 3 for antibody 35557
AKSLGVDAMTPRVYDS

SEQ ID NO: 71115 - protein, 9 aa, Homo sapiens
  light chain complementarity determining region 3 for antibody 35558
HQYGESPRL

SEQ ID NO: 71116 - protein, 16 aa, Homo sapiens
  heavy chain complementarity determining region 3 for antibody 35558
AKSLGVDAMTTRVYDS

SEQ ID NO: 71117 - protein, 11 aa, Homo sapiens
  light chain complementarity determining region 3 for antibody 35559
HQVYTTPRGLP

SEQ ID NO: 71118 - protein, 12 aa, Homo sapiens
  heavy chain complementarity determining region 3 for antibody 35559
AKESRGLHAFDL

SEQ ID NO: 71119 - protein, 9 aa, Homo sapiens
  light chain complementarity determining region 3 for antibody 35560
HQTSGLPLT

SEQ ID NO: 71120 - protein, 14 aa, Homo sapiens
  heavy chain complementarity determining region 3 for antibody 35560
ARYVDWDDSDPHDY

SEQ ID NO: 71121 - protein, 9 aa, Homo sapiens
  light chain complementarity determining region 3 for antibody 35561
HQTRGFPLT

SEQ ID NO: 71122 - protein, 14 aa, Homo sapiens
  heavy chain complementarity determining region 3 for antibody 35561
ARYVDWDDSDPHDY

SEQ ID NO: 71123 - protein, 9 aa, Homo sapiens
  light chain complementarity determining region 3 for antibody 35562
HQSSSFPIT

SEQ ID NO: 71124 - protein, 6 aa, Homo sapiens
  heavy chain complementarity determining region 3 for antibody 35562
ATVFEY

SEQ ID NO: 71125 - protein, 9 aa, Homo sapiens
  light chain complementarity determining region 3 for antibody 35563
HQSSNLPLT

SEQ ID NO: 71126 - protein, 19 aa, Homo sapiens
  heavy chain complementarity determining region 3 for antibody 35563
AKDRRDYTLWGSSSGGMDV

SEQ ID NO: 71127 - protein, 10 aa, Homo sapiens
  light chain complementarity determining region 3 for antibody 35564
HQRYKWPPYT

SEQ ID NO: 71128 - protein, 11 aa, Homo sapiens
  heavy chain complementarity determining region 3 for antibody 35564
ARGVGSYVFES

SEQ ID NO: 71129 - protein, 9 aa, Homo sapiens
  light chain complementarity determining region 3 for antibody 35565
HQRSDWPAT

SEQ ID NO: 71130 - protein, 9 aa, Homo sapiens
  heavy chain complementarity determining region 3 for antibody 35565
ASGDYAFDL

SEQ ID NO: 71131 - protein, 9 aa, Homo sapiens
  light chain complementarity determining region 3 for antibody 35566
HQHYTTPPP

SEQ ID NO: 71132 - protein, 10 aa, Homo sapiens
  heavy chain complementarity determining region 3 for antibody 35566
ARGSYNSVWA

SEQ ID NO: 71133 - protein, 9 aa, Homo sapiens
  light chain complementarity determining region 3 for antibody 35567
HQHYTPPHT

SEQ ID NO: 71134 - protein, 10 aa, Homo sapiens
  heavy chain complementarity determining region 3 for antibody 35567
ARGSYNSVWA

SEQ ID NO: 71135 - protein, 9 aa, Homo sapiens
  light chain complementarity determining region 3 for antibody 35568
HQDGSSPWT

SEQ ID NO: 71136 - protein, 9 aa, Homo sapiens
  heavy chain complementarity determining region 3 for antibody 35568
ARAYGPADY

SEQ ID NO: 71137 - protein, 9 aa, Homo sapiens
  light chain complementarity determining region 3 for antibody 35569
HHYYSPPFT

SEQ ID NO: 71138 - protein, 13 aa, Homo sapiens
  heavy chain complementarity determining region 3 for antibody 35569
RGSWFLIPYYFDY

SEQ ID NO: 71139 - protein, 9 aa, Homo sapiens
  light chain complementarity determining region 3 for antibody 35570
HHTYTFPRP

SEQ ID NO: 71140 - protein, 20 aa, Homo sapiens
  heavy chain complementarity determining region 3 for antibody 35570
ARGRRIAALSTAHYYYGMDV

SEQ ID NO: 71141 - protein, 9 aa, Homo sapiens
  light chain complementarity determining region 3 for antibody 35571
HHTSTFPRT

SEQ ID NO: 71142 - protein, 20 aa, Homo sapiens
  heavy chain complementarity determining region 3 for antibody 35571
ARGRRIAARSTAHYYYGMDV

SEQ ID NO: 71143 - protein, 9 aa, Homo sapiens
  light chain complementarity determining region 3 for antibody 35572
HHTSTFPLT

SEQ ID NO: 71144 - protein, 20 aa, Homo sapiens
  heavy chain complementarity determining region 3 for antibody 35572
ARGRRIAALSTAHYYYGMDV

SEQ ID NO: 71145 - protein, 9 aa, Homo sapiens
  light chain complementarity determining region 3 for antibody 35573
EQYHNWPPT

SEQ ID NO: 71146 - protein, 19 aa, Homo sapiens
  heavy chain complementarity determining region 3 for antibody 35573
TKNRAPSSFWSGLGDAFDP

SEQ ID NO: 71147 - protein, 9 aa, Homo sapiens
  light chain complementarity determining region 3 for antibody 35574
VQYNSYPRT

SEQ ID NO: 71148 - protein, 6 aa, Homo sapiens
  heavy chain complementarity determining region 3 for antibody 35574
TRALDY

SEQ ID NO: 71149 - protein, 9 aa, Homo sapiens
  light chain complementarity determining region 3 for antibody 35575
VQYNRYPRT

SEQ ID NO: 71150 - protein, 6 aa, Homo sapiens
  heavy chain complementarity determining region 3 for antibody 35575
TRALDS

SEQ ID NO: 71151 - protein, 9 aa, Homo sapiens
  light chain complementarity determining region 3 for antibody 35576
VQVLQTPLT

SEQ ID NO: 71152 - protein, 12 aa, Homo sapiens
  heavy chain complementarity determining region 3 for antibody 35576
VRDGELNWGTCH

SEQ ID NO: 71153 - protein, 9 aa, Homo sapiens
  light chain complementarity determining region 3 for antibody 35577
VQNNRYPRT

SEQ ID NO: 71154 - protein, 6 aa, Homo sapiens
  heavy chain complementarity determining region 3 for antibody 35577
TRALDY

SEQ ID NO: 71155 - protein, 10 aa, Homo sapiens
  light chain complementarity determining region 3 for antibody 35578
VQALQSPPWT

SEQ ID NO: 71156 - protein, 16 aa, Homo sapiens
  heavy chain complementarity determining region 3 for antibody 35578
ARDLAVDNYYYYGMDV

SEQ ID NO: 71157 - protein, 11 aa, Homo sapiens
  light chain complementarity determining region 3 for antibody 35579
RQYGTAPPGIA

SEQ ID NO: 71158 - protein, 12 aa, Homo sapiens
  heavy chain complementarity determining region 3 for antibody 35579
AKKIGNFDVFDV

SEQ ID NO: 71159 - protein, 9 aa, Homo sapiens
  light chain complementarity determining region 3 for antibody 35580
RQYGSSPRT

SEQ ID NO: 71160 - protein, 25 aa, Homo sapiens
  heavy chain complementarity determining region 3 for antibody 35580
ARLRIDRLRLPGAMRGPLYDCGLNV

SEQ ID NO: 71161 - protein, 9 aa, Homo sapiens
  light chain complementarity determining region 3 for antibody 35581
RQYDRSPET

SEQ ID NO: 71162 - protein, 12 aa, Homo sapiens
  heavy chain complementarity determining region 3 for antibody 35581
ARPLYNSGFFEY

SEQ ID NO: 71163 - protein, 10 aa, Homo sapiens
  light chain complementarity determining region 3 for antibody 35582
RQRYKWPPYT

SEQ ID NO: 71164 - protein, 11 aa, Homo sapiens
  heavy chain complementarity determining region 3 for antibody 35582
ARGVGSYVFES

SEQ ID NO: 71165 - protein, 9 aa, Homo sapiens
  light chain complementarity determining region 3 for antibody 35583
RQHTHWPWT

SEQ ID NO: 71166 - protein, 12 aa, Homo sapiens
  heavy chain complementarity determining region 3 for antibody 35583
ATSPHRDSRSSY

SEQ ID NO: 71167 - protein, 9 aa, Homo sapiens
  light chain complementarity determining region 3 for antibody 35584
RQGTYWPHI

SEQ ID NO: 71168 - protein, 11 aa, Homo sapiens
  heavy chain complementarity determining region 3 for antibody 35584
ARDPFFGALDC

SEQ ID NO: 71169 - protein, 9 aa, Homo sapiens
  light chain complementarity determining region 3 for antibody 35585
RQGTHWPWT

SEQ ID NO: 71170 - protein, 12 aa, Homo sapiens
  heavy chain complementarity determining region 3 for antibody 35585
AKGPLIAMTGMI

SEQ ID NO: 71171 - protein, 9 aa, Homo sapiens
  light chain complementarity determining region 3 for antibody 35586
RQATHWPWT

SEQ ID NO: 71172 - protein, 12 aa, Homo sapiens
  heavy chain complementarity determining region 3 for antibody 35586
ARGANPFDAFDI

SEQ ID NO: 71173 - protein, 9 aa, Homo sapiens
  light chain complementarity determining region 3 for antibody 35587
RQALQTPQT

SEQ ID NO: 71174 - protein, 13 aa, Homo sapiens
  heavy chain complementarity determining region 3 for antibody 35587
ARFQGAAAGLGLH

SEQ ID NO: 71175 - protein, 9 aa, Homo sapiens
  light chain complementarity determining region 3 for antibody 35588
RQALQTPNT

SEQ ID NO: 71176 - protein, 21 aa, Homo sapiens
  heavy chain complementarity determining region 3 for antibody 35588
ARDAPVSRPYSSGWYSSAFDY

SEQ ID NO: 71177 - protein, 9 aa, Homo sapiens
  light chain complementarity determining region 3 for antibody 35589
RQALLTPRT

SEQ ID NO: 71178 - protein, 13 aa, Homo sapiens
  heavy chain complementarity determining region 3 for antibody 35589
ARDQHAGHYGLDA

SEQ ID NO: 71179 - protein, 9 aa, Homo sapiens
  light chain complementarity determining region 3 for antibody 35590
RQALETPRT

SEQ ID NO: 71180 - protein, 12 aa, Homo sapiens
  heavy chain complementarity determining region 3 for antibody 35590
ARDVPTISRFDH

SEQ ID NO: 71181 - protein, 9 aa, Homo sapiens
  light chain complementarity determining region 3 for antibody 35591
RQALETPFT

SEQ ID NO: 71182 - protein, 15 aa, Homo sapiens
  heavy chain complementarity determining region 3 for antibody 35591
VRHYRIITAPLEGDS

SEQ ID NO: 71183 - protein, 11 aa, Homo sapiens
  light chain complementarity determining region 3 for antibody 35592
RKDGTAPPGIA

SEQ ID NO: 71184 - protein, 12 aa, Homo sapiens
  heavy chain complementarity determining region 3 for antibody 35592
AKKIGNFDVFDV

SEQ ID NO: 71185 - protein, 9 aa, Homo sapiens
  light chain complementarity determining region 3 for antibody 35593
RHALEPPYI

SEQ ID NO: 71186 - protein, 10 aa, Homo sapiens
  heavy chain complementarity determining region 3 for antibody 35593
ARDLSGGNDY

SEQ ID NO: 71187 - protein, 9 aa, Homo sapiens
  light chain complementarity determining region 3 for antibody 35594
QYYGSAPRP

SEQ ID NO: 71188 - protein, 18 aa, Homo sapiens
  heavy chain complementarity determining region 3 for antibody 35594
AKNRNLPGSNWLHDAFDI

SEQ ID NO: 71189 - protein, 10 aa, Homo sapiens
  light chain complementarity determining region 3 for antibody 35595
QYYDDSPGYP

SEQ ID NO: 71190 - protein, 12 aa, Homo sapiens
  heavy chain complementarity determining region 3 for antibody 35595
ARETTNIGELDY

SEQ ID NO: 71191 - protein, 10 aa, Homo sapiens
  light chain complementarity determining region 3 for antibody 35596
QWRDEWPPVI

SEQ ID NO: 71192 - protein, 12 aa, Homo sapiens
  heavy chain complementarity determining region 3 for antibody 35596
VRDHITGWKFDY

SEQ ID NO: 71193 - protein, 9 aa, Homo sapiens
  light chain complementarity determining region 3 for antibody 35597
QRYDIVPLT

SEQ ID NO: 71194 - protein, 14 aa, Homo sapiens
  heavy chain complementarity determining region 3 for antibody 35597
AKDFNEQYFSGLDY

SEQ ID NO: 71195 - protein, 9 aa, Homo sapiens
  light chain complementarity determining region 3 for antibody 35598
QRSHSRPFT

SEQ ID NO: 71196 - protein, 20 aa, Homo sapiens
  heavy chain complementarity determining region 3 for antibody 35598
AKGIAVAALRTVYYYYGMDV

SEQ ID NO: 71197 - protein, 8 aa, Homo sapiens
  light chain complementarity determining region 3 for antibody 35599
QRSDSSLA

SEQ ID NO: 71198 - protein, 17 aa, Homo sapiens
  heavy chain complementarity determining region 3 for antibody 35599
VRNYLAVFGRAPDAFDI

SEQ ID NO: 71199 - protein, 9 aa, Homo sapiens
  light chain complementarity determining region 3 for antibody 35600
QQYYTTPRT

SEQ ID NO: 71200 - protein, 19 aa, Homo sapiens
  heavy chain complementarity determining region 3 for antibody 35600
ARDQERNGYDMGEFGYFDL

SEQ ID NO: 71201 - protein, 9 aa, Homo sapiens
  light chain complementarity determining region 3 for antibody 35601
QQYYTSVRP

SEQ ID NO: 71202 - protein, 12 aa, Homo sapiens
  heavy chain complementarity determining region 3 for antibody 35601
VKDCGLGGSRDS

SEQ ID NO: 71203 - protein, 9 aa, Homo sapiens
  light chain complementarity determining region 3 for antibody 35602
QQYYTSPRT

SEQ ID NO: 71204 - protein, 8 aa, Homo sapiens
  heavy chain complementarity determining region 3 for antibody 35602
ARDGAFDS

SEQ ID NO: 71205 - protein, 9 aa, Homo sapiens
  light chain complementarity determining region 3 for antibody 35603
QQYYTSLRT

SEQ ID NO: 71206 - protein, 12 aa, Homo sapiens
  heavy chain complementarity determining region 3 for antibody 35603
VKDRGLGGSRDS

SEQ ID NO: 71207 - protein, 9 aa, Homo sapiens
  light chain complementarity determining region 3 for antibody 35604
QQYYTPPRP

SEQ ID NO: 71208 - protein, 8 aa, Homo sapiens
  heavy chain complementarity determining region 3 for antibody 35604
ARDGAFDS

SEQ ID NO: 71209 - protein, 11 aa, Homo sapiens
  light chain complementarity determining region 3 for antibody 35605
QQYYTLPSKVT

SEQ ID NO: 71210 - protein, 18 aa, Homo sapiens
  heavy chain complementarity determining region 3 for antibody 35605
ARGLKEGAPDQLSNYFDY

SEQ ID NO: 71211 - protein, 9 aa, Homo sapiens
  light chain complementarity determining region 3 for antibody 35606
QQYYTFFRT

SEQ ID NO: 71212 - protein, 12 aa, Homo sapiens
  heavy chain complementarity determining region 3 for antibody 35606
VKDCGLGGSRDS

SEQ ID NO: 71213 - protein, 8 aa, Homo sapiens
  light chain complementarity determining region 3 for antibody 35607
QQYYSTRT

SEQ ID NO: 71214 - protein, 19 aa, Homo sapiens
  heavy chain complementarity determining region 3 for antibody 35607
ASDPSETYYYDSSGYYYGG

SEQ ID NO: 71215 - protein, 9 aa, Homo sapiens
  light chain complementarity determining region 3 for antibody 35608
QQYYSTPYT

SEQ ID NO: 71216 - protein, 17 aa, Homo sapiens
  heavy chain complementarity determining region 3 for antibody 35608
ARDGTAPVKVAYWYFDL

SEQ ID NO: 71217 - protein, 9 aa, Homo sapiens
  light chain complementarity determining region 3 for antibody 35609
QQYYSTPPT

SEQ ID NO: 71218 - protein, 15 aa, Homo sapiens
  heavy chain complementarity determining region 3 for antibody 35609
VHTQLWFGDQCYFDF

SEQ ID NO: 71219 - protein, 9 aa, Homo sapiens
  light chain complementarity determining region 3 for antibody 35610
QQYYSTPPT

SEQ ID NO: 71220 - protein, 20 aa, Homo sapiens
  heavy chain complementarity determining region 3 for antibody 35610
ARDQAYFYALGSSGVDWLDP

SEQ ID NO: 71221 - protein, 9 aa, Homo sapiens
  light chain complementarity determining region 3 for antibody 35611
QQYYSTPNT

SEQ ID NO: 71222 - protein, 14 aa, Homo sapiens
  heavy chain complementarity determining region 3 for antibody 35611
ARHWRETTGDAFDI

SEQ ID NO: 71223 - protein, 9 aa, Homo sapiens
  light chain complementarity determining region 3 for antibody 35612
QQYYSTPLP

SEQ ID NO: 71224 - protein, 20 aa, Homo sapiens
  heavy chain complementarity determining region 3 for antibody 35612
ARDQAYYYGSGSSGVDWFDP

SEQ ID NO: 71225 - protein, 9 aa, Homo sapiens
  light chain complementarity determining region 3 for antibody 35613
QQYYSSPNT

SEQ ID NO: 71226 - protein, 23 aa, Homo sapiens
  heavy chain complementarity determining region 3 for antibody 35613
ARGVTDCSGRNCYGGEVINAFDV

SEQ ID NO: 71227 - protein, 9 aa, Homo sapiens
  light chain complementarity determining region 3 for antibody 35614
QQYYSSLRT

SEQ ID NO: 71228 - protein, 12 aa, Homo sapiens
  heavy chain complementarity determining region 3 for antibody 35614
VKDCGLGGSRDS

SEQ ID NO: 71229 - protein, 9 aa, Homo sapiens
  light chain complementarity determining region 3 for antibody 35615
QQYYSNPLT

SEQ ID NO: 71230 - protein, 20 aa, Homo sapiens
  heavy chain complementarity determining region 3 for antibody 35615
ARDQAYYYGSGSSGVDWFDP

SEQ ID NO: 71231 - protein, 9 aa, Homo sapiens
  light chain complementarity determining region 3 for antibody 35616
QQYYSIPRT

SEQ ID NO: 71232 - protein, 13 aa, Homo sapiens
  heavy chain complementarity determining region 3 for antibody 35616
TTDGDYDLGTVDF

SEQ ID NO: 71233 - protein, 9 aa, Homo sapiens
  light chain complementarity determining region 3 for antibody 35617
QQYYSFPPT

SEQ ID NO: 71234 - protein, 5 aa, Homo sapiens
  heavy chain complementarity determining region 3 for antibody 35617
GPPPY

SEQ ID NO: 71235 - protein, 9 aa, Homo sapiens
  light chain complementarity determining region 3 for antibody 35618
QQYYSFPPT

SEQ ID NO: 71236 - protein, 19 aa, Homo sapiens
  heavy chain complementarity determining region 3 for antibody 35618
ARLLSDSGGWFAGSYYFDH

SEQ ID NO: 71237 - protein, 9 aa, Homo sapiens
  light chain complementarity determining region 3 for antibody 35619
QQYYRAPYN

SEQ ID NO: 71238 - protein, 13 aa, Homo sapiens
  heavy chain complementarity determining region 3 for antibody 35619
VRDWKPAAGTGYY

SEQ ID NO: 71239 - protein, 9 aa, Homo sapiens
  light chain complementarity determining region 3 for antibody 35620
QQYYNVPPT

SEQ ID NO: 71240 - protein, 20 aa, Homo sapiens
  heavy chain complementarity determining region 3 for antibody 35620
VRDSVPHTAGHRPGITINGY

SEQ ID NO: 71241 - protein, 9 aa, Homo sapiens
  light chain complementarity determining region 3 for antibody 35621
QQYYNSPIT

SEQ ID NO: 71242 - protein, 11 aa, Homo sapiens
  heavy chain complementarity determining region 3 for antibody 35621
ATGGGGWLFGL

SEQ ID NO: 71243 - protein, 9 aa, Homo sapiens
  light chain complementarity determining region 3 for antibody 35622
QQYYNPPWT

SEQ ID NO: 71244 - protein, 16 aa, Homo sapiens
  heavy chain complementarity determining region 3 for antibody 35622
ARQSWIRGVLLGAFDY

SEQ ID NO: 71245 - protein, 9 aa, Homo sapiens
  light chain complementarity determining region 3 for antibody 35623
QQYYNAPLT

SEQ ID NO: 71246 - protein, 13 aa, Homo sapiens
  heavy chain complementarity determining region 3 for antibody 35623
ARDPGADRSSRDS

SEQ ID NO: 71247 - protein, 9 aa, Homo sapiens
  light chain complementarity determining region 3 for antibody 35624
QQYYKTPPT

SEQ ID NO: 71248 - protein, 11 aa, Homo sapiens
  heavy chain complementarity determining region 3 for antibody 35624
ARSGDSGYFDV

SEQ ID NO: 71249 - protein, 9 aa, Homo sapiens
  light chain complementarity determining region 3 for antibody 35625
QQYYDTPGT

SEQ ID NO: 71250 - protein, 12 aa, Homo sapiens
  heavy chain complementarity determining region 3 for antibody 35625
VRGSEPQRAFDV

SEQ ID NO: 71251 - protein, 10 aa, Homo sapiens
  light chain complementarity determining region 3 for antibody 35626
QQYYDLLPIT

SEQ ID NO: 71252 - protein, 12 aa, Homo sapiens
  heavy chain complementarity determining region 3 for antibody 35626
ARDVTGTRLFDF

SEQ ID NO: 71253 - protein, 9 aa, Homo sapiens
  light chain complementarity determining region 3 for antibody 35627
QQYVTTPLT

SEQ ID NO: 71254 - protein, 8 aa, Homo sapiens
  heavy chain complementarity determining region 3 for antibody 35627
VRMSDYSL

SEQ ID NO: 71255 - protein, 11 aa, Homo sapiens
  light chain complementarity determining region 3 for antibody 35628
QQYVSSPPGFT

SEQ ID NO: 71256 - protein, 18 aa, Homo sapiens
  heavy chain complementarity determining region 3 for antibody 35628
AKVSRGLTHGSGSYYFDF

SEQ ID NO: 71257 - protein, 9 aa, Homo sapiens
  light chain complementarity determining region 3 for antibody 35629
QQYVSSPAT

SEQ ID NO: 71258 - protein, 14 aa, Homo sapiens
  heavy chain complementarity determining region 3 for antibody 35629
ARGGNYGSGSYFHY

SEQ ID NO: 71259 - protein, 8 aa, Homo sapiens
  light chain complementarity determining region 3 for antibody 35630
QQYVGSPS

SEQ ID NO: 71260 - protein, 16 aa, Homo sapiens
  heavy chain complementarity determining region 3 for antibody 35630
ATDWGSGTQWIRAFDV

SEQ ID NO: 71261 - protein, 10 aa, Homo sapiens
  light chain complementarity determining region 3 for antibody 35631
QQYVGSPPFT

SEQ ID NO: 71262 - protein, 13 aa, Homo sapiens
  heavy chain complementarity determining region 3 for antibody 35631
ARVAVAGRGYFHH

SEQ ID NO: 71263 - protein, 10 aa, Homo sapiens
  light chain complementarity determining region 3 for antibody 35632
QQYVGSPPFT

SEQ ID NO: 71264 - protein, 13 aa, Homo sapiens
  heavy chain complementarity determining region 3 for antibody 35632
ARVAVAGRGSFQH

SEQ ID NO: 71265 - protein, 10 aa, Homo sapiens
  light chain complementarity determining region 3 for antibody 35633
QQYVGSHPFT

SEQ ID NO: 71266 - protein, 13 aa, Homo sapiens
  heavy chain complementarity determining region 3 for antibody 35633
ARVAVAGRGYFQH

SEQ ID NO: 71267 - protein, 10 aa, Homo sapiens
  light chain complementarity determining region 3 for antibody 35634
QQYVGPPPFT

SEQ ID NO: 71268 - protein, 13 aa, Homo sapiens
  heavy chain complementarity determining region 3 for antibody 35634
ARVAVAGRGYFQH

SEQ ID NO: 71269 - protein, 8 aa, Homo sapiens
  light chain complementarity determining region 3 for antibody 35635
QQYTYWWT

SEQ ID NO: 71270 - protein, 9 aa, Homo sapiens
  heavy chain complementarity determining region 3 for antibody 35635
ASRDDRGPY

SEQ ID NO: 71271 - protein, 9 aa, Homo sapiens
  light chain complementarity determining region 3 for antibody 35636
QQYTTSPPT

SEQ ID NO: 71272 - protein, 11 aa, Homo sapiens
  heavy chain complementarity determining region 3 for antibody 35636
VREEFGWEMTY

SEQ ID NO: 71273 - protein, 9 aa, Homo sapiens
  light chain complementarity determining region 3 for antibody 35637
QQYTNWPFT

SEQ ID NO: 71274 - protein, 13 aa, Homo sapiens
  heavy chain complementarity determining region 3 for antibody 35637
ARAGWEFFTWFDS

SEQ ID NO: 71275 - protein, 9 aa, Homo sapiens
  light chain complementarity determining region 3 for antibody 35638
QQYTNWPFT

SEQ ID NO: 71276 - protein, 20 aa, Homo sapiens
  heavy chain complementarity determining region 3 for antibody 35638
ARAGMVGDYDFWSGHGGFDP

SEQ ID NO: 71277 - protein, 10 aa, Homo sapiens
  light chain complementarity determining region 3 for antibody 35639
QQYSSYGGVT

SEQ ID NO: 71278 - protein, 15 aa, Homo sapiens
  heavy chain complementarity determining region 3 for antibody 35639
ARAGSSLSPLDAFDI

SEQ ID NO: 71279 - protein, 9 aa, Homo sapiens
  light chain complementarity determining region 3 for antibody 35640
QQYSSTPWT

SEQ ID NO: 71280 - protein, 12 aa, Homo sapiens
  heavy chain complementarity determining region 3 for antibody 35640
ARVNWGSRGFDS

SEQ ID NO: 71281 - protein, 9 aa, Homo sapiens
  light chain complementarity determining region 3 for antibody 35641
QQYSSSPPS

SEQ ID NO: 71282 - protein, 19 aa, Homo sapiens
  heavy chain complementarity determining region 3 for antibody 35641
ARAGGNYYDRTSCYGPFDY

SEQ ID NO: 71283 - protein, 9 aa, Homo sapiens
  light chain complementarity determining region 3 for antibody 35642
QQYSSSPPS

SEQ ID NO: 71284 - protein, 19 aa, Homo sapiens
  heavy chain complementarity determining region 3 for antibody 35642
ARAGGNSYDRTSYYGPFDY

SEQ ID NO: 71285 - protein, 9 aa, Homo sapiens
  light chain complementarity determining region 3 for antibody 35643
QQYSSSPLP

SEQ ID NO: 71286 - protein, 15 aa, Homo sapiens
  heavy chain complementarity determining region 3 for antibody 35643
ATGRIVAAKNVHFDY

SEQ ID NO: 71287 - protein, 10 aa, Homo sapiens
  light chain complementarity determining region 3 for antibody 35644
QQYSSSISYT

SEQ ID NO: 71288 - protein, 15 aa, Homo sapiens
  heavy chain complementarity determining region 3 for antibody 35644
ARGRYDSGGWGYFHL

SEQ ID NO: 71289 - protein, 9 aa, Homo sapiens
  light chain complementarity determining region 3 for antibody 35645
QQYSSSHPS

SEQ ID NO: 71290 - protein, 19 aa, Homo sapiens
  heavy chain complementarity determining region 3 for antibody 35645
ARAGGNYYDRTSYYGPFDY

SEQ ID NO: 71291 - protein, 9 aa, Homo sapiens
  light chain complementarity determining region 3 for antibody 35646
QQYSSPPWT

SEQ ID NO: 71292 - protein, 19 aa, Homo sapiens
  heavy chain complementarity determining region 3 for antibody 35646
ARGSSLVDHFGGAYYFFDY

SEQ ID NO: 71293 - protein, 9 aa, Homo sapiens
  light chain complementarity determining region 3 for antibody 35647
QQYSSPPGT

SEQ ID NO: 71294 - protein, 17 aa, Homo sapiens
  heavy chain complementarity determining region 3 for antibody 35647
ARDMLTSKRWPDNFFDV

SEQ ID NO: 71295 - protein, 9 aa, Homo sapiens
  light chain complementarity determining region 3 for antibody 35648
QQYSSLPPS

SEQ ID NO: 71296 - protein, 19 aa, Homo sapiens
  heavy chain complementarity determining region 3 for antibody 35648
ARAGGNYYDRTSYYGPFDY

SEQ ID NO: 71297 - protein, 9 aa, Homo sapiens
  light chain complementarity determining region 3 for antibody 35649
QQYSSIPST

SEQ ID NO: 71298 - protein, 19 aa, Homo sapiens
  heavy chain complementarity determining region 3 for antibody 35649
ARVNEVGFGLLIFRNGMDV

SEQ ID NO: 71299 - protein, 9 aa, Homo sapiens
  light chain complementarity determining region 3 for antibody 35650
QQYSSFPLT

SEQ ID NO: 71300 - protein, 13 aa, Homo sapiens
  heavy chain complementarity determining region 3 for antibody 35650
ATENIDNRGGMDV

SEQ ID NO: 71301 - protein, 10 aa, Homo sapiens
  light chain complementarity determining region 3 for antibody 35651
QQYSGSPALP

SEQ ID NO: 71302 - protein, 15 aa, Homo sapiens
  heavy chain complementarity determining region 3 for antibody 35651
AKDAWYSSGWYFFDH

SEQ ID NO: 71303 - protein, 8 aa, Homo sapiens
  light chain complementarity determining region 3 for antibody 35652
QQYSDLNT

SEQ ID NO: 71304 - protein, 17 aa, Homo sapiens
  heavy chain complementarity determining region 3 for antibody 35652
AHRRYYNGNWNGATFDV

SEQ ID NO: 71305 - protein, 9 aa, Homo sapiens
  light chain complementarity determining region 3 for antibody 35653
QQYSATPNT

SEQ ID NO: 71306 - protein, 13 aa, Homo sapiens
  heavy chain complementarity determining region 3 for antibody 35653
VRGGDYMPKGLDY

SEQ ID NO: 71307 - protein, 9 aa, Homo sapiens
  light chain complementarity determining region 3 for antibody 35654
QQYSATPDS

SEQ ID NO: 71308 - protein, 13 aa, Homo sapiens
  heavy chain complementarity determining region 3 for antibody 35654
AKSIADTGFYYDY

SEQ ID NO: 71309 - protein, 8 aa, Homo sapiens
  light chain complementarity determining region 3 for antibody 35655
QQYRSSFP

SEQ ID NO: 71310 - protein, 13 aa, Homo sapiens
  heavy chain complementarity determining region 3 for antibody 35655
AAESGWYQGAFDI

SEQ ID NO: 71311 - protein, 9 aa, Homo sapiens
  light chain complementarity determining region 3 for antibody 35656
QQYRRPPST

SEQ ID NO: 71312 - protein, 17 aa, Homo sapiens
  heavy chain complementarity determining region 3 for antibody 35656
AGLSSRLGDGSPSLFDY

SEQ ID NO: 71313 - protein, 10 aa, Homo sapiens
  light chain complementarity determining region 3 for antibody 35657
QQYRKWLMDS

SEQ ID NO: 71314 - protein, 11 aa, Homo sapiens
  heavy chain complementarity determining region 3 for antibody 35657
VRVAVAGAADY

SEQ ID NO: 71315 - protein, 9 aa, Homo sapiens
  light chain complementarity determining region 3 for antibody 35658
QQYRGDPSS

SEQ ID NO: 71316 - protein, 20 aa, Homo sapiens
  heavy chain complementarity determining region 3 for antibody 35658
ARDVDYCENGVCYSYWYFDL

SEQ ID NO: 71317 - protein, 9 aa, Homo sapiens
  light chain complementarity determining region 3 for antibody 35659
QQYQSWPYN

SEQ ID NO: 71318 - protein, 11 aa, Homo sapiens
  heavy chain complementarity determining region 3 for antibody 35659
GGFYHGGPCGY

SEQ ID NO: 71319 - protein, 9 aa, Homo sapiens
  light chain complementarity determining region 3 for antibody 35660
QQYQSWPNT

SEQ ID NO: 71320 - protein, 11 aa, Homo sapiens
  heavy chain complementarity determining region 3 for antibody 35660
GGFYHGGPCGY

SEQ ID NO: 71321 - protein, 9 aa, Homo sapiens
  light chain complementarity determining region 3 for antibody 35661
QQYQSCPYT

SEQ ID NO: 71322 - protein, 11 aa, Homo sapiens
  heavy chain complementarity determining region 3 for antibody 35661
GGFYHGGPCGY

SEQ ID NO: 71323 - protein, 9 aa, Homo sapiens
  light chain complementarity determining region 3 for antibody 35662
QQYQNWPYT

SEQ ID NO: 71324 - protein, 11 aa, Homo sapiens
  heavy chain complementarity determining region 3 for antibody 35662
GGFYHGGPCGY

SEQ ID NO: 71325 - protein, 9 aa, Homo sapiens
  light chain complementarity determining region 3 for antibody 35663
QQYQLIPPT

SEQ ID NO: 71326 - protein, 8 aa, Homo sapiens
  heavy chain complementarity determining region 3 for antibody 35663
ASGWGLAS

SEQ ID NO: 71327 - protein, 9 aa, Homo sapiens
  light chain complementarity determining region 3 for antibody 35664
QQYQLIPPP

SEQ ID NO: 71328 - protein, 8 aa, Homo sapiens
  heavy chain complementarity determining region 3 for antibody 35664
ASGWGLAS

SEQ ID NO: 71329 - protein, 9 aa, Homo sapiens
  light chain complementarity determining region 3 for antibody 35665
QQYNVWPLT

SEQ ID NO: 71330 - protein, 17 aa, Homo sapiens
  heavy chain complementarity determining region 3 for antibody 35665
ASAGDDYFGDSDYALDY

SEQ ID NO: 71331 - protein, 8 aa, Homo sapiens
  light chain complementarity determining region 3 for antibody 35666
QQYNVFLT

SEQ ID NO: 71332 - protein, 10 aa, Homo sapiens
  heavy chain complementarity determining region 3 for antibody 35666
ATDRRSVLSY

SEQ ID NO: 71333 - protein, 9 aa, Homo sapiens
  light chain complementarity determining region 3 for antibody 35667
QQYNTYSET

SEQ ID NO: 71334 - protein, 8 aa, Homo sapiens
  heavy chain complementarity determining region 3 for antibody 35667
ATSPQSGY

SEQ ID NO: 71335 - protein, 8 aa, Homo sapiens
  light chain complementarity determining region 3 for antibody 35668
QQYNTYAP

SEQ ID NO: 71336 - protein, 16 aa, Homo sapiens
  heavy chain complementarity determining region 3 for antibody 35668
ATELYYGSPTHTGFAI

SEQ ID NO: 71337 - protein, 9 aa, Homo sapiens
  light chain complementarity determining region 3 for antibody 35669
QQYNSYSYT

SEQ ID NO: 71338 - protein, 21 aa, Homo sapiens
  heavy chain complementarity determining region 3 for antibody 35669
ARLGNYYDSSGYAKDGPYFDY

SEQ ID NO: 71339 - protein, 9 aa, Homo sapiens
  light chain complementarity determining region 3 for antibody 35670
QQYNSYSYT

SEQ ID NO: 71340 - protein, 21 aa, Homo sapiens
  heavy chain complementarity determining region 3 for antibody 35670
AKDAGLSIFRYFDGLFDAFHI

SEQ ID NO: 71341 - protein, 9 aa, Homo sapiens
  light chain complementarity determining region 3 for antibody 35671
QQYNSYSWT

SEQ ID NO: 71342 - protein, 17 aa, Homo sapiens
  heavy chain complementarity determining region 3 for antibody 35671
VKESWQWLVDYYYGMDV

SEQ ID NO: 71343 - protein, 9 aa, Homo sapiens
  light chain complementarity determining region 3 for antibody 35672
QQYNSYSWT

SEQ ID NO: 71344 - protein, 17 aa, Homo sapiens
  heavy chain complementarity determining region 3 for antibody 35672
SRVRIYENTGYYPGLDY

SEQ ID NO: 71345 - protein, 9 aa, Homo sapiens
  light chain complementarity determining region 3 for antibody 35673
QQYNSYSWT

SEQ ID NO: 71346 - protein, 14 aa, Homo sapiens
  heavy chain complementarity determining region 3 for antibody 35673
ARDLGHNFGSGMDV

SEQ ID NO: 71347 - protein, 9 aa, Homo sapiens
  light chain complementarity determining region 3 for antibody 35674
QQYNSYSVT

SEQ ID NO: 71348 - protein, 17 aa, Homo sapiens
  heavy chain complementarity determining region 3 for antibody 35674
VKESWQWLVGYYYGMDV

SEQ ID NO: 71349 - protein, 9 aa, Homo sapiens
  light chain complementarity determining region 3 for antibody 35675
QQYNSYSVR

SEQ ID NO: 71350 - protein, 17 aa, Homo sapiens
  heavy chain complementarity determining region 3 for antibody 35675
VKESWQWLVDYYYGMDV

SEQ ID NO: 71351 - protein, 9 aa, Homo sapiens
  light chain complementarity determining region 3 for antibody 35676
QQYNSYSVK

SEQ ID NO: 71352 - protein, 17 aa, Homo sapiens
  heavy chain complementarity determining region 3 for antibody 35676
VKESWQWLVDYYYGMDV

SEQ ID NO: 71353 - protein, 8 aa, Homo sapiens
  light chain complementarity determining region 3 for antibody 35677
QQYNSYST

SEQ ID NO: 71354 - protein, 10 aa, Homo sapiens
  heavy chain complementarity determining region 3 for antibody 35677
ARDVVGSDDH

SEQ ID NO: 71355 - protein, 10 aa, Homo sapiens
  light chain complementarity determining region 3 for antibody 35678
QQYNSYSPYT

SEQ ID NO: 71356 - protein, 14 aa, Homo sapiens
  heavy chain complementarity determining region 3 for antibody 35678
ARDQRTGSGVVIWD

SEQ ID NO: 71357 - protein, 10 aa, Homo sapiens
  light chain complementarity determining region 3 for antibody 35679
QQYNSYSPYT

SEQ ID NO: 71358 - protein, 14 aa, Homo sapiens
  heavy chain complementarity determining region 3 for antibody 35679
ARDQRTGSGVVIVD

SEQ ID NO: 71359 - protein, 10 aa, Homo sapiens
  light chain complementarity determining region 3 for antibody 35680
QQYNSYSPYT

SEQ ID NO: 71360 - protein, 14 aa, Homo sapiens
  heavy chain complementarity determining region 3 for antibody 35680
ARDQRTGSGVVIFD

SEQ ID NO: 71361 - protein, 8 aa, Homo sapiens
  light chain complementarity determining region 3 for antibody 35681
QQYNSYSP

SEQ ID NO: 71362 - protein, 12 aa, Homo sapiens
  heavy chain complementarity determining region 3 for antibody 35681
VKDCGLGGSRDF

SEQ ID NO: 71363 - protein, 11 aa, Homo sapiens
  light chain complementarity determining region 3 for antibody 35682
QQYNSYSPMHT

SEQ ID NO: 71364 - protein, 19 aa, Homo sapiens
  heavy chain complementarity determining region 3 for antibody 35682
ARAGGNYYDRTSYYGPFDY

SEQ ID NO: 71365 - protein, 10 aa, Homo sapiens
  light chain complementarity determining region 3 for antibody 35683
QQYNSYSPLT

SEQ ID NO: 71366 - protein, 12 aa, Homo sapiens
  heavy chain complementarity determining region 3 for antibody 35683
TRFNWDRGTFDY

SEQ ID NO: 71367 - protein, 9 aa, Homo sapiens
  light chain complementarity determining region 3 for antibody 35684
QQYNSYSGT

SEQ ID NO: 71368 - protein, 11 aa, Homo sapiens
  heavy chain complementarity determining region 3 for antibody 35684
ARRSSYGQFDY

SEQ ID NO: 71369 - protein, 9 aa, Homo sapiens
  light chain complementarity determining region 3 for antibody 35685
QQYNSYSGT

SEQ ID NO: 71370 - protein, 19 aa, Homo sapiens
  heavy chain complementarity determining region 3 for antibody 35685
ARAPALLWLGDHMYNYFDP

SEQ ID NO: 71371 - protein, 10 aa, Homo sapiens
  light chain complementarity determining region 3 for antibody 35686
QQYNSYSDST

SEQ ID NO: 71372 - protein, 12 aa, Homo sapiens
  heavy chain complementarity determining region 3 for antibody 35686
ARADGDYACFDH

SEQ ID NO: 71373 - protein, 9 aa, Homo sapiens
  light chain complementarity determining region 3 for antibody 35687
QQYNSYQYT

SEQ ID NO: 71374 - protein, 9 aa, Homo sapiens
  heavy chain complementarity determining region 3 for antibody 35687
VREDWYFDH

SEQ ID NO: 71375 - protein, 9 aa, Homo sapiens
  light chain complementarity determining region 3 for antibody 35688
QQYNSYPRT

SEQ ID NO: 71376 - protein, 18 aa, Homo sapiens
  heavy chain complementarity determining region 3 for antibody 35688
ARHLGHGGYSYSSDAFNI

SEQ ID NO: 71377 - protein, 9 aa, Homo sapiens
  light chain complementarity determining region 3 for antibody 35689
QQYNSYPHT

SEQ ID NO: 71378 - protein, 31 aa, Homo sapiens
  heavy chain complementarity determining region 3 for antibody 35689
ARVELLRLSIDTGRYWGPKITPTQNVQYFEH

SEQ ID NO: 71379 - protein, 8 aa, Homo sapiens
  light chain complementarity determining region 3 for antibody 35690
QQYNSYLT

SEQ ID NO: 71380 - protein, 14 aa, Homo sapiens
  heavy chain complementarity determining region 3 for antibody 35690
ARNSEGSGWLPCDY

SEQ ID NO: 71381 - protein, 8 aa, Homo sapiens
  light chain complementarity determining region 3 for antibody 35691
QQYNSWYT

SEQ ID NO: 71382 - protein, 14 aa, Homo sapiens
  heavy chain complementarity determining region 3 for antibody 35691
ARENSISRKRSFDQ

SEQ ID NO: 71383 - protein, 9 aa, Homo sapiens
  light chain complementarity determining region 3 for antibody 35692
QQYNSVPLT

SEQ ID NO: 71384 - protein, 11 aa, Homo sapiens
  heavy chain complementarity determining region 3 for antibody 35692
ARKGTGNAMDI

SEQ ID NO: 71385 - protein, 10 aa, Homo sapiens
  light chain complementarity determining region 3 for antibody 35693
QQYNSTPPLT

SEQ ID NO: 71386 - protein, 13 aa, Homo sapiens
  heavy chain complementarity determining region 3 for antibody 35693
AKHYYNKAWYFDL

SEQ ID NO: 71387 - protein, 9 aa, Homo sapiens
  light chain complementarity determining region 3 for antibody 35694
QQYNSIPWP

SEQ ID NO: 71388 - protein, 14 aa, Homo sapiens
  heavy chain complementarity determining region 3 for antibody 35694
ARESGAGSYQGFDY

SEQ ID NO: 71389 - protein, 10 aa, Homo sapiens
  light chain complementarity determining region 3 for antibody 35695
QQYNSDPPQT

SEQ ID NO: 71390 - protein, 14 aa, Homo sapiens
  heavy chain complementarity determining region 3 for antibody 35695
ARVSQKRSTFPFDY

SEQ ID NO: 71391 - protein, 9 aa, Homo sapiens
  light chain complementarity determining region 3 for antibody 35696
QQYNSAPRT

SEQ ID NO: 71392 - protein, 13 aa, Homo sapiens
  heavy chain complementarity determining region 3 for antibody 35696
ARDLGDHRGAFDI

SEQ ID NO: 71393 - protein, 9 aa, Homo sapiens
  light chain complementarity determining region 3 for antibody 35697
QQYNSAPLT

SEQ ID NO: 71394 - protein, 11 aa, Homo sapiens
  heavy chain complementarity determining region 3 for antibody 35697
ATKFKGAPLDY

SEQ ID NO: 71395 - protein, 9 aa, Homo sapiens
  light chain complementarity determining region 3 for antibody 35698
QQYNRRPAT

SEQ ID NO: 71396 - protein, 20 aa, Homo sapiens
  heavy chain complementarity determining region 3 for antibody 35698
ARDPREYYDLRNYYVYYFDS

SEQ ID NO: 71397 - protein, 10 aa, Homo sapiens [sequence omitted]

SEQ ID NO: 71398 - protein, 15 aa, Homo sapiens
  heavy chain complementarity determining region 3 for antibody 35699
ARIRGSGYYLGAFDL

SEQ ID NO: 71399 - protein, 10 aa, Homo sapiens
  light chain complementarity determining region 3 for antibody 35700
QQYNNWPRYP

SEQ ID NO: 71400 - protein, 14 aa, Homo sapiens
  heavy chain complementarity determining region 3 for antibody 35700
ARLGEGYSYGPSDY

SEQ ID NO: 71401 - protein, 10 aa, Homo sapiens
  light chain complementarity determining region 3 for antibody 35701
QQYNNWPRYN

SEQ ID NO: 71402 - protein, 14 aa, Homo sapiens
  heavy chain complementarity determining region 3 for antibody 35701
ARLGEGYSYGPSDY

SEQ ID NO: 71403 - protein, 10 aa, Homo sapiens
  light chain complementarity determining region 3 for antibody 35702
QQYNNWPPYT

SEQ ID NO: 71404 - protein, 19 aa, Homo sapiens
  heavy chain complementarity determining region 3 for antibody 35702
TTVGYQSVRGAYYYYGMNV

SEQ ID NO: 71405 - protein, 11 aa, Homo sapiens
  light chain complementarity determining region 3 for antibody 35703
QQYNNWPPSWT

SEQ ID NO: 71406 - protein, 19 aa, Homo sapiens
  heavy chain complementarity determining region 3 for antibody 35703
ARGTPSGYSGYDSGLVFDY

SEQ ID NO: 71407 - protein, 10 aa, Homo sapiens
  light chain complementarity determining region 3 for antibody 35704
QQYNNWPPPT

SEQ ID NO: 71408 - protein, 15 aa, Homo sapiens
  heavy chain complementarity determining region 3 for antibody 35704
ARYYYDSSGYYVFDY

SEQ ID NO: 71409 - protein, 11 aa, Homo sapiens
  light chain complementarity determining region 3 for antibody 35705
QQYNNWPPPLT

SEQ ID NO: 71410 - protein, 17 aa, Homo sapiens
  heavy chain complementarity determining region 3 for antibody 35705
AREGMVRGVTYPPYFDY

SEQ ID NO: 71411 - protein, 10 aa, Homo sapiens
  light chain complementarity determining region 3 for antibody 35706
QQYNNWPPNT

SEQ ID NO: 71412 - protein, 24 aa, Homo sapiens
  heavy chain complementarity determining region 3 for antibody 35706
ARDFRPTWSPPICGVDCHGYYFDY

SEQ ID NO: 71413 - protein, 10 aa, Homo sapiens
  light chain complementarity determining region 3 for antibody 35707
QQYNNWPPLT

SEQ ID NO: 71414 - protein, 13 aa, Homo sapiens
  heavy chain complementarity determining region 3 for antibody 35707
GKDMYRVSSIINY

SEQ ID NO: 71415 - protein, 10 aa, Homo sapiens
  light chain complementarity determining region 3 for antibody 35708
QQYNNWPPLT

SEQ ID NO: 71416 - protein, 18 aa, Homo sapiens
  heavy chain complementarity determining region 3 for antibody 35708
ARGYGSGSYFNYYYGMDV

SEQ ID NO: 71417 - protein, 10 aa, Homo sapiens
  light chain complementarity determining region 3 for antibody 35709
QQYNNWPPLT

SEQ ID NO: 71418 - protein, 19 aa, Homo sapiens
  heavy chain complementarity determining region 3 for antibody 35709
ARGLYYSDRWGVSYWYFDL

SEQ ID NO: 71419 - protein, 11 aa, Homo sapiens
  light chain complementarity determining region 3 for antibody 35710
QQYNNWPPLST

SEQ ID NO: 71420 - protein, 13 aa, Homo sapiens
  heavy chain complementarity determining region 3 for antibody 35710
AKDLAGLSLAFDY

SEQ ID NO: 71421 - protein, 10 aa, Homo sapiens
  light chain complementarity determining region 3 for antibody 35711
QQYNNWPPDT

SEQ ID NO: 71422 - protein, 14 aa, Homo sapiens
  heavy chain complementarity determining region 3 for antibody 35711
GRWTYSGNDVGLSH

SEQ ID NO: 71423 - protein, 9 aa, Homo sapiens
  light chain complementarity determining region 3 for antibody 35712
QQYNNWPLT

SEQ ID NO: 71424 - protein, 13 aa, Homo sapiens
  heavy chain complementarity determining region 3 for antibody 35712
ARAGWEFFTWFDS

SEQ ID NO: 71425 - protein, 9 aa, Homo sapiens
  light chain complementarity determining region 3 for antibody 35713
QQYNNWPLT

SEQ ID NO: 71426 - protein, 16 aa, Homo sapiens
  heavy chain complementarity determining region 3 for antibody 35713
AKRVWFGDLASAVFDV

SEQ ID NO: 71427 - protein, 11 aa, Homo sapiens
  light chain complementarity determining region 3 for antibody 35714
QQYNNWPLPPT

SEQ ID NO: 71428 - protein, 17 aa, Homo sapiens
  heavy chain complementarity determining region 3 for antibody 35714
AREGMVRGVTYPPYFDY

SEQ ID NO: 71429 - protein, 10 aa, Homo sapiens
  light chain complementarity determining region 3 for antibody 35715
QQYNNWPGYT

SEQ ID NO: 71430 - protein, 23 aa, Homo sapiens
  heavy chain complementarity determining region 3 for antibody 35715
VKDHRYSGGLPGKRNQSLRDMDV

SEQ ID NO: 71431 - protein, 8 aa, Homo sapiens
  light chain complementarity determining region 3 for antibody 35716
QQYNNHRT

SEQ ID NO: 71432 - protein, 17 aa, Homo sapiens
  heavy chain complementarity determining region 3 for antibody 35716
ARRLGIRGVRGLGWFDS

SEQ ID NO: 71433 - protein, 10 aa, Homo sapiens
  light chain complementarity determining region 3 for antibody 35717
QQYNNCPPRT

SEQ ID NO: 71434 - protein, 12 aa, Homo sapiens
  heavy chain complementarity determining region 3 for antibody 35717
ARDLIYSSGFDY

SEQ ID NO: 71435 - protein, 10 aa, Homo sapiens
  light chain complementarity determining region 3 for antibody 35718
QQYNKWPPLP

SEQ ID NO: 71436 - protein, 13 aa, Homo sapiens
  heavy chain complementarity determining region 3 for antibody 35718
GKDMYRVSSIINY

SEQ ID NO: 71437 - protein, 9 aa, Homo sapiens
  light chain complementarity determining region 3 for antibody 35719
QQYNKWPFS

SEQ ID NO: 71438 - protein, 12 aa, Homo sapiens
  heavy chain complementarity determining region 3 for antibody 35719
ARESTADDYTDQ

SEQ ID NO: 71439 - protein, 9 aa, Homo sapiens
  light chain complementarity determining region 3 for antibody 35720
QQYNGYSWT

SEQ ID NO: 71440 - protein, 18 aa, Homo sapiens
  heavy chain complementarity determining region 3 for antibody 35720
ARDFGGRAYTKVENAFDI

SEQ ID NO: 71441 - protein, 9 aa, Homo sapiens
  light chain complementarity determining region 3 for antibody 35721
QQYNGYSRT

SEQ ID NO: 71442 - protein, 18 aa, Homo sapiens
  heavy chain complementarity determining region 3 for antibody 35721
ERDFGGRAYTKVENAFDI

SEQ ID NO: 71443 - protein, 9 aa, Homo sapiens
  light chain complementarity determining region 3 for antibody 35722
QQYNGYSRT

SEQ ID NO: 71444 - protein, 18 aa, Homo sapiens
  heavy chain complementarity determining region 3 for antibody 35722
ARDFGGRAYTKVENALDI

SEQ ID NO: 71445 - protein, 9 aa, Homo sapiens
  light chain complementarity determining region 3 for antibody 35723
QQYNGSSRT

SEQ ID NO: 71446 - protein, 18 aa, Homo sapiens
  heavy chain complementarity determining region 3 for antibody 35723
ARDFGGRAYTKVENAFDI

SEQ ID NO: 71447 - protein, 8 aa, Homo sapiens
  light chain complementarity determining region 3 for antibody 35724
QQYNGLWT

SEQ ID NO: 71448 - protein, 10 aa, Homo sapiens
  heavy chain complementarity determining region 3 for antibody 35724
ARDRRSLLDY

SEQ ID NO: 71449 - protein, 11 aa, Homo sapiens
  light chain complementarity determining region 3 for antibody 35725
QQYNDWPPALT

SEQ ID NO: 71450 - protein, 12 aa, Homo sapiens
  heavy chain complementarity determining region 3 for antibody 35725
SSSSSGWTWLYY

SEQ ID NO: 71451 - protein, 10 aa, Homo sapiens
  light chain complementarity determining region 3 for antibody 35726
QQYNDWPGFT

SEQ ID NO: 71452 - protein, 15 aa, Homo sapiens
  heavy chain complementarity determining region 3 for antibody 35726
ARTLSINGFYSGSDL

SEQ ID NO: 71453 - protein, 9 aa, Homo sapiens
  light chain complementarity determining region 3 for antibody 35727
QQYLVLPPT

SEQ ID NO: 71454 - protein, 15 aa, Homo sapiens
  heavy chain complementarity determining region 3 for antibody 35727
AKDGGPYINRWYRNE

SEQ ID NO: 71455 - protein, 9 aa, Homo sapiens
  light chain complementarity determining region 3 for antibody 35728
QQYLSLPPT

SEQ ID NO: 71456 - protein, 16 aa, Homo sapiens
  heavy chain complementarity determining region 3 for antibody 35728
ARDRPLRGSYYGWSDS

SEQ ID NO: 71457 - protein, 11 aa, Homo sapiens
  light chain complementarity determining region 3 for antibody 35729
QQYLNWPPAWR

SEQ ID NO: 71458 - protein, 14 aa, Homo sapiens
  heavy chain complementarity determining region 3 for antibody 35729
ARPQPGDYYHGMDV

SEQ ID NO: 71459 - protein, 8 aa, Homo sapiens
  light chain complementarity determining region 3 for antibody 35730
QQYLLYWT

SEQ ID NO: 71460 - protein, 19 aa, Homo sapiens
  heavy chain complementarity determining region 3 for antibody 35730
AKEGLSYDIDDAKRGYFDS

SEQ ID NO: 71461 - protein, 9 aa, Homo sapiens
  light chain complementarity determining region 3 for antibody 35731
QQYKRYSYT

SEQ ID NO: 71462 - protein, 13 aa, Homo sapiens
  heavy chain complementarity determining region 3 for antibody 35731
ARARDSYNLYFDY

SEQ ID NO: 71463 - protein, 9 aa, Homo sapiens
  light chain complementarity determining region 3 for antibody 35732
QQYKNYPLT

SEQ ID NO: 71464 - protein, 14 aa, Homo sapiens
  heavy chain complementarity determining region 3 for antibody 35732
AKAKDSSGYDLFDF

SEQ ID NO: 71465 - protein, 10 aa, Homo sapiens
  light chain complementarity determining region 3 for antibody 35733
QQYKNWPPWT

SEQ ID NO: 71466 - protein, 20 aa, Homo sapiens
  heavy chain complementarity determining region 3 for antibody 35733
ARGDMVRGALAFYRYYALDV

SEQ ID NO: 71467 - protein, 9 aa, Homo sapiens
  light chain complementarity determining region 3 for antibody 35734
QQYKHYPFT

SEQ ID NO: 71468 - protein, 14 aa, Homo sapiens
  heavy chain complementarity determining region 3 for antibody 35734
AKAKDSSGYDLFDF

SEQ ID NO: 71469 - protein, 11 aa, Homo sapiens
  light chain complementarity determining region 3 for antibody 35735
QQYKDWPPALP

SEQ ID NO: 71470 - protein, 12 aa, Homo sapiens
  heavy chain complementarity determining region 3 for antibody 35735
SSSSSGWTWLYY

SEQ ID NO: 71471 - protein, 10 aa, Homo sapiens
  light chain complementarity determining region 3 for antibody 35736
QQYKDLPPWA

SEQ ID NO: 71472 - protein, 16 aa, Homo sapiens
  heavy chain complementarity determining region 3 for antibody 35736
ASQADTSVYYPRVFDY

SEQ ID NO: 71473 - protein, 11 aa, Homo sapiens
  light chain complementarity determining region 3 for antibody 35737
QQYINSPPMSI

SEQ ID NO: 71474 - protein, 14 aa, Homo sapiens
  heavy chain complementarity determining region 3 for antibody 35737
AGHVVVTGTRGFDY

SEQ ID NO: 71475 - protein, 9 aa, Homo sapiens
  light chain complementarity determining region 3 for antibody 35738
QQYIIYPLP

SEQ ID NO: 71476 - protein, 14 aa, Homo sapiens
  heavy chain complementarity determining region 3 for antibody 35738
ARDLGFHTGGNFDY

SEQ ID NO: 71477 - protein, 9 aa, Homo sapiens
  light chain complementarity determining region 3 for antibody 35739
QQYIGWPRT

SEQ ID NO: 71478 - protein, 6 aa, Homo sapiens
  heavy chain complementarity determining region 3 for antibody 35739
GSGFEY

SEQ ID NO: 71479 - protein, 9 aa, Homo sapiens
  light chain complementarity determining region 3 for antibody 35740
QQYIGWPRK

SEQ ID NO: 71480 - protein, 6 aa, Homo sapiens
  heavy chain complementarity determining region 3 for antibody 35740
GSVFEY

SEQ ID NO: 71481 - protein, 9 aa, Homo sapiens
  light chain complementarity determining region 3 for antibody 35741
QQYHTPPNT

SEQ ID NO: 71482 - protein, 9 aa, Homo sapiens
  heavy chain complementarity determining region 3 for antibody 35741
ARDRDAADS

SEQ ID NO: 71483 - protein, 9 aa, Homo sapiens
  light chain complementarity determining region 3 for antibody 35742
QQYHSYSVT

SEQ ID NO: 71484 - protein, 17 aa, Homo sapiens
  heavy chain complementarity determining region 3 for antibody 35742
VKESWQWLVDYYYGMDV

SEQ ID NO: 71485 - protein, 9 aa, Homo sapiens
  light chain complementarity determining region 3 for antibody 35743
QQYHSNPRT

SEQ ID NO: 71486 - protein, 18 aa, Homo sapiens
  heavy chain complementarity determining region 3 for antibody 35743
AREFLRYFDSSKAYNFDD

SEQ ID NO: 71487 - protein, 9 aa, Homo sapiens
  light chain complementarity determining region 3 for antibody 35744
QQYHSHPRP

SEQ ID NO: 71488 - protein, 18 aa, Homo sapiens
  heavy chain complementarity determining region 3 for antibody 35744
AREFLRYFDSSKAYNFDD

SEQ ID NO: 71489 - protein, 9 aa, Homo sapiens
  light chain complementarity determining region 3 for antibody 35745
QQYHSDPPT

SEQ ID NO: 71490 - protein, 15 aa, Homo sapiens
  heavy chain complementarity determining region 3 for antibody 35745
ARDGYCSGGSCSFDY

SEQ ID NO: 71491 - protein, 9 aa, Homo sapiens
  light chain complementarity determining region 3 for antibody 35746
QQYHSDPLT

SEQ ID NO: 71492 - protein, 15 aa, Homo sapiens
  heavy chain complementarity determining region 3 for antibody 35746
ARDGYCSGGSCSFDY

SEQ ID NO: 71493 - protein, 10 aa, Homo sapiens
  light chain complementarity determining region 3 for antibody 35747
QQYHNRPPDT

SEQ ID NO: 71494 - protein, 14 aa, Homo sapiens
  heavy chain complementarity determining region 3 for antibody 35747
ARDPPCIALAGNSG

SEQ ID NO: 71495 - protein, 8 aa, Homo sapiens
  light chain complementarity determining region 3 for antibody 35748
QQYGVSPS

SEQ ID NO: 71496 - protein, 16 aa, Homo sapiens
  heavy chain complementarity determining region 3 for antibody 35748
ATDWGSGTQWIRAFDV

SEQ ID NO: 71497 - protein, 8 aa, Homo sapiens
  light chain complementarity determining region 3 for antibody 35749
QQYGTSYP

SEQ ID NO: 71498 - protein, 17 aa, Homo sapiens
  heavy chain complementarity determining region 3 for antibody 35749
ARHPGYYDSSGSDAFDI

SEQ ID NO: 71499 - protein, 8 aa, Homo sapiens
  light chain complementarity determining region 3 for antibody 35750
QQYGTSWT

SEQ ID NO: 71500 - protein, 21 aa, Homo sapiens
  heavy chain complementarity determining region 3 for antibody 35750
GRQRNFEGDSGFKFPEGHFDL

SEQ ID NO: 71501 - protein, 9 aa, Homo sapiens
  light chain complementarity determining region 3 for antibody 35751
QQYGTSTLN

SEQ ID NO: 71502 - protein, 13 aa, Homo sapiens
  heavy chain complementarity determining region 3 for antibody 35751
ASISVGTVAAGKG

SEQ ID NO: 71503 - protein, 9 aa, Homo sapiens
  light chain complementarity determining region 3 for antibody 35752
QQYGTSSLT

SEQ ID NO: 71504 - protein, 21 aa, Homo sapiens
  heavy chain complementarity determining region 3 for antibody 35752
ARMSAGSYYDSSGSYLYYFDN

SEQ ID NO: 71505 - protein, 8 aa, Homo sapiens
  light chain complementarity determining region 3 for antibody 35753
QQYGTSRT

SEQ ID NO: 71506 - protein, 13 aa, Homo sapiens
  heavy chain complementarity determining region 3 for antibody 35753
ARGQFLGGRYYEN

SEQ ID NO: 71507 - protein, 9 aa, Homo sapiens
  light chain complementarity determining region 3 for antibody 35754
QQYGTSPST

SEQ ID NO: 71508 - protein, 15 aa, Homo sapiens
  heavy chain complementarity determining region 3 for antibody 35754
ARQNDFLSGPGEFDP

SEQ ID NO: 71509 - protein, 9 aa, Homo sapiens
  light chain complementarity determining region 3 for antibody 35755
QQYGTSPRN

SEQ ID NO: 71510 - protein, 13 aa, Homo sapiens
  heavy chain complementarity determining region 3 for antibody 35755
ASISVGTVAAGKG

SEQ ID NO: 71511 - protein, 9 aa, Homo sapiens
  light chain complementarity determining region 3 for antibody 35756
QQYGTSPLT

SEQ ID NO: 71512 - protein, 13 aa, Homo sapiens
  heavy chain complementarity determining region 3 for antibody 35756
ASISVGTVAAGKG

SEQ ID NO: 71513 - protein, 9 aa, Homo sapiens
  light chain complementarity determining region 3 for antibody 35757
QQYGTSPLT

SEQ ID NO: 71514 - protein, 15 aa, Homo sapiens
  heavy chain complementarity determining region 3 for antibody 35757
ARQNDFLSGPGEFDP

SEQ ID NO: 71515 - protein, 9 aa, Homo sapiens
  light chain complementarity determining region 3 for antibody 35758
QQYGTSPLT

SEQ ID NO: 71516 - protein, 14 aa, Homo sapiens
  heavy chain complementarity determining region 3 for antibody 35758
ARDMVRGVPDYLDY

SEQ ID NO: 71517 - protein, 9 aa, Homo sapiens
  light chain complementarity determining region 3 for antibody 35759
QQYGTSPLT

SEQ ID NO: 71518 - protein, 14 aa, Homo sapiens
  heavy chain complementarity determining region 3 for antibody 35759
AGDMFRGVPDYLDY

SEQ ID NO: 71519 - protein, 9 aa, Homo sapiens
  light chain complementarity determining region 3 for antibody 35760
QQYGTSPLN

SEQ ID NO: 71520 - protein, 13 aa, Homo sapiens
  heavy chain complementarity determining region 3 for antibody 35760
ASMSVGTVAAGKG

SEQ ID NO: 71521 - protein, 9 aa, Homo sapiens
  light chain complementarity determining region 3 for antibody 35761
QQYGTSPLK

SEQ ID NO: 71522 - protein, 13 aa, Homo sapiens
  heavy chain complementarity determining region 3 for antibody 35761
ASISVGTVAAGKG

SEQ ID NO: 71523 - protein, 9 aa, Homo sapiens
  light chain complementarity determining region 3 for antibody 35762
QQYGTSPLH

SEQ ID NO: 71524 - protein, 13 aa, Homo sapiens
  heavy chain complementarity determining region 3 for antibody 35762
ASISVGTVAAGKG

SEQ ID NO: 71525 - protein, 9 aa, Homo sapiens
  light chain complementarity determining region 3 for antibody 35763
QQYGTSPIN

SEQ ID NO: 71526 - protein, 13 aa, Homo sapiens
  heavy chain complementarity determining region 3 for antibody 35763
ASISVGTVAAGKG

SEQ ID NO: 71527 - protein, 9 aa, Homo sapiens
  light chain complementarity determining region 3 for antibody 35764
QQYGTSPFT

SEQ ID NO: 71528 - protein, 14 aa, Homo sapiens
  heavy chain complementarity determining region 3 for antibody 35764
ARGGPAATSSSWCY

SEQ ID NO: 71529 - protein, 9 aa, Homo sapiens
  light chain complementarity determining region 3 for antibody 35765
QQYGTPPLT

SEQ ID NO: 71530 - protein, 14 aa, Homo sapiens
  heavy chain complementarity determining region 3 for antibody 35765
AHRSYNSGRGAFDI

SEQ ID NO: 71531 - protein, 9 aa, Homo sapiens
  light chain complementarity determining region 3 for antibody 35766
QQYGTLPGT

SEQ ID NO: 71532 - protein, 13 aa, Homo sapiens
  heavy chain complementarity determining region 3 for antibody 35766
VRDQAAYINWFDP

SEQ ID NO: 71533 - protein, 9 aa, Homo sapiens
  light chain complementarity determining region 3 for antibody 35767
QQYGTITRT

SEQ ID NO: 71534 - protein, 13 aa, Homo sapiens
  heavy chain complementarity determining region 3 for antibody 35767
AGGNFHRSGYAEY

SEQ ID NO: 71535 - protein, 9 aa, Homo sapiens
  light chain complementarity determining region 3 for antibody 35768
QQYGTIPRP

SEQ ID NO: 71536 - protein, 13 aa, Homo sapiens
  heavy chain complementarity determining region 3 for antibody 35768
AGGNFHRSGYAEY

SEQ ID NO: 71537 - protein, 9 aa, Homo sapiens
  light chain complementarity determining region 3 for antibody 35769
QQYGSYPTT

SEQ ID NO: 71538 - protein, 17 aa, Homo sapiens
  heavy chain complementarity determining region 3 for antibody 35769
ARDLGTYDATRHWYFDL

SEQ ID NO: 71539 - protein, 9 aa, Homo sapiens
  light chain complementarity determining region 3 for antibody 35770
QQYGSSTRT

SEQ ID NO: 71540 - protein, 17 aa, Homo sapiens
  heavy chain complementarity determining region 3 for antibody 35770
ARALDIVVVVDAIWFDP

SEQ ID NO: 71541 - protein, 9 aa, Homo sapiens
  light chain complementarity determining region 3 for antibody 35771
QQYGSSSYT

SEQ ID NO: 71542 - protein, 11 aa, Homo sapiens
  heavy chain complementarity determining region 3 for antibody 35771
ARGGFYGSFDY

SEQ ID NO: 71543 - protein, 9 aa, Homo sapiens
  light chain complementarity determining region 3 for antibody 35772
QQYGSSSWT

SEQ ID NO: 71544 - protein, 21 aa, Homo sapiens
  heavy chain complementarity determining region 3 for antibody 35772
ARDAPVSRPYSSGWYSSAFDY

SEQ ID NO: 71545 - protein, 10 aa, Homo sapiens
  light chain complementarity determining region 3 for antibody 35773
QQYGSSSMNT

SEQ ID NO: 71546 - protein, 19 aa, Homo sapiens
  heavy chain complementarity determining region 3 for antibody 35773
AKDQLMFYYDNSGYPGADY

SEQ ID NO: 71547 - protein, 9 aa, Homo sapiens
  light chain complementarity determining region 3 for antibody 35774
QQYGSSSIT

SEQ ID NO: 71548 - protein, 14 aa, Homo sapiens
  heavy chain complementarity determining region 3 for antibody 35774
ARGEMGTVSFYFDH

SEQ ID NO: 71549 - protein, 9 aa, Homo sapiens
  light chain complementarity determining region 3 for antibody 35775
QQYGSSPYT

SEQ ID NO: 71550 - protein, 15 aa, Homo sapiens
  heavy chain complementarity determining region 3 for antibody 35775
TRDGKKDGHNDAFDF

SEQ ID NO: 71551 - protein, 9 aa, Homo sapiens
  light chain complementarity determining region 3 for antibody 35776
QQYGSSPYT

SEQ ID NO: 71552 - protein, 14 aa, Homo sapiens
  heavy chain complementarity determining region 3 for antibody 35776
ARRSGYHYGSNLDY

SEQ ID NO: 71553 - protein, 9 aa, Homo sapiens
  light chain complementarity determining region 3 for antibody 35777
QQYGSSPYN

SEQ ID NO: 71554 - protein, 14 aa, Homo sapiens
  heavy chain complementarity determining region 3 for antibody 35777
ARHSGYHYGSNLDY

SEQ ID NO: 71555 - protein, 9 aa, Homo sapiens
  light chain complementarity determining region 3 for antibody 35778
QQYGSSPWT

SEQ ID NO: 71556 - protein, 14 aa, Homo sapiens
  heavy chain complementarity determining region 3 for antibody 35778
ARDSSSPSWGPIDY

SEQ ID NO: 71557 - protein, 10 aa, Homo sapiens
  light chain complementarity determining region 3 for antibody 35779
QQYGSSPTWR

SEQ ID NO: 71558 - protein, 15 aa, Homo sapiens
  heavy chain complementarity determining region 3 for antibody 35779
TRDLLDSGGAYFADH

SEQ ID NO: 71559 - protein, 9 aa, Homo sapiens
  light chain complementarity determining region 3 for antibody 35780
QQYGSSPTT

SEQ ID NO: 71560 - protein, 17 aa, Homo sapiens
  heavy chain complementarity determining region 3 for antibody 35780
ARDLGTYDATRHWYFDP

SEQ ID NO: 71561 - protein, 9 aa, Homo sapiens
  light chain complementarity determining region 3 for antibody 35781
QQYGSSPST

SEQ ID NO: 71562 - protein, 17 aa, Homo sapiens
  heavy chain complementarity determining region 3 for antibody 35781
ARDLGTYDATRHWYFDL

SEQ ID NO: 71563 - protein, 10 aa, Homo sapiens
  light chain complementarity determining region 3 for antibody 35782
QQYGSSPSLP

SEQ ID NO: 71564 - protein, 17 aa, Homo sapiens
  heavy chain complementarity determining region 3 for antibody 35782
ARVYYYGSGSYLSGPGY

SEQ ID NO: 71565 - protein, 8 aa, Homo sapiens
  light chain complementarity determining region 3 for antibody 35783
QQYGSSPS

SEQ ID NO: 71566 - protein, 16 aa, Homo sapiens
  heavy chain complementarity determining region 3 for antibody 35783
ATDWGSGTQWIRAFDV

SEQ ID NO: 71567 - protein, 9 aa, Homo sapiens
  light chain complementarity determining region 3 for antibody 35784
QQYGSSPRT

SEQ ID NO: 71568 - protein, 18 aa, Homo sapiens
  heavy chain complementarity determining region 3 for antibody 35784
ATAFWVGLGVPPPGFFDY

SEQ ID NO: 71569 - protein, 9 aa, Homo sapiens
  light chain complementarity determining region 3 for antibody 35785
QQYGSSPRT

SEQ ID NO: 71570 - protein, 25 aa, Homo sapiens
  heavy chain complementarity determining region 3 for antibody 35785
ARLRIVRLRLPGAMRGPLYDCGLNV

SEQ ID NO: 71571 - protein, 9 aa, Homo sapiens
  light chain complementarity determining region 3 for antibody 35786
QQYGSSPRT

SEQ ID NO: 71572 - protein, 25 aa, Homo sapiens
  heavy chain complementarity determining region 3 for antibody 35786
ARLRIDRLRLPGAMRGPLYGCGLNV

SEQ ID NO: 71573 - protein, 9 aa, Homo sapiens
  light chain complementarity determining region 3 for antibody 35787
QQYGSSPRT

SEQ ID NO: 71574 - protein, 25 aa, Homo sapiens
  heavy chain complementarity determining region 3 for antibody 35787
ARLRIDRLRLPGAMRGPLYDCCLNV

SEQ ID NO: 71575 - protein, 9 aa, Homo sapiens
  light chain complementarity determining region 3 for antibody 35788
QQYGSSPRT

SEQ ID NO: 71576 - protein, 25 aa, Homo sapiens
  heavy chain complementarity determining region 3 for antibody 35788
ARLRIDRLRLPGAMRGPLCDCGLNV

SEQ ID NO: 71577 - protein, 9 aa, Homo sapiens
  light chain complementarity determining region 3 for antibody 35789
QQYGSSPRT

SEQ ID NO: 71578 - protein, 15 aa, Homo sapiens
  heavy chain complementarity determining region 3 for antibody 35789
ARGPHPPYYGGFFHR

SEQ ID NO: 71579 - protein, 9 aa, Homo sapiens
  light chain complementarity determining region 3 for antibody 35790
QQYGSSPRT

SEQ ID NO: 71580 - protein, 17 aa, Homo sapiens
  heavy chain complementarity determining region 3 for antibody 35790
ARAWDIVVVVDAIWFDP

SEQ ID NO: 71581 - protein, 9 aa, Homo sapiens
  light chain complementarity determining region 3 for antibody 35791
QQYGSSPRT

SEQ ID NO: 71582 - protein, 17 aa, Homo sapiens
  heavy chain complementarity determining region 3 for antibody 35791
ARASDIVVVVDAIWFDP

SEQ ID NO: 71583 - protein, 9 aa, Homo sapiens
  light chain complementarity determining region 3 for antibody 35792
QQYGSSPRT

SEQ ID NO: 71584 - protein, 19 aa, Homo sapiens
  heavy chain complementarity determining region 3 for antibody 35792
AKEHSPLSLIAVEGFDFDY

SEQ ID NO: 71585 - protein, 9 aa, Homo sapiens
  light chain complementarity determining region 3 for antibody 35793
QQYGSSPRP

SEQ ID NO: 71586 - protein, 19 aa, Homo sapiens
  heavy chain complementarity determining region 3 for antibody 35793
ARDLSGRGDGYSNGWYPHI

SEQ ID NO: 71587 - protein, 9 aa, Homo sapiens
  light chain complementarity determining region 3 for antibody 35794
QQYGSSPRM

SEQ ID NO: 71588 - protein, 25 aa, Homo sapiens
  heavy chain complementarity determining region 3 for antibody 35794
ARLRIDRLRLPGAMRGPLYDCGLNV

SEQ ID NO: 71589 - protein, 9 aa, Homo sapiens
  light chain complementarity determining region 3 for antibody 35795
QQYGSSPQT

SEQ ID NO: 71590 - protein, 13 aa, Homo sapiens
  heavy chain complementarity determining region 3 for antibody 35795
AGGNFHSGGYGEY

SEQ ID NO: 71591 - protein, 10 aa, Homo sapiens
  light chain complementarity determining region 3 for antibody 35796
QQYGSSPPWT

SEQ ID NO: 71592 - protein, 18 aa, Homo sapiens
  heavy chain complementarity determining region 3 for antibody 35796
AREYYDFWNPPPRAWFDP

SEQ ID NO: 71593 - protein, 10 aa, Homo sapiens
  light chain complementarity determining region 3 for antibody 35797
QQYGSSPPWR

SEQ ID NO: 71594 - protein, 13 aa, Homo sapiens
  heavy chain complementarity determining region 3 for antibody 35797
ARSGGSYYYAFDI

SEQ ID NO: 71595 - protein, 8 aa, Homo sapiens
  light chain complementarity determining region 3 for antibody 35798
QQYGSSPP

SEQ ID NO: 71596 - protein, 11 aa, Homo sapiens
  heavy chain complementarity determining region 3 for antibody 35798
VRNGVRGANDY

SEQ ID NO: 71597 - protein, 9 aa, Homo sapiens
  light chain complementarity determining region 3 for antibody 35799
QQYGSSPPT

SEQ ID NO: 71598 - protein, 19 aa, Homo sapiens
  heavy chain complementarity determining region 3 for antibody 35799
ARGSNSSRRRAAVVGDFDL

SEQ ID NO: 71599 - protein, 9 aa, Homo sapiens
  light chain complementarity determining region 3 for antibody 35800
QQYGSSPPS

SEQ ID NO: 71600 - protein, 19 aa, Homo sapiens
  heavy chain complementarity determining region 3 for antibody 35800
ARAGGNYYDRTSYYGPFDY

SEQ ID NO: 71601 - protein, 10 aa, Homo sapiens
  light chain complementarity determining region 3 for antibody 35801
QQYGSSPPRT

SEQ ID NO: 71602 - protein, 18 aa, Homo sapiens
  heavy chain complementarity determining region 3 for antibody 35801
ARGGYDYGWGSYGVYFDY

SEQ ID NO: 71603 - protein, 10 aa, Homo sapiens
  light chain complementarity determining region 3 for antibody 35802
QQYGSSPPPT

SEQ ID NO: 71604 - protein, 20 aa, Homo sapiens
  heavy chain complementarity determining region 3 for antibody 35802
ARESVIMFGGVIVIRGAFDI

SEQ ID NO: 71605 - protein, 10 aa, Homo sapiens
  light chain complementarity determining region 3 for antibody 35803
QQYGSSPPPT

SEQ ID NO: 71606 - protein, 19 aa, Homo sapiens
  heavy chain complementarity determining region 3 for antibody 35803
AREPVFGVVTTYYYYGMDV

SEQ ID NO: 71607 - protein, 9 aa, Homo sapiens
  light chain complementarity determining region 3 for antibody 35804
QQYGSSPPP

SEQ ID NO: 71608 - protein, 11 aa, Homo sapiens
  heavy chain complementarity determining region 3 for antibody 35804
ARTPLWFGPYF

SEQ ID NO: 71609 - protein, 10 aa, Homo sapiens
  light chain complementarity determining region 3 for antibody 35805
QQYGSSPPLT

SEQ ID NO: 71610 - protein, 17 aa, Homo sapiens
  heavy chain complementarity determining region 3 for antibody 35805
ARGPCSTACARAVDFDY

SEQ ID NO: 71611 - protein, 10 aa, Homo sapiens
  light chain complementarity determining region 3 for antibody 35806
QQYGSSPPLP

SEQ ID NO: 71612 - protein, 17 aa, Homo sapiens
  heavy chain complementarity determining region 3 for antibody 35806
ARGPCSTTCARAVDFDY

SEQ ID NO: 71613 - protein, 11 aa, Homo sapiens
  light chain complementarity determining region 3 for antibody 35807
QQYGSSPPKYT

SEQ ID NO: 71614 - protein, 19 aa, Homo sapiens
  heavy chain complementarity determining region 3 for antibody 35807
ARGPYITFGGVIGPWVIDH

SEQ ID NO: 71615 - protein, 10 aa, Homo sapiens
  light chain complementarity determining region 3 for antibody 35808
QQYGSSPPGT

SEQ ID NO: 71616 - protein, 17 aa, Homo sapiens
  heavy chain complementarity determining region 3 for antibody 35808
ARDPLRSGWFYNDAFDI

SEQ ID NO: 71617 - protein, 10 aa, Homo sapiens
  light chain complementarity determining region 3 for antibody 35809
QQYGSSPPFP

SEQ ID NO: 71618 - protein, 12 aa, Homo sapiens
  heavy chain complementarity determining region 3 for antibody 35809
ARERGRGFGLDI

SEQ ID NO: 71619 - protein, 10 aa, Homo sapiens
  light chain complementarity determining region 3 for antibody 35810
QQYGSSPPDT

SEQ ID NO: 71620 - protein, 12 aa, Homo sapiens
  heavy chain complementarity determining region 3 for antibody 35810
ARVSYGYNSLGY

SEQ ID NO: 71621 - protein, 10 aa, Homo sapiens
  light chain complementarity determining region 3 for antibody 35811
QQYGSSPMYI

SEQ ID NO: 71622 - protein, 11 aa, Homo sapiens
  heavy chain complementarity determining region 3 for antibody 35811
ARGGQWGSLDY

SEQ ID NO: 71623 - protein, 10 aa, Homo sapiens
  light chain complementarity determining region 3 for antibody 35812
QQYGSSPLYS

SEQ ID NO: 71624 - protein, 14 aa, Homo sapiens
  heavy chain complementarity determining region 3 for antibody 35812
ARGAGADYQPPLTD

SEQ ID NO: 71625 - protein, 9 aa, Homo sapiens
  light chain complementarity determining region 3 for antibody 35813
QQYGSSPLT

SEQ ID NO: 71626 - protein, 17 aa, Homo sapiens
  heavy chain complementarity determining region 3 for antibody 35813
VRGIDYYGSGGHHWFDP

SEQ ID NO: 71627 - protein, 9 aa, Homo sapiens
  light chain complementarity determining region 3 for antibody 35814
QQYGSSPLT

SEQ ID NO: 71628 - protein, 12 aa, Homo sapiens
  heavy chain complementarity determining region 3 for antibody 35814
ARPPYSGIDFDS

SEQ ID NO: 71629 - protein, 9 aa, Homo sapiens
  light chain complementarity determining region 3 for antibody 35815
QQYGSSPLT

SEQ ID NO: 71630 - protein, 25 aa, Homo sapiens
  heavy chain complementarity determining region 3 for antibody 35815
ARLRIDRLRLPGAMRGPLYDCGLNV

SEQ ID NO: 71631 - protein, 9 aa, Homo sapiens
  light chain complementarity determining region 3 for antibody 35816
QQYGSSPLT

SEQ ID NO: 71632 - protein, 14 aa, Homo sapiens
  heavy chain complementarity determining region 3 for antibody 35816
ARGLRGLKDWYFDL

SEQ ID NO: 71633 - protein, 10 aa, Homo sapiens
  light chain complementarity determining region 3 for antibody 35817
QQYGSSPLFP

SEQ ID NO: 71634 - protein, 19 aa, Homo sapiens
  heavy chain complementarity determining region 3 for antibody 35817
ARGFREVVSATDAYNWFDP

SEQ ID NO: 71635 - protein, 8 aa, Homo sapiens
  light chain complementarity determining region 3 for antibody 35818
QQYGSSPL

SEQ ID NO: 71636 - protein, 10 aa, Homo sapiens
  heavy chain complementarity determining region 3 for antibody 35818
ARGSYNSVWA

SEQ ID NO: 71637 - protein, 10 aa, Homo sapiens
  light chain complementarity determining region 3 for antibody 35819
QQYGSSPIFP

SEQ ID NO: 71638 - protein, 19 aa, Homo sapiens
  heavy chain complementarity determining region 3 for antibody 35819
ARDLVGVFGDEIDSSPFDH

SEQ ID NO: 71639 - protein, 9 aa, Homo sapiens
  light chain complementarity determining region 3 for antibody 35820
QQYGSSPHP

SEQ ID NO: 71640 - protein, 14 aa, Homo sapiens
  heavy chain complementarity determining region 3 for antibody 35820
ARDRRLGGYRLLDH

SEQ ID NO: 71641 - protein, 9 aa, Homo sapiens
  light chain complementarity determining region 3 for antibody 35821
QQYGSSPGT

SEQ ID NO: 71642 - protein, 25 aa, Homo sapiens
  heavy chain complementarity determining region 3 for antibody 35821
ARLRIDRLRLPGAMRGPLYDCGLNV

SEQ ID NO: 71643 - protein, 9 aa, Homo sapiens
  light chain complementarity determining region 3 for antibody 35822
QQYGSSPGT

SEQ ID NO: 71644 - protein, 14 aa, Homo sapiens
  heavy chain complementarity determining region 3 for antibody 35822
ARGGQSYPNGYFDL

SEQ ID NO: 71645 - protein, 9 aa, Homo sapiens
  light chain complementarity determining region 3 for antibody 35823
QQYGSSPGT

SEQ ID NO: 71646 - protein, 14 aa, Homo sapiens
  heavy chain complementarity determining region 3 for antibody 35823
ARDSSSTSWGPIDY

SEQ ID NO: 71647 - protein, 9 aa, Homo sapiens
  light chain complementarity determining region 3 for antibody 35824
QQYGSSPGA

SEQ ID NO: 71648 - protein, 14 aa, Homo sapiens
  heavy chain complementarity determining region 3 for antibody 35824
VRDRYDGGNSPFDY

SEQ ID NO: 71649 - protein, 9 aa, Homo sapiens
  light chain complementarity determining region 3 for antibody 35825
QQYGSSPDT

SEQ ID NO: 71650 - protein, 21 aa, Homo sapiens
  heavy chain complementarity determining region 3 for antibody 35825
ARQGSRYHCSGGSCYLGLTDY

SEQ ID NO: 71651 - protein, 9 aa, Homo sapiens
  light chain complementarity determining region 3 for antibody 35826
QQYGSSPAT

SEQ ID NO: 71652 - protein, 12 aa, Homo sapiens
  heavy chain complementarity determining region 3 for antibody 35826
ARGYGWCSCPEY

SEQ ID NO: 71653 - protein, 9 aa, Homo sapiens
  light chain complementarity determining region 3 for antibody 35827
QQYGSSLYT

SEQ ID NO: 71654 - protein, 16 aa, Homo sapiens
  heavy chain complementarity determining region 3 for antibody 35827
ARAKHYGDYYYCGMDA

SEQ ID NO: 71655 - protein, 9 aa, Homo sapiens
  light chain complementarity determining region 3 for antibody 35828
QQYGSSLRT

SEQ ID NO: 71656 - protein, 17 aa, Homo sapiens
  heavy chain complementarity determining region 3 for antibody 35828
ARDGWYDSSMWFDGFDI

SEQ ID NO: 71657 - protein, 9 aa, Homo sapiens
  light chain complementarity determining region 3 for antibody 35829
QQYGSSHRT

SEQ ID NO: 71658 - protein, 25 aa, Homo sapiens
  heavy chain complementarity determining region 3 for antibody 35829
ARLRIDRLRLPGAMRGPLYDCGLNV

SEQ ID NO: 71659 - protein, 10 aa, Homo sapiens
  light chain complementarity determining region 3 for antibody 35830
QQYGSSHMYS

SEQ ID NO: 71660 - protein, 11 aa, Homo sapiens
  heavy chain complementarity determining region 3 for antibody 35830
ARGGQWGSLDY

SEQ ID NO: 71661 - protein, 9 aa, Homo sapiens
  light chain complementarity determining region 3 for antibody 35831
QQYGSPPRT

SEQ ID NO: 71662 - protein, 25 aa, Homo sapiens
  heavy chain complementarity determining region 3 for antibody 35831
ARLRIDRLRLPGAMRGPLYDCGLNV

SEQ ID NO: 71663 - protein, 9 aa, Homo sapiens
  light chain complementarity determining region 3 for antibody 35832
QQYGSPPRR

SEQ ID NO: 71664 - protein, 14 aa, Homo sapiens
  heavy chain complementarity determining region 3 for antibody 35832
AGGNFCGYDCYSEY

SEQ ID NO: 71665 - protein, 10 aa, Homo sapiens
  light chain complementarity determining region 3 for antibody 35833
QQYGSPPMYS

SEQ ID NO: 71666 - protein, 11 aa, Homo sapiens
  heavy chain complementarity determining region 3 for antibody 35833
ARGGQWGSLDY

SEQ ID NO: 71667 - protein, 9 aa, Homo sapiens
  light chain complementarity determining region 3 for antibody 35834
QQYGSPLWT

SEQ ID NO: 71668 - protein, 17 aa, Homo sapiens
  heavy chain complementarity determining region 3 for antibody 35834
ARDGWYDSSMWFDGFDI

SEQ ID NO: 71669 - protein, 9 aa, Homo sapiens
  light chain complementarity determining region 3 for antibody 35835
QQYGSLPLT

SEQ ID NO: 71670 - protein, 15 aa, Homo sapiens
  heavy chain complementarity determining region 3 for antibody 35835
ANRPNYYDKAGAFDI

SEQ ID NO: 71671 - protein, 9 aa, Homo sapiens
  light chain complementarity determining region 3 for antibody 35836
QQYGSLPLT

SEQ ID NO: 71672 - protein, 15 aa, Homo sapiens
  heavy chain complementarity determining region 3 for antibody 35836
AHRPNYYDKAGAFDL

SEQ ID NO: 71673 - protein, 9 aa, Homo sapiens
  light chain complementarity determining region 3 for antibody 35837
QQYGSLPLT

SEQ ID NO: 71674 - protein, 15 aa, Homo sapiens
  heavy chain complementarity determining region 3 for antibody 35837
AHRPKYYDKAGAFDI

SEQ ID NO: 71675 - protein, 10 aa, Homo sapiens
  light chain complementarity determining region 3 for antibody 35838
QQYGSLPAWR

SEQ ID NO: 71676 - protein, 19 aa, Homo sapiens
  heavy chain complementarity determining region 3 for antibody 35838
ARGDGVRSGEFYYYQGLDV

SEQ ID NO: 71677 - protein, 9 aa, Homo sapiens
  light chain complementarity determining region 3 for antibody 35839
QQYGSIPRT

SEQ ID NO: 71678 - protein, 13 aa, Homo sapiens
  heavy chain complementarity determining region 3 for antibody 35839
AGGIFDSSGYGDY

SEQ ID NO: 71679 - protein, 9 aa, Homo sapiens
  light chain complementarity determining region 3 for antibody 35840
QQYGSIPRS

SEQ ID NO: 71680 - protein, 13 aa, Homo sapiens
  heavy chain complementarity determining region 3 for antibody 35840
AGGTWHSGSYYDS

SEQ ID NO: 71681 - protein, 9 aa, Homo sapiens
  light chain complementarity determining region 3 for antibody 35841
QQYGSIPRS

SEQ ID NO: 71682 - protein, 13 aa, Homo sapiens
  heavy chain complementarity determining region 3 for antibody 35841
AGGTWHSGIYYDS

SEQ ID NO: 71683 - protein, 9 aa, Homo sapiens
  light chain complementarity determining region 3 for antibody 35842
QQYGSIPRS

SEQ ID NO: 71684 - protein, 13 aa, Homo sapiens
  heavy chain complementarity determining region 3 for antibody 35842
AGGAWHSGIYYES

SEQ ID NO: 71685 - protein, 9 aa, Homo sapiens
  light chain complementarity determining region 3 for antibody 35843
QQYGSFPRS

SEQ ID NO: 71686 - protein, 13 aa, Homo sapiens
  heavy chain complementarity determining region 3 for antibody 35843
AGGTWHSGIYYES

SEQ ID NO: 71687 - protein, 9 aa, Homo sapiens
  light chain complementarity determining region 3 for antibody 35844
QQYGSFPLT

SEQ ID NO: 71688 - protein, 15 aa, Homo sapiens
  heavy chain complementarity determining region 3 for antibody 35844
AHRPNYYDKAGAFDI

SEQ ID NO: 71689 - protein, 9 aa, Homo sapiens
  light chain complementarity determining region 3 for antibody 35845
QQYGRTPRT

SEQ ID NO: 71690 - protein, 14 aa, Homo sapiens
  heavy chain complementarity determining region 3 for antibody 35845
AGGDVCGADCYSEY

SEQ ID NO: 71691 - protein, 9 aa, Homo sapiens
  light chain complementarity determining region 3 for antibody 35846
QQYGRTPRT

SEQ ID NO: 71692 - protein, 14 aa, Homo sapiens
  heavy chain complementarity determining region 3 for antibody 35846
AGGDLCGADCYSEY

SEQ ID NO: 71693 - protein, 9 aa, Homo sapiens
  light chain complementarity determining region 3 for antibody 35847
QQYGRTPRP

SEQ ID NO: 71694 - protein, 14 aa, Homo sapiens
  heavy chain complementarity determining region 3 for antibody 35847
AGGDFCGADCYSEY

SEQ ID NO: 71695 - protein, 9 aa, Homo sapiens
  light chain complementarity determining region 3 for antibody 35848
QQYGRTPLT

SEQ ID NO: 71696 - protein, 14 aa, Homo sapiens
  heavy chain complementarity determining region 3 for antibody 35848
AGGDFCGADCYSEY

SEQ ID NO: 71697 - protein, 9 aa, Homo sapiens
  light chain complementarity determining region 3 for antibody 35849
QQYGRSPRT

SEQ ID NO: 71698 - protein, 14 aa, Homo sapiens
  heavy chain complementarity determining region 3 for antibody 35849
AGGDFCGADCYSEY

SEQ ID NO: 71699 - protein, 9 aa, Homo sapiens
  light chain complementarity determining region 3 for antibody 35850
QQYGRSPRP

SEQ ID NO: 71700 - protein, 15 aa, Homo sapiens
  heavy chain complementarity determining region 3 for antibody 35850
AKDGPYCGGDCYFDS

SEQ ID NO: 71701 - protein, 10 aa, Homo sapiens
  light chain complementarity determining region 3 for antibody 35851
QQYGRSPPWT

SEQ ID NO: 71702 - protein, 14 aa, Homo sapiens
  heavy chain complementarity determining region 3 for antibody 35851
ARGGSSGYTHQFDY

SEQ ID NO: 71703 - protein, 11 aa, Homo sapiens
  light chain complementarity determining region 3 for antibody 35852
QQYGRSPPMYS

SEQ ID NO: 71704 - protein, 13 aa, Homo sapiens
  heavy chain complementarity determining region 3 for antibody 35852
AREGSTVTTHFDS

SEQ ID NO: 71705 - protein, 10 aa, Homo sapiens
  light chain complementarity determining region 3 for antibody 35853
QQYGRSPMYS

SEQ ID NO: 71706 - protein, 11 aa, Homo sapiens
  heavy chain complementarity determining region 3 for antibody 35853
ARGGQWGSLDY

SEQ ID NO: 71707 - protein, 9 aa, Homo sapiens
  light chain complementarity determining region 3 for antibody 35854
QQYGRSPLP

SEQ ID NO: 71708 - protein, 14 aa, Homo sapiens
  heavy chain complementarity determining region 3 for antibody 35854
AKDRRVAGDWYFDL

SEQ ID NO: 71709 - protein, 8 aa, Homo sapiens
  light chain complementarity determining region 3 for antibody 35855
QQYGRSPK

SEQ ID NO: 71710 - protein, 21 aa, Homo sapiens
  heavy chain complementarity determining region 3 for antibody 35855
ARERERYFDWSHRDYYYALDV

SEQ ID NO: 71711 - protein, 9 aa, Homo sapiens
  light chain complementarity determining region 3 for antibody 35856
QQYGRSFYS

SEQ ID NO: 71712 - protein, 14 aa, Homo sapiens
  heavy chain complementarity determining region 3 for antibody 35856
ARVGTYSYGEMFDY

SEQ ID NO: 71713 - protein, 9 aa, Homo sapiens
  light chain complementarity determining region 3 for antibody 35857
QQYGRQPRT

SEQ ID NO: 71714 - protein, 14 aa, Homo sapiens
  heavy chain complementarity determining region 3 for antibody 35857
AGGDFCGADCYSEY

SEQ ID NO: 71715 - protein, 9 aa, Homo sapiens
  light chain complementarity determining region 3 for antibody 35858
QQYGRPSLT

SEQ ID NO: 71716 - protein, 19 aa, Homo sapiens
  heavy chain complementarity determining region 3 for antibody 35858
ARDRIVVGATFYSYSGMDV

SEQ ID NO: 71717 - protein, 10 aa, Homo sapiens
  light chain complementarity determining region 3 for antibody 35859
QQYGRPPWGA

SEQ ID NO: 71718 - protein, 17 aa, Homo sapiens
  heavy chain complementarity determining region 3 for antibody 35859
AKDYGTVTKDLVGYLDY

SEQ ID NO: 71719 - protein, 9 aa, Homo sapiens
  light chain complementarity determining region 3 for antibody 35860
QQYGRPPRT

SEQ ID NO: 71720 - protein, 14 aa, Homo sapiens
  heavy chain complementarity determining region 3 for antibody 35860
AGGNFCGYDCYSEY

SEQ ID NO: 71721 - protein, 9 aa, Homo sapiens
  light chain complementarity determining region 3 for antibody 35861
QQYGRLPRT

SEQ ID NO: 71722 - protein, 15 aa, Homo sapiens
  heavy chain complementarity determining region 3 for antibody 35861
AKDGPYCGGDCYFDS

SEQ ID NO: 71723 - protein, 9 aa, Homo sapiens
  light chain complementarity determining region 3 for antibody 35862
QQYGRLPRT

SEQ ID NO: 71724 - protein, 13 aa, Homo sapiens
  heavy chain complementarity determining region 3 for antibody 35862
AGGLYDSSGYSEF

SEQ ID NO: 71725 - protein, 9 aa, Homo sapiens
  light chain complementarity determining region 3 for antibody 35863
QQYGRLPPT

SEQ ID NO: 71726 - protein, 13 aa, Homo sapiens
  heavy chain complementarity determining region 3 for antibody 35863
ARRLVIGRNAFDI

SEQ ID NO: 71727 - protein, 9 aa, Homo sapiens
  light chain complementarity determining region 3 for antibody 35864
QQYGRIPRT

SEQ ID NO: 71728 - protein, 13 aa, Homo sapiens
  heavy chain complementarity determining region 3 for antibody 35864
AGGLYDSSGYSDF

SEQ ID NO: 71729 - protein, 10 aa, Homo sapiens
  light chain complementarity determining region 3 for antibody 35865
QQYGNSPSFT

SEQ ID NO: 71730 - protein, 13 aa, Homo sapiens
  heavy chain complementarity determining region 3 for antibody 35865
ASWSHSDLDAFDI

SEQ ID NO: 71731 - protein, 9 aa, Homo sapiens
  light chain complementarity determining region 3 for antibody 35866
QQYGNSPRT

SEQ ID NO: 71732 - protein, 16 aa, Homo sapiens
  heavy chain complementarity determining region 3 for antibody 35866
ARGTFYQGSSDNYPEN

SEQ ID NO: 71733 - protein, 10 aa, Homo sapiens
  light chain complementarity determining region 3 for antibody 35867
QQYGNSPPCT

SEQ ID NO: 71734 - protein, 13 aa, Homo sapiens
  heavy chain complementarity determining region 3 for antibody 35867
ASWSHSDLDAFDI

SEQ ID NO: 71735 - protein, 9 aa, Homo sapiens
  light chain complementarity determining region 3 for antibody 35868
QQYGNSPFT

SEQ ID NO: 71736 - protein, 15 aa, Homo sapiens
  heavy chain complementarity determining region 3 for antibody 35868
ARQKGQRAAAGYFDS

SEQ ID NO: 71737 - protein, 9 aa, Homo sapiens
  light chain complementarity determining region 3 for antibody 35869
QQYGNSPFT

SEQ ID NO: 71738 - protein, 15 aa, Homo sapiens
  heavy chain complementarity determining region 3 for antibody 35869
AGQKGQRASAGYFDS

SEQ ID NO: 71739 - protein, 9 aa, Homo sapiens
  light chain complementarity determining region 3 for antibody 35870
QQYGNIPRT

SEQ ID NO: 71740 - protein, 12 aa, Homo sapiens
  heavy chain complementarity determining region 3 for antibody 35870
ATKYTGQNPFNI

SEQ ID NO: 71741 - protein, 10 aa, Homo sapiens
  light chain complementarity determining region 3 for antibody 35871
QQYGISPKWR

SEQ ID NO: 71742 - protein, 17 aa, Homo sapiens
  heavy chain complementarity determining region 3 for antibody 35871
ARDPCKKATDVVCAWDS

SEQ ID NO: 71743 - protein, 9 aa, Homo sapiens
  light chain complementarity determining region 3 for antibody 35872
QQYGHLPRT

SEQ ID NO: 71744 - protein, 15 aa, Homo sapiens
  heavy chain complementarity determining region 3 for antibody 35872
ARGEFYVSGSYYRED

SEQ ID NO: 71745 - protein, 9 aa, Homo sapiens
  light chain complementarity determining region 3 for antibody 35873
QQYGHLPRT

SEQ ID NO: 71746 - protein, 13 aa, Homo sapiens
  heavy chain complementarity determining region 3 for antibody 35873
AGGQFHSSGYSEF

SEQ ID NO: 71747 - protein, 9 aa, Homo sapiens
  light chain complementarity determining region 3 for antibody 35874
QQYGHLPRT

SEQ ID NO: 71748 - protein, 13 aa, Homo sapiens
  heavy chain complementarity determining region 3 for antibody 35874
AGGNFHSGGYGEY

SEQ ID NO: 71749 - protein, 9 aa, Homo sapiens
  light chain complementarity determining region 3 for antibody 35875
QQYGHIPRP

SEQ ID NO: 71750 - protein, 15 aa, Homo sapiens
  heavy chain complementarity determining region 3 for antibody 35875
ARGEFYVSGSYYRED

SEQ ID NO: 71751 - protein, 9 aa, Homo sapiens
  light chain complementarity determining region 3 for antibody 35876
QQYGHFPRT

SEQ ID NO: 71752 - protein, 15 aa, Homo sapiens
  heavy chain complementarity determining region 3 for antibody 35876
ARGEFYVSGSYYRED

SEQ ID NO: 71753 - protein, 10 aa, Homo sapiens
  light chain complementarity determining region 3 for antibody 35877
QQYGGTPPFG

SEQ ID NO: 71754 - protein, 12 aa, Homo sapiens
  heavy chain complementarity determining region 3 for antibody 35877
ARETGGSYYMDA

SEQ ID NO: 71755 - protein, 9 aa, Homo sapiens
  light chain complementarity determining region 3 for antibody 35878
QQYGGSQGP

SEQ ID NO: 71756 - protein, 13 aa, Homo sapiens
  heavy chain complementarity determining region 3 for antibody 35878
TKEIPEAGHPGGS

SEQ ID NO: 71757 - protein, 9 aa, Homo sapiens
  light chain complementarity determining region 3 for antibody 35879
QQYGGSPYT

SEQ ID NO: 71758 - protein, 22 aa, Homo sapiens
  heavy chain complementarity determining region 3 for antibody 35879
ARNTIQWSGAFSRKKKSYGLDV

SEQ ID NO: 71759 - protein, 8 aa, Homo sapiens
  light chain complementarity determining region 3 for antibody 35880
QQYGGSPS

SEQ ID NO: 71760 - protein, 16 aa, Homo sapiens
  heavy chain complementarity determining region 3 for antibody 35880
ATDWGSGTQWIRAFDI

SEQ ID NO: 71761 - protein, 8 aa, Homo sapiens
  light chain complementarity determining region 3 for antibody 35881
QQYGGSPS

SEQ ID NO: 71762 - protein, 16 aa, Homo sapiens
  heavy chain complementarity determining region 3 for antibody 35881
ATAWGSGTQWIRAFDV

SEQ ID NO: 71763 - protein, 8 aa, Homo sapiens
  light chain complementarity determining region 3 for antibody 35882
QQYGGSPS

SEQ ID NO: 71764 - protein, 16 aa, Homo sapiens
  heavy chain complementarity determining region 3 for antibody 35882
AADWGSGAQWIRAFDV

SEQ ID NO: 71765 - protein, 8 aa, Homo sapiens
  light chain complementarity determining region 3 for antibody 35883
QQYGGSPR

SEQ ID NO: 71766 - protein, 16 aa, Homo sapiens
  heavy chain complementarity determining region 3 for antibody 35883
ATGWGSGTQWIRAFDV

SEQ ID NO: 71767 - protein, 8 aa, Homo sapiens
  light chain complementarity determining region 3 for antibody 35884
QQYGGSPR

SEQ ID NO: 71768 - protein, 16 aa, Homo sapiens
  heavy chain complementarity determining region 3 for antibody 35884
AADWGSGTQWIRAFDV

SEQ ID NO: 71769 - protein, 11 aa, Homo sapiens
  light chain complementarity determining region 3 for antibody 35885
QQYGGSPPGIT

SEQ ID NO: 71770 - protein, 13 aa, Homo sapiens
  heavy chain complementarity determining region 3 for antibody 35885
AKYRGGYIYAIES

SEQ ID NO: 71771 - protein, 10 aa, Homo sapiens
  light chain complementarity determining region 3 for antibody 35886
QQYGGSPPFT

SEQ ID NO: 71772 - protein, 13 aa, Homo sapiens
  heavy chain complementarity determining region 3 for antibody 35886
ARVAVAGRGYFQH

SEQ ID NO: 71773 - protein, 9 aa, Homo sapiens
  light chain complementarity determining region 3 for antibody 35887
QQYGGSPNP

SEQ ID NO: 71774 - protein, 14 aa, Homo sapiens
  heavy chain complementarity determining region 3 for antibody 35887
ARATFMIVDYAFDI

SEQ ID NO: 71775 - protein, 9 aa, Homo sapiens
  light chain complementarity determining region 3 for antibody 35888
QQYGGSPGT

SEQ ID NO: 71776 - protein, 8 aa, Homo sapiens
  heavy chain complementarity determining region 3 for antibody 35888
ARGLSLDS

SEQ ID NO: 71777 - protein, 8 aa, Homo sapiens
  light chain complementarity determining region 3 for antibody 35889
QQYGGSLS

SEQ ID NO: 71778 - protein, 16 aa, Homo sapiens
  heavy chain complementarity determining region 3 for antibody 35889
ATDWGSGTQWIRAFDV

SEQ ID NO: 71779 - protein, 9 aa, Homo sapiens
  light chain complementarity determining region 3 for antibody 35890
QQYGGPSRT

SEQ ID NO: 71780 - protein, 11 aa, Homo sapiens
  heavy chain complementarity determining region 3 for antibody 35890
ARGRWAGAFDI

SEQ ID NO: 71781 - protein, 9 aa, Homo sapiens
  light chain complementarity determining region 3 for antibody 35891
QQYGGPPRT

SEQ ID NO: 71782 - protein, 13 aa, Homo sapiens
  heavy chain complementarity determining region 3 for antibody 35891
ASGYFDRSGYYEF

SEQ ID NO: 71783 - protein, 8 aa, Homo sapiens
  light chain complementarity determining region 3 for antibody 35892
QQYGGPPR

SEQ ID NO: 71784 - protein, 16 aa, Homo sapiens
  heavy chain complementarity determining region 3 for antibody 35892
ATDWGSGTQWIRAFDV

SEQ ID NO: 71785 - protein, 10 aa, Homo sapiens
  light chain complementarity determining region 3 for antibody 35893
QQYGESPLYP

SEQ ID NO: 71786 - protein, 12 aa, Homo sapiens
  heavy chain complementarity determining region 3 for antibody 35893
ARHKRGTNAFDI

SEQ ID NO: 71787 - protein, 9 aa, Homo sapiens
  light chain complementarity determining region 3 for antibody 35894
QQYGDSPWT

SEQ ID NO: 71788 - protein, 17 aa, Homo sapiens
  heavy chain complementarity determining region 3 for antibody 35894
ARDSMTGRRGRGRFFGY

SEQ ID NO: 71789 - protein, 10 aa, Homo sapiens
  light chain complementarity determining region 3 for antibody 35895
QQYGDSPLYT

SEQ ID NO: 71790 - protein, 12 aa, Homo sapiens
  heavy chain complementarity determining region 3 for antibody 35895
ARHKRGTNAFDI

SEQ ID NO: 71791 - protein, 8 aa, Homo sapiens
  light chain complementarity determining region 3 for antibody 35896
QQYGCSPR

SEQ ID NO: 71792 - protein, 16 aa, Homo sapiens
  heavy chain complementarity determining region 3 for antibody 35896
ATDWGSGTQWIRAFDV

SEQ ID NO: 71793 - protein, 9 aa, Homo sapiens
  light chain complementarity determining region 3 for antibody 35897
QQYFSTPQT

SEQ ID NO: 71794 - protein, 18 aa, Homo sapiens
  heavy chain complementarity determining region 3 for antibody 35897
ARERFGDYPGGSDTVSDF

SEQ ID NO: 71795 - protein, 9 aa, Homo sapiens
  light chain complementarity determining region 3 for antibody 35898
QQYFSHVYT

SEQ ID NO: 71796 - protein, 18 aa, Homo sapiens
  heavy chain complementarity determining region 3 for antibody 35898
VQERDGYCDSHACYGLDV

SEQ ID NO: 71797 - protein, 9 aa, Homo sapiens
  light chain complementarity determining region 3 for antibody 35899
QQYFSHVYT

SEQ ID NO: 71798 - protein, 18 aa, Homo sapiens
  heavy chain complementarity determining region 3 for antibody 35899
AQERDGYCDGHACYGLDV

SEQ ID NO: 71799 - protein, 9 aa, Homo sapiens
  light chain complementarity determining region 3 for antibody 35900
QQYFSHVNT

SEQ ID NO: 71800 - protein, 18 aa, Homo sapiens
  heavy chain complementarity determining region 3 for antibody 35900
AQERDGYCDSHACYGLDV

SEQ ID NO: 71801 - protein, 9 aa, Homo sapiens
  light chain complementarity determining region 3 for antibody 35901
QQYFSHVDT

SEQ ID NO: 71802 - protein, 18 aa, Homo sapiens
  heavy chain complementarity determining region 3 for antibody 35901
AQERDGYCDSHACYGLDV

SEQ ID NO: 71803 - protein, 7 aa, Homo sapiens
  light chain complementarity determining region 3 for antibody 35902
QQYFGNS

SEQ ID NO: 71804 - protein, 13 aa, Homo sapiens
  heavy chain complementarity determining region 3 for antibody 35902
ARGRGSGNDAFDF

SEQ ID NO: 71805 - protein, 11 aa, Homo sapiens
  light chain complementarity determining region 3 for antibody 35903
QQYETSPPGYT

SEQ ID NO: 71806 - protein, 14 aa, Homo sapiens
  heavy chain complementarity determining region 3 for antibody 35903
ARENSISRKRSFDH

SEQ ID NO: 71807 - protein, 11 aa, Homo sapiens
  light chain complementarity determining region 3 for antibody 35904
QQYETSPPGYP

SEQ ID NO: 71808 - protein, 14 aa, Homo sapiens
  heavy chain complementarity determining region 3 for antibody 35904
ARENTISRKRYFDQ

SEQ ID NO: 71809 - protein, 11 aa, Homo sapiens
  light chain complementarity determining region 3 for antibody 35905
QQYETSPPGNP

SEQ ID NO: 71810 - protein, 14 aa, Homo sapiens
  heavy chain complementarity determining region 3 for antibody 35905
ARENSISRKRSFDQ

SEQ ID NO: 71811 - protein, 9 aa, Homo sapiens
  light chain complementarity determining region 3 for antibody 35906
QQYERLPLT

SEQ ID NO: 71812 - protein, 11 aa, Homo sapiens
  heavy chain complementarity determining region 3 for antibody 35906
ASQRIHDAFDT

SEQ ID NO: 71813 - protein, 9 aa, Homo sapiens
  light chain complementarity determining region 3 for antibody 35907
QQYEFVPLT

SEQ ID NO: 71814 - protein, 16 aa, Homo sapiens
  heavy chain complementarity determining region 3 for antibody 35907
ARRALLWFGELGWFDP

SEQ ID NO: 71815 - protein, 9 aa, Homo sapiens
  light chain complementarity determining region 3 for antibody 35908
QQYDSYSGT

SEQ ID NO: 71816 - protein, 12 aa, Homo sapiens
  heavy chain complementarity determining region 3 for antibody 35908
ARGRFGDLVYDY

SEQ ID NO: 71817 - protein, 9 aa, Homo sapiens
  light chain complementarity determining region 3 for antibody 35909
QQYDSYPYP

SEQ ID NO: 71818 - protein, 15 aa, Homo sapiens
  heavy chain complementarity determining region 3 for antibody 35909
VKDRSSGWPGDWFDP

SEQ ID NO: 71819 - protein, 9 aa, Homo sapiens
  light chain complementarity determining region 3 for antibody 35910
QQYDSYPWP

SEQ ID NO: 71820 - protein, 11 aa, Homo sapiens
  heavy chain complementarity determining region 3 for antibody 35910
ARLAGDKAFDL

SEQ ID NO: 71821 - protein, 9 aa, Homo sapiens
  light chain complementarity determining region 3 for antibody 35911
QQYDSWPTT

SEQ ID NO: 71822 - protein, 15 aa, Homo sapiens
  heavy chain complementarity determining region 3 for antibody 35911
VRRLAAAGLHRGFDL

SEQ ID NO: 71823 - protein, 9 aa, Homo sapiens
  light chain complementarity determining region 3 for antibody 35912
QQYDSSSYT

SEQ ID NO: 71824 - protein, 11 aa, Homo sapiens
  heavy chain complementarity determining region 3 for antibody 35912
ARGGFYGSFDF

SEQ ID NO: 71825 - protein, 9 aa, Homo sapiens
  light chain complementarity determining region 3 for antibody 35913
QQYDSSSNT

SEQ ID NO: 71826 - protein, 11 aa, Homo sapiens
  heavy chain complementarity determining region 3 for antibody 35913
ARGGFYGSFDY

SEQ ID NO: 71827 - protein, 9 aa, Homo sapiens
  light chain complementarity determining region 3 for antibody 35914
QQYDSSPRT

SEQ ID NO: 71828 - protein, 13 aa, Homo sapiens
  heavy chain complementarity determining region 3 for antibody 35914
AKSVLAVPRVYDY

SEQ ID NO: 71829 - protein, 10 aa, Homo sapiens
  light chain complementarity determining region 3 for antibody 35915
QQYDSLSPLT

SEQ ID NO: 71830 - protein, 17 aa, Homo sapiens
  heavy chain complementarity determining region 3 for antibody 35915
ARLMTSSRPDYYYGLDV

SEQ ID NO: 71831 - protein, 9 aa, Homo sapiens
  light chain complementarity determining region 3 for antibody 35916
QQYDSAPAT

SEQ ID NO: 71832 - protein, 11 aa, Homo sapiens
  heavy chain complementarity determining region 3 for antibody 35916
AKDPSSGPSDY

SEQ ID NO: 71833 - protein, 9 aa, Homo sapiens
  light chain complementarity determining region 3 for antibody 35917
QQYDRSPRM

SEQ ID NO: 71834 - protein, 15 aa, Homo sapiens
  heavy chain complementarity determining region 3 for antibody 35917
ARDGNVLSTGYPLDS

SEQ ID NO: 71835 - protein, 9 aa, Homo sapiens
  light chain complementarity determining region 3 for antibody 35918
QQYDRSPET

SEQ ID NO: 71836 - protein, 12 aa, Homo sapiens
  heavy chain complementarity determining region 3 for antibody 35918
ARPLYNSGFFDY

SEQ ID NO: 71837 - protein, 7 aa, Homo sapiens
  light chain complementarity determining region 3 for antibody 35919
QQYDPYT

SEQ ID NO: 71838 - protein, 15 aa, Homo sapiens
  heavy chain complementarity determining region 3 for antibody 35919
VKDRSSGWPGDWFDP

SEQ ID NO: 71839 - protein, 10 aa, Homo sapiens
  light chain complementarity determining region 3 for antibody 35920
QQYDNWPPLT

SEQ ID NO: 71840 - protein, 16 aa, Homo sapiens
  heavy chain complementarity determining region 3 for antibody 35920
ARDRVSHYAESGPFEF

SEQ ID NO: 71841 - protein, 10 aa, Homo sapiens
  light chain complementarity determining region 3 for antibody 35921
QQYDNWPPLP

SEQ ID NO: 71842 - protein, 16 aa, Homo sapiens
  heavy chain complementarity determining region 3 for antibody 35921
ARDRVSHYAESGTFEF

SEQ ID NO: 71843 - protein, 8 aa, Homo sapiens
  light chain complementarity determining region 3 for antibody 35922
QQYDNSRT

SEQ ID NO: 71844 - protein, 15 aa, Homo sapiens
  heavy chain complementarity determining region 3 for antibody 35922
AKTGYCSAGNCPFDS

SEQ ID NO: 71845 - protein, 8 aa, Homo sapiens
  light chain complementarity determining region 3 for antibody 35923
QQYDNSRT

SEQ ID NO: 71846 - protein, 15 aa, Homo sapiens
  heavy chain complementarity determining region 3 for antibody 35923
AKADYCSAGNCPFDS

SEQ ID NO: 71847 - protein, 11 aa, Homo sapiens
  light chain complementarity determining region 3 for antibody 35924
QQYDNSALEFT

SEQ ID NO: 71848 - protein, 15 aa, Homo sapiens
  heavy chain complementarity determining region 3 for antibody 35924
VREGVTMIEPGGFDV

SEQ ID NO: 71849 - protein, 9 aa, Homo sapiens
  light chain complementarity determining region 3 for antibody 35925
QQYDNLPVT

SEQ ID NO: 71850 - protein, 10 aa, Homo sapiens
  heavy chain complementarity determining region 3 for antibody 35925
ASGGGHAYGY

SEQ ID NO: 71851 - protein, 8 aa, Homo sapiens
  light chain complementarity determining region 3 for antibody 35926
QQYDNLPT

SEQ ID NO: 71852 - protein, 25 aa, Homo sapiens
  heavy chain complementarity determining region 3 for antibody 35926
ARDRTRAPLGYCGGGSCPTPNWFDP

SEQ ID NO: 71853 - protein, 8 aa, Homo sapiens
  light chain complementarity determining region 3 for antibody 35927
QQYDNLPT

SEQ ID NO: 71854 - protein, 25 aa, Homo sapiens
  heavy chain complementarity determining region 3 for antibody 35927
ARDRTRAPLGYCGGGSCPASNWFDP

SEQ ID NO: 71855 - protein, 10 aa, Homo sapiens
  light chain complementarity determining region 3 for antibody 35928
QQYDNLPPYP

SEQ ID NO: 71856 - protein, 18 aa, Homo sapiens
  heavy chain complementarity determining region 3 for antibody 35928
ARDAGILSSSSWYVGFDI

SEQ ID NO: 71857 - protein, 8 aa, Homo sapiens
  light chain complementarity determining region 3 for antibody 35929
QQYDNLPP

SEQ ID NO: 71858 - protein, 25 aa, Homo sapiens
  heavy chain complementarity determining region 3 for antibody 35929
ARDRTRAPLGYCGGGSCPTSNWFDP

SEQ ID NO: 71859 - protein, 11 aa, Homo sapiens
  light chain complementarity determining region 3 for antibody 35930
QQYDNLPPANT

SEQ ID NO: 71860 - protein, 9 aa, Homo sapiens
  heavy chain complementarity determining region 3 for antibody 35930
ASGFTAFDY

SEQ ID NO: 71861 - protein, 9 aa, Homo sapiens
  light chain complementarity determining region 3 for antibody 35931
QQYDNLPLT

SEQ ID NO: 71862 - protein, 13 aa, Homo sapiens
  heavy chain complementarity determining region 3 for antibody 35931
AKEGDSSGDYFDS

SEQ ID NO: 71863 - protein, 9 aa, Homo sapiens
  light chain complementarity determining region 3 for antibody 35932
QQYDNLPIT

SEQ ID NO: 71864 - protein, 13 aa, Homo sapiens
  heavy chain complementarity determining region 3 for antibody 35932
VRHMNWNDPYFDY

SEQ ID NO: 71865 - protein, 9 aa, Homo sapiens
  light chain complementarity determining region 3 for antibody 35933
QQYDNLPFT

SEQ ID NO: 71866 - protein, 10 aa, Homo sapiens
  heavy chain complementarity determining region 3 for antibody 35933
ASGGGHTYGY

SEQ ID NO: 71867 - protein, 8 aa, Homo sapiens
  light chain complementarity determining region 3 for antibody 35934
QQYDNLAP

SEQ ID NO: 71868 - protein, 13 aa, Homo sapiens
  heavy chain complementarity determining region 3 for antibody 35934
ARGDLLAAAGTDF

SEQ ID NO: 71869 - protein, 9 aa, Homo sapiens
  light chain complementarity determining region 3 for antibody 35935
QQYDNALFT

SEQ ID NO: 71870 - protein, 17 aa, Homo sapiens
  heavy chain complementarity determining region 3 for antibody 35935
TTDRDCSSTNCPGAFDF

SEQ ID NO: 71871 - protein, 8 aa, Homo sapiens
  light chain complementarity determining region 3 for antibody 35936
QQYDGSPS

SEQ ID NO: 71872 - protein, 16 aa, Homo sapiens
  heavy chain complementarity determining region 3 for antibody 35936
ATDWGSGTQWIRAFDV

SEQ ID NO: 71873 - protein, 9 aa, Homo sapiens
  light chain complementarity determining region 3 for antibody 35937
QQYDFLPPS

SEQ ID NO: 71874 - protein, 21 aa, Homo sapiens
  heavy chain complementarity determining region 3 for antibody 35937
ARGLHIVVVTSILRGFWYFGL

SEQ ID NO: 71875 - protein, 10 aa, Homo sapiens
  light chain complementarity determining region 3 for antibody 35938
QQYDDWPPST

SEQ ID NO: 71876 - protein, 21 aa, Homo sapiens
  heavy chain complementarity determining region 3 for antibody 35938
ARHFLQYFDDGSYYPEGLFDL

SEQ ID NO: 71877 - protein, 10 aa, Homo sapiens
  light chain complementarity determining region 3 for antibody 35939
QQYDDWPPIT

SEQ ID NO: 71878 - protein, 21 aa, Homo sapiens
  heavy chain complementarity determining region 3 for antibody 35939
ARHFLQYFDDGSYSPEGLFDL

SEQ ID NO: 71879 - protein, 10 aa, Homo sapiens
  light chain complementarity determining region 3 for antibody 35940
QQYDDWPPIP

SEQ ID NO: 71880 - protein, 21 aa, Homo sapiens
  heavy chain complementarity determining region 3 for antibody 35940
ARHFLQYFDDGSYYPEGLFDL

SEQ ID NO: 71881 - protein, 9 aa, Homo sapiens
  light chain complementarity determining region 3 for antibody 35941
QQYDDWPLP

SEQ ID NO: 71882 - protein, 15 aa, Homo sapiens
  heavy chain complementarity determining region 3 for antibody 35941
ARTKEWFGEIDPFDS

SEQ ID NO: 71883 - protein, 9 aa, Homo sapiens
  light chain complementarity determining region 3 for antibody 35942
QQYDDLPLT

SEQ ID NO: 71884 - protein, 15 aa, Homo sapiens
  heavy chain complementarity determining region 3 for antibody 35942
ARTKEWFGEIDPFDS

SEQ ID NO: 71885 - protein, 10 aa, Homo sapiens
  light chain complementarity determining region 3 for antibody 35943
QQYDDLLPLT

SEQ ID NO: 71886 - protein, 12 aa, Homo sapiens
  heavy chain complementarity determining region 3 for antibody 35943
ARDVTGTRLFDF

SEQ ID NO: 71887 - protein, 9 aa, Homo sapiens
  light chain complementarity determining region 3 for antibody 35944
QQYCSSPRT

SEQ ID NO: 71888 - protein, 17 aa, Homo sapiens
  heavy chain complementarity determining region 3 for antibody 35944
ARALDIVVVVDAIWFDP

SEQ ID NO: 71889 - protein, 10 aa, Homo sapiens
  light chain complementarity determining region 3 for antibody 35945
QQYCSSPPLT

SEQ ID NO: 71890 - protein, 18 aa, Homo sapiens
  heavy chain complementarity determining region 3 for antibody 35945
ARGGYDYGWGSYGVYFDY

SEQ ID NO: 71891 - protein, 9 aa, Homo sapiens
  light chain complementarity determining region 3 for antibody 35946
QQYAYSPFT

SEQ ID NO: 71892 - protein, 10 aa, Homo sapiens
  heavy chain complementarity determining region 3 for antibody 35946
ATGAGWLVDY

SEQ ID NO: 71893 - protein, 9 aa, Homo sapiens
  light chain complementarity determining region 3 for antibody 35947
QQYATSPPT

SEQ ID NO: 71894 - protein, 10 aa, Homo sapiens
  heavy chain complementarity determining region 3 for antibody 35947
VAGAGWLPDY

SEQ ID NO: 71895 - protein, 9 aa, Homo sapiens
  light chain complementarity determining region 3 for antibody 35948
QQYATSLGT

SEQ ID NO: 71896 - protein, 15 aa, Homo sapiens
  heavy chain complementarity determining region 3 for antibody 35948
ARQKVRGRVRDHFDM

SEQ ID NO: 71897 - protein, 9 aa, Homo sapiens
  light chain complementarity determining region 3 for antibody 35949
QQYATSLGT

SEQ ID NO: 71898 - protein, 15 aa, Homo sapiens
  heavy chain complementarity determining region 3 for antibody 35949
ARQKVRGRMRDHFDI

SEQ ID NO: 71899 - protein, 9 aa, Homo sapiens
  light chain complementarity determining region 3 for antibody 35950
QQYATSLGA

SEQ ID NO: 71900 - protein, 15 aa, Homo sapiens
  heavy chain complementarity determining region 3 for antibody 35950
ARQKVRGRMRDHFDM

SEQ ID NO: 71901 - protein, 10 aa, Homo sapiens
  light chain complementarity determining region 3 for antibody 35951
QQYATPPPWT

SEQ ID NO: 71902 - protein, 11 aa, Homo sapiens
  heavy chain complementarity determining region 3 for antibody 35951
ARSSGWWSFDY

SEQ ID NO: 71903 - protein, 9 aa, Homo sapiens
  light chain complementarity determining region 3 for antibody 35952
QQYATPPLT

SEQ ID NO: 71904 - protein, 10 aa, Homo sapiens
  heavy chain complementarity determining region 3 for antibody 35952
VAGAGWLPDY

SEQ ID NO: 71905 - protein, 9 aa, Homo sapiens
  light chain complementarity determining region 3 for antibody 35953
QQYARSPFT

SEQ ID NO: 71906 - protein, 18 aa, Homo sapiens
  heavy chain complementarity determining region 3 for antibody 35953
AARGANCGGDCYYWYFDL

SEQ ID NO: 71907 - protein, 9 aa, Homo sapiens
  light chain complementarity determining region 3 for antibody 35954
QQYARAPIT

SEQ ID NO: 71908 - protein, 10 aa, Homo sapiens
  heavy chain complementarity determining region 3 for antibody 35954
ARMNGWLIDY

SEQ ID NO: 71909 - protein, 8 aa, Homo sapiens
  light chain complementarity determining region 3 for antibody 35955
QQYANSRT

SEQ ID NO: 71910 - protein, 15 aa, Homo sapiens
  heavy chain complementarity determining region 3 for antibody 35955
AKTDYCSAGNCPFDS

SEQ ID NO: 71911 - protein, 10 aa, Homo sapiens
  light chain complementarity determining region 3 for antibody 35956
QQYANQPPIP

SEQ ID NO: 71912 - protein, 12 aa, Homo sapiens
  heavy chain complementarity determining region 3 for antibody 35956
ARVLDSLSPAFH

SEQ ID NO: 71913 - protein, 9 aa, Homo sapiens
  light chain complementarity determining region 3 for antibody 35957
QQYANPPWT

SEQ ID NO: 71914 - protein, 11 aa, Homo sapiens
  heavy chain complementarity determining region 3 for antibody 35957
ATWAFRHGVDV

SEQ ID NO: 71915 - protein, 9 aa, Homo sapiens
  light chain complementarity determining region 3 for antibody 35958
QQYAKSPWR

SEQ ID NO: 71916 - protein, 13 aa, Homo sapiens
  heavy chain complementarity determining region 3 for antibody 35958
ARDSADYGDPLDY

SEQ ID NO: 71917 - protein, 9 aa, Homo sapiens
  light chain complementarity determining region 3 for antibody 35959
QQYAKSPWK

SEQ ID NO: 71918 - protein, 13 aa, Homo sapiens
  heavy chain complementarity determining region 3 for antibody 35959
ARDSADYGDPLDY

SEQ ID NO: 71919 - protein, 9 aa, Homo sapiens
  light chain complementarity determining region 3 for antibody 35960
QQYAKSPGT

SEQ ID NO: 71920 - protein, 13 aa, Homo sapiens
  heavy chain complementarity determining region 3 for antibody 35960
ARDSADYGDPLDY

SEQ ID NO: 71921 - protein, 9 aa, Homo sapiens
  light chain complementarity determining region 3 for antibody 35961
QQYAGPPGT

SEQ ID NO: 71922 - protein, 8 aa, Homo sapiens
  heavy chain complementarity determining region 3 for antibody 35961
ARGLSLDS

SEQ ID NO: 71923 - protein, 8 aa, Homo sapiens
  light chain complementarity determining region 3 for antibody 35962
QQYADSYT

SEQ ID NO: 71924 - protein, 13 aa, Homo sapiens
  heavy chain complementarity determining region 3 for antibody 35962
AHRPVPRGPFFDY

SEQ ID NO: 71925 - protein, 9 aa, Homo sapiens
  light chain complementarity determining region 3 for antibody 35963
QQWAVSPLT

SEQ ID NO: 71926 - protein, 10 aa, Homo sapiens
  heavy chain complementarity determining region 3 for antibody 35963
SSGSGWTSED

SEQ ID NO: 71927 - protein, 9 aa, Homo sapiens
  light chain complementarity determining region 3 for antibody 35964
QQVISYPFN

SEQ ID NO: 71928 - protein, 12 aa, Homo sapiens
  heavy chain complementarity determining region 3 for antibody 35964
ARPLDGDHGFDP

SEQ ID NO: 71929 - protein, 9 aa, Homo sapiens
  light chain complementarity determining region 3 for antibody 35965
QQTYRTLLT

SEQ ID NO: 71930 - protein, 14 aa, Homo sapiens
  heavy chain complementarity determining region 3 for antibody 35965
ASCSSTSCYRGFDS

SEQ ID NO: 71931 - protein, 8 aa, Homo sapiens
  light chain complementarity determining region 3 for antibody 35966
QQTYNLPT

SEQ ID NO: 71932 - protein, 16 aa, Homo sapiens
  heavy chain complementarity determining region 3 for antibody 35966
ARDNLLHGSSSGVMDH

SEQ ID NO: 71933 - protein, 10 aa, Homo sapiens
  light chain complementarity determining region 3 for antibody 35967
QQTDSTPPYP

SEQ ID NO: 71934 - protein, 8 aa, Homo sapiens
  heavy chain complementarity determining region 3 for antibody 35967
LPLRFTDY

SEQ ID NO: 71935 - protein, 10 aa, Homo sapiens
  light chain complementarity determining region 3 for antibody 35968
QQSYTTPLVT

SEQ ID NO: 71936 - protein, 17 aa, Homo sapiens
  heavy chain complementarity determining region 3 for antibody 35968
AKSVGVDDAMTTRVYDS

SEQ ID NO: 71937 - protein, 9 aa, Homo sapiens
  light chain complementarity determining region 3 for antibody 35969
QQSYTTLLT

SEQ ID NO: 71938 - protein, 12 aa, Homo sapiens
  heavy chain complementarity determining region 3 for antibody 35969
VSRFTMRPYFQH

SEQ ID NO: 71939 - protein, 9 aa, Homo sapiens
  light chain complementarity determining region 3 for antibody 35970
QQSYTSPYT

SEQ ID NO: 71940 - protein, 16 aa, Homo sapiens
  heavy chain complementarity determining region 3 for antibody 35970
ATGWGSGTQWIRAFDV

SEQ ID NO: 71941 - protein, 9 aa, Homo sapiens
  light chain complementarity determining region 3 for antibody 35971
QQSYTSPRT

SEQ ID NO: 71942 - protein, 10 aa, Homo sapiens
  heavy chain complementarity determining region 3 for antibody 35971
ARDKNGNFDS

SEQ ID NO: 71943 - protein, 9 aa, Homo sapiens
  light chain complementarity determining region 3 for antibody 35972
QQSYTNPPP

SEQ ID NO: 71944 - protein, 16 aa, Homo sapiens
  heavy chain complementarity determining region 3 for antibody 35972
ARDLQLYSTSSGVFGS

SEQ ID NO: 71945 - protein, 9 aa, Homo sapiens
  light chain complementarity determining region 3 for antibody 35973
QQSYSTYLS

SEQ ID NO: 71946 - protein, 16 aa, Homo sapiens
  heavy chain complementarity determining region 3 for antibody 35973
ARRDYDILTGYSYFDH

SEQ ID NO: 71947 - protein, 9 aa, Homo sapiens
  light chain complementarity determining region 3 for antibody 35974
QQSYSTPYT

SEQ ID NO: 71948 - protein, 15 aa, Homo sapiens
  heavy chain complementarity determining region 3 for antibody 35974
TRDHQRGTYLYSCDS

SEQ ID NO: 71949 - protein, 9 aa, Homo sapiens
  light chain complementarity determining region 3 for antibody 35975
QQSYSTPYT

SEQ ID NO: 71950 - protein, 12 aa, Homo sapiens
  heavy chain complementarity determining region 3 for antibody 35975
AREYGAPGAFDI

SEQ ID NO: 71951 - protein, 9 aa, Homo sapiens
  light chain complementarity determining region 3 for antibody 35976
QQSYSTPYT

SEQ ID NO: 71952 - protein, 11 aa, Homo sapiens
  heavy chain complementarity determining region 3 for antibody 35976
AASSYYGVFHY

SEQ ID NO: 71953 - protein, 9 aa, Homo sapiens
  light chain complementarity determining region 3 for antibody 35977
QQSYSTPYP

SEQ ID NO: 71954 - protein, 24 aa, Homo sapiens
  heavy chain complementarity determining region 3 for antibody 35977
ARGQLYDSRGYYSFSGNTRHWFDP

SEQ ID NO: 71955 - protein, 9 aa, Homo sapiens
  light chain complementarity determining region 3 for antibody 35978
QQSYSTPWT

SEQ ID NO: 71956 - protein, 13 aa, Homo sapiens
  heavy chain complementarity determining region 3 for antibody 35978
ARENDYSSSWLDY

SEQ ID NO: 71957 - protein, 9 aa, Homo sapiens
  light chain complementarity determining region 3 for antibody 35979
QQSYSTPST

SEQ ID NO: 71958 - protein, 14 aa, Homo sapiens
  heavy chain complementarity determining region 3 for antibody 35979
ARGGGVATSYGMDV

SEQ ID NO: 71959 - protein, 9 aa, Homo sapiens
  light chain complementarity determining region 3 for antibody 35980
QQSYSTPRT

SEQ ID NO: 71960 - protein, 12 aa, Homo sapiens
  heavy chain complementarity determining region 3 for antibody 35980
VRLLDSSGSLGY

SEQ ID NO: 71961 - protein, 9 aa, Homo sapiens
  light chain complementarity determining region 3 for antibody 35981
QQSYSTPRT

SEQ ID NO: 71962 - protein, 15 aa, Homo sapiens
  heavy chain complementarity determining region 3 for antibody 35981
ARDRGAAALFYGVDV

SEQ ID NO: 71963 - protein, 9 aa, Homo sapiens
  light chain complementarity determining region 3 for antibody 35982
QQSYSTPRP

SEQ ID NO: 71964 - protein, 19 aa, Homo sapiens
  heavy chain complementarity determining region 3 for antibody 35982
ARDWMAWFGAQRRENAFDI

SEQ ID NO: 71965 - protein, 11 aa, Homo sapiens
  light chain complementarity determining region 3 for antibody 35983
QQSYSTPRALT

SEQ ID NO: 71966 - protein, 13 aa, Homo sapiens
  heavy chain complementarity determining region 3 for antibody 35983
AGGQFHSSGYSEF

SEQ ID NO: 71967 - protein, 9 aa, Homo sapiens
  light chain complementarity determining region 3 for antibody 35984
QQSYSTPPT

SEQ ID NO: 71968 - protein, 23 aa, Homo sapiens
  heavy chain complementarity determining region 3 for antibody 35984
ARIESDATMVRGVIITKGNWFDP

SEQ ID NO: 71969 - protein, 10 aa, Homo sapiens
  light chain complementarity determining region 3 for antibody 35985
QQSYSTPPST

SEQ ID NO: 71970 - protein, 15 aa, Homo sapiens
  heavy chain complementarity determining region 3 for antibody 35985
VRTKEWFGKIDPFDY

SEQ ID NO: 71971 - protein, 10 aa, Homo sapiens
  light chain complementarity determining region 3 for antibody 35986
QQSYSTPPST

SEQ ID NO: 71972 - protein, 21 aa, Homo sapiens
  heavy chain complementarity determining region 3 for antibody 35986
ARDAPVSRPYSSGWYSSAFDY

SEQ ID NO: 71973 - protein, 9 aa, Homo sapiens
  light chain complementarity determining region 3 for antibody 35987
QQSYSTPGT

SEQ ID NO: 71974 - protein, 16 aa, Homo sapiens
  heavy chain complementarity determining region 3 for antibody 35987
ARTVGITMIERHVFDL

SEQ ID NO: 71975 - protein, 10 aa, Homo sapiens
  light chain complementarity determining region 3 for antibody 35988
QQSYSTPALP

SEQ ID NO: 71976 - protein, 19 aa, Homo sapiens
  heavy chain complementarity determining region 3 for antibody 35988
AKPNRGQWLPMGPQYYFDS

SEQ ID NO: 71977 - protein, 10 aa, Homo sapiens
  light chain complementarity determining region 3 for antibody 35989
QQSYSTFLRT

SEQ ID NO: 71978 - protein, 14 aa, Homo sapiens
  heavy chain complementarity determining region 3 for antibody 35989
ARVGYSSGGDWFDP

SEQ ID NO: 71979 - protein, 9 aa, Homo sapiens
  light chain complementarity determining region 3 for antibody 35990
QQSYSSPRT

SEQ ID NO: 71980 - protein, 10 aa, Homo sapiens
  heavy chain complementarity determining region 3 for antibody 35990
AGGDFRQFDY

SEQ ID NO: 71981 - protein, 9 aa, Homo sapiens
  light chain complementarity determining region 3 for antibody 35991
QQSYSSLLT

SEQ ID NO: 71982 - protein, 16 aa, Homo sapiens
  heavy chain complementarity determining region 3 for antibody 35991
ARGGGSTYTTKRAFDS

SEQ ID NO: 71983 - protein, 9 aa, Homo sapiens
  light chain complementarity determining region 3 for antibody 35992
QQSYSSLLT

SEQ ID NO: 71984 - protein, 16 aa, Homo sapiens
  heavy chain complementarity determining region 3 for antibody 35992
AREGGSTYTTKRAFGS

SEQ ID NO: 71985 - protein, 9 aa, Homo sapiens
  light chain complementarity determining region 3 for antibody 35993
QQSYSSLLT

SEQ ID NO: 71986 - protein, 16 aa, Homo sapiens
  heavy chain complementarity determining region 3 for antibody 35993
AREGGSTYATKRAFDS

SEQ ID NO: 71987 - protein, 9 aa, Homo sapiens
  light chain complementarity determining region 3 for antibody 35994
QQSYSSLLT

SEQ ID NO: 71988 - protein, 16 aa, Homo sapiens
  heavy chain complementarity determining region 3 for antibody 35994
AREGGSAYTTKRAFDS

SEQ ID NO: 71989 - protein, 9 aa, Homo sapiens
  light chain complementarity determining region 3 for antibody 35995
QQSYSSLLN

SEQ ID NO: 71990 - protein, 16 aa, Homo sapiens
  heavy chain complementarity determining region 3 for antibody 35995
AREGGSTYTTKRAFDS

SEQ ID NO: 71991 - protein, 9 aa, Homo sapiens
  light chain complementarity determining region 3 for antibody 35996
QQSYSSLFT

SEQ ID NO: 71992 - protein, 16 aa, Homo sapiens
  heavy chain complementarity determining region 3 for antibody 35996
AREGGSTYTTKRAFDS

SEQ ID NO: 71993 - protein, 9 aa, Homo sapiens
  light chain complementarity determining region 3 for antibody 35997
QQSYSRLYT

SEQ ID NO: 71994 - protein, 15 aa, Homo sapiens
  heavy chain complementarity determining region 3 for antibody 35997
TRGNSGNYLVRAFDI

SEQ ID NO: 71995 - protein, 9 aa, Homo sapiens
  light chain complementarity determining region 3 for antibody 35998
QQSYSPPPT

SEQ ID NO: 71996 - protein, 20 aa, Homo sapiens
  heavy chain complementarity determining region 3 for antibody 35998
AKDVTPDYCYGSGSSLYFDY

SEQ ID NO: 71997 - protein, 8 aa, Homo sapiens
  light chain complementarity determining region 3 for antibody 35999
QQSYSNPT

SEQ ID NO: 71998 - protein, 21 aa, Homo sapiens
  heavy chain complementarity determining region 3 for antibody 35999
ARVHPVYGDSYYQLQYYGMDV

SEQ ID NO: 71999 - protein, 10 aa, Homo sapiens
  light chain complementarity determining region 3 for antibody 36000
QQSYSLPPLS

SEQ ID NO: 72000 - protein, 15 aa, Homo sapiens
  heavy chain complementarity determining region 3 for antibody 36000
VSDRNISGVRGAFDI

SEQ ID NO: 72001 - protein, 9 aa, Homo sapiens
  light chain complementarity determining region 3 for antibody 36001
QQSYSIPLT

SEQ ID NO: 72002 - protein, 15 aa, Homo sapiens
  heavy chain complementarity determining region 3 for antibody 36001
ARGGDSSGYHAPSDY

SEQ ID NO: 72003 - protein, 9 aa, Homo sapiens
  light chain complementarity determining region 3 for antibody 36002
QQSYSGHRT

SEQ ID NO: 72004 - protein, 17 aa, Homo sapiens
  heavy chain complementarity determining region 3 for antibody 36002
AKAPTSTYSGKYGGFDY

SEQ ID NO: 72005 - protein, 9 aa, Homo sapiens
  light chain complementarity determining region 3 for antibody 36003
QQSYSFPWT

SEQ ID NO: 72006 - protein, 16 aa, Homo sapiens
  heavy chain complementarity determining region 3 for antibody 36003
AREPGLGPTTVYGMDV

SEQ ID NO: 72007 - protein, 9 aa, Homo sapiens
  light chain complementarity determining region 3 for antibody 36004
QQSYSFPRT

SEQ ID NO: 72008 - protein, 16 aa, Homo sapiens
  heavy chain complementarity determining region 3 for antibody 36004
ARDPGLGPTTVYGMDV

SEQ ID NO: 72009 - protein, 9 aa, Homo sapiens
  light chain complementarity determining region 3 for antibody 36005
QQSYSDPPT

SEQ ID NO: 72010 - protein, 16 aa, Homo sapiens
  heavy chain complementarity determining region 3 for antibody 36005
ARHLQIHSPSSGVFGI

SEQ ID NO: 72011 - protein, 9 aa, Homo sapiens
  light chain complementarity determining region 3 for antibody 36006
QQSYSAPWT

SEQ ID NO: 72012 - protein, 12 aa, Homo sapiens
  heavy chain complementarity determining region 3 for antibody 36006
ARGGVVAGRNDY

SEQ ID NO: 72013 - protein, 8 aa, Homo sapiens
  light chain complementarity determining region 3 for antibody 36007
QQSYSALT

SEQ ID NO: 72014 - protein, 23 aa, Homo sapiens
  heavy chain complementarity determining region 3 for antibody 36007
ARGRPPSGWYRLKDRTYYYGLDV

SEQ ID NO: 72015 - protein, 9 aa, Homo sapiens
  light chain complementarity determining region 3 for antibody 36008
QQSYRILWT

SEQ ID NO: 72016 - protein, 13 aa, Homo sapiens
  heavy chain complementarity determining region 3 for antibody 36008
VTRACRFGKVMDV

SEQ ID NO: 72017 - protein, 9 aa, Homo sapiens
  light chain complementarity determining region 3 for antibody 36009
QQSYNTPWT

SEQ ID NO: 72018 - protein, 15 aa, Homo sapiens
  heavy chain complementarity determining region 3 for antibody 36009
TTEMWCGELSVTAHY

SEQ ID NO: 72019 - protein, 9 aa, Homo sapiens
  light chain complementarity determining region 3 for antibody 36010
QQSYNSPRT

SEQ ID NO: 72020 - protein, 22 aa, Homo sapiens
  heavy chain complementarity determining region 3 for antibody 36010
ARGRAHMTMTVVSRPYYYGVDV

SEQ ID NO: 72021 - protein, 9 aa, Homo sapiens
  light chain complementarity determining region 3 for antibody 36011
QQSYKTPWT

SEQ ID NO: 72022 - protein, 18 aa, Homo sapiens
  heavy chain complementarity determining region 3 for antibody 36011
ARAAAWELLFQYYYAMDV

SEQ ID NO: 72023 - protein, 8 aa, Homo sapiens
  light chain complementarity determining region 3 for antibody 36012
QQSYGIPT

SEQ ID NO: 72024 - protein, 13 aa, Homo sapiens
  heavy chain complementarity determining region 3 for antibody 36012
ARDRPGTYYAFDI

SEQ ID NO: 72025 - protein, 9 aa, Homo sapiens
  light chain complementarity determining region 3 for antibody 36013
QQSTRTPYT

SEQ ID NO: 72026 - protein, 14 aa, Homo sapiens
  heavy chain complementarity determining region 3 for antibody 36013
ATEGPSRMGKFFDS

SEQ ID NO: 72027 - protein, 9 aa, Homo sapiens
  light chain complementarity determining region 3 for antibody 36014
QQSSSTPPP

SEQ ID NO: 72028 - protein, 11 aa, Homo sapiens
  heavy chain complementarity determining region 3 for antibody 36014
TGERAGTIVDY

SEQ ID NO: 72029 - protein, 9 aa, Homo sapiens
  light chain complementarity determining region 3 for antibody 36015
QQSSSTAYT

SEQ ID NO: 72030 - protein, 15 aa, Homo sapiens
  heavy chain complementarity determining region 3 for antibody 36015
ARQFTSGWYGYWFDP

SEQ ID NO: 72031 - protein, 9 aa, Homo sapiens
  light chain complementarity determining region 3 for antibody 36016
QQSNSYSVT

SEQ ID NO: 72032 - protein, 17 aa, Homo sapiens
  heavy chain complementarity determining region 3 for antibody 36016
VKESWQWLVDYYYGMDV

SEQ ID NO: 72033 - protein, 9 aa, Homo sapiens
  light chain complementarity determining region 3 for antibody 36017
QQSNSTPYT

SEQ ID NO: 72034 - protein, 14 aa, Homo sapiens
  heavy chain complementarity determining region 3 for antibody 36017
ATEGPSRMGKFFDS

SEQ ID NO: 72035 - protein, 9 aa, Homo sapiens
  light chain complementarity determining region 3 for antibody 36018
QQSNSFPLT

SEQ ID NO: 72036 - protein, 13 aa, Homo sapiens
  heavy chain complementarity determining region 3 for antibody 36018
AGGVFDSSGYHDY

SEQ ID NO: 72037 - protein, 9 aa, Homo sapiens
  light chain complementarity determining region 3 for antibody 36019
QQSNRTPST

SEQ ID NO: 72038 - protein, 14 aa, Homo sapiens
  heavy chain complementarity determining region 3 for antibody 36019
ATEGPSRMGKFFDS

SEQ ID NO: 72039 - protein, 8 aa, Homo sapiens
  light chain complementarity determining region 3 for antibody 36020
QQSNNWPT

SEQ ID NO: 72040 - protein, 16 aa, Homo sapiens
  heavy chain complementarity determining region 3 for antibody 36020
AREGMTTDPSRAAFDL

SEQ ID NO: 72041 - protein, 9 aa, Homo sapiens
  light chain complementarity determining region 3 for antibody 36021
QQSNKTPYT

SEQ ID NO: 72042 - protein, 14 aa, Homo sapiens
  heavy chain complementarity determining region 3 for antibody 36021
ATEGPSRMGKFFDS

SEQ ID NO: 72043 - protein, 8 aa, Homo sapiens
  light chain complementarity determining region 3 for antibody 36022
QQSIGTPT

SEQ ID NO: 72044 - protein, 14 aa, Homo sapiens
  heavy chain complementarity determining region 3 for antibody 36022
AREADTGYGYYCDL

SEQ ID NO: 72045 - protein, 9 aa, Homo sapiens
  light chain complementarity determining region 3 for antibody 36023
QQSHSRPFT

SEQ ID NO: 72046 - protein, 20 aa, Homo sapiens
  heavy chain complementarity determining region 3 for antibody 36023
AKGIAVAALRTVYYYYGMDV

SEQ ID NO: 72047 - protein, 8 aa, Homo sapiens
  light chain complementarity determining region 3 for antibody 36024
QQSHSART

SEQ ID NO: 72048 - protein, 19 aa, Homo sapiens
  heavy chain complementarity determining region 3 for antibody 36024
ASEGARGGGTTTPHWYFDL

SEQ ID NO: 72049 - protein, 8 aa, Homo sapiens
  light chain complementarity determining region 3 for antibody 36025
QQSHSARK

SEQ ID NO: 72050 - protein, 19 aa, Homo sapiens
  heavy chain complementarity determining region 3 for antibody 36025
AREGARGGGTTTPHWYFDL

SEQ ID NO: 72051 - protein, 8 aa, Homo sapiens
  light chain complementarity determining region 3 for antibody 36026
QQSHRART

SEQ ID NO: 72052 - protein, 19 aa, Homo sapiens
  heavy chain complementarity determining region 3 for antibody 36026
AREGARGGGTTTPHWYFDL

SEQ ID NO: 72053 - protein, 10 aa, Homo sapiens
  light chain complementarity determining region 3 for antibody 36027
QQSHNNPPYT

SEQ ID NO: 72054 - protein, 21 aa, Homo sapiens
  heavy chain complementarity determining region 3 for antibody 36027
ARTGRHYSDSTVYYYRPRIDY

SEQ ID NO: 72055 - protein, 9 aa, Homo sapiens
  light chain complementarity determining region 3 for antibody 36028
QQSGSSPRT

SEQ ID NO: 72056 - protein, 25 aa, Homo sapiens
  heavy chain complementarity determining region 3 for antibody 36028
ARLRIDRLRLPGAMRGPLYDCGLNV

SEQ ID NO: 72057 - protein, 9 aa, Homo sapiens
  light chain complementarity determining region 3 for antibody 36029
QQSFSSPWT

SEQ ID NO: 72058 - protein, 13 aa, Homo sapiens
  heavy chain complementarity determining region 3 for antibody 36029
ARVVSAAVDFFDF

SEQ ID NO: 72059 - protein, 9 aa, Homo sapiens
  light chain complementarity determining region 3 for antibody 36030
QQSFSPPLT

SEQ ID NO: 72060 - protein, 13 aa, Homo sapiens
  heavy chain complementarity determining region 3 for antibody 36030
ARVVSAAVDFFDF

SEQ ID NO: 72061 - protein, 9 aa, Homo sapiens
  light chain complementarity determining region 3 for antibody 36031
QQSFRTPWT

SEQ ID NO: 72062 - protein, 18 aa, Homo sapiens
  heavy chain complementarity determining region 3 for antibody 36031
ARLNENYHDSGGYYSFDS

SEQ ID NO: 72063 - protein, 9 aa, Homo sapiens
  light chain complementarity determining region 3 for antibody 36032
QQSFRPPWT

SEQ ID NO: 72064 - protein, 13 aa, Homo sapiens
  heavy chain complementarity determining region 3 for antibody 36032
ARVVSAAVDFFDF

SEQ ID NO: 72065 - protein, 9 aa, Homo sapiens
  light chain complementarity determining region 3 for antibody 36033
QQSFNTPRT

SEQ ID NO: 72066 - protein, 14 aa, Homo sapiens
  heavy chain complementarity determining region 3 for antibody 36033
ARDWGVGAGDFLDL

SEQ ID NO: 72067 - protein, 9 aa, Homo sapiens
  light chain complementarity determining region 3 for antibody 36034
QQSFNTPRP

SEQ ID NO: 72068 - protein, 14 aa, Homo sapiens
  heavy chain complementarity determining region 3 for antibody 36034
ARDWGVGAGAFLDL

SEQ ID NO: 72069 - protein, 9 aa, Homo sapiens
  light chain complementarity determining region 3 for antibody 36035
QQRYSTPYT

SEQ ID NO: 72070 - protein, 17 aa, Homo sapiens
  heavy chain complementarity determining region 3 for antibody 36035
TTEQISNDYYDSGAFDY

SEQ ID NO: 72071 - protein, 9 aa, Homo sapiens
  light chain complementarity determining region 3 for antibody 36036
QQRYSPLFT

SEQ ID NO: 72072 - protein, 16 aa, Homo sapiens
  heavy chain complementarity determining region 3 for antibody 36036
ARGREYGGSLYWYFDL

SEQ ID NO: 72073 - protein, 8 aa, Homo sapiens
  light chain complementarity determining region 3 for antibody 36037
QQRYSNPI

SEQ ID NO: 72074 - protein, 18 aa, Homo sapiens
  heavy chain complementarity determining region 3 for antibody 36037
AKDRQGGLYRYGDYEFDY

SEQ ID NO: 72075 - protein, 10 aa, Homo sapiens
  light chain complementarity determining region 3 for antibody 36038
QQRYRWPPYT

SEQ ID NO: 72076 - protein, 11 aa, Homo sapiens
  heavy chain complementarity determining region 3 for antibody 36038
ARGVGSYVFES

SEQ ID NO: 72077 - protein, 10 aa, Homo sapiens
  light chain complementarity determining region 3 for antibody 36039
QQRYNWPPFT

SEQ ID NO: 72078 - protein, 11 aa, Homo sapiens
  heavy chain complementarity determining region 3 for antibody 36039
ARGVSSYPFDS

SEQ ID NO: 72079 - protein, 10 aa, Homo sapiens
  light chain complementarity determining region 3 for antibody 36040
QQRYNWPPFT

SEQ ID NO: 72080 - protein, 11 aa, Homo sapiens
  heavy chain complementarity determining region 3 for antibody 36040
ARGVGSYPLDS

SEQ ID NO: 72081 - protein, 10 aa, Homo sapiens
  light chain complementarity determining region 3 for antibody 36041
QQRYNWPPDT

SEQ ID NO: 72082 - protein, 11 aa, Homo sapiens
  heavy chain complementarity determining region 3 for antibody 36041
ARGVGSYVFES

SEQ ID NO: 72083 - protein, 10 aa, Homo sapiens
  light chain complementarity determining region 3 for antibody 36042
QQRYNWHPYT

SEQ ID NO: 72084 - protein, 11 aa, Homo sapiens
  heavy chain complementarity determining region 3 for antibody 36042
ARGVGSYVFES

SEQ ID NO: 72085 - protein, 10 aa, Homo sapiens
  light chain complementarity determining region 3 for antibody 36043
QQRYNCPPYT

SEQ ID NO: 72086 - protein, 11 aa, Homo sapiens
  heavy chain complementarity determining region 3 for antibody 36043
ARGVGSYVFES

SEQ ID NO: 72087 - protein, 10 aa, Homo sapiens
  light chain complementarity determining region 3 for antibody 36044
QQRYKWPPYT

SEQ ID NO: 72088 - protein, 11 aa, Homo sapiens
  heavy chain complementarity determining region 3 for antibody 36044
ARGVGSYAFES

SEQ ID NO: 72089 - protein, 10 aa, Homo sapiens
  light chain complementarity determining region 3 for antibody 36045
QQRYKWPPYT

SEQ ID NO: 72090 - protein, 11 aa, Homo sapiens
  heavy chain complementarity determining region 3 for antibody 36045
ARGVGGYVFES

SEQ ID NO: 72091 - protein, 10 aa, Homo sapiens
  light chain complementarity determining region 3 for antibody 36046
QQRYKWPPYI

SEQ ID NO: 72092 - protein, 11 aa, Homo sapiens
  heavy chain complementarity determining region 3 for antibody 36046
ARGVGSYVFES

SEQ ID NO: 72093 - protein, 10 aa, Homo sapiens
  light chain complementarity determining region 3 for antibody 36047
QQRYKWPPHT

SEQ ID NO: 72094 - protein, 11 aa, Homo sapiens
  heavy chain complementarity determining region 3 for antibody 36047
ARGVGSYVFDS

SEQ ID NO: 72095 - protein, 8 aa, Homo sapiens
  light chain complementarity determining region 3 for antibody 36048
QQRYKWPP

SEQ ID NO: 72096 - protein, 11 aa, Homo sapiens
  heavy chain complementarity determining region 3 for antibody 36048
ARGVGSYVFES

SEQ ID NO: 72097 - protein, 10 aa, Homo sapiens
  light chain complementarity determining region 3 for antibody 36049
QQRYKCPPYT

SEQ ID NO: 72098 - protein, 11 aa, Homo sapiens
  heavy chain complementarity determining region 3 for antibody 36049
ARGVGSYVFES

SEQ ID NO: 72099 - protein, 11 aa, Homo sapiens
  light chain complementarity determining region 3 for antibody 36050
QQRVNWPPSVP

SEQ ID NO: 72100 - protein, 15 aa, Homo sapiens
  heavy chain complementarity determining region 3 for antibody 36050
ARDRDGMYSAHAFDI

SEQ ID NO: 72101 - protein, 11 aa, Homo sapiens
  light chain complementarity determining region 3 for antibody 36051
QQRVNWPPSGT

SEQ ID NO: 72102 - protein, 15 aa, Homo sapiens
  heavy chain complementarity determining region 3 for antibody 36051
ARDRDGMYSAHAFDI

SEQ ID NO: 72103 - protein, 11 aa, Homo sapiens
  light chain complementarity determining region 3 for antibody 36052
QQRVNWPPSAT

SEQ ID NO: 72104 - protein, 15 aa, Homo sapiens
  heavy chain complementarity determining region 3 for antibody 36052
ARDRDGMYSAHAFDI

SEQ ID NO: 72105 - protein, 11 aa, Homo sapiens
  light chain complementarity determining region 3 for antibody 36053
QQRVNCPPSVT

SEQ ID NO: 72106 - protein, 15 aa, Homo sapiens
  heavy chain complementarity determining region 3 for antibody 36053
ARDRDGMYSAHAFDI

SEQ ID NO: 72107 - protein, 9 aa, Homo sapiens
  light chain complementarity determining region 3 for antibody 36054
QQRTNWRFT

SEQ ID NO: 72108 - protein, 16 aa, Homo sapiens
  heavy chain complementarity determining region 3 for antibody 36054
ARDQGFCRGPNCYMRY

SEQ ID NO: 72109 - protein, 9 aa, Homo sapiens
  light chain complementarity determining region 3 for antibody 36055
QQRTNWRFT

SEQ ID NO: 72110 - protein, 16 aa, Homo sapiens
  heavy chain complementarity determining region 3 for antibody 36055
ARDQGFCRGPNCYMHF

SEQ ID NO: 72111 - protein, 9 aa, Homo sapiens
  light chain complementarity determining region 3 for antibody 36056
QQRTNWPRK

SEQ ID NO: 72112 - protein, 12 aa, Homo sapiens
  heavy chain complementarity determining region 3 for antibody 36056
AKEWANWGVFDY

SEQ ID NO: 72113 - protein, 9 aa, Homo sapiens
  light chain complementarity determining region 3 for antibody 36057
QQRTNRPRT

SEQ ID NO: 72114 - protein, 12 aa, Homo sapiens
  heavy chain complementarity determining region 3 for antibody 36057
AKEWANWGVFDY

SEQ ID NO: 72115 - protein, 9 aa, Homo sapiens
  light chain complementarity determining region 3 for antibody 36058
QQRTDWPLT

SEQ ID NO: 72116 - protein, 19 aa, Homo sapiens
  heavy chain complementarity determining region 3 for antibody 36058
ARDSFWPGSGNYFGDILDS

SEQ ID NO: 72117 - protein, 9 aa, Homo sapiens
  light chain complementarity determining region 3 for antibody 36059
QQRSSWPYT

SEQ ID NO: 72118 - protein, 11 aa, Homo sapiens
  heavy chain complementarity determining region 3 for antibody 36059
VKGWGGSSIDY

SEQ ID NO: 72119 - protein, 9 aa, Homo sapiens
  light chain complementarity determining region 3 for antibody 36060
QQRSSWPYT

SEQ ID NO: 72120 - protein, 11 aa, Homo sapiens
  heavy chain complementarity determining region 3 for antibody 36060
VERWGGSSIDY

SEQ ID NO: 72121 - protein, 9 aa, Homo sapiens
  light chain complementarity determining region 3 for antibody 36061
QQRSSRPIT

SEQ ID NO: 72122 - protein, 15 aa, Homo sapiens
  heavy chain complementarity determining region 3 for antibody 36061
ARELPVTNVYHYYDY

SEQ ID NO: 72123 - protein, 8 aa, Homo sapiens
  light chain complementarity determining region 3 for antibody 36062
QQRSRRLS

SEQ ID NO: 72124 - protein, 12 aa, Homo sapiens
  heavy chain complementarity determining region 3 for antibody 36062
ARDASAVSEHTP

SEQ ID NO: 72125 - protein, 8 aa, Homo sapiens
  light chain complementarity determining region 3 for antibody 36063
QQRSNWYP

SEQ ID NO: 72126 - protein, 15 aa, Homo sapiens
  heavy chain complementarity determining region 3 for antibody 36063
ARDLEQWLLDNWFDP

SEQ ID NO: 72127 - protein, 9 aa, Homo sapiens
  light chain complementarity determining region 3 for antibody 36064
QQRSNWRGT

SEQ ID NO: 72128 - protein, 17 aa, Homo sapiens
  heavy chain complementarity determining region 3 for antibody 36064
VRGIDYYGSGGHHWFDP

SEQ ID NO: 72129 - protein, 9 aa, Homo sapiens
  light chain complementarity determining region 3 for antibody 36065
QQRSNWPYP

SEQ ID NO: 72130 - protein, 11 aa, Homo sapiens
  heavy chain complementarity determining region 3 for antibody 36065
VRRWGGDEVDY

SEQ ID NO: 72131 - protein, 9 aa, Homo sapiens
  light chain complementarity determining region 3 for antibody 36066
QQRSNWPWP

SEQ ID NO: 72132 - protein, 20 aa, Homo sapiens
  heavy chain complementarity determining region 3 for antibody 36066
ARASPVYCSGGSCYYYGMDV

SEQ ID NO: 72133 - protein, 10 aa, Homo sapiens
  light chain complementarity determining region 3 for antibody 36067
QQRSNWPRLP

SEQ ID NO: 72134 - protein, 17 aa, Homo sapiens
  heavy chain complementarity determining region 3 for antibody 36067
AREYCGGDYPCGDPFDF

SEQ ID NO: 72135 - protein, 10 aa, Homo sapiens
  light chain complementarity determining region 3 for antibody 36068
QQRSNWPQFT

SEQ ID NO: 72136 - protein, 19 aa, Homo sapiens
  heavy chain complementarity determining region 3 for antibody 36068
AGVGTTYVRDDYYYCGMDV

SEQ ID NO: 72137 - protein, 10 aa, Homo sapiens
  light chain complementarity determining region 3 for antibody 36069
QQRSNWPPYT

SEQ ID NO: 72138 - protein, 11 aa, Homo sapiens
  heavy chain complementarity determining region 3 for antibody 36069
ARGVGSYVFES

SEQ ID NO: 72139 - protein, 9 aa, Homo sapiens
  light chain complementarity determining region 3 for antibody 36070
QQRSNWPPT

SEQ ID NO: 72140 - protein, 15 aa, Homo sapiens
  heavy chain complementarity determining region 3 for antibody 36070
ARESFDISGNNWFAP

SEQ ID NO: 72141 - protein, 9 aa, Homo sapiens
  light chain complementarity determining region 3 for antibody 36071
QQRSNWPPT

SEQ ID NO: 72142 - protein, 15 aa, Homo sapiens
  heavy chain complementarity determining region 3 for antibody 36071
ARDLSYFGSRRGFDP

SEQ ID NO: 72143 - protein, 11 aa, Homo sapiens
  light chain complementarity determining region 3 for antibody 36072
QQRSNWPPMST

SEQ ID NO: 72144 - protein, 15 aa, Homo sapiens
  heavy chain complementarity determining region 3 for antibody 36072
ARDGYCSGGSCSFDY

SEQ ID NO: 72145 - protein, 10 aa, Homo sapiens
  light chain complementarity determining region 3 for antibody 36073
QQRSNWPPIT

SEQ ID NO: 72146 - protein, 22 aa, Homo sapiens
  heavy chain complementarity determining region 3 for antibody 36073
ATDRDFSRGNITSTYYPGVLSE

SEQ ID NO: 72147 - protein, 10 aa, Homo sapiens
  light chain complementarity determining region 3 for antibody 36074
QQRSNWPPIT

SEQ ID NO: 72148 - protein, 22 aa, Homo sapiens
  heavy chain complementarity determining region 3 for antibody 36074
ATDRDFSRGNITSTYYPGVLID

SEQ ID NO: 72149 - protein, 10 aa, Homo sapiens
  light chain complementarity determining region 3 for antibody 36075
QQRSNWPPFT

SEQ ID NO: 72150 - protein, 18 aa, Homo sapiens
  heavy chain complementarity determining region 3 for antibody 36075
ARDTLWLSDYNYEDFFDS

SEQ ID NO: 72151 - protein, 11 aa, Homo sapiens
  light chain complementarity determining region 3 for antibody 36076
QQRSNWPPELP

SEQ ID NO: 72152 - protein, 11 aa, Homo sapiens
  heavy chain complementarity determining region 3 for antibody 36076
PIFMVRGDKDY

SEQ ID NO: 72153 - protein, 9 aa, Homo sapiens
  light chain complementarity determining region 3 for antibody 36077
QQRSNWPLT

SEQ ID NO: 72154 - protein, 7 aa, Homo sapiens
  heavy chain complementarity determining region 3 for antibody 36077
ADPPSDF

SEQ ID NO: 72155 - protein, 9 aa, Homo sapiens
  light chain complementarity determining region 3 for antibody 36078
QQRSNWPLP

SEQ ID NO: 72156 - protein, 15 aa, Homo sapiens
  heavy chain complementarity determining region 3 for antibody 36078
ARDLSYFGSRRGFDP

SEQ ID NO: 72157 - protein, 9 aa, Homo sapiens
  light chain complementarity determining region 3 for antibody 36079
QQRSNWPHT

SEQ ID NO: 72158 - protein, 11 aa, Homo sapiens
  heavy chain complementarity determining region 3 for antibody 36079
VRRWGGDEVDY

SEQ ID NO: 72159 - protein, 8 aa, Homo sapiens
  light chain complementarity determining region 3 for antibody 36080
QQRSNWPA

SEQ ID NO: 72160 - protein, 20 aa, Homo sapiens
  heavy chain complementarity determining region 3 for antibody 36080
ARVWFGERTRGYYYYYGIDV

SEQ ID NO: 72161 - protein, 8 aa, Homo sapiens
  light chain complementarity determining region 3 for antibody 36081
QQRSNWPA

SEQ ID NO: 72162 - protein, 19 aa, Homo sapiens
  heavy chain complementarity determining region 3 for antibody 36081
ARVWFGERTRGYYYYGMDV

SEQ ID NO: 72163 - protein, 8 aa, Homo sapiens
  light chain complementarity determining region 3 for antibody 36082
QQRSNWHT

SEQ ID NO: 72164 - protein, 15 aa, Homo sapiens
  heavy chain complementarity determining region 3 for antibody 36082
ARDLEQWLLDNWFDP

SEQ ID NO: 72165 - protein, 9 aa, Homo sapiens
  light chain complementarity determining region 3 for antibody 36083
QQRSKWPLT

SEQ ID NO: 72166 - protein, 18 aa, Homo sapiens
  heavy chain complementarity determining region 3 for antibody 36083
ARRGSRGVEAAQYNCFDP

SEQ ID NO: 72167 - protein, 10 aa, Homo sapiens
  light chain complementarity determining region 3 for antibody 36084
QQRSKRPPLT

SEQ ID NO: 72168 - protein, 9 aa, Homo sapiens
  heavy chain complementarity determining region 3 for antibody 36084
ARVDGYFDY

SEQ ID NO: 72169 - protein, 9 aa, Homo sapiens
  light chain complementarity determining region 3 for antibody 36085
QQRSKRPLT

SEQ ID NO: 72170 - protein, 18 aa, Homo sapiens
  heavy chain complementarity determining region 3 for antibody 36085
ARRGSRGVEAAQYNWFDP

SEQ ID NO: 72171 - protein, 11 aa, Homo sapiens
  light chain complementarity determining region 3 for antibody 36086
QQRSHWPPGAA

SEQ ID NO: 72172 - protein, 17 aa, Homo sapiens
  heavy chain complementarity determining region 3 for antibody 36086
ARALDIVVVVDAIWFDP

SEQ ID NO: 72173 - protein, 10 aa, Homo sapiens
  light chain complementarity determining region 3 for antibody 36087
QQRSGWPPLT

SEQ ID NO: 72174 - protein, 10 aa, Homo sapiens
  heavy chain complementarity determining region 3 for antibody 36087
ARDYSMTFDY

SEQ ID NO: 72175 - protein, 10 aa, Homo sapiens
  light chain complementarity determining region 3 for antibody 36088
QQRSDWPPLT

SEQ ID NO: 72176 - protein, 10 aa, Homo sapiens
  heavy chain complementarity determining region 3 for antibody 36088
ERDYTMTFDY

SEQ ID NO: 72177 - protein, 10 aa, Homo sapiens
  light chain complementarity determining region 3 for antibody 36089
QQRSDWPPLT

SEQ ID NO: 72178 - protein, 10 aa, Homo sapiens
  heavy chain complementarity determining region 3 for antibody 36089
ARDYSMPFDY

SEQ ID NO: 72179 - protein, 10 aa, Homo sapiens
  light chain complementarity determining region 3 for antibody 36090
QQRSDWPPLH

SEQ ID NO: 72180 - protein, 10 aa, Homo sapiens
  heavy chain complementarity determining region 3 for antibody 36090
ARDYSMTFDY

SEQ ID NO: 72181 - protein, 10 aa, Homo sapiens
  light chain complementarity determining region 3 for antibody 36091
QQRSDWPPHT

SEQ ID NO: 72182 - protein, 18 aa, Homo sapiens
  heavy chain complementarity determining region 3 for antibody 36091
AREGRSGYRIPAAYGMDV

SEQ ID NO: 72183 - protein, 9 aa, Homo sapiens
  light chain complementarity determining region 3 for antibody 36092
QQRRDWRVP

SEQ ID NO: 72184 - protein, 17 aa, Homo sapiens
  heavy chain complementarity determining region 3 for antibody 36092
AKPINIYDRSGSYSFDY

SEQ ID NO: 72185 - protein, 9 aa, Homo sapiens
  light chain complementarity determining region 3 for antibody 36093
QQRNNWPST

SEQ ID NO: 72186 - protein, 15 aa, Homo sapiens
  heavy chain complementarity determining region 3 for antibody 36093
AREVAGYSSGWLFDF

SEQ ID NO: 72187 - protein, 9 aa, Homo sapiens
  light chain complementarity determining region 3 for antibody 36094
QQRNNWPSP

SEQ ID NO: 72188 - protein, 15 aa, Homo sapiens
  heavy chain complementarity determining region 3 for antibody 36094
AREFAGYSSGWLFDF

SEQ ID NO: 72189 - protein, 8 aa, Homo sapiens
  light chain complementarity determining region 3 for antibody 36095
QQRIGTRT

SEQ ID NO: 72190 - protein, 14 aa, Homo sapiens
  heavy chain complementarity determining region 3 for antibody 36095
AREADTGYGYYCDL

SEQ ID NO: 72191 - protein, 10 aa, Homo sapiens
  light chain complementarity determining region 3 for antibody 36096
QQRHNNTPYT

SEQ ID NO: 72192 - protein, 21 aa, Homo sapiens
  heavy chain complementarity determining region 3 for antibody 36096
ARTGRHYSDSTVYYYRPRIDY

SEQ ID NO: 72193 - protein, 10 aa, Homo sapiens
  light chain complementarity determining region 3 for antibody 36097
QQRGTWPPLT

SEQ ID NO: 72194 - protein, 10 aa, Homo sapiens
  heavy chain complementarity determining region 3 for antibody 36097
ARGYGDYFDH

SEQ ID NO: 72195 - protein, 9 aa, Homo sapiens
  light chain complementarity determining region 3 for antibody 36098
QQRGSWPYT

SEQ ID NO: 72196 - protein, 11 aa, Homo sapiens
  heavy chain complementarity determining region 3 for antibody 36098
VKRWGGSSIDY

SEQ ID NO: 72197 - protein, 11 aa, Homo sapiens
  light chain complementarity determining region 3 for antibody 36099
QQRGNWPPSVT

SEQ ID NO: 72198 - protein, 15 aa, Homo sapiens
  heavy chain complementarity determining region 3 for antibody 36099
ARDRDGMYSAHAFDI

SEQ ID NO: 72199 - protein, 9 aa, Homo sapiens
  light chain complementarity determining region 3 for antibody 36100
QQRGNWPLT

SEQ ID NO: 72200 - protein, 15 aa, Homo sapiens
  heavy chain complementarity determining region 3 for antibody 36100
ARDQYRIGESNYFDF

SEQ ID NO: 72201 - protein, 10 aa, Homo sapiens
  light chain complementarity determining region 3 for antibody 36101
QQRGIWPDMS

SEQ ID NO: 72202 - protein, 14 aa, Homo sapiens
  heavy chain complementarity determining region 3 for antibody 36101
AKDHDSNISGFGDL

SEQ ID NO: 72203 - protein, 10 aa, Homo sapiens
  light chain complementarity determining region 3 for antibody 36102
QQRFTTPTWT

SEQ ID NO: 72204 - protein, 19 aa, Homo sapiens
  heavy chain complementarity determining region 3 for antibody 36102
ARQGDDVVVLAASPSSFDV

SEQ ID NO: 72205 - protein, 9 aa, Homo sapiens
  light chain complementarity determining region 3 for antibody 36103
QQRFNWPLT

SEQ ID NO: 72206 - protein, 11 aa, Homo sapiens
  heavy chain complementarity determining region 3 for antibody 36103
ARNILGGHTDF

SEQ ID NO: 72207 - protein, 9 aa, Homo sapiens
  light chain complementarity determining region 3 for antibody 36104
QQRFNTPRT

SEQ ID NO: 72208 - protein, 14 aa, Homo sapiens
  heavy chain complementarity determining region 3 for antibody 36104
ARDWGVGAGAFLDL

SEQ ID NO: 72209 - protein, 9 aa, Homo sapiens
  light chain complementarity determining region 3 for antibody 36105
QQRFDWPPT

SEQ ID NO: 72210 - protein, 12 aa, Homo sapiens
  heavy chain complementarity determining region 3 for antibody 36105
ARDLYDNNQSDY

SEQ ID NO: 72211 - protein, 9 aa, Homo sapiens
  light chain complementarity determining region 3 for antibody 36106
QQRDSTPIT

SEQ ID NO: 72212 - protein, 16 aa, Homo sapiens
  heavy chain complementarity determining region 3 for antibody 36106
SRGAYYSSSWYGWFDP

SEQ ID NO: 72213 - protein, 8 aa, Homo sapiens
  light chain complementarity determining region 3 for antibody 36107
QQRDDWFT

SEQ ID NO: 72214 - protein, 14 aa, Homo sapiens
  heavy chain complementarity determining region 3 for antibody 36107
ARETSNYGGYVLHF

SEQ ID NO: 72215 - protein, 9 aa, Homo sapiens
  light chain complementarity determining region 3 for antibody 36108
QQRCSWPYT

SEQ ID NO: 72216 - protein, 11 aa, Homo sapiens
  heavy chain complementarity determining region 3 for antibody 36108
VKRWGGSSIDY

SEQ ID NO: 72217 - protein, 10 aa, Homo sapiens
  light chain complementarity determining region 3 for antibody 36109
QQRCKWPPYT

SEQ ID NO: 72218 - protein, 11 aa, Homo sapiens
  heavy chain complementarity determining region 3 for antibody 36109
ARGVGSYVFES

SEQ ID NO: 72219 - protein, 11 aa, Homo sapiens
  light chain complementarity determining region 3 for antibody 36110
QQRASWPPGVP

SEQ ID NO: 72220 - protein, 18 aa, Homo sapiens
  heavy chain complementarity determining region 3 for antibody 36110
ARVYCSGGSCYSGDFFDI

SEQ ID NO: 72221 - protein, 8 aa, Homo sapiens
  light chain complementarity determining region 3 for antibody 36111
QQQVSSVS

SEQ ID NO: 72222 - protein, 13 aa, Homo sapiens
  heavy chain complementarity determining region 3 for antibody 36111
VRTWFGELSHFDY

SEQ ID NO: 72223 - protein, 9 aa, Homo sapiens
  light chain complementarity determining region 3 for antibody 36112
QQPYSMPLT

SEQ ID NO: 72224 - protein, 14 aa, Homo sapiens
  heavy chain complementarity determining region 3 for antibody 36112
ARGRDTSGYSGLDY

SEQ ID NO: 72225 - protein, 9 aa, Homo sapiens
  light chain complementarity determining region 3 for antibody 36113
QQPHSYPLT

SEQ ID NO: 72226 - protein, 20 aa, Homo sapiens
  heavy chain complementarity determining region 3 for antibody 36113
AHRRVRDTARGNYYSYGTDV

SEQ ID NO: 72227 - protein, 10 aa, Homo sapiens
  light chain complementarity determining region 3 for antibody 36114
QQNVNFVAYT

SEQ ID NO: 72228 - protein, 12 aa, Homo sapiens
  heavy chain complementarity determining region 3 for antibody 36114
AREMTNLGEFDY

SEQ ID NO: 72229 - protein, 10 aa, Homo sapiens
  light chain complementarity determining region 3 for antibody 36115
QQNVNFVAYI

SEQ ID NO: 72230 - protein, 12 aa, Homo sapiens
  heavy chain complementarity determining region 3 for antibody 36115
AREMTNLGELDY

SEQ ID NO: 72231 - protein, 9 aa, Homo sapiens
  light chain complementarity determining region 3 for antibody 36116
QQNNSFPWT

SEQ ID NO: 72232 - protein, 18 aa, Homo sapiens
  heavy chain complementarity determining region 3 for antibody 36116
ARQYSSKWTDDYYYGMDV

SEQ ID NO: 72233 - protein, 8 aa, Homo sapiens
  light chain complementarity determining region 3 for antibody 36117
QQNNNWPT

SEQ ID NO: 72234 - protein, 12 aa, Homo sapiens
  heavy chain complementarity determining region 3 for antibody 36117
AKPLPASAYFDS

SEQ ID NO: 72235 - protein, 9 aa, Homo sapiens
  light chain complementarity determining region 3 for antibody 36118
QQNNGSSRT

SEQ ID NO: 72236 - protein, 18 aa, Homo sapiens
  heavy chain complementarity determining region 3 for antibody 36118
ARDFGGRAYTKVENAFDI

SEQ ID NO: 72237 - protein, 8 aa, Homo sapiens
  light chain complementarity determining region 3 for antibody 36119
QQNLLYWT

SEQ ID NO: 72238 - protein, 19 aa, Homo sapiens
  heavy chain complementarity determining region 3 for antibody 36119
AKEGLSYDIDDSKRGYFDS

SEQ ID NO: 72239 - protein, 9 aa, Homo sapiens
  light chain complementarity determining region 3 for antibody 36120
QQNKKWPLT

SEQ ID NO: 72240 - protein, 17 aa, Homo sapiens
  heavy chain complementarity determining region 3 for antibody 36120
TRDMRFSDYTLGYGMDV

SEQ ID NO: 72241 - protein, 9 aa, Homo sapiens
  light chain complementarity determining region 3 for antibody 36121
QQNGTSPLT

SEQ ID NO: 72242 - protein, 14 aa, Homo sapiens
  heavy chain complementarity determining region 3 for antibody 36121
ARDMFRGVPDYLDY

SEQ ID NO: 72243 - protein, 10 aa, Homo sapiens
  light chain complementarity determining region 3 for antibody 36122
QQNGSSSMYT

SEQ ID NO: 72244 - protein, 19 aa, Homo sapiens
  heavy chain complementarity determining region 3 for antibody 36122
AKDQLMFYYDNSGYPGADY

SEQ ID NO: 72245 - protein, 9 aa, Homo sapiens
  light chain complementarity determining region 3 for antibody 36123
QQNGSSPYT

SEQ ID NO: 72246 - protein, 15 aa, Homo sapiens
  heavy chain complementarity determining region 3 for antibody 36123
AKYRGIHYNVYHFDN

SEQ ID NO: 72247 - protein, 9 aa, Homo sapiens
  light chain complementarity determining region 3 for antibody 36124
QQNGSSPRT

SEQ ID NO: 72248 - protein, 19 aa, Homo sapiens
  heavy chain complementarity determining region 3 for antibody 36124
ARDLSGRGDGYSNGWYPHI

SEQ ID NO: 72249 - protein, 10 aa, Homo sapiens
  light chain complementarity determining region 3 for antibody 36125
QQNGSSPMYS

SEQ ID NO: 72250 - protein, 11 aa, Homo sapiens
  heavy chain complementarity determining region 3 for antibody 36125
ARGGQWGSLDY

SEQ ID NO: 72251 - protein, 10 aa, Homo sapiens
  light chain complementarity determining region 3 for antibody 36126
QQNGSSPLNT

SEQ ID NO: 72252 - protein, 12 aa, Homo sapiens
  heavy chain complementarity determining region 3 for antibody 36126
ARHKRGTNAFDI

SEQ ID NO: 72253 - protein, 9 aa, Homo sapiens
  light chain complementarity determining region 3 for antibody 36127
QQNGRSSLT

SEQ ID NO: 72254 - protein, 19 aa, Homo sapiens
  heavy chain complementarity determining region 3 for antibody 36127
ARDRIVVGATFYSYSGMDV

SEQ ID NO: 72255 - protein, 9 aa, Homo sapiens
  light chain complementarity determining region 3 for antibody 36128
QQNGRSPRT

SEQ ID NO: 72256 - protein, 15 aa, Homo sapiens
  heavy chain complementarity determining region 3 for antibody 36128
AKDGPYCGGDCYFDS

SEQ ID NO: 72257 - protein, 9 aa, Homo sapiens
  light chain complementarity determining region 3 for antibody 36129
QQNGGSPRT

SEQ ID NO: 72258 - protein, 13 aa, Homo sapiens
  heavy chain complementarity determining region 3 for antibody 36129
ASGYFDSGAYYEF

SEQ ID NO: 72259 - protein, 9 aa, Homo sapiens
  light chain complementarity determining region 3 for antibody 36130
QQNDSSSYT

SEQ ID NO: 72260 - protein, 11 aa, Homo sapiens
  heavy chain complementarity determining region 3 for antibody 36130
ARGGFYGSFDY

SEQ ID NO: 72261 - protein, 8 aa, Homo sapiens
  light chain complementarity determining region 3 for antibody 36131
QQNDSLIT

SEQ ID NO: 72262 - protein, 19 aa, Homo sapiens
  heavy chain complementarity determining region 3 for antibody 36131
ARHGKNAYSSGSRWGAFDI

SEQ ID NO: 72263 - protein, 9 aa, Homo sapiens
  light chain complementarity determining region 3 for antibody 36132
QQNDRLPPT

SEQ ID NO: 72264 - protein, 16 aa, Homo sapiens
  heavy chain complementarity determining region 3 for antibody 36132
ARLSFRRHDGSGSFGH

SEQ ID NO: 72265 - protein, 9 aa, Homo sapiens
  light chain complementarity determining region 3 for antibody 36133
QQNDIFPLT

SEQ ID NO: 72266 - protein, 12 aa, Homo sapiens
  heavy chain complementarity determining region 3 for antibody 36133
TTDRSYGYYFPY

SEQ ID NO: 72267 - protein, 9 aa, Homo sapiens
  light chain complementarity determining region 3 for antibody 36134
QQNATSLGT

SEQ ID NO: 72268 - protein, 15 aa, Homo sapiens
  heavy chain complementarity determining region 3 for antibody 36134
ARQKVRGRMRDHFDM

SEQ ID NO: 72269 - protein, 8 aa, Homo sapiens
  light chain complementarity determining region 3 for antibody 36135
QQNASSHT

SEQ ID NO: 72270 - protein, 17 aa, Homo sapiens
  heavy chain complementarity determining region 3 for antibody 36135
ATVKSDYGMGTLGRLDD

SEQ ID NO: 72271 - protein, 9 aa, Homo sapiens
  light chain complementarity determining region 3 for antibody 36136
QQLSNYPPT

SEQ ID NO: 72272 - protein, 26 aa, Homo sapiens
  heavy chain complementarity determining region 3 for antibody 36136
ARGSRGYKDENSSLRRLQYYQYGMDV

SEQ ID NO: 72273 - protein, 10 aa, Homo sapiens
  light chain complementarity determining region 3 for antibody 36137
QQLSNYPPLT

SEQ ID NO: 72274 - protein, 15 aa, Homo sapiens
  heavy chain complementarity determining region 3 for antibody 36137
ARDEGGGNRYWYFDL

SEQ ID NO: 72275 - protein, 9 aa, Homo sapiens
  light chain complementarity determining region 3 for antibody 36138
QQLNTYPPP

SEQ ID NO: 72276 - protein, 16 aa, Homo sapiens
  heavy chain complementarity determining region 3 for antibody 36138
ARVRSALQVYFNPLGY

SEQ ID NO: 72277 - protein, 9 aa, Homo sapiens
  light chain complementarity determining region 3 for antibody 36139
QQLNTYPLT

SEQ ID NO: 72278 - protein, 16 aa, Homo sapiens
  heavy chain complementarity determining region 3 for antibody 36139
ARGDKRSSWPTEKLDY

SEQ ID NO: 72279 - protein, 9 aa, Homo sapiens
  light chain complementarity determining region 3 for antibody 36140
QQLNSYPRT

SEQ ID NO: 72280 - protein, 10 aa, Homo sapiens
  heavy chain complementarity determining region 3 for antibody 36140
ALDSGGLSRY

SEQ ID NO: 72281 - protein, 9 aa, Homo sapiens
  light chain complementarity determining region 3 for antibody 36141
QQLNSYPPT

SEQ ID NO: 72282 - protein, 14 aa, Homo sapiens
  heavy chain complementarity determining region 3 for antibody 36141
ARENSVAAARAYDY

SEQ ID NO: 72283 - protein, 10 aa, Homo sapiens
  light chain complementarity determining region 3 for antibody 36142
QQLNSYLPFP

SEQ ID NO: 72284 - protein, 17 aa, Homo sapiens
  heavy chain complementarity determining region 3 for antibody 36142
ATEGKHDSSGYYEPFDY

SEQ ID NO: 72285 - protein, 9 aa, Homo sapiens
  light chain complementarity determining region 3 for antibody 36143
QQLKSYPPP

SEQ ID NO: 72286 - protein, 14 aa, Homo sapiens
  heavy chain complementarity determining region 3 for antibody 36143
ARENSVAAARAYDY

SEQ ID NO: 72287 - protein, 9 aa, Homo sapiens
  light chain complementarity determining region 3 for antibody 36144
QQIYTSPYT

SEQ ID NO: 72288 - protein, 16 aa, Homo sapiens
  heavy chain complementarity determining region 3 for antibody 36144
ATDWGSGTQWIRAFDV

SEQ ID NO: 72289 - protein, 8 aa, Homo sapiens
  light chain complementarity determining region 3 for antibody 36145
QQHVSSVS

SEQ ID NO: 72290 - protein, 13 aa, Homo sapiens
  heavy chain complementarity determining region 3 for antibody 36145
VRAWFGELSHFDY

SEQ ID NO: 72291 - protein, 9 aa, Homo sapiens
  light chain complementarity determining region 3 for antibody 36146
QQHTTYPFT

SEQ ID NO: 72292 - protein, 14 aa, Homo sapiens
  heavy chain complementarity determining region 3 for antibody 36146
ARGGPIRLHSYFHH

SEQ ID NO: 72293 - protein, 9 aa, Homo sapiens
  light chain complementarity determining region 3 for antibody 36147
QQHNRWPAT

SEQ ID NO: 72294 - protein, 20 aa, Homo sapiens
  heavy chain complementarity determining region 3 for antibody 36147
ARDPREYYDLRNYYVYYFDS

SEQ ID NO: 72295 - protein, 10 aa, Homo sapiens
  light chain complementarity determining region 3 for antibody 36148
QQHNNRPPWT

SEQ ID NO: 72296 - protein, 17 aa, Homo sapiens
  heavy chain complementarity determining region 3 for antibody 36148
ATRTRQLGEDTYWYFDL

SEQ ID NO: 72297 - protein, 9 aa, Homo sapiens
  light chain complementarity determining region 3 for antibody 36149
QQHNFYPLT

SEQ ID NO: 72298 - protein, 11 aa, Homo sapiens
  heavy chain complementarity determining region 3 for antibody 36149
ARGGSRREIDY

SEQ ID NO: 72299 - protein, 9 aa, Homo sapiens
  light chain complementarity determining region 3 for antibody 36150
QQHHALPLT

SEQ ID NO: 72300 - protein, 13 aa, Homo sapiens
  heavy chain complementarity determining region 3 for antibody 36150
ARDGVPGKFNRAH

SEQ ID NO: 72301 - protein, 9 aa, Homo sapiens
  light chain complementarity determining region 3 for antibody 36151
QQHGTSPLN

SEQ ID NO: 72302 - protein, 13 aa, Homo sapiens
  heavy chain complementarity determining region 3 for antibody 36151
ASISVGTVAAGKG

SEQ ID NO: 72303 - protein, 9 aa, Homo sapiens
  light chain complementarity determining region 3 for antibody 36152
QQHGTSPFT

SEQ ID NO: 72304 - protein, 14 aa, Homo sapiens
  heavy chain complementarity determining region 3 for antibody 36152
ARGGPAATSSSWLY

SEQ ID NO: 72305 - protein, 9 aa, Homo sapiens
  light chain complementarity determining region 3 for antibody 36153
QQHGSSPWT

SEQ ID NO: 72306 - protein, 14 aa, Homo sapiens
  heavy chain complementarity determining region 3 for antibody 36153
ARGGQSYPNGYFDL

SEQ ID NO: 72307 - protein, 9 aa, Homo sapiens
  light chain complementarity determining region 3 for antibody 36154
QQHGSSPRT

SEQ ID NO: 72308 - protein, 19 aa, Homo sapiens
  heavy chain complementarity determining region 3 for antibody 36154
AKEHSPFSLIAVEGFDFDY

SEQ ID NO: 72309 - protein, 9 aa, Homo sapiens
  light chain complementarity determining region 3 for antibody 36155
QQHGRSSLT

SEQ ID NO: 72310 - protein, 19 aa, Homo sapiens
  heavy chain complementarity determining region 3 for antibody 36155
ARDRIVVGATFYSYSGMDV

SEQ ID NO: 72311 - protein, 9 aa, Homo sapiens
  light chain complementarity determining region 3 for antibody 36156
QQHGNLPRT

SEQ ID NO: 72312 - protein, 13 aa, Homo sapiens
  heavy chain complementarity determining region 3 for antibody 36156
AGGNFHSGGYGEY

SEQ ID NO: 72313 - protein, 9 aa, Homo sapiens
  light chain complementarity determining region 3 for antibody 36157
QQHGGSSRT

SEQ ID NO: 72314 - protein, 11 aa, Homo sapiens
  heavy chain complementarity determining region 3 for antibody 36157
ARGRWAGAFDI

SEQ ID NO: 72315 - protein, 8 aa, Homo sapiens
  light chain complementarity determining region 3 for antibody 36158
QQHGGSPS

SEQ ID NO: 72316 - protein, 16 aa, Homo sapiens
  heavy chain complementarity determining region 3 for antibody 36158
ASDWGSGTQWIRAFDV

SEQ ID NO: 72317 - protein, 9 aa, Homo sapiens
  light chain complementarity determining region 3 for antibody 36159
QQHFTPPPT

SEQ ID NO: 72318 - protein, 18 aa, Homo sapiens
  heavy chain complementarity determining region 3 for antibody 36159
ARMRVSMVRGVISAWFDS

SEQ ID NO: 72319 - protein, 9 aa, Homo sapiens
  light chain complementarity determining region 3 for antibody 36160
QQHDTYPWT

SEQ ID NO: 72320 - protein, 16 aa, Homo sapiens
  heavy chain complementarity determining region 3 for antibody 36160
ARAANSAPYNNYYFDY

SEQ ID NO: 72321 - protein, 9 aa, Homo sapiens
  light chain complementarity determining region 3 for antibody 36161
QQHDTYPGT

SEQ ID NO: 72322 - protein, 16 aa, Homo sapiens
  heavy chain complementarity determining region 3 for antibody 36161
ARAANSAPYNNYYFDY

SEQ ID NO: 72323 - protein, 9 aa, Homo sapiens
  light chain complementarity determining region 3 for antibody 36162
QQGYSTPFI

SEQ ID NO: 72324 - protein, 15 aa, Homo sapiens
  heavy chain complementarity determining region 3 for antibody 36162
ARAQVIWGQLYYFDS

SEQ ID NO: 72325 - protein, 9 aa, Homo sapiens
  light chain complementarity determining region 3 for antibody 36163
QQGYSSPYT

SEQ ID NO: 72326 - protein, 28 aa, Homo sapiens
  heavy chain complementarity determining region 3 for antibody 36163
ARVLRHSNHDFWSGNDPQRKYHYYGMDV

SEQ ID NO: 72327 - protein, 9 aa, Homo sapiens
  light chain complementarity determining region 3 for antibody 36164
QQGYSSPLL

SEQ ID NO: 72328 - protein, 15 aa, Homo sapiens
  heavy chain complementarity determining region 3 for antibody 36164
ARAQVIWGQLYYFDY

SEQ ID NO: 72329 - protein, 9 aa, Homo sapiens
  light chain complementarity determining region 3 for antibody 36165
QQGYSPPLI

SEQ ID NO: 72330 - protein, 15 aa, Homo sapiens
  heavy chain complementarity determining region 3 for antibody 36165
ARAQVIWGQLYYFDS

SEQ ID NO: 72331 - protein, 9 aa, Homo sapiens
  light chain complementarity determining region 3 for antibody 36166
QQGYSPPFT

SEQ ID NO: 72332 - protein, 15 aa, Homo sapiens
  heavy chain complementarity determining region 3 for antibody 36166
AKAQVIWGQLYYFDS

SEQ ID NO: 72333 - protein, 9 aa, Homo sapiens
  light chain complementarity determining region 3 for antibody 36167
QQGYSPPFI

SEQ ID NO: 72334 - protein, 15 aa, Homo sapiens
  heavy chain complementarity determining region 3 for antibody 36167
ARAQVIWGQLYSFDS

SEQ ID NO: 72335 - protein, 9 aa, Homo sapiens
  light chain complementarity determining region 3 for antibody 36168
QQGYSPPFI

SEQ ID NO: 72336 - protein, 15 aa, Homo sapiens
  heavy chain complementarity determining region 3 for antibody 36168
ARAQVIWGQLCYFDS

SEQ ID NO: 72337 - protein, 9 aa, Homo sapiens
  light chain complementarity determining region 3 for antibody 36169
QQGYRPPFL

SEQ ID NO: 72338 - protein, 15 aa, Homo sapiens
  heavy chain complementarity determining region 3 for antibody 36169
TRAQVIWGQLYYFDY

SEQ ID NO: 72339 - protein, 9 aa, Homo sapiens
  light chain complementarity determining region 3 for antibody 36170
QQGYRPPFI

SEQ ID NO: 72340 - protein, 15 aa, Homo sapiens
  heavy chain complementarity determining region 3 for antibody 36170
TRAQVMWGQLYYFDY

SEQ ID NO: 72341 - protein, 9 aa, Homo sapiens
  light chain complementarity determining region 3 for antibody 36171
QQGYDTPRP

SEQ ID NO: 72342 - protein, 12 aa, Homo sapiens
  heavy chain complementarity determining region 3 for antibody 36171
ASGGSRVTTLRY

SEQ ID NO: 72343 - protein, 9 aa, Homo sapiens
  light chain complementarity determining region 3 for antibody 36172
QQGYDNPLT

SEQ ID NO: 72344 - protein, 15 aa, Homo sapiens
  heavy chain complementarity determining region 3 for antibody 36172
ARAQVIWGQLYYFDS

SEQ ID NO: 72345 - protein, 9 aa, Homo sapiens
  light chain complementarity determining region 3 for antibody 36173
QQGSNWPGT

SEQ ID NO: 72346 - protein, 9 aa, Homo sapiens
  heavy chain complementarity determining region 3 for antibody 36173
ARVLVTEGG

SEQ ID NO: 72347 - protein, 9 aa, Homo sapiens
  light chain complementarity determining region 3 for antibody 36174
QQGSHSPLT

SEQ ID NO: 72348 - protein, 10 aa, Homo sapiens
  heavy chain complementarity determining region 3 for antibody 36174
ASGSGWLTDS

SEQ ID NO: 72349 - protein, 9 aa, Homo sapiens
  light chain complementarity determining region 3 for antibody 36175
QQGNSYSIT

SEQ ID NO: 72350 - protein, 14 aa, Homo sapiens
  heavy chain complementarity determining region 3 for antibody 36175
ATEGPSRMGKFFDS

SEQ ID NO: 72351 - protein, 9 aa, Homo sapiens
  light chain complementarity determining region 3 for antibody 36176
QQGMSFPPT

SEQ ID NO: 72352 - protein, 16 aa, Homo sapiens
  heavy chain complementarity determining region 3 for antibody 36176
ARGQSQWNDGYFGLDV

SEQ ID NO: 72353 - protein, 9 aa, Homo sapiens
  light chain complementarity determining region 3 for antibody 36177
QQGHAFPPT

SEQ ID NO: 72354 - protein, 16 aa, Homo sapiens
  heavy chain complementarity determining region 3 for antibody 36177
ASNPCVGGGCYQTFDN

SEQ ID NO: 72355 - protein, 10 aa, Homo sapiens
  light chain complementarity determining region 3 for antibody 36178
QQGGGSPLFT

SEQ ID NO: 72356 - protein, 14 aa, Homo sapiens
  heavy chain complementarity determining region 3 for antibody 36178
VRPRHVAVNWYIDS

SEQ ID NO: 72357 - protein, 9 aa, Homo sapiens
  light chain complementarity determining region 3 for antibody 36179
QQFYNNPQI

SEQ ID NO: 72358 - protein, 14 aa, Homo sapiens
  heavy chain complementarity determining region 3 for antibody 36179
ARQEYSDMWYEVDH

SEQ ID NO: 72359 - protein, 10 aa, Homo sapiens
  light chain complementarity determining region 3 for antibody 36180
QQFNNYLALT

SEQ ID NO: 72360 - protein, 10 aa, Homo sapiens
  heavy chain complementarity determining region 3 for antibody 36180
ARATARAFDI

SEQ ID NO: 72361 - protein, 10 aa, Homo sapiens
  light chain complementarity determining region 3 for antibody 36181
QQFNNSRALT

SEQ ID NO: 72362 - protein, 10 aa, Homo sapiens
  heavy chain complementarity determining region 3 for antibody 36181
ARATARAFDI

SEQ ID NO: 72363 - protein, 10 aa, Homo sapiens
  light chain complementarity determining region 3 for antibody 36182
QQFGTSSRFT

SEQ ID NO: 72364 - protein, 9 aa, Homo sapiens
  heavy chain complementarity determining region 3 for antibody 36182
ARGYQDLDY

SEQ ID NO: 72365 - protein, 9 aa, Homo sapiens
  light chain complementarity determining region 3 for antibody 36183
QQFGSLPRT

SEQ ID NO: 72366 - protein, 16 aa, Homo sapiens
  heavy chain complementarity determining region 3 for antibody 36183
AKLRRRDYSGRDAFDI

SEQ ID NO: 72367 - protein, 8 aa, Homo sapiens
  light chain complementarity determining region 3 for antibody 36184
QQFGGSPS

SEQ ID NO: 72368 - protein, 16 aa, Homo sapiens
  heavy chain complementarity determining region 3 for antibody 36184
ATDWGSGTQWIRAFDV

SEQ ID NO: 72369 - protein, 10 aa, Homo sapiens
  light chain complementarity determining region 3 for antibody 36185
QQFDSSPRWT

SEQ ID NO: 72370 - protein, 16 aa, Homo sapiens
  heavy chain complementarity determining region 3 for antibody 36185
ARDSSIVVIPGGFLDP

SEQ ID NO: 72371 - protein, 10 aa, Homo sapiens
  light chain complementarity determining region 3 for antibody 36186
QQFDSSPRWT

SEQ ID NO: 72372 - protein, 16 aa, Homo sapiens
  heavy chain complementarity determining region 3 for antibody 36186
ARDSSIVVIPGGFFDL

SEQ ID NO: 72373 - protein, 10 aa, Homo sapiens
  light chain complementarity determining region 3 for antibody 36187
QQFDSSPRWR

SEQ ID NO: 72374 - protein, 16 aa, Homo sapiens
  heavy chain complementarity determining region 3 for antibody 36187
ARDSSIVVIPGGFLDL

SEQ ID NO: 72375 - protein, 9 aa, Homo sapiens
  light chain complementarity determining region 3 for antibody 36188
QQFDRYPHT

SEQ ID NO: 72376 - protein, 19 aa, Homo sapiens
  heavy chain complementarity determining region 3 for antibody 36188
ARDSRRMVRGLIVYNWFDP

SEQ ID NO: 72377 - protein, 10 aa, Homo sapiens
  light chain complementarity determining region 3 for antibody 36189
QQFDRSPRWT

SEQ ID NO: 72378 - protein, 16 aa, Homo sapiens
  heavy chain complementarity determining region 3 for antibody 36189
ARDSSIVVIPGGFLDL

SEQ ID NO: 72379 - protein, 9 aa, Homo sapiens
  light chain complementarity determining region 3 for antibody 36190
QQFDNYPLP

SEQ ID NO: 72380 - protein, 20 aa, Homo sapiens
  heavy chain complementarity determining region 3 for antibody 36190
ARDLGRSGSIGIIRNDAFNV

SEQ ID NO: 72381 - protein, 9 aa, Homo sapiens
  light chain complementarity determining region 3 for antibody 36191
QQFDELPLT

SEQ ID NO: 72382 - protein, 9 aa, Homo sapiens
  heavy chain complementarity determining region 3 for antibody 36191
ARSTHPRGP

SEQ ID NO: 72383 - protein, 9 aa, Homo sapiens
  light chain complementarity determining region 3 for antibody 36192
QQFDDLPIT

SEQ ID NO: 72384 - protein, 9 aa, Homo sapiens
  heavy chain complementarity determining region 3 for antibody 36192
ARSTHPRGP

SEQ ID NO: 72385 - protein, 9 aa, Homo sapiens
  light chain complementarity determining region 3 for antibody 36193
QQDRSSPWT

SEQ ID NO: 72386 - protein, 22 aa, Homo sapiens
  heavy chain complementarity determining region 3 for antibody 36193
ARAVATTRWGRSGGDWGAPFDI

SEQ ID NO: 72387 - protein, 10 aa, Homo sapiens
  light chain complementarity determining region 3 for antibody 36194
QQDNSWPLYT

SEQ ID NO: 72388 - protein, 14 aa, Homo sapiens
  heavy chain complementarity determining region 3 for antibody 36194
ARSGDGINLGFFDY

SEQ ID NO: 72389 - protein, 9 aa, Homo sapiens
  light chain complementarity determining region 3 for antibody 36195
QQDNSFPWT

SEQ ID NO: 72390 - protein, 11 aa, Homo sapiens
  heavy chain complementarity determining region 3 for antibody 36195
VRRVYNDFFGD

SEQ ID NO: 72391 - protein, 10 aa, Homo sapiens
  light chain complementarity determining region 3 for antibody 36196
QQDNNWPPLT

SEQ ID NO: 72392 - protein, 15 aa, Homo sapiens
  heavy chain complementarity determining region 3 for antibody 36196
ARYYYDSSGYYVFDY

SEQ ID NO: 72393 - protein, 9 aa, Homo sapiens
  light chain complementarity determining region 3 for antibody 36197
QQDISYPFT

SEQ ID NO: 72394 - protein, 12 aa, Homo sapiens
  heavy chain complementarity determining region 3 for antibody 36197
ARPLDGDHGFDP

SEQ ID NO: 72395 - protein, 9 aa, Homo sapiens
  light chain complementarity determining region 3 for antibody 36198
QQDHSDPPT

SEQ ID NO: 72396 - protein, 10 aa, Homo sapiens
  heavy chain complementarity determining region 3 for antibody 36198
AGGTGWILDT

SEQ ID NO: 72397 - protein, 9 aa, Homo sapiens
  light chain complementarity determining region 3 for antibody 36199
QQDHALPLT

SEQ ID NO: 72398 - protein, 13 aa, Homo sapiens
  heavy chain complementarity determining region 3 for antibody 36199
ARDGVPGKFNRAH

SEQ ID NO: 72399 - protein, 6 aa, Homo sapiens
  light chain complementarity determining region 3 for antibody 36200
QQDGST

SEQ ID NO: 72400 - protein, 15 aa, Homo sapiens
  heavy chain complementarity determining region 3 for antibody 36200
ARGGLDGDYEDAFDI

SEQ ID NO: 72401 - protein, 9 aa, Homo sapiens
  light chain complementarity determining region 3 for antibody 36201
QQDGSSSWT

SEQ ID NO: 72402 - protein, 21 aa, Homo sapiens
  heavy chain complementarity determining region 3 for antibody 36201
ARDAPVSRPYSSGWYSSAFDY

SEQ ID NO: 72403 - protein, 9 aa, Homo sapiens
  light chain complementarity determining region 3 for antibody 36202
QQDGSSPWT

SEQ ID NO: 72404 - protein, 14 aa, Homo sapiens
  heavy chain complementarity determining region 3 for antibody 36202
ARGGQSYPNGYFDL

SEQ ID NO: 72405 - protein, 8 aa, Homo sapiens
  light chain complementarity determining region 3 for antibody 36203
QQDGSSPT

SEQ ID NO: 72406 - protein, 11 aa, Homo sapiens
  heavy chain complementarity determining region 3 for antibody 36203
VRNGVRGANDY

SEQ ID NO: 72407 - protein, 9 aa, Homo sapiens
  light chain complementarity determining region 3 for antibody 36204
QQDGSSPTT

SEQ ID NO: 72408 - protein, 15 aa, Homo sapiens
  heavy chain complementarity determining region 3 for antibody 36204
SRDLLWFGPTSAFDF

SEQ ID NO: 72409 - protein, 9 aa, Homo sapiens
  light chain complementarity determining region 3 for antibody 36205
QQDGSSPTT

SEQ ID NO: 72410 - protein, 17 aa, Homo sapiens
  heavy chain complementarity determining region 3 for antibody 36205
ARLGGSGWNRGHNWFDP

SEQ ID NO: 72411 - protein, 8 aa, Homo sapiens
  light chain complementarity determining region 3 for antibody 36206
QQDGSSPT

SEQ ID NO: 72412 - protein, 25 aa, Homo sapiens
  heavy chain complementarity determining region 3 for antibody 36206
AWGGYCSGGSCYSGQRAYYYYGMDV

SEQ ID NO: 72413 - protein, 9 aa, Homo sapiens
  light chain complementarity determining region 3 for antibody 36207
QQDGSSPST

SEQ ID NO: 72414 - protein, 13 aa, Homo sapiens
  heavy chain complementarity determining region 3 for antibody 36207
ARDGQWLVRYFDY

SEQ ID NO: 72415 - protein, 8 aa, Homo sapiens
  light chain complementarity determining region 3 for antibody 36208
QQDGSSPS

SEQ ID NO: 72416 - protein, 17 aa, Homo sapiens
  heavy chain complementarity determining region 3 for antibody 36208
ARGTGFCSSPTCYGLHY

SEQ ID NO: 72417 - protein, 9 aa, Homo sapiens
  light chain complementarity determining region 3 for antibody 36209
QQDGSSPRT

SEQ ID NO: 72418 - protein, 16 aa, Homo sapiens
  heavy chain complementarity determining region 3 for antibody 36209
ATSPGIREASGYYFDY

SEQ ID NO: 72419 - protein, 9 aa, Homo sapiens
  light chain complementarity determining region 3 for antibody 36210
QQDGSSPRT

SEQ ID NO: 72420 - protein, 9 aa, Homo sapiens
  heavy chain complementarity determining region 3 for antibody 36210
ARRSYGRDY

SEQ ID NO: 72421 - protein, 9 aa, Homo sapiens
  light chain complementarity determining region 3 for antibody 36211
QQDGSSPRT

SEQ ID NO: 72422 - protein, 19 aa, Homo sapiens
  heavy chain complementarity determining region 3 for antibody 36211
AKEHSPFSLIAVEGFDFDY

SEQ ID NO: 72423 - protein, 10 aa, Homo sapiens
  light chain complementarity determining region 3 for antibody 36212
QQDGSSPPWT

SEQ ID NO: 72424 - protein, 16 aa, Homo sapiens
  heavy chain complementarity determining region 3 for antibody 36212
ARVQWVRGVLRGGLDY

SEQ ID NO: 72425 - protein, 10 aa, Homo sapiens
  light chain complementarity determining region 3 for antibody 36213
QQDGSSPPWT

SEQ ID NO: 72426 - protein, 13 aa, Homo sapiens
  heavy chain complementarity determining region 3 for antibody 36213
ARSGGSYYYAFDI

SEQ ID NO: 72427 - protein, 10 aa, Homo sapiens
  light chain complementarity determining region 3 for antibody 36214
QQDGSSPPLT

SEQ ID NO: 72428 - protein, 12 aa, Homo sapiens
  heavy chain complementarity determining region 3 for antibody 36214
ARLHYFDYYFDY

SEQ ID NO: 72429 - protein, 10 aa, Homo sapiens
  light chain complementarity determining region 3 for antibody 36215
QQDGSSPPFT

SEQ ID NO: 72430 - protein, 12 aa, Homo sapiens
  heavy chain complementarity determining region 3 for antibody 36215
ARERGRGFGLDI

SEQ ID NO: 72431 - protein, 9 aa, Homo sapiens
  light chain complementarity determining region 3 for antibody 36216
QQDGSSPLT

SEQ ID NO: 72432 - protein, 19 aa, Homo sapiens
  heavy chain complementarity determining region 3 for antibody 36216
ARGSSSSRRRAAVVGYFDL

SEQ ID NO: 72433 - protein, 9 aa, Homo sapiens
  light chain complementarity determining region 3 for antibody 36217
QQDGSSPGT

SEQ ID NO: 72434 - protein, 16 aa, Homo sapiens
  heavy chain complementarity determining region 3 for antibody 36217
ARVVWGGSWYVGWFDT

SEQ ID NO: 72435 - protein, 9 aa, Homo sapiens
  light chain complementarity determining region 3 for antibody 36218
QQDGSSLRT

SEQ ID NO: 72436 - protein, 21 aa, Homo sapiens
  heavy chain complementarity determining region 3 for antibody 36218
ARGPTTKYVFGSGSYGKYLDS

SEQ ID NO: 72437 - protein, 9 aa, Homo sapiens
  light chain complementarity determining region 3 for antibody 36219
QQDGRIPRT

SEQ ID NO: 72438 - protein, 13 aa, Homo sapiens
  heavy chain complementarity determining region 3 for antibody 36219
AGGLYDSSGYSEF

SEQ ID NO: 72439 - protein, 9 aa, Homo sapiens
  light chain complementarity determining region 3 for antibody 36220
QQDGNSPRT

SEQ ID NO: 72440 - protein, 15 aa, Homo sapiens
  heavy chain complementarity determining region 3 for antibody 36220
ARGNYYGSGSYYRED

SEQ ID NO: 72441 - protein, 9 aa, Homo sapiens
  light chain complementarity determining region 3 for antibody 36221
QQDGNLPRT

SEQ ID NO: 72442 - protein, 13 aa, Homo sapiens
  heavy chain complementarity determining region 3 for antibody 36221
AGGQFHSSGYSEF

SEQ ID NO: 72443 - protein, 9 aa, Homo sapiens
  light chain complementarity determining region 3 for antibody 36222
QQDGNLPRT

SEQ ID NO: 72444 - protein, 13 aa, Homo sapiens
  heavy chain complementarity determining region 3 for antibody 36222
AGGDFHRGGYSEF

SEQ ID NO: 72445 - protein, 10 aa, Homo sapiens
  light chain complementarity determining region 3 for antibody 36223
QQDGISPKWT

SEQ ID NO: 72446 - protein, 17 aa, Homo sapiens
  heavy chain complementarity determining region 3 for antibody 36223
ARDPCKKATDVVCAWDS

SEQ ID NO: 72447 - protein, 9 aa, Homo sapiens
  light chain complementarity determining region 3 for antibody 36224
QQDGGSQGT

SEQ ID NO: 72448 - protein, 13 aa, Homo sapiens
  heavy chain complementarity determining region 3 for antibody 36224
TKEIPEAGHPGGS

SEQ ID NO: 72449 - protein, 10 aa, Homo sapiens
  light chain complementarity determining region 3 for antibody 36225
QQDGGSPSFT

SEQ ID NO: 72450 - protein, 14 aa, Homo sapiens
  heavy chain complementarity determining region 3 for antibody 36225
ARRDYIGTLHYFDP

SEQ ID NO: 72451 - protein, 9 aa, Homo sapiens
  light chain complementarity determining region 3 for antibody 36226
QQDGDSPLT

SEQ ID NO: 72452 - protein, 15 aa, Homo sapiens
  heavy chain complementarity determining region 3 for antibody 36226
AKGRRGSYSHDAFDV

SEQ ID NO: 72453 - protein, 9 aa, Homo sapiens
  light chain complementarity determining region 3 for antibody 36227
QQDDSLPIT

SEQ ID NO: 72454 - protein, 20 aa, Homo sapiens
  heavy chain complementarity determining region 3 for antibody 36227
VRGPHIVVLTSVPWRWSFGL

SEQ ID NO: 72455 - protein, 9 aa, Homo sapiens
  light chain complementarity determining region 3 for antibody 36228
QQDAYSPIT

SEQ ID NO: 72456 - protein, 10 aa, Homo sapiens
  heavy chain complementarity determining region 3 for antibody 36228
ATGAGWLVDY

SEQ ID NO: 72457 - protein, 9 aa, Homo sapiens
  light chain complementarity determining region 3 for antibody 36229
QQDASSPFT

SEQ ID NO: 72458 - protein, 18 aa, Homo sapiens
  heavy chain complementarity determining region 3 for antibody 36229
AARGANCGGDCYYWYFDL

SEQ ID NO: 72459 - protein, 8 aa, Homo sapiens
  light chain complementarity determining region 3 for antibody 36230
QQDASSHT

SEQ ID NO: 72460 - protein, 17 aa, Homo sapiens
  heavy chain complementarity determining region 3 for antibody 36230
ATVKSDYGMGTLGRLDD

SEQ ID NO: 72461 - protein, 9 aa, Homo sapiens
  light chain complementarity determining region 3 for antibody 36231
QQDAGSPGT

SEQ ID NO: 72462 - protein, 8 aa, Homo sapiens
  heavy chain complementarity determining region 3 for antibody 36231
ARGLSLDS

SEQ ID NO: 72463 - protein, 9 aa, Homo sapiens
  light chain complementarity determining region 3 for antibody 36232
QQCYSTPFT

SEQ ID NO: 72464 - protein, 14 aa, Homo sapiens
  heavy chain complementarity determining region 3 for antibody 36232
ARLVDWDGPKYFDY

SEQ ID NO: 72465 - protein, 9 aa, Homo sapiens
  light chain complementarity determining region 3 for antibody 36233
QQCYRTPFT

SEQ ID NO: 72466 - protein, 14 aa, Homo sapiens
  heavy chain complementarity determining region 3 for antibody 36233
ARTVDWDGPKYFDS

SEQ ID NO: 72467 - protein, 10 aa, Homo sapiens
  light chain complementarity determining region 3 for antibody 36234
QQCYKWPPYT

SEQ ID NO: 72468 - protein, 11 aa, Homo sapiens
  heavy chain complementarity determining region 3 for antibody 36234
ARGVGSYVFES

SEQ ID NO: 72469 - protein, 9 aa, Homo sapiens
  light chain complementarity determining region 3 for antibody 36235
QQCSHSPLP

SEQ ID NO: 72470 - protein, 10 aa, Homo sapiens
  heavy chain complementarity determining region 3 for antibody 36235
ASGSGWLTDS

SEQ ID NO: 72471 - protein, 9 aa, Homo sapiens
  light chain complementarity determining region 3 for antibody 36236
QQCAVSPLP

SEQ ID NO: 72472 - protein, 10 aa, Homo sapiens
  heavy chain complementarity determining region 3 for antibody 36236
SSGSGWTSED

SEQ ID NO: 72473 - protein, 9 aa, Homo sapiens
  light chain complementarity determining region 3 for antibody 36237
QQAYSFPYT

SEQ ID NO: 72474 - protein, 14 aa, Homo sapiens
  heavy chain complementarity determining region 3 for antibody 36237
ARDPQRGRPDYFDY

SEQ ID NO: 72475 - protein, 10 aa, Homo sapiens
  light chain complementarity determining region 3 for antibody 36238
QQANSVLSVR

SEQ ID NO: 72476 - protein, 12 aa, Homo sapiens
  heavy chain complementarity determining region 3 for antibody 36238
ARRKLRMRSFDV

SEQ ID NO: 72477 - protein, 10 aa, Homo sapiens
  light chain complementarity determining region 3 for antibody 36239
QQANSFPPFP

SEQ ID NO: 72478 - protein, 12 aa, Homo sapiens
  heavy chain complementarity determining region 3 for antibody 36239
ARDYDEVGAFNY

SEQ ID NO: 72479 - protein, 9 aa, Homo sapiens
  light chain complementarity determining region 3 for antibody 36240
QQANSFPLT

SEQ ID NO: 72480 - protein, 14 aa, Homo sapiens
  heavy chain complementarity determining region 3 for antibody 36240
ARDYRDRNGYYFNH

SEQ ID NO: 72481 - protein, 9 aa, Homo sapiens
  light chain complementarity determining region 3 for antibody 36241
QQANSFPLT

SEQ ID NO: 72482 - protein, 17 aa, Homo sapiens
  heavy chain complementarity determining region 3 for antibody 36241
AKARGLFIAEAGTPSDS

SEQ ID NO: 72483 - protein, 9 aa, Homo sapiens
  light chain complementarity determining region 3 for antibody 36242
QQANSFLIT

SEQ ID NO: 72484 - protein, 10 aa, Homo sapiens
  heavy chain complementarity determining region 3 for antibody 36242
ASRSVGAFDL

SEQ ID NO: 72485 - protein, 10 aa, Homo sapiens
  light chain complementarity determining region 3 for antibody 36243
QQANRVLSVS

SEQ ID NO: 72486 - protein, 12 aa, Homo sapiens
  heavy chain complementarity determining region 3 for antibody 36243
ARRKLRMRSFDV

SEQ ID NO: 72487 - protein, 9 aa, Homo sapiens
  light chain complementarity determining region 3 for antibody 36244
QQANRFLIT

SEQ ID NO: 72488 - protein, 10 aa, Homo sapiens
  heavy chain complementarity determining region 3 for antibody 36244
ARRSVGAFDL

SEQ ID NO: 72489 - protein, 9 aa, Homo sapiens
  light chain complementarity determining region 3 for antibody 36245
QQADSFPYT

SEQ ID NO: 72490 - protein, 13 aa, Homo sapiens
  heavy chain complementarity determining region 3 for antibody 36245
ARNRVGANYGMDV

SEQ ID NO: 72491 - protein, 9 aa, Homo sapiens
  light chain complementarity determining region 3 for antibody 36246
QPYNTAPFT

SEQ ID NO: 72492 - protein, 15 aa, Homo sapiens
  heavy chain complementarity determining region 3 for antibody 36246
ARDQGPYSSDWSFDQ

SEQ ID NO: 72493 - protein, 8 aa, Homo sapiens
  light chain complementarity determining region 3 for antibody 36247
QPYGTSWT

SEQ ID NO: 72494 - protein, 21 aa, Homo sapiens
  heavy chain complementarity determining region 3 for antibody 36247
GRQRNFEGDSGFKFPEGYFDL

SEQ ID NO: 72495 - protein, 10 aa, Homo sapiens
  light chain complementarity determining region 3 for antibody 36248
QPYGSSLMYT

SEQ ID NO: 72496 - protein, 14 aa, Homo sapiens
  heavy chain complementarity determining region 3 for antibody 36248
TTDRPLTGMVTFDF

SEQ ID NO: 72497 - protein, 9 aa, Homo sapiens
  light chain complementarity determining region 3 for antibody 36249
QPYGRSPRT

SEQ ID NO: 72498 - protein, 15 aa, Homo sapiens
  heavy chain complementarity determining region 3 for antibody 36249
AKDGPYCGGDCYFDS

SEQ ID NO: 72499 - protein, 10 aa, Homo sapiens
  light chain complementarity determining region 3 for antibody 36250
QPYGNSPPFT

SEQ ID NO: 72500 - protein, 13 aa, Homo sapiens
  heavy chain complementarity determining region 3 for antibody 36250
ASWSHSDLDAFDI

SEQ ID NO: 72501 - protein, 9 aa, Homo sapiens
  light chain complementarity determining region 3 for antibody 36251
QPYAKSPWT

SEQ ID NO: 72502 - protein, 13 aa, Homo sapiens
  heavy chain complementarity determining region 3 for antibody 36251
ARDSADYGDPLDY

SEQ ID NO: 72503 - protein, 10 aa, Homo sapiens
  light chain complementarity determining region 3 for antibody 36252
QPWVSSPAYT

SEQ ID NO: 72504 - protein, 12 aa, Homo sapiens
  heavy chain complementarity determining region 3 for antibody 36252
ARETTQFGELDN

SEQ ID NO: 72505 - protein, 9 aa, Homo sapiens
  light chain complementarity determining region 3 for antibody 36253
QPSHSRPFT

SEQ ID NO: 72506 - protein, 20 aa, Homo sapiens
  heavy chain complementarity determining region 3 for antibody 36253
AKGIAVAALRTVYYYYGMDV

SEQ ID NO: 72507 - protein, 10 aa, Homo sapiens
  light chain complementarity determining region 3 for antibody 36254
QPRYNWPPYT

SEQ ID NO: 72508 - protein, 11 aa, Homo sapiens
  heavy chain complementarity determining region 3 for antibody 36254
ARGVGSYVFES

SEQ ID NO: 72509 - protein, 10 aa, Homo sapiens
  light chain complementarity determining region 3 for antibody 36255
QPRYKWPPYT

SEQ ID NO: 72510 - protein, 11 aa, Homo sapiens
  heavy chain complementarity determining region 3 for antibody 36255
ARGVGSYVFES

SEQ ID NO: 72511 - protein, 9 aa, Homo sapiens
  light chain complementarity determining region 3 for antibody 36256
QPRNIWRVT

SEQ ID NO: 72512 - protein, 7 aa, Homo sapiens
  heavy chain complementarity determining region 3 for antibody 36256
TLSSFDY

SEQ ID NO: 72513 - protein, 9 aa, Homo sapiens
  light chain complementarity determining region 3 for antibody 36257
QNYNTAPYT

SEQ ID NO: 72514 - protein, 13 aa, Homo sapiens
  heavy chain complementarity determining region 3 for antibody 36257
ARLPYWELYYDDY

SEQ ID NO: 72515 - protein, 8 aa, Homo sapiens
  light chain complementarity determining region 3 for antibody 36258
QNYGSSPL

SEQ ID NO: 72516 - protein, 14 aa, Homo sapiens
  heavy chain complementarity determining region 3 for antibody 36258
ARDMWDVGDTPPSY

SEQ ID NO: 72517 - protein, 10 aa, Homo sapiens
  light chain complementarity determining region 3 for antibody 36259
QNWVSSPAYT

SEQ ID NO: 72518 - protein, 12 aa, Homo sapiens
  heavy chain complementarity determining region 3 for antibody 36259
ARETTQFGELDN

SEQ ID NO: 72519 - protein, 9 aa, Homo sapiens
  light chain complementarity determining region 3 for antibody 36260
QNRRTWLYS

SEQ ID NO: 72520 - protein, 20 aa, Homo sapiens
  heavy chain complementarity determining region 3 for antibody 36260
ARDGSAGMAARGTPYYGLDV

SEQ ID NO: 72521 - protein, 9 aa, Homo sapiens
  light chain complementarity determining region 3 for antibody 36261
QLYGSSPYT

SEQ ID NO: 72522 - protein, 14 aa, Homo sapiens
  heavy chain complementarity determining region 3 for antibody 36261
ARVGLYSSGEIFDY

SEQ ID NO: 72523 - protein, 9 aa, Homo sapiens
  light chain complementarity determining region 3 for antibody 36262
QLYGSSPRT

SEQ ID NO: 72524 - protein, 25 aa, Homo sapiens
  heavy chain complementarity determining region 3 for antibody 36262
ARLRIDRLRLPGAMRGPLYDCGLNV

SEQ ID NO: 72525 - protein, 11 aa, Homo sapiens
  light chain complementarity determining region 3 for antibody 36263
QLYGSSPPMYP

SEQ ID NO: 72526 - protein, 10 aa, Homo sapiens
  heavy chain complementarity determining region 3 for antibody 36263
ISNGYYCLEY

SEQ ID NO: 72527 - protein, 11 aa, Homo sapiens
  light chain complementarity determining region 3 for antibody 36264
QLYGSSPPMST

SEQ ID NO: 72528 - protein, 10 aa, Homo sapiens
  heavy chain complementarity determining region 3 for antibody 36264
ISNGYYCLEY

SEQ ID NO: 72529 - protein, 11 aa, Homo sapiens
  light chain complementarity determining region 3 for antibody 36265
QLYETSPPGYP

SEQ ID NO: 72530 - protein, 14 aa, Homo sapiens
  heavy chain complementarity determining region 3 for antibody 36265
AREISISRKRSFDQ

SEQ ID NO: 72531 - protein, 11 aa, Homo sapiens
  light chain complementarity determining region 3 for antibody 36266
QLYETSPPGNT

SEQ ID NO: 72532 - protein, 14 aa, Homo sapiens
  heavy chain complementarity determining region 3 for antibody 36266
AREISISRKRSFDQ

SEQ ID NO: 72533 - protein, 11 aa, Homo sapiens
  light chain complementarity determining region 3 for antibody 36267
QLRSNWPSGLS

SEQ ID NO: 72534 - protein, 19 aa, Homo sapiens
  heavy chain complementarity determining region 3 for antibody 36267
ATDLMRDAAVVGMGTYFDF

SEQ ID NO: 72535 - protein, 9 aa, Homo sapiens
  light chain complementarity determining region 3 for antibody 36268
QLRGDWPRT

SEQ ID NO: 72536 - protein, 23 aa, Homo sapiens
  heavy chain complementarity determining region 3 for antibody 36268
ARDHLPGTVVGGNRKKLFYGVDV

SEQ ID NO: 72537 - protein, 9 aa, Homo sapiens
  light chain complementarity determining region 3 for antibody 36269
QKYNTAPHT

SEQ ID NO: 72538 - protein, 13 aa, Homo sapiens
  heavy chain complementarity determining region 3 for antibody 36269
ARLPYWELYYDDY

SEQ ID NO: 72539 - protein, 9 aa, Homo sapiens
  light chain complementarity determining region 3 for antibody 36270
QKYNSVPPT

SEQ ID NO: 72540 - protein, 14 aa, Homo sapiens
  heavy chain complementarity determining region 3 for antibody 36270
ARDPSYGGFYSFDS

SEQ ID NO: 72541 - protein, 9 aa, Homo sapiens
  light chain complementarity determining region 3 for antibody 36271
QKYNSVPPT

SEQ ID NO: 72542 - protein, 14 aa, Homo sapiens
  heavy chain complementarity determining region 3 for antibody 36271
ARDPSYGGFCYFDS

SEQ ID NO: 72543 - protein, 9 aa, Homo sapiens
  light chain complementarity determining region 3 for antibody 36272
QKYNSSPFT

SEQ ID NO: 72544 - protein, 16 aa, Homo sapiens
  heavy chain complementarity determining region 3 for antibody 36272
ARVWLGGYNYGHHFDY

SEQ ID NO: 72545 - protein, 10 aa, Homo sapiens
  light chain complementarity determining region 3 for antibody 36273
QKYNSDPPQP

SEQ ID NO: 72546 - protein, 14 aa, Homo sapiens
  heavy chain complementarity determining region 3 for antibody 36273
ARVSQKRSTFPFDY

SEQ ID NO: 72547 - protein, 9 aa, Homo sapiens
  light chain complementarity determining region 3 for antibody 36274
QKYNSAPQT

SEQ ID NO: 72548 - protein, 13 aa, Homo sapiens
  heavy chain complementarity determining region 3 for antibody 36274
ARDKLVGKAVLDY

SEQ ID NO: 72549 - protein, 9 aa, Homo sapiens
  light chain complementarity determining region 3 for antibody 36275
QKYNSAPPT

SEQ ID NO: 72550 - protein, 11 aa, Homo sapiens
  heavy chain complementarity determining region 3 for antibody 36275
ATKFKGAPLDY

SEQ ID NO: 72551 - protein, 9 aa, Homo sapiens
  light chain complementarity determining region 3 for antibody 36276
QKYNSAPLT

SEQ ID NO: 72552 - protein, 20 aa, Homo sapiens
  heavy chain complementarity determining region 3 for antibody 36276
ATVLRGRGGSVYYVGGAFDI

SEQ ID NO: 72553 - protein, 9 aa, Homo sapiens
  light chain complementarity determining region 3 for antibody 36277
QKYNSAPFT

SEQ ID NO: 72554 - protein, 11 aa, Homo sapiens
  heavy chain complementarity determining region 3 for antibody 36277
ATKFKGAPLDY

SEQ ID NO: 72555 - protein, 9 aa, Homo sapiens
  light chain complementarity determining region 3 for antibody 36278
QKYNRAPLT

SEQ ID NO: 72556 - protein, 20 aa, Homo sapiens
  heavy chain complementarity determining region 3 for antibody 36278
ATVLRGRGSSVYYVGGAFDI

SEQ ID NO: 72557 - protein, 9 aa, Homo sapiens
  light chain complementarity determining region 3 for antibody 36279
QKYNRAPHT

SEQ ID NO: 72558 - protein, 15 aa, Homo sapiens
  heavy chain complementarity determining region 3 for antibody 36279
ARTMFQWFGAYGMDV

SEQ ID NO: 72559 - protein, 9 aa, Homo sapiens
  light chain complementarity determining region 3 for antibody 36280
QKYKSAPLT

SEQ ID NO: 72560 - protein, 11 aa, Homo sapiens
  heavy chain complementarity determining region 3 for antibody 36280
ATKFKGAPLDY

SEQ ID NO: 72561 - protein, 9 aa, Homo sapiens
  light chain complementarity determining region 3 for antibody 36281
QKYGTSPLN

SEQ ID NO: 72562 - protein, 13 aa, Homo sapiens
  heavy chain complementarity determining region 3 for antibody 36281
ASISVGTVAAGKG

SEQ ID NO: 72563 - protein, 11 aa, Homo sapiens
  light chain complementarity determining region 3 for antibody 36282
QKYGTAPPGSA

SEQ ID NO: 72564 - protein, 12 aa, Homo sapiens
  heavy chain complementarity determining region 3 for antibody 36282
AKKIGNFDVLDV

SEQ ID NO: 72565 - protein, 11 aa, Homo sapiens
  light chain complementarity determining region 3 for antibody 36283
QKYGTAPPGIP

SEQ ID NO: 72566 - protein, 12 aa, Homo sapiens
  heavy chain complementarity determining region 3 for antibody 36283
AKKIGNFDVLDV

SEQ ID NO: 72567 - protein, 10 aa, Homo sapiens
  light chain complementarity determining region 3 for antibody 36284
QKYGSSPMYS

SEQ ID NO: 72568 - protein, 11 aa, Homo sapiens
  heavy chain complementarity determining region 3 for antibody 36284
ARGGQWGSLDY

SEQ ID NO: 72569 - protein, 11 aa, Homo sapiens
  light chain complementarity determining region 3 for antibody 36285
QKYDTGPPGPT

SEQ ID NO: 72570 - protein, 11 aa, Homo sapiens
  heavy chain complementarity determining region 3 for antibody 36285
VSARGGNYFDY

SEQ ID NO: 72571 - protein, 9 aa, Homo sapiens
  light chain complementarity determining region 3 for antibody 36286
QKYDSDPPT

SEQ ID NO: 72572 - protein, 16 aa, Homo sapiens
  heavy chain complementarity determining region 3 for antibody 36286
AKSHPTTGTGPHFCDY

SEQ ID NO: 72573 - protein, 9 aa, Homo sapiens
  light chain complementarity determining region 3 for antibody 36287
QKNVSTPRP

SEQ ID NO: 72574 - protein, 18 aa, Homo sapiens
  heavy chain complementarity determining region 3 for antibody 36287
AHERWEKNPSYKYYGMDL

SEQ ID NO: 72575 - protein, 8 aa, Homo sapiens
  light chain complementarity determining region 3 for antibody 36288
QKNNSAPL

SEQ ID NO: 72576 - protein, 15 aa, Homo sapiens
  heavy chain complementarity determining region 3 for antibody 36288
VRHYRETVAGIEGDS

SEQ ID NO: 72577 - protein, 9 aa, Homo sapiens
  light chain complementarity determining region 3 for antibody 36289
QKDNSAPWT

SEQ ID NO: 72578 - protein, 16 aa, Homo sapiens
  heavy chain complementarity determining region 3 for antibody 36289
ARGGRVGASYYYGMDV

SEQ ID NO: 72579 - protein, 9 aa, Homo sapiens
  light chain complementarity determining region 3 for antibody 36290
QKDNSAPLT

SEQ ID NO: 72580 - protein, 11 aa, Homo sapiens
  heavy chain complementarity determining region 3 for antibody 36290
ATKFKGAPLDY

SEQ ID NO: 72581 - protein, 9 aa, Homo sapiens
  light chain complementarity determining region 3 for antibody 36291
QHYYTSVRT

SEQ ID NO: 72582 - protein, 12 aa, Homo sapiens
  heavy chain complementarity determining region 3 for antibody 36291
VKDCGLGGSRDF

SEQ ID NO: 72583 - protein, 9 aa, Homo sapiens
  light chain complementarity determining region 3 for antibody 36292
QHYYTSPRT

SEQ ID NO: 72584 - protein, 18 aa, Homo sapiens
  heavy chain complementarity determining region 3 for antibody 36292
AREGWGSGLRGQRPGFDY

SEQ ID NO: 72585 - protein, 9 aa, Homo sapiens
  light chain complementarity determining region 3 for antibody 36293
QHYYSIPWT

SEQ ID NO: 72586 - protein, 14 aa, Homo sapiens
  heavy chain complementarity determining region 3 for antibody 36293
TRDRLAGSYSGYDY

SEQ ID NO: 72587 - protein, 9 aa, Homo sapiens
  light chain complementarity determining region 3 for antibody 36294
QHYYRAPIT

SEQ ID NO: 72588 - protein, 21 aa, Homo sapiens
  heavy chain complementarity determining region 3 for antibody 36294
ARDRVAFPTGAWYEKLDCLDY

SEQ ID NO: 72589 - protein, 8 aa, Homo sapiens
  light chain complementarity determining region 3 for antibody 36295
QHYYGPWT

SEQ ID NO: 72590 - protein, 11 aa, Homo sapiens
  heavy chain complementarity determining region 3 for antibody 36295
AASSYYGVFHY

SEQ ID NO: 72591 - protein, 9 aa, Homo sapiens
  light chain complementarity determining region 3 for antibody 36296
QHYYDRPLT

SEQ ID NO: 72592 - protein, 15 aa, Homo sapiens
  heavy chain complementarity determining region 3 for antibody 36296
AREVIAVGDSDAFDI

SEQ ID NO: 72593 - protein, 11 aa, Homo sapiens
  light chain complementarity determining region 3 for antibody 36297
QHYSTSSLSLT

SEQ ID NO: 72594 - protein, 16 aa, Homo sapiens
  heavy chain complementarity determining region 3 for antibody 36297
ARFFLAGYSWYEGVDY

SEQ ID NO: 72595 - protein, 11 aa, Homo sapiens
  light chain complementarity determining region 3 for antibody 36298
QHYSTSSLAPT

SEQ ID NO: 72596 - protein, 16 aa, Homo sapiens
  heavy chain complementarity determining region 3 for antibody 36298
ARFFLAGYSWYEGVDY

SEQ ID NO: 72597 - protein, 9 aa, Homo sapiens
  light chain complementarity determining region 3 for antibody 36299
QHYSSTPWT

SEQ ID NO: 72598 - protein, 12 aa, Homo sapiens
  heavy chain complementarity determining region 3 for antibody 36299
ARVNWGSRGFDS

SEQ ID NO: 72599 - protein, 9 aa, Homo sapiens
  light chain complementarity determining region 3 for antibody 36300
QHYRSAPYT

SEQ ID NO: 72600 - protein, 16 aa, Homo sapiens
  heavy chain complementarity determining region 3 for antibody 36300
ARDQGFCRGPNCYMLF

SEQ ID NO: 72601 - protein, 10 aa, Homo sapiens
  light chain complementarity determining region 3 for antibody 36301
QHYPNWPPWT

SEQ ID NO: 72602 - protein, 13 aa, Homo sapiens
  heavy chain complementarity determining region 3 for antibody 36301
AKGRVRELYYFET

SEQ ID NO: 72603 - protein, 9 aa, Homo sapiens
  light chain complementarity determining region 3 for antibody 36302
QHYNRVPLT

SEQ ID NO: 72604 - protein, 10 aa, Homo sapiens
  heavy chain complementarity determining region 3 for antibody 36302
ARDVVGSDDQ

SEQ ID NO: 72605 - protein, 8 aa, Homo sapiens
  light chain complementarity determining region 3 for antibody 36303
QHYNNWPT

SEQ ID NO: 72606 - protein, 16 aa, Homo sapiens
  heavy chain complementarity determining region 3 for antibody 36303
AREGMTTDPSRAAFDL

SEQ ID NO: 72607 - protein, 10 aa, Homo sapiens
  light chain complementarity determining region 3 for antibody 36304
QHYNNWPSFP

SEQ ID NO: 72608 - protein, 11 aa, Homo sapiens
  heavy chain complementarity determining region 3 for antibody 36304
TRDDYGGGADY

SEQ ID NO: 72609 - protein, 9 aa, Homo sapiens
  light chain complementarity determining region 3 for antibody 36305
QHYNIYSGT

SEQ ID NO: 72610 - protein, 8 aa, Homo sapiens
  heavy chain complementarity determining region 3 for antibody 36305
ATSPQRGS

SEQ ID NO: 72611 - protein, 9 aa, Homo sapiens
  light chain complementarity determining region 3 for antibody 36306
QHYNIYSEP

SEQ ID NO: 72612 - protein, 8 aa, Homo sapiens
  heavy chain complementarity determining region 3 for antibody 36306
ATSPQRGS

SEQ ID NO: 72613 - protein, 9 aa, Homo sapiens
  light chain complementarity determining region 3 for antibody 36307
QHYNFYSET

SEQ ID NO: 72614 - protein, 8 aa, Homo sapiens
  heavy chain complementarity determining region 3 for antibody 36307
ATSPQRGS

SEQ ID NO: 72615 - protein, 9 aa, Homo sapiens
  light chain complementarity determining region 3 for antibody 36308
QHYNASFWT

SEQ ID NO: 72616 - protein, 16 aa, Homo sapiens
  heavy chain complementarity determining region 3 for antibody 36308
ASLGGAHYYGPGSHYF

SEQ ID NO: 72617 - protein, 9 aa, Homo sapiens
  light chain complementarity determining region 3 for antibody 36309
QHYHNWPRP

SEQ ID NO: 72618 - protein, 16 aa, Homo sapiens
  heavy chain complementarity determining region 3 for antibody 36309
AKDGGDYYDSFEYFQY

SEQ ID NO: 72619 - protein, 10 aa, Homo sapiens
  light chain complementarity determining region 3 for antibody 36310
QHYHNWPPRT

SEQ ID NO: 72620 - protein, 13 aa, Homo sapiens
  heavy chain complementarity determining region 3 for antibody 36310
AKGRVRELYYFEP

SEQ ID NO: 72621 - protein, 10 aa, Homo sapiens
  light chain complementarity determining region 3 for antibody 36311
QHYHNWPPLT

SEQ ID NO: 72622 - protein, 13 aa, Homo sapiens
  heavy chain complementarity determining region 3 for antibody 36311
AKGRVRELYYFET

SEQ ID NO: 72623 - protein, 10 aa, Homo sapiens
  light chain complementarity determining region 3 for antibody 36312
QHYHNLPPWT

SEQ ID NO: 72624 - protein, 13 aa, Homo sapiens
  heavy chain complementarity determining region 3 for antibody 36312
AKGRVRELYYFEP

SEQ ID NO: 72625 - protein, 8 aa, Homo sapiens
  light chain complementarity determining region 3 for antibody 36313
QHYGTSAP

SEQ ID NO: 72626 - protein, 18 aa, Homo sapiens
  heavy chain complementarity determining region 3 for antibody 36313
ARWGGYCSSSSCYWLFDY

SEQ ID NO: 72627 - protein, 9 aa, Homo sapiens
  light chain complementarity determining region 3 for antibody 36314
QHYGSSPWT

SEQ ID NO: 72628 - protein, 15 aa, Homo sapiens
  heavy chain complementarity determining region 3 for antibody 36314
AREAFDIAGHYRADY

SEQ ID NO: 72629 - protein, 10 aa, Homo sapiens
  light chain complementarity determining region 3 for antibody 36315
QHYGSSPPYP

SEQ ID NO: 72630 - protein, 10 aa, Homo sapiens
  heavy chain complementarity determining region 3 for antibody 36315
ARDWRYNIYD

SEQ ID NO: 72631 - protein, 10 aa, Homo sapiens
  light chain complementarity determining region 3 for antibody 36316
QHYGSSPMYT

SEQ ID NO: 72632 - protein, 14 aa, Homo sapiens
  heavy chain complementarity determining region 3 for antibody 36316
TTDRPLTGMVTFDF

SEQ ID NO: 72633 - protein, 9 aa, Homo sapiens
  light chain complementarity determining region 3 for antibody 36317
QHYGSSPLT

SEQ ID NO: 72634 - protein, 12 aa, Homo sapiens
  heavy chain complementarity determining region 3 for antibody 36317
ARDTGDFEVHVS

SEQ ID NO: 72635 - protein, 10 aa, Homo sapiens
  light chain complementarity determining region 3 for antibody 36318
QHYGSSLMYT

SEQ ID NO: 72636 - protein, 14 aa, Homo sapiens
  heavy chain complementarity determining region 3 for antibody 36318
TTDRPLTGMVTFGF

SEQ ID NO: 72637 - protein, 10 aa, Homo sapiens
  light chain complementarity determining region 3 for antibody 36319
QHYGSSLMYT

SEQ ID NO: 72638 - protein, 14 aa, Homo sapiens
  heavy chain complementarity determining region 3 for antibody 36319
TTDRPLPGMVTFDF

SEQ ID NO: 72639 - protein, 10 aa, Homo sapiens
  light chain complementarity determining region 3 for antibody 36320
QHYGSSLIYT

SEQ ID NO: 72640 - protein, 14 aa, Homo sapiens
  heavy chain complementarity determining region 3 for antibody 36320
TTDRPLTGMVTFDF

SEQ ID NO: 72641 - protein, 10 aa, Homo sapiens
  light chain complementarity determining region 3 for antibody 36321
QHYGSSFMYT

SEQ ID NO: 72642 - protein, 14 aa, Homo sapiens
  heavy chain complementarity determining region 3 for antibody 36321
TTDRPLTGMVTFDF

SEQ ID NO: 72643 - protein, 10 aa, Homo sapiens
  light chain complementarity determining region 3 for antibody 36322
QHYGRSPPNS

SEQ ID NO: 72644 - protein, 23 aa, Homo sapiens
  heavy chain complementarity determining region 3 for antibody 36322
ARGLRSSDWSKIMEMDSYYGLDV

SEQ ID NO: 72645 - protein, 10 aa, Homo sapiens
  light chain complementarity determining region 3 for antibody 36323
QHYGRSLMYT

SEQ ID NO: 72646 - protein, 14 aa, Homo sapiens
  heavy chain complementarity determining region 3 for antibody 36323
TTDRPLTGMVTFDF

SEQ ID NO: 72647 - protein, 10 aa, Homo sapiens
  light chain complementarity determining region 3 for antibody 36324
QHYGISPRLT

SEQ ID NO: 72648 - protein, 12 aa, Homo sapiens
  heavy chain complementarity determining region 3 for antibody 36324
ARDVVGATASDF

SEQ ID NO: 72649 - protein, 10 aa, Homo sapiens
  light chain complementarity determining region 3 for antibody 36325
QHYGISPRFI

SEQ ID NO: 72650 - protein, 12 aa, Homo sapiens
  heavy chain complementarity determining region 3 for antibody 36325
ARDVVGATASDF

SEQ ID NO: 72651 - protein, 8 aa, Homo sapiens
  light chain complementarity determining region 3 for antibody 36326
QHYGGSPS

SEQ ID NO: 72652 - protein, 16 aa, Homo sapiens
  heavy chain complementarity determining region 3 for antibody 36326
ATDWGSGTQWIRAFDV

SEQ ID NO: 72653 - protein, 10 aa, Homo sapiens
  light chain complementarity determining region 3 for antibody 36327
QHYGDAPTWR

SEQ ID NO: 72654 - protein, 18 aa, Homo sapiens
  heavy chain complementarity determining region 3 for antibody 36327
ARGGQYMVRGAIIETGDY

SEQ ID NO: 72655 - protein, 10 aa, Homo sapiens
  light chain complementarity determining region 3 for antibody 36328
QHYGDAPTGT

SEQ ID NO: 72656 - protein, 18 aa, Homo sapiens
  heavy chain complementarity determining region 3 for antibody 36328
ARGGQYMVRGAIIETGDY

SEQ ID NO: 72657 - protein, 9 aa, Homo sapiens
  light chain complementarity determining region 3 for antibody 36329
QHYFSHVYT

SEQ ID NO: 72658 - protein, 18 aa, Homo sapiens
  heavy chain complementarity determining region 3 for antibody 36329
AQERDGYCDSHACYGLDV

SEQ ID NO: 72659 - protein, 10 aa, Homo sapiens
  light chain complementarity determining region 3 for antibody 36330
QHYDTSREWT

SEQ ID NO: 72660 - protein, 10 aa, Homo sapiens
  heavy chain complementarity determining region 3 for antibody 36330
ARGTNWNGDF

SEQ ID NO: 72661 - protein, 11 aa, Homo sapiens
  light chain complementarity determining region 3 for antibody 36331
QHYDNSPIMYN

SEQ ID NO: 72662 - protein, 12 aa, Homo sapiens
  heavy chain complementarity determining region 3 for antibody 36331
ARHIAGSNAFDY

SEQ ID NO: 72663 - protein, 11 aa, Homo sapiens
  light chain complementarity determining region 3 for antibody 36332
QHYDNSPIMNT

SEQ ID NO: 72664 - protein, 12 aa, Homo sapiens
  heavy chain complementarity determining region 3 for antibody 36332
ARHIAGSNAFDY

SEQ ID NO: 72665 - protein, 10 aa, Homo sapiens
  light chain complementarity determining region 3 for antibody 36333
QHYDNFPPFT

SEQ ID NO: 72666 - protein, 16 aa, Homo sapiens
  heavy chain complementarity determining region 3 for antibody 36333
ARARGRWLQAGAAFDF

SEQ ID NO: 72667 - protein, 8 aa, Homo sapiens
  light chain complementarity determining region 3 for antibody 36334
QHYDGPGT

SEQ ID NO: 72668 - protein, 11 aa, Homo sapiens
  heavy chain complementarity determining region 3 for antibody 36334
AASSYYGVFHY

SEQ ID NO: 72669 - protein, 10 aa, Homo sapiens
  light chain complementarity determining region 3 for antibody 36335
QHYDASPMNT

SEQ ID NO: 72670 - protein, 11 aa, Homo sapiens
  heavy chain complementarity determining region 3 for antibody 36335
MRGPAHGAFDI

SEQ ID NO: 72671 - protein, 10 aa, Homo sapiens
  light chain complementarity determining region 3 for antibody 36336
QHYDASPLYT

SEQ ID NO: 72672 - protein, 11 aa, Homo sapiens
  heavy chain complementarity determining region 3 for antibody 36336
MRGPAHGAFDI

SEQ ID NO: 72673 - protein, 10 aa, Homo sapiens
  light chain complementarity determining region 3 for antibody 36337
QHWVSSPSYT

SEQ ID NO: 72674 - protein, 12 aa, Homo sapiens
  heavy chain complementarity determining region 3 for antibody 36337
ARETTQFGELDN

SEQ ID NO: 72675 - protein, 10 aa, Homo sapiens
  light chain complementarity determining region 3 for antibody 36338
QHWVSSPPYP

SEQ ID NO: 72676 - protein, 12 aa, Homo sapiens
  heavy chain complementarity determining region 3 for antibody 36338
ARETTQFGELDN

SEQ ID NO: 72677 - protein, 10 aa, Homo sapiens
  light chain complementarity determining region 3 for antibody 36339
QHWVSSPEYT

SEQ ID NO: 72678 - protein, 12 aa, Homo sapiens
  heavy chain complementarity determining region 3 for antibody 36339
ARETTQFGELDN

SEQ ID NO: 72679 - protein, 10 aa, Homo sapiens
  light chain complementarity determining region 3 for antibody 36340
QHWVSSPAYT

SEQ ID NO: 72680 - protein, 12 aa, Homo sapiens
  heavy chain complementarity determining region 3 for antibody 36340
ARETTQFGELGN

SEQ ID NO: 72681 - protein, 10 aa, Homo sapiens
  light chain complementarity determining region 3 for antibody 36341
QHWVSSPAYS

SEQ ID NO: 72682 - protein, 12 aa, Homo sapiens
  heavy chain complementarity determining region 3 for antibody 36341
ARETTQFGELDN

SEQ ID NO: 72683 - protein, 10 aa, Homo sapiens
  light chain complementarity determining region 3 for antibody 36342
QHWVSSPAYI

SEQ ID NO: 72684 - protein, 12 aa, Homo sapiens
  heavy chain complementarity determining region 3 for antibody 36342
ARETTQFGELDN

SEQ ID NO: 72685 - protein, 10 aa, Homo sapiens
  light chain complementarity determining region 3 for antibody 36343
QHWVRSPAYT

SEQ ID NO: 72686 - protein, 12 aa, Homo sapiens
  heavy chain complementarity determining region 3 for antibody 36343
ARETTQFGELDN

SEQ ID NO: 72687 - protein, 10 aa, Homo sapiens
  light chain complementarity determining region 3 for antibody 36344
QHWVISPAYT

SEQ ID NO: 72688 - protein, 12 aa, Homo sapiens
  heavy chain complementarity determining region 3 for antibody 36344
ARETTQFGELDN

SEQ ID NO: 72689 - protein, 10 aa, Homo sapiens
  light chain complementarity determining region 3 for antibody 36345
QHWFSSPAYT

SEQ ID NO: 72690 - protein, 12 aa, Homo sapiens
  heavy chain complementarity determining region 3 for antibody 36345
ARETTQFGELDN

SEQ ID NO: 72691 - protein, 9 aa, Homo sapiens
  light chain complementarity determining region 3 for antibody 36346
QHTPTFPRT

SEQ ID NO: 72692 - protein, 20 aa, Homo sapiens
  heavy chain complementarity determining region 3 for antibody 36346
GRGRRIAALSTAHYYYGMDV

SEQ ID NO: 72693 - protein, 9 aa, Homo sapiens
  light chain complementarity determining region 3 for antibody 36347
QHTHTFPRT

SEQ ID NO: 72694 - protein, 20 aa, Homo sapiens
  heavy chain complementarity determining region 3 for antibody 36347
GRGRRVAALSTAHYYYGMDV

SEQ ID NO: 72695 - protein, 9 aa, Homo sapiens
  light chain complementarity determining region 3 for antibody 36348
QHTHTFPRT

SEQ ID NO: 72696 - protein, 20 aa, Homo sapiens
  heavy chain complementarity determining region 3 for antibody 36348
GRGRRIAALSTARYYYGMDV

SEQ ID NO: 72697 - protein, 9 aa, Homo sapiens
  light chain complementarity determining region 3 for antibody 36349
QHTHTFPRT

SEQ ID NO: 72698 - protein, 20 aa, Homo sapiens
  heavy chain complementarity determining region 3 for antibody 36349
GRGRRIAALSTAHYYCGMDV

SEQ ID NO: 72699 - protein, 9 aa, Homo sapiens
  light chain complementarity determining region 3 for antibody 36350
QHTHTFPRT

SEQ ID NO: 72700 - protein, 20 aa, Homo sapiens
  heavy chain complementarity determining region 3 for antibody 36350
GRGRRIAALPTAHYYYGMDV

SEQ ID NO: 72701 - protein, 9 aa, Homo sapiens
  light chain complementarity determining region 3 for antibody 36351
QHTHTFPRT

SEQ ID NO: 72702 - protein, 20 aa, Homo sapiens
  heavy chain complementarity determining region 3 for antibody 36351
GRCRRIAALSTAHYYYGMDV

SEQ ID NO: 72703 - protein, 9 aa, Homo sapiens
  light chain complementarity determining region 3 for antibody 36352
QHTHTFPPT

SEQ ID NO: 72704 - protein, 20 aa, Homo sapiens
  heavy chain complementarity determining region 3 for antibody 36352
GRGRRIAALSTAHYYYGMDV

SEQ ID NO: 72705 - protein, 9 aa, Homo sapiens
  light chain complementarity determining region 3 for antibody 36353
QHTHTFLRT

SEQ ID NO: 72706 - protein, 20 aa, Homo sapiens
  heavy chain complementarity determining region 3 for antibody 36353
GRGRRIAALSTAHYYYGMDV

SEQ ID NO: 72707 - protein, 9 aa, Homo sapiens
  light chain complementarity determining region 3 for antibody 36354
QHTHRRPFT

SEQ ID NO: 72708 - protein, 20 aa, Homo sapiens
  heavy chain complementarity determining region 3 for antibody 36354
AKGIAVAALRTVYYYYGLDV

SEQ ID NO: 72709 - protein, 9 aa, Homo sapiens
  light chain complementarity determining region 3 for antibody 36355
QHSYSSLLT

SEQ ID NO: 72710 - protein, 16 aa, Homo sapiens
  heavy chain complementarity determining region 3 for antibody 36355
AREGGSTYTTKRAFDS

SEQ ID NO: 72711 - protein, 9 aa, Homo sapiens
  light chain complementarity determining region 3 for antibody 36356
QHSHSRPST

SEQ ID NO: 72712 - protein, 20 aa, Homo sapiens
  heavy chain complementarity determining region 3 for antibody 36356
AKGIAVAALRTVYYYYGMDV

SEQ ID NO: 72713 - protein, 9 aa, Homo sapiens
  light chain complementarity determining region 3 for antibody 36357
QHSHSRPFT

SEQ ID NO: 72714 - protein, 20 aa, Homo sapiens
  heavy chain complementarity determining region 3 for antibody 36357
ANGIAVAALRTVYYYYGMDV

SEQ ID NO: 72715 - protein, 9 aa, Homo sapiens
  light chain complementarity determining region 3 for antibody 36358
QHSHSRPFT

SEQ ID NO: 72716 - protein, 20 aa, Homo sapiens
  heavy chain complementarity determining region 3 for antibody 36358
AKGIAVAAVRTVYYYYGMDV

SEQ ID NO: 72717 - protein, 9 aa, Homo sapiens
  light chain complementarity determining region 3 for antibody 36359
QHSHSRPFT

SEQ ID NO: 72718 - protein, 20 aa, Homo sapiens
  heavy chain complementarity determining region 3 for antibody 36359
AKGIAVAALRTVYYSYGMDV

SEQ ID NO: 72719 - protein, 9 aa, Homo sapiens
  light chain complementarity determining region 3 for antibody 36360
QHSHSRPFN

SEQ ID NO: 72720 - protein, 20 aa, Homo sapiens
  heavy chain complementarity determining region 3 for antibody 36360
AKGIAVAALRTVYYYYGMDV

SEQ ID NO: 72721 - protein, 9 aa, Homo sapiens
  light chain complementarity determining region 3 for antibody 36361
QHSHSLPFT

SEQ ID NO: 72722 - protein, 20 aa, Homo sapiens
  heavy chain complementarity determining region 3 for antibody 36361
AKGIAVAALRTVYYYYGMDV

SEQ ID NO: 72723 - protein, 9 aa, Homo sapiens
  light chain complementarity determining region 3 for antibody 36362
QHSHSCPFT

SEQ ID NO: 72724 - protein, 20 aa, Homo sapiens
  heavy chain complementarity determining region 3 for antibody 36362
AKGIAVAALRTVYYYYGMDV

SEQ ID NO: 72725 - protein, 9 aa, Homo sapiens
  light chain complementarity determining region 3 for antibody 36363
QHSHRRPFT

SEQ ID NO: 72726 - protein, 20 aa, Homo sapiens
  heavy chain complementarity determining region 3 for antibody 36363
AKGIAVAALRTVYYYYGMDV

SEQ ID NO: 72727 - protein, 11 aa, Homo sapiens
  light chain complementarity determining region 3 for antibody 36364
QHRSNWPPGFT

SEQ ID NO: 72728 - protein, 13 aa, Homo sapiens
  heavy chain complementarity determining region 3 for antibody 36364
ACALAHPGDYFDF

SEQ ID NO: 72729 - protein, 9 aa, Homo sapiens
  light chain complementarity determining region 3 for antibody 36365
QHRRPWLYS

SEQ ID NO: 72730 - protein, 20 aa, Homo sapiens
  heavy chain complementarity determining region 3 for antibody 36365
ARDGSAGMAARGTPYYGLDV

SEQ ID NO: 72731 - protein, 9 aa, Homo sapiens
  light chain complementarity determining region 3 for antibody 36366
QHRNSWPDT

SEQ ID NO: 72732 - protein, 15 aa, Homo sapiens
  heavy chain complementarity determining region 3 for antibody 36366
AKEGYYADGSGYCPN

SEQ ID NO: 72733 - protein, 11 aa, Homo sapiens
  light chain complementarity determining region 3 for antibody 36367
QHRINWPPSIP

SEQ ID NO: 72734 - protein, 15 aa, Homo sapiens
  heavy chain complementarity determining region 3 for antibody 36367
ARDRDVMYSVHAFDI

SEQ ID NO: 72735 - protein, 10 aa, Homo sapiens
  light chain complementarity determining region 3 for antibody 36368
QHRGKWPPPT

SEQ ID NO: 72736 - protein, 15 aa, Homo sapiens
  heavy chain complementarity determining region 3 for antibody 36368
VRLGVGFDDSSDDDY

SEQ ID NO: 72737 - protein, 10 aa, Homo sapiens
  light chain complementarity determining region 3 for antibody 36369
QHRGKWPPHP

SEQ ID NO: 72738 - protein, 15 aa, Homo sapiens
  heavy chain complementarity determining region 3 for antibody 36369
VRLGVGFDDSSDDDY

SEQ ID NO: 72739 - protein, 9 aa, Homo sapiens
  light chain complementarity determining region 3 for antibody 36370
QHNYNPPLT

SEQ ID NO: 72740 - protein, 13 aa, Homo sapiens
  heavy chain complementarity determining region 3 for antibody 36370
VRGRNYDRDGFDP

SEQ ID NO: 72741 - protein, 10 aa, Homo sapiens
  light chain complementarity determining region 3 for antibody 36371
QHLVSSPAYT

SEQ ID NO: 72742 - protein, 12 aa, Homo sapiens
  heavy chain complementarity determining region 3 for antibody 36371
ARETTQFGELDN

SEQ ID NO: 72743 - protein, 9 aa, Homo sapiens
  light chain complementarity determining region 3 for antibody 36372
QHLHSFPLT

SEQ ID NO: 72744 - protein, 15 aa, Homo sapiens
  heavy chain complementarity determining region 3 for antibody 36372
ARAGAYSGGRYYFDY

SEQ ID NO: 72745 - protein, 9 aa, Homo sapiens
  light chain complementarity determining region 3 for antibody 36373
QHGYSSPLI

SEQ ID NO: 72746 - protein, 15 aa, Homo sapiens
  heavy chain complementarity determining region 3 for antibody 36373
ARAQVIWGQLYYFDY

SEQ ID NO: 72747 - protein, 9 aa, Homo sapiens
  light chain complementarity determining region 3 for antibody 36374
QHGYRTPFT

SEQ ID NO: 72748 - protein, 15 aa, Homo sapiens
  heavy chain complementarity determining region 3 for antibody 36374
AKAQVIWGQLCYFES

SEQ ID NO: 72749 - protein, 9 aa, Homo sapiens
  light chain complementarity determining region 3 for antibody 36375
QHFNSYPLT

SEQ ID NO: 72750 - protein, 14 aa, Homo sapiens
  heavy chain complementarity determining region 3 for antibody 36375
GRAMAVAGYWFFHL

SEQ ID NO: 72751 - protein, 9 aa, Homo sapiens
  light chain complementarity determining region 3 for antibody 36376
QHFNSYPLP

SEQ ID NO: 72752 - protein, 14 aa, Homo sapiens
  heavy chain complementarity determining region 3 for antibody 36376
VRAMAVAGYWFFHL

SEQ ID NO: 72753 - protein, 10 aa, Homo sapiens
  light chain complementarity determining region 3 for antibody 36377
QHFDNLPMLT

SEQ ID NO: 72754 - protein, 16 aa, Homo sapiens
  heavy chain complementarity determining region 3 for antibody 36377
ARVPRGSYASGTLFDY

SEQ ID NO: 72755 - protein, 10 aa, Homo sapiens
  light chain complementarity determining region 3 for antibody 36378
QHFDNLPMFP

SEQ ID NO: 72756 - protein, 16 aa, Homo sapiens
  heavy chain complementarity determining region 3 for antibody 36378
ARVPRGSYASGTLFDY

SEQ ID NO: 72757 - protein, 11 aa, Homo sapiens
  light chain complementarity determining region 3 for antibody 36379
QFYGASPPGYG

SEQ ID NO: 72758 - protein, 14 aa, Homo sapiens
  heavy chain complementarity determining region 3 for antibody 36379
AKHMPVPGTRGFDA

SEQ ID NO: 72759 - protein, 6 aa, Homo sapiens
  light chain complementarity determining region 3 for antibody 36380
QEYGST

SEQ ID NO: 72760 - protein, 12 aa, Homo sapiens
  heavy chain complementarity determining region 3 for antibody 36380
ARDHISGWSLPN

SEQ ID NO: 72761 - protein, 10 aa, Homo sapiens
  light chain complementarity determining region 3 for antibody 36381
QERSDWPRFT

SEQ ID NO: 72762 - protein, 14 aa, Homo sapiens
  heavy chain complementarity determining region 3 for antibody 36381
ARWYYYDGSGLGDY

SEQ ID NO: 72763 - protein, 6 aa, Homo sapiens
  light chain complementarity determining region 3 for antibody 36382
QENGST

SEQ ID NO: 72764 - protein, 12 aa, Homo sapiens
  heavy chain complementarity determining region 3 for antibody 36382
ARDHISGWSLSN

SEQ ID NO: 72765 - protein, 6 aa, Homo sapiens
  light chain complementarity determining region 3 for antibody 36383
QEDGST

SEQ ID NO: 72766 - protein, 12 aa, Homo sapiens
  heavy chain complementarity determining region 3 for antibody 36383
ARDHISGWSLSN

SEQ ID NO: 72767 - protein, 10 aa, Homo sapiens
  light chain complementarity determining region 3 for antibody 36384
QDYDSWPALT

SEQ ID NO: 72768 - protein, 15 aa, Homo sapiens
  heavy chain complementarity determining region 3 for antibody 36384
ARILTHTLTRGVVGD

SEQ ID NO: 72769 - protein, 10 aa, Homo sapiens
  light chain complementarity determining region 3 for antibody 36385
QCRDEWPPVI

SEQ ID NO: 72770 - protein, 12 aa, Homo sapiens
  heavy chain complementarity determining region 3 for antibody 36385
VGDHITGWKFDY

SEQ ID NO: 72771 - protein, 10 aa, Homo sapiens
  light chain complementarity determining region 3 for antibody 36386
QAYGNLPLVT

SEQ ID NO: 72772 - protein, 15 aa, Homo sapiens
  heavy chain complementarity determining region 3 for antibody 36386
AVWGPGSDWWPLYDY

SEQ ID NO: 72773 - protein, 9 aa, Homo sapiens
  light chain complementarity determining region 3 for antibody 36387
PQYYTSVRT

SEQ ID NO: 72774 - protein, 12 aa, Homo sapiens
  heavy chain complementarity determining region 3 for antibody 36387
VKDCGLGGSRDF

SEQ ID NO: 72775 - protein, 9 aa, Homo sapiens
  light chain complementarity determining region 3 for antibody 36388
PQYQSWPYT

SEQ ID NO: 72776 - protein, 11 aa, Homo sapiens
  heavy chain complementarity determining region 3 for antibody 36388
GGFYHGGPCGY

SEQ ID NO: 72777 - protein, 8 aa, Homo sapiens
  light chain complementarity determining region 3 for antibody 36389
PQYNNWWT

SEQ ID NO: 72778 - protein, 10 aa, Homo sapiens
  heavy chain complementarity determining region 3 for antibody 36389
ARAGFGAFDI

SEQ ID NO: 72779 - protein, 8 aa, Homo sapiens
  light chain complementarity determining region 3 for antibody 36390
PQYLSTPT

SEQ ID NO: 72780 - protein, 16 aa, Homo sapiens
  heavy chain complementarity determining region 3 for antibody 36390
VRRLNDYGDPDPHFDS

SEQ ID NO: 72781 - protein, 9 aa, Homo sapiens
  light chain complementarity determining region 3 for antibody 36391
PQYGTSPLT

SEQ ID NO: 72782 - protein, 14 aa, Homo sapiens
  heavy chain complementarity determining region 3 for antibody 36391
AHRSYNSGRGAFDI

SEQ ID NO: 72783 - protein, 9 aa, Homo sapiens
  light chain complementarity determining region 3 for antibody 36392
PQYGNLPRT

SEQ ID NO: 72784 - protein, 13 aa, Homo sapiens
  heavy chain complementarity determining region 3 for antibody 36392
AGGNFHSGGYGEY

SEQ ID NO: 72785 - protein, 9 aa, Homo sapiens
  light chain complementarity determining region 3 for antibody 36393
PQVISYPFT

SEQ ID NO: 72786 - protein, 12 aa, Homo sapiens
  heavy chain complementarity determining region 3 for antibody 36393
ARPLDGDHGFDP

SEQ ID NO: 72787 - protein, 9 aa, Homo sapiens
  light chain complementarity determining region 3 for antibody 36394
PQRSNWPWT

SEQ ID NO: 72788 - protein, 20 aa, Homo sapiens
  heavy chain complementarity determining region 3 for antibody 36394
ARASPVYCSGGSCYYYGMDV

SEQ ID NO: 72789 - protein, 9 aa, Homo sapiens
  light chain complementarity determining region 3 for antibody 36395
PQAYSSPYT

SEQ ID NO: 72790 - protein, 14 aa, Homo sapiens
  heavy chain complementarity determining region 3 for antibody 36395
ARDPQRGRPDYFDY

SEQ ID NO: 72791 - protein, 9 aa, Homo sapiens
  light chain complementarity determining region 3 for antibody 36396
PHTSTFPRP

SEQ ID NO: 72792 - protein, 20 aa, Homo sapiens
  heavy chain complementarity determining region 3 for antibody 36396
ARGRRIAALSTAHYYYGMDV

SEQ ID NO: 72793 - protein, 9 aa, Homo sapiens
  light chain complementarity determining region 3 for antibody 36397
PHSHSRPFT

SEQ ID NO: 72794 - protein, 20 aa, Homo sapiens
  heavy chain complementarity determining region 3 for antibody 36397
AKGIAVAALRTVYYYYGMDV

SEQ ID NO: 72795 - protein, 10 aa, Homo sapiens
  light chain complementarity determining region 3 for antibody 36398
PCRDEWPPVI

SEQ ID NO: 72796 - protein, 12 aa, Homo sapiens
  heavy chain complementarity determining region 3 for antibody 36398
VRDHITGWKFDY

SEQ ID NO: 72797 - protein, 9 aa, Homo sapiens
  light chain complementarity determining region 3 for antibody 36399
NQCSNWPGT

SEQ ID NO: 72798 - protein, 14 aa, Homo sapiens
  heavy chain complementarity determining region 3 for antibody 36399
ARGVAAPIPRYFHH

SEQ ID NO: 72799 - protein, 9 aa, Homo sapiens
  light chain complementarity determining region 3 for antibody 36400
MQYRYWPPT

SEQ ID NO: 72800 - protein, 8 aa, Homo sapiens
  heavy chain complementarity determining region 3 for antibody 36400
VCWGTFHL

SEQ ID NO: 72801 - protein, 9 aa, Homo sapiens
  light chain complementarity determining region 3 for antibody 36401
MQWTYWPGT

SEQ ID NO: 72802 - protein, 11 aa, Homo sapiens
  heavy chain complementarity determining region 3 for antibody 36401
ATGGLRVVFGP

SEQ ID NO: 72803 - protein, 9 aa, Homo sapiens
  light chain complementarity determining region 3 for antibody 36402
MQVQQTGFT

SEQ ID NO: 72804 - protein, 20 aa, Homo sapiens
  heavy chain complementarity determining region 3 for antibody 36402
AREGHRATARNRYYYNGIDV

SEQ ID NO: 72805 - protein, 9 aa, Homo sapiens
  light chain complementarity determining region 3 for antibody 36403
MQVQHTRFT

SEQ ID NO: 72806 - protein, 20 aa, Homo sapiens
  heavy chain complementarity determining region 3 for antibody 36403
AREGHRATARNRYYYNGIDV

SEQ ID NO: 72807 - protein, 9 aa, Homo sapiens
  light chain complementarity determining region 3 for antibody 36404
MQVLHSPRP

SEQ ID NO: 72808 - protein, 11 aa, Homo sapiens
  heavy chain complementarity determining region 3 for antibody 36404
TRLIDRGSSDR

SEQ ID NO: 72809 - protein, 9 aa, Homo sapiens
  light chain complementarity determining region 3 for antibody 36405
MQTVQFGWT

SEQ ID NO: 72810 - protein, 14 aa, Homo sapiens
  heavy chain complementarity determining region 3 for antibody 36405
ARSVNTGQYYGLGY

SEQ ID NO: 72811 - protein, 9 aa, Homo sapiens
  light chain complementarity determining region 3 for antibody 36406
MQTLHTPWT

SEQ ID NO: 72812 - protein, 16 aa, Homo sapiens
  heavy chain complementarity determining region 3 for antibody 36406
ARVQAAAVIHVYGLDV

SEQ ID NO: 72813 - protein, 8 aa, Homo sapiens
  light chain complementarity determining region 3 for antibody 36407
MQTLHGFT

SEQ ID NO: 72814 - protein, 12 aa, Homo sapiens
  heavy chain complementarity determining region 3 for antibody 36407
VRGAPDYGVFDF

SEQ ID NO: 72815 - protein, 9 aa, Homo sapiens
  light chain complementarity determining region 3 for antibody 36408
MQSTQGLWT

SEQ ID NO: 72816 - protein, 16 aa, Homo sapiens
  heavy chain complementarity determining region 3 for antibody 36408
GTRQYLYDTSGYSFDS

SEQ ID NO: 72817 - protein, 9 aa, Homo sapiens
  light chain complementarity determining region 3 for antibody 36409
MQSTPWPWT

SEQ ID NO: 72818 - protein, 10 aa, Homo sapiens
  heavy chain complementarity determining region 3 for antibody 36409
VQDHRYGSGN

SEQ ID NO: 72819 - protein, 9 aa, Homo sapiens
  light chain complementarity determining region 3 for antibody 36410
MQSTNWPWT

SEQ ID NO: 72820 - protein, 10 aa, Homo sapiens
  heavy chain complementarity determining region 3 for antibody 36410
VQDHRYGSGN

SEQ ID NO: 72821 - protein, 10 aa, Homo sapiens
  light chain complementarity determining region 3 for antibody 36411
MQSTHWPRIP

SEQ ID NO: 72822 - protein, 16 aa, Homo sapiens
  heavy chain complementarity determining region 3 for antibody 36411
VKDALTSYYDSSGYYH

SEQ ID NO: 72823 - protein, 9 aa, Homo sapiens
  light chain complementarity determining region 3 for antibody 36412
MQSTHGPWT

SEQ ID NO: 72824 - protein, 10 aa, Homo sapiens
  heavy chain complementarity determining region 3 for antibody 36412
VQDHRYGSGN

SEQ ID NO: 72825 - protein, 9 aa, Homo sapiens
  light chain complementarity determining region 3 for antibody 36413
MQSRSWPHT

SEQ ID NO: 72826 - protein, 8 aa, Homo sapiens
  heavy chain complementarity determining region 3 for antibody 36413
TAWGSSQH

SEQ ID NO: 72827 - protein, 9 aa, Homo sapiens
  light chain complementarity determining region 3 for antibody 36414
MQSRRWPQT

SEQ ID NO: 72828 - protein, 8 aa, Homo sapiens
  heavy chain complementarity determining region 3 for antibody 36414
TAWGSSHH

SEQ ID NO: 72829 - protein, 9 aa, Homo sapiens
  light chain complementarity determining region 3 for antibody 36415
MQSLQTPRT

SEQ ID NO: 72830 - protein, 30 aa, Homo sapiens
  heavy chain complementarity determining region 3 for antibody 36415
ARGRTRTLPFIDKFGSGTNKPHPEVEWFDP

SEQ ID NO: 72831 - protein, 9 aa, Homo sapiens
  light chain complementarity determining region 3 for antibody 36416
MQSLQTPGT

SEQ ID NO: 72832 - protein, 30 aa, Homo sapiens; identical to SEQ ID NO: 66826
  heavy chain complementarity determining region 3 for antibody 36416

SEQ ID NO: 72833 - protein, 9 aa, Homo sapiens
  light chain complementarity determining region 3 for antibody 36417
MQSLQAPST

SEQ ID NO: 72834 - protein, 12 aa, Homo sapiens
  heavy chain complementarity determining region 3 for antibody 36417
TRDPPTRWGMEV

SEQ ID NO: 72835 - protein, 9 aa, Homo sapiens
  light chain complementarity determining region 3 for antibody 36418
MQSLQAPIT

SEQ ID NO: 72836 - protein, 12 aa, Homo sapiens
  heavy chain complementarity determining region 3 for antibody 36418
TREPPTRWGMEV

SEQ ID NO: 72837 - protein, 10 aa, Homo sapiens
  light chain complementarity determining region 3 for antibody 36419
MQSIQPPRRT

SEQ ID NO: 72838 - protein, 8 aa, Homo sapiens
  heavy chain complementarity determining region 3 for antibody 36419
AKGYGFDC

SEQ ID NO: 72839 - protein, 10 aa, Homo sapiens
  light chain complementarity determining region 3 for antibody 36420
MQSAHWPPFT

SEQ ID NO: 72840 - protein, 19 aa, Homo sapiens
  heavy chain complementarity determining region 3 for antibody 36420
ARDPFRTGNYWEGYDVFDI

SEQ ID NO: 72841 - protein, 9 aa, Homo sapiens
  light chain complementarity determining region 3 for antibody 36421
MQRVQTPGR

SEQ ID NO: 72842 - protein, 17 aa, Homo sapiens
  heavy chain complementarity determining region 3 for antibody 36421
IPVMLVRFLEDLQLFNY

SEQ ID NO: 72843 - protein, 9 aa, Homo sapiens
  light chain complementarity determining region 3 for antibody 36422
MQRTHWPWT

SEQ ID NO: 72844 - protein, 10 aa, Homo sapiens
  heavy chain complementarity determining region 3 for antibody 36422
VQDHRYGSGN

SEQ ID NO: 72845 - protein, 10 aa, Homo sapiens
  light chain complementarity determining region 3 for antibody 36423
MQRIQPPRWT

SEQ ID NO: 72846 - protein, 8 aa, Homo sapiens
  heavy chain complementarity determining region 3 for antibody 36423
AKGYGFDC

SEQ ID NO: 72847 - protein, 9 aa, Homo sapiens
  light chain complementarity determining region 3 for antibody 36424
MQPLQTPNT

SEQ ID NO: 72848 - protein, 13 aa, Homo sapiens
  heavy chain complementarity determining region 3 for antibody 36424
AHWGHTNGWHFDY

SEQ ID NO: 72849 - protein, 9 aa, Homo sapiens
  light chain complementarity determining region 3 for antibody 36425
MQNTQWPPT

SEQ ID NO: 72850 - protein, 8 aa, Homo sapiens
  heavy chain complementarity determining region 3 for antibody 36425
ALGQDMIY

SEQ ID NO: 72851 - protein, 9 aa, Homo sapiens
  light chain complementarity determining region 3 for antibody 36426
MQNTQGPLT

SEQ ID NO: 72852 - protein, 8 aa, Homo sapiens
  heavy chain complementarity determining region 3 for antibody 36426
ALGQDMGR

SEQ ID NO: 72853 - protein, 9 aa, Homo sapiens
  light chain complementarity determining region 3 for antibody 36427
MQHTPWPWT

SEQ ID NO: 72854 - protein, 12 aa, Homo sapiens
  heavy chain complementarity determining region 3 for antibody 36427
ATSPHRDSRSSY

SEQ ID NO: 72855 - protein, 9 aa, Homo sapiens
  light chain complementarity determining region 3 for antibody 36428
MQHTHWPWT

SEQ ID NO: 72856 - protein, 12 aa, Homo sapiens
  heavy chain complementarity determining region 3 for antibody 36428
ATSPQRDSRSSY

SEQ ID NO: 72857 - protein, 9 aa, Homo sapiens
  light chain complementarity determining region 3 for antibody 36429
MQHTHWPGP

SEQ ID NO: 72858 - protein, 12 aa, Homo sapiens
  heavy chain complementarity determining region 3 for antibody 36429
ATSPHRDSRSSY

SEQ ID NO: 72859 - protein, 9 aa, Homo sapiens
  light chain complementarity determining region 3 for antibody 36430
MQHPHWPWT

SEQ ID NO: 72860 - protein, 12 aa, Homo sapiens
  heavy chain complementarity determining region 3 for antibody 36430
ATSPHRDSRSSY

SEQ ID NO: 72861 - protein, 9 aa, Homo sapiens
  light chain complementarity determining region 3 for antibody 36431
MQGVAWPWT

SEQ ID NO: 72862 - protein, 11 aa, Homo sapiens
  heavy chain complementarity determining region 3 for antibody 36431
WAGYKYGPGDY

SEQ ID NO: 72863 - protein, 9 aa, Homo sapiens
  light chain complementarity determining region 3 for antibody 36432
MQGTYWPGT

SEQ ID NO: 72864 - protein, 11 aa, Homo sapiens
  heavy chain complementarity determining region 3 for antibody 36432
ATGGLRVVFGP

SEQ ID NO: 72865 - protein, 8 aa, Homo sapiens
  light chain complementarity determining region 3 for antibody 36433
MQGTYGPP

SEQ ID NO: 72866 - protein, 17 aa, Homo sapiens
  heavy chain complementarity determining region 3 for antibody 36433
SIYWYDGNYANPDYFDY

SEQ ID NO: 72867 - protein, 9 aa, Homo sapiens
  light chain complementarity determining region 3 for antibody 36434
MQGTYCPHI

SEQ ID NO: 72868 - protein, 11 aa, Homo sapiens
  heavy chain complementarity determining region 3 for antibody 36434
ARDPFFGALDC

SEQ ID NO: 72869 - protein, 8 aa, Homo sapiens
  light chain complementarity determining region 3 for antibody 36435
MQGTSGRR

SEQ ID NO: 72870 - protein, 17 aa, Homo sapiens
  heavy chain complementarity determining region 3 for antibody 36435
AHRRYYNGNWNGATCDV

SEQ ID NO: 72871 - protein, 8 aa, Homo sapiens
  light chain complementarity determining region 3 for antibody 36436
MQGTSGRP

SEQ ID NO: 72872 - protein, 17 aa, Homo sapiens
  heavy chain complementarity determining region 3 for antibody 36436
AHRRYYNGNWNGATCDV

SEQ ID NO: 72873 - protein, 8 aa, Homo sapiens
  light chain complementarity determining region 3 for antibody 36437
MQGTSGGP

SEQ ID NO: 72874 - protein, 17 aa, Homo sapiens
  heavy chain complementarity determining region 3 for antibody 36437
AHRRYYNGNWNGATFDV

SEQ ID NO: 72875 - protein, 10 aa, Homo sapiens
  light chain complementarity determining region 3 for antibody 36438
MQGTQWPPRT

SEQ ID NO: 72876 - protein, 5 aa, Homo sapiens
  heavy chain complementarity determining region 3 for antibody 36438
VRWDY

SEQ ID NO: 72877 - protein, 8 aa, Homo sapiens
  light chain complementarity determining region 3 for antibody 36439
MQGTQGRT

SEQ ID NO: 72878 - protein, 15 aa, Homo sapiens
  heavy chain complementarity determining region 3 for antibody 36439
VRDWAITRLLGNFDC

SEQ ID NO: 72879 - protein, 8 aa, Homo sapiens
  light chain complementarity determining region 3 for antibody 36440
MQGTQGRP

SEQ ID NO: 72880 - protein, 15 aa, Homo sapiens
  heavy chain complementarity determining region 3 for antibody 36440
ATDWSFQMIEGNFHH

SEQ ID NO: 72881 - protein, 10 aa, Homo sapiens
  light chain complementarity determining region 3 for antibody 36441
MQGTQGPPGT

SEQ ID NO: 72882 - protein, 5 aa, Homo sapiens
  heavy chain complementarity determining region 3 for antibody 36441
VRWDY

SEQ ID NO: 72883 - protein, 9 aa, Homo sapiens
  light chain complementarity determining region 3 for antibody 36442
MQGTPWPWT

SEQ ID NO: 72884 - protein, 12 aa, Homo sapiens
  heavy chain complementarity determining region 3 for antibody 36442
AKGPLIAMTGMI

SEQ ID NO: 72885 - protein, 9 aa, Homo sapiens
  light chain complementarity determining region 3 for antibody 36443
MQGTPTPPT

SEQ ID NO: 72886 - protein, 12 aa, Homo sapiens
  heavy chain complementarity determining region 3 for antibody 36443
VKVWGWLNDGGY

SEQ ID NO: 72887 - protein, 9 aa, Homo sapiens
  light chain complementarity determining region 3 for antibody 36444
MQGTPRPPT

SEQ ID NO: 72888 - protein, 16 aa, Homo sapiens
  heavy chain complementarity determining region 3 for antibody 36444
ATDWGSGTQWIRAFDV

SEQ ID NO: 72889 - protein, 10 aa, Homo sapiens
  light chain complementarity determining region 3 for antibody 36445
MQGTNWPPWT

SEQ ID NO: 72890 - protein, 7 aa, Homo sapiens
  heavy chain complementarity determining region 3 for antibody 36445
VRGTFDI

SEQ ID NO: 72891 - protein, 9 aa, Homo sapiens
  light chain complementarity determining region 3 for antibody 36446
MQGTNWPHT

SEQ ID NO: 72892 - protein, 11 aa, Homo sapiens
  heavy chain complementarity determining region 3 for antibody 36446
AMLGRGHDNDF

SEQ ID NO: 72893 - protein, 9 aa, Homo sapiens
  light chain complementarity determining region 3 for antibody 36447
MQGTNWPHI

SEQ ID NO: 72894 - protein, 11 aa, Homo sapiens
  heavy chain complementarity determining region 3 for antibody 36447
ARDPFFGALDC

SEQ ID NO: 72895 - protein, 9 aa, Homo sapiens
  light chain complementarity determining region 3 for antibody 36448
MQGTNTPPT

SEQ ID NO: 72896 - protein, 12 aa, Homo sapiens
  heavy chain complementarity determining region 3 for antibody 36448
VKVWGWLNDGGY

SEQ ID NO: 72897 - protein, 9 aa, Homo sapiens
  light chain complementarity determining region 3 for antibody 36449
MQGTNRPPT

SEQ ID NO: 72898 - protein, 16 aa, Homo sapiens
  heavy chain complementarity determining region 3 for antibody 36449
ATDWGSGTQWIRAFDV

SEQ ID NO: 72899 - protein, 8 aa, Homo sapiens
  light chain complementarity determining region 3 for antibody 36450
MQGTHWVP

SEQ ID NO: 72900 - protein, 15 aa, Homo sapiens
  heavy chain complementarity determining region 3 for antibody 36450
AKAPPGGTWGPSFDC

SEQ ID NO: 72901 - protein, 9 aa, Homo sapiens
  light chain complementarity determining region 3 for antibody 36451
MQGTHWPYT

SEQ ID NO: 72902 - protein, 11 aa, Homo sapiens
  heavy chain complementarity determining region 3 for antibody 36451
GKDGTPGGLDY

SEQ ID NO: 72903 - protein, 9 aa, Homo sapiens
  light chain complementarity determining region 3 for antibody 36452
MQGTHWPYT

SEQ ID NO: 72904 - protein, 25 aa, Homo sapiens
  heavy chain complementarity determining region 3 for antibody 36452
ARDFGVGRLRSWHQRTDKEDDTFHI

SEQ ID NO: 72905 - protein, 9 aa, Homo sapiens
  light chain complementarity determining region 3 for antibody 36453
MQGTHWPWT

SEQ ID NO: 72906 - protein, 10 aa, Homo sapiens
  heavy chain complementarity determining region 3 for antibody 36453
AREAHWGPDY

SEQ ID NO: 72907 - protein, 9 aa, Homo sapiens
  light chain complementarity determining region 3 for antibody 36454
MQGTHWPWT

SEQ ID NO: 72908 - protein, 12 aa, Homo sapiens
  heavy chain complementarity determining region 3 for antibody 36454
AKGPLIAMPGMI

SEQ ID NO: 72909 - protein, 9 aa, Homo sapiens
  light chain complementarity determining region 3 for antibody 36455
MQGTHWPWP

SEQ ID NO: 72910 - protein, 15 aa, Homo sapiens
  heavy chain complementarity determining region 3 for antibody 36455
ALGDTSRGNQYQKDV

SEQ ID NO: 72911 - protein, 9 aa, Homo sapiens
  light chain complementarity determining region 3 for antibody 36456
MQGTHWPRA

SEQ ID NO: 72912 - protein, 16 aa, Homo sapiens
  heavy chain complementarity determining region 3 for antibody 36456
ARDERGDHGDYGYFDL

SEQ ID NO: 72913 - protein, 10 aa, Homo sapiens
  light chain complementarity determining region 3 for antibody 36457
MQGTHWPPYP

SEQ ID NO: 72914 - protein, 15 aa, Homo sapiens
  heavy chain complementarity determining region 3 for antibody 36457
AKSTVTTMSGGHVDS

SEQ ID NO: 72915 - protein, 10 aa, Homo sapiens
  light chain complementarity determining region 3 for antibody 36458
MQGTHWPPWT

SEQ ID NO: 72916 - protein, 7 aa, Homo sapiens
  heavy chain complementarity determining region 3 for antibody 36458
VRGPFDI

SEQ ID NO: 72917 - protein, 9 aa, Homo sapiens
  light chain complementarity determining region 3 for antibody 36459
MQGTHWPPT

SEQ ID NO: 72918 - protein, 17 aa, Homo sapiens
  heavy chain complementarity determining region 3 for antibody 36459
AREPQAHNDLYSGYEKN

SEQ ID NO: 72919 - protein, 9 aa, Homo sapiens
  light chain complementarity determining region 3 for antibody 36460
MQGTHWPPT

SEQ ID NO: 72920 - protein, 18 aa, Homo sapiens
  heavy chain complementarity determining region 3 for antibody 36460
AKDLRAFIMRVESDNFQV

SEQ ID NO: 72921 - protein, 11 aa, Homo sapiens
  light chain complementarity determining region 3 for antibody 36461
MQGTHWPPRYT

SEQ ID NO: 72922 - protein, 17 aa, Homo sapiens
  heavy chain complementarity determining region 3 for antibody 36461
ARGGSGYYQEGDDTFGF

SEQ ID NO: 72923 - protein, 10 aa, Homo sapiens
  light chain complementarity determining region 3 for antibody 36462
MQGTHWPPGT

SEQ ID NO: 72924 - protein, 12 aa, Homo sapiens
  heavy chain complementarity determining region 3 for antibody 36462
AREFSLQDAFDI

SEQ ID NO: 72925 - protein, 9 aa, Homo sapiens
  light chain complementarity determining region 3 for antibody 36463
MQGTHWPLT

SEQ ID NO: 72926 - protein, 19 aa, Homo sapiens
  heavy chain complementarity determining region 3 for antibody 36463
VRDDRGHCSGGSCEGYFDD

SEQ ID NO: 72927 - protein, 9 aa, Homo sapiens
  light chain complementarity determining region 3 for antibody 36464
MQGTHWPLT

SEQ ID NO: 72928 - protein, 19 aa, Homo sapiens
  heavy chain complementarity determining region 3 for antibody 36464
VRDDRDQCSGGSCEGYFDD

SEQ ID NO: 72929 - protein, 9 aa, Homo sapiens
  light chain complementarity determining region 3 for antibody 36465
MQGTHWPLT

SEQ ID NO: 72930 - protein, 17 aa, Homo sapiens
  heavy chain complementarity determining region 3 for antibody 36465
ARDDRAAAAGGEYDFDL

SEQ ID NO: 72931 - protein, 9 aa, Homo sapiens
  light chain complementarity determining region 3 for antibody 36466
MQGTHWPKR

SEQ ID NO: 72932 - protein, 9 aa, Homo sapiens
  heavy chain complementarity determining region 3 for antibody 36466
AKGYYDSSY

SEQ ID NO: 72933 - protein, 9 aa, Homo sapiens
  light chain complementarity determining region 3 for antibody 36467
MQGTHWPGT

SEQ ID NO: 72934 - protein, 9 aa, Homo sapiens
  heavy chain complementarity determining region 3 for antibody 36467
AKGFYDSGG

SEQ ID NO: 72935 - protein, 9 aa, Homo sapiens
  light chain complementarity determining region 3 for antibody 36468
MQGTHWPGR

SEQ ID NO: 72936 - protein, 10 aa, Homo sapiens
  heavy chain complementarity determining region 3 for antibody 36468
ARETHWGPDY

SEQ ID NO: 72937 - protein, 9 aa, Homo sapiens
  light chain complementarity determining region 3 for antibody 36469
MQGTHWPFT

SEQ ID NO: 72938 - protein, 19 aa, Homo sapiens
  heavy chain complementarity determining region 3 for antibody 36469
VRDDRDHCSGGSCEGYFDD

SEQ ID NO: 72939 - protein, 7 aa, Homo sapiens
  light chain complementarity determining region 3 for antibody 36470
MQGTHWP

SEQ ID NO: 72940 - protein, 13 aa, Homo sapiens
  heavy chain complementarity determining region 3 for antibody 36470
ARASGYSSGPFDY

SEQ ID NO: 72941 - protein, 9 aa, Homo sapiens
  light chain complementarity determining region 3 for antibody 36471
MQGTHWLWT

SEQ ID NO: 72942 - protein, 10 aa, Homo sapiens
  heavy chain complementarity determining region 3 for antibody 36471
LHFFHASPGA

SEQ ID NO: 72943 - protein, 9 aa, Homo sapiens
  light chain complementarity determining region 3 for antibody 36472
MQGTHTPPP

SEQ ID NO: 72944 - protein, 12 aa, Homo sapiens
  heavy chain complementarity determining region 3 for antibody 36472
VKVWGWLNDGGY

SEQ ID NO: 72945 - protein, 8 aa, Homo sapiens
  light chain complementarity determining region 3 for antibody 36473
MQGTHMDT

SEQ ID NO: 72946 - protein, 15 aa, Homo sapiens
  heavy chain complementarity determining region 3 for antibody 36473
ARCGANSCPQSAMDV

SEQ ID NO: 72947 - protein, 8 aa, Homo sapiens
  light chain complementarity determining region 3 for antibody 36474
MQGTHLYT

SEQ ID NO: 72948 - protein, 15 aa, Homo sapiens
  heavy chain complementarity determining region 3 for antibody 36474
ARCGANSCPQSAMDV

SEQ ID NO: 72949 - protein, 9 aa, Homo sapiens
  light chain complementarity determining region 3 for antibody 36475
MQGTHGPRT

SEQ ID NO: 72950 - protein, 12 aa, Homo sapiens
  heavy chain complementarity determining region 3 for antibody 36475
ARGSHLIMFGGL

SEQ ID NO: 72951 - protein, 9 aa, Homo sapiens
  light chain complementarity determining region 3 for antibody 36476
MQGTHGPRT

SEQ ID NO: 72952 - protein, 10 aa, Homo sapiens
  heavy chain complementarity determining region 3 for antibody 36476
ARDWGLGSGN

SEQ ID NO: 72953 - protein, 11 aa, Homo sapiens
  light chain complementarity determining region 3 for antibody 36477
MQGTHGPPMYT

SEQ ID NO: 72954 - protein, 17 aa, Homo sapiens
  heavy chain complementarity determining region 3 for antibody 36477
ARGGSGYYQEGDDTFGF

SEQ ID NO: 72955 - protein, 10 aa, Homo sapiens
  light chain complementarity determining region 3 for antibody 36478
MQGTHGPPGT

SEQ ID NO: 72956 - protein, 11 aa, Homo sapiens
  heavy chain complementarity determining region 3 for antibody 36478
ARDHPGIGIDY

SEQ ID NO: 72957 - protein, 9 aa, Homo sapiens
  light chain complementarity determining region 3 for antibody 36479
MQGTHGPKT

SEQ ID NO: 72958 - protein, 12 aa, Homo sapiens
  heavy chain complementarity determining region 3 for antibody 36479
AKDQGVGATPDS

SEQ ID NO: 72959 - protein, 9 aa, Homo sapiens
  light chain complementarity determining region 3 for antibody 36480
MQGTFWPWT

SEQ ID NO: 72960 - protein, 19 aa, Homo sapiens
  heavy chain complementarity determining region 3 for antibody 36480
ARDRIVVGATFYSYSGMDV

SEQ ID NO: 72961 - protein, 9 aa, Homo sapiens
  light chain complementarity determining region 3 for antibody 36481
MQGSHWPRT

SEQ ID NO: 72962 - protein, 13 aa, Homo sapiens
  heavy chain complementarity determining region 3 for antibody 36481
VRNLGDGYNSIDY

SEQ ID NO: 72963 - protein, 9 aa, Homo sapiens
  light chain complementarity determining region 3 for antibody 36482
MQGSHWPRT

SEQ ID NO: 72964 - protein, 13 aa, Homo sapiens
  heavy chain complementarity determining region 3 for antibody 36482
ARDLGDGYNSIDY

SEQ ID NO: 72965 - protein, 9 aa, Homo sapiens
  light chain complementarity determining region 3 for antibody 36483
MQGSHWPPT

SEQ ID NO: 72966 - protein, 13 aa, Homo sapiens
  heavy chain complementarity determining region 3 for antibody 36483
VRKLGDGYNSIDY

SEQ ID NO: 72967 - protein, 9 aa, Homo sapiens
  light chain complementarity determining region 3 for antibody 36484
MQGSHWPLT

SEQ ID NO: 72968 - protein, 17 aa, Homo sapiens
  heavy chain complementarity determining region 3 for antibody 36484
ARDDRAAAAGGEYYFDL

SEQ ID NO: 72969 - protein, 9 aa, Homo sapiens
  light chain complementarity determining region 3 for antibody 36485
MQGSHGPPT

SEQ ID NO: 72970 - protein, 13 aa, Homo sapiens
  heavy chain complementarity determining region 3 for antibody 36485
VRNLGDGYNSIDY

SEQ ID NO: 72971 - protein, 9 aa, Homo sapiens
  light chain complementarity determining region 3 for antibody 36486
MQGPHWPWT

SEQ ID NO: 72972 - protein, 10 aa, Homo sapiens
  heavy chain complementarity determining region 3 for antibody 36486
ARETHWGPDY

SEQ ID NO: 72973 - protein, 9 aa, Homo sapiens
  light chain complementarity determining region 3 for antibody 36487
MQGLQTPYT

SEQ ID NO: 72974 - protein, 10 aa, Homo sapiens
  heavy chain complementarity determining region 3 for antibody 36487
GRDVSGARDY

SEQ ID NO: 72975 - protein, 9 aa, Homo sapiens
  light chain complementarity determining region 3 for antibody 36488
MQGLQTPYT

SEQ ID NO: 72976 - protein, 10 aa, Homo sapiens
  heavy chain complementarity determining region 3 for antibody 36488
GRDLSGAIDY

SEQ ID NO: 72977 - protein, 9 aa, Homo sapiens
  light chain complementarity determining region 3 for antibody 36489
MQGLQTPYT

SEQ ID NO: 72978 - protein, 10 aa, Homo sapiens
  heavy chain complementarity determining region 3 for antibody 36489
ARDGVGSDDQ

SEQ ID NO: 72979 - protein, 9 aa, Homo sapiens
  light chain complementarity determining region 3 for antibody 36490
MQGLQTPYP

SEQ ID NO: 72980 - protein, 10 aa, Homo sapiens
  heavy chain complementarity determining region 3 for antibody 36490
GSDLTGARDH

SEQ ID NO: 72981 - protein, 9 aa, Homo sapiens
  light chain complementarity determining region 3 for antibody 36491
MQGLQTPWT

SEQ ID NO: 72982 - protein, 15 aa, Homo sapiens
  heavy chain complementarity determining region 3 for antibody 36491
ASWVHEYGDFNAFDF

SEQ ID NO: 72983 - protein, 9 aa, Homo sapiens
  light chain complementarity determining region 3 for antibody 36492
MQGLQTPST

SEQ ID NO: 72984 - protein, 10 aa, Homo sapiens
  heavy chain complementarity determining region 3 for antibody 36492
GSDLSGARDY

SEQ ID NO: 72985 - protein, 9 aa, Homo sapiens
  light chain complementarity determining region 3 for antibody 36493
MQGLQTPNT

SEQ ID NO: 72986 - protein, 10 aa, Homo sapiens
  heavy chain complementarity determining region 3 for antibody 36493
GSDLSGARDY

SEQ ID NO: 72987 - protein, 9 aa, Homo sapiens
  light chain complementarity determining region 3 for antibody 36494
MQGLQTPHT

SEQ ID NO: 72988 - protein, 10 aa, Homo sapiens
  heavy chain complementarity determining region 3 for antibody 36494
ARDVVGSDDQ

SEQ ID NO: 72989 - protein, 9 aa, Homo sapiens
  light chain complementarity determining region 3 for antibody 36495
MQGLQTPGT

SEQ ID NO: 72990 - protein, 12 aa, Homo sapiens
  heavy chain complementarity determining region 3 for antibody 36495
ARDLGYTSGWRL

SEQ ID NO: 72991 - protein, 9 aa, Homo sapiens
  light chain complementarity determining region 3 for antibody 36496
MQGLQTPFT

SEQ ID NO: 72992 - protein, 10 aa, Homo sapiens
  heavy chain complementarity determining region 3 for antibody 36496
GSDLTGARDH

SEQ ID NO: 72993 - protein, 9 aa, Homo sapiens
  light chain complementarity determining region 3 for antibody 36497
MQGLQTPFT

SEQ ID NO: 72994 - protein, 13 aa, Homo sapiens
  heavy chain complementarity determining region 3 for antibody 36497
ARAITKAGSGFDY

SEQ ID NO: 72995 - protein, 9 aa, Homo sapiens
  light chain complementarity determining region 3 for antibody 36498
MQGLQTPET

SEQ ID NO: 72996 - protein, 10 aa, Homo sapiens
  heavy chain complementarity determining region 3 for antibody 36498
GSDLSGARDY

SEQ ID NO: 72997 - protein, 9 aa, Homo sapiens
  light chain complementarity determining region 3 for antibody 36499
MQGLQTPET

SEQ ID NO: 72998 - protein, 10 aa, Homo sapiens
  heavy chain complementarity determining region 3 for antibody 36499
ARDVVGSDDQ

SEQ ID NO: 72999 - protein, 9 aa, Homo sapiens
  light chain complementarity determining region 3 for antibody 36500
MQGLQTPDT

SEQ ID NO: 73000 - protein, 10 aa, Homo sapiens
  heavy chain complementarity determining region 3 for antibody 36500
GRDLTGSKDY

SEQ ID NO: 73001 - protein, 9 aa, Homo sapiens
  light chain complementarity determining region 3 for antibody 36501
MQGLQNPYT

SEQ ID NO: 73002 - protein, 10 aa, Homo sapiens
  heavy chain complementarity determining region 3 for antibody 36501
ARDVVGSDDQ

SEQ ID NO: 73003 - protein, 9 aa, Homo sapiens
  light chain complementarity determining region 3 for antibody 36502
MQGLQIPYT

SEQ ID NO: 73004 - protein, 10 aa, Homo sapiens
  heavy chain complementarity determining region 3 for antibody 36502
GRDLSGARDY

SEQ ID NO: 73005 - protein, 9 aa, Homo sapiens
  light chain complementarity determining region 3 for antibody 36503
MQGLQAPLS

SEQ ID NO: 73006 - protein, 18 aa, Homo sapiens
  heavy chain complementarity determining region 3 for antibody 36503
ARPKVGATDYHYYFGMDV

SEQ ID NO: 73007 - protein, 9 aa, Homo sapiens
  light chain complementarity determining region 3 for antibody 36504
MQGLPTPYT

SEQ ID NO: 73008 - protein, 10 aa, Homo sapiens
  heavy chain complementarity determining region 3 for antibody 36504
GSDLTGARDH

SEQ ID NO: 73009 - protein, 8 aa, Homo sapiens
  light chain complementarity determining region 3 for antibody 36505
MQGLHHLP

SEQ ID NO: 73010 - protein, 16 aa, Homo sapiens
  heavy chain complementarity determining region 3 for antibody 36505
AKWGGVAMAGHYYFDY

SEQ ID NO: 73011 - protein, 8 aa, Homo sapiens
  light chain complementarity determining region 3 for antibody 36506
MQGLESPP

SEQ ID NO: 73012 - protein, 12 aa, Homo sapiens
  heavy chain complementarity determining region 3 for antibody 36506
GRHDQWLVRMGN

SEQ ID NO: 73013 - protein, 9 aa, Homo sapiens
  light chain complementarity determining region 3 for antibody 36507
MQGKHWPLT

SEQ ID NO: 73014 - protein, 17 aa, Homo sapiens
  heavy chain complementarity determining region 3 for antibody 36507
ARDDRAAAAGGEYYFDL

SEQ ID NO: 73015 - protein, 8 aa, Homo sapiens
  light chain complementarity determining region 3 for antibody 36508
MQGKHMYT

SEQ ID NO: 73016 - protein, 15 aa, Homo sapiens
  heavy chain complementarity determining region 3 for antibody 36508
ARCGANSCPQSAMDV

SEQ ID NO: 73017 - protein, 9 aa, Homo sapiens
  light chain complementarity determining region 3 for antibody 36509
MQGIQTPYT

SEQ ID NO: 73018 - protein, 10 aa, Homo sapiens
  heavy chain complementarity determining region 3 for antibody 36509
GSDLTGARDH

SEQ ID NO: 73019 - protein, 9 aa, Homo sapiens
  light chain complementarity determining region 3 for antibody 36510
MQGIQTPYT

SEQ ID NO: 73020 - protein, 10 aa, Homo sapiens
  heavy chain complementarity determining region 3 for antibody 36510
GRDLSGARDY

SEQ ID NO: 73021 - protein, 9 aa, Homo sapiens
  light chain complementarity determining region 3 for antibody 36511
MQGIQTPYT

SEQ ID NO: 73022 - protein, 10 aa, Homo sapiens
  heavy chain complementarity determining region 3 for antibody 36511
ARDVVGSDDQ

SEQ ID NO: 73023 - protein, 9 aa, Homo sapiens
  light chain complementarity determining region 3 for antibody 36512
MQGFQTPYT

SEQ ID NO: 73024 - protein, 10 aa, Homo sapiens
  heavy chain complementarity determining region 3 for antibody 36512
GSDLTGARDH

SEQ ID NO: 73025 - protein, 9 aa, Homo sapiens
  light chain complementarity determining region 3 for antibody 36513
MQGAPWPPT

SEQ ID NO: 73026 - protein, 13 aa, Homo sapiens
  heavy chain complementarity determining region 3 for antibody 36513
LRASRDGYNSIDY

SEQ ID NO: 73027 - protein, 9 aa, Homo sapiens
  light chain complementarity determining region 3 for antibody 36514
MQGAHWPRT

SEQ ID NO: 73028 - protein, 10 aa, Homo sapiens
  heavy chain complementarity determining region 3 for antibody 36514
VTGTLGPTMG

SEQ ID NO: 73029 - protein, 9 aa, Homo sapiens
  light chain complementarity determining region 3 for antibody 36515
MQDLQTPYT

SEQ ID NO: 73030 - protein, 21 aa, Homo sapiens
  heavy chain complementarity determining region 3 for antibody 36515
ARDAPVSRPYSSGWYSSAFDY

SEQ ID NO: 73031 - protein, 9 aa, Homo sapiens
  light chain complementarity determining region 3 for antibody 36516
MQAVQTPYT

SEQ ID NO: 73032 - protein, 16 aa, Homo sapiens
  heavy chain complementarity determining region 3 for antibody 36516
ARAGFSFGVPIGAFDI

SEQ ID NO: 73033 - protein, 9 aa, Homo sapiens
  light chain complementarity determining region 3 for antibody 36517
MQATHWPWP

SEQ ID NO: 73034 - protein, 12 aa, Homo sapiens
  heavy chain complementarity determining region 3 for antibody 36517
AADCSSASCPGY

SEQ ID NO: 73035 - protein, 10 aa, Homo sapiens
  light chain complementarity determining region 3 for antibody 36518
MQATHWPGFP

SEQ ID NO: 73036 - protein, 10 aa, Homo sapiens
  heavy chain complementarity determining region 3 for antibody 36518
ATSQLSTTDY

SEQ ID NO: 73037 - protein, 9 aa, Homo sapiens
  light chain complementarity determining region 3 for antibody 36519
MQATHGPPV

SEQ ID NO: 73038 - protein, 18 aa, Homo sapiens
  heavy chain complementarity determining region 3 for antibody 36519
VRGGTIDWEKRQASLIDY

SEQ ID NO: 73039 - protein, 10 aa, Homo sapiens
  light chain complementarity determining region 3 for antibody 36520
MQATHGPGFT

SEQ ID NO: 73040 - protein, 10 aa, Homo sapiens
  heavy chain complementarity determining region 3 for antibody 36520
ATSQLSTTDY

SEQ ID NO: 73041 - protein, 9 aa, Homo sapiens
  light chain complementarity determining region 3 for antibody 36521
MQALRTPRT

SEQ ID NO: 73042 - protein, 6 aa, Homo sapiens
  heavy chain complementarity determining region 3 for antibody 36521
TRALDY

SEQ ID NO: 73043 - protein, 9 aa, Homo sapiens
  light chain complementarity determining region 3 for antibody 36522
MQALRSPRT

SEQ ID NO: 73044 - protein, 19 aa, Homo sapiens
  heavy chain complementarity determining region 3 for antibody 36522
ARRGATVAGISGWGYGMDV

SEQ ID NO: 73045 - protein, 9 aa, Homo sapiens
  light chain complementarity determining region 3 for antibody 36523
MQALRSPLP

SEQ ID NO: 73046 - protein, 19 aa, Homo sapiens
  heavy chain complementarity determining region 3 for antibody 36523
ARRGATVAGISGWGYGMDV

SEQ ID NO: 73047 - protein, 9 aa, Homo sapiens
  light chain complementarity determining region 3 for antibody 36524
MQALQVPNT

SEQ ID NO: 73048 - protein, 12 aa, Homo sapiens
  heavy chain complementarity determining region 3 for antibody 36524
ARARGVAGKLDS

SEQ ID NO: 73049 - protein, 8 aa, Homo sapiens
  light chain complementarity determining region 3 for antibody 36525
MQALQTRA

SEQ ID NO: 73050 - protein, 13 aa, Homo sapiens
  heavy chain complementarity determining region 3 for antibody 36525
ARDESYGDYGMDV

SEQ ID NO: 73051 - protein, 9 aa, Homo sapiens
  light chain complementarity determining region 3 for antibody 36526
MQALQTPYT

SEQ ID NO: 73052 - protein, 16 aa, Homo sapiens
  heavy chain complementarity determining region 3 for antibody 36526
ARHRAAGGGYYYGMDV

SEQ ID NO: 73053 - protein, 9 aa, Homo sapiens
  light chain complementarity determining region 3 for antibody 36527
MQALQTPYN

SEQ ID NO: 73054 - protein, 21 aa, Homo sapiens
  heavy chain complementarity determining region 3 for antibody 36527
ARDAPVSRPYSSGWYSSAFDY

SEQ ID NO: 73055 - protein, 9 aa, Homo sapiens
  light chain complementarity determining region 3 for antibody 36528
MQALQTPWT

SEQ ID NO: 73056 - protein, 20 aa, Homo sapiens
  heavy chain complementarity determining region 3 for antibody 36528
ARLFVTMAGGSDYVYAGLDP

SEQ ID NO: 73057 - protein, 9 aa, Homo sapiens
  light chain complementarity determining region 3 for antibody 36529
MQALQTPVT

SEQ ID NO: 73058 - protein, 11 aa, Homo sapiens
  heavy chain complementarity determining region 3 for antibody 36529
ARHGMWFGGLT

SEQ ID NO: 73059 - protein, 9 aa, Homo sapiens
  light chain complementarity determining region 3 for antibody 36530
MQALQTPTT

SEQ ID NO: 73060 - protein, 13 aa, Homo sapiens
  heavy chain complementarity determining region 3 for antibody 36530
TMVVDYGDYGFDC

SEQ ID NO: 73061 - protein, 8 aa, Homo sapiens
  light chain complementarity determining region 3 for antibody 36531
MQALQTPT

SEQ ID NO: 73062 - protein, 14 aa, Homo sapiens
  heavy chain complementarity determining region 3 for antibody 36531
RRDYYDSSGYRLDY

SEQ ID NO: 73063 - protein, 8 aa, Homo sapiens
  light chain complementarity determining region 3 for antibody 36532
MQALQTPS

SEQ ID NO: 73064 - protein, 15 aa, Homo sapiens
  heavy chain complementarity determining region 3 for antibody 36532
ARRDYYDSSGYRLDY

SEQ ID NO: 73065 - protein, 9 aa, Homo sapiens
  light chain complementarity determining region 3 for antibody 36533
MQALQTPQT

SEQ ID NO: 73066 - protein, 13 aa, Homo sapiens
  heavy chain complementarity determining region 3 for antibody 36533
ARFQGAAAGLGVH

SEQ ID NO: 73067 - protein, 9 aa, Homo sapiens
  light chain complementarity determining region 3 for antibody 36534
MQALQTPQP

SEQ ID NO: 73068 - protein, 13 aa, Homo sapiens
  heavy chain complementarity determining region 3 for antibody 36534
ARFQGAAAGLGLH

SEQ ID NO: 73069 - protein, 10 aa, Homo sapiens
  light chain complementarity determining region 3 for antibody 36535
MQALQTPQFT

SEQ ID NO: 73070 - protein, 20 aa, Homo sapiens
  heavy chain complementarity determining region 3 for antibody 36535
ARGKRAEPAVRKYYYNGLDV

SEQ ID NO: 73071 - protein, 9 aa, Homo sapiens
  light chain complementarity determining region 3 for antibody 36536
MQALQTPPP

SEQ ID NO: 73072 - protein, 15 aa, Homo sapiens
  heavy chain complementarity determining region 3 for antibody 36536
ARDGLRDGFSDAFDI

SEQ ID NO: 73073 - protein, 9 aa, Homo sapiens
  light chain complementarity determining region 3 for antibody 36537
MQALQTPPN

SEQ ID NO: 73074 - protein, 22 aa, Homo sapiens
  heavy chain complementarity determining region 3 for antibody 36537
VKDHNNMARGVTIEGKYNWFDP

SEQ ID NO: 73075 - protein, 8 aa, Homo sapiens
  light chain complementarity determining region 3 for antibody 36538
MQALQTPP

SEQ ID NO: 73076 - protein, 16 aa, Homo sapiens
  heavy chain complementarity determining region 3 for antibody 36538
ARAFWSGYLRSGGMDV

SEQ ID NO: 73077 - protein, 9 aa, Homo sapiens
  light chain complementarity determining region 3 for antibody 36539
MQALQTPLP

SEQ ID NO: 73078 - protein, 24 aa, Homo sapiens
  heavy chain complementarity determining region 3 for antibody 36539
ARDRRASFYDIWTGYTETWDAFDI

SEQ ID NO: 73079 - protein, 9 aa, Homo sapiens
  light chain complementarity determining region 3 for antibody 36540
MQALQTPIT

SEQ ID NO: 73080 - protein, 10 aa, Homo sapiens
  heavy chain complementarity determining region 3 for antibody 36540
GMSIAVAASN

SEQ ID NO: 73081 - protein, 9 aa, Homo sapiens
  light chain complementarity determining region 3 for antibody 36541
MQALQTPHT

SEQ ID NO: 73082 - protein, 21 aa, Homo sapiens
  heavy chain complementarity determining region 3 for antibody 36541
ARDAPVSRPYSSGWYSSAFDY

SEQ ID NO: 73083 - protein, 9 aa, Homo sapiens
  light chain complementarity determining region 3 for antibody 36542
MQALQTPGT

SEQ ID NO: 73084 - protein, 20 aa, Homo sapiens
  heavy chain complementarity determining region 3 for antibody 36542
ATSLSAYDSSGYRSLYAFDI

SEQ ID NO: 73085 - protein, 9 aa, Homo sapiens
  light chain complementarity determining region 3 for antibody 36543
MQALQTPGT

SEQ ID NO: 73086 - protein, 9 aa, Homo sapiens
  heavy chain complementarity determining region 3 for antibody 36543
AKGKDAFGV

SEQ ID NO: 73087 - protein, 9 aa, Homo sapiens
  light chain complementarity determining region 3 for antibody 36544
MQALQTPAT

SEQ ID NO: 73088 - protein, 21 aa, Homo sapiens
  heavy chain complementarity determining region 3 for antibody 36544
ARDAPVSRPYSSGWYSSAFDY

SEQ ID NO: 73089 - protein, 9 aa, Homo sapiens
  light chain complementarity determining region 3 for antibody 36545
MQALQTLLT

SEQ ID NO: 73090 - protein, 15 aa, Homo sapiens
  heavy chain complementarity determining region 3 for antibody 36545
TYSSSWLGYYYGMDV

SEQ ID NO: 73091 - protein, 9 aa, Homo sapiens
  light chain complementarity determining region 3 for antibody 36546
MQALQTAQT

SEQ ID NO: 73092 - protein, 21 aa, Homo sapiens
  heavy chain complementarity determining region 3 for antibody 36546
ARSMGCISTSCYAGWSYGMDV

SEQ ID NO: 73093 - protein, 9 aa, Homo sapiens
  light chain complementarity determining region 3 for antibody 36547
MQALQSPVT

SEQ ID NO: 73094 - protein, 12 aa, Homo sapiens
  heavy chain complementarity determining region 3 for antibody 36547
ARDGGKSWSELT

SEQ ID NO: 73095 - protein, 9 aa, Homo sapiens
  light chain complementarity determining region 3 for antibody 36548
MQALQSPLT

SEQ ID NO: 73096 - protein, 19 aa, Homo sapiens
  heavy chain complementarity determining region 3 for antibody 36548
ATDRGQGQQVVPAYWYLYL

SEQ ID NO: 73097 - protein, 9 aa, Homo sapiens
  light chain complementarity determining region 3 for antibody 36549
MQALQSPLT

SEQ ID NO: 73098 - protein, 12 aa, Homo sapiens
  heavy chain complementarity determining region 3 for antibody 36549
ARDGGKSWSDLT

SEQ ID NO: 73099 - protein, 9 aa, Homo sapiens
  light chain complementarity determining region 3 for antibody 36550
MQALQSLFT

SEQ ID NO: 73100 - protein, 25 aa, Homo sapiens
  heavy chain complementarity determining region 3 for antibody 36550
ATPRILTADGELIMTGPDYYSGVDV

SEQ ID NO: 73101 - protein, 8 aa, Homo sapiens
  light chain complementarity determining region 3 for antibody 36551
MQALQPPT

SEQ ID NO: 73102 - protein, 15 aa, Homo sapiens
  heavy chain complementarity determining region 3 for antibody 36551
ARRDYYDSSGYRLDY

SEQ ID NO: 73103 - protein, 9 aa, Homo sapiens
  light chain complementarity determining region 3 for antibody 36552
MQALQIPRT

SEQ ID NO: 73104 - protein, 6 aa, Homo sapiens
  heavy chain complementarity determining region 3 for antibody 36552
TRALDY

SEQ ID NO: 73105 - protein, 9 aa, Homo sapiens
  light chain complementarity determining region 3 for antibody 36553
MQALQAPRA

SEQ ID NO: 73106 - protein, 13 aa, Homo sapiens
  heavy chain complementarity determining region 3 for antibody 36553
ARPNNALGRAFDI

SEQ ID NO: 73107 - protein, 9 aa, Homo sapiens
  light chain complementarity determining region 3 for antibody 36554
MQALQAPIT

SEQ ID NO: 73108 - protein, 12 aa, Homo sapiens
  heavy chain complementarity determining region 3 for antibody 36554
TRDPPTRWGMEV

SEQ ID NO: 73109 - protein, 8 aa, Homo sapiens
  light chain complementarity determining region 3 for antibody 36555
MQALQALP

SEQ ID NO: 73110 - protein, 16 aa, Homo sapiens
  heavy chain complementarity determining region 3 for antibody 36555
AKAGWLVGYDLSRGCA

SEQ ID NO: 73111 - protein, 9 aa, Homo sapiens
  light chain complementarity determining region 3 for antibody 36556
MQALPTPFT

SEQ ID NO: 73112 - protein, 13 aa, Homo sapiens
  heavy chain complementarity determining region 3 for antibody 36556
ARAITKAGSGFDY

SEQ ID NO: 73113 - protein, 8 aa, Homo sapiens
  light chain complementarity determining region 3 for antibody 36557
MQALKTPT

SEQ ID NO: 73114 - protein, 15 aa, Homo sapiens
  heavy chain complementarity determining region 3 for antibody 36557
ARRDYYDSSGYRLDY

SEQ ID NO: 73115 - protein, 10 aa, Homo sapiens
  light chain complementarity determining region 3 for antibody 36558
MQALHTPPWT

SEQ ID NO: 73116 - protein, 17 aa, Homo sapiens
  heavy chain complementarity determining region 3 for antibody 36558
TSLGYSFGSVSYYGLDV

SEQ ID NO: 73117 - protein, 9 aa, Homo sapiens
  light chain complementarity determining region 3 for antibody 36559
MQALHTPFT

SEQ ID NO: 73118 - protein, 13 aa, Homo sapiens
  heavy chain complementarity determining region 3 for antibody 36559
ARAITKAGSGFDY

SEQ ID NO: 73119 - protein, 8 aa, Homo sapiens
  light chain complementarity determining region 3 for antibody 36560
MQALHTGR

SEQ ID NO: 73120 - protein, 18 aa, Homo sapiens
  heavy chain complementarity determining region 3 for antibody 36560
ARSRPYGGDANPARHFDY

SEQ ID NO: 73121 - protein, 8 aa, Homo sapiens
  light chain complementarity determining region 3 for antibody 36561
MQALHLLT

SEQ ID NO: 73122 - protein, 16 aa, Homo sapiens
  heavy chain complementarity determining region 3 for antibody 36561
AKWGGVAMAGHYYFDY

SEQ ID NO: 73123 - protein, 9 aa, Homo sapiens
  light chain complementarity determining region 3 for antibody 36562
MQALGTPFT

SEQ ID NO: 73124 - protein, 15 aa, Homo sapiens
  heavy chain complementarity determining region 3 for antibody 36562
VRHYRVLAAGIEGDS

SEQ ID NO: 73125 - protein, 9 aa, Homo sapiens
  light chain complementarity determining region 3 for antibody 36563
MQALGIPPT

SEQ ID NO: 73126 - protein, 12 aa, Homo sapiens
  heavy chain complementarity determining region 3 for antibody 36563
AKDLVGGARGGN

SEQ ID NO: 73127 - protein, 9 aa, Homo sapiens
  light chain complementarity determining region 3 for antibody 36564
MQALETQFT

SEQ ID NO: 73128 - protein, 15 aa, Homo sapiens
  heavy chain complementarity determining region 3 for antibody 36564
VRHYRETVAGIEGDS

SEQ ID NO: 73129 - protein, 9 aa, Homo sapiens
  light chain complementarity determining region 3 for antibody 36565
MQALETPST

SEQ ID NO: 73130 - protein, 15 aa, Homo sapiens
  heavy chain complementarity determining region 3 for antibody 36565
VRHYRIITAPLEGDS

SEQ ID NO: 73131 - protein, 9 aa, Homo sapiens
  light chain complementarity determining region 3 for antibody 36566
MQALETPFT

SEQ ID NO: 73132 - protein, 15 aa, Homo sapiens
  heavy chain complementarity determining region 3 for antibody 36566
VRQYRELTTGIEGDS

SEQ ID NO: 73133 - protein, 9 aa, Homo sapiens
  light chain complementarity determining region 3 for antibody 36567
MQALETPFT

SEQ ID NO: 73134 - protein, 15 aa, Homo sapiens
  heavy chain complementarity determining region 3 for antibody 36567
VRHYRKTVAGIEGDS

SEQ ID NO: 73135 - protein, 9 aa, Homo sapiens
  light chain complementarity determining region 3 for antibody 36568
MQALETPFT

SEQ ID NO: 73136 - protein, 15 aa, Homo sapiens
  heavy chain complementarity determining region 3 for antibody 36568
VRHYRIITAPLEGDP

SEQ ID NO: 73137 - protein, 9 aa, Homo sapiens
  light chain complementarity determining region 3 for antibody 36569
MQALETPFT

SEQ ID NO: 73138 - protein, 15 aa, Homo sapiens
  heavy chain complementarity determining region 3 for antibody 36569
VRHYRETVAGIDGDC

SEQ ID NO: 73139 - protein, 9 aa, Homo sapiens
  light chain complementarity determining region 3 for antibody 36570
MQALETPFT

SEQ ID NO: 73140 - protein, 15 aa, Homo sapiens
  heavy chain complementarity determining region 3 for antibody 36570
VRHYRELTTGTEGDS

SEQ ID NO: 73141 - protein, 9 aa, Homo sapiens
  light chain complementarity determining region 3 for antibody 36571
MQALETPFP

SEQ ID NO: 73142 - protein, 15 aa, Homo sapiens
  heavy chain complementarity determining region 3 for antibody 36571
VRHYRELTTGIEGDS

SEQ ID NO: 73143 - protein, 9 aa, Homo sapiens
  light chain complementarity determining region 3 for antibody 36572
MQALESPFT

SEQ ID NO: 73144 - protein, 15 aa, Homo sapiens
  heavy chain complementarity determining region 3 for antibody 36572
VRHYRIITAPLEGDS

SEQ ID NO: 73145 - protein, 9 aa, Homo sapiens
  light chain complementarity determining region 3 for antibody 36573
MQALEPPFT

SEQ ID NO: 73146 - protein, 15 aa, Homo sapiens
  heavy chain complementarity determining region 3 for antibody 36573
VRHYRIITAPLEGDS

SEQ ID NO: 73147 - protein, 9 aa, Homo sapiens
  light chain complementarity determining region 3 for antibody 36574
MQALEPPFT

SEQ ID NO: 73148 - protein, 15 aa, Homo sapiens
  heavy chain complementarity determining region 3 for antibody 36574
VRHYRELTTGIEGDS

SEQ ID NO: 73149 - protein, 9 aa, Homo sapiens
  light chain complementarity determining region 3 for antibody 36575
MQALENPFT

SEQ ID NO: 73150 - protein, 15 aa, Homo sapiens
  heavy chain complementarity determining region 3 for antibody 36575
VRHYRIITAPLEGDS

SEQ ID NO: 73151 - protein, 9 aa, Homo sapiens
  light chain complementarity determining region 3 for antibody 36576
MQALENPFT

SEQ ID NO: 73152 - protein, 15 aa, Homo sapiens
  heavy chain complementarity determining region 3 for antibody 36576
VRHYRETVAGIEGDS

SEQ ID NO: 73153 - protein, 9 aa, Homo sapiens
  light chain complementarity determining region 3 for antibody 36577
MQALELPFT

SEQ ID NO: 73154 - protein, 15 aa, Homo sapiens
  heavy chain complementarity determining region 3 for antibody 36577
VRHYRIITAPLEGDS

SEQ ID NO: 73155 - protein, 9 aa, Homo sapiens
  light chain complementarity determining region 3 for antibody 36578
MQALEIPLT

SEQ ID NO: 73156 - protein, 15 aa, Homo sapiens
  heavy chain complementarity determining region 3 for antibody 36578
VRHYRIITAPLEGDS

SEQ ID NO: 73157 - protein, 9 aa, Homo sapiens
  light chain complementarity determining region 3 for antibody 36579
MQALEIPFT

SEQ ID NO: 73158 - protein, 15 aa, Homo sapiens
  heavy chain complementarity determining region 3 for antibody 36579
VRHYRIITAPLEGDS

SEQ ID NO: 73159 - protein, 9 aa, Homo sapiens
  light chain complementarity determining region 3 for antibody 36580
MQALEIPFT

SEQ ID NO: 73160 - protein, 15 aa, Homo sapiens
  heavy chain complementarity determining region 3 for antibody 36580
VRHYRELATGIEGDS

SEQ ID NO: 73161 - protein, 9 aa, Homo sapiens
  light chain complementarity determining region 3 for antibody 36581
MQALATPFT

SEQ ID NO: 73162 - protein, 15 aa, Homo sapiens
  heavy chain complementarity determining region 3 for antibody 36581
VRHYRETVAGIEGDS

SEQ ID NO: 73163 - protein, 9 aa, Homo sapiens
  light chain complementarity determining region 3 for antibody 36582
MPGLQTPYT

SEQ ID NO: 73164 - protein, 10 aa, Homo sapiens
  heavy chain complementarity determining region 3 for antibody 36582
ARDVVGSDDQ

SEQ ID NO: 73165 - protein, 9 aa, Homo sapiens
  light chain complementarity determining region 3 for antibody 36583
MPGAHWPPT

SEQ ID NO: 73166 - protein, 13 aa, Homo sapiens
  heavy chain complementarity determining region 3 for antibody 36583
LRASRDGYNSIDY

SEQ ID NO: 73167 - protein, 9 aa, Homo sapiens
  light chain complementarity determining region 3 for antibody 36584
MPDTHWPHT

SEQ ID NO: 73168 - protein, 14 aa, Homo sapiens
  heavy chain complementarity determining region 3 for antibody 36584
ARFMVRDVLYFFDF

SEQ ID NO: 73169 - protein, 9 aa, Homo sapiens
  light chain complementarity determining region 3 for antibody 36585
MPALETPFT

SEQ ID NO: 73170 - protein, 15 aa, Homo sapiens
  heavy chain complementarity determining region 3 for antibody 36585
VRHYRIITAPLEGDS

SEQ ID NO: 73171 - protein, 9 aa, Homo sapiens
  light chain complementarity determining region 3 for antibody 36586
MLALQAPRA

SEQ ID NO: 73172 - protein, 13 aa, Homo sapiens
  heavy chain complementarity determining region 3 for antibody 36586
ARPNNALGRAFDI

SEQ ID NO: 73173 - protein, 8 aa, Homo sapiens
  light chain complementarity determining region 3 for antibody 36587
MKGTQGRP

SEQ ID NO: 73174 - protein, 15 aa, Homo sapiens
  heavy chain complementarity determining region 3 for antibody 36587
ATDWSCQMIEGNFHH

SEQ ID NO: 73175 - protein, 9 aa, Homo sapiens
  light chain complementarity determining region 3 for antibody 36588
MKALETPFT

SEQ ID NO: 73176 - protein, 15 aa, Homo sapiens
  heavy chain complementarity determining region 3 for antibody 36588
VRHYRETVAGIEGDS

SEQ ID NO: 73177 - protein, 9 aa, Homo sapiens
  light chain complementarity determining region 3 for antibody 36589
MHGLQTPYT

SEQ ID NO: 73178 - protein, 10 aa, Homo sapiens
  heavy chain complementarity determining region 3 for antibody 36589
GRDLSGARDY

SEQ ID NO: 73179 - protein, 9 aa, Homo sapiens
  light chain complementarity determining region 3 for antibody 36590
MHALQAPRG

SEQ ID NO: 73180 - protein, 13 aa, Homo sapiens
  heavy chain complementarity determining region 3 for antibody 36590
ARPNNQLGRAFDV

SEQ ID NO: 73181 - protein, 9 aa, Homo sapiens
  light chain complementarity determining region 3 for antibody 36591
MHALQAPRG

SEQ ID NO: 73182 - protein, 13 aa, Homo sapiens
  heavy chain complementarity determining region 3 for antibody 36591
ARPNNALGRAFDI

SEQ ID NO: 73183 - protein, 9 aa, Homo sapiens
  light chain complementarity determining region 3 for antibody 36592
MHALHAPRA

SEQ ID NO: 73184 - protein, 13 aa, Homo sapiens
  heavy chain complementarity determining region 3 for antibody 36592
ARPNNALGRAFDI

SEQ ID NO: 73185 - protein, 9 aa, Homo sapiens
  light chain complementarity determining region 3 for antibody 36593
MGTLQTPPT

SEQ ID NO: 73186 - protein, 15 aa, Homo sapiens
  heavy chain complementarity determining region 3 for antibody 36593
TRDGKKDGHNDAFDV

SEQ ID NO: 73187 - protein, 9 aa, Homo sapiens
  light chain complementarity determining region 3 for antibody 36594
MGTLQTPPP

SEQ ID NO: 73188 - protein, 12 aa, Homo sapiens
  heavy chain complementarity determining region 3 for antibody 36594
ARDLGYTSGWRL

SEQ ID NO: 73189 - protein, 9 aa, Homo sapiens
  light chain complementarity determining region 3 for antibody 36595
MGTLQNPPT

SEQ ID NO: 73190 - protein, 15 aa, Homo sapiens
  heavy chain complementarity determining region 3 for antibody 36595
TRDGKKDGHNDAFDI

SEQ ID NO: 73191 - protein, 9 aa, Homo sapiens
  light chain complementarity determining region 3 for antibody 36596
MEALRAPLP

SEQ ID NO: 73192 - protein, 19 aa, Homo sapiens
  heavy chain complementarity determining region 3 for antibody 36596
ANRKSLIQNLVGWGWAMGY

SEQ ID NO: 73193 - protein, 9 aa, Homo sapiens
  light chain complementarity determining region 3 for antibody 36597
MASSHWPLS

SEQ ID NO: 73194 - protein, 8 aa, Homo sapiens
  heavy chain complementarity determining region 3 for antibody 36597
ARGRSMSE

SEQ ID NO: 73195 - protein, 9 aa, Homo sapiens
  light chain complementarity determining region 3 for antibody 36598
MASRPWPLS

SEQ ID NO: 73196 - protein, 8 aa, Homo sapiens
  heavy chain complementarity determining region 3 for antibody 36598
ARGRSMSE

SEQ ID NO: 73197 - protein, 9 aa, Homo sapiens
  light chain complementarity determining region 3 for antibody 36599
MASRNWPLS

SEQ ID NO: 73198 - protein, 8 aa, Homo sapiens
  heavy chain complementarity determining region 3 for antibody 36599
ARGRSMSE

SEQ ID NO: 73199 - protein, 9 aa, Homo sapiens
  light chain complementarity determining region 3 for antibody 36600
MASGHWPLS

SEQ ID NO: 73200 - protein, 8 aa, Homo sapiens
  heavy chain complementarity determining region 3 for antibody 36600
ARGRSMSE

SEQ ID NO: 73201 - protein, 9 aa, Homo sapiens
  light chain complementarity determining region 3 for antibody 36601
LQYYATPRT

SEQ ID NO: 73202 - protein, 15 aa, Homo sapiens
  heavy chain complementarity determining region 3 for antibody 36601
VRQSKVDNNYNYPDF

SEQ ID NO: 73203 - protein, 9 aa, Homo sapiens
  light chain complementarity determining region 3 for antibody 36602
LQYYAPPWT

SEQ ID NO: 73204 - protein, 15 aa, Homo sapiens
  heavy chain complementarity determining region 3 for antibody 36602
VRQSKVDNNYNYPDF

SEQ ID NO: 73205 - protein, 9 aa, Homo sapiens
  light chain complementarity determining region 3 for antibody 36603
LQYKSYPRT

SEQ ID NO: 73206 - protein, 6 aa, Homo sapiens
  heavy chain complementarity determining region 3 for antibody 36603
SSALDY

SEQ ID NO: 73207 - protein, 9 aa, Homo sapiens
  light chain complementarity determining region 3 for antibody 36604
LQYKSYPPT

SEQ ID NO: 73208 - protein, 6 aa, Homo sapiens
  heavy chain complementarity determining region 3 for antibody 36604
SRALDY

SEQ ID NO: 73209 - protein, 9 aa, Homo sapiens
  light chain complementarity determining region 3 for antibody 36605
LQYHTFPYT

SEQ ID NO: 73210 - protein, 13 aa, Homo sapiens
  heavy chain complementarity determining region 3 for antibody 36605
ARFCGGDCSPFDY

SEQ ID NO: 73211 - protein, 9 aa, Homo sapiens
  light chain complementarity determining region 3 for antibody 36606
LQYHRTPFT

SEQ ID NO: 73212 - protein, 10 aa, Homo sapiens
  heavy chain complementarity determining region 3 for antibody 36606
GGGWGSHPEH

SEQ ID NO: 73213 - protein, 9 aa, Homo sapiens
  light chain complementarity determining region 3 for antibody 36607
LQYGSSPRT

SEQ ID NO: 73214 - protein, 25 aa, Homo sapiens
  heavy chain complementarity determining region 3 for antibody 36607
ARLRIDRLRLPGAMRGPLYDCGLNV

SEQ ID NO: 73215 - protein, 9 aa, Homo sapiens
  light chain complementarity determining region 3 for antibody 36608
LQYGGPPLT

SEQ ID NO: 73216 - protein, 8 aa, Homo sapiens
  heavy chain complementarity determining region 3 for antibody 36608
VRIMDPGY

SEQ ID NO: 73217 - protein, 9 aa, Homo sapiens
  light chain complementarity determining region 3 for antibody 36609
LQVVSFPCT

SEQ ID NO: 73218 - protein, 8 aa, Homo sapiens
  heavy chain complementarity determining region 3 for antibody 36609
ARNSGWYD

SEQ ID NO: 73219 - protein, 9 aa, Homo sapiens
  light chain complementarity determining region 3 for antibody 36610
LQVHTDPLT

SEQ ID NO: 73220 - protein, 10 aa, Homo sapiens
  heavy chain complementarity determining region 3 for antibody 36610
VVGSGWFFEY

SEQ ID NO: 73221 - protein, 9 aa, Homo sapiens
  light chain complementarity determining region 3 for antibody 36611
LQRIHWPWT

SEQ ID NO: 73222 - protein, 11 aa, Homo sapiens
  heavy chain complementarity determining region 3 for antibody 36611
ARFERRKPGPD

SEQ ID NO: 73223 - protein, 9 aa, Homo sapiens
  light chain complementarity determining region 3 for antibody 36612
LQNEYWPRT

SEQ ID NO: 73224 - protein, 11 aa, Homo sapiens
  heavy chain complementarity determining region 3 for antibody 36612
VRVGGAGSFDH

SEQ ID NO: 73225 - protein, 9 aa, Homo sapiens
  light chain complementarity determining region 3 for antibody 36613
LQNEYWPRP

SEQ ID NO: 73226 - protein, 11 aa, Homo sapiens
  heavy chain complementarity determining region 3 for antibody 36613
VRVGGAGYFDH

SEQ ID NO: 73227 - protein, 9 aa, Homo sapiens
  light chain complementarity determining region 3 for antibody 36614
LQNECWPRT

SEQ ID NO: 73228 - protein, 11 aa, Homo sapiens
  heavy chain complementarity determining region 3 for antibody 36614
VRVGGAGYFDH

SEQ ID NO: 73229 - protein, 9 aa, Homo sapiens
  light chain complementarity determining region 3 for antibody 36615
LQNDYWPRP

SEQ ID NO: 73230 - protein, 11 aa, Homo sapiens
  heavy chain complementarity determining region 3 for antibody 36615
VRVGGAGYFDH

SEQ ID NO: 73231 - protein, 9 aa, Homo sapiens
  light chain complementarity determining region 3 for antibody 36616
LQNAYWPRT

SEQ ID NO: 73232 - protein, 11 aa, Homo sapiens
  heavy chain complementarity determining region 3 for antibody 36616
VRVGGAGYFDH

SEQ ID NO: 73233 - protein, 9 aa, Homo sapiens
  light chain complementarity determining region 3 for antibody 36617
LQLYNFPWT

SEQ ID NO: 73234 - protein, 12 aa, Homo sapiens
  heavy chain complementarity determining region 3 for antibody 36617
ARHLRVPERLDS

SEQ ID NO: 73235 - protein, 9 aa, Homo sapiens
  light chain complementarity determining region 3 for antibody 36618
LQLSISPRT

SEQ ID NO: 73236 - protein, 11 aa, Homo sapiens
  heavy chain complementarity determining region 3 for antibody 36618
TTGLGSGGINW

SEQ ID NO: 73237 - protein, 9 aa, Homo sapiens
  light chain complementarity determining region 3 for antibody 36619
LQHYTYPFT

SEQ ID NO: 73238 - protein, 20 aa, Homo sapiens
  heavy chain complementarity determining region 3 for antibody 36619
ARGAHVVVVTSFRGSQGINS

SEQ ID NO: 73239 - protein, 9 aa, Homo sapiens
  light chain complementarity determining region 3 for antibody 36620
LQHYNLPWT

SEQ ID NO: 73240 - protein, 12 aa, Homo sapiens
  heavy chain complementarity determining region 3 for antibody 36620
ARHLRVPERLDS

SEQ ID NO: 73241 - protein, 9 aa, Homo sapiens
  light chain complementarity determining region 3 for antibody 36621
LQHYNFPWP

SEQ ID NO: 73242 - protein, 12 aa, Homo sapiens
  heavy chain complementarity determining region 3 for antibody 36621
ARHLRVPERLDS

SEQ ID NO: 73243 - protein, 9 aa, Homo sapiens
  light chain complementarity determining region 3 for antibody 36622
LQHYNFPCT

SEQ ID NO: 73244 - protein, 12 aa, Homo sapiens
  heavy chain complementarity determining region 3 for antibody 36622
ARHLRVPERLDS

SEQ ID NO: 73245 - protein, 9 aa, Homo sapiens
  light chain complementarity determining region 3 for antibody 36623
LQHSISPRT

SEQ ID NO: 73246 - protein, 11 aa, Homo sapiens
  heavy chain complementarity determining region 3 for antibody 36623
TTGLGSGGITW

SEQ ID NO: 73247 - protein, 9 aa, Homo sapiens
  light chain complementarity determining region 3 for antibody 36624
LQHSISPRT

SEQ ID NO: 73248 - protein, 11 aa, Homo sapiens
  heavy chain complementarity determining region 3 for antibody 36624
TTGLGSGGIDW

SEQ ID NO: 73249 - protein, 9 aa, Homo sapiens
  light chain complementarity determining region 3 for antibody 36625
LQHSGDSWT

SEQ ID NO: 73250 - protein, 20 aa, Homo sapiens
  heavy chain complementarity determining region 3 for antibody 36625
ARAREILQVMPGLAAGSPDC

SEQ ID NO: 73251 - protein, 9 aa, Homo sapiens
  light chain complementarity determining region 3 for antibody 36626
LQHNTYPRT

SEQ ID NO: 73252 - protein, 17 aa, Homo sapiens
  heavy chain complementarity determining region 3 for antibody 36626
ARDKARDYNSSPRACDQ

SEQ ID NO: 73253 - protein, 9 aa, Homo sapiens
  light chain complementarity determining region 3 for antibody 36627
LQHNSYPRT

SEQ ID NO: 73254 - protein, 13 aa, Homo sapiens
  heavy chain complementarity determining region 3 for antibody 36627
AREIYSSSFSFDY

SEQ ID NO: 73255 - protein, 9 aa, Homo sapiens
  light chain complementarity determining region 3 for antibody 36628
LQHNSYPPT

SEQ ID NO: 73256 - protein, 17 aa, Homo sapiens
  heavy chain complementarity determining region 3 for antibody 36628
ARGTRRGYCSAGSCYGY

SEQ ID NO: 73257 - protein, 9 aa, Homo sapiens
  light chain complementarity determining region 3 for antibody 36629
LQHNSYPLT

SEQ ID NO: 73258 - protein, 17 aa, Homo sapiens
  heavy chain complementarity determining region 3 for antibody 36629
ARGTRRGYCSAGSCSGY

SEQ ID NO: 73259 - protein, 9 aa, Homo sapiens
  light chain complementarity determining region 3 for antibody 36630
LQHNSYPLT

SEQ ID NO: 73260 - protein, 17 aa, Homo sapiens
  heavy chain complementarity determining region 3 for antibody 36630
ARGTRRGDCSAGSCYGY

SEQ ID NO: 73261 - protein, 9 aa, Homo sapiens
  light chain complementarity determining region 3 for antibody 36631
LQHNSYPLT

SEQ ID NO: 73262 - protein, 17 aa, Homo sapiens
  heavy chain complementarity determining region 3 for antibody 36631
ARGPRRGYCSAGSCYGY

SEQ ID NO: 73263 - protein, 9 aa, Homo sapiens
  light chain complementarity determining region 3 for antibody 36632
LQHNSYPLT

SEQ ID NO: 73264 - protein, 17 aa, Homo sapiens
  heavy chain complementarity determining region 3 for antibody 36632
ARGARRGYCSAGSCYGY

SEQ ID NO: 73265 - protein, 9 aa, Homo sapiens
  light chain complementarity determining region 3 for antibody 36633
LQHNSYPLP

SEQ ID NO: 73266 - protein, 13 aa, Homo sapiens
  heavy chain complementarity determining region 3 for antibody 36633
ARHMVRGGMVVDD

SEQ ID NO: 73267 - protein, 9 aa, Homo sapiens
  light chain complementarity determining region 3 for antibody 36634
LQHNSYLVH

SEQ ID NO: 73268 - protein, 14 aa, Homo sapiens
  heavy chain complementarity determining region 3 for antibody 36634
TRTSIWGVGSYFDS

SEQ ID NO: 73269 - protein, 9 aa, Homo sapiens
  light chain complementarity determining region 3 for antibody 36635
LQHKTYPRT

SEQ ID NO: 73270 - protein, 8 aa, Homo sapiens
  heavy chain complementarity determining region 3 for antibody 36635
PTGGRDGC

SEQ ID NO: 73271 - protein, 9 aa, Homo sapiens
  light chain complementarity determining region 3 for antibody 36636
LQHKSYPHP

SEQ ID NO: 73272 - protein, 15 aa, Homo sapiens
  heavy chain complementarity determining region 3 for antibody 36636
GRSKFYYDTISQFDY

SEQ ID NO: 73273 - protein, 9 aa, Homo sapiens
  light chain complementarity determining region 3 for antibody 36637
LQHKSFPLT

SEQ ID NO: 73274 - protein, 16 aa, Homo sapiens
  heavy chain complementarity determining region 3 for antibody 36637
ARDLMIFGVVQHWFDP

SEQ ID NO: 73275 - protein, 9 aa, Homo sapiens
  light chain complementarity determining region 3 for antibody 36638
LQHDNFPLT

SEQ ID NO: 73276 - protein, 28 aa, Homo sapiens
  heavy chain complementarity determining region 3 for antibody 36638
ARDRAKSDYGSGSYLPGKVLYYYYGMDV

SEQ ID NO: 73277 - protein, 9 aa, Homo sapiens
  light chain complementarity determining region 3 for antibody 36639
LQHDNFHLT

SEQ ID NO: 73278 - protein, 14 aa, Homo sapiens
  heavy chain complementarity determining region 3 for antibody 36639
ARDRRFWANWYFDL

SEQ ID NO: 73279 - protein, 9 aa, Homo sapiens
  light chain complementarity determining region 3 for antibody 36640
LQGTHWPLT

SEQ ID NO: 73280 - protein, 19 aa, Homo sapiens
  heavy chain complementarity determining region 3 for antibody 36640
VRDDRDHCSGGSCEGYFDD

SEQ ID NO: 73281 - protein, 9 aa, Homo sapiens
  light chain complementarity determining region 3 for antibody 36641
LQGTHWPKT

SEQ ID NO: 73282 - protein, 9 aa, Homo sapiens
  heavy chain complementarity determining region 3 for antibody 36641
AKGYYDSSY

SEQ ID NO: 73283 - protein, 9 aa, Homo sapiens
  light chain complementarity determining region 3 for antibody 36642
LQGNSFPHT

SEQ ID NO: 73284 - protein, 14 aa, Homo sapiens
  heavy chain complementarity determining region 3 for antibody 36642
ARYCSGSSCYSMDY

SEQ ID NO: 73285 - protein, 9 aa, Homo sapiens
  light chain complementarity determining region 3 for antibody 36643
LQGLQTPYT

SEQ ID NO: 73286 - protein, 10 aa, Homo sapiens
  heavy chain complementarity determining region 3 for antibody 36643
ARDVVGSDDQ

SEQ ID NO: 73287 - protein, 9 aa, Homo sapiens
  light chain complementarity determining region 3 for antibody 36644
LQFDSVPLT

SEQ ID NO: 73288 - protein, 18 aa, Homo sapiens
  heavy chain complementarity determining region 3 for antibody 36644
VRGGRDSQGPLGYYGLGV

SEQ ID NO: 73289 - protein, 9 aa, Homo sapiens
  light chain complementarity determining region 3 for antibody 36645
LQFDSLPLT

SEQ ID NO: 73290 - protein, 16 aa, Homo sapiens
  heavy chain complementarity determining region 3 for antibody 36645
GRSPHPQGDKVIRLDY

SEQ ID NO: 73291 - protein, 9 aa, Homo sapiens
  light chain complementarity determining region 3 for antibody 36646
LQFDRLPLT

SEQ ID NO: 73292 - protein, 16 aa, Homo sapiens
  heavy chain complementarity determining region 3 for antibody 36646
GRSHHPQGDKVIRLDY

SEQ ID NO: 73293 - protein, 9 aa, Homo sapiens
  light chain complementarity determining region 3 for antibody 36647
LQDYRFPYS

SEQ ID NO: 73294 - protein, 16 aa, Homo sapiens
  heavy chain complementarity determining region 3 for antibody 36647
ARDGLGSEAMEVGFDV

SEQ ID NO: 73295 - protein, 9 aa, Homo sapiens
  light chain complementarity determining region 3 for antibody 36648
LQDYNYLLT

SEQ ID NO: 73296 - protein, 16 aa, Homo sapiens
  heavy chain complementarity determining region 3 for antibody 36648
ARQNWGYSGYDRRLDY

SEQ ID NO: 73297 - protein, 9 aa, Homo sapiens
  light chain complementarity determining region 3 for antibody 36649
LQDYDYPLT

SEQ ID NO: 73298 - protein, 18 aa, Homo sapiens
  heavy chain complementarity determining region 3 for antibody 36649
ARSLYHSVSGAYYDAFDL

SEQ ID NO: 73299 - protein, 9 aa, Homo sapiens
  light chain complementarity determining region 3 for antibody 36650
LQDYDYPLT

SEQ ID NO: 73300 - protein, 18 aa, Homo sapiens
  heavy chain complementarity determining region 3 for antibody 36650
AGSLYHSVSGAYYDAFDI

SEQ ID NO: 73301 - protein, 9 aa, Homo sapiens
  light chain complementarity determining region 3 for antibody 36651
LQDNNYPRT

SEQ ID NO: 73302 - protein, 18 aa, Homo sapiens
  heavy chain complementarity determining region 3 for antibody 36651
VRDTTFANSGPYYDSYDY

SEQ ID NO: 73303 - protein, 9 aa, Homo sapiens
  light chain complementarity determining region 3 for antibody 36652
LQDGGTPLT

SEQ ID NO: 73304 - protein, 8 aa, Homo sapiens
  heavy chain complementarity determining region 3 for antibody 36652
VRIMDPGY

SEQ ID NO: 73305 - protein, 9 aa, Homo sapiens
  light chain complementarity determining region 3 for antibody 36653
LQDFNYLRT

SEQ ID NO: 73306 - protein, 18 aa, Homo sapiens
  heavy chain complementarity determining region 3 for antibody 36653
GRDSTYANSDYYYDRFDY

SEQ ID NO: 73307 - protein, 9 aa, Homo sapiens
  light chain complementarity determining region 3 for antibody 36654
LQDFHYPRT

SEQ ID NO: 73308 - protein, 17 aa, Homo sapiens
  heavy chain complementarity determining region 3 for antibody 36654
VRDDRPICSGGSCYPDV

SEQ ID NO: 73309 - protein, 9 aa, Homo sapiens
  light chain complementarity determining region 3 for antibody 36655
LQAYNFPWT

SEQ ID NO: 73310 - protein, 18 aa, Homo sapiens
  heavy chain complementarity determining region 3 for antibody 36655
ARAGDSGSCSFSYSGMDI

SEQ ID NO: 73311 - protein, 9 aa, Homo sapiens
  light chain complementarity determining region 3 for antibody 36656
LQATHWPWR

SEQ ID NO: 73312 - protein, 12 aa, Homo sapiens
  heavy chain complementarity determining region 3 for antibody 36656
ARGANPFDAFDI

SEQ ID NO: 73313 - protein, 9 aa, Homo sapiens
  light chain complementarity determining region 3 for antibody 36657
LQANSFPLL

SEQ ID NO: 73314 - protein, 19 aa, Homo sapiens
  heavy chain complementarity determining region 3 for antibody 36657
ARGQYNDGSKNYIGGRIDY

SEQ ID NO: 73315 - protein, 9 aa, Homo sapiens
  light chain complementarity determining region 3 for antibody 36658
LQALQTPYT

SEQ ID NO: 73316 - protein, 21 aa, Homo sapiens
  heavy chain complementarity determining region 3 for antibody 36658
ARDAPVSRPYSSGWYSSAFDY

SEQ ID NO: 73317 - protein, 9 aa, Homo sapiens
  light chain complementarity determining region 3 for antibody 36659
LQAHNFPRP

SEQ ID NO: 73318 - protein, 8 aa, Homo sapiens
  heavy chain complementarity determining region 3 for antibody 36659
ARNSGWYD

SEQ ID NO: 73319 - protein, 9 aa, Homo sapiens
  light chain complementarity determining region 3 for antibody 36660
LPNEYWPRT

SEQ ID NO: 73320 - protein, 11 aa, Homo sapiens
  heavy chain complementarity determining region 3 for antibody 36660
VRVGGAGYFDH

SEQ ID NO: 73321 - protein, 9 aa, Homo sapiens
  light chain complementarity determining region 3 for antibody 36661
LPFDSLPLT

SEQ ID NO: 73322 - protein, 16 aa, Homo sapiens
  heavy chain complementarity determining region 3 for antibody 36661
GRSHHPQGDKVIRLDY

SEQ ID NO: 73323 - protein, 9 aa, Homo sapiens
  light chain complementarity determining region 3 for antibody 36662
LHHKTYPRT

SEQ ID NO: 73324 - protein, 8 aa, Homo sapiens
  heavy chain complementarity determining region 3 for antibody 36662
TTGGRDGC

SEQ ID NO: 73325 - protein, 9 aa, Homo sapiens
  light chain complementarity determining region 3 for antibody 36663
KQYYTTPLT

SEQ ID NO: 73326 - protein, 14 aa, Homo sapiens
  heavy chain complementarity determining region 3 for antibody 36663
AKDRRAVGISVWEY

SEQ ID NO: 73327 - protein, 9 aa, Homo sapiens
  light chain complementarity determining region 3 for antibody 36664
KQYYTTPLI

SEQ ID NO: 73328 - protein, 14 aa, Homo sapiens
  heavy chain complementarity determining region 3 for antibody 36664
AKDRIAVGISVWEY

SEQ ID NO: 73329 - protein, 9 aa, Homo sapiens
  light chain complementarity determining region 3 for antibody 36665
KQYYTPPLP

SEQ ID NO: 73330 - protein, 14 aa, Homo sapiens
  heavy chain complementarity determining region 3 for antibody 36665
AKDRIAVGISVWEY

SEQ ID NO: 73331 - protein, 9 aa, Homo sapiens
  light chain complementarity determining region 3 for antibody 36666
KQYYTNPPT

SEQ ID NO: 73332 - protein, 14 aa, Homo sapiens
  heavy chain complementarity determining region 3 for antibody 36666
AKDRIAVGISVWEY

SEQ ID NO: 73333 - protein, 9 aa, Homo sapiens
  light chain complementarity determining region 3 for antibody 36667
KQYYTIPLT

SEQ ID NO: 73334 - protein, 14 aa, Homo sapiens
  heavy chain complementarity determining region 3 for antibody 36667
AKDRIAVGISVWEY

SEQ ID NO: 73335 - protein, 8 aa, Homo sapiens
  light chain complementarity determining region 3 for antibody 36668
KQYGGSPR

SEQ ID NO: 73336 - protein, 16 aa, Homo sapiens
  heavy chain complementarity determining region 3 for antibody 36668
ATDWGSGTQWIRAFDV

SEQ ID NO: 73337 - protein, 9 aa, Homo sapiens
  light chain complementarity determining region 3 for antibody 36669
HYYDTSPWT

SEQ ID NO: 73338 - protein, 9 aa, Homo sapiens
  heavy chain complementarity determining region 3 for antibody 36669
ASILHDRSL

SEQ ID NO: 73339 - protein, 9 aa, Homo sapiens
  light chain complementarity determining region 3 for antibody 36670
HQYYTVPHT

SEQ ID NO: 73340 - protein, 8 aa, Homo sapiens
  heavy chain complementarity determining region 3 for antibody 36670
ARSGVTDF

SEQ ID NO: 73341 - protein, 9 aa, Homo sapiens
  light chain complementarity determining region 3 for antibody 36671
HQYYDSPGT

SEQ ID NO: 73342 - protein, 11 aa, Homo sapiens
  heavy chain complementarity determining region 3 for antibody 36671
ARGRDSWKAGY

SEQ ID NO: 73343 - protein, 10 aa, Homo sapiens
  light chain complementarity determining region 3 for antibody 36672
HQYVNWPPGT

SEQ ID NO: 73344 - protein, 12 aa, Homo sapiens
  heavy chain complementarity determining region 3 for antibody 36672
ARDRGAAGPLLY

SEQ ID NO: 73345 - protein, 8 aa, Homo sapiens
  light chain complementarity determining region 3 for antibody 36673
HQYSDYWA

SEQ ID NO: 73346 - protein, 11 aa, Homo sapiens
  heavy chain complementarity determining region 3 for antibody 36673
ATGVWGVGIRW

SEQ ID NO: 73347 - protein, 9 aa, Homo sapiens
  light chain complementarity determining region 3 for antibody 36674
HQYNSYSQT

SEQ ID NO: 73348 - protein, 16 aa, Homo sapiens
  heavy chain complementarity determining region 3 for antibody 36674
ARDSPRYSYGQKAFDI

SEQ ID NO: 73349 - protein, 9 aa, Homo sapiens
  light chain complementarity determining region 3 for antibody 36675
HQYNGYSRT

SEQ ID NO: 73350 - protein, 18 aa, Homo sapiens
  heavy chain complementarity determining region 3 for antibody 36675
ARDFGGRAYTKVENAFDI

SEQ ID NO: 73351 - protein, 9 aa, Homo sapiens
  light chain complementarity determining region 3 for antibody 36676
HQYGTSPFT

SEQ ID NO: 73352 - protein, 15 aa, Homo sapiens
  heavy chain complementarity determining region 3 for antibody 36676
ARQNDFLSGPGEFDP

SEQ ID NO: 73353 - protein, 9 aa, Homo sapiens
  light chain complementarity determining region 3 for antibody 36677
HQYGSIPPT

SEQ ID NO: 73354 - protein, 14 aa, Homo sapiens
  heavy chain complementarity determining region 3 for antibody 36677
ARGGRYTSSWYLDH

SEQ ID NO: 73355 - protein, 9 aa, Homo sapiens
  light chain complementarity determining region 3 for antibody 36678
HQYGNSPRT

SEQ ID NO: 73356 - protein, 16 aa, Homo sapiens
  heavy chain complementarity determining region 3 for antibody 36678
ARGTFYQGSSDNYHEN

SEQ ID NO: 73357 - protein, 9 aa, Homo sapiens
  light chain complementarity determining region 3 for antibody 36679
HQYGNSPFT

SEQ ID NO: 73358 - protein, 15 aa, Homo sapiens
  heavy chain complementarity determining region 3 for antibody 36679
ARQKGQRASAGYFDS

SEQ ID NO: 73359 - protein, 9 aa, Homo sapiens
  light chain complementarity determining region 3 for antibody 36680
HQYGESPRR

SEQ ID NO: 73360 - protein, 16 aa, Homo sapiens
  heavy chain complementarity determining region 3 for antibody 36680
AKSLGVDAMTTRVYDS

SEQ ID NO: 73361 - protein, 9 aa, Homo sapiens
  light chain complementarity determining region 3 for antibody 36681
HQYGESPRM

SEQ ID NO: 73362 - protein, 16 aa, Homo sapiens
  heavy chain complementarity determining region 3 for antibody 36681
AKSLGVDAMTTRVSDS

SEQ ID NO: 73363 - protein, 8 aa, Homo sapiens
  light chain complementarity determining region 3 for antibody 36682
HQYDNSRT

SEQ ID NO: 73364 - protein, 15 aa, Homo sapiens
  heavy chain complementarity determining region 3 for antibody 36682
AKTDYCSAGNCPFDS

SEQ ID NO: 73365 - protein, 9 aa, Homo sapiens
  light chain complementarity determining region 3 for antibody 36683
HQYDNDPPP

SEQ ID NO: 73366 - protein, 14 aa, Homo sapiens
  heavy chain complementarity determining region 3 for antibody 36683
GRQRFGGNSGIIAY

SEQ ID NO: 73367 - protein, 9 aa, Homo sapiens
  light chain complementarity determining region 3 for antibody 36684
HQTRGLPLP

SEQ ID NO: 73368 - protein, 14 aa, Homo sapiens
  heavy chain complementarity determining region 3 for antibody 36684
ARYVDWDDSDPHDY

SEQ ID NO: 73369 - protein, 9 aa, Homo sapiens
  light chain complementarity determining region 3 for antibody 36685
HQSYSIPRT

SEQ ID NO: 73370 - protein, 12 aa, Homo sapiens
  heavy chain complementarity determining region 3 for antibody 36685
ARNGAGSYGMDV

SEQ ID NO: 73371 - protein, 8 aa, Homo sapiens
  light chain complementarity determining region 3 for antibody 36686
HQSYDRET

SEQ ID NO: 73372 - protein, 12 aa, Homo sapiens
  heavy chain complementarity determining region 3 for antibody 36686
VRRGDVAGMFDY

SEQ ID NO: 73373 - protein, 8 aa, Homo sapiens
  light chain complementarity determining region 3 for antibody 36687
HQSYDRET

SEQ ID NO: 73374 - protein, 12 aa, Homo sapiens
  heavy chain complementarity determining region 3 for antibody 36687
VRRGAVAGMFDY

SEQ ID NO: 73375 - protein, 9 aa, Homo sapiens
  light chain complementarity determining region 3 for antibody 36688
HQSSSLPIT

SEQ ID NO: 73376 - protein, 6 aa, Homo sapiens
  heavy chain complementarity determining region 3 for antibody 36688
ATVFDY

SEQ ID NO: 73377 - protein, 9 aa, Homo sapiens
  light chain complementarity determining region 3 for antibody 36689
HQSSSIPLT

SEQ ID NO: 73378 - protein, 16 aa, Homo sapiens
  heavy chain complementarity determining region 3 for antibody 36689
ARGRALRMVFANWFDP

SEQ ID NO: 73379 - protein, 9 aa, Homo sapiens
  light chain complementarity determining region 3 for antibody 36690
HQSGTLPGT

SEQ ID NO: 73380 - protein, 14 aa, Homo sapiens
  heavy chain complementarity determining region 3 for antibody 36690
IMDASGTGGWYADS

SEQ ID NO: 73381 - protein, 9 aa, Homo sapiens
  light chain complementarity determining region 3 for antibody 36691
HQRSSLQET

SEQ ID NO: 73382 - protein, 12 aa, Homo sapiens
  heavy chain complementarity determining region 3 for antibody 36691
VKDCGLGGSRDF

SEQ ID NO: 73383 - protein, 9 aa, Homo sapiens
  light chain complementarity determining region 3 for antibody 36692
HQRSNWPLT

SEQ ID NO: 73384 - protein, 15 aa, Homo sapiens
  heavy chain complementarity determining region 3 for antibody 36692
ARDLSYFGSRRGFDP

SEQ ID NO: 73385 - protein, 9 aa, Homo sapiens
  light chain complementarity determining region 3 for antibody 36693
HQRSNWPGT

SEQ ID NO: 73386 - protein, 6 aa, Homo sapiens
  heavy chain complementarity determining region 3 for antibody 36693
TTVFDY

SEQ ID NO: 73387 - protein, 9 aa, Homo sapiens
  light chain complementarity determining region 3 for antibody 36694
HQRSNWPGT

SEQ ID NO: 73388 - protein, 6 aa, Homo sapiens
  heavy chain complementarity determining region 3 for antibody 36694
TPVFDY

SEQ ID NO: 73389 - protein, 9 aa, Homo sapiens
  light chain complementarity determining region 3 for antibody 36695
HQRSNWPFP

SEQ ID NO: 73390 - protein, 16 aa, Homo sapiens
  heavy chain complementarity determining region 3 for antibody 36695
AGATSSDWYGGVLHDY

SEQ ID NO: 73391 - protein, 8 aa, Homo sapiens
  light chain complementarity determining region 3 for antibody 36696
HQRSNWLS

SEQ ID NO: 73392 - protein, 13 aa, Homo sapiens
  heavy chain complementarity determining region 3 for antibody 36696
AKERLRSQSDLDY

SEQ ID NO: 73393 - protein, 9 aa, Homo sapiens
  light chain complementarity determining region 3 for antibody 36697
HQRSNRPFT

SEQ ID NO: 73394 - protein, 16 aa, Homo sapiens
  heavy chain complementarity determining region 3 for antibody 36697
AGATSSDWYGGVLHDY

SEQ ID NO: 73395 - protein, 9 aa, Homo sapiens
  light chain complementarity determining region 3 for antibody 36698
HQRSDWPEP

SEQ ID NO: 73396 - protein, 9 aa, Homo sapiens
  heavy chain complementarity determining region 3 for antibody 36698
ASGDYAFDL

SEQ ID NO: 73397 - protein, 9 aa, Homo sapiens
  light chain complementarity determining region 3 for antibody 36699
HQRRDWPET

SEQ ID NO: 73398 - protein, 9 aa, Homo sapiens
  heavy chain complementarity determining region 3 for antibody 36699
ASGDYAFDL

SEQ ID NO: 73399 - protein, 9 aa, Homo sapiens
  light chain complementarity determining region 3 for antibody 36700
HQHYTTLHT

SEQ ID NO: 73400 - protein, 10 aa, Homo sapiens
  heavy chain complementarity determining region 3 for antibody 36700
ARGSYNSVWA

SEQ ID NO: 73401 - protein, 9 aa, Homo sapiens
  light chain complementarity determining region 3 for antibody 36701
HHYSTSPRT

SEQ ID NO: 73402 - protein, 16 aa, Homo sapiens
  heavy chain complementarity determining region 3 for antibody 36701
ARGPPPRFSTSWYGEY

SEQ ID NO: 73403 - protein, 9 aa, Homo sapiens
  light chain complementarity determining region 3 for antibody 36702
HHYHTFPYT

SEQ ID NO: 73404 - protein, 13 aa, Homo sapiens
  heavy chain complementarity determining region 3 for antibody 36702
ARFCGGDCSPFDY

SEQ ID NO: 73405 - protein, 9 aa, Homo sapiens
  light chain complementarity determining region 3 for antibody 36703
HHYGTSPRT

SEQ ID NO: 73406 - protein, 13 aa, Homo sapiens
  heavy chain complementarity determining region 3 for antibody 36703
ATESGKYQGGLDY

SEQ ID NO: 73407 - protein, 8 aa, Homo sapiens
  light chain complementarity determining region 3 for antibody 36704
HHYGTSAT

SEQ ID NO: 73408 - protein, 18 aa, Homo sapiens
  heavy chain complementarity determining region 3 for antibody 36704
ARWGGYCSSSSCYWLFDY

SEQ ID NO: 73409 - protein, 9 aa, Homo sapiens
  light chain complementarity determining region 3 for antibody 36705
HHYGDSART

SEQ ID NO: 73410 - protein, 13 aa, Homo sapiens
  heavy chain complementarity determining region 3 for antibody 36705
AKARYDAPRCYDS

SEQ ID NO: 73411 - protein, 9 aa, Homo sapiens
  light chain complementarity determining region 3 for antibody 36706
HHTYTFPRT

SEQ ID NO: 73412 - protein, 20 aa, Homo sapiens
  heavy chain complementarity determining region 3 for antibody 36706
ARGRRIAARSTAHYYYGMDV

SEQ ID NO: 73413 - protein, 9 aa, Homo sapiens
  light chain complementarity determining region 3 for antibody 36707
HHTSTFPRT

SEQ ID NO: 73414 - protein, 15 aa, Homo sapiens
  heavy chain complementarity determining region 3 for antibody 36707
IRQSKADGNYNYPDF

SEQ ID NO: 73415 - protein, 9 aa, Homo sapiens
  light chain complementarity determining region 3 for antibody 36708
HHTSTFPRT

SEQ ID NO: 73416 - protein, 20 aa, Homo sapiens
  heavy chain complementarity determining region 3 for antibody 36708
ARGRRIAALSTAHYYYGIDV

SEQ ID NO: 73417 - protein, 9 aa, Homo sapiens
  light chain complementarity determining region 3 for antibody 36709
HHTSTFPRT

SEQ ID NO: 73418 - protein, 20 aa, Homo sapiens
  heavy chain complementarity determining region 3 for antibody 36709
ARGRRIAALSTAHDYYGMDV

SEQ ID NO: 73419 - protein, 9 aa, Homo sapiens
  light chain complementarity determining region 3 for antibody 36710
HHCGDSPLT

SEQ ID NO: 73420 - protein, 21 aa, Homo sapiens
  heavy chain complementarity determining region 3 for antibody 36710
ARIERPLRLRLGEFSLSPPDF

SEQ ID NO: 73421 - protein, 9 aa, Homo sapiens
  light chain complementarity determining region 3 for antibody 36711
FQALQTGFT

SEQ ID NO: 73422 - protein, 14 aa, Homo sapiens
  heavy chain complementarity determining region 3 for antibody 36711
AREILTYGDFGVDF

SEQ ID NO: 73423 - protein, 9 aa, Homo sapiens
  light chain complementarity determining region 3 for antibody 36712
EQYNRYPRT

SEQ ID NO: 73424 - protein, 6 aa, Homo sapiens
  heavy chain complementarity determining region 3 for antibody 36712
TRALDY

SEQ ID NO: 73425 - protein, 9 aa, Homo sapiens
  light chain complementarity determining region 3 for antibody 36713
EQRINWPLT

SEQ ID NO: 73426 - protein, 17 aa, Homo sapiens
  heavy chain complementarity determining region 3 for antibody 36713
ATRLGIAPEPHYWYFDL

SEQ ID NO: 73427 - protein, 9 aa, Homo sapiens
  light chain complementarity determining region 3 for antibody 36714
YQYGESPRM

SEQ ID NO: 73428 - protein, 16 aa, Homo sapiens
  heavy chain complementarity determining region 3 for antibody 36714
AKSLGVDAMTTRVYDS

SEQ ID NO: 73429 - protein, 9 aa, Homo sapiens
  light chain complementarity determining region 3 for antibody 36715
VQYNSNPRT

SEQ ID NO: 73430 - protein, 6 aa, Homo sapiens
  heavy chain complementarity determining region 3 for antibody 36715
TRALDY

SEQ ID NO: 73431 - protein, 9 aa, Homo sapiens
  light chain complementarity determining region 3 for antibody 36716
VQYNRYPRK

SEQ ID NO: 73432 - protein, 6 aa, Homo sapiens
  heavy chain complementarity determining region 3 for antibody 36716
TRALDY

SEQ ID NO: 73433 - protein, 9 aa, Homo sapiens
  light chain complementarity determining region 3 for antibody 36717
VQYNRFPRT

SEQ ID NO: 73434 - protein, 6 aa, Homo sapiens
  heavy chain complementarity determining region 3 for antibody 36717
TRALDY

SEQ ID NO: 73435 - protein, 10 aa, Homo sapiens
  light chain complementarity determining region 3 for antibody 36718
VQTLQSPPGT

SEQ ID NO: 73436 - protein, 16 aa, Homo sapiens
  heavy chain complementarity determining region 3 for antibody 36718
ARDLAVDNYYYYGMDV

SEQ ID NO: 73437 - protein, 11 aa, Homo sapiens
  light chain complementarity determining region 3 for antibody 36719
VQGTHLPPMWT

SEQ ID NO: 73438 - protein, 17 aa, Homo sapiens
  heavy chain complementarity determining region 3 for antibody 36719
ERCPTFYDFSGHSEIDY

SEQ ID NO: 73439 - protein, 10 aa, Homo sapiens
  light chain complementarity determining region 3 for antibody 36720
VQDTHWPPGT

SEQ ID NO: 73440 - protein, 16 aa, Homo sapiens
  heavy chain complementarity determining region 3 for antibody 36720
AKRVWFGELASAVFDG

SEQ ID NO: 73441 - protein, 9 aa, Homo sapiens
  light chain complementarity determining region 3 for antibody 36721
VQALQTPFT

SEQ ID NO: 73442 - protein, 13 aa, Homo sapiens
  heavy chain complementarity determining region 3 for antibody 36721
ARAITKAGSGFDY

SEQ ID NO: 73443 - protein, 9 aa, Homo sapiens
  light chain complementarity determining region 3 for antibody 36722
VQALETPFT

SEQ ID NO: 73444 - protein, 15 aa, Homo sapiens
  heavy chain complementarity determining region 3 for antibody 36722
VRHYRETVAGIEGDS

SEQ ID NO: 73445 - protein, 9 aa, Homo sapiens
  light chain complementarity determining region 3 for antibody 36723
TQGTHWPLT

SEQ ID NO: 73446 - protein, 19 aa, Homo sapiens
  heavy chain complementarity determining region 3 for antibody 36723
VRDDRDHCSGGSCEGYFDD

SEQ ID NO: 73447 - protein, 10 aa, Homo sapiens
  light chain complementarity determining region 3 for antibody 36724
RQYYNWPPWT

SEQ ID NO: 73448 - protein, 21 aa, Homo sapiens
  heavy chain complementarity determining region 3 for antibody 36724
ARETMGLGTSGGIIVRGHFDY

SEQ ID NO: 73449 - protein, 11 aa, Homo sapiens
  light chain complementarity determining region 3 for antibody 36725
RQYSTSPIRYT

SEQ ID NO: 73450 - protein, 13 aa, Homo sapiens
  heavy chain complementarity determining region 3 for antibody 36725
ARDRGEFTYAHDY

SEQ ID NO: 73451 - protein, 9 aa, Homo sapiens
  light chain complementarity determining region 3 for antibody 36726
RQYQSWPYT

SEQ ID NO: 73452 - protein, 11 aa, Homo sapiens
  heavy chain complementarity determining region 3 for antibody 36726
GGFYHGGPCGY

SEQ ID NO: 73453 - protein, 9 aa, Homo sapiens
  light chain complementarity determining region 3 for antibody 36727
RQYNSYPRT

SEQ ID NO: 73454 - protein, 19 aa, Homo sapiens
  heavy chain complementarity determining region 3 for antibody 36727
TRELYLHYYDTTGRGVFDY

SEQ ID NO: 73455 - protein, 10 aa, Homo sapiens
  light chain complementarity determining region 3 for antibody 36728
RQYNSWPLYT

SEQ ID NO: 73456 - protein, 14 aa, Homo sapiens
  heavy chain complementarity determining region 3 for antibody 36728
ARSGDGINLGFFDY

SEQ ID NO: 73457 - protein, 10 aa, Homo sapiens
  light chain complementarity determining region 3 for antibody 36729
RQYNNWPPRT

SEQ ID NO: 73458 - protein, 12 aa, Homo sapiens
  heavy chain complementarity determining region 3 for antibody 36729
ARDLIYSSGFDY

SEQ ID NO: 73459 - protein, 11 aa, Homo sapiens
  light chain complementarity determining region 3 for antibody 36730
RQYLNWPPAWT

SEQ ID NO: 73460 - protein, 14 aa, Homo sapiens
  heavy chain complementarity determining region 3 for antibody 36730
ARPQPGDYYHGMDV

SEQ ID NO: 73461 - protein, 8 aa, Homo sapiens
  light chain complementarity determining region 3 for antibody 36731
RQYGSSLT

SEQ ID NO: 73462 - protein, 13 aa, Homo sapiens
  heavy chain complementarity determining region 3 for antibody 36731
ARVHYSSREAVGY

SEQ ID NO: 73463 - protein, 9 aa, Homo sapiens
  light chain complementarity determining region 3 for antibody 36732
RQYDNLPLT

SEQ ID NO: 73464 - protein, 12 aa, Homo sapiens
  heavy chain complementarity determining region 3 for antibody 36732
VKDCGLGGPRDY

SEQ ID NO: 73465 - protein, 10 aa, Homo sapiens
  light chain complementarity determining region 3 for antibody 36733
RQYDDLLPIT

SEQ ID NO: 73466 - protein, 12 aa, Homo sapiens
  heavy chain complementarity determining region 3 for antibody 36733
ARDVTGTRLFDF

SEQ ID NO: 73467 - protein, 9 aa, Homo sapiens
  light chain complementarity determining region 3 for antibody 36734
RQSYTTPWT

SEQ ID NO: 73468 - protein, 12 aa, Homo sapiens
  heavy chain complementarity determining region 3 for antibody 36734
TRDPLSSNDPDY

SEQ ID NO: 73469 - protein, 9 aa, Homo sapiens
  light chain complementarity determining region 3 for antibody 36735
RQSYSSQLT

SEQ ID NO: 73470 - protein, 16 aa, Homo sapiens
  heavy chain complementarity determining region 3 for antibody 36735
AREEGSTYTSNRAFDS

SEQ ID NO: 73471 - protein, 9 aa, Homo sapiens
  light chain complementarity determining region 3 for antibody 36736
RQSRRWPHT

SEQ ID NO: 73472 - protein, 8 aa, Homo sapiens
  heavy chain complementarity determining region 3 for antibody 36736
TAWGSSQH

SEQ ID NO: 73473 - protein, 10 aa, Homo sapiens
  light chain complementarity determining region 3 for antibody 36737
RQRYSWPPLT

SEQ ID NO: 73474 - protein, 14 aa, Homo sapiens
  heavy chain complementarity determining region 3 for antibody 36737
AKGANLHHPYYFDY

SEQ ID NO: 73475 - protein, 10 aa, Homo sapiens
  light chain complementarity determining region 3 for antibody 36738
RQRYKWPPYT

SEQ ID NO: 73476 - protein, 11 aa, Homo sapiens
  heavy chain complementarity determining region 3 for antibody 36738
ARGVGSYVFDS

SEQ ID NO: 73477 - protein, 9 aa, Homo sapiens
  light chain complementarity determining region 3 for antibody 36739
RQRVQTPGT

SEQ ID NO: 73478 - protein, 17 aa, Homo sapiens
  heavy chain complementarity determining region 3 for antibody 36739
IPVMLVRFLEDLQLFNY

SEQ ID NO: 73479 - protein, 9 aa, Homo sapiens
  light chain complementarity determining region 3 for antibody 36740
RQNYRTPPT

SEQ ID NO: 73480 - protein, 21 aa, Homo sapiens
  heavy chain complementarity determining region 3 for antibody 36740
TRRNLAGPMVRGAIVAYGFDI

SEQ ID NO: 73481 - protein, 9 aa, Homo sapiens
  light chain complementarity determining region 3 for antibody 36741
RQGTHWPRT

SEQ ID NO: 73482 - protein, 10 aa, Homo sapiens
  heavy chain complementarity determining region 3 for antibody 36741
ARDWGLGSGN

SEQ ID NO: 73483 - protein, 9 aa, Homo sapiens
  light chain complementarity determining region 3 for antibody 36742
RQGTHWPPT

SEQ ID NO: 73484 - protein, 15 aa, Homo sapiens
  heavy chain complementarity determining region 3 for antibody 36742
AKSSGQNIAVAGFDC

SEQ ID NO: 73485 - protein, 9 aa, Homo sapiens
  light chain complementarity determining region 3 for antibody 36743
RQGTHWPLT

SEQ ID NO: 73486 - protein, 19 aa, Homo sapiens
  heavy chain complementarity determining region 3 for antibody 36743
VRDDRDHCSGGSCEGYFDD

SEQ ID NO: 73487 - protein, 9 aa, Homo sapiens
  light chain complementarity determining region 3 for antibody 36744
RQGTHWPLT

SEQ ID NO: 73488 - protein, 18 aa, Homo sapiens
  heavy chain complementarity determining region 3 for antibody 36744
AKDLRAFIMRVESDNFQV

SEQ ID NO: 73489 - protein, 9 aa, Homo sapiens
  light chain complementarity determining region 3 for antibody 36745
RQGSHWPPT

SEQ ID NO: 73490 - protein, 13 aa, Homo sapiens
  heavy chain complementarity determining region 3 for antibody 36745
VRNLGDGYNSIDY

SEQ ID NO: 73491 - protein, 9 aa, Homo sapiens
  light chain complementarity determining region 3 for antibody 36746
RQGRQTPIT

SEQ ID NO: 73492 - protein, 15 aa, Homo sapiens
  heavy chain complementarity determining region 3 for antibody 36746
ARDVGFGSVPYYFDS

SEQ ID NO: 73493 - protein, 9 aa, Homo sapiens
  light chain complementarity determining region 3 for antibody 36747
RQGLQTPYT

SEQ ID NO: 73494 - protein, 10 aa, Homo sapiens
  heavy chain complementarity determining region 3 for antibody 36747
GSDLSGARDY

SEQ ID NO: 73495 - protein, 9 aa, Homo sapiens
  light chain complementarity determining region 3 for antibody 36748
RQGLQTPYT

SEQ ID NO: 73496 - protein, 10 aa, Homo sapiens
  heavy chain complementarity determining region 3 for antibody 36748
GRDLTGSKDY

SEQ ID NO: 73497 - protein, 9 aa, Homo sapiens
  light chain complementarity determining region 3 for antibody 36749
RQGLQTPYT

SEQ ID NO: 73498 - protein, 10 aa, Homo sapiens
  heavy chain complementarity determining region 3 for antibody 36749
ARDVVGSDDH

SEQ ID NO: 73499 - protein, 9 aa, Homo sapiens
  light chain complementarity determining region 3 for antibody 36750
RQGLQTPYP

SEQ ID NO: 73500 - protein, 10 aa, Homo sapiens
  heavy chain complementarity determining region 3 for antibody 36750
GRDLSGARDY

SEQ ID NO: 73501 - protein, 9 aa, Homo sapiens
  light chain complementarity determining region 3 for antibody 36751
RQGLQTPWT

SEQ ID NO: 73502 - protein, 11 aa, Homo sapiens
  heavy chain complementarity determining region 3 for antibody 36751
ASALDYGGIDY

SEQ ID NO: 73503 - protein, 9 aa, Homo sapiens
  light chain complementarity determining region 3 for antibody 36752
RQGLPTPYT

SEQ ID NO: 73504 - protein, 10 aa, Homo sapiens
  heavy chain complementarity determining region 3 for antibody 36752
GSDLTGARDH

SEQ ID NO: 73505 - protein, 9 aa, Homo sapiens
  light chain complementarity determining region 3 for antibody 36753
RQGAYWPPT

SEQ ID NO: 73506 - protein, 14 aa, Homo sapiens
  heavy chain complementarity determining region 3 for antibody 36753
ARDSDSGGPNDLDV

SEQ ID NO: 73507 - protein, 9 aa, Homo sapiens
  light chain complementarity determining region 3 for antibody 36754
RQDYDYPFT

SEQ ID NO: 73508 - protein, 16 aa, Homo sapiens
  heavy chain complementarity determining region 3 for antibody 36754
TRDVKKTKDYEDALDI

SEQ ID NO: 73509 - protein, 9 aa, Homo sapiens
  light chain complementarity determining region 3 for antibody 36755
RQDLETPFT

SEQ ID NO: 73510 - protein, 15 aa, Homo sapiens
  heavy chain complementarity determining region 3 for antibody 36755
VRHYRIITAPLEGDS

SEQ ID NO: 73511 - protein, 9 aa, Homo sapiens
  light chain complementarity determining region 3 for antibody 36756
RQATHWPWT

SEQ ID NO: 73512 - protein, 12 aa, Homo sapiens
  heavy chain complementarity determining region 3 for antibody 36756
AADCSSASCPGY

SEQ ID NO: 73513 - protein, 9 aa, Homo sapiens
  light chain complementarity determining region 3 for antibody 36757
RQARDWPPT

SEQ ID NO: 73514 - protein, 18 aa, Homo sapiens
  heavy chain complementarity determining region 3 for antibody 36757
LRGGTIEWELRQSSLIDC

SEQ ID NO: 73515 - protein, 9 aa, Homo sapiens
  light chain complementarity determining region 3 for antibody 36758
RQALQVPNT

SEQ ID NO: 73516 - protein, 12 aa, Homo sapiens
  heavy chain complementarity determining region 3 for antibody 36758
ARARGVAGKLDS

SEQ ID NO: 73517 - protein, 9 aa, Homo sapiens
  light chain complementarity determining region 3 for antibody 36759
RQALQTPPT

SEQ ID NO: 73518 - protein, 15 aa, Homo sapiens
  heavy chain complementarity determining region 3 for antibody 36759
ARDGLRDGFSDAFDI

SEQ ID NO: 73519 - protein, 9 aa, Homo sapiens
  light chain complementarity determining region 3 for antibody 36760
RQALQTPLT

SEQ ID NO: 73520 - protein, 14 aa, Homo sapiens
  heavy chain complementarity determining region 3 for antibody 36760
VKTLSPGGAYFFDS

SEQ ID NO: 73521 - protein, 9 aa, Homo sapiens
  light chain complementarity determining region 3 for antibody 36761
RQALQTPLT

SEQ ID NO: 73522 - protein, 14 aa, Homo sapiens
  heavy chain complementarity determining region 3 for antibody 36761
ARGLAARPLWRFDY

SEQ ID NO: 73523 - protein, 9 aa, Homo sapiens
  light chain complementarity determining region 3 for antibody 36762
RQALQIPRT

SEQ ID NO: 73524 - protein, 18 aa, Homo sapiens
  heavy chain complementarity determining region 3 for antibody 36762
ARGGTMVRGSDYYFGMHV

SEQ ID NO: 73525 - protein, 9 aa, Homo sapiens
  light chain complementarity determining region 3 for antibody 36763
RQALGTPPT

SEQ ID NO: 73526 - protein, 12 aa, Homo sapiens
  heavy chain complementarity determining region 3 for antibody 36763
AKDLVGGARGGN

SEQ ID NO: 73527 - protein, 9 aa, Homo sapiens
  light chain complementarity determining region 3 for antibody 36764
RQALETPLT

SEQ ID NO: 73528 - protein, 15 aa, Homo sapiens
  heavy chain complementarity determining region 3 for antibody 36764
VRHYRETVAGIEGDS

SEQ ID NO: 73529 - protein, 9 aa, Homo sapiens
  light chain complementarity determining region 3 for antibody 36765
RQALETPFT

SEQ ID NO: 73530 - protein, 15 aa, Homo sapiens
  heavy chain complementarity determining region 3 for antibody 36765
VRHYRETVAGIEGDC

SEQ ID NO: 73531 - protein, 9 aa, Homo sapiens
  light chain complementarity determining region 3 for antibody 36766
RQALETPFT

SEQ ID NO: 73532 - protein, 15 aa, Homo sapiens
  heavy chain complementarity determining region 3 for antibody 36766
LRHYRSLATGTEEDC

SEQ ID NO: 73533 - protein, 9 aa, Homo sapiens
  light chain complementarity determining region 3 for antibody 36767
RQALETPFT

SEQ ID NO: 73534 - protein, 15 aa, Homo sapiens
  heavy chain complementarity determining region 3 for antibody 36767
IRHYRVAVAGIEGDY

SEQ ID NO: 73535 - protein, 9 aa, Homo sapiens
  light chain complementarity determining region 3 for antibody 36768
RQAAHWPHT

SEQ ID NO: 73536 - protein, 12 aa, Homo sapiens
  heavy chain complementarity determining region 3 for antibody 36768
ARGARDSSGVDY

SEQ ID NO: 73537 - protein, 9 aa, Homo sapiens
  light chain complementarity determining region 3 for antibody 36769
RKYNSAPQT

SEQ ID NO: 73538 - protein, 13 aa, Homo sapiens
  heavy chain complementarity determining region 3 for antibody 36769
ARDRLVGKALLDY

SEQ ID NO: 73539 - protein, 11 aa, Homo sapiens
  light chain complementarity determining region 3 for antibody 36770
RKYGTAPPGSA

SEQ ID NO: 73540 - protein, 12 aa, Homo sapiens
  heavy chain complementarity determining region 3 for antibody 36770
AKKIGNFDVFDV

SEQ ID NO: 73541 - protein, 9 aa, Homo sapiens
  light chain complementarity determining region 3 for antibody 36771
RHNYNPPFT

SEQ ID NO: 73542 - protein, 13 aa, Homo sapiens
  heavy chain complementarity determining region 3 for antibody 36771
VRGRNYDRDGFDP

SEQ ID NO: 73543 - protein, 9 aa, Homo sapiens
  light chain complementarity determining region 3 for antibody 36772
RHALETPFT

SEQ ID NO: 73544 - protein, 15 aa, Homo sapiens
  heavy chain complementarity determining region 3 for antibody 36772
VRHYRETVAGIEGDS

SEQ ID NO: 73545 - protein, 9 aa, Homo sapiens
  light chain complementarity determining region 3 for antibody 36773
RASRHWPLS

SEQ ID NO: 73546 - protein, 8 aa, Homo sapiens
  heavy chain complementarity determining region 3 for antibody 36773
ARGRSMSE

SEQ ID NO: 73547 - protein, 8 aa, Homo sapiens
  light chain complementarity determining region 3 for antibody 36774
QYYGSSPT

SEQ ID NO: 73548 - protein, 9 aa, Homo sapiens
  heavy chain complementarity determining region 3 for antibody 36774
ARGYDAFDF

SEQ ID NO: 73549 - protein, 9 aa, Homo sapiens
  light chain complementarity determining region 3 for antibody 36775
QYYGIAPRT

SEQ ID NO: 73550 - protein, 18 aa, Homo sapiens
  heavy chain complementarity determining region 3 for antibody 36775
AKNRNLPGSNWLHDAFDI

SEQ ID NO: 73551 - protein, 9 aa, Homo sapiens
  light chain complementarity determining region 3 for antibody 36776
QYYGASPGT

SEQ ID NO: 73552 - protein, 11 aa, Homo sapiens
  heavy chain complementarity determining region 3 for antibody 36776
ARGEVGYAFDI

SEQ ID NO: 73553 - protein, 8 aa, Homo sapiens
  light chain complementarity determining region 3 for antibody 36777
QYRRSPGT

SEQ ID NO: 73554 - protein, 17 aa, Homo sapiens
  heavy chain complementarity determining region 3 for antibody 36777
AGLSSRLGDGSPSLFDY

SEQ ID NO: 73555 - protein, 9 aa, Homo sapiens
  light chain complementarity determining region 3 for antibody 36778
QVYGDSPKK

SEQ ID NO: 73556 - protein, 10 aa, Homo sapiens
  heavy chain complementarity determining region 3 for antibody 36778
AREGLGGFDN

SEQ ID NO: 73557 - protein, 10 aa, Homo sapiens
  light chain complementarity determining region 3 for antibody 36779
QVRDEWPPVI

SEQ ID NO: 73558 - protein, 12 aa, Homo sapiens
  heavy chain complementarity determining region 3 for antibody 36779
VRDHITGWKFDY

SEQ ID NO: 73559 - protein, 8 aa, Homo sapiens
  light chain complementarity determining region 3 for antibody 36780
QTYNSLYT

SEQ ID NO: 73560 - protein, 14 aa, Homo sapiens
  heavy chain complementarity determining region 3 for antibody 36780
ARENSISRKRSFDQ

SEQ ID NO: 73561 - protein, 11 aa, Homo sapiens
  light chain complementarity determining region 3 for antibody 36781
QTYDSVPHGVT

SEQ ID NO: 73562 - protein, 15 aa, Homo sapiens
  heavy chain complementarity determining region 3 for antibody 36781
ARGGYSSGWYYWFDP

SEQ ID NO: 73563 - protein, 10 aa, Homo sapiens
  light chain complementarity determining region 3 for antibody 36782
QRYSTSPPYT

SEQ ID NO: 73564 - protein, 16 aa, Homo sapiens
  heavy chain complementarity determining region 3 for antibody 36782
ARDGYRSGYYAHEFDF

SEQ ID NO: 73565 - protein, 9 aa, Homo sapiens
  light chain complementarity determining region 3 for antibody 36783
QRYSSSSGK

SEQ ID NO: 73566 - protein, 12 aa, Homo sapiens
  heavy chain complementarity determining region 3 for antibody 36783
ARDSLGGSFNDN

SEQ ID NO: 73567 - protein, 9 aa, Homo sapiens
  light chain complementarity determining region 3 for antibody 36784
QRYNGYLWT

SEQ ID NO: 73568 - protein, 14 aa, Homo sapiens
  heavy chain complementarity determining region 3 for antibody 36784
MIRGHSYDFDPRPF

SEQ ID NO: 73569 - protein, 9 aa, Homo sapiens
  light chain complementarity determining region 3 for antibody 36785
QRYGSSPQT

SEQ ID NO: 73570 - protein, 19 aa, Homo sapiens
  heavy chain complementarity determining region 3 for antibody 36785
ARVFRGLRSRSYFGYGMDL

SEQ ID NO: 73571 - protein, 9 aa, Homo sapiens
  light chain complementarity determining region 3 for antibody 36786
QRYGSSFYS

SEQ ID NO: 73572 - protein, 14 aa, Homo sapiens
  heavy chain complementarity determining region 3 for antibody 36786
ARVGTYSYGEMFDY

SEQ ID NO: 73573 - protein, 8 aa, Homo sapiens
  light chain complementarity determining region 3 for antibody 36787
QRYGSLYT

SEQ ID NO: 73574 - protein, 18 aa, Homo sapiens
  heavy chain complementarity determining region 3 for antibody 36787
AKEETPIWVGELLSPFDY

SEQ ID NO: 73575 - protein, 10 aa, Homo sapiens
  light chain complementarity determining region 3 for antibody 36788
QRYGNSPRYS

SEQ ID NO: 73576 - protein, 16 aa, Homo sapiens
  heavy chain complementarity determining region 3 for antibody 36788
TTDWGSGYYWIRAFDL

SEQ ID NO: 73577 - protein, 9 aa, Homo sapiens
  light chain complementarity determining region 3 for antibody 36789
QRTYSTLLT

SEQ ID NO: 73578 - protein, 14 aa, Homo sapiens
  heavy chain complementarity determining region 3 for antibody 36789
ASCSSTSCYRGFDS

SEQ ID NO: 73579 - protein, 9 aa, Homo sapiens
  light chain complementarity determining region 3 for antibody 36790
QRTYNAPPT

SEQ ID NO: 73580 - protein, 13 aa, Homo sapiens
  heavy chain complementarity determining region 3 for antibody 36790
ARAITKAGSGFDY

SEQ ID NO: 73581 - protein, 9 aa, Homo sapiens
  light chain complementarity determining region 3 for antibody 36791
QRTYNAPPH

SEQ ID NO: 73582 - protein, 13 aa, Homo sapiens
  heavy chain complementarity determining region 3 for antibody 36791
ARAITKAGSGFDY

SEQ ID NO: 73583 - protein, 10 aa, Homo sapiens
  light chain complementarity determining region 3 for antibody 36792
QRTYNAPPFT

SEQ ID NO: 73584 - protein, 17 aa, Homo sapiens
  heavy chain complementarity determining region 3 for antibody 36792
ATEQISNDYYDSGAFDY

SEQ ID NO: 73585 - protein, 10 aa, Homo sapiens
  light chain complementarity determining region 3 for antibody 36793
QRRYKWPPYT

SEQ ID NO: 73586 - protein, 11 aa, Homo sapiens
  heavy chain complementarity determining region 3 for antibody 36793
ARGVGSYVFES

SEQ ID NO: 73587 - protein, 9 aa, Homo sapiens
  light chain complementarity determining region 3 for antibody 36794
QRRSSWPYT

SEQ ID NO: 73588 - protein, 11 aa, Homo sapiens
  heavy chain complementarity determining region 3 for antibody 36794
VKRWGGSSIDY

SEQ ID NO: 73589 - protein, 9 aa, Homo sapiens
  light chain complementarity determining region 3 for antibody 36795
QRRSSWPIT

SEQ ID NO: 73590 - protein, 15 aa, Homo sapiens
  heavy chain complementarity determining region 3 for antibody 36795
ARELPVTNVYHYYDY

SEQ ID NO: 73591 - protein, 10 aa, Homo sapiens
  light chain complementarity determining region 3 for antibody 36796
QRRDEWPPVI

SEQ ID NO: 73592 - protein, 12 aa, Homo sapiens
  heavy chain complementarity determining region 3 for antibody 36796
VRDHTTGWKFDY

SEQ ID NO: 73593 - protein, 9 aa, Homo sapiens
  light chain complementarity determining region 3 for antibody 36797
QQYYVVPFT

SEQ ID NO: 73594 - protein, 14 aa, Homo sapiens
  heavy chain complementarity determining region 3 for antibody 36797
AKCELNYGNDALDM

SEQ ID NO: 73595 - protein, 9 aa, Homo sapiens
  light chain complementarity determining region 3 for antibody 36798
QQYYTYPLT

SEQ ID NO: 73596 - protein, 15 aa, Homo sapiens
  heavy chain complementarity determining region 3 for antibody 36798
APGAWVRGVTSRFDY

SEQ ID NO: 73597 - protein, 9 aa, Homo sapiens
  light chain complementarity determining region 3 for antibody 36799
QQYYTYLRT

SEQ ID NO: 73598 - protein, 12 aa, Homo sapiens
  heavy chain complementarity determining region 3 for antibody 36799
VKDCGLGGSRDS

SEQ ID NO: 73599 - protein, 9 aa, Homo sapiens
  light chain complementarity determining region 3 for antibody 36800
QQYYTTPRT

SEQ ID NO: 73600 - protein, 8 aa, Homo sapiens
  heavy chain complementarity determining region 3 for antibody 36800
ARGGAFDS

SEQ ID NO: 73601 - protein, 11 aa, Homo sapiens
  light chain complementarity determining region 3 for antibody 36801
QQYYTTPPMYN

SEQ ID NO: 73602 - protein, 16 aa, Homo sapiens
  heavy chain complementarity determining region 3 for antibody 36801
ARDPDTSGWYLHAFDI

SEQ ID NO: 73603 - protein, 10 aa, Homo sapiens
  light chain complementarity determining region 3 for antibody 36802
QQYYTTPIYS

SEQ ID NO: 73604 - protein, 17 aa, Homo sapiens
  heavy chain complementarity determining region 3 for antibody 36802
ARDRVKVGAHPSSASDI

SEQ ID NO: 73605 - protein, 9 aa, Homo sapiens
  light chain complementarity determining region 3 for antibody 36803
QQYYTTLRT

SEQ ID NO: 73606 - protein, 8 aa, Homo sapiens
  heavy chain complementarity determining region 3 for antibody 36803
ARDGAFDS

SEQ ID NO: 73607 - protein, 9 aa, Homo sapiens
  light chain complementarity determining region 3 for antibody 36804
QQYYTSVRT

SEQ ID NO: 73608 - protein, 16 aa, Homo sapiens
  heavy chain complementarity determining region 3 for antibody 36804
ARGLRITMVRGSGFDY

SEQ ID NO: 73609 - protein, 9 aa, Homo sapiens
  light chain complementarity determining region 3 for antibody 36805
QQYYTSVRQ

SEQ ID NO: 73610 - protein, 12 aa, Homo sapiens
  heavy chain complementarity determining region 3 for antibody 36805
VKDCGLGGSRDF

SEQ ID NO: 73611 - protein, 9 aa, Homo sapiens
  light chain complementarity determining region 3 for antibody 36806
QQYYTSVRP

SEQ ID NO: 73612 - protein, 12 aa, Homo sapiens
  heavy chain complementarity determining region 3 for antibody 36806
VKDCGLGGPRDY

SEQ ID NO: 73613 - protein, 9 aa, Homo sapiens
  light chain complementarity determining region 3 for antibody 36807
QQYYTSVRA

SEQ ID NO: 73614 - protein, 12 aa, Homo sapiens
  heavy chain complementarity determining region 3 for antibody 36807
VKDCGLGGSRDF

SEQ ID NO: 73615 - protein, 9 aa, Homo sapiens
  light chain complementarity determining region 3 for antibody 36808
QQYYTSSRT

SEQ ID NO: 73616 - protein, 12 aa, Homo sapiens
  heavy chain complementarity determining region 3 for antibody 36808
VKDCGLGGSRDF

SEQ ID NO: 73617 - protein, 10 aa, Homo sapiens
  light chain complementarity determining region 3 for antibody 36809
QQYYTSPPRT

SEQ ID NO: 73618 - protein, 12 aa, Homo sapiens
  heavy chain complementarity determining region 3 for antibody 36809
VKDCGLGGTRDV

SEQ ID NO: 73619 - protein, 9 aa, Homo sapiens
  light chain complementarity determining region 3 for antibody 36810
QQYYTSLRT

SEQ ID NO: 73620 - protein, 12 aa, Homo sapiens
  heavy chain complementarity determining region 3 for antibody 36810
VKECGLGGSRDS

SEQ ID NO: 73621 - protein, 9 aa, Homo sapiens
  light chain complementarity determining region 3 for antibody 36811
QQYYTSLRT

SEQ ID NO: 73622 - protein, 12 aa, Homo sapiens
  heavy chain complementarity determining region 3 for antibody 36811
VKDCGLGGSRDP

SEQ ID NO: 73623 - protein, 9 aa, Homo sapiens
  light chain complementarity determining region 3 for antibody 36812
QQYYTSLRT

SEQ ID NO: 73624 - protein, 18 aa, Homo sapiens
  heavy chain complementarity determining region 3 for antibody 36812
AREGWGSGLRGQRPGFDY

SEQ ID NO: 73625 - protein, 9 aa, Homo sapiens
  light chain complementarity determining region 3 for antibody 36813
QQYYTSLRA

SEQ ID NO: 73626 - protein, 12 aa, Homo sapiens
  heavy chain complementarity determining region 3 for antibody 36813
VKDCGLGGSRDS

SEQ ID NO: 73627 - protein, 9 aa, Homo sapiens
  light chain complementarity determining region 3 for antibody 36814
QQYYTSGRT

SEQ ID NO: 73628 - protein, 12 aa, Homo sapiens
  heavy chain complementarity determining region 3 for antibody 36814
VKDCGLGGSRDF

SEQ ID NO: 73629 - protein, 9 aa, Homo sapiens
  light chain complementarity determining region 3 for antibody 36815
QQYYTIPVT

SEQ ID NO: 73630 - protein, 18 aa, Homo sapiens
  heavy chain complementarity determining region 3 for antibody 36815
ARDLGGCGGNFCSYYFDI

SEQ ID NO: 73631 - protein, 8 aa, Homo sapiens
  light chain complementarity determining region 3 for antibody 36816
QQYYTHKT

SEQ ID NO: 73632 - protein, 22 aa, Homo sapiens
  heavy chain complementarity determining region 3 for antibody 36816
AREDGWVAAAGGPRPDYWYFDL

SEQ ID NO: 73633 - protein, 9 aa, Homo sapiens
  light chain complementarity determining region 3 for antibody 36817
QQYYTGPHT

SEQ ID NO: 73634 - protein, 13 aa, Homo sapiens
  heavy chain complementarity determining region 3 for antibody 36817
AREMDSKGGGFDV

SEQ ID NO: 73635 - protein, 9 aa, Homo sapiens
  light chain complementarity determining region 3 for antibody 36818
QQYYTFVRT

SEQ ID NO: 73636 - protein, 12 aa, Homo sapiens
  heavy chain complementarity determining region 3 for antibody 36818
VKDCGLGGSRDS

SEQ ID NO: 73637 - protein, 9 aa, Homo sapiens
  light chain complementarity determining region 3 for antibody 36819
QQYYSYSVT

SEQ ID NO: 73638 - protein, 17 aa, Homo sapiens
  heavy chain complementarity determining region 3 for antibody 36819
VKESWQWLVDYYYGMDV

SEQ ID NO: 73639 - protein, 9 aa, Homo sapiens
  light chain complementarity determining region 3 for antibody 36820
QQYYSYRRT

SEQ ID NO: 73640 - protein, 9 aa, Homo sapiens
  heavy chain complementarity determining region 3 for antibody 36820
AKGSSALEY

SEQ ID NO: 73641 - protein, 10 aa, Homo sapiens
  light chain complementarity determining region 3 for antibody 36821
QQYYSYLALT

SEQ ID NO: 73642 - protein, 16 aa, Homo sapiens
  heavy chain complementarity determining region 3 for antibody 36821
ARSARAAARPMLWCDF

SEQ ID NO: 73643 - protein, 9 aa, Homo sapiens
  light chain complementarity determining region 3 for antibody 36822
QQYYSVPWT

SEQ ID NO: 73644 - protein, 14 aa, Homo sapiens
  heavy chain complementarity determining region 3 for antibody 36822
AKDGGRGGGSAFDY

SEQ ID NO: 73645 - protein, 9 aa, Homo sapiens
  light chain complementarity determining region 3 for antibody 36823
QQYYSTPWT

SEQ ID NO: 73646 - protein, 17 aa, Homo sapiens
  heavy chain complementarity determining region 3 for antibody 36823
VHTGKLQYHVYPPYFPH

SEQ ID NO: 73647 - protein, 9 aa, Homo sapiens
  light chain complementarity determining region 3 for antibody 36824
QQYYSTPWT

SEQ ID NO: 73648 - protein, 15 aa, Homo sapiens
  heavy chain complementarity determining region 3 for antibody 36824
IRQSKMNNNWDYPDS

SEQ ID NO: 73649 - protein, 9 aa, Homo sapiens
  light chain complementarity determining region 3 for antibody 36825
QQYYSTPRT

SEQ ID NO: 73650 - protein, 15 aa, Homo sapiens
  heavy chain complementarity determining region 3 for antibody 36825
ARGGVRWGYPNPVDY

SEQ ID NO: 73651 - protein, 9 aa, Homo sapiens
  light chain complementarity determining region 3 for antibody 36826
QQYYSTPPT

SEQ ID NO: 73652 - protein, 12 aa, Homo sapiens
  heavy chain complementarity determining region 3 for antibody 36826
VRTVTAHDVFDM

SEQ ID NO: 73653 - protein, 9 aa, Homo sapiens
  light chain complementarity determining region 3 for antibody 36827
QQYYSTPPT

SEQ ID NO: 73654 - protein, 20 aa, Homo sapiens
  heavy chain complementarity determining region 3 for antibody 36827
ARDQAYYLASGSSGVDWFDP

SEQ ID NO: 73655 - protein, 10 aa, Homo sapiens
  light chain complementarity determining region 3 for antibody 36828
QQYYSTPLWT

SEQ ID NO: 73656 - protein, 15 aa, Homo sapiens
  heavy chain complementarity determining region 3 for antibody 36828
ARDFMTSVTRGAFDI

SEQ ID NO: 73657 - protein, 9 aa, Homo sapiens
  light chain complementarity determining region 3 for antibody 36829
QQYYSTPLT

SEQ ID NO: 73658 - protein, 20 aa, Homo sapiens
  heavy chain complementarity determining region 3 for antibody 36829
ARDQAYYYGSGSSGVDWLDP

SEQ ID NO: 73659 - protein, 9 aa, Homo sapiens
  light chain complementarity determining region 3 for antibody 36830
QQYYSTPLT

SEQ ID NO: 73660 - protein, 19 aa, Homo sapiens
  heavy chain complementarity determining region 3 for antibody 36830
ARDQAYYALGSSGVDWLDP

SEQ ID NO: 73661 - protein, 9 aa, Homo sapiens
  light chain complementarity determining region 3 for antibody 36831
QQYYSTPIT

SEQ ID NO: 73662 - protein, 15 aa, Homo sapiens
  heavy chain complementarity determining region 3 for antibody 36831
ARDSIGSSSWYWLDY

SEQ ID NO: 73663 - protein, 9 aa, Homo sapiens
  light chain complementarity determining region 3 for antibody 36832
QQYYSTPGT

SEQ ID NO: 73664 - protein, 15 aa, Homo sapiens
  heavy chain complementarity determining region 3 for antibody 36832
IRQSKVDNNYNYPDF

SEQ ID NO: 73665 - protein, 9 aa, Homo sapiens
  light chain complementarity determining region 3 for antibody 36833
QQYYSTPFT

SEQ ID NO: 73666 - protein, 11 aa, Homo sapiens
  heavy chain complementarity determining region 3 for antibody 36833
ANSFYYDFCGY

SEQ ID NO: 73667 - protein, 10 aa, Homo sapiens
  light chain complementarity determining region 3 for antibody 36834
QQYYSSLALP

SEQ ID NO: 73668 - protein, 16 aa, Homo sapiens
  heavy chain complementarity determining region 3 for antibody 36834
ARSARAAARPMLWCDF

SEQ ID NO: 73669 - protein, 8 aa, Homo sapiens
  light chain complementarity determining region 3 for antibody 36835
QQYYSRPT

SEQ ID NO: 73670 - protein, 10 aa, Homo sapiens
  heavy chain complementarity determining region 3 for antibody 36835
VRSGEWQLGT

SEQ ID NO: 73671 - protein, 9 aa, Homo sapiens
  light chain complementarity determining region 3 for antibody 36836
QQYYSRPFT

SEQ ID NO: 73672 - protein, 16 aa, Homo sapiens
  heavy chain complementarity determining region 3 for antibody 36836
ARVEYDSSGYSPPFDD

SEQ ID NO: 73673 - protein, 9 aa, Homo sapiens
  light chain complementarity determining region 3 for antibody 36837
QQYYSPPGT

SEQ ID NO: 73674 - protein, 15 aa, Homo sapiens
  heavy chain complementarity determining region 3 for antibody 36837
ARGSESSGFFWYFDL

SEQ ID NO: 73675 - protein, 9 aa, Homo sapiens
  light chain complementarity determining region 3 for antibody 36838
QQYYSLPPT

SEQ ID NO: 73676 - protein, 10 aa, Homo sapiens
  heavy chain complementarity determining region 3 for antibody 36838
ARGREKHLDI

SEQ ID NO: 73677 - protein, 9 aa, Homo sapiens
  light chain complementarity determining region 3 for antibody 36839
QQYYSIPPT

SEQ ID NO: 73678 - protein, 5 aa, Homo sapiens
  heavy chain complementarity determining region 3 for antibody 36839
GPPTY

SEQ ID NO: 73679 - protein, 9 aa, Homo sapiens
  light chain complementarity determining region 3 for antibody 36840
QQYYSIPPT

SEQ ID NO: 73680 - protein, 18 aa, Homo sapiens
  heavy chain complementarity determining region 3 for antibody 36840
AKARDSRRDDYNHPPFDM

SEQ ID NO: 73681 - protein, 9 aa, Homo sapiens
  light chain complementarity determining region 3 for antibody 36841
QQYYSGPWT

SEQ ID NO: 73682 - protein, 14 aa, Homo sapiens
  heavy chain complementarity determining region 3 for antibody 36841
AKDGGRGGGSAFDY

SEQ ID NO: 73683 - protein, 9 aa, Homo sapiens
  light chain complementarity determining region 3 for antibody 36842
QQYYSFPYT

SEQ ID NO: 73684 - protein, 16 aa, Homo sapiens
  heavy chain complementarity determining region 3 for antibody 36842
ARDAAHRRDGYNAIDY

SEQ ID NO: 73685 - protein, 9 aa, Homo sapiens
  light chain complementarity determining region 3 for antibody 36843
QQYYSFPWT

SEQ ID NO: 73686 - protein, 14 aa, Homo sapiens
  heavy chain complementarity determining region 3 for antibody 36843
TRDRLAGSYSGYDY

SEQ ID NO: 73687 - protein, 9 aa, Homo sapiens
  light chain complementarity determining region 3 for antibody 36844
QQYYSFPFT

SEQ ID NO: 73688 - protein, 16 aa, Homo sapiens
  heavy chain complementarity determining region 3 for antibody 36844
ARDRPGESSPYSSFFF

SEQ ID NO: 73689 - protein, 9 aa, Homo sapiens
  light chain complementarity determining region 3 for antibody 36845
QQYYRYPYT

SEQ ID NO: 73690 - protein, 14 aa, Homo sapiens
  heavy chain complementarity determining region 3 for antibody 36845
AKIQALGDTWAFDL

SEQ ID NO: 73691 - protein, 9 aa, Homo sapiens
  light chain complementarity determining region 3 for antibody 36846
QQYYRYPGT

SEQ ID NO: 73692 - protein, 15 aa, Homo sapiens
  heavy chain complementarity determining region 3 for antibody 36846
AHGQHTTTVTSYFNF

SEQ ID NO: 73693 - protein, 9 aa, Homo sapiens
  light chain complementarity determining region 3 for antibody 36847
QQYYRTPYP

SEQ ID NO: 73694 - protein, 15 aa, Homo sapiens
  heavy chain complementarity determining region 3 for antibody 36847
VRDAGGWGYDWHFDL

SEQ ID NO: 73695 - protein, 9 aa, Homo sapiens
  light chain complementarity determining region 3 for antibody 36848
QQYYRIPPT

SEQ ID NO: 73696 - protein, 5 aa, Homo sapiens
  heavy chain complementarity determining region 3 for antibody 36848
GPPPY

SEQ ID NO: 73697 - protein, 9 aa, Homo sapiens
  light chain complementarity determining region 3 for antibody 36849
QQYYRAPTT

SEQ ID NO: 73698 - protein, 21 aa, Homo sapiens
  heavy chain complementarity determining region 3 for antibody 36849
ARDRVAFPTGAWYEKLDCLDY

SEQ ID NO: 73699 - protein, 9 aa, Homo sapiens
  light chain complementarity determining region 3 for antibody 36850
QQYYPTPRP

SEQ ID NO: 73700 - protein, 8 aa, Homo sapiens
  heavy chain complementarity determining region 3 for antibody 36850
ARDGAFDS

SEQ ID NO: 73701 - protein, 9 aa, Homo sapiens
  light chain complementarity determining region 3 for antibody 36851
QQYYNVPPT

SEQ ID NO: 73702 - protein, 20 aa, Homo sapiens
  heavy chain complementarity determining region 3 for antibody 36851
VRDSVPHTTGHRPGISINGY

SEQ ID NO: 73703 - protein, 9 aa, Homo sapiens
  light chain complementarity determining region 3 for antibody 36852
QQYYNFPNT

SEQ ID NO: 73704 - protein, 17 aa, Homo sapiens
  heavy chain complementarity determining region 3 for antibody 36852
ARDDTAMAKVAYWYFNV

SEQ ID NO: 73705 - protein, 9 aa, Homo sapiens
  light chain complementarity determining region 3 for antibody 36853
QQYYKNPLT

SEQ ID NO: 73706 - protein, 11 aa, Homo sapiens
  heavy chain complementarity determining region 3 for antibody 36853
ARSGDSGYFDV

SEQ ID NO: 73707 - protein, 9 aa, Homo sapiens
  light chain complementarity determining region 3 for antibody 36854
QQYYIVPPT

SEQ ID NO: 73708 - protein, 20 aa, Homo sapiens
  heavy chain complementarity determining region 3 for antibody 36854
VRDSVPHTTGHRPGITINGY

SEQ ID NO: 73709 - protein, 9 aa, Homo sapiens
  light chain complementarity determining region 3 for antibody 36855
QQYYGYPQT

SEQ ID NO: 73710 - protein, 12 aa, Homo sapiens
  heavy chain complementarity determining region 3 for antibody 36855
ARTYGSGSYVDY

SEQ ID NO: 73711 - protein, 9 aa, Homo sapiens
  light chain complementarity determining region 3 for antibody 36856
QQYYGYLHT

SEQ ID NO: 73712 - protein, 12 aa, Homo sapiens
  heavy chain complementarity determining region 3 for antibody 36856
ARTYGSGSYVDY

SEQ ID NO: 73713 - protein, 9 aa, Homo sapiens
  light chain complementarity determining region 3 for antibody 36857
QQYYDVPFT

SEQ ID NO: 73714 - protein, 14 aa, Homo sapiens
  heavy chain complementarity determining region 3 for antibody 36857
AKCELNYGNDALDI

SEQ ID NO: 73715 - protein, 9 aa, Homo sapiens
  light chain complementarity determining region 3 for antibody 36858
QQYYDTPWT

SEQ ID NO: 73716 - protein, 12 aa, Homo sapiens
  heavy chain complementarity determining region 3 for antibody 36858
VRGSEPQRAFDV

SEQ ID NO: 73717 - protein, 9 aa, Homo sapiens
  light chain complementarity determining region 3 for antibody 36859
QQYYAINYT

SEQ ID NO: 73718 - protein, 12 aa, Homo sapiens
  heavy chain complementarity determining region 3 for antibody 36859
AREDTSGSYLGV

SEQ ID NO: 73719 - protein, 9 aa, Homo sapiens
  light chain complementarity determining region 3 for antibody 36860
QQYWSSPLT

SEQ ID NO: 73720 - protein, 14 aa, Homo sapiens
  heavy chain complementarity determining region 3 for antibody 36860
ARYSSSSKVSPTAY

SEQ ID NO: 73721 - protein, 9 aa, Homo sapiens
  light chain complementarity determining region 3 for antibody 36861
QQYWDSPGT

SEQ ID NO: 73722 - protein, 22 aa, Homo sapiens
  heavy chain complementarity determining region 3 for antibody 36861
ARPKAQGGYFDGSGYERGAFDI

SEQ ID NO: 73723 - protein, 9 aa, Homo sapiens
  light chain complementarity determining region 3 for antibody 36862
QQYWDPPGT

SEQ ID NO: 73724 - protein, 22 aa, Homo sapiens
  heavy chain complementarity determining region 3 for antibody 36862
ARPKTQGGYFDGSGYERGAFDI

SEQ ID NO: 73725 - protein, 9 aa, Homo sapiens
  light chain complementarity determining region 3 for antibody 36863
QQYVTYPIP

SEQ ID NO: 73726 - protein, 13 aa, Homo sapiens
  heavy chain complementarity determining region 3 for antibody 36863
GRGGYTSSWYWVY

SEQ ID NO: 73727 - protein, 9 aa, Homo sapiens
  light chain complementarity determining region 3 for antibody 36864
QQYVTPPRR

SEQ ID NO: 73728 - protein, 16 aa, Homo sapiens
  heavy chain complementarity determining region 3 for antibody 36864
VRDTGGGWGEDNYFDP

SEQ ID NO: 73729 - protein, 9 aa, Homo sapiens
  light chain complementarity determining region 3 for antibody 36865
QQYVSTPRP

SEQ ID NO: 73730 - protein, 18 aa, Homo sapiens
  heavy chain complementarity determining region 3 for antibody 36865
AHERWEKNPSYKYYGMDL

SEQ ID NO: 73731 - protein, 9 aa, Homo sapiens
  light chain complementarity determining region 3 for antibody 36866
QQYVSSPYT

SEQ ID NO: 73732 - protein, 14 aa, Homo sapiens
  heavy chain complementarity determining region 3 for antibody 36866
ARVGPYSSGEFFDY

SEQ ID NO: 73733 - protein, 9 aa, Homo sapiens
  light chain complementarity determining region 3 for antibody 36867
QQYVSSPWT

SEQ ID NO: 73734 - protein, 13 aa, Homo sapiens
  heavy chain complementarity determining region 3 for antibody 36867
ARAKSWSGRLFDY

SEQ ID NO: 73735 - protein, 11 aa, Homo sapiens
  light chain complementarity determining region 3 for antibody 36868
QQYVSSPPGLT

SEQ ID NO: 73736 - protein, 18 aa, Homo sapiens
  heavy chain complementarity determining region 3 for antibody 36868
AKVSRGLNHGSGSYYFDF

SEQ ID NO: 73737 - protein, 9 aa, Homo sapiens
  light chain complementarity determining region 3 for antibody 36869
QQYVSSPGT

SEQ ID NO: 73738 - protein, 14 aa, Homo sapiens
  heavy chain complementarity determining region 3 for antibody 36869
ARGGNYGSGSYLHY

SEQ ID NO: 73739 - protein, 9 aa, Homo sapiens
  light chain complementarity determining region 3 for antibody 36870
QQYVSLPDT

SEQ ID NO: 73740 - protein, 14 aa, Homo sapiens
  heavy chain complementarity determining region 3 for antibody 36870
ARGGNYGSGSYLHY

SEQ ID NO: 73741 - protein, 11 aa, Homo sapiens
  light chain complementarity determining region 3 for antibody 36871
QQYVRSPPGFP

SEQ ID NO: 73742 - protein, 18 aa, Homo sapiens
  heavy chain complementarity determining region 3 for antibody 36871
AKVSRGLNHGSGSYYFDF

SEQ ID NO: 73743 - protein, 10 aa, Homo sapiens
  light chain complementarity determining region 3 for antibody 36872
QQYVNSFPIT

SEQ ID NO: 73744 - protein, 15 aa, Homo sapiens
  heavy chain complementarity determining region 3 for antibody 36872
ARDVTTFIDPDAFDL

SEQ ID NO: 73745 - protein, 10 aa, Homo sapiens
  light chain complementarity determining region 3 for antibody 36873
QQYVGSPTFT

SEQ ID NO: 73746 - protein, 13 aa, Homo sapiens
  heavy chain complementarity determining region 3 for antibody 36873
ARVAVAGRGYFQH

SEQ ID NO: 73747 - protein, 10 aa, Homo sapiens
  light chain complementarity determining region 3 for antibody 36874
QQYVGSPPFP

SEQ ID NO: 73748 - protein, 13 aa, Homo sapiens
  heavy chain complementarity determining region 3 for antibody 36874
ARVAVAGRGYFQH

SEQ ID NO: 73749 - protein, 9 aa, Homo sapiens
  light chain complementarity determining region 3 for antibody 36875
QQYTTSPLP

SEQ ID NO: 73750 - protein, 11 aa, Homo sapiens
  heavy chain complementarity determining region 3 for antibody 36875
VREEFGWEMTY

SEQ ID NO: 73751 - protein, 9 aa, Homo sapiens
  light chain complementarity determining region 3 for antibody 36876
QQYSYRPPT

SEQ ID NO: 73752 - protein, 10 aa, Homo sapiens
  heavy chain complementarity determining region 3 for antibody 36876
VRGTRNAFDI

SEQ ID NO: 73753 - protein, 9 aa, Homo sapiens
  light chain complementarity determining region 3 for antibody 36877
QQYSTYSRT

SEQ ID NO: 73754 - protein, 14 aa, Homo sapiens
  heavy chain complementarity determining region 3 for antibody 36877
ARDRESSWYPYLDS

SEQ ID NO: 73755 - protein, 8 aa, Homo sapiens
  light chain complementarity determining region 3 for antibody 36878
QQYSTYRR

SEQ ID NO: 73756 - protein, 21 aa, Homo sapiens
  heavy chain complementarity determining region 3 for antibody 36878
ARDNPGDSSSDWSTRTSAFDM

SEQ ID NO: 73757 - protein, 9 aa, Homo sapiens
  light chain complementarity determining region 3 for antibody 36879
QQYSTYPGT

SEQ ID NO: 73758 - protein, 14 aa, Homo sapiens
  heavy chain complementarity determining region 3 for antibody 36879
AKDWSGGDSGYIDS

SEQ ID NO: 73759 - protein, 9 aa, Homo sapiens
  light chain complementarity determining region 3 for antibody 36880
QQYSTSFRT

SEQ ID NO: 73760 - protein, 17 aa, Homo sapiens
  heavy chain complementarity determining region 3 for antibody 36880
AKGPAIAVAVPPYYFDY

SEQ ID NO: 73761 - protein, 8 aa, Homo sapiens
  light chain complementarity determining region 3 for antibody 36881
QQYSSYPT

SEQ ID NO: 73762 - protein, 17 aa, Homo sapiens
  heavy chain complementarity determining region 3 for antibody 36881
ARRLLYSRYDGGYFSAS

SEQ ID NO: 73763 - protein, 9 aa, Homo sapiens
  light chain complementarity determining region 3 for antibody 36882
QQYSSYPPT

SEQ ID NO: 73764 - protein, 12 aa, Homo sapiens
  heavy chain complementarity determining region 3 for antibody 36882
ARMLGFGSGLAY

SEQ ID NO: 73765 - protein, 10 aa, Homo sapiens
  light chain complementarity determining region 3 for antibody 36883
QQYSSYGGGT

SEQ ID NO: 73766 - protein, 15 aa, Homo sapiens
  heavy chain complementarity determining region 3 for antibody 36883
ARAGSSLSPLDAFDI

SEQ ID NO: 73767 - protein, 10 aa, Homo sapiens
  light chain complementarity determining region 3 for antibody 36884
QQYSSWRALT

SEQ ID NO: 73768 - protein, 14 aa, Homo sapiens
  heavy chain complementarity determining region 3 for antibody 36884
APDPITGDYDVLDY

SEQ ID NO: 73769 - protein, 9 aa, Homo sapiens
  light chain complementarity determining region 3 for antibody 36885
QQYSSSPTS

SEQ ID NO: 73770 - protein, 19 aa, Homo sapiens
  heavy chain complementarity determining region 3 for antibody 36885
ARAGGNYYDRTSYYGPFDY

SEQ ID NO: 73771 - protein, 10 aa, Homo sapiens
  light chain complementarity determining region 3 for antibody 36886
QQYSSSPPWT

SEQ ID NO: 73772 - protein, 14 aa, Homo sapiens
  heavy chain complementarity determining region 3 for antibody 36886
ARGGNRVHNHQFDY

SEQ ID NO: 73773 - protein, 9 aa, Homo sapiens
  light chain complementarity determining region 3 for antibody 36887
QQYSSSPPT

SEQ ID NO: 73774 - protein, 15 aa, Homo sapiens
  heavy chain complementarity determining region 3 for antibody 36887
ATGRIVAAKNVHFDY

SEQ ID NO: 73775 - protein, 9 aa, Homo sapiens
  light chain complementarity determining region 3 for antibody 36888
QQYSSSPPS

SEQ ID NO: 73776 - protein, 19 aa, Homo sapiens
  heavy chain complementarity determining region 3 for antibody 36888
ASAGGNYYDRTSYYGPFDY

SEQ ID NO: 73777 - protein, 9 aa, Homo sapiens
  light chain complementarity determining region 3 for antibody 36889
QQYSSSPPS

SEQ ID NO: 73778 - protein, 19 aa, Homo sapiens
  heavy chain complementarity determining region 3 for antibody 36889
ARAGGDYYDRTSYYGPFDY

SEQ ID NO: 73779 - protein, 10 aa, Homo sapiens
  light chain complementarity determining region 3 for antibody 36890
QQYSSSISST

SEQ ID NO: 73780 - protein, 15 aa, Homo sapiens
  heavy chain complementarity determining region 3 for antibody 36890
ARGRYDSGGWGYFQL

SEQ ID NO: 73781 - protein, 9 aa, Homo sapiens
  light chain complementarity determining region 3 for antibody 36891
QQYSSPPRT

SEQ ID NO: 73782 - protein, 17 aa, Homo sapiens
  heavy chain complementarity determining region 3 for antibody 36891
ARDMLTSKRWPDNFFDV

SEQ ID NO: 73783 - protein, 9 aa, Homo sapiens
  light chain complementarity determining region 3 for antibody 36892
QQYSSLSRT

SEQ ID NO: 73784 - protein, 17 aa, Homo sapiens
  heavy chain complementarity determining region 3 for antibody 36892
VREDGCRGGSGRLYFDL

SEQ ID NO: 73785 - protein, 8 aa, Homo sapiens
  light chain complementarity determining region 3 for antibody 36893
QQYSRSRT

SEQ ID NO: 73786 - protein, 19 aa, Homo sapiens
  heavy chain complementarity determining region 3 for antibody 36893
ARDGVACSGDSCDQTEVDS

SEQ ID NO: 73787 - protein, 9 aa, Homo sapiens
  light chain complementarity determining region 3 for antibody 36894
QQYSRSPPS

SEQ ID NO: 73788 - protein, 19 aa, Homo sapiens
  heavy chain complementarity determining region 3 for antibody 36894
ARAGGNYYDRTSYYGPFDY

SEQ ID NO: 73789 - protein, 10 aa, Homo sapiens
  light chain complementarity determining region 3 for antibody 36895
QQYSRSISYT

SEQ ID NO: 73790 - protein, 15 aa, Homo sapiens
  heavy chain complementarity determining region 3 for antibody 36895
ARGRYDSGGWGYFQL

SEQ ID NO: 73791 - protein, 9 aa, Homo sapiens
  light chain complementarity determining region 3 for antibody 36896
QQYSNWPYT

SEQ ID NO: 73792 - protein, 18 aa, Homo sapiens
  heavy chain complementarity determining region 3 for antibody 36896
AKDRRRSPFFPVLGALDV

SEQ ID NO: 73793 - protein, 9 aa, Homo sapiens
  light chain complementarity determining region 3 for antibody 36897
QQYSNWPYT

SEQ ID NO: 73794 - protein, 18 aa, Homo sapiens
  heavy chain complementarity determining region 3 for antibody 36897
AKDRRRSAFFPVLGALDV

SEQ ID NO: 73795 - protein, 9 aa, Homo sapiens
  light chain complementarity determining region 3 for antibody 36898
QQYSNSPRT

SEQ ID NO: 73796 - protein, 16 aa, Homo sapiens
  heavy chain complementarity determining region 3 for antibody 36898
ARGTFYQGSSDNYHEN

SEQ ID NO: 73797 - protein, 10 aa, Homo sapiens
  light chain complementarity determining region 3 for antibody 36899
QQYSNFSPWT

SEQ ID NO: 73798 - protein, 11 aa, Homo sapiens
  heavy chain complementarity determining region 3 for antibody 36899
ARDGSARPADY

SEQ ID NO: 73799 - protein, 10 aa, Homo sapiens
  light chain complementarity determining region 3 for antibody 36900
QQYSGSPALT

SEQ ID NO: 73800 - protein, 15 aa, Homo sapiens
  heavy chain complementarity determining region 3 for antibody 36900
AKDAWYCSGWYFFDQ

SEQ ID NO: 73801 - protein, 9 aa, Homo sapiens
  light chain complementarity determining region 3 for antibody 36901
QQYSGPPRT

SEQ ID NO: 73802 - protein, 14 aa, Homo sapiens
  heavy chain complementarity determining region 3 for antibody 36901
ATGWYDSSGHYLEY

SEQ ID NO: 73803 - protein, 8 aa, Homo sapiens
  light chain complementarity determining region 3 for antibody 36902
QQYSEFNT

SEQ ID NO: 73804 - protein, 17 aa, Homo sapiens
  heavy chain complementarity determining region 3 for antibody 36902
AHRRYYNGNWNGATFDV

SEQ ID NO: 73805 - protein, 9 aa, Homo sapiens
  light chain complementarity determining region 3 for antibody 36903
QQYSDYPFT

SEQ ID NO: 73806 - protein, 15 aa, Homo sapiens
  heavy chain complementarity determining region 3 for antibody 36903
ARGRTEPGAGYYFDF

SEQ ID NO: 73807 - protein, 9 aa, Homo sapiens
  light chain complementarity determining region 3 for antibody 36904
QQYSDSPLP

SEQ ID NO: 73808 - protein, 11 aa, Homo sapiens
  heavy chain complementarity determining region 3 for antibody 36904
VRLLVVAGTGV

SEQ ID NO: 73809 - protein, 8 aa, Homo sapiens
  light chain complementarity determining region 3 for antibody 36905
QQYSDFTT

SEQ ID NO: 73810 - protein, 17 aa, Homo sapiens
  heavy chain complementarity determining region 3 for antibody 36905
AHRRYYNGNWNGATFDV

SEQ ID NO: 73811 - protein, 8 aa, Homo sapiens
  light chain complementarity determining region 3 for antibody 36906
QQYSDFNT

SEQ ID NO: 73812 - protein, 17 aa, Homo sapiens
  heavy chain complementarity determining region 3 for antibody 36906
AHRRYYNGNWNGATGDV

SEQ ID NO: 73813 - protein, 8 aa, Homo sapiens
  light chain complementarity determining region 3 for antibody 36907
QQYSDFNT

SEQ ID NO: 73814 - protein, 17 aa, Homo sapiens
  heavy chain complementarity determining region 3 for antibody 36907
AHRRYYNGNWNGAIFDV

SEQ ID NO: 73815 - protein, 8 aa, Homo sapiens
  light chain complementarity determining region 3 for antibody 36908
QQYSDFNP

SEQ ID NO: 73816 - protein, 17 aa, Homo sapiens
  heavy chain complementarity determining region 3 for antibody 36908
AHRRYYNGNWNGATFDV

SEQ ID NO: 73817 - protein, 8 aa, Homo sapiens
  light chain complementarity determining region 3 for antibody 36909
QQYSDFNN

SEQ ID NO: 73818 - protein, 17 aa, Homo sapiens
  heavy chain complementarity determining region 3 for antibody 36909
AHRRYYNGNWNGATFDV

SEQ ID NO: 73819 - protein, 8 aa, Homo sapiens
  light chain complementarity determining region 3 for antibody 36910
QQYSDFHT

SEQ ID NO: 73820 - protein, 17 aa, Homo sapiens
  heavy chain complementarity determining region 3 for antibody 36910
AHRRYYNGNWNGATFDV

SEQ ID NO: 73821 - protein, 9 aa, Homo sapiens
  light chain complementarity determining region 3 for antibody 36911
QQYSATPSS

SEQ ID NO: 73822 - protein, 13 aa, Homo sapiens
  heavy chain complementarity determining region 3 for antibody 36911
AKSIADTGFYYDY

SEQ ID NO: 73823 - protein, 9 aa, Homo sapiens
  light chain complementarity determining region 3 for antibody 36912
QQYRSSPWP

SEQ ID NO: 73824 - protein, 22 aa, Homo sapiens
  heavy chain complementarity determining region 3 for antibody 36912
ARAVATTRWGRSGGDWGAPFDI

SEQ ID NO: 73825 - protein, 9 aa, Homo sapiens
  light chain complementarity determining region 3 for antibody 36913
QQYRSSPLT

SEQ ID NO: 73826 - protein, 15 aa, Homo sapiens
  heavy chain complementarity determining region 3 for antibody 36913
ATGRIVAAKNVHFDY

SEQ ID NO: 73827 - protein, 9 aa, Homo sapiens
  light chain complementarity determining region 3 for antibody 36914
QQYRRSTST

SEQ ID NO: 73828 - protein, 17 aa, Homo sapiens
  heavy chain complementarity determining region 3 for antibody 36914
AGLSSRLGDGSPSLFDY

SEQ ID NO: 73829 - protein, 9 aa, Homo sapiens
  light chain complementarity determining region 3 for antibody 36915
QQYRRSPST

SEQ ID NO: 73830 - protein, 17 aa, Homo sapiens
  heavy chain complementarity determining region 3 for antibody 36915
AGLSSRLGDGSPSPFDY

SEQ ID NO: 73831 - protein, 9 aa, Homo sapiens
  light chain complementarity determining region 3 for antibody 36916
QQYRRSPSK

SEQ ID NO: 73832 - protein, 17 aa, Homo sapiens
  heavy chain complementarity determining region 3 for antibody 36916
AGLSSRLGDGSPSLFDY

SEQ ID NO: 73833 - protein, 9 aa, Homo sapiens
  light chain complementarity determining region 3 for antibody 36917
QQYRRSPGT

SEQ ID NO: 73834 - protein, 17 aa, Homo sapiens
  heavy chain complementarity determining region 3 for antibody 36917
AGLSSRLGDGSPSLFDY

SEQ ID NO: 73835 - protein, 8 aa, Homo sapiens
  light chain complementarity determining region 3 for antibody 36918
QQYRRSFP

SEQ ID NO: 73836 - protein, 13 aa, Homo sapiens
  heavy chain complementarity determining region 3 for antibody 36918
ATESGWYQGAFDI

SEQ ID NO: 73837 - protein, 9 aa, Homo sapiens
  light chain complementarity determining region 3 for antibody 36919
QQYRNSLFT

SEQ ID NO: 73838 - protein, 10 aa, Homo sapiens
  heavy chain complementarity determining region 3 for antibody 36919
AREAARALLL

SEQ ID NO: 73839 - protein, 9 aa, Homo sapiens
  light chain complementarity determining region 3 for antibody 36920
QQYRNLPYT

SEQ ID NO: 73840 - protein, 24 aa, Homo sapiens
  heavy chain complementarity determining region 3 for antibody 36920
TTDLVVVTATGHNPHHEGPGDSDY

SEQ ID NO: 73841 - protein, 10 aa, Homo sapiens
  light chain complementarity determining region 3 for antibody 36921
QQYRNFSPWT

SEQ ID NO: 73842 - protein, 11 aa, Homo sapiens
  heavy chain complementarity determining region 3 for antibody 36921
ARDGSARPAEY

SEQ ID NO: 73843 - protein, 10 aa, Homo sapiens
  light chain complementarity determining region 3 for antibody 36922
QQYRKWLMYP

SEQ ID NO: 73844 - protein, 11 aa, Homo sapiens
  heavy chain complementarity determining region 3 for antibody 36922
VRVAVAGAADY

SEQ ID NO: 73845 - protein, 10 aa, Homo sapiens
  light chain complementarity determining region 3 for antibody 36923
QQYRGSPALT

SEQ ID NO: 73846 - protein, 15 aa, Homo sapiens
  heavy chain complementarity determining region 3 for antibody 36923
AKDAWYSSGWYFFDQ

SEQ ID NO: 73847 - protein, 9 aa, Homo sapiens
  light chain complementarity determining region 3 for antibody 36924
QQYRDYPVT

SEQ ID NO: 73848 - protein, 15 aa, Homo sapiens
  heavy chain complementarity determining region 3 for antibody 36924
ARGRTEPGAGYYFDF

SEQ ID NO: 73849 - protein, 9 aa, Homo sapiens
  light chain complementarity determining region 3 for antibody 36925
QQYQTAPWA

SEQ ID NO: 73850 - protein, 17 aa, Homo sapiens
  heavy chain complementarity determining region 3 for antibody 36925
ARIEGFTWDWLLGGFDV

SEQ ID NO: 73851 - protein, 9 aa, Homo sapiens
  light chain complementarity determining region 3 for antibody 36926
QQYQTAPRT

SEQ ID NO: 73852 - protein, 17 aa, Homo sapiens
  heavy chain complementarity determining region 3 for antibody 36926
ARIEGFTWDWLLGGFDV

SEQ ID NO: 73853 - protein, 9 aa, Homo sapiens
  light chain complementarity determining region 3 for antibody 36927
QQYQSWPYT

SEQ ID NO: 73854 - protein, 11 aa, Homo sapiens
  heavy chain complementarity determining region 3 for antibody 36927
GGFDHGGPCGY

SEQ ID NO: 73855 - protein, 9 aa, Homo sapiens
  light chain complementarity determining region 3 for antibody 36928
QQYQSWPYP

SEQ ID NO: 73856 - protein, 11 aa, Homo sapiens
  heavy chain complementarity determining region 3 for antibody 36928
GGFYHGGPCGY

SEQ ID NO: 73857 - protein, 9 aa, Homo sapiens
  light chain complementarity determining region 3 for antibody 36929
QQYQSWPST

SEQ ID NO: 73858 - protein, 11 aa, Homo sapiens
  heavy chain complementarity determining region 3 for antibody 36929
GGFYHGGPCGY

SEQ ID NO: 73859 - protein, 9 aa, Homo sapiens
  light chain complementarity determining region 3 for antibody 36930
QQYPSLPLT

SEQ ID NO: 73860 - protein, 16 aa, Homo sapiens
  heavy chain complementarity determining region 3 for antibody 36930
ARDRPLRGSYYGWSDS

SEQ ID NO: 73861 - protein, 8 aa, Homo sapiens
  light chain complementarity determining region 3 for antibody 36931
QQYNVFWP

SEQ ID NO: 73862 - protein, 10 aa, Homo sapiens
  heavy chain complementarity determining region 3 for antibody 36931
ATDRRSVLSY

SEQ ID NO: 73863 - protein, 8 aa, Homo sapiens
  light chain complementarity determining region 3 for antibody 36932
QQYNVFST

SEQ ID NO: 73864 - protein, 10 aa, Homo sapiens
  heavy chain complementarity determining region 3 for antibody 36932
ATDRRSVLSY

SEQ ID NO: 73865 - protein, 9 aa, Homo sapiens
  light chain complementarity determining region 3 for antibody 36933
QQYNTYPRP

SEQ ID NO: 73866 - protein, 17 aa, Homo sapiens
  heavy chain complementarity determining region 3 for antibody 36933
ARDPYLDTDGRYYEGTY

SEQ ID NO: 73867 - protein, 9 aa, Homo sapiens
  light chain complementarity determining region 3 for antibody 36934
QQYNTYPLT

SEQ ID NO: 73868 - protein, 20 aa, Homo sapiens
  heavy chain complementarity determining region 3 for antibody 36934
AREKDCIGDECYSPNNWFDP

SEQ ID NO: 73869 - protein, 9 aa, Homo sapiens
  light chain complementarity determining region 3 for antibody 36935
QQYNTYLRT

SEQ ID NO: 73870 - protein, 17 aa, Homo sapiens
  heavy chain complementarity determining region 3 for antibody 36935
ARDPYLDTDGRYYEGTY

SEQ ID NO: 73871 - protein, 8 aa, Homo sapiens
  light chain complementarity determining region 3 for antibody 36936
QQYNTYAT

SEQ ID NO: 73872 - protein, 16 aa, Homo sapiens
  heavy chain complementarity determining region 3 for antibody 36936
ATEPYYGSPTHTGFAI

SEQ ID NO: 73873 - protein, 8 aa, Homo sapiens
  light chain complementarity determining region 3 for antibody 36937
QQYNTYAT

SEQ ID NO: 73874 - protein, 16 aa, Homo sapiens
  heavy chain complementarity determining region 3 for antibody 36937
ATEFYYGSPTHTGFAI

SEQ ID NO: 73875 - protein, 9 aa, Homo sapiens
  light chain complementarity determining region 3 for antibody 36938
QQYNTWPST

SEQ ID NO: 73876 - protein, 22 aa, Homo sapiens
  heavy chain complementarity determining region 3 for antibody 36938
AREVRASGYDDFYNYYYYGLDV

SEQ ID NO: 73877 - protein, 9 aa, Homo sapiens
  light chain complementarity determining region 3 for antibody 36939
QQYNTWPFT

SEQ ID NO: 73878 - protein, 13 aa, Homo sapiens
  heavy chain complementarity determining region 3 for antibody 36939
ARAGWEFFTWFDS

SEQ ID NO: 73879 - protein, 8 aa, Homo sapiens
  light chain complementarity determining region 3 for antibody 36940
QQYNTWLS

SEQ ID NO: 73880 - protein, 12 aa, Homo sapiens
  heavy chain complementarity determining region 3 for antibody 36940
ARLLWDSYYSDS

SEQ ID NO: 73881 - protein, 8 aa, Homo sapiens
  light chain complementarity determining region 3 for antibody 36941
QQYNTWLR

SEQ ID NO: 73882 - protein, 12 aa, Homo sapiens
  heavy chain complementarity determining region 3 for antibody 36941
ARLLWDSYYFDS

SEQ ID NO: 73883 - protein, 9 aa, Homo sapiens
  light chain complementarity determining region 3 for antibody 36942
QQYNTAPYT

SEQ ID NO: 73884 - protein, 13 aa, Homo sapiens
  heavy chain complementarity determining region 3 for antibody 36942
ARLPYWELYYDDY

SEQ ID NO: 73885 - protein, 10 aa, Homo sapiens
  light chain complementarity determining region 3 for antibody 36943
QQYNSYWLLT

SEQ ID NO: 73886 - protein, 20 aa, Homo sapiens
  heavy chain complementarity determining region 3 for antibody 36943
ARGLKLLRATHYGPPSWFDP

SEQ ID NO: 73887 - protein, 9 aa, Homo sapiens
  light chain complementarity determining region 3 for antibody 36944
QQYNSYVLT

SEQ ID NO: 73888 - protein, 11 aa, Homo sapiens
  heavy chain complementarity determining region 3 for antibody 36944
VTGYTSHFGSR

SEQ ID NO: 73889 - protein, 9 aa, Homo sapiens
  light chain complementarity determining region 3 for antibody 36945
QQYNSYSYT

SEQ ID NO: 73890 - protein, 13 aa, Homo sapiens
  heavy chain complementarity determining region 3 for antibody 36945
ARISSPWPPLFDY

SEQ ID NO: 73891 - protein, 9 aa, Homo sapiens
  light chain complementarity determining region 3 for antibody 36946
QQYNSYSYP

SEQ ID NO: 73892 - protein, 14 aa, Homo sapiens
  heavy chain complementarity determining region 3 for antibody 36946
AKAHSMVRRYYFDY

SEQ ID NO: 73893 - protein, 9 aa, Homo sapiens
  light chain complementarity determining region 3 for antibody 36947
QQYNSYSWT

SEQ ID NO: 73894 - protein, 14 aa, Homo sapiens
  heavy chain complementarity determining region 3 for antibody 36947
ARGAGADYHPPLTD

SEQ ID NO: 73895 - protein, 9 aa, Homo sapiens
  light chain complementarity determining region 3 for antibody 36948
QQYNSYSWP

SEQ ID NO: 73896 - protein, 28 aa, Homo sapiens
  heavy chain complementarity determining region 3 for antibody 36948
GRVLRLSNLDFWRGNDPQRKYHYYSMDV

SEQ ID NO: 73897 - protein, 9 aa, Homo sapiens
  light chain complementarity determining region 3 for antibody 36949
QQYNSYSVT

SEQ ID NO: 73898 - protein, 17 aa, Homo sapiens
  heavy chain complementarity determining region 3 for antibody 36949
VKESWQWLVVYYYGMDV

SEQ ID NO: 73899 - protein, 9 aa, Homo sapiens
  light chain complementarity determining region 3 for antibody 36950
QQYNSYSVT

SEQ ID NO: 73900 - protein, 17 aa, Homo sapiens
  heavy chain complementarity determining region 3 for antibody 36950
VKESWQWLVDYYYGLDV

SEQ ID NO: 73901 - protein, 9 aa, Homo sapiens
  light chain complementarity determining region 3 for antibody 36951
QQYNSYSVT

SEQ ID NO: 73902 - protein, 17 aa, Homo sapiens
  heavy chain complementarity determining region 3 for antibody 36951
VKESWQWLVDYYYAMDV

SEQ ID NO: 73903 - protein, 9 aa, Homo sapiens
  light chain complementarity determining region 3 for antibody 36952
QQYNSYSVT

SEQ ID NO: 73904 - protein, 17 aa, Homo sapiens
  heavy chain complementarity determining region 3 for antibody 36952
VKESWQWLVDYYSGMDV

SEQ ID NO: 73905 - protein, 9 aa, Homo sapiens
  light chain complementarity determining region 3 for antibody 36953
QQYNSYSVT

SEQ ID NO: 73906 - protein, 17 aa, Homo sapiens
  heavy chain complementarity determining region 3 for antibody 36953
VKESWQWLVDYDYGMDV

SEQ ID NO: 73907 - protein, 9 aa, Homo sapiens
  light chain complementarity determining region 3 for antibody 36954
QQYNSYSVT

SEQ ID NO: 73908 - protein, 17 aa, Homo sapiens
  heavy chain complementarity determining region 3 for antibody 36954
VKESWQWLVDYCYGMDV

SEQ ID NO: 73909 - protein, 9 aa, Homo sapiens
  light chain complementarity determining region 3 for antibody 36955
QQYNSYSVT

SEQ ID NO: 73910 - protein, 17 aa, Homo sapiens
  heavy chain complementarity determining region 3 for antibody 36955
VKESWQWLVDDYYGMDV

SEQ ID NO: 73911 - protein, 9 aa, Homo sapiens
  light chain complementarity determining region 3 for antibody 36956
QQYNSYSVT

SEQ ID NO: 73912 - protein, 17 aa, Homo sapiens
  heavy chain complementarity determining region 3 for antibody 36956
VKESWQWLGDYYYGMDV

SEQ ID NO: 73913 - protein, 9 aa, Homo sapiens
  light chain complementarity determining region 3 for antibody 36957
QQYNSYSVT

SEQ ID NO: 73914 - protein, 17 aa, Homo sapiens
  heavy chain complementarity determining region 3 for antibody 36957
VKESWQWLADYYYGMDV

SEQ ID NO: 73915 - protein, 9 aa, Homo sapiens
  light chain complementarity determining region 3 for antibody 36958
QQYNSYSVP

SEQ ID NO: 73916 - protein, 17 aa, Homo sapiens
  heavy chain complementarity determining region 3 for antibody 36958
VKESWQWLVDYYYGMDV

SEQ ID NO: 73917 - protein, 8 aa, Homo sapiens
  light chain complementarity determining region 3 for antibody 36959
QQYNSYST

SEQ ID NO: 73918 - protein, 12 aa, Homo sapiens
  heavy chain complementarity determining region 3 for antibody 36959
VKDSGLGGSRDF

SEQ ID NO: 73919 - protein, 9 aa, Homo sapiens
  light chain complementarity determining region 3 for antibody 36960
QQYNSYSST

SEQ ID NO: 73920 - protein, 12 aa, Homo sapiens
  heavy chain complementarity determining region 3 for antibody 36960
ARGEGFGELSDY

SEQ ID NO: 73921 - protein, 8 aa, Homo sapiens
  light chain complementarity determining region 3 for antibody 36961
QQYNSYSS

SEQ ID NO: 73922 - protein, 18 aa, Homo sapiens
  heavy chain complementarity determining region 3 for antibody 36961
ARSWKVVVAAGAVRYFDY

SEQ ID NO: 73923 - protein, 9 aa, Homo sapiens
  light chain complementarity determining region 3 for antibody 36962
QQYNSYSRT

SEQ ID NO: 73924 - protein, 9 aa, Homo sapiens
  heavy chain complementarity determining region 3 for antibody 36962
AKGSSALEY

SEQ ID NO: 73925 - protein, 9 aa, Homo sapiens
  light chain complementarity determining region 3 for antibody 36963
QQYNSYSQT

SEQ ID NO: 73926 - protein, 14 aa, Homo sapiens
  heavy chain complementarity determining region 3 for antibody 36963
TTHLDYCPSSSCDY

SEQ ID NO: 73927 - protein, 10 aa, Homo sapiens
  light chain complementarity determining region 3 for antibody 36964
QQYNSYSPST

SEQ ID NO: 73928 - protein, 14 aa, Homo sapiens
  heavy chain complementarity determining region 3 for antibody 36964
ARDQRTGSGVVILD

SEQ ID NO: 73929 - protein, 11 aa, Homo sapiens
  light chain complementarity determining region 3 for antibody 36965
QQYNSYSPMYT

SEQ ID NO: 73930 - protein, 19 aa, Homo sapiens
  heavy chain complementarity determining region 3 for antibody 36965
ARAGGNYYYRTSYYGPFDY

SEQ ID NO: 73931 - protein, 11 aa, Homo sapiens
  light chain complementarity determining region 3 for antibody 36966
QQYNSYSPMYP

SEQ ID NO: 73932 - protein, 19 aa, Homo sapiens
  heavy chain complementarity determining region 3 for antibody 36966
ARAGGNYYDRTSYYGPFDY

SEQ ID NO: 73933 - protein, 10 aa, Homo sapiens
  light chain complementarity determining region 3 for antibody 36967
QQYNSYSPLT

SEQ ID NO: 73934 - protein, 12 aa, Homo sapiens
  heavy chain complementarity determining region 3 for antibody 36967
THVNWDRGTFDY

SEQ ID NO: 73935 - protein, 10 aa, Homo sapiens
  light chain complementarity determining region 3 for antibody 36968
QQYNSYSPLT

SEQ ID NO: 73936 - protein, 12 aa, Homo sapiens
  heavy chain complementarity determining region 3 for antibody 36968
THFNWDRGPFDY

SEQ ID NO: 73937 - protein, 10 aa, Homo sapiens
  light chain complementarity determining region 3 for antibody 36969
QQYNSYSPLT

SEQ ID NO: 73938 - protein, 12 aa, Homo sapiens
  heavy chain complementarity determining region 3 for antibody 36969
THFNCDRGTFDY

SEQ ID NO: 73939 - protein, 11 aa, Homo sapiens
  light chain complementarity determining region 3 for antibody 36970
QQYNSYSPLNT

SEQ ID NO: 73940 - protein, 19 aa, Homo sapiens
  heavy chain complementarity determining region 3 for antibody 36970
ARAGGNYYDRTSYYGPFDY

SEQ ID NO: 73941 - protein, 8 aa, Homo sapiens
  light chain complementarity determining region 3 for antibody 36971
QQYNSYSP

SEQ ID NO: 73942 - protein, 10 aa, Homo sapiens
  heavy chain complementarity determining region 3 for antibody 36971
ARDVVGSDDQ

SEQ ID NO: 73943 - protein, 10 aa, Homo sapiens
  light chain complementarity determining region 3 for antibody 36972
QQYNSYSLYS

SEQ ID NO: 73944 - protein, 20 aa, Homo sapiens
  heavy chain complementarity determining region 3 for antibody 36972
GKDLWDGGYCSRASCHGIDS

SEQ ID NO: 73945 - protein, 9 aa, Homo sapiens
  light chain complementarity determining region 3 for antibody 36973
QQYNSYSLP

SEQ ID NO: 73946 - protein, 20 aa, Homo sapiens
  heavy chain complementarity determining region 3 for antibody 36973
ARDFFPFPRGPESFDDVFDI

SEQ ID NO: 73947 - protein, 10 aa, Homo sapiens
  light chain complementarity determining region 3 for antibody 36974
QQYNSYSGWT

SEQ ID NO: 73948 - protein, 14 aa, Homo sapiens
  heavy chain complementarity determining region 3 for antibody 36974
TRTEWSSGWRLFDY

SEQ ID NO: 73949 - protein, 10 aa, Homo sapiens
  light chain complementarity determining region 3 for antibody 36975
QQYNSYSGWT

SEQ ID NO: 73950 - protein, 16 aa, Homo sapiens
  heavy chain complementarity determining region 3 for antibody 36975
ARGAFYYDTSGSLFDV

SEQ ID NO: 73951 - protein, 9 aa, Homo sapiens
  light chain complementarity determining region 3 for antibody 36976
QQYNSYSAT

SEQ ID NO: 73952 - protein, 17 aa, Homo sapiens
  heavy chain complementarity determining region 3 for antibody 36976
VKESWQWLVDYYYGMDV

SEQ ID NO: 73953 - protein, 9 aa, Homo sapiens
  light chain complementarity determining region 3 for antibody 36977
QQYNSYSAT

SEQ ID NO: 73954 - protein, 17 aa, Homo sapiens
  heavy chain complementarity determining region 3 for antibody 36977
VKESWQWLGDYYYGMDV

SEQ ID NO: 73955 - protein, 10 aa, Homo sapiens
  light chain complementarity determining region 3 for antibody 36978
QQYNSYSALT

SEQ ID NO: 73956 - protein, 19 aa, Homo sapiens
  heavy chain complementarity determining region 3 for antibody 36978
ARLTFDCSGGSCYHGAFDI

SEQ ID NO: 73957 - protein, 9 aa, Homo sapiens
  light chain complementarity determining region 3 for antibody 36979
QQYNSYRRT

SEQ ID NO: 73958 - protein, 9 aa, Homo sapiens
  heavy chain complementarity determining region 3 for antibody 36979
AKGSSALGY

SEQ ID NO: 73959 - protein, 9 aa, Homo sapiens
  light chain complementarity determining region 3 for antibody 36980
QQYNSYRRT

SEQ ID NO: 73960 - protein, 9 aa, Homo sapiens
  heavy chain complementarity determining region 3 for antibody 36980
AKGSAALEY

SEQ ID NO: 73961 - protein, 9 aa, Homo sapiens
  light chain complementarity determining region 3 for antibody 36981
QQYNSYPYT

SEQ ID NO: 73962 - protein, 14 aa, Homo sapiens
  heavy chain complementarity determining region 3 for antibody 36981
IGQDCSGRACDSPR

SEQ ID NO: 73963 - protein, 9 aa, Homo sapiens
  light chain complementarity determining region 3 for antibody 36982
QQYNSYPYT

SEQ ID NO: 73964 - protein, 19 aa, Homo sapiens
  heavy chain complementarity determining region 3 for antibody 36982
ARVGGWYGEFSRVDHRQLF

SEQ ID NO: 73965 - protein, 9 aa, Homo sapiens
  light chain complementarity determining region 3 for antibody 36983
QQYNSYPYT

SEQ ID NO: 73966 - protein, 21 aa, Homo sapiens
  heavy chain complementarity determining region 3 for antibody 36983
ARDVKHYDSSGSHWPLDMFDM

SEQ ID NO: 73967 - protein, 9 aa, Homo sapiens
  light chain complementarity determining region 3 for antibody 36984
QQYNSYPVT

SEQ ID NO: 73968 - protein, 17 aa, Homo sapiens
  heavy chain complementarity determining region 3 for antibody 36984
VKESWQWLVDYYYGMDV

SEQ ID NO: 73969 - protein, 9 aa, Homo sapiens
  light chain complementarity determining region 3 for antibody 36985
QQYNSYPST

SEQ ID NO: 73970 - protein, 15 aa, Homo sapiens
  heavy chain complementarity determining region 3 for antibody 36985
ARMHATGSYNGAFDV

SEQ ID NO: 73971 - protein, 9 aa, Homo sapiens
  light chain complementarity determining region 3 for antibody 36986
QQYNSYPRP

SEQ ID NO: 73972 - protein, 19 aa, Homo sapiens
  heavy chain complementarity determining region 3 for antibody 36986
TRELYLHYYDTTGRGVFDY

SEQ ID NO: 73973 - protein, 10 aa, Homo sapiens
  light chain complementarity determining region 3 for antibody 36987
QQYNSYPPIP

SEQ ID NO: 73974 - protein, 15 aa, Homo sapiens
  heavy chain complementarity determining region 3 for antibody 36987
ARVRRHYSNYDGLDY

SEQ ID NO: 73975 - protein, 9 aa, Homo sapiens
  light chain complementarity determining region 3 for antibody 36988
QQYNSYPLT

SEQ ID NO: 73976 - protein, 14 aa, Homo sapiens
  heavy chain complementarity determining region 3 for antibody 36988
ARVAPLDGDYALAC

SEQ ID NO: 73977 - protein, 9 aa, Homo sapiens
  light chain complementarity determining region 3 for antibody 36989
QQYNSYPLT

SEQ ID NO: 73978 - protein, 18 aa, Homo sapiens
  heavy chain complementarity determining region 3 for antibody 36989
AKEYSSGCCPPFGYGMDV

SEQ ID NO: 73979 - protein, 9 aa, Homo sapiens
  light chain complementarity determining region 3 for antibody 36990
QQYNSYPLT

SEQ ID NO: 73980 - protein, 20 aa, Homo sapiens
  heavy chain complementarity determining region 3 for antibody 36990
AKERSHYDSNKFLPPFFFDY

SEQ ID NO: 73981 - protein, 8 aa, Homo sapiens
  light chain complementarity determining region 3 for antibody 36991
QQYNSYPK

SEQ ID NO: 73982 - protein, 18 aa, Homo sapiens
  heavy chain complementarity determining region 3 for antibody 36991
ARTYSDLLTGYIGPYFDS

SEQ ID NO: 73983 - protein, 8 aa, Homo sapiens
  light chain complementarity determining region 3 for antibody 36992
QQYNSYLT

SEQ ID NO: 73984 - protein, 15 aa, Homo sapiens
  heavy chain complementarity determining region 3 for antibody 36992
AKSTVTTMSGGHVDS

SEQ ID NO: 73985 - protein, 9 aa, Homo sapiens
  light chain complementarity determining region 3 for antibody 36993
QQYNSYGLT

SEQ ID NO: 73986 - protein, 11 aa, Homo sapiens
  heavy chain complementarity determining region 3 for antibody 36993
VTGYTSHFGSL

SEQ ID NO: 73987 - protein, 9 aa, Homo sapiens
  light chain complementarity determining region 3 for antibody 36994
QQYNSYGLT

SEQ ID NO: 73988 - protein, 11 aa, Homo sapiens
  heavy chain complementarity determining region 3 for antibody 36994
VTGYTSHFGAR

SEQ ID NO: 73989 - protein, 9 aa, Homo sapiens
  light chain complementarity determining region 3 for antibody 36995
QQYNSYGLT

SEQ ID NO: 73990 - protein, 11 aa, Homo sapiens
  heavy chain complementarity determining region 3 for antibody 36995
VTGYASHFGSR

SEQ ID NO: 73991 - protein, 9 aa, Homo sapiens
  light chain complementarity determining region 3 for antibody 36996
QQYNSYGLP

SEQ ID NO: 73992 - protein, 11 aa, Homo sapiens
  heavy chain complementarity determining region 3 for antibody 36996
VTGYTSHFGSR

SEQ ID NO: 73993 - protein, 10 aa, Homo sapiens
  light chain complementarity determining region 3 for antibody 36997
QQYNSYFTWT

SEQ ID NO: 73994 - protein, 16 aa, Homo sapiens
  heavy chain complementarity determining region 3 for antibody 36997
ARYHSTAAVDAWWFDP

SEQ ID NO: 73995 - protein, 8 aa, Homo sapiens
  light chain complementarity determining region 3 for antibody 36998
QQYNSYFS

SEQ ID NO: 73996 - protein, 18 aa, Homo sapiens
  heavy chain complementarity determining region 3 for antibody 36998
ARSWKVVVASGAVRYFDY

SEQ ID NO: 73997 - protein, 10 aa, Homo sapiens
  light chain complementarity determining region 3 for antibody 36999
QQYNSYFPYT

SEQ ID NO: 73998 - protein, 14 aa, Homo sapiens
  heavy chain complementarity determining region 3 for antibody 36999
ARDQRTGSGVVILD

SEQ ID NO: 73999 - protein, 10 aa, Homo sapiens
  light chain complementarity determining region 3 for antibody 37000
QQYNSYFPLT

SEQ ID NO: 74000 - protein, 12 aa, Homo sapiens
  heavy chain complementarity determining region 3 for antibody 37000
THFNWDRGTFDY

SEQ ID NO: 74001 - protein, 9 aa, Homo sapiens
  light chain complementarity determining region 3 for antibody 37001
QQYNSYELT

SEQ ID NO: 74002 - protein, 11 aa, Homo sapiens
  heavy chain complementarity determining region 3 for antibody 37001
VTGYTSHFGSR

SEQ ID NO: 74003 - protein, 8 aa, Homo sapiens
  light chain complementarity determining region 3 for antibody 37002
QQYNSYCT

SEQ ID NO: 74004 - protein, 12 aa, Homo sapiens
  heavy chain complementarity determining region 3 for antibody 37002
VKDCGLGGSRDF

SEQ ID NO: 74005 - protein, 8 aa, Homo sapiens
  light chain complementarity determining region 3 for antibody 37003
QQYNSYCS

SEQ ID NO: 74006 - protein, 21 aa, Homo sapiens
  heavy chain complementarity determining region 3 for antibody 37003
ARAKVQRLIMGRKIIPYFFDS

SEQ ID NO: 74007 - protein, 9 aa, Homo sapiens
  light chain complementarity determining region 3 for antibody 37004
QQYNSWPYT

SEQ ID NO: 74008 - protein, 18 aa, Homo sapiens
  heavy chain complementarity determining region 3 for antibody 37004
VRGGTDLTGVAGMAPFHN

SEQ ID NO: 74009 - protein, 8 aa, Homo sapiens
  light chain complementarity determining region 3 for antibody 37005
QQYNSWPT

SEQ ID NO: 74010 - protein, 10 aa, Homo sapiens
  heavy chain complementarity determining region 3 for antibody 37005
VKNKFNYGDF

SEQ ID NO: 74011 - protein, 10 aa, Homo sapiens
  light chain complementarity determining region 3 for antibody 37006
QQYNSWPRYT

SEQ ID NO: 74012 - protein, 14 aa, Homo sapiens
  heavy chain complementarity determining region 3 for antibody 37006
ARSGDGINLGFFDY

SEQ ID NO: 74013 - protein, 10 aa, Homo sapiens
  light chain complementarity determining region 3 for antibody 37007
QQYNSWPLYP

SEQ ID NO: 74014 - protein, 14 aa, Homo sapiens
  heavy chain complementarity determining region 3 for antibody 37007
ARSGDGINLGFFDY

SEQ ID NO: 74015 - protein, 10 aa, Homo sapiens
  light chain complementarity determining region 3 for antibody 37008
QQYNSWPLDT

SEQ ID NO: 74016 - protein, 14 aa, Homo sapiens
  heavy chain complementarity determining region 3 for antibody 37008
ARSGDGINLGFFDY

SEQ ID NO: 74017 - protein, 9 aa, Homo sapiens
  light chain complementarity determining region 3 for antibody 37009
QQYNSSSVT

SEQ ID NO: 74018 - protein, 17 aa, Homo sapiens
  heavy chain complementarity determining region 3 for antibody 37009
VKESWQWLVDYYYGMDV

SEQ ID NO: 74019 - protein, 11 aa, Homo sapiens
  light chain complementarity determining region 3 for antibody 37010
QQYNSSPPGFT

SEQ ID NO: 74020 - protein, 14 aa, Homo sapiens
  heavy chain complementarity determining region 3 for antibody 37010
ATSARSSRKRSFDH

SEQ ID NO: 74021 - protein, 8 aa, Homo sapiens
  light chain complementarity determining region 3 for antibody 37011
QQYNSPFT

SEQ ID NO: 74022 - protein, 12 aa, Homo sapiens
  heavy chain complementarity determining region 3 for antibody 37011
ARALSSSWYAFY

SEQ ID NO: 74023 - protein, 8 aa, Homo sapiens
  light chain complementarity determining region 3 for antibody 37012
QQYNSNSS

SEQ ID NO: 74024 - protein, 18 aa, Homo sapiens
  heavy chain complementarity determining region 3 for antibody 37012
ARSWKVVVASGAVRYFDY

SEQ ID NO: 74025 - protein, 8 aa, Homo sapiens
  light chain complementarity determining region 3 for antibody 37013
QQYNSLYT

SEQ ID NO: 74026 - protein, 14 aa, Homo sapiens
  heavy chain complementarity determining region 3 for antibody 37013
ARESSISRKRSFDQ

SEQ ID NO: 74027 - protein, 8 aa, Homo sapiens
  light chain complementarity determining region 3 for antibody 37014
QQYNSLYT

SEQ ID NO: 74028 - protein, 14 aa, Homo sapiens
  heavy chain complementarity determining region 3 for antibody 37014
ARENSSSRKRSFDQ

SEQ ID NO: 74029 - protein, 8 aa, Homo sapiens
  light chain complementarity determining region 3 for antibody 37015
QQYNSLYT

SEQ ID NO: 74030 - protein, 14 aa, Homo sapiens
  heavy chain complementarity determining region 3 for antibody 37015
ARENSISRKSSFDH

SEQ ID NO: 74031 - protein, 8 aa, Homo sapiens
  light chain complementarity determining region 3 for antibody 37016
QQYNSLYT

SEQ ID NO: 74032 - protein, 14 aa, Homo sapiens
  heavy chain complementarity determining region 3 for antibody 37016
ARENSISRKRSSDQ

SEQ ID NO: 74033 - protein, 8 aa, Homo sapiens
  light chain complementarity determining region 3 for antibody 37017
QQYNSLYT

SEQ ID NO: 74034 - protein, 14 aa, Homo sapiens
  heavy chain complementarity determining region 3 for antibody 37017
ARENSISRKRSLDQ

SEQ ID NO: 74035 - protein, 8 aa, Homo sapiens
  light chain complementarity determining region 3 for antibody 37018
QQYNSLYT

SEQ ID NO: 74036 - protein, 14 aa, Homo sapiens
  heavy chain complementarity determining region 3 for antibody 37018
ARENSISRKGSFDQ

SEQ ID NO: 74037 - protein, 8 aa, Homo sapiens
  light chain complementarity determining region 3 for antibody 37019
QQYNSLYT

SEQ ID NO: 74038 - protein, 14 aa, Homo sapiens
  heavy chain complementarity determining region 3 for antibody 37019
ARENSISRERSFDQ

SEQ ID NO: 74039 - protein, 8 aa, Homo sapiens
  light chain complementarity determining region 3 for antibody 37020
QQYNSLYT

SEQ ID NO: 74040 - protein, 14 aa, Homo sapiens
  heavy chain complementarity determining region 3 for antibody 37020
ARENSIARKRSFDQ

SEQ ID NO: 74041 - protein, 8 aa, Homo sapiens
  light chain complementarity determining region 3 for antibody 37021
QQYNSLYT

SEQ ID NO: 74042 - protein, 14 aa, Homo sapiens
  heavy chain complementarity determining region 3 for antibody 37021
AREKSISRKRSFDQ

SEQ ID NO: 74043 - protein, 8 aa, Homo sapiens
  light chain complementarity determining region 3 for antibody 37022
QQYNSLST

SEQ ID NO: 74044 - protein, 14 aa, Homo sapiens
  heavy chain complementarity determining region 3 for antibody 37022
ARENSISRKRSFDH

SEQ ID NO: 74045 - protein, 9 aa, Homo sapiens
  light chain complementarity determining region 3 for antibody 37023
QQYNSHLIT

SEQ ID NO: 74046 - protein, 14 aa, Homo sapiens
  heavy chain complementarity determining region 3 for antibody 37023
AGIMVDTATDAFDI

SEQ ID NO: 74047 - protein, 9 aa, Homo sapiens
  light chain complementarity determining region 3 for antibody 37024
QQYNSFAWT

SEQ ID NO: 74048 - protein, 12 aa, Homo sapiens
  heavy chain complementarity determining region 3 for antibody 37024
VRDSREACAMDV

SEQ ID NO: 74049 - protein, 9 aa, Homo sapiens
  light chain complementarity determining region 3 for antibody 37025
QQYNSAPRT

SEQ ID NO: 74050 - protein, 11 aa, Homo sapiens
  heavy chain complementarity determining region 3 for antibody 37025
ARDAAYSCFDY

SEQ ID NO: 74051 - protein, 9 aa, Homo sapiens
  light chain complementarity determining region 3 for antibody 37026
QQYNSAPQT

SEQ ID NO: 74052 - protein, 13 aa, Homo sapiens
  heavy chain complementarity determining region 3 for antibody 37026
ARDRLVGKALLDY

SEQ ID NO: 74053 - protein, 9 aa, Homo sapiens
  light chain complementarity determining region 3 for antibody 37027
QQYNSAPFT

SEQ ID NO: 74054 - protein, 19 aa, Homo sapiens
  heavy chain complementarity determining region 3 for antibody 37027
ARLPGPAAAANHPPYNFDY

SEQ ID NO: 74055 - protein, 9 aa, Homo sapiens
  light chain complementarity determining region 3 for antibody 37028
QQYNRYSYT

SEQ ID NO: 74056 - protein, 12 aa, Homo sapiens
  heavy chain complementarity determining region 3 for antibody 37028
ARGEGFGELSDY

SEQ ID NO: 74057 - protein, 10 aa, Homo sapiens
  light chain complementarity determining region 3 for antibody 37029
QQYNRYSEST

SEQ ID NO: 74058 - protein, 12 aa, Homo sapiens
  heavy chain complementarity determining region 3 for antibody 37029
ARADGDYACFDH

SEQ ID NO: 74059 - protein, 8 aa, Homo sapiens
  light chain complementarity determining region 3 for antibody 37030
QQYNRYPT

SEQ ID NO: 74060 - protein, 15 aa, Homo sapiens
  heavy chain complementarity determining region 3 for antibody 37030
AKSTVTTMSGGHVDS

SEQ ID NO: 74061 - protein, 9 aa, Homo sapiens
  light chain complementarity determining region 3 for antibody 37031
QQYNRYPFT

SEQ ID NO: 74062 - protein, 11 aa, Homo sapiens
  heavy chain complementarity determining region 3 for antibody 37031
ARQTRGNTIST

SEQ ID NO: 74063 - protein, 8 aa, Homo sapiens
  light chain complementarity determining region 3 for antibody 37032
QQYNRYFT

SEQ ID NO: 74064 - protein, 15 aa, Homo sapiens
  heavy chain complementarity determining region 3 for antibody 37032
AKSTVTTMSGGHVDS

SEQ ID NO: 74065 - protein, 9 aa, Homo sapiens
  light chain complementarity determining region 3 for antibody 37033
QQYNRWPET

SEQ ID NO: 74066 - protein, 20 aa, Homo sapiens
  heavy chain complementarity determining region 3 for antibody 37033
ARDPREYYDLRNYYVYYFDS

SEQ ID NO: 74067 - protein, 9 aa, Homo sapiens
  light chain complementarity determining region 3 for antibody 37034
QQYNRWPAT

SEQ ID NO: 74068 - protein, 20 aa, Homo sapiens
  heavy chain complementarity determining region 3 for antibody 37034
ARDPREYYDLRNYYVYSFDS

SEQ ID NO: 74069 - protein, 8 aa, Homo sapiens
  light chain complementarity determining region 3 for antibody 37035
QQYNRSLT

SEQ ID NO: 74070 - protein, 15 aa, Homo sapiens
  heavy chain complementarity determining region 3 for antibody 37035
AKSTVTTMSGGHVDS

SEQ ID NO: 74071 - protein, 8 aa, Homo sapiens
  light chain complementarity determining region 3 for antibody 37036
QQYNRNLT

SEQ ID NO: 74072 - protein, 15 aa, Homo sapiens
  heavy chain complementarity determining region 3 for antibody 37036
AKSTVTTMSGGHVDS

SEQ ID NO: 74073 - protein, 8 aa, Homo sapiens
  light chain complementarity determining region 3 for antibody 37037
QQYNPYWT

SEQ ID NO: 74074 - protein, 14 aa, Homo sapiens
  heavy chain complementarity determining region 3 for antibody 37037
ARGGSSGYYHHFDS

SEQ ID NO: 74075 - protein, 8 aa, Homo sapiens
  light chain complementarity determining region 3 for antibody 37038
QQYNNYWT

SEQ ID NO: 74076 - protein, 14 aa, Homo sapiens
  heavy chain complementarity determining region 3 for antibody 37038
ARGGSSGYYHHFDS

SEQ ID NO: 74077 - protein, 9 aa, Homo sapiens
  light chain complementarity determining region 3 for antibody 37039
QQYNNYPYT

SEQ ID NO: 74078 - protein, 9 aa, Homo sapiens
  heavy chain complementarity determining region 3 for antibody 37039
ARDFGYPRP

SEQ ID NO: 74079 - protein, 9 aa, Homo sapiens
  light chain complementarity determining region 3 for antibody 37040
QQYNNYPPT

SEQ ID NO: 74080 - protein, 12 aa, Homo sapiens
  heavy chain complementarity determining region 3 for antibody 37040
ATYRHYPDYSDF

SEQ ID NO: 74081 - protein, 9 aa, Homo sapiens
  light chain complementarity determining region 3 for antibody 37041
QQYNNYPLT

SEQ ID NO: 74082 - protein, 18 aa, Homo sapiens
  heavy chain complementarity determining region 3 for antibody 37041
AKGLHYYYFQSDGSMFDF

SEQ ID NO: 74083 - protein, 9 aa, Homo sapiens
  light chain complementarity determining region 3 for antibody 37042
QQYNNYPIT

SEQ ID NO: 74084 - protein, 12 aa, Homo sapiens
  heavy chain complementarity determining region 3 for antibody 37042
ATYRHYPDYSDF

SEQ ID NO: 74085 - protein, 8 aa, Homo sapiens
  light chain complementarity determining region 3 for antibody 37043
QQYNNYAT

SEQ ID NO: 74086 - protein, 16 aa, Homo sapiens
  heavy chain complementarity determining region 3 for antibody 37043
ATELYYGSPTHTGFAI

SEQ ID NO: 74087 - protein, 8 aa, Homo sapiens
  light chain complementarity determining region 3 for antibody 37044
QQYNNWWT

SEQ ID NO: 74088 - protein, 10 aa, Homo sapiens
  heavy chain complementarity determining region 3 for antibody 37044
ARDGFGAFDI

SEQ ID NO: 74089 - protein, 8 aa, Homo sapiens
  light chain complementarity determining region 3 for antibody 37045
QQYNNWWR

SEQ ID NO: 74090 - protein, 10 aa, Homo sapiens
  heavy chain complementarity determining region 3 for antibody 37045
ARAGFGAFDI

SEQ ID NO: 74091 - protein, 8 aa, Homo sapiens
  light chain complementarity determining region 3 for antibody 37046
QQYNNWWP

SEQ ID NO: 74092 - protein, 10 aa, Homo sapiens
  heavy chain complementarity determining region 3 for antibody 37046
ARAGFGAFDI

SEQ ID NO: 74093 - protein, 10 aa, Homo sapiens
  light chain complementarity determining region 3 for antibody 37047
QQYNNWPWYP

SEQ ID NO: 74094 - protein, 17 aa, Homo sapiens
  heavy chain complementarity determining region 3 for antibody 37047
ARHRQQVVSPAYWYFDF

SEQ ID NO: 74095 - protein, 9 aa, Homo sapiens
  light chain complementarity determining region 3 for antibody 37048
QQYNNWPWT

SEQ ID NO: 74096 - protein, 13 aa, Homo sapiens
  heavy chain complementarity determining region 3 for antibody 37048
TTDRLVIREVADS

SEQ ID NO: 74097 - protein, 8 aa, Homo sapiens
  light chain complementarity determining region 3 for antibody 37049
QQYNNWPT

SEQ ID NO: 74098 - protein, 16 aa, Homo sapiens
  heavy chain complementarity determining region 3 for antibody 37049
AREGMTTDPARAAFDL

SEQ ID NO: 74099 - protein, 9 aa, Homo sapiens
  light chain complementarity determining region 3 for antibody 37050
QQYNNWPRT

SEQ ID NO: 74100 - protein, 14 aa, Homo sapiens
  heavy chain complementarity determining region 3 for antibody 37050
ATSSATVTMTWFDP

SEQ ID NO: 74101 - protein, 9 aa, Homo sapiens
  light chain complementarity determining region 3 for antibody 37051
QQYNNWPRT

SEQ ID NO: 74102 - protein, 13 aa, Homo sapiens
  heavy chain complementarity determining region 3 for antibody 37051
ARLGSAIIGYFDV

SEQ ID NO: 74103 - protein, 9 aa, Homo sapiens
  light chain complementarity determining region 3 for antibody 37052
QQYNNWPRT

SEQ ID NO: 74104 - protein, 15 aa, Homo sapiens
  heavy chain complementarity determining region 3 for antibody 37052
ARDPRTGYTGGWFDY

SEQ ID NO: 74105 - protein, 10 aa, Homo sapiens
  light chain complementarity determining region 3 for antibody 37053
QQYNNWPRST

SEQ ID NO: 74106 - protein, 14 aa, Homo sapiens
  heavy chain complementarity determining region 3 for antibody 37053
ARLGEGYSYGPSDY

SEQ ID NO: 74107 - protein, 10 aa, Homo sapiens
  light chain complementarity determining region 3 for antibody 37054
QQYNNWPPYT

SEQ ID NO: 74108 - protein, 14 aa, Homo sapiens
  heavy chain complementarity determining region 3 for antibody 37054
ARVGLSRGLYYFDY

SEQ ID NO: 74109 - protein, 10 aa, Homo sapiens
  light chain complementarity determining region 3 for antibody 37055
QQYNNWPPYT

SEQ ID NO: 74110 - protein, 19 aa, Homo sapiens
  heavy chain complementarity determining region 3 for antibody 37055
ARLTFDCSGGSCYHGAFDI

SEQ ID NO: 74111 - protein, 10 aa, Homo sapiens
  light chain complementarity determining region 3 for antibody 37056
QQYNNWPPYT

SEQ ID NO: 74112 - protein, 18 aa, Homo sapiens
  heavy chain complementarity determining region 3 for antibody 37056
ARGNVYYYDPSDYIYFDQ

SEQ ID NO: 74113 - protein, 10 aa, Homo sapiens [sequence omitted]

SEQ ID NO: 74114 - protein, 10 aa, Homo sapiens
  heavy chain complementarity determining region 3 for antibody 37057
SKGGAWYPDY

SEQ ID NO: 74115 - protein, 11 aa, Homo sapiens
  light chain complementarity determining region 3 for antibody 37058
QQYNNWPPVYT

SEQ ID NO: 74116 - protein, 12 aa, Homo sapiens
  heavy chain complementarity determining region 3 for antibody 37058
ARMSGYYYYFDY

SEQ ID NO: 74117 - protein, 10 aa, Homo sapiens
  light chain complementarity determining region 3 for antibody 37059
QQYNNWPPST

SEQ ID NO: 74118 - protein, 18 aa, Homo sapiens
  heavy chain complementarity determining region 3 for antibody 37059
ARGNVYYYDPSDYIYFDQ

SEQ ID NO: 74119 - protein, 10 aa, Homo sapiens
  light chain complementarity determining region 3 for antibody 37060
QQYNNWPPRT

SEQ ID NO: 74120 - protein, 12 aa, Homo sapiens
  heavy chain complementarity determining region 3 for antibody 37060
ARDLIYSSGSDY

SEQ ID NO: 74121 - protein, 10 aa, Homo sapiens
  light chain complementarity determining region 3 for antibody 37061
QQYNNWPPRT

SEQ ID NO: 74122 - protein, 12 aa, Homo sapiens
  heavy chain complementarity determining region 3 for antibody 37061
ARDLIYSSGFGY

SEQ ID NO: 74123 - protein, 12 aa, Homo sapiens
  light chain complementarity determining region 3 for antibody 37062
QQYNNWPPRPPT

SEQ ID NO: 74124 - protein, 13 aa, Homo sapiens
  heavy chain complementarity determining region 3 for antibody 37062
ASRPSGTYGPFNY

SEQ ID NO: 74125 - protein, 12 aa, Homo sapiens
  light chain complementarity determining region 3 for antibody 37063
QQYNNWPPRPLN

SEQ ID NO: 74126 - protein, 13 aa, Homo sapiens
  heavy chain complementarity determining region 3 for antibody 37063
ASRPSGTYGPFNY

SEQ ID NO: 74127 - protein, 10 aa, Homo sapiens
  light chain complementarity determining region 3 for antibody 37064
QQYNNWPPPT

SEQ ID NO: 74128 - protein, 15 aa, Homo sapiens
  heavy chain complementarity determining region 3 for antibody 37064
AKEPDCGRNCLFFDS

SEQ ID NO: 74129 - protein, 10 aa, Homo sapiens
  light chain complementarity determining region 3 for antibody 37065
QQYNNWPPLT

SEQ ID NO: 74130 - protein, 15 aa, Homo sapiens
  heavy chain complementarity determining region 3 for antibody 37065
ARYCYDSSGYYVFDY

SEQ ID NO: 74131 - protein, 10 aa, Homo sapiens
  light chain complementarity determining region 3 for antibody 37066
QQYNNWPPFT

SEQ ID NO: 74132 - protein, 15 aa, Homo sapiens
  heavy chain complementarity determining region 3 for antibody 37066
AKEPDCGRNCLFFDS

SEQ ID NO: 74133 - protein, 10 aa, Homo sapiens
  light chain complementarity determining region 3 for antibody 37067
QQYNNWPPDT

SEQ ID NO: 74134 - protein, 18 aa, Homo sapiens
  heavy chain complementarity determining region 3 for antibody 37067
ARGNVYYYDTSDYIYFDQ

SEQ ID NO: 74135 - protein, 9 aa, Homo sapiens
  light chain complementarity determining region 3 for antibody 37068
QQYNNWPLT

SEQ ID NO: 74136 - protein, 13 aa, Homo sapiens
  heavy chain complementarity determining region 3 for antibody 37068
ARDSTAVYGTFDS

SEQ ID NO: 74137 - protein, 9 aa, Homo sapiens
  light chain complementarity determining region 3 for antibody 37069
QQYNNWPLT

SEQ ID NO: 74138 - protein, 18 aa, Homo sapiens
  heavy chain complementarity determining region 3 for antibody 37069
ARDLRPFGGITPFGWFDP

SEQ ID NO: 74139 - protein, 9 aa, Homo sapiens
  light chain complementarity determining region 3 for antibody 37070
QQYNNWPLT

SEQ ID NO: 74140 - protein, 15 aa, Homo sapiens
  heavy chain complementarity determining region 3 for antibody 37070
APRAAETNPWYGMDV

SEQ ID NO: 74141 - protein, 9 aa, Homo sapiens
  light chain complementarity determining region 3 for antibody 37071
QQYNNWPLT

SEQ ID NO: 74142 - protein, 16 aa, Homo sapiens
  heavy chain complementarity determining region 3 for antibody 37071
AKRVWFGDLASAVFDD

SEQ ID NO: 74143 - protein, 11 aa, Homo sapiens
  light chain complementarity determining region 3 for antibody 37072
QQYNNWPLPLT

SEQ ID NO: 74144 - protein, 17 aa, Homo sapiens
  heavy chain complementarity determining region 3 for antibody 37072
AREGMVRGVPYPPYFDY

SEQ ID NO: 74145 - protein, 9 aa, Homo sapiens
  light chain complementarity determining region 3 for antibody 37073
QQYNNWPLP

SEQ ID NO: 74146 - protein, 18 aa, Homo sapiens
  heavy chain complementarity determining region 3 for antibody 37073
ARDFRPFGGITPFGWFDP

SEQ ID NO: 74147 - protein, 10 aa, Homo sapiens
  light chain complementarity determining region 3 for antibody 37074
QQYNNWPLLT

SEQ ID NO: 74148 - protein, 14 aa, Homo sapiens
  heavy chain complementarity determining region 3 for antibody 37074
ARSVGSYRVGDFDN

SEQ ID NO: 74149 - protein, 11 aa, Homo sapiens
  light chain complementarity determining region 3 for antibody 37075
QQYNNWPLIFT

SEQ ID NO: 74150 - protein, 13 aa, Homo sapiens
  heavy chain complementarity determining region 3 for antibody 37075
ARGTTVGMVILDY

SEQ ID NO: 74151 - protein, 10 aa, Homo sapiens
  light chain complementarity determining region 3 for antibody 37076
QQYNNWPGYT

SEQ ID NO: 74152 - protein, 17 aa, Homo sapiens
  heavy chain complementarity determining region 3 for antibody 37076
ARHRQQVVSPAYWYFDF

SEQ ID NO: 74153 - protein, 9 aa, Homo sapiens
  light chain complementarity determining region 3 for antibody 37077
QQYNNWPFP

SEQ ID NO: 74154 - protein, 13 aa, Homo sapiens
  heavy chain complementarity determining region 3 for antibody 37077
ARAGWEFFTWFDS

SEQ ID NO: 74155 - protein, 8 aa, Homo sapiens
  light chain complementarity determining region 3 for antibody 37078
QQYNNWLT

SEQ ID NO: 74156 - protein, 16 aa, Homo sapiens
  heavy chain complementarity determining region 3 for antibody 37078
ARGVTGYSYGPYYFDY

SEQ ID NO: 74157 - protein, 8 aa, Homo sapiens
  light chain complementarity determining region 3 for antibody 37079
QQYNNWLT

SEQ ID NO: 74158 - protein, 10 aa, Homo sapiens
  heavy chain complementarity determining region 3 for antibody 37079
ARAGFGAFDI

SEQ ID NO: 74159 - protein, 9 aa, Homo sapiens
  light chain complementarity determining region 3 for antibody 37080
QQYNNWLLT

SEQ ID NO: 74160 - protein, 10 aa, Homo sapiens
  heavy chain complementarity determining region 3 for antibody 37080
TRGSSGRFDY

SEQ ID NO: 74161 - protein, 9 aa, Homo sapiens
  light chain complementarity determining region 3 for antibody 37081
QQYNNWLIP

SEQ ID NO: 74162 - protein, 10 aa, Homo sapiens
  heavy chain complementarity determining region 3 for antibody 37081
TRGSSGRFDY

SEQ ID NO: 74163 - protein, 10 aa, Homo sapiens
  light chain complementarity determining region 3 for antibody 37082
QQYNNWLGVT

SEQ ID NO: 74164 - protein, 13 aa, Homo sapiens
  heavy chain complementarity determining region 3 for antibody 37082
ARHGRRSGWYYTY

SEQ ID NO: 74165 - protein, 10 aa, Homo sapiens
  light chain complementarity determining region 3 for antibody 37083
QQYNNWLGRT

SEQ ID NO: 74166 - protein, 13 aa, Homo sapiens
  heavy chain complementarity determining region 3 for antibody 37083
ARHGRRSGWYYTY

SEQ ID NO: 74167 - protein, 10 aa, Homo sapiens
  light chain complementarity determining region 3 for antibody 37084
QQYNNWLGGT

SEQ ID NO: 74168 - protein, 13 aa, Homo sapiens
  heavy chain complementarity determining region 3 for antibody 37084
ARHGRRSGWYYTY

SEQ ID NO: 74169 - protein, 10 aa, Homo sapiens
  light chain complementarity determining region 3 for antibody 37085
QQYNNWHPLT

SEQ ID NO: 74170 - protein, 15 aa, Homo sapiens
  heavy chain complementarity determining region 3 for antibody 37085
ARYYYDSSGYYVFDY

SEQ ID NO: 74171 - protein, 9 aa, Homo sapiens
  light chain complementarity determining region 3 for antibody 37086
QQYNNWFIT

SEQ ID NO: 74172 - protein, 10 aa, Homo sapiens
  heavy chain complementarity determining region 3 for antibody 37086
TRGSSGRFDY

SEQ ID NO: 74173 - protein, 10 aa, Homo sapiens
  light chain complementarity determining region 3 for antibody 37087
QQYNNRPRKT

SEQ ID NO: 74174 - protein, 12 aa, Homo sapiens
  heavy chain complementarity determining region 3 for antibody 37087
AKMMPRHDVFDL

SEQ ID NO: 74175 - protein, 10 aa, Homo sapiens
  light chain complementarity determining region 3 for antibody 37088
QQYNNRPPWT

SEQ ID NO: 74176 - protein, 12 aa, Homo sapiens
  heavy chain complementarity determining region 3 for antibody 37088
ARHRGMDYALDL

SEQ ID NO: 74177 - protein, 10 aa, Homo sapiens
  light chain complementarity determining region 3 for antibody 37089
QQYNNRPPWT

SEQ ID NO: 74178 - protein, 17 aa, Homo sapiens
  heavy chain complementarity determining region 3 for antibody 37089
AARTRQLGEDTYWYFDL

SEQ ID NO: 74179 - protein, 10 aa, Homo sapiens
  light chain complementarity determining region 3 for antibody 37090
QQYNNRPPWR

SEQ ID NO: 74180 - protein, 12 aa, Homo sapiens
  heavy chain complementarity determining region 3 for antibody 37090
ARHRGMDDALDL

SEQ ID NO: 74181 - protein, 10 aa, Homo sapiens
  light chain complementarity determining region 3 for antibody 37091
QQYNNRPPRT

SEQ ID NO: 74182 - protein, 17 aa, Homo sapiens
  heavy chain complementarity determining region 3 for antibody 37091
ATRTRQLGEDTYWYFDL

SEQ ID NO: 74183 - protein, 10 aa, Homo sapiens
  light chain complementarity determining region 3 for antibody 37092
QQYNNRPPRT

SEQ ID NO: 74184 - protein, 12 aa, Homo sapiens
  heavy chain complementarity determining region 3 for antibody 37092
ARHRGMDDALDL

SEQ ID NO: 74185 - protein, 10 aa, Homo sapiens
  light chain complementarity determining region 3 for antibody 37093
QQYNNRPPGT

SEQ ID NO: 74186 - protein, 17 aa, Homo sapiens
  heavy chain complementarity determining region 3 for antibody 37093
ATRTRQLGEDTYWYFDL

SEQ ID NO: 74187 - protein, 9 aa, Homo sapiens
  light chain complementarity determining region 3 for antibody 37094
QQYNNPPPT

SEQ ID NO: 74188 - protein, 11 aa, Homo sapiens
  heavy chain complementarity determining region 3 for antibody 37094
ASGRSWRRLDY

SEQ ID NO: 74189 - protein, 10 aa, Homo sapiens
  light chain complementarity determining region 3 for antibody 37095
QQYNNPLWVT

SEQ ID NO: 74190 - protein, 16 aa, Homo sapiens
  heavy chain complementarity determining region 3 for antibody 37095
ARDRGSVLEPQHVYDV

SEQ ID NO: 74191 - protein, 10 aa, Homo sapiens
  light chain complementarity determining region 3 for antibody 37096
QQYNNLPPLT

SEQ ID NO: 74192 - protein, 15 aa, Homo sapiens
  heavy chain complementarity determining region 3 for antibody 37096
ARYYYDSSGYYVFDY

SEQ ID NO: 74193 - protein, 9 aa, Homo sapiens
  light chain complementarity determining region 3 for antibody 37097
QQYNNLPLT

SEQ ID NO: 74194 - protein, 13 aa, Homo sapiens
  heavy chain complementarity determining region 3 for antibody 37097
ARDSTAVSGTFDS

SEQ ID NO: 74195 - protein, 10 aa, Homo sapiens
  light chain complementarity determining region 3 for antibody 37098
QQYNNCPSYT

SEQ ID NO: 74196 - protein, 17 aa, Homo sapiens
  heavy chain complementarity determining region 3 for antibody 37098
AVTPAVAEWDISWYFDV

SEQ ID NO: 74197 - protein, 9 aa, Homo sapiens
  light chain complementarity determining region 3 for antibody 37099
QQYNLYPHT

SEQ ID NO: 74198 - protein, 16 aa, Homo sapiens
  heavy chain complementarity determining region 3 for antibody 37099
ARETDRGSYGSGSYDY

SEQ ID NO: 74199 - protein, 10 aa, Homo sapiens
  light chain complementarity determining region 3 for antibody 37100
QQYNKWPPLT

SEQ ID NO: 74200 - protein, 12 aa, Homo sapiens
  heavy chain complementarity determining region 3 for antibody 37100
GKDMYRVSSINY

SEQ ID NO: 74201 - protein, 9 aa, Homo sapiens
  light chain complementarity determining region 3 for antibody 37101
QQYNKGPRT

SEQ ID NO: 74202 - protein, 13 aa, Homo sapiens
  heavy chain complementarity determining region 3 for antibody 37101
ARLGSAIIGYFDV

SEQ ID NO: 74203 - protein, 10 aa, Homo sapiens
  light chain complementarity determining region 3 for antibody 37102
QQYNKGPPLT

SEQ ID NO: 74204 - protein, 13 aa, Homo sapiens
  heavy chain complementarity determining region 3 for antibody 37102
GKDMYRVSSIINY

SEQ ID NO: 74205 - protein, 10 aa, Homo sapiens
  light chain complementarity determining region 3 for antibody 37103
QQYNIWPPFT

SEQ ID NO: 74206 - protein, 17 aa, Homo sapiens
  heavy chain complementarity determining region 3 for antibody 37103
TSRRYCSTTRCWRAFDY

SEQ ID NO: 74207 - protein, 10 aa, Homo sapiens
  light chain complementarity determining region 3 for antibody 37104
QQYNHWPPVT

SEQ ID NO: 74208 - protein, 12 aa, Homo sapiens
  heavy chain complementarity determining region 3 for antibody 37104
VKPAYSSGWFDF

SEQ ID NO: 74209 - protein, 10 aa, Homo sapiens
  light chain complementarity determining region 3 for antibody 37105
QQYNHWPPGT

SEQ ID NO: 74210 - protein, 12 aa, Homo sapiens
  heavy chain complementarity determining region 3 for antibody 37105
VKPAYSSGWYDF

SEQ ID NO: 74211 - protein, 10 aa, Homo sapiens
  light chain complementarity determining region 3 for antibody 37106
QQYNHLPPVT

SEQ ID NO: 74212 - protein, 12 aa, Homo sapiens
  heavy chain complementarity determining region 3 for antibody 37106
VKPAYSSGWYDF

SEQ ID NO: 74213 - protein, 9 aa, Homo sapiens
  light chain complementarity determining region 3 for antibody 37107
QQYNGYSRT

SEQ ID NO: 74214 - protein, 18 aa, Homo sapiens
  heavy chain complementarity determining region 3 for antibody 37107
AREFGGRAYTKVENAFDI

SEQ ID NO: 74215 - protein, 9 aa, Homo sapiens
  light chain complementarity determining region 3 for antibody 37108
QQYNGYSRT

SEQ ID NO: 74216 - protein, 18 aa, Homo sapiens
  heavy chain complementarity determining region 3 for antibody 37108
ARDSGGRAYTKVENAFDI

SEQ ID NO: 74217 - protein, 9 aa, Homo sapiens
  light chain complementarity determining region 3 for antibody 37109
QQYNGYSRT

SEQ ID NO: 74218 - protein, 18 aa, Homo sapiens
  heavy chain complementarity determining region 3 for antibody 37109
ARDFGGRAYTNVENAFDI

SEQ ID NO: 74219 - protein, 9 aa, Homo sapiens
  light chain complementarity determining region 3 for antibody 37110
QQYNGYSRT

SEQ ID NO: 74220 - protein, 18 aa, Homo sapiens
  heavy chain complementarity determining region 3 for antibody 37110
ARDFGGRAYTKVENAFDT

SEQ ID NO: 74221 - protein, 9 aa, Homo sapiens
  light chain complementarity determining region 3 for antibody 37111
QQYNGYSRT

SEQ ID NO: 74222 - protein, 18 aa, Homo sapiens
  heavy chain complementarity determining region 3 for antibody 37111
ARDFGGRAYTKVEDAFDI

SEQ ID NO: 74223 - protein, 9 aa, Homo sapiens
  light chain complementarity determining region 3 for antibody 37112
QQYNGYSRT

SEQ ID NO: 74224 - protein, 18 aa, Homo sapiens
  heavy chain complementarity determining region 3 for antibody 37112
ARDFGGRAYTKVDNAFDI

SEQ ID NO: 74225 - protein, 9 aa, Homo sapiens
  light chain complementarity determining region 3 for antibody 37113
QQYNGYSRT

SEQ ID NO: 74226 - protein, 18 aa, Homo sapiens
  heavy chain complementarity determining region 3 for antibody 37113
ARDFGGRAYKKVENAFDI

SEQ ID NO: 74227 - protein, 9 aa, Homo sapiens
  light chain complementarity determining region 3 for antibody 37114
QQYNGYSRT

SEQ ID NO: 74228 - protein, 18 aa, Homo sapiens
  heavy chain complementarity determining region 3 for antibody 37114
ARDFGGRAYAKVENAFDI

SEQ ID NO: 74229 - protein, 9 aa, Homo sapiens
  light chain complementarity determining region 3 for antibody 37115
QQYNGYSRT

SEQ ID NO: 74230 - protein, 18 aa, Homo sapiens
  heavy chain complementarity determining region 3 for antibody 37115
ARDFGGRASTKVENAFDI

SEQ ID NO: 74231 - protein, 9 aa, Homo sapiens
  light chain complementarity determining region 3 for antibody 37116
QQYNGYSRT

SEQ ID NO: 74232 - protein, 18 aa, Homo sapiens
  heavy chain complementarity determining region 3 for antibody 37116
ARDFGGRADTKVENAFDI

SEQ ID NO: 74233 - protein, 9 aa, Homo sapiens
  light chain complementarity determining region 3 for antibody 37117
QQYNGYSRT

SEQ ID NO: 74234 - protein, 18 aa, Homo sapiens
  heavy chain complementarity determining region 3 for antibody 37117
ARDFGGRACTKVENAFDI

SEQ ID NO: 74235 - protein, 9 aa, Homo sapiens
  light chain complementarity determining region 3 for antibody 37118
QQYNGYSRT

SEQ ID NO: 74236 - protein, 18 aa, Homo sapiens
  heavy chain complementarity determining region 3 for antibody 37118
AGDFGGRAYTKVENAFDI

SEQ ID NO: 74237 - protein, 9 aa, Homo sapiens
  light chain complementarity determining region 3 for antibody 37119
QQYNGYSRS

SEQ ID NO: 74238 - protein, 18 aa, Homo sapiens
  heavy chain complementarity determining region 3 for antibody 37119
ARDFGGRAYTKVENAFDI

SEQ ID NO: 74239 - protein, 9 aa, Homo sapiens
  light chain complementarity determining region 3 for antibody 37120
QQYNGYSRP

SEQ ID NO: 74240 - protein, 18 aa, Homo sapiens
  heavy chain complementarity determining region 3 for antibody 37120
ARDFGGRAYTKVENAFDI

SEQ ID NO: 74241 - protein, 9 aa, Homo sapiens
  light chain complementarity determining region 3 for antibody 37121
QQYNGYSRK

SEQ ID NO: 74242 - protein, 18 aa, Homo sapiens
  heavy chain complementarity determining region 3 for antibody 37121
ARDFGGRAYTKVENAFDI

SEQ ID NO: 74243 - protein, 9 aa, Homo sapiens
  light chain complementarity determining region 3 for antibody 37122
QQYNGYLWT

SEQ ID NO: 74244 - protein, 14 aa, Homo sapiens
  heavy chain complementarity determining region 3 for antibody 37122
MIRGHSYDFDPWPF

SEQ ID NO: 74245 - protein, 9 aa, Homo sapiens
  light chain complementarity determining region 3 for antibody 37123
QQYNGYLWP

SEQ ID NO: 74246 - protein, 14 aa, Homo sapiens
  heavy chain complementarity determining region 3 for antibody 37123
MIRGHSYDFDPRPF

SEQ ID NO: 74247 - protein, 9 aa, Homo sapiens
  light chain complementarity determining region 3 for antibody 37124
QQYNGYLRT

SEQ ID NO: 74248 - protein, 18 aa, Homo sapiens
  heavy chain complementarity determining region 3 for antibody 37124
ARDFGGRAYTKVENAFDI

SEQ ID NO: 74249 - protein, 9 aa, Homo sapiens
  light chain complementarity determining region 3 for antibody 37125
QQYNGYLGT

SEQ ID NO: 74250 - protein, 14 aa, Homo sapiens
  heavy chain complementarity determining region 3 for antibody 37125
MIRGHSYDFDPRPF

SEQ ID NO: 74251 - protein, 8 aa, Homo sapiens
  light chain complementarity determining region 3 for antibody 37126
QQYNGLYT

SEQ ID NO: 74252 - protein, 14 aa, Homo sapiens
  heavy chain complementarity determining region 3 for antibody 37126
ARENSISRKRSFDQ

SEQ ID NO: 74253 - protein, 9 aa, Homo sapiens
  light chain complementarity determining region 3 for antibody 37127
QQYNGESRT

SEQ ID NO: 74254 - protein, 18 aa, Homo sapiens
  heavy chain complementarity determining region 3 for antibody 37127
ARGRTFDRLSHRGGGFDS

SEQ ID NO: 74255 - protein, 9 aa, Homo sapiens
  light chain complementarity determining region 3 for antibody 37128
QQYNGESRT

SEQ ID NO: 74256 - protein, 18 aa, Homo sapiens
  heavy chain complementarity determining region 3 for antibody 37128
ARGRTCDWLSHRGGGFDS

SEQ ID NO: 74257 - protein, 8 aa, Homo sapiens
  light chain complementarity determining region 3 for antibody 37129
QQYNFLWP

SEQ ID NO: 74258 - protein, 10 aa, Homo sapiens
  heavy chain complementarity determining region 3 for antibody 37129
ARDRRSVLSD

SEQ ID NO: 74259 - protein, 10 aa, Homo sapiens
  light chain complementarity determining region 3 for antibody 37130
QQYNDWPVLT

SEQ ID NO: 74260 - protein, 15 aa, Homo sapiens
  heavy chain complementarity determining region 3 for antibody 37130
ARTLSINGFYSGSDL

SEQ ID NO: 74261 - protein, 11 aa, Homo sapiens
  light chain complementarity determining region 3 for antibody 37131
QQYNDWPPGST

SEQ ID NO: 74262 - protein, 20 aa, Homo sapiens
  heavy chain complementarity determining region 3 for antibody 37131
AGSRPLFLFGELSQQSHFDF

SEQ ID NO: 74263 - protein, 9 aa, Homo sapiens
  light chain complementarity determining region 3 for antibody 37132
QQYNAYPWT

SEQ ID NO: 74264 - protein, 13 aa, Homo sapiens
  heavy chain complementarity determining region 3 for antibody 37132
AKVHFAEFNYFDY

SEQ ID NO: 74265 - protein, 8 aa, Homo sapiens
  light chain complementarity determining region 3 for antibody 37133
QQYMDFNT

SEQ ID NO: 74266 - protein, 17 aa, Homo sapiens
  heavy chain complementarity determining region 3 for antibody 37133
AHRRYYNGNWNGATFDV

SEQ ID NO: 74267 - protein, 9 aa, Homo sapiens
  light chain complementarity determining region 3 for antibody 37134
QQYLVLPLT

SEQ ID NO: 74268 - protein, 15 aa, Homo sapiens
  heavy chain complementarity determining region 3 for antibody 37134
AKDGGPYINRWYRND

SEQ ID NO: 74269 - protein, 9 aa, Homo sapiens
  light chain complementarity determining region 3 for antibody 37135
QQYLTYSST

SEQ ID NO: 74270 - protein, 11 aa, Homo sapiens
  heavy chain complementarity determining region 3 for antibody 37135
ARAAFSWYFDL

SEQ ID NO: 74271 - protein, 9 aa, Homo sapiens
  light chain complementarity determining region 3 for antibody 37136
QQYLTYSRK

SEQ ID NO: 74272 - protein, 11 aa, Homo sapiens
  heavy chain complementarity determining region 3 for antibody 37136
ARAAFSWYFDL

SEQ ID NO: 74273 - protein, 11 aa, Homo sapiens
  light chain complementarity determining region 3 for antibody 37137
QQYLTPPATYI

SEQ ID NO: 74274 - protein, 14 aa, Homo sapiens
  heavy chain complementarity determining region 3 for antibody 37137
ASHVIVTGTRGFDS

SEQ ID NO: 74275 - protein, 11 aa, Homo sapiens
  light chain complementarity determining region 3 for antibody 37138
QQYLNWPPSWT

SEQ ID NO: 74276 - protein, 14 aa, Homo sapiens
  heavy chain complementarity determining region 3 for antibody 37138
ARPQPGDYYHGMDV

SEQ ID NO: 74277 - protein, 9 aa, Homo sapiens
  light chain complementarity determining region 3 for antibody 37139
QQYLNERGT

SEQ ID NO: 74278 - protein, 11 aa, Homo sapiens
  heavy chain complementarity determining region 3 for antibody 37139
ARIMVRGAYDN

SEQ ID NO: 74279 - protein, 8 aa, Homo sapiens
  light chain complementarity determining region 3 for antibody 37140
QQYLLYWT

SEQ ID NO: 74280 - protein, 19 aa, Homo sapiens
  heavy chain complementarity determining region 3 for antibody 37140
AKEGLSYDINDSKRGYFNS

SEQ ID NO: 74281 - protein, 8 aa, Homo sapiens
  light chain complementarity determining region 3 for antibody 37141
QQYLLSWT

SEQ ID NO: 74282 - protein, 19 aa, Homo sapiens
  heavy chain complementarity determining region 3 for antibody 37141
AKEGLSYDINDSKRGYFDS

SEQ ID NO: 74283 - protein, 8 aa, Homo sapiens
  light chain complementarity determining region 3 for antibody 37142
QQYLLHWT

SEQ ID NO: 74284 - protein, 19 aa, Homo sapiens
  heavy chain complementarity determining region 3 for antibody 37142
AKEGLSYDINDSKRGYFDS

SEQ ID NO: 74285 - protein, 9 aa, Homo sapiens
  light chain complementarity determining region 3 for antibody 37143
QQYKTYYRT

SEQ ID NO: 74286 - protein, 16 aa, Homo sapiens
  heavy chain complementarity determining region 3 for antibody 37143
GRLYHYDSGSYAPSDY

SEQ ID NO: 74287 - protein, 9 aa, Homo sapiens
  light chain complementarity determining region 3 for antibody 37144
QQYKSAPQT

SEQ ID NO: 74288 - protein, 13 aa, Homo sapiens
  heavy chain complementarity determining region 3 for antibody 37144
ARDKLVGKAVLDY

SEQ ID NO: 74289 - protein, 9 aa, Homo sapiens
  light chain complementarity determining region 3 for antibody 37145
QQYKKGPLT

SEQ ID NO: 74290 - protein, 17 aa, Homo sapiens
  heavy chain complementarity determining region 3 for antibody 37145
TRDMRFSDYTLGYGMDV

SEQ ID NO: 74291 - protein, 8 aa, Homo sapiens
  light chain complementarity determining region 3 for antibody 37146
QQYKDWPS

SEQ ID NO: 74292 - protein, 14 aa, Homo sapiens
  heavy chain complementarity determining region 3 for antibody 37146
ARTVYSFGSYYFDF

SEQ ID NO: 74293 - protein, 10 aa, Homo sapiens
  light chain complementarity determining region 3 for antibody 37147
QQYKDLPPWM

SEQ ID NO: 74294 - protein, 16 aa, Homo sapiens
  heavy chain complementarity determining region 3 for antibody 37147
ASQADTSVYYPRVFDY

SEQ ID NO: 74295 - protein, 10 aa, Homo sapiens
  light chain complementarity determining region 3 for antibody 37148
QQYKDLPPGT

SEQ ID NO: 74296 - protein, 16 aa, Homo sapiens
  heavy chain complementarity determining region 3 for antibody 37148
ASQADTSVYYPRVFDY

SEQ ID NO: 74297 - protein, 9 aa, Homo sapiens
  light chain complementarity determining region 3 for antibody 37149
QQYKAYPGT

SEQ ID NO: 74298 - protein, 13 aa, Homo sapiens
  heavy chain complementarity determining region 3 for antibody 37149
AKVHFAEFNYFDY

SEQ ID NO: 74299 - protein, 9 aa, Homo sapiens
  light chain complementarity determining region 3 for antibody 37150
QQYITYPLT

SEQ ID NO: 74300 - protein, 14 aa, Homo sapiens
  heavy chain complementarity determining region 3 for antibody 37150
ARDLGFHTGGNFDY

SEQ ID NO: 74301 - protein, 10 aa, Homo sapiens
  light chain complementarity determining region 3 for antibody 37151
QQYISYSPYT

SEQ ID NO: 74302 - protein, 15 aa, Homo sapiens
  heavy chain complementarity determining region 3 for antibody 37151
ALSCGGDCSSGPGRY

SEQ ID NO: 74303 - protein, 10 aa, Homo sapiens
  light chain complementarity determining region 3 for antibody 37152
QQYISYSPST

SEQ ID NO: 74304 - protein, 15 aa, Homo sapiens
  heavy chain complementarity determining region 3 for antibody 37152
ALSCGGDCSSVPGRY

SEQ ID NO: 74305 - protein, 9 aa, Homo sapiens
  light chain complementarity determining region 3 for antibody 37153
QQYISYSLT

SEQ ID NO: 74306 - protein, 20 aa, Homo sapiens
  heavy chain complementarity determining region 3 for antibody 37153
ARDFFPFPRGPESFDDVFDI

SEQ ID NO: 74307 - protein, 10 aa, Homo sapiens
  light chain complementarity determining region 3 for antibody 37154
QQYISYFPYT

SEQ ID NO: 74308 - protein, 15 aa, Homo sapiens
  heavy chain complementarity determining region 3 for antibody 37154
ALSCGGDCSSVPGRY

SEQ ID NO: 74309 - protein, 8 aa, Homo sapiens
  light chain complementarity determining region 3 for antibody 37155
QQYISYCT

SEQ ID NO: 74310 - protein, 19 aa, Homo sapiens
  heavy chain complementarity determining region 3 for antibody 37155
ATPGVGDFWSGSKYYAMDV

SEQ ID NO: 74311 - protein, 9 aa, Homo sapiens
  light chain complementarity determining region 3 for antibody 37156
QQYISAPHT

SEQ ID NO: 74312 - protein, 24 aa, Homo sapiens
  heavy chain complementarity determining region 3 for antibody 37156
ARVLDYDSGSGTYSKPLIWYAFDI

SEQ ID NO: 74313 - protein, 8 aa, Homo sapiens
  light chain complementarity determining region 3 for antibody 37157
QQYINWPT

SEQ ID NO: 74314 - protein, 12 aa, Homo sapiens
  heavy chain complementarity determining region 3 for antibody 37157
AKPLPASAYFDS

SEQ ID NO: 74315 - protein, 9 aa, Homo sapiens
  light chain complementarity determining region 3 for antibody 37158
QQYIGGPRT

SEQ ID NO: 74316 - protein, 6 aa, Homo sapiens
  heavy chain complementarity determining region 3 for antibody 37158
GSVFEY

SEQ ID NO: 74317 - protein, 9 aa, Homo sapiens
  light chain complementarity determining region 3 for antibody 37159
QQYICWPRT

SEQ ID NO: 74318 - protein, 6 aa, Homo sapiens
  heavy chain complementarity determining region 3 for antibody 37159
GSVFEY

SEQ ID NO: 74319 - protein, 8 aa, Homo sapiens
  light chain complementarity determining region 3 for antibody 37160
QQYHYWGA

SEQ ID NO: 74320 - protein, 10 aa, Homo sapiens
  heavy chain complementarity determining region 3 for antibody 37160
AARPSGSYPR

SEQ ID NO: 74321 - protein, 9 aa, Homo sapiens
  light chain complementarity determining region 3 for antibody 37161
QQYHTTPNT

SEQ ID NO: 74322 - protein, 9 aa, Homo sapiens
  heavy chain complementarity determining region 3 for antibody 37161
ARDRDTADS

SEQ ID NO: 74323 - protein, 9 aa, Homo sapiens
  light chain complementarity determining region 3 for antibody 37162
QQYHTSPKT

SEQ ID NO: 74324 - protein, 9 aa, Homo sapiens
  heavy chain complementarity determining region 3 for antibody 37162
ARDRDAADS

SEQ ID NO: 74325 - protein, 9 aa, Homo sapiens
  light chain complementarity determining region 3 for antibody 37163
QQYHTNPNT

SEQ ID NO: 74326 - protein, 9 aa, Homo sapiens
  heavy chain complementarity determining region 3 for antibody 37163
ARDRDAADS

SEQ ID NO: 74327 - protein, 9 aa, Homo sapiens
  light chain complementarity determining region 3 for antibody 37164
QQYHTAPLT

SEQ ID NO: 74328 - protein, 18 aa, Homo sapiens
  heavy chain complementarity determining region 3 for antibody 37164
ARDVGDDSTGYNYGYFDL

SEQ ID NO: 74329 - protein, 8 aa, Homo sapiens
  light chain complementarity determining region 3 for antibody 37165
QQYHSYSS

SEQ ID NO: 74330 - protein, 18 aa, Homo sapiens
  heavy chain complementarity determining region 3 for antibody 37165
ARSWKVVVASGAVRYFDY

SEQ ID NO: 74331 - protein, 9 aa, Homo sapiens
  light chain complementarity determining region 3 for antibody 37166
QQYHSYPLT

SEQ ID NO: 74332 - protein, 18 aa, Homo sapiens
  heavy chain complementarity determining region 3 for antibody 37166
ARSKTRVGVDSYYYGLDV

SEQ ID NO: 74333 - protein, 9 aa, Homo sapiens
  light chain complementarity determining region 3 for antibody 37167
QQYHSWPFT

SEQ ID NO: 74334 - protein, 11 aa, Homo sapiens
  heavy chain complementarity determining region 3 for antibody 37167
GGFYHGGPCGY

SEQ ID NO: 74335 - protein, 9 aa, Homo sapiens
  light chain complementarity determining region 3 for antibody 37168
QQYHSHPRT

SEQ ID NO: 74336 - protein, 18 aa, Homo sapiens
  heavy chain complementarity determining region 3 for antibody 37168
AREFLRYFDSSKAYTFDD

SEQ ID NO: 74337 - protein, 9 aa, Homo sapiens
  light chain complementarity determining region 3 for antibody 37169
QQYHSHPRT

SEQ ID NO: 74338 - protein, 18 aa, Homo sapiens
  heavy chain complementarity determining region 3 for antibody 37169
AREFLRYFDSSKAYNVDD

SEQ ID NO: 74339 - protein, 9 aa, Homo sapiens
  light chain complementarity determining region 3 for antibody 37170
QQYHSHPRT

SEQ ID NO: 74340 - protein, 18 aa, Homo sapiens
  heavy chain complementarity determining region 3 for antibody 37170
AREFLRYCDSSKAYNFDD

SEQ ID NO: 74341 - protein, 9 aa, Homo sapiens
  light chain complementarity determining region 3 for antibody 37171
QQYHSHPRT

SEQ ID NO: 74342 - protein, 18 aa, Homo sapiens
  heavy chain complementarity determining region 3 for antibody 37171
ARECLRYFDSSKAYNFDD

SEQ ID NO: 74343 - protein, 9 aa, Homo sapiens
  light chain complementarity determining region 3 for antibody 37172
QQYHSDPPP

SEQ ID NO: 74344 - protein, 10 aa, Homo sapiens
  heavy chain complementarity determining region 3 for antibody 37172
AGGTGWILDT

SEQ ID NO: 74345 - protein, 9 aa, Homo sapiens
  light chain complementarity determining region 3 for antibody 37173
QQYHSDPLP

SEQ ID NO: 74346 - protein, 10 aa, Homo sapiens
  heavy chain complementarity determining region 3 for antibody 37173
AGGTGWILDT

SEQ ID NO: 74347 - protein, 10 aa, Homo sapiens
  light chain complementarity determining region 3 for antibody 37174
QQYHPWPPWT

SEQ ID NO: 74348 - protein, 16 aa, Homo sapiens
  heavy chain complementarity determining region 3 for antibody 37174
ARVDDFGSGNQGTFDP

SEQ ID NO: 74349 - protein, 10 aa, Homo sapiens
  light chain complementarity determining region 3 for antibody 37175
QQYHNWPPRT

SEQ ID NO: 74350 - protein, 12 aa, Homo sapiens
  heavy chain complementarity determining region 3 for antibody 37175
ARDLIYSSGFDY

SEQ ID NO: 74351 - protein, 10 aa, Homo sapiens
  light chain complementarity determining region 3 for antibody 37176
QQYHNRPPDT

SEQ ID NO: 74352 - protein, 14 aa, Homo sapiens
  heavy chain complementarity determining region 3 for antibody 37176
ARGPPGIALAGNSG

SEQ ID NO: 74353 - protein, 10 aa, Homo sapiens
  light chain complementarity determining region 3 for antibody 37177
QQYHNRPPDT

SEQ ID NO: 74354 - protein, 14 aa, Homo sapiens
  heavy chain complementarity determining region 3 for antibody 37177
ARDPPGIALAGNSV

SEQ ID NO: 74355 - protein, 10 aa, Homo sapiens
  light chain complementarity determining region 3 for antibody 37178
QQYHNRPPDT

SEQ ID NO: 74356 - protein, 14 aa, Homo sapiens
  heavy chain complementarity determining region 3 for antibody 37178
ARDPPGIALAGNSA

SEQ ID NO: 74357 - protein, 10 aa, Homo sapiens
  light chain complementarity determining region 3 for antibody 37179
QQYHHWPPWT

SEQ ID NO: 74358 - protein, 18 aa, Homo sapiens
  heavy chain complementarity determining region 3 for antibody 37179
ARGVPPFWAPGGVGPFDF

SEQ ID NO: 74359 - protein, 10 aa, Homo sapiens
  light chain complementarity determining region 3 for antibody 37180
QQYHHWPPWT

SEQ ID NO: 74360 - protein, 16 aa, Homo sapiens
  heavy chain complementarity determining region 3 for antibody 37180
AGVDDFGSGNQGTFDP

SEQ ID NO: 74361 - protein, 10 aa, Homo sapiens
  light chain complementarity determining region 3 for antibody 37181
QQYHHWPPRT

SEQ ID NO: 74362 - protein, 16 aa, Homo sapiens
  heavy chain complementarity determining region 3 for antibody 37181
ARVDDFGSGNQGTFDP

SEQ ID NO: 74363 - protein, 9 aa, Homo sapiens
  light chain complementarity determining region 3 for antibody 37182
QQYHDRPVT

SEQ ID NO: 74364 - protein, 20 aa, Homo sapiens
  heavy chain complementarity determining region 3 for antibody 37182
SRRHLLVGGDRVAAGRAADY

SEQ ID NO: 74365 - protein, 9 aa, Homo sapiens
  light chain complementarity determining region 3 for antibody 37183
QQYHDRPAT

SEQ ID NO: 74366 - protein, 20 aa, Homo sapiens
  heavy chain complementarity determining region 3 for antibody 37183
SRRHLLVGGDRVAAGRAADY

SEQ ID NO: 74367 - protein, 9 aa, Homo sapiens
  light chain complementarity determining region 3 for antibody 37184
QQYHALPLT

SEQ ID NO: 74368 - protein, 13 aa, Homo sapiens
  heavy chain complementarity determining region 3 for antibody 37184
ASDGVPGKFNRAH

SEQ ID NO: 74369 - protein, 9 aa, Homo sapiens
  light chain complementarity determining region 3 for antibody 37185
QQYGYSPIT

SEQ ID NO: 74370 - protein, 10 aa, Homo sapiens
  heavy chain complementarity determining region 3 for antibody 37185
ATGAGWLVDY

SEQ ID NO: 74371 - protein, 9 aa, Homo sapiens
  light chain complementarity determining region 3 for antibody 37186
QQYGYPPRT

SEQ ID NO: 74372 - protein, 25 aa, Homo sapiens
  heavy chain complementarity determining region 3 for antibody 37186
ARLRVDRLRLPGAMRGPLYDRGLNV

SEQ ID NO: 74373 - protein, 9 aa, Homo sapiens
  light chain complementarity determining region 3 for antibody 37187
QQYGVSPFF

SEQ ID NO: 74374 - protein, 12 aa, Homo sapiens
  heavy chain complementarity determining region 3 for antibody 37187
AGGWNELDYFDY

SEQ ID NO: 74375 - protein, 9 aa, Homo sapiens
  light chain complementarity determining region 3 for antibody 37188
QQYGTWPPT

SEQ ID NO: 74376 - protein, 21 aa, Homo sapiens
  heavy chain complementarity determining region 3 for antibody 37188
ARGGGPFYFDHSGFRLYYFHV

SEQ ID NO: 74377 - protein, 9 aa, Homo sapiens
  light chain complementarity determining region 3 for antibody 37189
QQYGTTPRT

SEQ ID NO: 74378 - protein, 25 aa, Homo sapiens
  heavy chain complementarity determining region 3 for antibody 37189
ARLRVDRLRLPGAMRGPLYDRGLNV

SEQ ID NO: 74379 - protein, 8 aa, Homo sapiens
  light chain complementarity determining region 3 for antibody 37190
QQYGTSWT

SEQ ID NO: 74380 - protein, 21 aa, Homo sapiens
  heavy chain complementarity determining region 3 for antibody 37190
GRQRNFEGDSGFKVPEGYFDL

SEQ ID NO: 74381 - protein, 8 aa, Homo sapiens
  light chain complementarity determining region 3 for antibody 37191
QQYGTSWT

SEQ ID NO: 74382 - protein, 21 aa, Homo sapiens
  heavy chain complementarity determining region 3 for antibody 37191
GRQRNFEGDSGFKFPDGYFDL

SEQ ID NO: 74383 - protein, 9 aa, Homo sapiens
  light chain complementarity determining region 3 for antibody 37192
QQYGTSTIT

SEQ ID NO: 74384 - protein, 16 aa, Homo sapiens
  heavy chain complementarity determining region 3 for antibody 37192
ARDQQLHGGSSGVFGY

SEQ ID NO: 74385 - protein, 8 aa, Homo sapiens
  light chain complementarity determining region 3 for antibody 37193
QQYGTSST

SEQ ID NO: 74386 - protein, 17 aa, Homo sapiens
  heavy chain complementarity determining region 3 for antibody 37193
ARHPGYYDSSGSDAFDI

SEQ ID NO: 74387 - protein, 8 aa, Homo sapiens
  light chain complementarity determining region 3 for antibody 37194
QQYGTSRR

SEQ ID NO: 74388 - protein, 13 aa, Homo sapiens
  heavy chain complementarity determining region 3 for antibody 37194
ARGQFVGSAYYEN

SEQ ID NO: 74389 - protein, 8 aa, Homo sapiens
  light chain complementarity determining region 3 for antibody 37195
QQYGTSRM

SEQ ID NO: 74390 - protein, 13 aa, Homo sapiens
  heavy chain complementarity determining region 3 for antibody 37195
ARGQFVGSAYFEN

SEQ ID NO: 74391 - protein, 8 aa, Homo sapiens
  light chain complementarity determining region 3 for antibody 37196
QQYGTSRM

SEQ ID NO: 74392 - protein, 13 aa, Homo sapiens
  heavy chain complementarity determining region 3 for antibody 37196
ARGQFVGSAYFDN

SEQ ID NO: 74393 - protein, 8 aa, Homo sapiens
  light chain complementarity determining region 3 for antibody 37197
QQYGTSRL

SEQ ID NO: 74394 - protein, 13 aa, Homo sapiens
  heavy chain complementarity determining region 3 for antibody 37197
ARGQFVGSAYYDN

SEQ ID NO: 74395 - protein, 9 aa, Homo sapiens
  light chain complementarity determining region 3 for antibody 37198
QQYGTSQFT

SEQ ID NO: 74396 - protein, 14 aa, Homo sapiens
  heavy chain complementarity determining region 3 for antibody 37198
ARGGPAATSSSWLY

SEQ ID NO: 74397 - protein, 9 aa, Homo sapiens
  light chain complementarity determining region 3 for antibody 37199
QQYGTSPWT

SEQ ID NO: 74398 - protein, 15 aa, Homo sapiens
  heavy chain complementarity determining region 3 for antibody 37199
VHTQLWFGDQCYFDF

SEQ ID NO: 74399 - protein, 9 aa, Homo sapiens
  light chain complementarity determining region 3 for antibody 37200
QQYGTSPWT

SEQ ID NO: 74400 - protein, 16 aa, Homo sapiens
  heavy chain complementarity determining region 3 for antibody 37200
ASSITICGVVLRPLDY

SEQ ID NO: 74401 - protein, 9 aa, Homo sapiens
  light chain complementarity determining region 3 for antibody 37201
QQYGTSPWT

SEQ ID NO: 74402 - protein, 16 aa, Homo sapiens
  heavy chain complementarity determining region 3 for antibody 37201
ASSIAIFGVVLRPLDY

SEQ ID NO: 74403 - protein, 10 aa, Homo sapiens
  light chain complementarity determining region 3 for antibody 37202
QQYGTSPSWT

SEQ ID NO: 74404 - protein, 18 aa, Homo sapiens
  heavy chain complementarity determining region 3 for antibody 37202
VRDLPIDTLLVTVGGGDF

SEQ ID NO: 74405 - protein, 10 aa, Homo sapiens
  light chain complementarity determining region 3 for antibody 37203
QQYGTSPRWR

SEQ ID NO: 74406 - protein, 18 aa, Homo sapiens
  heavy chain complementarity determining region 3 for antibody 37203
VRDLPIDTLLVTVGGGDF

SEQ ID NO: 74407 - protein, 10 aa, Homo sapiens
  light chain complementarity determining region 3 for antibody 37204
QQYGTSPRLT

SEQ ID NO: 74408 - protein, 18 aa, Homo sapiens
  heavy chain complementarity determining region 3 for antibody 37204
VRDLPIDTLLVTVGGGDF

SEQ ID NO: 74409 - protein, 10 aa, Homo sapiens
  light chain complementarity determining region 3 for antibody 37205
QQYGTSPPYT

SEQ ID NO: 74410 - protein, 10 aa, Homo sapiens
  heavy chain complementarity determining region 3 for antibody 37205
GGGPGWLTYA

SEQ ID NO: 74411 - protein, 9 aa, Homo sapiens
  light chain complementarity determining region 3 for antibody 37206
QQYGTSPPN

SEQ ID NO: 74412 - protein, 13 aa, Homo sapiens
  heavy chain complementarity determining region 3 for antibody 37206
ASISVGTVAAGNG

SEQ ID NO: 74413 - protein, 10 aa, Homo sapiens
  light chain complementarity determining region 3 for antibody 37207
QQYGTSPPFT

SEQ ID NO: 74414 - protein, 13 aa, Homo sapiens
  heavy chain complementarity determining region 3 for antibody 37207
ASWSHSDLDAFDI

SEQ ID NO: 74415 - protein, 9 aa, Homo sapiens
  light chain complementarity determining region 3 for antibody 37208
QQYGTSPLT

SEQ ID NO: 74416 - protein, 14 aa, Homo sapiens
  heavy chain complementarity determining region 3 for antibody 37208
ARGMFRGVPDYLDY

SEQ ID NO: 74417 - protein, 9 aa, Homo sapiens
  light chain complementarity determining region 3 for antibody 37209
QQYGTSPLT

SEQ ID NO: 74418 - protein, 14 aa, Homo sapiens
  heavy chain complementarity determining region 3 for antibody 37209
ARDMLRGVPDYLDY

SEQ ID NO: 74419 - protein, 9 aa, Homo sapiens
  light chain complementarity determining region 3 for antibody 37210
QQYGTSPLT

SEQ ID NO: 74420 - protein, 14 aa, Homo sapiens
  heavy chain complementarity determining region 3 for antibody 37210
ARDMFRGVLDYLDY

SEQ ID NO: 74421 - protein, 9 aa, Homo sapiens
  light chain complementarity determining region 3 for antibody 37211
QQYGTSPLT

SEQ ID NO: 74422 - protein, 14 aa, Homo sapiens
  heavy chain complementarity determining region 3 for antibody 37211
ARDMCRGVPDYLDY

SEQ ID NO: 74423 - protein, 9 aa, Homo sapiens
  light chain complementarity determining region 3 for antibody 37212
QQYGTSPLP

SEQ ID NO: 74424 - protein, 14 aa, Homo sapiens
  heavy chain complementarity determining region 3 for antibody 37212
ARGGPAATSSSWLY

SEQ ID NO: 74425 - protein, 9 aa, Homo sapiens
  light chain complementarity determining region 3 for antibody 37213
QQYGTSPLN

SEQ ID NO: 74426 - protein, 13 aa, Homo sapiens
  heavy chain complementarity determining region 3 for antibody 37213
ASISVSTVAAGKG

SEQ ID NO: 74427 - protein, 9 aa, Homo sapiens
  light chain complementarity determining region 3 for antibody 37214
QQYGTSPLN

SEQ ID NO: 74428 - protein, 13 aa, Homo sapiens
  heavy chain complementarity determining region 3 for antibody 37214
ASISVGTVAAGKD

SEQ ID NO: 74429 - protein, 9 aa, Homo sapiens
  light chain complementarity determining region 3 for antibody 37215
QQYGTSPLN

SEQ ID NO: 74430 - protein, 13 aa, Homo sapiens
  heavy chain complementarity determining region 3 for antibody 37215
ASISVGSVAAGKG

SEQ ID NO: 74431 - protein, 9 aa, Homo sapiens
  light chain complementarity determining region 3 for antibody 37216
QQYGTSPLN

SEQ ID NO: 74432 - protein, 13 aa, Homo sapiens
  heavy chain complementarity determining region 3 for antibody 37216
ARISVGTVAAGKG

SEQ ID NO: 74433 - protein, 10 aa, Homo sapiens
  light chain complementarity determining region 3 for antibody 37217
QQYGTSPHAT

SEQ ID NO: 74434 - protein, 26 aa, Homo sapiens
  heavy chain complementarity determining region 3 for antibody 37217
ARDWGSIAARLSAPKPGSDYYYGMDV

SEQ ID NO: 74435 - protein, 9 aa, Homo sapiens
  light chain complementarity determining region 3 for antibody 37218
QQYGTSPFT

SEQ ID NO: 74436 - protein, 15 aa, Homo sapiens
  heavy chain complementarity determining region 3 for antibody 37218
ASQNDFLSGPGEFDP

SEQ ID NO: 74437 - protein, 9 aa, Homo sapiens
  light chain complementarity determining region 3 for antibody 37219
QQYGTSPFT

SEQ ID NO: 74438 - protein, 15 aa, Homo sapiens
  heavy chain complementarity determining region 3 for antibody 37219
ARTKGGRCHSPAIDL

SEQ ID NO: 74439 - protein, 9 aa, Homo sapiens
  light chain complementarity determining region 3 for antibody 37220
QQYGTSPFT

SEQ ID NO: 74440 - protein, 15 aa, Homo sapiens
  heavy chain complementarity determining region 3 for antibody 37220
ARQNDVLSGPGEFDP

SEQ ID NO: 74441 - protein, 9 aa, Homo sapiens
  light chain complementarity determining region 3 for antibody 37221
QQYGTSPFT

SEQ ID NO: 74442 - protein, 15 aa, Homo sapiens
  heavy chain complementarity determining region 3 for antibody 37221
ARQNAFLSGPGEFDP

SEQ ID NO: 74443 - protein, 9 aa, Homo sapiens
  light chain complementarity determining region 3 for antibody 37222
QQYGTSPFT

SEQ ID NO: 74444 - protein, 21 aa, Homo sapiens
  heavy chain complementarity determining region 3 for antibody 37222
ARMSAGSYYDSSGSYLYYFDN

SEQ ID NO: 74445 - protein, 9 aa, Homo sapiens
  light chain complementarity determining region 3 for antibody 37223
QQYGTSPFT

SEQ ID NO: 74446 - protein, 15 aa, Homo sapiens
  heavy chain complementarity determining region 3 for antibody 37223
ARHNDFLSGPGEFDP

SEQ ID NO: 74447 - protein, 9 aa, Homo sapiens
  light chain complementarity determining region 3 for antibody 37224
QQYGTSPFT

SEQ ID NO: 74448 - protein, 14 aa, Homo sapiens
  heavy chain complementarity determining region 3 for antibody 37224
ARGGPDATSSSWLY

SEQ ID NO: 74449 - protein, 9 aa, Homo sapiens
  light chain complementarity determining region 3 for antibody 37225
QQYGTSPFT

SEQ ID NO: 74450 - protein, 14 aa, Homo sapiens
  heavy chain complementarity determining region 3 for antibody 37225
ARGGPAAASSSCLY

SEQ ID NO: 74451 - protein, 9 aa, Homo sapiens
  light chain complementarity determining region 3 for antibody 37226
QQYGTSPFP

SEQ ID NO: 74452 - protein, 14 aa, Homo sapiens
  heavy chain complementarity determining region 3 for antibody 37226
ARGGPAATSSSWVY

SEQ ID NO: 74453 - protein, 9 aa, Homo sapiens
  light chain complementarity determining region 3 for antibody 37227
QQYGTSPFN

SEQ ID NO: 74454 - protein, 13 aa, Homo sapiens
  heavy chain complementarity determining region 3 for antibody 37227
ASISVGTVAAGND

SEQ ID NO: 74455 - protein, 8 aa, Homo sapiens
  light chain complementarity determining region 3 for antibody 37228
QQYGTSLT

SEQ ID NO: 74456 - protein, 17 aa, Homo sapiens
  heavy chain complementarity determining region 3 for antibody 37228
SRKAHDSDISGFYPYDY

SEQ ID NO: 74457 - protein, 8 aa, Homo sapiens
  light chain complementarity determining region 3 for antibody 37229
QQYGTSLT

SEQ ID NO: 74458 - protein, 21 aa, Homo sapiens
  heavy chain complementarity determining region 3 for antibody 37229
GRQRNFEGDSGFKFPEGYFDL

SEQ ID NO: 74459 - protein, 10 aa, Homo sapiens
  light chain complementarity determining region 3 for antibody 37230
QQYGTSLPCT

SEQ ID NO: 74460 - protein, 16 aa, Homo sapiens
  heavy chain complementarity determining region 3 for antibody 37230
TKDRDYDDYEWCAFDT

SEQ ID NO: 74461 - protein, 9 aa, Homo sapiens
  light chain complementarity determining region 3 for antibody 37231
QQYGTSLLN

SEQ ID NO: 74462 - protein, 13 aa, Homo sapiens
  heavy chain complementarity determining region 3 for antibody 37231
ASISVGTVAAGKG

SEQ ID NO: 74463 - protein, 9 aa, Homo sapiens
  light chain complementarity determining region 3 for antibody 37232
QQYGTQPRT

SEQ ID NO: 74464 - protein, 25 aa, Homo sapiens
  heavy chain complementarity determining region 3 for antibody 37232
ARLRVDRLRLPGAMRGPLYDRGLNV

SEQ ID NO: 74465 - protein, 9 aa, Homo sapiens
  light chain complementarity determining region 3 for antibody 37233
QQYGTPTIT

SEQ ID NO: 74466 - protein, 16 aa, Homo sapiens
  heavy chain complementarity determining region 3 for antibody 37233
SRDQQLHGGSSGVFGY

SEQ ID NO: 74467 - protein, 9 aa, Homo sapiens
  light chain complementarity determining region 3 for antibody 37234
QQYGTPPRT

SEQ ID NO: 74468 - protein, 25 aa, Homo sapiens
  heavy chain complementarity determining region 3 for antibody 37234
ASLRVARLRLPGAMRGPLYDRGLNV

SEQ ID NO: 74469 - protein, 9 aa, Homo sapiens
  light chain complementarity determining region 3 for antibody 37235
QQYGTPPRT

SEQ ID NO: 74470 - protein, 25 aa, Homo sapiens
  heavy chain complementarity determining region 3 for antibody 37235
ARLRVARLRLPGAMRGPLYDRGLNV

SEQ ID NO: 74471 - protein, 9 aa, Homo sapiens
  light chain complementarity determining region 3 for antibody 37236
QQYGTPPRP

SEQ ID NO: 74472 - protein, 25 aa, Homo sapiens
  heavy chain complementarity determining region 3 for antibody 37236
ARLRVDRLRLPGAMRGPLYDRGLNV

SEQ ID NO: 74473 - protein, 9 aa, Homo sapiens
  light chain complementarity determining region 3 for antibody 37237
QQYGTPPRP

SEQ ID NO: 74474 - protein, 16 aa, Homo sapiens
  heavy chain complementarity determining region 3 for antibody 37237
ARDTGGGWGEDNYFDP

SEQ ID NO: 74475 - protein, 9 aa, Homo sapiens
  light chain complementarity determining region 3 for antibody 37238
QQYGTPPLT

SEQ ID NO: 74476 - protein, 14 aa, Homo sapiens
  heavy chain complementarity determining region 3 for antibody 37238
ARDMFRGVPDYLDY

SEQ ID NO: 74477 - protein, 9 aa, Homo sapiens
  light chain complementarity determining region 3 for antibody 37239
QQYGTPPFT

SEQ ID NO: 74478 - protein, 15 aa, Homo sapiens
  heavy chain complementarity determining region 3 for antibody 37239
ARQNDFLSGPGEFDP

SEQ ID NO: 74479 - protein, 9 aa, Homo sapiens
  light chain complementarity determining region 3 for antibody 37240
QQYGTLPWT

SEQ ID NO: 74480 - protein, 13 aa, Homo sapiens
  heavy chain complementarity determining region 3 for antibody 37240
VRDQAAYINGFDP

SEQ ID NO: 74481 - protein, 9 aa, Homo sapiens
  light chain complementarity determining region 3 for antibody 37241
QQYGTLPWT

SEQ ID NO: 74482 - protein, 13 aa, Homo sapiens
  heavy chain complementarity determining region 3 for antibody 37241
VRDQAAHINWFDP

SEQ ID NO: 74483 - protein, 9 aa, Homo sapiens
  light chain complementarity determining region 3 for antibody 37242
QQYGTLPRT

SEQ ID NO: 74484 - protein, 13 aa, Homo sapiens
  heavy chain complementarity determining region 3 for antibody 37242
VRDQAAYINWFDP

SEQ ID NO: 74485 - protein, 9 aa, Homo sapiens
  light chain complementarity determining region 3 for antibody 37243
QQYGTLPRT

SEQ ID NO: 74486 - protein, 13 aa, Homo sapiens
  heavy chain complementarity determining region 3 for antibody 37243
AGGNFHSGGYGEY

SEQ ID NO: 74487 - protein, 9 aa, Homo sapiens
  light chain complementarity determining region 3 for antibody 37244
QQYGTIPRT

SEQ ID NO: 74488 - protein, 13 aa, Homo sapiens
  heavy chain complementarity determining region 3 for antibody 37244
AGGNFRRSGYAEY

SEQ ID NO: 74489 - protein, 9 aa, Homo sapiens
  light chain complementarity determining region 3 for antibody 37245
QQYGTIPRK

SEQ ID NO: 74490 - protein, 13 aa, Homo sapiens
  heavy chain complementarity determining region 3 for antibody 37245
AGGNFHRSGYAEY

SEQ ID NO: 74491 - protein, 9 aa, Homo sapiens
  light chain complementarity determining region 3 for antibody 37246
QQYGTFTWT

SEQ ID NO: 74492 - protein, 13 aa, Homo sapiens
  heavy chain complementarity determining region 3 for antibody 37246
VRDQAAYINWFDP

SEQ ID NO: 74493 - protein, 10 aa, Homo sapiens
  light chain complementarity determining region 3 for antibody 37247
QQYGTAPPYT

SEQ ID NO: 74494 - protein, 10 aa, Homo sapiens
  heavy chain complementarity determining region 3 for antibody 37247
GGGPGWLPYA

SEQ ID NO: 74495 - protein, 10 aa, Homo sapiens
  light chain complementarity determining region 3 for antibody 37248
QQYGTAPPYP

SEQ ID NO: 74496 - protein, 10 aa, Homo sapiens
  heavy chain complementarity determining region 3 for antibody 37248
GGGPGWLTYA

SEQ ID NO: 74497 - protein, 9 aa, Homo sapiens
  light chain complementarity determining region 3 for antibody 37249
QQYGSYPRT

SEQ ID NO: 74498 - protein, 17 aa, Homo sapiens
  heavy chain complementarity determining region 3 for antibody 37249
ARALDIVVVVDAIWFDP

SEQ ID NO: 74499 - protein, 10 aa, Homo sapiens
  light chain complementarity determining region 3 for antibody 37250
QQYGSYPMYS

SEQ ID NO: 74500 - protein, 11 aa, Homo sapiens
  heavy chain complementarity determining region 3 for antibody 37250
ARGGQWGSLDY

SEQ ID NO: 74501 - protein, 9 aa, Homo sapiens
  light chain complementarity determining region 3 for antibody 37251
QQYGSYPLT

SEQ ID NO: 74502 - protein, 12 aa, Homo sapiens
  heavy chain complementarity determining region 3 for antibody 37251
ARSPYSGIDFDS

SEQ ID NO: 74503 - protein, 9 aa, Homo sapiens
  light chain complementarity determining region 3 for antibody 37252
QQYGSTTLT

SEQ ID NO: 74504 - protein, 15 aa, Homo sapiens
  heavy chain complementarity determining region 3 for antibody 37252
ARGPHPPYYGGFFHL

SEQ ID NO: 74505 - protein, 9 aa, Homo sapiens
  light chain complementarity determining region 3 for antibody 37253
QQYGSTPRT

SEQ ID NO: 74506 - protein, 25 aa, Homo sapiens
  heavy chain complementarity determining region 3 for antibody 37253
ARLRIDRLRLPGAMRGPLYDCGLNV

SEQ ID NO: 74507 - protein, 8 aa, Homo sapiens
  light chain complementarity determining region 3 for antibody 37254
QQYGSSYN

SEQ ID NO: 74508 - protein, 20 aa, Homo sapiens
  heavy chain complementarity determining region 3 for antibody 37254
ARDLRVRGVIGPSIRGSFDI

SEQ ID NO: 74509 - protein, 9 aa, Homo sapiens
  light chain complementarity determining region 3 for antibody 37255
QQYGSSWVP

SEQ ID NO: 74510 - protein, 20 aa, Homo sapiens
  heavy chain complementarity determining region 3 for antibody 37255
AREGGHRQWLEIYDPGYFHH

SEQ ID NO: 74511 - protein, 9 aa, Homo sapiens
  light chain complementarity determining region 3 for antibody 37256
QQYGSSVLT

SEQ ID NO: 74512 - protein, 17 aa, Homo sapiens
  heavy chain complementarity determining region 3 for antibody 37256
ARRSALWPLELPGPIDH

SEQ ID NO: 74513 - protein, 10 aa, Homo sapiens
  light chain complementarity determining region 3 for antibody 37257
QQYGSSTRNT

SEQ ID NO: 74514 - protein, 19 aa, Homo sapiens
  heavy chain complementarity determining region 3 for antibody 37257
ARGSSLVEHFGGAYYFFDY

SEQ ID NO: 74515 - protein, 9 aa, Homo sapiens
  light chain complementarity determining region 3 for antibody 37258
QQYGSSTLT

SEQ ID NO: 74516 - protein, 15 aa, Homo sapiens
  heavy chain complementarity determining region 3 for antibody 37258
ARGPHPPYYGGFFHR

SEQ ID NO: 74517 - protein, 9 aa, Homo sapiens
  light chain complementarity determining region 3 for antibody 37259
QQYGSSSWP

SEQ ID NO: 74518 - protein, 21 aa, Homo sapiens
  heavy chain complementarity determining region 3 for antibody 37259
ARDAPVSRPYSSGWYSSAFDY

SEQ ID NO: 74519 - protein, 8 aa, Homo sapiens
  light chain complementarity determining region 3 for antibody 37260
QQYGSSST

SEQ ID NO: 74520 - protein, 20 aa, Homo sapiens
  heavy chain complementarity determining region 3 for antibody 37260
ARDLRVRGVIGPSIRGSFDI

SEQ ID NO: 74521 - protein, 9 aa, Homo sapiens
  light chain complementarity determining region 3 for antibody 37261
QQYGSSSRT

SEQ ID NO: 74522 - protein, 25 aa, Homo sapiens
  heavy chain complementarity determining region 3 for antibody 37261
ARLRIDRLRLPGAMRGPLYDCGLNV

SEQ ID NO: 74523 - protein, 10 aa, Homo sapiens
  light chain complementarity determining region 3 for antibody 37262
QQYGSSSMYT

SEQ ID NO: 74524 - protein, 19 aa, Homo sapiens
  heavy chain complementarity determining region 3 for antibody 37262
AKDQLMFYYENSGYPGADY

SEQ ID NO: 74525 - protein, 10 aa, Homo sapiens
  light chain complementarity determining region 3 for antibody 37263
QQYGSSSMYT

SEQ ID NO: 74526 - protein, 19 aa, Homo sapiens
  heavy chain complementarity determining region 3 for antibody 37263
AKDQLMFYYDNSGYPGPDY

SEQ ID NO: 74527 - protein, 10 aa, Homo sapiens
  light chain complementarity determining region 3 for antibody 37264
QQYGSSSMYT

SEQ ID NO: 74528 - protein, 19 aa, Homo sapiens
  heavy chain complementarity determining region 3 for antibody 37264
AKDQLMFYYDNSGYPGADS

SEQ ID NO: 74529 - protein, 10 aa, Homo sapiens
  light chain complementarity determining region 3 for antibody 37265
QQYGSSSMYT

SEQ ID NO: 74530 - protein, 19 aa, Homo sapiens
  heavy chain complementarity determining region 3 for antibody 37265
AKDQLMFYYDNSGSPGADY

SEQ ID NO: 74531 - protein, 10 aa, Homo sapiens
  light chain complementarity determining region 3 for antibody 37266
QQYGSSSMYT

SEQ ID NO: 74532 - protein, 19 aa, Homo sapiens
  heavy chain complementarity determining region 3 for antibody 37266
AKDQLMFYYDNSGCPGADY

SEQ ID NO: 74533 - protein, 10 aa, Homo sapiens
  light chain complementarity determining region 3 for antibody 37267
QQYGSSSMYT

SEQ ID NO: 74534 - protein, 19 aa, Homo sapiens
  heavy chain complementarity determining region 3 for antibody 37267
AKDQLMFDYDNSGYPGADY

SEQ ID NO: 74535 - protein, 10 aa, Homo sapiens
  light chain complementarity determining region 3 for antibody 37268
QQYGSSSMYT

SEQ ID NO: 74536 - protein, 19 aa, Homo sapiens
  heavy chain complementarity determining region 3 for antibody 37268
AKDQLMCYYDNSGYPGADY

SEQ ID NO: 74537 - protein, 10 aa, Homo sapiens
  light chain complementarity determining region 3 for antibody 37269
QQYGSSSMYI

SEQ ID NO: 74538 - protein, 19 aa, Homo sapiens
  heavy chain complementarity determining region 3 for antibody 37269
AKDQLMFYYDNSGYPGADY

SEQ ID NO: 74539 - protein, 10 aa, Homo sapiens
  light chain complementarity determining region 3 for antibody 37270
QQYGSSSMVT

SEQ ID NO: 74540 - protein, 19 aa, Homo sapiens
  heavy chain complementarity determining region 3 for antibody 37270
AKDQLMFYYDNSGYPGADY

SEQ ID NO: 74541 - protein, 10 aa, Homo sapiens
  light chain complementarity determining region 3 for antibody 37271
QQYGSSSMFT

SEQ ID NO: 74542 - protein, 19 aa, Homo sapiens
  heavy chain complementarity determining region 3 for antibody 37271
AKDQLMFYYDNSGYPGADY

SEQ ID NO: 74543 - protein, 9 aa, Homo sapiens
  light chain complementarity determining region 3 for antibody 37272
QQYGSSRWT

SEQ ID NO: 74544 - protein, 13 aa, Homo sapiens
  heavy chain complementarity determining region 3 for antibody 37272
TTELRWGGVNFDY

SEQ ID NO: 74545 - protein, 9 aa, Homo sapiens
  light chain complementarity determining region 3 for antibody 37273
QQYGSSRGP

SEQ ID NO: 74546 - protein, 12 aa, Homo sapiens
  heavy chain complementarity determining region 3 for antibody 37273
SRGQGQWLVPAF

SEQ ID NO: 74547 - protein, 9 aa, Homo sapiens
  light chain complementarity determining region 3 for antibody 37274
QQYGSSPYT

SEQ ID NO: 74548 - protein, 21 aa, Homo sapiens
  heavy chain complementarity determining region 3 for antibody 37274
ASQGSRYHCSGGSCYLGLTDY

SEQ ID NO: 74549 - protein, 9 aa, Homo sapiens
  light chain complementarity determining region 3 for antibody 37275
QQYGSSPYT

SEQ ID NO: 74550 - protein, 14 aa, Homo sapiens
  heavy chain complementarity determining region 3 for antibody 37275
ARHSGYHYGSHLDY

SEQ ID NO: 74551 - protein, 9 aa, Homo sapiens
  light chain complementarity determining region 3 for antibody 37276
QQYGSSPYT

SEQ ID NO: 74552 - protein, 16 aa, Homo sapiens
  heavy chain complementarity determining region 3 for antibody 37276
ARGLYGSGGHSNPFDC

SEQ ID NO: 74553 - protein, 9 aa, Homo sapiens
  light chain complementarity determining region 3 for antibody 37277
QQYGSSPYP

SEQ ID NO: 74554 - protein, 12 aa, Homo sapiens
  heavy chain complementarity determining region 3 for antibody 37277
VREGDGYKYFDY

SEQ ID NO: 74555 - protein, 9 aa, Homo sapiens
  light chain complementarity determining region 3 for antibody 37278
QQYGSSPYP

SEQ ID NO: 74556 - protein, 15 aa, Homo sapiens
  heavy chain complementarity determining region 3 for antibody 37278
AKYRGIHYNVYHFDN

SEQ ID NO: 74557 - protein, 9 aa, Homo sapiens
  light chain complementarity determining region 3 for antibody 37279
QQYGSSPWT

SEQ ID NO: 74558 - protein, 12 aa, Homo sapiens
  heavy chain complementarity determining region 3 for antibody 37279
ATSLWFGIHPEY

SEQ ID NO: 74559 - protein, 9 aa, Homo sapiens
  light chain complementarity determining region 3 for antibody 37280
QQYGSSPWT

SEQ ID NO: 74560 - protein, 15 aa, Homo sapiens
  heavy chain complementarity determining region 3 for antibody 37280
AREAVDIAGHYRADY

SEQ ID NO: 74561 - protein, 9 aa, Homo sapiens
  light chain complementarity determining region 3 for antibody 37281
QQYGSSPWT

SEQ ID NO: 74562 - protein, 17 aa, Homo sapiens
  heavy chain complementarity determining region 3 for antibody 37281
ARDGWYDSSMWFDGFDI

SEQ ID NO: 74563 - protein, 9 aa, Homo sapiens
  light chain complementarity determining region 3 for antibody 37282
QQYGSSPWT

SEQ ID NO: 74564 - protein, 13 aa, Homo sapiens
  heavy chain complementarity determining region 3 for antibody 37282
ARAESWSGRLFDY

SEQ ID NO: 74565 - protein, 9 aa, Homo sapiens
  light chain complementarity determining region 3 for antibody 37283
QQYGSSPWP

SEQ ID NO: 74566 - protein, 14 aa, Homo sapiens
  heavy chain complementarity determining region 3 for antibody 37283
ARDSSSTSWGPIDY

SEQ ID NO: 74567 - protein, 9 aa, Homo sapiens
  light chain complementarity determining region 3 for antibody 37284
QQYGSSPWA

SEQ ID NO: 74568 - protein, 22 aa, Homo sapiens
  heavy chain complementarity determining region 3 for antibody 37284
TRVSIGVYDTVNGYYHPGPMDS

SEQ ID NO: 74569 - protein, 9 aa, Homo sapiens
  light chain complementarity determining region 3 for antibody 37285
QQYGSSPVT

SEQ ID NO: 74570 - protein, 26 aa, Homo sapiens
  heavy chain complementarity determining region 3 for antibody 37285
AREPQTYYYGSGSYSRRLYYYYGMDV

SEQ ID NO: 74571 - protein, 9 aa, Homo sapiens
  light chain complementarity determining region 3 for antibody 37286
QQYGSSPVT

SEQ ID NO: 74572 - protein, 26 aa, Homo sapiens
  heavy chain complementarity determining region 3 for antibody 37286
AREPHTYYYGSGSYSRSLYYYYGMDV

SEQ ID NO: 74573 - protein, 10 aa, Homo sapiens
  light chain complementarity determining region 3 for antibody 37287
QQYGSSPTWT

SEQ ID NO: 74574 - protein, 13 aa, Homo sapiens
  heavy chain complementarity determining region 3 for antibody 37287
ARSGGSYYYAFDI

SEQ ID NO: 74575 - protein, 9 aa, Homo sapiens
  light chain complementarity determining region 3 for antibody 37288
QQYGSSPTT

SEQ ID NO: 74576 - protein, 15 aa, Homo sapiens
  heavy chain complementarity determining region 3 for antibody 37288
SRDLLWFGPPSAFDF

SEQ ID NO: 74577 - protein, 9 aa, Homo sapiens
  light chain complementarity determining region 3 for antibody 37289
QQYGSSPTT

SEQ ID NO: 74578 - protein, 15 aa, Homo sapiens
  heavy chain complementarity determining region 3 for antibody 37289
ARDWGDDFFHYGMDV

SEQ ID NO: 74579 - protein, 10 aa, Homo sapiens
  light chain complementarity determining region 3 for antibody 37290
QQYGSSPTRT

SEQ ID NO: 74580 - protein, 15 aa, Homo sapiens
  heavy chain complementarity determining region 3 for antibody 37290
TRDLLDSGGAYFADH

SEQ ID NO: 74581 - protein, 9 aa, Homo sapiens
  light chain complementarity determining region 3 for antibody 37291
QQYGSSPTP

SEQ ID NO: 74582 - protein, 15 aa, Homo sapiens
  heavy chain complementarity determining region 3 for antibody 37291
SRDLLWFGPTSAFDF

SEQ ID NO: 74583 - protein, 9 aa, Homo sapiens
  light chain complementarity determining region 3 for antibody 37292
QQYGSSPTI

SEQ ID NO: 74584 - protein, 17 aa, Homo sapiens
  heavy chain complementarity determining region 3 for antibody 37292
ARDLGTYDATRHWYFDL

SEQ ID NO: 74585 - protein, 10 aa, Homo sapiens
  light chain complementarity determining region 3 for antibody 37293
QQYGSSPTGR

SEQ ID NO: 74586 - protein, 15 aa, Homo sapiens
  heavy chain complementarity determining region 3 for antibody 37293
TRDLLDSGGAYFADH

SEQ ID NO: 74587 - protein, 8 aa, Homo sapiens
  light chain complementarity determining region 3 for antibody 37294
QQYGSSPT

SEQ ID NO: 74588 - protein, 23 aa, Homo sapiens
  heavy chain complementarity determining region 3 for antibody 37294
ARPKRHYYDSSGYYASALDAFDI

SEQ ID NO: 74589 - protein, 8 aa, Homo sapiens
  light chain complementarity determining region 3 for antibody 37295
QQYGSSPT

SEQ ID NO: 74590 - protein, 23 aa, Homo sapiens
  heavy chain complementarity determining region 3 for antibody 37295
ARPKRHYYDSSGYCSSALDAFDI

SEQ ID NO: 74591 - protein, 8 aa, Homo sapiens
  light chain complementarity determining region 3 for antibody 37296
QQYGSSPT

SEQ ID NO: 74592 - protein, 12 aa, Homo sapiens
  heavy chain complementarity determining region 3 for antibody 37296
AREPAEDYYLDF

SEQ ID NO: 74593 - protein, 8 aa, Homo sapiens
  light chain complementarity determining region 3 for antibody 37297
QQYGSSPS

SEQ ID NO: 74594 - protein, 11 aa, Homo sapiens
  heavy chain complementarity determining region 3 for antibody 37297
VRNGVRGANDY

SEQ ID NO: 74595 - protein, 9 aa, Homo sapiens
  light chain complementarity determining region 3 for antibody 37298
QQYGSSPST

SEQ ID NO: 74596 - protein, 25 aa, Homo sapiens
  heavy chain complementarity determining region 3 for antibody 37298
ARTTGLSSYDSRGHYAGVYYNGLDV

SEQ ID NO: 74597 - protein, 9 aa, Homo sapiens
  light chain complementarity determining region 3 for antibody 37299
QQYGSSPST

SEQ ID NO: 74598 - protein, 13 aa, Homo sapiens
  heavy chain complementarity determining region 3 for antibody 37299
ARDGQWLVRFFDY

SEQ ID NO: 74599 - protein, 9 aa, Homo sapiens
  light chain complementarity determining region 3 for antibody 37300
QQYGSSPSP

SEQ ID NO: 74600 - protein, 13 aa, Homo sapiens
  heavy chain complementarity determining region 3 for antibody 37300
ARDGQWLVRYFDY

SEQ ID NO: 74601 - protein, 10 aa, Homo sapiens
  light chain complementarity determining region 3 for antibody 37301
QQYGSSPSLT

SEQ ID NO: 74602 - protein, 17 aa, Homo sapiens
  heavy chain complementarity determining region 3 for antibody 37301
ARVYYYGSGSYLFGPGY

SEQ ID NO: 74603 - protein, 8 aa, Homo sapiens
  light chain complementarity determining region 3 for antibody 37302
QQYGSSPS

SEQ ID NO: 74604 - protein, 20 aa, Homo sapiens
  heavy chain complementarity determining region 3 for antibody 37302
ARDQAYSYALGSSGVDWLDP

SEQ ID NO: 74605 - protein, 10 aa, Homo sapiens
  light chain complementarity determining region 3 for antibody 37303
QQYGSSPRYI

SEQ ID NO: 74606 - protein, 17 aa, Homo sapiens
  heavy chain complementarity determining region 3 for antibody 37303
ARISVWTVYTGSYHFDY

SEQ ID NO: 74607 - protein, 9 aa, Homo sapiens
  light chain complementarity determining region 3 for antibody 37304
QQYGSSPRT

SEQ ID NO: 74608 - protein, 22 aa, Homo sapiens
  heavy chain complementarity determining region 3 for antibody 37304
GRGFRHYERSSYFSWGGEYYHD

SEQ ID NO: 74609 - protein, 9 aa, Homo sapiens
  light chain complementarity determining region 3 for antibody 37305
QQYGSSPRT

SEQ ID NO: 74610 - protein, 13 aa, Homo sapiens
  heavy chain complementarity determining region 3 for antibody 37305
ERGSGIFGGFFDY

SEQ ID NO: 74611 - protein, 9 aa, Homo sapiens
  light chain complementarity determining region 3 for antibody 37306
QQYGSSPRT

SEQ ID NO: 74612 - protein, 22 aa, Homo sapiens
  heavy chain complementarity determining region 3 for antibody 37306
ARVLGTCTNDICYSYHDDAFGT

SEQ ID NO: 74613 - protein, 9 aa, Homo sapiens
  light chain complementarity determining region 3 for antibody 37307
QQYGSSPRT

SEQ ID NO: 74614 - protein, 17 aa, Homo sapiens
  heavy chain complementarity determining region 3 for antibody 37307
ARTLDIVVVVDAIWFDP

SEQ ID NO: 74615 - protein, 9 aa, Homo sapiens
  light chain complementarity determining region 3 for antibody 37308
QQYGSSPRT

SEQ ID NO: 74616 - protein, 25 aa, Homo sapiens
  heavy chain complementarity determining region 3 for antibody 37308
ARPRIDRLRLPGAMRGPLYDCGLNV

SEQ ID NO: 74617 - protein, 9 aa, Homo sapiens
  light chain complementarity determining region 3 for antibody 37309
QQYGSSPRT

SEQ ID NO: 74618 - protein, 25 aa, Homo sapiens
  heavy chain complementarity determining region 3 for antibody 37309
ARLSIDRLRLPGAMRGPLYDCGLNV

SEQ ID NO: 74619 - protein, 9 aa, Homo sapiens
  light chain complementarity determining region 3 for antibody 37310
QQYGSSPRT

SEQ ID NO: 74620 - protein, 25 aa, Homo sapiens
  heavy chain complementarity determining region 3 for antibody 37310
ARLRVDRLRLPGAMRGPLYDCGLNV

SEQ ID NO: 74621 - protein, 9 aa, Homo sapiens
  light chain complementarity determining region 3 for antibody 37311
QQYGSSPRT

SEQ ID NO: 74622 - protein, 25 aa, Homo sapiens
  heavy chain complementarity determining region 3 for antibody 37311
ARLRIGRLRLPGAMRGPLYDCGLNV

SEQ ID NO: 74623 - protein, 9 aa, Homo sapiens
  light chain complementarity determining region 3 for antibody 37312
QQYGSSPRT

SEQ ID NO: 74624 - protein, 25 aa, Homo sapiens
  heavy chain complementarity determining region 3 for antibody 37312
ARLRIDRLRPPGAMRGPLYDCGLNV

SEQ ID NO: 74625 - protein, 9 aa, Homo sapiens
  light chain complementarity determining region 3 for antibody 37313
QQYGSSPRT

SEQ ID NO: 74626 - protein, 25 aa, Homo sapiens
  heavy chain complementarity determining region 3 for antibody 37313
ARLRIDRLRLPGAMRGPWYDCGLNV

SEQ ID NO: 74627 - protein, 9 aa, Homo sapiens
  light chain complementarity determining region 3 for antibody 37314
QQYGSSPRT

SEQ ID NO: 74628 - protein, 25 aa, Homo sapiens
  heavy chain complementarity determining region 3 for antibody 37314
ARLRIDRLRLPGAMRGPLYDRGLNV

SEQ ID NO: 74629 - protein, 9 aa, Homo sapiens
  light chain complementarity determining region 3 for antibody 37315
QQYGSSPRT

SEQ ID NO: 74630 - protein, 25 aa, Homo sapiens
  heavy chain complementarity determining region 3 for antibody 37315
ARLRIDRLRLPGAMRGPLYDCGVNV

SEQ ID NO: 74631 - protein, 9 aa, Homo sapiens
  light chain complementarity determining region 3 for antibody 37316
QQYGSSPRT

SEQ ID NO: 74632 - protein, 27 aa, Homo sapiens
  heavy chain complementarity determining region 3 for antibody 37316
ARGVGSCTSFWCRRGRDPHYQKRGFDY

SEQ ID NO: 74633 - protein, 9 aa, Homo sapiens
  light chain complementarity determining region 3 for antibody 37317
QQYGSSPRT

SEQ ID NO: 74634 - protein, 19 aa, Homo sapiens
  heavy chain complementarity determining region 3 for antibody 37317
ARGSNSSRRRAAVVGDFDL

SEQ ID NO: 74635 - protein, 9 aa, Homo sapiens
  light chain complementarity determining region 3 for antibody 37318
QQYGSSPRT

SEQ ID NO: 74636 - protein, 14 aa, Homo sapiens
  heavy chain complementarity determining region 3 for antibody 37318
ARGGQSYPNGYFDL

SEQ ID NO: 74637 - protein, 9 aa, Homo sapiens
  light chain complementarity determining region 3 for antibody 37319
QQYGSSPRT

SEQ ID NO: 74638 - protein, 16 aa, Homo sapiens
  heavy chain complementarity determining region 3 for antibody 37319
ARDRGSSGWRWGFFDS

SEQ ID NO: 74639 - protein, 9 aa, Homo sapiens
  light chain complementarity determining region 3 for antibody 37320
QQYGSSPRT

SEQ ID NO: 74640 - protein, 17 aa, Homo sapiens
  heavy chain complementarity determining region 3 for antibody 37320
ARALDIVVVVDDIWFDP

SEQ ID NO: 74641 - protein, 9 aa, Homo sapiens
  light chain complementarity determining region 3 for antibody 37321
QQYGSSPRT

SEQ ID NO: 74642 - protein, 17 aa, Homo sapiens
  heavy chain complementarity determining region 3 for antibody 37321
ARALDIVVVVDAIWFGP

SEQ ID NO: 74643 - protein, 9 aa, Homo sapiens
  light chain complementarity determining region 3 for antibody 37322
QQYGSSPRT

SEQ ID NO: 74644 - protein, 17 aa, Homo sapiens
  heavy chain complementarity determining region 3 for antibody 37322
ARALDIVVVVDAIWFDL

SEQ ID NO: 74645 - protein, 9 aa, Homo sapiens
  light chain complementarity determining region 3 for antibody 37323
QQYGSSPRT

SEQ ID NO: 74646 - protein, 17 aa, Homo sapiens
  heavy chain complementarity determining region 3 for antibody 37323
ARALDIVVVVDAIRFDP

SEQ ID NO: 74647 - protein, 9 aa, Homo sapiens
  light chain complementarity determining region 3 for antibody 37324
QQYGSSPRT

SEQ ID NO: 74648 - protein, 17 aa, Homo sapiens
  heavy chain complementarity determining region 3 for antibody 37324
ARALDIVVVADAIWFDP

SEQ ID NO: 74649 - protein, 9 aa, Homo sapiens
  light chain complementarity determining region 3 for antibody 37325
QQYGSSPRT

SEQ ID NO: 74650 - protein, 19 aa, Homo sapiens
  heavy chain complementarity determining region 3 for antibody 37325
AKEHSPCSLIAVEGFDFDY

SEQ ID NO: 74651 - protein, 9 aa, Homo sapiens
  light chain complementarity determining region 3 for antibody 37326
QQYGSSPRT

SEQ ID NO: 74652 - protein, 16 aa, Homo sapiens
  heavy chain complementarity determining region 3 for antibody 37326
AATRRRREGYRVVLDY

SEQ ID NO: 74653 - protein, 9 aa, Homo sapiens
  light chain complementarity determining region 3 for antibody 37327
QQYGSSPRS

SEQ ID NO: 74654 - protein, 17 aa, Homo sapiens
  heavy chain complementarity determining region 3 for antibody 37327
ARALDIVVVVDAIWFDP

SEQ ID NO: 74655 - protein, 9 aa, Homo sapiens
  light chain complementarity determining region 3 for antibody 37328
QQYGSSPRQ

SEQ ID NO: 74656 - protein, 25 aa, Homo sapiens
  heavy chain complementarity determining region 3 for antibody 37328
ARLRIDRLRLPGAMRGPLYDCGLNV

SEQ ID NO: 74657 - protein, 9 aa, Homo sapiens
  light chain complementarity determining region 3 for antibody 37329
QQYGSSPRQ

SEQ ID NO: 74658 - protein, 17 aa, Homo sapiens
  heavy chain complementarity determining region 3 for antibody 37329
ARALDIVVVVDAIWFDP

SEQ ID NO: 74659 - protein, 9 aa, Homo sapiens
  light chain complementarity determining region 3 for antibody 37330
QQYGSSPRP

SEQ ID NO: 74660 - protein, 25 aa, Homo sapiens
  heavy chain complementarity determining region 3 for antibody 37330
ARLRIDRLRLPGAMRGPLYDCGLDV

SEQ ID NO: 74661 - protein, 9 aa, Homo sapiens
  light chain complementarity determining region 3 for antibody 37331
QQYGSSPRP

SEQ ID NO: 74662 - protein, 14 aa, Homo sapiens
  heavy chain complementarity determining region 3 for antibody 37331
ARGQGLLAGDVFDV

SEQ ID NO: 74663 - protein, 9 aa, Homo sapiens
  light chain complementarity determining region 3 for antibody 37332
QQYGSSPRP

SEQ ID NO: 74664 - protein, 11 aa, Homo sapiens
  heavy chain complementarity determining region 3 for antibody 37332
AREAVARPPDY

SEQ ID NO: 74665 - protein, 9 aa, Homo sapiens
  light chain complementarity determining region 3 for antibody 37333
QQYGSSPRK

SEQ ID NO: 74666 - protein, 17 aa, Homo sapiens
  heavy chain complementarity determining region 3 for antibody 37333
ARALDIVVVVDAIWFDP

SEQ ID NO: 74667 - protein, 10 aa, Homo sapiens
  light chain complementarity determining region 3 for antibody 37334
QQYGSSPRFT

SEQ ID NO: 74668 - protein, 14 aa, Homo sapiens
  heavy chain complementarity determining region 3 for antibody 37334
ARWYYYDGSGLVDY

SEQ ID NO: 74669 - protein, 10 aa, Homo sapiens
  light chain complementarity determining region 3 for antibody 37335
QQYGSSPRFT

SEQ ID NO: 74670 - protein, 14 aa, Homo sapiens
  heavy chain complementarity determining region 3 for antibody 37335
ARWYCYDGSGLGDY

SEQ ID NO: 74671 - protein, 10 aa, Homo sapiens
  light chain complementarity determining region 3 for antibody 37336
QQYGSSPRDT

SEQ ID NO: 74672 - protein, 17 aa, Homo sapiens
  heavy chain complementarity determining region 3 for antibody 37336
ARISVWTVYTGSYHFDY

SEQ ID NO: 74673 - protein, 9 aa, Homo sapiens
  light chain complementarity determining region 3 for antibody 37337
QQYGSSPQT

SEQ ID NO: 74674 - protein, 19 aa, Homo sapiens
  heavy chain complementarity determining region 3 for antibody 37337
ARVFRGLRSRSYFGYGVDL

SEQ ID NO: 74675 - protein, 9 aa, Homo sapiens
  light chain complementarity determining region 3 for antibody 37338
QQYGSSPQT

SEQ ID NO: 74676 - protein, 19 aa, Homo sapiens
  heavy chain complementarity determining region 3 for antibody 37338
ARVCRGLRSRSYFGYGMDL

SEQ ID NO: 74677 - protein, 9 aa, Homo sapiens
  light chain complementarity determining region 3 for antibody 37339
QQYGSSPQK

SEQ ID NO: 74678 - protein, 19 aa, Homo sapiens
  heavy chain complementarity determining region 3 for antibody 37339
ARVFRGLRSRSYFGYGMDL

SEQ ID NO: 74679 - protein, 10 aa, Homo sapiens
  light chain complementarity determining region 3 for antibody 37340
QQYGSSPPYT

SEQ ID NO: 74680 - protein, 23 aa, Homo sapiens
  heavy chain complementarity determining region 3 for antibody 37340
ARDYLRHYSFDSSDYPPLKTFYI

SEQ ID NO: 74681 - protein, 10 aa, Homo sapiens
  light chain complementarity determining region 3 for antibody 37341
QQYGSSPPYT

SEQ ID NO: 74682 - protein, 23 aa, Homo sapiens
  heavy chain complementarity determining region 3 for antibody 37341
ARAYLRHYSFDSSDYPPLKTFYM

SEQ ID NO: 74683 - protein, 10 aa, Homo sapiens
  light chain complementarity determining region 3 for antibody 37342
QQYGSSPPYI

SEQ ID NO: 74684 - protein, 18 aa, Homo sapiens
  heavy chain complementarity determining region 3 for antibody 37342
ATGKWFGDFNFYYYAMDV

SEQ ID NO: 74685 - protein, 10 aa, Homo sapiens
  light chain complementarity determining region 3 for antibody 37343
QQYGSSPPWT

SEQ ID NO: 74686 - protein, 13 aa, Homo sapiens
  heavy chain complementarity determining region 3 for antibody 37343
ARIPDISGWPFGL

SEQ ID NO: 74687 - protein, 10 aa, Homo sapiens
  light chain complementarity determining region 3 for antibody 37344
QQYGSSPPWT

SEQ ID NO: 74688 - protein, 14 aa, Homo sapiens
  heavy chain complementarity determining region 3 for antibody 37344
ARGASSSLYHPFDS

SEQ ID NO: 74689 - protein, 10 aa, Homo sapiens
  light chain complementarity determining region 3 for antibody 37345
QQYGSSPPWT

SEQ ID NO: 74690 - protein, 14 aa, Homo sapiens
  heavy chain complementarity determining region 3 for antibody 37345
ARGASSSCYHPFDS

SEQ ID NO: 74691 - protein, 10 aa, Homo sapiens
  light chain complementarity determining region 3 for antibody 37346
QQYGSSPPWT

SEQ ID NO: 74692 - protein, 18 aa, Homo sapiens
  heavy chain complementarity determining region 3 for antibody 37346
AREYSDFWKPPPRAWFDP

SEQ ID NO: 74693 - protein, 10 aa, Homo sapiens
  light chain complementarity determining region 3 for antibody 37347
QQYGSSPPWR

SEQ ID NO: 74694 - protein, 13 aa, Homo sapiens
  heavy chain complementarity determining region 3 for antibody 37347
ARIPDISGWPFDL

SEQ ID NO: 74695 - protein, 10 aa, Homo sapiens
  light chain complementarity determining region 3 for antibody 37348
QQYGSSPPWP

SEQ ID NO: 74696 - protein, 13 aa, Homo sapiens
  heavy chain complementarity determining region 3 for antibody 37348
ARSGGSYYYAFDI

SEQ ID NO: 74697 - protein, 10 aa, Homo sapiens
  light chain complementarity determining region 3 for antibody 37349
QQYGSSPPVT

SEQ ID NO: 74698 - protein, 14 aa, Homo sapiens
  heavy chain complementarity determining region 3 for antibody 37349
ATEGPSRMGKFFDS

SEQ ID NO: 74699 - protein, 9 aa, Homo sapiens
  light chain complementarity determining region 3 for antibody 37350
QQYGSSPPT

SEQ ID NO: 74700 - protein, 14 aa, Homo sapiens
  heavy chain complementarity determining region 3 for antibody 37350
TRDPIPYSSWYFDL

SEQ ID NO: 74701 - protein, 9 aa, Homo sapiens
  light chain complementarity determining region 3 for antibody 37351
QQYGSSPPT

SEQ ID NO: 74702 - protein, 19 aa, Homo sapiens
  heavy chain complementarity determining region 3 for antibody 37351
ARVFRGLRSRSYFGYGMDL

SEQ ID NO: 74703 - protein, 9 aa, Homo sapiens
  light chain complementarity determining region 3 for antibody 37352
QQYGSSPPT

SEQ ID NO: 74704 - protein, 11 aa, Homo sapiens
  heavy chain complementarity determining region 3 for antibody 37352
ARPGREGGFDY

SEQ ID NO: 74705 - protein, 9 aa, Homo sapiens
  light chain complementarity determining region 3 for antibody 37353
QQYGSSPPT

SEQ ID NO: 74706 - protein, 25 aa, Homo sapiens
  heavy chain complementarity determining region 3 for antibody 37353
ARLRIDRLRLPGAMRGPLYDCGLNV

SEQ ID NO: 74707 - protein, 9 aa, Homo sapiens
  light chain complementarity determining region 3 for antibody 37354
QQYGSSPPT

SEQ ID NO: 74708 - protein, 14 aa, Homo sapiens
  heavy chain complementarity determining region 3 for antibody 37354
ARDRRLGGYRLLDH

SEQ ID NO: 74709 - protein, 9 aa, Homo sapiens
  light chain complementarity determining region 3 for antibody 37355
QQYGSSPPT

SEQ ID NO: 74710 - protein, 16 aa, Homo sapiens
  heavy chain complementarity determining region 3 for antibody 37355
ARDFHPRAASDPAYDY

SEQ ID NO: 74711 - protein, 9 aa, Homo sapiens
  light chain complementarity determining region 3 for antibody 37356
QQYGSSPPT

SEQ ID NO: 74712 - protein, 16 aa, Homo sapiens
  heavy chain complementarity determining region 3 for antibody 37356
ARDFHPMAASDAAYDY

SEQ ID NO: 74713 - protein, 9 aa, Homo sapiens
  light chain complementarity determining region 3 for antibody 37357
QQYGSSPPN

SEQ ID NO: 74714 - protein, 11 aa, Homo sapiens
  heavy chain complementarity determining region 3 for antibody 37357
ARTPLWFGPYF

SEQ ID NO: 74715 - protein, 11 aa, Homo sapiens
  light chain complementarity determining region 3 for antibody 37358
QQYGSSPPMTT

SEQ ID NO: 74716 - protein, 17 aa, Homo sapiens
  heavy chain complementarity determining region 3 for antibody 37358
ARILGGQKYYFYYGMDV

SEQ ID NO: 74717 - protein, 11 aa, Homo sapiens
  light chain complementarity determining region 3 for antibody 37359
QQYGSSPPMST

SEQ ID NO: 74718 - protein, 17 aa, Homo sapiens
  heavy chain complementarity determining region 3 for antibody 37359
ARILGGQKYYFYYGMDV

SEQ ID NO: 74719 - protein, 11 aa, Homo sapiens
  light chain complementarity determining region 3 for antibody 37360
QQYGSSPPMSP

SEQ ID NO: 74720 - protein, 17 aa, Homo sapiens
  heavy chain complementarity determining region 3 for antibody 37360
ARILGGQKYYFYYGMDV

SEQ ID NO: 74721 - protein, 11 aa, Homo sapiens
  light chain complementarity determining region 3 for antibody 37361
QQYGSSPPMNT

SEQ ID NO: 74722 - protein, 17 aa, Homo sapiens
  heavy chain complementarity determining region 3 for antibody 37361
ARILGGQKYYFYYGMDV

SEQ ID NO: 74723 - protein, 10 aa, Homo sapiens
  light chain complementarity determining region 3 for antibody 37362
QQYGSSPPLT

SEQ ID NO: 74724 - protein, 18 aa, Homo sapiens
  heavy chain complementarity determining region 3 for antibody 37362
ARGGYDYGWGSYGVYFDS

SEQ ID NO: 74725 - protein, 10 aa, Homo sapiens
  light chain complementarity determining region 3 for antibody 37363
QQYGSSPPLT

SEQ ID NO: 74726 - protein, 18 aa, Homo sapiens
  heavy chain complementarity determining region 3 for antibody 37363
ARGGYDYGWGSYGGYFDY

SEQ ID NO: 74727 - protein, 10 aa, Homo sapiens
  light chain complementarity determining region 3 for antibody 37364
QQYGSSPPLT

SEQ ID NO: 74728 - protein, 18 aa, Homo sapiens
  heavy chain complementarity determining region 3 for antibody 37364
ARGGYDYGWGRYGVYFDY

SEQ ID NO: 74729 - protein, 10 aa, Homo sapiens
  light chain complementarity determining region 3 for antibody 37365
QQYGSSPPLT

SEQ ID NO: 74730 - protein, 18 aa, Homo sapiens
  heavy chain complementarity determining region 3 for antibody 37365
ARGGSDYGWGSYGVYFDY

SEQ ID NO: 74731 - protein, 10 aa, Homo sapiens
  light chain complementarity determining region 3 for antibody 37366
QQYGSSPPLT

SEQ ID NO: 74732 - protein, 19 aa, Homo sapiens
  heavy chain complementarity determining region 3 for antibody 37366
AREPVVGVVTTYYYYGMDV

SEQ ID NO: 74733 - protein, 10 aa, Homo sapiens
  light chain complementarity determining region 3 for antibody 37367
QQYGSSPPLS

SEQ ID NO: 74734 - protein, 18 aa, Homo sapiens
  heavy chain complementarity determining region 3 for antibody 37367
ARGGYDYGWGSYGVYFDY

SEQ ID NO: 74735 - protein, 10 aa, Homo sapiens
  light chain complementarity determining region 3 for antibody 37368
QQYGSSPPLP

SEQ ID NO: 74736 - protein, 19 aa, Homo sapiens
  heavy chain complementarity determining region 3 for antibody 37368
AREPVFGVVTTYYYYGMDV

SEQ ID NO: 74737 - protein, 10 aa, Homo sapiens
  light chain complementarity determining region 3 for antibody 37369
QQYGSSPPLI

SEQ ID NO: 74738 - protein, 18 aa, Homo sapiens
  heavy chain complementarity determining region 3 for antibody 37369
ARGGYDYGWGSYGVYFDY

SEQ ID NO: 74739 - protein, 10 aa, Homo sapiens
  light chain complementarity determining region 3 for antibody 37370
QQYGSSPPGT

SEQ ID NO: 74740 - protein, 14 aa, Homo sapiens
  heavy chain complementarity determining region 3 for antibody 37370
ATEGPSRMGKFFDS

SEQ ID NO: 74741 - protein, 10 aa, Homo sapiens
  light chain complementarity determining region 3 for antibody 37371
QQYGSSPPGT

SEQ ID NO: 74742 - protein, 28 aa, Homo sapiens
  heavy chain complementarity determining region 3 for antibody 37371
ARVKRGSGGWYSPRAEIKKHYYYYAMDV

SEQ ID NO: 74743 - protein, 10 aa, Homo sapiens
  light chain complementarity determining region 3 for antibody 37372
QQYGSSPPGT

SEQ ID NO: 74744 - protein, 13 aa, Homo sapiens
  heavy chain complementarity determining region 3 for antibody 37372
ARIPDISGWPFDL

SEQ ID NO: 74745 - protein, 10 aa, Homo sapiens
  light chain complementarity determining region 3 for antibody 37373
QQYGSSPPGT

SEQ ID NO: 74746 - protein, 14 aa, Homo sapiens
  heavy chain complementarity determining region 3 for antibody 37373
ARGASSSFYHPFDS

SEQ ID NO: 74747 - protein, 10 aa, Homo sapiens
  light chain complementarity determining region 3 for antibody 37374
QQYGSSPPGT

SEQ ID NO: 74748 - protein, 18 aa, Homo sapiens
  heavy chain complementarity determining region 3 for antibody 37374
AREYSDFWKPPPRAWFDP

SEQ ID NO: 74749 - protein, 11 aa, Homo sapiens
  light chain complementarity determining region 3 for antibody 37375
QQYGSSPPGFT

SEQ ID NO: 74750 - protein, 18 aa, Homo sapiens
  heavy chain complementarity determining region 3 for antibody 37375
AKVSRGLNHGSGSYYFDF

SEQ ID NO: 74751 - protein, 10 aa, Homo sapiens
  light chain complementarity determining region 3 for antibody 37376
QQYGSSPPFT

SEQ ID NO: 74752 - protein, 18 aa, Homo sapiens
  heavy chain complementarity determining region 3 for antibody 37376
ARGGYDYGWGSYGVYFDY

SEQ ID NO: 74753 - protein, 10 aa, Homo sapiens
  light chain complementarity determining region 3 for antibody 37377
QQYGSSPPFI

SEQ ID NO: 74754 - protein, 12 aa, Homo sapiens
  heavy chain complementarity determining region 3 for antibody 37377
ARERGRGFGLDI

SEQ ID NO: 74755 - protein, 10 aa, Homo sapiens
  light chain complementarity determining region 3 for antibody 37378
QQYGSSPPDT

SEQ ID NO: 74756 - protein, 18 aa, Homo sapiens
  heavy chain complementarity determining region 3 for antibody 37378
ATGKWFGDFNFYYYAMDV

SEQ ID NO: 74757 - protein, 10 aa, Homo sapiens
  light chain complementarity determining region 3 for antibody 37379
QQYGSSPMYS

SEQ ID NO: 74758 - protein, 11 aa, Homo sapiens
  heavy chain complementarity determining region 3 for antibody 37379
ARGGRWGSLDY

SEQ ID NO: 74759 - protein, 10 aa, Homo sapiens
  light chain complementarity determining region 3 for antibody 37380
QQYGSSPMYS

SEQ ID NO: 74760 - protein, 11 aa, Homo sapiens
  heavy chain complementarity determining region 3 for antibody 37380
ARGGQWGSLDF

SEQ ID NO: 74761 - protein, 10 aa, Homo sapiens
  light chain complementarity determining region 3 for antibody 37381
QQYGSSPMYS

SEQ ID NO: 74762 - protein, 11 aa, Homo sapiens
  heavy chain complementarity determining region 3 for antibody 37381
ARGGQWGALDY

SEQ ID NO: 74763 - protein, 10 aa, Homo sapiens
  light chain complementarity determining region 3 for antibody 37382
QQYGSSPMYS

SEQ ID NO: 74764 - protein, 11 aa, Homo sapiens
  heavy chain complementarity determining region 3 for antibody 37382
ARGGQGGSLDY

SEQ ID NO: 74765 - protein, 10 aa, Homo sapiens
  light chain complementarity determining region 3 for antibody 37383
QQYGSSPMYS

SEQ ID NO: 74766 - protein, 11 aa, Homo sapiens
  heavy chain complementarity determining region 3 for antibody 37383
ARGGHWGSLDY

SEQ ID NO: 74767 - protein, 10 aa, Homo sapiens
  light chain complementarity determining region 3 for antibody 37384
QQYGSSPMYP

SEQ ID NO: 74768 - protein, 22 aa, Homo sapiens
  heavy chain complementarity determining region 3 for antibody 37384
TTGDLWWFGELSYSPSDSYNDI

SEQ ID NO: 74769 - protein, 10 aa, Homo sapiens
  light chain complementarity determining region 3 for antibody 37385
QQYGSSPMKS

SEQ ID NO: 74770 - protein, 11 aa, Homo sapiens
  heavy chain complementarity determining region 3 for antibody 37385
ARGGQWGSLDY

SEQ ID NO: 74771 - protein, 10 aa, Homo sapiens
  light chain complementarity determining region 3 for antibody 37386
QQYGSSPMHS

SEQ ID NO: 74772 - protein, 11 aa, Homo sapiens
  heavy chain complementarity determining region 3 for antibody 37386
ARGGQWGSLDY

SEQ ID NO: 74773 - protein, 10 aa, Homo sapiens
  light chain complementarity determining region 3 for antibody 37387
QQYGSSPMDG

SEQ ID NO: 74774 - protein, 11 aa, Homo sapiens
  heavy chain complementarity determining region 3 for antibody 37387
ARGGQWGSLDY

SEQ ID NO: 74775 - protein, 10 aa, Homo sapiens
  light chain complementarity determining region 3 for antibody 37388
QQYGSSPLYT

SEQ ID NO: 74776 - protein, 18 aa, Homo sapiens
  heavy chain complementarity determining region 3 for antibody 37388
ARVRGGQYYYDSSGWVDY

SEQ ID NO: 74777 - protein, 10 aa, Homo sapiens
  light chain complementarity determining region 3 for antibody 37389
QQYGSSPLYT

SEQ ID NO: 74778 - protein, 18 aa, Homo sapiens
  heavy chain complementarity determining region 3 for antibody 37389
ARVLGGQYYYDSSGCVDY

SEQ ID NO: 74779 - protein, 10 aa, Homo sapiens
  light chain complementarity determining region 3 for antibody 37390
QQYGSSPLYI

SEQ ID NO: 74780 - protein, 18 aa, Homo sapiens
  heavy chain complementarity determining region 3 for antibody 37390
ARVLGGQYYYDSSGWVDY

SEQ ID NO: 74781 - protein, 10 aa, Homo sapiens
  light chain complementarity determining region 3 for antibody 37391
QQYGSSPLYG

SEQ ID NO: 74782 - protein, 15 aa, Homo sapiens
  heavy chain complementarity determining region 3 for antibody 37391
ARCGGGDCYWKDFDY

SEQ ID NO: 74783 - protein, 9 aa, Homo sapiens
  light chain complementarity determining region 3 for antibody 37392
QQYGSSPLT

SEQ ID NO: 74784 - protein, 25 aa, Homo sapiens
  heavy chain complementarity determining region 3 for antibody 37392
ARRRHGCVFCARRRSNILVGYGMDV

SEQ ID NO: 74785 - protein, 9 aa, Homo sapiens
  light chain complementarity determining region 3 for antibody 37393
QQYGSSPLT

SEQ ID NO: 74786 - protein, 17 aa, Homo sapiens
  heavy chain complementarity determining region 3 for antibody 37393
ARALDIVVVVDAIWFDP

SEQ ID NO: 74787 - protein, 10 aa, Homo sapiens
  light chain complementarity determining region 3 for antibody 37394
QQYGSSPLSS

SEQ ID NO: 74788 - protein, 11 aa, Homo sapiens
  heavy chain complementarity determining region 3 for antibody 37394
ARGGQWGSLDY

SEQ ID NO: 74789 - protein, 16 aa, Homo sapiens
  light chain complementarity determining region 3 for antibody 37395
QQYGSSPLSLGGGAVT

SEQ ID NO: 74790 - protein, 11 aa, Homo sapiens
  heavy chain complementarity determining region 3 for antibody 37395
AKMNVNWIFDT

SEQ ID NO: 74791 - protein, 9 aa, Homo sapiens
  light chain complementarity determining region 3 for antibody 37396
QQYGSSPLP

SEQ ID NO: 74792 - protein, 12 aa, Homo sapiens
  heavy chain complementarity determining region 3 for antibody 37396
ARSPYSGIDFDS

SEQ ID NO: 74793 - protein, 9 aa, Homo sapiens
  light chain complementarity determining region 3 for antibody 37397
QQYGSSPLP

SEQ ID NO: 74794 - protein, 14 aa, Homo sapiens
  heavy chain complementarity determining region 3 for antibody 37397
ARGLRGLKNWYFDL

SEQ ID NO: 74795 - protein, 10 aa, Homo sapiens
  light chain complementarity determining region 3 for antibody 37398
QQYGSSPLNT

SEQ ID NO: 74796 - protein, 12 aa, Homo sapiens
  heavy chain complementarity determining region 3 for antibody 37398
ARHKRGTNAFDI

SEQ ID NO: 74797 - protein, 10 aa, Homo sapiens
  light chain complementarity determining region 3 for antibody 37399
QQYGSSPLFT

SEQ ID NO: 74798 - protein, 14 aa, Homo sapiens
  heavy chain complementarity determining region 3 for antibody 37399
VSPRHVVVNWYIDS

SEQ ID NO: 74799 - protein, 10 aa, Homo sapiens
  light chain complementarity determining region 3 for antibody 37400
QQYGSSPLFT

SEQ ID NO: 74800 - protein, 11 aa, Homo sapiens
  heavy chain complementarity determining region 3 for antibody 37400
ARYGSEVAFDI

SEQ ID NO: 74801 - protein, 10 aa, Homo sapiens
  light chain complementarity determining region 3 for antibody 37401
QQYGSSPLDT

SEQ ID NO: 74802 - protein, 18 aa, Homo sapiens
  heavy chain complementarity determining region 3 for antibody 37401
ARVLGGQYYYDSSGWVDY

SEQ ID NO: 74803 - protein, 9 aa, Homo sapiens
  light chain complementarity determining region 3 for antibody 37402
QQYGSSPLA

SEQ ID NO: 74804 - protein, 18 aa, Homo sapiens
  heavy chain complementarity determining region 3 for antibody 37402
VRGGRHDSSGYYYVPFDY

SEQ ID NO: 74805 - protein, 8 aa, Homo sapiens
  light chain complementarity determining region 3 for antibody 37403
QQYGSSPL

SEQ ID NO: 74806 - protein, 14 aa, Homo sapiens
  heavy chain complementarity determining region 3 for antibody 37403
ARDMWDVGDTPPSY

SEQ ID NO: 74807 - protein, 9 aa, Homo sapiens
  light chain complementarity determining region 3 for antibody 37404
QQYGSSPKT

SEQ ID NO: 74808 - protein, 14 aa, Homo sapiens
  heavy chain complementarity determining region 3 for antibody 37404
TRDPIPYSSWYFDL

SEQ ID NO: 74809 - protein, 9 aa, Homo sapiens
  light chain complementarity determining region 3 for antibody 37405
QQYGSSPKT

SEQ ID NO: 74810 - protein, 22 aa, Homo sapiens
  heavy chain complementarity determining region 3 for antibody 37405
ARHSRNPSPRIGDVMIYYYFDL

SEQ ID NO: 74811 - protein, 10 aa, Homo sapiens
  light chain complementarity determining region 3 for antibody 37406
QQYGSSPIFI

SEQ ID NO: 74812 - protein, 19 aa, Homo sapiens
  heavy chain complementarity determining region 3 for antibody 37406
ARDLVGVFGDEIDSSPFDH

SEQ ID NO: 74813 - protein, 9 aa, Homo sapiens
  light chain complementarity determining region 3 for antibody 37407
QQYGSSPHT

SEQ ID NO: 74814 - protein, 14 aa, Homo sapiens
  heavy chain complementarity determining region 3 for antibody 37407
ARHSGYHYGSNLDY

SEQ ID NO: 74815 - protein, 9 aa, Homo sapiens
  light chain complementarity determining region 3 for antibody 37408
QQYGSSPGT

SEQ ID NO: 74816 - protein, 12 aa, Homo sapiens
  heavy chain complementarity determining region 3 for antibody 37408
VKDCGLGGSRDS

SEQ ID NO: 74817 - protein, 9 aa, Homo sapiens
  light chain complementarity determining region 3 for antibody 37409
QQYGSSPGT

SEQ ID NO: 74818 - protein, 18 aa, Homo sapiens
  heavy chain complementarity determining region 3 for antibody 37409
SRIDYYDTNGWSLDASHI

SEQ ID NO: 74819 - protein, 9 aa, Homo sapiens
  light chain complementarity determining region 3 for antibody 37410
QQYGSSPGT

SEQ ID NO: 74820 - protein, 10 aa, Homo sapiens
  heavy chain complementarity determining region 3 for antibody 37410
GGGGGWYPPN

SEQ ID NO: 74821 - protein, 9 aa, Homo sapiens
  light chain complementarity determining region 3 for antibody 37411
QQYGSSPGT

SEQ ID NO: 74822 - protein, 16 aa, Homo sapiens
  heavy chain complementarity determining region 3 for antibody 37411
ATPLWYGGSSAWYFDL

SEQ ID NO: 74823 - protein, 9 aa, Homo sapiens
  light chain complementarity determining region 3 for antibody 37412
QQYGSSPGT

SEQ ID NO: 74824 - protein, 15 aa, Homo sapiens
  heavy chain complementarity determining region 3 for antibody 37412
ARRTSSWYADWYFDL

SEQ ID NO: 74825 - protein, 9 aa, Homo sapiens
  light chain complementarity determining region 3 for antibody 37413
QQYGSSPGT

SEQ ID NO: 74826 - protein, 17 aa, Homo sapiens
  heavy chain complementarity determining region 3 for antibody 37413
ARALDIVVVVDAIWFDP

SEQ ID NO: 74827 - protein, 9 aa, Homo sapiens
  light chain complementarity determining region 3 for antibody 37414
QQYGSSPGT

SEQ ID NO: 74828 - protein, 20 aa, Homo sapiens
  heavy chain complementarity determining region 3 for antibody 37414
ARALAYYDSSGYLLNFPFDY

SEQ ID NO: 74829 - protein, 9 aa, Homo sapiens
  light chain complementarity determining region 3 for antibody 37415
QQYGSSPGP

SEQ ID NO: 74830 - protein, 16 aa, Homo sapiens
  heavy chain complementarity determining region 3 for antibody 37415
ARVVWGGSWYVGWFDT

SEQ ID NO: 74831 - protein, 10 aa, Homo sapiens
  light chain complementarity determining region 3 for antibody 37416
QQYGSSPGFP

SEQ ID NO: 74832 - protein, 11 aa, Homo sapiens
  heavy chain complementarity determining region 3 for antibody 37416
VRERAGGFFDY

SEQ ID NO: 74833 - protein, 9 aa, Homo sapiens
  light chain complementarity determining region 3 for antibody 37417
QQYGSSPFT

SEQ ID NO: 74834 - protein, 14 aa, Homo sapiens
  heavy chain complementarity determining region 3 for antibody 37417
ARGGPAATSSSWLY

SEQ ID NO: 74835 - protein, 9 aa, Homo sapiens
  light chain complementarity determining region 3 for antibody 37418
QQYGSSPFT

SEQ ID NO: 74836 - protein, 17 aa, Homo sapiens
  heavy chain complementarity determining region 3 for antibody 37418
AKSSVWLNNYYYYGSDL

SEQ ID NO: 74837 - protein, 9 aa, Homo sapiens
  light chain complementarity determining region 3 for antibody 37419
QQYGSSPFT

SEQ ID NO: 74838 - protein, 17 aa, Homo sapiens
  heavy chain complementarity determining region 3 for antibody 37419
AKSSVWLNNYYSYGLDL

SEQ ID NO: 74839 - protein, 9 aa, Homo sapiens
  light chain complementarity determining region 3 for antibody 37420
QQYGSSPFT

SEQ ID NO: 74840 - protein, 17 aa, Homo sapiens
  heavy chain complementarity determining region 3 for antibody 37420
AKSSVWLNNYSYYGLDL

SEQ ID NO: 74841 - protein, 9 aa, Homo sapiens
  light chain complementarity determining region 3 for antibody 37421
QQYGSSPFT

SEQ ID NO: 74842 - protein, 17 aa, Homo sapiens
  heavy chain complementarity determining region 3 for antibody 37421
AKSRVWLNNYYYYGLDL

SEQ ID NO: 74843 - protein, 9 aa, Homo sapiens
  light chain complementarity determining region 3 for antibody 37422
QQYGSSPFT

SEQ ID NO: 74844 - protein, 18 aa, Homo sapiens
  heavy chain complementarity determining region 3 for antibody 37422
AARGANCGGDCYYWYFDL

SEQ ID NO: 74845 - protein, 9 aa, Homo sapiens
  light chain complementarity determining region 3 for antibody 37423
QQYGSSPFP

SEQ ID NO: 74846 - protein, 19 aa, Homo sapiens
  heavy chain complementarity determining region 3 for antibody 37423
ARSPSWFGEHRGRGNWFDP

SEQ ID NO: 74847 - protein, 9 aa, Homo sapiens
  light chain complementarity determining region 3 for antibody 37424
QQYGSSPFA

SEQ ID NO: 74848 - protein, 18 aa, Homo sapiens
  heavy chain complementarity determining region 3 for antibody 37424
VRGGRHESSGYYYVPFDY

SEQ ID NO: 74849 - protein, 9 aa, Homo sapiens
  light chain complementarity determining region 3 for antibody 37425
QQYGSSPFA

SEQ ID NO: 74850 - protein, 18 aa, Homo sapiens
  heavy chain complementarity determining region 3 for antibody 37425
VRGGRHDSSGYYYGPFDY

SEQ ID NO: 74851 - protein, 9 aa, Homo sapiens
  light chain complementarity determining region 3 for antibody 37426
QQYGSSPDT

SEQ ID NO: 74852 - protein, 14 aa, Homo sapiens
  heavy chain complementarity determining region 3 for antibody 37426
ASAYGSGSYYPFDY

SEQ ID NO: 74853 - protein, 9 aa, Homo sapiens
  light chain complementarity determining region 3 for antibody 37427
QQYGSSPDT

SEQ ID NO: 74854 - protein, 14 aa, Homo sapiens
  heavy chain complementarity determining region 3 for antibody 37427
ARGGNYGSGSYLHY

SEQ ID NO: 74855 - protein, 9 aa, Homo sapiens
  light chain complementarity determining region 3 for antibody 37428
QQYGSSPCA

SEQ ID NO: 74856 - protein, 18 aa, Homo sapiens
  heavy chain complementarity determining region 3 for antibody 37428
VRGGRHDSSGYYYVPFDY

SEQ ID NO: 74857 - protein, 9 aa, Homo sapiens
  light chain complementarity determining region 3 for antibody 37429
QQYGSSPAT

SEQ ID NO: 74858 - protein, 15 aa, Homo sapiens
  heavy chain complementarity determining region 3 for antibody 37429
ARDLGDDFFHYGMDV

SEQ ID NO: 74859 - protein, 9 aa, Homo sapiens
  light chain complementarity determining region 3 for antibody 37430
QQYGSSLYI

SEQ ID NO: 74860 - protein, 16 aa, Homo sapiens
  heavy chain complementarity determining region 3 for antibody 37430
ARAKHYGDYYYYGMDA

SEQ ID NO: 74861 - protein, 9 aa, Homo sapiens
  light chain complementarity determining region 3 for antibody 37431
QQYGSSLWT

SEQ ID NO: 74862 - protein, 17 aa, Homo sapiens
  heavy chain complementarity determining region 3 for antibody 37431
ARDGWYDSSMCFDGFDI

SEQ ID NO: 74863 - protein, 9 aa, Homo sapiens
  light chain complementarity determining region 3 for antibody 37432
QQYGSSLVT

SEQ ID NO: 74864 - protein, 16 aa, Homo sapiens
  heavy chain complementarity determining region 3 for antibody 37432
TTDWGSGYYWIRAFDL

SEQ ID NO: 74865 - protein, 11 aa, Homo sapiens
  light chain complementarity determining region 3 for antibody 37433
QQYGSSLRTWT

SEQ ID NO: 74866 - protein, 16 aa, Homo sapiens
  heavy chain complementarity determining region 3 for antibody 37433
ARARGRWLQAGAAFDC

SEQ ID NO: 74867 - protein, 9 aa, Homo sapiens
  light chain complementarity determining region 3 for antibody 37434
QQYGSSLRT

SEQ ID NO: 74868 - protein, 21 aa, Homo sapiens
  heavy chain complementarity determining region 3 for antibody 37434
ARGPTTKYVFGSGSYGKCLDS

SEQ ID NO: 74869 - protein, 9 aa, Homo sapiens
  light chain complementarity determining region 3 for antibody 37435
QQYGSSLRT

SEQ ID NO: 74870 - protein, 21 aa, Homo sapiens
  heavy chain complementarity determining region 3 for antibody 37435
ARGPTTKCVFGSGSYGKYLDS

SEQ ID NO: 74871 - protein, 9 aa, Homo sapiens
  light chain complementarity determining region 3 for antibody 37436
QQYGSSLRT

SEQ ID NO: 74872 - protein, 17 aa, Homo sapiens
  heavy chain complementarity determining region 3 for antibody 37436
ARALDIVVVVDAIWFDP

SEQ ID NO: 74873 - protein, 9 aa, Homo sapiens
  light chain complementarity determining region 3 for antibody 37437
QQYGSSLRP

SEQ ID NO: 74874 - protein, 21 aa, Homo sapiens
  heavy chain complementarity determining region 3 for antibody 37437
ARGPTTKYVFGSGSYGKYLDS

SEQ ID NO: 74875 - protein, 9 aa, Homo sapiens
  light chain complementarity determining region 3 for antibody 37438
QQYGSSLRK

SEQ ID NO: 74876 - protein, 21 aa, Homo sapiens
  heavy chain complementarity determining region 3 for antibody 37438
ARGPTTKYVFGSGSYGKYLDS

SEQ ID NO: 74877 - protein, 8 aa, Homo sapiens
  light chain complementarity determining region 3 for antibody 37439
QQYGSSLP

SEQ ID NO: 74878 - protein, 13 aa, Homo sapiens
  heavy chain complementarity determining region 3 for antibody 37439
ARVHYSSREAVDY

SEQ ID NO: 74879 - protein, 9 aa, Homo sapiens
  light chain complementarity determining region 3 for antibody 37440
QQYGSSLIT

SEQ ID NO: 74880 - protein, 13 aa, Homo sapiens
  heavy chain complementarity determining region 3 for antibody 37440
ARGSGSHQGEFDY

SEQ ID NO: 74881 - protein, 9 aa, Homo sapiens
  light chain complementarity determining region 3 for antibody 37441
QQYGSSLIT

SEQ ID NO: 74882 - protein, 13 aa, Homo sapiens
  heavy chain complementarity determining region 3 for antibody 37441
ARGAGSHQDEFDY

SEQ ID NO: 74883 - protein, 9 aa, Homo sapiens
  light chain complementarity determining region 3 for antibody 37442
QQYGSSLIP

SEQ ID NO: 74884 - protein, 13 aa, Homo sapiens
  heavy chain complementarity determining region 3 for antibody 37442
ARGSGSHQDEFDY

SEQ ID NO: 74885 - protein, 9 aa, Homo sapiens
  light chain complementarity determining region 3 for antibody 37443
QQYGSSLFT

SEQ ID NO: 74886 - protein, 16 aa, Homo sapiens
  heavy chain complementarity determining region 3 for antibody 37443
ARAKHYGDYYYYGMDA

SEQ ID NO: 74887 - protein, 9 aa, Homo sapiens
  light chain complementarity determining region 3 for antibody 37444
QQYGSSLCT

SEQ ID NO: 74888 - protein, 16 aa, Homo sapiens
  heavy chain complementarity determining region 3 for antibody 37444
ARAKHYGDYYYYGMDA

SEQ ID NO: 74889 - protein, 9 aa, Homo sapiens
  light chain complementarity determining region 3 for antibody 37445
QQYGSSIVT

SEQ ID NO: 74890 - protein, 16 aa, Homo sapiens
  heavy chain complementarity determining region 3 for antibody 37445
TTDWGSGYCWIRAFDL

SEQ ID NO: 74891 - protein, 9 aa, Homo sapiens
  light chain complementarity determining region 3 for antibody 37446
QQYGSSIVT

SEQ ID NO: 74892 - protein, 16 aa, Homo sapiens
  heavy chain complementarity determining region 3 for antibody 37446
TTDCGSGYYWIRAFDL

SEQ ID NO: 74893 - protein, 9 aa, Homo sapiens
  light chain complementarity determining region 3 for antibody 37447
QQYGSSIVT

SEQ ID NO: 74894 - protein, 16 aa, Homo sapiens
  heavy chain complementarity determining region 3 for antibody 37447
STDWGSGYYWIRAFDL

SEQ ID NO: 74895 - protein, 9 aa, Homo sapiens
  light chain complementarity determining region 3 for antibody 37448
QQYGSSIRT

SEQ ID NO: 74896 - protein, 21 aa, Homo sapiens
  heavy chain complementarity determining region 3 for antibody 37448
ARGPTTKYVFGSGSYGKYLDS

SEQ ID NO: 74897 - protein, 9 aa, Homo sapiens
  light chain complementarity determining region 3 for antibody 37449
QQYGSSIGT

SEQ ID NO: 74898 - protein, 16 aa, Homo sapiens
  heavy chain complementarity determining region 3 for antibody 37449
TTDWGSGYYWIRAFDL

SEQ ID NO: 74899 - protein, 9 aa, Homo sapiens
  light chain complementarity determining region 3 for antibody 37450
QQYGSSHRT

SEQ ID NO: 74900 - protein, 17 aa, Homo sapiens
  heavy chain complementarity determining region 3 for antibody 37450
ARALDIVVVVDAIWFDP

SEQ ID NO: 74901 - protein, 9 aa, Homo sapiens
  light chain complementarity determining region 3 for antibody 37451
QQYGSSHQT

SEQ ID NO: 74902 - protein, 14 aa, Homo sapiens
  heavy chain complementarity determining region 3 for antibody 37451
TRDPIPYSSWYFDL

SEQ ID NO: 74903 - protein, 9 aa, Homo sapiens
  light chain complementarity determining region 3 for antibody 37452
QQYGSSHLT

SEQ ID NO: 74904 - protein, 12 aa, Homo sapiens
  heavy chain complementarity determining region 3 for antibody 37452
ARSPYSGIDFDS

SEQ ID NO: 74905 - protein, 9 aa, Homo sapiens
  light chain complementarity determining region 3 for antibody 37453
QQYGSSFYR

SEQ ID NO: 74906 - protein, 14 aa, Homo sapiens
  heavy chain complementarity determining region 3 for antibody 37453
ARVGTYSYGEMFDY

SEQ ID NO: 74907 - protein, 8 aa, Homo sapiens
  light chain complementarity determining region 3 for antibody 37454
QQYGSSFT

SEQ ID NO: 74908 - protein, 16 aa, Homo sapiens
  heavy chain complementarity determining region 3 for antibody 37454
ARGPGVGVAGATYCDS

SEQ ID NO: 74909 - protein, 9 aa, Homo sapiens
  light chain complementarity determining region 3 for antibody 37455
QQYGSSFRT

SEQ ID NO: 74910 - protein, 21 aa, Homo sapiens
  heavy chain complementarity determining region 3 for antibody 37455
ARGPTTKYVFGSGSYGKYLDS

SEQ ID NO: 74911 - protein, 8 aa, Homo sapiens
  light chain complementarity determining region 3 for antibody 37456
QQYGSSDT

SEQ ID NO: 74912 - protein, 20 aa, Homo sapiens
  heavy chain complementarity determining region 3 for antibody 37456
ARDLRVRGVIGPSIRGSFDI

SEQ ID NO: 74913 - protein, 9 aa, Homo sapiens
  light chain complementarity determining region 3 for antibody 37457
QQYGSSAST

SEQ ID NO: 74914 - protein, 17 aa, Homo sapiens
  heavy chain complementarity determining region 3 for antibody 37457
ARGVWAGVNLPEGYFDY

SEQ ID NO: 74915 - protein, 10 aa, Homo sapiens
  light chain complementarity determining region 3 for antibody 37458
QQYGSSAMYS

SEQ ID NO: 74916 - protein, 11 aa, Homo sapiens
  heavy chain complementarity determining region 3 for antibody 37458
ARGGQWGSLDY

SEQ ID NO: 74917 - protein, 9 aa, Homo sapiens
  light chain complementarity determining region 3 for antibody 37459
QQYGSSADT

SEQ ID NO: 74918 - protein, 17 aa, Homo sapiens
  heavy chain complementarity determining region 3 for antibody 37459
ARGVWAGVNLPEGYFDY

SEQ ID NO: 74919 - protein, 9 aa, Homo sapiens
  light chain complementarity determining region 3 for antibody 37460
QQYGSPTRT

SEQ ID NO: 74920 - protein, 14 aa, Homo sapiens
  heavy chain complementarity determining region 3 for antibody 37460
AGGNFCGYDCYSEY

SEQ ID NO: 74921 - protein, 8 aa, Homo sapiens
  light chain complementarity determining region 3 for antibody 37461
QQYGSPPT

SEQ ID NO: 74922 - protein, 23 aa, Homo sapiens
  heavy chain complementarity determining region 3 for antibody 37461
ARPKRHYYDSSGYYSSALDAFDI

SEQ ID NO: 74923 - protein, 9 aa, Homo sapiens
  light chain complementarity determining region 3 for antibody 37462
QQYGSPPST

SEQ ID NO: 74924 - protein, 13 aa, Homo sapiens
  heavy chain complementarity determining region 3 for antibody 37462
ARDGQWLVRYFDY

SEQ ID NO: 74925 - protein, 9 aa, Homo sapiens
  light chain complementarity determining region 3 for antibody 37463
QQYGSPPRT

SEQ ID NO: 74926 - protein, 14 aa, Homo sapiens
  heavy chain complementarity determining region 3 for antibody 37463
AGGNVCGYDCYSEY

SEQ ID NO: 74927 - protein, 9 aa, Homo sapiens
  light chain complementarity determining region 3 for antibody 37464
QQYGSPPRT

SEQ ID NO: 74928 - protein, 14 aa, Homo sapiens
  heavy chain complementarity determining region 3 for antibody 37464
AGGNSCGYDCYSEY

SEQ ID NO: 74929 - protein, 9 aa, Homo sapiens
  light chain complementarity determining region 3 for antibody 37465
QQYGSPPRT

SEQ ID NO: 74930 - protein, 14 aa, Homo sapiens
  heavy chain complementarity determining region 3 for antibody 37465
AGGNFCGYDCYREY

SEQ ID NO: 74931 - protein, 9 aa, Homo sapiens
  light chain complementarity determining region 3 for antibody 37466
QQYGSPPRT

SEQ ID NO: 74932 - protein, 6 aa, Homo sapiens
  heavy chain complementarity determining region 3 for antibody 37466
ADIFAL

SEQ ID NO: 74933 - protein, 9 aa, Homo sapiens
  light chain complementarity determining region 3 for antibody 37467
QQYGSPPRP

SEQ ID NO: 74934 - protein, 14 aa, Homo sapiens
  heavy chain complementarity determining region 3 for antibody 37467
AGGNFCGYDCYSEY

SEQ ID NO: 74935 - protein, 9 aa, Homo sapiens
  light chain complementarity determining region 3 for antibody 37468
QQYGSPPRM

SEQ ID NO: 74936 - protein, 14 aa, Homo sapiens
  heavy chain complementarity determining region 3 for antibody 37468
AGGNFCGYDCYSEY

SEQ ID NO: 74937 - protein, 9 aa, Homo sapiens
  light chain complementarity determining region 3 for antibody 37469
QQYGSPPRK

SEQ ID NO: 74938 - protein, 17 aa, Homo sapiens
  heavy chain complementarity determining region 3 for antibody 37469
ARALDIVVVVDAIWFDP

SEQ ID NO: 74939 - protein, 9 aa, Homo sapiens
  light chain complementarity determining region 3 for antibody 37470
QQYGSPPGT

SEQ ID NO: 74940 - protein, 10 aa, Homo sapiens
  heavy chain complementarity determining region 3 for antibody 37470
GGGGGWYSPN

SEQ ID NO: 74941 - protein, 6 aa, Homo sapiens
  light chain complementarity determining region 3 for antibody 37471
QQYGSP

SEQ ID NO: 74942 - protein, 15 aa, Homo sapiens
  heavy chain complementarity determining region 3 for antibody 37471
ARGGLDGDYEDAFDI

SEQ ID NO: 74943 - protein, 9 aa, Homo sapiens
  light chain complementarity determining region 3 for antibody 37472
QQYGSLPVT

SEQ ID NO: 74944 - protein, 15 aa, Homo sapiens
  heavy chain complementarity determining region 3 for antibody 37472
AHRPNYYDKAGAFDI

SEQ ID NO: 74945 - protein, 10 aa, Homo sapiens
  light chain complementarity determining region 3 for antibody 37473
QQYGSLPTWT

SEQ ID NO: 74946 - protein, 15 aa, Homo sapiens
  heavy chain complementarity determining region 3 for antibody 37473
TRDLLDSGGAYFADH

SEQ ID NO: 74947 - protein, 9 aa, Homo sapiens
  light chain complementarity determining region 3 for antibody 37474
QQYGSLPTT

SEQ ID NO: 74948 - protein, 15 aa, Homo sapiens
  heavy chain complementarity determining region 3 for antibody 37474
SRDLLWFGPTSAFDF

SEQ ID NO: 74949 - protein, 9 aa, Homo sapiens
  light chain complementarity determining region 3 for antibody 37475
QQYGSLPST

SEQ ID NO: 74950 - protein, 15 aa, Homo sapiens
  heavy chain complementarity determining region 3 for antibody 37475
AHRPNYYDKAGAFDI

SEQ ID NO: 74951 - protein, 8 aa, Homo sapiens
  light chain complementarity determining region 3 for antibody 37476
QQYGSLPS

SEQ ID NO: 74952 - protein, 20 aa, Homo sapiens
  heavy chain complementarity determining region 3 for antibody 37476
ARDQAYFYALGSSGVDWLDP

SEQ ID NO: 74953 - protein, 9 aa, Homo sapiens
  light chain complementarity determining region 3 for antibody 37477
QQYGSLPRT

SEQ ID NO: 74954 - protein, 13 aa, Homo sapiens
  heavy chain complementarity determining region 3 for antibody 37477
AGGQFDNTGYKEY

SEQ ID NO: 74955 - protein, 9 aa, Homo sapiens
  light chain complementarity determining region 3 for antibody 37478
QQYGSLPRT

SEQ ID NO: 74956 - protein, 14 aa, Homo sapiens
  heavy chain complementarity determining region 3 for antibody 37478
AGGDFCGSDCYSEY

SEQ ID NO: 74957 - protein, 10 aa, Homo sapiens
  light chain complementarity determining region 3 for antibody 37479
QQYGSLPPLT

SEQ ID NO: 74958 - protein, 18 aa, Homo sapiens
  heavy chain complementarity determining region 3 for antibody 37479
ARGGYDYGWGSYGVYFDY

SEQ ID NO: 74959 - protein, 10 aa, Homo sapiens
  light chain complementarity determining region 3 for antibody 37480
QQYGSLPMYS

SEQ ID NO: 74960 - protein, 11 aa, Homo sapiens
  heavy chain complementarity determining region 3 for antibody 37480
ARGGQWGSLDY

SEQ ID NO: 74961 - protein, 9 aa, Homo sapiens
  light chain complementarity determining region 3 for antibody 37481
QQYGSLPLT

SEQ ID NO: 74962 - protein, 15 aa, Homo sapiens
  heavy chain complementarity determining region 3 for antibody 37481
AHRPNDYDKAGAFDI

SEQ ID NO: 74963 - protein, 9 aa, Homo sapiens
  light chain complementarity determining region 3 for antibody 37482
QQYGSLPLT

SEQ ID NO: 74964 - protein, 15 aa, Homo sapiens
  heavy chain complementarity determining region 3 for antibody 37482
AHRPNCYDKAGAFDI

SEQ ID NO: 74965 - protein, 9 aa, Homo sapiens
  light chain complementarity determining region 3 for antibody 37483
QQYGSLPLN

SEQ ID NO: 74966 - protein, 15 aa, Homo sapiens
  heavy chain complementarity determining region 3 for antibody 37483
AHRPNYYDKAGAFDI

SEQ ID NO: 74967 - protein, 9 aa, Homo sapiens
  light chain complementarity determining region 3 for antibody 37484
QQYGSLPLA

SEQ ID NO: 74968 - protein, 15 aa, Homo sapiens
  heavy chain complementarity determining region 3 for antibody 37484
AHRPNYYDKAGAFDI

SEQ ID NO: 74969 - protein, 10 aa, Homo sapiens
  light chain complementarity determining region 3 for antibody 37485
QQYGSLPAWP

SEQ ID NO: 74970 - protein, 19 aa, Homo sapiens
  heavy chain complementarity determining region 3 for antibody 37485
ARGDGVRSGEFYYYQGLDV

SEQ ID NO: 74971 - protein, 10 aa, Homo sapiens
  light chain complementarity determining region 3 for antibody 37486
QQYGSLPAGT

SEQ ID NO: 74972 - protein, 19 aa, Homo sapiens
  heavy chain complementarity determining region 3 for antibody 37486
ARGDGVRSGEFYYYQGLDV

SEQ ID NO: 74973 - protein, 9 aa, Homo sapiens
  light chain complementarity determining region 3 for antibody 37487
QQYGSLLYT

SEQ ID NO: 74974 - protein, 16 aa, Homo sapiens
  heavy chain complementarity determining region 3 for antibody 37487
ARAKHYGDYYYYGMDA

SEQ ID NO: 74975 - protein, 9 aa, Homo sapiens
  light chain complementarity determining region 3 for antibody 37488
QQYGSLLLT

SEQ ID NO: 74976 - protein, 15 aa, Homo sapiens
  heavy chain complementarity determining region 3 for antibody 37488
AHRPNYYDKAGAFDI

SEQ ID NO: 74977 - protein, 9 aa, Homo sapiens
  light chain complementarity determining region 3 for antibody 37489
QQYGSIPRT

SEQ ID NO: 74978 - protein, 13 aa, Homo sapiens
  heavy chain complementarity determining region 3 for antibody 37489
ALGHYHTTGHSEF

SEQ ID NO: 74979 - protein, 9 aa, Homo sapiens
  light chain complementarity determining region 3 for antibody 37490
QQYGSIPRT

SEQ ID NO: 74980 - protein, 13 aa, Homo sapiens
  heavy chain complementarity determining region 3 for antibody 37490
ALGHYHTPGYSEF

SEQ ID NO: 74981 - protein, 9 aa, Homo sapiens
  light chain complementarity determining region 3 for antibody 37491
QQYGSIPRS

SEQ ID NO: 74982 - protein, 13 aa, Homo sapiens
  heavy chain complementarity determining region 3 for antibody 37491
AGGTWHSGIYFDS

SEQ ID NO: 74983 - protein, 9 aa, Homo sapiens
  light chain complementarity determining region 3 for antibody 37492
QQYGSIPRS

SEQ ID NO: 74984 - protein, 13 aa, Homo sapiens
  heavy chain complementarity determining region 3 for antibody 37492
AGGSWHSGIYYES

SEQ ID NO: 74985 - protein, 9 aa, Homo sapiens
  light chain complementarity determining region 3 for antibody 37493
QQYGSIPRK

SEQ ID NO: 74986 - protein, 13 aa, Homo sapiens
  heavy chain complementarity determining region 3 for antibody 37493
AGGIFDSSGYGEY

SEQ ID NO: 74987 - protein, 9 aa, Homo sapiens
  light chain complementarity determining region 3 for antibody 37494
QQYGSIPRF

SEQ ID NO: 74988 - protein, 13 aa, Homo sapiens
  heavy chain complementarity determining region 3 for antibody 37494
AGGTWHSGIYYES

SEQ ID NO: 74989 - protein, 9 aa, Homo sapiens
  light chain complementarity determining region 3 for antibody 37495
QQYGSIPLS

SEQ ID NO: 74990 - protein, 13 aa, Homo sapiens
  heavy chain complementarity determining region 3 for antibody 37495
AGGTWHSGIYYES

SEQ ID NO: 74991 - protein, 9 aa, Homo sapiens
  light chain complementarity determining region 3 for antibody 37496
QQYGSILRS

SEQ ID NO: 74992 - protein, 13 aa, Homo sapiens
  heavy chain complementarity determining region 3 for antibody 37496
AGGTWHSGIYYES

SEQ ID NO: 74993 - protein, 9 aa, Homo sapiens
  light chain complementarity determining region 3 for antibody 37497
QQYGSFPPT

SEQ ID NO: 74994 - protein, 17 aa, Homo sapiens
  heavy chain complementarity determining region 3 for antibody 37497
ARGLMERWLVPLYHFDL

SEQ ID NO: 74995 - protein, 9 aa, Homo sapiens
  light chain complementarity determining region 3 for antibody 37498
QQYGSEPRT

SEQ ID NO: 74996 - protein, 25 aa, Homo sapiens
  heavy chain complementarity determining region 3 for antibody 37498
ARLRIDRLRLPGAMRGPLYDCGLNV

SEQ ID NO: 74997 - protein, 9 aa, Homo sapiens
  light chain complementarity determining region 3 for antibody 37499
QQYGSAPRT

SEQ ID NO: 74998 - protein, 17 aa, Homo sapiens
  heavy chain complementarity determining region 3 for antibody 37499
ARALDIVVVVDAIWFDP

SEQ ID NO: 74999 - protein, 9 aa, Homo sapiens
  light chain complementarity determining region 3 for antibody 37500
QQYGRTTLT

SEQ ID NO: 75000 - protein, 15 aa, Homo sapiens
  heavy chain complementarity determining region 3 for antibody 37500
ARGPHPPYYGGFFHR

SEQ ID NO: 75001 - protein, 9 aa, Homo sapiens
  light chain complementarity determining region 3 for antibody 37501
QQYGRTPRK

SEQ ID NO: 75002 - protein, 14 aa, Homo sapiens
  heavy chain complementarity determining region 3 for antibody 37501
AGGDFCGADCYSDY

SEQ ID NO: 75003 - protein, 9 aa, Homo sapiens
  light chain complementarity determining region 3 for antibody 37502
QQYGRTHRT

SEQ ID NO: 75004 - protein, 14 aa, Homo sapiens
  heavy chain complementarity determining region 3 for antibody 37502
AGGDCCGADCYSEY

SEQ ID NO: 75005 - protein, 10 aa, Homo sapiens
  light chain complementarity determining region 3 for antibody 37503
QQYGRSTGYT

SEQ ID NO: 75006 - protein, 11 aa, Homo sapiens
  heavy chain complementarity determining region 3 for antibody 37503
ASDHSGWSLYY

SEQ ID NO: 75007 - protein, 9 aa, Homo sapiens
  light chain complementarity determining region 3 for antibody 37504
QQYGRSSRT

SEQ ID NO: 75008 - protein, 19 aa, Homo sapiens
  heavy chain complementarity determining region 3 for antibody 37504
ARDRIVVGATFYSYSGMDV

SEQ ID NO: 75009 - protein, 10 aa, Homo sapiens
  light chain complementarity determining region 3 for antibody 37505
QQYGRSSMYT

SEQ ID NO: 75010 - protein, 19 aa, Homo sapiens
  heavy chain complementarity determining region 3 for antibody 37505
AKDQLMFYYDNSGYPGADY

SEQ ID NO: 75011 - protein, 9 aa, Homo sapiens
  light chain complementarity determining region 3 for antibody 37506
QQYGRSSLT

SEQ ID NO: 75012 - protein, 19 aa, Homo sapiens
  heavy chain complementarity determining region 3 for antibody 37506
ARDRRVVGATFYSYSGMDV

SEQ ID NO: 75013 - protein, 9 aa, Homo sapiens
  light chain complementarity determining region 3 for antibody 37507
QQYGRSSLT

SEQ ID NO: 75014 - protein, 19 aa, Homo sapiens
  heavy chain complementarity determining region 3 for antibody 37507
ARDRIVVGATFYSYAGMDV

SEQ ID NO: 75015 - protein, 9 aa, Homo sapiens
  light chain complementarity determining region 3 for antibody 37508
QQYGRSSLT

SEQ ID NO: 75016 - protein, 19 aa, Homo sapiens
  heavy chain complementarity determining region 3 for antibody 37508
ARDRIVVGATFYSDSGMDV

SEQ ID NO: 75017 - protein, 9 aa, Homo sapiens
  light chain complementarity determining region 3 for antibody 37509
QQYGRSSLT

SEQ ID NO: 75018 - protein, 19 aa, Homo sapiens
  heavy chain complementarity determining region 3 for antibody 37509
ARDRIVVGATFCSYSGMDV

SEQ ID NO: 75019 - protein, 9 aa, Homo sapiens
  light chain complementarity determining region 3 for antibody 37510
QQYGRSSLI

SEQ ID NO: 75020 - protein, 19 aa, Homo sapiens
  heavy chain complementarity determining region 3 for antibody 37510
ARDRIVVGATFYSYSGMDV

SEQ ID NO: 75021 - protein, 9 aa, Homo sapiens
  light chain complementarity determining region 3 for antibody 37511
QQYGRSSFT

SEQ ID NO: 75022 - protein, 19 aa, Homo sapiens
  heavy chain complementarity determining region 3 for antibody 37511
ARDRIVVGATFYSYSGMDV

SEQ ID NO: 75023 - protein, 9 aa, Homo sapiens
  light chain complementarity determining region 3 for antibody 37512
QQYGRSPYT

SEQ ID NO: 75024 - protein, 14 aa, Homo sapiens
  heavy chain complementarity determining region 3 for antibody 37512
ARHSGYHYGSNLDY

SEQ ID NO: 75025 - protein, 9 aa, Homo sapiens
  light chain complementarity determining region 3 for antibody 37513
QQYGRSPWT

SEQ ID NO: 75026 - protein, 19 aa, Homo sapiens
  heavy chain complementarity determining region 3 for antibody 37513
VRERYYYDSRGKRNGGLDV

SEQ ID NO: 75027 - protein, 9 aa, Homo sapiens
  light chain complementarity determining region 3 for antibody 37514
QQYGRSPWT

SEQ ID NO: 75028 - protein, 14 aa, Homo sapiens
  heavy chain complementarity determining region 3 for antibody 37514
ARGGQSYPNGYFDL

SEQ ID NO: 75029 - protein, 9 aa, Homo sapiens
  light chain complementarity determining region 3 for antibody 37515
QQYGRSPWT

SEQ ID NO: 75030 - protein, 15 aa, Homo sapiens
  heavy chain complementarity determining region 3 for antibody 37515
AKDGPYCGGDCYFDS

SEQ ID NO: 75031 - protein, 10 aa, Homo sapiens
  light chain complementarity determining region 3 for antibody 37516
QQYGRSPWGG

SEQ ID NO: 75032 - protein, 17 aa, Homo sapiens
  heavy chain complementarity determining region 3 for antibody 37516
AKDYGTVTKELVGYLDY

SEQ ID NO: 75033 - protein, 10 aa, Homo sapiens
  light chain complementarity determining region 3 for antibody 37517
QQYGRSPWGG

SEQ ID NO: 75034 - protein, 17 aa, Homo sapiens
  heavy chain complementarity determining region 3 for antibody 37517
AKDYGTVTKDLVGYLDY

SEQ ID NO: 75035 - protein, 10 aa, Homo sapiens
  light chain complementarity determining region 3 for antibody 37518
QQYGRSPTWT

SEQ ID NO: 75036 - protein, 15 aa, Homo sapiens
  heavy chain complementarity determining region 3 for antibody 37518
TRDLLDSGGAYFADH

SEQ ID NO: 75037 - protein, 8 aa, Homo sapiens
  light chain complementarity determining region 3 for antibody 37519
QQYGRSPT

SEQ ID NO: 75038 - protein, 11 aa, Homo sapiens
  heavy chain complementarity determining region 3 for antibody 37519
VRNGVRGANDY

SEQ ID NO: 75039 - protein, 9 aa, Homo sapiens
  light chain complementarity determining region 3 for antibody 37520
QQYGRSPTT

SEQ ID NO: 75040 - protein, 17 aa, Homo sapiens
  heavy chain complementarity determining region 3 for antibody 37520
ARDLGTYDATRHWYFDL

SEQ ID NO: 75041 - protein, 8 aa, Homo sapiens
  light chain complementarity determining region 3 for antibody 37521
QQYGRSPT

SEQ ID NO: 75042 - protein, 17 aa, Homo sapiens
  heavy chain complementarity determining region 3 for antibody 37521
ARGYDSSGYYYENAFDI

SEQ ID NO: 75043 - protein, 8 aa, Homo sapiens
  light chain complementarity determining region 3 for antibody 37522
QQYGRSPT

SEQ ID NO: 75044 - protein, 21 aa, Homo sapiens
  heavy chain complementarity determining region 3 for antibody 37522
ARERERYFDWSRRDYYYALDV

SEQ ID NO: 75045 - protein, 9 aa, Homo sapiens
  light chain complementarity determining region 3 for antibody 37523
QQYGRSPST

SEQ ID NO: 75046 - protein, 13 aa, Homo sapiens
  heavy chain complementarity determining region 3 for antibody 37523
ARDGQWLVRYFDY

SEQ ID NO: 75047 - protein, 9 aa, Homo sapiens
  light chain complementarity determining region 3 for antibody 37524
QQYGRSPRT

SEQ ID NO: 75048 - protein, 15 aa, Homo sapiens
  heavy chain complementarity determining region 3 for antibody 37524
AKDGPYCGGDCYFDA

SEQ ID NO: 75049 - protein, 9 aa, Homo sapiens
  light chain complementarity determining region 3 for antibody 37525
QQYGRSPRT

SEQ ID NO: 75050 - protein, 15 aa, Homo sapiens
  heavy chain complementarity determining region 3 for antibody 37525
AKDGPDCGGDCYFDS

SEQ ID NO: 75051 - protein, 10 aa, Homo sapiens
  light chain complementarity determining region 3 for antibody 37526
QQYGRSPRGA

SEQ ID NO: 75052 - protein, 17 aa, Homo sapiens
  heavy chain complementarity determining region 3 for antibody 37526
AKDYGTVTKDLVGYLDY

SEQ ID NO: 75053 - protein, 9 aa, Homo sapiens
  light chain complementarity determining region 3 for antibody 37527
QQYGRSPQT

SEQ ID NO: 75054 - protein, 15 aa, Homo sapiens
  heavy chain complementarity determining region 3 for antibody 37527
ARRRIRFLEWRPFDY

SEQ ID NO: 75055 - protein, 10 aa, Homo sapiens
  light chain complementarity determining region 3 for antibody 37528
QQYGRSPPYT

SEQ ID NO: 75056 - protein, 18 aa, Homo sapiens
  heavy chain complementarity determining region 3 for antibody 37528
ATGKWFGDFNFYYYAMDV

SEQ ID NO: 75057 - protein, 10 aa, Homo sapiens
  light chain complementarity determining region 3 for antibody 37529
QQYGRSPPYT

SEQ ID NO: 75058 - protein, 23 aa, Homo sapiens
  heavy chain complementarity determining region 3 for antibody 37529
ARDYLRHYSFDSSDYPPLKTFYM

SEQ ID NO: 75059 - protein, 10 aa, Homo sapiens
  light chain complementarity determining region 3 for antibody 37530
QQYGRSPPWT

SEQ ID NO: 75060 - protein, 14 aa, Homo sapiens
  heavy chain complementarity determining region 3 for antibody 37530
ARGGSSGYNRQFDY

SEQ ID NO: 75061 - protein, 10 aa, Homo sapiens
  light chain complementarity determining region 3 for antibody 37531
QQYGRSPPWR

SEQ ID NO: 75062 - protein, 14 aa, Homo sapiens
  heavy chain complementarity determining region 3 for antibody 37531
ARGGSSGYNHQFDY

SEQ ID NO: 75063 - protein, 9 aa, Homo sapiens
  light chain complementarity determining region 3 for antibody 37532
QQYGRSPIT

SEQ ID NO: 75064 - protein, 12 aa, Homo sapiens
  heavy chain complementarity determining region 3 for antibody 37532
AKWDGNNWHWDF

SEQ ID NO: 75065 - protein, 9 aa, Homo sapiens
  light chain complementarity determining region 3 for antibody 37533
QQYGRSPGT

SEQ ID NO: 75066 - protein, 19 aa, Homo sapiens
  heavy chain complementarity determining region 3 for antibody 37533
VRERYYYDSRGKRNGGMDV

SEQ ID NO: 75067 - protein, 9 aa, Homo sapiens
  light chain complementarity determining region 3 for antibody 37534
QQYGRSPGT

SEQ ID NO: 75068 - protein, 10 aa, Homo sapiens
  heavy chain complementarity determining region 3 for antibody 37534
GGGGGWYSPN

SEQ ID NO: 75069 - protein, 9 aa, Homo sapiens
  light chain complementarity determining region 3 for antibody 37535
QQYGRSLRT

SEQ ID NO: 75070 - protein, 21 aa, Homo sapiens
  heavy chain complementarity determining region 3 for antibody 37535
ARGPTTKYVFGSGSYGKYLDS

SEQ ID NO: 75071 - protein, 8 aa, Homo sapiens
  light chain complementarity determining region 3 for antibody 37536
QQYGRSLN

SEQ ID NO: 75072 - protein, 17 aa, Homo sapiens
  heavy chain complementarity determining region 3 for antibody 37536
ARGYDSSGYYYENAFDI

SEQ ID NO: 75073 - protein, 9 aa, Homo sapiens
  light chain complementarity determining region 3 for antibody 37537
QQYGRSLIT

SEQ ID NO: 75074 - protein, 13 aa, Homo sapiens
  heavy chain complementarity determining region 3 for antibody 37537
ARGSGSHQDEFDY

SEQ ID NO: 75075 - protein, 9 aa, Homo sapiens
  light chain complementarity determining region 3 for antibody 37538
QQYGRPPWT

SEQ ID NO: 75076 - protein, 19 aa, Homo sapiens
  heavy chain complementarity determining region 3 for antibody 37538
VRERYYYDSRGKRNGGMDV

SEQ ID NO: 75077 - protein, 9 aa, Homo sapiens
  light chain complementarity determining region 3 for antibody 37539
QQYGRLPVT

SEQ ID NO: 75078 - protein, 11 aa, Homo sapiens
  heavy chain complementarity determining region 3 for antibody 37539
AHRFRTYYFDH

SEQ ID NO: 75079 - protein, 9 aa, Homo sapiens
  light chain complementarity determining region 3 for antibody 37540
QQYGRLPLT

SEQ ID NO: 75080 - protein, 11 aa, Homo sapiens
  heavy chain complementarity determining region 3 for antibody 37540
AHRFRTYYFDH

SEQ ID NO: 75081 - protein, 9 aa, Homo sapiens
  light chain complementarity determining region 3 for antibody 37541
QQYGRLPIT

SEQ ID NO: 75082 - protein, 11 aa, Homo sapiens
  heavy chain complementarity determining region 3 for antibody 37541
AHRFRTYYFDP

SEQ ID NO: 75083 - protein, 9 aa, Homo sapiens
  light chain complementarity determining region 3 for antibody 37542
QQYGRLHQT

SEQ ID NO: 75084 - protein, 13 aa, Homo sapiens
  heavy chain complementarity determining region 3 for antibody 37542
ARRLVIGRNAFDI

SEQ ID NO: 75085 - protein, 9 aa, Homo sapiens
  light chain complementarity determining region 3 for antibody 37543
QQYGRKPRT

SEQ ID NO: 75086 - protein, 14 aa, Homo sapiens
  heavy chain complementarity determining region 3 for antibody 37543
AGGDFCGADCYSEY

SEQ ID NO: 75087 - protein, 9 aa, Homo sapiens
  light chain complementarity determining region 3 for antibody 37544
QQYGRASLT

SEQ ID NO: 75088 - protein, 19 aa, Homo sapiens
  heavy chain complementarity determining region 3 for antibody 37544
ARDRIVVGATFYSYSGMDV

SEQ ID NO: 75089 - protein, 9 aa, Homo sapiens
  light chain complementarity determining region 3 for antibody 37545
QQYGPSPPN

SEQ ID NO: 75090 - protein, 13 aa, Homo sapiens
  heavy chain complementarity determining region 3 for antibody 37545
ASISVGTVAAGKG

SEQ ID NO: 75091 - protein, 9 aa, Homo sapiens
  light chain complementarity determining region 3 for antibody 37546
QQYGPSPLT

SEQ ID NO: 75092 - protein, 14 aa, Homo sapiens
  heavy chain complementarity determining region 3 for antibody 37546
ARDMFRGVPDYLDY

SEQ ID NO: 75093 - protein, 9 aa, Homo sapiens
  light chain complementarity determining region 3 for antibody 37547
QQYGPSPFT

SEQ ID NO: 75094 - protein, 14 aa, Homo sapiens
  heavy chain complementarity determining region 3 for antibody 37547
ARGGPAATSSSWLY

SEQ ID NO: 75095 - protein, 9 aa, Homo sapiens
  light chain complementarity determining region 3 for antibody 37548
QQYGPIPRT

SEQ ID NO: 75096 - protein, 15 aa, Homo sapiens
  heavy chain complementarity determining region 3 for antibody 37548
ARGEFYVSGSYYRED

SEQ ID NO: 75097 - protein, 9 aa, Homo sapiens
  light chain complementarity determining region 3 for antibody 37549
QQYGNSPWT

SEQ ID NO: 75098 - protein, 18 aa, Homo sapiens
  heavy chain complementarity determining region 3 for antibody 37549
ARVSGLRSNGDYVFVFEI

SEQ ID NO: 75099 - protein, 9 aa, Homo sapiens
  light chain complementarity determining region 3 for antibody 37550
QQYGNSPWR

SEQ ID NO: 75100 - protein, 18 aa, Homo sapiens
  heavy chain complementarity determining region 3 for antibody 37550
ARVSGLRSNGDYVFAFDI

SEQ ID NO: 75101 - protein, 9 aa, Homo sapiens
  light chain complementarity determining region 3 for antibody 37551
QQYGNSPRT

SEQ ID NO: 75102 - protein, 18 aa, Homo sapiens
  heavy chain complementarity determining region 3 for antibody 37551
ARVSGLRSNGDYVFAFEI

SEQ ID NO: 75103 - protein, 9 aa, Homo sapiens
  light chain complementarity determining region 3 for antibody 37552
QQYGNSPRT

SEQ ID NO: 75104 - protein, 25 aa, Homo sapiens
  heavy chain complementarity determining region 3 for antibody 37552
ARLRIDRLRLPGAMRGPLYDCGLNV

SEQ ID NO: 75105 - protein, 9 aa, Homo sapiens
  light chain complementarity determining region 3 for antibody 37553
QQYGNSPRT

SEQ ID NO: 75106 - protein, 15 aa, Homo sapiens
  heavy chain complementarity determining region 3 for antibody 37553
ARGVGTTGIVGYLDN

SEQ ID NO: 75107 - protein, 9 aa, Homo sapiens
  light chain complementarity determining region 3 for antibody 37554
QQYGNSPRT

SEQ ID NO: 75108 - protein, 15 aa, Homo sapiens
  heavy chain complementarity determining region 3 for antibody 37554
ARGVGTTGIFGCLDN

SEQ ID NO: 75109 - protein, 9 aa, Homo sapiens
  light chain complementarity determining region 3 for antibody 37555
QQYGNSPRT

SEQ ID NO: 75110 - protein, 16 aa, Homo sapiens
  heavy chain complementarity determining region 3 for antibody 37555
ARGTVYQGSSDNYHEN

SEQ ID NO: 75111 - protein, 9 aa, Homo sapiens
  light chain complementarity determining region 3 for antibody 37556
QQYGNSPRT

SEQ ID NO: 75112 - protein, 16 aa, Homo sapiens
  heavy chain complementarity determining region 3 for antibody 37556
ARGTLYQGSSDNYHEN

SEQ ID NO: 75113 - protein, 9 aa, Homo sapiens
  light chain complementarity determining region 3 for antibody 37557
QQYGNSPRT

SEQ ID NO: 75114 - protein, 16 aa, Homo sapiens
  heavy chain complementarity determining region 3 for antibody 37557
ARGTFYQGSSDNYLEN

SEQ ID NO: 75115 - protein, 9 aa, Homo sapiens
  light chain complementarity determining region 3 for antibody 37558
QQYGNSPRT

SEQ ID NO: 75116 - protein, 15 aa, Homo sapiens
  heavy chain complementarity determining region 3 for antibody 37558
ARGNYYGSGSYYRDD

SEQ ID NO: 75117 - protein, 9 aa, Homo sapiens
  light chain complementarity determining region 3 for antibody 37559
QQYGNSPRT

SEQ ID NO: 75118 - protein, 15 aa, Homo sapiens
  heavy chain complementarity determining region 3 for antibody 37559
AGGWFNYYSSGYYDT

SEQ ID NO: 75119 - protein, 9 aa, Homo sapiens
  light chain complementarity determining region 3 for antibody 37560
QQYGNSPRR

SEQ ID NO: 75120 - protein, 15 aa, Homo sapiens
  heavy chain complementarity determining region 3 for antibody 37560
ARGNYYGSGSYYRED

SEQ ID NO: 75121 - protein, 10 aa, Homo sapiens
  light chain complementarity determining region 3 for antibody 37561
QQYGNSPPST

SEQ ID NO: 75122 - protein, 13 aa, Homo sapiens
  heavy chain complementarity determining region 3 for antibody 37561
ASWSHSDLDAFDI

SEQ ID NO: 75123 - protein, 10 aa, Homo sapiens
  light chain complementarity determining region 3 for antibody 37562
QQYGNSPPLT

SEQ ID NO: 75124 - protein, 13 aa, Homo sapiens
  heavy chain complementarity determining region 3 for antibody 37562
ASWSHSDLDAFDI

SEQ ID NO: 75125 - protein, 10 aa, Homo sapiens
  light chain complementarity determining region 3 for antibody 37563
QQYGNSPPFT

SEQ ID NO: 75126 - protein, 13 aa, Homo sapiens
  heavy chain complementarity determining region 3 for antibody 37563
ASWSHSDLDAFDL

SEQ ID NO: 75127 - protein, 10 aa, Homo sapiens
  light chain complementarity determining region 3 for antibody 37564
QQYGNSPPFT

SEQ ID NO: 75128 - protein, 13 aa, Homo sapiens
  heavy chain complementarity determining region 3 for antibody 37564
ASWSHSALDAFDI

SEQ ID NO: 75129 - protein, 9 aa, Homo sapiens
  light chain complementarity determining region 3 for antibody 37565
QQYGNSPLT

SEQ ID NO: 75130 - protein, 15 aa, Homo sapiens
  heavy chain complementarity determining region 3 for antibody 37565
ARQKGQRASAGYFDS

SEQ ID NO: 75131 - protein, 9 aa, Homo sapiens
  light chain complementarity determining region 3 for antibody 37566
QQYGNSPLT

SEQ ID NO: 75132 - protein, 25 aa, Homo sapiens
  heavy chain complementarity determining region 3 for antibody 37566
ARDSYLGYYDDDGYYFPFNYFGMDV

SEQ ID NO: 75133 - protein, 9 aa, Homo sapiens
  light chain complementarity determining region 3 for antibody 37567
QQYGNSPLN

SEQ ID NO: 75134 - protein, 13 aa, Homo sapiens
  heavy chain complementarity determining region 3 for antibody 37567
ASISVGTVAAGKG

SEQ ID NO: 75135 - protein, 9 aa, Homo sapiens
  light chain complementarity determining region 3 for antibody 37568
QQYGNSPFT

SEQ ID NO: 75136 - protein, 15 aa, Homo sapiens
  heavy chain complementarity determining region 3 for antibody 37568
ARQKGQRASAGCFDS

SEQ ID NO: 75137 - protein, 9 aa, Homo sapiens
  light chain complementarity determining region 3 for antibody 37569
QQYGNSPFN

SEQ ID NO: 75138 - protein, 15 aa, Homo sapiens
  heavy chain complementarity determining region 3 for antibody 37569
ARQKGQRASAGYFDS

SEQ ID NO: 75139 - protein, 10 aa, Homo sapiens
  light chain complementarity determining region 3 for antibody 37570
QQYGNSLPFT

SEQ ID NO: 75140 - protein, 13 aa, Homo sapiens
  heavy chain complementarity determining region 3 for antibody 37570
ASWSHSDLDAFDI

SEQ ID NO: 75141 - protein, 10 aa, Homo sapiens
  light chain complementarity determining region 3 for antibody 37571
QQYGNPPPFT

SEQ ID NO: 75142 - protein, 13 aa, Homo sapiens
  heavy chain complementarity determining region 3 for antibody 37571
ASWSHSDLDAFDI

SEQ ID NO: 75143 - protein, 9 aa, Homo sapiens
  light chain complementarity determining region 3 for antibody 37572
QQYGNPPFT

SEQ ID NO: 75144 - protein, 15 aa, Homo sapiens
  heavy chain complementarity determining region 3 for antibody 37572
ARQKGQRASAGYFDS

SEQ ID NO: 75145 - protein, 9 aa, Homo sapiens
  light chain complementarity determining region 3 for antibody 37573
QQYGNLPST

SEQ ID NO: 75146 - protein, 13 aa, Homo sapiens
  heavy chain complementarity determining region 3 for antibody 37573
AGGNFHSGGYGEY

SEQ ID NO: 75147 - protein, 9 aa, Homo sapiens
  light chain complementarity determining region 3 for antibody 37574
QQYGNLPRT

SEQ ID NO: 75148 - protein, 13 aa, Homo sapiens
  heavy chain complementarity determining region 3 for antibody 37574
VGGNFHSGGYGEY

SEQ ID NO: 75149 - protein, 9 aa, Homo sapiens
  light chain complementarity determining region 3 for antibody 37575
QQYGNLPRT

SEQ ID NO: 75150 - protein, 13 aa, Homo sapiens
  heavy chain complementarity determining region 3 for antibody 37575
AGVNFHSGGYGEY

SEQ ID NO: 75151 - protein, 9 aa, Homo sapiens
  light chain complementarity determining region 3 for antibody 37576
QQYGNLPRT

SEQ ID NO: 75152 - protein, 13 aa, Homo sapiens
  heavy chain complementarity determining region 3 for antibody 37576
AGGNFYSGGYGEY

SEQ ID NO: 75153 - protein, 9 aa, Homo sapiens
  light chain complementarity determining region 3 for antibody 37577
QQYGNLPRT

SEQ ID NO: 75154 - protein, 13 aa, Homo sapiens
  heavy chain complementarity determining region 3 for antibody 37577
AGGLFHTSGYSEF

SEQ ID NO: 75155 - protein, 9 aa, Homo sapiens
  light chain complementarity determining region 3 for antibody 37578
QQYGNLPRT

SEQ ID NO: 75156 - protein, 13 aa, Homo sapiens
  heavy chain complementarity determining region 3 for antibody 37578
AGGEFHRGGYSDF

SEQ ID NO: 75157 - protein, 9 aa, Homo sapiens
  light chain complementarity determining region 3 for antibody 37579
QQYGNLPRT

SEQ ID NO: 75158 - protein, 13 aa, Homo sapiens
  heavy chain complementarity determining region 3 for antibody 37579
AGGDFHRGGYSDF

SEQ ID NO: 75159 - protein, 9 aa, Homo sapiens
  light chain complementarity determining region 3 for antibody 37580
QQYGNLPRR

SEQ ID NO: 75160 - protein, 13 aa, Homo sapiens
  heavy chain complementarity determining region 3 for antibody 37580
AGGNFHSGGYGEY

SEQ ID NO: 75161 - protein, 9 aa, Homo sapiens
  light chain complementarity determining region 3 for antibody 37581
QQYGNLPRP

SEQ ID NO: 75162 - protein, 13 aa, Homo sapiens
  heavy chain complementarity determining region 3 for antibody 37581
AGGQFHSSGYSEF

SEQ ID NO: 75163 - protein, 9 aa, Homo sapiens
  light chain complementarity determining region 3 for antibody 37582
QQYGNLPRK

SEQ ID NO: 75164 - protein, 13 aa, Homo sapiens
  heavy chain complementarity determining region 3 for antibody 37582
AGGDFHSGGYSEF

SEQ ID NO: 75165 - protein, 9 aa, Homo sapiens
  light chain complementarity determining region 3 for antibody 37583
QQYGNLPPT

SEQ ID NO: 75166 - protein, 19 aa, Homo sapiens
  heavy chain complementarity determining region 3 for antibody 37583
ARDPFRTGNYWEGYDVFDI

SEQ ID NO: 75167 - protein, 10 aa, Homo sapiens
  light chain complementarity determining region 3 for antibody 37584
QQYGNLPPFT

SEQ ID NO: 75168 - protein, 13 aa, Homo sapiens
  heavy chain complementarity determining region 3 for antibody 37584
ASWSHSDLDAFDI

SEQ ID NO: 75169 - protein, 9 aa, Homo sapiens
  light chain complementarity determining region 3 for antibody 37585
QQYGNLPGT

SEQ ID NO: 75170 - protein, 13 aa, Homo sapiens
  heavy chain complementarity determining region 3 for antibody 37585
AGGNFHSGGYGEY

SEQ ID NO: 75171 - protein, 9 aa, Homo sapiens
  light chain complementarity determining region 3 for antibody 37586
QQYGNLLRT

SEQ ID NO: 75172 - protein, 13 aa, Homo sapiens
  heavy chain complementarity determining region 3 for antibody 37586
AGGDFHSGGYSEF

SEQ ID NO: 75173 - protein, 9 aa, Homo sapiens
  light chain complementarity determining region 3 for antibody 37587
QQYGNIPRT

SEQ ID NO: 75174 - protein, 12 aa, Homo sapiens
  heavy chain complementarity determining region 3 for antibody 37587
GGLFHTSGYSEF

SEQ ID NO: 75175 - protein, 9 aa, Homo sapiens
  light chain complementarity determining region 3 for antibody 37588
QQYGNIPRT

SEQ ID NO: 75176 - protein, 13 aa, Homo sapiens
  heavy chain complementarity determining region 3 for antibody 37588
AGGLFHASGYSEF

SEQ ID NO: 75177 - protein, 9 aa, Homo sapiens
  light chain complementarity determining region 3 for antibody 37589
QQYGNIPRS

SEQ ID NO: 75178 - protein, 13 aa, Homo sapiens
  heavy chain complementarity determining region 3 for antibody 37589
AGGLFHTSGYSEF

SEQ ID NO: 75179 - protein, 9 aa, Homo sapiens
  light chain complementarity determining region 3 for antibody 37590
QQYGNFPRT

SEQ ID NO: 75180 - protein, 13 aa, Homo sapiens
  heavy chain complementarity determining region 3 for antibody 37590
AGGNFHSGGYGEY

SEQ ID NO: 75181 - protein, 9 aa, Homo sapiens
  light chain complementarity determining region 3 for antibody 37591
QQYGISPYT

SEQ ID NO: 75182 - protein, 14 aa, Homo sapiens
  heavy chain complementarity determining region 3 for antibody 37591
ARHSGYHYGSNLDY

SEQ ID NO: 75183 - protein, 10 aa, Homo sapiens
  light chain complementarity determining region 3 for antibody 37592
QQYGISPTWT

SEQ ID NO: 75184 - protein, 17 aa, Homo sapiens
  heavy chain complementarity determining region 3 for antibody 37592
ARDPCKKATDVVCAWDS

SEQ ID NO: 75185 - protein, 9 aa, Homo sapiens
  light chain complementarity determining region 3 for antibody 37593
QQYGISPTT

SEQ ID NO: 75186 - protein, 17 aa, Homo sapiens
  heavy chain complementarity determining region 3 for antibody 37593
ARDLGTYDATRHWYFDL

SEQ ID NO: 75187 - protein, 9 aa, Homo sapiens
  light chain complementarity determining region 3 for antibody 37594
QQYGISPRT

SEQ ID NO: 75188 - protein, 17 aa, Homo sapiens
  heavy chain complementarity determining region 3 for antibody 37594
ARALDIVVVVDAIWFDP

SEQ ID NO: 75189 - protein, 10 aa, Homo sapiens
  light chain complementarity determining region 3 for antibody 37595
QQYGISPPYT

SEQ ID NO: 75190 - protein, 18 aa, Homo sapiens
  heavy chain complementarity determining region 3 for antibody 37595
ATGKWFGDFNFYYYAMDV

SEQ ID NO: 75191 - protein, 10 aa, Homo sapiens
  light chain complementarity determining region 3 for antibody 37596
QQYGISPKRT

SEQ ID NO: 75192 - protein, 17 aa, Homo sapiens
  heavy chain complementarity determining region 3 for antibody 37596
ARDPCKKATDVVCAWDS

SEQ ID NO: 75193 - protein, 10 aa, Homo sapiens
  light chain complementarity determining region 3 for antibody 37597
QQYGISPKGT

SEQ ID NO: 75194 - protein, 17 aa, Homo sapiens
  heavy chain complementarity determining region 3 for antibody 37597
ARDPCKKATDVVCAWDS

SEQ ID NO: 75195 - protein, 10 aa, Homo sapiens
  light chain complementarity determining region 3 for antibody 37598
QQYGISPKGR

SEQ ID NO: 75196 - protein, 17 aa, Homo sapiens
  heavy chain complementarity determining region 3 for antibody 37598
ARDPCKKATDVVCAWDS

SEQ ID NO: 75197 - protein, 9 aa, Homo sapiens
  light chain complementarity determining region 3 for antibody 37599
QQYGISLIT

SEQ ID NO: 75198 - protein, 13 aa, Homo sapiens
  heavy chain complementarity determining region 3 for antibody 37599
ARGSGSHQDEFDY

SEQ ID NO: 75199 - protein, 9 aa, Homo sapiens
  light chain complementarity determining region 3 for antibody 37600
QQYGILPRT

SEQ ID NO: 75200 - protein, 13 aa, Homo sapiens
  heavy chain complementarity determining region 3 for antibody 37600
AGGNFHSGGYGEY

SEQ ID NO: 75201 - protein, 10 aa, Homo sapiens
  light chain complementarity determining region 3 for antibody 37601
QQYGHSPPFT

SEQ ID NO: 75202 - protein, 13 aa, Homo sapiens
  heavy chain complementarity determining region 3 for antibody 37601
ASWSHSDLDAFDI

SEQ ID NO: 75203 - protein, 9 aa, Homo sapiens
  light chain complementarity determining region 3 for antibody 37602
QQYGHIPRT

SEQ ID NO: 75204 - protein, 15 aa, Homo sapiens
  heavy chain complementarity determining region 3 for antibody 37602
ASGEFYVSGSYYRED

SEQ ID NO: 75205 - protein, 9 aa, Homo sapiens
  light chain complementarity determining region 3 for antibody 37603
QQYGHIPRT

SEQ ID NO: 75206 - protein, 15 aa, Homo sapiens
  heavy chain complementarity determining region 3 for antibody 37603
ARGEFYVSGSYSRED

SEQ ID NO: 75207 - protein, 9 aa, Homo sapiens
  light chain complementarity determining region 3 for antibody 37604
QQYGHIHRT

SEQ ID NO: 75208 - protein, 15 aa, Homo sapiens
  heavy chain complementarity determining region 3 for antibody 37604
ARGEFYVSGSYYRED

SEQ ID NO: 75209 - protein, 10 aa, Homo sapiens
  light chain complementarity determining region 3 for antibody 37605
QQYGGTTPFS

SEQ ID NO: 75210 - protein, 12 aa, Homo sapiens
  heavy chain complementarity determining region 3 for antibody 37605
ARETGGSYYMDA

SEQ ID NO: 75211 - protein, 10 aa, Homo sapiens
  light chain complementarity determining region 3 for antibody 37606
QQYGGTPPLS

SEQ ID NO: 75212 - protein, 12 aa, Homo sapiens
  heavy chain complementarity determining region 3 for antibody 37606
ARETGGSYYMDA

SEQ ID NO: 75213 - protein, 10 aa, Homo sapiens
  light chain complementarity determining region 3 for antibody 37607
QQYGGTPPFS

SEQ ID NO: 75214 - protein, 12 aa, Homo sapiens
  heavy chain complementarity determining region 3 for antibody 37607
ARETGGRYYMDA

SEQ ID NO: 75215 - protein, 8 aa, Homo sapiens
  light chain complementarity determining region 3 for antibody 37608
QQYGGSTR

SEQ ID NO: 75216 - protein, 16 aa, Homo sapiens
  heavy chain complementarity determining region 3 for antibody 37608
ATDWGSGTQWIRAFDV

SEQ ID NO: 75217 - protein, 9 aa, Homo sapiens
  light chain complementarity determining region 3 for antibody 37609
QQYGGSSRT

SEQ ID NO: 75218 - protein, 11 aa, Homo sapiens
  heavy chain complementarity determining region 3 for antibody 37609
ARGRWAGAFDL

SEQ ID NO: 75219 - protein, 9 aa, Homo sapiens
  light chain complementarity determining region 3 for antibody 37610
QQYGGSSRK

SEQ ID NO: 75220 - protein, 11 aa, Homo sapiens
  heavy chain complementarity determining region 3 for antibody 37610
ARGRWAGAFDI

SEQ ID NO: 75221 - protein, 8 aa, Homo sapiens
  light chain complementarity determining region 3 for antibody 37611
QQYGGSRS

SEQ ID NO: 75222 - protein, 16 aa, Homo sapiens
  heavy chain complementarity determining region 3 for antibody 37611
ATDWGSGTQWIRAFDV

SEQ ID NO: 75223 - protein, 9 aa, Homo sapiens
  light chain complementarity determining region 3 for antibody 37612
QQYGGSQGT

SEQ ID NO: 75224 - protein, 13 aa, Homo sapiens
  heavy chain complementarity determining region 3 for antibody 37612
TKEMPEAGHPGGS

SEQ ID NO: 75225 - protein, 9 aa, Homo sapiens
  light chain complementarity determining region 3 for antibody 37613
QQYGGSQGT

SEQ ID NO: 75226 - protein, 13 aa, Homo sapiens
  heavy chain complementarity determining region 3 for antibody 37613
TKEIPEAGHPGGY

SEQ ID NO: 75227 - protein, 9 aa, Homo sapiens
  light chain complementarity determining region 3 for antibody 37614
QQYGGSQGT

SEQ ID NO: 75228 - protein, 13 aa, Homo sapiens
  heavy chain complementarity determining region 3 for antibody 37614
TKEIPEAGHPGDS

SEQ ID NO: 75229 - protein, 9 aa, Homo sapiens
  light chain complementarity determining region 3 for antibody 37615
QQYGGSPYT

SEQ ID NO: 75230 - protein, 14 aa, Homo sapiens
  heavy chain complementarity determining region 3 for antibody 37615
ARATFMIVDYAFDI

SEQ ID NO: 75231 - protein, 9 aa, Homo sapiens
  light chain complementarity determining region 3 for antibody 37616
QQYGGSPWT

SEQ ID NO: 75232 - protein, 13 aa, Homo sapiens
  heavy chain complementarity determining region 3 for antibody 37616
ASGYFDSGAYYEF

SEQ ID NO: 75233 - protein, 9 aa, Homo sapiens
  light chain complementarity determining region 3 for antibody 37617
QQYGGSPWP

SEQ ID NO: 75234 - protein, 15 aa, Homo sapiens
  heavy chain complementarity determining region 3 for antibody 37617
ARPTAIYYSHYAIDV

SEQ ID NO: 75235 - protein, 8 aa, Homo sapiens
  light chain complementarity determining region 3 for antibody 37618
QQYGGSPS

SEQ ID NO: 75236 - protein, 16 aa, Homo sapiens
  heavy chain complementarity determining region 3 for antibody 37618
VTDWGSGTQWIRAFDV

SEQ ID NO: 75237 - protein, 10 aa, Homo sapiens
  light chain complementarity determining region 3 for antibody 37619
QQYGGSPSFI

SEQ ID NO: 75238 - protein, 14 aa, Homo sapiens
  heavy chain complementarity determining region 3 for antibody 37619
ARRDYIGTLHYFDP

SEQ ID NO: 75239 - protein, 8 aa, Homo sapiens
  light chain complementarity determining region 3 for antibody 37620
QQYGGSPS

SEQ ID NO: 75240 - protein, 16 aa, Homo sapiens
  heavy chain complementarity determining region 3 for antibody 37620
ATYWGSGTQGIRAFDV

SEQ ID NO: 75241 - protein, 8 aa, Homo sapiens
  light chain complementarity determining region 3 for antibody 37621
QQYGGSPS

SEQ ID NO: 75242 - protein, 16 aa, Homo sapiens
  heavy chain complementarity determining region 3 for antibody 37621
ATDWGSVTQWIRAFDV

SEQ ID NO: 75243 - protein, 8 aa, Homo sapiens
  light chain complementarity determining region 3 for antibody 37622
QQYGGSPS

SEQ ID NO: 75244 - protein, 16 aa, Homo sapiens
  heavy chain complementarity determining region 3 for antibody 37622
ATDWGSGTQWVRAFDV

SEQ ID NO: 75245 - protein, 8 aa, Homo sapiens
  light chain complementarity determining region 3 for antibody 37623
QQYGGSPS

SEQ ID NO: 75246 - protein, 16 aa, Homo sapiens
  heavy chain complementarity determining region 3 for antibody 37623
ATDWGSGTQWLRAFDV

SEQ ID NO: 75247 - protein, 8 aa, Homo sapiens
  light chain complementarity determining region 3 for antibody 37624
QQYGGSPS

SEQ ID NO: 75248 - protein, 16 aa, Homo sapiens
  heavy chain complementarity determining region 3 for antibody 37624
ATDWGSGTQWIRSFDV

SEQ ID NO: 75249 - protein, 8 aa, Homo sapiens
  light chain complementarity determining region 3 for antibody 37625
QQYGGSPS

SEQ ID NO: 75250 - protein, 16 aa, Homo sapiens
  heavy chain complementarity determining region 3 for antibody 37625
ATDWGSGTQWIRALDV

SEQ ID NO: 75251 - protein, 8 aa, Homo sapiens
  light chain complementarity determining region 3 for antibody 37626
QQYGGSPS

SEQ ID NO: 75252 - protein, 16 aa, Homo sapiens
  heavy chain complementarity determining region 3 for antibody 37626
ATDWGSGTQWIRAFGV

SEQ ID NO: 75253 - protein, 8 aa, Homo sapiens
  light chain complementarity determining region 3 for antibody 37627
QQYGGSPS

SEQ ID NO: 75254 - protein, 16 aa, Homo sapiens
  heavy chain complementarity determining region 3 for antibody 37627
ATDWGSGTQWILAFDV

SEQ ID NO: 75255 - protein, 8 aa, Homo sapiens
  light chain complementarity determining region 3 for antibody 37628
QQYGGSPS

SEQ ID NO: 75256 - protein, 16 aa, Homo sapiens
  heavy chain complementarity determining region 3 for antibody 37628
ATDWGSGTQRIRAFDV

SEQ ID NO: 75257 - protein, 8 aa, Homo sapiens
  light chain complementarity determining region 3 for antibody 37629
QQYGGSPS

SEQ ID NO: 75258 - protein, 16 aa, Homo sapiens
  heavy chain complementarity determining region 3 for antibody 37629
ATDWGSGTQCIRAFDV

SEQ ID NO: 75259 - protein, 8 aa, Homo sapiens
  light chain complementarity determining region 3 for antibody 37630
QQYGGSPS

SEQ ID NO: 75260 - protein, 16 aa, Homo sapiens
  heavy chain complementarity determining region 3 for antibody 37630
ATDWGSGTKWIRAFDV

SEQ ID NO: 75261 - protein, 8 aa, Homo sapiens
  light chain complementarity determining region 3 for antibody 37631
QQYGGSPS

SEQ ID NO: 75262 - protein, 16 aa, Homo sapiens
  heavy chain complementarity determining region 3 for antibody 37631
ATDWGSGSQWIRAFDV

SEQ ID NO: 75263 - protein, 8 aa, Homo sapiens
  light chain complementarity determining region 3 for antibody 37632
QQYGGSPS

SEQ ID NO: 75264 - protein, 16 aa, Homo sapiens
  heavy chain complementarity determining region 3 for antibody 37632
ATDWGSGPQWIRAFDV

SEQ ID NO: 75265 - protein, 8 aa, Homo sapiens
  light chain complementarity determining region 3 for antibody 37633
QQYGGSPS

SEQ ID NO: 75266 - protein, 16 aa, Homo sapiens
  heavy chain complementarity determining region 3 for antibody 37633
ASDWGSGTQGIRAFDV

SEQ ID NO: 75267 - protein, 8 aa, Homo sapiens
  light chain complementarity determining region 3 for antibody 37634
QQYGGSPS

SEQ ID NO: 75268 - protein, 12 aa, Homo sapiens
  heavy chain complementarity determining region 3 for antibody 37634
AKKIGNFDVLDV

SEQ ID NO: 75269 - protein, 8 aa, Homo sapiens
  light chain complementarity determining region 3 for antibody 37635
QQYGGSPS

SEQ ID NO: 75270 - protein, 16 aa, Homo sapiens
  heavy chain complementarity determining region 3 for antibody 37635
AIDWGSGTQWIRAFDV

SEQ ID NO: 75271 - protein, 9 aa, Homo sapiens
  light chain complementarity determining region 3 for antibody 37636
QQYGGSPRT

SEQ ID NO: 75272 - protein, 13 aa, Homo sapiens
  heavy chain complementarity determining region 3 for antibody 37636
ASGYVDSGAYYEF

SEQ ID NO: 75273 - protein, 9 aa, Homo sapiens
  light chain complementarity determining region 3 for antibody 37637
QQYGGSPRT

SEQ ID NO: 75274 - protein, 13 aa, Homo sapiens
  heavy chain complementarity determining region 3 for antibody 37637
ASGYVDRSGYYEF

SEQ ID NO: 75275 - protein, 9 aa, Homo sapiens
  light chain complementarity determining region 3 for antibody 37638
QQYGGSPRT

SEQ ID NO: 75276 - protein, 13 aa, Homo sapiens
  heavy chain complementarity determining region 3 for antibody 37638
ASGYFDSGAYYGF

SEQ ID NO: 75277 - protein, 9 aa, Homo sapiens
  light chain complementarity determining region 3 for antibody 37639
QQYGGSPRT

SEQ ID NO: 75278 - protein, 13 aa, Homo sapiens
  heavy chain complementarity determining region 3 for antibody 37639
ASGYFDSGAYFDF

SEQ ID NO: 75279 - protein, 9 aa, Homo sapiens
  light chain complementarity determining region 3 for antibody 37640
QQYGGSPRT

SEQ ID NO: 75280 - protein, 15 aa, Homo sapiens
  heavy chain complementarity determining region 3 for antibody 37640
ARPTAIYYSHYAIDV

SEQ ID NO: 75281 - protein, 9 aa, Homo sapiens
  light chain complementarity determining region 3 for antibody 37641
QQYGGSPRT

SEQ ID NO: 75282 - protein, 11 aa, Homo sapiens
  heavy chain complementarity determining region 3 for antibody 37641
ARGRWAGAFDI

SEQ ID NO: 75283 - protein, 9 aa, Homo sapiens
  light chain complementarity determining region 3 for antibody 37642
QQYGGSPRK

SEQ ID NO: 75284 - protein, 13 aa, Homo sapiens
  heavy chain complementarity determining region 3 for antibody 37642
ASGYFDSGAYYEF

SEQ ID NO: 75285 - protein, 8 aa, Homo sapiens
  light chain complementarity determining region 3 for antibody 37643
QQYGGSPR

SEQ ID NO: 75286 - protein, 16 aa, Homo sapiens
  heavy chain complementarity determining region 3 for antibody 37643
ATDWGSGTHWIRAFDV

SEQ ID NO: 75287 - protein, 11 aa, Homo sapiens
  light chain complementarity determining region 3 for antibody 37644
QQYGGSPPGIP

SEQ ID NO: 75288 - protein, 13 aa, Homo sapiens
  heavy chain complementarity determining region 3 for antibody 37644
AKHRGGYTYAIES

SEQ ID NO: 75289 - protein, 11 aa, Homo sapiens
  light chain complementarity determining region 3 for antibody 37645
QQYGGSPPALT

SEQ ID NO: 75290 - protein, 17 aa, Homo sapiens
  heavy chain complementarity determining region 3 for antibody 37645
ARVSGGGYYKLYYGMDV

SEQ ID NO: 75291 - protein, 11 aa, Homo sapiens
  light chain complementarity determining region 3 for antibody 37646
QQYGGSPPALP

SEQ ID NO: 75292 - protein, 17 aa, Homo sapiens
  heavy chain complementarity determining region 3 for antibody 37646
ARVSGGGYYKLYYGMDV

SEQ ID NO: 75293 - protein, 9 aa, Homo sapiens
  light chain complementarity determining region 3 for antibody 37647
QQYGGSPNT

SEQ ID NO: 75294 - protein, 14 aa, Homo sapiens
  heavy chain complementarity determining region 3 for antibody 37647
ARAAFMIVDYAFDI

SEQ ID NO: 75295 - protein, 10 aa, Homo sapiens
  light chain complementarity determining region 3 for antibody 37648
QQYGGSPLGT

SEQ ID NO: 75296 - protein, 16 aa, Homo sapiens
  heavy chain complementarity determining region 3 for antibody 37648
ARESGGIVARRNYFDH

SEQ ID NO: 75297 - protein, 9 aa, Homo sapiens
  light chain complementarity determining region 3 for antibody 37649
QQYGGSPHT

SEQ ID NO: 75298 - protein, 14 aa, Homo sapiens
  heavy chain complementarity determining region 3 for antibody 37649
ARATFMIVDYAFDI

SEQ ID NO: 75299 - protein, 9 aa, Homo sapiens
  light chain complementarity determining region 3 for antibody 37650
QQYGGSPFF

SEQ ID NO: 75300 - protein, 12 aa, Homo sapiens
  heavy chain complementarity determining region 3 for antibody 37650
ARGWNELDYFDY

SEQ ID NO: 75301 - protein, 10 aa, Homo sapiens
  light chain complementarity determining region 3 for antibody 37651
QQYGGSLPWR

SEQ ID NO: 75302 - protein, 16 aa, Homo sapiens
  heavy chain complementarity determining region 3 for antibody 37651
ARWIATPLVPRGPMDV

SEQ ID NO: 75303 - protein, 9 aa, Homo sapiens
  light chain complementarity determining region 3 for antibody 37652
QQYGGSLGT

SEQ ID NO: 75304 - protein, 13 aa, Homo sapiens
  heavy chain complementarity determining region 3 for antibody 37652
TKEIPEAGHPGGS

SEQ ID NO: 75305 - protein, 8 aa, Homo sapiens
  light chain complementarity determining region 3 for antibody 37653
QQYGGSHS

SEQ ID NO: 75306 - protein, 16 aa, Homo sapiens
  heavy chain complementarity determining region 3 for antibody 37653
ATDWGSGTQWIRAFDV

SEQ ID NO: 75307 - protein, 10 aa, Homo sapiens
  light chain complementarity determining region 3 for antibody 37654
QQYGGPPSFT

SEQ ID NO: 75308 - protein, 14 aa, Homo sapiens
  heavy chain complementarity determining region 3 for antibody 37654
ARRDYIGTLHYFDP

SEQ ID NO: 75309 - protein, 9 aa, Homo sapiens
  light chain complementarity determining region 3 for antibody 37655
QQYGGLPRT

SEQ ID NO: 75310 - protein, 13 aa, Homo sapiens
  heavy chain complementarity determining region 3 for antibody 37655
ARGPEGLGGDSPL

SEQ ID NO: 75311 - protein, 8 aa, Homo sapiens
  light chain complementarity determining region 3 for antibody 37656
QQYGGLPR

SEQ ID NO: 75312 - protein, 16 aa, Homo sapiens
  heavy chain complementarity determining region 3 for antibody 37656
ATDWGSGTQWIRAFDV

SEQ ID NO: 75313 - protein, 8 aa, Homo sapiens
  light chain complementarity determining region 3 for antibody 37657
QQYGGAPR

SEQ ID NO: 75314 - protein, 16 aa, Homo sapiens
  heavy chain complementarity determining region 3 for antibody 37657
ATDWGSGTQWIRAFDV

SEQ ID NO: 75315 - protein, 6 aa, Homo sapiens
  light chain complementarity determining region 3 for antibody 37658
QQYGDT

SEQ ID NO: 75316 - protein, 12 aa, Homo sapiens
  heavy chain complementarity determining region 3 for antibody 37658
ARDHSSGWSLSN

SEQ ID NO: 75317 - protein, 9 aa, Homo sapiens
  light chain complementarity determining region 3 for antibody 37659
QQYGDSPST

SEQ ID NO: 75318 - protein, 22 aa, Homo sapiens
  heavy chain complementarity determining region 3 for antibody 37659
ARNTIQWSGAFSRKKKSYGLDV

SEQ ID NO: 75319 - protein, 8 aa, Homo sapiens
  light chain complementarity determining region 3 for antibody 37660
QQYGDSPS

SEQ ID NO: 75320 - protein, 16 aa, Homo sapiens
  heavy chain complementarity determining region 3 for antibody 37660
ATDWGSGTQWIRAFDV

SEQ ID NO: 75321 - protein, 9 aa, Homo sapiens
  light chain complementarity determining region 3 for antibody 37661
QQYGDSPLP

SEQ ID NO: 75322 - protein, 15 aa, Homo sapiens
  heavy chain complementarity determining region 3 for antibody 37661
AKGRRGSYSHDAFDV

SEQ ID NO: 75323 - protein, 9 aa, Homo sapiens
  light chain complementarity determining region 3 for antibody 37662
QQYGDSPHT

SEQ ID NO: 75324 - protein, 22 aa, Homo sapiens
  heavy chain complementarity determining region 3 for antibody 37662
ARNTIQWSGAFSRKKKSYGLDV

SEQ ID NO: 75325 - protein, 9 aa, Homo sapiens
  light chain complementarity determining region 3 for antibody 37663
QQYGDSPFT

SEQ ID NO: 75326 - protein, 15 aa, Homo sapiens
  heavy chain complementarity determining region 3 for antibody 37663
ARQKGQRASAGYFDS

SEQ ID NO: 75327 - protein, 9 aa, Homo sapiens
  light chain complementarity determining region 3 for antibody 37664
QQYGDSARP

SEQ ID NO: 75328 - protein, 13 aa, Homo sapiens
  heavy chain complementarity determining region 3 for antibody 37664
ARGYFYSDGYIED

SEQ ID NO: 75329 - protein, 9 aa, Homo sapiens
  light chain complementarity determining region 3 for antibody 37665
QQYGDLPYT

SEQ ID NO: 75330 - protein, 22 aa, Homo sapiens
  heavy chain complementarity determining region 3 for antibody 37665
TRRRPTGRTSLRRGGRQGAFDI

SEQ ID NO: 75331 - protein, 9 aa, Homo sapiens
  light chain complementarity determining region 3 for antibody 37666
QQYGASPLN

SEQ ID NO: 75332 - protein, 13 aa, Homo sapiens
  heavy chain complementarity determining region 3 for antibody 37666
ASISVGTVAAGKG

SEQ ID NO: 75333 - protein, 9 aa, Homo sapiens
  light chain complementarity determining region 3 for antibody 37667
QQYFYSPPT

SEQ ID NO: 75334 - protein, 10 aa, Homo sapiens
  heavy chain complementarity determining region 3 for antibody 37667
VRGTRNAFDI

SEQ ID NO: 75335 - protein, 9 aa, Homo sapiens
  light chain complementarity determining region 3 for antibody 37668
QQYFTTPTT

SEQ ID NO: 75336 - protein, 10 aa, Homo sapiens
  heavy chain complementarity determining region 3 for antibody 37668
ARSGGYGWDS

SEQ ID NO: 75337 - protein, 9 aa, Homo sapiens
  light chain complementarity determining region 3 for antibody 37669
QQYFTSVRT

SEQ ID NO: 75338 - protein, 12 aa, Homo sapiens
  heavy chain complementarity determining region 3 for antibody 37669
VKDCGLGGSRDF

SEQ ID NO: 75339 - protein, 9 aa, Homo sapiens
  light chain complementarity determining region 3 for antibody 37670
QQYFTSLRT

SEQ ID NO: 75340 - protein, 12 aa, Homo sapiens
  heavy chain complementarity determining region 3 for antibody 37670
VKDCGLGGPRDY

SEQ ID NO: 75341 - protein, 9 aa, Homo sapiens
  light chain complementarity determining region 3 for antibody 37671
QQYFSSPWT

SEQ ID NO: 75342 - protein, 13 aa, Homo sapiens
  heavy chain complementarity determining region 3 for antibody 37671
ARGSGSHCAPFDH

SEQ ID NO: 75343 - protein, 9 aa, Homo sapiens
  light chain complementarity determining region 3 for antibody 37672
QQYFSRVYT

SEQ ID NO: 75344 - protein, 18 aa, Homo sapiens
  heavy chain complementarity determining region 3 for antibody 37672
AQERDGYCDSHACYGLDV

SEQ ID NO: 75345 - protein, 9 aa, Homo sapiens
  light chain complementarity determining region 3 for antibody 37673
QQYFSPVYT

SEQ ID NO: 75346 - protein, 18 aa, Homo sapiens
  heavy chain complementarity determining region 3 for antibody 37673
AQERDGYCDSHACYGLDV

SEQ ID NO: 75347 - protein, 9 aa, Homo sapiens
  light chain complementarity determining region 3 for antibody 37674
QQYFSNVYT

SEQ ID NO: 75348 - protein, 18 aa, Homo sapiens
  heavy chain complementarity determining region 3 for antibody 37674
AQERDGYCDSHACYGLDV

SEQ ID NO: 75349 - protein, 9 aa, Homo sapiens
  light chain complementarity determining region 3 for antibody 37675
QQYFSLLYT

SEQ ID NO: 75350 - protein, 18 aa, Homo sapiens
  heavy chain complementarity determining region 3 for antibody 37675
AQERDGYCDSHACYGLDV

SEQ ID NO: 75351 - protein, 9 aa, Homo sapiens
  light chain complementarity determining region 3 for antibody 37676
QQYFSHWYT

SEQ ID NO: 75352 - protein, 18 aa, Homo sapiens
  heavy chain complementarity determining region 3 for antibody 37676
AQERDGYCDSHACYGLDV

SEQ ID NO: 75353 - protein, 9 aa, Homo sapiens
  light chain complementarity determining region 3 for antibody 37677
QQYFSHVYT

SEQ ID NO: 75354 - protein, 18 aa, Homo sapiens
  heavy chain complementarity determining region 3 for antibody 37677
AQERDGYWDSHACYGLDV

SEQ ID NO: 75355 - protein, 9 aa, Homo sapiens
  light chain complementarity determining region 3 for antibody 37678
QQYFSHVYT

SEQ ID NO: 75356 - protein, 18 aa, Homo sapiens
  heavy chain complementarity determining region 3 for antibody 37678
AQERDGYCDSQACYGLDV

SEQ ID NO: 75357 - protein, 9 aa, Homo sapiens
  light chain complementarity determining region 3 for antibody 37679
QQYFSHVYN

SEQ ID NO: 75358 - protein, 18 aa, Homo sapiens
  heavy chain complementarity determining region 3 for antibody 37679
AQERDGYCDSHACYGLDV

SEQ ID NO: 75359 - protein, 9 aa, Homo sapiens
  light chain complementarity determining region 3 for antibody 37680
QQYFRSPWT

SEQ ID NO: 75360 - protein, 13 aa, Homo sapiens
  heavy chain complementarity determining region 3 for antibody 37680
ARGSGSHYAPFDH

SEQ ID NO: 75361 - protein, 9 aa, Homo sapiens
  light chain complementarity determining region 3 for antibody 37681
QQYFLTPVT

SEQ ID NO: 75362 - protein, 11 aa, Homo sapiens
  heavy chain complementarity determining region 3 for antibody 37681
AKIEGGGFAGY

SEQ ID NO: 75363 - protein, 9 aa, Homo sapiens
  light chain complementarity determining region 3 for antibody 37682
QQYFKNPLT

SEQ ID NO: 75364 - protein, 11 aa, Homo sapiens
  heavy chain complementarity determining region 3 for antibody 37682
ARSGDSGYFDV

SEQ ID NO: 75365 - protein, 9 aa, Homo sapiens
  light chain complementarity determining region 3 for antibody 37683
QQYFISPYT

SEQ ID NO: 75366 - protein, 12 aa, Homo sapiens
  heavy chain complementarity determining region 3 for antibody 37683
VRPYYYDSRDDH

SEQ ID NO: 75367 - protein, 9 aa, Homo sapiens
  light chain complementarity determining region 3 for antibody 37684
QQYFISPDT

SEQ ID NO: 75368 - protein, 12 aa, Homo sapiens
  heavy chain complementarity determining region 3 for antibody 37684
VRPYYYDSSDDH

SEQ ID NO: 75369 - protein, 9 aa, Homo sapiens
  light chain complementarity determining region 3 for antibody 37685
QQYFATPHS

SEQ ID NO: 75370 - protein, 13 aa, Homo sapiens
  heavy chain complementarity determining region 3 for antibody 37685
AKSIADTGFYYDY

SEQ ID NO: 75371 - protein, 11 aa, Homo sapiens
  light chain complementarity determining region 3 for antibody 37686
QQYETSPPGST

SEQ ID NO: 75372 - protein, 14 aa, Homo sapiens
  heavy chain complementarity determining region 3 for antibody 37686
ARENSISRKRSFDQ

SEQ ID NO: 75373 - protein, 11 aa, Homo sapiens
  light chain complementarity determining region 3 for antibody 37687
QQYETSPPGNP

SEQ ID NO: 75374 - protein, 14 aa, Homo sapiens
  heavy chain complementarity determining region 3 for antibody 37687
ARENTISRKRYFDQ

SEQ ID NO: 75375 - protein, 9 aa, Homo sapiens
  light chain complementarity determining region 3 for antibody 37688
QQYETLPFT

SEQ ID NO: 75376 - protein, 15 aa, Homo sapiens
  heavy chain complementarity determining region 3 for antibody 37688
AKDTAVPATESTFDY

SEQ ID NO: 75377 - protein, 8 aa, Homo sapiens
  light chain complementarity determining region 3 for antibody 37689
QQYESYSS

SEQ ID NO: 75378 - protein, 16 aa, Homo sapiens
  heavy chain complementarity determining region 3 for antibody 37689
ARMNAYGGSNPNWFDP

SEQ ID NO: 75379 - protein, 9 aa, Homo sapiens
  light chain complementarity determining region 3 for antibody 37690
QQYESYPPT

SEQ ID NO: 75380 - protein, 17 aa, Homo sapiens
  heavy chain complementarity determining region 3 for antibody 37690
ARGVGRGLEASPGIFDY

SEQ ID NO: 75381 - protein, 9 aa, Homo sapiens
  light chain complementarity determining region 3 for antibody 37691
QQYESYPLT

SEQ ID NO: 75382 - protein, 17 aa, Homo sapiens
  heavy chain complementarity determining region 3 for antibody 37691
ARGVGRGLEASPGSFDY

SEQ ID NO: 75383 - protein, 9 aa, Homo sapiens
  light chain complementarity determining region 3 for antibody 37692
QQYESLPPT

SEQ ID NO: 75384 - protein, 12 aa, Homo sapiens
  heavy chain complementarity determining region 3 for antibody 37692
VRDRVAGDAFDP

SEQ ID NO: 75385 - protein, 9 aa, Homo sapiens
  light chain complementarity determining region 3 for antibody 37693
QQYESLPPT

SEQ ID NO: 75386 - protein, 12 aa, Homo sapiens
  heavy chain complementarity determining region 3 for antibody 37693
VRDRVAGDAFDA

SEQ ID NO: 75387 - protein, 9 aa, Homo sapiens
  light chain complementarity determining region 3 for antibody 37694
QQYESLPLT

SEQ ID NO: 75388 - protein, 11 aa, Homo sapiens
  heavy chain complementarity determining region 3 for antibody 37694
ARQRIHDAFDT

SEQ ID NO: 75389 - protein, 9 aa, Homo sapiens
  light chain complementarity determining region 3 for antibody 37695
QQYESLPLP

SEQ ID NO: 75390 - protein, 11 aa, Homo sapiens
  heavy chain complementarity determining region 3 for antibody 37695
ASQRIHDAFDT

SEQ ID NO: 75391 - protein, 9 aa, Homo sapiens
  light chain complementarity determining region 3 for antibody 37696
QQYESIPPT

SEQ ID NO: 75392 - protein, 12 aa, Homo sapiens
  heavy chain complementarity determining region 3 for antibody 37696
VRDRVAGDAFDT

SEQ ID NO: 75393 - protein, 9 aa, Homo sapiens
  light chain complementarity determining region 3 for antibody 37697
QQYESFPLT

SEQ ID NO: 75394 - protein, 11 aa, Homo sapiens
  heavy chain complementarity determining region 3 for antibody 37697
ASQRIHDAFDT

SEQ ID NO: 75395 - protein, 9 aa, Homo sapiens
  light chain complementarity determining region 3 for antibody 37698
QQYERSPRM

SEQ ID NO: 75396 - protein, 15 aa, Homo sapiens
  heavy chain complementarity determining region 3 for antibody 37698
ARDGNVPSTGYPLDS

SEQ ID NO: 75397 - protein, 9 aa, Homo sapiens
  light chain complementarity determining region 3 for antibody 37699
QQYERSPRL

SEQ ID NO: 75398 - protein, 15 aa, Homo sapiens
  heavy chain complementarity determining region 3 for antibody 37699
ARDGNVLSTGYPLDS

SEQ ID NO: 75399 - protein, 8 aa, Homo sapiens
  light chain complementarity determining region 3 for antibody 37700
QQYENLWK

SEQ ID NO: 75400 - protein, 25 aa, Homo sapiens
  heavy chain complementarity determining region 3 for antibody 37700
ARVRRGFHSDSSGYYHMEGDDSFDI

SEQ ID NO: 75401 - protein, 9 aa, Homo sapiens
  light chain complementarity determining region 3 for antibody 37701
QQYENLPVT

SEQ ID NO: 75402 - protein, 10 aa, Homo sapiens
  heavy chain complementarity determining region 3 for antibody 37701
ASGGGHTYGY

SEQ ID NO: 75403 - protein, 8 aa, Homo sapiens
  light chain complementarity determining region 3 for antibody 37702
QQYENLGT

SEQ ID NO: 75404 - protein, 25 aa, Homo sapiens
  heavy chain complementarity determining region 3 for antibody 37702
ARVRRGFHSDSSGYYHMEGDDSFDI

SEQ ID NO: 75405 - protein, 9 aa, Homo sapiens
  light chain complementarity determining region 3 for antibody 37703
QQYEFVPPT

SEQ ID NO: 75406 - protein, 8 aa, Homo sapiens
  heavy chain complementarity determining region 3 for antibody 37703
ASGWALRD

SEQ ID NO: 75407 - protein, 9 aa, Homo sapiens
  light chain complementarity determining region 3 for antibody 37704
QQYEDLPIT

SEQ ID NO: 75408 - protein, 12 aa, Homo sapiens
  heavy chain complementarity determining region 3 for antibody 37704
TTFYPGAGCFQH

SEQ ID NO: 75409 - protein, 9 aa, Homo sapiens
  light chain complementarity determining region 3 for antibody 37705
QQYEDLPIT

SEQ ID NO: 75410 - protein, 12 aa, Homo sapiens
  heavy chain complementarity determining region 3 for antibody 37705
ATFYPGAGYFQH

SEQ ID NO: 75411 - protein, 8 aa, Homo sapiens
  light chain complementarity determining region 3 for antibody 37706
QQYDYSWT

SEQ ID NO: 75412 - protein, 10 aa, Homo sapiens
  heavy chain complementarity determining region 3 for antibody 37706
AGREVSGSPF

SEQ ID NO: 75413 - protein, 8 aa, Homo sapiens
  light chain complementarity determining region 3 for antibody 37707
QQYDYLWP

SEQ ID NO: 75414 - protein, 10 aa, Homo sapiens
  heavy chain complementarity determining region 3 for antibody 37707
AGREVSGSPF

SEQ ID NO: 75415 - protein, 8 aa, Homo sapiens
  light chain complementarity determining region 3 for antibody 37708
QQYDYLRT

SEQ ID NO: 75416 - protein, 10 aa, Homo sapiens
  heavy chain complementarity determining region 3 for antibody 37708
AGREVSGSPF

SEQ ID NO: 75417 - protein, 9 aa, Homo sapiens
  light chain complementarity determining region 3 for antibody 37709
QQYDYFPFT

SEQ ID NO: 75418 - protein, 27 aa, Homo sapiens
  heavy chain complementarity determining region 3 for antibody 37709
ARGANCSGGGCYLGGTGTYTYYYGMGV

SEQ ID NO: 75419 - protein, 9 aa, Homo sapiens
  light chain complementarity determining region 3 for antibody 37710
QQYDTYPGP

SEQ ID NO: 75420 - protein, 11 aa, Homo sapiens
  heavy chain complementarity determining region 3 for antibody 37710
ARGTYGQAFDI

SEQ ID NO: 75421 - protein, 9 aa, Homo sapiens
  light chain complementarity determining region 3 for antibody 37711
QQYDTSPWT

SEQ ID NO: 75422 - protein, 15 aa, Homo sapiens
  heavy chain complementarity determining region 3 for antibody 37711
VHTQLWFGDQCYVDF

SEQ ID NO: 75423 - protein, 9 aa, Homo sapiens
  light chain complementarity determining region 3 for antibody 37712
QQYDTSPWK

SEQ ID NO: 75424 - protein, 15 aa, Homo sapiens
  heavy chain complementarity determining region 3 for antibody 37712
VHTQLWFGDQCYFDF

SEQ ID NO: 75425 - protein, 11 aa, Homo sapiens
  light chain complementarity determining region 3 for antibody 37713
QQYDTSPPGYT

SEQ ID NO: 75426 - protein, 14 aa, Homo sapiens
  heavy chain complementarity determining region 3 for antibody 37713
ARENSISRKRSFDQ

SEQ ID NO: 75427 - protein, 11 aa, Homo sapiens
  light chain complementarity determining region 3 for antibody 37714
QQYDTSPPGDT

SEQ ID NO: 75428 - protein, 14 aa, Homo sapiens
  heavy chain complementarity determining region 3 for antibody 37714
ARETSNSRKRSFDQ

SEQ ID NO: 75429 - protein, 9 aa, Homo sapiens
  light chain complementarity determining region 3 for antibody 37715
QQYDTSPLT

SEQ ID NO: 75430 - protein, 16 aa, Homo sapiens
  heavy chain complementarity determining region 3 for antibody 37715
VRDAWRESGRNAPGAN

SEQ ID NO: 75431 - protein, 9 aa, Homo sapiens
  light chain complementarity determining region 3 for antibody 37716
QQYDTSPGT

SEQ ID NO: 75432 - protein, 15 aa, Homo sapiens
  heavy chain complementarity determining region 3 for antibody 37716
VHTQLWFGDQCYFDF

SEQ ID NO: 75433 - protein, 9 aa, Homo sapiens
  light chain complementarity determining region 3 for antibody 37717
QQYDTPPWT

SEQ ID NO: 75434 - protein, 13 aa, Homo sapiens
  heavy chain complementarity determining region 3 for antibody 37717
ARETRIHLPAFDY

SEQ ID NO: 75435 - protein, 9 aa, Homo sapiens
  light chain complementarity determining region 3 for antibody 37718
QQYDTPPWP

SEQ ID NO: 75436 - protein, 13 aa, Homo sapiens
  heavy chain complementarity determining region 3 for antibody 37718
ARETRIHLPAFEY

SEQ ID NO: 75437 - protein, 9 aa, Homo sapiens
  light chain complementarity determining region 3 for antibody 37719
QQYDTKPWT

SEQ ID NO: 75438 - protein, 20 aa, Homo sapiens
  heavy chain complementarity determining region 3 for antibody 37719
ATDKKGVYYDGSEYYWGFDY

SEQ ID NO: 75439 - protein, 8 aa, Homo sapiens
  light chain complementarity determining region 3 for antibody 37720
QQYDSYWP

SEQ ID NO: 75440 - protein, 17 aa, Homo sapiens
  heavy chain complementarity determining region 3 for antibody 37720
AKDPGGRGPGPYWFFDL

SEQ ID NO: 75441 - protein, 9 aa, Homo sapiens
  light chain complementarity determining region 3 for antibody 37721
QQYDSYSWK

SEQ ID NO: 75442 - protein, 12 aa, Homo sapiens
  heavy chain complementarity determining region 3 for antibody 37721
ARGRFGDLVYDY

SEQ ID NO: 75443 - protein, 8 aa, Homo sapiens
  light chain complementarity determining region 3 for antibody 37722
QQYDSYST

SEQ ID NO: 75444 - protein, 16 aa, Homo sapiens
  heavy chain complementarity determining region 3 for antibody 37722
AKDALALTSKPYYFNF

SEQ ID NO: 75445 - protein, 9 aa, Homo sapiens
  light chain complementarity determining region 3 for antibody 37723
QQYDSYPWT

SEQ ID NO: 75446 - protein, 11 aa, Homo sapiens
  heavy chain complementarity determining region 3 for antibody 37723
ARLAGDNAFDL

SEQ ID NO: 75447 - protein, 9 aa, Homo sapiens
  light chain complementarity determining region 3 for antibody 37724
QQYDSYPWT

SEQ ID NO: 75448 - protein, 11 aa, Homo sapiens
  heavy chain complementarity determining region 3 for antibody 37724
ARLAGDKAFDF

SEQ ID NO: 75449 - protein, 9 aa, Homo sapiens
  light chain complementarity determining region 3 for antibody 37725
QQYDSYPRT

SEQ ID NO: 75450 - protein, 11 aa, Homo sapiens
  heavy chain complementarity determining region 3 for antibody 37725
ARRSSYGQFDY

SEQ ID NO: 75451 - protein, 9 aa, Homo sapiens
  light chain complementarity determining region 3 for antibody 37726
QQYDSYPLT

SEQ ID NO: 75452 - protein, 17 aa, Homo sapiens
  heavy chain complementarity determining region 3 for antibody 37726
ARGVGRGLEASPGIFDY

SEQ ID NO: 75453 - protein, 9 aa, Homo sapiens
  light chain complementarity determining region 3 for antibody 37727
QQYDSYPIT

SEQ ID NO: 75454 - protein, 11 aa, Homo sapiens
  heavy chain complementarity determining region 3 for antibody 37727
ARVSELTAEDF

SEQ ID NO: 75455 - protein, 9 aa, Homo sapiens
  light chain complementarity determining region 3 for antibody 37728
QQYDSWPYT

SEQ ID NO: 75456 - protein, 13 aa, Homo sapiens
  heavy chain complementarity determining region 3 for antibody 37728
ARGNGGSDGSDWF

SEQ ID NO: 75457 - protein, 9 aa, Homo sapiens
  light chain complementarity determining region 3 for antibody 37729
QQYDSSSST

SEQ ID NO: 75458 - protein, 11 aa, Homo sapiens
  heavy chain complementarity determining region 3 for antibody 37729
ARGGFYGSFDY

SEQ ID NO: 75459 - protein, 9 aa, Homo sapiens
  light chain complementarity determining region 3 for antibody 37730
QQYDSSSHT

SEQ ID NO: 75460 - protein, 11 aa, Homo sapiens
  heavy chain complementarity determining region 3 for antibody 37730
ARGGFYGSFDY

SEQ ID NO: 75461 - protein, 9 aa, Homo sapiens
  light chain complementarity determining region 3 for antibody 37731
QQYDSSPRT

SEQ ID NO: 75462 - protein, 13 aa, Homo sapiens
  heavy chain complementarity determining region 3 for antibody 37731
AKSVLTVPGVYDY

SEQ ID NO: 75463 - protein, 9 aa, Homo sapiens
  light chain complementarity determining region 3 for antibody 37732
QQYDSPPWT

SEQ ID NO: 75464 - protein, 13 aa, Homo sapiens
  heavy chain complementarity determining region 3 for antibody 37732
ARETRIHLPAFEY

SEQ ID NO: 75465 - protein, 10 aa, Homo sapiens
  light chain complementarity determining region 3 for antibody 37733
QQYDSLSPLT

SEQ ID NO: 75466 - protein, 18 aa, Homo sapiens
  heavy chain complementarity determining region 3 for antibody 37733
ARLMTSSRTDYYYYGLDV

SEQ ID NO: 75467 - protein, 10 aa, Homo sapiens
  light chain complementarity determining region 3 for antibody 37734
QQYDSLSPLT

SEQ ID NO: 75468 - protein, 18 aa, Homo sapiens
  heavy chain complementarity determining region 3 for antibody 37734
ARLMTSSRPDYYYYGLDA

SEQ ID NO: 75469 - protein, 9 aa, Homo sapiens
  light chain complementarity determining region 3 for antibody 37735
QQYDSLPRT

SEQ ID NO: 75470 - protein, 13 aa, Homo sapiens
  heavy chain complementarity determining region 3 for antibody 37735
AKSVLTVPRVYDY

SEQ ID NO: 75471 - protein, 9 aa, Homo sapiens
  light chain complementarity determining region 3 for antibody 37736
QQYDSLPLT

SEQ ID NO: 75472 - protein, 13 aa, Homo sapiens
  heavy chain complementarity determining region 3 for antibody 37736
ARDGVPGRFSRAY

SEQ ID NO: 75473 - protein, 9 aa, Homo sapiens
  light chain complementarity determining region 3 for antibody 37737
QQYDSLPLT

SEQ ID NO: 75474 - protein, 15 aa, Homo sapiens
  heavy chain complementarity determining region 3 for antibody 37737
ARAPLMVWSGPTFDY

SEQ ID NO: 75475 - protein, 9 aa, Homo sapiens
  light chain complementarity determining region 3 for antibody 37738
QQYDSLPLN

SEQ ID NO: 75476 - protein, 13 aa, Homo sapiens
  heavy chain complementarity determining region 3 for antibody 37738
ARDGVPGKFSRAY

SEQ ID NO: 75477 - protein, 9 aa, Homo sapiens
  light chain complementarity determining region 3 for antibody 37739
QQYDSLPFT

SEQ ID NO: 75478 - protein, 6 aa, Homo sapiens
  heavy chain complementarity determining region 3 for antibody 37739
ARRRDF

SEQ ID NO: 75479 - protein, 9 aa, Homo sapiens
  light chain complementarity determining region 3 for antibody 37740
QQYDSILYT

SEQ ID NO: 75480 - protein, 13 aa, Homo sapiens
  heavy chain complementarity determining region 3 for antibody 37740
AREPRSLTGYIDY

SEQ ID NO: 75481 - protein, 9 aa, Homo sapiens
  light chain complementarity determining region 3 for antibody 37741
QQYDSFPLT

SEQ ID NO: 75482 - protein, 13 aa, Homo sapiens
  heavy chain complementarity determining region 3 for antibody 37741
ARDGVPGKFSRAY

SEQ ID NO: 75483 - protein, 9 aa, Homo sapiens
  light chain complementarity determining region 3 for antibody 37742
QQYDSAPDP

SEQ ID NO: 75484 - protein, 11 aa, Homo sapiens
  heavy chain complementarity determining region 3 for antibody 37742
AKDPSSGPSDY

SEQ ID NO: 75485 - protein, 9 aa, Homo sapiens
  light chain complementarity determining region 3 for antibody 37743
QQYDRYPIT

SEQ ID NO: 75486 - protein, 11 aa, Homo sapiens
  heavy chain complementarity determining region 3 for antibody 37743
ARVSELTADDF

SEQ ID NO: 75487 - protein, 9 aa, Homo sapiens
  light chain complementarity determining region 3 for antibody 37744
QQYDRYPIT

SEQ ID NO: 75488 - protein, 11 aa, Homo sapiens
  heavy chain complementarity determining region 3 for antibody 37744
ARVSELPAEDF

SEQ ID NO: 75489 - protein, 10 aa, Homo sapiens
  light chain complementarity determining region 3 for antibody 37745
QQYDRSTGHT

SEQ ID NO: 75490 - protein, 21 aa, Homo sapiens
  heavy chain complementarity determining region 3 for antibody 37745
ARAGEYSELLTGHYNGYNFDY

SEQ ID NO: 75491 - protein, 9 aa, Homo sapiens
  light chain complementarity determining region 3 for antibody 37746
QQYDRSSYT

SEQ ID NO: 75492 - protein, 11 aa, Homo sapiens
  heavy chain complementarity determining region 3 for antibody 37746
ARGGFYGSFDY

SEQ ID NO: 75493 - protein, 11 aa, Homo sapiens
  light chain complementarity determining region 3 for antibody 37747
QQYDRSQPMST

SEQ ID NO: 75494 - protein, 14 aa, Homo sapiens
  heavy chain complementarity determining region 3 for antibody 37747
ARHMTLSGTRGFDY

SEQ ID NO: 75495 - protein, 11 aa, Homo sapiens
  light chain complementarity determining region 3 for antibody 37748
QQYDRSQPMDT

SEQ ID NO: 75496 - protein, 14 aa, Homo sapiens
  heavy chain complementarity determining region 3 for antibody 37748
ARHMTLSGTRGFDY

SEQ ID NO: 75497 - protein, 11 aa, Homo sapiens
  light chain complementarity determining region 3 for antibody 37749
QQYDRSPTGFT

SEQ ID NO: 75498 - protein, 14 aa, Homo sapiens
  heavy chain complementarity determining region 3 for antibody 37749
ARETHNSRKRSFDQ

SEQ ID NO: 75499 - protein, 9 aa, Homo sapiens
  light chain complementarity determining region 3 for antibody 37750
QQYDRSPRP

SEQ ID NO: 75500 - protein, 15 aa, Homo sapiens
  heavy chain complementarity determining region 3 for antibody 37750
ARDADLYSSSWFFDH

SEQ ID NO: 75501 - protein, 9 aa, Homo sapiens
  light chain complementarity determining region 3 for antibody 37751
QQYDRSPQT

SEQ ID NO: 75502 - protein, 12 aa, Homo sapiens
  heavy chain complementarity determining region 3 for antibody 37751
ARPLYNSGFFEY

SEQ ID NO: 75503 - protein, 11 aa, Homo sapiens
  light chain complementarity determining region 3 for antibody 37752
QQYDRSPPGYT

SEQ ID NO: 75504 - protein, 14 aa, Homo sapiens
  heavy chain complementarity determining region 3 for antibody 37752
ARDTHNSRKRSFDQ

SEQ ID NO: 75505 - protein, 11 aa, Homo sapiens
  light chain complementarity determining region 3 for antibody 37753
QQYDRSPPGNT

SEQ ID NO: 75506 - protein, 14 aa, Homo sapiens
  heavy chain complementarity determining region 3 for antibody 37753
ARDTHNSRKRSFDQ

SEQ ID NO: 75507 - protein, 11 aa, Homo sapiens
  light chain complementarity determining region 3 for antibody 37754
QQYDRSPPGFT

SEQ ID NO: 75508 - protein, 14 aa, Homo sapiens
  heavy chain complementarity determining region 3 for antibody 37754
ARETRNSRKRSFDQ

SEQ ID NO: 75509 - protein, 11 aa, Homo sapiens
  light chain complementarity determining region 3 for antibody 37755
QQYDRSPPGFT

SEQ ID NO: 75510 - protein, 14 aa, Homo sapiens
  heavy chain complementarity determining region 3 for antibody 37755
ARETHNSRKRSFDH

SEQ ID NO: 75511 - protein, 11 aa, Homo sapiens
  light chain complementarity determining region 3 for antibody 37756
QQYDRPPPGFT

SEQ ID NO: 75512 - protein, 14 aa, Homo sapiens
  heavy chain complementarity determining region 3 for antibody 37756
ARETHNSRKRSFDQ

SEQ ID NO: 75513 - protein, 9 aa, Homo sapiens
  light chain complementarity determining region 3 for antibody 37757
QQYDRLPPT

SEQ ID NO: 75514 - protein, 14 aa, Homo sapiens
  heavy chain complementarity determining region 3 for antibody 37757
EVGPSDTALVNLPY

SEQ ID NO: 75515 - protein, 9 aa, Homo sapiens
  light chain complementarity determining region 3 for antibody 37758
QQYDRAPDT

SEQ ID NO: 75516 - protein, 11 aa, Homo sapiens
  heavy chain complementarity determining region 3 for antibody 37758
AKDPSSGPSDY

SEQ ID NO: 75517 - protein, 9 aa, Homo sapiens
  light chain complementarity determining region 3 for antibody 37759
QQYDPSPWT

SEQ ID NO: 75518 - protein, 15 aa, Homo sapiens
  heavy chain complementarity determining region 3 for antibody 37759
VHTQLWFGDQCYFDF

SEQ ID NO: 75519 - protein, 9 aa, Homo sapiens
  light chain complementarity determining region 3 for antibody 37760
QQYDNYPIT

SEQ ID NO: 75520 - protein, 19 aa, Homo sapiens
  heavy chain complementarity determining region 3 for antibody 37760
ARAGSFTGISMIGDDAFDF

SEQ ID NO: 75521 - protein, 9 aa, Homo sapiens
  light chain complementarity determining region 3 for antibody 37761
QQYDNYPIT

SEQ ID NO: 75522 - protein, 19 aa, Homo sapiens
  heavy chain complementarity determining region 3 for antibody 37761
AGAGSFTGISMIGEDAFDF

SEQ ID NO: 75523 - protein, 9 aa, Homo sapiens
  light chain complementarity determining region 3 for antibody 37762
QQYDNYPFT

SEQ ID NO: 75524 - protein, 19 aa, Homo sapiens
  heavy chain complementarity determining region 3 for antibody 37762
ARAGSFTGISMIGEDAFDF

SEQ ID NO: 75525 - protein, 9 aa, Homo sapiens
  light chain complementarity determining region 3 for antibody 37763
QQYDNWPRT

SEQ ID NO: 75526 - protein, 20 aa, Homo sapiens
  heavy chain complementarity determining region 3 for antibody 37763
ARLPDFFHSGLHYVNCHYDS

SEQ ID NO: 75527 - protein, 10 aa, Homo sapiens
  light chain complementarity determining region 3 for antibody 37764
QQYDNWPPWT

SEQ ID NO: 75528 - protein, 6 aa, Homo sapiens
  heavy chain complementarity determining region 3 for antibody 37764
TAIYEF

SEQ ID NO: 75529 - protein, 10 aa, Homo sapiens
  light chain complementarity determining region 3 for antibody 37765
QQYDNWPPLT

SEQ ID NO: 75530 - protein, 16 aa, Homo sapiens
  heavy chain complementarity determining region 3 for antibody 37765
ARDRVSHYAESGTFDF

SEQ ID NO: 75531 - protein, 10 aa, Homo sapiens
  light chain complementarity determining region 3 for antibody 37766
QQYDNWLPLT

SEQ ID NO: 75532 - protein, 16 aa, Homo sapiens
  heavy chain complementarity determining region 3 for antibody 37766
ARDRVSHYAESGTFEF

SEQ ID NO: 75533 - protein, 9 aa, Homo sapiens
  light chain complementarity determining region 3 for antibody 37767
QQYDNVPRT

SEQ ID NO: 75534 - protein, 19 aa, Homo sapiens
  heavy chain complementarity determining region 3 for antibody 37767
TTDGGLIMFGGIGVSESTH

SEQ ID NO: 75535 - protein, 10 aa, Homo sapiens
  light chain complementarity determining region 3 for antibody 37768
QQYDNVPGVT

SEQ ID NO: 75536 - protein, 15 aa, Homo sapiens
  heavy chain complementarity determining region 3 for antibody 37768
ARGTSAPRFYFSLDV

SEQ ID NO: 75537 - protein, 9 aa, Homo sapiens
  light chain complementarity determining region 3 for antibody 37769
QQYDNTPWT

SEQ ID NO: 75538 - protein, 20 aa, Homo sapiens
  heavy chain complementarity determining region 3 for antibody 37769
ATDKKGVYYDGSEYYWGFDY

SEQ ID NO: 75539 - protein, 8 aa, Homo sapiens
  light chain complementarity determining region 3 for antibody 37770
QQYDNSRT

SEQ ID NO: 75540 - protein, 15 aa, Homo sapiens
  heavy chain complementarity determining region 3 for antibody 37770
SKTDYCSAGNCPFDS

SEQ ID NO: 75541 - protein, 8 aa, Homo sapiens
  light chain complementarity determining region 3 for antibody 37771
QQYDNSRT

SEQ ID NO: 75542 - protein, 15 aa, Homo sapiens
  heavy chain complementarity determining region 3 for antibody 37771
AKTDYCSAGTCPFDS

SEQ ID NO: 75543 - protein, 8 aa, Homo sapiens
  light chain complementarity determining region 3 for antibody 37772
QQYDNSRT

SEQ ID NO: 75544 - protein, 15 aa, Homo sapiens
  heavy chain complementarity determining region 3 for antibody 37772
AKTAYCSAGNCPFDS

SEQ ID NO: 75545 - protein, 8 aa, Homo sapiens
  light chain complementarity determining region 3 for antibody 37773
QQYDNSRP

SEQ ID NO: 75546 - protein, 15 aa, Homo sapiens
  heavy chain complementarity determining region 3 for antibody 37773
AKTDYCSAGNCPFDS

SEQ ID NO: 75547 - protein, 9 aa, Homo sapiens
  light chain complementarity determining region 3 for antibody 37774
QQYDNSLGT

SEQ ID NO: 75548 - protein, 11 aa, Homo sapiens
  heavy chain complementarity determining region 3 for antibody 37774
ARVGRVGFEFL

SEQ ID NO: 75549 - protein, 11 aa, Homo sapiens
  light chain complementarity determining region 3 for antibody 37775
QQYDNSALEFN

SEQ ID NO: 75550 - protein, 15 aa, Homo sapiens
  heavy chain complementarity determining region 3 for antibody 37775
VREVVTMIEPGGFDV

SEQ ID NO: 75551 - protein, 8 aa, Homo sapiens
  light chain complementarity determining region 3 for antibody 37776
QQYDNPYT

SEQ ID NO: 75552 - protein, 18 aa, Homo sapiens
  heavy chain complementarity determining region 3 for antibody 37776
ARVFCDGGVCFQGDAFDI

SEQ ID NO: 75553 - protein, 11 aa, Homo sapiens
  light chain complementarity determining region 3 for antibody 37777
QQYDNNVFRLT

SEQ ID NO: 75554 - protein, 15 aa, Homo sapiens
  heavy chain complementarity determining region 3 for antibody 37777
AKEMTYSGRFTTFDN

SEQ ID NO: 75555 - protein, 9 aa, Homo sapiens
  light chain complementarity determining region 3 for antibody 37778
QQYDNNPPT

SEQ ID NO: 75556 - protein, 20 aa, Homo sapiens
  heavy chain complementarity determining region 3 for antibody 37778
AKDKLRSVVRGVILGCYFAP

SEQ ID NO: 75557 - protein, 8 aa, Homo sapiens
  light chain complementarity determining region 3 for antibody 37779
QQYDNLYT

SEQ ID NO: 75558 - protein, 18 aa, Homo sapiens
  heavy chain complementarity determining region 3 for antibody 37779
ARVFCDGGVCFQGDAFDL

SEQ ID NO: 75559 - protein, 8 aa, Homo sapiens
  light chain complementarity determining region 3 for antibody 37780
QQYDNLWT

SEQ ID NO: 75560 - protein, 25 aa, Homo sapiens
  heavy chain complementarity determining region 3 for antibody 37780
ARVRRGFHSDSSGYYHMEGDDSFDI

SEQ ID NO: 75561 - protein, 8 aa, Homo sapiens
  light chain complementarity determining region 3 for antibody 37781
QQYDNLST

SEQ ID NO: 75562 - protein, 18 aa, Homo sapiens
  heavy chain complementarity determining region 3 for antibody 37781
ARVFCDGGVCFQGDAFDI

SEQ ID NO: 75563 - protein, 10 aa, Homo sapiens
  light chain complementarity determining region 3 for antibody 37782
QQYDNLSPYT

SEQ ID NO: 75564 - protein, 18 aa, Homo sapiens
  heavy chain complementarity determining region 3 for antibody 37782
ARDAGILSSSSWYVGFDI

SEQ ID NO: 75565 - protein, 9 aa, Homo sapiens
  light chain complementarity determining region 3 for antibody 37783
QQYDNLSPT

SEQ ID NO: 75566 - protein, 15 aa, Homo sapiens
  heavy chain complementarity determining region 3 for antibody 37783
ARVAFGTAAPPYFDY

SEQ ID NO: 75567 - protein, 9 aa, Homo sapiens
  light chain complementarity determining region 3 for antibody 37784
QQYDNLPYT

SEQ ID NO: 75568 - protein, 14 aa, Homo sapiens
  heavy chain complementarity determining region 3 for antibody 37784
AGTVDWDGPKYFDS

SEQ ID NO: 75569 - protein, 9 aa, Homo sapiens
  light chain complementarity determining region 3 for antibody 37785
QQYDNLPVT

SEQ ID NO: 75570 - protein, 10 aa, Homo sapiens
  heavy chain complementarity determining region 3 for antibody 37785
ASGGGHTSGY

SEQ ID NO: 75571 - protein, 9 aa, Homo sapiens
  light chain complementarity determining region 3 for antibody 37786
QQYDNLPVT

SEQ ID NO: 75572 - protein, 10 aa, Homo sapiens
  heavy chain complementarity determining region 3 for antibody 37786
ASGGGHSYGY

SEQ ID NO: 75573 - protein, 9 aa, Homo sapiens
  light chain complementarity determining region 3 for antibody 37787
QQYDNLPVT

SEQ ID NO: 75574 - protein, 10 aa, Homo sapiens
  heavy chain complementarity determining region 3 for antibody 37787
ASGGGHPYGY

SEQ ID NO: 75575 - protein, 9 aa, Homo sapiens
  light chain complementarity determining region 3 for antibody 37788
QQYDNLPVT

SEQ ID NO: 75576 - protein, 10 aa, Homo sapiens
  heavy chain complementarity determining region 3 for antibody 37788
AGGGGHTYGY

SEQ ID NO: 75577 - protein, 9 aa, Homo sapiens
  light chain complementarity determining region 3 for antibody 37789
QQYDNLPVP

SEQ ID NO: 75578 - protein, 10 aa, Homo sapiens
  heavy chain complementarity determining region 3 for antibody 37789
ASGGGHTYGY

SEQ ID NO: 75579 - protein, 10 aa, Homo sapiens
  light chain complementarity determining region 3 for antibody 37790
QQYDNLPRYT

SEQ ID NO: 75580 - protein, 19 aa, Homo sapiens
  heavy chain complementarity determining region 3 for antibody 37790
ARDRYYYEHSGYVIDPCDV

SEQ ID NO: 75581 - protein, 12 aa, Homo sapiens
  light chain complementarity determining region 3 for antibody 37791
QQYDNLPRPLLA

SEQ ID NO: 75582 - protein, 12 aa, Homo sapiens
  heavy chain complementarity determining region 3 for antibody 37791
EMTPRGGYLFDY

SEQ ID NO: 75583 - protein, 9 aa, Homo sapiens
  light chain complementarity determining region 3 for antibody 37792
QQYDNLPRP

SEQ ID NO: 75584 - protein, 20 aa, Homo sapiens
  heavy chain complementarity determining region 3 for antibody 37792
ARDQAYYYGSGSSGVDWLDP

SEQ ID NO: 75585 - protein, 10 aa, Homo sapiens
  light chain complementarity determining region 3 for antibody 37793
QQYDNLPPYP

SEQ ID NO: 75586 - protein, 15 aa, Homo sapiens
  heavy chain complementarity determining region 3 for antibody 37793
VRDPGTAGSDWYFDL

SEQ ID NO: 75587 - protein, 9 aa, Homo sapiens
  light chain complementarity determining region 3 for antibody 37794
QQYDNLPPT

SEQ ID NO: 75588 - protein, 17 aa, Homo sapiens
  heavy chain complementarity determining region 3 for antibody 37794
ARVPYCYDSSGYNVRDY

SEQ ID NO: 75589 - protein, 11 aa, Homo sapiens
  light chain complementarity determining region 3 for antibody 37795
QQYDNLPPPYT

SEQ ID NO: 75590 - protein, 9 aa, Homo sapiens
  heavy chain complementarity determining region 3 for antibody 37795
ASGFTAFDY

SEQ ID NO: 75591 - protein, 10 aa, Homo sapiens
  light chain complementarity determining region 3 for antibody 37796
QQYDNLPPPT

SEQ ID NO: 75592 - protein, 14 aa, Homo sapiens
  heavy chain complementarity determining region 3 for antibody 37796
ATDLAHRSHWRNVN

SEQ ID NO: 75593 - protein, 9 aa, Homo sapiens
  light chain complementarity determining region 3 for antibody 37797
QQYDNLPPP

SEQ ID NO: 75594 - protein, 17 aa, Homo sapiens
  heavy chain complementarity determining region 3 for antibody 37797
ARVPYYYDSSGYNVRDY

SEQ ID NO: 75595 - protein, 11 aa, Homo sapiens
  light chain complementarity determining region 3 for antibody 37798
QQYDNLPPMNT

SEQ ID NO: 75596 - protein, 10 aa, Homo sapiens
  heavy chain complementarity determining region 3 for antibody 37798
ARASRGWLDP

SEQ ID NO: 75597 - protein, 10 aa, Homo sapiens
  light chain complementarity determining region 3 for antibody 37799
QQYDNLPPLT

SEQ ID NO: 75598 - protein, 14 aa, Homo sapiens
  heavy chain complementarity determining region 3 for antibody 37799
ATDLAHRSHWRNGN

SEQ ID NO: 75599 - protein, 10 aa, Homo sapiens
  light chain complementarity determining region 3 for antibody 37800
QQYDNLPPLP

SEQ ID NO: 75600 - protein, 14 aa, Homo sapiens
  heavy chain complementarity determining region 3 for antibody 37800
ATDLAHRSHWRNVN

SEQ ID NO: 75601 - protein, 11 aa, Homo sapiens
  light chain complementarity determining region 3 for antibody 37801
QQYDNLPPAHT

SEQ ID NO: 75602 - protein, 9 aa, Homo sapiens
  heavy chain complementarity determining region 3 for antibody 37801
ASGFTAFDY

SEQ ID NO: 75603 - protein, 11 aa, Homo sapiens
  light chain complementarity determining region 3 for antibody 37802
QQYDNLPPADT

SEQ ID NO: 75604 - protein, 9 aa, Homo sapiens
  heavy chain complementarity determining region 3 for antibody 37802
ASGFTAFDY

SEQ ID NO: 75605 - protein, 9 aa, Homo sapiens
  light chain complementarity determining region 3 for antibody 37803
QQYDNLPLT

SEQ ID NO: 75606 - protein, 13 aa, Homo sapiens
  heavy chain complementarity determining region 3 for antibody 37803
AREGDSSGDYFDY

SEQ ID NO: 75607 - protein, 9 aa, Homo sapiens
  light chain complementarity determining region 3 for antibody 37804
QQYDNLPFT

SEQ ID NO: 75608 - protein, 12 aa, Homo sapiens
  heavy chain complementarity determining region 3 for antibody 37804
VKDCGLGGPRDY

SEQ ID NO: 75609 - protein, 9 aa, Homo sapiens
  light chain complementarity determining region 3 for antibody 37805
QQYDNLPFT

SEQ ID NO: 75610 - protein, 11 aa, Homo sapiens
  heavy chain complementarity determining region 3 for antibody 37805
AHSGSGWLLDF

SEQ ID NO: 75611 - protein, 10 aa, Homo sapiens
  light chain complementarity determining region 3 for antibody 37806
QQYDNLPAGS

SEQ ID NO: 75612 - protein, 14 aa, Homo sapiens
  heavy chain complementarity determining region 3 for antibody 37806
ARGQNIAAARVFDY

SEQ ID NO: 75613 - protein, 10 aa, Homo sapiens
  light chain complementarity determining region 3 for antibody 37807
QQYDNLPAGP

SEQ ID NO: 75614 - protein, 14 aa, Homo sapiens
  heavy chain complementarity determining region 3 for antibody 37807
ARGQNIAAAGVFDY

SEQ ID NO: 75615 - protein, 8 aa, Homo sapiens
  light chain complementarity determining region 3 for antibody 37808
QQYDNLLT

SEQ ID NO: 75616 - protein, 15 aa, Homo sapiens
  heavy chain complementarity determining region 3 for antibody 37808
VRQYRETVAGIEGDS

SEQ ID NO: 75617 - protein, 8 aa, Homo sapiens
  light chain complementarity determining region 3 for antibody 37809
QQYDNLLP

SEQ ID NO: 75618 - protein, 15 aa, Homo sapiens
  heavy chain complementarity determining region 3 for antibody 37809
VRHYRETVAGIEGDS

SEQ ID NO: 75619 - protein, 10 aa, Homo sapiens
  light chain complementarity determining region 3 for antibody 37810
QQYDNLLPLT

SEQ ID NO: 75620 - protein, 12 aa, Homo sapiens
  heavy chain complementarity determining region 3 for antibody 37810
AREEVTTGYFDY

SEQ ID NO: 75621 - protein, 8 aa, Homo sapiens
  light chain complementarity determining region 3 for antibody 37811
QQYDNLLL

SEQ ID NO: 75622 - protein, 20 aa, Homo sapiens
  heavy chain complementarity determining region 3 for antibody 37811
ARHLKRTEPKGRSGHYLTDY

SEQ ID NO: 75623 - protein, 8 aa, Homo sapiens
  light chain complementarity determining region 3 for antibody 37812
QQYDNIYT

SEQ ID NO: 75624 - protein, 18 aa, Homo sapiens
  heavy chain complementarity determining region 3 for antibody 37812
ARVFCDGGVCFQGDAFDI

SEQ ID NO: 75625 - protein, 9 aa, Homo sapiens
  light chain complementarity determining region 3 for antibody 37813
QQYDNIPYT

SEQ ID NO: 75626 - protein, 16 aa, Homo sapiens
  heavy chain complementarity determining region 3 for antibody 37813
GTRQYLYDTSGYSFDS

SEQ ID NO: 75627 - protein, 10 aa, Homo sapiens
  light chain complementarity determining region 3 for antibody 37814
QQYDNIPPYT

SEQ ID NO: 75628 - protein, 23 aa, Homo sapiens
  heavy chain complementarity determining region 3 for antibody 37814
ARSPRGLDDVRSPQNPPNYYFDS

SEQ ID NO: 75629 - protein, 8 aa, Homo sapiens
  light chain complementarity determining region 3 for antibody 37815
QQYDNIAT

SEQ ID NO: 75630 - protein, 13 aa, Homo sapiens
  heavy chain complementarity determining region 3 for antibody 37815
ARGDLLAAAGTDF

SEQ ID NO: 75631 - protein, 9 aa, Homo sapiens
  light chain complementarity determining region 3 for antibody 37816
QQYDNFPVT

SEQ ID NO: 75632 - protein, 10 aa, Homo sapiens
  heavy chain complementarity determining region 3 for antibody 37816
ASGGGHTYGY

SEQ ID NO: 75633 - protein, 9 aa, Homo sapiens
  light chain complementarity determining region 3 for antibody 37817
QQYDNFPRT

SEQ ID NO: 75634 - protein, 20 aa, Homo sapiens
  heavy chain complementarity determining region 3 for antibody 37817
ARDQAYYYGSGSSGVDWLDP

SEQ ID NO: 75635 - protein, 9 aa, Homo sapiens
  light chain complementarity determining region 3 for antibody 37818
QQYDLFPFT

SEQ ID NO: 75636 - protein, 13 aa, Homo sapiens
  heavy chain complementarity determining region 3 for antibody 37818
AKGSGRGFGVLDD

SEQ ID NO: 75637 - protein, 9 aa, Homo sapiens
  light chain complementarity determining region 3 for antibody 37819
QQYDIFPLT

SEQ ID NO: 75638 - protein, 12 aa, Homo sapiens
  heavy chain complementarity determining region 3 for antibody 37819
TTDRSYGYYFPH

SEQ ID NO: 75639 - protein, 9 aa, Homo sapiens
  light chain complementarity determining region 3 for antibody 37820
QQYDIFPLT

SEQ ID NO: 75640 - protein, 17 aa, Homo sapiens
  heavy chain complementarity determining region 3 for antibody 37820
ARARYGDYVLEHGYFDL

SEQ ID NO: 75641 - protein, 9 aa, Homo sapiens
  light chain complementarity determining region 3 for antibody 37821
QQYDIFPLP

SEQ ID NO: 75642 - protein, 17 aa, Homo sapiens
  heavy chain complementarity determining region 3 for antibody 37821
ARALYGDYVLEHGYFDL

SEQ ID NO: 75643 - protein, 9 aa, Homo sapiens
  light chain complementarity determining region 3 for antibody 37822
QQYDGYSVS

SEQ ID NO: 75644 - protein, 11 aa, Homo sapiens
  heavy chain complementarity determining region 3 for antibody 37822
ARGNSGYHIKY

SEQ ID NO: 75645 - protein, 10 aa, Homo sapiens
  light chain complementarity determining region 3 for antibody 37823
QQYDDWPPTT

SEQ ID NO: 75646 - protein, 21 aa, Homo sapiens
  heavy chain complementarity determining region 3 for antibody 37823
ARHFLQYFDDGSYYPEGLFDL

SEQ ID NO: 75647 - protein, 8 aa, Homo sapiens
  light chain complementarity determining region 3 for antibody 37824
QQYDDLRA

SEQ ID NO: 75648 - protein, 19 aa, Homo sapiens
  heavy chain complementarity determining region 3 for antibody 37824
ARDPSYYYDSSGSPRFFQH

SEQ ID NO: 75649 - protein, 9 aa, Homo sapiens
  light chain complementarity determining region 3 for antibody 37825
QQYDDLPYT

SEQ ID NO: 75650 - protein, 13 aa, Homo sapiens
  heavy chain complementarity determining region 3 for antibody 37825
ATGKGIFFDWLSK

SEQ ID NO: 75651 - protein, 9 aa, Homo sapiens
  light chain complementarity determining region 3 for antibody 37826
QQYDDLPWT

SEQ ID NO: 75652 - protein, 13 aa, Homo sapiens
  heavy chain complementarity determining region 3 for antibody 37826
VRDGYGTNGGLDY

SEQ ID NO: 75653 - protein, 9 aa, Homo sapiens
  light chain complementarity determining region 3 for antibody 37827
QQYDDLPWT

SEQ ID NO: 75654 - protein, 13 aa, Homo sapiens
  heavy chain complementarity determining region 3 for antibody 37827
VRDDYGTDGGLDY

SEQ ID NO: 75655 - protein, 9 aa, Homo sapiens
  light chain complementarity determining region 3 for antibody 37828
QQYDDLPWT

SEQ ID NO: 75656 - protein, 13 aa, Homo sapiens
  heavy chain complementarity determining region 3 for antibody 37828
VRDDYGINGGLDY

SEQ ID NO: 75657 - protein, 10 aa, Homo sapiens
  light chain complementarity determining region 3 for antibody 37829
QQYDDLPPIT

SEQ ID NO: 75658 - protein, 12 aa, Homo sapiens
  heavy chain complementarity determining region 3 for antibody 37829
ARDVTGTRLFDF

SEQ ID NO: 75659 - protein, 10 aa, Homo sapiens
  light chain complementarity determining region 3 for antibody 37830
QQYDDLLPTT

SEQ ID NO: 75660 - protein, 12 aa, Homo sapiens
  heavy chain complementarity determining region 3 for antibody 37830
ARDVTGTRLFDF

SEQ ID NO: 75661 - protein, 10 aa, Homo sapiens
  light chain complementarity determining region 3 for antibody 37831
QQYDDLLPIT

SEQ ID NO: 75662 - protein, 12 aa, Homo sapiens
  heavy chain complementarity determining region 3 for antibody 37831
ARDVTGTRPFDF

SEQ ID NO: 75663 - protein, 10 aa, Homo sapiens
  light chain complementarity determining region 3 for antibody 37832
QQYDDLLPIP

SEQ ID NO: 75664 - protein, 12 aa, Homo sapiens
  heavy chain complementarity determining region 3 for antibody 37832
ARDVTGTRLFDF

SEQ ID NO: 75665 - protein, 10 aa, Homo sapiens
  light chain complementarity determining region 3 for antibody 37833
QQYDDLFPIT

SEQ ID NO: 75666 - protein, 12 aa, Homo sapiens
  heavy chain complementarity determining region 3 for antibody 37833
ARDVTGTRLFDF

SEQ ID NO: 75667 - protein, 9 aa, Homo sapiens
  light chain complementarity determining region 3 for antibody 37834
QQYDDFPWT

SEQ ID NO: 75668 - protein, 13 aa, Homo sapiens
  heavy chain complementarity determining region 3 for antibody 37834
VRDDYGTNGGLDY

SEQ ID NO: 75669 - protein, 10 aa, Homo sapiens
  light chain complementarity determining region 3 for antibody 37835
QQYDDFLPIT

SEQ ID NO: 75670 - protein, 12 aa, Homo sapiens
  heavy chain complementarity determining region 3 for antibody 37835
ARDVTGTRLFDF

SEQ ID NO: 75671 - protein, 9 aa, Homo sapiens
  light chain complementarity determining region 3 for antibody 37836
QQYDDAPRA

SEQ ID NO: 75672 - protein, 5 aa, Homo sapiens
  heavy chain complementarity determining region 3 for antibody 37836
TTDFI

SEQ ID NO: 75673 - protein, 9 aa, Homo sapiens
  light chain complementarity determining region 3 for antibody 37837
QQYDCYSGT

SEQ ID NO: 75674 - protein, 15 aa, Homo sapiens
  heavy chain complementarity determining region 3 for antibody 37837
VKDKVELATITAFEI

SEQ ID NO: 75675 - protein, 9 aa, Homo sapiens
  light chain complementarity determining region 3 for antibody 37838
QQYCTSPFT

SEQ ID NO: 75676 - protein, 14 aa, Homo sapiens
  heavy chain complementarity determining region 3 for antibody 37838
ARGGPAATSSSWLY

SEQ ID NO: 75677 - protein, 9 aa, Homo sapiens
  light chain complementarity determining region 3 for antibody 37839
QQYCSSPPS

SEQ ID NO: 75678 - protein, 19 aa, Homo sapiens
  heavy chain complementarity determining region 3 for antibody 37839
ARAGGNYYDRTSYYGPFDY

SEQ ID NO: 75679 - protein, 9 aa, Homo sapiens
  light chain complementarity determining region 3 for antibody 37840
QQYCSSPFA

SEQ ID NO: 75680 - protein, 18 aa, Homo sapiens
  heavy chain complementarity determining region 3 for antibody 37840
VRGGRHDSSGYYYVPFDY

SEQ ID NO: 75681 - protein, 9 aa, Homo sapiens
  light chain complementarity determining region 3 for antibody 37841
QQYCSSPET

SEQ ID NO: 75682 - protein, 12 aa, Homo sapiens
  heavy chain complementarity determining region 3 for antibody 37841
ARGYGWCSCPEY

SEQ ID NO: 75683 - protein, 9 aa, Homo sapiens
  light chain complementarity determining region 3 for antibody 37842
QQYAYSPLT

SEQ ID NO: 75684 - protein, 10 aa, Homo sapiens
  heavy chain complementarity determining region 3 for antibody 37842
ATGAGWLFDY

SEQ ID NO: 75685 - protein, 9 aa, Homo sapiens
  light chain complementarity determining region 3 for antibody 37843
QQYAYSPLP

SEQ ID NO: 75686 - protein, 10 aa, Homo sapiens
  heavy chain complementarity determining region 3 for antibody 37843
ATGAGWLVDY

SEQ ID NO: 75687 - protein, 9 aa, Homo sapiens
  light chain complementarity determining region 3 for antibody 37844
QQYAYSPIP

SEQ ID NO: 75688 - protein, 10 aa, Homo sapiens
  heavy chain complementarity determining region 3 for antibody 37844
ATGAGWLVDY

SEQ ID NO: 75689 - protein, 9 aa, Homo sapiens
  light chain complementarity determining region 3 for antibody 37845
QQYAVSPLT

SEQ ID NO: 75690 - protein, 14 aa, Homo sapiens
  heavy chain complementarity determining region 3 for antibody 37845
AKALFALGWNAFDI

SEQ ID NO: 75691 - protein, 9 aa, Homo sapiens
  light chain complementarity determining region 3 for antibody 37846
QQYATSPRP

SEQ ID NO: 75692 - protein, 15 aa, Homo sapiens
  heavy chain complementarity determining region 3 for antibody 37846
ARDGNVLATGYPLDY

SEQ ID NO: 75693 - protein, 9 aa, Homo sapiens
  light chain complementarity determining region 3 for antibody 37847
QQYATSPLT

SEQ ID NO: 75694 - protein, 8 aa, Homo sapiens
  heavy chain complementarity determining region 3 for antibody 37847
VWLFPPGY

SEQ ID NO: 75695 - protein, 9 aa, Homo sapiens
  light chain complementarity determining region 3 for antibody 37848
QQYATSPLP

SEQ ID NO: 75696 - protein, 8 aa, Homo sapiens
  heavy chain complementarity determining region 3 for antibody 37848
ALGQDMGR

SEQ ID NO: 75697 - protein, 9 aa, Homo sapiens
  light chain complementarity determining region 3 for antibody 37849
QQYATSLGT

SEQ ID NO: 75698 - protein, 15 aa, Homo sapiens
  heavy chain complementarity determining region 3 for antibody 37849
ARQKVRGRRRDHFDM

SEQ ID NO: 75699 - protein, 9 aa, Homo sapiens
  light chain complementarity determining region 3 for antibody 37850
QQYATSLGP

SEQ ID NO: 75700 - protein, 15 aa, Homo sapiens
  heavy chain complementarity determining region 3 for antibody 37850
ARQKVRGRMRDHFDM

SEQ ID NO: 75701 - protein, 9 aa, Homo sapiens
  light chain complementarity determining region 3 for antibody 37851
QQYASYSGT

SEQ ID NO: 75702 - protein, 15 aa, Homo sapiens
  heavy chain complementarity determining region 3 for antibody 37851
VKDKVELATITAFEI

SEQ ID NO: 75703 - protein, 8 aa, Homo sapiens
  light chain complementarity determining region 3 for antibody 37852
QQYASSNT

SEQ ID NO: 75704 - protein, 17 aa, Homo sapiens
  heavy chain complementarity determining region 3 for antibody 37852
ATVKSDYGMGTLGRLDD

SEQ ID NO: 75705 - protein, 9 aa, Homo sapiens
  light chain complementarity determining region 3 for antibody 37853
QQYASPPFT

SEQ ID NO: 75706 - protein, 18 aa, Homo sapiens
  heavy chain complementarity determining region 3 for antibody 37853
AARGANCGGDCYYWYFDL

SEQ ID NO: 75707 - protein, 9 aa, Homo sapiens
  light chain complementarity determining region 3 for antibody 37854
QQYASAPLT

SEQ ID NO: 75708 - protein, 10 aa, Homo sapiens
  heavy chain complementarity determining region 3 for antibody 37854
ARMNGWLIDY

SEQ ID NO: 75709 - protein, 9 aa, Homo sapiens
  light chain complementarity determining region 3 for antibody 37855
QQYAQSPWT

SEQ ID NO: 75710 - protein, 13 aa, Homo sapiens
  heavy chain complementarity determining region 3 for antibody 37855
ARDSADYGDPLDY

SEQ ID NO: 75711 - protein, 9 aa, Homo sapiens
  light chain complementarity determining region 3 for antibody 37856
QQYAPSPLT

SEQ ID NO: 75712 - protein, 10 aa, Homo sapiens
  heavy chain complementarity determining region 3 for antibody 37856
VAGAGWLPDY

SEQ ID NO: 75713 - protein, 11 aa, Homo sapiens
  light chain complementarity determining region 3 for antibody 37857
QQYAPSPEKNP

SEQ ID NO: 75714 - protein, 13 aa, Homo sapiens
  heavy chain complementarity determining region 3 for antibody 37857
AREEMIGGSPFDF

SEQ ID NO: 75715 - protein, 9 aa, Homo sapiens
  light chain complementarity determining region 3 for antibody 37858
QQYANWPRT

SEQ ID NO: 75716 - protein, 20 aa, Homo sapiens
  heavy chain complementarity determining region 3 for antibody 37858
ARLPDFFHGGLHYVNCHYDS

SEQ ID NO: 75717 - protein, 9 aa, Homo sapiens
  light chain complementarity determining region 3 for antibody 37859
QQYANSPWT

SEQ ID NO: 75718 - protein, 13 aa, Homo sapiens
  heavy chain complementarity determining region 3 for antibody 37859
ARDSADYGDPLDY

SEQ ID NO: 75719 - protein, 9 aa, Homo sapiens
  light chain complementarity determining region 3 for antibody 37860
QQYANPPST

SEQ ID NO: 75720 - protein, 10 aa, Homo sapiens
  heavy chain complementarity determining region 3 for antibody 37860
ARVGKRWGDY

SEQ ID NO: 75721 - protein, 9 aa, Homo sapiens
  light chain complementarity determining region 3 for antibody 37861
QQYANLPWP

SEQ ID NO: 75722 - protein, 11 aa, Homo sapiens
  heavy chain complementarity determining region 3 for antibody 37861
ATWAFRHGVDV

SEQ ID NO: 75723 - protein, 9 aa, Homo sapiens
  light chain complementarity determining region 3 for antibody 37862
QQYANLPRT

SEQ ID NO: 75724 - protein, 11 aa, Homo sapiens
  heavy chain complementarity determining region 3 for antibody 37862
ATWACRHGVDV

SEQ ID NO: 75725 - protein, 9 aa, Homo sapiens
  light chain complementarity determining region 3 for antibody 37863
QQYAKYPWT

SEQ ID NO: 75726 - protein, 13 aa, Homo sapiens
  heavy chain complementarity determining region 3 for antibody 37863
ARDSADYGDPLDY

SEQ ID NO: 75727 - protein, 9 aa, Homo sapiens
  light chain complementarity determining region 3 for antibody 37864
QQYAKSSWT

SEQ ID NO: 75728 - protein, 13 aa, Homo sapiens
  heavy chain complementarity determining region 3 for antibody 37864
ARDSADYGDPLDY

SEQ ID NO: 75729 - protein, 9 aa, Homo sapiens
  light chain complementarity determining region 3 for antibody 37865
QQYAKSPWT

SEQ ID NO: 75730 - protein, 13 aa, Homo sapiens
  heavy chain complementarity determining region 3 for antibody 37865
ARDSADYGGPLDY

SEQ ID NO: 75731 - protein, 9 aa, Homo sapiens
  light chain complementarity determining region 3 for antibody 37866
QQYAKPPWT

SEQ ID NO: 75732 - protein, 13 aa, Homo sapiens
  heavy chain complementarity determining region 3 for antibody 37866
ARDSADYGDPLDY

SEQ ID NO: 75733 - protein, 9 aa, Homo sapiens
  light chain complementarity determining region 3 for antibody 37867
QQYAGSPLT

SEQ ID NO: 75734 - protein, 15 aa, Homo sapiens
  heavy chain complementarity determining region 3 for antibody 37867
ARGLSAGWTRNWFAP

SEQ ID NO: 75735 - protein, 9 aa, Homo sapiens
  light chain complementarity determining region 3 for antibody 37868
QQYADSPLT

SEQ ID NO: 75736 - protein, 14 aa, Homo sapiens
  heavy chain complementarity determining region 3 for antibody 37868
AKALCALGWNAFDI

SEQ ID NO: 75737 - protein, 10 aa, Homo sapiens
  light chain complementarity determining region 3 for antibody 37869
QQYADLLPIT

SEQ ID NO: 75738 - protein, 12 aa, Homo sapiens
  heavy chain complementarity determining region 3 for antibody 37869
ARDVTGTRLFDF

SEQ ID NO: 75739 - protein, 9 aa, Homo sapiens
  light chain complementarity determining region 3 for antibody 37870
QQYACSPGT

SEQ ID NO: 75740 - protein, 8 aa, Homo sapiens
  heavy chain complementarity determining region 3 for antibody 37870
ARGLSLDS

SEQ ID NO: 75741 - protein, 9 aa, Homo sapiens
  light chain complementarity determining region 3 for antibody 37871
QQWSNWPRT

SEQ ID NO: 75742 - protein, 17 aa, Homo sapiens
  heavy chain complementarity determining region 3 for antibody 37871
ARVPYRVRGVQRPGIDY

SEQ ID NO: 75743 - protein, 9 aa, Homo sapiens
  light chain complementarity determining region 3 for antibody 37872
QQWNSYSIT

SEQ ID NO: 75744 - protein, 14 aa, Homo sapiens
  heavy chain complementarity determining region 3 for antibody 37872
ATEGPSRMGKFFDS

SEQ ID NO: 75745 - protein, 9 aa, Homo sapiens
  light chain complementarity determining region 3 for antibody 37873
QQVYTYPLT

SEQ ID NO: 75746 - protein, 12 aa, Homo sapiens
  heavy chain complementarity determining region 3 for antibody 37873
TRVLSSAIGEWD

SEQ ID NO: 75747 - protein, 10 aa, Homo sapiens
  light chain complementarity determining region 3 for antibody 37874
QQVNSRGGFT

SEQ ID NO: 75748 - protein, 19 aa, Homo sapiens
  heavy chain complementarity determining region 3 for antibody 37874
ARLTFDCSGGSCYHGAFDI

SEQ ID NO: 75749 - protein, 9 aa, Homo sapiens
  light chain complementarity determining region 3 for antibody 37875
QQVNNYSWT

SEQ ID NO: 75750 - protein, 17 aa, Homo sapiens
  heavy chain complementarity determining region 3 for antibody 37875
VRGIDYYGSGGHHWFDP

SEQ ID NO: 75751 - protein, 11 aa, Homo sapiens
  light chain complementarity determining region 3 for antibody 37876
QQVNGYPPMYT

SEQ ID NO: 75752 - protein, 19 aa, Homo sapiens
  heavy chain complementarity determining region 3 for antibody 37876
AGGFREVVSATDAYNWFDP

SEQ ID NO: 75753 - protein, 11 aa, Homo sapiens
  light chain complementarity determining region 3 for antibody 37877
QQVNGYPPIYT

SEQ ID NO: 75754 - protein, 19 aa, Homo sapiens
  heavy chain complementarity determining region 3 for antibody 37877
ARGFREVVSATDAYNWFDP

SEQ ID NO: 75755 - protein, 9 aa, Homo sapiens
  light chain complementarity determining region 3 for antibody 37878
QQVISYPLT

SEQ ID NO: 75756 - protein, 12 aa, Homo sapiens
  heavy chain complementarity determining region 3 for antibody 37878
ARPLDGDHGFDP

SEQ ID NO: 75757 - protein, 9 aa, Homo sapiens
  light chain complementarity determining region 3 for antibody 37879
QQVISYPFT

SEQ ID NO: 75758 - protein, 12 aa, Homo sapiens
  heavy chain complementarity determining region 3 for antibody 37879
ARPLDGDPGFDP

SEQ ID NO: 75759 - protein, 9 aa, Homo sapiens
  light chain complementarity determining region 3 for antibody 37880
QQVIRYPFT

SEQ ID NO: 75760 - protein, 12 aa, Homo sapiens
  heavy chain complementarity determining region 3 for antibody 37880
ARPLDGDHGFDP

SEQ ID NO: 75761 - protein, 10 aa, Homo sapiens
  light chain complementarity determining region 3 for antibody 37881
QQVGTSSRFT

SEQ ID NO: 75762 - protein, 9 aa, Homo sapiens
  heavy chain complementarity determining region 3 for antibody 37881
ARGYQELDY

SEQ ID NO: 75763 - protein, 9 aa, Homo sapiens
  light chain complementarity determining region 3 for antibody 37882
QQVDSFPLT

SEQ ID NO: 75764 - protein, 10 aa, Homo sapiens
  heavy chain complementarity determining region 3 for antibody 37882
ARVTFYGMDV

SEQ ID NO: 75765 - protein, 10 aa, Homo sapiens
  light chain complementarity determining region 3 for antibody 37883
QQTYTTPAYT

SEQ ID NO: 75766 - protein, 11 aa, Homo sapiens
  heavy chain complementarity determining region 3 for antibody 37883
ATDSSGWPDDY

SEQ ID NO: 75767 - protein, 8 aa, Homo sapiens
  light chain complementarity determining region 3 for antibody 37884
QQTYTAPA

SEQ ID NO: 75768 - protein, 15 aa, Homo sapiens
  heavy chain complementarity determining region 3 for antibody 37884
ARNRDYFDSFEDLDY

SEQ ID NO: 75769 - protein, 9 aa, Homo sapiens
  light chain complementarity determining region 3 for antibody 37885
QQTYSTPPT

SEQ ID NO: 75770 - protein, 14 aa, Homo sapiens
  heavy chain complementarity determining region 3 for antibody 37885
ARGGFGTRKWLVDS

SEQ ID NO: 75771 - protein, 9 aa, Homo sapiens
  light chain complementarity determining region 3 for antibody 37886
QQTYSSPLT

SEQ ID NO: 75772 - protein, 17 aa, Homo sapiens
  heavy chain complementarity determining region 3 for antibody 37886
ARSGPEWLVHADRPLDY

SEQ ID NO: 75773 - protein, 9 aa, Homo sapiens
  light chain complementarity determining region 3 for antibody 37887
QQTYSMPLT

SEQ ID NO: 75774 - protein, 14 aa, Homo sapiens
  heavy chain complementarity determining region 3 for antibody 37887
ARGRDTSGYPGLDY

SEQ ID NO: 75775 - protein, 9 aa, Homo sapiens
  light chain complementarity determining region 3 for antibody 37888
QQTYSMPLT

SEQ ID NO: 75776 - protein, 14 aa, Homo sapiens
  heavy chain complementarity determining region 3 for antibody 37888
ARGRDASGYSGLDY

SEQ ID NO: 75777 - protein, 9 aa, Homo sapiens
  light chain complementarity determining region 3 for antibody 37889
QQTYSGLYT

SEQ ID NO: 75778 - protein, 13 aa, Homo sapiens
  heavy chain complementarity determining region 3 for antibody 37889
TRGGIAARPSHDS

SEQ ID NO: 75779 - protein, 9 aa, Homo sapiens
  light chain complementarity determining region 3 for antibody 37890
QQTTNFPLT

SEQ ID NO: 75780 - protein, 11 aa, Homo sapiens
  heavy chain complementarity determining region 3 for antibody 37890
ARSGGGAAPDY

SEQ ID NO: 75781 - protein, 9 aa, Homo sapiens
  light chain complementarity determining region 3 for antibody 37891
QQTTNFPLT

SEQ ID NO: 75782 - protein, 12 aa, Homo sapiens
  heavy chain complementarity determining region 3 for antibody 37891
AREQGGGAAPDY

SEQ ID NO: 75783 - protein, 9 aa, Homo sapiens
  light chain complementarity determining region 3 for antibody 37892
QQTITIPLT

SEQ ID NO: 75784 - protein, 8 aa, Homo sapiens
  heavy chain complementarity determining region 3 for antibody 37892
LIYSSGWN

SEQ ID NO: 75785 - protein, 9 aa, Homo sapiens
  light chain complementarity determining region 3 for antibody 37893
QQTHTFPRT

SEQ ID NO: 75786 - protein, 20 aa, Homo sapiens
  heavy chain complementarity determining region 3 for antibody 37893
ARGRRIAALSTAHYYYGMDV

SEQ ID NO: 75787 - protein, 9 aa, Homo sapiens
  light chain complementarity determining region 3 for antibody 37894
QQTHTAPHT

SEQ ID NO: 75788 - protein, 13 aa, Homo sapiens
  heavy chain complementarity determining region 3 for antibody 37894
ARARNYDRISLDF

SEQ ID NO: 75789 - protein, 9 aa, Homo sapiens
  light chain complementarity determining region 3 for antibody 37895
QQTHTALYT

SEQ ID NO: 75790 - protein, 13 aa, Homo sapiens
  heavy chain complementarity determining region 3 for antibody 37895
ARARNYDRISLDF

SEQ ID NO: 75791 - protein, 8 aa, Homo sapiens
  light chain complementarity determining region 3 for antibody 37896
QQTGPSWT

SEQ ID NO: 75792 - protein, 14 aa, Homo sapiens
  heavy chain complementarity determining region 3 for antibody 37896
ARGLQGNGWEPFDF

SEQ ID NO: 75793 - protein, 9 aa, Homo sapiens
  light chain complementarity determining region 3 for antibody 37897
QQTGNLPRT

SEQ ID NO: 75794 - protein, 13 aa, Homo sapiens
  heavy chain complementarity determining region 3 for antibody 37897
AGGNFHSGGYGEY

SEQ ID NO: 75795 - protein, 10 aa, Homo sapiens
  light chain complementarity determining region 3 for antibody 37898
QQTFSPLALP

SEQ ID NO: 75796 - protein, 23 aa, Homo sapiens
  heavy chain complementarity determining region 3 for antibody 37898
ARTPPFGDLSSVTFYQFFYGMDV

SEQ ID NO: 75797 - protein, 10 aa, Homo sapiens
  light chain complementarity determining region 3 for antibody 37899
QQTDSTPPYT

SEQ ID NO: 75798 - protein, 18 aa, Homo sapiens
  heavy chain complementarity determining region 3 for antibody 37899
AREGYYYGAGSYHDAFDI

SEQ ID NO: 75799 - protein, 10 aa, Homo sapiens
  light chain complementarity determining region 3 for antibody 37900
QQTDSTPPHT

SEQ ID NO: 75800 - protein, 8 aa, Homo sapiens
  heavy chain complementarity determining region 3 for antibody 37900
LPLRFTDY

SEQ ID NO: 75801 - protein, 9 aa, Homo sapiens
  light chain complementarity determining region 3 for antibody 37901
QQTDSFPLP

SEQ ID NO: 75802 - protein, 17 aa, Homo sapiens
  heavy chain complementarity determining region 3 for antibody 37901
ARPGSSIAAAGSLYFDL

SEQ ID NO: 75803 - protein, 9 aa, Homo sapiens
  light chain complementarity determining region 3 for antibody 37902
QQSYTTVGT

SEQ ID NO: 75804 - protein, 16 aa, Homo sapiens
  heavy chain complementarity determining region 3 for antibody 37902
ARYDGGTVTNPRWLDP

SEQ ID NO: 75805 - protein, 9 aa, Homo sapiens
  light chain complementarity determining region 3 for antibody 37903
QQSYTTPQP

SEQ ID NO: 75806 - protein, 11 aa, Homo sapiens
  heavy chain complementarity determining region 3 for antibody 37903
ARDGPPSAFDI

SEQ ID NO: 75807 - protein, 11 aa, Homo sapiens
  light chain complementarity determining region 3 for antibody 37904
QQSYTTPPMYT

SEQ ID NO: 75808 - protein, 16 aa, Homo sapiens
  heavy chain complementarity determining region 3 for antibody 37904
ARDPDTSGWYLHAFDI

SEQ ID NO: 75809 - protein, 8 aa, Homo sapiens
  light chain complementarity determining region 3 for antibody 37905
QQSYTSVT

SEQ ID NO: 75810 - protein, 19 aa, Homo sapiens
  heavy chain complementarity determining region 3 for antibody 37905
ARERTSSSNWFVGAAYLLH

SEQ ID NO: 75811 - protein, 9 aa, Homo sapiens
  light chain complementarity determining region 3 for antibody 37906
QQSYTSVRT

SEQ ID NO: 75812 - protein, 12 aa, Homo sapiens
  heavy chain complementarity determining region 3 for antibody 37906
VKDCGLGGSRDS

SEQ ID NO: 75813 - protein, 9 aa, Homo sapiens
  light chain complementarity determining region 3 for antibody 37907
QQSYTSPYT

SEQ ID NO: 75814 - protein, 16 aa, Homo sapiens
  heavy chain complementarity determining region 3 for antibody 37907
ATDWGSGTQWTRAFDV

SEQ ID NO: 75815 - protein, 9 aa, Homo sapiens
  light chain complementarity determining region 3 for antibody 37908
QQSYTSPYT

SEQ ID NO: 75816 - protein, 16 aa, Homo sapiens
  heavy chain complementarity determining region 3 for antibody 37908
ATDWGSGTQWLRAFDV

SEQ ID NO: 75817 - protein, 9 aa, Homo sapiens
  light chain complementarity determining region 3 for antibody 37909
QQSYTSPYT

SEQ ID NO: 75818 - protein, 16 aa, Homo sapiens
  heavy chain complementarity determining region 3 for antibody 37909
ATDWGSGTQRIRAFDV

SEQ ID NO: 75819 - protein, 9 aa, Homo sapiens
  light chain complementarity determining region 3 for antibody 37910
QQSYTSPYT

SEQ ID NO: 75820 - protein, 16 aa, Homo sapiens
  heavy chain complementarity determining region 3 for antibody 37910
ATDWGSGTQGIRAFDV

SEQ ID NO: 75821 - protein, 9 aa, Homo sapiens
  light chain complementarity determining region 3 for antibody 37911
QQSYTSPYT

SEQ ID NO: 75822 - protein, 16 aa, Homo sapiens
  heavy chain complementarity determining region 3 for antibody 37911
ATDWGSGTHWIRAFDV

SEQ ID NO: 75823 - protein, 9 aa, Homo sapiens
  light chain complementarity determining region 3 for antibody 37912
QQSYTSPYN

SEQ ID NO: 75824 - protein, 16 aa, Homo sapiens
  heavy chain complementarity determining region 3 for antibody 37912
ATDWGSGTQWIRAFDV

SEQ ID NO: 75825 - protein, 9 aa, Homo sapiens
  light chain complementarity determining region 3 for antibody 37913
QQSYTSPSN

SEQ ID NO: 75826 - protein, 15 aa, Homo sapiens
  heavy chain complementarity determining region 3 for antibody 37913
ARLSIQLWQKTWFDP

SEQ ID NO: 75827 - protein, 9 aa, Homo sapiens
  light chain complementarity determining region 3 for antibody 37914
QQSYTSPFT

SEQ ID NO: 75828 - protein, 16 aa, Homo sapiens
  heavy chain complementarity determining region 3 for antibody 37914
ATDWGSGTQWIRAFDV

SEQ ID NO: 75829 - protein, 9 aa, Homo sapiens
  light chain complementarity determining region 3 for antibody 37915
QQSYTSPFA

SEQ ID NO: 75830 - protein, 5 aa, Homo sapiens
  heavy chain complementarity determining region 3 for antibody 37915
GTREF

SEQ ID NO: 75831 - protein, 9 aa, Homo sapiens
  light chain complementarity determining region 3 for antibody 37916
QQSYTNPPT

SEQ ID NO: 75832 - protein, 16 aa, Homo sapiens
  heavy chain complementarity determining region 3 for antibody 37916
ARDLQLYSPSSGVFGS

SEQ ID NO: 75833 - protein, 9 aa, Homo sapiens
  light chain complementarity determining region 3 for antibody 37917
QQSYTAPLT

SEQ ID NO: 75834 - protein, 15 aa, Homo sapiens
  heavy chain complementarity determining region 3 for antibody 37917
TRDRLPDDSRGVTDY

SEQ ID NO: 75835 - protein, 9 aa, Homo sapiens
  light chain complementarity determining region 3 for antibody 37918
QQSYSYPRT

SEQ ID NO: 75836 - protein, 10 aa, Homo sapiens
  heavy chain complementarity determining region 3 for antibody 37918
AGGDFRKFDY

SEQ ID NO: 75837 - protein, 9 aa, Homo sapiens
  light chain complementarity determining region 3 for antibody 37919
QQSYSTVYT

SEQ ID NO: 75838 - protein, 15 aa, Homo sapiens
  heavy chain complementarity determining region 3 for antibody 37919
ARQFTSGWYGYWFDP

SEQ ID NO: 75839 - protein, 9 aa, Homo sapiens
  light chain complementarity determining region 3 for antibody 37920
QQSYSTSYT

SEQ ID NO: 75840 - protein, 12 aa, Homo sapiens
  heavy chain complementarity determining region 3 for antibody 37920
ASDPGHSGNYDR

SEQ ID NO: 75841 - protein, 9 aa, Homo sapiens
  light chain complementarity determining region 3 for antibody 37921
QQSYSTSWT

SEQ ID NO: 75842 - protein, 13 aa, Homo sapiens
  heavy chain complementarity determining region 3 for antibody 37921
ARVLSRFTAGLDY

SEQ ID NO: 75843 - protein, 9 aa, Homo sapiens
  light chain complementarity determining region 3 for antibody 37922
QQSYSTSDT

SEQ ID NO: 75844 - protein, 12 aa, Homo sapiens
  heavy chain complementarity determining region 3 for antibody 37922
ASDPGHSGNYYR

SEQ ID NO: 75845 - protein, 9 aa, Homo sapiens
  light chain complementarity determining region 3 for antibody 37923
QQSYSTQWT

SEQ ID NO: 75846 - protein, 23 aa, Homo sapiens
  heavy chain complementarity determining region 3 for antibody 37923
ARLSRDPIAVRTAPLNYYCAMDV

SEQ ID NO: 75847 - protein, 9 aa, Homo sapiens
  light chain complementarity determining region 3 for antibody 37924
QQSYSTQGT

SEQ ID NO: 75848 - protein, 23 aa, Homo sapiens
  heavy chain complementarity determining region 3 for antibody 37924
ARLSRDPIAVRTAPLNYYFAMDV

SEQ ID NO: 75849 - protein, 9 aa, Homo sapiens
  light chain complementarity determining region 3 for antibody 37925
QQSYSTPYT

SEQ ID NO: 75850 - protein, 15 aa, Homo sapiens
  heavy chain complementarity determining region 3 for antibody 37925
TRDHQRGTYLYSFDA

SEQ ID NO: 75851 - protein, 9 aa, Homo sapiens
  light chain complementarity determining region 3 for antibody 37926
QQSYSTPYT

SEQ ID NO: 75852 - protein, 14 aa, Homo sapiens
  heavy chain complementarity determining region 3 for antibody 37926
ATNGLLWSEGAGDF

SEQ ID NO: 75853 - protein, 9 aa, Homo sapiens
  light chain complementarity determining region 3 for antibody 37927
QQSYSTPYT

SEQ ID NO: 75854 - protein, 17 aa, Homo sapiens
  heavy chain complementarity determining region 3 for antibody 37927
ASGGVSDYRSHYYGMDV

SEQ ID NO: 75855 - protein, 9 aa, Homo sapiens
  light chain complementarity determining region 3 for antibody 37928
QQSYSTPYT

SEQ ID NO: 75856 - protein, 16 aa, Homo sapiens
  heavy chain complementarity determining region 3 for antibody 37928
ARRYCSGNTCYGDFDY

SEQ ID NO: 75857 - protein, 9 aa, Homo sapiens
  light chain complementarity determining region 3 for antibody 37929
QQSYSTPWR

SEQ ID NO: 75858 - protein, 13 aa, Homo sapiens
  heavy chain complementarity determining region 3 for antibody 37929
VNVSQWLDDAFNF

SEQ ID NO: 75859 - protein, 9 aa, Homo sapiens
  light chain complementarity determining region 3 for antibody 37930
QQSYSTPWK

SEQ ID NO: 75860 - protein, 13 aa, Homo sapiens
  heavy chain complementarity determining region 3 for antibody 37930
VNVSQWLDDAFNF

SEQ ID NO: 75861 - protein, 9 aa, Homo sapiens
  light chain complementarity determining region 3 for antibody 37931
QQSYSTPST

SEQ ID NO: 75862 - protein, 17 aa, Homo sapiens
  heavy chain complementarity determining region 3 for antibody 37931
TTEQISNDYYDSGAFDY

SEQ ID NO: 75863 - protein, 9 aa, Homo sapiens
  light chain complementarity determining region 3 for antibody 37932
QQSYSTPRT

SEQ ID NO: 75864 - protein, 12 aa, Homo sapiens
  heavy chain complementarity determining region 3 for antibody 37932
TGEAPARAWFDP

SEQ ID NO: 75865 - protein, 9 aa, Homo sapiens
  light chain complementarity determining region 3 for antibody 37933
QQSYSTPRT

SEQ ID NO: 75866 - protein, 20 aa, Homo sapiens
  heavy chain complementarity determining region 3 for antibody 37933
ASPRGVSHLATAGSPDYFDL

SEQ ID NO: 75867 - protein, 9 aa, Homo sapiens
  light chain complementarity determining region 3 for antibody 37934
QQSYSTPRP

SEQ ID NO: 75868 - protein, 20 aa, Homo sapiens
  heavy chain complementarity determining region 3 for antibody 37934
ARPRGVSHLATAGSPDYFDL

SEQ ID NO: 75869 - protein, 11 aa, Homo sapiens
  light chain complementarity determining region 3 for antibody 37935
QQSYSTPQALT

SEQ ID NO: 75870 - protein, 15 aa, Homo sapiens
  heavy chain complementarity determining region 3 for antibody 37935
ARQCIGSFGETMFDY

SEQ ID NO: 75871 - protein, 10 aa, Homo sapiens
  light chain complementarity determining region 3 for antibody 37936
QQSYSTPPYT

SEQ ID NO: 75872 - protein, 15 aa, Homo sapiens
  heavy chain complementarity determining region 3 for antibody 37936
ARDSLIGHGSTGDVY

SEQ ID NO: 75873 - protein, 10 aa, Homo sapiens
  light chain complementarity determining region 3 for antibody 37937
QQSYSTPPYT

SEQ ID NO: 75874 - protein, 7 aa, Homo sapiens
  heavy chain complementarity determining region 3 for antibody 37937
ADPPSDF

SEQ ID NO: 75875 - protein, 10 aa, Homo sapiens
  light chain complementarity determining region 3 for antibody 37938
QQSYSTPPYP

SEQ ID NO: 75876 - protein, 18 aa, Homo sapiens
  heavy chain complementarity determining region 3 for antibody 37938
ARSPYCEGDCFSRAQLDY

SEQ ID NO: 75877 - protein, 10 aa, Homo sapiens
  light chain complementarity determining region 3 for antibody 37939
QQSYSTPPYP

SEQ ID NO: 75878 - protein, 12 aa, Homo sapiens
  heavy chain complementarity determining region 3 for antibody 37939
ARPFDDYGENDY

SEQ ID NO: 75879 - protein, 9 aa, Homo sapiens
  light chain complementarity determining region 3 for antibody 37940
QQSYSTPPT

SEQ ID NO: 75880 - protein, 13 aa, Homo sapiens
  heavy chain complementarity determining region 3 for antibody 37940
ARHLPKSRNSYDY

SEQ ID NO: 75881 - protein, 9 aa, Homo sapiens
  light chain complementarity determining region 3 for antibody 37941
QQSYSTPPT

SEQ ID NO: 75882 - protein, 19 aa, Homo sapiens
  heavy chain complementarity determining region 3 for antibody 37941
AKEHSPFSLIAVEGFDFDY

SEQ ID NO: 75883 - protein, 9 aa, Homo sapiens
  light chain complementarity determining region 3 for antibody 37942
QQSYSTPPT

SEQ ID NO: 75884 - protein, 18 aa, Homo sapiens
  heavy chain complementarity determining region 3 for antibody 37942
AKDRSYVDYVSGSYRFDY

SEQ ID NO: 75885 - protein, 11 aa, Homo sapiens
  light chain complementarity determining region 3 for antibody 37943
QQSYSTPPMYT

SEQ ID NO: 75886 - protein, 14 aa, Homo sapiens
  heavy chain complementarity determining region 3 for antibody 37943
AKDRYSRRAYYFDY

SEQ ID NO: 75887 - protein, 10 aa, Homo sapiens
  light chain complementarity determining region 3 for antibody 37944
QQSYSTPPHT

SEQ ID NO: 75888 - protein, 15 aa, Homo sapiens
  heavy chain complementarity determining region 3 for antibody 37944
VRTKEWFGKIDPFDY

SEQ ID NO: 75889 - protein, 10 aa, Homo sapiens
  light chain complementarity determining region 3 for antibody 37945
QQSYSTPMYP

SEQ ID NO: 75890 - protein, 12 aa, Homo sapiens
  heavy chain complementarity determining region 3 for antibody 37945
AREPTFNPHFDY

SEQ ID NO: 75891 - protein, 10 aa, Homo sapiens
  light chain complementarity determining region 3 for antibody 37946
QQSYSTPMAT

SEQ ID NO: 75892 - protein, 9 aa, Homo sapiens
  heavy chain complementarity determining region 3 for antibody 37946
ARGHNGWGD

SEQ ID NO: 75893 - protein, 9 aa, Homo sapiens
  light chain complementarity determining region 3 for antibody 37947
QQSYSTPLT

SEQ ID NO: 75894 - protein, 15 aa, Homo sapiens
  heavy chain complementarity determining region 3 for antibody 37947
VRHYRIITAPLEGDS

SEQ ID NO: 75895 - protein, 9 aa, Homo sapiens
  light chain complementarity determining region 3 for antibody 37948
QQSYSTPLT

SEQ ID NO: 75896 - protein, 17 aa, Homo sapiens
  heavy chain complementarity determining region 3 for antibody 37948
TPHPIISVRGVITPLDY

SEQ ID NO: 75897 - protein, 9 aa, Homo sapiens
  light chain complementarity determining region 3 for antibody 37949
QQSYSTPLT

SEQ ID NO: 75898 - protein, 17 aa, Homo sapiens
  heavy chain complementarity determining region 3 for antibody 37949
TPHPIIIVRGVITPLDY

SEQ ID NO: 75899 - protein, 9 aa, Homo sapiens
  light chain complementarity determining region 3 for antibody 37950
QQSYSTPLT

SEQ ID NO: 75900 - protein, 16 aa, Homo sapiens
  heavy chain complementarity determining region 3 for antibody 37950
AREGGGTYTSNRAFDY

SEQ ID NO: 75901 - protein, 9 aa, Homo sapiens
  light chain complementarity determining region 3 for antibody 37951
QQSYSTPLT

SEQ ID NO: 75902 - protein, 22 aa, Homo sapiens
  heavy chain complementarity determining region 3 for antibody 37951
AKPGYYGSGRGLQIYYYHGMDV

SEQ ID NO: 75903 - protein, 9 aa, Homo sapiens
  light chain complementarity determining region 3 for antibody 37952
QQSYSTPLP

SEQ ID NO: 75904 - protein, 15 aa, Homo sapiens
  heavy chain complementarity determining region 3 for antibody 37952
ATPPVGDYPKGVLHI

SEQ ID NO: 75905 - protein, 10 aa, Homo sapiens
  light chain complementarity determining region 3 for antibody 37953
QQSYSTPLFT

SEQ ID NO: 75906 - protein, 17 aa, Homo sapiens
  heavy chain complementarity determining region 3 for antibody 37953
AKGRNCSGGSCNFRYDY

SEQ ID NO: 75907 - protein, 9 aa, Homo sapiens
  light chain complementarity determining region 3 for antibody 37954
QQSYSTPHP

SEQ ID NO: 75908 - protein, 23 aa, Homo sapiens
  heavy chain complementarity determining region 3 for antibody 37954
ARIESDATMVRGVIITKGNWFDP

SEQ ID NO: 75909 - protein, 9 aa, Homo sapiens
  light chain complementarity determining region 3 for antibody 37955
QQSYSTPGT

SEQ ID NO: 75910 - protein, 13 aa, Homo sapiens
  heavy chain complementarity determining region 3 for antibody 37955
VNVSQWLDDAFNF

SEQ ID NO: 75911 - protein, 9 aa, Homo sapiens
  light chain complementarity determining region 3 for antibody 37956
QQSYSTPGT

SEQ ID NO: 75912 - protein, 15 aa, Homo sapiens
  heavy chain complementarity determining region 3 for antibody 37956
ASRYSSGWYYYGMDV

SEQ ID NO: 75913 - protein, 9 aa, Homo sapiens
  light chain complementarity determining region 3 for antibody 37957
QQSYSTPDT

SEQ ID NO: 75914 - protein, 14 aa, Homo sapiens
  heavy chain complementarity determining region 3 for antibody 37957
ATNGLLWSEGTGDF

SEQ ID NO: 75915 - protein, 9 aa, Homo sapiens
  light chain complementarity determining region 3 for antibody 37958
QQSYSTPDT

SEQ ID NO: 75916 - protein, 24 aa, Homo sapiens
  heavy chain complementarity determining region 3 for antibody 37958
ARGQLYDSRGYYSFSGNTRHWFDP

SEQ ID NO: 75917 - protein, 10 aa, Homo sapiens
  light chain complementarity determining region 3 for antibody 37959
QQSYSTPAPT

SEQ ID NO: 75918 - protein, 19 aa, Homo sapiens
  heavy chain complementarity determining region 3 for antibody 37959
AKPNRGQWLPMGPQYYFDS

SEQ ID NO: 75919 - protein, 10 aa, Homo sapiens
  light chain complementarity determining region 3 for antibody 37960
QQSYSTPALT

SEQ ID NO: 75920 - protein, 19 aa, Homo sapiens
  heavy chain complementarity determining region 3 for antibody 37960
ANPNRGQWLPMGPQYYFDS

SEQ ID NO: 75921 - protein, 9 aa, Homo sapiens
  light chain complementarity determining region 3 for antibody 37961
QQSYSTLRP

SEQ ID NO: 75922 - protein, 16 aa, Homo sapiens
  heavy chain complementarity determining region 3 for antibody 37961
AHRLGGSGSYEDAFDI

SEQ ID NO: 75923 - protein, 9 aa, Homo sapiens
  light chain complementarity determining region 3 for antibody 37962
QQSYSTLLT

SEQ ID NO: 75924 - protein, 16 aa, Homo sapiens
  heavy chain complementarity determining region 3 for antibody 37962
AREGGGTYASNRAFDY

SEQ ID NO: 75925 - protein, 10 aa, Homo sapiens
  light chain complementarity determining region 3 for antibody 37963
QQSYSTFSWP

SEQ ID NO: 75926 - protein, 14 aa, Homo sapiens
  heavy chain complementarity determining region 3 for antibody 37963
ARVDTSGGKNCFDP

SEQ ID NO: 75927 - protein, 10 aa, Homo sapiens
  light chain complementarity determining region 3 for antibody 37964
QQSYSTFSGT

SEQ ID NO: 75928 - protein, 14 aa, Homo sapiens
  heavy chain complementarity determining region 3 for antibody 37964
ARVDTSGGKNCFDP

SEQ ID NO: 75929 - protein, 9 aa, Homo sapiens
  light chain complementarity determining region 3 for antibody 37965
QQSYSTAYT

SEQ ID NO: 75930 - protein, 14 aa, Homo sapiens
  heavy chain complementarity determining region 3 for antibody 37965
ARLRSGGDFTPFDF

SEQ ID NO: 75931 - protein, 9 aa, Homo sapiens
  light chain complementarity determining region 3 for antibody 37966
QQSYSSQLP

SEQ ID NO: 75932 - protein, 16 aa, Homo sapiens
  heavy chain complementarity determining region 3 for antibody 37966
AREEGSTYTSNRAFDS

SEQ ID NO: 75933 - protein, 9 aa, Homo sapiens
  light chain complementarity determining region 3 for antibody 37967
QQSYSSPYT

SEQ ID NO: 75934 - protein, 11 aa, Homo sapiens
  heavy chain complementarity determining region 3 for antibody 37967
TTSLLAIWGSY

SEQ ID NO: 75935 - protein, 9 aa, Homo sapiens
  light chain complementarity determining region 3 for antibody 37968
QQSYSSPYT

SEQ ID NO: 75936 - protein, 15 aa, Homo sapiens
  heavy chain complementarity determining region 3 for antibody 37968
TRGNSGNYLVRAFDI

SEQ ID NO: 75937 - protein, 9 aa, Homo sapiens
  light chain complementarity determining region 3 for antibody 37969
QQSYSSPYT

SEQ ID NO: 75938 - protein, 16 aa, Homo sapiens
  heavy chain complementarity determining region 3 for antibody 37969
ATDWGSGTQWIRAFDV

SEQ ID NO: 75939 - protein, 9 aa, Homo sapiens
  light chain complementarity determining region 3 for antibody 37970
QQSYSSPYT

SEQ ID NO: 75940 - protein, 14 aa, Homo sapiens
  heavy chain complementarity determining region 3 for antibody 37970
ARDPQRGKPDYFDY

SEQ ID NO: 75941 - protein, 9 aa, Homo sapiens
  light chain complementarity determining region 3 for antibody 37971
QQSYSSPRT

SEQ ID NO: 75942 - protein, 22 aa, Homo sapiens
  heavy chain complementarity determining region 3 for antibody 37971
AREPAPYYDMLIVDDYYYGMDV

SEQ ID NO: 75943 - protein, 9 aa, Homo sapiens
  light chain complementarity determining region 3 for antibody 37972
QQSYSSPRT

SEQ ID NO: 75944 - protein, 22 aa, Homo sapiens
  heavy chain complementarity determining region 3 for antibody 37972
AREPAPYYDILIVDDYYYGMDA

SEQ ID NO: 75945 - protein, 9 aa, Homo sapiens
  light chain complementarity determining region 3 for antibody 37973
QQSYSSPRT

SEQ ID NO: 75946 - protein, 10 aa, Homo sapiens
  heavy chain complementarity determining region 3 for antibody 37973
AGGDFRNFDY

SEQ ID NO: 75947 - protein, 9 aa, Homo sapiens
  light chain complementarity determining region 3 for antibody 37974
QQSYSSPRT

SEQ ID NO: 75948 - protein, 10 aa, Homo sapiens
  heavy chain complementarity determining region 3 for antibody 37974
AGGDFRKFGY

SEQ ID NO: 75949 - protein, 9 aa, Homo sapiens
  light chain complementarity determining region 3 for antibody 37975
QQSYSSPPT

SEQ ID NO: 75950 - protein, 16 aa, Homo sapiens
  heavy chain complementarity determining region 3 for antibody 37975
AREGGSTYTTKRAFDS

SEQ ID NO: 75951 - protein, 9 aa, Homo sapiens
  light chain complementarity determining region 3 for antibody 37976
QQSYSSPLP

SEQ ID NO: 75952 - protein, 16 aa, Homo sapiens
  heavy chain complementarity determining region 3 for antibody 37976
AREGGSTYTTKRAFDS

SEQ ID NO: 75953 - protein, 9 aa, Homo sapiens
  light chain complementarity determining region 3 for antibody 37977
QQSYSSPGT

SEQ ID NO: 75954 - protein, 16 aa, Homo sapiens
  heavy chain complementarity determining region 3 for antibody 37977
AREGAVGVTTSGIFDI

SEQ ID NO: 75955 - protein, 8 aa, Homo sapiens
  light chain complementarity determining region 3 for antibody 37978
QQSYSSLT

SEQ ID NO: 75956 - protein, 24 aa, Homo sapiens
  heavy chain complementarity determining region 3 for antibody 37978
ARGRPPSGWYRLKDRTYYYYGLDV

SEQ ID NO: 75957 - protein, 9 aa, Homo sapiens
  light chain complementarity determining region 3 for antibody 37979
QQSYSSLST

SEQ ID NO: 75958 - protein, 16 aa, Homo sapiens
  heavy chain complementarity determining region 3 for antibody 37979
AREGGSTYTTKRAFDS

SEQ ID NO: 75959 - protein, 9 aa, Homo sapiens
  light chain complementarity determining region 3 for antibody 37980
QQSYSSLLT

SEQ ID NO: 75960 - protein, 16 aa, Homo sapiens
  heavy chain complementarity determining region 3 for antibody 37980
TREGGSTYTTKRAFDS

SEQ ID NO: 75961 - protein, 9 aa, Homo sapiens
  light chain complementarity determining region 3 for antibody 37981
QQSYSSLLT

SEQ ID NO: 75962 - protein, 16 aa, Homo sapiens
  heavy chain complementarity determining region 3 for antibody 37981
AREGGSTYTTKRAFDP

SEQ ID NO: 75963 - protein, 9 aa, Homo sapiens
  light chain complementarity determining region 3 for antibody 37982
QQSYSSLLT

SEQ ID NO: 75964 - protein, 16 aa, Homo sapiens
  heavy chain complementarity determining region 3 for antibody 37982
AREGGSTYTPKRAFDS

SEQ ID NO: 75965 - protein, 9 aa, Homo sapiens
  light chain complementarity determining region 3 for antibody 37983
QQSYSSLLT

SEQ ID NO: 75966 - protein, 16 aa, Homo sapiens
  heavy chain complementarity determining region 3 for antibody 37983
AREGGPTYTTKRAFDS

SEQ ID NO: 75967 - protein, 9 aa, Homo sapiens
  light chain complementarity determining region 3 for antibody 37984
QQSYSPPRP

SEQ ID NO: 75968 - protein, 21 aa, Homo sapiens
  heavy chain complementarity determining region 3 for antibody 37984
ARVTVRVPSTTGFGEYYGLDV

SEQ ID NO: 75969 - protein, 11 aa, Homo sapiens
  light chain complementarity determining region 3 for antibody 37985
QQSYSPPPMYT

SEQ ID NO: 75970 - protein, 14 aa, Homo sapiens
  heavy chain complementarity determining region 3 for antibody 37985
AKDRYSRRVYYFDY

SEQ ID NO: 75971 - protein, 9 aa, Homo sapiens
  light chain complementarity determining region 3 for antibody 37986
QQSYSPPFT

SEQ ID NO: 75972 - protein, 16 aa, Homo sapiens
  heavy chain complementarity determining region 3 for antibody 37986
ARGREYGDSLYWYFDL

SEQ ID NO: 75973 - protein, 9 aa, Homo sapiens
  light chain complementarity determining region 3 for antibody 37987
QQSYSPLST

SEQ ID NO: 75974 - protein, 15 aa, Homo sapiens
  heavy chain complementarity determining region 3 for antibody 37987
ARDRDYGDYADGSDP

SEQ ID NO: 75975 - protein, 9 aa, Homo sapiens
  light chain complementarity determining region 3 for antibody 37988
QQSYSPFFT

SEQ ID NO: 75976 - protein, 16 aa, Homo sapiens
  heavy chain complementarity determining region 3 for antibody 37988
ARGREYGDSLYWYFDL

SEQ ID NO: 75977 - protein, 8 aa, Homo sapiens
  light chain complementarity determining region 3 for antibody 37989
QQSYSNPL

SEQ ID NO: 75978 - protein, 13 aa, Homo sapiens
  heavy chain complementarity determining region 3 for antibody 37989
SRDKELGFGVLDY

SEQ ID NO: 75979 - protein, 9 aa, Homo sapiens
  light chain complementarity determining region 3 for antibody 37990
QQSYSNPIT

SEQ ID NO: 75980 - protein, 8 aa, Homo sapiens
  heavy chain complementarity determining region 3 for antibody 37990
ARGRRLST

SEQ ID NO: 75981 - protein, 9 aa, Homo sapiens
  light chain complementarity determining region 3 for antibody 37991
QQSYSNPFT

SEQ ID NO: 75982 - protein, 15 aa, Homo sapiens
  heavy chain complementarity determining region 3 for antibody 37991
ARSRRSGLHYYGMDV

SEQ ID NO: 75983 - protein, 9 aa, Homo sapiens
  light chain complementarity determining region 3 for antibody 37992
QQSYSNPFT

SEQ ID NO: 75984 - protein, 14 aa, Homo sapiens
  heavy chain complementarity determining region 3 for antibody 37992
AKAVTTMVRGVIDY

SEQ ID NO: 75985 - protein, 9 aa, Homo sapiens
  light chain complementarity determining region 3 for antibody 37993
QQSYSLPYT

SEQ ID NO: 75986 - protein, 14 aa, Homo sapiens
  heavy chain complementarity determining region 3 for antibody 37993
AREEIWGTIRGFDM

SEQ ID NO: 75987 - protein, 9 aa, Homo sapiens
  light chain complementarity determining region 3 for antibody 37994
QQSYSLPRN

SEQ ID NO: 75988 - protein, 13 aa, Homo sapiens
  heavy chain complementarity determining region 3 for antibody 37994
VYCSTDKCYAFDN

SEQ ID NO: 75989 - protein, 10 aa, Homo sapiens
  light chain complementarity determining region 3 for antibody 37995
QQSYSLPPLS

SEQ ID NO: 75990 - protein, 15 aa, Homo sapiens
  heavy chain complementarity determining region 3 for antibody 37995
VSDRNSSGFRGAFDI

SEQ ID NO: 75991 - protein, 9 aa, Homo sapiens
  light chain complementarity determining region 3 for antibody 37996
QQSYSIPRT

SEQ ID NO: 75992 - protein, 13 aa, Homo sapiens
  heavy chain complementarity determining region 3 for antibody 37996
VYCSTDKCYAFDN

SEQ ID NO: 75993 - protein, 9 aa, Homo sapiens
  light chain complementarity determining region 3 for antibody 37997
QQSYSIPRT

SEQ ID NO: 75994 - protein, 12 aa, Homo sapiens
  heavy chain complementarity determining region 3 for antibody 37997
ARNGAGSYGIDV

SEQ ID NO: 75995 - protein, 9 aa, Homo sapiens
  light chain complementarity determining region 3 for antibody 37998
QQSYSIPFP

SEQ ID NO: 75996 - protein, 15 aa, Homo sapiens
  heavy chain complementarity determining region 3 for antibody 37998
ARGGDSSGYHAPSDY

SEQ ID NO: 75997 - protein, 8 aa, Homo sapiens
  light chain complementarity determining region 3 for antibody 37999
QQSYSGLT

SEQ ID NO: 75998 - protein, 24 aa, Homo sapiens
  heavy chain complementarity determining region 3 for antibody 37999
ARGRPPSGWYRLKDRTYYYYGLDV

SEQ ID NO: 75999 - protein, 9 aa, Homo sapiens
  light chain complementarity determining region 3 for antibody 38000
QQSYSFPRT

SEQ ID NO: 76000 - protein, 10 aa, Homo sapiens
  heavy chain complementarity determining region 3 for antibody 38000
AGGDFRKFDY

SEQ ID NO: 76001 - protein, 10 aa, Homo sapiens
  light chain complementarity determining region 3 for antibody 38001
QQSYSFPPLS

SEQ ID NO: 76002 - protein, 15 aa, Homo sapiens
  heavy chain complementarity determining region 3 for antibody 38001
VSDRNISGFRGAFDI

SEQ ID NO: 76003 - protein, 9 aa, Homo sapiens
  light chain complementarity determining region 3 for antibody 38002
QQSYSFLLT

SEQ ID NO: 76004 - protein, 16 aa, Homo sapiens
  heavy chain complementarity determining region 3 for antibody 38002
AREGGSTYTTKRAFDS

SEQ ID NO: 76005 - protein, 9 aa, Homo sapiens
  light chain complementarity determining region 3 for antibody 38003
QQSYSDPPT

SEQ ID NO: 76006 - protein, 16 aa, Homo sapiens
  heavy chain complementarity determining region 3 for antibody 38003
ARHLQIHSTSSGIFGI

SEQ ID NO: 76007 - protein, 9 aa, Homo sapiens
  light chain complementarity determining region 3 for antibody 38004
QQSYSDFYT

SEQ ID NO: 76008 - protein, 18 aa, Homo sapiens
  heavy chain complementarity determining region 3 for antibody 38004
AREVHGSGSHVAADYFQH

SEQ ID NO: 76009 - protein, 9 aa, Homo sapiens
  light chain complementarity determining region 3 for antibody 38005
QQSYSAPWP

SEQ ID NO: 76010 - protein, 13 aa, Homo sapiens
  heavy chain complementarity determining region 3 for antibody 38005
ARQDESTSYYFDL

SEQ ID NO: 76011 - protein, 10 aa, Homo sapiens
  light chain complementarity determining region 3 for antibody 38006
QQSYSAPPYT

SEQ ID NO: 76012 - protein, 13 aa, Homo sapiens
  heavy chain complementarity determining region 3 for antibody 38006
TTIGAFLDDAFDF

SEQ ID NO: 76013 - protein, 8 aa, Homo sapiens
  light chain complementarity determining region 3 for antibody 38007
QQSYSALT

SEQ ID NO: 76014 - protein, 24 aa, Homo sapiens
  heavy chain complementarity determining region 3 for antibody 38007
ARGRPPSSWYRLKDRTYYYYGLDV

SEQ ID NO: 76015 - protein, 8 aa, Homo sapiens
  light chain complementarity determining region 3 for antibody 38008
QQSYSALT

SEQ ID NO: 76016 - protein, 24 aa, Homo sapiens
  heavy chain complementarity determining region 3 for antibody 38008
ARGRPPSGWYRRKDRTYYYYGLDV

SEQ ID NO: 76017 - protein, 8 aa, Homo sapiens
  light chain complementarity determining region 3 for antibody 38009
QQSYSALT

SEQ ID NO: 76018 - protein, 24 aa, Homo sapiens
  heavy chain complementarity determining region 3 for antibody 38009
ARGRPPSGWYRLKDRTYCYYGLDV

SEQ ID NO: 76019 - protein, 8 aa, Homo sapiens
  light chain complementarity determining region 3 for antibody 38010
QQSYSALT

SEQ ID NO: 76020 - protein, 24 aa, Homo sapiens
  heavy chain complementarity determining region 3 for antibody 38010
ARGRPPSGWYRLKDRTCYYYGLDV

SEQ ID NO: 76021 - protein, 8 aa, Homo sapiens
  light chain complementarity determining region 3 for antibody 38011
QQSYSALT

SEQ ID NO: 76022 - protein, 24 aa, Homo sapiens
  heavy chain complementarity determining region 3 for antibody 38011
ARGRPPSGWDRLKDRTYYYYGLDV

SEQ ID NO: 76023 - protein, 8 aa, Homo sapiens
  light chain complementarity determining region 3 for antibody 38012
QQSYSALT

SEQ ID NO: 76024 - protein, 24 aa, Homo sapiens
  heavy chain complementarity determining region 3 for antibody 38012
ARGRPPSGWCRLKDRTYYYYGLDV

SEQ ID NO: 76025 - protein, 10 aa, Homo sapiens
  light chain complementarity determining region 3 for antibody 38013
QQSYSALPFT

SEQ ID NO: 76026 - protein, 21 aa, Homo sapiens
  heavy chain complementarity determining region 3 for antibody 38013
ARDVKHYDSSGSYWPLDVFDI

SEQ ID NO: 76027 - protein, 9 aa, Homo sapiens
  light chain complementarity determining region 3 for antibody 38014
QQSYRTPYT

SEQ ID NO: 76028 - protein, 17 aa, Homo sapiens
  heavy chain complementarity determining region 3 for antibody 38014
SSGGVSDYRSHYYGMDV

SEQ ID NO: 76029 - protein, 9 aa, Homo sapiens
  light chain complementarity determining region 3 for antibody 38015
QQSYRTPYT

SEQ ID NO: 76030 - protein, 12 aa, Homo sapiens
  heavy chain complementarity determining region 3 for antibody 38015
AREYGAQGAFDI

SEQ ID NO: 76031 - protein, 9 aa, Homo sapiens
  light chain complementarity determining region 3 for antibody 38016
QQSYRTPYP

SEQ ID NO: 76032 - protein, 12 aa, Homo sapiens
  heavy chain complementarity determining region 3 for antibody 38016
AREYGAPGAFDI

SEQ ID NO: 76033 - protein, 9 aa, Homo sapiens
  light chain complementarity determining region 3 for antibody 38017
QQSYRTPST

SEQ ID NO: 76034 - protein, 12 aa, Homo sapiens
  heavy chain complementarity determining region 3 for antibody 38017
AREYGAPGAFDI

SEQ ID NO: 76035 - protein, 9 aa, Homo sapiens
  light chain complementarity determining region 3 for antibody 38018
QQSYRTPRT

SEQ ID NO: 76036 - protein, 15 aa, Homo sapiens
  heavy chain complementarity determining region 3 for antibody 38018
ARDRGAAALFYGLDV

SEQ ID NO: 76037 - protein, 9 aa, Homo sapiens
  light chain complementarity determining region 3 for antibody 38019
QQSYRTPRT

SEQ ID NO: 76038 - protein, 15 aa, Homo sapiens
  heavy chain complementarity determining region 3 for antibody 38019
AGDRGAAALFYGVDV

SEQ ID NO: 76039 - protein, 9 aa, Homo sapiens
  light chain complementarity determining region 3 for antibody 38020
QQSYRTPPT

SEQ ID NO: 76040 - protein, 14 aa, Homo sapiens
  heavy chain complementarity determining region 3 for antibody 38020
ARDGHTKTWYALDH

SEQ ID NO: 76041 - protein, 10 aa, Homo sapiens
  light chain complementarity determining region 3 for antibody 38021
QQSYRTPMYT

SEQ ID NO: 76042 - protein, 20 aa, Homo sapiens
  heavy chain complementarity determining region 3 for antibody 38021
ARVLTRGGYSYGRGYDAFDI

SEQ ID NO: 76043 - protein, 10 aa, Homo sapiens
  light chain complementarity determining region 3 for antibody 38022
QQSYRTPMYT

SEQ ID NO: 76044 - protein, 20 aa, Homo sapiens
  heavy chain complementarity determining region 3 for antibody 38022
ARVLSRGGYSYGRGYDVFDI

SEQ ID NO: 76045 - protein, 10 aa, Homo sapiens
  light chain complementarity determining region 3 for antibody 38023
QQSYRTPMNT

SEQ ID NO: 76046 - protein, 20 aa, Homo sapiens
  heavy chain complementarity determining region 3 for antibody 38023
ARVLTRGGYSYGRGYDVFDI

SEQ ID NO: 76047 - protein, 10 aa, Homo sapiens
  light chain complementarity determining region 3 for antibody 38024
QQSYRTPIYT

SEQ ID NO: 76048 - protein, 20 aa, Homo sapiens
  heavy chain complementarity determining region 3 for antibody 38024
ARVLTRGGYSYGRGYDVFDI

SEQ ID NO: 76049 - protein, 9 aa, Homo sapiens
  light chain complementarity determining region 3 for antibody 38025
QQSYRTPHT

SEQ ID NO: 76050 - protein, 23 aa, Homo sapiens
  heavy chain complementarity determining region 3 for antibody 38025
ARIESDATMVRGVIITKGNWFDP

SEQ ID NO: 76051 - protein, 9 aa, Homo sapiens
  light chain complementarity determining region 3 for antibody 38026
QQSYRNPQT

SEQ ID NO: 76052 - protein, 14 aa, Homo sapiens
  heavy chain complementarity determining region 3 for antibody 38026
ARDGHTKTWYALDH

SEQ ID NO: 76053 - protein, 9 aa, Homo sapiens
  light chain complementarity determining region 3 for antibody 38027
QQSYRLPYT

SEQ ID NO: 76054 - protein, 14 aa, Homo sapiens
  heavy chain complementarity determining region 3 for antibody 38027
AREESWGTIRGFDM

SEQ ID NO: 76055 - protein, 9 aa, Homo sapiens
  light chain complementarity determining region 3 for antibody 38028
QQSYRLLWT

SEQ ID NO: 76056 - protein, 13 aa, Homo sapiens
  heavy chain complementarity determining region 3 for antibody 38028
VTRAFRFGKVMDV

SEQ ID NO: 76057 - protein, 9 aa, Homo sapiens
  light chain complementarity determining region 3 for antibody 38029
QQSYRILWT

SEQ ID NO: 76058 - protein, 13 aa, Homo sapiens
  heavy chain complementarity determining region 3 for antibody 38029
VTRAFRCGKVMDV

SEQ ID NO: 76059 - protein, 9 aa, Homo sapiens
  light chain complementarity determining region 3 for antibody 38030
QQSYRDFYT

SEQ ID NO: 76060 - protein, 18 aa, Homo sapiens
  heavy chain complementarity determining region 3 for antibody 38030
AREVHGSGSHVTADYFQH

SEQ ID NO: 76061 - protein, 9 aa, Homo sapiens
  light chain complementarity determining region 3 for antibody 38031
QQSYRAPQT

SEQ ID NO: 76062 - protein, 14 aa, Homo sapiens
  heavy chain complementarity determining region 3 for antibody 38031
ARDGHTKTWYALDH

SEQ ID NO: 76063 - protein, 9 aa, Homo sapiens
  light chain complementarity determining region 3 for antibody 38032
QQSYPSPYT

SEQ ID NO: 76064 - protein, 16 aa, Homo sapiens
  heavy chain complementarity determining region 3 for antibody 38032
ATDWGSGTQWIRAFDV

SEQ ID NO: 76065 - protein, 10 aa, Homo sapiens
  light chain complementarity determining region 3 for antibody 38033
QQSYNTSLYT

SEQ ID NO: 76066 - protein, 28 aa, Homo sapiens
  heavy chain complementarity determining region 3 for antibody 38033
AREPPPAKKVDCGYASCSVVYEHYGLDV

SEQ ID NO: 76067 - protein, 10 aa, Homo sapiens
  light chain complementarity determining region 3 for antibody 38034
QQSYNTPPWP

SEQ ID NO: 76068 - protein, 12 aa, Homo sapiens
  heavy chain complementarity determining region 3 for antibody 38034
ARVSPVRGVIEY

SEQ ID NO: 76069 - protein, 10 aa, Homo sapiens
  light chain complementarity determining region 3 for antibody 38035
QQSYNTPPRT

SEQ ID NO: 76070 - protein, 12 aa, Homo sapiens
  heavy chain complementarity determining region 3 for antibody 38035
ARVSPVRGVIEY

SEQ ID NO: 76071 - protein, 9 aa, Homo sapiens
  light chain complementarity determining region 3 for antibody 38036
QQSYNSPYT

SEQ ID NO: 76072 - protein, 16 aa, Homo sapiens
  heavy chain complementarity determining region 3 for antibody 38036
ATDWGSGTQWIRAFDV

SEQ ID NO: 76073 - protein, 9 aa, Homo sapiens
  light chain complementarity determining region 3 for antibody 38037
QQSYNSPFT

SEQ ID NO: 76074 - protein, 15 aa, Homo sapiens
  heavy chain complementarity determining region 3 for antibody 38037
ARDSPEEGATPRLDQ

SEQ ID NO: 76075 - protein, 9 aa, Homo sapiens
  light chain complementarity determining region 3 for antibody 38038
QQSYNPPWT

SEQ ID NO: 76076 - protein, 15 aa, Homo sapiens
  heavy chain complementarity determining region 3 for antibody 38038
TTEMWFGELSVTAHY

SEQ ID NO: 76077 - protein, 10 aa, Homo sapiens
  light chain complementarity determining region 3 for antibody 38039
QQSYKWPPYT

SEQ ID NO: 76078 - protein, 11 aa, Homo sapiens
  heavy chain complementarity determining region 3 for antibody 38039
ARGVGSYVFES

SEQ ID NO: 76079 - protein, 9 aa, Homo sapiens
  light chain complementarity determining region 3 for antibody 38040
QQSYKTPPT

SEQ ID NO: 76080 - protein, 15 aa, Homo sapiens
  heavy chain complementarity determining region 3 for antibody 38040
AKGLKGPVVGTPIGN

SEQ ID NO: 76081 - protein, 9 aa, Homo sapiens
  light chain complementarity determining region 3 for antibody 38041
QQSYKTPHN

SEQ ID NO: 76082 - protein, 15 aa, Homo sapiens
  heavy chain complementarity determining region 3 for antibody 38041
AKGLKGPVVGTPIGN

SEQ ID NO: 76083 - protein, 9 aa, Homo sapiens
  light chain complementarity determining region 3 for antibody 38042
QQSYKTPGT

SEQ ID NO: 76084 - protein, 18 aa, Homo sapiens
  heavy chain complementarity determining region 3 for antibody 38042
ARATAWELLFQYYYAMDV

SEQ ID NO: 76085 - protein, 9 aa, Homo sapiens
  light chain complementarity determining region 3 for antibody 38043
QQSYKTHHT

SEQ ID NO: 76086 - protein, 15 aa, Homo sapiens
  heavy chain complementarity determining region 3 for antibody 38043
AKGLKGPVVGTPIGN

SEQ ID NO: 76087 - protein, 9 aa, Homo sapiens
  light chain complementarity determining region 3 for antibody 38044
QQSYITPRT

SEQ ID NO: 76088 - protein, 19 aa, Homo sapiens
  heavy chain complementarity determining region 3 for antibody 38044
ARDWMAWFGAQRRENAFDI

SEQ ID NO: 76089 - protein, 10 aa, Homo sapiens
  light chain complementarity determining region 3 for antibody 38045
QQSYITPPFT

SEQ ID NO: 76090 - protein, 18 aa, Homo sapiens
  heavy chain complementarity determining region 3 for antibody 38045
AREAMIRTVIVAYNCLDP

SEQ ID NO: 76091 - protein, 9 aa, Homo sapiens
  light chain complementarity determining region 3 for antibody 38046
QQSYITPIT

SEQ ID NO: 76092 - protein, 18 aa, Homo sapiens
  heavy chain complementarity determining region 3 for antibody 38046
AKDTEYYDFTGYPGDFQY

SEQ ID NO: 76093 - protein, 9 aa, Homo sapiens
  light chain complementarity determining region 3 for antibody 38047
QQSYGYPHT

SEQ ID NO: 76094 - protein, 12 aa, Homo sapiens
  heavy chain complementarity determining region 3 for antibody 38047
ARTYGSGSYVDY

SEQ ID NO: 76095 - protein, 8 aa, Homo sapiens
  light chain complementarity determining region 3 for antibody 38048
QQSYGTPT

SEQ ID NO: 76096 - protein, 13 aa, Homo sapiens
  heavy chain complementarity determining region 3 for antibody 38048
ARDRPGTYYAFDI

SEQ ID NO: 76097 - protein, 9 aa, Homo sapiens
  light chain complementarity determining region 3 for antibody 38049
QQSYGTPLT

SEQ ID NO: 76098 - protein, 15 aa, Homo sapiens
  heavy chain complementarity determining region 3 for antibody 38049
ARDRESGYTNYDFNS

SEQ ID NO: 76099 - protein, 10 aa, Homo sapiens
  light chain complementarity determining region 3 for antibody 38050
QQSYGTPLFT

SEQ ID NO: 76100 - protein, 10 aa, Homo sapiens
  heavy chain complementarity determining region 3 for antibody 38050
TTSRWGPFDY

SEQ ID NO: 76101 - protein, 8 aa, Homo sapiens
  light chain complementarity determining region 3 for antibody 38051
QQSYGSPT

SEQ ID NO: 76102 - protein, 13 aa, Homo sapiens
  heavy chain complementarity determining region 3 for antibody 38051
ARDSPGTYYAFDI

SEQ ID NO: 76103 - protein, 8 aa, Homo sapiens
  light chain complementarity determining region 3 for antibody 38052
QQSYGSPT

SEQ ID NO: 76104 - protein, 13 aa, Homo sapiens
  heavy chain complementarity determining region 3 for antibody 38052
ARDRPGTYYAFDT

SEQ ID NO: 76105 - protein, 8 aa, Homo sapiens
  light chain complementarity determining region 3 for antibody 38053
QQSYGSPP

SEQ ID NO: 76106 - protein, 13 aa, Homo sapiens
  heavy chain complementarity determining region 3 for antibody 38053
ARDRPGTYYAFDI

SEQ ID NO: 76107 - protein, 9 aa, Homo sapiens
  light chain complementarity determining region 3 for antibody 38054
QQSYGFPYT

SEQ ID NO: 76108 - protein, 13 aa, Homo sapiens
  heavy chain complementarity determining region 3 for antibody 38054
VRLNDVNGWPFDH

SEQ ID NO: 76109 - protein, 11 aa, Homo sapiens
  light chain complementarity determining region 3 for antibody 38055
QQSYGAPPLYT

SEQ ID NO: 76110 - protein, 12 aa, Homo sapiens
  heavy chain complementarity determining region 3 for antibody 38055
AKNSGVRRAFDI

SEQ ID NO: 76111 - protein, 9 aa, Homo sapiens
  light chain complementarity determining region 3 for antibody 38056
QQSYDIPIT

SEQ ID NO: 76112 - protein, 11 aa, Homo sapiens
  heavy chain complementarity determining region 3 for antibody 38056
ARGHYRNHFDY

SEQ ID NO: 76113 - protein, 9 aa, Homo sapiens
  light chain complementarity determining region 3 for antibody 38057
QQSYAVPWT

SEQ ID NO: 76114 - protein, 18 aa, Homo sapiens
  heavy chain complementarity determining region 3 for antibody 38057
TRTGAGDGYNYANYGMDV

SEQ ID NO: 76115 - protein, 9 aa, Homo sapiens
  light chain complementarity determining region 3 for antibody 38058
QQSSSTVYT

SEQ ID NO: 76116 - protein, 15 aa, Homo sapiens
  heavy chain complementarity determining region 3 for antibody 38058
ARQFPSGWYGYWFDP

SEQ ID NO: 76117 - protein, 9 aa, Homo sapiens
  light chain complementarity determining region 3 for antibody 38059
QQSSSTVYN

SEQ ID NO: 76118 - protein, 15 aa, Homo sapiens
  heavy chain complementarity determining region 3 for antibody 38059
ARQFTSGWYGYWFDP

SEQ ID NO: 76119 - protein, 9 aa, Homo sapiens
  light chain complementarity determining region 3 for antibody 38060
QQSSSTVDT

SEQ ID NO: 76120 - protein, 15 aa, Homo sapiens
  heavy chain complementarity determining region 3 for antibody 38060
ARQFTSGWYGYWFDP

SEQ ID NO: 76121 - protein, 8 aa, Homo sapiens
  light chain complementarity determining region 3 for antibody 38061
QQSSSTPL

SEQ ID NO: 76122 - protein, 13 aa, Homo sapiens
  heavy chain complementarity determining region 3 for antibody 38061
SRDKELGFGVLDY

SEQ ID NO: 76123 - protein, 9 aa, Homo sapiens
  light chain complementarity determining region 3 for antibody 38062
QQSSSPPWT

SEQ ID NO: 76124 - protein, 13 aa, Homo sapiens
  heavy chain complementarity determining region 3 for antibody 38062
ARVVSAAVDFFDF

SEQ ID NO: 76125 - protein, 9 aa, Homo sapiens
  light chain complementarity determining region 3 for antibody 38063
QQSSSIPIT

SEQ ID NO: 76126 - protein, 16 aa, Homo sapiens
  heavy chain complementarity determining region 3 for antibody 38063
ARGRALRMVFANWFDP

SEQ ID NO: 76127 - protein, 9 aa, Homo sapiens
  light chain complementarity determining region 3 for antibody 38064
QQSSSFPLT

SEQ ID NO: 76128 - protein, 16 aa, Homo sapiens
  heavy chain complementarity determining region 3 for antibody 38064
ARGRALRMVFANWFDP

SEQ ID NO: 76129 - protein, 9 aa, Homo sapiens
  light chain complementarity determining region 3 for antibody 38065
QQSSRIPPT

SEQ ID NO: 76130 - protein, 13 aa, Homo sapiens
  heavy chain complementarity determining region 3 for antibody 38065
ARGSHLRYRAFDI

SEQ ID NO: 76131 - protein, 9 aa, Homo sapiens
  light chain complementarity determining region 3 for antibody 38066
QQSSRILWT

SEQ ID NO: 76132 - protein, 13 aa, Homo sapiens
  heavy chain complementarity determining region 3 for antibody 38066
VTRAFRFGKVMDV

SEQ ID NO: 76133 - protein, 9 aa, Homo sapiens
  light chain complementarity determining region 3 for antibody 38067
QQSSNWPWT

SEQ ID NO: 76134 - protein, 20 aa, Homo sapiens
  heavy chain complementarity determining region 3 for antibody 38067
ARASPVYCSGGSCYYYGMDV

SEQ ID NO: 76135 - protein, 9 aa, Homo sapiens
  light chain complementarity determining region 3 for antibody 38068
QQSSDFPYT

SEQ ID NO: 76136 - protein, 13 aa, Homo sapiens
  heavy chain complementarity determining region 3 for antibody 38068
ARIPDISGWPFDL

SEQ ID NO: 76137 - protein, 8 aa, Homo sapiens
  light chain complementarity determining region 3 for antibody 38069
QQSNSYSS

SEQ ID NO: 76138 - protein, 18 aa, Homo sapiens
  heavy chain complementarity determining region 3 for antibody 38069
ARSWKVVVASGAVRYFDY

SEQ ID NO: 76139 - protein, 9 aa, Homo sapiens
  light chain complementarity determining region 3 for antibody 38070
QQSNSSLLT

SEQ ID NO: 76140 - protein, 16 aa, Homo sapiens
  heavy chain complementarity determining region 3 for antibody 38070
AREGGSTYTTKRAFDS

SEQ ID NO: 76141 - protein, 8 aa, Homo sapiens
  light chain complementarity determining region 3 for antibody 38071
QQSNSLYT

SEQ ID NO: 76142 - protein, 14 aa, Homo sapiens
  heavy chain complementarity determining region 3 for antibody 38071
ARENSISRKRSFDQ

SEQ ID NO: 76143 - protein, 9 aa, Homo sapiens
  light chain complementarity determining region 3 for antibody 38072
QQSNSFPRT

SEQ ID NO: 76144 - protein, 15 aa, Homo sapiens
  heavy chain complementarity determining region 3 for antibody 38072
VRDLGDYAGNDWFDP

SEQ ID NO: 76145 - protein, 9 aa, Homo sapiens
  light chain complementarity determining region 3 for antibody 38073
QQSNSFLIT

SEQ ID NO: 76146 - protein, 10 aa, Homo sapiens
  heavy chain complementarity determining region 3 for antibody 38073
ARRSVGAFDL

SEQ ID NO: 76147 - protein, 9 aa, Homo sapiens
  light chain complementarity determining region 3 for antibody 38074
QQSNRTPYT

SEQ ID NO: 76148 - protein, 14 aa, Homo sapiens
  heavy chain complementarity determining region 3 for antibody 38074
ATEGPSRMGKSFDS

SEQ ID NO: 76149 - protein, 9 aa, Homo sapiens
  light chain complementarity determining region 3 for antibody 38075
QQSNRTPYT

SEQ ID NO: 76150 - protein, 14 aa, Homo sapiens
  heavy chain complementarity determining region 3 for antibody 38075
ATEGPSRMGKLFDS

SEQ ID NO: 76151 - protein, 9 aa, Homo sapiens
  light chain complementarity determining region 3 for antibody 38076
QQSNRTPYP

SEQ ID NO: 76152 - protein, 14 aa, Homo sapiens
  heavy chain complementarity determining region 3 for antibody 38076
ATEGPSRMGKFFDS

SEQ ID NO: 76153 - protein, 9 aa, Homo sapiens
  light chain complementarity determining region 3 for antibody 38077
QQSNRTPNT

SEQ ID NO: 76154 - protein, 14 aa, Homo sapiens
  heavy chain complementarity determining region 3 for antibody 38077
ATEGPSRMGKFFDS

SEQ ID NO: 76155 - protein, 9 aa, Homo sapiens
  light chain complementarity determining region 3 for antibody 38078
QQSNRTPDT

SEQ ID NO: 76156 - protein, 14 aa, Homo sapiens
  heavy chain complementarity determining region 3 for antibody 38078
ATEGPSRMGKFFDS

SEQ ID NO: 76157 - protein, 8 aa, Homo sapiens
  light chain complementarity determining region 3 for antibody 38079
QQSNNWPT

SEQ ID NO: 76158 - protein, 12 aa, Homo sapiens
  heavy chain complementarity determining region 3 for antibody 38079
AKPLPASAYFDS

SEQ ID NO: 76159 - protein, 10 aa, Homo sapiens
  light chain complementarity determining region 3 for antibody 38080
QQSNNWPPLT

SEQ ID NO: 76160 - protein, 15 aa, Homo sapiens
  heavy chain complementarity determining region 3 for antibody 38080
ARYYYDSSGYYVFDY

SEQ ID NO: 76161 - protein, 10 aa, Homo sapiens
  light chain complementarity determining region 3 for antibody 38081
QQSNNRPRNT

SEQ ID NO: 76162 - protein, 12 aa, Homo sapiens
  heavy chain complementarity determining region 3 for antibody 38081
AKMMPRHDVFDL

SEQ ID NO: 76163 - protein, 9 aa, Homo sapiens
  light chain complementarity determining region 3 for antibody 38082
QQSNGYSRT

SEQ ID NO: 76164 - protein, 18 aa, Homo sapiens
  heavy chain complementarity determining region 3 for antibody 38082
ARDFGGRAYTKVENAFDI

SEQ ID NO: 76165 - protein, 9 aa, Homo sapiens
  light chain complementarity determining region 3 for antibody 38083
QQSNGFPYT

SEQ ID NO: 76166 - protein, 13 aa, Homo sapiens
  heavy chain complementarity determining region 3 for antibody 38083
VRLNDVNGWPFDH

SEQ ID NO: 76167 - protein, 9 aa, Homo sapiens
  light chain complementarity determining region 3 for antibody 38084
QQSITIPLT

SEQ ID NO: 76168 - protein, 8 aa, Homo sapiens
  heavy chain complementarity determining region 3 for antibody 38084
LIYSSGCN

SEQ ID NO: 76169 - protein, 9 aa, Homo sapiens
  light chain complementarity determining region 3 for antibody 38085
QQSHSVPDI

SEQ ID NO: 76170 - protein, 16 aa, Homo sapiens
  heavy chain complementarity determining region 3 for antibody 38085
VTPVSPWMTATGPFDY

SEQ ID NO: 76171 - protein, 9 aa, Homo sapiens
  light chain complementarity determining region 3 for antibody 38086
QQSHSTPYT

SEQ ID NO: 76172 - protein, 15 aa, Homo sapiens
  heavy chain complementarity determining region 3 for antibody 38086
TRDHQRGTYLYSFDS

SEQ ID NO: 76173 - protein, 9 aa, Homo sapiens
  light chain complementarity determining region 3 for antibody 38087
QQSHSTPWT

SEQ ID NO: 76174 - protein, 9 aa, Homo sapiens
  heavy chain complementarity determining region 3 for antibody 38087
ARGDDSFDY

SEQ ID NO: 76175 - protein, 9 aa, Homo sapiens
  light chain complementarity determining region 3 for antibody 38088
QQSHSGPYI

SEQ ID NO: 76176 - protein, 16 aa, Homo sapiens
  heavy chain complementarity determining region 3 for antibody 38088
VTPVSPWMTATGPFDY

SEQ ID NO: 76177 - protein, 8 aa, Homo sapiens
  light chain complementarity determining region 3 for antibody 38089
QQSHSART

SEQ ID NO: 76178 - protein, 19 aa, Homo sapiens
  heavy chain complementarity determining region 3 for antibody 38089
AREGERGGGTTTPHWYFDL

SEQ ID NO: 76179 - protein, 8 aa, Homo sapiens
  light chain complementarity determining region 3 for antibody 38090
QQSHSART

SEQ ID NO: 76180 - protein, 19 aa, Homo sapiens
  heavy chain complementarity determining region 3 for antibody 38090
AREGAWGGGTTTPHWYFDL

SEQ ID NO: 76181 - protein, 8 aa, Homo sapiens
  light chain complementarity determining region 3 for antibody 38091
QQSHSART

SEQ ID NO: 76182 - protein, 19 aa, Homo sapiens
  heavy chain complementarity determining region 3 for antibody 38091
AREGARGGGTPTPHWYFDL

SEQ ID NO: 76183 - protein, 8 aa, Homo sapiens
  light chain complementarity determining region 3 for antibody 38092
QQSHSART

SEQ ID NO: 76184 - protein, 19 aa, Homo sapiens
  heavy chain complementarity determining region 3 for antibody 38092
AREGARGGGTATPHWYFDL

SEQ ID NO: 76185 - protein, 8 aa, Homo sapiens
  light chain complementarity determining region 3 for antibody 38093
QQSHSART

SEQ ID NO: 76186 - protein, 19 aa, Homo sapiens
  heavy chain complementarity determining region 3 for antibody 38093
AREGARGGGATTPHWYFDL

SEQ ID NO: 76187 - protein, 8 aa, Homo sapiens
  light chain complementarity determining region 3 for antibody 38094
QQSHSART

SEQ ID NO: 76188 - protein, 19 aa, Homo sapiens
  heavy chain complementarity determining region 3 for antibody 38094
AREGAGGGGTTTPHWYFDL

SEQ ID NO: 76189 - protein, 8 aa, Homo sapiens
  light chain complementarity determining region 3 for antibody 38095
QQSHSART

SEQ ID NO: 76190 - protein, 5 aa, Homo sapiens
  heavy chain complementarity determining region 3 for antibody 38095
AREGA

SEQ ID NO: 76191 - protein, 8 aa, Homo sapiens
  light chain complementarity determining region 3 for antibody 38096
QQSHSART

SEQ ID NO: 76192 - protein, 19 aa, Homo sapiens
  heavy chain complementarity determining region 3 for antibody 38096
AGEGARGGGTTTPHWYFDL

SEQ ID NO: 76193 - protein, 8 aa, Homo sapiens
  light chain complementarity determining region 3 for antibody 38097
QQSHSARP

SEQ ID NO: 76194 - protein, 19 aa, Homo sapiens
  heavy chain complementarity determining region 3 for antibody 38097
AREGARGGGTTTPHWYFDL

SEQ ID NO: 76195 - protein, 10 aa, Homo sapiens
  light chain complementarity determining region 3 for antibody 38098
QQSHNWPPWT

SEQ ID NO: 76196 - protein, 18 aa, Homo sapiens
  heavy chain complementarity determining region 3 for antibody 38098
ARGVPPFWAPGGVGPFDF

SEQ ID NO: 76197 - protein, 8 aa, Homo sapiens
  light chain complementarity determining region 3 for antibody 38099
QQSHNSYP

SEQ ID NO: 76198 - protein, 15 aa, Homo sapiens
  heavy chain complementarity determining region 3 for antibody 38099
AKDQLCSGGSCPFDY

SEQ ID NO: 76199 - protein, 10 aa, Homo sapiens
  light chain complementarity determining region 3 for antibody 38100
QQSHNNTPYT

SEQ ID NO: 76200 - protein, 21 aa, Homo sapiens
  heavy chain complementarity determining region 3 for antibody 38100
ARTGRHYSDSTVYYYRPRVDY

SEQ ID NO: 76201 - protein, 10 aa, Homo sapiens
  light chain complementarity determining region 3 for antibody 38101
QQSHNNTPYP

SEQ ID NO: 76202 - protein, 21 aa, Homo sapiens
  heavy chain complementarity determining region 3 for antibody 38101
ARTGRHYSDSTVYYYRPRIDY

SEQ ID NO: 76203 - protein, 10 aa, Homo sapiens
  light chain complementarity determining region 3 for antibody 38102
QQSHNNTPDT

SEQ ID NO: 76204 - protein, 21 aa, Homo sapiens
  heavy chain complementarity determining region 3 for antibody 38102
ARTGRHYSDSTVYYYRPRIDY

SEQ ID NO: 76205 - protein, 10 aa, Homo sapiens
  light chain complementarity determining region 3 for antibody 38103
QQSHHWPPWP

SEQ ID NO: 76206 - protein, 18 aa, Homo sapiens
  heavy chain complementarity determining region 3 for antibody 38103
ARGVPPFWAPGGVGPFDF

SEQ ID NO: 76207 - protein, 10 aa, Homo sapiens
  light chain complementarity determining region 3 for antibody 38104
QQSHHWPPGT

SEQ ID NO: 76208 - protein, 18 aa, Homo sapiens
  heavy chain complementarity determining region 3 for antibody 38104
ARGVPPFWAPGGVGPFDF

SEQ ID NO: 76209 - protein, 9 aa, Homo sapiens
  light chain complementarity determining region 3 for antibody 38105
QQSHDFPYT

SEQ ID NO: 76210 - protein, 13 aa, Homo sapiens
  heavy chain complementarity determining region 3 for antibody 38105
ASLKDINGWPFDY

SEQ ID NO: 76211 - protein, 9 aa, Homo sapiens
  light chain complementarity determining region 3 for antibody 38106
QQSHDFPYT

SEQ ID NO: 76212 - protein, 13 aa, Homo sapiens
  heavy chain complementarity determining region 3 for antibody 38106
AGLKDINGWPFDY

SEQ ID NO: 76213 - protein, 9 aa, Homo sapiens
  light chain complementarity determining region 3 for antibody 38107
QQSGTSPLT

SEQ ID NO: 76214 - protein, 14 aa, Homo sapiens
  heavy chain complementarity determining region 3 for antibody 38107
ARDMFRGVPDYLDY

SEQ ID NO: 76215 - protein, 9 aa, Homo sapiens
  light chain complementarity determining region 3 for antibody 38108
QQSGTLPWT

SEQ ID NO: 76216 - protein, 13 aa, Homo sapiens
  heavy chain complementarity determining region 3 for antibody 38108
VRDQAAYINWFDP

SEQ ID NO: 76217 - protein, 9 aa, Homo sapiens
  light chain complementarity determining region 3 for antibody 38109
QQSGSSPRT

SEQ ID NO: 76218 - protein, 17 aa, Homo sapiens
  heavy chain complementarity determining region 3 for antibody 38109
ARALDIVVVVDAIWFDP

SEQ ID NO: 76219 - protein, 9 aa, Homo sapiens
  light chain complementarity determining region 3 for antibody 38110
QQSGSSPQT

SEQ ID NO: 76220 - protein, 19 aa, Homo sapiens
  heavy chain complementarity determining region 3 for antibody 38110
ARVFRGLRSRSYFGYGMDL

SEQ ID NO: 76221 - protein, 10 aa, Homo sapiens
  light chain complementarity determining region 3 for antibody 38111
QQSGSSPPLT

SEQ ID NO: 76222 - protein, 18 aa, Homo sapiens
  heavy chain complementarity determining region 3 for antibody 38111
ARGGYDYGWGSYGVYFDY

SEQ ID NO: 76223 - protein, 10 aa, Homo sapiens
  light chain complementarity determining region 3 for antibody 38112
QQSGSSPMYS

SEQ ID NO: 76224 - protein, 11 aa, Homo sapiens
  heavy chain complementarity determining region 3 for antibody 38112
ARGGQWGSLDY

SEQ ID NO: 76225 - protein, 8 aa, Homo sapiens
  light chain complementarity determining region 3 for antibody 38113
QQSGRSPT

SEQ ID NO: 76226 - protein, 21 aa, Homo sapiens
  heavy chain complementarity determining region 3 for antibody 38113
ARERERYFDWSHRDYYYALDV

SEQ ID NO: 76227 - protein, 9 aa, Homo sapiens
  light chain complementarity determining region 3 for antibody 38114
QQSGHIPRT

SEQ ID NO: 76228 - protein, 15 aa, Homo sapiens
  heavy chain complementarity determining region 3 for antibody 38114
ARGEFYVSGSYYRED

SEQ ID NO: 76229 - protein, 10 aa, Homo sapiens
  light chain complementarity determining region 3 for antibody 38115
QQSFTTPTGT

SEQ ID NO: 76230 - protein, 19 aa, Homo sapiens
  heavy chain complementarity determining region 3 for antibody 38115
ARQGDDVVVLAASPSSFDV

SEQ ID NO: 76231 - protein, 9 aa, Homo sapiens
  light chain complementarity determining region 3 for antibody 38116
QQSFTIPRP

SEQ ID NO: 76232 - protein, 14 aa, Homo sapiens
  heavy chain complementarity determining region 3 for antibody 38116
ATESSLSNGVSFDY

SEQ ID NO: 76233 - protein, 9 aa, Homo sapiens
  light chain complementarity determining region 3 for antibody 38117
QQSFSVPYR

SEQ ID NO: 76234 - protein, 15 aa, Homo sapiens
  heavy chain complementarity determining region 3 for antibody 38117
VRERGYSYGLGLFDS

SEQ ID NO: 76235 - protein, 10 aa, Homo sapiens
  light chain complementarity determining region 3 for antibody 38118
QQSFSTSLLP

SEQ ID NO: 76236 - protein, 14 aa, Homo sapiens
  heavy chain complementarity determining region 3 for antibody 38118
AKDRYGQGRSGLDS

SEQ ID NO: 76237 - protein, 10 aa, Homo sapiens
  light chain complementarity determining region 3 for antibody 38119
QQSFSTSLLN

SEQ ID NO: 76238 - protein, 14 aa, Homo sapiens
  heavy chain complementarity determining region 3 for antibody 38119
AKDRYGQGRSGLDS

SEQ ID NO: 76239 - protein, 9 aa, Homo sapiens
  light chain complementarity determining region 3 for antibody 38120
QQSFSTPWT

SEQ ID NO: 76240 - protein, 13 aa, Homo sapiens
  heavy chain complementarity determining region 3 for antibody 38120
ARVVSAAVDFFDF

SEQ ID NO: 76241 - protein, 9 aa, Homo sapiens
  light chain complementarity determining region 3 for antibody 38121
QQSFSTPGT

SEQ ID NO: 76242 - protein, 18 aa, Homo sapiens
  heavy chain complementarity determining region 3 for antibody 38121
ARLNENYHDSGGYYSFDS

SEQ ID NO: 76243 - protein, 9 aa, Homo sapiens
  light chain complementarity determining region 3 for antibody 38122
QQSFSSPYI

SEQ ID NO: 76244 - protein, 11 aa, Homo sapiens
  heavy chain complementarity determining region 3 for antibody 38122
TTSLLAIWGIY

SEQ ID NO: 76245 - protein, 9 aa, Homo sapiens
  light chain complementarity determining region 3 for antibody 38123
QQSFSSPRT

SEQ ID NO: 76246 - protein, 21 aa, Homo sapiens
  heavy chain complementarity determining region 3 for antibody 38123
ARWGDCTGRNCCRYYYYGLDV

SEQ ID NO: 76247 - protein, 9 aa, Homo sapiens
  light chain complementarity determining region 3 for antibody 38124
QQSFSPPWT

SEQ ID NO: 76248 - protein, 13 aa, Homo sapiens
  heavy chain complementarity determining region 3 for antibody 38124
ARVVSAAVYFFDF

SEQ ID NO: 76249 - protein, 9 aa, Homo sapiens
  light chain complementarity determining region 3 for antibody 38125
QQSFSPPWS

SEQ ID NO: 76250 - protein, 13 aa, Homo sapiens
  heavy chain complementarity determining region 3 for antibody 38125
ARVVSAAVDFFDF

SEQ ID NO: 76251 - protein, 9 aa, Homo sapiens
  light chain complementarity determining region 3 for antibody 38126
QQSFSPPGT

SEQ ID NO: 76252 - protein, 13 aa, Homo sapiens
  heavy chain complementarity determining region 3 for antibody 38126
ARVVSAAVDFFDF

SEQ ID NO: 76253 - protein, 9 aa, Homo sapiens
  light chain complementarity determining region 3 for antibody 38127
QQSFSHVYT

SEQ ID NO: 76254 - protein, 18 aa, Homo sapiens
  heavy chain complementarity determining region 3 for antibody 38127
AQERDGYCDSHACYGLDV

SEQ ID NO: 76255 - protein, 9 aa, Homo sapiens
  light chain complementarity determining region 3 for antibody 38128
QQSFSGPYS

SEQ ID NO: 76256 - protein, 15 aa, Homo sapiens
  heavy chain complementarity determining region 3 for antibody 38128
VRERGYSYGLGLFDS

SEQ ID NO: 76257 - protein, 9 aa, Homo sapiens
  light chain complementarity determining region 3 for antibody 38129
QQSFNTPWT

SEQ ID NO: 76258 - protein, 14 aa, Homo sapiens
  heavy chain complementarity determining region 3 for antibody 38129
VRAFPLTVATAFDI

SEQ ID NO: 76259 - protein, 9 aa, Homo sapiens
  light chain complementarity determining region 3 for antibody 38130
QQSFNTLYT

SEQ ID NO: 76260 - protein, 14 aa, Homo sapiens
  heavy chain complementarity determining region 3 for antibody 38130
SRDVLQYGHRLFDS

SEQ ID NO: 76261 - protein, 9 aa, Homo sapiens
  light chain complementarity determining region 3 for antibody 38131
QQSFNTLYT

SEQ ID NO: 76262 - protein, 14 aa, Homo sapiens
  heavy chain complementarity determining region 3 for antibody 38131
ARDVVQYGHRLFDS

SEQ ID NO: 76263 - protein, 9 aa, Homo sapiens
  light chain complementarity determining region 3 for antibody 38132
QQSFNTLYP

SEQ ID NO: 76264 - protein, 14 aa, Homo sapiens
  heavy chain complementarity determining region 3 for antibody 38132
ARDVLQYGHRLFDS

SEQ ID NO: 76265 - protein, 9 aa, Homo sapiens
  light chain complementarity determining region 3 for antibody 38133
QQSESYPLT

SEQ ID NO: 76266 - protein, 17 aa, Homo sapiens
  heavy chain complementarity determining region 3 for antibody 38133
ARGVGRGLEASPGIFDY

SEQ ID NO: 76267 - protein, 9 aa, Homo sapiens
  light chain complementarity determining region 3 for antibody 38134
QQSDTTPWT

SEQ ID NO: 76268 - protein, 20 aa, Homo sapiens
  heavy chain complementarity determining region 3 for antibody 38134
ATDKKGVYYDGSEYYWGFDY

SEQ ID NO: 76269 - protein, 9 aa, Homo sapiens
  light chain complementarity determining region 3 for antibody 38135
QQSDTIPYT

SEQ ID NO: 76270 - protein, 14 aa, Homo sapiens
  heavy chain complementarity determining region 3 for antibody 38135
ARGGESRGWYGFDF

SEQ ID NO: 76271 - protein, 9 aa, Homo sapiens
  light chain complementarity determining region 3 for antibody 38136
QQSDSYSWT

SEQ ID NO: 76272 - protein, 12 aa, Homo sapiens
  heavy chain complementarity determining region 3 for antibody 38136
ARGRFGDLVYDY

SEQ ID NO: 76273 - protein, 9 aa, Homo sapiens
  light chain complementarity determining region 3 for antibody 38137
QQSDSVPQT

SEQ ID NO: 76274 - protein, 18 aa, Homo sapiens
  heavy chain complementarity determining region 3 for antibody 38137
ARHLCHGGYSYSSDAFNI

SEQ ID NO: 76275 - protein, 9 aa, Homo sapiens
  light chain complementarity determining region 3 for antibody 38138
QQSDSTPIN

SEQ ID NO: 76276 - protein, 16 aa, Homo sapiens
  heavy chain complementarity determining region 3 for antibody 38138
SRGAYYSSSWYGWFDP

SEQ ID NO: 76277 - protein, 9 aa, Homo sapiens
  light chain complementarity determining region 3 for antibody 38139
QQSDSFPQT

SEQ ID NO: 76278 - protein, 13 aa, Homo sapiens
  heavy chain complementarity determining region 3 for antibody 38139
ARDSVQNRDTFDV

SEQ ID NO: 76279 - protein, 9 aa, Homo sapiens
  light chain complementarity determining region 3 for antibody 38140
QQSDRYPIT

SEQ ID NO: 76280 - protein, 11 aa, Homo sapiens
  heavy chain complementarity determining region 3 for antibody 38140
ARVSELTAEDF

SEQ ID NO: 76281 - protein, 8 aa, Homo sapiens
  light chain complementarity determining region 3 for antibody 38141
QQSDNSRT

SEQ ID NO: 76282 - protein, 15 aa, Homo sapiens
  heavy chain complementarity determining region 3 for antibody 38141
AKTDYCSAGNCPFDS

SEQ ID NO: 76283 - protein, 9 aa, Homo sapiens
  light chain complementarity determining region 3 for antibody 38142
QQSATKPFT

SEQ ID NO: 76284 - protein, 14 aa, Homo sapiens
  heavy chain complementarity determining region 3 for antibody 38142
AGDCSSDWYEGMDV

SEQ ID NO: 76285 - protein, 9 aa, Homo sapiens
  light chain complementarity determining region 3 for antibody 38143
QQSATAPRT

SEQ ID NO: 76286 - protein, 14 aa, Homo sapiens
  heavy chain complementarity determining region 3 for antibody 38143
AKDPTGDGGGYFDY

SEQ ID NO: 76287 - protein, 9 aa, Homo sapiens
  light chain complementarity determining region 3 for antibody 38144
QQRYTAPDT

SEQ ID NO: 76288 - protein, 15 aa, Homo sapiens
  heavy chain complementarity determining region 3 for antibody 38144
ARGAGYSYGPGYFDY

SEQ ID NO: 76289 - protein, 10 aa, Homo sapiens
  light chain complementarity determining region 3 for antibody 38145
QQRYSWPPYT

SEQ ID NO: 76290 - protein, 11 aa, Homo sapiens
  heavy chain complementarity determining region 3 for antibody 38145
ARGVGSYVFES

SEQ ID NO: 76291 - protein, 10 aa, Homo sapiens
  light chain complementarity determining region 3 for antibody 38146
QQRYSWPPRP

SEQ ID NO: 76292 - protein, 14 aa, Homo sapiens
  heavy chain complementarity determining region 3 for antibody 38146
AKGANLHHPYYFDY

SEQ ID NO: 76293 - protein, 10 aa, Homo sapiens
  light chain complementarity determining region 3 for antibody 38147
QQRYSWPPPT

SEQ ID NO: 76294 - protein, 14 aa, Homo sapiens
  heavy chain complementarity determining region 3 for antibody 38147
AKGANLHHPYYFDY

SEQ ID NO: 76295 - protein, 9 aa, Homo sapiens
  light chain complementarity determining region 3 for antibody 38148
QQRYSTSWT

SEQ ID NO: 76296 - protein, 13 aa, Homo sapiens
  heavy chain complementarity determining region 3 for antibody 38148
ARVLSRFAAGLDY

SEQ ID NO: 76297 - protein, 9 aa, Homo sapiens
  light chain complementarity determining region 3 for antibody 38149
QQRYSTPWT

SEQ ID NO: 76298 - protein, 11 aa, Homo sapiens
  heavy chain complementarity determining region 3 for antibody 38149
ARGRYLAPYDF

SEQ ID NO: 76299 - protein, 9 aa, Homo sapiens
  light chain complementarity determining region 3 for antibody 38150
QQRYSTPRT

SEQ ID NO: 76300 - protein, 12 aa, Homo sapiens
  heavy chain complementarity determining region 3 for antibody 38150
ARGWQLANAFDI

SEQ ID NO: 76301 - protein, 9 aa, Homo sapiens
  light chain complementarity determining region 3 for antibody 38151
QQRYSTPRT

SEQ ID NO: 76302 - protein, 20 aa, Homo sapiens
  heavy chain complementarity determining region 3 for antibody 38151
ARESGVFPFFDWLPHTWFDP

SEQ ID NO: 76303 - protein, 9 aa, Homo sapiens
  light chain complementarity determining region 3 for antibody 38152
QQRYSTPQT

SEQ ID NO: 76304 - protein, 17 aa, Homo sapiens
  heavy chain complementarity determining region 3 for antibody 38152
AKAKSSSWYEVGSAFDI

SEQ ID NO: 76305 - protein, 9 aa, Homo sapiens
  light chain complementarity determining region 3 for antibody 38153
QQRYSTPPT

SEQ ID NO: 76306 - protein, 15 aa, Homo sapiens
  heavy chain complementarity determining region 3 for antibody 38153
AHNEGYSYGYLSFGY

SEQ ID NO: 76307 - protein, 8 aa, Homo sapiens
  light chain complementarity determining region 3 for antibody 38154
QQRYSTPL

SEQ ID NO: 76308 - protein, 13 aa, Homo sapiens
  heavy chain complementarity determining region 3 for antibody 38154
SRDKELGFGVLDY

SEQ ID NO: 76309 - protein, 9 aa, Homo sapiens
  light chain complementarity determining region 3 for antibody 38155
QQRYSTPHT

SEQ ID NO: 76310 - protein, 23 aa, Homo sapiens
  heavy chain complementarity determining region 3 for antibody 38155
ARIESDATMVRGVIITKGNWFDP

SEQ ID NO: 76311 - protein, 9 aa, Homo sapiens
  light chain complementarity determining region 3 for antibody 38156
QQRYSTPFT

SEQ ID NO: 76312 - protein, 15 aa, Homo sapiens
  heavy chain complementarity determining region 3 for antibody 38156
ARSRRSGLHYYGMDV

SEQ ID NO: 76313 - protein, 10 aa, Homo sapiens
  light chain complementarity determining region 3 for antibody 38157
QQRYSTPEIT

SEQ ID NO: 76314 - protein, 14 aa, Homo sapiens
  heavy chain complementarity determining region 3 for antibody 38157
AKDHDSYVSGFGDL

SEQ ID NO: 76315 - protein, 9 aa, Homo sapiens
  light chain complementarity determining region 3 for antibody 38158
QQRYSSPLT

SEQ ID NO: 76316 - protein, 16 aa, Homo sapiens
  heavy chain complementarity determining region 3 for antibody 38158
AREGGSTYTTKRAFDS

SEQ ID NO: 76317 - protein, 9 aa, Homo sapiens
  light chain complementarity determining region 3 for antibody 38159
QQRYSSLFT

SEQ ID NO: 76318 - protein, 16 aa, Homo sapiens
  heavy chain complementarity determining region 3 for antibody 38159
AREGGSTYTTKRAFDS

SEQ ID NO: 76319 - protein, 9 aa, Homo sapiens
  light chain complementarity determining region 3 for antibody 38160
QQRYSPPRT

SEQ ID NO: 76320 - protein, 21 aa, Homo sapiens
  heavy chain complementarity determining region 3 for antibody 38160
ARVTVRVPSTTGFGEYYGLDV

SEQ ID NO: 76321 - protein, 10 aa, Homo sapiens
  light chain complementarity determining region 3 for antibody 38161
QQRYRWPPST

SEQ ID NO: 76322 - protein, 11 aa, Homo sapiens
  heavy chain complementarity determining region 3 for antibody 38161
ARGVGSYVFES

SEQ ID NO: 76323 - protein, 9 aa, Homo sapiens
  light chain complementarity determining region 3 for antibody 38162
QQRYRTPYT

SEQ ID NO: 76324 - protein, 12 aa, Homo sapiens
  heavy chain complementarity determining region 3 for antibody 38162
AREYGAPGAFDI

SEQ ID NO: 76325 - protein, 9 aa, Homo sapiens
  light chain complementarity determining region 3 for antibody 38163
QQRYRTPRT

SEQ ID NO: 76326 - protein, 17 aa, Homo sapiens
  heavy chain complementarity determining region 3 for antibody 38163
ARVHYDSSGYYYDAFDI

SEQ ID NO: 76327 - protein, 10 aa, Homo sapiens
  light chain complementarity determining region 3 for antibody 38164
QQRYNWSPYT

SEQ ID NO: 76328 - protein, 11 aa, Homo sapiens
  heavy chain complementarity determining region 3 for antibody 38164
ARGVGSYVFES

SEQ ID NO: 76329 - protein, 10 aa, Homo sapiens
  light chain complementarity determining region 3 for antibody 38165
QQRYNWPPYT

SEQ ID NO: 76330 - protein, 11 aa, Homo sapiens
  heavy chain complementarity determining region 3 for antibody 38165
ARGVGCYVFES

SEQ ID NO: 76331 - protein, 10 aa, Homo sapiens
  light chain complementarity determining region 3 for antibody 38166
QQRYNWPPYP

SEQ ID NO: 76332 - protein, 15 aa, Homo sapiens
  heavy chain complementarity determining region 3 for antibody 38166
ARGATSGRQEYYFDY

SEQ ID NO: 76333 - protein, 10 aa, Homo sapiens
  light chain complementarity determining region 3 for antibody 38167
QQRYNWPPVT

SEQ ID NO: 76334 - protein, 11 aa, Homo sapiens
  heavy chain complementarity determining region 3 for antibody 38167
ARGVGSYVFES

SEQ ID NO: 76335 - protein, 10 aa, Homo sapiens
  light chain complementarity determining region 3 for antibody 38168
QQRYNWPPVT

SEQ ID NO: 76336 - protein, 15 aa, Homo sapiens
  heavy chain complementarity determining region 3 for antibody 38168
ARFPGIAAAGIQEDF

SEQ ID NO: 76337 - protein, 10 aa, Homo sapiens
  light chain complementarity determining region 3 for antibody 38169
QQRYNWPPFT

SEQ ID NO: 76338 - protein, 11 aa, Homo sapiens
  heavy chain complementarity determining region 3 for antibody 38169
ARGVGSYVFDS

SEQ ID NO: 76339 - protein, 10 aa, Homo sapiens
  light chain complementarity determining region 3 for antibody 38170
QQRYNWPPFT

SEQ ID NO: 76340 - protein, 11 aa, Homo sapiens
  heavy chain complementarity determining region 3 for antibody 38170
ARGVGSCPFDS

SEQ ID NO: 76341 - protein, 10 aa, Homo sapiens
  light chain complementarity determining region 3 for antibody 38171
QQRYNWLPYT

SEQ ID NO: 76342 - protein, 11 aa, Homo sapiens
  heavy chain complementarity determining region 3 for antibody 38171
ARGVGSYVFES

SEQ ID NO: 76343 - protein, 10 aa, Homo sapiens
  light chain complementarity determining region 3 for antibody 38172
QQRYNTPPIT

SEQ ID NO: 76344 - protein, 24 aa, Homo sapiens
  heavy chain complementarity determining region 3 for antibody 38172
ARGRPPSGWYRLKDRTYYYYGLDV

SEQ ID NO: 76345 - protein, 10 aa, Homo sapiens
  light chain complementarity determining region 3 for antibody 38173
QQRYNLPPTT

SEQ ID NO: 76346 - protein, 12 aa, Homo sapiens
  heavy chain complementarity determining region 3 for antibody 38173
ARGETFSSGFDY

SEQ ID NO: 76347 - protein, 10 aa, Homo sapiens
  light chain complementarity determining region 3 for antibody 38174
QQRYNLPPIP

SEQ ID NO: 76348 - protein, 12 aa, Homo sapiens
  heavy chain complementarity determining region 3 for antibody 38174
ARGETFSSGFDY

SEQ ID NO: 76349 - protein, 10 aa, Homo sapiens
  light chain complementarity determining region 3 for antibody 38175
QQRYNGPPYP

SEQ ID NO: 76350 - protein, 11 aa, Homo sapiens
  heavy chain complementarity determining region 3 for antibody 38175
ARGVGSYVFES

SEQ ID NO: 76351 - protein, 10 aa, Homo sapiens
  light chain complementarity determining region 3 for antibody 38176
QQRYNGPPFT

SEQ ID NO: 76352 - protein, 11 aa, Homo sapiens
  heavy chain complementarity determining region 3 for antibody 38176
ARGVGSYPFDS

SEQ ID NO: 76353 - protein, 10 aa, Homo sapiens
  light chain complementarity determining region 3 for antibody 38177
QQRYKWSPST

SEQ ID NO: 76354 - protein, 11 aa, Homo sapiens
  heavy chain complementarity determining region 3 for antibody 38177
ARGVGSYVFES

SEQ ID NO: 76355 - protein, 10 aa, Homo sapiens
  light chain complementarity determining region 3 for antibody 38178
QQRYKWPSYP

SEQ ID NO: 76356 - protein, 11 aa, Homo sapiens
  heavy chain complementarity determining region 3 for antibody 38178
ARGVGSYVFES

SEQ ID NO: 76357 - protein, 10 aa, Homo sapiens
  light chain complementarity determining region 3 for antibody 38179
QQRYKWPSST

SEQ ID NO: 76358 - protein, 11 aa, Homo sapiens
  heavy chain complementarity determining region 3 for antibody 38179
ARGVGSYVFES

SEQ ID NO: 76359 - protein, 10 aa, Homo sapiens
  light chain complementarity determining region 3 for antibody 38180
QQRYKWPPYT

SEQ ID NO: 76360 - protein, 11 aa, Homo sapiens
  heavy chain complementarity determining region 3 for antibody 38180
VRGVGSYVFES

SEQ ID NO: 76361 - protein, 10 aa, Homo sapiens
  light chain complementarity determining region 3 for antibody 38181
QQRYKWPPYT

SEQ ID NO: 76362 - protein, 11 aa, Homo sapiens
  heavy chain complementarity determining region 3 for antibody 38181
ARGVCSYVFES

SEQ ID NO: 76363 - protein, 10 aa, Homo sapiens
  light chain complementarity determining region 3 for antibody 38182
QQRYKWPPTT

SEQ ID NO: 76364 - protein, 11 aa, Homo sapiens
  heavy chain complementarity determining region 3 for antibody 38182
ARGVGSYVFES

SEQ ID NO: 76365 - protein, 10 aa, Homo sapiens
  light chain complementarity determining region 3 for antibody 38183
QQRYKWPPNT

SEQ ID NO: 76366 - protein, 11 aa, Homo sapiens
  heavy chain complementarity determining region 3 for antibody 38183
ARGVGSYVFDS

SEQ ID NO: 76367 - protein, 10 aa, Homo sapiens
  light chain complementarity determining region 3 for antibody 38184
QQRYKWPPHP

SEQ ID NO: 76368 - protein, 11 aa, Homo sapiens
  heavy chain complementarity determining region 3 for antibody 38184
ARGVGSYVFDS

SEQ ID NO: 76369 - protein, 10 aa, Homo sapiens
  light chain complementarity determining region 3 for antibody 38185
QQRYKWPPFT

SEQ ID NO: 76370 - protein, 11 aa, Homo sapiens
  heavy chain complementarity determining region 3 for antibody 38185
ARGVGSYVFDS

SEQ ID NO: 76371 - protein, 10 aa, Homo sapiens
  light chain complementarity determining region 3 for antibody 38186
QQRYKWPPCT

SEQ ID NO: 76372 - protein, 11 aa, Homo sapiens
  heavy chain complementarity determining region 3 for antibody 38186
ARGVGSYVFDS

SEQ ID NO: 76373 - protein, 10 aa, Homo sapiens
  light chain complementarity determining region 3 for antibody 38187
QQRYKWLPYT

SEQ ID NO: 76374 - protein, 11 aa, Homo sapiens
  heavy chain complementarity determining region 3 for antibody 38187
ARGVGSYVFES

SEQ ID NO: 76375 - protein, 9 aa, Homo sapiens
  light chain complementarity determining region 3 for antibody 38188
QQRYKTPWT

SEQ ID NO: 76376 - protein, 18 aa, Homo sapiens
  heavy chain complementarity determining region 3 for antibody 38188
ARATAWELLFQYYYAMDV

SEQ ID NO: 76377 - protein, 10 aa, Homo sapiens
  light chain complementarity determining region 3 for antibody 38189
QQRYKRPPYT

SEQ ID NO: 76378 - protein, 11 aa, Homo sapiens
  heavy chain complementarity determining region 3 for antibody 38189
ARGVGSYVFDS

SEQ ID NO: 76379 - protein, 10 aa, Homo sapiens
  light chain complementarity determining region 3 for antibody 38190
QQRYKLPPYT

SEQ ID NO: 76380 - protein, 11 aa, Homo sapiens
  heavy chain complementarity determining region 3 for antibody 38190
ARGVGSYVFES

SEQ ID NO: 76381 - protein, 10 aa, Homo sapiens
  light chain complementarity determining region 3 for antibody 38191
QQRYKLPPYT

SEQ ID NO: 76382 - protein, 11 aa, Homo sapiens
  heavy chain complementarity determining region 3 for antibody 38191
ARGVGSYVFDS

SEQ ID NO: 76383 - protein, 10 aa, Homo sapiens
  light chain complementarity determining region 3 for antibody 38192
QQRYKGPPYT

SEQ ID NO: 76384 - protein, 11 aa, Homo sapiens
  heavy chain complementarity determining region 3 for antibody 38192
ARGVGSYVFDS

SEQ ID NO: 76385 - protein, 10 aa, Homo sapiens
  light chain complementarity determining region 3 for antibody 38193
QQRYKGPPDT

SEQ ID NO: 76386 - protein, 11 aa, Homo sapiens
  heavy chain complementarity determining region 3 for antibody 38193
ARGVGSYVFES

SEQ ID NO: 76387 - protein, 10 aa, Homo sapiens
  light chain complementarity determining region 3 for antibody 38194
QQRYKGPLYT

SEQ ID NO: 76388 - protein, 11 aa, Homo sapiens
  heavy chain complementarity determining region 3 for antibody 38194
ARGVGSYVFES

SEQ ID NO: 76389 - protein, 10 aa, Homo sapiens
  light chain complementarity determining region 3 for antibody 38195
QQRYHWPPYT

SEQ ID NO: 76390 - protein, 11 aa, Homo sapiens
  heavy chain complementarity determining region 3 for antibody 38195
ARGVGSYVFDS

SEQ ID NO: 76391 - protein, 8 aa, Homo sapiens
  light chain complementarity determining region 3 for antibody 38196
QQRYGSPT

SEQ ID NO: 76392 - protein, 13 aa, Homo sapiens
  heavy chain complementarity determining region 3 for antibody 38196
ARDRPGTYYAFDI

SEQ ID NO: 76393 - protein, 11 aa, Homo sapiens
  light chain complementarity determining region 3 for antibody 38197
QQRVNWPPSVT

SEQ ID NO: 76394 - protein, 15 aa, Homo sapiens
  heavy chain complementarity determining region 3 for antibody 38197
ARDRDGMYSAHAFNI

SEQ ID NO: 76395 - protein, 11 aa, Homo sapiens
  light chain complementarity determining region 3 for antibody 38198
QQRVNWPPSVT

SEQ ID NO: 76396 - protein, 15 aa, Homo sapiens
  heavy chain complementarity determining region 3 for antibody 38198
ARDRDGMYSAHACDI

SEQ ID NO: 76397 - protein, 11 aa, Homo sapiens
  light chain complementarity determining region 3 for antibody 38199
QQRVNWPPSVT

SEQ ID NO: 76398 - protein, 15 aa, Homo sapiens
  heavy chain complementarity determining region 3 for antibody 38199
ARDRDGMYAAHAFDI

SEQ ID NO: 76399 - protein, 11 aa, Homo sapiens
  light chain complementarity determining region 3 for antibody 38200
QQRVNWPPSFT

SEQ ID NO: 76400 - protein, 15 aa, Homo sapiens
  heavy chain complementarity determining region 3 for antibody 38200
ARDRDGMYSAHAFDI

SEQ ID NO: 76401 - protein, 11 aa, Homo sapiens
  light chain complementarity determining region 3 for antibody 38201
QQRVNWPPAVT

SEQ ID NO: 76402 - protein, 15 aa, Homo sapiens
  heavy chain complementarity determining region 3 for antibody 38201
ARDRDGMYSAHAFDI

SEQ ID NO: 76403 - protein, 9 aa, Homo sapiens
  light chain complementarity determining region 3 for antibody 38202
QQRVASPWT

SEQ ID NO: 76404 - protein, 15 aa, Homo sapiens
  heavy chain complementarity determining region 3 for antibody 38202
ASPPVGDVPNGVFDI

SEQ ID NO: 76405 - protein, 10 aa, Homo sapiens
  light chain complementarity determining region 3 for antibody 38203
QQRTTWPPST

SEQ ID NO: 76406 - protein, 18 aa, Homo sapiens
  heavy chain complementarity determining region 3 for antibody 38203
ARDRTNSGWFNVGRYFDY

SEQ ID NO: 76407 - protein, 9 aa, Homo sapiens
  light chain complementarity determining region 3 for antibody 38204
QQRTNWRLT

SEQ ID NO: 76408 - protein, 16 aa, Homo sapiens
  heavy chain complementarity determining region 3 for antibody 38204
ARDQGYCLGTNCYLLH

SEQ ID NO: 76409 - protein, 9 aa, Homo sapiens
  light chain complementarity determining region 3 for antibody 38205
QQRTNWRFT

SEQ ID NO: 76410 - protein, 16 aa, Homo sapiens
  heavy chain complementarity determining region 3 for antibody 38205
ARDQGYCLGTNCYLHH

SEQ ID NO: 76411 - protein, 9 aa, Homo sapiens
  light chain complementarity determining region 3 for antibody 38206
QQRTNWRFT

SEQ ID NO: 76412 - protein, 16 aa, Homo sapiens
  heavy chain complementarity determining region 3 for antibody 38206
ARDQGYCLGTHCYLLH

SEQ ID NO: 76413 - protein, 9 aa, Homo sapiens
  light chain complementarity determining region 3 for antibody 38207
QQRTNWRFT

SEQ ID NO: 76414 - protein, 16 aa, Homo sapiens
  heavy chain complementarity determining region 3 for antibody 38207
ARDQGFCRGPNCYTLY

SEQ ID NO: 76415 - protein, 9 aa, Homo sapiens
  light chain complementarity determining region 3 for antibody 38208
QQRTNWRFT

SEQ ID NO: 76416 - protein, 16 aa, Homo sapiens
  heavy chain complementarity determining region 3 for antibody 38208
ARAQGFCRGPNCYMLF

SEQ ID NO: 76417 - protein, 9 aa, Homo sapiens
  light chain complementarity determining region 3 for antibody 38209
QQRTNWRFP

SEQ ID NO: 76418 - protein, 16 aa, Homo sapiens
  heavy chain complementarity determining region 3 for antibody 38209
ARDQGFCRGPNCYMLY

SEQ ID NO: 76419 - protein, 9 aa, Homo sapiens
  light chain complementarity determining region 3 for antibody 38210
QQRTNWRFP

SEQ ID NO: 76420 - protein, 16 aa, Homo sapiens
  heavy chain complementarity determining region 3 for antibody 38210
ARDQGFCRGPNCYMLF

SEQ ID NO: 76421 - protein, 9 aa, Homo sapiens
  light chain complementarity determining region 3 for antibody 38211
QQRTNWRFN

SEQ ID NO: 76422 - protein, 16 aa, Homo sapiens
  heavy chain complementarity determining region 3 for antibody 38211
ARDQGFCRGPNCYMLF

SEQ ID NO: 76423 - protein, 8 aa, Homo sapiens
  light chain complementarity determining region 3 for antibody 38212
QQRTNWPS

SEQ ID NO: 76424 - protein, 14 aa, Homo sapiens
  heavy chain complementarity determining region 3 for antibody 38212
ARVDIAAGGAPFDP

SEQ ID NO: 76425 - protein, 10 aa, Homo sapiens
  light chain complementarity determining region 3 for antibody 38213
QQRTNWPPSP

SEQ ID NO: 76426 - protein, 18 aa, Homo sapiens
  heavy chain complementarity determining region 3 for antibody 38213
ARDRTNSGWFNVGRYFDY

SEQ ID NO: 76427 - protein, 11 aa, Homo sapiens
  light chain complementarity determining region 3 for antibody 38214
QQRTNWPPSGT

SEQ ID NO: 76428 - protein, 14 aa, Homo sapiens
  heavy chain complementarity determining region 3 for antibody 38214
AGTSNTGWSLGWGY

SEQ ID NO: 76429 - protein, 9 aa, Homo sapiens
  light chain complementarity determining region 3 for antibody 38215
QQRTNWPLT

SEQ ID NO: 76430 - protein, 12 aa, Homo sapiens
  heavy chain complementarity determining region 3 for antibody 38215
ARHLRVPERLDS

SEQ ID NO: 76431 - protein, 9 aa, Homo sapiens
  light chain complementarity determining region 3 for antibody 38216
QQRTNWPLT

SEQ ID NO: 76432 - protein, 12 aa, Homo sapiens
  heavy chain complementarity determining region 3 for antibody 38216
AKEWANWGVFDY

SEQ ID NO: 76433 - protein, 8 aa, Homo sapiens
  light chain complementarity determining region 3 for antibody 38217
QQRTNWLT

SEQ ID NO: 76434 - protein, 20 aa, Homo sapiens
  heavy chain complementarity determining region 3 for antibody 38217
SRVWVRAAAGPRNYYYGLDV

SEQ ID NO: 76435 - protein, 8 aa, Homo sapiens
  light chain complementarity determining region 3 for antibody 38218
QQRTNLPS

SEQ ID NO: 76436 - protein, 12 aa, Homo sapiens
  heavy chain complementarity determining region 3 for antibody 38218
ARDRGGTYWLDY

SEQ ID NO: 76437 - protein, 9 aa, Homo sapiens
  light chain complementarity determining region 3 for antibody 38219
QQRTNLPRT

SEQ ID NO: 76438 - protein, 12 aa, Homo sapiens
  heavy chain complementarity determining region 3 for antibody 38219
AKEWANWGVFDY

SEQ ID NO: 76439 - protein, 8 aa, Homo sapiens
  light chain complementarity determining region 3 for antibody 38220
QQRTNCPS

SEQ ID NO: 76440 - protein, 12 aa, Homo sapiens
  heavy chain complementarity determining region 3 for antibody 38220
ARDRGGTYWLDY

SEQ ID NO: 76441 - protein, 11 aa, Homo sapiens
  light chain complementarity determining region 3 for antibody 38221
QQRTIWPPDFT

SEQ ID NO: 76442 - protein, 14 aa, Homo sapiens
  heavy chain complementarity determining region 3 for antibody 38221
ARGNLDGEVRAPDV

SEQ ID NO: 76443 - protein, 11 aa, Homo sapiens
  light chain complementarity determining region 3 for antibody 38222
QQRSTWPPAFP

SEQ ID NO: 76444 - protein, 13 aa, Homo sapiens
  heavy chain complementarity determining region 3 for antibody 38222
AHRRLVQLGAFDI

SEQ ID NO: 76445 - protein, 9 aa, Homo sapiens
  light chain complementarity determining region 3 for antibody 38223
QQRSTWPLT

SEQ ID NO: 76446 - protein, 11 aa, Homo sapiens
  heavy chain complementarity determining region 3 for antibody 38223
ALGQWLAPFDY

SEQ ID NO: 76447 - protein, 8 aa, Homo sapiens
  light chain complementarity determining region 3 for antibody 38224
QQRSTLYS

SEQ ID NO: 76448 - protein, 17 aa, Homo sapiens
  heavy chain complementarity determining region 3 for antibody 38224
ARRYWNPSSGWSQDFDY

SEQ ID NO: 76449 - protein, 8 aa, Homo sapiens
  light chain complementarity determining region 3 for antibody 38225
QQRSTGPT

SEQ ID NO: 76450 - protein, 13 aa, Homo sapiens
  heavy chain complementarity determining region 3 for antibody 38225
AREPNGPLNAFDL

SEQ ID NO: 76451 - protein, 9 aa, Homo sapiens
  light chain complementarity determining region 3 for antibody 38226
QQRSSWPYT

SEQ ID NO: 76452 - protein, 11 aa, Homo sapiens
  heavy chain complementarity determining region 3 for antibody 38226
VKRWGGRSIDY

SEQ ID NO: 76453 - protein, 9 aa, Homo sapiens
  light chain complementarity determining region 3 for antibody 38227
QQRSSWPYT

SEQ ID NO: 76454 - protein, 11 aa, Homo sapiens
  heavy chain complementarity determining region 3 for antibody 38227
VKRWGGGSIDY

SEQ ID NO: 76455 - protein, 8 aa, Homo sapiens
  light chain complementarity determining region 3 for antibody 38228
QQRSSWPT

SEQ ID NO: 76456 - protein, 26 aa, Homo sapiens
  heavy chain complementarity determining region 3 for antibody 38228
ARGVGATYYDRSASNPASRVYWFFDV

SEQ ID NO: 76457 - protein, 9 aa, Homo sapiens
  light chain complementarity determining region 3 for antibody 38229
QQRSSWPST

SEQ ID NO: 76458 - protein, 22 aa, Homo sapiens
  heavy chain complementarity determining region 3 for antibody 38229
ARIPPRHCGGDCYYKFPYYFDY

SEQ ID NO: 76459 - protein, 9 aa, Homo sapiens
  light chain complementarity determining region 3 for antibody 38230
QQRSSWPNT

SEQ ID NO: 76460 - protein, 11 aa, Homo sapiens
  heavy chain complementarity determining region 3 for antibody 38230
VKRWGGSSIDY

SEQ ID NO: 76461 - protein, 9 aa, Homo sapiens
  light chain complementarity determining region 3 for antibody 38231
QQRSSWPGT

SEQ ID NO: 76462 - protein, 21 aa, Homo sapiens
  heavy chain complementarity determining region 3 for antibody 38231
HIRKDYYYDNRGYYEVHFFDY

SEQ ID NO: 76463 - protein, 9 aa, Homo sapiens
  light chain complementarity determining region 3 for antibody 38232
QQRSSGPYT

SEQ ID NO: 76464 - protein, 11 aa, Homo sapiens
  heavy chain complementarity determining region 3 for antibody 38232
VKRWGGSSIDY

SEQ ID NO: 76465 - protein, 8 aa, Homo sapiens
  light chain complementarity determining region 3 for antibody 38233
QQRSRWLS

SEQ ID NO: 76466 - protein, 12 aa, Homo sapiens
  heavy chain complementarity determining region 3 for antibody 38233
ARDASAVSEHPP

SEQ ID NO: 76467 - protein, 8 aa, Homo sapiens
  light chain complementarity determining region 3 for antibody 38234
QQRSRWLF

SEQ ID NO: 76468 - protein, 12 aa, Homo sapiens
  heavy chain complementarity determining region 3 for antibody 38234
ARDASAVSEHTP

SEQ ID NO: 76469 - protein, 8 aa, Homo sapiens
  light chain complementarity determining region 3 for antibody 38235
QQRSNWYP

SEQ ID NO: 76470 - protein, 13 aa, Homo sapiens
  heavy chain complementarity determining region 3 for antibody 38235
ARDGVPGKFSRAY

SEQ ID NO: 76471 - protein, 8 aa, Homo sapiens
  light chain complementarity determining region 3 for antibody 38236
QQRSNWST

SEQ ID NO: 76472 - protein, 15 aa, Homo sapiens
  heavy chain complementarity determining region 3 for antibody 38236
ARDLEQWLLDNWFDP

SEQ ID NO: 76473 - protein, 9 aa, Homo sapiens
  light chain complementarity determining region 3 for antibody 38237
QQRSNWRFT

SEQ ID NO: 76474 - protein, 13 aa, Homo sapiens
  heavy chain complementarity determining region 3 for antibody 38237
AKSYTAGVGAFHF

SEQ ID NO: 76475 - protein, 9 aa, Homo sapiens
  light chain complementarity determining region 3 for antibody 38238
QQRSNWPWT

SEQ ID NO: 76476 - protein, 20 aa, Homo sapiens
  heavy chain complementarity determining region 3 for antibody 38238
ARASPVYCSGGSCYYSGMDV

SEQ ID NO: 76477 - protein, 9 aa, Homo sapiens
  light chain complementarity determining region 3 for antibody 38239
QQRSNWPWP

SEQ ID NO: 76478 - protein, 10 aa, Homo sapiens
  heavy chain complementarity determining region 3 for antibody 38239
ARIAARRVDY

SEQ ID NO: 76479 - protein, 9 aa, Homo sapiens
  light chain complementarity determining region 3 for antibody 38240
QQRSNWPWK

SEQ ID NO: 76480 - protein, 10 aa, Homo sapiens
  heavy chain complementarity determining region 3 for antibody 38240
ARIAARRVDY

SEQ ID NO: 76481 - protein, 9 aa, Homo sapiens
  light chain complementarity determining region 3 for antibody 38241
QQRSNWPWK

SEQ ID NO: 76482 - protein, 20 aa, Homo sapiens
  heavy chain complementarity determining region 3 for antibody 38241
ARASPVYCSGGSCYYYGMDV

SEQ ID NO: 76483 - protein, 8 aa, Homo sapiens
  light chain complementarity determining region 3 for antibody 38242
QQRSNWPT

SEQ ID NO: 76484 - protein, 15 aa, Homo sapiens
  heavy chain complementarity determining region 3 for antibody 38242
AHRPNYYDKAGAFDI

SEQ ID NO: 76485 - protein, 8 aa, Homo sapiens
  light chain complementarity determining region 3 for antibody 38243
QQRSNWPS

SEQ ID NO: 76486 - protein, 20 aa, Homo sapiens
  heavy chain complementarity determining region 3 for antibody 38243
ARVWFGERTRGYYYYYGMDV

SEQ ID NO: 76487 - protein, 8 aa, Homo sapiens
  light chain complementarity determining region 3 for antibody 38244
QQRSNWPS

SEQ ID NO: 76488 - protein, 13 aa, Homo sapiens
  heavy chain complementarity determining region 3 for antibody 38244
AKERLRSHSDLDY

SEQ ID NO: 76489 - protein, 10 aa, Homo sapiens
  light chain complementarity determining region 3 for antibody 38245
QQRSNWPRRT

SEQ ID NO: 76490 - protein, 17 aa, Homo sapiens
  heavy chain complementarity determining region 3 for antibody 38245
AREYCGGDYPCGDPFDF

SEQ ID NO: 76491 - protein, 10 aa, Homo sapiens
  light chain complementarity determining region 3 for antibody 38246
QQRSNWPRPT

SEQ ID NO: 76492 - protein, 17 aa, Homo sapiens
  heavy chain complementarity determining region 3 for antibody 38246
AREYCGGDYPCGDPFDF

SEQ ID NO: 76493 - protein, 9 aa, Homo sapiens
  light chain complementarity determining region 3 for antibody 38247
QQRSNWPQT

SEQ ID NO: 76494 - protein, 20 aa, Homo sapiens
  heavy chain complementarity determining region 3 for antibody 38247
AGLPPVAARKRSYYYYGMDV

SEQ ID NO: 76495 - protein, 10 aa, Homo sapiens
  light chain complementarity determining region 3 for antibody 38248
QQRSNWPPYT

SEQ ID NO: 76496 - protein, 15 aa, Homo sapiens
  heavy chain complementarity determining region 3 for antibody 38248
ARGATSGRQEYYFDY

SEQ ID NO: 76497 - protein, 10 aa, Homo sapiens
  light chain complementarity determining region 3 for antibody 38249
QQRSNWPPWT

SEQ ID NO: 76498 - protein, 16 aa, Homo sapiens
  heavy chain complementarity determining region 3 for antibody 38249
ARDVVRFLEWSPHFDY

SEQ ID NO: 76499 - protein, 10 aa, Homo sapiens
  light chain complementarity determining region 3 for antibody 38250
QQRSNWPPWT

SEQ ID NO: 76500 - protein, 16 aa, Homo sapiens
  heavy chain complementarity determining region 3 for antibody 38250
ARDVLRFLEWSPHSDY

SEQ ID NO: 76501 - protein, 10 aa, Homo sapiens
  light chain complementarity determining region 3 for antibody 38251
QQRSNWPPWP

SEQ ID NO: 76502 - protein, 16 aa, Homo sapiens
  heavy chain complementarity determining region 3 for antibody 38251
ARDVLRFLEWSPHFDY

SEQ ID NO: 76503 - protein, 10 aa, Homo sapiens
  light chain complementarity determining region 3 for antibody 38252
QQRSNWPPVP

SEQ ID NO: 76504 - protein, 14 aa, Homo sapiens
  heavy chain complementarity determining region 3 for antibody 38252
ARGGRWLQFADFDY

SEQ ID NO: 76505 - protein, 9 aa, Homo sapiens
  light chain complementarity determining region 3 for antibody 38253
QQRSNWPPT

SEQ ID NO: 76506 - protein, 11 aa, Homo sapiens
  heavy chain complementarity determining region 3 for antibody 38253
ALGQWLAPFDY

SEQ ID NO: 76507 - protein, 9 aa, Homo sapiens
  light chain complementarity determining region 3 for antibody 38254
QQRSNWPPT

SEQ ID NO: 76508 - protein, 16 aa, Homo sapiens
  heavy chain complementarity determining region 3 for antibody 38254
AKDSGPGDYYHAGMDV

SEQ ID NO: 76509 - protein, 9 aa, Homo sapiens
  light chain complementarity determining region 3 for antibody 38255
QQRSNWPPT

SEQ ID NO: 76510 - protein, 16 aa, Homo sapiens
  heavy chain complementarity determining region 3 for antibody 38255
AKDSGPGDYCHSGMDV

SEQ ID NO: 76511 - protein, 9 aa, Homo sapiens
  light chain complementarity determining region 3 for antibody 38256
QQRSNWPPT

SEQ ID NO: 76512 - protein, 12 aa, Homo sapiens
  heavy chain complementarity determining region 3 for antibody 38256
AKDHSRSYFFDY

SEQ ID NO: 76513 - protein, 10 aa, Homo sapiens
  light chain complementarity determining region 3 for antibody 38257
QQRSNWPPST

SEQ ID NO: 76514 - protein, 11 aa, Homo sapiens
  heavy chain complementarity determining region 3 for antibody 38257
ARGVGSYVFES

SEQ ID NO: 76515 - protein, 10 aa, Homo sapiens
  light chain complementarity determining region 3 for antibody 38258
QQRSNWPPRT

SEQ ID NO: 76516 - protein, 16 aa, Homo sapiens
  heavy chain complementarity determining region 3 for antibody 38258
ARDVLRFLEWSPHFDY

SEQ ID NO: 76517 - protein, 10 aa, Homo sapiens
  light chain complementarity determining region 3 for antibody 38259
QQRSNWPPPT

SEQ ID NO: 76518 - protein, 17 aa, Homo sapiens
  heavy chain complementarity determining region 3 for antibody 38259
MRGVENYFDLTTGDFDL

SEQ ID NO: 76519 - protein, 10 aa, Homo sapiens
  light chain complementarity determining region 3 for antibody 38260
QQRSNWPPLT

SEQ ID NO: 76520 - protein, 17 aa, Homo sapiens
  heavy chain complementarity determining region 3 for antibody 38260
MRGVENYFDLTPGDFDL

SEQ ID NO: 76521 - protein, 10 aa, Homo sapiens
  light chain complementarity determining region 3 for antibody 38261
QQRSNWPPLT

SEQ ID NO: 76522 - protein, 14 aa, Homo sapiens
  heavy chain complementarity determining region 3 for antibody 38261
ARNRDSGWLDAFDI

SEQ ID NO: 76523 - protein, 10 aa, Homo sapiens
  light chain complementarity determining region 3 for antibody 38262
QQRSNWPPLT

SEQ ID NO: 76524 - protein, 17 aa, Homo sapiens
  heavy chain complementarity determining region 3 for antibody 38262
AAGYHSESLSADEVFDI

SEQ ID NO: 76525 - protein, 10 aa, Homo sapiens
  light chain complementarity determining region 3 for antibody 38263
QQRSNWPPLP

SEQ ID NO: 76526 - protein, 14 aa, Homo sapiens
  heavy chain complementarity determining region 3 for antibody 38263
AKNRDSGWLDAFDI

SEQ ID NO: 76527 - protein, 10 aa, Homo sapiens
  light chain complementarity determining region 3 for antibody 38264
QQRSNWPPIT

SEQ ID NO: 76528 - protein, 22 aa, Homo sapiens
  heavy chain complementarity determining region 3 for antibody 38264
ATDRDFSRGNITSTYYPGVLSD

SEQ ID NO: 76529 - protein, 10 aa, Homo sapiens
  light chain complementarity determining region 3 for antibody 38265
QQRSNWPPIT

SEQ ID NO: 76530 - protein, 17 aa, Homo sapiens
  heavy chain complementarity determining region 3 for antibody 38265
AAGYHSESLSADEAFDI

SEQ ID NO: 76531 - protein, 11 aa, Homo sapiens
  light chain complementarity determining region 3 for antibody 38266
QQRSNWPPGLT

SEQ ID NO: 76532 - protein, 11 aa, Homo sapiens
  heavy chain complementarity determining region 3 for antibody 38266
PIFMVRGDKDY

SEQ ID NO: 76533 - protein, 12 aa, Homo sapiens
  light chain complementarity determining region 3 for antibody 38267
QQRSNWPPGGVT

SEQ ID NO: 76534 - protein, 13 aa, Homo sapiens
  heavy chain complementarity determining region 3 for antibody 38267
ARGYGWYGGYFDY

SEQ ID NO: 76535 - protein, 12 aa, Homo sapiens
  light chain complementarity determining region 3 for antibody 38268
QQRSNWPPGGVA

SEQ ID NO: 76536 - protein, 13 aa, Homo sapiens
  heavy chain complementarity determining region 3 for antibody 38268
ARGYGWYGDYFDY

SEQ ID NO: 76537 - protein, 9 aa, Homo sapiens
  light chain complementarity determining region 3 for antibody 38269
QQRSNWPLT

SEQ ID NO: 76538 - protein, 14 aa, Homo sapiens
  heavy chain complementarity determining region 3 for antibody 38269
VKGKNSGWYGAFDI

SEQ ID NO: 76539 - protein, 9 aa, Homo sapiens
  light chain complementarity determining region 3 for antibody 38270
QQRSNWPLT

SEQ ID NO: 76540 - protein, 10 aa, Homo sapiens
  heavy chain complementarity determining region 3 for antibody 38270
ARIAARRVDY

SEQ ID NO: 76541 - protein, 9 aa, Homo sapiens
  light chain complementarity determining region 3 for antibody 38271
QQRSNWPLT

SEQ ID NO: 76542 - protein, 15 aa, Homo sapiens
  heavy chain complementarity determining region 3 for antibody 38271
ARELSYFGSRRGFDP

SEQ ID NO: 76543 - protein, 9 aa, Homo sapiens
  light chain complementarity determining region 3 for antibody 38272
QQRSNWPLT

SEQ ID NO: 76544 - protein, 15 aa, Homo sapiens
  heavy chain complementarity determining region 3 for antibody 38272
ARDLSSFGSRRGFDP

SEQ ID NO: 76545 - protein, 9 aa, Homo sapiens
  light chain complementarity determining region 3 for antibody 38273
QQRSNWPLT

SEQ ID NO: 76546 - protein, 11 aa, Homo sapiens
  heavy chain complementarity determining region 3 for antibody 38273
ALGQWLAHFDY

SEQ ID NO: 76547 - protein, 9 aa, Homo sapiens
  light chain complementarity determining region 3 for antibody 38274
QQRSNWPLT

SEQ ID NO: 76548 - protein, 19 aa, Homo sapiens
  heavy chain complementarity determining region 3 for antibody 38274
AKLYGDYGEAYYYYYGMDV

SEQ ID NO: 76549 - protein, 9 aa, Homo sapiens
  light chain complementarity determining region 3 for antibody 38275
QQRSNWPKT

SEQ ID NO: 76550 - protein, 12 aa, Homo sapiens
  heavy chain complementarity determining region 3 for antibody 38275
AKDHSRSYFFDY

SEQ ID NO: 76551 - protein, 10 aa, Homo sapiens
  light chain complementarity determining region 3 for antibody 38276
QQRSNWPGNT

SEQ ID NO: 76552 - protein, 14 aa, Homo sapiens
  heavy chain complementarity determining region 3 for antibody 38276
VRDSSSWYVKYFQH

SEQ ID NO: 76553 - protein, 9 aa, Homo sapiens
  light chain complementarity determining region 3 for antibody 38277
QQRSNWPFT

SEQ ID NO: 76554 - protein, 12 aa, Homo sapiens
  heavy chain complementarity determining region 3 for antibody 38277
TKTIAVTDKGDY

SEQ ID NO: 76555 - protein, 9 aa, Homo sapiens
  light chain complementarity determining region 3 for antibody 38278
QQRSNWPCT

SEQ ID NO: 76556 - protein, 11 aa, Homo sapiens
  heavy chain complementarity determining region 3 for antibody 38278
VRRWGGDEVDY

SEQ ID NO: 76557 - protein, 8 aa, Homo sapiens
  light chain complementarity determining region 3 for antibody 38279
QQRSNWPA

SEQ ID NO: 76558 - protein, 20 aa, Homo sapiens
  heavy chain complementarity determining region 3 for antibody 38279
ARVWFGERTRGYYYYDGMDV

SEQ ID NO: 76559 - protein, 8 aa, Homo sapiens
  light chain complementarity determining region 3 for antibody 38280
QQRSNWPA

SEQ ID NO: 76560 - protein, 20 aa, Homo sapiens
  heavy chain complementarity determining region 3 for antibody 38280
ARVWFGERTRGYYYYCGMDV

SEQ ID NO: 76561 - protein, 8 aa, Homo sapiens
  light chain complementarity determining region 3 for antibody 38281
QQRSNWPA

SEQ ID NO: 76562 - protein, 20 aa, Homo sapiens
  heavy chain complementarity determining region 3 for antibody 38281
ARVRFGERTRGYYYYYGMDV

SEQ ID NO: 76563 - protein, 8 aa, Homo sapiens
  light chain complementarity determining region 3 for antibody 38282
QQRSNWNT

SEQ ID NO: 76564 - protein, 15 aa, Homo sapiens
  heavy chain complementarity determining region 3 for antibody 38282
ARDLEQWLLDNWFDP

SEQ ID NO: 76565 - protein, 8 aa, Homo sapiens
  light chain complementarity determining region 3 for antibody 38283
QQRSNWLT

SEQ ID NO: 76566 - protein, 13 aa, Homo sapiens
  heavy chain complementarity determining region 3 for antibody 38283
ATLVIHPPPFSDY

SEQ ID NO: 76567 - protein, 8 aa, Homo sapiens
  light chain complementarity determining region 3 for antibody 38284
QQRSNWLT

SEQ ID NO: 76568 - protein, 15 aa, Homo sapiens
  heavy chain complementarity determining region 3 for antibody 38284
ARNNYYYDSSGFLDY

SEQ ID NO: 76569 - protein, 8 aa, Homo sapiens
  light chain complementarity determining region 3 for antibody 38285
QQRSNWLP

SEQ ID NO: 76570 - protein, 13 aa, Homo sapiens
  heavy chain complementarity determining region 3 for antibody 38285
ATLVIHPTPFSDY

SEQ ID NO: 76571 - protein, 8 aa, Homo sapiens
  light chain complementarity determining region 3 for antibody 38286
QQRSNWLP

SEQ ID NO: 76572 - protein, 15 aa, Homo sapiens
  heavy chain complementarity determining region 3 for antibody 38286
AHRPNYYDKAGAFDI

SEQ ID NO: 76573 - protein, 8 aa, Homo sapiens
  light chain complementarity determining region 3 for antibody 38287
QQRSNWLA

SEQ ID NO: 76574 - protein, 13 aa, Homo sapiens
  heavy chain complementarity determining region 3 for antibody 38287
AKERLRSQSDLDY

SEQ ID NO: 76575 - protein, 9 aa, Homo sapiens
  light chain complementarity determining region 3 for antibody 38288
QQRSNWHYT

SEQ ID NO: 76576 - protein, 10 aa, Homo sapiens
  heavy chain complementarity determining region 3 for antibody 38288
GGGPGWLTYA

SEQ ID NO: 76577 - protein, 8 aa, Homo sapiens
  light chain complementarity determining region 3 for antibody 38289
QQRSNWHT

SEQ ID NO: 76578 - protein, 13 aa, Homo sapiens
  heavy chain complementarity determining region 3 for antibody 38289
ARDGVPGKFSRAY

SEQ ID NO: 76579 - protein, 10 aa, Homo sapiens
  light chain complementarity determining region 3 for antibody 38290
QQRSNRPPLT

SEQ ID NO: 76580 - protein, 14 aa, Homo sapiens
  heavy chain complementarity determining region 3 for antibody 38290
AKNRDSGWLDAFDI

SEQ ID NO: 76581 - protein, 11 aa, Homo sapiens
  light chain complementarity determining region 3 for antibody 38291
QQRSNRPPELT

SEQ ID NO: 76582 - protein, 11 aa, Homo sapiens
  heavy chain complementarity determining region 3 for antibody 38291
PIFMVRGDKDY

SEQ ID NO: 76583 - protein, 8 aa, Homo sapiens
  light chain complementarity determining region 3 for antibody 38292
QQRSNPST

SEQ ID NO: 76584 - protein, 9 aa, Homo sapiens
  heavy chain complementarity determining region 3 for antibody 38292
AREWRGFDY

SEQ ID NO: 76585 - protein, 9 aa, Homo sapiens
  light chain complementarity determining region 3 for antibody 38293
QQRSNLPWT

SEQ ID NO: 76586 - protein, 20 aa, Homo sapiens
  heavy chain complementarity determining region 3 for antibody 38293
ARASPVYCSGGSCYYYGMDV

SEQ ID NO: 76587 - protein, 9 aa, Homo sapiens
  light chain complementarity determining region 3 for antibody 38294
QQRSNLPST

SEQ ID NO: 76588 - protein, 19 aa, Homo sapiens
  heavy chain complementarity determining region 3 for antibody 38294
ARDPQHYSNSSGYYYEPDH

SEQ ID NO: 76589 - protein, 8 aa, Homo sapiens
  light chain complementarity determining region 3 for antibody 38295
QQRSNLPA

SEQ ID NO: 76590 - protein, 20 aa, Homo sapiens
  heavy chain complementarity determining region 3 for antibody 38295
ARVWFGERTRGYYYYYGMDV

SEQ ID NO: 76591 - protein, 10 aa, Homo sapiens
  light chain complementarity determining region 3 for antibody 38296
QQRSNGPPLT

SEQ ID NO: 76592 - protein, 17 aa, Homo sapiens
  heavy chain complementarity determining region 3 for antibody 38296
MRGVENYFDLTTGDFDL

SEQ ID NO: 76593 - protein, 9 aa, Homo sapiens
  light chain complementarity determining region 3 for antibody 38297
QQRSNCPLT

SEQ ID NO: 76594 - protein, 15 aa, Homo sapiens
  heavy chain complementarity determining region 3 for antibody 38297
ARESFDISGNNWFAP

SEQ ID NO: 76595 - protein, 9 aa, Homo sapiens
  light chain complementarity determining region 3 for antibody 38298
QQRSKWPPT

SEQ ID NO: 76596 - protein, 13 aa, Homo sapiens
  heavy chain complementarity determining region 3 for antibody 38298
VRGSYSVDTYFDQ

SEQ ID NO: 76597 - protein, 10 aa, Homo sapiens
  light chain complementarity determining region 3 for antibody 38299
QQRSKWPPLT

SEQ ID NO: 76598 - protein, 9 aa, Homo sapiens
  heavy chain complementarity determining region 3 for antibody 38299
AGVDGYFDY

SEQ ID NO: 76599 - protein, 10 aa, Homo sapiens
  light chain complementarity determining region 3 for antibody 38300
QQRSKWPPFT

SEQ ID NO: 76600 - protein, 9 aa, Homo sapiens
  heavy chain complementarity determining region 3 for antibody 38300
ARVDGYFDY

SEQ ID NO: 76601 - protein, 8 aa, Homo sapiens
  light chain complementarity determining region 3 for antibody 38301
QQRSKWPA

SEQ ID NO: 76602 - protein, 20 aa, Homo sapiens
  heavy chain complementarity determining region 3 for antibody 38301
ARVWFGERTRGYYYYYGMDV

SEQ ID NO: 76603 - protein, 10 aa, Homo sapiens
  light chain complementarity determining region 3 for antibody 38302
QQRSKGPPLT

SEQ ID NO: 76604 - protein, 9 aa, Homo sapiens
  heavy chain complementarity determining region 3 for antibody 38302
ARVDGYFDY

SEQ ID NO: 76605 - protein, 10 aa, Homo sapiens
  light chain complementarity determining region 3 for antibody 38303
QQRSGWPPYT

SEQ ID NO: 76606 - protein, 18 aa, Homo sapiens
  heavy chain complementarity determining region 3 for antibody 38303
AREGRSGYRIPAAYGMDV

SEQ ID NO: 76607 - protein, 9 aa, Homo sapiens
  light chain complementarity determining region 3 for antibody 38304
QQRSDWPWT

SEQ ID NO: 76608 - protein, 10 aa, Homo sapiens
  heavy chain complementarity determining region 3 for antibody 38304
ARIAARRVDY

SEQ ID NO: 76609 - protein, 10 aa, Homo sapiens
  light chain complementarity determining region 3 for antibody 38305
QQRSDWPPYT

SEQ ID NO: 76610 - protein, 18 aa, Homo sapiens
  heavy chain complementarity determining region 3 for antibody 38305
AREGRSGYRIPAACGMDV

SEQ ID NO: 76611 - protein, 10 aa, Homo sapiens
  light chain complementarity determining region 3 for antibody 38306
QQRSDWPPLT

SEQ ID NO: 76612 - protein, 10 aa, Homo sapiens
  heavy chain complementarity determining region 3 for antibody 38306
ARDYTMAFDY

SEQ ID NO: 76613 - protein, 10 aa, Homo sapiens
  light chain complementarity determining region 3 for antibody 38307
QQRSDWPPHP

SEQ ID NO: 76614 - protein, 18 aa, Homo sapiens
  heavy chain complementarity determining region 3 for antibody 38307
AREGRSGYRIPAAYGMDV

SEQ ID NO: 76615 - protein, 8 aa, Homo sapiens
  light chain complementarity determining region 3 for antibody 38308
QQRSDWIT

SEQ ID NO: 76616 - protein, 18 aa, Homo sapiens
  heavy chain complementarity determining region 3 for antibody 38308
GKASLGHCSGRNCYYLDS

SEQ ID NO: 76617 - protein, 10 aa, Homo sapiens
  light chain complementarity determining region 3 for antibody 38309
QQRSAWPPLT

SEQ ID NO: 76618 - protein, 10 aa, Homo sapiens
  heavy chain complementarity determining region 3 for antibody 38309
ARDYSMTFDY

SEQ ID NO: 76619 - protein, 9 aa, Homo sapiens
  light chain complementarity determining region 3 for antibody 38310
QQRSAWPLT

SEQ ID NO: 76620 - protein, 7 aa, Homo sapiens
  heavy chain complementarity determining region 3 for antibody 38310
VSDEWWP

SEQ ID NO: 76621 - protein, 11 aa, Homo sapiens
  light chain complementarity determining region 3 for antibody 38311
QQRRTWPPAFT

SEQ ID NO: 76622 - protein, 13 aa, Homo sapiens
  heavy chain complementarity determining region 3 for antibody 38311
AHRRLVQLGAFDI

SEQ ID NO: 76623 - protein, 9 aa, Homo sapiens
  light chain complementarity determining region 3 for antibody 38312
QQRRNWPYT

SEQ ID NO: 76624 - protein, 11 aa, Homo sapiens
  heavy chain complementarity determining region 3 for antibody 38312
VRRWGGDEVDY

SEQ ID NO: 76625 - protein, 9 aa, Homo sapiens
  light chain complementarity determining region 3 for antibody 38313
QQRRNWPQT

SEQ ID NO: 76626 - protein, 12 aa, Homo sapiens
  heavy chain complementarity determining region 3 for antibody 38313
AKDHSRSYFFDY

SEQ ID NO: 76627 - protein, 10 aa, Homo sapiens
  light chain complementarity determining region 3 for antibody 38314
QQRRNWPPLT

SEQ ID NO: 76628 - protein, 17 aa, Homo sapiens
  heavy chain complementarity determining region 3 for antibody 38314
MRGVENYFDLTTGDFDL

SEQ ID NO: 76629 - protein, 9 aa, Homo sapiens
  light chain complementarity determining region 3 for antibody 38315
QQRRNWPLT

SEQ ID NO: 76630 - protein, 10 aa, Homo sapiens
  heavy chain complementarity determining region 3 for antibody 38315
ATPAAAPVDY

SEQ ID NO: 76631 - protein, 9 aa, Homo sapiens
  light chain complementarity determining region 3 for antibody 38316
QQRRNWPLT

SEQ ID NO: 76632 - protein, 15 aa, Homo sapiens
  heavy chain complementarity determining region 3 for antibody 38316
ARDLSYFGSRRGFDP

SEQ ID NO: 76633 - protein, 8 aa, Homo sapiens
  light chain complementarity determining region 3 for antibody 38317
QQRRNWPA

SEQ ID NO: 76634 - protein, 20 aa, Homo sapiens
  heavy chain complementarity determining region 3 for antibody 38317
ARVWFGERTRGYYYYYGMDV

SEQ ID NO: 76635 - protein, 8 aa, Homo sapiens
  light chain complementarity determining region 3 for antibody 38318
QQRRNWLT

SEQ ID NO: 76636 - protein, 15 aa, Homo sapiens
  heavy chain complementarity determining region 3 for antibody 38318
AHRPNYYDKAGAFDI

SEQ ID NO: 76637 - protein, 9 aa, Homo sapiens
  light chain complementarity determining region 3 for antibody 38319
QQRRFTPFT

SEQ ID NO: 76638 - protein, 17 aa, Homo sapiens
  heavy chain complementarity determining region 3 for antibody 38319
ARLMVSPSKWIQYGFDV

SEQ ID NO: 76639 - protein, 9 aa, Homo sapiens
  light chain complementarity determining region 3 for antibody 38320
QQRRDWRCT

SEQ ID NO: 76640 - protein, 17 aa, Homo sapiens
  heavy chain complementarity determining region 3 for antibody 38320
AKPINIYDRSGSYSFDY

SEQ ID NO: 76641 - protein, 8 aa, Homo sapiens
  light chain complementarity determining region 3 for antibody 38321
QQRRDLIT

SEQ ID NO: 76642 - protein, 18 aa, Homo sapiens
  heavy chain complementarity determining region 3 for antibody 38321
GKASLGHCSGRNCYYLDS

SEQ ID NO: 76643 - protein, 9 aa, Homo sapiens
  light chain complementarity determining region 3 for antibody 38322
QQRRAWPLT

SEQ ID NO: 76644 - protein, 7 aa, Homo sapiens
  heavy chain complementarity determining region 3 for antibody 38322
VRDEWWP

SEQ ID NO: 76645 - protein, 10 aa, Homo sapiens
  light chain complementarity determining region 3 for antibody 38323
QQRNPWPPVI

SEQ ID NO: 76646 - protein, 12 aa, Homo sapiens
  heavy chain complementarity determining region 3 for antibody 38323
VRDGTSGWYFDF

SEQ ID NO: 76647 - protein, 9 aa, Homo sapiens
  light chain complementarity determining region 3 for antibody 38324
QQRNNWRFT

SEQ ID NO: 76648 - protein, 16 aa, Homo sapiens
  heavy chain complementarity determining region 3 for antibody 38324
ARDQGFCRGPNCYMLY

SEQ ID NO: 76649 - protein, 9 aa, Homo sapiens
  light chain complementarity determining region 3 for antibody 38325
QQRNNWRFT

SEQ ID NO: 76650 - protein, 16 aa, Homo sapiens
  heavy chain complementarity determining region 3 for antibody 38325
ARDQGFCRGPNCYMLF

SEQ ID NO: 76651 - protein, 9 aa, Homo sapiens
  light chain complementarity determining region 3 for antibody 38326
QQRNNWPST

SEQ ID NO: 76652 - protein, 15 aa, Homo sapiens
  heavy chain complementarity determining region 3 for antibody 38326
ARECAGYSSGWLFDF

SEQ ID NO: 76653 - protein, 10 aa, Homo sapiens
  light chain complementarity determining region 3 for antibody 38327
QQRNIWPPVI

SEQ ID NO: 76654 - protein, 12 aa, Homo sapiens
  heavy chain complementarity determining region 3 for antibody 38327
VRDGTSGWYFDF

SEQ ID NO: 76655 - protein, 10 aa, Homo sapiens
  light chain complementarity determining region 3 for antibody 38328
QQRNHWPPWT

SEQ ID NO: 76656 - protein, 13 aa, Homo sapiens
  heavy chain complementarity determining region 3 for antibody 38328
HATGWLEGKWFDP

SEQ ID NO: 76657 - protein, 10 aa, Homo sapiens
  light chain complementarity determining region 3 for antibody 38329
QQRNHWPPRT

SEQ ID NO: 76658 - protein, 13 aa, Homo sapiens
  heavy chain complementarity determining region 3 for antibody 38329
HTTGWLEGKWFDP

SEQ ID NO: 76659 - protein, 10 aa, Homo sapiens
  light chain complementarity determining region 3 for antibody 38330
QQRLPWPPIT

SEQ ID NO: 76660 - protein, 14 aa, Homo sapiens
  heavy chain complementarity determining region 3 for antibody 38330
ARAGQTGADNWFDP

SEQ ID NO: 76661 - protein, 9 aa, Homo sapiens
  light chain complementarity determining region 3 for antibody 38331
QQRLNWPLT

SEQ ID NO: 76662 - protein, 11 aa, Homo sapiens
  heavy chain complementarity determining region 3 for antibody 38331
ARNILGGPTDF

SEQ ID NO: 76663 - protein, 9 aa, Homo sapiens
  light chain complementarity determining region 3 for antibody 38332
QQRLNWPLT

SEQ ID NO: 76664 - protein, 11 aa, Homo sapiens
  heavy chain complementarity determining region 3 for antibody 38332
ARNILGGHTDL

SEQ ID NO: 76665 - protein, 9 aa, Homo sapiens
  light chain complementarity determining region 3 for antibody 38333
QQRLNWPLP

SEQ ID NO: 76666 - protein, 11 aa, Homo sapiens
  heavy chain complementarity determining region 3 for antibody 38333
ARNILGGHTDF

SEQ ID NO: 76667 - protein, 9 aa, Homo sapiens
  light chain complementarity determining region 3 for antibody 38334
QQRLNRPLT

SEQ ID NO: 76668 - protein, 11 aa, Homo sapiens
  heavy chain complementarity determining region 3 for antibody 38334
ARNILGGHTDF

SEQ ID NO: 76669 - protein, 8 aa, Homo sapiens
  light chain complementarity determining region 3 for antibody 38335
QQRLKMYT

SEQ ID NO: 76670 - protein, 17 aa, Homo sapiens
  heavy chain complementarity determining region 3 for antibody 38335
ARDRGYSYDFRPDAFDI

SEQ ID NO: 76671 - protein, 8 aa, Homo sapiens
  light chain complementarity determining region 3 for antibody 38336
QQRHSART

SEQ ID NO: 76672 - protein, 19 aa, Homo sapiens
  heavy chain complementarity determining region 3 for antibody 38336
AREGARGGGTTTPHWYFDL

SEQ ID NO: 76673 - protein, 9 aa, Homo sapiens
  light chain complementarity determining region 3 for antibody 38337
QQRHKGPRT

SEQ ID NO: 76674 - protein, 15 aa, Homo sapiens
  heavy chain complementarity determining region 3 for antibody 38337
ARDCYGGSCQYYSDY

SEQ ID NO: 76675 - protein, 9 aa, Homo sapiens
  light chain complementarity determining region 3 for antibody 38338
QQRGNWPWT

SEQ ID NO: 76676 - protein, 10 aa, Homo sapiens
  heavy chain complementarity determining region 3 for antibody 38338
ARIAARRVDY

SEQ ID NO: 76677 - protein, 9 aa, Homo sapiens
  light chain complementarity determining region 3 for antibody 38339
QQRGNWPQT

SEQ ID NO: 76678 - protein, 12 aa, Homo sapiens
  heavy chain complementarity determining region 3 for antibody 38339
AKDHSRSYFFDY

SEQ ID NO: 76679 - protein, 9 aa, Homo sapiens
  light chain complementarity determining region 3 for antibody 38340
QQRGNWPPL

SEQ ID NO: 76680 - protein, 16 aa, Homo sapiens
  heavy chain complementarity determining region 3 for antibody 38340
ARLLDPDGYNFWYFDY

SEQ ID NO: 76681 - protein, 10 aa, Homo sapiens
  light chain complementarity determining region 3 for antibody 38341
QQRGNWPALT

SEQ ID NO: 76682 - protein, 17 aa, Homo sapiens
  heavy chain complementarity determining region 3 for antibody 38341
ARDVGVSYSDILTGFDY

SEQ ID NO: 76683 - protein, 10 aa, Homo sapiens
  light chain complementarity determining region 3 for antibody 38342
QQRGKWPEIS

SEQ ID NO: 76684 - protein, 14 aa, Homo sapiens
  heavy chain complementarity determining region 3 for antibody 38342
AKDHDSNSSGFGDL

SEQ ID NO: 76685 - protein, 10 aa, Homo sapiens
  light chain complementarity determining region 3 for antibody 38343
QQRGKWPAIS

SEQ ID NO: 76686 - protein, 14 aa, Homo sapiens
  heavy chain complementarity determining region 3 for antibody 38343
AKDHDSNISGFGEL

SEQ ID NO: 76687 - protein, 10 aa, Homo sapiens
  light chain complementarity determining region 3 for antibody 38344
QQRGKGPEIS

SEQ ID NO: 76688 - protein, 14 aa, Homo sapiens
  heavy chain complementarity determining region 3 for antibody 38344
AKDHDSNISGFGEL

SEQ ID NO: 76689 - protein, 10 aa, Homo sapiens
  light chain complementarity determining region 3 for antibody 38345
QQRGIWPGMS

SEQ ID NO: 76690 - protein, 14 aa, Homo sapiens
  heavy chain complementarity determining region 3 for antibody 38345
AKDHDSNISGFGDL

SEQ ID NO: 76691 - protein, 9 aa, Homo sapiens
  light chain complementarity determining region 3 for antibody 38346
QQRFTIPRT

SEQ ID NO: 76692 - protein, 14 aa, Homo sapiens
  heavy chain complementarity determining region 3 for antibody 38346
ATESSLSNGVSFDY

SEQ ID NO: 76693 - protein, 9 aa, Homo sapiens
  light chain complementarity determining region 3 for antibody 38347
QQRFSSPRT

SEQ ID NO: 76694 - protein, 21 aa, Homo sapiens
  heavy chain complementarity determining region 3 for antibody 38347
ARWGDCTGRNCYRYYYYGLDV

SEQ ID NO: 76695 - protein, 9 aa, Homo sapiens
  light chain complementarity determining region 3 for antibody 38348
QQRFSAPLT

SEQ ID NO: 76696 - protein, 13 aa, Homo sapiens
  heavy chain complementarity determining region 3 for antibody 38348
ARSISGELSWFDP

SEQ ID NO: 76697 - protein, 9 aa, Homo sapiens
  light chain complementarity determining region 3 for antibody 38349
QQRFNWPQP

SEQ ID NO: 76698 - protein, 14 aa, Homo sapiens
  heavy chain complementarity determining region 3 for antibody 38349
ITDNYQSGTYQGLH

SEQ ID NO: 76699 - protein, 9 aa, Homo sapiens
  light chain complementarity determining region 3 for antibody 38350
QQRFNWPPT

SEQ ID NO: 76700 - protein, 14 aa, Homo sapiens
  heavy chain complementarity determining region 3 for antibody 38350
ITDNYQSGTYQGLH

SEQ ID NO: 76701 - protein, 9 aa, Homo sapiens
  light chain complementarity determining region 3 for antibody 38351
QQRFNTPWT

SEQ ID NO: 76702 - protein, 14 aa, Homo sapiens
  heavy chain complementarity determining region 3 for antibody 38351
VRAFPLTVTTAFDI

SEQ ID NO: 76703 - protein, 10 aa, Homo sapiens
  light chain complementarity determining region 3 for antibody 38352
QQRFKWPPYT

SEQ ID NO: 76704 - protein, 11 aa, Homo sapiens
  heavy chain complementarity determining region 3 for antibody 38352
ARGVGSYVFES

SEQ ID NO: 76705 - protein, 8 aa, Homo sapiens
  light chain complementarity determining region 3 for antibody 38353
QQRFKMYT

SEQ ID NO: 76706 - protein, 17 aa, Homo sapiens
  heavy chain complementarity determining region 3 for antibody 38353
ARDRGYSYDFRSDAFDI

SEQ ID NO: 76707 - protein, 9 aa, Homo sapiens
  light chain complementarity determining region 3 for antibody 38354
QQRFDWPLT

SEQ ID NO: 76708 - protein, 12 aa, Homo sapiens
  heavy chain complementarity determining region 3 for antibody 38354
ARELYDNNQSDY

SEQ ID NO: 76709 - protein, 9 aa, Homo sapiens
  light chain complementarity determining region 3 for antibody 38355
QQRFDWPLT

SEQ ID NO: 76710 - protein, 12 aa, Homo sapiens
  heavy chain complementarity determining region 3 for antibody 38355
ARDRYDNNQSDY

SEQ ID NO: 76711 - protein, 9 aa, Homo sapiens
  light chain complementarity determining region 3 for antibody 38356
QQRFDWLLT

SEQ ID NO: 76712 - protein, 12 aa, Homo sapiens
  heavy chain complementarity determining region 3 for antibody 38356
ARDLYDNNQSDY

SEQ ID NO: 76713 - protein, 8 aa, Homo sapiens
  light chain complementarity determining region 3 for antibody 38357
QQRDDWVT

SEQ ID NO: 76714 - protein, 14 aa, Homo sapiens
  heavy chain complementarity determining region 3 for antibody 38357
ARETSNYGGYVLHV

SEQ ID NO: 76715 - protein, 8 aa, Homo sapiens
  light chain complementarity determining region 3 for antibody 38358
QQRDDWVN

SEQ ID NO: 76716 - protein, 14 aa, Homo sapiens
  heavy chain complementarity determining region 3 for antibody 38358
ARETSNYGGYVLHF

SEQ ID NO: 76717 - protein, 8 aa, Homo sapiens
  light chain complementarity determining region 3 for antibody 38359
QQRDDWGT

SEQ ID NO: 76718 - protein, 14 aa, Homo sapiens
  heavy chain complementarity determining region 3 for antibody 38359
ARETSNYGGYVLHF

SEQ ID NO: 76719 - protein, 8 aa, Homo sapiens
  light chain complementarity determining region 3 for antibody 38360
QQRDDRVT

SEQ ID NO: 76720 - protein, 14 aa, Homo sapiens
  heavy chain complementarity determining region 3 for antibody 38360
ARETSNYGGYVLHF

SEQ ID NO: 76721 - protein, 8 aa, Homo sapiens
  light chain complementarity determining region 3 for antibody 38361
QQRDDGVT

SEQ ID NO: 76722 - protein, 14 aa, Homo sapiens
  heavy chain complementarity determining region 3 for antibody 38361
ARETSNYGGYVLHF

SEQ ID NO: 76723 - protein, 8 aa, Homo sapiens
  light chain complementarity determining region 3 for antibody 38362
QQRDDCVT

SEQ ID NO: 76724 - protein, 14 aa, Homo sapiens
  heavy chain complementarity determining region 3 for antibody 38362
ARETSNYGGYVLHF

SEQ ID NO: 76725 - protein, 10 aa, Homo sapiens
  light chain complementarity determining region 3 for antibody 38363
QQRCNWPPIT

SEQ ID NO: 76726 - protein, 17 aa, Homo sapiens
  heavy chain complementarity determining region 3 for antibody 38363
AAGYHSESLSADEVFDI

SEQ ID NO: 76727 - protein, 9 aa, Homo sapiens
  light chain complementarity determining region 3 for antibody 38364
QQRCNWPLT

SEQ ID NO: 76728 - protein, 22 aa, Homo sapiens
  heavy chain complementarity determining region 3 for antibody 38364
ARVPYYYDSSGYYYDYYYGMDV

SEQ ID NO: 76729 - protein, 8 aa, Homo sapiens
  light chain complementarity determining region 3 for antibody 38365
QQRCNWPA

SEQ ID NO: 76730 - protein, 20 aa, Homo sapiens
  heavy chain complementarity determining region 3 for antibody 38365
ARVWFGERTRGYYYYYGMDV

SEQ ID NO: 76731 - protein, 11 aa, Homo sapiens
  light chain complementarity determining region 3 for antibody 38366
QQRASWPPGVT

SEQ ID NO: 76732 - protein, 18 aa, Homo sapiens
  heavy chain complementarity determining region 3 for antibody 38366
ARVYCSGGSCYAGDFFDI

SEQ ID NO: 76733 - protein, 8 aa, Homo sapiens
  light chain complementarity determining region 3 for antibody 38367
QQRANALP

SEQ ID NO: 76734 - protein, 13 aa, Homo sapiens
  heavy chain complementarity determining region 3 for antibody 38367
GGGDIEAIPTSDY

SEQ ID NO: 76735 - protein, 11 aa, Homo sapiens
  light chain complementarity determining region 3 for antibody 38368
QQRAEGTNWLT

SEQ ID NO: 76736 - protein, 15 aa, Homo sapiens
  heavy chain complementarity determining region 3 for antibody 38368
ARGGYSSNWYWWFDP

SEQ ID NO: 76737 - protein, 8 aa, Homo sapiens
  light chain complementarity determining region 3 for antibody 38369
QQRADWVT

SEQ ID NO: 76738 - protein, 14 aa, Homo sapiens
  heavy chain complementarity determining region 3 for antibody 38369
ARETSNYGGYVLHF

SEQ ID NO: 76739 - protein, 9 aa, Homo sapiens
  light chain complementarity determining region 3 for antibody 38370
QQQGSSPLT

SEQ ID NO: 76740 - protein, 18 aa, Homo sapiens
  heavy chain complementarity determining region 3 for antibody 38370
ASTNTGPVKWGPENYFDY

SEQ ID NO: 76741 - protein, 9 aa, Homo sapiens
  light chain complementarity determining region 3 for antibody 38371
QQPYSTLLT

SEQ ID NO: 76742 - protein, 14 aa, Homo sapiens
  heavy chain complementarity determining region 3 for antibody 38371
ASCSSTSCYRGFDS

SEQ ID NO: 76743 - protein, 9 aa, Homo sapiens
  light chain complementarity determining region 3 for antibody 38372
QQPYSIPRT

SEQ ID NO: 76744 - protein, 10 aa, Homo sapiens
  heavy chain complementarity determining region 3 for antibody 38372
AKDKTGYFDS

SEQ ID NO: 76745 - protein, 9 aa, Homo sapiens
  light chain complementarity determining region 3 for antibody 38373
QQPYNSPFT

SEQ ID NO: 76746 - protein, 15 aa, Homo sapiens
  heavy chain complementarity determining region 3 for antibody 38373
ARDSTEEGATPRLDQ

SEQ ID NO: 76747 - protein, 8 aa, Homo sapiens
  light chain complementarity determining region 3 for antibody 38374
QQPVSSVS

SEQ ID NO: 76748 - protein, 13 aa, Homo sapiens
  heavy chain complementarity determining region 3 for antibody 38374
VRTWFGELSHFDY

SEQ ID NO: 76749 - protein, 9 aa, Homo sapiens
  light chain complementarity determining region 3 for antibody 38375
QQPGSSPLT

SEQ ID NO: 76750 - protein, 18 aa, Homo sapiens
  heavy chain complementarity determining region 3 for antibody 38375
ASTNTGPVKWGPENYFDY

SEQ ID NO: 76751 - protein, 9 aa, Homo sapiens
  light chain complementarity determining region 3 for antibody 38376
QQPFTTPPT

SEQ ID NO: 76752 - protein, 18 aa, Homo sapiens
  heavy chain complementarity determining region 3 for antibody 38376
ARMRVSMVRGVISAWFDS

SEQ ID NO: 76753 - protein, 9 aa, Homo sapiens
  light chain complementarity determining region 3 for antibody 38377
QQNYTTPRT

SEQ ID NO: 76754 - protein, 8 aa, Homo sapiens
  heavy chain complementarity determining region 3 for antibody 38377
ARDGAFDS

SEQ ID NO: 76755 - protein, 9 aa, Homo sapiens
  light chain complementarity determining region 3 for antibody 38378
QQNYSTPPP

SEQ ID NO: 76756 - protein, 16 aa, Homo sapiens
  heavy chain complementarity determining region 3 for antibody 38378
AVGADTAMVTFGNFDY

SEQ ID NO: 76757 - protein, 8 aa, Homo sapiens
  light chain complementarity determining region 3 for antibody 38379
QQNYSTPA

SEQ ID NO: 76758 - protein, 12 aa, Homo sapiens
  heavy chain complementarity determining region 3 for antibody 38379
ARAVGTTCALDI

SEQ ID NO: 76759 - protein, 9 aa, Homo sapiens
  light chain complementarity determining region 3 for antibody 38380
QQNYSTLLT

SEQ ID NO: 76760 - protein, 14 aa, Homo sapiens
  heavy chain complementarity determining region 3 for antibody 38380
ASCSSTSCYRGFDS

SEQ ID NO: 76761 - protein, 9 aa, Homo sapiens
  light chain complementarity determining region 3 for antibody 38381
QQNYSTHPT

SEQ ID NO: 76762 - protein, 16 aa, Homo sapiens
  heavy chain complementarity determining region 3 for antibody 38381
AVGADTAMVTFGNFDY

SEQ ID NO: 76763 - protein, 8 aa, Homo sapiens
  light chain complementarity determining region 3 for antibody 38382
QQNYSLWT

SEQ ID NO: 76764 - protein, 14 aa, Homo sapiens
  heavy chain complementarity determining region 3 for antibody 38382
ASGLNRDGYKYFNF

SEQ ID NO: 76765 - protein, 9 aa, Homo sapiens
  light chain complementarity determining region 3 for antibody 38383
QQNYRTHPT

SEQ ID NO: 76766 - protein, 21 aa, Homo sapiens
  heavy chain complementarity determining region 3 for antibody 38383
TRRNLAGPMVRGAIVAYGFDI

SEQ ID NO: 76767 - protein, 9 aa, Homo sapiens
  light chain complementarity determining region 3 for antibody 38384
QQNYITPQK

SEQ ID NO: 76768 - protein, 17 aa, Homo sapiens
  heavy chain complementarity determining region 3 for antibody 38384
TTDHTYYDFLSDYPVGC

SEQ ID NO: 76769 - protein, 10 aa, Homo sapiens
  light chain complementarity determining region 3 for antibody 38385
QQNVNFLAYT

SEQ ID NO: 76770 - protein, 12 aa, Homo sapiens
  heavy chain complementarity determining region 3 for antibody 38385
AREMTNLGELDY

SEQ ID NO: 76771 - protein, 9 aa, Homo sapiens
  light chain complementarity determining region 3 for antibody 38386
QQNSSHPLT

SEQ ID NO: 76772 - protein, 8 aa, Homo sapiens
  heavy chain complementarity determining region 3 for antibody 38386
ARYAISVC

SEQ ID NO: 76773 - protein, 9 aa, Homo sapiens
  light chain complementarity determining region 3 for antibody 38387
QQNRRSPST

SEQ ID NO: 76774 - protein, 17 aa, Homo sapiens
  heavy chain complementarity determining region 3 for antibody 38387
AGLSSRLGDGSPSLFDY

SEQ ID NO: 76775 - protein, 9 aa, Homo sapiens
  light chain complementarity determining region 3 for antibody 38388
QQNNSYSYT

SEQ ID NO: 76776 - protein, 12 aa, Homo sapiens
  heavy chain complementarity determining region 3 for antibody 38388
ARGEGFGELSDY

SEQ ID NO: 76777 - protein, 9 aa, Homo sapiens
  light chain complementarity determining region 3 for antibody 38389
QQNNSYSWT

SEQ ID NO: 76778 - protein, 24 aa, Homo sapiens
  heavy chain complementarity determining region 3 for antibody 38389
ARDFYPSYTYSSSWGLYYYYGMDV

SEQ ID NO: 76779 - protein, 8 aa, Homo sapiens
  light chain complementarity determining region 3 for antibody 38390
QQNNSYST

SEQ ID NO: 76780 - protein, 19 aa, Homo sapiens
  heavy chain complementarity determining region 3 for antibody 38390
VRQGYCSSSDCSVGWYIDL

SEQ ID NO: 76781 - protein, 10 aa, Homo sapiens
  light chain complementarity determining region 3 for antibody 38391
QQNNSYSPYT

SEQ ID NO: 76782 - protein, 14 aa, Homo sapiens
  heavy chain complementarity determining region 3 for antibody 38391
ARDQRTGSGVVILD

SEQ ID NO: 76783 - protein, 9 aa, Homo sapiens
  light chain complementarity determining region 3 for antibody 38392
QQNNSYRRT

SEQ ID NO: 76784 - protein, 9 aa, Homo sapiens
  heavy chain complementarity determining region 3 for antibody 38392
AKGSSALEY

SEQ ID NO: 76785 - protein, 9 aa, Homo sapiens
  light chain complementarity determining region 3 for antibody 38393
QQNNSYPYT

SEQ ID NO: 76786 - protein, 14 aa, Homo sapiens
  heavy chain complementarity determining region 3 for antibody 38393
IGQDCSGRACDYPR

SEQ ID NO: 76787 - protein, 9 aa, Homo sapiens
  light chain complementarity determining region 3 for antibody 38394
QQNNSYPLT

SEQ ID NO: 76788 - protein, 19 aa, Homo sapiens
  heavy chain complementarity determining region 3 for antibody 38394
ARGPPGFFWSGSIPYYFDY

SEQ ID NO: 76789 - protein, 9 aa, Homo sapiens
  light chain complementarity determining region 3 for antibody 38395
QQNNNYPPP

SEQ ID NO: 76790 - protein, 16 aa, Homo sapiens
  heavy chain complementarity determining region 3 for antibody 38395
TLQYHNEFTGYYLFDY

SEQ ID NO: 76791 - protein, 10 aa, Homo sapiens
  light chain complementarity determining region 3 for antibody 38396
QQNNNWPPLT

SEQ ID NO: 76792 - protein, 15 aa, Homo sapiens
  heavy chain complementarity determining region 3 for antibody 38396
ARYYYDSSGYYVFDY

SEQ ID NO: 76793 - protein, 9 aa, Homo sapiens
  light chain complementarity determining region 3 for antibody 38397
QQNHSHPRT

SEQ ID NO: 76794 - protein, 18 aa, Homo sapiens
  heavy chain complementarity determining region 3 for antibody 38397
AREFLRYFDSSKAYNFDD

SEQ ID NO: 76795 - protein, 9 aa, Homo sapiens
  light chain complementarity determining region 3 for antibody 38398
QQNHALPLT

SEQ ID NO: 76796 - protein, 13 aa, Homo sapiens
  heavy chain complementarity determining region 3 for antibody 38398
ARDGVPGKFNRAH

SEQ ID NO: 76797 - protein, 9 aa, Homo sapiens
  light chain complementarity determining region 3 for antibody 38399
QQNGTSPFT

SEQ ID NO: 76798 - protein, 15 aa, Homo sapiens
  heavy chain complementarity determining region 3 for antibody 38399
ARQNDFLSGPGEFDP

SEQ ID NO: 76799 - protein, 9 aa, Homo sapiens
  light chain complementarity determining region 3 for antibody 38400
QQNGTSPFT

SEQ ID NO: 76800 - protein, 14 aa, Homo sapiens
  heavy chain complementarity determining region 3 for antibody 38400
ARGGPAATSSSWLY

SEQ ID NO: 76801 - protein, 9 aa, Homo sapiens
  light chain complementarity determining region 3 for antibody 38401
QQNGTPPRT

SEQ ID NO: 76802 - protein, 25 aa, Homo sapiens
  heavy chain complementarity determining region 3 for antibody 38401
ARRRVDRLRLPGAMRGPLYDRGLNV

SEQ ID NO: 76803 - protein, 9 aa, Homo sapiens
  light chain complementarity determining region 3 for antibody 38402
QQNGSSPWT

SEQ ID NO: 76804 - protein, 14 aa, Homo sapiens
  heavy chain complementarity determining region 3 for antibody 38402
ARDSSSTSWGPIDY

SEQ ID NO: 76805 - protein, 9 aa, Homo sapiens
  light chain complementarity determining region 3 for antibody 38403
QQNGSSPVT

SEQ ID NO: 76806 - protein, 26 aa, Homo sapiens
  heavy chain complementarity determining region 3 for antibody 38403
AREPHTYYYGSGSYSRRLYYYYGMDV

SEQ ID NO: 76807 - protein, 8 aa, Homo sapiens
  light chain complementarity determining region 3 for antibody 38404
QQNGSSPS

SEQ ID NO: 76808 - protein, 20 aa, Homo sapiens
  heavy chain complementarity determining region 3 for antibody 38404
ARDQAYFYALGSSGVDWLDP

SEQ ID NO: 76809 - protein, 9 aa, Homo sapiens
  light chain complementarity determining region 3 for antibody 38405
QQNGSSPRT

SEQ ID NO: 76810 - protein, 9 aa, Homo sapiens
  heavy chain complementarity determining region 3 for antibody 38405
ARRSYGRDY

SEQ ID NO: 76811 - protein, 9 aa, Homo sapiens
  light chain complementarity determining region 3 for antibody 38406
QQNGSSPRT

SEQ ID NO: 76812 - protein, 27 aa, Homo sapiens
  heavy chain complementarity determining region 3 for antibody 38406
ARGVGSCTSFLCRRGRDPHYQKRGFDY

SEQ ID NO: 76813 - protein, 10 aa, Homo sapiens
  light chain complementarity determining region 3 for antibody 38407
QQNGSSPPLT

SEQ ID NO: 76814 - protein, 18 aa, Homo sapiens
  heavy chain complementarity determining region 3 for antibody 38407
ARGGYDYGWGSYGVYFDY

SEQ ID NO: 76815 - protein, 10 aa, Homo sapiens
  light chain complementarity determining region 3 for antibody 38408
QQNGSSPPLT

SEQ ID NO: 76816 - protein, 18 aa, Homo sapiens
  heavy chain complementarity determining region 3 for antibody 38408
ARGGYDYGGGSYGVYFDY

SEQ ID NO: 76817 - protein, 9 aa, Homo sapiens
  light chain complementarity determining region 3 for antibody 38409
QQNGSSPLT

SEQ ID NO: 76818 - protein, 18 aa, Homo sapiens
  heavy chain complementarity determining region 3 for antibody 38409
ASTNTGPVKWGPENYFDY

SEQ ID NO: 76819 - protein, 9 aa, Homo sapiens
  light chain complementarity determining region 3 for antibody 38410
QQNGSSPLT

SEQ ID NO: 76820 - protein, 15 aa, Homo sapiens
  heavy chain complementarity determining region 3 for antibody 38410
ARRRSNILVGYGMDV

SEQ ID NO: 76821 - protein, 9 aa, Homo sapiens
  light chain complementarity determining region 3 for antibody 38411
QQNGSSPLT

SEQ ID NO: 76822 - protein, 20 aa, Homo sapiens
  heavy chain complementarity determining region 3 for antibody 38411
ARGVGLGYCSSTSCPYYFDY

SEQ ID NO: 76823 - protein, 10 aa, Homo sapiens
  light chain complementarity determining region 3 for antibody 38412
QQNGSSPLFT

SEQ ID NO: 76824 - protein, 14 aa, Homo sapiens
  heavy chain complementarity determining region 3 for antibody 38412
VRPRHVVVNWYIDS

SEQ ID NO: 76825 - protein, 9 aa, Homo sapiens
  light chain complementarity determining region 3 for antibody 38413
QQNGSSPGT

SEQ ID NO: 76826 - protein, 18 aa, Homo sapiens
  heavy chain complementarity determining region 3 for antibody 38413
SRIDYYDTNGWSLDAFHI

SEQ ID NO: 76827 - protein, 9 aa, Homo sapiens
  light chain complementarity determining region 3 for antibody 38414
QQNGSPPRT

SEQ ID NO: 76828 - protein, 14 aa, Homo sapiens
  heavy chain complementarity determining region 3 for antibody 38414
AGGNFCGYDCYSEY

SEQ ID NO: 76829 - protein, 9 aa, Homo sapiens
  light chain complementarity determining region 3 for antibody 38415
QQNGSPPRT

SEQ ID NO: 76830 - protein, 6 aa, Homo sapiens
  heavy chain complementarity determining region 3 for antibody 38415
ADIFAF

SEQ ID NO: 76831 - protein, 9 aa, Homo sapiens
  light chain complementarity determining region 3 for antibody 38416
QQNGSLPRT

SEQ ID NO: 76832 - protein, 13 aa, Homo sapiens
  heavy chain complementarity determining region 3 for antibody 38416
AGGQFDNTGYREY

SEQ ID NO: 76833 - protein, 9 aa, Homo sapiens
  light chain complementarity determining region 3 for antibody 38417
QQNGSIPRS

SEQ ID NO: 76834 - protein, 13 aa, Homo sapiens
  heavy chain complementarity determining region 3 for antibody 38417
AGGTWHSGIYYES

SEQ ID NO: 76835 - protein, 9 aa, Homo sapiens
  light chain complementarity determining region 3 for antibody 38418
QQNGSIPRS

SEQ ID NO: 76836 - protein, 13 aa, Homo sapiens
  heavy chain complementarity determining region 3 for antibody 38418
AGGTWHSGIYYDS

SEQ ID NO: 76837 - protein, 9 aa, Homo sapiens
  light chain complementarity determining region 3 for antibody 38419
QQNGRTPRT

SEQ ID NO: 76838 - protein, 14 aa, Homo sapiens
  heavy chain complementarity determining region 3 for antibody 38419
AGGDFCGADCYSEY

SEQ ID NO: 76839 - protein, 9 aa, Homo sapiens
  light chain complementarity determining region 3 for antibody 38420
QQNGRLPPT

SEQ ID NO: 76840 - protein, 16 aa, Homo sapiens
  heavy chain complementarity determining region 3 for antibody 38420
ARLSFRRHDGRGSFGH

SEQ ID NO: 76841 - protein, 9 aa, Homo sapiens
  light chain complementarity determining region 3 for antibody 38421
QQNGNSPRT

SEQ ID NO: 76842 - protein, 16 aa, Homo sapiens
  heavy chain complementarity determining region 3 for antibody 38421
ARGTFYQGSSDNYHEN

SEQ ID NO: 76843 - protein, 9 aa, Homo sapiens
  light chain complementarity determining region 3 for antibody 38422
QQNGNSPFT

SEQ ID NO: 76844 - protein, 15 aa, Homo sapiens
  heavy chain complementarity determining region 3 for antibody 38422
ARQKGQRASAGYFDS

SEQ ID NO: 76845 - protein, 9 aa, Homo sapiens
  light chain complementarity determining region 3 for antibody 38423
QQNGNLPRT

SEQ ID NO: 76846 - protein, 13 aa, Homo sapiens
  heavy chain complementarity determining region 3 for antibody 38423
AGGQFHSSGYSEF

SEQ ID NO: 76847 - protein, 9 aa, Homo sapiens
  light chain complementarity determining region 3 for antibody 38424
QQNGNIPRT

SEQ ID NO: 76848 - protein, 13 aa, Homo sapiens
  heavy chain complementarity determining region 3 for antibody 38424
AGGLFHTSGYSEF

SEQ ID NO: 76849 - protein, 9 aa, Homo sapiens
  light chain complementarity determining region 3 for antibody 38425
QQNGGSPWT

SEQ ID NO: 76850 - protein, 18 aa, Homo sapiens
  heavy chain complementarity determining region 3 for antibody 38425
ATNPSIAEPGKIYYYFDL

SEQ ID NO: 76851 - protein, 8 aa, Homo sapiens
  light chain complementarity determining region 3 for antibody 38426
QQNGGSPS

SEQ ID NO: 76852 - protein, 16 aa, Homo sapiens
  heavy chain complementarity determining region 3 for antibody 38426
AADWGSGTQWIRAFDV

SEQ ID NO: 76853 - protein, 8 aa, Homo sapiens
  light chain complementarity determining region 3 for antibody 38427
QQNFTYWT

SEQ ID NO: 76854 - protein, 18 aa, Homo sapiens
  heavy chain complementarity determining region 3 for antibody 38427
ARRGYDTLTGLPAGWFDL

SEQ ID NO: 76855 - protein, 9 aa, Homo sapiens
  light chain complementarity determining region 3 for antibody 38428
QQNFNTPRT

SEQ ID NO: 76856 - protein, 15 aa, Homo sapiens
  heavy chain complementarity determining region 3 for antibody 38428
ARDCEVEWEVATFDL

SEQ ID NO: 76857 - protein, 9 aa, Homo sapiens
  light chain complementarity determining region 3 for antibody 38429
QQNFNTPRT

SEQ ID NO: 76858 - protein, 15 aa, Homo sapiens
  heavy chain complementarity determining region 3 for antibody 38429
AGDFEVEWEVATFDL

SEQ ID NO: 76859 - protein, 8 aa, Homo sapiens
  light chain complementarity determining region 3 for antibody 38430
QQNESLFT

SEQ ID NO: 76860 - protein, 19 aa, Homo sapiens
  heavy chain complementarity determining region 3 for antibody 38430
ARHGKNAYSSGSRWGAFDI

SEQ ID NO: 76861 - protein, 9 aa, Homo sapiens
  light chain complementarity determining region 3 for antibody 38431
QQNDTSPWT

SEQ ID NO: 76862 - protein, 15 aa, Homo sapiens
  heavy chain complementarity determining region 3 for antibody 38431
VHTQLWFGDQCYFDF

SEQ ID NO: 76863 - protein, 8 aa, Homo sapiens
  light chain complementarity determining region 3 for antibody 38432
QQNDSYST

SEQ ID NO: 76864 - protein, 16 aa, Homo sapiens
  heavy chain complementarity determining region 3 for antibody 38432
AKDALALTSKPYYFDF

SEQ ID NO: 76865 - protein, 10 aa, Homo sapiens
  light chain complementarity determining region 3 for antibody 38433
QQNDSSAMLT

SEQ ID NO: 76866 - protein, 13 aa, Homo sapiens
  heavy chain complementarity determining region 3 for antibody 38433
ARVSGWSRGGFDY

SEQ ID NO: 76867 - protein, 9 aa, Homo sapiens
  light chain complementarity determining region 3 for antibody 38434
QQNDRSPET

SEQ ID NO: 76868 - protein, 12 aa, Homo sapiens
  heavy chain complementarity determining region 3 for antibody 38434
ARPLYNSGFFEY

SEQ ID NO: 76869 - protein, 9 aa, Homo sapiens
  light chain complementarity determining region 3 for antibody 38435
QQNDRLPPT

SEQ ID NO: 76870 - protein, 16 aa, Homo sapiens
  heavy chain complementarity determining region 3 for antibody 38435
ARLSLRRHDGRGSFGH

SEQ ID NO: 76871 - protein, 9 aa, Homo sapiens
  light chain complementarity determining region 3 for antibody 38436
QQNDRLPPT

SEQ ID NO: 76872 - protein, 16 aa, Homo sapiens
  heavy chain complementarity determining region 3 for antibody 38436
ARLSCRRHDGRGSFGH

SEQ ID NO: 76873 - protein, 9 aa, Homo sapiens
  light chain complementarity determining region 3 for antibody 38437
QQNDRLPPP

SEQ ID NO: 76874 - protein, 16 aa, Homo sapiens
  heavy chain complementarity determining region 3 for antibody 38437
ARLSFRRHDGRGSFGH

SEQ ID NO: 76875 - protein, 8 aa, Homo sapiens
  light chain complementarity determining region 3 for antibody 38438
QQNDNLPT

SEQ ID NO: 76876 - protein, 25 aa, Homo sapiens
  heavy chain complementarity determining region 3 for antibody 38438
ARDRTRAPLGYCGGGSCPTSNWFDP

SEQ ID NO: 76877 - protein, 11 aa, Homo sapiens
  light chain complementarity determining region 3 for antibody 38439
QQNDNLPPAYT

SEQ ID NO: 76878 - protein, 9 aa, Homo sapiens
  heavy chain complementarity determining region 3 for antibody 38439
ASGFTAFDY

SEQ ID NO: 76879 - protein, 8 aa, Homo sapiens
  light chain complementarity determining region 3 for antibody 38440
QQNDNLAT

SEQ ID NO: 76880 - protein, 13 aa, Homo sapiens
  heavy chain complementarity determining region 3 for antibody 38440
ARGDLLAAAGTDF

SEQ ID NO: 76881 - protein, 10 aa, Homo sapiens
  light chain complementarity determining region 3 for antibody 38441
QQNDISAMFT

SEQ ID NO: 76882 - protein, 13 aa, Homo sapiens
  heavy chain complementarity determining region 3 for antibody 38441
ARVSGWSRGGFDY

SEQ ID NO: 76883 - protein, 8 aa, Homo sapiens
  light chain complementarity determining region 3 for antibody 38442
QQNDDLRA

SEQ ID NO: 76884 - protein, 19 aa, Homo sapiens
  heavy chain complementarity determining region 3 for antibody 38442
ARDPSYYYDSSGSPRYFQH

SEQ ID NO: 76885 - protein, 10 aa, Homo sapiens
  light chain complementarity determining region 3 for antibody 38443
QQNDDLLPIT

SEQ ID NO: 76886 - protein, 12 aa, Homo sapiens
  heavy chain complementarity determining region 3 for antibody 38443
ARDVTGTRLFDF

SEQ ID NO: 76887 - protein, 9 aa, Homo sapiens
  light chain complementarity determining region 3 for antibody 38444
QQNASSPFT

SEQ ID NO: 76888 - protein, 18 aa, Homo sapiens
  heavy chain complementarity determining region 3 for antibody 38444
AARGANCGGDCYYWYFDL

SEQ ID NO: 76889 - protein, 10 aa, Homo sapiens
  light chain complementarity determining region 3 for antibody 38445
QQLYSYLPFT

SEQ ID NO: 76890 - protein, 17 aa, Homo sapiens
  heavy chain complementarity determining region 3 for antibody 38445
ATEGKHDSSGYYEPFDY

SEQ ID NO: 76891 - protein, 9 aa, Homo sapiens
  light chain complementarity determining region 3 for antibody 38446
QQLSAWPLT

SEQ ID NO: 76892 - protein, 7 aa, Homo sapiens
  heavy chain complementarity determining region 3 for antibody 38446
VRDEWWP

SEQ ID NO: 76893 - protein, 9 aa, Homo sapiens
  light chain complementarity determining region 3 for antibody 38447
QQLRGFPLT

SEQ ID NO: 76894 - protein, 21 aa, Homo sapiens
  heavy chain complementarity determining region 3 for antibody 38447
AKGANYHYVSGSYYPGHWFPS

SEQ ID NO: 76895 - protein, 9 aa, Homo sapiens
  light chain complementarity determining region 3 for antibody 38448
QQLNTYPPT

SEQ ID NO: 76896 - protein, 14 aa, Homo sapiens
  heavy chain complementarity determining region 3 for antibody 38448
AGENSVAATRAYDY

SEQ ID NO: 76897 - protein, 9 aa, Homo sapiens
  light chain complementarity determining region 3 for antibody 38449
QQLNSYPYT

SEQ ID NO: 76898 - protein, 18 aa, Homo sapiens
  heavy chain complementarity determining region 3 for antibody 38449
ARGGQYGSSITCYALLDY

SEQ ID NO: 76899 - protein, 9 aa, Homo sapiens
  light chain complementarity determining region 3 for antibody 38450
QQLNSYPST

SEQ ID NO: 76900 - protein, 18 aa, Homo sapiens
  heavy chain complementarity determining region 3 for antibody 38450
ARGGQYCSSITCYALLDY

SEQ ID NO: 76901 - protein, 10 aa, Homo sapiens
  light chain complementarity determining region 3 for antibody 38451
QQLNSYPPYP

SEQ ID NO: 76902 - protein, 21 aa, Homo sapiens
  heavy chain complementarity determining region 3 for antibody 38451
TTDQAYYGSGNYYSSLPVFDY

SEQ ID NO: 76903 - protein, 10 aa, Homo sapiens
  light chain complementarity determining region 3 for antibody 38452
QQLNSYPPFT

SEQ ID NO: 76904 - protein, 17 aa, Homo sapiens
  heavy chain complementarity determining region 3 for antibody 38452
ATEGKHDSSGYYEPFDY

SEQ ID NO: 76905 - protein, 10 aa, Homo sapiens
  light chain complementarity determining region 3 for antibody 38453
QQLNSYPPCT

SEQ ID NO: 76906 - protein, 20 aa, Homo sapiens
  heavy chain complementarity determining region 3 for antibody 38453
ARDSPWEVKWPRPVPRGMDV

SEQ ID NO: 76907 - protein, 8 aa, Homo sapiens
  light chain complementarity determining region 3 for antibody 38454
QQLNSYPP

SEQ ID NO: 76908 - protein, 13 aa, Homo sapiens
  heavy chain complementarity determining region 3 for antibody 38454
ARHVYTMVTPFDY

SEQ ID NO: 76909 - protein, 9 aa, Homo sapiens
  light chain complementarity determining region 3 for antibody 38455
QQLNSYPLT

SEQ ID NO: 76910 - protein, 13 aa, Homo sapiens
  heavy chain complementarity determining region 3 for antibody 38455
ARGLHSGYYGMDV

SEQ ID NO: 76911 - protein, 9 aa, Homo sapiens
  light chain complementarity determining region 3 for antibody 38456
QQLNSYPLP

SEQ ID NO: 76912 - protein, 15 aa, Homo sapiens
  heavy chain complementarity determining region 3 for antibody 38456
AREFYGSGSYYLIDY

SEQ ID NO: 76913 - protein, 9 aa, Homo sapiens
  light chain complementarity determining region 3 for antibody 38457
QQLNSYPIT

SEQ ID NO: 76914 - protein, 13 aa, Homo sapiens
  heavy chain complementarity determining region 3 for antibody 38457
ARGHLGLELLSDY

SEQ ID NO: 76915 - protein, 9 aa, Homo sapiens
  light chain complementarity determining region 3 for antibody 38458
QQLNSYFVT

SEQ ID NO: 76916 - protein, 14 aa, Homo sapiens
  heavy chain complementarity determining region 3 for antibody 38458
TADTFDSRRWCNDY

SEQ ID NO: 76917 - protein, 9 aa, Homo sapiens
  light chain complementarity determining region 3 for antibody 38459
QQLNSSPLT

SEQ ID NO: 76918 - protein, 16 aa, Homo sapiens
  heavy chain complementarity determining region 3 for antibody 38459
VRRDEVTVFWGGPLDF

SEQ ID NO: 76919 - protein, 8 aa, Homo sapiens
  light chain complementarity determining region 3 for antibody 38460
QQLNSPPT

SEQ ID NO: 76920 - protein, 18 aa, Homo sapiens
  heavy chain complementarity determining region 3 for antibody 38460
ARDGGYYVSGSYYTFFDY

SEQ ID NO: 76921 - protein, 8 aa, Homo sapiens
  light chain complementarity determining region 3 for antibody 38461
QQLNSPLT

SEQ ID NO: 76922 - protein, 18 aa, Homo sapiens
  heavy chain complementarity determining region 3 for antibody 38461
ARDGGYYVSGSDYTFFDY

SEQ ID NO: 76923 - protein, 9 aa, Homo sapiens
  light chain complementarity determining region 3 for antibody 38462
QQLLSYPRP

SEQ ID NO: 76924 - protein, 14 aa, Homo sapiens
  heavy chain complementarity determining region 3 for antibody 38462
AKESDDFWSGYLDF

SEQ ID NO: 76925 - protein, 9 aa, Homo sapiens
  light chain complementarity determining region 3 for antibody 38463
QQLKSYPPT

SEQ ID NO: 76926 - protein, 14 aa, Homo sapiens
  heavy chain complementarity determining region 3 for antibody 38463
ARENAVAAARAYDY

SEQ ID NO: 76927 - protein, 9 aa, Homo sapiens
  light chain complementarity determining region 3 for antibody 38464
QQLKSYPPT

SEQ ID NO: 76928 - protein, 14 aa, Homo sapiens
  heavy chain complementarity determining region 3 for antibody 38464
ARENAVAAARACDY

SEQ ID NO: 76929 - protein, 9 aa, Homo sapiens
  light chain complementarity determining region 3 for antibody 38465
QQLKSYPPT

SEQ ID NO: 76930 - protein, 14 aa, Homo sapiens
  heavy chain complementarity determining region 3 for antibody 38465
AREDSVAAARAYDY

SEQ ID NO: 76931 - protein, 9 aa, Homo sapiens
  light chain complementarity determining region 3 for antibody 38466
QQLKSYPLT

SEQ ID NO: 76932 - protein, 13 aa, Homo sapiens
  heavy chain complementarity determining region 3 for antibody 38466
VPVMEVTLGAFDF

SEQ ID NO: 76933 - protein, 9 aa, Homo sapiens
  light chain complementarity determining region 3 for antibody 38467
QQLKSYPLP

SEQ ID NO: 76934 - protein, 13 aa, Homo sapiens
  heavy chain complementarity determining region 3 for antibody 38467
VPVMEVTLGAFAF

SEQ ID NO: 76935 - protein, 9 aa, Homo sapiens
  light chain complementarity determining region 3 for antibody 38468
QQLKSYPFT

SEQ ID NO: 76936 - protein, 13 aa, Homo sapiens
  heavy chain complementarity determining region 3 for antibody 38468
VPVMEVTLGAFAF

SEQ ID NO: 76937 - protein, 9 aa, Homo sapiens
  light chain complementarity determining region 3 for antibody 38469
QQLKNYPYS

SEQ ID NO: 76938 - protein, 19 aa, Homo sapiens
  heavy chain complementarity determining region 3 for antibody 38469
AKDARDSSGYYYGPYYFDY

SEQ ID NO: 76939 - protein, 11 aa, Homo sapiens
  light chain complementarity determining region 3 for antibody 38470
QQLKDYPRELT

SEQ ID NO: 76940 - protein, 14 aa, Homo sapiens
  heavy chain complementarity determining region 3 for antibody 38470
ARDLFGGRPGAFDS

SEQ ID NO: 76941 - protein, 9 aa, Homo sapiens
  light chain complementarity determining region 3 for antibody 38471
QQLDSYPLP

SEQ ID NO: 76942 - protein, 11 aa, Homo sapiens
  heavy chain complementarity determining region 3 for antibody 38471
ARQTGYTDFDY

SEQ ID NO: 76943 - protein, 9 aa, Homo sapiens
  light chain complementarity determining region 3 for antibody 38472
QQLDSYPIT

SEQ ID NO: 76944 - protein, 13 aa, Homo sapiens
  heavy chain complementarity determining region 3 for antibody 38472
ARGRLGLELLSDY

SEQ ID NO: 76945 - protein, 9 aa, Homo sapiens
  light chain complementarity determining region 3 for antibody 38473
QQLDSFPLT

SEQ ID NO: 76946 - protein, 10 aa, Homo sapiens
  heavy chain complementarity determining region 3 for antibody 38473
ARVTFYGMDV

SEQ ID NO: 76947 - protein, 9 aa, Homo sapiens
  light chain complementarity determining region 3 for antibody 38474
QQLDRYPLT

SEQ ID NO: 76948 - protein, 19 aa, Homo sapiens
  heavy chain complementarity determining region 3 for antibody 38474
ARDSRRMVRGLIVYNWFDP

SEQ ID NO: 76949 - protein, 9 aa, Homo sapiens
  light chain complementarity determining region 3 for antibody 38475
QQINSYPPK

SEQ ID NO: 76950 - protein, 16 aa, Homo sapiens
  heavy chain complementarity determining region 3 for antibody 38475
ARVRSGLMVYTQPLGY

SEQ ID NO: 76951 - protein, 8 aa, Homo sapiens
  light chain complementarity determining region 3 for antibody 38476
QQIHSART

SEQ ID NO: 76952 - protein, 19 aa, Homo sapiens
  heavy chain complementarity determining region 3 for antibody 38476
AREGARGGGTTTPHWYFDL

SEQ ID NO: 76953 - protein, 8 aa, Homo sapiens
  light chain complementarity determining region 3 for antibody 38477
QQHVSSVS

SEQ ID NO: 76954 - protein, 13 aa, Homo sapiens
  heavy chain complementarity determining region 3 for antibody 38477
VRPWFGELSHFDY

SEQ ID NO: 76955 - protein, 8 aa, Homo sapiens
  light chain complementarity determining region 3 for antibody 38478
QQHVSSSS

SEQ ID NO: 76956 - protein, 13 aa, Homo sapiens
  heavy chain complementarity determining region 3 for antibody 38478
VRTWFGELSHFDY

SEQ ID NO: 76957 - protein, 8 aa, Homo sapiens
  light chain complementarity determining region 3 for antibody 38479
QQHVSSFS

SEQ ID NO: 76958 - protein, 13 aa, Homo sapiens
  heavy chain complementarity determining region 3 for antibody 38479
VRTWFGELSHFDY

SEQ ID NO: 76959 - protein, 9 aa, Homo sapiens
  light chain complementarity determining region 3 for antibody 38480
QQHSSLPLT

SEQ ID NO: 76960 - protein, 15 aa, Homo sapiens
  heavy chain complementarity determining region 3 for antibody 38480
ATGRIVAAKNVHFDY

SEQ ID NO: 76961 - protein, 9 aa, Homo sapiens
  light chain complementarity determining region 3 for antibody 38481
QQHSNWPRT

SEQ ID NO: 76962 - protein, 14 aa, Homo sapiens
  heavy chain complementarity determining region 3 for antibody 38481
AKHRYDSSGYYFDY

SEQ ID NO: 76963 - protein, 9 aa, Homo sapiens
  light chain complementarity determining region 3 for antibody 38482
QQHSNWPLP

SEQ ID NO: 76964 - protein, 14 aa, Homo sapiens
  heavy chain complementarity determining region 3 for antibody 38482
AKHRYDSSGYYFDY

SEQ ID NO: 76965 - protein, 9 aa, Homo sapiens
  light chain complementarity determining region 3 for antibody 38483
QQHSNWLWT

SEQ ID NO: 76966 - protein, 20 aa, Homo sapiens
  heavy chain complementarity determining region 3 for antibody 38483
VYRRGYEYVGASYRYTMSDY

SEQ ID NO: 76967 - protein, 9 aa, Homo sapiens
  light chain complementarity determining region 3 for antibody 38484
QQHNYYPWT

SEQ ID NO: 76968 - protein, 10 aa, Homo sapiens
  heavy chain complementarity determining region 3 for antibody 38484
ARDYEAALDY

SEQ ID NO: 76969 - protein, 8 aa, Homo sapiens
  light chain complementarity determining region 3 for antibody 38485
QQHNVLWT

SEQ ID NO: 76970 - protein, 10 aa, Homo sapiens
  heavy chain complementarity determining region 3 for antibody 38485
ARDRRSLLDY

SEQ ID NO: 76971 - protein, 8 aa, Homo sapiens
  light chain complementarity determining region 3 for antibody 38486
QQHNVFWT

SEQ ID NO: 76972 - protein, 10 aa, Homo sapiens
  heavy chain complementarity determining region 3 for antibody 38486
ATDRRSVLSY

SEQ ID NO: 76973 - protein, 8 aa, Homo sapiens
  light chain complementarity determining region 3 for antibody 38487
QQHNTYWT

SEQ ID NO: 76974 - protein, 14 aa, Homo sapiens
  heavy chain complementarity determining region 3 for antibody 38487
ARGGSSGYYHHFDS

SEQ ID NO: 76975 - protein, 8 aa, Homo sapiens
  light chain complementarity determining region 3 for antibody 38488
QQHNSYST

SEQ ID NO: 76976 - protein, 10 aa, Homo sapiens
  heavy chain complementarity determining region 3 for antibody 38488
ARDVVGSDDQ

SEQ ID NO: 76977 - protein, 9 aa, Homo sapiens
  light chain complementarity determining region 3 for antibody 38489
QQHNSYRRT

SEQ ID NO: 76978 - protein, 9 aa, Homo sapiens
  heavy chain complementarity determining region 3 for antibody 38489
AKGSSALDY

SEQ ID NO: 76979 - protein, 9 aa, Homo sapiens
  light chain complementarity determining region 3 for antibody 38490
QQHNSYPIT

SEQ ID NO: 76980 - protein, 11 aa, Homo sapiens
  heavy chain complementarity determining region 3 for antibody 38490
ARGGSRREIDY

SEQ ID NO: 76981 - protein, 10 aa, Homo sapiens
  light chain complementarity determining region 3 for antibody 38491
QQHNSYFTWT

SEQ ID NO: 76982 - protein, 16 aa, Homo sapiens
  heavy chain complementarity determining region 3 for antibody 38491
ARDHSTAAVDAWWFDP

SEQ ID NO: 76983 - protein, 9 aa, Homo sapiens
  light chain complementarity determining region 3 for antibody 38492
QQHNSYEYT

SEQ ID NO: 76984 - protein, 11 aa, Homo sapiens
  heavy chain complementarity determining region 3 for antibody 38492
ARDSGHGDYVS

SEQ ID NO: 76985 - protein, 8 aa, Homo sapiens
  light chain complementarity determining region 3 for antibody 38493
QQHNNWWT

SEQ ID NO: 76986 - protein, 10 aa, Homo sapiens
  heavy chain complementarity determining region 3 for antibody 38493
ARAGFGAFDI

SEQ ID NO: 76987 - protein, 10 aa, Homo sapiens
  light chain complementarity determining region 3 for antibody 38494
QQHNNWPRYT

SEQ ID NO: 76988 - protein, 14 aa, Homo sapiens
  heavy chain complementarity determining region 3 for antibody 38494
ARLGEGYSYGPSDY

SEQ ID NO: 76989 - protein, 10 aa, Homo sapiens
  light chain complementarity determining region 3 for antibody 38495
QQHNNWPPLT

SEQ ID NO: 76990 - protein, 15 aa, Homo sapiens
  heavy chain complementarity determining region 3 for antibody 38495
ARYYYDSSGYYVFDY

SEQ ID NO: 76991 - protein, 9 aa, Homo sapiens
  light chain complementarity determining region 3 for antibody 38496
QQHNNWPFT

SEQ ID NO: 76992 - protein, 13 aa, Homo sapiens
  heavy chain complementarity determining region 3 for antibody 38496
ARAGWEFFTWFDS

SEQ ID NO: 76993 - protein, 10 aa, Homo sapiens
  light chain complementarity determining region 3 for antibody 38497
QQHNKWPPLT

SEQ ID NO: 76994 - protein, 13 aa, Homo sapiens
  heavy chain complementarity determining region 3 for antibody 38497
GKDMYRVSSIINY

SEQ ID NO: 76995 - protein, 9 aa, Homo sapiens
  light chain complementarity determining region 3 for antibody 38498
QQHNFYPTT

SEQ ID NO: 76996 - protein, 11 aa, Homo sapiens
  heavy chain complementarity determining region 3 for antibody 38498
ARGGSRREIDY

SEQ ID NO: 76997 - protein, 9 aa, Homo sapiens
  light chain complementarity determining region 3 for antibody 38499
QQHNFYPIT

SEQ ID NO: 76998 - protein, 11 aa, Homo sapiens
  heavy chain complementarity determining region 3 for antibody 38499
ARGGRRREIDY

SEQ ID NO: 76999 - protein, 9 aa, Homo sapiens
  light chain complementarity determining region 3 for antibody 38500
QQHNDYPWT

SEQ ID NO: 77000 - protein, 10 aa, Homo sapiens
  heavy chain complementarity determining region 3 for antibody 38500
ARDDEAALDY

SEQ ID NO: 77001 - protein, 9 aa, Homo sapiens
  light chain complementarity determining region 3 for antibody 38501
QQHNDYPWK

SEQ ID NO: 77002 - protein, 10 aa, Homo sapiens
  heavy chain complementarity determining region 3 for antibody 38501
ARDYEAALDY

SEQ ID NO: 77003 - protein, 9 aa, Homo sapiens
  light chain complementarity determining region 3 for antibody 38502
QQHKKWPLT

SEQ ID NO: 77004 - protein, 17 aa, Homo sapiens
  heavy chain complementarity determining region 3 for antibody 38502
TRDMRFSDYTLGYGMDV

SEQ ID NO: 77005 - protein, 8 aa, Homo sapiens
  light chain complementarity determining region 3 for antibody 38503
QQHGTSWT

SEQ ID NO: 77006 - protein, 21 aa, Homo sapiens
  heavy chain complementarity determining region 3 for antibody 38503
GRQRNFEGDSGFKFPEGYFDL

SEQ ID NO: 77007 - protein, 11 aa, Homo sapiens
  light chain complementarity determining region 3 for antibody 38504
QQHGTSPPPWA

SEQ ID NO: 77008 - protein, 12 aa, Homo sapiens
  heavy chain complementarity determining region 3 for antibody 38504
VKEKGGVRVFDF

SEQ ID NO: 77009 - protein, 9 aa, Homo sapiens
  light chain complementarity determining region 3 for antibody 38505
QQHGSSPRT

SEQ ID NO: 77010 - protein, 16 aa, Homo sapiens
  heavy chain complementarity determining region 3 for antibody 38505
ARDRGSSGWHWGFFDS

SEQ ID NO: 77011 - protein, 9 aa, Homo sapiens
  light chain complementarity determining region 3 for antibody 38506
QQHGSSPGT

SEQ ID NO: 77012 - protein, 15 aa, Homo sapiens
  heavy chain complementarity determining region 3 for antibody 38506
ASGSFDTLTGSYSEV

SEQ ID NO: 77013 - protein, 9 aa, Homo sapiens
  light chain complementarity determining region 3 for antibody 38507
QQHGSLPLT

SEQ ID NO: 77014 - protein, 15 aa, Homo sapiens
  heavy chain complementarity determining region 3 for antibody 38507
AHRPNYYDKAGAFDI

SEQ ID NO: 77015 - protein, 10 aa, Homo sapiens
  light chain complementarity determining region 3 for antibody 38508
QQHGNSPPFT

SEQ ID NO: 77016 - protein, 13 aa, Homo sapiens
  heavy chain complementarity determining region 3 for antibody 38508
ASWSHSDLDAFDI

SEQ ID NO: 77017 - protein, 9 aa, Homo sapiens
  light chain complementarity determining region 3 for antibody 38509
QQHGNLPRT

SEQ ID NO: 77018 - protein, 13 aa, Homo sapiens
  heavy chain complementarity determining region 3 for antibody 38509
AGGQFHSSGYSEF

SEQ ID NO: 77019 - protein, 8 aa, Homo sapiens
  light chain complementarity determining region 3 for antibody 38510
QQHGGSPR

SEQ ID NO: 77020 - protein, 16 aa, Homo sapiens
  heavy chain complementarity determining region 3 for antibody 38510
ATDWGSGTQWIRAFDV

SEQ ID NO: 77021 - protein, 9 aa, Homo sapiens
  light chain complementarity determining region 3 for antibody 38511
QQHFSIPRT

SEQ ID NO: 77022 - protein, 10 aa, Homo sapiens
  heavy chain complementarity determining region 3 for antibody 38511
AKDKTGYFDS

SEQ ID NO: 77023 - protein, 9 aa, Homo sapiens
  light chain complementarity determining region 3 for antibody 38512
QQHFSHVYT

SEQ ID NO: 77024 - protein, 18 aa, Homo sapiens
  heavy chain complementarity determining region 3 for antibody 38512
AQERDGYCDSHACYGLDV

SEQ ID NO: 77025 - protein, 8 aa, Homo sapiens
  light chain complementarity determining region 3 for antibody 38513
QQHENLWT

SEQ ID NO: 77026 - protein, 25 aa, Homo sapiens
  heavy chain complementarity determining region 3 for antibody 38513
ARVRRGFHSDSSGYYHMEGDDSFDI

SEQ ID NO: 77027 - protein, 9 aa, Homo sapiens
  light chain complementarity determining region 3 for antibody 38514
QQHDSYSWT

SEQ ID NO: 77028 - protein, 12 aa, Homo sapiens
  heavy chain complementarity determining region 3 for antibody 38514
ARGRFGDLVYDY

SEQ ID NO: 77029 - protein, 8 aa, Homo sapiens
  light chain complementarity determining region 3 for antibody 38515
QQHDSYST

SEQ ID NO: 77030 - protein, 16 aa, Homo sapiens
  heavy chain complementarity determining region 3 for antibody 38515
AKDALALTSKPYYFDF

SEQ ID NO: 77031 - protein, 8 aa, Homo sapiens
  light chain complementarity determining region 3 for antibody 38516
QQHDSSVS

SEQ ID NO: 77032 - protein, 13 aa, Homo sapiens
  heavy chain complementarity determining region 3 for antibody 38516
VRTWFGELSHFDY

SEQ ID NO: 77033 - protein, 9 aa, Homo sapiens
  light chain complementarity determining region 3 for antibody 38517
QQHDSSSYT

SEQ ID NO: 77034 - protein, 11 aa, Homo sapiens
  heavy chain complementarity determining region 3 for antibody 38517
ARGGFYGSFDY

SEQ ID NO: 77035 - protein, 9 aa, Homo sapiens
  light chain complementarity determining region 3 for antibody 38518
QQHDNLPRT

SEQ ID NO: 77036 - protein, 20 aa, Homo sapiens
  heavy chain complementarity determining region 3 for antibody 38518
ARDQAYYYGSGSSGVDWLDP

SEQ ID NO: 77037 - protein, 9 aa, Homo sapiens
  light chain complementarity determining region 3 for antibody 38519
QQHDIWPLT

SEQ ID NO: 77038 - protein, 14 aa, Homo sapiens
  heavy chain complementarity determining region 3 for antibody 38519
AGISSMWGLRLLDY

SEQ ID NO: 77039 - protein, 9 aa, Homo sapiens
  light chain complementarity determining region 3 for antibody 38520
QQHDIWPLP

SEQ ID NO: 77040 - protein, 14 aa, Homo sapiens
  heavy chain complementarity determining region 3 for antibody 38520
AGISSMWELRLLDY

SEQ ID NO: 77041 - protein, 10 aa, Homo sapiens
  light chain complementarity determining region 3 for antibody 38521
QQHDDVPPIT

SEQ ID NO: 77042 - protein, 13 aa, Homo sapiens
  heavy chain complementarity determining region 3 for antibody 38521
AREGRLGGAPLDY

SEQ ID NO: 77043 - protein, 10 aa, Homo sapiens
  light chain complementarity determining region 3 for antibody 38522
QQHDDLLPIT

SEQ ID NO: 77044 - protein, 12 aa, Homo sapiens
  heavy chain complementarity determining region 3 for antibody 38522
ARDVTGTRLFDF

SEQ ID NO: 77045 - protein, 9 aa, Homo sapiens
  light chain complementarity determining region 3 for antibody 38523
QQHANPPYT

SEQ ID NO: 77046 - protein, 10 aa, Homo sapiens
  heavy chain complementarity determining region 3 for antibody 38523
ARVGKRWGDY

SEQ ID NO: 77047 - protein, 8 aa, Homo sapiens
  light chain complementarity determining region 3 for antibody 38524
QQGYSTPL

SEQ ID NO: 77048 - protein, 13 aa, Homo sapiens
  heavy chain complementarity determining region 3 for antibody 38524
SRDKELGFGVLDY

SEQ ID NO: 77049 - protein, 9 aa, Homo sapiens
  light chain complementarity determining region 3 for antibody 38525
QQGYSSPYT

SEQ ID NO: 77050 - protein, 14 aa, Homo sapiens
  heavy chain complementarity determining region 3 for antibody 38525
AREPQKGKPDYFDY

SEQ ID NO: 77051 - protein, 9 aa, Homo sapiens
  light chain complementarity determining region 3 for antibody 38526
QQGYSSPYT

SEQ ID NO: 77052 - protein, 14 aa, Homo sapiens
  heavy chain complementarity determining region 3 for antibody 38526
ARDPQKGKPDYSDY

SEQ ID NO: 77053 - protein, 9 aa, Homo sapiens
  light chain complementarity determining region 3 for antibody 38527
QQGYSSPYP

SEQ ID NO: 77054 - protein, 14 aa, Homo sapiens
  heavy chain complementarity determining region 3 for antibody 38527
ARDPQKGKPDYFDY

SEQ ID NO: 77055 - protein, 9 aa, Homo sapiens
  light chain complementarity determining region 3 for antibody 38528
QQGYSSPLI

SEQ ID NO: 77056 - protein, 15 aa, Homo sapiens
  heavy chain complementarity determining region 3 for antibody 38528
ARAQVIWGQLYFFDY

SEQ ID NO: 77057 - protein, 9 aa, Homo sapiens
  light chain complementarity determining region 3 for antibody 38529
QQGYSSPLI

SEQ ID NO: 77058 - protein, 15 aa, Homo sapiens
  heavy chain complementarity determining region 3 for antibody 38529
ARAQVIWGQLSYFDY

SEQ ID NO: 77059 - protein, 9 aa, Homo sapiens
  light chain complementarity determining region 3 for antibody 38530
QQGYSSPFI

SEQ ID NO: 77060 - protein, 15 aa, Homo sapiens
  heavy chain complementarity determining region 3 for antibody 38530
ARAQVIWGQLYYFDY

SEQ ID NO: 77061 - protein, 9 aa, Homo sapiens
  light chain complementarity determining region 3 for antibody 38531
QQGYSPPLT

SEQ ID NO: 77062 - protein, 15 aa, Homo sapiens
  heavy chain complementarity determining region 3 for antibody 38531
AKAQVIWGQLYYFES

SEQ ID NO: 77063 - protein, 9 aa, Homo sapiens
  light chain complementarity determining region 3 for antibody 38532
QQGYSPPFT

SEQ ID NO: 77064 - protein, 15 aa, Homo sapiens
  heavy chain complementarity determining region 3 for antibody 38532
AKAQVSWGQLYYFES

SEQ ID NO: 77065 - protein, 9 aa, Homo sapiens
  light chain complementarity determining region 3 for antibody 38533
QQGYSPPFL

SEQ ID NO: 77066 - protein, 15 aa, Homo sapiens
  heavy chain complementarity determining region 3 for antibody 38533
ARAQVIWGQLYYFDS

SEQ ID NO: 77067 - protein, 9 aa, Homo sapiens
  light chain complementarity determining region 3 for antibody 38534
QQGYSIPRT

SEQ ID NO: 77068 - protein, 12 aa, Homo sapiens
  heavy chain complementarity determining region 3 for antibody 38534
ARNGAGSYGMDV

SEQ ID NO: 77069 - protein, 9 aa, Homo sapiens
  light chain complementarity determining region 3 for antibody 38535
QQGYRTPRT

SEQ ID NO: 77070 - protein, 15 aa, Homo sapiens
  heavy chain complementarity determining region 3 for antibody 38535
ARDRGAAALFYGVDV

SEQ ID NO: 77071 - protein, 9 aa, Homo sapiens
  light chain complementarity determining region 3 for antibody 38536
QQGYRPPFI

SEQ ID NO: 77072 - protein, 15 aa, Homo sapiens
  heavy chain complementarity determining region 3 for antibody 38536
TRAQVIWGQLYYLDY

SEQ ID NO: 77073 - protein, 8 aa, Homo sapiens
  light chain complementarity determining region 3 for antibody 38537
QQGYNWVL

SEQ ID NO: 77074 - protein, 21 aa, Homo sapiens
  heavy chain complementarity determining region 3 for antibody 38537
ARNDPDNTQGGHTSGNKYLDQ

SEQ ID NO: 77075 - protein, 8 aa, Homo sapiens
  light chain complementarity determining region 3 for antibody 38538
QQGYNWVI

SEQ ID NO: 77076 - protein, 21 aa, Homo sapiens
  heavy chain complementarity determining region 3 for antibody 38538
ARNDPDNTQGGHTSGNKSLDQ

SEQ ID NO: 77077 - protein, 8 aa, Homo sapiens
  light chain complementarity determining region 3 for antibody 38539
QQGYNWVI

SEQ ID NO: 77078 - protein, 21 aa, Homo sapiens
  heavy chain complementarity determining region 3 for antibody 38539
ARNDPDNTQGGHTSGNKCLDQ

SEQ ID NO: 77079 - protein, 8 aa, Homo sapiens
  light chain complementarity determining region 3 for antibody 38540
QQGYNWVI

SEQ ID NO: 77080 - protein, 21 aa, Homo sapiens
  heavy chain complementarity determining region 3 for antibody 38540
ARNDPDNTQGGHTAGNKYLDQ

SEQ ID NO: 77081 - protein, 8 aa, Homo sapiens
  light chain complementarity determining region 3 for antibody 38541
QQGYNWVF

SEQ ID NO: 77082 - protein, 21 aa, Homo sapiens
  heavy chain complementarity determining region 3 for antibody 38541
ARNDPDNTQGGHTSGNKYLDQ

SEQ ID NO: 77083 - protein, 9 aa, Homo sapiens
  light chain complementarity determining region 3 for antibody 38542
QQGYNPPFI

SEQ ID NO: 77084 - protein, 15 aa, Homo sapiens
  heavy chain complementarity determining region 3 for antibody 38542
ARAQVIWGQLCYFDS

SEQ ID NO: 77085 - protein, 8 aa, Homo sapiens
  light chain complementarity determining region 3 for antibody 38543
QQGYHWVI

SEQ ID NO: 77086 - protein, 21 aa, Homo sapiens
  heavy chain complementarity determining region 3 for antibody 38543
ARNDPDNTQGGHTSGNKYLDH

SEQ ID NO: 77087 - protein, 9 aa, Homo sapiens
  light chain complementarity determining region 3 for antibody 38544
QQGYDTPRT

SEQ ID NO: 77088 - protein, 12 aa, Homo sapiens
  heavy chain complementarity determining region 3 for antibody 38544
ASGGSRVTTLSY

SEQ ID NO: 77089 - protein, 9 aa, Homo sapiens
  light chain complementarity determining region 3 for antibody 38545
QQGSNCPWT

SEQ ID NO: 77090 - protein, 9 aa, Homo sapiens
  heavy chain complementarity determining region 3 for antibody 38545
ARVLVTEGG

SEQ ID NO: 77091 - protein, 9 aa, Homo sapiens
  light chain complementarity determining region 3 for antibody 38546
QQGNSIPWT

SEQ ID NO: 77092 - protein, 16 aa, Homo sapiens
  heavy chain complementarity determining region 3 for antibody 38546
ARLLSGYSGYVPEGDY

SEQ ID NO: 77093 - protein, 10 aa, Homo sapiens
  light chain complementarity determining region 3 for antibody 38547
QQGNSHGGFT

SEQ ID NO: 77094 - protein, 19 aa, Homo sapiens
  heavy chain complementarity determining region 3 for antibody 38547
ARLTFDCSGGSCYHGAFDI

SEQ ID NO: 77095 - protein, 9 aa, Homo sapiens
  light chain complementarity determining region 3 for antibody 38548
QQGNSFPHT

SEQ ID NO: 77096 - protein, 14 aa, Homo sapiens
  heavy chain complementarity determining region 3 for antibody 38548
ARYCSGTRCYSMDY

SEQ ID NO: 77097 - protein, 9 aa, Homo sapiens
  light chain complementarity determining region 3 for antibody 38549
QQGNSFPFT

SEQ ID NO: 77098 - protein, 14 aa, Homo sapiens
  heavy chain complementarity determining region 3 for antibody 38549
ARVRYASGTYYPES

SEQ ID NO: 77099 - protein, 9 aa, Homo sapiens
  light chain complementarity determining region 3 for antibody 38550
QQGNRFPHT

SEQ ID NO: 77100 - protein, 14 aa, Homo sapiens
  heavy chain complementarity determining region 3 for antibody 38550
ARYCSGSSCYSMDY

SEQ ID NO: 77101 - protein, 9 aa, Homo sapiens
  light chain complementarity determining region 3 for antibody 38551
QQGNGFPIT

SEQ ID NO: 77102 - protein, 13 aa, Homo sapiens
  heavy chain complementarity determining region 3 for antibody 38551
ASVSYYGSNAFDI

SEQ ID NO: 77103 - protein, 9 aa, Homo sapiens
  light chain complementarity determining region 3 for antibody 38552
QQGISYPFT

SEQ ID NO: 77104 - protein, 12 aa, Homo sapiens
  heavy chain complementarity determining region 3 for antibody 38552
ARPLDGDHGFDP

SEQ ID NO: 77105 - protein, 9 aa, Homo sapiens
  light chain complementarity determining region 3 for antibody 38553
QQGHSIPWT

SEQ ID NO: 77106 - protein, 16 aa, Homo sapiens
  heavy chain complementarity determining region 3 for antibody 38553
ARLLSGYSGYVPDGDY

SEQ ID NO: 77107 - protein, 9 aa, Homo sapiens
  light chain complementarity determining region 3 for antibody 38554
QQGGTPPWT

SEQ ID NO: 77108 - protein, 13 aa, Homo sapiens
  heavy chain complementarity determining region 3 for antibody 38554
AREVYMKTPAFGL

SEQ ID NO: 77109 - protein, 9 aa, Homo sapiens
  light chain complementarity determining region 3 for antibody 38555
QQGGASPWT

SEQ ID NO: 77110 - protein, 15 aa, Homo sapiens
  heavy chain complementarity determining region 3 for antibody 38555
ASPPVGDVPNGVFDI

SEQ ID NO: 77111 - protein, 9 aa, Homo sapiens
  light chain complementarity determining region 3 for antibody 38556
QQGDSFPET

SEQ ID NO: 77112 - protein, 15 aa, Homo sapiens
  heavy chain complementarity determining region 3 for antibody 38556
ARDLGRQKSGAHMAY

SEQ ID NO: 77113 - protein, 9 aa, Homo sapiens
  light chain complementarity determining region 3 for antibody 38557
QQGDSFPEP

SEQ ID NO: 77114 - protein, 15 aa, Homo sapiens
  heavy chain complementarity determining region 3 for antibody 38557
ARDLGRQKSGAYMAY

SEQ ID NO: 77115 - protein, 9 aa, Homo sapiens
  light chain complementarity determining region 3 for antibody 38558
QQGATAPRT

SEQ ID NO: 77116 - protein, 14 aa, Homo sapiens
  heavy chain complementarity determining region 3 for antibody 38558
AKDPTGDGGGYFDY

SEQ ID NO: 77117 - protein, 9 aa, Homo sapiens
  light chain complementarity determining region 3 for antibody 38559
QQGATAPRP

SEQ ID NO: 77118 - protein, 14 aa, Homo sapiens
  heavy chain complementarity determining region 3 for antibody 38559
AKDPTGDGGGYFDY

SEQ ID NO: 77119 - protein, 9 aa, Homo sapiens
  light chain complementarity determining region 3 for antibody 38560
QQFYTYPLT

SEQ ID NO: 77120 - protein, 12 aa, Homo sapiens
  heavy chain complementarity determining region 3 for antibody 38560
TRVLSSAIGDWD

SEQ ID NO: 77121 - protein, 9 aa, Homo sapiens
  light chain complementarity determining region 3 for antibody 38561
QQFYTYPLT

SEQ ID NO: 77122 - protein, 12 aa, Homo sapiens
  heavy chain complementarity determining region 3 for antibody 38561
TRGLSSAIGEWD

SEQ ID NO: 77123 - protein, 9 aa, Homo sapiens
  light chain complementarity determining region 3 for antibody 38562
QQFYTTPRT

SEQ ID NO: 77124 - protein, 8 aa, Homo sapiens
  heavy chain complementarity determining region 3 for antibody 38562
ARDGAFDS

SEQ ID NO: 77125 - protein, 9 aa, Homo sapiens
  light chain complementarity determining region 3 for antibody 38563
QQFYTSPLT

SEQ ID NO: 77126 - protein, 12 aa, Homo sapiens
  heavy chain complementarity determining region 3 for antibody 38563
TRVLSSAIGEWD

SEQ ID NO: 77127 - protein, 9 aa, Homo sapiens
  light chain complementarity determining region 3 for antibody 38564
QQFYTSLRT

SEQ ID NO: 77128 - protein, 12 aa, Homo sapiens
  heavy chain complementarity determining region 3 for antibody 38564
VKDCGLGGSRDS

SEQ ID NO: 77129 - protein, 9 aa, Homo sapiens
  light chain complementarity determining region 3 for antibody 38565
QQFYSSPIT

SEQ ID NO: 77130 - protein, 21 aa, Homo sapiens
  heavy chain complementarity determining region 3 for antibody 38565
AKDAGLSIFRYFDGLFDAFHI

SEQ ID NO: 77131 - protein, 9 aa, Homo sapiens
  light chain complementarity determining region 3 for antibody 38566
QQFYSPPLT

SEQ ID NO: 77132 - protein, 14 aa, Homo sapiens
  heavy chain complementarity determining region 3 for antibody 38566
ARHKSEGEFMSCDY

SEQ ID NO: 77133 - protein, 9 aa, Homo sapiens
  light chain complementarity determining region 3 for antibody 38567
QQFYITPWT

SEQ ID NO: 77134 - protein, 15 aa, Homo sapiens
  heavy chain complementarity determining region 3 for antibody 38567
IGQSKVDANWNYPDF

SEQ ID NO: 77135 - protein, 9 aa, Homo sapiens
  light chain complementarity determining region 3 for antibody 38568
QQFYINPFT

SEQ ID NO: 77136 - protein, 14 aa, Homo sapiens
  heavy chain complementarity determining region 3 for antibody 38568
ARQEHSDIWHAVDH

SEQ ID NO: 77137 - protein, 9 aa, Homo sapiens
  light chain complementarity determining region 3 for antibody 38569
QQFYDLPYT

SEQ ID NO: 77138 - protein, 14 aa, Homo sapiens
  heavy chain complementarity determining region 3 for antibody 38569
VRGSADFWSGRMDY

SEQ ID NO: 77139 - protein, 9 aa, Homo sapiens
  light chain complementarity determining region 3 for antibody 38570
QQFTTYPFT

SEQ ID NO: 77140 - protein, 15 aa, Homo sapiens
  heavy chain complementarity determining region 3 for antibody 38570
ARGLMVRGINDGVDI

SEQ ID NO: 77141 - protein, 9 aa, Homo sapiens
  light chain complementarity determining region 3 for antibody 38571
QQFSNSLFT

SEQ ID NO: 77142 - protein, 16 aa, Homo sapiens
  heavy chain complementarity determining region 3 for antibody 38571
TRSMRGVRLGPRLFDY

SEQ ID NO: 77143 - protein, 9 aa, Homo sapiens
  light chain complementarity determining region 3 for antibody 38572
QQFSGDLYT

SEQ ID NO: 77144 - protein, 13 aa, Homo sapiens
  heavy chain complementarity determining region 3 for antibody 38572
VRDDYGTNGGLDY

SEQ ID NO: 77145 - protein, 9 aa, Homo sapiens
  light chain complementarity determining region 3 for antibody 38573
QQFRSYPLT

SEQ ID NO: 77146 - protein, 15 aa, Homo sapiens
  heavy chain complementarity determining region 3 for antibody 38573
ARTSYTFSGHWYFDL

SEQ ID NO: 77147 - protein, 9 aa, Homo sapiens
  light chain complementarity determining region 3 for antibody 38574
QQFNTYPFT

SEQ ID NO: 77148 - protein, 18 aa, Homo sapiens
  heavy chain complementarity determining region 3 for antibody 38574
ARGPYCSGEICYSQYFDS

SEQ ID NO: 77149 - protein, 10 aa, Homo sapiens
  light chain complementarity determining region 3 for antibody 38575
QQFNNYRALT

SEQ ID NO: 77150 - protein, 10 aa, Homo sapiens
  heavy chain complementarity determining region 3 for antibody 38575
ARAAARAFDI

SEQ ID NO: 77151 - protein, 10 aa, Homo sapiens
  light chain complementarity determining region 3 for antibody 38576
QQFNNYQALT

SEQ ID NO: 77152 - protein, 10 aa, Homo sapiens
  heavy chain complementarity determining region 3 for antibody 38576
ARATARAFDI

SEQ ID NO: 77153 - protein, 11 aa, Homo sapiens
  light chain complementarity determining region 3 for antibody 38577
QQFNNYPRELT

SEQ ID NO: 77154 - protein, 14 aa, Homo sapiens
  heavy chain complementarity determining region 3 for antibody 38577
ARDLFGGGPGAYDY

SEQ ID NO: 77155 - protein, 11 aa, Homo sapiens
  light chain complementarity determining region 3 for antibody 38578
QQFNNYPRELP

SEQ ID NO: 77156 - protein, 14 aa, Homo sapiens
  heavy chain complementarity determining region 3 for antibody 38578
ARDLFGGRPGAYDY

SEQ ID NO: 77157 - protein, 9 aa, Homo sapiens
  light chain complementarity determining region 3 for antibody 38579
QQFNIYPPT

SEQ ID NO: 77158 - protein, 15 aa, Homo sapiens
  heavy chain complementarity determining region 3 for antibody 38579
VRDYGIRVRQDYFDY

SEQ ID NO: 77159 - protein, 9 aa, Homo sapiens
  light chain complementarity determining region 3 for antibody 38580
QQFNIYPPT

SEQ ID NO: 77160 - protein, 15 aa, Homo sapiens
  heavy chain complementarity determining region 3 for antibody 38580
VRDSGMRVRQDYFDY

SEQ ID NO: 77161 - protein, 9 aa, Homo sapiens
  light chain complementarity determining region 3 for antibody 38581
QQFNIYPPT

SEQ ID NO: 77162 - protein, 15 aa, Homo sapiens
  heavy chain complementarity determining region 3 for antibody 38581
VRDSGIRVRQGYFDY

SEQ ID NO: 77163 - protein, 9 aa, Homo sapiens
  light chain complementarity determining region 3 for antibody 38582
QQFNIYPPT

SEQ ID NO: 77164 - protein, 15 aa, Homo sapiens
  heavy chain complementarity determining region 3 for antibody 38582
VRDSGIRFRQDYFDY

SEQ ID NO: 77165 - protein, 9 aa, Homo sapiens
  light chain complementarity determining region 3 for antibody 38583
QQFNDYPLT

SEQ ID NO: 77166 - protein, 10 aa, Homo sapiens
  heavy chain complementarity determining region 3 for antibody 38583
ARDPYGRGGY

SEQ ID NO: 77167 - protein, 9 aa, Homo sapiens
  light chain complementarity determining region 3 for antibody 38584
QQFKIYPFT

SEQ ID NO: 77168 - protein, 14 aa, Homo sapiens
  heavy chain complementarity determining region 3 for antibody 38584
AKAKDSSGYHSFDS

SEQ ID NO: 77169 - protein, 9 aa, Homo sapiens
  light chain complementarity determining region 3 for antibody 38585
QQFKDYPLP

SEQ ID NO: 77170 - protein, 10 aa, Homo sapiens
  heavy chain complementarity determining region 3 for antibody 38585
ARDPYGRGGY

SEQ ID NO: 77171 - protein, 9 aa, Homo sapiens
  light chain complementarity determining region 3 for antibody 38586
QQFISYPIT

SEQ ID NO: 77172 - protein, 13 aa, Homo sapiens
  heavy chain complementarity determining region 3 for antibody 38586
ARTKDGGFFAFDF

SEQ ID NO: 77173 - protein, 10 aa, Homo sapiens
  light chain complementarity determining region 3 for antibody 38587
QQFINYRALT

SEQ ID NO: 77174 - protein, 10 aa, Homo sapiens
  heavy chain complementarity determining region 3 for antibody 38587
ARATARAFDI

SEQ ID NO: 77175 - protein, 9 aa, Homo sapiens
  light chain complementarity determining region 3 for antibody 38588
QQFHGIPLT

SEQ ID NO: 77176 - protein, 10 aa, Homo sapiens
  heavy chain complementarity determining region 3 for antibody 38588
AGGTGWILDT

SEQ ID NO: 77177 - protein, 9 aa, Homo sapiens
  light chain complementarity determining region 3 for antibody 38589
QQFGSTTLT

SEQ ID NO: 77178 - protein, 15 aa, Homo sapiens
  heavy chain complementarity determining region 3 for antibody 38589
ARGPHPPYYGGFFHR

SEQ ID NO: 77179 - protein, 9 aa, Homo sapiens
  light chain complementarity determining region 3 for antibody 38590
QQFGSSPRT

SEQ ID NO: 77180 - protein, 16 aa, Homo sapiens
  heavy chain complementarity determining region 3 for antibody 38590
AKVRRRDYSGRDAFDI

SEQ ID NO: 77181 - protein, 10 aa, Homo sapiens
  light chain complementarity determining region 3 for antibody 38591
QQFGSSPRDS

SEQ ID NO: 77182 - protein, 20 aa, Homo sapiens
  heavy chain complementarity determining region 3 for antibody 38591
ARTTYYYDTSGYQGRGGFDY

SEQ ID NO: 77183 - protein, 9 aa, Homo sapiens
  light chain complementarity determining region 3 for antibody 38592
QQFGRSPRT

SEQ ID NO: 77184 - protein, 16 aa, Homo sapiens
  heavy chain complementarity determining region 3 for antibody 38592
AKLRRRDYSGRDAFDI

SEQ ID NO: 77185 - protein, 9 aa, Homo sapiens
  light chain complementarity determining region 3 for antibody 38593
QQFGNSPFT

SEQ ID NO: 77186 - protein, 15 aa, Homo sapiens
  heavy chain complementarity determining region 3 for antibody 38593
ARQKGQRASAGYFDS

SEQ ID NO: 77187 - protein, 11 aa, Homo sapiens
  light chain complementarity determining region 3 for antibody 38594
QQFGGSGQVYT

SEQ ID NO: 77188 - protein, 12 aa, Homo sapiens
  heavy chain complementarity determining region 3 for antibody 38594
AREAPNPFNFDY

SEQ ID NO: 77189 - protein, 11 aa, Homo sapiens
  light chain complementarity determining region 3 for antibody 38595
QQFGGSGQGYP

SEQ ID NO: 77190 - protein, 12 aa, Homo sapiens
  heavy chain complementarity determining region 3 for antibody 38595
AREAPNTFNFDY

SEQ ID NO: 77191 - protein, 9 aa, Homo sapiens
  light chain complementarity determining region 3 for antibody 38596
QQFGASPGT

SEQ ID NO: 77192 - protein, 24 aa, Homo sapiens
  heavy chain complementarity determining region 3 for antibody 38596
AGIPITLIRGVDVDVNYDYYGMAV

SEQ ID NO: 77193 - protein, 10 aa, Homo sapiens
  light chain complementarity determining region 3 for antibody 38597
QQFFMTPPST

SEQ ID NO: 77194 - protein, 14 aa, Homo sapiens
  heavy chain complementarity determining region 3 for antibody 38597
TTDGGLVHRPIFDH

SEQ ID NO: 77195 - protein, 10 aa, Homo sapiens
  light chain complementarity determining region 3 for antibody 38598
QQFFMNPPYT

SEQ ID NO: 77196 - protein, 14 aa, Homo sapiens
  heavy chain complementarity determining region 3 for antibody 38598
TTDGGLVHRPIFDH

SEQ ID NO: 77197 - protein, 10 aa, Homo sapiens
  light chain complementarity determining region 3 for antibody 38599
QQFDSSPLWT

SEQ ID NO: 77198 - protein, 16 aa, Homo sapiens
  heavy chain complementarity determining region 3 for antibody 38599
ARDSSIVVIPGGFLDL

SEQ ID NO: 77199 - protein, 9 aa, Homo sapiens
  light chain complementarity determining region 3 for antibody 38600
QQFDSFPLT

SEQ ID NO: 77200 - protein, 10 aa, Homo sapiens
  heavy chain complementarity determining region 3 for antibody 38600
ARVTFNGMDV

SEQ ID NO: 77201 - protein, 9 aa, Homo sapiens
  light chain complementarity determining region 3 for antibody 38601
QQFDRYPPT

SEQ ID NO: 77202 - protein, 19 aa, Homo sapiens
  heavy chain complementarity determining region 3 for antibody 38601
ARDSRRMVRGLIVYNWFDP

SEQ ID NO: 77203 - protein, 9 aa, Homo sapiens
  light chain complementarity determining region 3 for antibody 38602
QQFDRYPIT

SEQ ID NO: 77204 - protein, 19 aa, Homo sapiens
  heavy chain complementarity determining region 3 for antibody 38602
ARDSRRMVRGLIVYNWFDP

SEQ ID NO: 77205 - protein, 9 aa, Homo sapiens
  light chain complementarity determining region 3 for antibody 38603
QQFDNSPLT

SEQ ID NO: 77206 - protein, 20 aa, Homo sapiens
  heavy chain complementarity determining region 3 for antibody 38603
ARDLGRSGSIGIIRNDAFNV

SEQ ID NO: 77207 - protein, 9 aa, Homo sapiens
  light chain complementarity determining region 3 for antibody 38604
QQFDNLPVT

SEQ ID NO: 77208 - protein, 10 aa, Homo sapiens
  heavy chain complementarity determining region 3 for antibody 38604
ASGGGHTYGY

SEQ ID NO: 77209 - protein, 9 aa, Homo sapiens
  light chain complementarity determining region 3 for antibody 38605
QQFDKLPIT

SEQ ID NO: 77210 - protein, 9 aa, Homo sapiens
  heavy chain complementarity determining region 3 for antibody 38605
ARSTHPRGP

SEQ ID NO: 77211 - protein, 9 aa, Homo sapiens
  light chain complementarity determining region 3 for antibody 38606
QQFDGYPLT

SEQ ID NO: 77212 - protein, 19 aa, Homo sapiens
  heavy chain complementarity determining region 3 for antibody 38606
ARDSRRMVRGLIVYNWFDP

SEQ ID NO: 77213 - protein, 9 aa, Homo sapiens
  light chain complementarity determining region 3 for antibody 38607
QQFDELPIT

SEQ ID NO: 77214 - protein, 9 aa, Homo sapiens
  heavy chain complementarity determining region 3 for antibody 38607
ARSTHPLGP

SEQ ID NO: 77215 - protein, 9 aa, Homo sapiens
  light chain complementarity determining region 3 for antibody 38608
QQFDELPIP

SEQ ID NO: 77216 - protein, 9 aa, Homo sapiens
  heavy chain complementarity determining region 3 for antibody 38608
ARSTHPRGP

SEQ ID NO: 77217 - protein, 10 aa, Homo sapiens
  light chain complementarity determining region 3 for antibody 38609
QQFASSPRWT

SEQ ID NO: 77218 - protein, 16 aa, Homo sapiens
  heavy chain complementarity determining region 3 for antibody 38609
ARDSSIVVIPGGFLDL

SEQ ID NO: 77219 - protein, 11 aa, Homo sapiens
  light chain complementarity determining region 3 for antibody 38610
QQFAGSPPGGA

SEQ ID NO: 77220 - protein, 15 aa, Homo sapiens
  heavy chain complementarity determining region 3 for antibody 38610
AKTQTPYGDYGSVDY

SEQ ID NO: 77221 - protein, 9 aa, Homo sapiens
  light chain complementarity determining region 3 for antibody 38611
QQFADSGYT

SEQ ID NO: 77222 - protein, 13 aa, Homo sapiens
  heavy chain complementarity determining region 3 for antibody 38611
VRERHPGAFYFDF

SEQ ID NO: 77223 - protein, 8 aa, Homo sapiens
  light chain complementarity determining region 3 for antibody 38612
QQDYTHNT

SEQ ID NO: 77224 - protein, 22 aa, Homo sapiens
  heavy chain complementarity determining region 3 for antibody 38612
AREDGWVAAAGGPRPDYWYFDL

SEQ ID NO: 77225 - protein, 9 aa, Homo sapiens
  light chain complementarity determining region 3 for antibody 38613
QQDYSPLIT

SEQ ID NO: 77226 - protein, 18 aa, Homo sapiens
  heavy chain complementarity determining region 3 for antibody 38613
ARSTAGYCSGSTCYVFDS

SEQ ID NO: 77227 - protein, 9 aa, Homo sapiens
  light chain complementarity determining region 3 for antibody 38614
QQDWDSPGT

SEQ ID NO: 77228 - protein, 22 aa, Homo sapiens
  heavy chain complementarity determining region 3 for antibody 38614
ARPKTQGGYFDGSGYERGAFDI

SEQ ID NO: 77229 - protein, 11 aa, Homo sapiens
  light chain complementarity determining region 3 for antibody 38615
QQDVSSPPGFP

SEQ ID NO: 77230 - protein, 18 aa, Homo sapiens
  heavy chain complementarity determining region 3 for antibody 38615
AKVSRGLNHGSGSYYFDF

SEQ ID NO: 77231 - protein, 9 aa, Homo sapiens
  light chain complementarity determining region 3 for antibody 38616
QQDVSSPDT

SEQ ID NO: 77232 - protein, 14 aa, Homo sapiens
  heavy chain complementarity determining region 3 for antibody 38616
ARGGNYGSGSYLHY

SEQ ID NO: 77233 - protein, 9 aa, Homo sapiens
  light chain complementarity determining region 3 for antibody 38617
QQDTSSPLT

SEQ ID NO: 77234 - protein, 11 aa, Homo sapiens
  heavy chain complementarity determining region 3 for antibody 38617
VREEFGWEMTY

SEQ ID NO: 77235 - protein, 9 aa, Homo sapiens
  light chain complementarity determining region 3 for antibody 38618
QQDSSSPPS

SEQ ID NO: 77236 - protein, 19 aa, Homo sapiens
  heavy chain complementarity determining region 3 for antibody 38618
ARAGGNYYDRTSYYGPFDY

SEQ ID NO: 77237 - protein, 9 aa, Homo sapiens
  light chain complementarity determining region 3 for antibody 38619
QQDSGSPRT

SEQ ID NO: 77238 - protein, 14 aa, Homo sapiens
  heavy chain complementarity determining region 3 for antibody 38619
ATGWYDSSGHYLEY

SEQ ID NO: 77239 - protein, 9 aa, Homo sapiens
  light chain complementarity determining region 3 for antibody 38620
QQDSATPYS

SEQ ID NO: 77240 - protein, 13 aa, Homo sapiens
  heavy chain complementarity determining region 3 for antibody 38620
AKSIADTGFYYDY

SEQ ID NO: 77241 - protein, 9 aa, Homo sapiens
  light chain complementarity determining region 3 for antibody 38621
QQDRTYSRT

SEQ ID NO: 77242 - protein, 14 aa, Homo sapiens
  heavy chain complementarity determining region 3 for antibody 38621
ARDRESSWYPHLDS

SEQ ID NO: 77243 - protein, 8 aa, Homo sapiens
  light chain complementarity determining region 3 for antibody 38622
QQDRSSFP

SEQ ID NO: 77244 - protein, 13 aa, Homo sapiens
  heavy chain complementarity determining region 3 for antibody 38622
ATESGWYQGAFDI

SEQ ID NO: 77245 - protein, 9 aa, Homo sapiens
  light chain complementarity determining region 3 for antibody 38623
QQDQSWPYT

SEQ ID NO: 77246 - protein, 11 aa, Homo sapiens
  heavy chain complementarity determining region 3 for antibody 38623
GGFYHGGPCGY

SEQ ID NO: 77247 - protein, 8 aa, Homo sapiens
  light chain complementarity determining region 3 for antibody 38624
QQDNSYPT

SEQ ID NO: 77248 - protein, 18 aa, Homo sapiens
  heavy chain complementarity determining region 3 for antibody 38624
ARTYSDLLTGYIGPYFDS

SEQ ID NO: 77249 - protein, 9 aa, Homo sapiens
  light chain complementarity determining region 3 for antibody 38625
QQDNRWPAT

SEQ ID NO: 77250 - protein, 20 aa, Homo sapiens
  heavy chain complementarity determining region 3 for antibody 38625
ARDPREYYDLRNYYVYYFDS

SEQ ID NO: 77251 - protein, 8 aa, Homo sapiens
  light chain complementarity determining region 3 for antibody 38626
QQDNNWWT

SEQ ID NO: 77252 - protein, 10 aa, Homo sapiens
  heavy chain complementarity determining region 3 for antibody 38626
ARAGFGAFDI

SEQ ID NO: 77253 - protein, 10 aa, Homo sapiens
  light chain complementarity determining region 3 for antibody 38627
QQDNNWPRYT

SEQ ID NO: 77254 - protein, 14 aa, Homo sapiens
  heavy chain complementarity determining region 3 for antibody 38627
ARLGEGYSYGPSDY

SEQ ID NO: 77255 - protein, 9 aa, Homo sapiens
  light chain complementarity determining region 3 for antibody 38628
QQDNNWPLT

SEQ ID NO: 77256 - protein, 13 aa, Homo sapiens
  heavy chain complementarity determining region 3 for antibody 38628
ARDSTAVSGTFDS

SEQ ID NO: 77257 - protein, 9 aa, Homo sapiens
  light chain complementarity determining region 3 for antibody 38629
QQDNNWLIT

SEQ ID NO: 77258 - protein, 10 aa, Homo sapiens
  heavy chain complementarity determining region 3 for antibody 38629
TRGSSGRFDY

SEQ ID NO: 77259 - protein, 10 aa, Homo sapiens
  light chain complementarity determining region 3 for antibody 38630
QQDNNWLGWT

SEQ ID NO: 77260 - protein, 13 aa, Homo sapiens
  heavy chain complementarity determining region 3 for antibody 38630
ARHGRRSGWYYTY

SEQ ID NO: 77261 - protein, 9 aa, Homo sapiens
  light chain complementarity determining region 3 for antibody 38631
QQDNGYSRT

SEQ ID NO: 77262 - protein, 18 aa, Homo sapiens
  heavy chain complementarity determining region 3 for antibody 38631
ARDFGGRAYTKVENAFDI

SEQ ID NO: 77263 - protein, 9 aa, Homo sapiens
  light chain complementarity determining region 3 for antibody 38632
QQDKKWPLT

SEQ ID NO: 77264 - protein, 17 aa, Homo sapiens
  heavy chain complementarity determining region 3 for antibody 38632
TRDMRFSDYTLGYGMDV

SEQ ID NO: 77265 - protein, 9 aa, Homo sapiens
  light chain complementarity determining region 3 for antibody 38633
QQDHSDPLT

SEQ ID NO: 77266 - protein, 10 aa, Homo sapiens
  heavy chain complementarity determining region 3 for antibody 38633
AGGTGWILDT

SEQ ID NO: 77267 - protein, 10 aa, Homo sapiens
  light chain complementarity determining region 3 for antibody 38634
QQDHNRPPDT

SEQ ID NO: 77268 - protein, 14 aa, Homo sapiens
  heavy chain complementarity determining region 3 for antibody 38634
ARDPPGIALAGNSG

SEQ ID NO: 77269 - protein, 9 aa, Homo sapiens
  light chain complementarity determining region 3 for antibody 38635
QQDGTWPPT

SEQ ID NO: 77270 - protein, 21 aa, Homo sapiens
  heavy chain complementarity determining region 3 for antibody 38635
ARGGGPFYFDHSGFRLYYFHI

SEQ ID NO: 77271 - protein, 8 aa, Homo sapiens
  light chain complementarity determining region 3 for antibody 38636
QQDGTSYT

SEQ ID NO: 77272 - protein, 17 aa, Homo sapiens
  heavy chain complementarity determining region 3 for antibody 38636
ARHPGYYDSSGSDAFDI

SEQ ID NO: 77273 - protein, 9 aa, Homo sapiens
  light chain complementarity determining region 3 for antibody 38637
QQDGTSYRT

SEQ ID NO: 77274 - protein, 12 aa, Homo sapiens
  heavy chain complementarity determining region 3 for antibody 38637
ARDSGSGWYFKY

SEQ ID NO: 77275 - protein, 10 aa, Homo sapiens
  light chain complementarity determining region 3 for antibody 38638
QQDGTSPPWT

SEQ ID NO: 77276 - protein, 12 aa, Homo sapiens
  heavy chain complementarity determining region 3 for antibody 38638
ARGGSSGYQFDY

SEQ ID NO: 77277 - protein, 9 aa, Homo sapiens
  light chain complementarity determining region 3 for antibody 38639
QQDGTSPLT

SEQ ID NO: 77278 - protein, 14 aa, Homo sapiens
  heavy chain complementarity determining region 3 for antibody 38639
ARGGPAATSSSWLY

SEQ ID NO: 77279 - protein, 9 aa, Homo sapiens
  light chain complementarity determining region 3 for antibody 38640
QQDGTSPLT

SEQ ID NO: 77280 - protein, 14 aa, Homo sapiens
  heavy chain complementarity determining region 3 for antibody 38640
AHRSYNSGRGAFDI

SEQ ID NO: 77281 - protein, 9 aa, Homo sapiens
  light chain complementarity determining region 3 for antibody 38641
QQDGTSPFP

SEQ ID NO: 77282 - protein, 14 aa, Homo sapiens
  heavy chain complementarity determining region 3 for antibody 38641
ARGGPAATSSSWLY

SEQ ID NO: 77283 - protein, 8 aa, Homo sapiens
  light chain complementarity determining region 3 for antibody 38642
QQDGSSYT

SEQ ID NO: 77284 - protein, 20 aa, Homo sapiens
  heavy chain complementarity determining region 3 for antibody 38642
ARDLRVRGVIGPSIRGSFDI

SEQ ID NO: 77285 - protein, 9 aa, Homo sapiens
  light chain complementarity determining region 3 for antibody 38643
QQDGSSWVT

SEQ ID NO: 77286 - protein, 20 aa, Homo sapiens
  heavy chain complementarity determining region 3 for antibody 38643
AREGGHRQWLEIYDPGYFHH

SEQ ID NO: 77287 - protein, 9 aa, Homo sapiens
  light chain complementarity determining region 3 for antibody 38644
QQDGSSPYT

SEQ ID NO: 77288 - protein, 21 aa, Homo sapiens
  heavy chain complementarity determining region 3 for antibody 38644
ARQGSRYHCSGGSCYLGLTDY

SEQ ID NO: 77289 - protein, 9 aa, Homo sapiens
  light chain complementarity determining region 3 for antibody 38645
QQDGSSPWT

SEQ ID NO: 77290 - protein, 15 aa, Homo sapiens
  heavy chain complementarity determining region 3 for antibody 38645
ARRTSSWYADWYFDL

SEQ ID NO: 77291 - protein, 9 aa, Homo sapiens
  light chain complementarity determining region 3 for antibody 38646
QQDGSSPVT

SEQ ID NO: 77292 - protein, 26 aa, Homo sapiens
  heavy chain complementarity determining region 3 for antibody 38646
AREPHTYYYGSGSYSRRLYYYYGMDV

SEQ ID NO: 77293 - protein, 8 aa, Homo sapiens
  light chain complementarity determining region 3 for antibody 38647
QQDGSSPT

SEQ ID NO: 77294 - protein, 23 aa, Homo sapiens
  heavy chain complementarity determining region 3 for antibody 38647
ARPKRHYYDSSGYYSSALDAFDI

SEQ ID NO: 77295 - protein, 10 aa, Homo sapiens
  light chain complementarity determining region 3 for antibody 38648
QQDGSSPSLT

SEQ ID NO: 77296 - protein, 17 aa, Homo sapiens
  heavy chain complementarity determining region 3 for antibody 38648
ARVYYYGSGSYLSGPGY

SEQ ID NO: 77297 - protein, 8 aa, Homo sapiens
  light chain complementarity determining region 3 for antibody 38649
QQDGSSPS

SEQ ID NO: 77298 - protein, 14 aa, Homo sapiens
  heavy chain complementarity determining region 3 for antibody 38649
ARGGSSGYNHQFDY

SEQ ID NO: 77299 - protein, 10 aa, Homo sapiens
  light chain complementarity determining region 3 for antibody 38650
QQDGSSPRYT

SEQ ID NO: 77300 - protein, 17 aa, Homo sapiens
  heavy chain complementarity determining region 3 for antibody 38650
ARISVWTVYTGSYHFDY

SEQ ID NO: 77301 - protein, 9 aa, Homo sapiens
  light chain complementarity determining region 3 for antibody 38651
QQDGSSPRT

SEQ ID NO: 77302 - protein, 10 aa, Homo sapiens
  heavy chain complementarity determining region 3 for antibody 38651
TKDENGGFDP

SEQ ID NO: 77303 - protein, 9 aa, Homo sapiens
  light chain complementarity determining region 3 for antibody 38652
QQDGSSPRT

SEQ ID NO: 77304 - protein, 22 aa, Homo sapiens
  heavy chain complementarity determining region 3 for antibody 38652
ARVLGTCTNDICYSYHGDAFGT

SEQ ID NO: 77305 - protein, 9 aa, Homo sapiens
  light chain complementarity determining region 3 for antibody 38653
QQDGSSPRT

SEQ ID NO: 77306 - protein, 25 aa, Homo sapiens
  heavy chain complementarity determining region 3 for antibody 38653
ARLRIGRLRLPGAMRGPLYDCGLNV

SEQ ID NO: 77307 - protein, 9 aa, Homo sapiens
  light chain complementarity determining region 3 for antibody 38654
QQDGSSPRT

SEQ ID NO: 77308 - protein, 14 aa, Homo sapiens
  heavy chain complementarity determining region 3 for antibody 38654
ARGQGLLAGDVFDV

SEQ ID NO: 77309 - protein, 9 aa, Homo sapiens
  light chain complementarity determining region 3 for antibody 38655
QQDGSSPRT

SEQ ID NO: 77310 - protein, 16 aa, Homo sapiens
  heavy chain complementarity determining region 3 for antibody 38655
ARDRGSSGWHWGFLDS

SEQ ID NO: 77311 - protein, 9 aa, Homo sapiens
  light chain complementarity determining region 3 for antibody 38656
QQDGSSPRT

SEQ ID NO: 77312 - protein, 17 aa, Homo sapiens
  heavy chain complementarity determining region 3 for antibody 38656
ARALDIVVVVDAIWCDP

SEQ ID NO: 77313 - protein, 9 aa, Homo sapiens
  light chain complementarity determining region 3 for antibody 38657
QQDGSSPRT

SEQ ID NO: 77314 - protein, 13 aa, Homo sapiens
  heavy chain complementarity determining region 3 for antibody 38657
AGGQYLDWAPFAD

SEQ ID NO: 77315 - protein, 9 aa, Homo sapiens
  light chain complementarity determining region 3 for antibody 38658
QQDGSSPQT

SEQ ID NO: 77316 - protein, 14 aa, Homo sapiens
  heavy chain complementarity determining region 3 for antibody 38658
TRDPIPYSSWYFDL

SEQ ID NO: 77317 - protein, 10 aa, Homo sapiens
  light chain complementarity determining region 3 for antibody 38659
QQDGSSPPVT

SEQ ID NO: 77318 - protein, 17 aa, Homo sapiens
  heavy chain complementarity determining region 3 for antibody 38659
ARDPLRSGWFYNDAFDI

SEQ ID NO: 77319 - protein, 10 aa, Homo sapiens
  light chain complementarity determining region 3 for antibody 38660
QQDGSSPLYT

SEQ ID NO: 77320 - protein, 18 aa, Homo sapiens
  heavy chain complementarity determining region 3 for antibody 38660
ARVLGGQYYYDSSGWVDY

SEQ ID NO: 77321 - protein, 10 aa, Homo sapiens
  light chain complementarity determining region 3 for antibody 38661
QQDGSSPLYS

SEQ ID NO: 77322 - protein, 11 aa, Homo sapiens
  heavy chain complementarity determining region 3 for antibody 38661
ARGGQWGSLDY

SEQ ID NO: 77323 - protein, 9 aa, Homo sapiens
  light chain complementarity determining region 3 for antibody 38662
QQDGSSPLT

SEQ ID NO: 77324 - protein, 12 aa, Homo sapiens
  heavy chain complementarity determining region 3 for antibody 38662
ARGRAYNPDMDV

SEQ ID NO: 77325 - protein, 9 aa, Homo sapiens
  light chain complementarity determining region 3 for antibody 38663
QQDGSSPLT

SEQ ID NO: 77326 - protein, 14 aa, Homo sapiens
  heavy chain complementarity determining region 3 for antibody 38663
ARGLRGLKNWYFDL

SEQ ID NO: 77327 - protein, 9 aa, Homo sapiens
  light chain complementarity determining region 3 for antibody 38664
QQDGSSPGT

SEQ ID NO: 77328 - protein, 10 aa, Homo sapiens
  heavy chain complementarity determining region 3 for antibody 38664
GGGGGWYSPN

SEQ ID NO: 77329 - protein, 9 aa, Homo sapiens
  light chain complementarity determining region 3 for antibody 38665
QQDGSSPFT

SEQ ID NO: 77330 - protein, 19 aa, Homo sapiens
  heavy chain complementarity determining region 3 for antibody 38665
ARSPSWFGEHRGRGNWFDP

SEQ ID NO: 77331 - protein, 9 aa, Homo sapiens
  light chain complementarity determining region 3 for antibody 38666
QQDGSSPCT

SEQ ID NO: 77332 - protein, 18 aa, Homo sapiens
  heavy chain complementarity determining region 3 for antibody 38666
ARSPLFNGRNPRYWHFDL

SEQ ID NO: 77333 - protein, 9 aa, Homo sapiens
  light chain complementarity determining region 3 for antibody 38667
QQDGSSLYT

SEQ ID NO: 77334 - protein, 16 aa, Homo sapiens
  heavy chain complementarity determining region 3 for antibody 38667
ARAKHYGDYYYYGMDA

SEQ ID NO: 77335 - protein, 9 aa, Homo sapiens
  light chain complementarity determining region 3 for antibody 38668
QQDGSSLIT

SEQ ID NO: 77336 - protein, 13 aa, Homo sapiens
  heavy chain complementarity determining region 3 for antibody 38668
ARGSGSHQDEFDY

SEQ ID NO: 77337 - protein, 10 aa, Homo sapiens
  light chain complementarity determining region 3 for antibody 38669
QQDGSPSMYT

SEQ ID NO: 77338 - protein, 19 aa, Homo sapiens
  heavy chain complementarity determining region 3 for antibody 38669
AKDQLMFYYDNSGYPGADY

SEQ ID NO: 77339 - protein, 8 aa, Homo sapiens
  light chain complementarity determining region 3 for antibody 38670
QQDGSLYT

SEQ ID NO: 77340 - protein, 18 aa, Homo sapiens
  heavy chain complementarity determining region 3 for antibody 38670
AKEETPIWVGELLSPFDY

SEQ ID NO: 77341 - protein, 9 aa, Homo sapiens
  light chain complementarity determining region 3 for antibody 38671
QQDGSLPRT

SEQ ID NO: 77342 - protein, 13 aa, Homo sapiens
  heavy chain complementarity determining region 3 for antibody 38671
AGGQFDNTGYREY

SEQ ID NO: 77343 - protein, 9 aa, Homo sapiens
  light chain complementarity determining region 3 for antibody 38672
QQDGSIPRT

SEQ ID NO: 77344 - protein, 13 aa, Homo sapiens
  heavy chain complementarity determining region 3 for antibody 38672
AGGIFDSSGYGEY

SEQ ID NO: 77345 - protein, 9 aa, Homo sapiens
  light chain complementarity determining region 3 for antibody 38673
QQDGSFPPT

SEQ ID NO: 77346 - protein, 17 aa, Homo sapiens
  heavy chain complementarity determining region 3 for antibody 38673
ARGLMERWLVPLYYFDL

SEQ ID NO: 77347 - protein, 9 aa, Homo sapiens
  light chain complementarity determining region 3 for antibody 38674
QQDGRSSLT

SEQ ID NO: 77348 - protein, 19 aa, Homo sapiens
  heavy chain complementarity determining region 3 for antibody 38674
ARDRIVVGATFYSYSGMDV

SEQ ID NO: 77349 - protein, 9 aa, Homo sapiens
  light chain complementarity determining region 3 for antibody 38675
QQDGRSPWT

SEQ ID NO: 77350 - protein, 19 aa, Homo sapiens
  heavy chain complementarity determining region 3 for antibody 38675
VRERYYYDSRGKRNGGMDV

SEQ ID NO: 77351 - protein, 9 aa, Homo sapiens
  light chain complementarity determining region 3 for antibody 38676
QQDGRSPLT

SEQ ID NO: 77352 - protein, 12 aa, Homo sapiens
  heavy chain complementarity determining region 3 for antibody 38676
ARAQLWSNDIDY

SEQ ID NO: 77353 - protein, 8 aa, Homo sapiens
  light chain complementarity determining region 3 for antibody 38677
QQDGRSLT

SEQ ID NO: 77354 - protein, 17 aa, Homo sapiens
  heavy chain complementarity determining region 3 for antibody 38677
ARGYDSSGYYYENAFDI

SEQ ID NO: 77355 - protein, 9 aa, Homo sapiens
  light chain complementarity determining region 3 for antibody 38678
QQDGNSPRT

SEQ ID NO: 77356 - protein, 13 aa, Homo sapiens
  heavy chain complementarity determining region 3 for antibody 38678
ARTGRVAGVEGAH

SEQ ID NO: 77357 - protein, 9 aa, Homo sapiens
  light chain complementarity determining region 3 for antibody 38679
QQDGNSPRT

SEQ ID NO: 77358 - protein, 15 aa, Homo sapiens
  heavy chain complementarity determining region 3 for antibody 38679
ARGVGTTGIFGYLDN

SEQ ID NO: 77359 - protein, 9 aa, Homo sapiens
  light chain complementarity determining region 3 for antibody 38680
QQDGNSPRT

SEQ ID NO: 77360 - protein, 15 aa, Homo sapiens
  heavy chain complementarity determining region 3 for antibody 38680
AGGWFNYYSSGYYEP

SEQ ID NO: 77361 - protein, 9 aa, Homo sapiens
  light chain complementarity determining region 3 for antibody 38681
QQDGNSPLT

SEQ ID NO: 77362 - protein, 14 aa, Homo sapiens
  heavy chain complementarity determining region 3 for antibody 38681
AHRSYNSGRGAFDI

SEQ ID NO: 77363 - protein, 9 aa, Homo sapiens
  light chain complementarity determining region 3 for antibody 38682
QQDGNSPFT

SEQ ID NO: 77364 - protein, 25 aa, Homo sapiens
  heavy chain complementarity determining region 3 for antibody 38682
ARDSYLGYYDDDGYYFPFNYFGMDV

SEQ ID NO: 77365 - protein, 9 aa, Homo sapiens
  light chain complementarity determining region 3 for antibody 38683
QQDGNLPRT

SEQ ID NO: 77366 - protein, 13 aa, Homo sapiens
  heavy chain complementarity determining region 3 for antibody 38683
AGGNFHSGGYGDY

SEQ ID NO: 77367 - protein, 9 aa, Homo sapiens
  light chain complementarity determining region 3 for antibody 38684
QQDGNLPRT

SEQ ID NO: 77368 - protein, 13 aa, Homo sapiens
  heavy chain complementarity determining region 3 for antibody 38684
AGGDFHRGGYSEY

SEQ ID NO: 77369 - protein, 9 aa, Homo sapiens
  light chain complementarity determining region 3 for antibody 38685
QQDGHLPRT

SEQ ID NO: 77370 - protein, 13 aa, Homo sapiens
  heavy chain complementarity determining region 3 for antibody 38685
AGGDFHRGGYSEY

SEQ ID NO: 77371 - protein, 9 aa, Homo sapiens
  light chain complementarity determining region 3 for antibody 38686
QQDGGSSRT

SEQ ID NO: 77372 - protein, 11 aa, Homo sapiens
  heavy chain complementarity determining region 3 for antibody 38686
ARGRWAGAFDI

SEQ ID NO: 77373 - protein, 8 aa, Homo sapiens
  light chain complementarity determining region 3 for antibody 38687
QQDGGSPS

SEQ ID NO: 77374 - protein, 16 aa, Homo sapiens
  heavy chain complementarity determining region 3 for antibody 38687
AADWGSGTQWIRAFDV

SEQ ID NO: 77375 - protein, 8 aa, Homo sapiens
  light chain complementarity determining region 3 for antibody 38688
QQDGGSPG

SEQ ID NO: 77376 - protein, 16 aa, Homo sapiens
  heavy chain complementarity determining region 3 for antibody 38688
ATDWGSGTQWIRAFDV

SEQ ID NO: 77377 - protein, 10 aa, Homo sapiens
  light chain complementarity determining region 3 for antibody 38689
QQDGGSLPWT

SEQ ID NO: 77378 - protein, 16 aa, Homo sapiens
  heavy chain complementarity determining region 3 for antibody 38689
ARWIATPLVPRGPMDV

SEQ ID NO: 77379 - protein, 8 aa, Homo sapiens
  light chain complementarity determining region 3 for antibody 38690
QQDGCSPS

SEQ ID NO: 77380 - protein, 16 aa, Homo sapiens
  heavy chain complementarity determining region 3 for antibody 38690
ATDWGSGTQWIRAFDV

SEQ ID NO: 77381 - protein, 9 aa, Homo sapiens
  light chain complementarity determining region 3 for antibody 38691
QQDDTTPWT

SEQ ID NO: 77382 - protein, 20 aa, Homo sapiens
  heavy chain complementarity determining region 3 for antibody 38691
ATDKKGVYYDGSEYYWGFDY

SEQ ID NO: 77383 - protein, 9 aa, Homo sapiens
  light chain complementarity determining region 3 for antibody 38692
QQDDTSPWT

SEQ ID NO: 77384 - protein, 15 aa, Homo sapiens
  heavy chain complementarity determining region 3 for antibody 38692
VHTQLWFGDQCYFDF

SEQ ID NO: 77385 - protein, 9 aa, Homo sapiens
  light chain complementarity determining region 3 for antibody 38693
QQDDSSSYT

SEQ ID NO: 77386 - protein, 11 aa, Homo sapiens
  heavy chain complementarity determining region 3 for antibody 38693
ARGGFYGSFDY

SEQ ID NO: 77387 - protein, 9 aa, Homo sapiens
  light chain complementarity determining region 3 for antibody 38694
QQDDSSPRT

SEQ ID NO: 77388 - protein, 13 aa, Homo sapiens
  heavy chain complementarity determining region 3 for antibody 38694
AKSVLTVPRVYDY

SEQ ID NO: 77389 - protein, 9 aa, Homo sapiens
  light chain complementarity determining region 3 for antibody 38695
QQDDRYPIT

SEQ ID NO: 77390 - protein, 11 aa, Homo sapiens
  heavy chain complementarity determining region 3 for antibody 38695
ARVSELTAEDF

SEQ ID NO: 77391 - protein, 11 aa, Homo sapiens
  light chain complementarity determining region 3 for antibody 38696
QQDDRSPPGFT

SEQ ID NO: 77392 - protein, 14 aa, Homo sapiens
  heavy chain complementarity determining region 3 for antibody 38696
ARETHNSRKRSFDQ

SEQ ID NO: 77393 - protein, 9 aa, Homo sapiens
  light chain complementarity determining region 3 for antibody 38697
QQDDNLPVT

SEQ ID NO: 77394 - protein, 10 aa, Homo sapiens
  heavy chain complementarity determining region 3 for antibody 38697
ASGGGHTYGY

SEQ ID NO: 77395 - protein, 8 aa, Homo sapiens
  light chain complementarity determining region 3 for antibody 38698
QQDDDLRA

SEQ ID NO: 77396 - protein, 19 aa, Homo sapiens
  heavy chain complementarity determining region 3 for antibody 38698
ARDPSYYYDSSGSPRYFQH

SEQ ID NO: 77397 - protein, 9 aa, Homo sapiens
  light chain complementarity determining region 3 for antibody 38699
QQDANLPWT

SEQ ID NO: 77398 - protein, 11 aa, Homo sapiens
  heavy chain complementarity determining region 3 for antibody 38699
ATWAFRHGVDV

SEQ ID NO: 77399 - protein, 9 aa, Homo sapiens
  light chain complementarity determining region 3 for antibody 38700
QQCYSSLLT

SEQ ID NO: 77400 - protein, 16 aa, Homo sapiens
  heavy chain complementarity determining region 3 for antibody 38700
AREGGSTYTTKRAFDS

SEQ ID NO: 77401 - protein, 9 aa, Homo sapiens
  light chain complementarity determining region 3 for antibody 38701
QQCYSNPFT

SEQ ID NO: 77402 - protein, 14 aa, Homo sapiens
  heavy chain complementarity determining region 3 for antibody 38701
ARTVDWDGPKYFDS

SEQ ID NO: 77403 - protein, 9 aa, Homo sapiens
  light chain complementarity determining region 3 for antibody 38702
QQCVDSPWT

SEQ ID NO: 77404 - protein, 15 aa, Homo sapiens
  heavy chain complementarity determining region 3 for antibody 38702
ATPPVGDYPKGVLHI

SEQ ID NO: 77405 - protein, 9 aa, Homo sapiens
  light chain complementarity determining region 3 for antibody 38703
QQCVASPRT

SEQ ID NO: 77406 - protein, 15 aa, Homo sapiens
  heavy chain complementarity determining region 3 for antibody 38703
ASPPVGDVPNGVFDI

SEQ ID NO: 77407 - protein, 9 aa, Homo sapiens
  light chain complementarity determining region 3 for antibody 38704
QQCTSYSLT

SEQ ID NO: 77408 - protein, 15 aa, Homo sapiens
  heavy chain complementarity determining region 3 for antibody 38704
TGKHITTSGVVKADY

SEQ ID NO: 77409 - protein, 9 aa, Homo sapiens
  light chain complementarity determining region 3 for antibody 38705
QQCSNSPLT

SEQ ID NO: 77410 - protein, 10 aa, Homo sapiens
  heavy chain complementarity determining region 3 for antibody 38705
ASGSGWLTDS

SEQ ID NO: 77411 - protein, 8 aa, Homo sapiens
  light chain complementarity determining region 3 for antibody 38706
QQCNSYSS

SEQ ID NO: 77412 - protein, 18 aa, Homo sapiens
  heavy chain complementarity determining region 3 for antibody 38706
ARSWKVVVASGAVRYFDY

SEQ ID NO: 77413 - protein, 9 aa, Homo sapiens
  light chain complementarity determining region 3 for antibody 38707
QQCNSYSRT

SEQ ID NO: 77414 - protein, 18 aa, Homo sapiens
  heavy chain complementarity determining region 3 for antibody 38707
ARGGPYSRGWYAAEYFQH

SEQ ID NO: 77415 - protein, 9 aa, Homo sapiens
  light chain complementarity determining region 3 for antibody 38708
QQCNSYSFT

SEQ ID NO: 77416 - protein, 14 aa, Homo sapiens
  heavy chain complementarity determining region 3 for antibody 38708
ATEGPSRMGKFFDS

SEQ ID NO: 77417 - protein, 9 aa, Homo sapiens
  light chain complementarity determining region 3 for antibody 38709
QQCGTPPRT

SEQ ID NO: 77418 - protein, 13 aa, Homo sapiens
  heavy chain complementarity determining region 3 for antibody 38709
AREVYMKTPAFGL

SEQ ID NO: 77419 - protein, 9 aa, Homo sapiens
  light chain complementarity determining region 3 for antibody 38710
QQCGSSPRT

SEQ ID NO: 77420 - protein, 25 aa, Homo sapiens
  heavy chain complementarity determining region 3 for antibody 38710
ARLRIDRLRLPGAMRGPLYDCGLNV

SEQ ID NO: 77421 - protein, 9 aa, Homo sapiens
  light chain complementarity determining region 3 for antibody 38711
QQCGNSPFT

SEQ ID NO: 77422 - protein, 15 aa, Homo sapiens
  heavy chain complementarity determining region 3 for antibody 38711
ARQKGQRASAGYFDS

SEQ ID NO: 77423 - protein, 10 aa, Homo sapiens
  light chain complementarity determining region 3 for antibody 38712
QQCGGSPLFP

SEQ ID NO: 77424 - protein, 14 aa, Homo sapiens
  heavy chain complementarity determining region 3 for antibody 38712
VRPRHVAVNWYIDS

SEQ ID NO: 77425 - protein, 9 aa, Homo sapiens
  light chain complementarity determining region 3 for antibody 38713
QQCGASPWT

SEQ ID NO: 77426 - protein, 15 aa, Homo sapiens
  heavy chain complementarity determining region 3 for antibody 38713
ASPPVGDVPNGVFDI

SEQ ID NO: 77427 - protein, 9 aa, Homo sapiens
  light chain complementarity determining region 3 for antibody 38714
QQCFNLPYT

SEQ ID NO: 77428 - protein, 13 aa, Homo sapiens
  heavy chain complementarity determining region 3 for antibody 38714
ATTNSSDYYALAF

SEQ ID NO: 77429 - protein, 9 aa, Homo sapiens
  light chain complementarity determining region 3 for antibody 38715
QQCAVSPLT

SEQ ID NO: 77430 - protein, 10 aa, Homo sapiens
  heavy chain complementarity determining region 3 for antibody 38715
SSGSGWTSDD

SEQ ID NO: 77431 - protein, 9 aa, Homo sapiens
  light chain complementarity determining region 3 for antibody 38716
QQCAASPLT

SEQ ID NO: 77432 - protein, 10 aa, Homo sapiens
  heavy chain complementarity determining region 3 for antibody 38716
SSGSGWTSED

SEQ ID NO: 77433 - protein, 9 aa, Homo sapiens
  light chain complementarity determining region 3 for antibody 38717
QQAYSSPYP

SEQ ID NO: 77434 - protein, 14 aa, Homo sapiens
  heavy chain complementarity determining region 3 for antibody 38717
ARDPQRGRPDYFDY

SEQ ID NO: 77435 - protein, 9 aa, Homo sapiens
  light chain complementarity determining region 3 for antibody 38718
QQAYSSPHT

SEQ ID NO: 77436 - protein, 14 aa, Homo sapiens
  heavy chain complementarity determining region 3 for antibody 38718
ARDPQRGKPDYFDY

SEQ ID NO: 77437 - protein, 9 aa, Homo sapiens
  light chain complementarity determining region 3 for antibody 38719
QQAYSSPFT

SEQ ID NO: 77438 - protein, 14 aa, Homo sapiens
  heavy chain complementarity determining region 3 for antibody 38719
ARDPQRGRPDYFDY

SEQ ID NO: 77439 - protein, 9 aa, Homo sapiens
  light chain complementarity determining region 3 for antibody 38720
QQAYSPPRP

SEQ ID NO: 77440 - protein, 14 aa, Homo sapiens
  heavy chain complementarity determining region 3 for antibody 38720
ARAISRAAVSRFDF

SEQ ID NO: 77441 - protein, 9 aa, Homo sapiens
  light chain complementarity determining region 3 for antibody 38721
QQAYSFPQT

SEQ ID NO: 77442 - protein, 13 aa, Homo sapiens
  heavy chain complementarity determining region 3 for antibody 38721
ARDSVQNRDTFDV

SEQ ID NO: 77443 - protein, 9 aa, Homo sapiens
  light chain complementarity determining region 3 for antibody 38722
QQAYSFPNT

SEQ ID NO: 77444 - protein, 14 aa, Homo sapiens
  heavy chain complementarity determining region 3 for antibody 38722
AREDVALTLYGMGV

SEQ ID NO: 77445 - protein, 9 aa, Homo sapiens
  light chain complementarity determining region 3 for antibody 38723
QQANSFPPT

SEQ ID NO: 77446 - protein, 12 aa, Homo sapiens
  heavy chain complementarity determining region 3 for antibody 38723
ATDVDRKCYFDN

SEQ ID NO: 77447 - protein, 9 aa, Homo sapiens
  light chain complementarity determining region 3 for antibody 38724
QQANSFPNT

SEQ ID NO: 77448 - protein, 14 aa, Homo sapiens
  heavy chain complementarity determining region 3 for antibody 38724
AREDVALTLYGMGV

SEQ ID NO: 77449 - protein, 9 aa, Homo sapiens
  light chain complementarity determining region 3 for antibody 38725
QQANSFPLT

SEQ ID NO: 77450 - protein, 20 aa, Homo sapiens
  heavy chain complementarity determining region 3 for antibody 38725
ARDSRSTSGESLYCYYGMDV

SEQ ID NO: 77451 - protein, 9 aa, Homo sapiens
  light chain complementarity determining region 3 for antibody 38726
QQANSFPLT

SEQ ID NO: 77452 - protein, 18 aa, Homo sapiens
  heavy chain complementarity determining region 3 for antibody 38726
ARAGYCSGGSCYSGFFDY

SEQ ID NO: 77453 - protein, 9 aa, Homo sapiens
  light chain complementarity determining region 3 for antibody 38727
QQANSFPLT

SEQ ID NO: 77454 - protein, 17 aa, Homo sapiens
  heavy chain complementarity determining region 3 for antibody 38727
AARTRQLGEDTYWYFDL

SEQ ID NO: 77455 - protein, 9 aa, Homo sapiens
  light chain complementarity determining region 3 for antibody 38728
QQANSFPLP

SEQ ID NO: 77456 - protein, 13 aa, Homo sapiens
  heavy chain complementarity determining region 3 for antibody 38728
ARGLDRSRHWFDP

SEQ ID NO: 77457 - protein, 9 aa, Homo sapiens
  light chain complementarity determining region 3 for antibody 38729
QQANSFPLP

SEQ ID NO: 77458 - protein, 11 aa, Homo sapiens
  heavy chain complementarity determining region 3 for antibody 38729
ARESTADAFDI

SEQ ID NO: 77459 - protein, 9 aa, Homo sapiens
  light chain complementarity determining region 3 for antibody 38730
QQANSFPLP

SEQ ID NO: 77460 - protein, 17 aa, Homo sapiens
  heavy chain complementarity determining region 3 for antibody 38730
AKERGLFIAEAGTPSDS

SEQ ID NO: 77461 - protein, 9 aa, Homo sapiens
  light chain complementarity determining region 3 for antibody 38731
QQANSFPFT

SEQ ID NO: 77462 - protein, 18 aa, Homo sapiens
  heavy chain complementarity determining region 3 for antibody 38731
VLMGHYYNSGSPNWYFDL

SEQ ID NO: 77463 - protein, 9 aa, Homo sapiens
  light chain complementarity determining region 3 for antibody 38732
QQANSFPFT

SEQ ID NO: 77464 - protein, 18 aa, Homo sapiens
  heavy chain complementarity determining region 3 for antibody 38732
ARAGYCSGGSCCSGFFDY

SEQ ID NO: 77465 - protein, 9 aa, Homo sapiens
  light chain complementarity determining region 3 for antibody 38733
QQANSFLIT

SEQ ID NO: 77466 - protein, 10 aa, Homo sapiens
  heavy chain complementarity determining region 3 for antibody 38733
ARRSVEAFDL

SEQ ID NO: 77467 - protein, 9 aa, Homo sapiens
  light chain complementarity determining region 3 for antibody 38734
QQANNWPFT

SEQ ID NO: 77468 - protein, 12 aa, Homo sapiens
  heavy chain complementarity determining region 3 for antibody 38734
AKDVTYNYAFDL

SEQ ID NO: 77469 - protein, 9 aa, Homo sapiens
  light chain complementarity determining region 3 for antibody 38735
QQANNFPLT

SEQ ID NO: 77470 - protein, 13 aa, Homo sapiens
  heavy chain complementarity determining region 3 for antibody 38735
ASSIVGATFYFDF

SEQ ID NO: 77471 - protein, 9 aa, Homo sapiens
  light chain complementarity determining region 3 for antibody 38736
QQANGFLIT

SEQ ID NO: 77472 - protein, 10 aa, Homo sapiens
  heavy chain complementarity determining region 3 for antibody 38736
ARRSVGAFDL

SEQ ID NO: 77473 - protein, 9 aa, Homo sapiens
  light chain complementarity determining region 3 for antibody 38737
QQAHSFPNP

SEQ ID NO: 77474 - protein, 14 aa, Homo sapiens
  heavy chain complementarity determining region 3 for antibody 38737
AREDVALTLYGMGV

SEQ ID NO: 77475 - protein, 9 aa, Homo sapiens
  light chain complementarity determining region 3 for antibody 38738
QQADSIPLT

SEQ ID NO: 77476 - protein, 16 aa, Homo sapiens
  heavy chain complementarity determining region 3 for antibody 38738
ARDAGNYNDDWYYFDL

SEQ ID NO: 77477 - protein, 9 aa, Homo sapiens
  light chain complementarity determining region 3 for antibody 38739
QPYYTTPRT

SEQ ID NO: 77478 - protein, 8 aa, Homo sapiens
  heavy chain complementarity determining region 3 for antibody 38739
ARDGAFDS

SEQ ID NO: 77479 - protein, 9 aa, Homo sapiens
  light chain complementarity determining region 3 for antibody 38740
QPYYTTPRP

SEQ ID NO: 77480 - protein, 8 aa, Homo sapiens
  heavy chain complementarity determining region 3 for antibody 38740
ARDGAFDS

SEQ ID NO: 77481 - protein, 9 aa, Homo sapiens
  light chain complementarity determining region 3 for antibody 38741
QPYYTSVRT

SEQ ID NO: 77482 - protein, 12 aa, Homo sapiens
  heavy chain complementarity determining region 3 for antibody 38741
VKDCGLGGSRDF

SEQ ID NO: 77483 - protein, 9 aa, Homo sapiens
  light chain complementarity determining region 3 for antibody 38742
QPYYTSVRT

SEQ ID NO: 77484 - protein, 12 aa, Homo sapiens
  heavy chain complementarity determining region 3 for antibody 38742
VKDCGLGGPRDY

SEQ ID NO: 77485 - protein, 9 aa, Homo sapiens
  light chain complementarity determining region 3 for antibody 38743
QPYYTSVRT

SEQ ID NO: 77486 - protein, 12 aa, Homo sapiens
  heavy chain complementarity determining region 3 for antibody 38743
VKDCGLGGPRDS

SEQ ID NO: 77487 - protein, 9 aa, Homo sapiens
  light chain complementarity determining region 3 for antibody 38744
QPYYTFLRT

SEQ ID NO: 77488 - protein, 12 aa, Homo sapiens
  heavy chain complementarity determining region 3 for antibody 38744
VKDCGLGGSRDS

SEQ ID NO: 77489 - protein, 9 aa, Homo sapiens
  light chain complementarity determining region 3 for antibody 38745
QPYYSYPYT

SEQ ID NO: 77490 - protein, 14 aa, Homo sapiens
  heavy chain complementarity determining region 3 for antibody 38745
AKIQALGDTWAFDL

SEQ ID NO: 77491 - protein, 9 aa, Homo sapiens
  light chain complementarity determining region 3 for antibody 38746
QPYYSTPFT

SEQ ID NO: 77492 - protein, 11 aa, Homo sapiens
  heavy chain complementarity determining region 3 for antibody 38746
ANSFYYDFCVY

SEQ ID NO: 77493 - protein, 8 aa, Homo sapiens
  light chain complementarity determining region 3 for antibody 38747
QPYSRSRT

SEQ ID NO: 77494 - protein, 19 aa, Homo sapiens
  heavy chain complementarity determining region 3 for antibody 38747
ARDGVACSGDSCYQTEVDS

SEQ ID NO: 77495 - protein, 9 aa, Homo sapiens
  light chain complementarity determining region 3 for antibody 38748
QPYRRSPST

SEQ ID NO: 77496 - protein, 17 aa, Homo sapiens
  heavy chain complementarity determining region 3 for antibody 38748
AGLSSRLGDGSPSLFDY

SEQ ID NO: 77497 - protein, 8 aa, Homo sapiens
  light chain complementarity determining region 3 for antibody 38749
QPYNVFWT

SEQ ID NO: 77498 - protein, 10 aa, Homo sapiens
  heavy chain complementarity determining region 3 for antibody 38749
ATDRRSVLSY

SEQ ID NO: 77499 - protein, 8 aa, Homo sapiens
  light chain complementarity determining region 3 for antibody 38750
QPYNTYAT

SEQ ID NO: 77500 - protein, 16 aa, Homo sapiens
  heavy chain complementarity determining region 3 for antibody 38750
ATELYYGSPTHTGFAI

SEQ ID NO: 77501 - protein, 9 aa, Homo sapiens
  light chain complementarity determining region 3 for antibody 38751
QPYNSYSRT

SEQ ID NO: 77502 - protein, 18 aa, Homo sapiens
  heavy chain complementarity determining region 3 for antibody 38751
ARIRGWGFGGKVYYGMDV

SEQ ID NO: 77503 - protein, 9 aa, Homo sapiens
  light chain complementarity determining region 3 for antibody 38752
QPYNSYSQT

SEQ ID NO: 77504 - protein, 14 aa, Homo sapiens
  heavy chain complementarity determining region 3 for antibody 38752
TTHLDYCPSSSCVY

SEQ ID NO: 77505 - protein, 10 aa, Homo sapiens
  light chain complementarity determining region 3 for antibody 38753
QPYNSYSPWT

SEQ ID NO: 77506 - protein, 20 aa, Homo sapiens
  heavy chain complementarity determining region 3 for antibody 38753
ATVLRGRGSSVYYVGGAFDI

SEQ ID NO: 77507 - protein, 9 aa, Homo sapiens
  light chain complementarity determining region 3 for antibody 38754
QPYNSYSGT

SEQ ID NO: 77508 - protein, 15 aa, Homo sapiens
  heavy chain complementarity determining region 3 for antibody 38754
AKEPDCGRNCLFFDS

SEQ ID NO: 77509 - protein, 9 aa, Homo sapiens
  light chain complementarity determining region 3 for antibody 38755
QPYNSYPLT

SEQ ID NO: 77510 - protein, 15 aa, Homo sapiens
  heavy chain complementarity determining region 3 for antibody 38755
ARERAGGYILMGWDF

SEQ ID NO: 77511 - protein, 9 aa, Homo sapiens
  light chain complementarity determining region 3 for antibody 38756
QPYNRWPAT

SEQ ID NO: 77512 - protein, 20 aa, Homo sapiens
  heavy chain complementarity determining region 3 for antibody 38756
ARDPREYYDLRNYYVYYFDS

SEQ ID NO: 77513 - protein, 9 aa, Homo sapiens
  light chain complementarity determining region 3 for antibody 38757
QPYNLYPHT

SEQ ID NO: 77514 - protein, 16 aa, Homo sapiens
  heavy chain complementarity determining region 3 for antibody 38757
ARETDHGSYGSGSYDY

SEQ ID NO: 77515 - protein, 9 aa, Homo sapiens
  light chain complementarity determining region 3 for antibody 38758
QPYHDRPET

SEQ ID NO: 77516 - protein, 20 aa, Homo sapiens
  heavy chain complementarity determining region 3 for antibody 38758
SRRHLLVGGDRVAAGRAADY

SEQ ID NO: 77517 - protein, 9 aa, Homo sapiens
  light chain complementarity determining region 3 for antibody 38759
QPYGTWPPT

SEQ ID NO: 77518 - protein, 21 aa, Homo sapiens
  heavy chain complementarity determining region 3 for antibody 38759
ARGGGPFYFDHSGFRLYYFHI

SEQ ID NO: 77519 - protein, 9 aa, Homo sapiens
  light chain complementarity determining region 3 for antibody 38760
QPYGTSSYT

SEQ ID NO: 77520 - protein, 14 aa, Homo sapiens
  heavy chain complementarity determining region 3 for antibody 38760
ARDYRDRNGYYFNH

SEQ ID NO: 77521 - protein, 9 aa, Homo sapiens
  light chain complementarity determining region 3 for antibody 38761
QPYGTSSFT

SEQ ID NO: 77522 - protein, 21 aa, Homo sapiens
  heavy chain complementarity determining region 3 for antibody 38761
ARMSAGSYYDSSGSYLYYFDN

SEQ ID NO: 77523 - protein, 9 aa, Homo sapiens
  light chain complementarity determining region 3 for antibody 38762
QPYGTIPRT

SEQ ID NO: 77524 - protein, 13 aa, Homo sapiens
  heavy chain complementarity determining region 3 for antibody 38762
AGGNFHRSGYAEY

SEQ ID NO: 77525 - protein, 9 aa, Homo sapiens
  light chain complementarity determining region 3 for antibody 38763
QPYGSSPWT

SEQ ID NO: 77526 - protein, 14 aa, Homo sapiens
  heavy chain complementarity determining region 3 for antibody 38763
ARGGQSYPNGYFDL

SEQ ID NO: 77527 - protein, 9 aa, Homo sapiens
  light chain complementarity determining region 3 for antibody 38764
QPYGSSPWT

SEQ ID NO: 77528 - protein, 14 aa, Homo sapiens
  heavy chain complementarity determining region 3 for antibody 38764
ARDSSSTSWGPIDY

SEQ ID NO: 77529 - protein, 9 aa, Homo sapiens
  light chain complementarity determining region 3 for antibody 38765
QPYGSSPQT

SEQ ID NO: 77530 - protein, 19 aa, Homo sapiens
  heavy chain complementarity determining region 3 for antibody 38765
ARVFRGLRSRSYFGYGMDL

SEQ ID NO: 77531 - protein, 9 aa, Homo sapiens
  light chain complementarity determining region 3 for antibody 38766
QPYGSSPQT

SEQ ID NO: 77532 - protein, 15 aa, Homo sapiens
  heavy chain complementarity determining region 3 for antibody 38766
ARRRIRFLEWRPFDY

SEQ ID NO: 77533 - protein, 10 aa, Homo sapiens
  light chain complementarity determining region 3 for antibody 38767
QPYGSSPPYT

SEQ ID NO: 77534 - protein, 18 aa, Homo sapiens
  heavy chain complementarity determining region 3 for antibody 38767
ATGKWFGDFNFYYYAMDV

SEQ ID NO: 77535 - protein, 9 aa, Homo sapiens
  light chain complementarity determining region 3 for antibody 38768
QPYGSSPPT

SEQ ID NO: 77536 - protein, 11 aa, Homo sapiens
  heavy chain complementarity determining region 3 for antibody 38768
ARTPLWFGPYF

SEQ ID NO: 77537 - protein, 9 aa, Homo sapiens
  light chain complementarity determining region 3 for antibody 38769
QPYGSSPPT

SEQ ID NO: 77538 - protein, 16 aa, Homo sapiens
  heavy chain complementarity determining region 3 for antibody 38769
ARDFHPMAASDTAYDY

SEQ ID NO: 77539 - protein, 10 aa, Homo sapiens
  light chain complementarity determining region 3 for antibody 38770
QPYGSSPPLT

SEQ ID NO: 77540 - protein, 18 aa, Homo sapiens
  heavy chain complementarity determining region 3 for antibody 38770
ARGGYDYGWGSYGVYFDY

SEQ ID NO: 77541 - protein, 10 aa, Homo sapiens
  light chain complementarity determining region 3 for antibody 38771
QPYGSSPMYS

SEQ ID NO: 77542 - protein, 11 aa, Homo sapiens
  heavy chain complementarity determining region 3 for antibody 38771
ARGGQWGSLDY

SEQ ID NO: 77543 - protein, 9 aa, Homo sapiens
  light chain complementarity determining region 3 for antibody 38772
QPYGSSLYT

SEQ ID NO: 77544 - protein, 16 aa, Homo sapiens
  heavy chain complementarity determining region 3 for antibody 38772
ARAKHYGDYYYYGMDA

SEQ ID NO: 77545 - protein, 9 aa, Homo sapiens
  light chain complementarity determining region 3 for antibody 38773
QPYGSIPRT

SEQ ID NO: 77546 - protein, 14 aa, Homo sapiens
  heavy chain complementarity determining region 3 for antibody 38773
AGGDFCGSDCYSEY

SEQ ID NO: 77547 - protein, 10 aa, Homo sapiens
  light chain complementarity determining region 3 for antibody 38774
QPYGGTPPFS

SEQ ID NO: 77548 - protein, 12 aa, Homo sapiens
  heavy chain complementarity determining region 3 for antibody 38774
ARETGGSYYMDA

SEQ ID NO: 77549 - protein, 9 aa, Homo sapiens
  light chain complementarity determining region 3 for antibody 38775
QPYFSSPWT

SEQ ID NO: 77550 - protein, 13 aa, Homo sapiens
  heavy chain complementarity determining region 3 for antibody 38775
ARGSGSHYAPFDH

SEQ ID NO: 77551 - protein, 9 aa, Homo sapiens
  light chain complementarity determining region 3 for antibody 38776
QPYESYPLT

SEQ ID NO: 77552 - protein, 17 aa, Homo sapiens
  heavy chain complementarity determining region 3 for antibody 38776
ARGVGRGLEASPGIFDY

SEQ ID NO: 77553 - protein, 9 aa, Homo sapiens
  light chain complementarity determining region 3 for antibody 38777
QPYDTSPWT

SEQ ID NO: 77554 - protein, 15 aa, Homo sapiens
  heavy chain complementarity determining region 3 for antibody 38777
VHTQLWFGDQCYFDF

SEQ ID NO: 77555 - protein, 11 aa, Homo sapiens
  light chain complementarity determining region 3 for antibody 38778
QPYDRSPPGFT

SEQ ID NO: 77556 - protein, 14 aa, Homo sapiens
  heavy chain complementarity determining region 3 for antibody 38778
ARETHNSRKRSFDQ

SEQ ID NO: 77557 - protein, 8 aa, Homo sapiens
  light chain complementarity determining region 3 for antibody 38779
QPYDDLRA

SEQ ID NO: 77558 - protein, 19 aa, Homo sapiens
  heavy chain complementarity determining region 3 for antibody 38779
ARDPSYYYDSSGSPRYFQH

SEQ ID NO: 77559 - protein, 9 aa, Homo sapiens
  light chain complementarity determining region 3 for antibody 38780
QPVISYPFT

SEQ ID NO: 77560 - protein, 12 aa, Homo sapiens
  heavy chain complementarity determining region 3 for antibody 38780
ARPLDGDHGFDP

SEQ ID NO: 77561 - protein, 9 aa, Homo sapiens
  light chain complementarity determining region 3 for antibody 38781
QPTHTFPRT

SEQ ID NO: 77562 - protein, 20 aa, Homo sapiens
  heavy chain complementarity determining region 3 for antibody 38781
GRGRRIAALSTAHYYYGMDV

SEQ ID NO: 77563 - protein, 9 aa, Homo sapiens
  light chain complementarity determining region 3 for antibody 38782
QPTHSRPFT

SEQ ID NO: 77564 - protein, 20 aa, Homo sapiens
  heavy chain complementarity determining region 3 for antibody 38782
AKGIAVAALRTVYYYYGLDV

SEQ ID NO: 77565 - protein, 9 aa, Homo sapiens
  light chain complementarity determining region 3 for antibody 38783
QPSYSTPYT

SEQ ID NO: 77566 - protein, 17 aa, Homo sapiens
  heavy chain complementarity determining region 3 for antibody 38783
SSGGVSDYRSHYYGMDV

SEQ ID NO: 77567 - protein, 9 aa, Homo sapiens
  light chain complementarity determining region 3 for antibody 38784
QPSYRILWT

SEQ ID NO: 77568 - protein, 13 aa, Homo sapiens
  heavy chain complementarity determining region 3 for antibody 38784
VTRAFRFGKVMDV

SEQ ID NO: 77569 - protein, 8 aa, Homo sapiens
  light chain complementarity determining region 3 for antibody 38785
QPSYGSPT

SEQ ID NO: 77570 - protein, 13 aa, Homo sapiens
  heavy chain complementarity determining region 3 for antibody 38785
ARDRPGTYYAFDI

SEQ ID NO: 77571 - protein, 11 aa, Homo sapiens
  light chain complementarity determining region 3 for antibody 38786
QPRVNWPPSVT

SEQ ID NO: 77572 - protein, 15 aa, Homo sapiens
  heavy chain complementarity determining region 3 for antibody 38786
ARDRDGMYSAHAFDI

SEQ ID NO: 77573 - protein, 9 aa, Homo sapiens
  light chain complementarity determining region 3 for antibody 38787
QPRSNWPWT

SEQ ID NO: 77574 - protein, 17 aa, Homo sapiens
  heavy chain complementarity determining region 3 for antibody 38787
AREDGGSSYNPYWYFDL

SEQ ID NO: 77575 - protein, 9 aa, Homo sapiens
  light chain complementarity determining region 3 for antibody 38788
QPRSNWPLT

SEQ ID NO: 77576 - protein, 14 aa, Homo sapiens
  heavy chain complementarity determining region 3 for antibody 38788
VKGKNSGWYGALDI

SEQ ID NO: 77577 - protein, 9 aa, Homo sapiens
  light chain complementarity determining region 3 for antibody 38789
QPRSNWPLT

SEQ ID NO: 77578 - protein, 15 aa, Homo sapiens
  heavy chain complementarity determining region 3 for antibody 38789
ARDLSYFGSRRGFDP

SEQ ID NO: 77579 - protein, 9 aa, Homo sapiens
  light chain complementarity determining region 3 for antibody 38790
QPNYNPPFT

SEQ ID NO: 77580 - protein, 13 aa, Homo sapiens
  heavy chain complementarity determining region 3 for antibody 38790
VRGRNYDRDGFDP

SEQ ID NO: 77581 - protein, 10 aa, Homo sapiens
  light chain complementarity determining region 3 for antibody 38791
QPNDSSAMFT

SEQ ID NO: 77582 - protein, 13 aa, Homo sapiens
  heavy chain complementarity determining region 3 for antibody 38791
ARVSGWSRGGFDY

SEQ ID NO: 77583 - protein, 8 aa, Homo sapiens
  light chain complementarity determining region 3 for antibody 38792
QPLQTPYT

SEQ ID NO: 77584 - protein, 13 aa, Homo sapiens
  heavy chain complementarity determining region 3 for antibody 38792
AHWGHTNGWHFDY

SEQ ID NO: 77585 - protein, 10 aa, Homo sapiens
  light chain complementarity determining region 3 for antibody 38793
QPLNSYLPFT

SEQ ID NO: 77586 - protein, 17 aa, Homo sapiens
  heavy chain complementarity determining region 3 for antibody 38793
ATEGKHDSSGYYEPFDY

SEQ ID NO: 77587 - protein, 9 aa, Homo sapiens
  light chain complementarity determining region 3 for antibody 38794
QPDGSSPRT

SEQ ID NO: 77588 - protein, 25 aa, Homo sapiens
  heavy chain complementarity determining region 3 for antibody 38794
ARLRIDRLRLPGAMRGPLYDCGLNV

SEQ ID NO: 77589 - protein, 9 aa, Homo sapiens
  light chain complementarity determining region 3 for antibody 38795
QNYYSWPFT

SEQ ID NO: 77590 - protein, 13 aa, Homo sapiens
  heavy chain complementarity determining region 3 for antibody 38795
ARGAVTTTYSFGY

SEQ ID NO: 77591 - protein, 11 aa, Homo sapiens
  light chain complementarity determining region 3 for antibody 38796
QNYSTSSLALT

SEQ ID NO: 77592 - protein, 16 aa, Homo sapiens
  heavy chain complementarity determining region 3 for antibody 38796
ARFFLAGYSWYEGVDY

SEQ ID NO: 77593 - protein, 9 aa, Homo sapiens
  light chain complementarity determining region 3 for antibody 38797
QNYNSAPLT

SEQ ID NO: 77594 - protein, 20 aa, Homo sapiens
  heavy chain complementarity determining region 3 for antibody 38797
AAVLRGLGNSAYSVGSAFDI

SEQ ID NO: 77595 - protein, 9 aa, Homo sapiens
  light chain complementarity determining region 3 for antibody 38798
QNYNSALFT

SEQ ID NO: 77596 - protein, 11 aa, Homo sapiens
  heavy chain complementarity determining region 3 for antibody 38798
ARVVSSSWLDI

SEQ ID NO: 77597 - protein, 8 aa, Homo sapiens
  light chain complementarity determining region 3 for antibody 38799
QNYNKWPS

SEQ ID NO: 77598 - protein, 16 aa, Homo sapiens
  heavy chain complementarity determining region 3 for antibody 38799
ARIYDNSGPLLGCFNI

SEQ ID NO: 77599 - protein, 9 aa, Homo sapiens
  light chain complementarity determining region 3 for antibody 38800
QNYDGAPGT

SEQ ID NO: 77600 - protein, 16 aa, Homo sapiens
  heavy chain complementarity determining region 3 for antibody 38800
AKKGGPVTATGNYFDL

SEQ ID NO: 77601 - protein, 9 aa, Homo sapiens
  light chain complementarity determining region 3 for antibody 38801
QNTHTFPRT

SEQ ID NO: 77602 - protein, 20 aa, Homo sapiens
  heavy chain complementarity determining region 3 for antibody 38801
GRGRRIAALSTAHYYYGMDV

SEQ ID NO: 77603 - protein, 9 aa, Homo sapiens
  light chain complementarity determining region 3 for antibody 38802
QNSHSRPFT

SEQ ID NO: 77604 - protein, 20 aa, Homo sapiens
  heavy chain complementarity determining region 3 for antibody 38802
AKGIAVAALRTVYYYYGMDV

SEQ ID NO: 77605 - protein, 11 aa, Homo sapiens
  light chain complementarity determining region 3 for antibody 38803
QNFDTSPPRWT

SEQ ID NO: 77606 - protein, 18 aa, Homo sapiens
  heavy chain complementarity determining region 3 for antibody 38803
ARGLRLRELSFLLLFFDY

SEQ ID NO: 77607 - protein, 10 aa, Homo sapiens
  light chain complementarity determining region 3 for antibody 38804
QLYSRSPTWT

SEQ ID NO: 77608 - protein, 19 aa, Homo sapiens
  heavy chain complementarity determining region 3 for antibody 38804
ARESYYPDIGGYAPRAFDI

SEQ ID NO: 77609 - protein, 10 aa, Homo sapiens
  light chain complementarity determining region 3 for antibody 38805
QLYSRSPTWA

SEQ ID NO: 77610 - protein, 19 aa, Homo sapiens
  heavy chain complementarity determining region 3 for antibody 38805
ARESYYPDIGGYTPRAFDI

SEQ ID NO: 77611 - protein, 10 aa, Homo sapiens
  light chain complementarity determining region 3 for antibody 38806
QLYNNWPRYT

SEQ ID NO: 77612 - protein, 14 aa, Homo sapiens
  heavy chain complementarity determining region 3 for antibody 38806
ARLGEGYSYGPSDY

SEQ ID NO: 77613 - protein, 10 aa, Homo sapiens
  light chain complementarity determining region 3 for antibody 38807
QLYNNRPRNT

SEQ ID NO: 77614 - protein, 12 aa, Homo sapiens
  heavy chain complementarity determining region 3 for antibody 38807
AKMMPRHDVFDL

SEQ ID NO: 77615 - protein, 9 aa, Homo sapiens
  light chain complementarity determining region 3 for antibody 38808
QLYGSSPYT

SEQ ID NO: 77616 - protein, 14 aa, Homo sapiens
  heavy chain complementarity determining region 3 for antibody 38808
ARVGPYSSGEIFDY

SEQ ID NO: 77617 - protein, 10 aa, Homo sapiens
  light chain complementarity determining region 3 for antibody 38809
QLYGSSPPWR

SEQ ID NO: 77618 - protein, 15 aa, Homo sapiens
  heavy chain complementarity determining region 3 for antibody 38809
ARCQRARSWYPALDL

SEQ ID NO: 77619 - protein, 11 aa, Homo sapiens
  light chain complementarity determining region 3 for antibody 38810
QLYGSSPPMNT

SEQ ID NO: 77620 - protein, 10 aa, Homo sapiens
  heavy chain complementarity determining region 3 for antibody 38810
ISNGYYCLEY

SEQ ID NO: 77621 - protein, 11 aa, Homo sapiens
  light chain complementarity determining region 3 for antibody 38811
QLYETSPPGDT

SEQ ID NO: 77622 - protein, 14 aa, Homo sapiens
  heavy chain complementarity determining region 3 for antibody 38811
AREISISRKRSFDQ

SEQ ID NO: 77623 - protein, 11 aa, Homo sapiens
  light chain complementarity determining region 3 for antibody 38812
QLYDRSPPMYT

SEQ ID NO: 77624 - protein, 14 aa, Homo sapiens
  heavy chain complementarity determining region 3 for antibody 38812
ASHIAINAKRGFDH

SEQ ID NO: 77625 - protein, 9 aa, Homo sapiens
  light chain complementarity determining region 3 for antibody 38813
QLSYTLLSP

SEQ ID NO: 77626 - protein, 12 aa, Homo sapiens
  heavy chain complementarity determining region 3 for antibody 38813
ARWDYVTNAHVY

SEQ ID NO: 77627 - protein, 9 aa, Homo sapiens
  light chain complementarity determining region 3 for antibody 38814
QLSYSTPYT

SEQ ID NO: 77628 - protein, 14 aa, Homo sapiens
  heavy chain complementarity determining region 3 for antibody 38814
ARGGGVATSYGMDV

SEQ ID NO: 77629 - protein, 9 aa, Homo sapiens
  light chain complementarity determining region 3 for antibody 38815
QLSYNLLST

SEQ ID NO: 77630 - protein, 12 aa, Homo sapiens
  heavy chain complementarity determining region 3 for antibody 38815
ARWDYVTNAHVY

SEQ ID NO: 77631 - protein, 10 aa, Homo sapiens
  light chain complementarity determining region 3 for antibody 38816
QLRSNWPPRT

SEQ ID NO: 77632 - protein, 16 aa, Homo sapiens
  heavy chain complementarity determining region 3 for antibody 38816
ARDVLRFLEWSPHFDY

SEQ ID NO: 77633 - protein, 11 aa, Homo sapiens
  light chain complementarity determining region 3 for antibody 38817
QLRSNWPPGPS

SEQ ID NO: 77634 - protein, 19 aa, Homo sapiens
  heavy chain complementarity determining region 3 for antibody 38817
ATDLMRDAAVVGMGTYFDF

SEQ ID NO: 77635 - protein, 11 aa, Homo sapiens
  light chain complementarity determining region 3 for antibody 38818
QLRSNWPPGIS

SEQ ID NO: 77636 - protein, 19 aa, Homo sapiens
  heavy chain complementarity determining region 3 for antibody 38818
ATDLMRDAAVVGMGTYFDF

SEQ ID NO: 77637 - protein, 11 aa, Homo sapiens
  light chain complementarity determining region 3 for antibody 38819
QLRSNLPPGLS

SEQ ID NO: 77638 - protein, 19 aa, Homo sapiens
  heavy chain complementarity determining region 3 for antibody 38819
ATDLMRDAAVVGMGTYFDF

SEQ ID NO: 77639 - protein, 10 aa, Homo sapiens
  light chain complementarity determining region 3 for antibody 38820
QLRSDWPPYT

SEQ ID NO: 77640 - protein, 18 aa, Homo sapiens
  heavy chain complementarity determining region 3 for antibody 38820
AREGRSGYRIPAAYGMDV

SEQ ID NO: 77641 - protein, 9 aa, Homo sapiens
  light chain complementarity determining region 3 for antibody 38821
QLLYSYPLT

SEQ ID NO: 77642 - protein, 14 aa, Homo sapiens
  heavy chain complementarity determining region 3 for antibody 38821
ARHHHGAGPPIIDH

SEQ ID NO: 77643 - protein, 9 aa, Homo sapiens
  light chain complementarity determining region 3 for antibody 38822
QLGYSPPFI

SEQ ID NO: 77644 - protein, 15 aa, Homo sapiens
  heavy chain complementarity determining region 3 for antibody 38822
ARAQVIWGQLYYFDS

SEQ ID NO: 77645 - protein, 9 aa, Homo sapiens
  light chain complementarity determining region 3 for antibody 38823
QKYYSALLT

SEQ ID NO: 77646 - protein, 17 aa, Homo sapiens
  heavy chain complementarity determining region 3 for antibody 38823
ARARHYYGSGNYYPFDY

SEQ ID NO: 77647 - protein, 9 aa, Homo sapiens
  light chain complementarity determining region 3 for antibody 38824
QKYYSALLT

SEQ ID NO: 77648 - protein, 17 aa, Homo sapiens
  heavy chain complementarity determining region 3 for antibody 38824
AGDRHYYGSGNYYPFDY

SEQ ID NO: 77649 - protein, 9 aa, Homo sapiens
  light chain complementarity determining region 3 for antibody 38825
QKYYGALLT

SEQ ID NO: 77650 - protein, 17 aa, Homo sapiens
  heavy chain complementarity determining region 3 for antibody 38825
ARDRHYYGSGNYYPFDY

SEQ ID NO: 77651 - protein, 9 aa, Homo sapiens
  light chain complementarity determining region 3 for antibody 38826
QKYVSTPRP

SEQ ID NO: 77652 - protein, 18 aa, Homo sapiens
  heavy chain complementarity determining region 3 for antibody 38826
ARERWEKNPSYKYYGMDL

SEQ ID NO: 77653 - protein, 9 aa, Homo sapiens
  light chain complementarity determining region 3 for antibody 38827
QKYTSAPLT

SEQ ID NO: 77654 - protein, 11 aa, Homo sapiens
  heavy chain complementarity determining region 3 for antibody 38827
ATKFKGAPLDY

SEQ ID NO: 77655 - protein, 9 aa, Homo sapiens
  light chain complementarity determining region 3 for antibody 38828
QKYQTAPLT

SEQ ID NO: 77656 - protein, 18 aa, Homo sapiens
  heavy chain complementarity determining region 3 for antibody 38828
ARDVGDDSTGYNYGYFDL

SEQ ID NO: 77657 - protein, 9 aa, Homo sapiens
  light chain complementarity determining region 3 for antibody 38829
QKYNTVPYT

SEQ ID NO: 77658 - protein, 13 aa, Homo sapiens
  heavy chain complementarity determining region 3 for antibody 38829
ARLPYWELYYDDY

SEQ ID NO: 77659 - protein, 9 aa, Homo sapiens
  light chain complementarity determining region 3 for antibody 38830
QKYNTSPYT

SEQ ID NO: 77660 - protein, 13 aa, Homo sapiens
  heavy chain complementarity determining region 3 for antibody 38830
ARLPYWELYYDDY

SEQ ID NO: 77661 - protein, 9 aa, Homo sapiens
  light chain complementarity determining region 3 for antibody 38831
QKYNTAPFT

SEQ ID NO: 77662 - protein, 13 aa, Homo sapiens
  heavy chain complementarity determining region 3 for antibody 38831
ARLPYWELYYDDY

SEQ ID NO: 77663 - protein, 9 aa, Homo sapiens
  light chain complementarity determining region 3 for antibody 38832
QKYNSYRRT

SEQ ID NO: 77664 - protein, 9 aa, Homo sapiens
  heavy chain complementarity determining region 3 for antibody 38832
AKGSSALEY

SEQ ID NO: 77665 - protein, 9 aa, Homo sapiens
  light chain complementarity determining region 3 for antibody 38833
QKYNSVPPT

SEQ ID NO: 77666 - protein, 14 aa, Homo sapiens
  heavy chain complementarity determining region 3 for antibody 38833
ARDPSYGGFYDFDS

SEQ ID NO: 77667 - protein, 9 aa, Homo sapiens
  light chain complementarity determining region 3 for antibody 38834
QKYNSVPLP

SEQ ID NO: 77668 - protein, 11 aa, Homo sapiens
  heavy chain complementarity determining region 3 for antibody 38834
ARKGTGNAMDI

SEQ ID NO: 77669 - protein, 10 aa, Homo sapiens
  light chain complementarity determining region 3 for antibody 38835
QKYNSDPPQK

SEQ ID NO: 77670 - protein, 14 aa, Homo sapiens
  heavy chain complementarity determining region 3 for antibody 38835
ARVSQKRSTFPFDY

SEQ ID NO: 77671 - protein, 9 aa, Homo sapiens
  light chain complementarity determining region 3 for antibody 38836
QKYNSAPRT

SEQ ID NO: 77672 - protein, 20 aa, Homo sapiens
  heavy chain complementarity determining region 3 for antibody 38836
ATVLRGRGSSVYYVGGAFDI

SEQ ID NO: 77673 - protein, 9 aa, Homo sapiens
  light chain complementarity determining region 3 for antibody 38837
QKYNSAPRT

SEQ ID NO: 77674 - protein, 11 aa, Homo sapiens
  heavy chain complementarity determining region 3 for antibody 38837
ATKFKGAPLEY

SEQ ID NO: 77675 - protein, 9 aa, Homo sapiens
  light chain complementarity determining region 3 for antibody 38838
QKYNSAPLT

SEQ ID NO: 77676 - protein, 17 aa, Homo sapiens
  heavy chain complementarity determining region 3 for antibody 38838
IPVMWVRFLEDLHLFNY

SEQ ID NO: 77677 - protein, 9 aa, Homo sapiens
  light chain complementarity determining region 3 for antibody 38839
QKYNSAPLT

SEQ ID NO: 77678 - protein, 20 aa, Homo sapiens
  heavy chain complementarity determining region 3 for antibody 38839
ATVLRGRGSSVYYVGGAFDL

SEQ ID NO: 77679 - protein, 9 aa, Homo sapiens
  light chain complementarity determining region 3 for antibody 38840
QKYNSAPLT

SEQ ID NO: 77680 - protein, 11 aa, Homo sapiens
  heavy chain complementarity determining region 3 for antibody 38840
AAKFKGAPLDY

SEQ ID NO: 77681 - protein, 9 aa, Homo sapiens
  light chain complementarity determining region 3 for antibody 38841
QKYNSAPLN

SEQ ID NO: 77682 - protein, 20 aa, Homo sapiens
  heavy chain complementarity determining region 3 for antibody 38841
ATVLRGRGSSVYYVGGAFDI

SEQ ID NO: 77683 - protein, 9 aa, Homo sapiens
  light chain complementarity determining region 3 for antibody 38842
QKYNSAPGT

SEQ ID NO: 77684 - protein, 16 aa, Homo sapiens
  heavy chain complementarity determining region 3 for antibody 38842
ARGGRVGASYYYGMDV

SEQ ID NO: 77685 - protein, 9 aa, Homo sapiens
  light chain complementarity determining region 3 for antibody 38843
QKYNSAPFT

SEQ ID NO: 77686 - protein, 13 aa, Homo sapiens
  heavy chain complementarity determining region 3 for antibody 38843
AKDITPQLRILDY

SEQ ID NO: 77687 - protein, 9 aa, Homo sapiens
  light chain complementarity determining region 3 for antibody 38844
QKYNSAPFP

SEQ ID NO: 77688 - protein, 16 aa, Homo sapiens
  heavy chain complementarity determining region 3 for antibody 38844
ARVWLGGYNYGHHFDY

SEQ ID NO: 77689 - protein, 9 aa, Homo sapiens
  light chain complementarity determining region 3 for antibody 38845
QKYNSAPFN

SEQ ID NO: 77690 - protein, 16 aa, Homo sapiens
  heavy chain complementarity determining region 3 for antibody 38845
ARVWLGGYNYGHHFDY

SEQ ID NO: 77691 - protein, 10 aa, Homo sapiens
  light chain complementarity determining region 3 for antibody 38846
QKYNRDPPQT

SEQ ID NO: 77692 - protein, 14 aa, Homo sapiens
  heavy chain complementarity determining region 3 for antibody 38846
ARVSQKRSTFPFDY

SEQ ID NO: 77693 - protein, 9 aa, Homo sapiens
  light chain complementarity determining region 3 for antibody 38847
QKYNRAPRT

SEQ ID NO: 77694 - protein, 11 aa, Homo sapiens
  heavy chain complementarity determining region 3 for antibody 38847
ARDAAYSCFDY

SEQ ID NO: 77695 - protein, 9 aa, Homo sapiens
  light chain complementarity determining region 3 for antibody 38848
QKYNRAPQT

SEQ ID NO: 77696 - protein, 13 aa, Homo sapiens
  heavy chain complementarity determining region 3 for antibody 38848
ARDRLVGKALLDY

SEQ ID NO: 77697 - protein, 9 aa, Homo sapiens
  light chain complementarity determining region 3 for antibody 38849
QKYNNAPYT

SEQ ID NO: 77698 - protein, 13 aa, Homo sapiens
  heavy chain complementarity determining region 3 for antibody 38849
ARLPYWELYYDDY

SEQ ID NO: 77699 - protein, 9 aa, Homo sapiens
  light chain complementarity determining region 3 for antibody 38850
QKYNIAPWP

SEQ ID NO: 77700 - protein, 8 aa, Homo sapiens
  heavy chain complementarity determining region 3 for antibody 38850
TSGHYGQY

SEQ ID NO: 77701 - protein, 9 aa, Homo sapiens
  light chain complementarity determining region 3 for antibody 38851
QKYHTAPLT

SEQ ID NO: 77702 - protein, 18 aa, Homo sapiens
  heavy chain complementarity determining region 3 for antibody 38851
ARDVGDDSTGYNYGYFDF

SEQ ID NO: 77703 - protein, 8 aa, Homo sapiens
  light chain complementarity determining region 3 for antibody 38852
QKYGTSRM

SEQ ID NO: 77704 - protein, 13 aa, Homo sapiens
  heavy chain complementarity determining region 3 for antibody 38852
ARGQFVGSAYYEN

SEQ ID NO: 77705 - protein, 11 aa, Homo sapiens
  light chain complementarity determining region 3 for antibody 38853
QKYGTAPPGMA

SEQ ID NO: 77706 - protein, 12 aa, Homo sapiens
  heavy chain complementarity determining region 3 for antibody 38853
AKKIGNFDVLDV

SEQ ID NO: 77707 - protein, 11 aa, Homo sapiens
  light chain complementarity determining region 3 for antibody 38854
QKYGTAPPGFA

SEQ ID NO: 77708 - protein, 12 aa, Homo sapiens
  heavy chain complementarity determining region 3 for antibody 38854
AKKIGNFDVLDV

SEQ ID NO: 77709 - protein, 8 aa, Homo sapiens
  light chain complementarity determining region 3 for antibody 38855
QKYGSSPP

SEQ ID NO: 77710 - protein, 14 aa, Homo sapiens
  heavy chain complementarity determining region 3 for antibody 38855
ARDMWDVGDTPPSY

SEQ ID NO: 77711 - protein, 10 aa, Homo sapiens
  light chain complementarity determining region 3 for antibody 38856
QKYGSSPLFT

SEQ ID NO: 77712 - protein, 14 aa, Homo sapiens
  heavy chain complementarity determining region 3 for antibody 38856
VRPRHVVVNWYIDS

SEQ ID NO: 77713 - protein, 8 aa, Homo sapiens
  light chain complementarity determining region 3 for antibody 38857
QKYGSSPL

SEQ ID NO: 77714 - protein, 14 aa, Homo sapiens
  heavy chain complementarity determining region 3 for antibody 38857
ARGMWDVGDTPPSY

SEQ ID NO: 77715 - protein, 8 aa, Homo sapiens
  light chain complementarity determining region 3 for antibody 38858
QKYGRSPL

SEQ ID NO: 77716 - protein, 14 aa, Homo sapiens
  heavy chain complementarity determining region 3 for antibody 38858
ARDMWDVGDTPPSY

SEQ ID NO: 77717 - protein, 9 aa, Homo sapiens
  light chain complementarity determining region 3 for antibody 38859
QKYGNSPFT

SEQ ID NO: 77718 - protein, 15 aa, Homo sapiens
  heavy chain complementarity determining region 3 for antibody 38859
ARQKGQRASAGYFDS

SEQ ID NO: 77719 - protein, 11 aa, Homo sapiens
  light chain complementarity determining region 3 for antibody 38860
QKYDTGPPGLS

SEQ ID NO: 77720 - protein, 11 aa, Homo sapiens
  heavy chain complementarity determining region 3 for antibody 38860
VSARGGNYFDY

SEQ ID NO: 77721 - protein, 11 aa, Homo sapiens
  light chain complementarity determining region 3 for antibody 38861
QKYDTCPPGLT

SEQ ID NO: 77722 - protein, 11 aa, Homo sapiens
  heavy chain complementarity determining region 3 for antibody 38861
VSARGGNYFDY

SEQ ID NO: 77723 - protein, 9 aa, Homo sapiens
  light chain complementarity determining region 3 for antibody 38862
QKYDSVPLP

SEQ ID NO: 77724 - protein, 16 aa, Homo sapiens
  heavy chain complementarity determining region 3 for antibody 38862
ARKPAPDTSGSYPLDY

SEQ ID NO: 77725 - protein, 9 aa, Homo sapiens
  light chain complementarity determining region 3 for antibody 38863
QKYDSAPPT

SEQ ID NO: 77726 - protein, 16 aa, Homo sapiens
  heavy chain complementarity determining region 3 for antibody 38863
AKSHPTAGTGPHFCDY

SEQ ID NO: 77727 - protein, 9 aa, Homo sapiens
  light chain complementarity determining region 3 for antibody 38864
QKYDGAPWT

SEQ ID NO: 77728 - protein, 9 aa, Homo sapiens
  heavy chain complementarity determining region 3 for antibody 38864
MGRNGGTED

SEQ ID NO: 77729 - protein, 9 aa, Homo sapiens
  light chain complementarity determining region 3 for antibody 38865
QKYDGAPWP

SEQ ID NO: 77730 - protein, 9 aa, Homo sapiens
  heavy chain complementarity determining region 3 for antibody 38865
MGRNGGTVD

SEQ ID NO: 77731 - protein, 9 aa, Homo sapiens
  light chain complementarity determining region 3 for antibody 38866
QKYAGSPGT

SEQ ID NO: 77732 - protein, 8 aa, Homo sapiens
  heavy chain complementarity determining region 3 for antibody 38866
ARGLSLDS

SEQ ID NO: 77733 - protein, 9 aa, Homo sapiens
  light chain complementarity determining region 3 for antibody 38867
QKVISYPFT

SEQ ID NO: 77734 - protein, 12 aa, Homo sapiens
  heavy chain complementarity determining region 3 for antibody 38867
ARPLDGDHGFDP

SEQ ID NO: 77735 - protein, 9 aa, Homo sapiens
  light chain complementarity determining region 3 for antibody 38868
QKTYTTPRT

SEQ ID NO: 77736 - protein, 15 aa, Homo sapiens
  heavy chain complementarity determining region 3 for antibody 38868
TNGETQTTYRDAFDI

SEQ ID NO: 77737 - protein, 9 aa, Homo sapiens
  light chain complementarity determining region 3 for antibody 38869
QKSNSAPLT

SEQ ID NO: 77738 - protein, 11 aa, Homo sapiens
  heavy chain complementarity determining region 3 for antibody 38869
ATKFKGAPLEY

SEQ ID NO: 77739 - protein, 9 aa, Homo sapiens
  light chain complementarity determining region 3 for antibody 38870
QKRSSWPYT

SEQ ID NO: 77740 - protein, 11 aa, Homo sapiens
  heavy chain complementarity determining region 3 for antibody 38870
VKRWGGSSIDY

SEQ ID NO: 77741 - protein, 9 aa, Homo sapiens
  light chain complementarity determining region 3 for antibody 38871
QKNNSYSET

SEQ ID NO: 77742 - protein, 8 aa, Homo sapiens
  heavy chain complementarity determining region 3 for antibody 38871
ATSPTLGY

SEQ ID NO: 77743 - protein, 9 aa, Homo sapiens
  light chain complementarity determining region 3 for antibody 38872
QKNNSAPLT

SEQ ID NO: 77744 - protein, 11 aa, Homo sapiens
  heavy chain complementarity determining region 3 for antibody 38872
ATKFKGAPLEY

SEQ ID NO: 77745 - protein, 9 aa, Homo sapiens
  light chain complementarity determining region 3 for antibody 38873
QKNNSAPLT

SEQ ID NO: 77746 - protein, 11 aa, Homo sapiens
  heavy chain complementarity determining region 3 for antibody 38873
ATKFKGAPLDY

SEQ ID NO: 77747 - protein, 8 aa, Homo sapiens
  light chain complementarity determining region 3 for antibody 38874
QKNGGSPS

SEQ ID NO: 77748 - protein, 16 aa, Homo sapiens
  heavy chain complementarity determining region 3 for antibody 38874
ATDWGSGTQWIRAFDV

SEQ ID NO: 77749 - protein, 9 aa, Homo sapiens
  light chain complementarity determining region 3 for antibody 38875
QKHTSAPFT

SEQ ID NO: 77750 - protein, 20 aa, Homo sapiens
  heavy chain complementarity determining region 3 for antibody 38875
AKDGYCSSGSCSILVYGMDV

SEQ ID NO: 77751 - protein, 9 aa, Homo sapiens
  light chain complementarity determining region 3 for antibody 38876
QKHNSGPRT

SEQ ID NO: 77752 - protein, 15 aa, Homo sapiens
  heavy chain complementarity determining region 3 for antibody 38876
ARARLFGVVAYYCDS

SEQ ID NO: 77753 - protein, 9 aa, Homo sapiens
  light chain complementarity determining region 3 for antibody 38877
QKHNSAPRT

SEQ ID NO: 77754 - protein, 11 aa, Homo sapiens
  heavy chain complementarity determining region 3 for antibody 38877
ARDAAYSCFDY

SEQ ID NO: 77755 - protein, 11 aa, Homo sapiens
  light chain complementarity determining region 3 for antibody 38878
QKHGTAPPGIA

SEQ ID NO: 77756 - protein, 12 aa, Homo sapiens
  heavy chain complementarity determining region 3 for antibody 38878
AKKIGNFDVLDV

SEQ ID NO: 77757 - protein, 8 aa, Homo sapiens
  light chain complementarity determining region 3 for antibody 38879
QKGYNWVI

SEQ ID NO: 77758 - protein, 21 aa, Homo sapiens
  heavy chain complementarity determining region 3 for antibody 38879
ARNDPDNTQGGHTSGNKYLDQ

SEQ ID NO: 77759 - protein, 9 aa, Homo sapiens
  light chain complementarity determining region 3 for antibody 38880
QKDYSALLT

SEQ ID NO: 77760 - protein, 17 aa, Homo sapiens
  heavy chain complementarity determining region 3 for antibody 38880
ARDRHYYGSGNYYPFDY

SEQ ID NO: 77761 - protein, 9 aa, Homo sapiens
  light chain complementarity determining region 3 for antibody 38881
QKDNSAPQT

SEQ ID NO: 77762 - protein, 13 aa, Homo sapiens
  heavy chain complementarity determining region 3 for antibody 38881
ARDRLVGKALLDY

SEQ ID NO: 77763 - protein, 9 aa, Homo sapiens
  light chain complementarity determining region 3 for antibody 38882
QKDNSAPLT

SEQ ID NO: 77764 - protein, 20 aa, Homo sapiens
  heavy chain complementarity determining region 3 for antibody 38882
ATVLRGRGSSVYYVGGAFDI

SEQ ID NO: 77765 - protein, 9 aa, Homo sapiens
  light chain complementarity determining region 3 for antibody 38883
QKDDSAPFT

SEQ ID NO: 77766 - protein, 15 aa, Homo sapiens
  heavy chain complementarity determining region 3 for antibody 38883
ARDNPPPFLDDLYNY

SEQ ID NO: 77767 - protein, 9 aa, Homo sapiens
  light chain complementarity determining region 3 for antibody 38884
QHYYTYPLT

SEQ ID NO: 77768 - protein, 15 aa, Homo sapiens
  heavy chain complementarity determining region 3 for antibody 38884
AHGAWVRGVTSRFDY

SEQ ID NO: 77769 - protein, 9 aa, Homo sapiens
  light chain complementarity determining region 3 for antibody 38885
QHYYTSLRP

SEQ ID NO: 77770 - protein, 12 aa, Homo sapiens
  heavy chain complementarity determining region 3 for antibody 38885
VKDCGLGGSRDS

SEQ ID NO: 77771 - protein, 9 aa, Homo sapiens
  light chain complementarity determining region 3 for antibody 38886
QHYYSSPIT

SEQ ID NO: 77772 - protein, 21 aa, Homo sapiens
  heavy chain complementarity determining region 3 for antibody 38886
AKDAGLSIFRYFDGLFDAFHI

SEQ ID NO: 77773 - protein, 8 aa, Homo sapiens
  light chain complementarity determining region 3 for antibody 38887
QHYYSPPS

SEQ ID NO: 77774 - protein, 16 aa, Homo sapiens
  heavy chain complementarity determining region 3 for antibody 38887
ARRGMWELSDADAFDV

SEQ ID NO: 77775 - protein, 9 aa, Homo sapiens
  light chain complementarity determining region 3 for antibody 38888
QHYYSIPLT

SEQ ID NO: 77776 - protein, 5 aa, Homo sapiens
  heavy chain complementarity determining region 3 for antibody 38888
GPPPY

SEQ ID NO: 77777 - protein, 10 aa, Homo sapiens
  light chain complementarity determining region 3 for antibody 38889
QHYYNWPPWT

SEQ ID NO: 77778 - protein, 13 aa, Homo sapiens
  heavy chain complementarity determining region 3 for antibody 38889
AKGRVRELYYFET

SEQ ID NO: 77779 - protein, 9 aa, Homo sapiens
  light chain complementarity determining region 3 for antibody 38890
QHYYNTPRT

SEQ ID NO: 77780 - protein, 14 aa, Homo sapiens
  heavy chain complementarity determining region 3 for antibody 38890
TRQTYYDFWSAYDY

SEQ ID NO: 77781 - protein, 9 aa, Homo sapiens
  light chain complementarity determining region 3 for antibody 38891
QHYYNTPQP

SEQ ID NO: 77782 - protein, 14 aa, Homo sapiens
  heavy chain complementarity determining region 3 for antibody 38891
TRQTYYDFWSAYDY

SEQ ID NO: 77783 - protein, 9 aa, Homo sapiens
  light chain complementarity determining region 3 for antibody 38892
QHYYNSPYN

SEQ ID NO: 77784 - protein, 19 aa, Homo sapiens
  heavy chain complementarity determining region 3 for antibody 38892
ARLLSDSGGWFAGSYYFDH

SEQ ID NO: 77785 - protein, 9 aa, Homo sapiens
  light chain complementarity determining region 3 for antibody 38893
QHYYITPQT

SEQ ID NO: 77786 - protein, 14 aa, Homo sapiens
  heavy chain complementarity determining region 3 for antibody 38893
TRQTYYDFWSAYDY

SEQ ID NO: 77787 - protein, 9 aa, Homo sapiens
  light chain complementarity determining region 3 for antibody 38894
QHYYISLRT

SEQ ID NO: 77788 - protein, 12 aa, Homo sapiens
  heavy chain complementarity determining region 3 for antibody 38894
VKDCGLGGSRDS

SEQ ID NO: 77789 - protein, 11 aa, Homo sapiens
  light chain complementarity determining region 3 for antibody 38895
QHYVNSPIMYT

SEQ ID NO: 77790 - protein, 12 aa, Homo sapiens
  heavy chain complementarity determining region 3 for antibody 38895
ARHIAGSNAFDY

SEQ ID NO: 77791 - protein, 10 aa, Homo sapiens
  light chain complementarity determining region 3 for antibody 38896
QHYVDSPLFT

SEQ ID NO: 77792 - protein, 13 aa, Homo sapiens
  heavy chain complementarity determining region 3 for antibody 38896
ARGARFSGWYGDY

SEQ ID NO: 77793 - protein, 10 aa, Homo sapiens
  light chain complementarity determining region 3 for antibody 38897
QHYVDSPLFT

SEQ ID NO: 77794 - protein, 13 aa, Homo sapiens
  heavy chain complementarity determining region 3 for antibody 38897
ARGAKFSGWCGDY

SEQ ID NO: 77795 - protein, 8 aa, Homo sapiens
  light chain complementarity determining region 3 for antibody 38898
QHYSYLFT

SEQ ID NO: 77796 - protein, 19 aa, Homo sapiens
  heavy chain complementarity determining region 3 for antibody 38898
ARVGLTYYYESSGSGYFDL

SEQ ID NO: 77797 - protein, 11 aa, Homo sapiens
  light chain complementarity determining region 3 for antibody 38899
QHYSTSSLSLP

SEQ ID NO: 77798 - protein, 16 aa, Homo sapiens
  heavy chain complementarity determining region 3 for antibody 38899
ARFFLAGYSWYEGVDY

SEQ ID NO: 77799 - protein, 11 aa, Homo sapiens
  light chain complementarity determining region 3 for antibody 38900
QHYSTSSLPLP

SEQ ID NO: 77800 - protein, 16 aa, Homo sapiens
  heavy chain complementarity determining region 3 for antibody 38900
ARFFLAGYSWYEGVDY

SEQ ID NO: 77801 - protein, 11 aa, Homo sapiens
  light chain complementarity determining region 3 for antibody 38901
QHYSTSSLALT

SEQ ID NO: 77802 - protein, 16 aa, Homo sapiens
  heavy chain complementarity determining region 3 for antibody 38901
ARFLLAGYSWYEGVDY

SEQ ID NO: 77803 - protein, 11 aa, Homo sapiens
  light chain complementarity determining region 3 for antibody 38902
QHYSTSSLAFT

SEQ ID NO: 77804 - protein, 16 aa, Homo sapiens
  heavy chain complementarity determining region 3 for antibody 38902
ARFFLAGYSWYEGVDY

SEQ ID NO: 77805 - protein, 11 aa, Homo sapiens
  light chain complementarity determining region 3 for antibody 38903
QHYSTPSLALT

SEQ ID NO: 77806 - protein, 16 aa, Homo sapiens
  heavy chain complementarity determining region 3 for antibody 38903
ARFFLAGYSWYEGVDY

SEQ ID NO: 77807 - protein, 8 aa, Homo sapiens
  light chain complementarity determining region 3 for antibody 38904
QHYSSYPT

SEQ ID NO: 77808 - protein, 17 aa, Homo sapiens
  heavy chain complementarity determining region 3 for antibody 38904
ARRLLYSRYDGGYFFAS

SEQ ID NO: 77809 - protein, 10 aa, Homo sapiens
  light chain complementarity determining region 3 for antibody 38905
QHYSSSISYT

SEQ ID NO: 77810 - protein, 15 aa, Homo sapiens
  heavy chain complementarity determining region 3 for antibody 38905
ARGRYDSGGWGYFQL

SEQ ID NO: 77811 - protein, 9 aa, Homo sapiens
  light chain complementarity determining region 3 for antibody 38906
QHYSNLPFT

SEQ ID NO: 77812 - protein, 18 aa, Homo sapiens
  heavy chain complementarity determining region 3 for antibody 38906
ATRGANCGGDCYYWYFDL

SEQ ID NO: 77813 - protein, 6 aa, Homo sapiens
  light chain complementarity determining region 3 for antibody 38907
QHYSET

SEQ ID NO: 77814 - protein, 8 aa, Homo sapiens
  heavy chain complementarity determining region 3 for antibody 38907
ATSPQRGS

SEQ ID NO: 77815 - protein, 8 aa, Homo sapiens
  light chain complementarity determining region 3 for antibody 38908
QHYSDFNT

SEQ ID NO: 77816 - protein, 17 aa, Homo sapiens
  heavy chain complementarity determining region 3 for antibody 38908
AHRRYYNGNWNGATFDV

SEQ ID NO: 77817 - protein, 9 aa, Homo sapiens
  light chain complementarity determining region 3 for antibody 38909
QHYRREPYT

SEQ ID NO: 77818 - protein, 16 aa, Homo sapiens
  heavy chain complementarity determining region 3 for antibody 38909
ARDQGFCRGPNCYMLF

SEQ ID NO: 77819 - protein, 9 aa, Homo sapiens
  light chain complementarity determining region 3 for antibody 38910
QHYRRAPYT

SEQ ID NO: 77820 - protein, 16 aa, Homo sapiens
  heavy chain complementarity determining region 3 for antibody 38910
ARDQGFCRGPNCYMRF

SEQ ID NO: 77821 - protein, 9 aa, Homo sapiens
  light chain complementarity determining region 3 for antibody 38911
QHYRRAPYT

SEQ ID NO: 77822 - protein, 16 aa, Homo sapiens
  heavy chain complementarity determining region 3 for antibody 38911
ARDQGFCRGPNCYMHF

SEQ ID NO: 77823 - protein, 9 aa, Homo sapiens
  light chain complementarity determining region 3 for antibody 38912
QHYRRAPDT

SEQ ID NO: 77824 - protein, 16 aa, Homo sapiens
  heavy chain complementarity determining region 3 for antibody 38912
ARDQGFCRGPNCYMLF

SEQ ID NO: 77825 - protein, 9 aa, Homo sapiens
  light chain complementarity determining region 3 for antibody 38913
QHYPNWPYT

SEQ ID NO: 77826 - protein, 19 aa, Homo sapiens
  heavy chain complementarity determining region 3 for antibody 38913
ARDLWDCYGSGSCFDAFDF

SEQ ID NO: 77827 - protein, 9 aa, Homo sapiens
  light chain complementarity determining region 3 for antibody 38914
QHYNTYSET

SEQ ID NO: 77828 - protein, 8 aa, Homo sapiens
  heavy chain complementarity determining region 3 for antibody 38914
ATSPQRGY

SEQ ID NO: 77829 - protein, 9 aa, Homo sapiens
  light chain complementarity determining region 3 for antibody 38915
QHYNTYPWT

SEQ ID NO: 77830 - protein, 17 aa, Homo sapiens
  heavy chain complementarity determining region 3 for antibody 38915
ARTIYDTSWSSLGYFDY

SEQ ID NO: 77831 - protein, 9 aa, Homo sapiens
  light chain complementarity determining region 3 for antibody 38916
QHYNTIYGT

SEQ ID NO: 77832 - protein, 21 aa, Homo sapiens
  heavy chain complementarity determining region 3 for antibody 38916
ARDAPVSRPYSSGWYSSAFDY

SEQ ID NO: 77833 - protein, 9 aa, Homo sapiens
  light chain complementarity determining region 3 for antibody 38917
QHYNSYSET

SEQ ID NO: 77834 - protein, 8 aa, Homo sapiens
  heavy chain complementarity determining region 3 for antibody 38917
ATSPQRGS

SEQ ID NO: 77835 - protein, 9 aa, Homo sapiens
  light chain complementarity determining region 3 for antibody 38918
QHYNSVPLP

SEQ ID NO: 77836 - protein, 10 aa, Homo sapiens
  heavy chain complementarity determining region 3 for antibody 38918
ARDVVGSDDQ

SEQ ID NO: 77837 - protein, 9 aa, Homo sapiens
  light chain complementarity determining region 3 for antibody 38919
QHYNSLPFS

SEQ ID NO: 77838 - protein, 16 aa, Homo sapiens
  heavy chain complementarity determining region 3 for antibody 38919
AKAGRVCSGGSCYVDS

SEQ ID NO: 77839 - protein, 10 aa, Homo sapiens
  light chain complementarity determining region 3 for antibody 38920
QHYNSISTWT

SEQ ID NO: 77840 - protein, 11 aa, Homo sapiens
  heavy chain complementarity determining region 3 for antibody 38920
ARNPEQWYFDL

SEQ ID NO: 77841 - protein, 9 aa, Homo sapiens
  light chain complementarity determining region 3 for antibody 38921
QHYNSFPLT

SEQ ID NO: 77842 - protein, 17 aa, Homo sapiens
  heavy chain complementarity determining region 3 for antibody 38921
ARVSYSHSGTYYRFFDS

SEQ ID NO: 77843 - protein, 9 aa, Homo sapiens
  light chain complementarity determining region 3 for antibody 38922
QHYNNWPYT

SEQ ID NO: 77844 - protein, 15 aa, Homo sapiens
  heavy chain complementarity determining region 3 for antibody 38922
KRGGTSGSPGGPFDL

SEQ ID NO: 77845 - protein, 9 aa, Homo sapiens
  light chain complementarity determining region 3 for antibody 38923
QHYNNWPYT

SEQ ID NO: 77846 - protein, 19 aa, Homo sapiens
  heavy chain complementarity determining region 3 for antibody 38923
ARDLWDCYGSGSCFDAFDF

SEQ ID NO: 77847 - protein, 10 aa, Homo sapiens
  light chain complementarity determining region 3 for antibody 38924
QHYNNWPSVT

SEQ ID NO: 77848 - protein, 11 aa, Homo sapiens
  heavy chain complementarity determining region 3 for antibody 38924
TRDDYGGGADY

SEQ ID NO: 77849 - protein, 10 aa, Homo sapiens
  light chain complementarity determining region 3 for antibody 38925
QHYNNWPSLT

SEQ ID NO: 77850 - protein, 11 aa, Homo sapiens
  heavy chain complementarity determining region 3 for antibody 38925
TRDDYGGGADY

SEQ ID NO: 77851 - protein, 10 aa, Homo sapiens
  light chain complementarity determining region 3 for antibody 38926
QHYNNWPSFT

SEQ ID NO: 77852 - protein, 11 aa, Homo sapiens
  heavy chain complementarity determining region 3 for antibody 38926
PRDDYGGGADY

SEQ ID NO: 77853 - protein, 8 aa, Homo sapiens
  light chain complementarity determining region 3 for antibody 38927
QHYNNWPS

SEQ ID NO: 77854 - protein, 16 aa, Homo sapiens
  heavy chain complementarity determining region 3 for antibody 38927
ARIYDNSGPLLGCFNI

SEQ ID NO: 77855 - protein, 11 aa, Homo sapiens
  light chain complementarity determining region 3 for antibody 38928
QHYNNWPPVLP

SEQ ID NO: 77856 - protein, 11 aa, Homo sapiens
  heavy chain complementarity determining region 3 for antibody 38928
ARFLANSGLDY

SEQ ID NO: 77857 - protein, 10 aa, Homo sapiens
  light chain complementarity determining region 3 for antibody 38929
QHYNNWPPLT

SEQ ID NO: 77858 - protein, 15 aa, Homo sapiens
  heavy chain complementarity determining region 3 for antibody 38929
AKEPDCGRNCLFFDS

SEQ ID NO: 77859 - protein, 9 aa, Homo sapiens
  light chain complementarity determining region 3 for antibody 38930
QHYNNWPNT

SEQ ID NO: 77860 - protein, 15 aa, Homo sapiens
  heavy chain complementarity determining region 3 for antibody 38930
KRGGTSGSPGVPFDL

SEQ ID NO: 77861 - protein, 9 aa, Homo sapiens
  light chain complementarity determining region 3 for antibody 38931
QHYNNIYGT

SEQ ID NO: 77862 - protein, 14 aa, Homo sapiens
  heavy chain complementarity determining region 3 for antibody 38931
VRASGSNLQPPFDF

SEQ ID NO: 77863 - protein, 9 aa, Homo sapiens
  light chain complementarity determining region 3 for antibody 38932
QHYNNIYGT

SEQ ID NO: 77864 - protein, 21 aa, Homo sapiens
  heavy chain complementarity determining region 3 for antibody 38932
GRDAPVSRPYSSGWYSSAFDY

SEQ ID NO: 77865 - protein, 9 aa, Homo sapiens
  light chain complementarity determining region 3 for antibody 38933
QHYNIYSKT

SEQ ID NO: 77866 - protein, 8 aa, Homo sapiens
  heavy chain complementarity determining region 3 for antibody 38933
ATSPQRGS

SEQ ID NO: 77867 - protein, 9 aa, Homo sapiens
  light chain complementarity determining region 3 for antibody 38934
QHYNIYSET

SEQ ID NO: 77868 - protein, 8 aa, Homo sapiens
  heavy chain complementarity determining region 3 for antibody 38934
ATAPQRGS

SEQ ID NO: 77869 - protein, 9 aa, Homo sapiens
  light chain complementarity determining region 3 for antibody 38935
QHYNGYLWT

SEQ ID NO: 77870 - protein, 14 aa, Homo sapiens
  heavy chain complementarity determining region 3 for antibody 38935
MIRGHSYDFDPRPF

SEQ ID NO: 77871 - protein, 9 aa, Homo sapiens
  light chain complementarity determining region 3 for antibody 38936
QHYNGLLWP

SEQ ID NO: 77872 - protein, 13 aa, Homo sapiens
  heavy chain complementarity determining region 3 for antibody 38936
ARGQSGDPRTYDY

SEQ ID NO: 77873 - protein, 9 aa, Homo sapiens
  light chain complementarity determining region 3 for antibody 38937
QHYNGDPWT

SEQ ID NO: 77874 - protein, 12 aa, Homo sapiens
  heavy chain complementarity determining region 3 for antibody 38937
VRTVTAHDVFDI

SEQ ID NO: 77875 - protein, 9 aa, Homo sapiens
  light chain complementarity determining region 3 for antibody 38938
QHYNGDPGT

SEQ ID NO: 77876 - protein, 12 aa, Homo sapiens
  heavy chain complementarity determining region 3 for antibody 38938
VRTVTAHDVFDM

SEQ ID NO: 77877 - protein, 9 aa, Homo sapiens
  light chain complementarity determining region 3 for antibody 38939
QHYNGDPGT

SEQ ID NO: 77878 - protein, 12 aa, Homo sapiens
  heavy chain complementarity determining region 3 for antibody 38939
VRTVTAHDVFDI

SEQ ID NO: 77879 - protein, 9 aa, Homo sapiens
  light chain complementarity determining region 3 for antibody 38940
QHYNASSWS

SEQ ID NO: 77880 - protein, 16 aa, Homo sapiens
  heavy chain complementarity determining region 3 for antibody 38940
ASLGGAHYYGPGSHYF

SEQ ID NO: 77881 - protein, 10 aa, Homo sapiens
  light chain complementarity determining region 3 for antibody 38941
QHYHYWPPWT

SEQ ID NO: 77882 - protein, 13 aa, Homo sapiens
  heavy chain complementarity determining region 3 for antibody 38941
AKGRVRELYYFEP

SEQ ID NO: 77883 - protein, 9 aa, Homo sapiens
  light chain complementarity determining region 3 for antibody 38942
QHYHYLPFT

SEQ ID NO: 77884 - protein, 24 aa, Homo sapiens
  heavy chain complementarity determining region 3 for antibody 38942
AASKIITITYGRLTVHGQSDSLDI

SEQ ID NO: 77885 - protein, 9 aa, Homo sapiens
  light chain complementarity determining region 3 for antibody 38943
QHYHRAPRT

SEQ ID NO: 77886 - protein, 7 aa, Homo sapiens
  heavy chain complementarity determining region 3 for antibody 38943
ALPAVDY

SEQ ID NO: 77887 - protein, 9 aa, Homo sapiens
  light chain complementarity determining region 3 for antibody 38944
QHYHNWPYT

SEQ ID NO: 77888 - protein, 19 aa, Homo sapiens
  heavy chain complementarity determining region 3 for antibody 38944
ARDLWDCYGSGSCFDAFDL

SEQ ID NO: 77889 - protein, 9 aa, Homo sapiens
  light chain complementarity determining region 3 for antibody 38945
QHYHNWPRT

SEQ ID NO: 77890 - protein, 16 aa, Homo sapiens
  heavy chain complementarity determining region 3 for antibody 38945
AKDGGDYYDSFEYFHY

SEQ ID NO: 77891 - protein, 9 aa, Homo sapiens
  light chain complementarity determining region 3 for antibody 38946
QHYHNWPRT

SEQ ID NO: 77892 - protein, 16 aa, Homo sapiens
  heavy chain complementarity determining region 3 for antibody 38946
AKDGGDYYDSFESFQY

SEQ ID NO: 77893 - protein, 9 aa, Homo sapiens
  light chain complementarity determining region 3 for antibody 38947
QHYHNWPRT

SEQ ID NO: 77894 - protein, 16 aa, Homo sapiens
  heavy chain complementarity determining region 3 for antibody 38947
AKDGGDCYDSFEYFQY

SEQ ID NO: 77895 - protein, 10 aa, Homo sapiens
  light chain complementarity determining region 3 for antibody 38948
QHYHNWPPWS

SEQ ID NO: 77896 - protein, 13 aa, Homo sapiens
  heavy chain complementarity determining region 3 for antibody 38948
AKGRVRELYYFET

SEQ ID NO: 77897 - protein, 10 aa, Homo sapiens
  light chain complementarity determining region 3 for antibody 38949
QHYHNWPPWK

SEQ ID NO: 77898 - protein, 13 aa, Homo sapiens
  heavy chain complementarity determining region 3 for antibody 38949
AKGRVRELYYFET

SEQ ID NO: 77899 - protein, 10 aa, Homo sapiens
  light chain complementarity determining region 3 for antibody 38950
QHYHNWPPVT

SEQ ID NO: 77900 - protein, 13 aa, Homo sapiens
  heavy chain complementarity determining region 3 for antibody 38950
AKGRVRELYYFET

SEQ ID NO: 77901 - protein, 10 aa, Homo sapiens
  light chain complementarity determining region 3 for antibody 38951
QHYHNWPPGA

SEQ ID NO: 77902 - protein, 13 aa, Homo sapiens
  heavy chain complementarity determining region 3 for antibody 38951
AKGRVRELYYFET

SEQ ID NO: 77903 - protein, 10 aa, Homo sapiens
  light chain complementarity determining region 3 for antibody 38952
QHYHNRPPWA

SEQ ID NO: 77904 - protein, 13 aa, Homo sapiens
  heavy chain complementarity determining region 3 for antibody 38952
AKGRVRELYYFET

SEQ ID NO: 77905 - protein, 10 aa, Homo sapiens
  light chain complementarity determining region 3 for antibody 38953
QHYHNRPPRT

SEQ ID NO: 77906 - protein, 13 aa, Homo sapiens
  heavy chain complementarity determining region 3 for antibody 38953
AKGRVRELYYFEP

SEQ ID NO: 77907 - protein, 10 aa, Homo sapiens
  light chain complementarity determining region 3 for antibody 38954
QHYHNLPPRT

SEQ ID NO: 77908 - protein, 13 aa, Homo sapiens
  heavy chain complementarity determining region 3 for antibody 38954
AKGRVRELYYFET

SEQ ID NO: 77909 - protein, 10 aa, Homo sapiens
  light chain complementarity determining region 3 for antibody 38955
QHYHNCPPWT

SEQ ID NO: 77910 - protein, 13 aa, Homo sapiens
  heavy chain complementarity determining region 3 for antibody 38955
AKGRVRELYYFET

SEQ ID NO: 77911 - protein, 9 aa, Homo sapiens
  light chain complementarity determining region 3 for antibody 38956
QHYGTSPFT

SEQ ID NO: 77912 - protein, 14 aa, Homo sapiens
  heavy chain complementarity determining region 3 for antibody 38956
ARGGPAATSSSWVY

SEQ ID NO: 77913 - protein, 8 aa, Homo sapiens
  light chain complementarity determining region 3 for antibody 38957
QHYGTSGT

SEQ ID NO: 77914 - protein, 15 aa, Homo sapiens
  heavy chain complementarity determining region 3 for antibody 38957
ARGEYNFIYYFAMDV

SEQ ID NO: 77915 - protein, 8 aa, Homo sapiens
  light chain complementarity determining region 3 for antibody 38958
QHYGTSAT

SEQ ID NO: 77916 - protein, 18 aa, Homo sapiens
  heavy chain complementarity determining region 3 for antibody 38958
ARWGGYCSSSSCYWQFDY

SEQ ID NO: 77917 - protein, 8 aa, Homo sapiens
  light chain complementarity determining region 3 for antibody 38959
QHYGSSRT

SEQ ID NO: 77918 - protein, 15 aa, Homo sapiens
  heavy chain complementarity determining region 3 for antibody 38959
AREVTSPSQSYPFDV

SEQ ID NO: 77919 - protein, 9 aa, Homo sapiens
  light chain complementarity determining region 3 for antibody 38960
QHYGSSPWT

SEQ ID NO: 77920 - protein, 15 aa, Homo sapiens
  heavy chain complementarity determining region 3 for antibody 38960
ARRTSSWYADWYFDL

SEQ ID NO: 77921 - protein, 9 aa, Homo sapiens
  light chain complementarity determining region 3 for antibody 38961
QHYGSSPST

SEQ ID NO: 77922 - protein, 13 aa, Homo sapiens
  heavy chain complementarity determining region 3 for antibody 38961
ARDGQWLVRYFDY

SEQ ID NO: 77923 - protein, 10 aa, Homo sapiens
  light chain complementarity determining region 3 for antibody 38962
QHYGSSPRFP

SEQ ID NO: 77924 - protein, 21 aa, Homo sapiens
  heavy chain complementarity determining region 3 for antibody 38962
VRDGGENSAWSSRLYYCGMDV

SEQ ID NO: 77925 - protein, 10 aa, Homo sapiens
  light chain complementarity determining region 3 for antibody 38963
QHYGSSPPYT

SEQ ID NO: 77926 - protein, 10 aa, Homo sapiens
  heavy chain complementarity determining region 3 for antibody 38963
ARDWRYNIDD

SEQ ID NO: 77927 - protein, 9 aa, Homo sapiens
  light chain complementarity determining region 3 for antibody 38964
QHYGSSPPT

SEQ ID NO: 77928 - protein, 12 aa, Homo sapiens
  heavy chain complementarity determining region 3 for antibody 38964
ARDTGDFEVQVS

SEQ ID NO: 77929 - protein, 11 aa, Homo sapiens
  light chain complementarity determining region 3 for antibody 38965
QHYGSSPPRVT

SEQ ID NO: 77930 - protein, 28 aa, Homo sapiens
  heavy chain complementarity determining region 3 for antibody 38965
ARGAKKEKLIFVRPRARGGDPRHWYFDL

SEQ ID NO: 77931 - protein, 11 aa, Homo sapiens
  light chain complementarity determining region 3 for antibody 38966
QHYGSSPPRGT

SEQ ID NO: 77932 - protein, 28 aa, Homo sapiens
  heavy chain complementarity determining region 3 for antibody 38966
ARGAKKEKLIFVRPRDRGGDTRHWYFDL

SEQ ID NO: 77933 - protein, 10 aa, Homo sapiens
  light chain complementarity determining region 3 for antibody 38967
QHYGSSPMYS

SEQ ID NO: 77934 - protein, 11 aa, Homo sapiens
  heavy chain complementarity determining region 3 for antibody 38967
ARGGQWGSLDY

SEQ ID NO: 77935 - protein, 9 aa, Homo sapiens
  light chain complementarity determining region 3 for antibody 38968
QHYGSSPLT

SEQ ID NO: 77936 - protein, 12 aa, Homo sapiens
  heavy chain complementarity determining region 3 for antibody 38968
ARDPGDFEVQVS

SEQ ID NO: 77937 - protein, 8 aa, Homo sapiens
  light chain complementarity determining region 3 for antibody 38969
QHYGSSLT

SEQ ID NO: 77938 - protein, 21 aa, Homo sapiens
  heavy chain complementarity determining region 3 for antibody 38969
ARSATYYDNSGSYGPSEYLHH

SEQ ID NO: 77939 - protein, 10 aa, Homo sapiens
  light chain complementarity determining region 3 for antibody 38970
QHYGSSLRYT

SEQ ID NO: 77940 - protein, 14 aa, Homo sapiens
  heavy chain complementarity determining region 3 for antibody 38970
TTDRPLTGMVTFDF

SEQ ID NO: 77941 - protein, 10 aa, Homo sapiens
  light chain complementarity determining region 3 for antibody 38971
QHYGSSLMYT

SEQ ID NO: 77942 - protein, 14 aa, Homo sapiens
  heavy chain complementarity determining region 3 for antibody 38971
TTDRRLTGMVTFDF

SEQ ID NO: 77943 - protein, 10 aa, Homo sapiens
  light chain complementarity determining region 3 for antibody 38972
QHYGSSLMYT

SEQ ID NO: 77944 - protein, 14 aa, Homo sapiens
  heavy chain complementarity determining region 3 for antibody 38972
TTDRPLTGMVSFDF

SEQ ID NO: 77945 - protein, 10 aa, Homo sapiens
  light chain complementarity determining region 3 for antibody 38973
QHYGSSLMYT

SEQ ID NO: 77946 - protein, 14 aa, Homo sapiens
  heavy chain complementarity determining region 3 for antibody 38973
TTDRPLTGMVAFDF

SEQ ID NO: 77947 - protein, 10 aa, Homo sapiens
  light chain complementarity determining region 3 for antibody 38974
QHYGSSLMYT

SEQ ID NO: 77948 - protein, 14 aa, Homo sapiens
  heavy chain complementarity determining region 3 for antibody 38974
TTDRPLTGMLTFDF

SEQ ID NO: 77949 - protein, 10 aa, Homo sapiens
  light chain complementarity determining region 3 for antibody 38975
QHYGSSLMYT

SEQ ID NO: 77950 - protein, 14 aa, Homo sapiens
  heavy chain complementarity determining region 3 for antibody 38975
TTDRPLTGMGTFDF

SEQ ID NO: 77951 - protein, 10 aa, Homo sapiens
  light chain complementarity determining region 3 for antibody 38976
QHYGSSLMYT

SEQ ID NO: 77952 - protein, 14 aa, Homo sapiens
  heavy chain complementarity determining region 3 for antibody 38976
STDRPLTGMVTFDF

SEQ ID NO: 77953 - protein, 10 aa, Homo sapiens
  light chain complementarity determining region 3 for antibody 38977
QHYGSSLMYL

SEQ ID NO: 77954 - protein, 14 aa, Homo sapiens
  heavy chain complementarity determining region 3 for antibody 38977
TTDRPLTGMVTFDF

SEQ ID NO: 77955 - protein, 10 aa, Homo sapiens
  light chain complementarity determining region 3 for antibody 38978
QHYGSSLLYT

SEQ ID NO: 77956 - protein, 14 aa, Homo sapiens
  heavy chain complementarity determining region 3 for antibody 38978
TTDRPLTGMVPFDF

SEQ ID NO: 77957 - protein, 10 aa, Homo sapiens
  light chain complementarity determining region 3 for antibody 38979
QHYGSSLLDP

SEQ ID NO: 77958 - protein, 14 aa, Homo sapiens
  heavy chain complementarity determining region 3 for antibody 38979
TTDRPLTGMVTFDF

SEQ ID NO: 77959 - protein, 10 aa, Homo sapiens
  light chain complementarity determining region 3 for antibody 38980
QHYGSSIMYT

SEQ ID NO: 77960 - protein, 14 aa, Homo sapiens
  heavy chain complementarity determining region 3 for antibody 38980
TTDRPLTGMVTFDF

SEQ ID NO: 77961 - protein, 10 aa, Homo sapiens
  light chain complementarity determining region 3 for antibody 38981
QHYGSPLMYT

SEQ ID NO: 77962 - protein, 14 aa, Homo sapiens
  heavy chain complementarity determining region 3 for antibody 38981
TTDRPLTGMVTFDF

SEQ ID NO: 77963 - protein, 10 aa, Homo sapiens
  light chain complementarity determining region 3 for antibody 38982
QHYGSLLMYT

SEQ ID NO: 77964 - protein, 14 aa, Homo sapiens
  heavy chain complementarity determining region 3 for antibody 38982
TTDRPLTGMVTFDF

SEQ ID NO: 77965 - protein, 10 aa, Homo sapiens
  light chain complementarity determining region 3 for antibody 38983
QHYGRSPTYS

SEQ ID NO: 77966 - protein, 23 aa, Homo sapiens
  heavy chain complementarity determining region 3 for antibody 38983
ARGLRSSDWSKIMEMDSYYGLDV

SEQ ID NO: 77967 - protein, 10 aa, Homo sapiens
  light chain complementarity determining region 3 for antibody 38984
QHYGRSPSYS

SEQ ID NO: 77968 - protein, 23 aa, Homo sapiens
  heavy chain complementarity determining region 3 for antibody 38984
ARGLRSSDWSKIMEMDSYYGLDV

SEQ ID NO: 77969 - protein, 9 aa, Homo sapiens
  light chain complementarity determining region 3 for antibody 38985
QHYGRSPPT

SEQ ID NO: 77970 - protein, 19 aa, Homo sapiens
  heavy chain complementarity determining region 3 for antibody 38985
AKAFSPHFVSITASGPFDF

SEQ ID NO: 77971 - protein, 8 aa, Homo sapiens
  light chain complementarity determining region 3 for antibody 38986
QHYGPTGT

SEQ ID NO: 77972 - protein, 15 aa, Homo sapiens
  heavy chain complementarity determining region 3 for antibody 38986
ARGEYNFIYYFAMDV

SEQ ID NO: 77973 - protein, 10 aa, Homo sapiens
  light chain complementarity determining region 3 for antibody 38987
QHYGNSPLFI

SEQ ID NO: 77974 - protein, 20 aa, Homo sapiens
  heavy chain complementarity determining region 3 for antibody 38987
VKDAMGAWSHYSERSGYLDA

SEQ ID NO: 77975 - protein, 10 aa, Homo sapiens
  light chain complementarity determining region 3 for antibody 38988
QHYGISPRFT

SEQ ID NO: 77976 - protein, 12 aa, Homo sapiens
  heavy chain complementarity determining region 3 for antibody 38988
ARDVAGATASDF

SEQ ID NO: 77977 - protein, 10 aa, Homo sapiens
  light chain complementarity determining region 3 for antibody 38989
QHYGISPRFP

SEQ ID NO: 77978 - protein, 12 aa, Homo sapiens
  heavy chain complementarity determining region 3 for antibody 38989
ARGVVGATASDF

SEQ ID NO: 77979 - protein, 9 aa, Homo sapiens
  light chain complementarity determining region 3 for antibody 38990
QHYGGSPYT

SEQ ID NO: 77980 - protein, 18 aa, Homo sapiens
  heavy chain complementarity determining region 3 for antibody 38990
ARARWDSYGFGRGWYFDL

SEQ ID NO: 77981 - protein, 9 aa, Homo sapiens
  light chain complementarity determining region 3 for antibody 38991
QHYGGSPST

SEQ ID NO: 77982 - protein, 18 aa, Homo sapiens
  heavy chain complementarity determining region 3 for antibody 38991
ARTRWDSYGFGRGWYFDL

SEQ ID NO: 77983 - protein, 9 aa, Homo sapiens
  light chain complementarity determining region 3 for antibody 38992
QHYGGSPRT

SEQ ID NO: 77984 - protein, 13 aa, Homo sapiens
  heavy chain complementarity determining region 3 for antibody 38992
ASGYFDRSGYYEF

SEQ ID NO: 77985 - protein, 9 aa, Homo sapiens
  light chain complementarity determining region 3 for antibody 38993
QHYGDSPYT

SEQ ID NO: 77986 - protein, 22 aa, Homo sapiens
  heavy chain complementarity determining region 3 for antibody 38993
TRRRPTGRTSLRRGGRQGAFDI

SEQ ID NO: 77987 - protein, 9 aa, Homo sapiens
  light chain complementarity determining region 3 for antibody 38994
QHYFSYPPT

SEQ ID NO: 77988 - protein, 15 aa, Homo sapiens
  heavy chain complementarity determining region 3 for antibody 38994
AKEGQLWSSLDAFDI

SEQ ID NO: 77989 - protein, 9 aa, Homo sapiens
  light chain complementarity determining region 3 for antibody 38995
QHYERSPRM

SEQ ID NO: 77990 - protein, 15 aa, Homo sapiens
  heavy chain complementarity determining region 3 for antibody 38995
ARDGNVLSTGYPLDS

SEQ ID NO: 77991 - protein, 9 aa, Homo sapiens
  light chain complementarity determining region 3 for antibody 38996
QHYDSSTYT

SEQ ID NO: 77992 - protein, 14 aa, Homo sapiens
  heavy chain complementarity determining region 3 for antibody 38996
AREGARYSSSWFDS

SEQ ID NO: 77993 - protein, 9 aa, Homo sapiens
  light chain complementarity determining region 3 for antibody 38997
QHYDSLLYT

SEQ ID NO: 77994 - protein, 13 aa, Homo sapiens
  heavy chain complementarity determining region 3 for antibody 38997
AREPRSLTGYIDY

SEQ ID NO: 77995 - protein, 8 aa, Homo sapiens
  light chain complementarity determining region 3 for antibody 38998
QHYDNSRA

SEQ ID NO: 77996 - protein, 13 aa, Homo sapiens
  heavy chain complementarity determining region 3 for antibody 38998
AISRGSLTTCEDY

SEQ ID NO: 77997 - protein, 11 aa, Homo sapiens
  light chain complementarity determining region 3 for antibody 38999
QHYDNSPIMFP

SEQ ID NO: 77998 - protein, 12 aa, Homo sapiens
  heavy chain complementarity determining region 3 for antibody 38999
ARHIAGSNAFDY

SEQ ID NO: 77999 - protein, 9 aa, Homo sapiens
  light chain complementarity determining region 3 for antibody 39000
QHYDNLSRT

SEQ ID NO: 78000 - protein, 18 aa, Homo sapiens
  heavy chain complementarity determining region 3 for antibody 39000
TRDLSPQMAPFRDDAFDI

SEQ ID NO: 78001 - protein, 9 aa, Homo sapiens
  light chain complementarity determining region 3 for antibody 39001
QHYDNLSRP

SEQ ID NO: 78002 - protein, 18 aa, Homo sapiens
  heavy chain complementarity determining region 3 for antibody 39001
TRDLSPQMAPFRDDASDI

SEQ ID NO: 78003 - protein, 9 aa, Homo sapiens
  light chain complementarity determining region 3 for antibody 39002
QHYDNHSRT

SEQ ID NO: 78004 - protein, 18 aa, Homo sapiens
  heavy chain complementarity determining region 3 for antibody 39002
TRDLSPQMAPFRDDASDI

SEQ ID NO: 78005 - protein, 10 aa, Homo sapiens
  light chain complementarity determining region 3 for antibody 39003
QHYDNFPPLT

SEQ ID NO: 78006 - protein, 16 aa, Homo sapiens
  heavy chain complementarity determining region 3 for antibody 39003
ARARGRWLQAGAAFDC

SEQ ID NO: 78007 - protein, 10 aa, Homo sapiens
  light chain complementarity determining region 3 for antibody 39004
QHYDGSPMYT

SEQ ID NO: 78008 - protein, 11 aa, Homo sapiens
  heavy chain complementarity determining region 3 for antibody 39004
MRGPAHGAFDI

SEQ ID NO: 78009 - protein, 8 aa, Homo sapiens
  light chain complementarity determining region 3 for antibody 39005
QHYDGPWT

SEQ ID NO: 78010 - protein, 11 aa, Homo sapiens
  heavy chain complementarity determining region 3 for antibody 39005
AASSYYGVSHY

SEQ ID NO: 78011 - protein, 8 aa, Homo sapiens
  light chain complementarity determining region 3 for antibody 39006
QHYDGPWP

SEQ ID NO: 78012 - protein, 11 aa, Homo sapiens
  heavy chain complementarity determining region 3 for antibody 39006
AASSYYGVFHY

SEQ ID NO: 78013 - protein, 8 aa, Homo sapiens
  light chain complementarity determining region 3 for antibody 39007
QHYDGPVT

SEQ ID NO: 78014 - protein, 11 aa, Homo sapiens
  heavy chain complementarity determining region 3 for antibody 39007
AASSYYGVFHY

SEQ ID NO: 78015 - protein, 8 aa, Homo sapiens
  light chain complementarity determining region 3 for antibody 39008
QHYDGPCT

SEQ ID NO: 78016 - protein, 11 aa, Homo sapiens
  heavy chain complementarity determining region 3 for antibody 39008
AASSYYGVFHY

SEQ ID NO: 78017 - protein, 11 aa, Homo sapiens
  light chain complementarity determining region 3 for antibody 39009
QHYANSPIMYT

SEQ ID NO: 78018 - protein, 12 aa, Homo sapiens
  heavy chain complementarity determining region 3 for antibody 39009
ARHIAGSNAFDY

SEQ ID NO: 78019 - protein, 10 aa, Homo sapiens
  light chain complementarity determining region 3 for antibody 39010
QHYANQPPIT

SEQ ID NO: 78020 - protein, 12 aa, Homo sapiens
  heavy chain complementarity determining region 3 for antibody 39010
ARVLDSLSPAFH

SEQ ID NO: 78021 - protein, 10 aa, Homo sapiens
  light chain complementarity determining region 3 for antibody 39011
QHWVSSQAYT

SEQ ID NO: 78022 - protein, 12 aa, Homo sapiens
  heavy chain complementarity determining region 3 for antibody 39011
ARETTQFGELDN

SEQ ID NO: 78023 - protein, 10 aa, Homo sapiens
  light chain complementarity determining region 3 for antibody 39012
QHWVSSPGYT

SEQ ID NO: 78024 - protein, 12 aa, Homo sapiens
  heavy chain complementarity determining region 3 for antibody 39012
ARETTQFGELDN

SEQ ID NO: 78025 - protein, 10 aa, Homo sapiens
  light chain complementarity determining region 3 for antibody 39013
QHWVSSPAYT

SEQ ID NO: 78026 - protein, 12 aa, Homo sapiens
  heavy chain complementarity determining region 3 for antibody 39013
ARETTQFRELDN

SEQ ID NO: 78027 - protein, 10 aa, Homo sapiens
  light chain complementarity determining region 3 for antibody 39014
QHWVSSPAYT

SEQ ID NO: 78028 - protein, 12 aa, Homo sapiens
  heavy chain complementarity determining region 3 for antibody 39014
ARETTQFGELDI

SEQ ID NO: 78029 - protein, 10 aa, Homo sapiens
  light chain complementarity determining region 3 for antibody 39015
QHWVSSPAYP

SEQ ID NO: 78030 - protein, 12 aa, Homo sapiens
  heavy chain complementarity determining region 3 for antibody 39015
ARETTRFGELDH

SEQ ID NO: 78031 - protein, 10 aa, Homo sapiens
  light chain complementarity determining region 3 for antibody 39016
QHWVSSPAYP

SEQ ID NO: 78032 - protein, 12 aa, Homo sapiens
  heavy chain complementarity determining region 3 for antibody 39016
ARETTQFGEFDN

SEQ ID NO: 78033 - protein, 10 aa, Homo sapiens
  light chain complementarity determining region 3 for antibody 39017
QHWVSSPAYA

SEQ ID NO: 78034 - protein, 12 aa, Homo sapiens
  heavy chain complementarity determining region 3 for antibody 39017
ARETTQFGELDN

SEQ ID NO: 78035 - protein, 10 aa, Homo sapiens
  light chain complementarity determining region 3 for antibody 39018
QHWVSSPAAT

SEQ ID NO: 78036 - protein, 12 aa, Homo sapiens
  heavy chain complementarity determining region 3 for antibody 39018
ARETTQFGELDN

SEQ ID NO: 78037 - protein, 10 aa, Homo sapiens
  light chain complementarity determining region 3 for antibody 39019
QHWVSPPAST

SEQ ID NO: 78038 - protein, 12 aa, Homo sapiens
  heavy chain complementarity determining region 3 for antibody 39019
ARETTQFGELDN

SEQ ID NO: 78039 - protein, 10 aa, Homo sapiens
  light chain complementarity determining region 3 for antibody 39020
QHWVSLPAYT

SEQ ID NO: 78040 - protein, 12 aa, Homo sapiens
  heavy chain complementarity determining region 3 for antibody 39020
ARETTQFGELDN

SEQ ID NO: 78041 - protein, 10 aa, Homo sapiens
  light chain complementarity determining region 3 for antibody 39021
QHWGSSPAYT

SEQ ID NO: 78042 - protein, 12 aa, Homo sapiens
  heavy chain complementarity determining region 3 for antibody 39021
ARETTRFGELDH

SEQ ID NO: 78043 - protein, 10 aa, Homo sapiens
  light chain complementarity determining region 3 for antibody 39022
QHWGSSPAYP

SEQ ID NO: 78044 - protein, 12 aa, Homo sapiens
  heavy chain complementarity determining region 3 for antibody 39022
ARETTQFGELDN

SEQ ID NO: 78045 - protein, 9 aa, Homo sapiens
  light chain complementarity determining region 3 for antibody 39023
QHTYTFPRT

SEQ ID NO: 78046 - protein, 20 aa, Homo sapiens
  heavy chain complementarity determining region 3 for antibody 39023
GRGRRIAALSTAHYYYGMDV

SEQ ID NO: 78047 - protein, 9 aa, Homo sapiens
  light chain complementarity determining region 3 for antibody 39024
QHTYTFPRT

SEQ ID NO: 78048 - protein, 20 aa, Homo sapiens
  heavy chain complementarity determining region 3 for antibody 39024
ARGRRIAALSTAHCYYGMDV

SEQ ID NO: 78049 - protein, 9 aa, Homo sapiens
  light chain complementarity determining region 3 for antibody 39025
QHTTTFPRT

SEQ ID NO: 78050 - protein, 20 aa, Homo sapiens
  heavy chain complementarity determining region 3 for antibody 39025
GRGRRIAALSTAHYYYGMDV

SEQ ID NO: 78051 - protein, 9 aa, Homo sapiens
  light chain complementarity determining region 3 for antibody 39026
QHTSTFPRT

SEQ ID NO: 78052 - protein, 15 aa, Homo sapiens
  heavy chain complementarity determining region 3 for antibody 39026
IRQSKVDGNYNYPDF

SEQ ID NO: 78053 - protein, 9 aa, Homo sapiens
  light chain complementarity determining region 3 for antibody 39027
QHTSTFPRT

SEQ ID NO: 78054 - protein, 20 aa, Homo sapiens
  heavy chain complementarity determining region 3 for antibody 39027
ARGRRIAARSTAHYYYGMDV

SEQ ID NO: 78055 - protein, 9 aa, Homo sapiens
  light chain complementarity determining region 3 for antibody 39028
QHTSTFPRP

SEQ ID NO: 78056 - protein, 20 aa, Homo sapiens
  heavy chain complementarity determining region 3 for antibody 39028
ARGRRIAALSTAHYYYGMDV

SEQ ID NO: 78057 - protein, 9 aa, Homo sapiens
  light chain complementarity determining region 3 for antibody 39029
QHTPSRPFT

SEQ ID NO: 78058 - protein, 20 aa, Homo sapiens
  heavy chain complementarity determining region 3 for antibody 39029
AKGIAVAALRTVYYYYGLDV

SEQ ID NO: 78059 - protein, 9 aa, Homo sapiens
  light chain complementarity determining region 3 for antibody 39030
QHTNTFPRT

SEQ ID NO: 78060 - protein, 20 aa, Homo sapiens
  heavy chain complementarity determining region 3 for antibody 39030
ARGRRIAALSTAHYYYGMDV

SEQ ID NO: 78061 - protein, 9 aa, Homo sapiens
  light chain complementarity determining region 3 for antibody 39031
QHTHTRPFT

SEQ ID NO: 78062 - protein, 20 aa, Homo sapiens
  heavy chain complementarity determining region 3 for antibody 39031
AKGIAVAALRTVYYYYGLDV

SEQ ID NO: 78063 - protein, 9 aa, Homo sapiens
  light chain complementarity determining region 3 for antibody 39032
QHTHTFPRT

SEQ ID NO: 78064 - protein, 20 aa, Homo sapiens
  heavy chain complementarity determining region 3 for antibody 39032
VRGRRIAALSTAHYYYGMDV

SEQ ID NO: 78065 - protein, 9 aa, Homo sapiens
  light chain complementarity determining region 3 for antibody 39033
QHTHTFPRT

SEQ ID NO: 78066 - protein, 20 aa, Homo sapiens
  heavy chain complementarity determining region 3 for antibody 39033
GRVRRIAALSTAHYYYGMDV

SEQ ID NO: 78067 - protein, 9 aa, Homo sapiens
  light chain complementarity determining region 3 for antibody 39034
QHTHTFPRT

SEQ ID NO: 78068 - protein, 20 aa, Homo sapiens
  heavy chain complementarity determining region 3 for antibody 39034
GRGRRIAAPSTAHYYYGMDV

SEQ ID NO: 78069 - protein, 9 aa, Homo sapiens
  light chain complementarity determining region 3 for antibody 39035
QHTHTFPRT

SEQ ID NO: 78070 - protein, 20 aa, Homo sapiens
  heavy chain complementarity determining region 3 for antibody 39035
GRGRRIAALSTAHYYYGKDV

SEQ ID NO: 78071 - protein, 9 aa, Homo sapiens
  light chain complementarity determining region 3 for antibody 39036
QHTHTFPRT

SEQ ID NO: 78072 - protein, 20 aa, Homo sapiens
  heavy chain complementarity determining region 3 for antibody 39036
GRGRRIAALSTAHYYYGIDV

SEQ ID NO: 78073 - protein, 9 aa, Homo sapiens
  light chain complementarity determining region 3 for antibody 39037
QHTHTFPRT

SEQ ID NO: 78074 - protein, 20 aa, Homo sapiens
  heavy chain complementarity determining region 3 for antibody 39037
GRGRRIAALSTAHYYSGMDV

SEQ ID NO: 78075 - protein, 9 aa, Homo sapiens
  light chain complementarity determining region 3 for antibody 39038
QHTHTFPRT

SEQ ID NO: 78076 - protein, 20 aa, Homo sapiens
  heavy chain complementarity determining region 3 for antibody 39038
GRGRRIAALSTAHDYYGMGV

SEQ ID NO: 78077 - protein, 9 aa, Homo sapiens
  light chain complementarity determining region 3 for antibody 39039
QHTHTFPRS

SEQ ID NO: 78078 - protein, 20 aa, Homo sapiens
  heavy chain complementarity determining region 3 for antibody 39039
GRGRRIAALSTAHYYYGMDV

SEQ ID NO: 78079 - protein, 9 aa, Homo sapiens
  light chain complementarity determining region 3 for antibody 39040
QHTHTFPLT

SEQ ID NO: 78080 - protein, 20 aa, Homo sapiens
  heavy chain complementarity determining region 3 for antibody 39040
GRGRRIAALSTAHYYYGMDV

SEQ ID NO: 78081 - protein, 9 aa, Homo sapiens
  light chain complementarity determining region 3 for antibody 39041
QHTHSRPFT

SEQ ID NO: 78082 - protein, 20 aa, Homo sapiens
  heavy chain complementarity determining region 3 for antibody 39041
AKGIAVAALRTVYYYYGLDI

SEQ ID NO: 78083 - protein, 9 aa, Homo sapiens
  light chain complementarity determining region 3 for antibody 39042
QHTHSRPFN

SEQ ID NO: 78084 - protein, 20 aa, Homo sapiens
  heavy chain complementarity determining region 3 for antibody 39042
AKGIAVAALRTVYYYYGLDV

SEQ ID NO: 78085 - protein, 9 aa, Homo sapiens
  light chain complementarity determining region 3 for antibody 39043
QHTHSPPFT

SEQ ID NO: 78086 - protein, 20 aa, Homo sapiens
  heavy chain complementarity determining region 3 for antibody 39043
AKGIAVAALRTVYYYYGLDV

SEQ ID NO: 78087 - protein, 9 aa, Homo sapiens
  light chain complementarity determining region 3 for antibody 39044
QHTHPFPRT

SEQ ID NO: 78088 - protein, 20 aa, Homo sapiens
  heavy chain complementarity determining region 3 for antibody 39044
ARGRRIAALSTAHYYYGMDV

SEQ ID NO: 78089 - protein, 9 aa, Homo sapiens
  light chain complementarity determining region 3 for antibody 39045
QHTHNRPFT

SEQ ID NO: 78090 - protein, 20 aa, Homo sapiens
  heavy chain complementarity determining region 3 for antibody 39045
AKGIAVAALRTVYYYYGLDV

SEQ ID NO: 78091 - protein, 9 aa, Homo sapiens
  light chain complementarity determining region 3 for antibody 39046
QHTHIRPFT

SEQ ID NO: 78092 - protein, 20 aa, Homo sapiens
  heavy chain complementarity determining region 3 for antibody 39046
AKGIAVAALRTVYYYYGLDV

SEQ ID NO: 78093 - protein, 9 aa, Homo sapiens
  light chain complementarity determining region 3 for antibody 39047
QHSYSTPYT

SEQ ID NO: 78094 - protein, 15 aa, Homo sapiens
  heavy chain complementarity determining region 3 for antibody 39047
TRDHQRGTYLYSFDS

SEQ ID NO: 78095 - protein, 9 aa, Homo sapiens
  light chain complementarity determining region 3 for antibody 39048
QHSYSSLYT

SEQ ID NO: 78096 - protein, 15 aa, Homo sapiens
  heavy chain complementarity determining region 3 for antibody 39048
TRGNSGNYLVRAFDI

SEQ ID NO: 78097 - protein, 9 aa, Homo sapiens
  light chain complementarity determining region 3 for antibody 39049
QHSYSRPFT

SEQ ID NO: 78098 - protein, 20 aa, Homo sapiens
  heavy chain complementarity determining region 3 for antibody 39049
AKGISVAALRTVYYYYGMDV

SEQ ID NO: 78099 - protein, 9 aa, Homo sapiens
  light chain complementarity determining region 3 for antibody 39050
QHSPSRPFT

SEQ ID NO: 78100 - protein, 20 aa, Homo sapiens
  heavy chain complementarity determining region 3 for antibody 39050
AKGIAVAALRTVYYYYGMDV

SEQ ID NO: 78101 - protein, 9 aa, Homo sapiens
  light chain complementarity determining region 3 for antibody 39051
QHSNSRPLT

SEQ ID NO: 78102 - protein, 20 aa, Homo sapiens
  heavy chain complementarity determining region 3 for antibody 39051
AKGIAVAALRTVYYYYGMDV

SEQ ID NO: 78103 - protein, 9 aa, Homo sapiens
  light chain complementarity determining region 3 for antibody 39052
QHSNSRPFT

SEQ ID NO: 78104 - protein, 20 aa, Homo sapiens
  heavy chain complementarity determining region 3 for antibody 39052
AKGISVAALRTVYYYYGMDV

SEQ ID NO: 78105 - protein, 9 aa, Homo sapiens
  light chain complementarity determining region 3 for antibody 39053
QHSNRTPYT

SEQ ID NO: 78106 - protein, 14 aa, Homo sapiens
  heavy chain complementarity determining region 3 for antibody 39053
ATEGPSRMGKFFDS

SEQ ID NO: 78107 - protein, 10 aa, Homo sapiens
  light chain complementarity determining region 3 for antibody 39054
QHSNNWPSFP

SEQ ID NO: 78108 - protein, 11 aa, Homo sapiens
  heavy chain complementarity determining region 3 for antibody 39054
TRDDYGGGADY

SEQ ID NO: 78109 - protein, 9 aa, Homo sapiens
  light chain complementarity determining region 3 for antibody 39055
QHSHSRPFT

SEQ ID NO: 78110 - protein, 20 aa, Homo sapiens
  heavy chain complementarity determining region 3 for antibody 39055
AKGVSVAALRTVYYYYGMDV

SEQ ID NO: 78111 - protein, 9 aa, Homo sapiens
  light chain complementarity determining region 3 for antibody 39056
QHSHSRPFT

SEQ ID NO: 78112 - protein, 20 aa, Homo sapiens
  heavy chain complementarity determining region 3 for antibody 39056
AKGVAVAALRTVYYYYGMDV

SEQ ID NO: 78113 - protein, 9 aa, Homo sapiens
  light chain complementarity determining region 3 for antibody 39057
QHSHSRPFT

SEQ ID NO: 78114 - protein, 20 aa, Homo sapiens
  heavy chain complementarity determining region 3 for antibody 39057
AKGTAVAALRTVYYYYGMDV

SEQ ID NO: 78115 - protein, 9 aa, Homo sapiens
  light chain complementarity determining region 3 for antibody 39058
QHSHSRPFT

SEQ ID NO: 78116 - protein, 20 aa, Homo sapiens
  heavy chain complementarity determining region 3 for antibody 39058
AKGISVAALRTVYSYYGMDV

SEQ ID NO: 78117 - protein, 9 aa, Homo sapiens
  light chain complementarity determining region 3 for antibody 39059
QHSHSRPFT

SEQ ID NO: 78118 - protein, 20 aa, Homo sapiens
  heavy chain complementarity determining region 3 for antibody 39059
AKGIAVAALRTVYYYYGMDF

SEQ ID NO: 78119 - protein, 9 aa, Homo sapiens
  light chain complementarity determining region 3 for antibody 39060
QHSHSRPFT

SEQ ID NO: 78120 - protein, 20 aa, Homo sapiens
  heavy chain complementarity determining region 3 for antibody 39060
AKGIAVAALRTVYYYYGIDV

SEQ ID NO: 78121 - protein, 9 aa, Homo sapiens
  light chain complementarity determining region 3 for antibody 39061
QHSHSRPFT

SEQ ID NO: 78122 - protein, 20 aa, Homo sapiens
  heavy chain complementarity determining region 3 for antibody 39061
AKGIAVAALRTAYYYYGMDV

SEQ ID NO: 78123 - protein, 9 aa, Homo sapiens
  light chain complementarity determining region 3 for antibody 39062
QHSHSRPFT

SEQ ID NO: 78124 - protein, 20 aa, Homo sapiens
  heavy chain complementarity determining region 3 for antibody 39062
AKGIAVAALRAVYYYYGMDV

SEQ ID NO: 78125 - protein, 9 aa, Homo sapiens
  light chain complementarity determining region 3 for antibody 39063
QHSHSRPFI

SEQ ID NO: 78126 - protein, 20 aa, Homo sapiens
  heavy chain complementarity determining region 3 for antibody 39063
AKGIAVAALRTVYYYYGMDV

SEQ ID NO: 78127 - protein, 9 aa, Homo sapiens
  light chain complementarity determining region 3 for antibody 39064
QHSHSRPFH

SEQ ID NO: 78128 - protein, 20 aa, Homo sapiens
  heavy chain complementarity determining region 3 for antibody 39064
AKGIAVAALRTVYYYYGMDV

SEQ ID NO: 78129 - protein, 9 aa, Homo sapiens
  light chain complementarity determining region 3 for antibody 39065
QHSHSRPFA

SEQ ID NO: 78130 - protein, 20 aa, Homo sapiens
  heavy chain complementarity determining region 3 for antibody 39065
AKGIAVAALRTVYYYYGMDV

SEQ ID NO: 78131 - protein, 9 aa, Homo sapiens
  light chain complementarity determining region 3 for antibody 39066
QHSHSPPFT

SEQ ID NO: 78132 - protein, 20 aa, Homo sapiens
  heavy chain complementarity determining region 3 for antibody 39066
AKGIAVAALRTVYYYYGMDV

SEQ ID NO: 78133 - protein, 9 aa, Homo sapiens
  light chain complementarity determining region 3 for antibody 39067
QHSHSLPFT

SEQ ID NO: 78134 - protein, 20 aa, Homo sapiens
  heavy chain complementarity determining region 3 for antibody 39067
AKGSAVAALRTVYYYYGMDV

SEQ ID NO: 78135 - protein, 9 aa, Homo sapiens
  light chain complementarity determining region 3 for antibody 39068
QHSHNRPFT

SEQ ID NO: 78136 - protein, 20 aa, Homo sapiens
  heavy chain complementarity determining region 3 for antibody 39068
AKGIAVAALRTVYYYYGMDV

SEQ ID NO: 78137 - protein, 9 aa, Homo sapiens
  light chain complementarity determining region 3 for antibody 39069
QHSHDFPYT

SEQ ID NO: 78138 - protein, 13 aa, Homo sapiens
  heavy chain complementarity determining region 3 for antibody 39069
ARLKDINGWPFDY

SEQ ID NO: 78139 - protein, 8 aa, Homo sapiens
  light chain complementarity determining region 3 for antibody 39070
QHSDGPWT

SEQ ID NO: 78140 - protein, 11 aa, Homo sapiens
  heavy chain complementarity determining region 3 for antibody 39070
AASSYYGVFHY

SEQ ID NO: 78141 - protein, 9 aa, Homo sapiens
  light chain complementarity determining region 3 for antibody 39071
QHSANWPLP

SEQ ID NO: 78142 - protein, 19 aa, Homo sapiens
  heavy chain complementarity determining region 3 for antibody 39071
ARDYHAGSGAYWAYNRFDP

SEQ ID NO: 78143 - protein, 10 aa, Homo sapiens
  light chain complementarity determining region 3 for antibody 39072
QHRYNWPPYT

SEQ ID NO: 78144 - protein, 15 aa, Homo sapiens
  heavy chain complementarity determining region 3 for antibody 39072
ARGATSGRQEYYFDY

SEQ ID NO: 78145 - protein, 9 aa, Homo sapiens
  light chain complementarity determining region 3 for antibody 39073
QHRTYWPGT

SEQ ID NO: 78146 - protein, 17 aa, Homo sapiens
  heavy chain complementarity determining region 3 for antibody 39073
GREYYDARSGSGNWFDP

SEQ ID NO: 78147 - protein, 9 aa, Homo sapiens
  light chain complementarity determining region 3 for antibody 39074
QHRTSWPYT

SEQ ID NO: 78148 - protein, 15 aa, Homo sapiens
  heavy chain complementarity determining region 3 for antibody 39074
AKEGYYADGSGYCPN

SEQ ID NO: 78149 - protein, 10 aa, Homo sapiens
  light chain complementarity determining region 3 for antibody 39075
QHRTDWLPRT

SEQ ID NO: 78150 - protein, 15 aa, Homo sapiens
  heavy chain complementarity determining region 3 for antibody 39075
ARDVGIDYNEGDRDY

SEQ ID NO: 78151 - protein, 10 aa, Homo sapiens
  light chain complementarity determining region 3 for antibody 39076
QHRTDWLPPT

SEQ ID NO: 78152 - protein, 15 aa, Homo sapiens
  heavy chain complementarity determining region 3 for antibody 39076
ARDVGIDYNEGDRDY

SEQ ID NO: 78153 - protein, 9 aa, Homo sapiens
  light chain complementarity determining region 3 for antibody 39077
QHRSNWPWT

SEQ ID NO: 78154 - protein, 20 aa, Homo sapiens
  heavy chain complementarity determining region 3 for antibody 39077
ARASPVYCSGGSCYYYGMDV

SEQ ID NO: 78155 - protein, 11 aa, Homo sapiens
  light chain complementarity determining region 3 for antibody 39078
QHRSNWPPGFT

SEQ ID NO: 78156 - protein, 13 aa, Homo sapiens
  heavy chain complementarity determining region 3 for antibody 39078
ACALAPPGDFFDF

SEQ ID NO: 78157 - protein, 10 aa, Homo sapiens
  light chain complementarity determining region 3 for antibody 39079
QHRSDWPPLT

SEQ ID NO: 78158 - protein, 10 aa, Homo sapiens
  heavy chain complementarity determining region 3 for antibody 39079
ARDYSMTFDY

SEQ ID NO: 78159 - protein, 10 aa, Homo sapiens
  light chain complementarity determining region 3 for antibody 39080
QHRSDWLPLP

SEQ ID NO: 78160 - protein, 15 aa, Homo sapiens
  heavy chain complementarity determining region 3 for antibody 39080
ARDIGIDYNEADRDY

SEQ ID NO: 78161 - protein, 9 aa, Homo sapiens
  light chain complementarity determining region 3 for antibody 39081
QHRRTWPQT

SEQ ID NO: 78162 - protein, 16 aa, Homo sapiens
  heavy chain complementarity determining region 3 for antibody 39081
ARDGASSWYFKHGLDV

SEQ ID NO: 78163 - protein, 9 aa, Homo sapiens
  light chain complementarity determining region 3 for antibody 39082
QHRRTWLYS

SEQ ID NO: 78164 - protein, 19 aa, Homo sapiens
  heavy chain complementarity determining region 3 for antibody 39082
ARDGSAGMAARGTPYGLDV

SEQ ID NO: 78165 - protein, 9 aa, Homo sapiens
  light chain complementarity determining region 3 for antibody 39083
QHRRTWLYS

SEQ ID NO: 78166 - protein, 20 aa, Homo sapiens
  heavy chain complementarity determining region 3 for antibody 39083
ARDGSAGMAARGTPYCGLDV

SEQ ID NO: 78167 - protein, 9 aa, Homo sapiens
  light chain complementarity determining region 3 for antibody 39084
QHRRTWLYS

SEQ ID NO: 78168 - protein, 20 aa, Homo sapiens
  heavy chain complementarity determining region 3 for antibody 39084
ARDGSAGMAARGSPYYGLDV

SEQ ID NO: 78169 - protein, 9 aa, Homo sapiens
  light chain complementarity determining region 3 for antibody 39085
QHRNTWRVT

SEQ ID NO: 78170 - protein, 7 aa, Homo sapiens
  heavy chain complementarity determining region 3 for antibody 39085
TLSSFDY

SEQ ID NO: 78171 - protein, 9 aa, Homo sapiens
  light chain complementarity determining region 3 for antibody 39086
QHRNSWPNT

SEQ ID NO: 78172 - protein, 15 aa, Homo sapiens
  heavy chain complementarity determining region 3 for antibody 39086
AKEGYYADGSGYCPN

SEQ ID NO: 78173 - protein, 9 aa, Homo sapiens
  light chain complementarity determining region 3 for antibody 39087
QHRNNWPLT

SEQ ID NO: 78174 - protein, 13 aa, Homo sapiens
  heavy chain complementarity determining region 3 for antibody 39087
ARGNRAAPGRLEC

SEQ ID NO: 78175 - protein, 9 aa, Homo sapiens
  light chain complementarity determining region 3 for antibody 39088
QHRNNWPLT

SEQ ID NO: 78176 - protein, 13 aa, Homo sapiens
  heavy chain complementarity determining region 3 for antibody 39088
ARGNIAAPGRLDC

SEQ ID NO: 78177 - protein, 9 aa, Homo sapiens
  light chain complementarity determining region 3 for antibody 39089
QHRNNWPLP

SEQ ID NO: 78178 - protein, 13 aa, Homo sapiens
  heavy chain complementarity determining region 3 for antibody 39089
ARGNIAAPGRLEC

SEQ ID NO: 78179 - protein, 9 aa, Homo sapiens
  light chain complementarity determining region 3 for antibody 39090
QHRNIWRVT

SEQ ID NO: 78180 - protein, 7 aa, Homo sapiens
  heavy chain complementarity determining region 3 for antibody 39090
TLSAFDY

SEQ ID NO: 78181 - protein, 9 aa, Homo sapiens
  light chain complementarity determining region 3 for antibody 39091
QHRNIWRVP

SEQ ID NO: 78182 - protein, 7 aa, Homo sapiens
  heavy chain complementarity determining region 3 for antibody 39091
TLSSFDY

SEQ ID NO: 78183 - protein, 11 aa, Homo sapiens
  light chain complementarity determining region 3 for antibody 39092
QHRINWPPSFT

SEQ ID NO: 78184 - protein, 15 aa, Homo sapiens
  heavy chain complementarity determining region 3 for antibody 39092
ARDRDVMYSVHAFDI

SEQ ID NO: 78185 - protein, 11 aa, Homo sapiens
  light chain complementarity determining region 3 for antibody 39093
QHRINSPPSIT

SEQ ID NO: 78186 - protein, 15 aa, Homo sapiens
  heavy chain complementarity determining region 3 for antibody 39093
ARDRDVMYSVHAFDI

SEQ ID NO: 78187 - protein, 11 aa, Homo sapiens
  light chain complementarity determining region 3 for antibody 39094
QHRINCPPSIT

SEQ ID NO: 78188 - protein, 15 aa, Homo sapiens
  heavy chain complementarity determining region 3 for antibody 39094
ARDRDVMYSVHAFDI

SEQ ID NO: 78189 - protein, 9 aa, Homo sapiens
  light chain complementarity determining region 3 for antibody 39095
QHRHSRPFT

SEQ ID NO: 78190 - protein, 20 aa, Homo sapiens
  heavy chain complementarity determining region 3 for antibody 39095
AKGIAVAALRTVYYYYGMDV

SEQ ID NO: 78191 - protein, 9 aa, Homo sapiens
  light chain complementarity determining region 3 for antibody 39096
QHRHSMPVT

SEQ ID NO: 78192 - protein, 18 aa, Homo sapiens
  heavy chain complementarity determining region 3 for antibody 39096
ARGMPYDTSGQVPHYFDY

SEQ ID NO: 78193 - protein, 10 aa, Homo sapiens
  light chain complementarity determining region 3 for antibody 39097
QHRGKWPPHN

SEQ ID NO: 78194 - protein, 15 aa, Homo sapiens
  heavy chain complementarity determining region 3 for antibody 39097
VRLGVGFDDSSDDDY

SEQ ID NO: 78195 - protein, 10 aa, Homo sapiens
  light chain complementarity determining region 3 for antibody 39098
QHNYWSSPLT

SEQ ID NO: 78196 - protein, 12 aa, Homo sapiens
  heavy chain complementarity determining region 3 for antibody 39098
RGRNYDRDGFDP

SEQ ID NO: 78197 - protein, 9 aa, Homo sapiens
  light chain complementarity determining region 3 for antibody 39099
QHNYNTPFT

SEQ ID NO: 78198 - protein, 13 aa, Homo sapiens
  heavy chain complementarity determining region 3 for antibody 39099
VRGRNYDRDGFDP

SEQ ID NO: 78199 - protein, 9 aa, Homo sapiens
  light chain complementarity determining region 3 for antibody 39100
QHNYNPPFT

SEQ ID NO: 78200 - protein, 13 aa, Homo sapiens
  heavy chain complementarity determining region 3 for antibody 39100
VRGRNYERDGFDP

SEQ ID NO: 78201 - protein, 9 aa, Homo sapiens
  light chain complementarity determining region 3 for antibody 39101
QHNYNPPFT

SEQ ID NO: 78202 - protein, 13 aa, Homo sapiens
  heavy chain complementarity determining region 3 for antibody 39101
VRGRNDDRDGFDP

SEQ ID NO: 78203 - protein, 8 aa, Homo sapiens
  light chain complementarity determining region 3 for antibody 39102
QHNGGSPS

SEQ ID NO: 78204 - protein, 16 aa, Homo sapiens
  heavy chain complementarity determining region 3 for antibody 39102
ATDWGSGTQWIRAFDV

SEQ ID NO: 78205 - protein, 9 aa, Homo sapiens
  light chain complementarity determining region 3 for antibody 39103
QHLKSYPLT

SEQ ID NO: 78206 - protein, 13 aa, Homo sapiens
  heavy chain complementarity determining region 3 for antibody 39103
VPVMEVTLGAFAF

SEQ ID NO: 78207 - protein, 9 aa, Homo sapiens
  light chain complementarity determining region 3 for antibody 39104
QHIHTFPRT

SEQ ID NO: 78208 - protein, 20 aa, Homo sapiens
  heavy chain complementarity determining region 3 for antibody 39104
GRGRRIAALSTAHYYYGMDV

SEQ ID NO: 78209 - protein, 9 aa, Homo sapiens
  light chain complementarity determining region 3 for antibody 39105
QHIHSRPFT

SEQ ID NO: 78210 - protein, 20 aa, Homo sapiens
  heavy chain complementarity determining region 3 for antibody 39105
AKGISVAALRTVYYYYGMDV

SEQ ID NO: 78211 - protein, 9 aa, Homo sapiens
  light chain complementarity determining region 3 for antibody 39106
QHHYNPPFT

SEQ ID NO: 78212 - protein, 13 aa, Homo sapiens
  heavy chain complementarity determining region 3 for antibody 39106
VRGRNYDRDGFDP

SEQ ID NO: 78213 - protein, 9 aa, Homo sapiens
  light chain complementarity determining region 3 for antibody 39107
QHGYRTPFT

SEQ ID NO: 78214 - protein, 15 aa, Homo sapiens
  heavy chain complementarity determining region 3 for antibody 39107
AKAQVSWGQLYYFES

SEQ ID NO: 78215 - protein, 9 aa, Homo sapiens
  light chain complementarity determining region 3 for antibody 39108
QHGYRTPFP

SEQ ID NO: 78216 - protein, 15 aa, Homo sapiens
  heavy chain complementarity determining region 3 for antibody 39108
AKAQVIWGQLYYFES

SEQ ID NO: 78217 - protein, 9 aa, Homo sapiens
  light chain complementarity determining region 3 for antibody 39109
QHFTHFPYG

SEQ ID NO: 78218 - protein, 13 aa, Homo sapiens
  heavy chain complementarity determining region 3 for antibody 39109
AGGRRTGYYGLDA

SEQ ID NO: 78219 - protein, 9 aa, Homo sapiens
  light chain complementarity determining region 3 for antibody 39110
QHFTHFPYG

SEQ ID NO: 78220 - protein, 13 aa, Homo sapiens
  heavy chain complementarity determining region 3 for antibody 39110
AGGLRTGYCGLDA

SEQ ID NO: 78221 - protein, 9 aa, Homo sapiens
  light chain complementarity determining region 3 for antibody 39111
QHFNSYPLT

SEQ ID NO: 78222 - protein, 14 aa, Homo sapiens
  heavy chain complementarity determining region 3 for antibody 39111
VRVMAVAGYWFFHL

SEQ ID NO: 78223 - protein, 9 aa, Homo sapiens
  light chain complementarity determining region 3 for antibody 39112
QHFHSYPLT

SEQ ID NO: 78224 - protein, 19 aa, Homo sapiens
  heavy chain complementarity determining region 3 for antibody 39112
ARDSRRMARGVVVYNWFDP

SEQ ID NO: 78225 - protein, 9 aa, Homo sapiens
  light chain complementarity determining region 3 for antibody 39113
QHFHSYLWT

SEQ ID NO: 78226 - protein, 12 aa, Homo sapiens
  heavy chain complementarity determining region 3 for antibody 39113
AKHIGPYRMWDI

SEQ ID NO: 78227 - protein, 10 aa, Homo sapiens
  light chain complementarity determining region 3 for antibody 39114
QHFGNLPMFT

SEQ ID NO: 78228 - protein, 16 aa, Homo sapiens
  heavy chain complementarity determining region 3 for antibody 39114
ARVPRGSYASGTLFDY

SEQ ID NO: 78229 - protein, 11 aa, Homo sapiens
  light chain complementarity determining region 3 for antibody 39115
QHFDTSPPRWT

SEQ ID NO: 78230 - protein, 18 aa, Homo sapiens
  heavy chain complementarity determining region 3 for antibody 39115
ARGLRLRELSFLFLFFDY

SEQ ID NO: 78231 - protein, 11 aa, Homo sapiens
  light chain complementarity determining region 3 for antibody 39116
QHFDTSPPRGT

SEQ ID NO: 78232 - protein, 18 aa, Homo sapiens
  heavy chain complementarity determining region 3 for antibody 39116
ARGFRLRELSFLLLFFDY

SEQ ID NO: 78233 - protein, 11 aa, Homo sapiens
  light chain complementarity determining region 3 for antibody 39117
QHFDTSPPRCT

SEQ ID NO: 78234 - protein, 18 aa, Homo sapiens
  heavy chain complementarity determining region 3 for antibody 39117
ARGLRLRELSFLLLFFDY

SEQ ID NO: 78235 - protein, 10 aa, Homo sapiens
  light chain complementarity determining region 3 for antibody 39118
QHFDNRPMFT

SEQ ID NO: 78236 - protein, 16 aa, Homo sapiens
  heavy chain complementarity determining region 3 for antibody 39118
ARVPRGSYASGTLFDY

SEQ ID NO: 78237 - protein, 10 aa, Homo sapiens
  light chain complementarity determining region 3 for antibody 39119
QHFDNLPMFT

SEQ ID NO: 78238 - protein, 16 aa, Homo sapiens
  heavy chain complementarity determining region 3 for antibody 39119
ARVPRGSYASGSLFDY

SEQ ID NO: 78239 - protein, 10 aa, Homo sapiens
  light chain complementarity determining region 3 for antibody 39120
QHFDNLPMFT

SEQ ID NO: 78240 - protein, 16 aa, Homo sapiens
  heavy chain complementarity determining region 3 for antibody 39120
ARVPRGSYASGPLFDY

SEQ ID NO: 78241 - protein, 10 aa, Homo sapiens
  light chain complementarity determining region 3 for antibody 39121
QHFDNIPMFT

SEQ ID NO: 78242 - protein, 16 aa, Homo sapiens
  heavy chain complementarity determining region 3 for antibody 39121
ARVPRGSYASGTLFDY

SEQ ID NO: 78243 - protein, 10 aa, Homo sapiens
  light chain complementarity determining region 3 for antibody 39122
QHDGNSPPFT

SEQ ID NO: 78244 - protein, 13 aa, Homo sapiens
  heavy chain complementarity determining region 3 for antibody 39122
ASWSHSDLDAFDI

SEQ ID NO: 78245 - protein, 8 aa, Homo sapiens
  light chain complementarity determining region 3 for antibody 39123
QHDGGSPS

SEQ ID NO: 78246 - protein, 16 aa, Homo sapiens
  heavy chain complementarity determining region 3 for antibody 39123
ATDWGSGTQWIRAFDV

SEQ ID NO: 78247 - protein, 8 aa, Homo sapiens
  light chain complementarity determining region 3 for antibody 39124
QHCGSTRT

SEQ ID NO: 78248 - protein, 15 aa, Homo sapiens
  heavy chain complementarity determining region 3 for antibody 39124
AREVTNPNKYYGFDV

SEQ ID NO: 78249 - protein, 8 aa, Homo sapiens
  light chain complementarity determining region 3 for antibody 39125
QHCGSTRT

SEQ ID NO: 78250 - protein, 15 aa, Homo sapiens
  heavy chain complementarity determining region 3 for antibody 39125
AREVTKPNKYYGLDV

SEQ ID NO: 78251 - protein, 10 aa, Homo sapiens
  light chain complementarity determining region 3 for antibody 39126
QHCGSSPAYT

SEQ ID NO: 78252 - protein, 12 aa, Homo sapiens
  heavy chain complementarity determining region 3 for antibody 39126
ARETTRFGELDH

SEQ ID NO: 78253 - protein, 10 aa, Homo sapiens
  light chain complementarity determining region 3 for antibody 39127
QHCGSSPAYT

SEQ ID NO: 78254 - protein, 12 aa, Homo sapiens
  heavy chain complementarity determining region 3 for antibody 39127
ARETTQFGELDN

SEQ ID NO: 78255 - protein, 10 aa, Homo sapiens
  light chain complementarity determining region 3 for antibody 39128
QHCGSSLMYT

SEQ ID NO: 78256 - protein, 14 aa, Homo sapiens
  heavy chain complementarity determining region 3 for antibody 39128
TTDRPLTGMVTFDF

SEQ ID NO: 78257 - protein, 8 aa, Homo sapiens
  light chain complementarity determining region 3 for antibody 39129
QHCGSKRT

SEQ ID NO: 78258 - protein, 15 aa, Homo sapiens
  heavy chain complementarity determining region 3 for antibody 39129
AREVTNPNKYYGLDV

SEQ ID NO: 78259 - protein, 8 aa, Homo sapiens
  light chain complementarity determining region 3 for antibody 39130
QHCGRTRT

SEQ ID NO: 78260 - protein, 15 aa, Homo sapiens
  heavy chain complementarity determining region 3 for antibody 39130
AREVTNPNKYYGLDV

SEQ ID NO: 78261 - protein, 11 aa, Homo sapiens
  light chain complementarity determining region 3 for antibody 39131
QHATNWPPWVT

SEQ ID NO: 78262 - protein, 13 aa, Homo sapiens
  heavy chain complementarity determining region 3 for antibody 39131
ATNTPGSTADFTY

SEQ ID NO: 78263 - protein, 11 aa, Homo sapiens
  light chain complementarity determining region 3 for antibody 39132
QHATNWPPGVT

SEQ ID NO: 78264 - protein, 13 aa, Homo sapiens
  heavy chain complementarity determining region 3 for antibody 39132
ATNTPGSPADFTY

SEQ ID NO: 78265 - protein, 11 aa, Homo sapiens
  light chain complementarity determining region 3 for antibody 39133
QHANNWPPGVT

SEQ ID NO: 78266 - protein, 13 aa, Homo sapiens
  heavy chain complementarity determining region 3 for antibody 39133
ATNTPGSTADFTY

SEQ ID NO: 78267 - protein, 9 aa, Homo sapiens
  light chain complementarity determining region 3 for antibody 39134
QHAHTFPRT

SEQ ID NO: 78268 - protein, 20 aa, Homo sapiens
  heavy chain complementarity determining region 3 for antibody 39134
GRGRRIAALSTAHYYYGMDV

SEQ ID NO: 78269 - protein, 9 aa, Homo sapiens
  light chain complementarity determining region 3 for antibody 39135
QGYDCFLYA

SEQ ID NO: 78270 - protein, 11 aa, Homo sapiens
  heavy chain complementarity determining region 3 for antibody 39135
ARVDERDLHDT

SEQ ID NO: 78271 - protein, 10 aa, Homo sapiens
  light chain complementarity determining region 3 for antibody 39136
QGRDEWPPVF

SEQ ID NO: 78272 - protein, 12 aa, Homo sapiens
  heavy chain complementarity determining region 3 for antibody 39136
VRDHITGWKFDY

SEQ ID NO: 78273 - protein, 10 aa, Homo sapiens
  light chain complementarity determining region 3 for antibody 39137
QGRDEWPPGI

SEQ ID NO: 78274 - protein, 12 aa, Homo sapiens
  heavy chain complementarity determining region 3 for antibody 39137
VRDHITGWKFDY

SEQ ID NO: 78275 - protein, 8 aa, Homo sapiens
  light chain complementarity determining region 3 for antibody 39138
QGLQTPYT

SEQ ID NO: 78276 - protein, 10 aa, Homo sapiens
  heavy chain complementarity determining region 3 for antibody 39138
GSDLSGARDY

SEQ ID NO: 78277 - protein, 9 aa, Homo sapiens
  light chain complementarity determining region 3 for antibody 39139
QEYYTSVRT

SEQ ID NO: 78278 - protein, 12 aa, Homo sapiens
  heavy chain complementarity determining region 3 for antibody 39139
VKDCGLGGPRDS

SEQ ID NO: 78279 - protein, 10 aa, Homo sapiens
  light chain complementarity determining region 3 for antibody 39140
QEYSTYSRRA

SEQ ID NO: 78280 - protein, 16 aa, Homo sapiens
  heavy chain complementarity determining region 3 for antibody 39140
ARGLSAAGRKTGALDI

SEQ ID NO: 78281 - protein, 9 aa, Homo sapiens
  light chain complementarity determining region 3 for antibody 39141
QEYSTSRGT

SEQ ID NO: 78282 - protein, 15 aa, Homo sapiens
  heavy chain complementarity determining region 3 for antibody 39141
ARNLVLNTKGYWVDF

SEQ ID NO: 78283 - protein, 9 aa, Homo sapiens
  light chain complementarity determining region 3 for antibody 39142
QEYSTFRGT

SEQ ID NO: 78284 - protein, 15 aa, Homo sapiens
  heavy chain complementarity determining region 3 for antibody 39142
ARNLMLNTKGYWVDF

SEQ ID NO: 78285 - protein, 9 aa, Homo sapiens
  light chain complementarity determining region 3 for antibody 39143
QEYNRAPRT

SEQ ID NO: 78286 - protein, 18 aa, Homo sapiens
  heavy chain complementarity determining region 3 for antibody 39143
ARDMYQVPYYNNFYGLDV

SEQ ID NO: 78287 - protein, 10 aa, Homo sapiens
  light chain complementarity determining region 3 for antibody 39144
QEYNNLGIFT

SEQ ID NO: 78288 - protein, 18 aa, Homo sapiens
  heavy chain complementarity determining region 3 for antibody 39144
ASVPTYYYGWGGSGWFDP

SEQ ID NO: 78289 - protein, 10 aa, Homo sapiens
  light chain complementarity determining region 3 for antibody 39145
QEYNNLGIFT

SEQ ID NO: 78290 - protein, 18 aa, Homo sapiens
  heavy chain complementarity determining region 3 for antibody 39145
ARVPTYCYGWGGSGWFDP

SEQ ID NO: 78291 - protein, 10 aa, Homo sapiens
  light chain complementarity determining region 3 for antibody 39146
QEYNNLGIFN

SEQ ID NO: 78292 - protein, 18 aa, Homo sapiens
  heavy chain complementarity determining region 3 for antibody 39146
ARVPTYYYGWGGSGWFDP

SEQ ID NO: 78293 - protein, 6 aa, Homo sapiens
  light chain complementarity determining region 3 for antibody 39147
QEYGST

SEQ ID NO: 78294 - protein, 12 aa, Homo sapiens
  heavy chain complementarity determining region 3 for antibody 39147
ARDHVSGWSLSN

SEQ ID NO: 78295 - protein, 6 aa, Homo sapiens
  light chain complementarity determining region 3 for antibody 39148
QEYGSP

SEQ ID NO: 78296 - protein, 12 aa, Homo sapiens
  heavy chain complementarity determining region 3 for antibody 39148
ARDHISGWSLSN

SEQ ID NO: 78297 - protein, 10 aa, Homo sapiens
  light chain complementarity determining region 3 for antibody 39149
QEYGNLPLVT

SEQ ID NO: 78298 - protein, 15 aa, Homo sapiens
  heavy chain complementarity determining region 3 for antibody 39149
AVWGPGSGWWPLYDY

SEQ ID NO: 78299 - protein, 10 aa, Homo sapiens
  light chain complementarity determining region 3 for antibody 39150
QEYGNFPLVT

SEQ ID NO: 78300 - protein, 15 aa, Homo sapiens
  heavy chain complementarity determining region 3 for antibody 39150
AVWGPGSDWWPLYDY

SEQ ID NO: 78301 - protein, 9 aa, Homo sapiens
  light chain complementarity determining region 3 for antibody 39151
QESYSVRLT

SEQ ID NO: 78302 - protein, 22 aa, Homo sapiens
  heavy chain complementarity determining region 3 for antibody 39151
AKETEYDFSDMSTQYYGHLFDQ

SEQ ID NO: 78303 - protein, 9 aa, Homo sapiens
  light chain complementarity determining region 3 for antibody 39152
QDYSTSRGT

SEQ ID NO: 78304 - protein, 15 aa, Homo sapiens
  heavy chain complementarity determining region 3 for antibody 39152
ARNLMLNTKGYWVDF

SEQ ID NO: 78305 - protein, 10 aa, Homo sapiens
  light chain complementarity determining region 3 for antibody 39153
QDYNSYFFYT

SEQ ID NO: 78306 - protein, 12 aa, Homo sapiens
  heavy chain complementarity determining region 3 for antibody 39153
ARGHGDYKGHGD

SEQ ID NO: 78307 - protein, 10 aa, Homo sapiens
  light chain complementarity determining region 3 for antibody 39154
QDYHSYFFFT

SEQ ID NO: 78308 - protein, 12 aa, Homo sapiens
  heavy chain complementarity determining region 3 for antibody 39154
ARGHGDYKGHGD

SEQ ID NO: 78309 - protein, 9 aa, Homo sapiens
  light chain complementarity determining region 3 for antibody 39155
QDLNGFPFT

SEQ ID NO: 78310 - protein, 12 aa, Homo sapiens
  heavy chain complementarity determining region 3 for antibody 39155
ASWGGAQGAIEF

SEQ ID NO: 78311 - protein, 10 aa, Homo sapiens
  light chain complementarity determining region 3 for antibody 39156
QCRDGWPPVI

SEQ ID NO: 78312 - protein, 12 aa, Homo sapiens
  heavy chain complementarity determining region 3 for antibody 39156
VRDHITGWKFDY

SEQ ID NO: 78313 - protein, 10 aa, Homo sapiens
  light chain complementarity determining region 3 for antibody 39157
QCRDEWPPVM

SEQ ID NO: 78314 - protein, 12 aa, Homo sapiens
  heavy chain complementarity determining region 3 for antibody 39157
VRDHITGWKFDY

SEQ ID NO: 78315 - protein, 10 aa, Homo sapiens
  light chain complementarity determining region 3 for antibody 39158
QCRDERPPVI

SEQ ID NO: 78316 - protein, 12 aa, Homo sapiens
  heavy chain complementarity determining region 3 for antibody 39158
VRDHITGWKFDY

SEQ ID NO: 78317 - protein, 10 aa, Homo sapiens
  light chain complementarity determining region 3 for antibody 39159
QAYHSYFFYT

SEQ ID NO: 78318 - protein, 12 aa, Homo sapiens
  heavy chain complementarity determining region 3 for antibody 39159
ARGHGDYKGHGD

SEQ ID NO: 78319 - protein, 9 aa, Homo sapiens
  light chain complementarity determining region 3 for antibody 39160
QAYGDSPKT

SEQ ID NO: 78320 - protein, 10 aa, Homo sapiens
  heavy chain complementarity determining region 3 for antibody 39160
AREGLGGFDN

SEQ ID NO: 78321 - protein, 11 aa, Homo sapiens
  light chain complementarity determining region 3 for antibody 39161
PSYNSYSASWT

SEQ ID NO: 78322 - protein, 15 aa, Homo sapiens
  heavy chain complementarity determining region 3 for antibody 39161
ARRYFYGSRNYLYDD

SEQ ID NO: 78323 - protein, 9 aa, Homo sapiens
  light chain complementarity determining region 3 for antibody 39162
PQYYTTRIT

SEQ ID NO: 78324 - protein, 15 aa, Homo sapiens
  heavy chain complementarity determining region 3 for antibody 39162
ARGPAHGLPNNWFDP

SEQ ID NO: 78325 - protein, 9 aa, Homo sapiens
  light chain complementarity determining region 3 for antibody 39163
PQYYTSVRT

SEQ ID NO: 78326 - protein, 12 aa, Homo sapiens
  heavy chain complementarity determining region 3 for antibody 39163
VKDCGLGGSRDS

SEQ ID NO: 78327 - protein, 9 aa, Homo sapiens
  light chain complementarity determining region 3 for antibody 39164
PQYTTSPLT

SEQ ID NO: 78328 - protein, 11 aa, Homo sapiens
  heavy chain complementarity determining region 3 for antibody 39164
VREEFGWEMTY

SEQ ID NO: 78329 - protein, 9 aa, Homo sapiens
  light chain complementarity determining region 3 for antibody 39165
PQYSTSPRT

SEQ ID NO: 78330 - protein, 16 aa, Homo sapiens
  heavy chain complementarity determining region 3 for antibody 39165
ARGPPPRFSTSWYGEY

SEQ ID NO: 78331 - protein, 10 aa, Homo sapiens
  light chain complementarity determining region 3 for antibody 39166
PQYSSSISYT

SEQ ID NO: 78332 - protein, 15 aa, Homo sapiens
  heavy chain complementarity determining region 3 for antibody 39166
ARGRYDSGGWGYFQL

SEQ ID NO: 78333 - protein, 9 aa, Homo sapiens
  light chain complementarity determining region 3 for antibody 39167
PQYRGDPDS

SEQ ID NO: 78334 - protein, 20 aa, Homo sapiens
  heavy chain complementarity determining region 3 for antibody 39167
ARDVDYCENGVCYSYWYFDL

SEQ ID NO: 78335 - protein, 9 aa, Homo sapiens
  light chain complementarity determining region 3 for antibody 39168
PQYNTYPWT

SEQ ID NO: 78336 - protein, 12 aa, Homo sapiens
  heavy chain complementarity determining region 3 for antibody 39168
VPPVSSYITLDS

SEQ ID NO: 78337 - protein, 9 aa, Homo sapiens
  light chain complementarity determining region 3 for antibody 39169
PQYNSYSVT

SEQ ID NO: 78338 - protein, 17 aa, Homo sapiens
  heavy chain complementarity determining region 3 for antibody 39169
VKESWQWLVDYYYGMDV

SEQ ID NO: 78339 - protein, 9 aa, Homo sapiens
  light chain complementarity determining region 3 for antibody 39170
PQYNSYRRT

SEQ ID NO: 78340 - protein, 9 aa, Homo sapiens
  heavy chain complementarity determining region 3 for antibody 39170
AKGSSALEY

SEQ ID NO: 78341 - protein, 9 aa, Homo sapiens
  light chain complementarity determining region 3 for antibody 39171
PQYNSYPLT

SEQ ID NO: 78342 - protein, 14 aa, Homo sapiens
  heavy chain complementarity determining region 3 for antibody 39171
ARVAPLDGDYALAY

SEQ ID NO: 78343 - protein, 10 aa, Homo sapiens
  light chain complementarity determining region 3 for antibody 39172
PQYNNWPPYT

SEQ ID NO: 78344 - protein, 14 aa, Homo sapiens
  heavy chain complementarity determining region 3 for antibody 39172
GRWTYSGNDVGLSH

SEQ ID NO: 78345 - protein, 9 aa, Homo sapiens
  light chain complementarity determining region 3 for antibody 39173
PQYNGYSRT

SEQ ID NO: 78346 - protein, 18 aa, Homo sapiens
  heavy chain complementarity determining region 3 for antibody 39173
ARDFGGRAYTKVENAFDI

SEQ ID NO: 78347 - protein, 8 aa, Homo sapiens
  light chain complementarity determining region 3 for antibody 39174
PQYNDWPS

SEQ ID NO: 78348 - protein, 14 aa, Homo sapiens
  heavy chain complementarity determining region 3 for antibody 39174
ARTVYSFGSYYFDF

SEQ ID NO: 78349 - protein, 10 aa, Homo sapiens
  light chain complementarity determining region 3 for antibody 39175
PQYHHWPPWT

SEQ ID NO: 78350 - protein, 16 aa, Homo sapiens
  heavy chain complementarity determining region 3 for antibody 39175
ARVDDFGSGNQGTFDP

SEQ ID NO: 78351 - protein, 9 aa, Homo sapiens
  light chain complementarity determining region 3 for antibody 39176
PQYGTSSFT

SEQ ID NO: 78352 - protein, 21 aa, Homo sapiens
  heavy chain complementarity determining region 3 for antibody 39176
ARMSAGSYYDSSGSYLYYFDN

SEQ ID NO: 78353 - protein, 9 aa, Homo sapiens
  light chain complementarity determining region 3 for antibody 39177
PQYGTSPLT

SEQ ID NO: 78354 - protein, 14 aa, Homo sapiens
  heavy chain complementarity determining region 3 for antibody 39177
ARDMFRGVPDYLDY

SEQ ID NO: 78355 - protein, 9 aa, Homo sapiens
  light chain complementarity determining region 3 for antibody 39178
PQYGSSSIT

SEQ ID NO: 78356 - protein, 13 aa, Homo sapiens
  heavy chain complementarity determining region 3 for antibody 39178
VKEFFMVFDAFHM

SEQ ID NO: 78357 - protein, 9 aa, Homo sapiens
  light chain complementarity determining region 3 for antibody 39179
PQYGSSPRT

SEQ ID NO: 78358 - protein, 17 aa, Homo sapiens
  heavy chain complementarity determining region 3 for antibody 39179
ARALDIVVVVDAIWFDP

SEQ ID NO: 78359 - protein, 10 aa, Homo sapiens
  light chain complementarity determining region 3 for antibody 39180
PQYGSSPPYT

SEQ ID NO: 78360 - protein, 18 aa, Homo sapiens
  heavy chain complementarity determining region 3 for antibody 39180
ATGKWFGDFNFYYYAMDV

SEQ ID NO: 78361 - protein, 9 aa, Homo sapiens
  light chain complementarity determining region 3 for antibody 39181
PQYGSSPET

SEQ ID NO: 78362 - protein, 12 aa, Homo sapiens
  heavy chain complementarity determining region 3 for antibody 39181
ARGYGWCSCPEY

SEQ ID NO: 78363 - protein, 9 aa, Homo sapiens
  light chain complementarity determining region 3 for antibody 39182
PQYGSSFYS

SEQ ID NO: 78364 - protein, 14 aa, Homo sapiens
  heavy chain complementarity determining region 3 for antibody 39182
ARVGTYSYGEMFDY

SEQ ID NO: 78365 - protein, 9 aa, Homo sapiens
  light chain complementarity determining region 3 for antibody 39183
PQYGSLPLT

SEQ ID NO: 78366 - protein, 15 aa, Homo sapiens
  heavy chain complementarity determining region 3 for antibody 39183
AHRPNYYDKAGAFDI

SEQ ID NO: 78367 - protein, 9 aa, Homo sapiens
  light chain complementarity determining region 3 for antibody 39184
PQYGSIPRS

SEQ ID NO: 78368 - protein, 13 aa, Homo sapiens
  heavy chain complementarity determining region 3 for antibody 39184
AGGTWHSGIYYES

SEQ ID NO: 78369 - protein, 10 aa, Homo sapiens
  light chain complementarity determining region 3 for antibody 39185
PQYGRSPWGG

SEQ ID NO: 78370 - protein, 17 aa, Homo sapiens
  heavy chain complementarity determining region 3 for antibody 39185
AKDYGTVTKDLVGYLDY

SEQ ID NO: 78371 - protein, 9 aa, Homo sapiens
  light chain complementarity determining region 3 for antibody 39186
PQYGRLPQT

SEQ ID NO: 78372 - protein, 13 aa, Homo sapiens
  heavy chain complementarity determining region 3 for antibody 39186
ARRLVIGRNAFDI

SEQ ID NO: 78373 - protein, 9 aa, Homo sapiens
  light chain complementarity determining region 3 for antibody 39187
PQYGRLPIT

SEQ ID NO: 78374 - protein, 11 aa, Homo sapiens
  heavy chain complementarity determining region 3 for antibody 39187
AHRFRTYYFDH

SEQ ID NO: 78375 - protein, 9 aa, Homo sapiens
  light chain complementarity determining region 3 for antibody 39188
PQYGNSPRT

SEQ ID NO: 78376 - protein, 16 aa, Homo sapiens
  heavy chain complementarity determining region 3 for antibody 39188
ARGTFYQGSSDNYHEN

SEQ ID NO: 78377 - protein, 9 aa, Homo sapiens
  light chain complementarity determining region 3 for antibody 39189
PQYFSSPWT

SEQ ID NO: 78378 - protein, 13 aa, Homo sapiens
  heavy chain complementarity determining region 3 for antibody 39189
ARGSGSHYAPFDH

SEQ ID NO: 78379 - protein, 11 aa, Homo sapiens
  light chain complementarity determining region 3 for antibody 39190
PQYDRSPPGFP

SEQ ID NO: 78380 - protein, 14 aa, Homo sapiens
  heavy chain complementarity determining region 3 for antibody 39190
ARETHNSRKRSFDQ

SEQ ID NO: 78381 - protein, 9 aa, Homo sapiens
  light chain complementarity determining region 3 for antibody 39191
PQYDNWPRT

SEQ ID NO: 78382 - protein, 20 aa, Homo sapiens
  heavy chain complementarity determining region 3 for antibody 39191
ARLPDFFHGGLHYVNCHYDS

SEQ ID NO: 78383 - protein, 9 aa, Homo sapiens
  light chain complementarity determining region 3 for antibody 39192
PQSYTSPYT

SEQ ID NO: 78384 - protein, 16 aa, Homo sapiens
  heavy chain complementarity determining region 3 for antibody 39192
ATDWGSGTQWIRAFDV

SEQ ID NO: 78385 - protein, 9 aa, Homo sapiens
  light chain complementarity determining region 3 for antibody 39193
PQSYSSLYT

SEQ ID NO: 78386 - protein, 15 aa, Homo sapiens
  heavy chain complementarity determining region 3 for antibody 39193
TRGNSGNYLVRAFDI

SEQ ID NO: 78387 - protein, 9 aa, Homo sapiens
  light chain complementarity determining region 3 for antibody 39194
PQSYSSLLT

SEQ ID NO: 78388 - protein, 16 aa, Homo sapiens
  heavy chain complementarity determining region 3 for antibody 39194
AREGGSTYTTKRAFDS

SEQ ID NO: 78389 - protein, 10 aa, Homo sapiens
  light chain complementarity determining region 3 for antibody 39195
PQRYKWPPYT

SEQ ID NO: 78390 - protein, 11 aa, Homo sapiens
  heavy chain complementarity determining region 3 for antibody 39195
ARGVGSYVFES

SEQ ID NO: 78391 - protein, 10 aa, Homo sapiens
  light chain complementarity determining region 3 for antibody 39196
PQRYKWPPYT

SEQ ID NO: 78392 - protein, 11 aa, Homo sapiens
  heavy chain complementarity determining region 3 for antibody 39196
ARGVGSYVFDS

SEQ ID NO: 78393 - protein, 11 aa, Homo sapiens
  light chain complementarity determining region 3 for antibody 39197
PQRVNWPPSVT

SEQ ID NO: 78394 - protein, 15 aa, Homo sapiens
  heavy chain complementarity determining region 3 for antibody 39197
ARDRDGMYSAHAFDI

SEQ ID NO: 78395 - protein, 9 aa, Homo sapiens
  light chain complementarity determining region 3 for antibody 39198
PQRSNWPYT

SEQ ID NO: 78396 - protein, 11 aa, Homo sapiens
  heavy chain complementarity determining region 3 for antibody 39198
VRRWGGDEVDY

SEQ ID NO: 78397 - protein, 9 aa, Homo sapiens
  light chain complementarity determining region 3 for antibody 39199
PQRSNWPWT

SEQ ID NO: 78398 - protein, 10 aa, Homo sapiens
  heavy chain complementarity determining region 3 for antibody 39199
ARIAARRVDY

SEQ ID NO: 78399 - protein, 9 aa, Homo sapiens
  light chain complementarity determining region 3 for antibody 39200
PQRSNWPRT

SEQ ID NO: 78400 - protein, 9 aa, Homo sapiens
  heavy chain complementarity determining region 3 for antibody 39200
AREWYENDY

SEQ ID NO: 78401 - protein, 10 aa, Homo sapiens
  light chain complementarity determining region 3 for antibody 39201
PQRSNWPPIT

SEQ ID NO: 78402 - protein, 17 aa, Homo sapiens
  heavy chain complementarity determining region 3 for antibody 39201
AKAKSSSWYEVGSAFDI

SEQ ID NO: 78403 - protein, 9 aa, Homo sapiens
  light chain complementarity determining region 3 for antibody 39202
PQRSNWPLT

SEQ ID NO: 78404 - protein, 12 aa, Homo sapiens
  heavy chain complementarity determining region 3 for antibody 39202
TKTIAVTDKGDY

SEQ ID NO: 78405 - protein, 9 aa, Homo sapiens
  light chain complementarity determining region 3 for antibody 39203
PQRSNWPFT

SEQ ID NO: 78406 - protein, 16 aa, Homo sapiens
  heavy chain complementarity determining region 3 for antibody 39203
AGATSSDWYGGVLHDY

SEQ ID NO: 78407 - protein, 10 aa, Homo sapiens
  light chain complementarity determining region 3 for antibody 39204
PQRSDWPPYT

SEQ ID NO: 78408 - protein, 18 aa, Homo sapiens
  heavy chain complementarity determining region 3 for antibody 39204
AREGRSGYRIPAAYGMDV

SEQ ID NO: 78409 - protein, 9 aa, Homo sapiens
  light chain complementarity determining region 3 for antibody 39205
PQRSDWPET

SEQ ID NO: 78410 - protein, 9 aa, Homo sapiens
  heavy chain complementarity determining region 3 for antibody 39205
ASGDYAFDL

SEQ ID NO: 78411 - protein, 9 aa, Homo sapiens
  light chain complementarity determining region 3 for antibody 39206
PQRRTWPQT

SEQ ID NO: 78412 - protein, 16 aa, Homo sapiens
  heavy chain complementarity determining region 3 for antibody 39206
ARDGASSWYFKHGLDV

SEQ ID NO: 78413 - protein, 9 aa, Homo sapiens
  light chain complementarity determining region 3 for antibody 39207
PQNEYWPRT

SEQ ID NO: 78414 - protein, 11 aa, Homo sapiens
  heavy chain complementarity determining region 3 for antibody 39207
VRVGGAGYFDH

SEQ ID NO: 78415 - protein, 10 aa, Homo sapiens
  light chain complementarity determining region 3 for antibody 39208
PQLNSYLPFT

SEQ ID NO: 78416 - protein, 17 aa, Homo sapiens
  heavy chain complementarity determining region 3 for antibody 39208
ATEGKHDSSGYYEPFDY

SEQ ID NO: 78417 - protein, 9 aa, Homo sapiens
  light chain complementarity determining region 3 for antibody 39209
PQHYTTPHT

SEQ ID NO: 78418 - protein, 10 aa, Homo sapiens
  heavy chain complementarity determining region 3 for antibody 39209
ARGSYNSVWA

SEQ ID NO: 78419 - protein, 8 aa, Homo sapiens
  light chain complementarity determining region 3 for antibody 39210
PQHYNSWT

SEQ ID NO: 78420 - protein, 17 aa, Homo sapiens
  heavy chain complementarity determining region 3 for antibody 39210
VKDRGYSGYDSLGFFDD

SEQ ID NO: 78421 - protein, 9 aa, Homo sapiens
  light chain complementarity determining region 3 for antibody 39211
PQHNDYPWT

SEQ ID NO: 78422 - protein, 10 aa, Homo sapiens
  heavy chain complementarity determining region 3 for antibody 39211
ARDYEAALDY

SEQ ID NO: 78423 - protein, 9 aa, Homo sapiens
  light chain complementarity determining region 3 for antibody 39212
PQGYSSPYT

SEQ ID NO: 78424 - protein, 14 aa, Homo sapiens
  heavy chain complementarity determining region 3 for antibody 39212
ARDPQKGKPDYFDY

SEQ ID NO: 78425 - protein, 9 aa, Homo sapiens
  light chain complementarity determining region 3 for antibody 39213
PQGYDTPRT

SEQ ID NO: 78426 - protein, 12 aa, Homo sapiens
  heavy chain complementarity determining region 3 for antibody 39213
ASGGSRVTTLRY

SEQ ID NO: 78427 - protein, 9 aa, Homo sapiens
  light chain complementarity determining region 3 for antibody 39214
PQFDELPIT

SEQ ID NO: 78428 - protein, 9 aa, Homo sapiens
  heavy chain complementarity determining region 3 for antibody 39214
ARSTHPRGP

SEQ ID NO: 78429 - protein, 9 aa, Homo sapiens
  light chain complementarity determining region 3 for antibody 39215
PKYVSTPRP

SEQ ID NO: 78430 - protein, 18 aa, Homo sapiens
  heavy chain complementarity determining region 3 for antibody 39215
AHERWEKNPSYKYYGMDL

SEQ ID NO: 78431 - protein, 9 aa, Homo sapiens
  light chain complementarity determining region 3 for antibody 39216
PKYSSAPLT

SEQ ID NO: 78432 - protein, 14 aa, Homo sapiens
  heavy chain complementarity determining region 3 for antibody 39216
ARERGVMTTLLLVY

SEQ ID NO: 78433 - protein, 9 aa, Homo sapiens
  light chain complementarity determining region 3 for antibody 39217
PKYNSAPLT

SEQ ID NO: 78434 - protein, 20 aa, Homo sapiens
  heavy chain complementarity determining region 3 for antibody 39217
ATVLRGRGSSVYYVGGAFDI

SEQ ID NO: 78435 - protein, 9 aa, Homo sapiens
  light chain complementarity determining region 3 for antibody 39218
PHYYERPLT

SEQ ID NO: 78436 - protein, 15 aa, Homo sapiens
  heavy chain complementarity determining region 3 for antibody 39218
AREVIAVGDSDAFDI

SEQ ID NO: 78437 - protein, 9 aa, Homo sapiens
  light chain complementarity determining region 3 for antibody 39219
PHYNIYSET

SEQ ID NO: 78438 - protein, 8 aa, Homo sapiens
  heavy chain complementarity determining region 3 for antibody 39219
ATSPQRGS

SEQ ID NO: 78439 - protein, 9 aa, Homo sapiens
  light chain complementarity determining region 3 for antibody 39220
PHYNASSLT

SEQ ID NO: 78440 - protein, 16 aa, Homo sapiens
  heavy chain complementarity determining region 3 for antibody 39220
ASLGGAHYYGPGSHYF

SEQ ID NO: 78441 - protein, 9 aa, Homo sapiens
  light chain complementarity determining region 3 for antibody 39221
PHYHNWPYT

SEQ ID NO: 78442 - protein, 19 aa, Homo sapiens
  heavy chain complementarity determining region 3 for antibody 39221
ARDLWDCYGSGSCFDAFDF

SEQ ID NO: 78443 - protein, 10 aa, Homo sapiens
  light chain complementarity determining region 3 for antibody 39222
PHYHNWPPWT

SEQ ID NO: 78444 - protein, 13 aa, Homo sapiens
  heavy chain complementarity determining region 3 for antibody 39222
AKGRVRELYYFEP

SEQ ID NO: 78445 - protein, 10 aa, Homo sapiens
  light chain complementarity determining region 3 for antibody 39223
PHYHNLPPWT

SEQ ID NO: 78446 - protein, 13 aa, Homo sapiens
  heavy chain complementarity determining region 3 for antibody 39223
AKGRVRELYYFET

SEQ ID NO: 78447 - protein, 10 aa, Homo sapiens
  light chain complementarity determining region 3 for antibody 39224
PHYGSSLMYT

SEQ ID NO: 78448 - protein, 14 aa, Homo sapiens
  heavy chain complementarity determining region 3 for antibody 39224
TTDRPLTGMVTFDF

SEQ ID NO: 78449 - protein, 9 aa, Homo sapiens
  light chain complementarity determining region 3 for antibody 39225
PHSHSRPFT

SEQ ID NO: 78450 - protein, 20 aa, Homo sapiens
  heavy chain complementarity determining region 3 for antibody 39225
AKGISVAALRTVYYYYGMDV

SEQ ID NO: 78451 - protein, 10 aa, Homo sapiens
  light chain complementarity determining region 3 for antibody 39226
PHHHNWPPWT

SEQ ID NO: 78452 - protein, 13 aa, Homo sapiens
  heavy chain complementarity determining region 3 for antibody 39226
AKGRVRELYYFET

SEQ ID NO: 78453 - protein, 6 aa, Homo sapiens
  light chain complementarity determining region 3 for antibody 39227
PEYGST

SEQ ID NO: 78454 - protein, 12 aa, Homo sapiens
  heavy chain complementarity determining region 3 for antibody 39227
ARDHISGWSLSN

SEQ ID NO: 78455 - protein, 9 aa, Homo sapiens
  light chain complementarity determining region 3 for antibody 39228
NQWSNWPVT

SEQ ID NO: 78456 - protein, 14 aa, Homo sapiens
  heavy chain complementarity determining region 3 for antibody 39228
ARGVAAPIPRYFHH

SEQ ID NO: 78457 - protein, 6 aa, Homo sapiens
  light chain complementarity determining region 3 for antibody 39229
NQNGDS

SEQ ID NO: 78458 - protein, 11 aa, Homo sapiens
  heavy chain complementarity determining region 3 for antibody 39229
ARSGYPGAFDI

SEQ ID NO: 78459 - protein, 9 aa, Homo sapiens
  light chain complementarity determining region 3 for antibody 39230
NQGSNWPVT

SEQ ID NO: 78460 - protein, 14 aa, Homo sapiens
  heavy chain complementarity determining region 3 for antibody 39230
ARGVAAPIPRYFHH

SEQ ID NO: 78461 - protein, 9 aa, Homo sapiens
  light chain complementarity determining region 3 for antibody 39231
NQCSNWPAT

SEQ ID NO: 78462 - protein, 14 aa, Homo sapiens
  heavy chain complementarity determining region 3 for antibody 39231
ARGVAAPIPRYFHH

SEQ ID NO: 78463 - protein, 9 aa, Homo sapiens
  light chain complementarity determining region 3 for antibody 39232
MRALQTRYT

SEQ ID NO: 78464 - protein, 21 aa, Homo sapiens
  heavy chain complementarity determining region 3 for antibody 39232
ARDAPVSRPYSSGWYSSAFDY

SEQ ID NO: 78465 - protein, 9 aa, Homo sapiens
  light chain complementarity determining region 3 for antibody 39233
MRALETPFT

SEQ ID NO: 78466 - protein, 15 aa, Homo sapiens
  heavy chain complementarity determining region 3 for antibody 39233
VRHYRETVAGIEGDS

SEQ ID NO: 78467 - protein, 9 aa, Homo sapiens
  light chain complementarity determining region 3 for antibody 39234
MQVQQTRLT

SEQ ID NO: 78468 - protein, 20 aa, Homo sapiens
  heavy chain complementarity determining region 3 for antibody 39234
AREGHRATARNRYYYNGIDV

SEQ ID NO: 78469 - protein, 9 aa, Homo sapiens
  light chain complementarity determining region 3 for antibody 39235
MQVQQTPFT

SEQ ID NO: 78470 - protein, 20 aa, Homo sapiens
  heavy chain complementarity determining region 3 for antibody 39235
AREGHRATARNRYYYNGIDV

SEQ ID NO: 78471 - protein, 9 aa, Homo sapiens
  light chain complementarity determining region 3 for antibody 39236
MQVLQTPYT

SEQ ID NO: 78472 - protein, 21 aa, Homo sapiens
  heavy chain complementarity determining region 3 for antibody 39236
ARDAPVSRPYSSGWYSSAFDY

SEQ ID NO: 78473 - protein, 9 aa, Homo sapiens
  light chain complementarity determining region 3 for antibody 39237
MQVLQTPRT

SEQ ID NO: 78474 - protein, 20 aa, Homo sapiens
  heavy chain complementarity determining region 3 for antibody 39237
TTGTKLFISGTIYHCYAMDV

SEQ ID NO: 78475 - protein, 9 aa, Homo sapiens
  light chain complementarity determining region 3 for antibody 39238
MQVLQTPLP

SEQ ID NO: 78476 - protein, 12 aa, Homo sapiens
  heavy chain complementarity determining region 3 for antibody 39238
AKDSAKKWELLD

SEQ ID NO: 78477 - protein, 9 aa, Homo sapiens
  light chain complementarity determining region 3 for antibody 39239
MQVLQTPFT

SEQ ID NO: 78478 - protein, 13 aa, Homo sapiens
  heavy chain complementarity determining region 3 for antibody 39239
ARAITKAGSGFDY

SEQ ID NO: 78479 - protein, 9 aa, Homo sapiens
  light chain complementarity determining region 3 for antibody 39240
MQVLQIPPT

SEQ ID NO: 78480 - protein, 17 aa, Homo sapiens
  heavy chain complementarity determining region 3 for antibody 39240
ARDTKISWFGERDYFDP

SEQ ID NO: 78481 - protein, 9 aa, Homo sapiens
  light chain complementarity determining region 3 for antibody 39241
MQVLQAPLY

SEQ ID NO: 78482 - protein, 18 aa, Homo sapiens
  heavy chain complementarity determining region 3 for antibody 39241
ARPKVGATDYHYYFGMDV

SEQ ID NO: 78483 - protein, 9 aa, Homo sapiens
  light chain complementarity determining region 3 for antibody 39242
MQVLQAPLA

SEQ ID NO: 78484 - protein, 18 aa, Homo sapiens
  heavy chain complementarity determining region 3 for antibody 39242
ARPKVGATDYHYYFGMDV

SEQ ID NO: 78485 - protein, 9 aa, Homo sapiens
  light chain complementarity determining region 3 for antibody 39243
MQVLPTPLT

SEQ ID NO: 78486 - protein, 12 aa, Homo sapiens
  heavy chain complementarity determining region 3 for antibody 39243
AKDSAKKWELLD

SEQ ID NO: 78487 - protein, 9 aa, Homo sapiens
  light chain complementarity determining region 3 for antibody 39244
MQVLKTPPT

SEQ ID NO: 78488 - protein, 12 aa, Homo sapiens
  heavy chain complementarity determining region 3 for antibody 39244
AKDSAKKWELLD

SEQ ID NO: 78489 - protein, 9 aa, Homo sapiens
  light chain complementarity determining region 3 for antibody 39245
MQVLKTPLT

SEQ ID NO: 78490 - protein, 12 aa, Homo sapiens
  heavy chain complementarity determining region 3 for antibody 39245
AKDSAKKWELLD

SEQ ID NO: 78491 - protein, 9 aa, Homo sapiens
  light chain complementarity determining region 3 for antibody 39246
MQVHQTRFT

SEQ ID NO: 78492 - protein, 20 aa, Homo sapiens
  heavy chain complementarity determining region 3 for antibody 39246
AREGHRATARNRYYYNGIDV

SEQ ID NO: 78493 - protein, 9 aa, Homo sapiens
  light chain complementarity determining region 3 for antibody 39247
MQTVPFVWT

SEQ ID NO: 78494 - protein, 14 aa, Homo sapiens
  heavy chain complementarity determining region 3 for antibody 39247
ARSVNTGQYYGLGY

SEQ ID NO: 78495 - protein, 10 aa, Homo sapiens
  light chain complementarity determining region 3 for antibody 39248
MQTSHWPPPT

SEQ ID NO: 78496 - protein, 14 aa, Homo sapiens
  heavy chain complementarity determining region 3 for antibody 39248
ATEVLKWVAELSDF

SEQ ID NO: 78497 - protein, 9 aa, Homo sapiens
  light chain complementarity determining region 3 for antibody 39249
MQTLQTPGT

SEQ ID NO: 78498 - protein, 15 aa, Homo sapiens
  heavy chain complementarity determining region 3 for antibody 39249
ARAQVIWGQLYYFDS

SEQ ID NO: 78499 - protein, 9 aa, Homo sapiens
  light chain complementarity determining region 3 for antibody 39250
MQTLQTLDT

SEQ ID NO: 78500 - protein, 18 aa, Homo sapiens
  heavy chain complementarity determining region 3 for antibody 39250
AKDGYHGSESYPAPRIVN

SEQ ID NO: 78501 - protein, 9 aa, Homo sapiens
  light chain complementarity determining region 3 for antibody 39251
MQTLHTPWT

SEQ ID NO: 78502 - protein, 16 aa, Homo sapiens
  heavy chain complementarity determining region 3 for antibody 39251
ARGQTAAVIHVYGLDV

SEQ ID NO: 78503 - protein, 9 aa, Homo sapiens
  light chain complementarity determining region 3 for antibody 39252
MQTLHTPGT

SEQ ID NO: 78504 - protein, 16 aa, Homo sapiens
  heavy chain complementarity determining region 3 for antibody 39252
ARVQTAAVIHVYGLDV

SEQ ID NO: 78505 - protein, 10 aa, Homo sapiens
  light chain complementarity determining region 3 for antibody 39253
MQTAHGPPPT

SEQ ID NO: 78506 - protein, 14 aa, Homo sapiens
  heavy chain complementarity determining region 3 for antibody 39253
ATEVLKWVAELSDF

SEQ ID NO: 78507 - protein, 9 aa, Homo sapiens
  light chain complementarity determining region 3 for antibody 39254
MQSTQWRGT

SEQ ID NO: 78508 - protein, 16 aa, Homo sapiens
  heavy chain complementarity determining region 3 for antibody 39254
GTRQYLYDTSGYSFDS

SEQ ID NO: 78509 - protein, 8 aa, Homo sapiens
  light chain complementarity determining region 3 for antibody 39255
MQSTQGPT

SEQ ID NO: 78510 - protein, 21 aa, Homo sapiens
  heavy chain complementarity determining region 3 for antibody 39255
AKDRPNYYGSNAGYYTPGGDR

SEQ ID NO: 78511 - protein, 8 aa, Homo sapiens
  light chain complementarity determining region 3 for antibody 39256
MQSTQGPP

SEQ ID NO: 78512 - protein, 21 aa, Homo sapiens
  heavy chain complementarity determining region 3 for antibody 39256
AKDRPNYYGSNAGYYTPGGDR

SEQ ID NO: 78513 - protein, 10 aa, Homo sapiens
  light chain complementarity determining region 3 for antibody 39257
MQSTHWRRIT

SEQ ID NO: 78514 - protein, 16 aa, Homo sapiens
  heavy chain complementarity determining region 3 for antibody 39257
VKDALTSYYDSSGYYH

SEQ ID NO: 78515 - protein, 9 aa, Homo sapiens
  light chain complementarity determining region 3 for antibody 39258
MQSTHWPYT

SEQ ID NO: 78516 - protein, 12 aa, Homo sapiens
  heavy chain complementarity determining region 3 for antibody 39258
ARDKSNHNPLVY

SEQ ID NO: 78517 - protein, 9 aa, Homo sapiens
  light chain complementarity determining region 3 for antibody 39259
MQSTHWPWT

SEQ ID NO: 78518 - protein, 10 aa, Homo sapiens
  heavy chain complementarity determining region 3 for antibody 39259
VQDHRYSSGN

SEQ ID NO: 78519 - protein, 10 aa, Homo sapiens
  light chain complementarity determining region 3 for antibody 39260
MQSTHWPRIT

SEQ ID NO: 78520 - protein, 16 aa, Homo sapiens
  heavy chain complementarity determining region 3 for antibody 39260
VKDALTSYYDSSGYDH

SEQ ID NO: 78521 - protein, 10 aa, Homo sapiens
  light chain complementarity determining region 3 for antibody 39261
MQSTHWPGTT

SEQ ID NO: 78522 - protein, 16 aa, Homo sapiens
  heavy chain complementarity determining region 3 for antibody 39261
VKDALTSYYDSSGYYH

SEQ ID NO: 78523 - protein, 10 aa, Homo sapiens
  light chain complementarity determining region 3 for antibody 39262
MQSTHWPGIT

SEQ ID NO: 78524 - protein, 16 aa, Homo sapiens
  heavy chain complementarity determining region 3 for antibody 39262
VKDALTSYYDSSGYYH

SEQ ID NO: 78525 - protein, 9 aa, Homo sapiens
  light chain complementarity determining region 3 for antibody 39263
MQSRRWRHT

SEQ ID NO: 78526 - protein, 8 aa, Homo sapiens
  heavy chain complementarity determining region 3 for antibody 39263
TAWGSSQH

SEQ ID NO: 78527 - protein, 9 aa, Homo sapiens
  light chain complementarity determining region 3 for antibody 39264
MQSRRWPPT

SEQ ID NO: 78528 - protein, 8 aa, Homo sapiens
  heavy chain complementarity determining region 3 for antibody 39264
TAWGSSHH

SEQ ID NO: 78529 - protein, 9 aa, Homo sapiens
  light chain complementarity determining region 3 for antibody 39265
MQSRRWPHP

SEQ ID NO: 78530 - protein, 8 aa, Homo sapiens
  heavy chain complementarity determining region 3 for antibody 39265
TAWGSSQH

SEQ ID NO: 78531 - protein, 9 aa, Homo sapiens
  light chain complementarity determining region 3 for antibody 39266
MQSRGGPHT

SEQ ID NO: 78532 - protein, 8 aa, Homo sapiens
  heavy chain complementarity determining region 3 for antibody 39266
TAWGSSQH

SEQ ID NO: 78533 - protein, 9 aa, Homo sapiens
  light chain complementarity determining region 3 for antibody 39267
MQSLQSPPA

SEQ ID NO: 78534 - protein, 25 aa, Homo sapiens
  heavy chain complementarity determining region 3 for antibody 39267
ARGFFDFWTGYLGLTIVNYYYGMDV

SEQ ID NO: 78535 - protein, 8 aa, Homo sapiens
  light chain complementarity determining region 3 for antibody 39268
MQSLQRLT

SEQ ID NO: 78536 - protein, 12 aa, Homo sapiens
  heavy chain complementarity determining region 3 for antibody 39268
VKDCGLGGSRDL

SEQ ID NO: 78537 - protein, 9 aa, Homo sapiens
  light chain complementarity determining region 3 for antibody 39269
MQSLQAPTT

SEQ ID NO: 78538 - protein, 12 aa, Homo sapiens
  heavy chain complementarity determining region 3 for antibody 39269
TRDPPTRWGMEV

SEQ ID NO: 78539 - protein, 8 aa, Homo sapiens
  light chain complementarity determining region 3 for antibody 39270
MQSLQALI

SEQ ID NO: 78540 - protein, 8 aa, Homo sapiens
  heavy chain complementarity determining region 3 for antibody 39270
VSQMRSPY

SEQ ID NO: 78541 - protein, 8 aa, Homo sapiens
  light chain complementarity determining region 3 for antibody 39271
MQSLHRLT

SEQ ID NO: 78542 - protein, 12 aa, Homo sapiens
  heavy chain complementarity determining region 3 for antibody 39271
VKDCGLGGSRDF

SEQ ID NO: 78543 - protein, 9 aa, Homo sapiens
  light chain complementarity determining region 3 for antibody 39272
MQSLHAPIT

SEQ ID NO: 78544 - protein, 12 aa, Homo sapiens
  heavy chain complementarity determining region 3 for antibody 39272
TRDPPTRWGMEV

SEQ ID NO: 78545 - protein, 10 aa, Homo sapiens
  light chain complementarity determining region 3 for antibody 39273
MQSIQPPGWT

SEQ ID NO: 78546 - protein, 8 aa, Homo sapiens
  heavy chain complementarity determining region 3 for antibody 39273
AKGYGFDC

SEQ ID NO: 78547 - protein, 10 aa, Homo sapiens
  light chain complementarity determining region 3 for antibody 39274
MQSIKPPRGT

SEQ ID NO: 78548 - protein, 8 aa, Homo sapiens
  heavy chain complementarity determining region 3 for antibody 39274
AKGYGFDC

SEQ ID NO: 78549 - protein, 9 aa, Homo sapiens
  light chain complementarity determining region 3 for antibody 39275
MQRVQTPGT

SEQ ID NO: 78550 - protein, 17 aa, Homo sapiens
  heavy chain complementarity determining region 3 for antibody 39275
IPVMLVRFLEDLHLFNY

SEQ ID NO: 78551 - protein, 9 aa, Homo sapiens
  light chain complementarity determining region 3 for antibody 39276
MQRVPTPGT

SEQ ID NO: 78552 - protein, 17 aa, Homo sapiens
  heavy chain complementarity determining region 3 for antibody 39276
IPVMLVRFLEDLQLFNY

SEQ ID NO: 78553 - protein, 8 aa, Homo sapiens
  light chain complementarity determining region 3 for antibody 39277
MQRTQWPT

SEQ ID NO: 78554 - protein, 21 aa, Homo sapiens
  heavy chain complementarity determining region 3 for antibody 39277
AKDRPNYYGTNAGYYTPGGDL

SEQ ID NO: 78555 - protein, 8 aa, Homo sapiens
  light chain complementarity determining region 3 for antibody 39278
MQRTQWPT

SEQ ID NO: 78556 - protein, 21 aa, Homo sapiens
  heavy chain complementarity determining region 3 for antibody 39278
AKDRPNYYGSNAGYYTPGGDR

SEQ ID NO: 78557 - protein, 10 aa, Homo sapiens
  light chain complementarity determining region 3 for antibody 39279
MQRTHWPRTT

SEQ ID NO: 78558 - protein, 16 aa, Homo sapiens
  heavy chain complementarity determining region 3 for antibody 39279
VKDALTSYYDSSGYYH

SEQ ID NO: 78559 - protein, 9 aa, Homo sapiens
  light chain complementarity determining region 3 for antibody 39280
MQRRRWPPT

SEQ ID NO: 78560 - protein, 8 aa, Homo sapiens
  heavy chain complementarity determining region 3 for antibody 39280
TAWGSSQH

SEQ ID NO: 78561 - protein, 9 aa, Homo sapiens
  light chain complementarity determining region 3 for antibody 39281
MQPLQTPYP

SEQ ID NO: 78562 - protein, 13 aa, Homo sapiens
  heavy chain complementarity determining region 3 for antibody 39281
AHWGHTNGWHFDY

SEQ ID NO: 78563 - protein, 9 aa, Homo sapiens
  light chain complementarity determining region 3 for antibody 39282
MQPLQTPDT

SEQ ID NO: 78564 - protein, 13 aa, Homo sapiens
  heavy chain complementarity determining region 3 for antibody 39282
AHWGHTNGWHFDY

SEQ ID NO: 78565 - protein, 8 aa, Homo sapiens
  light chain complementarity determining region 3 for antibody 39283
MQPLQGFI

SEQ ID NO: 78566 - protein, 12 aa, Homo sapiens
  heavy chain complementarity determining region 3 for antibody 39283
VRGAPDYGVFDF

SEQ ID NO: 78567 - protein, 9 aa, Homo sapiens
  light chain complementarity determining region 3 for antibody 39284
MQNTQWPPT

SEQ ID NO: 78568 - protein, 8 aa, Homo sapiens
  heavy chain complementarity determining region 3 for antibody 39284
ALGQDMGR

SEQ ID NO: 78569 - protein, 9 aa, Homo sapiens
  light chain complementarity determining region 3 for antibody 39285
MQNTQCPLT

SEQ ID NO: 78570 - protein, 8 aa, Homo sapiens
  heavy chain complementarity determining region 3 for antibody 39285
ALGQDMIY

SEQ ID NO: 78571 - protein, 9 aa, Homo sapiens
  light chain complementarity determining region 3 for antibody 39286
MQNLQTPTT

SEQ ID NO: 78572 - protein, 17 aa, Homo sapiens
  heavy chain complementarity determining region 3 for antibody 39286
ARVGPWLQYSGYDYPDY

SEQ ID NO: 78573 - protein, 9 aa, Homo sapiens
  light chain complementarity determining region 3 for antibody 39287
MQLTHWPWT

SEQ ID NO: 78574 - protein, 12 aa, Homo sapiens
  heavy chain complementarity determining region 3 for antibody 39287
ATSPHRDSRSSY

SEQ ID NO: 78575 - protein, 9 aa, Homo sapiens
  light chain complementarity determining region 3 for antibody 39288
MQLTHWPGT

SEQ ID NO: 78576 - protein, 12 aa, Homo sapiens
  heavy chain complementarity determining region 3 for antibody 39288
ATSPHRDSRSSY

SEQ ID NO: 78577 - protein, 9 aa, Homo sapiens
  light chain complementarity determining region 3 for antibody 39289
MQHTNWPWT

SEQ ID NO: 78578 - protein, 12 aa, Homo sapiens
  heavy chain complementarity determining region 3 for antibody 39289
ATSPHRDSRSSY

SEQ ID NO: 78579 - protein, 9 aa, Homo sapiens
  light chain complementarity determining region 3 for antibody 39290
MQHTHWPWR

SEQ ID NO: 78580 - protein, 12 aa, Homo sapiens
  heavy chain complementarity determining region 3 for antibody 39290
ATSPHRDSRSSY

SEQ ID NO: 78581 - protein, 9 aa, Homo sapiens
  light chain complementarity determining region 3 for antibody 39291
MQHTHWPWP

SEQ ID NO: 78582 - protein, 12 aa, Homo sapiens
  heavy chain complementarity determining region 3 for antibody 39291
ATSPHRDSRSSY

SEQ ID NO: 78583 - protein, 9 aa, Homo sapiens
  light chain complementarity determining region 3 for antibody 39292
MQHTHWPWK

SEQ ID NO: 78584 - protein, 12 aa, Homo sapiens
  heavy chain complementarity determining region 3 for antibody 39292
ATSPHRDSRSSY

SEQ ID NO: 78585 - protein, 9 aa, Homo sapiens
  light chain complementarity determining region 3 for antibody 39293
MQHTHWPRT

SEQ ID NO: 78586 - protein, 12 aa, Homo sapiens
  heavy chain complementarity determining region 3 for antibody 39293
ATSPHRDSRSSY

SEQ ID NO: 78587 - protein, 9 aa, Homo sapiens
  light chain complementarity determining region 3 for antibody 39294
MQHTHWPLT

SEQ ID NO: 78588 - protein, 12 aa, Homo sapiens
  heavy chain complementarity determining region 3 for antibody 39294
ATSPHRDSRSSY

SEQ ID NO: 78589 - protein, 9 aa, Homo sapiens
  light chain complementarity determining region 3 for antibody 39295
MQHQHWPWT

SEQ ID NO: 78590 - protein, 12 aa, Homo sapiens
  heavy chain complementarity determining region 3 for antibody 39295
ATSPHRDSRSSY

SEQ ID NO: 78591 - protein, 9 aa, Homo sapiens
  light chain complementarity determining region 3 for antibody 39296
MQHKNWPGT

SEQ ID NO: 78592 - protein, 12 aa, Homo sapiens
  heavy chain complementarity determining region 3 for antibody 39296
ATSPHRDSRSSY

SEQ ID NO: 78593 - protein, 9 aa, Homo sapiens
  light chain complementarity determining region 3 for antibody 39297
MQHIHWPWT

SEQ ID NO: 78594 - protein, 12 aa, Homo sapiens
  heavy chain complementarity determining region 3 for antibody 39297
ATSPHRDSRSSY

SEQ ID NO: 78595 - protein, 9 aa, Homo sapiens
  light chain complementarity determining region 3 for antibody 39298
MQGVQSPHT

SEQ ID NO: 78596 - protein, 15 aa, Homo sapiens
  heavy chain complementarity determining region 3 for antibody 39298
ARDYLSGTPGVAFDM

SEQ ID NO: 78597 - protein, 9 aa, Homo sapiens
  light chain complementarity determining region 3 for antibody 39299
MQGVAWPWR

SEQ ID NO: 78598 - protein, 11 aa, Homo sapiens
  heavy chain complementarity determining region 3 for antibody 39299
WAGYKYGTGDY

SEQ ID NO: 78599 - protein, 9 aa, Homo sapiens
  light chain complementarity determining region 3 for antibody 39300
MQGVAWPGR

SEQ ID NO: 78600 - protein, 11 aa, Homo sapiens
  heavy chain complementarity determining region 3 for antibody 39300
WAGYKYGTGDY

SEQ ID NO: 78601 - protein, 9 aa, Homo sapiens
  light chain complementarity determining region 3 for antibody 39301
MQGVAGPGT

SEQ ID NO: 78602 - protein, 11 aa, Homo sapiens
  heavy chain complementarity determining region 3 for antibody 39301
WAGYKYGTGDY

SEQ ID NO: 78603 - protein, 9 aa, Homo sapiens
  light chain complementarity determining region 3 for antibody 39302
MQGTYWPQL

SEQ ID NO: 78604 - protein, 11 aa, Homo sapiens
  heavy chain complementarity determining region 3 for antibody 39302
ARDPFFGALDC

SEQ ID NO: 78605 - protein, 9 aa, Homo sapiens
  light chain complementarity determining region 3 for antibody 39303
MQGTYWPQI

SEQ ID NO: 78606 - protein, 11 aa, Homo sapiens
  heavy chain complementarity determining region 3 for antibody 39303
ARDPFFGALDC

SEQ ID NO: 78607 - protein, 8 aa, Homo sapiens
  light chain complementarity determining region 3 for antibody 39304
MQGTYWPP

SEQ ID NO: 78608 - protein, 17 aa, Homo sapiens
  heavy chain complementarity determining region 3 for antibody 39304
SIYWYDGNYANPDYFDY

SEQ ID NO: 78609 - protein, 10 aa, Homo sapiens
  light chain complementarity determining region 3 for antibody 39305
MQGTYWPPLT

SEQ ID NO: 78610 - protein, 12 aa, Homo sapiens
  heavy chain complementarity determining region 3 for antibody 39305
AKDLYGDYDFDY

SEQ ID NO: 78611 - protein, 9 aa, Homo sapiens
  light chain complementarity determining region 3 for antibody 39306
MQGTYWLHI

SEQ ID NO: 78612 - protein, 11 aa, Homo sapiens
  heavy chain complementarity determining region 3 for antibody 39306
ARDPFFGALDC

SEQ ID NO: 78613 - protein, 9 aa, Homo sapiens
  light chain complementarity determining region 3 for antibody 39307
MQGTTWPRT

SEQ ID NO: 78614 - protein, 10 aa, Homo sapiens
  heavy chain complementarity determining region 3 for antibody 39307
ARVSLGGFDP

SEQ ID NO: 78615 - protein, 9 aa, Homo sapiens
  light chain complementarity determining region 3 for antibody 39308
MQGTSWPYT

SEQ ID NO: 78616 - protein, 19 aa, Homo sapiens
  heavy chain complementarity determining region 3 for antibody 39308
ARDWGTEVTAGVWIGWFDP

SEQ ID NO: 78617 - protein, 8 aa, Homo sapiens
  light chain complementarity determining region 3 for antibody 39309
MQGTSGRT

SEQ ID NO: 78618 - protein, 17 aa, Homo sapiens
  heavy chain complementarity determining region 3 for antibody 39309
AHRRYYNGNWNGATGDV

SEQ ID NO: 78619 - protein, 8 aa, Homo sapiens
  light chain complementarity determining region 3 for antibody 39310
MQGTSGRG

SEQ ID NO: 78620 - protein, 17 aa, Homo sapiens
  heavy chain complementarity determining region 3 for antibody 39310
AHRRYYNGNWNGATCDV

SEQ ID NO: 78621 - protein, 8 aa, Homo sapiens
  light chain complementarity determining region 3 for antibody 39311
MQGTSGRA

SEQ ID NO: 78622 - protein, 17 aa, Homo sapiens
  heavy chain complementarity determining region 3 for antibody 39311
AHRRYYNGNWNGATVDV

SEQ ID NO: 78623 - protein, 8 aa, Homo sapiens
  light chain complementarity determining region 3 for antibody 39312
MQGTSGGA

SEQ ID NO: 78624 - protein, 17 aa, Homo sapiens
  heavy chain complementarity determining region 3 for antibody 39312
AHRRYYNGNWNGATCDV

SEQ ID NO: 78625 - protein, 9 aa, Homo sapiens
  light chain complementarity determining region 3 for antibody 39313
MQGTRWRYT

SEQ ID NO: 78626 - protein, 19 aa, Homo sapiens
  heavy chain complementarity determining region 3 for antibody 39313
ARDWGTEVTAGVWIGWFDP

SEQ ID NO: 78627 - protein, 8 aa, Homo sapiens
  light chain complementarity determining region 3 for antibody 39314
MQGTQWRR

SEQ ID NO: 78628 - protein, 15 aa, Homo sapiens
  heavy chain complementarity determining region 3 for antibody 39314
VRDWAITRLLGNFDC

SEQ ID NO: 78629 - protein, 8 aa, Homo sapiens
  light chain complementarity determining region 3 for antibody 39315
MQGTQWGT

SEQ ID NO: 78630 - protein, 15 aa, Homo sapiens
  heavy chain complementarity determining region 3 for antibody 39315
VRDWAITRLLGNFDC

SEQ ID NO: 78631 - protein, 8 aa, Homo sapiens
  light chain complementarity determining region 3 for antibody 39316
MQGTQWGR

SEQ ID NO: 78632 - protein, 15 aa, Homo sapiens
  heavy chain complementarity determining region 3 for antibody 39316
VRDWAITRLLGNFDC

SEQ ID NO: 78633 - protein, 9 aa, Homo sapiens
  light chain complementarity determining region 3 for antibody 39317
MQGTQRPPT

SEQ ID NO: 78634 - protein, 16 aa, Homo sapiens
  heavy chain complementarity determining region 3 for antibody 39317
ATDWGSGTQWIRAFDV

SEQ ID NO: 78635 - protein, 9 aa, Homo sapiens
  light chain complementarity determining region 3 for antibody 39318
MQGTQGPWT

SEQ ID NO: 78636 - protein, 15 aa, Homo sapiens
  heavy chain complementarity determining region 3 for antibody 39318
VRFPPDLDIVGMIDY

SEQ ID NO: 78637 - protein, 9 aa, Homo sapiens
  light chain complementarity determining region 3 for antibody 39319
MQGTPWPQT

SEQ ID NO: 78638 - protein, 18 aa, Homo sapiens
  heavy chain complementarity determining region 3 for antibody 39319
TRDLRIAMAGTDDNGMDA

SEQ ID NO: 78639 - protein, 10 aa, Homo sapiens
  light chain complementarity determining region 3 for antibody 39320
MQGTPWPPWT

SEQ ID NO: 78640 - protein, 11 aa, Homo sapiens
  heavy chain complementarity determining region 3 for antibody 39320
ARDHPGIGIDY

SEQ ID NO: 78641 - protein, 9 aa, Homo sapiens
  light chain complementarity determining region 3 for antibody 39321
MQGTPWPPT

SEQ ID NO: 78642 - protein, 20 aa, Homo sapiens
  heavy chain complementarity determining region 3 for antibody 39321
ARGRQRTGYSSSWYLGHFDY

SEQ ID NO: 78643 - protein, 9 aa, Homo sapiens
  light chain complementarity determining region 3 for antibody 39322
MQGTPWPKT

SEQ ID NO: 78644 - protein, 9 aa, Homo sapiens
  heavy chain complementarity determining region 3 for antibody 39322
AKGYYDSSY

SEQ ID NO: 78645 - protein, 9 aa, Homo sapiens
  light chain complementarity determining region 3 for antibody 39323
MQGTPWPGT

SEQ ID NO: 78646 - protein, 19 aa, Homo sapiens
  heavy chain complementarity determining region 3 for antibody 39323
ARGPPRLFSVYWYSNGMDF

SEQ ID NO: 78647 - protein, 9 aa, Homo sapiens
  light chain complementarity determining region 3 for antibody 39324
MQGTPWPGT

SEQ ID NO: 78648 - protein, 10 aa, Homo sapiens
  heavy chain complementarity determining region 3 for antibody 39324
ARDWGLGSGN

SEQ ID NO: 78649 - protein, 8 aa, Homo sapiens
  light chain complementarity determining region 3 for antibody 39325
MQGTPMYT

SEQ ID NO: 78650 - protein, 15 aa, Homo sapiens
  heavy chain complementarity determining region 3 for antibody 39325
ARCGANSCPQSAMDV

SEQ ID NO: 78651 - protein, 9 aa, Homo sapiens
  light chain complementarity determining region 3 for antibody 39326
MQGTPGPLT

SEQ ID NO: 78652 - protein, 19 aa, Homo sapiens
  heavy chain complementarity determining region 3 for antibody 39326
VRDDRDHCSGGSCEGYFDD

SEQ ID NO: 78653 - protein, 9 aa, Homo sapiens
  light chain complementarity determining region 3 for antibody 39327
MQGTNWPPM

SEQ ID NO: 78654 - protein, 14 aa, Homo sapiens
  heavy chain complementarity determining region 3 for antibody 39327
VRDADSGGPNDMDV

SEQ ID NO: 78655 - protein, 10 aa, Homo sapiens
  light chain complementarity determining region 3 for antibody 39328
MQGTNWPPGT

SEQ ID NO: 78656 - protein, 11 aa, Homo sapiens
  heavy chain complementarity determining region 3 for antibody 39328
ARDHPGIGIDY

SEQ ID NO: 78657 - protein, 9 aa, Homo sapiens
  light chain complementarity determining region 3 for antibody 39329
MQGTNWPLT

SEQ ID NO: 78658 - protein, 18 aa, Homo sapiens
  heavy chain complementarity determining region 3 for antibody 39329
ARDRISVSVIHTYYSVDI

SEQ ID NO: 78659 - protein, 9 aa, Homo sapiens
  light chain complementarity determining region 3 for antibody 39330
MQGTNWPLT

SEQ ID NO: 78660 - protein, 17 aa, Homo sapiens
  heavy chain complementarity determining region 3 for antibody 39330
ARDDRAAAAGGEYYFDL

SEQ ID NO: 78661 - protein, 9 aa, Homo sapiens
  light chain complementarity determining region 3 for antibody 39331
MQGTNWPLA

SEQ ID NO: 78662 - protein, 16 aa, Homo sapiens
  heavy chain complementarity determining region 3 for antibody 39331
ARDERGDHGDYGYFDL

SEQ ID NO: 78663 - protein, 9 aa, Homo sapiens
  light chain complementarity determining region 3 for antibody 39332
MQGTNWPKT

SEQ ID NO: 78664 - protein, 9 aa, Homo sapiens
  heavy chain complementarity determining region 3 for antibody 39332
AKGYYDSSY

SEQ ID NO: 78665 - protein, 9 aa, Homo sapiens
  light chain complementarity determining region 3 for antibody 39333
MQGTNWPHT

SEQ ID NO: 78666 - protein, 17 aa, Homo sapiens
  heavy chain complementarity determining region 3 for antibody 39333
AREPQAHNDLYSGYEKN

SEQ ID NO: 78667 - protein, 9 aa, Homo sapiens
  light chain complementarity determining region 3 for antibody 39334
MQGTNWPGT

SEQ ID NO: 78668 - protein, 16 aa, Homo sapiens
  heavy chain complementarity determining region 3 for antibody 39334
TGDQRDRIFGVLDLPT

SEQ ID NO: 78669 - protein, 7 aa, Homo sapiens
  light chain complementarity determining region 3 for antibody 39335
MQGTNWP

SEQ ID NO: 78670 - protein, 17 aa, Homo sapiens
  heavy chain complementarity determining region 3 for antibody 39335
ARVPYYYDSSGYNVRDY

SEQ ID NO: 78671 - protein, 10 aa, Homo sapiens
  light chain complementarity determining region 3 for antibody 39336
MQGTNGPPYT

SEQ ID NO: 78672 - protein, 15 aa, Homo sapiens
  heavy chain complementarity determining region 3 for antibody 39336
AKSTVTTMSGGHVDS

SEQ ID NO: 78673 - protein, 8 aa, Homo sapiens
  light chain complementarity determining region 3 for antibody 39337
MQGTHWVT

SEQ ID NO: 78674 - protein, 15 aa, Homo sapiens
  heavy chain complementarity determining region 3 for antibody 39337
AKAPPGGTWGPSFDS

SEQ ID NO: 78675 - protein, 9 aa, Homo sapiens
  light chain complementarity determining region 3 for antibody 39338
MQGTHWSNT

SEQ ID NO: 78676 - protein, 11 aa, Homo sapiens
  heavy chain complementarity determining region 3 for antibody 39338
ASVRLGGPGAY

SEQ ID NO: 78677 - protein, 9 aa, Homo sapiens
  light chain complementarity determining region 3 for antibody 39339
MQGTHWRPT

SEQ ID NO: 78678 - protein, 19 aa, Homo sapiens
  heavy chain complementarity determining region 3 for antibody 39339
VRDDRDHCSGGSCEGYFDD

SEQ ID NO: 78679 - protein, 10 aa, Homo sapiens
  light chain complementarity determining region 3 for antibody 39340
MQGTHWRPRP

SEQ ID NO: 78680 - protein, 17 aa, Homo sapiens
  heavy chain complementarity determining region 3 for antibody 39340
ARALDIVVVVDAIWFDP

SEQ ID NO: 78681 - protein, 9 aa, Homo sapiens
  light chain complementarity determining region 3 for antibody 39341
MQGTHWQLT

SEQ ID NO: 78682 - protein, 19 aa, Homo sapiens
  heavy chain complementarity determining region 3 for antibody 39341
VRDDRDHCSGGSCEGYFDD

SEQ ID NO: 78683 - protein, 9 aa, Homo sapiens
  light chain complementarity determining region 3 for antibody 39342
MQGTHWPWT

SEQ ID NO: 78684 - protein, 16 aa, Homo sapiens
  heavy chain complementarity determining region 3 for antibody 39342
TGDQRDRIFGVLDLPP

SEQ ID NO: 78685 - protein, 9 aa, Homo sapiens
  light chain complementarity determining region 3 for antibody 39343
MQGTHWPWT

SEQ ID NO: 78686 - protein, 18 aa, Homo sapiens
  heavy chain complementarity determining region 3 for antibody 39343
ARGPPRLSVYWYSNGMDF

SEQ ID NO: 78687 - protein, 9 aa, Homo sapiens
  light chain complementarity determining region 3 for antibody 39344
MQGTHWPWR

SEQ ID NO: 78688 - protein, 10 aa, Homo sapiens
  heavy chain complementarity determining region 3 for antibody 39344
ARETHWGPDY

SEQ ID NO: 78689 - protein, 9 aa, Homo sapiens
  light chain complementarity determining region 3 for antibody 39345
MQGTHWPWR

SEQ ID NO: 78690 - protein, 12 aa, Homo sapiens
  heavy chain complementarity determining region 3 for antibody 39345
AKGPLIAMTGMI

SEQ ID NO: 78691 - protein, 9 aa, Homo sapiens
  light chain complementarity determining region 3 for antibody 39346
MQGTHWPWP

SEQ ID NO: 78692 - protein, 10 aa, Homo sapiens
  heavy chain complementarity determining region 3 for antibody 39346
ARETHWGPDY

SEQ ID NO: 78693 - protein, 8 aa, Homo sapiens
  light chain complementarity determining region 3 for antibody 39347
MQGTHWPT

SEQ ID NO: 78694 - protein, 21 aa, Homo sapiens
  heavy chain complementarity determining region 3 for antibody 39347
ARDRPNYYESNGQYYTPKGDL

SEQ ID NO: 78695 - protein, 10 aa, Homo sapiens
  light chain complementarity determining region 3 for antibody 39348
MQGTHWPRWT

SEQ ID NO: 78696 - protein, 7 aa, Homo sapiens
  heavy chain complementarity determining region 3 for antibody 39348
VRGTFDI

SEQ ID NO: 78697 - protein, 9 aa, Homo sapiens
  light chain complementarity determining region 3 for antibody 39349
MQGTHWPRT

SEQ ID NO: 78698 - protein, 10 aa, Homo sapiens
  heavy chain complementarity determining region 3 for antibody 39349
ASLNRRTSRR

SEQ ID NO: 78699 - protein, 9 aa, Homo sapiens
  light chain complementarity determining region 3 for antibody 39350
MQGTHWPRP

SEQ ID NO: 78700 - protein, 12 aa, Homo sapiens
  heavy chain complementarity determining region 3 for antibody 39350
ARGSHLIMFGGL

SEQ ID NO: 78701 - protein, 9 aa, Homo sapiens
  light chain complementarity determining region 3 for antibody 39351
MQGTHWPRG

SEQ ID NO: 78702 - protein, 16 aa, Homo sapiens
  heavy chain complementarity determining region 3 for antibody 39351
ARDERGDHGDYGYFDL

SEQ ID NO: 78703 - protein, 9 aa, Homo sapiens
  light chain complementarity determining region 3 for antibody 39352
MQGTHWPQP

SEQ ID NO: 78704 - protein, 18 aa, Homo sapiens
  heavy chain complementarity determining region 3 for antibody 39352
TRDLRIAMAGTDDNGMDA

SEQ ID NO: 78705 - protein, 10 aa, Homo sapiens
  light chain complementarity determining region 3 for antibody 39353
MQGTHWPPYT

SEQ ID NO: 78706 - protein, 15 aa, Homo sapiens
  heavy chain complementarity determining region 3 for antibody 39353
AKSSGQNIAVAGFDC

SEQ ID NO: 78707 - protein, 10 aa, Homo sapiens
  light chain complementarity determining region 3 for antibody 39354
MQGTHWPPYP

SEQ ID NO: 78708 - protein, 11 aa, Homo sapiens
  heavy chain complementarity determining region 3 for antibody 39354
VRVGGAGYFDH

SEQ ID NO: 78709 - protein, 10 aa, Homo sapiens
  light chain complementarity determining region 3 for antibody 39355
MQGTHWPPWT

SEQ ID NO: 78710 - protein, 8 aa, Homo sapiens
  heavy chain complementarity determining region 3 for antibody 39355
ARVDGSGH

SEQ ID NO: 78711 - protein, 10 aa, Homo sapiens
  light chain complementarity determining region 3 for antibody 39356
MQGTHWPPWR

SEQ ID NO: 78712 - protein, 7 aa, Homo sapiens
  heavy chain complementarity determining region 3 for antibody 39356
VRGTFDI

SEQ ID NO: 78713 - protein, 10 aa, Homo sapiens
  light chain complementarity determining region 3 for antibody 39357
MQGTHWPPWP

SEQ ID NO: 78714 - protein, 11 aa, Homo sapiens
  heavy chain complementarity determining region 3 for antibody 39357
ARDHPGIGIDY

SEQ ID NO: 78715 - protein, 10 aa, Homo sapiens
  light chain complementarity determining region 3 for antibody 39358
MQGTHWPPWA

SEQ ID NO: 78716 - protein, 7 aa, Homo sapiens
  heavy chain complementarity determining region 3 for antibody 39358
VRGTFDI

SEQ ID NO: 78717 - protein, 9 aa, Homo sapiens
  light chain complementarity determining region 3 for antibody 39359
MQGTHWPPT

SEQ ID NO: 78718 - protein, 18 aa, Homo sapiens
  heavy chain complementarity determining region 3 for antibody 39359
ARDRISVSVIHTYYSVDI

SEQ ID NO: 78719 - protein, 9 aa, Homo sapiens
  light chain complementarity determining region 3 for antibody 39360
MQGTHWPPS

SEQ ID NO: 78720 - protein, 14 aa, Homo sapiens
  heavy chain complementarity determining region 3 for antibody 39360
VRDADSGGPNDMDV

SEQ ID NO: 78721 - protein, 10 aa, Homo sapiens
  light chain complementarity determining region 3 for antibody 39361
MQGTHWPPST

SEQ ID NO: 78722 - protein, 11 aa, Homo sapiens
  heavy chain complementarity determining region 3 for antibody 39361
VRVGGAGYFDH

SEQ ID NO: 78723 - protein, 10 aa, Homo sapiens
  light chain complementarity determining region 3 for antibody 39362
MQGTHWPPST

SEQ ID NO: 78724 - protein, 15 aa, Homo sapiens
  heavy chain complementarity determining region 3 for antibody 39362
AKSTVTTMSGGHVDS

SEQ ID NO: 78725 - protein, 9 aa, Homo sapiens
  light chain complementarity determining region 3 for antibody 39363
MQGTHWPPR

SEQ ID NO: 78726 - protein, 14 aa, Homo sapiens
  heavy chain complementarity determining region 3 for antibody 39363
VRDADSGGPNDMDV

SEQ ID NO: 78727 - protein, 10 aa, Homo sapiens
  light chain complementarity determining region 3 for antibody 39364
MQGTHWPPRT

SEQ ID NO: 78728 - protein, 11 aa, Homo sapiens
  heavy chain complementarity determining region 3 for antibody 39364
ARDHPGIGIDY

SEQ ID NO: 78729 - protein, 9 aa, Homo sapiens
  light chain complementarity determining region 3 for antibody 39365
MQGTHWPPP

SEQ ID NO: 78730 - protein, 15 aa, Homo sapiens
  heavy chain complementarity determining region 3 for antibody 39365
AKSSGQNIAVAGFDC

SEQ ID NO: 78731 - protein, 10 aa, Homo sapiens
  light chain complementarity determining region 3 for antibody 39366
MQGTHWPPNT

SEQ ID NO: 78732 - protein, 11 aa, Homo sapiens
  heavy chain complementarity determining region 3 for antibody 39366
VRVGGAGYFDH

SEQ ID NO: 78733 - protein, 10 aa, Homo sapiens
  light chain complementarity determining region 3 for antibody 39367
MQGTHWPPNT

SEQ ID NO: 78734 - protein, 15 aa, Homo sapiens
  heavy chain complementarity determining region 3 for antibody 39367
AKSTVTTMSGGHVDS

SEQ ID NO: 78735 - protein, 11 aa, Homo sapiens
  light chain complementarity determining region 3 for antibody 39368
MQGTHWPPMDT

SEQ ID NO: 78736 - protein, 17 aa, Homo sapiens
  heavy chain complementarity determining region 3 for antibody 39368
ARGGSGYYQEGDDTFGF

SEQ ID NO: 78737 - protein, 10 aa, Homo sapiens
  light chain complementarity determining region 3 for antibody 39369
MQGTHWPPHT

SEQ ID NO: 78738 - protein, 15 aa, Homo sapiens
  heavy chain complementarity determining region 3 for antibody 39369
AKSTVTTMSGGHVDS

SEQ ID NO: 78739 - protein, 10 aa, Homo sapiens
  light chain complementarity determining region 3 for antibody 39370
MQGTHWPPGP

SEQ ID NO: 78740 - protein, 7 aa, Homo sapiens
  heavy chain complementarity determining region 3 for antibody 39370
VRGTFDI

SEQ ID NO: 78741 - protein, 10 aa, Homo sapiens
  light chain complementarity determining region 3 for antibody 39371
MQGTHWPPDT

SEQ ID NO: 78742 - protein, 15 aa, Homo sapiens
  heavy chain complementarity determining region 3 for antibody 39371
AKSTVTTMSGGHVDS

SEQ ID NO: 78743 - protein, 8 aa, Homo sapiens
  light chain complementarity determining region 3 for antibody 39372
MQGTHWPP

SEQ ID NO: 78744 - protein, 21 aa, Homo sapiens
  heavy chain complementarity determining region 3 for antibody 39372
AKDRPNYYESNGQYYTPKGDL

SEQ ID NO: 78745 - protein, 9 aa, Homo sapiens
  light chain complementarity determining region 3 for antibody 39373
MQGTHWPLT

SEQ ID NO: 78746 - protein, 19 aa, Homo sapiens
  heavy chain complementarity determining region 3 for antibody 39373
VRDDRDHGSGGSCEGYFDD

SEQ ID NO: 78747 - protein, 9 aa, Homo sapiens
  light chain complementarity determining region 3 for antibody 39374
MQGTHWPLT

SEQ ID NO: 78748 - protein, 19 aa, Homo sapiens
  heavy chain complementarity determining region 3 for antibody 39374
VRDDRDHCSGGSCEGSFDD

SEQ ID NO: 78749 - protein, 9 aa, Homo sapiens
  light chain complementarity determining region 3 for antibody 39375
MQGTHWPLT

SEQ ID NO: 78750 - protein, 19 aa, Homo sapiens
  heavy chain complementarity determining region 3 for antibody 39375
VRDDRAHCSGGSCEGYFDD

SEQ ID NO: 78751 - protein, 9 aa, Homo sapiens
  light chain complementarity determining region 3 for antibody 39376
MQGTHWPLT

SEQ ID NO: 78752 - protein, 17 aa, Homo sapiens
  heavy chain complementarity determining region 3 for antibody 39376
ARDGRAAAAGGEYYFDL

SEQ ID NO: 78753 - protein, 9 aa, Homo sapiens
  light chain complementarity determining region 3 for antibody 39377
MQGTHWPLT

SEQ ID NO: 78754 - protein, 17 aa, Homo sapiens
  heavy chain complementarity determining region 3 for antibody 39377
ARDERAAAAGGEYYFDL

SEQ ID NO: 78755 - protein, 9 aa, Homo sapiens
  light chain complementarity determining region 3 for antibody 39378
MQGTHWPLT

SEQ ID NO: 78756 - protein, 17 aa, Homo sapiens
  heavy chain complementarity determining region 3 for antibody 39378
ARDDRAAAAGGEYCFDL

SEQ ID NO: 78757 - protein, 9 aa, Homo sapiens
  light chain complementarity determining region 3 for antibody 39379
MQGTHWPLT

SEQ ID NO: 78758 - protein, 17 aa, Homo sapiens
  heavy chain complementarity determining region 3 for antibody 39379
ARDDRAAAAGGECYVDL

SEQ ID NO: 78759 - protein, 9 aa, Homo sapiens
  light chain complementarity determining region 3 for antibody 39380
MQGTHWPLP

SEQ ID NO: 78760 - protein, 18 aa, Homo sapiens
  heavy chain complementarity determining region 3 for antibody 39380
AKDLRAFIMRVESDNFQV

SEQ ID NO: 78761 - protein, 9 aa, Homo sapiens
  light chain complementarity determining region 3 for antibody 39381
MQGTHWPKT

SEQ ID NO: 78762 - protein, 12 aa, Homo sapiens
  heavy chain complementarity determining region 3 for antibody 39381
AKDQGVGAPPDS

SEQ ID NO: 78763 - protein, 9 aa, Homo sapiens
  light chain complementarity determining region 3 for antibody 39382
MQGTHWPGT

SEQ ID NO: 78764 - protein, 18 aa, Homo sapiens
  heavy chain complementarity determining region 3 for antibody 39382
ARGPPRLSVYWYSNGMDF

SEQ ID NO: 78765 - protein, 9 aa, Homo sapiens
  light chain complementarity determining region 3 for antibody 39383
MQGTHWPGR

SEQ ID NO: 78766 - protein, 16 aa, Homo sapiens
  heavy chain complementarity determining region 3 for antibody 39383
TGDQRDRIFGVLDLPT

SEQ ID NO: 78767 - protein, 9 aa, Homo sapiens
  light chain complementarity determining region 3 for antibody 39384
MQGTHWPGR

SEQ ID NO: 78768 - protein, 19 aa, Homo sapiens
  heavy chain complementarity determining region 3 for antibody 39384
ARGPPRLFSVYWYSNGMDF

SEQ ID NO: 78769 - protein, 9 aa, Homo sapiens
  light chain complementarity determining region 3 for antibody 39385
MQGTHWPGR

SEQ ID NO: 78770 - protein, 12 aa, Homo sapiens
  heavy chain complementarity determining region 3 for antibody 39385
AKGPLIAMTGMI

SEQ ID NO: 78771 - protein, 9 aa, Homo sapiens
  light chain complementarity determining region 3 for antibody 39386
MQGTHWPFT

SEQ ID NO: 78772 - protein, 17 aa, Homo sapiens
  heavy chain complementarity determining region 3 for antibody 39386
ARDDRAAAAGGEYYFDL

SEQ ID NO: 78773 - protein, 8 aa, Homo sapiens
  light chain complementarity determining region 3 for antibody 39387
MQGTHWPA

SEQ ID NO: 78774 - protein, 21 aa, Homo sapiens
  heavy chain complementarity determining region 3 for antibody 39387
AKDRPNYYESNGQYYTPKGDL

SEQ ID NO: 78775 - protein, 9 aa, Homo sapiens
  light chain complementarity determining region 3 for antibody 39388
MQGTHWHRT

SEQ ID NO: 78776 - protein, 12 aa, Homo sapiens
  heavy chain complementarity determining region 3 for antibody 39388
ARGSHLIMFGGL

SEQ ID NO: 78777 - protein, 9 aa, Homo sapiens
  light chain complementarity determining region 3 for antibody 39389
MQGTHWALT

SEQ ID NO: 78778 - protein, 19 aa, Homo sapiens
  heavy chain complementarity determining region 3 for antibody 39389
VRDDRDHCSGGSCEGYFDD

SEQ ID NO: 78779 - protein, 9 aa, Homo sapiens
  light chain complementarity determining region 3 for antibody 39390
MQGTHSPPT

SEQ ID NO: 78780 - protein, 16 aa, Homo sapiens
  heavy chain complementarity determining region 3 for antibody 39390
ATDWGSGTQWIRAFDV

SEQ ID NO: 78781 - protein, 8 aa, Homo sapiens
  light chain complementarity determining region 3 for antibody 39391
MQGTHRYP

SEQ ID NO: 78782 - protein, 15 aa, Homo sapiens
  heavy chain complementarity determining region 3 for antibody 39391
ARCGANSCPQSAMDV

SEQ ID NO: 78783 - protein, 10 aa, Homo sapiens
  light chain complementarity determining region 3 for antibody 39392
MQGTHRPPYT

SEQ ID NO: 78784 - protein, 15 aa, Homo sapiens
  heavy chain complementarity determining region 3 for antibody 39392
AKSTVTTMSGGHVDS

SEQ ID NO: 78785 - protein, 9 aa, Homo sapiens
  light chain complementarity determining region 3 for antibody 39393
MQGTHRPPT

SEQ ID NO: 78786 - protein, 16 aa, Homo sapiens
  heavy chain complementarity determining region 3 for antibody 39393
ATDWGSGTQWTRAFDV

SEQ ID NO: 78787 - protein, 9 aa, Homo sapiens
  light chain complementarity determining region 3 for antibody 39394
MQGTHRPPT

SEQ ID NO: 78788 - protein, 16 aa, Homo sapiens
  heavy chain complementarity determining region 3 for antibody 39394
ATDWGSGAQWIRAFDV

SEQ ID NO: 78789 - protein, 9 aa, Homo sapiens
  light chain complementarity determining region 3 for antibody 39395
MQGTHRPPT

SEQ ID NO: 78790 - protein, 18 aa, Homo sapiens
  heavy chain complementarity determining region 3 for antibody 39395
ARDMTAYSGYEQHDPFDV

SEQ ID NO: 78791 - protein, 9 aa, Homo sapiens
  light chain complementarity determining region 3 for antibody 39396
MQGTHRPPR

SEQ ID NO: 78792 - protein, 16 aa, Homo sapiens
  heavy chain complementarity determining region 3 for antibody 39396
ATDWGSGTQWIRAFDV

SEQ ID NO: 78793 - protein, 8 aa, Homo sapiens
  light chain complementarity determining region 3 for antibody 39397
MQGTHMYL

SEQ ID NO: 78794 - protein, 15 aa, Homo sapiens
  heavy chain complementarity determining region 3 for antibody 39397
ARCGANSCPQSAMDV

SEQ ID NO: 78795 - protein, 8 aa, Homo sapiens
  light chain complementarity determining region 3 for antibody 39398
MQGTHMYI

SEQ ID NO: 78796 - protein, 15 aa, Homo sapiens
  heavy chain complementarity determining region 3 for antibody 39398
ARCGANSCPQSAMDV

SEQ ID NO: 78797 - protein, 8 aa, Homo sapiens
  light chain complementarity determining region 3 for antibody 39399
MQGTHMST

SEQ ID NO: 78798 - protein, 15 aa, Homo sapiens
  heavy chain complementarity determining region 3 for antibody 39399
ARCGANSCPQSAMDV

SEQ ID NO: 78799 - protein, 8 aa, Homo sapiens
  light chain complementarity determining region 3 for antibody 39400
MQGTHMNT

SEQ ID NO: 78800 - protein, 15 aa, Homo sapiens
  heavy chain complementarity determining region 3 for antibody 39400
ARCGANSCPQSAMDV

SEQ ID NO: 78801 - protein, 9 aa, Homo sapiens
  light chain complementarity determining region 3 for antibody 39401
MQGTHIPPT

SEQ ID NO: 78802 - protein, 12 aa, Homo sapiens
  heavy chain complementarity determining region 3 for antibody 39401
VKVWGWLNDGGY

SEQ ID NO: 78803 - protein, 9 aa, Homo sapiens
  light chain complementarity determining region 3 for antibody 39402
MQGTHGRLT

SEQ ID NO: 78804 - protein, 19 aa, Homo sapiens
  heavy chain complementarity determining region 3 for antibody 39402
VRDDRDHCSGGSCEGYFDD

SEQ ID NO: 78805 - protein, 9 aa, Homo sapiens
  light chain complementarity determining region 3 for antibody 39403
MQGTHGPWT

SEQ ID NO: 78806 - protein, 16 aa, Homo sapiens
  heavy chain complementarity determining region 3 for antibody 39403
TGDQRDRIFGVLDLPT

SEQ ID NO: 78807 - protein, 9 aa, Homo sapiens
  light chain complementarity determining region 3 for antibody 39404
MQGTHGPWT

SEQ ID NO: 78808 - protein, 12 aa, Homo sapiens
  heavy chain complementarity determining region 3 for antibody 39404
AKGPLIAMTGMI

SEQ ID NO: 78809 - protein, 8 aa, Homo sapiens
  light chain complementarity determining region 3 for antibody 39405
MQGTHGPT

SEQ ID NO: 78810 - protein, 21 aa, Homo sapiens
  heavy chain complementarity determining region 3 for antibody 39405
AKDRPNYYESNGQYYTPKGDL

SEQ ID NO: 78811 - protein, 9 aa, Homo sapiens
  light chain complementarity determining region 3 for antibody 39406
MQGTHGPRT

SEQ ID NO: 78812 - protein, 19 aa, Homo sapiens
  heavy chain complementarity determining region 3 for antibody 39406
VRDDRDHCSGGSCEGYFDD

SEQ ID NO: 78813 - protein, 9 aa, Homo sapiens
  light chain complementarity determining region 3 for antibody 39407
MQGTHGPRT

SEQ ID NO: 78814 - protein, 9 aa, Homo sapiens
  heavy chain complementarity determining region 3 for antibody 39407
AKGFYDSGG

SEQ ID NO: 78815 - protein, 10 aa, Homo sapiens
  light chain complementarity determining region 3 for antibody 39408
MQGTHGPPYT

SEQ ID NO: 78816 - protein, 15 aa, Homo sapiens
  heavy chain complementarity determining region 3 for antibody 39408
AKSTVTTMSGGHVDS

SEQ ID NO: 78817 - protein, 10 aa, Homo sapiens
  light chain complementarity determining region 3 for antibody 39409
MQGTHGPPWT

SEQ ID NO: 78818 - protein, 17 aa, Homo sapiens
  heavy chain complementarity determining region 3 for antibody 39409
VRDDYSASGRRNAPGAD

SEQ ID NO: 78819 - protein, 9 aa, Homo sapiens
  light chain complementarity determining region 3 for antibody 39410
MQGTHGPPT

SEQ ID NO: 78820 - protein, 20 aa, Homo sapiens
  heavy chain complementarity determining region 3 for antibody 39410
ARGRQRTGYSSSWYLGHFDY

SEQ ID NO: 78821 - protein, 10 aa, Homo sapiens
  light chain complementarity determining region 3 for antibody 39411
MQGTHGPPNT

SEQ ID NO: 78822 - protein, 19 aa, Homo sapiens
  heavy chain complementarity determining region 3 for antibody 39411
ARIDCTKASPGSLCDAFDI

SEQ ID NO: 78823 - protein, 11 aa, Homo sapiens
  light chain complementarity determining region 3 for antibody 39412
MQGTHGPPKGT

SEQ ID NO: 78824 - protein, 21 aa, Homo sapiens
  heavy chain complementarity determining region 3 for antibody 39412
ARDAPVSRPYSSGWYSSAFDY

SEQ ID NO: 78825 - protein, 9 aa, Homo sapiens
  light chain complementarity determining region 3 for antibody 39413
MQGTHGPLT

SEQ ID NO: 78826 - protein, 19 aa, Homo sapiens
  heavy chain complementarity determining region 3 for antibody 39413
VRDDRDQCSGGSCEGYFDD

SEQ ID NO: 78827 - protein, 9 aa, Homo sapiens
  light chain complementarity determining region 3 for antibody 39414
MQGTHGPLA

SEQ ID NO: 78828 - protein, 16 aa, Homo sapiens
  heavy chain complementarity determining region 3 for antibody 39414
ARDERGDHGDYGYFDL

SEQ ID NO: 78829 - protein, 9 aa, Homo sapiens
  light chain complementarity determining region 3 for antibody 39415
MQGTHGPGT

SEQ ID NO: 78830 - protein, 16 aa, Homo sapiens
  heavy chain complementarity determining region 3 for antibody 39415
TGDQRDRIFGVLDLPT

SEQ ID NO: 78831 - protein, 9 aa, Homo sapiens
  light chain complementarity determining region 3 for antibody 39416
MQGTHGPGT

SEQ ID NO: 78832 - protein, 19 aa, Homo sapiens
  heavy chain complementarity determining region 3 for antibody 39416
ARGPPRLFSVYWYSNGMDF

SEQ ID NO: 78833 - protein, 10 aa, Homo sapiens
  light chain complementarity determining region 3 for antibody 39417
MQGTHCPPYT

SEQ ID NO: 78834 - protein, 11 aa, Homo sapiens
  heavy chain complementarity determining region 3 for antibody 39417
VRVGGAGYFDH

SEQ ID NO: 78835 - protein, 10 aa, Homo sapiens
  light chain complementarity determining region 3 for antibody 39418
MQGTHCPPWT

SEQ ID NO: 78836 - protein, 7 aa, Homo sapiens
  heavy chain complementarity determining region 3 for antibody 39418
VRGTFDI

SEQ ID NO: 78837 - protein, 9 aa, Homo sapiens
  light chain complementarity determining region 3 for antibody 39419
MQGTDWPHI

SEQ ID NO: 78838 - protein, 11 aa, Homo sapiens
  heavy chain complementarity determining region 3 for antibody 39419
ARDPFFGALDC

SEQ ID NO: 78839 - protein, 8 aa, Homo sapiens
  light chain complementarity determining region 3 for antibody 39420
MQGTCWPP

SEQ ID NO: 78840 - protein, 17 aa, Homo sapiens
  heavy chain complementarity determining region 3 for antibody 39420
SIYWYDGNYANPDYFDY

SEQ ID NO: 78841 - protein, 8 aa, Homo sapiens
  light chain complementarity determining region 3 for antibody 39421
MQGSSGRT

SEQ ID NO: 78842 - protein, 17 aa, Homo sapiens
  heavy chain complementarity determining region 3 for antibody 39421
AHRRYYNGNWNGATFDV

SEQ ID NO: 78843 - protein, 9 aa, Homo sapiens
  light chain complementarity determining region 3 for antibody 39422
MQGSPGPPT

SEQ ID NO: 78844 - protein, 13 aa, Homo sapiens
  heavy chain complementarity determining region 3 for antibody 39422
VRNLGDGYNSIDY

SEQ ID NO: 78845 - protein, 9 aa, Homo sapiens
  light chain complementarity determining region 3 for antibody 39423
MQGSHWPRT

SEQ ID NO: 78846 - protein, 10 aa, Homo sapiens
  heavy chain complementarity determining region 3 for antibody 39423
VLTGDSWGDR

SEQ ID NO: 78847 - protein, 9 aa, Homo sapiens
  light chain complementarity determining region 3 for antibody 39424
MQGSHWPPT

SEQ ID NO: 78848 - protein, 13 aa, Homo sapiens
  heavy chain complementarity determining region 3 for antibody 39424
VRNSGDGYNSIDY

SEQ ID NO: 78849 - protein, 9 aa, Homo sapiens
  light chain complementarity determining region 3 for antibody 39425
MQGSHWPPT

SEQ ID NO: 78850 - protein, 13 aa, Homo sapiens
  heavy chain complementarity determining region 3 for antibody 39425
VRNLGDGYNSSDY

SEQ ID NO: 78851 - protein, 9 aa, Homo sapiens
  light chain complementarity determining region 3 for antibody 39426
MQGSHWPPR

SEQ ID NO: 78852 - protein, 13 aa, Homo sapiens
  heavy chain complementarity determining region 3 for antibody 39426
VRNLGDGYNSIDY

SEQ ID NO: 78853 - protein, 9 aa, Homo sapiens
  light chain complementarity determining region 3 for antibody 39427
MQGSHWPPA

SEQ ID NO: 78854 - protein, 13 aa, Homo sapiens
  heavy chain complementarity determining region 3 for antibody 39427
VRNLGDGYNSIDY

SEQ ID NO: 78855 - protein, 9 aa, Homo sapiens
  light chain complementarity determining region 3 for antibody 39428
MQGSHWHPT

SEQ ID NO: 78856 - protein, 13 aa, Homo sapiens
  heavy chain complementarity determining region 3 for antibody 39428
VRNLGDGYNSIDY

SEQ ID NO: 78857 - protein, 9 aa, Homo sapiens
  light chain complementarity determining region 3 for antibody 39429
MQGRHWPLT

SEQ ID NO: 78858 - protein, 19 aa, Homo sapiens
  heavy chain complementarity determining region 3 for antibody 39429
VRDDRDHCSGGSCEGYFDD

SEQ ID NO: 78859 - protein, 9 aa, Homo sapiens
  light chain complementarity determining region 3 for antibody 39430
MQGPQWPPT

SEQ ID NO: 78860 - protein, 12 aa, Homo sapiens
  heavy chain complementarity determining region 3 for antibody 39430
AKEDGGYSQVDH

SEQ ID NO: 78861 - protein, 9 aa, Homo sapiens
  light chain complementarity determining region 3 for antibody 39431
MQGPQTPYT

SEQ ID NO: 78862 - protein, 10 aa, Homo sapiens
  heavy chain complementarity determining region 3 for antibody 39431
GRDLSGARDY

SEQ ID NO: 78863 - protein, 9 aa, Homo sapiens
  light chain complementarity determining region 3 for antibody 39432
MQGPHWPLT

SEQ ID NO: 78864 - protein, 17 aa, Homo sapiens
  heavy chain complementarity determining region 3 for antibody 39432
ARDDRAAAAGGEYYFDL

SEQ ID NO: 78865 - protein, 10 aa, Homo sapiens
  light chain complementarity determining region 3 for antibody 39433
MQGMLTPGNT

SEQ ID NO: 78866 - protein, 15 aa, Homo sapiens
  heavy chain complementarity determining region 3 for antibody 39433
ATAHPLLGRWHQLDP

SEQ ID NO: 78867 - protein, 9 aa, Homo sapiens
  light chain complementarity determining region 3 for antibody 39434
MQGLRSPLT

SEQ ID NO: 78868 - protein, 19 aa, Homo sapiens
  heavy chain complementarity determining region 3 for antibody 39434
ARRGATVAGISGWGYGMDV

SEQ ID NO: 78869 - protein, 9 aa, Homo sapiens
  light chain complementarity determining region 3 for antibody 39435
MQGLQTRYT

SEQ ID NO: 78870 - protein, 10 aa, Homo sapiens
  heavy chain complementarity determining region 3 for antibody 39435
GSDLTGARDH

SEQ ID NO: 78871 - protein, 9 aa, Homo sapiens
  light chain complementarity determining region 3 for antibody 39436
MQGLQTRYT

SEQ ID NO: 78872 - protein, 10 aa, Homo sapiens
  heavy chain complementarity determining region 3 for antibody 39436
GRDLTGSKDY

SEQ ID NO: 78873 - protein, 9 aa, Homo sapiens
  light chain complementarity determining region 3 for antibody 39437
MQGLQTRYP

SEQ ID NO: 78874 - protein, 10 aa, Homo sapiens
  heavy chain complementarity determining region 3 for antibody 39437
GSDLTGARDH

SEQ ID NO: 78875 - protein, 9 aa, Homo sapiens
  light chain complementarity determining region 3 for antibody 39438
MQGLQTPYT

SEQ ID NO: 78876 - protein, 10 aa, Homo sapiens
  heavy chain complementarity determining region 3 for antibody 39438
GSDVTGARDH

SEQ ID NO: 78877 - protein, 9 aa, Homo sapiens
  light chain complementarity determining region 3 for antibody 39439
MQGLQTPYT

SEQ ID NO: 78878 - protein, 10 aa, Homo sapiens
  heavy chain complementarity determining region 3 for antibody 39439
GSDLRGARDY

SEQ ID NO: 78879 - protein, 9 aa, Homo sapiens
  light chain complementarity determining region 3 for antibody 39440
MQGLQTPYT

SEQ ID NO: 78880 - protein, 10 aa, Homo sapiens
  heavy chain complementarity determining region 3 for antibody 39440
GSDLPGARDH

SEQ ID NO: 78881 - protein, 9 aa, Homo sapiens
  light chain complementarity determining region 3 for antibody 39441
MQGLQTPYT

SEQ ID NO: 78882 - protein, 10 aa, Homo sapiens
  heavy chain complementarity determining region 3 for antibody 39441
GRDLSGARGY

SEQ ID NO: 78883 - protein, 9 aa, Homo sapiens
  light chain complementarity determining region 3 for antibody 39442
MQGLQTPYT

SEQ ID NO: 78884 - protein, 10 aa, Homo sapiens
  heavy chain complementarity determining region 3 for antibody 39442
GRDLRGARDY

SEQ ID NO: 78885 - protein, 9 aa, Homo sapiens
  light chain complementarity determining region 3 for antibody 39443
MQGLQTPYT

SEQ ID NO: 78886 - protein, 13 aa, Homo sapiens
  heavy chain complementarity determining region 3 for antibody 39443
ARDDGEYYSALDP

SEQ ID NO: 78887 - protein, 9 aa, Homo sapiens
  light chain complementarity determining region 3 for antibody 39444
MQGLQTPYP

SEQ ID NO: 78888 - protein, 10 aa, Homo sapiens
  heavy chain complementarity determining region 3 for antibody 39444
GRDLTGSKDY

SEQ ID NO: 78889 - protein, 9 aa, Homo sapiens
  light chain complementarity determining region 3 for antibody 39445
MQGLQTPYN

SEQ ID NO: 78890 - protein, 10 aa, Homo sapiens
  heavy chain complementarity determining region 3 for antibody 39445
GSDLTGARDH

SEQ ID NO: 78891 - protein, 9 aa, Homo sapiens
  light chain complementarity determining region 3 for antibody 39446
MQGLQTPYN

SEQ ID NO: 78892 - protein, 10 aa, Homo sapiens
  heavy chain complementarity determining region 3 for antibody 39446
ARDVVGSDDQ

SEQ ID NO: 78893 - protein, 9 aa, Homo sapiens
  light chain complementarity determining region 3 for antibody 39447
MQGLQTPWA

SEQ ID NO: 78894 - protein, 13 aa, Homo sapiens
  heavy chain complementarity determining region 3 for antibody 39447
AKVVNTGPGGLQS

SEQ ID NO: 78895 - protein, 9 aa, Homo sapiens
  light chain complementarity determining region 3 for antibody 39448
MQGLQTPTT

SEQ ID NO: 78896 - protein, 10 aa, Homo sapiens
  heavy chain complementarity determining region 3 for antibody 39448
GSDLSGARDY

SEQ ID NO: 78897 - protein, 8 aa, Homo sapiens
  light chain complementarity determining region 3 for antibody 39449
MQGLQTPT

SEQ ID NO: 78898 - protein, 15 aa, Homo sapiens
  heavy chain complementarity determining region 3 for antibody 39449
TADRGDSSRWYGMAV

SEQ ID NO: 78899 - protein, 9 aa, Homo sapiens
  light chain complementarity determining region 3 for antibody 39450
MQGLQTPTP

SEQ ID NO: 78900 - protein, 10 aa, Homo sapiens
  heavy chain complementarity determining region 3 for antibody 39450
ARDVVGSDDQ

SEQ ID NO: 78901 - protein, 8 aa, Homo sapiens
  light chain complementarity determining region 3 for antibody 39451
MQGLQTPT

SEQ ID NO: 78902 - protein, 15 aa, Homo sapiens
  heavy chain complementarity determining region 3 for antibody 39451
ARRDYYDSSGYRLDY

SEQ ID NO: 78903 - protein, 8 aa, Homo sapiens
  light chain complementarity determining region 3 for antibody 39452
MQGLQTPT

SEQ ID NO: 78904 - protein, 16 aa, Homo sapiens
  heavy chain complementarity determining region 3 for antibody 39452
ARAFWSGYLRSGGMDV

SEQ ID NO: 78905 - protein, 9 aa, Homo sapiens
  light chain complementarity determining region 3 for antibody 39453
MQGLQTPST

SEQ ID NO: 78906 - protein, 10 aa, Homo sapiens
  heavy chain complementarity determining region 3 for antibody 39453
GRDLTGSKDY

SEQ ID NO: 78907 - protein, 9 aa, Homo sapiens
  light chain complementarity determining region 3 for antibody 39454
MQGLQTPSP

SEQ ID NO: 78908 - protein, 10 aa, Homo sapiens
  heavy chain complementarity determining region 3 for antibody 39454
ARDVVGSDDQ

SEQ ID NO: 78909 - protein, 9 aa, Homo sapiens
  light chain complementarity determining region 3 for antibody 39455
MQGLQTPQT

SEQ ID NO: 78910 - protein, 10 aa, Homo sapiens
  heavy chain complementarity determining region 3 for antibody 39455
GSDLSGARDY

SEQ ID NO: 78911 - protein, 9 aa, Homo sapiens
  light chain complementarity determining region 3 for antibody 39456
MQGLQTPPT

SEQ ID NO: 78912 - protein, 14 aa, Homo sapiens
  heavy chain complementarity determining region 3 for antibody 39456
ARGRSELVAGYFDY

SEQ ID NO: 78913 - protein, 9 aa, Homo sapiens
  light chain complementarity determining region 3 for antibody 39457
MQGLQTPNT

SEQ ID NO: 78914 - protein, 10 aa, Homo sapiens
  heavy chain complementarity determining region 3 for antibody 39457
GRDLTGSKDY

SEQ ID NO: 78915 - protein, 9 aa, Homo sapiens
  light chain complementarity determining region 3 for antibody 39458
MQGLQTPKT

SEQ ID NO: 78916 - protein, 10 aa, Homo sapiens
  heavy chain complementarity determining region 3 for antibody 39458
GRDLSGARDY

SEQ ID NO: 78917 - protein, 9 aa, Homo sapiens
  light chain complementarity determining region 3 for antibody 39459
MQGLQTPKP

SEQ ID NO: 78918 - protein, 10 aa, Homo sapiens
  heavy chain complementarity determining region 3 for antibody 39459
GRDLSGARDY

SEQ ID NO: 78919 - protein, 9 aa, Homo sapiens
  light chain complementarity determining region 3 for antibody 39460
MQGLQTPDT

SEQ ID NO: 78920 - protein, 10 aa, Homo sapiens
  heavy chain complementarity determining region 3 for antibody 39460
GSDLSGASDY

SEQ ID NO: 78921 - protein, 9 aa, Homo sapiens
  light chain complementarity determining region 3 for antibody 39461
MQGLQTPDT

SEQ ID NO: 78922 - protein, 10 aa, Homo sapiens
  heavy chain complementarity determining region 3 for antibody 39461
GRDVSGARDY

SEQ ID NO: 78923 - protein, 9 aa, Homo sapiens
  light chain complementarity determining region 3 for antibody 39462
MQGLQTPDT

SEQ ID NO: 78924 - protein, 10 aa, Homo sapiens
  heavy chain complementarity determining region 3 for antibody 39462
ARDVVGSDDH

SEQ ID NO: 78925 - protein, 9 aa, Homo sapiens
  light chain complementarity determining region 3 for antibody 39463
MQGLQSPYT

SEQ ID NO: 78926 - protein, 10 aa, Homo sapiens
  heavy chain complementarity determining region 3 for antibody 39463
GRDLSGARDY

SEQ ID NO: 78927 - protein, 9 aa, Homo sapiens
  light chain complementarity determining region 3 for antibody 39464
MQGLQSPHT

SEQ ID NO: 78928 - protein, 15 aa, Homo sapiens
  heavy chain complementarity determining region 3 for antibody 39464
ARDYLSGTPGVAFDI

SEQ ID NO: 78929 - protein, 9 aa, Homo sapiens
  light chain complementarity determining region 3 for antibody 39465
MQGLQPPSS

SEQ ID NO: 78930 - protein, 11 aa, Homo sapiens
  heavy chain complementarity determining region 3 for antibody 39465
ARPGEESQFDY

SEQ ID NO: 78931 - protein, 9 aa, Homo sapiens
  light chain complementarity determining region 3 for antibody 39466
MQGLQPPLT

SEQ ID NO: 78932 - protein, 14 aa, Homo sapiens
  heavy chain complementarity determining region 3 for antibody 39466
ARGRSELVAGYFDY

SEQ ID NO: 78933 - protein, 9 aa, Homo sapiens
  light chain complementarity determining region 3 for antibody 39467
MQGLQPPDS

SEQ ID NO: 78934 - protein, 11 aa, Homo sapiens
  heavy chain complementarity determining region 3 for antibody 39467
ARPGEESQFDY

SEQ ID NO: 78935 - protein, 9 aa, Homo sapiens
  light chain complementarity determining region 3 for antibody 39468
MQGLQIPYT

SEQ ID NO: 78936 - protein, 10 aa, Homo sapiens
  heavy chain complementarity determining region 3 for antibody 39468
GSDLTGARDH

SEQ ID NO: 78937 - protein, 9 aa, Homo sapiens
  light chain complementarity determining region 3 for antibody 39469
MQGLQIPRT

SEQ ID NO: 78938 - protein, 18 aa, Homo sapiens
  heavy chain complementarity determining region 3 for antibody 39469
ARGGTMVRGSDYYFGMHV

SEQ ID NO: 78939 - protein, 9 aa, Homo sapiens
  light chain complementarity determining region 3 for antibody 39470
MQGLQAPYT

SEQ ID NO: 78940 - protein, 10 aa, Homo sapiens
  heavy chain complementarity determining region 3 for antibody 39470
GRDLSGARDY

SEQ ID NO: 78941 - protein, 9 aa, Homo sapiens
  light chain complementarity determining region 3 for antibody 39471
MQGLPTPYT

SEQ ID NO: 78942 - protein, 10 aa, Homo sapiens
  heavy chain complementarity determining region 3 for antibody 39471
ARDVVGSDDQ

SEQ ID NO: 78943 - protein, 9 aa, Homo sapiens
  light chain complementarity determining region 3 for antibody 39472
MQGLLTPYT

SEQ ID NO: 78944 - protein, 10 aa, Homo sapiens
  heavy chain complementarity determining region 3 for antibody 39472
GSDLPGSRDF

SEQ ID NO: 78945 - protein, 10 aa, Homo sapiens
  light chain complementarity determining region 3 for antibody 39473
MQGLLTPGTT

SEQ ID NO: 78946 - protein, 15 aa, Homo sapiens
  heavy chain complementarity determining region 3 for antibody 39473
ATAHPLLGRWHQLDP

SEQ ID NO: 78947 - protein, 10 aa, Homo sapiens
  light chain complementarity determining region 3 for antibody 39474
MQGLLTPGNT

SEQ ID NO: 78948 - protein, 15 aa, Homo sapiens
  heavy chain complementarity determining region 3 for antibody 39474
ATAHPRLGRWHQLDP

SEQ ID NO: 78949 - protein, 10 aa, Homo sapiens
  light chain complementarity determining region 3 for antibody 39475
MQGLLTPGKT

SEQ ID NO: 78950 - protein, 15 aa, Homo sapiens
  heavy chain complementarity determining region 3 for antibody 39475
ATAHPLLGRWHQLDP

SEQ ID NO: 78951 - protein, 10 aa, Homo sapiens
  light chain complementarity determining region 3 for antibody 39476
MQGLLPPGNT

SEQ ID NO: 78952 - protein, 15 aa, Homo sapiens
  heavy chain complementarity determining region 3 for antibody 39476
ATAHPLLGRWHQLDP

SEQ ID NO: 78953 - protein, 9 aa, Homo sapiens
  light chain complementarity determining region 3 for antibody 39477
MQGLKTPYT

SEQ ID NO: 78954 - protein, 10 aa, Homo sapiens
  heavy chain complementarity determining region 3 for antibody 39477
GSDLTGARDH

SEQ ID NO: 78955 - protein, 9 aa, Homo sapiens
  light chain complementarity determining region 3 for antibody 39478
MQGLKTPYT

SEQ ID NO: 78956 - protein, 10 aa, Homo sapiens
  heavy chain complementarity determining region 3 for antibody 39478
GRDLTGSKDY

SEQ ID NO: 78957 - protein, 9 aa, Homo sapiens
  light chain complementarity determining region 3 for antibody 39479
MQGLKTPYP

SEQ ID NO: 78958 - protein, 10 aa, Homo sapiens
  heavy chain complementarity determining region 3 for antibody 39479
GRDLSGARDY

SEQ ID NO: 78959 - protein, 9 aa, Homo sapiens
  light chain complementarity determining region 3 for antibody 39480
MQGLKTPDT

SEQ ID NO: 78960 - protein, 10 aa, Homo sapiens
  heavy chain complementarity determining region 3 for antibody 39480
ARDVVGSDDQ

SEQ ID NO: 78961 - protein, 9 aa, Homo sapiens
  light chain complementarity determining region 3 for antibody 39481
MQGLHSPRT

SEQ ID NO: 78962 - protein, 11 aa, Homo sapiens
  heavy chain complementarity determining region 3 for antibody 39481
TRLIDRGSSDR

SEQ ID NO: 78963 - protein, 9 aa, Homo sapiens
  light chain complementarity determining region 3 for antibody 39482
MQGLETPYT

SEQ ID NO: 78964 - protein, 10 aa, Homo sapiens
  heavy chain complementarity determining region 3 for antibody 39482
GRDLSGARDY

SEQ ID NO: 78965 - protein, 9 aa, Homo sapiens
  light chain complementarity determining region 3 for antibody 39483
MQGLETPFT

SEQ ID NO: 78966 - protein, 15 aa, Homo sapiens
  heavy chain complementarity determining region 3 for antibody 39483
VRHYRIITAPLEGDS

SEQ ID NO: 78967 - protein, 9 aa, Homo sapiens
  light chain complementarity determining region 3 for antibody 39484
MQGLETPFT

SEQ ID NO: 78968 - protein, 15 aa, Homo sapiens
  heavy chain complementarity determining region 3 for antibody 39484
IRHYRVAVAGIEGDY

SEQ ID NO: 78969 - protein, 9 aa, Homo sapiens
  light chain complementarity determining region 3 for antibody 39485
MQGLETPFP

SEQ ID NO: 78970 - protein, 15 aa, Homo sapiens
  heavy chain complementarity determining region 3 for antibody 39485
VRHYRETVAGIEGDS

SEQ ID NO: 78971 - protein, 9 aa, Homo sapiens
  light chain complementarity determining region 3 for antibody 39486
MQGLEIPFT

SEQ ID NO: 78972 - protein, 15 aa, Homo sapiens
  heavy chain complementarity determining region 3 for antibody 39486
VRHYRETVAGIEGDS

SEQ ID NO: 78973 - protein, 9 aa, Homo sapiens
  light chain complementarity determining region 3 for antibody 39487
MQGKHWPWT

SEQ ID NO: 78974 - protein, 10 aa, Homo sapiens
  heavy chain complementarity determining region 3 for antibody 39487
ARETHWGPDY

SEQ ID NO: 78975 - protein, 9 aa, Homo sapiens
  light chain complementarity determining region 3 for antibody 39488
MQGKHWPWT

SEQ ID NO: 78976 - protein, 15 aa, Homo sapiens
  heavy chain complementarity determining region 3 for antibody 39488
ALGDTSRGNQYQKDV

SEQ ID NO: 78977 - protein, 9 aa, Homo sapiens
  light chain complementarity determining region 3 for antibody 39489
MQGKHWPPT

SEQ ID NO: 78978 - protein, 19 aa, Homo sapiens
  heavy chain complementarity determining region 3 for antibody 39489
VRDDRDHCSGGSCEGYFDD

SEQ ID NO: 78979 - protein, 9 aa, Homo sapiens
  light chain complementarity determining region 3 for antibody 39490
MQGKHWPPT

SEQ ID NO: 78980 - protein, 15 aa, Homo sapiens
  heavy chain complementarity determining region 3 for antibody 39490
AKSSGQNIAVAGFDC

SEQ ID NO: 78981 - protein, 9 aa, Homo sapiens
  light chain complementarity determining region 3 for antibody 39491
MQGKHWPLT

SEQ ID NO: 78982 - protein, 19 aa, Homo sapiens
  heavy chain complementarity determining region 3 for antibody 39491
VRDDRDHCSGGSCEGYFDD

SEQ ID NO: 78983 - protein, 9 aa, Homo sapiens
  light chain complementarity determining region 3 for antibody 39492
MQGKHWPLT

SEQ ID NO: 78984 - protein, 10 aa, Homo sapiens
  heavy chain complementarity determining region 3 for antibody 39492
ASLNRRTSRR

SEQ ID NO: 78985 - protein, 9 aa, Homo sapiens
  light chain complementarity determining region 3 for antibody 39493
MQGKHRPPT

SEQ ID NO: 78986 - protein, 16 aa, Homo sapiens
  heavy chain complementarity determining region 3 for antibody 39493
ATDWGSGTQWIRAFDV

SEQ ID NO: 78987 - protein, 9 aa, Homo sapiens
  light chain complementarity determining region 3 for antibody 39494
MQGKHGPKT

SEQ ID NO: 78988 - protein, 12 aa, Homo sapiens
  heavy chain complementarity determining region 3 for antibody 39494
AKDQGVGATPDS

SEQ ID NO: 78989 - protein, 9 aa, Homo sapiens
  light chain complementarity determining region 3 for antibody 39495
MQGAYWPPT

SEQ ID NO: 78990 - protein, 20 aa, Homo sapiens
  heavy chain complementarity determining region 3 for antibody 39495
ARRGVGKGEDYFDSSGYADY

SEQ ID NO: 78991 - protein, 8 aa, Homo sapiens
  light chain complementarity determining region 3 for antibody 39496
MQGASGRA

SEQ ID NO: 78992 - protein, 17 aa, Homo sapiens
  heavy chain complementarity determining region 3 for antibody 39496
AHRRYYNGNWNGATFDV

SEQ ID NO: 78993 - protein, 9 aa, Homo sapiens
  light chain complementarity determining region 3 for antibody 39497
MQGAHWPPT

SEQ ID NO: 78994 - protein, 13 aa, Homo sapiens
  heavy chain complementarity determining region 3 for antibody 39497
VRNLGDGYNSIDY

SEQ ID NO: 78995 - protein, 9 aa, Homo sapiens
  light chain complementarity determining region 3 for antibody 39498
MQGAHWPPP

SEQ ID NO: 78996 - protein, 13 aa, Homo sapiens
  heavy chain complementarity determining region 3 for antibody 39498
LRASRDGYNSIDY

SEQ ID NO: 78997 - protein, 9 aa, Homo sapiens
  light chain complementarity determining region 3 for antibody 39499
MQGAHWPLT

SEQ ID NO: 78998 - protein, 19 aa, Homo sapiens
  heavy chain complementarity determining region 3 for antibody 39499
VRDDRDHCSGGSCEGYFDD

SEQ ID NO: 78999 - protein, 9 aa, Homo sapiens
  light chain complementarity determining region 3 for antibody 39500
MQGAHWPGT

SEQ ID NO: 79000 - protein, 19 aa, Homo sapiens
  heavy chain complementarity determining region 3 for antibody 39500
ARAPALLWLGDHMYNYFDP

SEQ ID NO: 79001 - protein, 10 aa, Homo sapiens
  light chain complementarity determining region 3 for antibody 39501
MQGAHWLRWT

SEQ ID NO: 79002 - protein, 13 aa, Homo sapiens
  heavy chain complementarity determining region 3 for antibody 39501
NVGMVGHTSPVDH

SEQ ID NO: 79003 - protein, 10 aa, Homo sapiens
  light chain complementarity determining region 3 for antibody 39502
MQGAHWLPGT

SEQ ID NO: 79004 - protein, 13 aa, Homo sapiens
  heavy chain complementarity determining region 3 for antibody 39502
NVGMVGHTSPVDH

SEQ ID NO: 79005 - protein, 9 aa, Homo sapiens
  light chain complementarity determining region 3 for antibody 39503
MQGAHGPPT

SEQ ID NO: 79006 - protein, 13 aa, Homo sapiens
  heavy chain complementarity determining region 3 for antibody 39503
LRASRDGYNSIDY

SEQ ID NO: 79007 - protein, 9 aa, Homo sapiens
  light chain complementarity determining region 3 for antibody 39504
MQFLQAPIT

SEQ ID NO: 79008 - protein, 12 aa, Homo sapiens
  heavy chain complementarity determining region 3 for antibody 39504
TRDPPTRWGMEV

SEQ ID NO: 79009 - protein, 9 aa, Homo sapiens
  light chain complementarity determining region 3 for antibody 39505
MQDVQTPYT

SEQ ID NO: 79010 - protein, 16 aa, Homo sapiens
  heavy chain complementarity determining region 3 for antibody 39505
ARAGFSFGVPIGAFDI

SEQ ID NO: 79011 - protein, 9 aa, Homo sapiens
  light chain complementarity determining region 3 for antibody 39506
MQDLQTPNT

SEQ ID NO: 79012 - protein, 21 aa, Homo sapiens
  heavy chain complementarity determining region 3 for antibody 39506
ARDAPVSRPYSSGWYSSAFDY

SEQ ID NO: 79013 - protein, 9 aa, Homo sapiens
  light chain complementarity determining region 3 for antibody 39507
MQDLGTPPT

SEQ ID NO: 79014 - protein, 12 aa, Homo sapiens
  heavy chain complementarity determining region 3 for antibody 39507
AKDLVGGARGGN

SEQ ID NO: 79015 - protein, 9 aa, Homo sapiens
  light chain complementarity determining region 3 for antibody 39508
MQDLETPFT

SEQ ID NO: 79016 - protein, 15 aa, Homo sapiens
  heavy chain complementarity determining region 3 for antibody 39508
VRHYRITVAAVEGDS

SEQ ID NO: 79017 - protein, 9 aa, Homo sapiens
  light chain complementarity determining region 3 for antibody 39509
MQDFRFPYS

SEQ ID NO: 79018 - protein, 16 aa, Homo sapiens
  heavy chain complementarity determining region 3 for antibody 39509
ARDGLGSEAMKVGFDV

SEQ ID NO: 79019 - protein, 9 aa, Homo sapiens
  light chain complementarity determining region 3 for antibody 39510
MQCTYWPGR

SEQ ID NO: 79020 - protein, 11 aa, Homo sapiens
  heavy chain complementarity determining region 3 for antibody 39510
ATGGLRVVFGP

SEQ ID NO: 79021 - protein, 10 aa, Homo sapiens
  light chain complementarity determining region 3 for antibody 39511
MQAVQTPPIT

SEQ ID NO: 79022 - protein, 18 aa, Homo sapiens
  heavy chain complementarity determining region 3 for antibody 39511
ARYSPRLSSDSARGAFDF

SEQ ID NO: 79023 - protein, 9 aa, Homo sapiens
  light chain complementarity determining region 3 for antibody 39512
MQAVQTPHT

SEQ ID NO: 79024 - protein, 16 aa, Homo sapiens
  heavy chain complementarity determining region 3 for antibody 39512
ARAGFSFGVPIGAFDI

SEQ ID NO: 79025 - protein, 9 aa, Homo sapiens
  light chain complementarity determining region 3 for antibody 39513
MQATRWPWT

SEQ ID NO: 79026 - protein, 12 aa, Homo sapiens
  heavy chain complementarity determining region 3 for antibody 39513
AADCSSASCPGY

SEQ ID NO: 79027 - protein, 9 aa, Homo sapiens
  light chain complementarity determining region 3 for antibody 39514
MQATNWPWT

SEQ ID NO: 79028 - protein, 12 aa, Homo sapiens
  heavy chain complementarity determining region 3 for antibody 39514
AADCSSASCPGY

SEQ ID NO: 79029 - protein, 9 aa, Homo sapiens
  light chain complementarity determining region 3 for antibody 39515
MQATNWPWM

SEQ ID NO: 79030 - protein, 15 aa, Homo sapiens
  heavy chain complementarity determining region 3 for antibody 39515
ARDSPPRASGYDYVP

SEQ ID NO: 79031 - protein, 10 aa, Homo sapiens
  light chain complementarity determining region 3 for antibody 39516
MQATNWPPKT

SEQ ID NO: 79032 - protein, 11 aa, Homo sapiens
  heavy chain complementarity determining region 3 for antibody 39516
ARDPGRSGWDS

SEQ ID NO: 79033 - protein, 9 aa, Homo sapiens
  light chain complementarity determining region 3 for antibody 39517
MQATHWPWR

SEQ ID NO: 79034 - protein, 12 aa, Homo sapiens
  heavy chain complementarity determining region 3 for antibody 39517
AADCSSASCPGY

SEQ ID NO: 79035 - protein, 10 aa, Homo sapiens
  light chain complementarity determining region 3 for antibody 39518
MQATHWPPQT

SEQ ID NO: 79036 - protein, 11 aa, Homo sapiens
  heavy chain complementarity determining region 3 for antibody 39518
ARDPGRSGWDS

SEQ ID NO: 79037 - protein, 9 aa, Homo sapiens
  light chain complementarity determining region 3 for antibody 39519
MQATHWPGM

SEQ ID NO: 79038 - protein, 15 aa, Homo sapiens
  heavy chain complementarity determining region 3 for antibody 39519
ARDSPPRASGYDYVP

SEQ ID NO: 79039 - protein, 10 aa, Homo sapiens
  light chain complementarity determining region 3 for antibody 39520
MQATHWPGLT

SEQ ID NO: 79040 - protein, 10 aa, Homo sapiens
  heavy chain complementarity determining region 3 for antibody 39520
ATSHLSTTDY

SEQ ID NO: 79041 - protein, 10 aa, Homo sapiens
  light chain complementarity determining region 3 for antibody 39521
MQATHWPGFT

SEQ ID NO: 79042 - protein, 10 aa, Homo sapiens
  heavy chain complementarity determining region 3 for antibody 39521
ATSQLSTTGY

SEQ ID NO: 79043 - protein, 10 aa, Homo sapiens
  light chain complementarity determining region 3 for antibody 39522
MQATHWPGFT

SEQ ID NO: 79044 - protein, 10 aa, Homo sapiens
  heavy chain complementarity determining region 3 for antibody 39522
ATSQLSPTDY

SEQ ID NO: 79045 - protein, 9 aa, Homo sapiens
  light chain complementarity determining region 3 for antibody 39523
MQATHGPWR

SEQ ID NO: 79046 - protein, 12 aa, Homo sapiens
  heavy chain complementarity determining region 3 for antibody 39523
AADCSSASCPGY

SEQ ID NO: 79047 - protein, 8 aa, Homo sapiens
  light chain complementarity determining region 3 for antibody 39524
MQARHHLT

SEQ ID NO: 79048 - protein, 16 aa, Homo sapiens
  heavy chain complementarity determining region 3 for antibody 39524
AKWGGVAMAGHYYFDY

SEQ ID NO: 79049 - protein, 9 aa, Homo sapiens
  light chain complementarity determining region 3 for antibody 39525
MQARDWPPT

SEQ ID NO: 79050 - protein, 18 aa, Homo sapiens
  heavy chain complementarity determining region 3 for antibody 39525
LRGGTIGWELRQSSLIDC

SEQ ID NO: 79051 - protein, 9 aa, Homo sapiens
  light chain complementarity determining region 3 for antibody 39526
MQARDWPPP

SEQ ID NO: 79052 - protein, 18 aa, Homo sapiens
  heavy chain complementarity determining region 3 for antibody 39526
LRGGTIEWELRQSSLIDC

SEQ ID NO: 79053 - protein, 9 aa, Homo sapiens
  light chain complementarity determining region 3 for antibody 39527
MQANHWPWT

SEQ ID NO: 79054 - protein, 12 aa, Homo sapiens
  heavy chain complementarity determining region 3 for antibody 39527
AADCSSASCPGY

SEQ ID NO: 79055 - protein, 9 aa, Homo sapiens
  light chain complementarity determining region 3 for antibody 39528
MQALRTPYT

SEQ ID NO: 79056 - protein, 21 aa, Homo sapiens
  heavy chain complementarity determining region 3 for antibody 39528
ARDAPVSRPYSSGWYSSAFDY

SEQ ID NO: 79057 - protein, 9 aa, Homo sapiens
  light chain complementarity determining region 3 for antibody 39529
MQALQVRYT

SEQ ID NO: 79058 - protein, 12 aa, Homo sapiens
  heavy chain complementarity determining region 3 for antibody 39529
ARARGVAGKLDS

SEQ ID NO: 79059 - protein, 9 aa, Homo sapiens
  light chain complementarity determining region 3 for antibody 39530
MQALQVPYT

SEQ ID NO: 79060 - protein, 12 aa, Homo sapiens
  heavy chain complementarity determining region 3 for antibody 39530
ARARGVAGKPDS

SEQ ID NO: 79061 - protein, 9 aa, Homo sapiens
  light chain complementarity determining region 3 for antibody 39531
MQALQTTYT

SEQ ID NO: 79062 - protein, 15 aa, Homo sapiens
  heavy chain complementarity determining region 3 for antibody 39531
ARGPHPPYYGGFFHR

SEQ ID NO: 79063 - protein, 8 aa, Homo sapiens
  light chain complementarity determining region 3 for antibody 39532
MQALQTRP

SEQ ID NO: 79064 - protein, 13 aa, Homo sapiens
  heavy chain complementarity determining region 3 for antibody 39532
ARDESYGDYGMDV

SEQ ID NO: 79065 - protein, 9 aa, Homo sapiens
  light chain complementarity determining region 3 for antibody 39533
MQALQTQYT

SEQ ID NO: 79066 - protein, 21 aa, Homo sapiens
  heavy chain complementarity determining region 3 for antibody 39533
ARDAPVSRPYSSGWYSSAFDY

SEQ ID NO: 79067 - protein, 9 aa, Homo sapiens
  light chain complementarity determining region 3 for antibody 39534
MQALQTPYT

SEQ ID NO: 79068 - protein, 21 aa, Homo sapiens
  heavy chain complementarity determining region 3 for antibody 39534
ARDAPVSRPCSSGWYSSAFDY

SEQ ID NO: 79069 - protein, 9 aa, Homo sapiens
  light chain complementarity determining region 3 for antibody 39535
MQALQTPYT

SEQ ID NO: 79070 - protein, 21 aa, Homo sapiens
  heavy chain complementarity determining region 3 for antibody 39535
ARDAPFSRPYSSGWYSSAFDY

SEQ ID NO: 79071 - protein, 9 aa, Homo sapiens
  light chain complementarity determining region 3 for antibody 39536
MQALQTPYT

SEQ ID NO: 79072 - protein, 12 aa, Homo sapiens
  heavy chain complementarity determining region 3 for antibody 39536
ARARGVAGKLEN

SEQ ID NO: 79073 - protein, 9 aa, Homo sapiens
  light chain complementarity determining region 3 for antibody 39537
MQALQTPYT

SEQ ID NO: 79074 - protein, 12 aa, Homo sapiens
  heavy chain complementarity determining region 3 for antibody 39537
ARARGVAGKFDY

SEQ ID NO: 79075 - protein, 9 aa, Homo sapiens
  light chain complementarity determining region 3 for antibody 39538
MQALQTPYT

SEQ ID NO: 79076 - protein, 13 aa, Homo sapiens
  heavy chain complementarity determining region 3 for antibody 39538
ARAITKAGSGFDY

SEQ ID NO: 79077 - protein, 9 aa, Homo sapiens
  light chain complementarity determining region 3 for antibody 39539
MQALQTPYT

SEQ ID NO: 79078 - protein, 21 aa, Homo sapiens
  heavy chain complementarity determining region 3 for antibody 39539
AGDAPVSRPYSSGWYSSAFDY

SEQ ID NO: 79079 - protein, 9 aa, Homo sapiens
  light chain complementarity determining region 3 for antibody 39540
MQALQTPWT

SEQ ID NO: 79080 - protein, 20 aa, Homo sapiens
  heavy chain complementarity determining region 3 for antibody 39540
ATSLSAYDSSGYRSLYAFDI

SEQ ID NO: 79081 - protein, 9 aa, Homo sapiens
  light chain complementarity determining region 3 for antibody 39541
MQALQTPVP

SEQ ID NO: 79082 - protein, 13 aa, Homo sapiens
  heavy chain complementarity determining region 3 for antibody 39541
TMVVDYGDYGFDC

SEQ ID NO: 79083 - protein, 9 aa, Homo sapiens
  light chain complementarity determining region 3 for antibody 39542
MQALQTPST

SEQ ID NO: 79084 - protein, 13 aa, Homo sapiens
  heavy chain complementarity determining region 3 for antibody 39542
TMVVDYGDYGFDC

SEQ ID NO: 79085 - protein, 8 aa, Homo sapiens
  light chain complementarity determining region 3 for antibody 39543
MQALQTPS

SEQ ID NO: 79086 - protein, 15 aa, Homo sapiens
  heavy chain complementarity determining region 3 for antibody 39543
TADRGDSSRWYGMAV

SEQ ID NO: 79087 - protein, 9 aa, Homo sapiens
  light chain complementarity determining region 3 for antibody 39544
MQALQTPRT

SEQ ID NO: 79088 - protein, 6 aa, Homo sapiens
  heavy chain complementarity determining region 3 for antibody 39544
TRAFDY

SEQ ID NO: 79089 - protein, 9 aa, Homo sapiens
  light chain complementarity determining region 3 for antibody 39545
MQALQTPRT

SEQ ID NO: 79090 - protein, 12 aa, Homo sapiens
  heavy chain complementarity determining region 3 for antibody 39545
AREEVARWCFDY

SEQ ID NO: 79091 - protein, 9 aa, Homo sapiens
  light chain complementarity determining region 3 for antibody 39546
MQALQTPRP

SEQ ID NO: 79092 - protein, 22 aa, Homo sapiens
  heavy chain complementarity determining region 3 for antibody 39546
ARGHFRDTSQSPLQTSYYGMDV

SEQ ID NO: 79093 - protein, 9 aa, Homo sapiens
  light chain complementarity determining region 3 for antibody 39547
MQALQTPPT

SEQ ID NO: 79094 - protein, 14 aa, Homo sapiens
  heavy chain complementarity determining region 3 for antibody 39547
VKTLSPGGAYFFDS

SEQ ID NO: 79095 - protein, 9 aa, Homo sapiens
  light chain complementarity determining region 3 for antibody 39548
MQALQTPPT

SEQ ID NO: 79096 - protein, 22 aa, Homo sapiens
  heavy chain complementarity determining region 3 for antibody 39548
VKDHNNMARGVTIEGKYNWFDP

SEQ ID NO: 79097 - protein, 9 aa, Homo sapiens
  light chain complementarity determining region 3 for antibody 39549
MQALQTPPT

SEQ ID NO: 79098 - protein, 25 aa, Homo sapiens
  heavy chain complementarity determining region 3 for antibody 39549
ARNKEFGRKDYRGSGVGYYYHTMDV

SEQ ID NO: 79099 - protein, 9 aa, Homo sapiens
  light chain complementarity determining region 3 for antibody 39550
MQALQTPPT

SEQ ID NO: 79100 - protein, 22 aa, Homo sapiens
  heavy chain complementarity determining region 3 for antibody 39550
ARHDGVIAVAGNTHYYYYGMDV

SEQ ID NO: 79101 - protein, 9 aa, Homo sapiens
  light chain complementarity determining region 3 for antibody 39551
MQALQTPPP

SEQ ID NO: 79102 - protein, 14 aa, Homo sapiens
  heavy chain complementarity determining region 3 for antibody 39551
ARGLAARPLWRFDY

SEQ ID NO: 79103 - protein, 8 aa, Homo sapiens
  light chain complementarity determining region 3 for antibody 39552
MQALQTPP

SEQ ID NO: 79104 - protein, 18 aa, Homo sapiens
  heavy chain complementarity determining region 3 for antibody 39552
ASGTKKSGYTSSLGAFDI

SEQ ID NO: 79105 - protein, 9 aa, Homo sapiens
  light chain complementarity determining region 3 for antibody 39553
MQALQTPLT

SEQ ID NO: 79106 - protein, 16 aa, Homo sapiens
  heavy chain complementarity determining region 3 for antibody 39553
ARLRAAGYSYGYGFDF

SEQ ID NO: 79107 - protein, 9 aa, Homo sapiens
  light chain complementarity determining region 3 for antibody 39554
MQALQTPIT

SEQ ID NO: 79108 - protein, 13 aa, Homo sapiens
  heavy chain complementarity determining region 3 for antibody 39554
TMVVDYGDYGFDF

SEQ ID NO: 79109 - protein, 9 aa, Homo sapiens
  light chain complementarity determining region 3 for antibody 39555
MQALQTPIT

SEQ ID NO: 79110 - protein, 13 aa, Homo sapiens
  heavy chain complementarity determining region 3 for antibody 39555
TMVVDYGDCGFDC

SEQ ID NO: 79111 - protein, 9 aa, Homo sapiens
  light chain complementarity determining region 3 for antibody 39556
MQALQTPIT

SEQ ID NO: 79112 - protein, 13 aa, Homo sapiens
  heavy chain complementarity determining region 3 for antibody 39556
TMVGDYGDYGFDC

SEQ ID NO: 79113 - protein, 9 aa, Homo sapiens
  light chain complementarity determining region 3 for antibody 39557
MQALQTPIP

SEQ ID NO: 79114 - protein, 13 aa, Homo sapiens
  heavy chain complementarity determining region 3 for antibody 39557
TMVVDYGDYGFDC

SEQ ID NO: 79115 - protein, 8 aa, Homo sapiens
  light chain complementarity determining region 3 for antibody 39558
MQALQTPI

SEQ ID NO: 79116 - protein, 15 aa, Homo sapiens
  heavy chain complementarity determining region 3 for antibody 39558
ARRDYYDSSGYRLDY

SEQ ID NO: 79117 - protein, 9 aa, Homo sapiens
  light chain complementarity determining region 3 for antibody 39559
MQALQTPGT

SEQ ID NO: 79118 - protein, 11 aa, Homo sapiens
  heavy chain complementarity determining region 3 for antibody 39559
ARHGMWFGGLT

SEQ ID NO: 79119 - protein, 9 aa, Homo sapiens
  light chain complementarity determining region 3 for antibody 39560
MQALQTPFT

SEQ ID NO: 79120 - protein, 15 aa, Homo sapiens
  heavy chain complementarity determining region 3 for antibody 39560
VRHYRETVAGIEGDS

SEQ ID NO: 79121 - protein, 9 aa, Homo sapiens
  light chain complementarity determining region 3 for antibody 39561
MQALQTPFT

SEQ ID NO: 79122 - protein, 12 aa, Homo sapiens
  heavy chain complementarity determining region 3 for antibody 39561
ARGTVGGNSFDY

SEQ ID NO: 79123 - protein, 9 aa, Homo sapiens
  light chain complementarity determining region 3 for antibody 39562
MQALQTPFT

SEQ ID NO: 79124 - protein, 13 aa, Homo sapiens
  heavy chain complementarity determining region 3 for antibody 39562
ARAVTKAGSGFDY

SEQ ID NO: 79125 - protein, 9 aa, Homo sapiens
  light chain complementarity determining region 3 for antibody 39563
MQALQTPFN

SEQ ID NO: 79126 - protein, 13 aa, Homo sapiens
  heavy chain complementarity determining region 3 for antibody 39563
ARAITKAGSGFDY

SEQ ID NO: 79127 - protein, 9 aa, Homo sapiens
  light chain complementarity determining region 3 for antibody 39564
MQALQTLYT

SEQ ID NO: 79128 - protein, 21 aa, Homo sapiens
  heavy chain complementarity determining region 3 for antibody 39564
ARDAPVSRPYSSGWYSSAFDY

SEQ ID NO: 79129 - protein, 8 aa, Homo sapiens
  light chain complementarity determining region 3 for antibody 39565
MQALQTGT

SEQ ID NO: 79130 - protein, 23 aa, Homo sapiens
  heavy chain complementarity determining region 3 for antibody 39565
ARVDCSGGKCYSVDDFYYSGMDV

SEQ ID NO: 79131 - protein, 9 aa, Homo sapiens
  light chain complementarity determining region 3 for antibody 39566
MQALQTAKT

SEQ ID NO: 79132 - protein, 22 aa, Homo sapiens
  heavy chain complementarity determining region 3 for antibody 39566
ARSMGCISTSCYAGWSYYGMDV

SEQ ID NO: 79133 - protein, 9 aa, Homo sapiens
  light chain complementarity determining region 3 for antibody 39567
MQALQSPLT

SEQ ID NO: 79134 - protein, 12 aa, Homo sapiens
  heavy chain complementarity determining region 3 for antibody 39567
ARDGGKSWSELT

SEQ ID NO: 79135 - protein, 9 aa, Homo sapiens
  light chain complementarity determining region 3 for antibody 39568
MQALQSPIT

SEQ ID NO: 79136 - protein, 12 aa, Homo sapiens
  heavy chain complementarity determining region 3 for antibody 39568
ARGGGKSWSELT

SEQ ID NO: 79137 - protein, 9 aa, Homo sapiens
  light chain complementarity determining region 3 for antibody 39569
MQALQSPIT

SEQ ID NO: 79138 - protein, 12 aa, Homo sapiens
  heavy chain complementarity determining region 3 for antibody 39569
ARDGGKSWSDRT

SEQ ID NO: 79139 - protein, 9 aa, Homo sapiens
  light chain complementarity determining region 3 for antibody 39570
MQALQSPIP

SEQ ID NO: 79140 - protein, 12 aa, Homo sapiens
  heavy chain complementarity determining region 3 for antibody 39570
ARDGGKSWSELT

SEQ ID NO: 79141 - protein, 9 aa, Homo sapiens
  light chain complementarity determining region 3 for antibody 39571
MQALQSPFT

SEQ ID NO: 79142 - protein, 12 aa, Homo sapiens
  heavy chain complementarity determining region 3 for antibody 39571
ARGIVGGNSFDY

SEQ ID NO: 79143 - protein, 9 aa, Homo sapiens
  light chain complementarity determining region 3 for antibody 39572
MQALQPPYT

SEQ ID NO: 79144 - protein, 12 aa, Homo sapiens
  heavy chain complementarity determining region 3 for antibody 39572
ATSLWFGIHPEY

SEQ ID NO: 79145 - protein, 9 aa, Homo sapiens
  light chain complementarity determining region 3 for antibody 39573
MQALQPPTT

SEQ ID NO: 79146 - protein, 13 aa, Homo sapiens
  heavy chain complementarity determining region 3 for antibody 39573
TMVVDYGDYGFDC

SEQ ID NO: 79147 - protein, 9 aa, Homo sapiens
  light chain complementarity determining region 3 for antibody 39574
MQALQPPRT

SEQ ID NO: 79148 - protein, 18 aa, Homo sapiens
  heavy chain complementarity determining region 3 for antibody 39574
ARTQYVEMHIYYFYGLDV

SEQ ID NO: 79149 - protein, 9 aa, Homo sapiens
  light chain complementarity determining region 3 for antibody 39575
MQALQPPIT

SEQ ID NO: 79150 - protein, 13 aa, Homo sapiens
  heavy chain complementarity determining region 3 for antibody 39575
TMVVDYGDYGFDC

SEQ ID NO: 79151 - protein, 9 aa, Homo sapiens
  light chain complementarity determining region 3 for antibody 39576
MQALQPPFT

SEQ ID NO: 79152 - protein, 13 aa, Homo sapiens
  heavy chain complementarity determining region 3 for antibody 39576
ARAITKAGSGFDY

SEQ ID NO: 79153 - protein, 9 aa, Homo sapiens
  light chain complementarity determining region 3 for antibody 39577
MQALQPLFT

SEQ ID NO: 79154 - protein, 15 aa, Homo sapiens
  heavy chain complementarity determining region 3 for antibody 39577
TYSSSWLGYYYGMDV

SEQ ID NO: 79155 - protein, 8 aa, Homo sapiens
  light chain complementarity determining region 3 for antibody 39578
MQALQNPG

SEQ ID NO: 79156 - protein, 19 aa, Homo sapiens
  heavy chain complementarity determining region 3 for antibody 39578
ANFGSGNFYNVRYYYGMDV

SEQ ID NO: 79157 - protein, 9 aa, Homo sapiens
  light chain complementarity determining region 3 for antibody 39579
MQALQIPRP

SEQ ID NO: 79158 - protein, 18 aa, Homo sapiens
  heavy chain complementarity determining region 3 for antibody 39579
ARGGTMVRGSDYYFGMHV

SEQ ID NO: 79159 - protein, 9 aa, Homo sapiens
  light chain complementarity determining region 3 for antibody 39580
MQALQIPGT

SEQ ID NO: 79160 - protein, 18 aa, Homo sapiens
  heavy chain complementarity determining region 3 for antibody 39580
ARGGTMVRGSDYYFGMHV

SEQ ID NO: 79161 - protein, 9 aa, Homo sapiens
  light chain complementarity determining region 3 for antibody 39581
MQALQIPFT

SEQ ID NO: 79162 - protein, 13 aa, Homo sapiens
  heavy chain complementarity determining region 3 for antibody 39581
ARAITKAGSGFDY

SEQ ID NO: 79163 - protein, 9 aa, Homo sapiens
  light chain complementarity determining region 3 for antibody 39582
MQALQIAQT

SEQ ID NO: 79164 - protein, 22 aa, Homo sapiens
  heavy chain complementarity determining region 3 for antibody 39582
ARSMGCISTSCYAGWSYYGMDV

SEQ ID NO: 79165 - protein, 9 aa, Homo sapiens
  light chain complementarity determining region 3 for antibody 39583
MQALQFPLT

SEQ ID NO: 79166 - protein, 12 aa, Homo sapiens
  heavy chain complementarity determining region 3 for antibody 39583
ARDGGKSWSELT

SEQ ID NO: 79167 - protein, 9 aa, Homo sapiens
  light chain complementarity determining region 3 for antibody 39584
MQALQCPYT

SEQ ID NO: 79168 - protein, 12 aa, Homo sapiens
  heavy chain complementarity determining region 3 for antibody 39584
ARARGVAGKLDS

SEQ ID NO: 79169 - protein, 9 aa, Homo sapiens
  light chain complementarity determining region 3 for antibody 39585
MQALQAPTT

SEQ ID NO: 79170 - protein, 13 aa, Homo sapiens
  heavy chain complementarity determining region 3 for antibody 39585
TMVVDYGDYGFDC

SEQ ID NO: 79171 - protein, 9 aa, Homo sapiens
  light chain complementarity determining region 3 for antibody 39586
MQALQAPPT

SEQ ID NO: 79172 - protein, 19 aa, Homo sapiens
  heavy chain complementarity determining region 3 for antibody 39586
ARRQSLIEGLAGWGWAIGS

SEQ ID NO: 79173 - protein, 9 aa, Homo sapiens
  light chain complementarity determining region 3 for antibody 39587
MQALQAPFT

SEQ ID NO: 79174 - protein, 12 aa, Homo sapiens
  heavy chain complementarity determining region 3 for antibody 39587
TRDPPTRWGMEV

SEQ ID NO: 79175 - protein, 9 aa, Homo sapiens
  light chain complementarity determining region 3 for antibody 39588
MQALPTSGT

SEQ ID NO: 79176 - protein, 21 aa, Homo sapiens
  heavy chain complementarity determining region 3 for antibody 39588
AKDAPVVRPYSSGWYSSAFDS

SEQ ID NO: 79177 - protein, 8 aa, Homo sapiens
  light chain complementarity determining region 3 for antibody 39589
MQALPTPT

SEQ ID NO: 79178 - protein, 15 aa, Homo sapiens
  heavy chain complementarity determining region 3 for antibody 39589
TADRGDSSRWYGMAV

SEQ ID NO: 79179 - protein, 8 aa, Homo sapiens
  light chain complementarity determining region 3 for antibody 39590
MQALPTPT

SEQ ID NO: 79180 - protein, 12 aa, Homo sapiens
  heavy chain complementarity determining region 3 for antibody 39590
AKDVAAAESFDY

SEQ ID NO: 79181 - protein, 10 aa, Homo sapiens
  light chain complementarity determining region 3 for antibody 39591
MQALPTPPWT

SEQ ID NO: 79182 - protein, 17 aa, Homo sapiens
  heavy chain complementarity determining region 3 for antibody 39591
TSLGYSFGSVYYYGLDV

SEQ ID NO: 79183 - protein, 9 aa, Homo sapiens
  light chain complementarity determining region 3 for antibody 39592
MQALPTPFT

SEQ ID NO: 79184 - protein, 12 aa, Homo sapiens
  heavy chain complementarity determining region 3 for antibody 39592
ARGIVGGNSFDY

SEQ ID NO: 79185 - protein, 9 aa, Homo sapiens
  light chain complementarity determining region 3 for antibody 39593
MQALPTLFT

SEQ ID NO: 79186 - protein, 15 aa, Homo sapiens
  heavy chain complementarity determining region 3 for antibody 39593
TYSSSWLGYYYGMDV

SEQ ID NO: 79187 - protein, 9 aa, Homo sapiens
  light chain complementarity determining region 3 for antibody 39594
MQALLTPRP

SEQ ID NO: 79188 - protein, 13 aa, Homo sapiens
  heavy chain complementarity determining region 3 for antibody 39594
ARDQHAGHYGLDA

SEQ ID NO: 79189 - protein, 9 aa, Homo sapiens
  light chain complementarity determining region 3 for antibody 39595
MQALLIPRT

SEQ ID NO: 79190 - protein, 13 aa, Homo sapiens
  heavy chain complementarity determining region 3 for antibody 39595
ARDQHAGHYGLDA

SEQ ID NO: 79191 - protein, 8 aa, Homo sapiens
  light chain complementarity determining region 3 for antibody 39596
MQALKTRT

SEQ ID NO: 79192 - protein, 13 aa, Homo sapiens
  heavy chain complementarity determining region 3 for antibody 39596
ARDESYGGYGMDV

SEQ ID NO: 79193 - protein, 9 aa, Homo sapiens
  light chain complementarity determining region 3 for antibody 39597
MQALKTPWT

SEQ ID NO: 79194 - protein, 17 aa, Homo sapiens
  heavy chain complementarity determining region 3 for antibody 39597
SRRRKNGSPGRNNWFDP

SEQ ID NO: 79195 - protein, 8 aa, Homo sapiens
  light chain complementarity determining region 3 for antibody 39598
MQALKTPT

SEQ ID NO: 79196 - protein, 15 aa, Homo sapiens
  heavy chain complementarity determining region 3 for antibody 39598
TADRGDSSRWYGMAV

SEQ ID NO: 79197 - protein, 9 aa, Homo sapiens
  light chain complementarity determining region 3 for antibody 39599
MQALKTPRT

SEQ ID NO: 79198 - protein, 18 aa, Homo sapiens
  heavy chain complementarity determining region 3 for antibody 39599
ARTQYVEMHIYYFYGLDV

SEQ ID NO: 79199 - protein, 8 aa, Homo sapiens
  light chain complementarity determining region 3 for antibody 39600
MQALKTPP

SEQ ID NO: 79200 - protein, 15 aa, Homo sapiens
  heavy chain complementarity determining region 3 for antibody 39600
ARRDYYDSSGYRLDY

SEQ ID NO: 79201 - protein, 8 aa, Homo sapiens
  light chain complementarity determining region 3 for antibody 39601
MQALHTWR

SEQ ID NO: 79202 - protein, 18 aa, Homo sapiens
  heavy chain complementarity determining region 3 for antibody 39601
ARSRPYGGDATPARHFDY

SEQ ID NO: 79203 - protein, 9 aa, Homo sapiens
  light chain complementarity determining region 3 for antibody 39602
MQALHTPYT

SEQ ID NO: 79204 - protein, 16 aa, Homo sapiens
  heavy chain complementarity determining region 3 for antibody 39602
ARHRAAGGGYYYGMDV

SEQ ID NO: 79205 - protein, 8 aa, Homo sapiens
  light chain complementarity determining region 3 for antibody 39603
MQALHTPT

SEQ ID NO: 79206 - protein, 15 aa, Homo sapiens
  heavy chain complementarity determining region 3 for antibody 39603
TADRGDSSRWYGMAV

SEQ ID NO: 79207 - protein, 9 aa, Homo sapiens
  light chain complementarity determining region 3 for antibody 39604
MQALHTPRT

SEQ ID NO: 79208 - protein, 6 aa, Homo sapiens
  heavy chain complementarity determining region 3 for antibody 39604
TRALDY

SEQ ID NO: 79209 - protein, 9 aa, Homo sapiens
  light chain complementarity determining region 3 for antibody 39605
MQALHTPRR

SEQ ID NO: 79210 - protein, 15 aa, Homo sapiens
  heavy chain complementarity determining region 3 for antibody 39605
AKDLHRDNGMRQFEN

SEQ ID NO: 79211 - protein, 9 aa, Homo sapiens
  light chain complementarity determining region 3 for antibody 39606
MQALHTPRP

SEQ ID NO: 79212 - protein, 15 aa, Homo sapiens
  heavy chain complementarity determining region 3 for antibody 39606
AKDLHRDNGMRQFEN

SEQ ID NO: 79213 - protein, 9 aa, Homo sapiens
  light chain complementarity determining region 3 for antibody 39607
MQALHTPQT

SEQ ID NO: 79214 - protein, 13 aa, Homo sapiens
  heavy chain complementarity determining region 3 for antibody 39607
ARFQGAAAGLGLH

SEQ ID NO: 79215 - protein, 9 aa, Homo sapiens
  light chain complementarity determining region 3 for antibody 39608
MQALHTPLT

SEQ ID NO: 79216 - protein, 14 aa, Homo sapiens
  heavy chain complementarity determining region 3 for antibody 39608
ARGLAARPLWRFDY

SEQ ID NO: 79217 - protein, 8 aa, Homo sapiens
  light chain complementarity determining region 3 for antibody 39609
MQALHTPL

SEQ ID NO: 79218 - protein, 18 aa, Homo sapiens
  heavy chain complementarity determining region 3 for antibody 39609
ASGTKKSGYTSSLGAFDI

SEQ ID NO: 79219 - protein, 9 aa, Homo sapiens
  light chain complementarity determining region 3 for antibody 39610
MQALHTPIT

SEQ ID NO: 79220 - protein, 10 aa, Homo sapiens
  heavy chain complementarity determining region 3 for antibody 39610
GMSIAVAASK

SEQ ID NO: 79221 - protein, 9 aa, Homo sapiens
  light chain complementarity determining region 3 for antibody 39611
MQALHTLFT

SEQ ID NO: 79222 - protein, 15 aa, Homo sapiens
  heavy chain complementarity determining region 3 for antibody 39611
TYSSSWLGYYYGMDV

SEQ ID NO: 79223 - protein, 8 aa, Homo sapiens
  light chain complementarity determining region 3 for antibody 39612
MQALHNLT

SEQ ID NO: 79224 - protein, 16 aa, Homo sapiens
  heavy chain complementarity determining region 3 for antibody 39612
AKWGGVAMAGHYYFDY

SEQ ID NO: 79225 - protein, 9 aa, Homo sapiens
  light chain complementarity determining region 3 for antibody 39613
MQALGTPRT

SEQ ID NO: 79226 - protein, 12 aa, Homo sapiens
  heavy chain complementarity determining region 3 for antibody 39613
ARDVPTISRFDH

SEQ ID NO: 79227 - protein, 9 aa, Homo sapiens
  light chain complementarity determining region 3 for antibody 39614
MQALGTPPP

SEQ ID NO: 79228 - protein, 12 aa, Homo sapiens
  heavy chain complementarity determining region 3 for antibody 39614
AKDLVGGARGGN

SEQ ID NO: 79229 - protein, 9 aa, Homo sapiens
  light chain complementarity determining region 3 for antibody 39615
MQALGTPFT

SEQ ID NO: 79230 - protein, 15 aa, Homo sapiens
  heavy chain complementarity determining region 3 for antibody 39615
VRHYRELATGIEGDS

SEQ ID NO: 79231 - protein, 9 aa, Homo sapiens
  light chain complementarity determining region 3 for antibody 39616
MQALGTPFT

SEQ ID NO: 79232 - protein, 15 aa, Homo sapiens
  heavy chain complementarity determining region 3 for antibody 39616
LRHYRSLATGTEEDC

SEQ ID NO: 79233 - protein, 9 aa, Homo sapiens
  light chain complementarity determining region 3 for antibody 39617
MQALETPST

SEQ ID NO: 79234 - protein, 15 aa, Homo sapiens
  heavy chain complementarity determining region 3 for antibody 39617
LRHYRSLATGTEEDC

SEQ ID NO: 79235 - protein, 9 aa, Homo sapiens
  light chain complementarity determining region 3 for antibody 39618
MQALETPLT

SEQ ID NO: 79236 - protein, 15 aa, Homo sapiens
  heavy chain complementarity determining region 3 for antibody 39618
LRHYRSLATGTEEDC

SEQ ID NO: 79237 - protein, 9 aa, Homo sapiens
  light chain complementarity determining region 3 for antibody 39619
MQALETPLP

SEQ ID NO: 79238 - protein, 15 aa, Homo sapiens
  heavy chain complementarity determining region 3 for antibody 39619
VRHYRIITAPLEGDS

SEQ ID NO: 79239 - protein, 9 aa, Homo sapiens
  light chain complementarity determining region 3 for antibody 39620
MQALETPFT

SEQ ID NO: 79240 - protein, 15 aa, Homo sapiens
  heavy chain complementarity determining region 3 for antibody 39620
VSHYRIITAPLEGDS

SEQ ID NO: 79241 - protein, 9 aa, Homo sapiens
  light chain complementarity determining region 3 for antibody 39621
MQALETPFT

SEQ ID NO: 79242 - protein, 15 aa, Homo sapiens
  heavy chain complementarity determining region 3 for antibody 39621
VSHYRELTTGIEGDS

SEQ ID NO: 79243 - protein, 9 aa, Homo sapiens
  light chain complementarity determining region 3 for antibody 39622
MQALETPFT

SEQ ID NO: 79244 - protein, 15 aa, Homo sapiens
  heavy chain complementarity determining region 3 for antibody 39622
VRHYRRITAPLEGDS

SEQ ID NO: 79245 - protein, 9 aa, Homo sapiens
  light chain complementarity determining region 3 for antibody 39623
MQALETPFT

SEQ ID NO: 79246 - protein, 15 aa, Homo sapiens
  heavy chain complementarity determining region 3 for antibody 39623
VRHYRITVAAGEGDS

SEQ ID NO: 79247 - protein, 9 aa, Homo sapiens
  light chain complementarity determining region 3 for antibody 39624
MQALETPFT

SEQ ID NO: 79248 - protein, 15 aa, Homo sapiens
  heavy chain complementarity determining region 3 for antibody 39624
VRHYRIITAPLEWDS

SEQ ID NO: 79249 - protein, 9 aa, Homo sapiens
  light chain complementarity determining region 3 for antibody 39625
MQALETPFT

SEQ ID NO: 79250 - protein, 15 aa, Homo sapiens
  heavy chain complementarity determining region 3 for antibody 39625
VRHYRIITAPLEVDS

SEQ ID NO: 79251 - protein, 9 aa, Homo sapiens
  light chain complementarity determining region 3 for antibody 39626
MQALETPFT

SEQ ID NO: 79252 - protein, 15 aa, Homo sapiens
  heavy chain complementarity determining region 3 for antibody 39626
VRHYRIITAPLEGDT

SEQ ID NO: 79253 - protein, 9 aa, Homo sapiens
  light chain complementarity determining region 3 for antibody 39627
MQALETPFT

SEQ ID NO: 79254 - protein, 15 aa, Homo sapiens
  heavy chain complementarity determining region 3 for antibody 39627
VRHYRETVAGIKGDS

SEQ ID NO: 79255 - protein, 9 aa, Homo sapiens
  light chain complementarity determining region 3 for antibody 39628
MQALETPFT

SEQ ID NO: 79256 - protein, 15 aa, Homo sapiens
  heavy chain complementarity determining region 3 for antibody 39628
VRHYRETVAGIEGDA

SEQ ID NO: 79257 - protein, 9 aa, Homo sapiens
  light chain complementarity determining region 3 for antibody 39629
MQALETPFT

SEQ ID NO: 79258 - protein, 15 aa, Homo sapiens
  heavy chain complementarity determining region 3 for antibody 39629
VRHYRELTTGIEGDP

SEQ ID NO: 79259 - protein, 9 aa, Homo sapiens
  light chain complementarity determining region 3 for antibody 39630
MQALETPFT

SEQ ID NO: 79260 - protein, 15 aa, Homo sapiens
  heavy chain complementarity determining region 3 for antibody 39630
VRHYRELTTDIEGDS

SEQ ID NO: 79261 - protein, 9 aa, Homo sapiens
  light chain complementarity determining region 3 for antibody 39631
MQALETPFT

SEQ ID NO: 79262 - protein, 15 aa, Homo sapiens
  heavy chain complementarity determining region 3 for antibody 39631
VRHYREAVAGIEGDS

SEQ ID NO: 79263 - protein, 9 aa, Homo sapiens
  light chain complementarity determining region 3 for antibody 39632
MQALETPFT

SEQ ID NO: 79264 - protein, 15 aa, Homo sapiens
  heavy chain complementarity determining region 3 for antibody 39632
VRHDRETVAGIEGDS

SEQ ID NO: 79265 - protein, 9 aa, Homo sapiens
  light chain complementarity determining region 3 for antibody 39633
MQALETPFT

SEQ ID NO: 79266 - protein, 15 aa, Homo sapiens
  heavy chain complementarity determining region 3 for antibody 39633
VRDYRITVAAVEGDS

SEQ ID NO: 79267 - protein, 9 aa, Homo sapiens
  light chain complementarity determining region 3 for antibody 39634
MQALETPFN

SEQ ID NO: 79268 - protein, 15 aa, Homo sapiens
  heavy chain complementarity determining region 3 for antibody 39634
VRHYRETVAGIEGDS

SEQ ID NO: 79269 - protein, 9 aa, Homo sapiens
  light chain complementarity determining region 3 for antibody 39635
MQALETPFA

SEQ ID NO: 79270 - protein, 15 aa, Homo sapiens
  heavy chain complementarity determining region 3 for antibody 39635
VRHYRETVAGIEGDS

SEQ ID NO: 79271 - protein, 9 aa, Homo sapiens
  light chain complementarity determining region 3 for antibody 39636
MQALESPFT

SEQ ID NO: 79272 - protein, 15 aa, Homo sapiens
  heavy chain complementarity determining region 3 for antibody 39636
VRQYRETVAGIEGDS

SEQ ID NO: 79273 - protein, 9 aa, Homo sapiens
  light chain complementarity determining region 3 for antibody 39637
MQALESPFT

SEQ ID NO: 79274 - protein, 15 aa, Homo sapiens
  heavy chain complementarity determining region 3 for antibody 39637
VRHYRETVAGIEGDS

SEQ ID NO: 79275 - protein, 9 aa, Homo sapiens
  light chain complementarity determining region 3 for antibody 39638
MQALEPPFT

SEQ ID NO: 79276 - protein, 15 aa, Homo sapiens
  heavy chain complementarity determining region 3 for antibody 39638
VRHYRELATGIEGDS

SEQ ID NO: 79277 - protein, 9 aa, Homo sapiens
  light chain complementarity determining region 3 for antibody 39639
MQALEIPFT

SEQ ID NO: 79278 - protein, 15 aa, Homo sapiens
  heavy chain complementarity determining region 3 for antibody 39639
VRHYRVLAAGIEGDS

SEQ ID NO: 79279 - protein, 9 aa, Homo sapiens
  light chain complementarity determining region 3 for antibody 39640
MQALEIPFT

SEQ ID NO: 79280 - protein, 15 aa, Homo sapiens
  heavy chain complementarity determining region 3 for antibody 39640
VRHYRITVAAVEGDS

SEQ ID NO: 79281 - protein, 9 aa, Homo sapiens
  light chain complementarity determining region 3 for antibody 39641
MQALEIPFT

SEQ ID NO: 79282 - protein, 15 aa, Homo sapiens
  heavy chain complementarity determining region 3 for antibody 39641
VRHYRELTTGIEGDS

SEQ ID NO: 79283 - protein, 9 aa, Homo sapiens
  light chain complementarity determining region 3 for antibody 39642
MQALEIPFT

SEQ ID NO: 79284 - protein, 15 aa, Homo sapiens
  heavy chain complementarity determining region 3 for antibody 39642
LRHYRSLATGTEEDC

SEQ ID NO: 79285 - protein, 9 aa, Homo sapiens
  light chain complementarity determining region 3 for antibody 39643
MQALEIPFP

SEQ ID NO: 79286 - protein, 15 aa, Homo sapiens
  heavy chain complementarity determining region 3 for antibody 39643
VRHYRETVAGIEGDS

SEQ ID NO: 79287 - protein, 9 aa, Homo sapiens
  light chain complementarity determining region 3 for antibody 39644
MQALEAPFT

SEQ ID NO: 79288 - protein, 15 aa, Homo sapiens
  heavy chain complementarity determining region 3 for antibody 39644
VRHYRETVAGIEGDS

SEQ ID NO: 79289 - protein, 9 aa, Homo sapiens
  light chain complementarity determining region 3 for antibody 39645
MQALDTPFT

SEQ ID NO: 79290 - protein, 15 aa, Homo sapiens
  heavy chain complementarity determining region 3 for antibody 39645
VRQYRELATGIEGDS

SEQ ID NO: 79291 - protein, 9 aa, Homo sapiens
  light chain complementarity determining region 3 for antibody 39646
MQALDTPFP

SEQ ID NO: 79292 - protein, 15 aa, Homo sapiens
  heavy chain complementarity determining region 3 for antibody 39646
VRHYRELATGIEGDS

SEQ ID NO: 79293 - protein, 9 aa, Homo sapiens
  light chain complementarity determining region 3 for antibody 39647
MQALDPPFT

SEQ ID NO: 79294 - protein, 15 aa, Homo sapiens
  heavy chain complementarity determining region 3 for antibody 39647
VRHYRELATGIEGDS

SEQ ID NO: 79295 - protein, 9 aa, Homo sapiens
  light chain complementarity determining region 3 for antibody 39648
MQALATPFT

SEQ ID NO: 79296 - protein, 15 aa, Homo sapiens
  heavy chain complementarity determining region 3 for antibody 39648
VRHYRIITAPLEGDS

SEQ ID NO: 79297 - protein, 10 aa, Homo sapiens
  light chain complementarity determining region 3 for antibody 39649
MQAKHWPGFT

SEQ ID NO: 79298 - protein, 10 aa, Homo sapiens
  heavy chain complementarity determining region 3 for antibody 39649
ATSQLSTTDY

SEQ ID NO: 79299 - protein, 9 aa, Homo sapiens
  light chain complementarity determining region 3 for antibody 39650
MPVQQTRFT

SEQ ID NO: 79300 - protein, 20 aa, Homo sapiens
  heavy chain complementarity determining region 3 for antibody 39650
AREGHRATARNRYYYNGIDV

SEQ ID NO: 79301 - protein, 9 aa, Homo sapiens
  light chain complementarity determining region 3 for antibody 39651
MPSLQAPIT

SEQ ID NO: 79302 - protein, 12 aa, Homo sapiens
  heavy chain complementarity determining region 3 for antibody 39651
TRDPPTRWGMEV

SEQ ID NO: 79303 - protein, 9 aa, Homo sapiens
  light chain complementarity determining region 3 for antibody 39652
MPRVQTPGT

SEQ ID NO: 79304 - protein, 17 aa, Homo sapiens
  heavy chain complementarity determining region 3 for antibody 39652
IPVMLVRFLEDLQLFNY

SEQ ID NO: 79305 - protein, 9 aa, Homo sapiens
  light chain complementarity determining region 3 for antibody 39653
MPNTQWPLT

SEQ ID NO: 79306 - protein, 8 aa, Homo sapiens
  heavy chain complementarity determining region 3 for antibody 39653
ALGQDMIY

SEQ ID NO: 79307 - protein, 9 aa, Homo sapiens
  light chain complementarity determining region 3 for antibody 39654
MPNTQWPLT

SEQ ID NO: 79308 - protein, 8 aa, Homo sapiens
  heavy chain complementarity determining region 3 for antibody 39654
ALGQDMGR

SEQ ID NO: 79309 - protein, 9 aa, Homo sapiens
  light chain complementarity determining region 3 for antibody 39655
MPGTYWPHI

SEQ ID NO: 79310 - protein, 11 aa, Homo sapiens
  heavy chain complementarity determining region 3 for antibody 39655
ARDPFFGALDC

SEQ ID NO: 79311 - protein, 11 aa, Homo sapiens
  light chain complementarity determining region 3 for antibody 39656
MPGTHWPPMYT

SEQ ID NO: 79312 - protein, 17 aa, Homo sapiens
  heavy chain complementarity determining region 3 for antibody 39656
ARGGSGYYQEGDDTFGF

SEQ ID NO: 79313 - protein, 9 aa, Homo sapiens
  light chain complementarity determining region 3 for antibody 39657
MPGTHWPLT

SEQ ID NO: 79314 - protein, 19 aa, Homo sapiens
  heavy chain complementarity determining region 3 for antibody 39657
VRDDRDHCSGGSCEGYFDD

SEQ ID NO: 79315 - protein, 8 aa, Homo sapiens
  light chain complementarity determining region 3 for antibody 39658
MPGTHMYT

SEQ ID NO: 79316 - protein, 15 aa, Homo sapiens
  heavy chain complementarity determining region 3 for antibody 39658
ARCGANSCPQSAMDV

SEQ ID NO: 79317 - protein, 9 aa, Homo sapiens
  light chain complementarity determining region 3 for antibody 39659
MPGLQTPYT

SEQ ID NO: 79318 - protein, 10 aa, Homo sapiens
  heavy chain complementarity determining region 3 for antibody 39659
GSDLTGARDH

SEQ ID NO: 79319 - protein, 9 aa, Homo sapiens
  light chain complementarity determining region 3 for antibody 39660
MPGLQTPYT

SEQ ID NO: 79320 - protein, 10 aa, Homo sapiens
  heavy chain complementarity determining region 3 for antibody 39660
GSDLSGARDY

SEQ ID NO: 79321 - protein, 9 aa, Homo sapiens
  light chain complementarity determining region 3 for antibody 39661
MPGLQTPYT

SEQ ID NO: 79322 - protein, 10 aa, Homo sapiens
  heavy chain complementarity determining region 3 for antibody 39661
GRDLSGARDY

SEQ ID NO: 79323 - protein, 8 aa, Homo sapiens
  light chain complementarity determining region 3 for antibody 39662
MPALQTPT

SEQ ID NO: 79324 - protein, 15 aa, Homo sapiens
  heavy chain complementarity determining region 3 for antibody 39662
TADRGDSSRWYGMAV

SEQ ID NO: 79325 - protein, 9 aa, Homo sapiens
  light chain complementarity determining region 3 for antibody 39663
MPALQTPRT

SEQ ID NO: 79326 - protein, 6 aa, Homo sapiens
  heavy chain complementarity determining region 3 for antibody 39663
TRALDY

SEQ ID NO: 79327 - protein, 9 aa, Homo sapiens
  light chain complementarity determining region 3 for antibody 39664
MPALQTPRT

SEQ ID NO: 79328 - protein, 22 aa, Homo sapiens
  heavy chain complementarity determining region 3 for antibody 39664
ARHDGVIAVAGNTHYYYYGMDV

SEQ ID NO: 79329 - protein, 9 aa, Homo sapiens
  light chain complementarity determining region 3 for antibody 39665
MPALQTPRT

SEQ ID NO: 79330 - protein, 9 aa, Homo sapiens
  heavy chain complementarity determining region 3 for antibody 39665
AKGKDAFGV

SEQ ID NO: 79331 - protein, 9 aa, Homo sapiens
  light chain complementarity determining region 3 for antibody 39666
MPALQTLFT

SEQ ID NO: 79332 - protein, 21 aa, Homo sapiens
  heavy chain complementarity determining region 3 for antibody 39666
ANEGSRVGGSTNRYYYSGVDV

SEQ ID NO: 79333 - protein, 9 aa, Homo sapiens
  light chain complementarity determining region 3 for antibody 39667
MPALQAPRA

SEQ ID NO: 79334 - protein, 13 aa, Homo sapiens
  heavy chain complementarity determining region 3 for antibody 39667
ARPNNALGRAFDI

SEQ ID NO: 79335 - protein, 8 aa, Homo sapiens
  light chain complementarity determining region 3 for antibody 39668
MPALHTWT

SEQ ID NO: 79336 - protein, 18 aa, Homo sapiens
  heavy chain complementarity determining region 3 for antibody 39668
ARSRPYGGDANPARHFDY

SEQ ID NO: 79337 - protein, 9 aa, Homo sapiens
  light chain complementarity determining region 3 for antibody 39669
MPALETPFT

SEQ ID NO: 79338 - protein, 15 aa, Homo sapiens
  heavy chain complementarity determining region 3 for antibody 39669
VRHYRVLAAGIEGDS

SEQ ID NO: 79339 - protein, 9 aa, Homo sapiens
  light chain complementarity determining region 3 for antibody 39670
MPALETPFT

SEQ ID NO: 79340 - protein, 15 aa, Homo sapiens
  heavy chain complementarity determining region 3 for antibody 39670
VRHYRITVAGIEGDS

SEQ ID NO: 79341 - protein, 9 aa, Homo sapiens
  light chain complementarity determining region 3 for antibody 39671
MPALETPFT

SEQ ID NO: 79342 - protein, 15 aa, Homo sapiens
  heavy chain complementarity determining region 3 for antibody 39671
VRHYRETVAGIEGDC

SEQ ID NO: 79343 - protein, 9 aa, Homo sapiens
  light chain complementarity determining region 3 for antibody 39672
MPALETPFT

SEQ ID NO: 79344 - protein, 15 aa, Homo sapiens
  heavy chain complementarity determining region 3 for antibody 39672
VRHYRELATGIEGDS

SEQ ID NO: 79345 - protein, 9 aa, Homo sapiens
  light chain complementarity determining region 3 for antibody 39673
MPALETPFT

SEQ ID NO: 79346 - protein, 15 aa, Homo sapiens
  heavy chain complementarity determining region 3 for antibody 39673
LRHYRSLATGTEEDC

SEQ ID NO: 79347 - protein, 8 aa, Homo sapiens
  light chain complementarity determining region 3 for antibody 39674
MKGTQGRP

SEQ ID NO: 79348 - protein, 15 aa, Homo sapiens
  heavy chain complementarity determining region 3 for antibody 39674
ATEWSFQMIEGNFHH

SEQ ID NO: 79349 - protein, 8 aa, Homo sapiens
  light chain complementarity determining region 3 for antibody 39675
MKGTQGRP

SEQ ID NO: 79350 - protein, 15 aa, Homo sapiens
  heavy chain complementarity determining region 3 for antibody 39675
ATDWSFQRIEGNFHH

SEQ ID NO: 79351 - protein, 8 aa, Homo sapiens
  light chain complementarity determining region 3 for antibody 39676
MKGTQGRL

SEQ ID NO: 79352 - protein, 15 aa, Homo sapiens
  heavy chain complementarity determining region 3 for antibody 39676
ATDWSFQMIEGNFHH

SEQ ID NO: 79353 - protein, 9 aa, Homo sapiens
  light chain complementarity determining region 3 for antibody 39677
MKGTHWPLT

SEQ ID NO: 79354 - protein, 19 aa, Homo sapiens
  heavy chain complementarity determining region 3 for antibody 39677
VRDDRDHCSGGSCEGYFDD

SEQ ID NO: 79355 - protein, 9 aa, Homo sapiens
  light chain complementarity determining region 3 for antibody 39678
MKGLQTPYT

SEQ ID NO: 79356 - protein, 10 aa, Homo sapiens
  heavy chain complementarity determining region 3 for antibody 39678
GRDLSGARDY

SEQ ID NO: 79357 - protein, 9 aa, Homo sapiens
  light chain complementarity determining region 3 for antibody 39679
MKALETPFT

SEQ ID NO: 79358 - protein, 15 aa, Homo sapiens
  heavy chain complementarity determining region 3 for antibody 39679
VRHYRVLAAGIEGDS

SEQ ID NO: 79359 - protein, 9 aa, Homo sapiens
  light chain complementarity determining region 3 for antibody 39680
MKALETPFT

SEQ ID NO: 79360 - protein, 15 aa, Homo sapiens
  heavy chain complementarity determining region 3 for antibody 39680
VRHYRIITAPLEGDS

SEQ ID NO: 79361 - protein, 9 aa, Homo sapiens
  light chain complementarity determining region 3 for antibody 39681
MHVLQAPLS

SEQ ID NO: 79362 - protein, 18 aa, Homo sapiens
  heavy chain complementarity determining region 3 for antibody 39681
ARPKVGATDYHYYFGMDV

SEQ ID NO: 79363 - protein, 9 aa, Homo sapiens
  light chain complementarity determining region 3 for antibody 39682
MHSRRWPHT

SEQ ID NO: 79364 - protein, 8 aa, Homo sapiens
  heavy chain complementarity determining region 3 for antibody 39682
TAWGSSQH

SEQ ID NO: 79365 - protein, 9 aa, Homo sapiens
  light chain complementarity determining region 3 for antibody 39683
MHPLQTPYT

SEQ ID NO: 79366 - protein, 13 aa, Homo sapiens
  heavy chain complementarity determining region 3 for antibody 39683
AHWGHTNGWHFDY

SEQ ID NO: 79367 - protein, 9 aa, Homo sapiens
  light chain complementarity determining region 3 for antibody 39684
MHHTHWPGT

SEQ ID NO: 79368 - protein, 12 aa, Homo sapiens
  heavy chain complementarity determining region 3 for antibody 39684
ATSPHRDSRSSY

SEQ ID NO: 79369 - protein, 9 aa, Homo sapiens
  light chain complementarity determining region 3 for antibody 39685
MHGTYWPHI

SEQ ID NO: 79370 - protein, 11 aa, Homo sapiens
  heavy chain complementarity determining region 3 for antibody 39685
ARDPFFGALDC

SEQ ID NO: 79371 - protein, 9 aa, Homo sapiens
  light chain complementarity determining region 3 for antibody 39686
MHGTHRPPT

SEQ ID NO: 79372 - protein, 16 aa, Homo sapiens
  heavy chain complementarity determining region 3 for antibody 39686
ATDWGSGTQWIRAFDV

SEQ ID NO: 79373 - protein, 9 aa, Homo sapiens
  light chain complementarity determining region 3 for antibody 39687
MHCTYWPGT

SEQ ID NO: 79374 - protein, 11 aa, Homo sapiens
  heavy chain complementarity determining region 3 for antibody 39687
ATGGLRVVFGP

SEQ ID NO: 79375 - protein, 9 aa, Homo sapiens
  light chain complementarity determining region 3 for antibody 39688
MHALQTPDT

SEQ ID NO: 79376 - protein, 21 aa, Homo sapiens
  heavy chain complementarity determining region 3 for antibody 39688
ARDAPVSRPYSSGWYSSAFDY

SEQ ID NO: 79377 - protein, 9 aa, Homo sapiens
  light chain complementarity determining region 3 for antibody 39689
MHALQAPRA

SEQ ID NO: 79378 - protein, 13 aa, Homo sapiens
  heavy chain complementarity determining region 3 for antibody 39689
ARPNNALGRALDI

SEQ ID NO: 79379 - protein, 9 aa, Homo sapiens
  light chain complementarity determining region 3 for antibody 39690
MHALQAPGG

SEQ ID NO: 79380 - protein, 13 aa, Homo sapiens
  heavy chain complementarity determining region 3 for antibody 39690
ARPNNALGRAFDI

SEQ ID NO: 79381 - protein, 9 aa, Homo sapiens
  light chain complementarity determining region 3 for antibody 39691
MHALQAPGA

SEQ ID NO: 79382 - protein, 13 aa, Homo sapiens
  heavy chain complementarity determining region 3 for antibody 39691
ARPNNALGRAFDI

SEQ ID NO: 79383 - protein, 9 aa, Homo sapiens
  light chain complementarity determining region 3 for antibody 39692
MHALKAPRG

SEQ ID NO: 79384 - protein, 13 aa, Homo sapiens
  heavy chain complementarity determining region 3 for antibody 39692
ARPNNALGRAFDI

SEQ ID NO: 79385 - protein, 9 aa, Homo sapiens
  light chain complementarity determining region 3 for antibody 39693
MHALKAPRA

SEQ ID NO: 79386 - protein, 13 aa, Homo sapiens
  heavy chain complementarity determining region 3 for antibody 39693
ARPNNQLGRAFDV

SEQ ID NO: 79387 - protein, 9 aa, Homo sapiens
  light chain complementarity determining region 3 for antibody 39694
MHALHAPRA

SEQ ID NO: 79388 - protein, 13 aa, Homo sapiens
  heavy chain complementarity determining region 3 for antibody 39694
ARPNNQLGRAFDV

SEQ ID NO: 79389 - protein, 9 aa, Homo sapiens
  light chain complementarity determining region 3 for antibody 39695
MHALEPPYI

SEQ ID NO: 79390 - protein, 10 aa, Homo sapiens
  heavy chain complementarity determining region 3 for antibody 39695
ARDRSGGNDY

SEQ ID NO: 79391 - protein, 9 aa, Homo sapiens
  light chain complementarity determining region 3 for antibody 39696
MHALEPPDI

SEQ ID NO: 79392 - protein, 10 aa, Homo sapiens
  heavy chain complementarity determining region 3 for antibody 39696
ARDLSGGNDY

SEQ ID NO: 79393 - protein, 9 aa, Homo sapiens
  light chain complementarity determining region 3 for antibody 39697
MHALDPPYI

SEQ ID NO: 79394 - protein, 10 aa, Homo sapiens
  heavy chain complementarity determining region 3 for antibody 39697
ARDLSGGNDY

SEQ ID NO: 79395 - protein, 9 aa, Homo sapiens
  light chain complementarity determining region 3 for antibody 39698
MGTLQTPPP

SEQ ID NO: 79396 - protein, 15 aa, Homo sapiens
  heavy chain complementarity determining region 3 for antibody 39698
TRDGKKDGHNDAFDF

SEQ ID NO: 79397 - protein, 9 aa, Homo sapiens
  light chain complementarity determining region 3 for antibody 39699
MGTLQTPPG

SEQ ID NO: 79398 - protein, 15 aa, Homo sapiens
  heavy chain complementarity determining region 3 for antibody 39699
TRDGKKDGHNDAFDS

SEQ ID NO: 79399 - protein, 9 aa, Homo sapiens
  light chain complementarity determining region 3 for antibody 39700
MGTLQTPPA

SEQ ID NO: 79400 - protein, 12 aa, Homo sapiens
  heavy chain complementarity determining region 3 for antibody 39700
ARDLGYTSGWRL

SEQ ID NO: 79401 - protein, 9 aa, Homo sapiens
  light chain complementarity determining region 3 for antibody 39701
MGTLQNPPP

SEQ ID NO: 79402 - protein, 10 aa, Homo sapiens
  heavy chain complementarity determining region 3 for antibody 39701
ASGGGHTYGY

SEQ ID NO: 79403 - protein, 9 aa, Homo sapiens
  light chain complementarity determining region 3 for antibody 39702
MGPLQTPPP

SEQ ID NO: 79404 - protein, 15 aa, Homo sapiens
  heavy chain complementarity determining region 3 for antibody 39702
TRDGKKDGHNDAFDI

SEQ ID NO: 79405 - protein, 9 aa, Homo sapiens
  light chain complementarity determining region 3 for antibody 39703
MEVIQSPWT

SEQ ID NO: 79406 - protein, 18 aa, Homo sapiens
  heavy chain complementarity determining region 3 for antibody 39703
VRGGRMYCIGEPCYSGSR

SEQ ID NO: 79407 - protein, 9 aa, Homo sapiens
  light chain complementarity determining region 3 for antibody 39704
MEHTHWPWT

SEQ ID NO: 79408 - protein, 12 aa, Homo sapiens
  heavy chain complementarity determining region 3 for antibody 39704
ATSPHRDSRSSY

SEQ ID NO: 79409 - protein, 10 aa, Homo sapiens
  light chain complementarity determining region 3 for antibody 39705
MEGISWSGGA

SEQ ID NO: 79410 - protein, 13 aa, Homo sapiens
  heavy chain complementarity determining region 3 for antibody 39705
ATLVIHATPYPDY

SEQ ID NO: 79411 - protein, 9 aa, Homo sapiens
  light chain complementarity determining region 3 for antibody 39706
MEALRASLT

SEQ ID NO: 79412 - protein, 19 aa, Homo sapiens
  heavy chain complementarity determining region 3 for antibody 39706
ANRKSLIQNLVGWGWAMGY

SEQ ID NO: 79413 - protein, 9 aa, Homo sapiens
  light chain complementarity determining region 3 for antibody 39707
MEALETPFT

SEQ ID NO: 79414 - protein, 15 aa, Homo sapiens
  heavy chain complementarity determining region 3 for antibody 39707
VRHYRITVAAVEGDS

SEQ ID NO: 79415 - protein, 9 aa, Homo sapiens
  light chain complementarity determining region 3 for antibody 39708
MASRQWPLS

SEQ ID NO: 79416 - protein, 8 aa, Homo sapiens
  heavy chain complementarity determining region 3 for antibody 39708
ARGRSMSE

SEQ ID NO: 79417 - protein, 9 aa, Homo sapiens
  light chain complementarity determining region 3 for antibody 39709
MASRHWPPS

SEQ ID NO: 79418 - protein, 8 aa, Homo sapiens
  heavy chain complementarity determining region 3 for antibody 39709
ARGRSMSD

SEQ ID NO: 79419 - protein, 9 aa, Homo sapiens
  light chain complementarity determining region 3 for antibody 39710
LRFDSLPLT

SEQ ID NO: 79420 - protein, 16 aa, Homo sapiens
  heavy chain complementarity determining region 3 for antibody 39710
GRSHHPQGDKVIRLDY

SEQ ID NO: 79421 - protein, 9 aa, Homo sapiens
  light chain complementarity determining region 3 for antibody 39711
LQYYTSLRT

SEQ ID NO: 79422 - protein, 12 aa, Homo sapiens
  heavy chain complementarity determining region 3 for antibody 39711
VKDCGLGGSRDS

SEQ ID NO: 79423 - protein, 9 aa, Homo sapiens
  light chain complementarity determining region 3 for antibody 39712
LQYYSYPYT

SEQ ID NO: 79424 - protein, 20 aa, Homo sapiens
  heavy chain complementarity determining region 3 for antibody 39712
AKDLREDYKGFSFYYYGMDV

SEQ ID NO: 79425 - protein, 9 aa, Homo sapiens
  light chain complementarity determining region 3 for antibody 39713
LQYYSTPFT

SEQ ID NO: 79426 - protein, 10 aa, Homo sapiens
  heavy chain complementarity determining region 3 for antibody 39713
GGGWGSHPEH

SEQ ID NO: 79427 - protein, 9 aa, Homo sapiens
  light chain complementarity determining region 3 for antibody 39714
LQYYATPWT

SEQ ID NO: 79428 - protein, 15 aa, Homo sapiens
  heavy chain complementarity determining region 3 for antibody 39714
VRQSKVDNSYNYPDF

SEQ ID NO: 79429 - protein, 9 aa, Homo sapiens
  light chain complementarity determining region 3 for antibody 39715
LQYYATPWT

SEQ ID NO: 79430 - protein, 15 aa, Homo sapiens
  heavy chain complementarity determining region 3 for antibody 39715
VRQSKVDNNYNSPDF

SEQ ID NO: 79431 - protein, 9 aa, Homo sapiens
  light chain complementarity determining region 3 for antibody 39716
LQYYATPGT

SEQ ID NO: 79432 - protein, 15 aa, Homo sapiens
  heavy chain complementarity determining region 3 for antibody 39716
VRQSKVDNNYNSPDF

SEQ ID NO: 79433 - protein, 9 aa, Homo sapiens
  light chain complementarity determining region 3 for antibody 39717
LQYSSYPYT

SEQ ID NO: 79434 - protein, 13 aa, Homo sapiens
  heavy chain complementarity determining region 3 for antibody 39717
SRQHKYSWNDFDY

SEQ ID NO: 79435 - protein, 9 aa, Homo sapiens
  light chain complementarity determining region 3 for antibody 39718
LQYNSFPYT

SEQ ID NO: 79436 - protein, 9 aa, Homo sapiens
  heavy chain complementarity determining region 3 for antibody 39718
GRGVQSFDS

SEQ ID NO: 79437 - protein, 11 aa, Homo sapiens
  light chain complementarity determining region 3 for antibody 39719
LQYNNWPPVYT

SEQ ID NO: 79438 - protein, 15 aa, Homo sapiens
  heavy chain complementarity determining region 3 for antibody 39719
ASAHLSSSFHRYFDF

SEQ ID NO: 79439 - protein, 10 aa, Homo sapiens
  light chain complementarity determining region 3 for antibody 39720
LQYNKWPPLT

SEQ ID NO: 79440 - protein, 13 aa, Homo sapiens
  heavy chain complementarity determining region 3 for antibody 39720
GKDMYRVSSIINY

SEQ ID NO: 79441 - protein, 10 aa, Homo sapiens
  light chain complementarity determining region 3 for antibody 39721
LQYNIWPPGP

SEQ ID NO: 79442 - protein, 12 aa, Homo sapiens
  heavy chain complementarity determining region 3 for antibody 39721
ARTHSNGGLYDY

SEQ ID NO: 79443 - protein, 9 aa, Homo sapiens
  light chain complementarity determining region 3 for antibody 39722
LQYNAYPLT

SEQ ID NO: 79444 - protein, 12 aa, Homo sapiens
  heavy chain complementarity determining region 3 for antibody 39722
ARDLSSGWLGDH

SEQ ID NO: 79445 - protein, 9 aa, Homo sapiens
  light chain complementarity determining region 3 for antibody 39723
LQYKSYPRP

SEQ ID NO: 79446 - protein, 6 aa, Homo sapiens
  heavy chain complementarity determining region 3 for antibody 39723
SRALDY

SEQ ID NO: 79447 - protein, 9 aa, Homo sapiens
  light chain complementarity determining region 3 for antibody 39724
LQYKSSPRT

SEQ ID NO: 79448 - protein, 6 aa, Homo sapiens
  heavy chain complementarity determining region 3 for antibody 39724
SRALDY

SEQ ID NO: 79449 - protein, 9 aa, Homo sapiens
  light chain complementarity determining region 3 for antibody 39725
LQYKSNPRT

SEQ ID NO: 79450 - protein, 6 aa, Homo sapiens
  heavy chain complementarity determining region 3 for antibody 39725
SRALDY

SEQ ID NO: 79451 - protein, 9 aa, Homo sapiens
  light chain complementarity determining region 3 for antibody 39726
LQYKGYPRT

SEQ ID NO: 79452 - protein, 6 aa, Homo sapiens
  heavy chain complementarity determining region 3 for antibody 39726
SRALDY

SEQ ID NO: 79453 - protein, 9 aa, Homo sapiens
  light chain complementarity determining region 3 for antibody 39727
LQYGTSSFT

SEQ ID NO: 79454 - protein, 21 aa, Homo sapiens
  heavy chain complementarity determining region 3 for antibody 39727
ARMSAGSYYDSSGSYLYYFDN

SEQ ID NO: 79455 - protein, 9 aa, Homo sapiens
  light chain complementarity determining region 3 for antibody 39728
LQYGTSPLN

SEQ ID NO: 79456 - protein, 13 aa, Homo sapiens
  heavy chain complementarity determining region 3 for antibody 39728
ASISVGTVAAGKG

SEQ ID NO: 79457 - protein, 9 aa, Homo sapiens
  light chain complementarity determining region 3 for antibody 39729
LQYGTIPRT

SEQ ID NO: 79458 - protein, 13 aa, Homo sapiens
  heavy chain complementarity determining region 3 for antibody 39729
AGGNFHRSGYAEY

SEQ ID NO: 79459 - protein, 9 aa, Homo sapiens
  light chain complementarity determining region 3 for antibody 39730
LQYGSSPRT

SEQ ID NO: 79460 - protein, 17 aa, Homo sapiens
  heavy chain complementarity determining region 3 for antibody 39730
ARDPHSTPWFGPEPLDH

SEQ ID NO: 79461 - protein, 9 aa, Homo sapiens
  light chain complementarity determining region 3 for antibody 39731
LQYGSSPRP

SEQ ID NO: 79462 - protein, 17 aa, Homo sapiens
  heavy chain complementarity determining region 3 for antibody 39731
ARDPYSTPWFGPEPLDH

SEQ ID NO: 79463 - protein, 8 aa, Homo sapiens
  light chain complementarity determining region 3 for antibody 39732
LQYGGSPS

SEQ ID NO: 79464 - protein, 16 aa, Homo sapiens
  heavy chain complementarity determining region 3 for antibody 39732
ATDWGSGTQWIRAFDV

SEQ ID NO: 79465 - protein, 9 aa, Homo sapiens
  light chain complementarity determining region 3 for antibody 39733
LQYGGSPLT

SEQ ID NO: 79466 - protein, 8 aa, Homo sapiens
  heavy chain complementarity determining region 3 for antibody 39733
VRIMDPGY

SEQ ID NO: 79467 - protein, 9 aa, Homo sapiens
  light chain complementarity determining region 3 for antibody 39734
LQYGGAPHS

SEQ ID NO: 79468 - protein, 18 aa, Homo sapiens
  heavy chain complementarity determining region 3 for antibody 39734
ARGTKLMLRGIASFGLDA

SEQ ID NO: 79469 - protein, 9 aa, Homo sapiens
  light chain complementarity determining region 3 for antibody 39735
LQYGFSQYS

SEQ ID NO: 79470 - protein, 18 aa, Homo sapiens
  heavy chain complementarity determining region 3 for antibody 39735
TGVHGLTMLRGATKPFDF

SEQ ID NO: 79471 - protein, 9 aa, Homo sapiens
  light chain complementarity determining region 3 for antibody 39736
LQYGFAQYS

SEQ ID NO: 79472 - protein, 18 aa, Homo sapiens
  heavy chain complementarity determining region 3 for antibody 39736
TGVHGLTMLRGATNPFDF

SEQ ID NO: 79473 - protein, 9 aa, Homo sapiens
  light chain complementarity determining region 3 for antibody 39737
LQYGFAQYR

SEQ ID NO: 79474 - protein, 18 aa, Homo sapiens
  heavy chain complementarity determining region 3 for antibody 39737
TGVHGLTMLRGATKPFDF

SEQ ID NO: 79475 - protein, 9 aa, Homo sapiens
  light chain complementarity determining region 3 for antibody 39738
LQYGFAPYS

SEQ ID NO: 79476 - protein, 18 aa, Homo sapiens
  heavy chain complementarity determining region 3 for antibody 39738
TGVHGLTMLRGATKPFDF

SEQ ID NO: 79477 - protein, 9 aa, Homo sapiens
  light chain complementarity determining region 3 for antibody 39739
LQYFATPWT

SEQ ID NO: 79478 - protein, 15 aa, Homo sapiens
  heavy chain complementarity determining region 3 for antibody 39739
VRQSKVDNNYNYPDF

SEQ ID NO: 79479 - protein, 9 aa, Homo sapiens
  light chain complementarity determining region 3 for antibody 39740
LQYAGSPGT

SEQ ID NO: 79480 - protein, 8 aa, Homo sapiens
  heavy chain complementarity determining region 3 for antibody 39740
ARGLSLDS

SEQ ID NO: 79481 - protein, 9 aa, Homo sapiens
  light chain complementarity determining region 3 for antibody 39741
LQVVSSPRT

SEQ ID NO: 79482 - protein, 8 aa, Homo sapiens
  heavy chain complementarity determining region 3 for antibody 39741
ARNSGWYD

SEQ ID NO: 79483 - protein, 9 aa, Homo sapiens
  light chain complementarity determining region 3 for antibody 39742
LQVVSFPRT

SEQ ID NO: 79484 - protein, 8 aa, Homo sapiens
  heavy chain complementarity determining region 3 for antibody 39742
ARNSGWYA

SEQ ID NO: 79485 - protein, 9 aa, Homo sapiens
  light chain complementarity determining region 3 for antibody 39743
LQVVSFPRT

SEQ ID NO: 79486 - protein, 8 aa, Homo sapiens
  heavy chain complementarity determining region 3 for antibody 39743
ARNSGWDD

SEQ ID NO: 79487 - protein, 9 aa, Homo sapiens
  light chain complementarity determining region 3 for antibody 39744
LQVVSFPRL

SEQ ID NO: 79488 - protein, 8 aa, Homo sapiens
  heavy chain complementarity determining region 3 for antibody 39744
ARNSGWYD

SEQ ID NO: 79489 - protein, 9 aa, Homo sapiens
  light chain complementarity determining region 3 for antibody 39745
LQVVSFLRT

SEQ ID NO: 79490 - protein, 8 aa, Homo sapiens
  heavy chain complementarity determining region 3 for antibody 39745
ARNSGWYD

SEQ ID NO: 79491 - protein, 9 aa, Homo sapiens
  light chain complementarity determining region 3 for antibody 39746
LQVNSFPLI

SEQ ID NO: 79492 - protein, 19 aa, Homo sapiens
  heavy chain complementarity determining region 3 for antibody 39746
ARGQYNDGSKNYIGGRIDY

SEQ ID NO: 79493 - protein, 9 aa, Homo sapiens
  light chain complementarity determining region 3 for antibody 39747
LQVLQTPLT

SEQ ID NO: 79494 - protein, 12 aa, Homo sapiens
  heavy chain complementarity determining region 3 for antibody 39747
AKDSAKKWELLD

SEQ ID NO: 79495 - protein, 9 aa, Homo sapiens
  light chain complementarity determining region 3 for antibody 39748
LQTYNIPLT

SEQ ID NO: 79496 - protein, 14 aa, Homo sapiens
  heavy chain complementarity determining region 3 for antibody 39748
VKFPRGDSSFLQDF

SEQ ID NO: 79497 - protein, 9 aa, Homo sapiens
  light chain complementarity determining region 3 for antibody 39749
LQTYNIPIT

SEQ ID NO: 79498 - protein, 14 aa, Homo sapiens
  heavy chain complementarity determining region 3 for antibody 39749
VKVPRGDSSFLQDF

SEQ ID NO: 79499 - protein, 9 aa, Homo sapiens
  light chain complementarity determining region 3 for antibody 39750
LQTYNIPIT

SEQ ID NO: 79500 - protein, 14 aa, Homo sapiens
  heavy chain complementarity determining region 3 for antibody 39750
VKCPRGDSSFLQDF

SEQ ID NO: 79501 - protein, 9 aa, Homo sapiens
  light chain complementarity determining region 3 for antibody 39751
LQTLHTPWT

SEQ ID NO: 79502 - protein, 16 aa, Homo sapiens
  heavy chain complementarity determining region 3 for antibody 39751
ARVQTAAVIHVYGLDV

SEQ ID NO: 79503 - protein, 10 aa, Homo sapiens
  light chain complementarity determining region 3 for antibody 39752
LQTAHWPPPT

SEQ ID NO: 79504 - protein, 14 aa, Homo sapiens
  heavy chain complementarity determining region 3 for antibody 39752
ATEVLKWVAELSDF

SEQ ID NO: 79505 - protein, 10 aa, Homo sapiens
  light chain complementarity determining region 3 for antibody 39753
LQSYSIPPWT

SEQ ID NO: 79506 - protein, 14 aa, Homo sapiens
  heavy chain complementarity determining region 3 for antibody 39753
VKDDLGTTVDYFDY

SEQ ID NO: 79507 - protein, 9 aa, Homo sapiens
  light chain complementarity determining region 3 for antibody 39754
LQSYSCSYT

SEQ ID NO: 79508 - protein, 11 aa, Homo sapiens
  heavy chain complementarity determining region 3 for antibody 39754
ATMAPWRQTPP

SEQ ID NO: 79509 - protein, 9 aa, Homo sapiens
  light chain complementarity determining region 3 for antibody 39755
LQSYSCPYP

SEQ ID NO: 79510 - protein, 11 aa, Homo sapiens
  heavy chain complementarity determining region 3 for antibody 39755
ATMAPWRQTPP

SEQ ID NO: 79511 - protein, 9 aa, Homo sapiens
  light chain complementarity determining region 3 for antibody 39756
LQSTHWPGT

SEQ ID NO: 79512 - protein, 10 aa, Homo sapiens
  heavy chain complementarity determining region 3 for antibody 39756
VQDHRYGSGN

SEQ ID NO: 79513 - protein, 9 aa, Homo sapiens
  light chain complementarity determining region 3 for antibody 39757
LQSNSFPRT

SEQ ID NO: 79514 - protein, 8 aa, Homo sapiens
  heavy chain complementarity determining region 3 for antibody 39757
ARNSGWYD

SEQ ID NO: 79515 - protein, 9 aa, Homo sapiens
  light chain complementarity determining region 3 for antibody 39758
LQSKSYPRT

SEQ ID NO: 79516 - protein, 6 aa, Homo sapiens
  heavy chain complementarity determining region 3 for antibody 39758
SRALDY

SEQ ID NO: 79517 - protein, 9 aa, Homo sapiens
  light chain complementarity determining region 3 for antibody 39759
LQSIHWPWR

SEQ ID NO: 79518 - protein, 11 aa, Homo sapiens
  heavy chain complementarity determining region 3 for antibody 39759
ARFERRKPGPH

SEQ ID NO: 79519 - protein, 9 aa, Homo sapiens
  light chain complementarity determining region 3 for antibody 39760
LQSIHWPGT

SEQ ID NO: 79520 - protein, 11 aa, Homo sapiens
  heavy chain complementarity determining region 3 for antibody 39760
ARFGRRKPGPD

SEQ ID NO: 79521 - protein, 10 aa, Homo sapiens
  light chain complementarity determining region 3 for antibody 39761
LQRYNWPPYT

SEQ ID NO: 79522 - protein, 11 aa, Homo sapiens
  heavy chain complementarity determining region 3 for antibody 39761
ARGVGSYVFES

SEQ ID NO: 79523 - protein, 9 aa, Homo sapiens
  light chain complementarity determining region 3 for antibody 39762
LQRSISPRT

SEQ ID NO: 79524 - protein, 11 aa, Homo sapiens
  heavy chain complementarity determining region 3 for antibody 39762
TTGLGSGGINW

SEQ ID NO: 79525 - protein, 9 aa, Homo sapiens
  light chain complementarity determining region 3 for antibody 39763
LQRIHWPGT

SEQ ID NO: 79526 - protein, 11 aa, Homo sapiens
  heavy chain complementarity determining region 3 for antibody 39763
ARFERRKPGPD

SEQ ID NO: 79527 - protein, 9 aa, Homo sapiens
  light chain complementarity determining region 3 for antibody 39764
LQRIHWPGR

SEQ ID NO: 79528 - protein, 11 aa, Homo sapiens
  heavy chain complementarity determining region 3 for antibody 39764
ARFERRKPGPH

SEQ ID NO: 79529 - protein, 9 aa, Homo sapiens
  light chain complementarity determining region 3 for antibody 39765
LQRIHGPWT

SEQ ID NO: 79530 - protein, 11 aa, Homo sapiens
  heavy chain complementarity determining region 3 for antibody 39765
ARFERRKPGPD

SEQ ID NO: 79531 - protein, 9 aa, Homo sapiens
  light chain complementarity determining region 3 for antibody 39766
LQPYSCPYT

SEQ ID NO: 79532 - protein, 11 aa, Homo sapiens
  heavy chain complementarity determining region 3 for antibody 39766
ATMAPWRQTPP

SEQ ID NO: 79533 - protein, 9 aa, Homo sapiens
  light chain complementarity determining region 3 for antibody 39767
LQPNSYPLT

SEQ ID NO: 79534 - protein, 17 aa, Homo sapiens
  heavy chain complementarity determining region 3 for antibody 39767
ARGTRRGYCSAGSCYGY

SEQ ID NO: 79535 - protein, 9 aa, Homo sapiens
  light chain complementarity determining region 3 for antibody 39768
LQNYNIPIT

SEQ ID NO: 79536 - protein, 14 aa, Homo sapiens
  heavy chain complementarity determining region 3 for antibody 39768
VKFPRGDSSFLQDF

SEQ ID NO: 79537 - protein, 9 aa, Homo sapiens
  light chain complementarity determining region 3 for antibody 39769
LQNYNFPWT

SEQ ID NO: 79538 - protein, 12 aa, Homo sapiens
  heavy chain complementarity determining region 3 for antibody 39769
ARHLRVPERLDS

SEQ ID NO: 79539 - protein, 9 aa, Homo sapiens
  light chain complementarity determining region 3 for antibody 39770
LQNEYWPRT

SEQ ID NO: 79540 - protein, 11 aa, Homo sapiens
  heavy chain complementarity determining region 3 for antibody 39770
GRVGGAGYFNH

SEQ ID NO: 79541 - protein, 9 aa, Homo sapiens
  light chain complementarity determining region 3 for antibody 39771
LQNEYWPRN

SEQ ID NO: 79542 - protein, 11 aa, Homo sapiens
  heavy chain complementarity determining region 3 for antibody 39771
VRVGGAGYFDH

SEQ ID NO: 79543 - protein, 9 aa, Homo sapiens
  light chain complementarity determining region 3 for antibody 39772
LQNEYLPRT

SEQ ID NO: 79544 - protein, 11 aa, Homo sapiens
  heavy chain complementarity determining region 3 for antibody 39772
VRVGGAGYFDH

SEQ ID NO: 79545 - protein, 9 aa, Homo sapiens
  light chain complementarity determining region 3 for antibody 39773
LQNDNWPRT

SEQ ID NO: 79546 - protein, 11 aa, Homo sapiens
  heavy chain complementarity determining region 3 for antibody 39773
VRVGGAGYFDH

SEQ ID NO: 79547 - protein, 9 aa, Homo sapiens
  light chain complementarity determining region 3 for antibody 39774
LQLNSYPLT

SEQ ID NO: 79548 - protein, 13 aa, Homo sapiens
  heavy chain complementarity determining region 3 for antibody 39774
ARHMVRGGMVVDD

SEQ ID NO: 79549 - protein, 9 aa, Homo sapiens
  light chain complementarity determining region 3 for antibody 39775
LQLNSYPIT

SEQ ID NO: 79550 - protein, 20 aa, Homo sapiens
  heavy chain complementarity determining region 3 for antibody 39775
ASRGVGKGEDYFDSSGYADY

SEQ ID NO: 79551 - protein, 9 aa, Homo sapiens
  light chain complementarity determining region 3 for antibody 39776
LQLNSYPFT

SEQ ID NO: 79552 - protein, 20 aa, Homo sapiens
  heavy chain complementarity determining region 3 for antibody 39776
ARRGVGKGEDYFDSSGYADY

SEQ ID NO: 79553 - protein, 9 aa, Homo sapiens
  light chain complementarity determining region 3 for antibody 39777
LQLHSFPLT

SEQ ID NO: 79554 - protein, 15 aa, Homo sapiens
  heavy chain complementarity determining region 3 for antibody 39777
ARAGAYSGGRYYFDY

SEQ ID NO: 79555 - protein, 9 aa, Homo sapiens
  light chain complementarity determining region 3 for antibody 39778
LQIESVPLT

SEQ ID NO: 79556 - protein, 18 aa, Homo sapiens
  heavy chain complementarity determining region 3 for antibody 39778
VRGGRDSQGPLGYYGLGV

SEQ ID NO: 79557 - protein, 9 aa, Homo sapiens
  light chain complementarity determining region 3 for antibody 39779
LQHYTYPIT

SEQ ID NO: 79558 - protein, 20 aa, Homo sapiens
  heavy chain complementarity determining region 3 for antibody 39779
ARGAHVVVVTSFRGSQGINA

SEQ ID NO: 79559 - protein, 9 aa, Homo sapiens
  light chain complementarity determining region 3 for antibody 39780
LQHYTYPIT

SEQ ID NO: 79560 - protein, 20 aa, Homo sapiens
  heavy chain complementarity determining region 3 for antibody 39780
ARGAHVVVVTSFRGSQAINS

SEQ ID NO: 79561 - protein, 9 aa, Homo sapiens
  light chain complementarity determining region 3 for antibody 39781
LQHYTYPIT

SEQ ID NO: 79562 - protein, 20 aa, Homo sapiens
  heavy chain complementarity determining region 3 for antibody 39781
ARGAHVVVVTSFRGSHGINS

SEQ ID NO: 79563 - protein, 9 aa, Homo sapiens
  light chain complementarity determining region 3 for antibody 39782
LQHYNYPIT

SEQ ID NO: 79564 - protein, 20 aa, Homo sapiens
  heavy chain complementarity determining region 3 for antibody 39782
ARGAHVVVVTSFRGSQGINS

SEQ ID NO: 79565 - protein, 9 aa, Homo sapiens
  light chain complementarity determining region 3 for antibody 39783
LQHYNSPWT

SEQ ID NO: 79566 - protein, 12 aa, Homo sapiens
  heavy chain complementarity determining region 3 for antibody 39783
ARHLRVPERLDS

SEQ ID NO: 79567 - protein, 9 aa, Homo sapiens
  light chain complementarity determining region 3 for antibody 39784
LQHYNFPWT

SEQ ID NO: 79568 - protein, 12 aa, Homo sapiens
  heavy chain complementarity determining region 3 for antibody 39784
ARPLRVPERLDS

SEQ ID NO: 79569 - protein, 9 aa, Homo sapiens
  light chain complementarity determining region 3 for antibody 39785
LQHYNFPWT

SEQ ID NO: 79570 - protein, 12 aa, Homo sapiens
  heavy chain complementarity determining region 3 for antibody 39785
ARHRRVPERLDS

SEQ ID NO: 79571 - protein, 9 aa, Homo sapiens
  light chain complementarity determining region 3 for antibody 39786
LQHYNFPWT

SEQ ID NO: 79572 - protein, 12 aa, Homo sapiens
  heavy chain complementarity determining region 3 for antibody 39786
AGHLRVPERLDS

SEQ ID NO: 79573 - protein, 9 aa, Homo sapiens
  light chain complementarity determining region 3 for antibody 39787
LQHYNFPWK

SEQ ID NO: 79574 - protein, 12 aa, Homo sapiens
  heavy chain complementarity determining region 3 for antibody 39787
ARHLRVPERLDS

SEQ ID NO: 79575 - protein, 9 aa, Homo sapiens
  light chain complementarity determining region 3 for antibody 39788
LQHYNFPWA

SEQ ID NO: 79576 - protein, 12 aa, Homo sapiens
  heavy chain complementarity determining region 3 for antibody 39788
ARHLRVPERLDS

SEQ ID NO: 79577 - protein, 9 aa, Homo sapiens
  light chain complementarity determining region 3 for antibody 39789
LQHYNFPLT

SEQ ID NO: 79578 - protein, 12 aa, Homo sapiens
  heavy chain complementarity determining region 3 for antibody 39789
ARHLRVPERLDS

SEQ ID NO: 79579 - protein, 9 aa, Homo sapiens
  light chain complementarity determining region 3 for antibody 39790
LQHVNFPRT

SEQ ID NO: 79580 - protein, 17 aa, Homo sapiens
  heavy chain complementarity determining region 3 for antibody 39790
ARGSAARHLVHYNWFDP

SEQ ID NO: 79581 - protein, 9 aa, Homo sapiens
  light chain complementarity determining region 3 for antibody 39791
LQHVNFPLT

SEQ ID NO: 79582 - protein, 28 aa, Homo sapiens
  heavy chain complementarity determining region 3 for antibody 39791
ARDRSKSDYGSGSYLPGKVLYYYYGMDV

SEQ ID NO: 79583 - protein, 9 aa, Homo sapiens
  light chain complementarity determining region 3 for antibody 39792
LQHTGYSWT

SEQ ID NO: 79584 - protein, 13 aa, Homo sapiens
  heavy chain complementarity determining region 3 for antibody 39792
ARSSVVVTAILDY

SEQ ID NO: 79585 - protein, 9 aa, Homo sapiens
  light chain complementarity determining region 3 for antibody 39793
LQHSTYPIT

SEQ ID NO: 79586 - protein, 20 aa, Homo sapiens
  heavy chain complementarity determining region 3 for antibody 39793
ARGAHVVVVTSFRGSQGINS

SEQ ID NO: 79587 - protein, 9 aa, Homo sapiens
  light chain complementarity determining region 3 for antibody 39794
LQHSTSPRT

SEQ ID NO: 79588 - protein, 11 aa, Homo sapiens
  heavy chain complementarity determining region 3 for antibody 39794
TTGLGSGGISW

SEQ ID NO: 79589 - protein, 9 aa, Homo sapiens
  light chain complementarity determining region 3 for antibody 39795
LQHSTSPRT

SEQ ID NO: 79590 - protein, 11 aa, Homo sapiens
  heavy chain complementarity determining region 3 for antibody 39795
ATGLGSGGINW

SEQ ID NO: 79591 - protein, 9 aa, Homo sapiens
  light chain complementarity determining region 3 for antibody 39796
LQHSTSPRP

SEQ ID NO: 79592 - protein, 11 aa, Homo sapiens
  heavy chain complementarity determining region 3 for antibody 39796
TTGLGSGGINW

SEQ ID NO: 79593 - protein, 9 aa, Homo sapiens
  light chain complementarity determining region 3 for antibody 39797
LQHSSYLLT

SEQ ID NO: 79594 - protein, 14 aa, Homo sapiens
  heavy chain complementarity determining region 3 for antibody 39797
ARVDDYYGSGSFDI

SEQ ID NO: 79595 - protein, 9 aa, Homo sapiens
  light chain complementarity determining region 3 for antibody 39798
LQHSSSPRT

SEQ ID NO: 79596 - protein, 11 aa, Homo sapiens
  heavy chain complementarity determining region 3 for antibody 39798
TTGLGSGGINW

SEQ ID NO: 79597 - protein, 9 aa, Homo sapiens
  light chain complementarity determining region 3 for antibody 39799
LQHSISTRT

SEQ ID NO: 79598 - protein, 11 aa, Homo sapiens
  heavy chain complementarity determining region 3 for antibody 39799
TTGLGSGGINW

SEQ ID NO: 79599 - protein, 9 aa, Homo sapiens
  light chain complementarity determining region 3 for antibody 39800
LQHSISPRT

SEQ ID NO: 79600 - protein, 11 aa, Homo sapiens
  heavy chain complementarity determining region 3 for antibody 39800
TTGLGSGGSNC

SEQ ID NO: 79601 - protein, 9 aa, Homo sapiens
  light chain complementarity determining region 3 for antibody 39801
LQHSISPRT

SEQ ID NO: 79602 - protein, 11 aa, Homo sapiens
  heavy chain complementarity determining region 3 for antibody 39801
TTGLGSGGING

SEQ ID NO: 79603 - protein, 9 aa, Homo sapiens
  light chain complementarity determining region 3 for antibody 39802
LQHSISPRT

SEQ ID NO: 79604 - protein, 11 aa, Homo sapiens
  heavy chain complementarity determining region 3 for antibody 39802
PAGLGSGGINW

SEQ ID NO: 79605 - protein, 9 aa, Homo sapiens
  light chain complementarity determining region 3 for antibody 39803
LQHSISPRP

SEQ ID NO: 79606 - protein, 11 aa, Homo sapiens
  heavy chain complementarity determining region 3 for antibody 39803
TTGLGSGGINL

SEQ ID NO: 79607 - protein, 9 aa, Homo sapiens
  light chain complementarity determining region 3 for antibody 39804
LQHSISPRP

SEQ ID NO: 79608 - protein, 11 aa, Homo sapiens
  heavy chain complementarity determining region 3 for antibody 39804
TTGLGSGGINC

SEQ ID NO: 79609 - protein, 9 aa, Homo sapiens
  light chain complementarity determining region 3 for antibody 39805
LQHSISPRM

SEQ ID NO: 79610 - protein, 11 aa, Homo sapiens
  heavy chain complementarity determining region 3 for antibody 39805
TTGLGSGGINW

SEQ ID NO: 79611 - protein, 9 aa, Homo sapiens
  light chain complementarity determining region 3 for antibody 39806
LQHSISPRK

SEQ ID NO: 79612 - protein, 11 aa, Homo sapiens
  heavy chain complementarity determining region 3 for antibody 39806
TTGLGSGGINW

SEQ ID NO: 79613 - protein, 9 aa, Homo sapiens
  light chain complementarity determining region 3 for antibody 39807
LQHSISHRT

SEQ ID NO: 79614 - protein, 11 aa, Homo sapiens
  heavy chain complementarity determining region 3 for antibody 39807
TTGLGSGGINW

SEQ ID NO: 79615 - protein, 9 aa, Homo sapiens
  light chain complementarity determining region 3 for antibody 39808
LQHNTYPWT

SEQ ID NO: 79616 - protein, 18 aa, Homo sapiens
  heavy chain complementarity determining region 3 for antibody 39808
ARDGVDYAPRDYYYGLDV

SEQ ID NO: 79617 - protein, 9 aa, Homo sapiens
  light chain complementarity determining region 3 for antibody 39809
LQHNTYPLT

SEQ ID NO: 79618 - protein, 13 aa, Homo sapiens
  heavy chain complementarity determining region 3 for antibody 39809
ARRGTQLWCNFDQ

SEQ ID NO: 79619 - protein, 9 aa, Homo sapiens
  light chain complementarity determining region 3 for antibody 39810
LQHNSYTLT

SEQ ID NO: 79620 - protein, 17 aa, Homo sapiens
  heavy chain complementarity determining region 3 for antibody 39810
ARGTRRGYCSAGSCYGY

SEQ ID NO: 79621 - protein, 9 aa, Homo sapiens
  light chain complementarity determining region 3 for antibody 39811
LQHNSYPWT

SEQ ID NO: 79622 - protein, 16 aa, Homo sapiens
  heavy chain complementarity determining region 3 for antibody 39811
ARVGISVMAAGGSLDN

SEQ ID NO: 79623 - protein, 9 aa, Homo sapiens
  light chain complementarity determining region 3 for antibody 39812
LQHNSYPWT

SEQ ID NO: 79624 - protein, 16 aa, Homo sapiens
  heavy chain complementarity determining region 3 for antibody 39812
ARGGRVGASDYYGMDV

SEQ ID NO: 79625 - protein, 9 aa, Homo sapiens
  light chain complementarity determining region 3 for antibody 39813
LQHNSYPWT

SEQ ID NO: 79626 - protein, 13 aa, Homo sapiens
  heavy chain complementarity determining region 3 for antibody 39813
ARGAGDYINPFDD

SEQ ID NO: 79627 - protein, 9 aa, Homo sapiens
  light chain complementarity determining region 3 for antibody 39814
LQHNSYPWT

SEQ ID NO: 79628 - protein, 25 aa, Homo sapiens
  heavy chain complementarity determining region 3 for antibody 39814
AGGQVRRPRRRDYDFWSVTSVAMDV

SEQ ID NO: 79629 - protein, 9 aa, Homo sapiens
  light chain complementarity determining region 3 for antibody 39815
LQHNSYPWP

SEQ ID NO: 79630 - protein, 25 aa, Homo sapiens
  heavy chain complementarity determining region 3 for antibody 39815
AGGQVRRPRLRDYDFWSVTSVAMDV

SEQ ID NO: 79631 - protein, 9 aa, Homo sapiens
  light chain complementarity determining region 3 for antibody 39816
LQHNSYPSS

SEQ ID NO: 79632 - protein, 13 aa, Homo sapiens
  heavy chain complementarity determining region 3 for antibody 39816
AREIYSSSFSFDY

SEQ ID NO: 79633 - protein, 9 aa, Homo sapiens
  light chain complementarity determining region 3 for antibody 39817
LQHNSYPRT

SEQ ID NO: 79634 - protein, 17 aa, Homo sapiens
  heavy chain complementarity determining region 3 for antibody 39817
ARGTRRGYCSAGSCYGY

SEQ ID NO: 79635 - protein, 9 aa, Homo sapiens
  light chain complementarity determining region 3 for antibody 39818
LQHNSYPRT

SEQ ID NO: 79636 - protein, 11 aa, Homo sapiens
  heavy chain complementarity determining region 3 for antibody 39818
AMLGRGHDIDF

SEQ ID NO: 79637 - protein, 9 aa, Homo sapiens
  light chain complementarity determining region 3 for antibody 39819
LQHNSYPRS

SEQ ID NO: 79638 - protein, 13 aa, Homo sapiens
  heavy chain complementarity determining region 3 for antibody 39819
AREIHSTSCSFDY

SEQ ID NO: 79639 - protein, 9 aa, Homo sapiens
  light chain complementarity determining region 3 for antibody 39820
LQHNSYPRP

SEQ ID NO: 79640 - protein, 13 aa, Homo sapiens
  heavy chain complementarity determining region 3 for antibody 39820
AREIHSTSFSFDY

SEQ ID NO: 79641 - protein, 9 aa, Homo sapiens
  light chain complementarity determining region 3 for antibody 39821
LQHNSYPPP

SEQ ID NO: 79642 - protein, 16 aa, Homo sapiens
  heavy chain complementarity determining region 3 for antibody 39821
SREKFRGQQPRDVFDI

SEQ ID NO: 79643 - protein, 9 aa, Homo sapiens
  light chain complementarity determining region 3 for antibody 39822
LQHNSYPLT

SEQ ID NO: 79644 - protein, 13 aa, Homo sapiens
  heavy chain complementarity determining region 3 for antibody 39822
VRHGVVSPMVVDD

SEQ ID NO: 79645 - protein, 9 aa, Homo sapiens
  light chain complementarity determining region 3 for antibody 39823
LQHNSYPLT

SEQ ID NO: 79646 - protein, 15 aa, Homo sapiens
  heavy chain complementarity determining region 3 for antibody 39823
ARRNQEVRDSGAFDV

SEQ ID NO: 79647 - protein, 9 aa, Homo sapiens
  light chain complementarity determining region 3 for antibody 39824
LQHNSYPLT

SEQ ID NO: 79648 - protein, 17 aa, Homo sapiens
  heavy chain complementarity determining region 3 for antibody 39824
ARGTRRGYCSVGSCYGY

SEQ ID NO: 79649 - protein, 9 aa, Homo sapiens
  light chain complementarity determining region 3 for antibody 39825
LQHNSYPLT

SEQ ID NO: 79650 - protein, 17 aa, Homo sapiens
  heavy chain complementarity determining region 3 for antibody 39825
ARGTRRGYCSAGSCYGS

SEQ ID NO: 79651 - protein, 9 aa, Homo sapiens
  light chain complementarity determining region 3 for antibody 39826
LQHNSYPLT

SEQ ID NO: 79652 - protein, 17 aa, Homo sapiens
  heavy chain complementarity determining region 3 for antibody 39826
ARGTRRGYCSAGSCCGY

SEQ ID NO: 79653 - protein, 9 aa, Homo sapiens
  light chain complementarity determining region 3 for antibody 39827
LQHNSYPLT

SEQ ID NO: 79654 - protein, 17 aa, Homo sapiens
  heavy chain complementarity determining region 3 for antibody 39827
ARGTRRGYCRAGSCYGY

SEQ ID NO: 79655 - protein, 9 aa, Homo sapiens
  light chain complementarity determining region 3 for antibody 39828
LQHNSYPIT

SEQ ID NO: 79656 - protein, 17 aa, Homo sapiens
  heavy chain complementarity determining region 3 for antibody 39828
ARGTRRGYCSAGSCYGY

SEQ ID NO: 79657 - protein, 9 aa, Homo sapiens
  light chain complementarity determining region 3 for antibody 39829
LQHNSYLFT

SEQ ID NO: 79658 - protein, 14 aa, Homo sapiens
  heavy chain complementarity determining region 3 for antibody 39829
ARVDDYYGSGSFDI

SEQ ID NO: 79659 - protein, 9 aa, Homo sapiens
  light chain complementarity determining region 3 for antibody 39830
LQHNSSPRS

SEQ ID NO: 79660 - protein, 13 aa, Homo sapiens
  heavy chain complementarity determining region 3 for antibody 39830
AREIYSSSFSFDY

SEQ ID NO: 79661 - protein, 9 aa, Homo sapiens
  light chain complementarity determining region 3 for antibody 39831
LQHNSSPLT

SEQ ID NO: 79662 - protein, 17 aa, Homo sapiens
  heavy chain complementarity determining region 3 for antibody 39831
ARGTRRGYCSAGSCYGY

SEQ ID NO: 79663 - protein, 9 aa, Homo sapiens
  light chain complementarity determining region 3 for antibody 39832
LQHNSFPWT

SEQ ID NO: 79664 - protein, 11 aa, Homo sapiens
  heavy chain complementarity determining region 3 for antibody 39832
VRDVPTARFDY

SEQ ID NO: 79665 - protein, 9 aa, Homo sapiens
  light chain complementarity determining region 3 for antibody 39833
LQHNIYPLT

SEQ ID NO: 79666 - protein, 17 aa, Homo sapiens
  heavy chain complementarity determining region 3 for antibody 39833
ARGTRRGYCSAGSCYGY

SEQ ID NO: 79667 - protein, 9 aa, Homo sapiens
  light chain complementarity determining region 3 for antibody 39834
LQHNISPRT

SEQ ID NO: 79668 - protein, 11 aa, Homo sapiens
  heavy chain complementarity determining region 3 for antibody 39834
TTGLGSGGINW

SEQ ID NO: 79669 - protein, 9 aa, Homo sapiens
  light chain complementarity determining region 3 for antibody 39835
LQHNGFSWS

SEQ ID NO: 79670 - protein, 21 aa, Homo sapiens
  heavy chain complementarity determining region 3 for antibody 39835
AASPGGSGYDVGGSFYSGMDV

SEQ ID NO: 79671 - protein, 9 aa, Homo sapiens
  light chain complementarity determining region 3 for antibody 39836
LQHKTYPRK

SEQ ID NO: 79672 - protein, 8 aa, Homo sapiens
  heavy chain complementarity determining region 3 for antibody 39836
TTGGRDGC

SEQ ID NO: 79673 - protein, 9 aa, Homo sapiens
  light chain complementarity determining region 3 for antibody 39837
LQHKSYPRT

SEQ ID NO: 79674 - protein, 6 aa, Homo sapiens
  heavy chain complementarity determining region 3 for antibody 39837
SRALDY

SEQ ID NO: 79675 - protein, 9 aa, Homo sapiens
  light chain complementarity determining region 3 for antibody 39838
LQHKSYPQT

SEQ ID NO: 79676 - protein, 15 aa, Homo sapiens
  heavy chain complementarity determining region 3 for antibody 39838
GRSKFYYDTISQFDY

SEQ ID NO: 79677 - protein, 9 aa, Homo sapiens
  light chain complementarity determining region 3 for antibody 39839
LQHHNFPWT

SEQ ID NO: 79678 - protein, 12 aa, Homo sapiens
  heavy chain complementarity determining region 3 for antibody 39839
ARHLRVPERLDS

SEQ ID NO: 79679 - protein, 9 aa, Homo sapiens
  light chain complementarity determining region 3 for antibody 39840
LQHHLFPWT

SEQ ID NO: 79680 - protein, 11 aa, Homo sapiens
  heavy chain complementarity determining region 3 for antibody 39840
VRDDPTAHLDY

SEQ ID NO: 79681 - protein, 9 aa, Homo sapiens
  light chain complementarity determining region 3 for antibody 39841
LQHHLFPWT

SEQ ID NO: 79682 - protein, 9 aa, Homo sapiens
  heavy chain complementarity determining region 3 for antibody 39841
AKGYYDSNY

SEQ ID NO: 79683 - protein, 9 aa, Homo sapiens
  light chain complementarity determining region 3 for antibody 39842
LQHFTFPLT

SEQ ID NO: 79684 - protein, 18 aa, Homo sapiens
  heavy chain complementarity determining region 3 for antibody 39842
ARVFEWCGEIRGDGCSDY

SEQ ID NO: 79685 - protein, 9 aa, Homo sapiens
  light chain complementarity determining region 3 for antibody 39843
LQHFTFPLP

SEQ ID NO: 79686 - protein, 18 aa, Homo sapiens
  heavy chain complementarity determining region 3 for antibody 39843
ARVFEWFGEIRGDGCSDY

SEQ ID NO: 79687 - protein, 9 aa, Homo sapiens
  light chain complementarity determining region 3 for antibody 39844
LQHFSCPWT

SEQ ID NO: 79688 - protein, 15 aa, Homo sapiens
  heavy chain complementarity determining region 3 for antibody 39844
AKDASRIATQRGPDD

SEQ ID NO: 79689 - protein, 9 aa, Homo sapiens
  light chain complementarity determining region 3 for antibody 39845
LQHDYWPRT

SEQ ID NO: 79690 - protein, 11 aa, Homo sapiens
  heavy chain complementarity determining region 3 for antibody 39845
VRVGGAGYFDH

SEQ ID NO: 79691 - protein, 9 aa, Homo sapiens
  light chain complementarity determining region 3 for antibody 39846
LQHDNFSRT

SEQ ID NO: 79692 - protein, 17 aa, Homo sapiens
  heavy chain complementarity determining region 3 for antibody 39846
ARGSAARHLVHYNWFDP

SEQ ID NO: 79693 - protein, 11 aa, Homo sapiens
  light chain complementarity determining region 3 for antibody 39847
LQHDNFPYMYT

SEQ ID NO: 79694 - protein, 21 aa, Homo sapiens
  heavy chain complementarity determining region 3 for antibody 39847
AGELSSSSAKNHYYYYYGMDV

SEQ ID NO: 79695 - protein, 11 aa, Homo sapiens
  light chain complementarity determining region 3 for antibody 39848
LQHDNFPVTWR

SEQ ID NO: 79696 - protein, 16 aa, Homo sapiens
  heavy chain complementarity determining region 3 for antibody 39848
ARVVWGASWYVGWFDP

SEQ ID NO: 79697 - protein, 9 aa, Homo sapiens
  light chain complementarity determining region 3 for antibody 39849
LQHDNFPRT

SEQ ID NO: 79698 - protein, 17 aa, Homo sapiens
  heavy chain complementarity determining region 3 for antibody 39849
ARGSAARHLVQYNWFDP

SEQ ID NO: 79699 - protein, 9 aa, Homo sapiens
  light chain complementarity determining region 3 for antibody 39850
LQHDNFPLT

SEQ ID NO: 79700 - protein, 28 aa, Homo sapiens
  heavy chain complementarity determining region 3 for antibody 39850
ARDRSKSDYGSGSYLPGRVLYYYYGMDV

SEQ ID NO: 79701 - protein, 9 aa, Homo sapiens
  light chain complementarity determining region 3 for antibody 39851
LQHDKFPRT

SEQ ID NO: 79702 - protein, 17 aa, Homo sapiens
  heavy chain complementarity determining region 3 for antibody 39851
ARGSAARHLVHYNWFDP

SEQ ID NO: 79703 - protein, 9 aa, Homo sapiens
  light chain complementarity determining region 3 for antibody 39852
LQHCISPRT

SEQ ID NO: 79704 - protein, 11 aa, Homo sapiens
  heavy chain complementarity determining region 3 for antibody 39852
TTGLGSGGINW

SEQ ID NO: 79705 - protein, 9 aa, Homo sapiens
  light chain complementarity determining region 3 for antibody 39853
LQGVSFPRT

SEQ ID NO: 79706 - protein, 8 aa, Homo sapiens
  heavy chain complementarity determining region 3 for antibody 39853
ARNSGWYD

SEQ ID NO: 79707 - protein, 9 aa, Homo sapiens
  light chain complementarity determining region 3 for antibody 39854
LQGTHRPPT

SEQ ID NO: 79708 - protein, 16 aa, Homo sapiens
  heavy chain complementarity determining region 3 for antibody 39854
ATDWGSGTQWIRAFDV

SEQ ID NO: 79709 - protein, 9 aa, Homo sapiens
  light chain complementarity determining region 3 for antibody 39855
LQGTHGPPT

SEQ ID NO: 79710 - protein, 12 aa, Homo sapiens
  heavy chain complementarity determining region 3 for antibody 39855
ATDYGPIVTLAH

SEQ ID NO: 79711 - protein, 9 aa, Homo sapiens
  light chain complementarity determining region 3 for antibody 39856
LQGTHGPLT

SEQ ID NO: 79712 - protein, 19 aa, Homo sapiens
  heavy chain complementarity determining region 3 for antibody 39856
VRDDRDHCSGGSCEGYFDD

SEQ ID NO: 79713 - protein, 9 aa, Homo sapiens
  light chain complementarity determining region 3 for antibody 39857
LQGTHGPLT

SEQ ID NO: 79714 - protein, 17 aa, Homo sapiens
  heavy chain complementarity determining region 3 for antibody 39857
ARDDRAAAAGGEYYFDL

SEQ ID NO: 79715 - protein, 9 aa, Homo sapiens
  light chain complementarity determining region 3 for antibody 39858
LQGNSFPHT

SEQ ID NO: 79716 - protein, 14 aa, Homo sapiens
  heavy chain complementarity determining region 3 for antibody 39858
ARYCSGSSCYSMDH

SEQ ID NO: 79717 - protein, 9 aa, Homo sapiens
  light chain complementarity determining region 3 for antibody 39859
LQGNSFPHT

SEQ ID NO: 79718 - protein, 14 aa, Homo sapiens
  heavy chain complementarity determining region 3 for antibody 39859
ARYCSGNSCYSMDH

SEQ ID NO: 79719 - protein, 9 aa, Homo sapiens
  light chain complementarity determining region 3 for antibody 39860
LQGNRVPHT

SEQ ID NO: 79720 - protein, 14 aa, Homo sapiens
  heavy chain complementarity determining region 3 for antibody 39860
ARDRFGDSRISFDY

SEQ ID NO: 79721 - protein, 9 aa, Homo sapiens
  light chain complementarity determining region 3 for antibody 39861
LQGNRFPPT

SEQ ID NO: 79722 - protein, 14 aa, Homo sapiens
  heavy chain complementarity determining region 3 for antibody 39861
ARYCSGNACYSMDH

SEQ ID NO: 79723 - protein, 9 aa, Homo sapiens
  light chain complementarity determining region 3 for antibody 39862
LQGNRFPNT

SEQ ID NO: 79724 - protein, 14 aa, Homo sapiens
  heavy chain complementarity determining region 3 for antibody 39862
ARDRFGDSRISFDY

SEQ ID NO: 79725 - protein, 9 aa, Homo sapiens
  light chain complementarity determining region 3 for antibody 39863
LQGNRFPLT

SEQ ID NO: 79726 - protein, 14 aa, Homo sapiens
  heavy chain complementarity determining region 3 for antibody 39863
ARYCSGSSCYSMDY

SEQ ID NO: 79727 - protein, 9 aa, Homo sapiens
  light chain complementarity determining region 3 for antibody 39864
LQGNRFPHT

SEQ ID NO: 79728 - protein, 14 aa, Homo sapiens
  heavy chain complementarity determining region 3 for antibody 39864
ARYCSGSSGYSMDY

SEQ ID NO: 79729 - protein, 9 aa, Homo sapiens
  light chain complementarity determining region 3 for antibody 39865
LQGNRFPHT

SEQ ID NO: 79730 - protein, 14 aa, Homo sapiens
  heavy chain complementarity determining region 3 for antibody 39865
ARCCSGSSCYSMDY

SEQ ID NO: 79731 - protein, 9 aa, Homo sapiens
  light chain complementarity determining region 3 for antibody 39866
LQGNRFPHP

SEQ ID NO: 79732 - protein, 14 aa, Homo sapiens
  heavy chain complementarity determining region 3 for antibody 39866
ARDRFGDSRISFDY

SEQ ID NO: 79733 - protein, 9 aa, Homo sapiens
  light chain complementarity determining region 3 for antibody 39867
LQGLQTPYT

SEQ ID NO: 79734 - protein, 10 aa, Homo sapiens
  heavy chain complementarity determining region 3 for antibody 39867
GSDLSGARDY

SEQ ID NO: 79735 - protein, 9 aa, Homo sapiens
  light chain complementarity determining region 3 for antibody 39868
LQGLQTPWT

SEQ ID NO: 79736 - protein, 15 aa, Homo sapiens
  heavy chain complementarity determining region 3 for antibody 39868
ASWVHEYGDFNAFDL

SEQ ID NO: 79737 - protein, 9 aa, Homo sapiens
  light chain complementarity determining region 3 for antibody 39869
LQGAHWPVT

SEQ ID NO: 79738 - protein, 19 aa, Homo sapiens
  heavy chain complementarity determining region 3 for antibody 39869
ARAPALLWLGDHMYNYFDP

SEQ ID NO: 79739 - protein, 9 aa, Homo sapiens
  light chain complementarity determining region 3 for antibody 39870
LQFQNVPLT

SEQ ID NO: 79740 - protein, 8 aa, Homo sapiens
  heavy chain complementarity determining region 3 for antibody 39870
ARGCPAGS

SEQ ID NO: 79741 - protein, 9 aa, Homo sapiens
  light chain complementarity determining region 3 for antibody 39871
LQFQNVPLP

SEQ ID NO: 79742 - protein, 8 aa, Homo sapiens
  heavy chain complementarity determining region 3 for antibody 39871
ARGFPAGS

SEQ ID NO: 79743 - protein, 10 aa, Homo sapiens
  light chain complementarity determining region 3 for antibody 39872
LQFNIWPPGT

SEQ ID NO: 79744 - protein, 12 aa, Homo sapiens
  heavy chain complementarity determining region 3 for antibody 39872
ARTHSNGGLYDY

SEQ ID NO: 79745 - protein, 9 aa, Homo sapiens
  light chain complementarity determining region 3 for antibody 39873
LQFKNVPLT

SEQ ID NO: 79746 - protein, 8 aa, Homo sapiens
  heavy chain complementarity determining region 3 for antibody 39873
ARGFPAGS

SEQ ID NO: 79747 - protein, 9 aa, Homo sapiens
  light chain complementarity determining region 3 for antibody 39874
LQFHNVPLT

SEQ ID NO: 79748 - protein, 8 aa, Homo sapiens
  heavy chain complementarity determining region 3 for antibody 39874
ARGFPAGS

SEQ ID NO: 79749 - protein, 9 aa, Homo sapiens
  light chain complementarity determining region 3 for antibody 39875
LQFESVPLT

SEQ ID NO: 79750 - protein, 18 aa, Homo sapiens
  heavy chain complementarity determining region 3 for antibody 39875
VRGGRDSQGSLGYYGLGV

SEQ ID NO: 79751 - protein, 9 aa, Homo sapiens
  light chain complementarity determining region 3 for antibody 39876
LQFDSLPLT

SEQ ID NO: 79752 - protein, 16 aa, Homo sapiens
  heavy chain complementarity determining region 3 for antibody 39876
AKGHRPQGEKVIRLDY

SEQ ID NO: 79753 - protein, 9 aa, Homo sapiens
  light chain complementarity determining region 3 for antibody 39877
LQFDSLPLT

SEQ ID NO: 79754 - protein, 16 aa, Homo sapiens
  heavy chain complementarity determining region 3 for antibody 39877
AKGHPPQGEKVIRLDY

SEQ ID NO: 79755 - protein, 9 aa, Homo sapiens
  light chain complementarity determining region 3 for antibody 39878
LQFDSLPFT

SEQ ID NO: 79756 - protein, 16 aa, Homo sapiens
  heavy chain complementarity determining region 3 for antibody 39878
GRSHHPQGDKVIRLDY

SEQ ID NO: 79757 - protein, 9 aa, Homo sapiens
  light chain complementarity determining region 3 for antibody 39879
LQDYTYPLP

SEQ ID NO: 79758 - protein, 19 aa, Homo sapiens
  heavy chain complementarity determining region 3 for antibody 39879
AKKIIYYSDSGTYYSPFDY

SEQ ID NO: 79759 - protein, 9 aa, Homo sapiens
  light chain complementarity determining region 3 for antibody 39880
LQDYSYPYT

SEQ ID NO: 79760 - protein, 20 aa, Homo sapiens
  heavy chain complementarity determining region 3 for antibody 39880
AKDLREDYKGVSFYYYGMDV

SEQ ID NO: 79761 - protein, 9 aa, Homo sapiens
  light chain complementarity determining region 3 for antibody 39881
LQDYNYPRT

SEQ ID NO: 79762 - protein, 11 aa, Homo sapiens
  heavy chain complementarity determining region 3 for antibody 39881
ARGVGSYVFES

SEQ ID NO: 79763 - protein, 9 aa, Homo sapiens
  light chain complementarity determining region 3 for antibody 39882
LQDYNYPPT

SEQ ID NO: 79764 - protein, 10 aa, Homo sapiens
  heavy chain complementarity determining region 3 for antibody 39882
ARRGLFFGES

SEQ ID NO: 79765 - protein, 9 aa, Homo sapiens
  light chain complementarity determining region 3 for antibody 39883
LQDYDYQLT

SEQ ID NO: 79766 - protein, 18 aa, Homo sapiens
  heavy chain complementarity determining region 3 for antibody 39883
ARSLYHSVSGAYYDAFDI

SEQ ID NO: 79767 - protein, 9 aa, Homo sapiens
  light chain complementarity determining region 3 for antibody 39884
LQDYDYPLT

SEQ ID NO: 79768 - protein, 18 aa, Homo sapiens
  heavy chain complementarity determining region 3 for antibody 39884
ARSLYHSVSGAYYDAFGI

SEQ ID NO: 79769 - protein, 9 aa, Homo sapiens
  light chain complementarity determining region 3 for antibody 39885
LQDYDYPLT

SEQ ID NO: 79770 - protein, 18 aa, Homo sapiens
  heavy chain complementarity determining region 3 for antibody 39885
ARSLYHSVSGACYDAFDI

SEQ ID NO: 79771 - protein, 9 aa, Homo sapiens
  light chain complementarity determining region 3 for antibody 39886
LQDYDYPLT

SEQ ID NO: 79772 - protein, 18 aa, Homo sapiens
  heavy chain complementarity determining region 3 for antibody 39886
ARSLYHSGSGAYYDAFDI

SEQ ID NO: 79773 - protein, 9 aa, Homo sapiens
  light chain complementarity determining region 3 for antibody 39887
LQDYDYPGT

SEQ ID NO: 79774 - protein, 14 aa, Homo sapiens
  heavy chain complementarity determining region 3 for antibody 39887
ARDRSVAETASFDY

SEQ ID NO: 79775 - protein, 9 aa, Homo sapiens
  light chain complementarity determining region 3 for antibody 39888
LQDYDSPLT

SEQ ID NO: 79776 - protein, 18 aa, Homo sapiens
  heavy chain complementarity determining region 3 for antibody 39888
ARSLYHSVSGAYYDAFDI

SEQ ID NO: 79777 - protein, 9 aa, Homo sapiens
  light chain complementarity determining region 3 for antibody 39889
LQDYAYPLT

SEQ ID NO: 79778 - protein, 18 aa, Homo sapiens
  heavy chain complementarity determining region 3 for antibody 39889
ARSLYHSVSGAYYDAFDI

SEQ ID NO: 79779 - protein, 9 aa, Homo sapiens
  light chain complementarity determining region 3 for antibody 39890
LQDLTYPFT

SEQ ID NO: 79780 - protein, 10 aa, Homo sapiens
  heavy chain complementarity determining region 3 for antibody 39890
AKERAGEPDY

SEQ ID NO: 79781 - protein, 9 aa, Homo sapiens
  light chain complementarity determining region 3 for antibody 39891
LQDGGAPNS

SEQ ID NO: 79782 - protein, 18 aa, Homo sapiens
  heavy chain complementarity determining region 3 for antibody 39891
ARGTKLMLRGIASFGLDA

SEQ ID NO: 79783 - protein, 9 aa, Homo sapiens
  light chain complementarity determining region 3 for antibody 39892
LQDFTYPLT

SEQ ID NO: 79784 - protein, 10 aa, Homo sapiens
  heavy chain complementarity determining region 3 for antibody 39892
AKERAGEPDY

SEQ ID NO: 79785 - protein, 9 aa, Homo sapiens
  light chain complementarity determining region 3 for antibody 39893
LQDFNYPRT

SEQ ID NO: 79786 - protein, 18 aa, Homo sapiens
  heavy chain complementarity determining region 3 for antibody 39893
ARDLSPAGYGYGIDAFDF

SEQ ID NO: 79787 - protein, 9 aa, Homo sapiens
  light chain complementarity determining region 3 for antibody 39894
LQDFHYPRT

SEQ ID NO: 79788 - protein, 17 aa, Homo sapiens
  heavy chain complementarity determining region 3 for antibody 39894
VRDDRPICSGGPCYPDV

SEQ ID NO: 79789 - protein, 9 aa, Homo sapiens
  light chain complementarity determining region 3 for antibody 39895
LQAYNYPRT

SEQ ID NO: 79790 - protein, 19 aa, Homo sapiens
  heavy chain complementarity determining region 3 for antibody 39895
ARDVTPSGGSTIYYDAFDI

SEQ ID NO: 79791 - protein, 9 aa, Homo sapiens
  light chain complementarity determining region 3 for antibody 39896
LQAYNFPWK

SEQ ID NO: 79792 - protein, 18 aa, Homo sapiens
  heavy chain complementarity determining region 3 for antibody 39896
ARAGDSGSFSFSYSGMDI

SEQ ID NO: 79793 - protein, 9 aa, Homo sapiens
  light chain complementarity determining region 3 for antibody 39897
LQAVSFPRT

SEQ ID NO: 79794 - protein, 8 aa, Homo sapiens
  heavy chain complementarity determining region 3 for antibody 39897
ARNSGWYD

SEQ ID NO: 79795 - protein, 9 aa, Homo sapiens
  light chain complementarity determining region 3 for antibody 39898
LQATHWPWT

SEQ ID NO: 79796 - protein, 12 aa, Homo sapiens
  heavy chain complementarity determining region 3 for antibody 39898
AADCSSASCPGY

SEQ ID NO: 79797 - protein, 9 aa, Homo sapiens
  light chain complementarity determining region 3 for antibody 39899
LQATHWPGT

SEQ ID NO: 79798 - protein, 12 aa, Homo sapiens
  heavy chain complementarity determining region 3 for antibody 39899
ARGANPFDAFDI

SEQ ID NO: 79799 - protein, 9 aa, Homo sapiens
  light chain complementarity determining region 3 for antibody 39900
LQATHGPWT

SEQ ID NO: 79800 - protein, 12 aa, Homo sapiens
  heavy chain complementarity determining region 3 for antibody 39900
ARGANPFDAFDI

SEQ ID NO: 79801 - protein, 9 aa, Homo sapiens
  light chain complementarity determining region 3 for antibody 39901
LQARHWPWT

SEQ ID NO: 79802 - protein, 12 aa, Homo sapiens
  heavy chain complementarity determining region 3 for antibody 39901
ARGANPFDAFDI

SEQ ID NO: 79803 - protein, 9 aa, Homo sapiens
  light chain complementarity determining region 3 for antibody 39902
LQALQTPYT

SEQ ID NO: 79804 - protein, 21 aa, Homo sapiens
  heavy chain complementarity determining region 3 for antibody 39902
ARETNTWTYNGRYYYYCGLDV

SEQ ID NO: 79805 - protein, 9 aa, Homo sapiens
  light chain complementarity determining region 3 for antibody 39903
LQALQTPPT

SEQ ID NO: 79806 - protein, 15 aa, Homo sapiens
  heavy chain complementarity determining region 3 for antibody 39903
ARDGLRDGFSDAFDI

SEQ ID NO: 79807 - protein, 8 aa, Homo sapiens
  light chain complementarity determining region 3 for antibody 39904
LQALHTWT

SEQ ID NO: 79808 - protein, 18 aa, Homo sapiens
  heavy chain complementarity determining region 3 for antibody 39904
ARSRPYGGDANPARHFDY

SEQ ID NO: 79809 - protein, 8 aa, Homo sapiens
  light chain complementarity determining region 3 for antibody 39905
LQALHHLT

SEQ ID NO: 79810 - protein, 16 aa, Homo sapiens
  heavy chain complementarity determining region 3 for antibody 39905
AKWGGVAMAGHYYFDY

SEQ ID NO: 79811 - protein, 9 aa, Homo sapiens
  light chain complementarity determining region 3 for antibody 39906
LQALETPFT

SEQ ID NO: 79812 - protein, 15 aa, Homo sapiens
  heavy chain complementarity determining region 3 for antibody 39906
VRHYRIITAPLEGDS

SEQ ID NO: 79813 - protein, 9 aa, Homo sapiens
  light chain complementarity determining region 3 for antibody 39907
LQALEIPFT

SEQ ID NO: 79814 - protein, 15 aa, Homo sapiens
  heavy chain complementarity determining region 3 for antibody 39907
VRHYRETVAGIEGDS

SEQ ID NO: 79815 - protein, 8 aa, Homo sapiens
  light chain complementarity determining region 3 for antibody 39908
LPYGGSPS

SEQ ID NO: 79816 - protein, 16 aa, Homo sapiens
  heavy chain complementarity determining region 3 for antibody 39908
ATDWGSGTQWIRAFDV

SEQ ID NO: 79817 - protein, 9 aa, Homo sapiens
  light chain complementarity determining region 3 for antibody 39909
LPTYNIPIT

SEQ ID NO: 79818 - protein, 14 aa, Homo sapiens
  heavy chain complementarity determining region 3 for antibody 39909
VKFPRGDSSFLQDF

SEQ ID NO: 79819 - protein, 9 aa, Homo sapiens
  light chain complementarity determining region 3 for antibody 39910
LPTYIYPRT

SEQ ID NO: 79820 - protein, 9 aa, Homo sapiens
  heavy chain complementarity determining region 3 for antibody 39910
SRGHSGWGY

SEQ ID NO: 79821 - protein, 9 aa, Homo sapiens
  light chain complementarity determining region 3 for antibody 39911
LPHSISPRT

SEQ ID NO: 79822 - protein, 11 aa, Homo sapiens
  heavy chain complementarity determining region 3 for antibody 39911
TTGLGSGGINW

SEQ ID NO: 79823 - protein, 10 aa, Homo sapiens
  light chain complementarity determining region 3 for antibody 39912
LPHENFPLFT

SEQ ID NO: 79824 - protein, 16 aa, Homo sapiens
  heavy chain complementarity determining region 3 for antibody 39912
SRGAYYSSSWYGWFDP

SEQ ID NO: 79825 - protein, 9 aa, Homo sapiens
  light chain complementarity determining region 3 for antibody 39913
LPDYDYPLT

SEQ ID NO: 79826 - protein, 18 aa, Homo sapiens
  heavy chain complementarity determining region 3 for antibody 39913
ARSLYHSVSGAYYDAFDI

SEQ ID NO: 79827 - protein, 9 aa, Homo sapiens
  light chain complementarity determining region 3 for antibody 39914
LLVVSFPRT

SEQ ID NO: 79828 - protein, 8 aa, Homo sapiens
  heavy chain complementarity determining region 3 for antibody 39914
ARNSGWYD

SEQ ID NO: 79829 - protein, 9 aa, Homo sapiens
  light chain complementarity determining region 3 for antibody 39915
LLHSISPRT

SEQ ID NO: 79830 - protein, 11 aa, Homo sapiens
  heavy chain complementarity determining region 3 for antibody 39915
TTGLGSGGINW

SEQ ID NO: 79831 - protein, 9 aa, Homo sapiens
  light chain complementarity determining region 3 for antibody 39916
LLHNSFPWT

SEQ ID NO: 79832 - protein, 11 aa, Homo sapiens
  heavy chain complementarity determining region 3 for antibody 39916
VRDVPTAHFDY

SEQ ID NO: 79833 - protein, 9 aa, Homo sapiens
  light chain complementarity determining region 3 for antibody 39917
LLDYDYPLT

SEQ ID NO: 79834 - protein, 18 aa, Homo sapiens
  heavy chain complementarity determining region 3 for antibody 39917
ARSLYHSVSGAYYDAFDI

SEQ ID NO: 79835 - protein, 8 aa, Homo sapiens
  light chain complementarity determining region 3 for antibody 39918
LKGTQGRP

SEQ ID NO: 79836 - protein, 15 aa, Homo sapiens
  heavy chain complementarity determining region 3 for antibody 39918
ATDWSFQMIEGNFHH

SEQ ID NO: 79837 - protein, 9 aa, Homo sapiens
  light chain complementarity determining region 3 for antibody 39919
LHYYSTPWT

SEQ ID NO: 79838 - protein, 15 aa, Homo sapiens
  heavy chain complementarity determining region 3 for antibody 39919
IRQSKVDNYYNYPDF

SEQ ID NO: 79839 - protein, 9 aa, Homo sapiens
  light chain complementarity determining region 3 for antibody 39920
LHYKSYPRT

SEQ ID NO: 79840 - protein, 6 aa, Homo sapiens
  heavy chain complementarity determining region 3 for antibody 39920
SRALDY

SEQ ID NO: 79841 - protein, 9 aa, Homo sapiens
  light chain complementarity determining region 3 for antibody 39921
LHNYNPPFT

SEQ ID NO: 79842 - protein, 13 aa, Homo sapiens
  heavy chain complementarity determining region 3 for antibody 39921
VRGRNYDRDGFDP

SEQ ID NO: 79843 - protein, 9 aa, Homo sapiens
  light chain complementarity determining region 3 for antibody 39922
LHNKNFPYA

SEQ ID NO: 79844 - protein, 16 aa, Homo sapiens
  heavy chain complementarity determining region 3 for antibody 39922
ARGAFYYDTSGSLFDV

SEQ ID NO: 79845 - protein, 9 aa, Homo sapiens
  light chain complementarity determining region 3 for antibody 39923
LHHYNYRGT

SEQ ID NO: 79846 - protein, 13 aa, Homo sapiens
  heavy chain complementarity determining region 3 for antibody 39923
AKGEPWLSHRLDS

SEQ ID NO: 79847 - protein, 9 aa, Homo sapiens
  light chain complementarity determining region 3 for antibody 39924
LHHNSYPLT

SEQ ID NO: 79848 - protein, 17 aa, Homo sapiens
  heavy chain complementarity determining region 3 for antibody 39924
ARGTRRGYCSAGSCYGY

SEQ ID NO: 79849 - protein, 9 aa, Homo sapiens
  light chain complementarity determining region 3 for antibody 39925
LHHNIYSVT

SEQ ID NO: 79850 - protein, 16 aa, Homo sapiens
  heavy chain complementarity determining region 3 for antibody 39925
ARGLYGSGGHSNPFDC

SEQ ID NO: 79851 - protein, 11 aa, Homo sapiens
  light chain complementarity determining region 3 for antibody 39926
LHHDNFPVTWT

SEQ ID NO: 79852 - protein, 16 aa, Homo sapiens
  heavy chain complementarity determining region 3 for antibody 39926
ARVVWGASWYVGWFDP

SEQ ID NO: 79853 - protein, 9 aa, Homo sapiens
  light chain complementarity determining region 3 for antibody 39927
LHDYTYPRT

SEQ ID NO: 79854 - protein, 18 aa, Homo sapiens
  heavy chain complementarity determining region 3 for antibody 39927
ARDLDIEISPNCYDAYDI

SEQ ID NO: 79855 - protein, 9 aa, Homo sapiens
  light chain complementarity determining region 3 for antibody 39928
LHDYNYPRT

SEQ ID NO: 79856 - protein, 18 aa, Homo sapiens
  heavy chain complementarity determining region 3 for antibody 39928
VRDDDVVVNYITCDRYDY

SEQ ID NO: 79857 - protein, 9 aa, Homo sapiens
  light chain complementarity determining region 3 for antibody 39929
LHDYNYPRT

SEQ ID NO: 79858 - protein, 18 aa, Homo sapiens
  heavy chain complementarity determining region 3 for antibody 39929
VRDDDVVVNYIAWDRYDY

SEQ ID NO: 79859 - protein, 9 aa, Homo sapiens
  light chain complementarity determining region 3 for antibody 39930
LHDYDYPLT

SEQ ID NO: 79860 - protein, 18 aa, Homo sapiens
  heavy chain complementarity determining region 3 for antibody 39930
ARSLYHSVSGAYYDAFDI

SEQ ID NO: 79861 - protein, 9 aa, Homo sapiens
  light chain complementarity determining region 3 for antibody 39931
LHDASYPPS

SEQ ID NO: 79862 - protein, 18 aa, Homo sapiens
  heavy chain complementarity determining region 3 for antibody 39931
AKDRRTVYDSSDYLGFDH

SEQ ID NO: 79863 - protein, 9 aa, Homo sapiens
  light chain complementarity determining region 3 for antibody 39932
LHDASYPLS

SEQ ID NO: 79864 - protein, 18 aa, Homo sapiens
  heavy chain complementarity determining region 3 for antibody 39932
ARDRRTVYDSSDYLGFDH

SEQ ID NO: 79865 - protein, 9 aa, Homo sapiens
  light chain complementarity determining region 3 for antibody 39933
LHDASYPLP

SEQ ID NO: 79866 - protein, 18 aa, Homo sapiens
  heavy chain complementarity determining region 3 for antibody 39933
AKDRRTVYDSSDYLGFDH

SEQ ID NO: 79867 - protein, 9 aa, Homo sapiens
  light chain complementarity determining region 3 for antibody 39934
LHAASYPLS

SEQ ID NO: 79868 - protein, 18 aa, Homo sapiens
  heavy chain complementarity determining region 3 for antibody 39934
AKDRRTVYDSSDYLGFDH

SEQ ID NO: 79869 - protein, 9 aa, Homo sapiens
  light chain complementarity determining region 3 for antibody 39935
KQYYTYPLT

SEQ ID NO: 79870 - protein, 14 aa, Homo sapiens
  heavy chain complementarity determining region 3 for antibody 39935
AKDRIAVGISVWEY

SEQ ID NO: 79871 - protein, 9 aa, Homo sapiens
  light chain complementarity determining region 3 for antibody 39936
KQYYTTTLT

SEQ ID NO: 79872 - protein, 14 aa, Homo sapiens
  heavy chain complementarity determining region 3 for antibody 39936
AKDRIAVGISVWEY

SEQ ID NO: 79873 - protein, 9 aa, Homo sapiens
  light chain complementarity determining region 3 for antibody 39937
KQYYTTPPT

SEQ ID NO: 79874 - protein, 14 aa, Homo sapiens
  heavy chain complementarity determining region 3 for antibody 39937
AKDRIAVGISAWEY

SEQ ID NO: 79875 - protein, 9 aa, Homo sapiens
  light chain complementarity determining region 3 for antibody 39938
KQYYTTPLT

SEQ ID NO: 79876 - protein, 14 aa, Homo sapiens
  heavy chain complementarity determining region 3 for antibody 39938
AKDRIAVGTSVWEY

SEQ ID NO: 79877 - protein, 9 aa, Homo sapiens
  light chain complementarity determining region 3 for antibody 39939
KQYYTTPLT

SEQ ID NO: 79878 - protein, 14 aa, Homo sapiens
  heavy chain complementarity determining region 3 for antibody 39939
AKDRIAVGISAWEY

SEQ ID NO: 79879 - protein, 9 aa, Homo sapiens
  light chain complementarity determining region 3 for antibody 39940
KQYYTTPLS

SEQ ID NO: 79880 - protein, 14 aa, Homo sapiens
  heavy chain complementarity determining region 3 for antibody 39940
AKDRIAVGISVWEY

SEQ ID NO: 79881 - protein, 9 aa, Homo sapiens
  light chain complementarity determining region 3 for antibody 39941
KQYYTTPHT

SEQ ID NO: 79882 - protein, 14 aa, Homo sapiens
  heavy chain complementarity determining region 3 for antibody 39941
AKDRIAVGISVWEY

SEQ ID NO: 79883 - protein, 9 aa, Homo sapiens
  light chain complementarity determining region 3 for antibody 39942
KQYYTSPPT

SEQ ID NO: 79884 - protein, 14 aa, Homo sapiens
  heavy chain complementarity determining region 3 for antibody 39942
AKDRIAVGISVWEY

SEQ ID NO: 79885 - protein, 9 aa, Homo sapiens
  light chain complementarity determining region 3 for antibody 39943
KQYYTAPLT

SEQ ID NO: 79886 - protein, 14 aa, Homo sapiens
  heavy chain complementarity determining region 3 for antibody 39943
AKDRIAVGISVWEY

SEQ ID NO: 79887 - protein, 9 aa, Homo sapiens
  light chain complementarity determining region 3 for antibody 39944
KQYYPTPLT

SEQ ID NO: 79888 - protein, 14 aa, Homo sapiens
  heavy chain complementarity determining region 3 for antibody 39944
AKDRIAVGISVWEY

SEQ ID NO: 79889 - protein, 9 aa, Homo sapiens
  light chain complementarity determining region 3 for antibody 39945
KQYNGYSRT

SEQ ID NO: 79890 - protein, 18 aa, Homo sapiens
  heavy chain complementarity determining region 3 for antibody 39945
ARDFGGRAYTKVENAFDI

SEQ ID NO: 79891 - protein, 9 aa, Homo sapiens
  light chain complementarity determining region 3 for antibody 39946
KQYGSSPRT

SEQ ID NO: 79892 - protein, 25 aa, Homo sapiens
  heavy chain complementarity determining region 3 for antibody 39946
ARLRIDRLRLPGAMRGPLYDCGLNV

SEQ ID NO: 79893 - protein, 9 aa, Homo sapiens
  light chain complementarity determining region 3 for antibody 39947
KQYGSLPLT

SEQ ID NO: 79894 - protein, 15 aa, Homo sapiens
  heavy chain complementarity determining region 3 for antibody 39947
AHRPNYYDKAGAFDI

SEQ ID NO: 79895 - protein, 9 aa, Homo sapiens
  light chain complementarity determining region 3 for antibody 39948
KQYGNLPRT

SEQ ID NO: 79896 - protein, 13 aa, Homo sapiens
  heavy chain complementarity determining region 3 for antibody 39948
AGGQFHSSGYSEF

SEQ ID NO: 79897 - protein, 9 aa, Homo sapiens
  light chain complementarity determining region 3 for antibody 39949
KQSYTSPYT

SEQ ID NO: 79898 - protein, 16 aa, Homo sapiens
  heavy chain complementarity determining region 3 for antibody 39949
ATDWGSGTQWIRAFDV

SEQ ID NO: 79899 - protein, 9 aa, Homo sapiens
  light chain complementarity determining region 3 for antibody 39950
KQRTNWPRT

SEQ ID NO: 79900 - protein, 12 aa, Homo sapiens
  heavy chain complementarity determining region 3 for antibody 39950
AKEWANWGVFDY

SEQ ID NO: 79901 - protein, 9 aa, Homo sapiens
  light chain complementarity determining region 3 for antibody 39951
KQNFTTPLT

SEQ ID NO: 79902 - protein, 14 aa, Homo sapiens
  heavy chain complementarity determining region 3 for antibody 39951
AKDRIAVGISVWEY

SEQ ID NO: 79903 - protein, 9 aa, Homo sapiens
  light chain complementarity determining region 3 for antibody 39952
KQNDRLPPT

SEQ ID NO: 79904 - protein, 16 aa, Homo sapiens
  heavy chain complementarity determining region 3 for antibody 39952
ARLSFRRHDGRGSFGH

SEQ ID NO: 79905 - protein, 9 aa, Homo sapiens
  light chain complementarity determining region 3 for antibody 39953
KQLNSYPLT

SEQ ID NO: 79906 - protein, 16 aa, Homo sapiens
  heavy chain complementarity determining region 3 for antibody 39953
VRRDEVTVFWGGPLDF

SEQ ID NO: 79907 - protein, 9 aa, Homo sapiens
  light chain complementarity determining region 3 for antibody 39954
KQCYTTPLT

SEQ ID NO: 79908 - protein, 14 aa, Homo sapiens
  heavy chain complementarity determining region 3 for antibody 39954
AKDRIAVGISVWEY

SEQ ID NO: 79909 - protein, 9 aa, Homo sapiens
  light chain complementarity determining region 3 for antibody 39955
KKYYTTPLT

SEQ ID NO: 79910 - protein, 14 aa, Homo sapiens
  heavy chain complementarity determining region 3 for antibody 39955
AKDRIAVGISVWEY

SEQ ID NO: 79911 - protein, 9 aa, Homo sapiens
  light chain complementarity determining region 3 for antibody 39956
KHYYTPPLT

SEQ ID NO: 79912 - protein, 14 aa, Homo sapiens
  heavy chain complementarity determining region 3 for antibody 39956
AKDRIAVGISVWEY

SEQ ID NO: 79913 - protein, 9 aa, Homo sapiens
  light chain complementarity determining region 3 for antibody 39957
KHYFTTPLT

SEQ ID NO: 79914 - protein, 14 aa, Homo sapiens
  heavy chain complementarity determining region 3 for antibody 39957
AKDRIAVGISVWEY

SEQ ID NO: 79915 - protein, 9 aa, Homo sapiens
  light chain complementarity determining region 3 for antibody 39958
IQRSDYPLT

SEQ ID NO: 79916 - protein, 18 aa, Homo sapiens
  heavy chain complementarity determining region 3 for antibody 39958
ARVECSGGDCFSARYFDL

SEQ ID NO: 79917 - protein, 9 aa, Homo sapiens
  light chain complementarity determining region 3 for antibody 39959
IQHSDYPPT

SEQ ID NO: 79918 - protein, 18 aa, Homo sapiens
  heavy chain complementarity determining region 3 for antibody 39959
ARVECSGGDCFSARYFDL

SEQ ID NO: 79919 - protein, 9 aa, Homo sapiens
  light chain complementarity determining region 3 for antibody 39960
IQHSDYPLT

SEQ ID NO: 79920 - protein, 18 aa, Homo sapiens
  heavy chain complementarity determining region 3 for antibody 39960
ARVECSGGVCFSARYFDL

SEQ ID NO: 79921 - protein, 9 aa, Homo sapiens
  light chain complementarity determining region 3 for antibody 39961
IQHSDYPLT

SEQ ID NO: 79922 - protein, 18 aa, Homo sapiens
  heavy chain complementarity determining region 3 for antibody 39961
ARVECSGGDCLSARYFDL

SEQ ID NO: 79923 - protein, 9 aa, Homo sapiens
  light chain complementarity determining region 3 for antibody 39962
IQHSDYPLT

SEQ ID NO: 79924 - protein, 18 aa, Homo sapiens
  heavy chain complementarity determining region 3 for antibody 39962
ARVECSGGACFSARYFDL

SEQ ID NO: 79925 - protein, 9 aa, Homo sapiens
  light chain complementarity determining region 3 for antibody 39963
IQHRDYPLT

SEQ ID NO: 79926 - protein, 18 aa, Homo sapiens
  heavy chain complementarity determining region 3 for antibody 39963
ARVECSGGDCFSARYFDL

SEQ ID NO: 79927 - protein, 9 aa, Homo sapiens
  light chain complementarity determining region 3 for antibody 39964
IQALQTPYT

SEQ ID NO: 79928 - protein, 21 aa, Homo sapiens
  heavy chain complementarity determining region 3 for antibody 39964
ARDAPVSRPYSSGWYSSAFDY

SEQ ID NO: 79929 - protein, 8 aa, Homo sapiens
  light chain complementarity determining region 3 for antibody 39965
IQALQTPT

SEQ ID NO: 79930 - protein, 15 aa, Homo sapiens
  heavy chain complementarity determining region 3 for antibody 39965
ARRDYYDSSGYRLDY

SEQ ID NO: 79931 - protein, 9 aa, Homo sapiens
  light chain complementarity determining region 3 for antibody 39966
IQALETPFT

SEQ ID NO: 79932 - protein, 15 aa, Homo sapiens
  heavy chain complementarity determining region 3 for antibody 39966
VRHYRETVAGIEGDS

SEQ ID NO: 79933 - protein, 9 aa, Homo sapiens
  light chain complementarity determining region 3 for antibody 39967
HYYDTSPWT

SEQ ID NO: 79934 - protein, 9 aa, Homo sapiens
  heavy chain complementarity determining region 3 for antibody 39967
ASILHDRLL

SEQ ID NO: 79935 - protein, 11 aa, Homo sapiens
  light chain complementarity determining region 3 for antibody 39968
HVYEWTPPTYT

SEQ ID NO: 79936 - protein, 14 aa, Homo sapiens
  heavy chain complementarity determining region 3 for antibody 39968
ARHTSVTRHRGFDC

SEQ ID NO: 79937 - protein, 9 aa, Homo sapiens
  light chain complementarity determining region 3 for antibody 39969
HQYYTYPLT

SEQ ID NO: 79938 - protein, 15 aa, Homo sapiens
  heavy chain complementarity determining region 3 for antibody 39969
AHGAWVRGVTSRFDY

SEQ ID NO: 79939 - protein, 9 aa, Homo sapiens
  light chain complementarity determining region 3 for antibody 39970
HQYYTIPPT

SEQ ID NO: 79940 - protein, 21 aa, Homo sapiens
  heavy chain complementarity determining region 3 for antibody 39970
ATHPFYCGGGTCYLTGFYFDH

SEQ ID NO: 79941 - protein, 9 aa, Homo sapiens
  light chain complementarity determining region 3 for antibody 39971
HQYYTIPLP

SEQ ID NO: 79942 - protein, 21 aa, Homo sapiens
  heavy chain complementarity determining region 3 for antibody 39971
ATHPFYCGGGTCYLTGFYFDH

SEQ ID NO: 79943 - protein, 9 aa, Homo sapiens
  light chain complementarity determining region 3 for antibody 39972
HQYYSVPQT

SEQ ID NO: 79944 - protein, 11 aa, Homo sapiens
  heavy chain complementarity determining region 3 for antibody 39972
VRDNGDAAWDS

SEQ ID NO: 79945 - protein, 9 aa, Homo sapiens
  light chain complementarity determining region 3 for antibody 39973
HQYYSSPPT

SEQ ID NO: 79946 - protein, 5 aa, Homo sapiens
  heavy chain complementarity determining region 3 for antibody 39973
GTREF

SEQ ID NO: 79947 - protein, 9 aa, Homo sapiens
  light chain complementarity determining region 3 for antibody 39974
HQYYSPPLT

SEQ ID NO: 79948 - protein, 15 aa, Homo sapiens
  heavy chain complementarity determining region 3 for antibody 39974
ARDSSIVGARTHFDY

SEQ ID NO: 79949 - protein, 9 aa, Homo sapiens
  light chain complementarity determining region 3 for antibody 39975
HQYYSPPLT

SEQ ID NO: 79950 - protein, 15 aa, Homo sapiens
  heavy chain complementarity determining region 3 for antibody 39975
ARDSSIVGARPHFDY

SEQ ID NO: 79951 - protein, 9 aa, Homo sapiens
  light chain complementarity determining region 3 for antibody 39976
HQYYSGPLT

SEQ ID NO: 79952 - protein, 21 aa, Homo sapiens
  heavy chain complementarity determining region 3 for antibody 39976
AKDEGLSVFRSFDGLFDAFDI

SEQ ID NO: 79953 - protein, 9 aa, Homo sapiens
  light chain complementarity determining region 3 for antibody 39977
HQYYSAPLT

SEQ ID NO: 79954 - protein, 14 aa, Homo sapiens
  heavy chain complementarity determining region 3 for antibody 39977
AREDPLYKHYAMDV

SEQ ID NO: 79955 - protein, 10 aa, Homo sapiens
  light chain complementarity determining region 3 for antibody 39978
HQYVNWPPWT

SEQ ID NO: 79956 - protein, 12 aa, Homo sapiens
  heavy chain complementarity determining region 3 for antibody 39978
ARDRGAAGPLRY

SEQ ID NO: 79957 - protein, 10 aa, Homo sapiens
  light chain complementarity determining region 3 for antibody 39979
HQYVNWPPRT

SEQ ID NO: 79958 - protein, 12 aa, Homo sapiens
  heavy chain complementarity determining region 3 for antibody 39979
ARDRGAAGPLLY

SEQ ID NO: 79959 - protein, 9 aa, Homo sapiens
  light chain complementarity determining region 3 for antibody 39980
HQYSTSPRP

SEQ ID NO: 79960 - protein, 16 aa, Homo sapiens
  heavy chain complementarity determining region 3 for antibody 39980
ARGPPPRFSTSWYGEY

SEQ ID NO: 79961 - protein, 8 aa, Homo sapiens
  light chain complementarity determining region 3 for antibody 39981
HQYRASFP

SEQ ID NO: 79962 - protein, 13 aa, Homo sapiens
  heavy chain complementarity determining region 3 for antibody 39981
ATESGKYQGALDF

SEQ ID NO: 79963 - protein, 8 aa, Homo sapiens
  light chain complementarity determining region 3 for antibody 39982
HQYNVFWT

SEQ ID NO: 79964 - protein, 10 aa, Homo sapiens
  heavy chain complementarity determining region 3 for antibody 39982
ATDRRSVLSY

SEQ ID NO: 79965 - protein, 9 aa, Homo sapiens
  light chain complementarity determining region 3 for antibody 39983
HQYNTFPYT

SEQ ID NO: 79966 - protein, 13 aa, Homo sapiens
  heavy chain complementarity determining region 3 for antibody 39983
ARFCGGDCSPFDY

SEQ ID NO: 79967 - protein, 9 aa, Homo sapiens
  light chain complementarity determining region 3 for antibody 39984
HQYNTCSVM

SEQ ID NO: 79968 - protein, 19 aa, Homo sapiens
  heavy chain complementarity determining region 3 for antibody 39984
ARAQVLWFGGLAERGALDI

SEQ ID NO: 79969 - protein, 9 aa, Homo sapiens
  light chain complementarity determining region 3 for antibody 39985
HQYNSYSYT

SEQ ID NO: 79970 - protein, 15 aa, Homo sapiens
  heavy chain complementarity determining region 3 for antibody 39985
ARENDSGGSERAFDI

SEQ ID NO: 79971 - protein, 9 aa, Homo sapiens
  light chain complementarity determining region 3 for antibody 39986
HQYNSYSVT

SEQ ID NO: 79972 - protein, 17 aa, Homo sapiens
  heavy chain complementarity determining region 3 for antibody 39986
VKESWQWLVDYYYGMDV

SEQ ID NO: 79973 - protein, 8 aa, Homo sapiens
  light chain complementarity determining region 3 for antibody 39987
HQYNSLYT

SEQ ID NO: 79974 - protein, 14 aa, Homo sapiens
  heavy chain complementarity determining region 3 for antibody 39987
ARENSISRKRSFDQ

SEQ ID NO: 79975 - protein, 9 aa, Homo sapiens
  light chain complementarity determining region 3 for antibody 39988
HQYNSAPAT

SEQ ID NO: 79976 - protein, 11 aa, Homo sapiens
  heavy chain complementarity determining region 3 for antibody 39988
AREAAKWALDY

SEQ ID NO: 79977 - protein, 9 aa, Homo sapiens
  light chain complementarity determining region 3 for antibody 39989
HQYHTFPYT

SEQ ID NO: 79978 - protein, 13 aa, Homo sapiens
  heavy chain complementarity determining region 3 for antibody 39989
ARCCGGDCSPFDY

SEQ ID NO: 79979 - protein, 9 aa, Homo sapiens
  light chain complementarity determining region 3 for antibody 39990
HQYGTSSFT

SEQ ID NO: 79980 - protein, 21 aa, Homo sapiens
  heavy chain complementarity determining region 3 for antibody 39990
ARMSAGSYYDSSGSYLYYFDN

SEQ ID NO: 79981 - protein, 9 aa, Homo sapiens
  light chain complementarity determining region 3 for antibody 39991
HQYGTSPLT

SEQ ID NO: 79982 - protein, 14 aa, Homo sapiens
  heavy chain complementarity determining region 3 for antibody 39991
AHRSYNSGRGAFDI

SEQ ID NO: 79983 - protein, 9 aa, Homo sapiens
  light chain complementarity determining region 3 for antibody 39992
HQYGTAPWV

SEQ ID NO: 79984 - protein, 13 aa, Homo sapiens
  heavy chain complementarity determining region 3 for antibody 39992
VRGGRQFVHDLQD

SEQ ID NO: 79985 - protein, 9 aa, Homo sapiens
  light chain complementarity determining region 3 for antibody 39993
HQYGSSPWK

SEQ ID NO: 79986 - protein, 9 aa, Homo sapiens
  heavy chain complementarity determining region 3 for antibody 39993
ARAYGPADY

SEQ ID NO: 79987 - protein, 9 aa, Homo sapiens
  light chain complementarity determining region 3 for antibody 39994
HQYGSSPWA

SEQ ID NO: 79988 - protein, 9 aa, Homo sapiens
  heavy chain complementarity determining region 3 for antibody 39994
ARAYGPADY

SEQ ID NO: 79989 - protein, 9 aa, Homo sapiens
  light chain complementarity determining region 3 for antibody 39995
HQYGSSPNP

SEQ ID NO: 79990 - protein, 18 aa, Homo sapiens
  heavy chain complementarity determining region 3 for antibody 39995
ARQLRHYDDIGFPTEFDH

SEQ ID NO: 79991 - protein, 10 aa, Homo sapiens
  light chain complementarity determining region 3 for antibody 39996
HQYGSSPMYS

SEQ ID NO: 79992 - protein, 11 aa, Homo sapiens
  heavy chain complementarity determining region 3 for antibody 39996
ARGGQWGSLDY

SEQ ID NO: 79993 - protein, 9 aa, Homo sapiens
  light chain complementarity determining region 3 for antibody 39997
HQYGSSPLT

SEQ ID NO: 79994 - protein, 9 aa, Homo sapiens
  heavy chain complementarity determining region 3 for antibody 39997
ARAYGPADY

SEQ ID NO: 79995 - protein, 9 aa, Homo sapiens
  light chain complementarity determining region 3 for antibody 39998
HQYGSLPLT

SEQ ID NO: 79996 - protein, 15 aa, Homo sapiens
  heavy chain complementarity determining region 3 for antibody 39998
AHRPNYYDKAGAFDI

SEQ ID NO: 79997 - protein, 9 aa, Homo sapiens
  light chain complementarity determining region 3 for antibody 39999
HQYGSIPVT

SEQ ID NO: 79998 - protein, 14 aa, Homo sapiens
  heavy chain complementarity determining region 3 for antibody 39999
ARGGRYTSSWYLDH

SEQ ID NO: 79999 - protein, 9 aa, Homo sapiens
  light chain complementarity determining region 3 for antibody 40000
HQYGSIPLT

SEQ ID NO: 80000 - protein, 14 aa, Homo sapiens
  heavy chain complementarity determining region 3 for antibody 40000
ARGGRSTSSWYLDH

SEQ ID NO: 80001 - protein, 9 aa, Homo sapiens
  light chain complementarity determining region 3 for antibody 40001
HQYGRSPYP

SEQ ID NO: 80002 - protein, 11 aa, Homo sapiens
  heavy chain complementarity determining region 3 for antibody 40001
ATWAFYHGVDV

SEQ ID NO: 80003 - protein, 9 aa, Homo sapiens
  light chain complementarity determining region 3 for antibody 40002
HQYGRSPST

SEQ ID NO: 80004 - protein, 11 aa, Homo sapiens
  heavy chain complementarity determining region 3 for antibody 40002
ATWAFYHGVDV

SEQ ID NO: 80005 - protein, 9 aa, Homo sapiens
  light chain complementarity determining region 3 for antibody 40003
HQYGRSPNT

SEQ ID NO: 80006 - protein, 11 aa, Homo sapiens
  heavy chain complementarity determining region 3 for antibody 40003
ATWAFYHGVDV

SEQ ID NO: 80007 - protein, 9 aa, Homo sapiens
  light chain complementarity determining region 3 for antibody 40004
HQYGRSPNT

SEQ ID NO: 80008 - protein, 18 aa, Homo sapiens
  heavy chain complementarity determining region 3 for antibody 40004
ARQLRHYDDIGFPTEFDH

SEQ ID NO: 80009 - protein, 9 aa, Homo sapiens
  light chain complementarity determining region 3 for antibody 40005
HQYGRSPFT

SEQ ID NO: 80010 - protein, 11 aa, Homo sapiens
  heavy chain complementarity determining region 3 for antibody 40005
ATWAFYHGVDV

SEQ ID NO: 80011 - protein, 9 aa, Homo sapiens
  light chain complementarity determining region 3 for antibody 40006
HQYGRSPDT

SEQ ID NO: 80012 - protein, 11 aa, Homo sapiens
  heavy chain complementarity determining region 3 for antibody 40006
ATWAFYHGVDV

SEQ ID NO: 80013 - protein, 9 aa, Homo sapiens
  light chain complementarity determining region 3 for antibody 40007
HQYGRSPDH

SEQ ID NO: 80014 - protein, 14 aa, Homo sapiens
  heavy chain complementarity determining region 3 for antibody 40007
ARGGYYGSGSYLTN

SEQ ID NO: 80015 - protein, 9 aa, Homo sapiens
  light chain complementarity determining region 3 for antibody 40008
HQYGPSPRT

SEQ ID NO: 80016 - protein, 13 aa, Homo sapiens
  heavy chain complementarity determining region 3 for antibody 40008
ATESGSYYGGLDY

SEQ ID NO: 80017 - protein, 9 aa, Homo sapiens
  light chain complementarity determining region 3 for antibody 40009
HQYGNSPWT

SEQ ID NO: 80018 - protein, 18 aa, Homo sapiens
  heavy chain complementarity determining region 3 for antibody 40009
ARVSGLRSNGDYVFAFEI

SEQ ID NO: 80019 - protein, 10 aa, Homo sapiens
  light chain complementarity determining region 3 for antibody 40010
HQYGISLPWT

SEQ ID NO: 80020 - protein, 14 aa, Homo sapiens
  heavy chain complementarity determining region 3 for antibody 40010
ARGASSAYHSQLDF

SEQ ID NO: 80021 - protein, 9 aa, Homo sapiens
  light chain complementarity determining region 3 for antibody 40011
HQYGGSPRT

SEQ ID NO: 80022 - protein, 13 aa, Homo sapiens
  heavy chain complementarity determining region 3 for antibody 40011
ASGYFDSGAYYEF

SEQ ID NO: 80023 - protein, 9 aa, Homo sapiens
  light chain complementarity determining region 3 for antibody 40012
HQYGGSPRM

SEQ ID NO: 80024 - protein, 16 aa, Homo sapiens
  heavy chain complementarity determining region 3 for antibody 40012
AKSLGVDAMTTRVYDS

SEQ ID NO: 80025 - protein, 10 aa, Homo sapiens
  light chain complementarity determining region 3 for antibody 40013
HQYGGSPGWT

SEQ ID NO: 80026 - protein, 10 aa, Homo sapiens
  heavy chain complementarity determining region 3 for antibody 40013
AGDNRLDQAT

SEQ ID NO: 80027 - protein, 9 aa, Homo sapiens
  light chain complementarity determining region 3 for antibody 40014
HQYGESPRM

SEQ ID NO: 80028 - protein, 16 aa, Homo sapiens
  heavy chain complementarity determining region 3 for antibody 40014
AKSLRVDAMTTRVYDS

SEQ ID NO: 80029 - protein, 9 aa, Homo sapiens
  light chain complementarity determining region 3 for antibody 40015
HQYGESPRM

SEQ ID NO: 80030 - protein, 16 aa, Homo sapiens
  heavy chain complementarity determining region 3 for antibody 40015
AKSLGVDAMTTRVYDY

SEQ ID NO: 80031 - protein, 9 aa, Homo sapiens
  light chain complementarity determining region 3 for antibody 40016
HQYGESPRM

SEQ ID NO: 80032 - protein, 16 aa, Homo sapiens
  heavy chain complementarity determining region 3 for antibody 40016
AKSLGVDAMATRVYDS

SEQ ID NO: 80033 - protein, 9 aa, Homo sapiens
  light chain complementarity determining region 3 for antibody 40017
HQYGESPRM

SEQ ID NO: 80034 - protein, 16 aa, Homo sapiens
  heavy chain complementarity determining region 3 for antibody 40017
AKSLGGDAMTTRVYDS

SEQ ID NO: 80035 - protein, 9 aa, Homo sapiens
  light chain complementarity determining region 3 for antibody 40018
HQYGESPRK

SEQ ID NO: 80036 - protein, 16 aa, Homo sapiens
  heavy chain complementarity determining region 3 for antibody 40018
AKSLGVDAMTTRVYDS

SEQ ID NO: 80037 - protein, 9 aa, Homo sapiens
  light chain complementarity determining region 3 for antibody 40019
HQYFSHVYT

SEQ ID NO: 80038 - protein, 18 aa, Homo sapiens
  heavy chain complementarity determining region 3 for antibody 40019
AQERDGYCDSHACYGLDV

SEQ ID NO: 80039 - protein, 9 aa, Homo sapiens
  light chain complementarity determining region 3 for antibody 40020
HQYDNYPPS

SEQ ID NO: 80040 - protein, 14 aa, Homo sapiens
  heavy chain complementarity determining region 3 for antibody 40020
GRQRFGGNSGIIAY

SEQ ID NO: 80041 - protein, 8 aa, Homo sapiens
  light chain complementarity determining region 3 for antibody 40021
HQYDNLYT

SEQ ID NO: 80042 - protein, 18 aa, Homo sapiens
  heavy chain complementarity determining region 3 for antibody 40021
ARVFCDGGVCFQGDAFDI

SEQ ID NO: 80043 - protein, 9 aa, Homo sapiens
  light chain complementarity determining region 3 for antibody 40022
HQYDNLPVT

SEQ ID NO: 80044 - protein, 10 aa, Homo sapiens
  heavy chain complementarity determining region 3 for antibody 40022
ASGGGHTYGY

SEQ ID NO: 80045 - protein, 9 aa, Homo sapiens
  light chain complementarity determining region 3 for antibody 40023
HQYDNGPPS

SEQ ID NO: 80046 - protein, 14 aa, Homo sapiens
  heavy chain complementarity determining region 3 for antibody 40023
GRQRFGGNSGIIAY

SEQ ID NO: 80047 - protein, 9 aa, Homo sapiens
  light chain complementarity determining region 3 for antibody 40024
HQYDNFPLT

SEQ ID NO: 80048 - protein, 15 aa, Homo sapiens
  heavy chain complementarity determining region 3 for antibody 40024
ARGPRGYYFPGGPDY

SEQ ID NO: 80049 - protein, 10 aa, Homo sapiens
  light chain complementarity determining region 3 for antibody 40025
HQYDDWPPIT

SEQ ID NO: 80050 - protein, 21 aa, Homo sapiens
  heavy chain complementarity determining region 3 for antibody 40025
ARHFLQYFDDGSYYPEGLFDL

SEQ ID NO: 80051 - protein, 10 aa, Homo sapiens
  light chain complementarity determining region 3 for antibody 40026
HQYDDLLPIT

SEQ ID NO: 80052 - protein, 12 aa, Homo sapiens
  heavy chain complementarity determining region 3 for antibody 40026
ARDVTGTRLFDF

SEQ ID NO: 80053 - protein, 11 aa, Homo sapiens
  light chain complementarity determining region 3 for antibody 40027
HQYDASPPMSS

SEQ ID NO: 80054 - protein, 14 aa, Homo sapiens
  heavy chain complementarity determining region 3 for antibody 40027
ARHKQIPGTRGFDS

SEQ ID NO: 80055 - protein, 9 aa, Homo sapiens
  light chain complementarity determining region 3 for antibody 40028
HQYAYSPIT

SEQ ID NO: 80056 - protein, 10 aa, Homo sapiens
  heavy chain complementarity determining region 3 for antibody 40028
ATGAGWLVDY

SEQ ID NO: 80057 - protein, 9 aa, Homo sapiens
  light chain complementarity determining region 3 for antibody 40029
HQYATSPRT

SEQ ID NO: 80058 - protein, 14 aa, Homo sapiens
  heavy chain complementarity determining region 3 for antibody 40029
VHRSGLIFGMLIER

SEQ ID NO: 80059 - protein, 9 aa, Homo sapiens
  light chain complementarity determining region 3 for antibody 40030
HQYATSPLT

SEQ ID NO: 80060 - protein, 8 aa, Homo sapiens
  heavy chain complementarity determining region 3 for antibody 40030
VWLFPPGC

SEQ ID NO: 80061 - protein, 9 aa, Homo sapiens
  light chain complementarity determining region 3 for antibody 40031
HQYATSPLT

SEQ ID NO: 80062 - protein, 14 aa, Homo sapiens
  heavy chain complementarity determining region 3 for antibody 40031
VHRSGLIFGMLIER

SEQ ID NO: 80063 - protein, 9 aa, Homo sapiens
  light chain complementarity determining region 3 for antibody 40032
HQYATSPLT

SEQ ID NO: 80064 - protein, 10 aa, Homo sapiens
  heavy chain complementarity determining region 3 for antibody 40032
AGGGGWLIHC

SEQ ID NO: 80065 - protein, 11 aa, Homo sapiens
  light chain complementarity determining region 3 for antibody 40033
HQVYTTPRCLT

SEQ ID NO: 80066 - protein, 12 aa, Homo sapiens
  heavy chain complementarity determining region 3 for antibody 40033
AKESRGLHAFDL

SEQ ID NO: 80067 - protein, 9 aa, Homo sapiens
  light chain complementarity determining region 3 for antibody 40034
HQTYSTPYT

SEQ ID NO: 80068 - protein, 7 aa, Homo sapiens
  heavy chain complementarity determining region 3 for antibody 40034
ASTRGEY

SEQ ID NO: 80069 - protein, 9 aa, Homo sapiens
  light chain complementarity determining region 3 for antibody 40035
HQTYSTPYT

SEQ ID NO: 80070 - protein, 7 aa, Homo sapiens
  heavy chain complementarity determining region 3 for antibody 40035
AGTRGGY

SEQ ID NO: 80071 - protein, 9 aa, Homo sapiens
  light chain complementarity determining region 3 for antibody 40036
HQTYSTPYP

SEQ ID NO: 80072 - protein, 7 aa, Homo sapiens
  heavy chain complementarity determining region 3 for antibody 40036
ASTRGGY

SEQ ID NO: 80073 - protein, 9 aa, Homo sapiens
  light chain complementarity determining region 3 for antibody 40037
HQTSSLSPT

SEQ ID NO: 80074 - protein, 7 aa, Homo sapiens
  heavy chain complementarity determining region 3 for antibody 40037
TTEAYDI

SEQ ID NO: 80075 - protein, 9 aa, Homo sapiens
  light chain complementarity determining region 3 for antibody 40038
HQTSSLPQR

SEQ ID NO: 80076 - protein, 9 aa, Homo sapiens
  heavy chain complementarity determining region 3 for antibody 40038
ARGLWAMDV

SEQ ID NO: 80077 - protein, 9 aa, Homo sapiens
  light chain complementarity determining region 3 for antibody 40039
HQTSSLPQK

SEQ ID NO: 80078 - protein, 7 aa, Homo sapiens
  heavy chain complementarity determining region 3 for antibody 40039
TTEAYDI

SEQ ID NO: 80079 - protein, 9 aa, Homo sapiens
  light chain complementarity determining region 3 for antibody 40040
HQTSSLPPT

SEQ ID NO: 80080 - protein, 9 aa, Homo sapiens
  heavy chain complementarity determining region 3 for antibody 40040
ARGLWAMDV

SEQ ID NO: 80081 - protein, 9 aa, Homo sapiens
  light chain complementarity determining region 3 for antibody 40041
HQTRGLPPT

SEQ ID NO: 80082 - protein, 14 aa, Homo sapiens
  heavy chain complementarity determining region 3 for antibody 40041
ARYVDWDDSDPHDY

SEQ ID NO: 80083 - protein, 9 aa, Homo sapiens
  light chain complementarity determining region 3 for antibody 40042
HQTNSFPLT

SEQ ID NO: 80084 - protein, 18 aa, Homo sapiens
  heavy chain complementarity determining region 3 for antibody 40042
ASGTMVRGVTGYYYGMDV

SEQ ID NO: 80085 - protein, 9 aa, Homo sapiens
  light chain complementarity determining region 3 for antibody 40043
HQTGTLPLT

SEQ ID NO: 80086 - protein, 14 aa, Homo sapiens
  heavy chain complementarity determining region 3 for antibody 40043
VRDASGTDGWYADS

SEQ ID NO: 80087 - protein, 9 aa, Homo sapiens
  light chain complementarity determining region 3 for antibody 40044
HQTGTFPWT

SEQ ID NO: 80088 - protein, 14 aa, Homo sapiens
  heavy chain complementarity determining region 3 for antibody 40044
VRDASGTDGWYADS

SEQ ID NO: 80089 - protein, 9 aa, Homo sapiens
  light chain complementarity determining region 3 for antibody 40045
HQTGGLPLT

SEQ ID NO: 80090 - protein, 14 aa, Homo sapiens
  heavy chain complementarity determining region 3 for antibody 40045
ARYVDWDDSDPHDY

SEQ ID NO: 80091 - protein, 9 aa, Homo sapiens
  light chain complementarity determining region 3 for antibody 40046
HQSYTSPYT

SEQ ID NO: 80092 - protein, 16 aa, Homo sapiens
  heavy chain complementarity determining region 3 for antibody 40046
ATDWGSGTQWIRAFDV

SEQ ID NO: 80093 - protein, 9 aa, Homo sapiens
  light chain complementarity determining region 3 for antibody 40047
HQSYSTPYT

SEQ ID NO: 80094 - protein, 14 aa, Homo sapiens
  heavy chain complementarity determining region 3 for antibody 40047
ARGGGVATSYGMDV

SEQ ID NO: 80095 - protein, 9 aa, Homo sapiens
  light chain complementarity determining region 3 for antibody 40048
HQSYSTPWT

SEQ ID NO: 80096 - protein, 21 aa, Homo sapiens
  heavy chain complementarity determining region 3 for antibody 40048
ARARIMTMARGPVDHYFAMDV

SEQ ID NO: 80097 - protein, 9 aa, Homo sapiens
  light chain complementarity determining region 3 for antibody 40049
HQSYSGPRT

SEQ ID NO: 80098 - protein, 17 aa, Homo sapiens
  heavy chain complementarity determining region 3 for antibody 40049
AKAPTSTYSGKYGGFDY

SEQ ID NO: 80099 - protein, 9 aa, Homo sapiens
  light chain complementarity determining region 3 for antibody 40050
HQSYNTRYT

SEQ ID NO: 80100 - protein, 12 aa, Homo sapiens
  heavy chain complementarity determining region 3 for antibody 40050
ARDLRPGGAFDI

SEQ ID NO: 80101 - protein, 8 aa, Homo sapiens
  light chain complementarity determining region 3 for antibody 40051
HQSYDSEP

SEQ ID NO: 80102 - protein, 12 aa, Homo sapiens
  heavy chain complementarity determining region 3 for antibody 40051
VRRGDVAGMFDY

SEQ ID NO: 80103 - protein, 9 aa, Homo sapiens
  light chain complementarity determining region 3 for antibody 40052
HQSSSLPHT

SEQ ID NO: 80104 - protein, 17 aa, Homo sapiens
  heavy chain complementarity determining region 3 for antibody 40052
ARLNYYDSSGYPGAIDY

SEQ ID NO: 80105 - protein, 9 aa, Homo sapiens
  light chain complementarity determining region 3 for antibody 40053
HQSSSLKET

SEQ ID NO: 80106 - protein, 12 aa, Homo sapiens
  heavy chain complementarity determining region 3 for antibody 40053
VKDCGLGGSRDF

SEQ ID NO: 80107 - protein, 9 aa, Homo sapiens
  light chain complementarity determining region 3 for antibody 40054
HQSSNTWYT

SEQ ID NO: 80108 - protein, 12 aa, Homo sapiens
  heavy chain complementarity determining region 3 for antibody 40054
ARDLRPGGAFDI

SEQ ID NO: 80109 - protein, 9 aa, Homo sapiens
  light chain complementarity determining region 3 for antibody 40055
HQSGTSPRT

SEQ ID NO: 80110 - protein, 13 aa, Homo sapiens
  heavy chain complementarity determining region 3 for antibody 40055
ATESGSYYGGLDY

SEQ ID NO: 80111 - protein, 9 aa, Homo sapiens
  light chain complementarity determining region 3 for antibody 40056
HQSFNTLYT

SEQ ID NO: 80112 - protein, 14 aa, Homo sapiens
  heavy chain complementarity determining region 3 for antibody 40056
ARDVLQYGHRLFDS

SEQ ID NO: 80113 - protein, 10 aa, Homo sapiens
  light chain complementarity determining region 3 for antibody 40057
HQRYNWPPFT

SEQ ID NO: 80114 - protein, 11 aa, Homo sapiens
  heavy chain complementarity determining region 3 for antibody 40057
ARGVGSYPFDS

SEQ ID NO: 80115 - protein, 9 aa, Homo sapiens
  light chain complementarity determining region 3 for antibody 40058
HQRSSWPYT

SEQ ID NO: 80116 - protein, 11 aa, Homo sapiens
  heavy chain complementarity determining region 3 for antibody 40058
VKRWGGSSIDY

SEQ ID NO: 80117 - protein, 9 aa, Homo sapiens
  light chain complementarity determining region 3 for antibody 40059
HQRSSWPLT

SEQ ID NO: 80118 - protein, 15 aa, Homo sapiens
  heavy chain complementarity determining region 3 for antibody 40059
ARTKGGRCHSTAIDL

SEQ ID NO: 80119 - protein, 9 aa, Homo sapiens
  light chain complementarity determining region 3 for antibody 40060
HQRSSLPIT

SEQ ID NO: 80120 - protein, 6 aa, Homo sapiens
  heavy chain complementarity determining region 3 for antibody 40060
ATVFEY

SEQ ID NO: 80121 - protein, 9 aa, Homo sapiens
  light chain complementarity determining region 3 for antibody 40061
HQRSNWPWT

SEQ ID NO: 80122 - protein, 20 aa, Homo sapiens
  heavy chain complementarity determining region 3 for antibody 40061
ARASPVYCSGGSCYYYGMDV

SEQ ID NO: 80123 - protein, 9 aa, Homo sapiens
  light chain complementarity determining region 3 for antibody 40062
HQRSNWPGT

SEQ ID NO: 80124 - protein, 6 aa, Homo sapiens
  heavy chain complementarity determining region 3 for antibody 40062
TTVLEY

SEQ ID NO: 80125 - protein, 9 aa, Homo sapiens
  light chain complementarity determining region 3 for antibody 40063
HQRSNWPGT

SEQ ID NO: 80126 - protein, 6 aa, Homo sapiens
  heavy chain complementarity determining region 3 for antibody 40063
PTVFEY

SEQ ID NO: 80127 - protein, 9 aa, Homo sapiens
  light chain complementarity determining region 3 for antibody 40064
HQRSNWPGT

SEQ ID NO: 80128 - protein, 6 aa, Homo sapiens
  heavy chain complementarity determining region 3 for antibody 40064
PPVFEY

SEQ ID NO: 80129 - protein, 9 aa, Homo sapiens
  light chain complementarity determining region 3 for antibody 40065
HQRSNWPFT

SEQ ID NO: 80130 - protein, 16 aa, Homo sapiens
  heavy chain complementarity determining region 3 for antibody 40065
AGATSSDWYGGGLHDY

SEQ ID NO: 80131 - protein, 9 aa, Homo sapiens
  light chain complementarity determining region 3 for antibody 40066
HQRSNWPFN

SEQ ID NO: 80132 - protein, 16 aa, Homo sapiens
  heavy chain complementarity determining region 3 for antibody 40066
AGATSSDWYGGVLHDY

SEQ ID NO: 80133 - protein, 9 aa, Homo sapiens
  light chain complementarity determining region 3 for antibody 40067
HQRSNLPRT

SEQ ID NO: 80134 - protein, 9 aa, Homo sapiens
  heavy chain complementarity determining region 3 for antibody 40067
AREWYENDY

SEQ ID NO: 80135 - protein, 9 aa, Homo sapiens
  light chain complementarity determining region 3 for antibody 40068
HQRSNLPFT

SEQ ID NO: 80136 - protein, 16 aa, Homo sapiens
  heavy chain complementarity determining region 3 for antibody 40068
AGATSSDWYGGVLHDY

SEQ ID NO: 80137 - protein, 9 aa, Homo sapiens
  light chain complementarity determining region 3 for antibody 40069
HQPYTTPHT

SEQ ID NO: 80138 - protein, 10 aa, Homo sapiens
  heavy chain complementarity determining region 3 for antibody 40069
ARGSYNSVCA

SEQ ID NO: 80139 - protein, 9 aa, Homo sapiens
  light chain complementarity determining region 3 for antibody 40070
HQNGTSPRT

SEQ ID NO: 80140 - protein, 13 aa, Homo sapiens
  heavy chain complementarity determining region 3 for antibody 40070
ATESGSYYGGLDY

SEQ ID NO: 80141 - protein, 9 aa, Homo sapiens
  light chain complementarity determining region 3 for antibody 40071
HQNGSSPWT

SEQ ID NO: 80142 - protein, 9 aa, Homo sapiens
  heavy chain complementarity determining region 3 for antibody 40071
ARAYGPADY

SEQ ID NO: 80143 - protein, 9 aa, Homo sapiens
  light chain complementarity determining region 3 for antibody 40072
HQLNSYPLT

SEQ ID NO: 80144 - protein, 16 aa, Homo sapiens
  heavy chain complementarity determining region 3 for antibody 40072
VRRDEVTVFWGGPLDF

SEQ ID NO: 80145 - protein, 9 aa, Homo sapiens
  light chain complementarity determining region 3 for antibody 40073
HQIGTLPWT

SEQ ID NO: 80146 - protein, 14 aa, Homo sapiens
  heavy chain complementarity determining region 3 for antibody 40073
IMDASGTGGWYADS

SEQ ID NO: 80147 - protein, 9 aa, Homo sapiens
  light chain complementarity determining region 3 for antibody 40074
HQHYTTPPT

SEQ ID NO: 80148 - protein, 10 aa, Homo sapiens
  heavy chain complementarity determining region 3 for antibody 40074
ARGSYNSVCA

SEQ ID NO: 80149 - protein, 9 aa, Homo sapiens
  light chain complementarity determining region 3 for antibody 40075
HQHYTPPPT

SEQ ID NO: 80150 - protein, 10 aa, Homo sapiens
  heavy chain complementarity determining region 3 for antibody 40075
ARGSYNSVWA

SEQ ID NO: 80151 - protein, 10 aa, Homo sapiens
  light chain complementarity determining region 3 for antibody 40076
HQHGSSPPWT

SEQ ID NO: 80152 - protein, 14 aa, Homo sapiens
  heavy chain complementarity determining region 3 for antibody 40076
AKIQALGDTWAFDL

SEQ ID NO: 80153 - protein, 9 aa, Homo sapiens
  light chain complementarity determining region 3 for antibody 40077
HQHGSIPLT

SEQ ID NO: 80154 - protein, 14 aa, Homo sapiens
  heavy chain complementarity determining region 3 for antibody 40077
ARGGRYTSSWYLDH

SEQ ID NO: 80155 - protein, 10 aa, Homo sapiens
  light chain complementarity determining region 3 for antibody 40078
HQHGGSPVWT

SEQ ID NO: 80156 - protein, 10 aa, Homo sapiens
  heavy chain complementarity determining region 3 for antibody 40078
AGDNRLDQAT

SEQ ID NO: 80157 - protein, 8 aa, Homo sapiens
  light chain complementarity determining region 3 for antibody 40079
HQGYNWVI

SEQ ID NO: 80158 - protein, 21 aa, Homo sapiens
  heavy chain complementarity determining region 3 for antibody 40079
ARNDPDNTQGGHTSGNKYLDQ

SEQ ID NO: 80159 - protein, 9 aa, Homo sapiens
  light chain complementarity determining region 3 for antibody 40080
HQFGSLPRT

SEQ ID NO: 80160 - protein, 17 aa, Homo sapiens
  heavy chain complementarity determining region 3 for antibody 40080
ARVGPWLQYSGYDFPDY

SEQ ID NO: 80161 - protein, 9 aa, Homo sapiens
  light chain complementarity determining region 3 for antibody 40081
HQFDKSPRT

SEQ ID NO: 80162 - protein, 17 aa, Homo sapiens
  heavy chain complementarity determining region 3 for antibody 40081
ARRPYLWGSYRPGAFDI

SEQ ID NO: 80163 - protein, 9 aa, Homo sapiens
  light chain complementarity determining region 3 for antibody 40082
HQFDKSPQT

SEQ ID NO: 80164 - protein, 17 aa, Homo sapiens
  heavy chain complementarity determining region 3 for antibody 40082
ARRPYRWGSYRPGAFDI

SEQ ID NO: 80165 - protein, 9 aa, Homo sapiens
  light chain complementarity determining region 3 for antibody 40083
HQDNTYPWT

SEQ ID NO: 80166 - protein, 12 aa, Homo sapiens
  heavy chain complementarity determining region 3 for antibody 40083
VPPVSSYITLDS

SEQ ID NO: 80167 - protein, 9 aa, Homo sapiens
  light chain complementarity determining region 3 for antibody 40084
HQDGTSPRT

SEQ ID NO: 80168 - protein, 13 aa, Homo sapiens
  heavy chain complementarity determining region 3 for antibody 40084
ATESGSYYGGLDY

SEQ ID NO: 80169 - protein, 9 aa, Homo sapiens
  light chain complementarity determining region 3 for antibody 40085
HQDATSPWT

SEQ ID NO: 80170 - protein, 14 aa, Homo sapiens
  heavy chain complementarity determining region 3 for antibody 40085
VHRSGLIFGMLIER

SEQ ID NO: 80171 - protein, 9 aa, Homo sapiens
  light chain complementarity determining region 3 for antibody 40086
HQCSNWPVT

SEQ ID NO: 80172 - protein, 14 aa, Homo sapiens
  heavy chain complementarity determining region 3 for antibody 40086
ARGVAAPIPRYFHH

SEQ ID NO: 80173 - protein, 9 aa, Homo sapiens
  light chain complementarity determining region 3 for antibody 40087
HQCSNWPRT

SEQ ID NO: 80174 - protein, 17 aa, Homo sapiens
  heavy chain complementarity determining region 3 for antibody 40087
ARVPYRVRGVQRPGIDY

SEQ ID NO: 80175 - protein, 9 aa, Homo sapiens
  light chain complementarity determining region 3 for antibody 40088
HQCSDWPET

SEQ ID NO: 80176 - protein, 9 aa, Homo sapiens
  heavy chain complementarity determining region 3 for antibody 40088
ASGDYAFDL

SEQ ID NO: 80177 - protein, 9 aa, Homo sapiens
  light chain complementarity determining region 3 for antibody 40089
HQCAVSPLT

SEQ ID NO: 80178 - protein, 10 aa, Homo sapiens
  heavy chain complementarity determining region 3 for antibody 40089
SSGSGWTSED

SEQ ID NO: 80179 - protein, 9 aa, Homo sapiens
  light chain complementarity determining region 3 for antibody 40090
HQAYSSPYT

SEQ ID NO: 80180 - protein, 14 aa, Homo sapiens
  heavy chain complementarity determining region 3 for antibody 40090
ARDPQRGKPDYFDY

SEQ ID NO: 80181 - protein, 9 aa, Homo sapiens
  light chain complementarity determining region 3 for antibody 40091
HPYYDSPWT

SEQ ID NO: 80182 - protein, 11 aa, Homo sapiens
  heavy chain complementarity determining region 3 for antibody 40091
ARGRDSWKAGY

SEQ ID NO: 80183 - protein, 9 aa, Homo sapiens
  light chain complementarity determining region 3 for antibody 40092
HPTYTFPRT

SEQ ID NO: 80184 - protein, 20 aa, Homo sapiens
  heavy chain complementarity determining region 3 for antibody 40092
ARGRRIAALSTAHYYYGMDV

SEQ ID NO: 80185 - protein, 9 aa, Homo sapiens
  light chain complementarity determining region 3 for antibody 40093
HPTSTFPRT

SEQ ID NO: 80186 - protein, 20 aa, Homo sapiens
  heavy chain complementarity determining region 3 for antibody 40093
ARGRRIAALSTAHYYYGMDV

SEQ ID NO: 80187 - protein, 9 aa, Homo sapiens
  light chain complementarity determining region 3 for antibody 40094
HPSSSLPIT

SEQ ID NO: 80188 - protein, 6 aa, Homo sapiens
  heavy chain complementarity determining region 3 for antibody 40094
ATVFEY

SEQ ID NO: 80189 - protein, 9 aa, Homo sapiens
  light chain complementarity determining region 3 for antibody 40095
HHYYSSPRM

SEQ ID NO: 80190 - protein, 16 aa, Homo sapiens
  heavy chain complementarity determining region 3 for antibody 40095
ARVTLDDDGNPDAFDV

SEQ ID NO: 80191 - protein, 9 aa, Homo sapiens
  light chain complementarity determining region 3 for antibody 40096
HHYSSPLRS

SEQ ID NO: 80192 - protein, 14 aa, Homo sapiens
  heavy chain complementarity determining region 3 for antibody 40096
AKNQGHDYGDYLAY

SEQ ID NO: 80193 - protein, 9 aa, Homo sapiens
  light chain complementarity determining region 3 for antibody 40097
HHYNNWPYT

SEQ ID NO: 80194 - protein, 15 aa, Homo sapiens
  heavy chain complementarity determining region 3 for antibody 40097
KRGGTSGSPGVPFDL

SEQ ID NO: 80195 - protein, 9 aa, Homo sapiens
  light chain complementarity determining region 3 for antibody 40098
HHYHNWPRT

SEQ ID NO: 80196 - protein, 16 aa, Homo sapiens
  heavy chain complementarity determining region 3 for antibody 40098
AKDGGDYYDSFEYFQY

SEQ ID NO: 80197 - protein, 9 aa, Homo sapiens
  light chain complementarity determining region 3 for antibody 40099
HHYGESART

SEQ ID NO: 80198 - protein, 13 aa, Homo sapiens
  heavy chain complementarity determining region 3 for antibody 40099
AKARYDAPRCYES

SEQ ID NO: 80199 - protein, 9 aa, Homo sapiens
  light chain complementarity determining region 3 for antibody 40100
HHYGDSARP

SEQ ID NO: 80200 - protein, 13 aa, Homo sapiens
  heavy chain complementarity determining region 3 for antibody 40100
AKARYDAPRCYES

SEQ ID NO: 80201 - protein, 9 aa, Homo sapiens
  light chain complementarity determining region 3 for antibody 40101
HHYDNLSRT

SEQ ID NO: 80202 - protein, 18 aa, Homo sapiens
  heavy chain complementarity determining region 3 for antibody 40101
TRDLSPQMAPFRDDASDI

SEQ ID NO: 80203 - protein, 9 aa, Homo sapiens
  light chain complementarity determining region 3 for antibody 40102
HHTYTFPRT

SEQ ID NO: 80204 - protein, 20 aa, Homo sapiens
  heavy chain complementarity determining region 3 for antibody 40102
ARGRRIAALSTAHYYCGMDV

SEQ ID NO: 80205 - protein, 9 aa, Homo sapiens
  light chain complementarity determining region 3 for antibody 40103
HHTSTFPWT

SEQ ID NO: 80206 - protein, 20 aa, Homo sapiens
  heavy chain complementarity determining region 3 for antibody 40103
ARGRRIAALSTAHYYYGMDV

SEQ ID NO: 80207 - protein, 9 aa, Homo sapiens
  light chain complementarity determining region 3 for antibody 40104
HHTSTFPRT

SEQ ID NO: 80208 - protein, 15 aa, Homo sapiens
  heavy chain complementarity determining region 3 for antibody 40104
IRQSKVDGNYSYPDF

SEQ ID NO: 80209 - protein, 9 aa, Homo sapiens
  light chain complementarity determining region 3 for antibody 40105
HHTSTFPRT

SEQ ID NO: 80210 - protein, 20 aa, Homo sapiens
  heavy chain complementarity determining region 3 for antibody 40105
ARGRRIAALATAHYYYGMDV

SEQ ID NO: 80211 - protein, 9 aa, Homo sapiens
  light chain complementarity determining region 3 for antibody 40106
HHTFTFPRT

SEQ ID NO: 80212 - protein, 20 aa, Homo sapiens
  heavy chain complementarity determining region 3 for antibody 40106
ARGRRIAALSTAHYYYGMDV

SEQ ID NO: 80213 - protein, 9 aa, Homo sapiens
  light chain complementarity determining region 3 for antibody 40107
HHTFTFPRP

SEQ ID NO: 80214 - protein, 20 aa, Homo sapiens
  heavy chain complementarity determining region 3 for antibody 40107
ARGRRIAALSTAHYYYGMDV

SEQ ID NO: 80215 - protein, 9 aa, Homo sapiens
  light chain complementarity determining region 3 for antibody 40108
HHPSTFPRT

SEQ ID NO: 80216 - protein, 20 aa, Homo sapiens
  heavy chain complementarity determining region 3 for antibody 40108
ARGRRIAALSTAHYYYGMDV

SEQ ID NO: 80217 - protein, 9 aa, Homo sapiens
  light chain complementarity determining region 3 for antibody 40109
HHNSTFPRT

SEQ ID NO: 80218 - protein, 20 aa, Homo sapiens
  heavy chain complementarity determining region 3 for antibody 40109
ARGRRIAALSTAHYYYGMDV

SEQ ID NO: 80219 - protein, 10 aa, Homo sapiens
  light chain complementarity determining region 3 for antibody 40110
HHFGSSPRAT

SEQ ID NO: 80220 - protein, 19 aa, Homo sapiens
  heavy chain complementarity determining region 3 for antibody 40110
ARFVGGFGESGFYYYGMDV

SEQ ID NO: 80221 - protein, 9 aa, Homo sapiens
  light chain complementarity determining region 3 for antibody 40111
HEYSTSRGT

SEQ ID NO: 80222 - protein, 15 aa, Homo sapiens
  heavy chain complementarity determining region 3 for antibody 40111
ARNLMLNTKGYWVDF

SEQ ID NO: 80223 - protein, 9 aa, Homo sapiens
  light chain complementarity determining region 3 for antibody 40112
HCYGASPLS

SEQ ID NO: 80224 - protein, 15 aa, Homo sapiens
  heavy chain complementarity determining region 3 for antibody 40112
ASRIVASSHKTPFDP

SEQ ID NO: 80225 - protein, 9 aa, Homo sapiens
  light chain complementarity determining region 3 for antibody 40113
GQYNSYPRT

SEQ ID NO: 80226 - protein, 6 aa, Homo sapiens
  heavy chain complementarity determining region 3 for antibody 40113
TRALDY

SEQ ID NO: 80227 - protein, 9 aa, Homo sapiens
  light chain complementarity determining region 3 for antibody 40114
FQGTRWPDT

SEQ ID NO: 80228 - protein, 10 aa, Homo sapiens
  heavy chain complementarity determining region 3 for antibody 40114
ARDFYGSIDY

SEQ ID NO: 80229 - protein, 9 aa, Homo sapiens
  light chain complementarity determining region 3 for antibody 40115
FQGTPWPDT

SEQ ID NO: 80230 - protein, 10 aa, Homo sapiens
  heavy chain complementarity determining region 3 for antibody 40115
ARDFYGSIDY

SEQ ID NO: 80231 - protein, 9 aa, Homo sapiens
  light chain complementarity determining region 3 for antibody 40116
FQGTLWPDP

SEQ ID NO: 80232 - protein, 10 aa, Homo sapiens
  heavy chain complementarity determining region 3 for antibody 40116
ARDFYGSIDY

SEQ ID NO: 80233 - protein, 9 aa, Homo sapiens
  light chain complementarity determining region 3 for antibody 40117
FQGTLWPAT

SEQ ID NO: 80234 - protein, 10 aa, Homo sapiens
  heavy chain complementarity determining region 3 for antibody 40117
ARDFYGSIDY

SEQ ID NO: 80235 - protein, 9 aa, Homo sapiens
  light chain complementarity determining region 3 for antibody 40118
FQGTLGPDT

SEQ ID NO: 80236 - protein, 10 aa, Homo sapiens
  heavy chain complementarity determining region 3 for antibody 40118
ARDFYGSIDY

SEQ ID NO: 80237 - protein, 9 aa, Homo sapiens
  light chain complementarity determining region 3 for antibody 40119
FQGTLCPDT

SEQ ID NO: 80238 - protein, 10 aa, Homo sapiens
  heavy chain complementarity determining region 3 for antibody 40119
ARDFYGSIDY

SEQ ID NO: 80239 - protein, 9 aa, Homo sapiens
  light chain complementarity determining region 3 for antibody 40120
FQGTHGPRA

SEQ ID NO: 80240 - protein, 18 aa, Homo sapiens
  heavy chain complementarity determining region 3 for antibody 40120
TRDGDERGSREVGRPLSY

SEQ ID NO: 80241 - protein, 9 aa, Homo sapiens
  light chain complementarity determining region 3 for antibody 40121
ERHDVALGT

SEQ ID NO: 80242 - protein, 15 aa, Homo sapiens
  heavy chain complementarity determining region 3 for antibody 40121
VRVITVVRGIRELDY

SEQ ID NO: 80243 - protein, 9 aa, Homo sapiens
  light chain complementarity determining region 3 for antibody 40122
EQYYTTPVP

SEQ ID NO: 80244 - protein, 17 aa, Homo sapiens
  heavy chain complementarity determining region 3 for antibody 40122
ARQFRWGSGSSWYVFGY

SEQ ID NO: 80245 - protein, 9 aa, Homo sapiens
  light chain complementarity determining region 3 for antibody 40123
EQYHNWPPT

SEQ ID NO: 80246 - protein, 19 aa, Homo sapiens
  heavy chain complementarity determining region 3 for antibody 40123
AKNRAPSSFWSGLGDAFDT

SEQ ID NO: 80247 - protein, 9 aa, Homo sapiens
  light chain complementarity determining region 3 for antibody 40124
EQRLDWHLT

SEQ ID NO: 80248 - protein, 11 aa, Homo sapiens
  heavy chain complementarity determining region 3 for antibody 40124
ARNILGGHTDF

SEQ ID NO: 80249 - protein, 9 aa, Homo sapiens
  light chain complementarity determining region 3 for antibody 40125
AQYGSGPRT

SEQ ID NO: 80250 - protein, 9 aa, Homo sapiens
  heavy chain complementarity determining region 3 for antibody 40125
AREWSAFDF

SEQ ID NO: 80251 - protein, 9 aa, Homo sapiens
  light chain complementarity determining region 3 for antibody 40126
AQDGSRPRT

SEQ ID NO: 80252 - protein, 9 aa, Homo sapiens
  heavy chain complementarity determining region 3 for antibody 40126
AREWSAFDF

SEQ ID NO: 80253 - protein, 9 aa, Homo sapiens
  light chain complementarity determining region 3 for antibody 40127
QQYGRSPRT

SEQ ID NO: 80254 - protein, 15 aa, Homo sapiens
  heavy chain complementarity determining region 3 for antibody 40127
AKDGEFCGSNCYFGS

SEQ ID NO: 80255 - protein, 10 aa, Homo sapiens
  light chain complementarity determining region 3 for antibody 40128
QQRSKWPPLT

SEQ ID NO: 80256 - protein, 9 aa, Homo sapiens
  heavy chain complementarity determining region 3 for antibody 40128
ARVDGYFDY

SEQ ID NO: 80257 - protein, 10 aa, Homo sapiens
  light chain complementarity determining region 3 for antibody 40129
QQRYNWPPFT

SEQ ID NO: 80258 - protein, 11 aa, Homo sapiens
  heavy chain complementarity determining region 3 for antibody 40129
ARGVGSYPFDS

SEQ ID NO: 80259 - protein, 9 aa, Homo sapiens
  light chain complementarity determining region 3 for antibody 40130
QQYGSSPWT

SEQ ID NO: 80260 - protein, 17 aa, Homo sapiens
  heavy chain complementarity determining region 3 for antibody 40130
ARGGAYYDSSGYDQFDY

SEQ ID NO: 80261 - protein, 10 aa, Homo sapiens
  light chain complementarity determining region 3 for antibody 40131
QQSYSTLLYT

SEQ ID NO: 80262 - protein, 11 aa, Homo sapiens
  heavy chain complementarity determining region 3 for antibody 40131
AKDNNFWTIDY

SEQ ID NO: 80263 - protein, 10 aa, Homo sapiens
  light chain complementarity determining region 3 for antibody 40132
QQYNSNSIYT

SEQ ID NO: 80264 - protein, 16 aa, Homo sapiens
  heavy chain complementarity determining region 3 for antibody 40132
AREGEGAYGEDEYFQH

SEQ ID NO: 80265 - protein, 10 aa, Homo sapiens
  light chain complementarity determining region 3 for antibody 40133
QQSYSTPPFT

SEQ ID NO: 80266 - protein, 17 aa, Homo sapiens
  heavy chain complementarity determining region 3 for antibody 40133
ARGSPISEVLTGNRFDA

SEQ ID NO: 80267 - protein, 9 aa, Homo sapiens
  light chain complementarity determining region 3 for antibody 40134
HQYGSSPRT

SEQ ID NO: 80268 - protein, 13 aa, Homo sapiens
  heavy chain complementarity determining region 3 for antibody 40134
ATESGSYYGGLDY

SEQ ID NO: 80269 - protein, 8 aa, Homo sapiens
  light chain complementarity determining region 3 for antibody 40135
QQYRSSFP

SEQ ID NO: 80270 - protein, 13 aa, Homo sapiens
  heavy chain complementarity determining region 3 for antibody 40135
ATESGWYQGAFDI

SEQ ID NO: 80271 - protein, 9 aa, Homo sapiens
  light chain complementarity determining region 3 for antibody 40136
QQGYSPPFI

SEQ ID NO: 80272 - protein, 15 aa, Homo sapiens
  heavy chain complementarity determining region 3 for antibody 40136
ARAQVIWGQLYYFDS

SEQ ID NO: 80273 - protein, 9 aa, Homo sapiens
  light chain complementarity determining region 3 for antibody 40137
QHYGGSPYT

SEQ ID NO: 80274 - protein, 17 aa, Homo sapiens
  heavy chain complementarity determining region 3 for antibody 40137
ARVDLSEQWLVLWYFDL

SEQ ID NO: 80275 - protein, 9 aa, Homo sapiens
  light chain complementarity determining region 3 for antibody 40138
QQSYTTPQT

SEQ ID NO: 80276 - protein, 21 aa, Homo sapiens
  heavy chain complementarity determining region 3 for antibody 40138
ARDLKLTSYYYDSSDDHYFDY

SEQ ID NO: 80277 - protein, 11 aa, Homo sapiens
  light chain complementarity determining region 3 for antibody 40139
QQRQESTNWLN

SEQ ID NO: 80278 - protein, 15 aa, Homo sapiens
  heavy chain complementarity determining region 3 for antibody 40139
ARGGYSSNWYWWFDP

SEQ ID NO: 80279 - protein, 9 aa, Homo sapiens
  light chain complementarity determining region 3 for antibody 40140
QQYGSSPQT

SEQ ID NO: 80280 - protein, 12 aa, Homo sapiens
  heavy chain complementarity determining region 3 for antibody 40140
ARNGYSSSWYRN

SEQ ID NO: 80281 - protein, 9 aa, Homo sapiens
  light chain complementarity determining region 3 for antibody 40141
QQAHSFPRT

SEQ ID NO: 80282 - protein, 13 aa, Homo sapiens
  heavy chain complementarity determining region 3 for antibody 40141
ATSHDYGDSALDS

SEQ ID NO: 80283 - protein, 10 aa, Homo sapiens
  light chain complementarity determining region 3 for antibody 40142
QQYGTAPPYT

SEQ ID NO: 80284 - protein, 12 aa, Homo sapiens
  heavy chain complementarity determining region 3 for antibody 40142
ANEVGPAPAYDV

SEQ ID NO: 80285 - protein, 9 aa, Homo sapiens
  light chain complementarity determining region 3 for antibody 40143
QKYNRAPFT

SEQ ID NO: 80286 - protein, 17 aa, Homo sapiens
  heavy chain complementarity determining region 3 for antibody 40143
ARGGAYYDSSGYDQFDY

SEQ ID NO: 80287 - protein, 8 aa, Homo sapiens
  light chain complementarity determining region 3 for antibody 40144
QQYDMWPT

SEQ ID NO: 80288 - protein, 16 aa, Homo sapiens
  heavy chain complementarity determining region 3 for antibody 40144
ARHLGGRHGVRSVLGH

SEQ ID NO: 80289 - protein, 10 aa, Homo sapiens
  light chain complementarity determining region 3 for antibody 40145
QQRYNWPPYT

SEQ ID NO: 80290 - protein, 11 aa, Homo sapiens
  heavy chain complementarity determining region 3 for antibody 40145
ARGVGSYVFES

SEQ ID NO: 80291 - protein, 11 aa, Homo sapiens
  light chain complementarity determining region 3 for antibody 40146
QQRSNWPPGAT

SEQ ID NO: 80292 - protein, 11 aa, Homo sapiens
  heavy chain complementarity determining region 3 for antibody 40146
ARGTSVWYFDL

SEQ ID NO: 80293 - protein, 9 aa, Homo sapiens
  light chain complementarity determining region 3 for antibody 40147
QQSHTSPPT

SEQ ID NO: 80294 - protein, 15 aa, Homo sapiens
  heavy chain complementarity determining region 3 for antibody 40147
ARGSDLEDPPGAFDL

SEQ ID NO: 80295 - protein, 8 aa, Homo sapiens
  light chain complementarity determining region 3 for antibody 40148
QQYDTNSS

SEQ ID NO: 80296 - protein, 16 aa, Homo sapiens
  heavy chain complementarity determining region 3 for antibody 40148
ARVISKWESILDAFKM

SEQ ID NO: 80297 - protein, 9 aa, Homo sapiens
  light chain complementarity determining region 3 for antibody 40149
QQCATSPLT

SEQ ID NO: 80298 - protein, 11 aa, Homo sapiens
  heavy chain complementarity determining region 3 for antibody 40149
VRDRGWLQHDY

SEQ ID NO: 80299 - protein, 9 aa, Homo sapiens
  light chain complementarity determining region 3 for antibody 40150
QQYGSSPIT

SEQ ID NO: 80300 - protein, 15 aa, Homo sapiens
  heavy chain complementarity determining region 3 for antibody 40150
ARVLLVGFEEYYFDY

SEQ ID NO: 80301 - protein, 9 aa, Homo sapiens
  light chain complementarity determining region 3 for antibody 40151
QQYGHSQYT

SEQ ID NO: 80302 - protein, 8 aa, Homo sapiens
  heavy chain complementarity determining region 3 for antibody 40151
ARARYFDY

SEQ ID NO: 80303 - protein, 9 aa, Homo sapiens
  light chain complementarity determining region 3 for antibody 40152
QQSHITPIT

SEQ ID NO: 80304 - protein, 10 aa, Homo sapiens
  heavy chain complementarity determining region 3 for antibody 40152
TRSKGYGMDV

SEQ ID NO: 80305 - protein, 9 aa, Homo sapiens
  light chain complementarity determining region 3 for antibody 40153
MQGTHWPLT

SEQ ID NO: 80306 - protein, 9 aa, Homo sapiens
  heavy chain complementarity determining region 3 for antibody 40153
TWSNSGGDY

SEQ ID NO: 80307 - protein, 9 aa, Homo sapiens
  light chain complementarity determining region 3 for antibody 40154
QQYGDSPWT

SEQ ID NO: 80308 - protein, 11 aa, Homo sapiens
  heavy chain complementarity determining region 3 for antibody 40154
ARIDVTVGYDI

SEQ ID NO: 80309 - protein, 9 aa, Homo sapiens
  light chain complementarity determining region 3 for antibody 40155
QQYGSSPLT

SEQ ID NO: 80310 - protein, 19 aa, Homo sapiens
  heavy chain complementarity determining region 3 for antibody 40155
ATVSTYPSGSLGILGTFDF

SEQ ID NO: 80311 - protein, 9 aa, Homo sapiens
  light chain complementarity determining region 3 for antibody 40156
QQYGSSPFT

SEQ ID NO: 80312 - protein, 12 aa, Homo sapiens
  heavy chain complementarity determining region 3 for antibody 40156
ARMLGFGSGLAY

SEQ ID NO: 80313 - protein, 9 aa, Homo sapiens
  light chain complementarity determining region 3 for antibody 40157
QQRSNWPLT

SEQ ID NO: 80314 - protein, 14 aa, Homo sapiens
  heavy chain complementarity determining region 3 for antibody 40157
ARHGAAGRIAWFDP

SEQ ID NO: 80315 - protein, 9 aa, Homo sapiens
  light chain complementarity determining region 3 for antibody 40158
MQALQTPGT

SEQ ID NO: 80316 - protein, 18 aa, Homo sapiens
  heavy chain complementarity determining region 3 for antibody 40158
AASGRYFFQNSGPLGFGY

SEQ ID NO: 80317 - protein, 9 aa, Homo sapiens
  light chain complementarity determining region 3 for antibody 40159
QQYNDHGVT

SEQ ID NO: 80318 - protein, 9 aa, Homo sapiens
  heavy chain complementarity determining region 3 for antibody 40159
ARGPIHFDY

SEQ ID NO: 80319 - protein, 10 aa, Homo sapiens
  light chain complementarity determining region 3 for antibody 40160
QQRSNWPPLT

SEQ ID NO: 80320 - protein, 11 aa, Homo sapiens
  heavy chain complementarity determining region 3 for antibody 40160
AGWRPTRHFDY

SEQ ID NO: 80321 - protein, 9 aa, Homo sapiens
  light chain complementarity determining region 3 for antibody 40161
QQYGSSPWT

SEQ ID NO: 80322 - protein, 11 aa, Homo sapiens
  heavy chain complementarity determining region 3 for antibody 40161
ARDAQWGWLDP

SEQ ID NO: 80323 - protein, 10 aa, Homo sapiens
  light chain complementarity determining region 3 for antibody 40162
QQRSNWPPYT

SEQ ID NO: 80324 - protein, 11 aa, Homo sapiens
  heavy chain complementarity determining region 3 for antibody 40162
ARGVGSYPFDS

SEQ ID NO: 80325 - protein, 9 aa, Homo sapiens
  light chain complementarity determining region 3 for antibody 40163
QQANRFPFT

SEQ ID NO: 80326 - protein, 13 aa, Homo sapiens
  heavy chain complementarity determining region 3 for antibody 40163
ARGTGGNYKMFDS

SEQ ID NO: 80327 - protein, 9 aa, Homo sapiens
  light chain complementarity determining region 3 for antibody 40164
VQYNRYPRT

SEQ ID NO: 80328 - protein, 6 aa, Homo sapiens
  heavy chain complementarity determining region 3 for antibody 40164
TRALDY

SEQ ID NO: 80329 - protein, 9 aa, Homo sapiens
  light chain complementarity determining region 3 for antibody 40165
QRYNDYPFT

SEQ ID NO: 80330 - protein, 13 aa, Homo sapiens
  heavy chain complementarity determining region 3 for antibody 40165
ARIPRYSSGWSDY

SEQ ID NO: 80331 - protein, 8 aa, Homo sapiens
  light chain complementarity determining region 3 for antibody 40166
QQYNSRWT

SEQ ID NO: 80332 - protein, 14 aa, Homo sapiens
  heavy chain complementarity determining region 3 for antibody 40166
ARDGGRLLYDAFDL

SEQ ID NO: 80333 - protein, 9 aa, Homo sapiens
  light chain complementarity determining region 3 for antibody 40167
LQHDNFLWT

SEQ ID NO: 80334 - protein, 14 aa, Homo sapiens
  heavy chain complementarity determining region 3 for antibody 40167
ARDRRQWQHDGFDI

SEQ ID NO: 80335 - protein, 8 aa, Homo sapiens
  light chain complementarity determining region 3 for antibody 40168
QQYGNSRT

SEQ ID NO: 80336 - protein, 15 aa, Homo sapiens
  heavy chain complementarity determining region 3 for antibody 40168
AKTDYCSAANCPFDS

SEQ ID NO: 80337 - protein, 9 aa, Homo sapiens
  light chain complementarity determining region 3 for antibody 40169
QHRNNWPPS

SEQ ID NO: 80338 - protein, 17 aa, Homo sapiens
  heavy chain complementarity determining region 3 for antibody 40169
ASEGGYCYSTSCRYFDY

SEQ ID NO: 80339 - protein, 6 aa, Homo sapiens
  light chain complementarity determining region 3 for antibody 40170
QQYGAT

SEQ ID NO: 80340 - protein, 12 aa, Homo sapiens
  heavy chain complementarity determining region 3 for antibody 40170
ARDHISGWSLSN

SEQ ID NO: 80341 - protein, 9 aa, Homo sapiens
  light chain complementarity determining region 3 for antibody 40171
QQTYSPPFT

SEQ ID NO: 80342 - protein, 14 aa, Homo sapiens
  heavy chain complementarity determining region 3 for antibody 40171
ARGRDTSGYSGLDY

SEQ ID NO: 80343 - protein, 9 aa, Homo sapiens
  light chain complementarity determining region 3 for antibody 40172
QQGYNTPFT

SEQ ID NO: 80344 - protein, 15 aa, Homo sapiens
  heavy chain complementarity determining region 3 for antibody 40172
TKAQVIWGQLYYFES

SEQ ID NO: 80345 - protein, 9 aa, Homo sapiens
  light chain complementarity determining region 3 for antibody 40173
QQYTGAPLT

SEQ ID NO: 80346 - protein, 11 aa, Homo sapiens
  heavy chain complementarity determining region 3 for antibody 40173
ARRGVTPALDI

SEQ ID NO: 80347 - protein, 9 aa, Homo sapiens
  light chain complementarity determining region 3 for antibody 40174
QQSYSTPLS

SEQ ID NO: 80348 - protein, 14 aa, Homo sapiens
  heavy chain complementarity determining region 3 for antibody 40174
ARSSDTSGYSRFDY

SEQ ID NO: 80349 - protein, 8 aa, Homo sapiens
  light chain complementarity determining region 3 for antibody 40175
QQYRDSFP

SEQ ID NO: 80350 - protein, 13 aa, Homo sapiens
  heavy chain complementarity determining region 3 for antibody 40175
ATESGSYQGAFDI

SEQ ID NO: 80351 - protein, 9 aa, Homo sapiens
  light chain complementarity determining region 3 for antibody 40176
QQYDIFPLT

SEQ ID NO: 80352 - protein, 12 aa, Homo sapiens
  heavy chain complementarity determining region 3 for antibody 40176
TTDRSYGYYSPH

SEQ ID NO: 80353 - protein, 9 aa, Homo sapiens
  light chain complementarity determining region 3 for antibody 40177
QQSYSIPRT

SEQ ID NO: 80354 - protein, 14 aa, Homo sapiens
  heavy chain complementarity determining region 3 for antibody 40177
AENQYSSGSLSSDI

SEQ ID NO: 80355 - protein, 9 aa, Homo sapiens
  light chain complementarity determining region 3 for antibody 40178
QQYGTSPFT

SEQ ID NO: 80356 - protein, 9 aa, Homo sapiens
  heavy chain complementarity determining region 3 for antibody 40178
ARGAGSLSY

SEQ ID NO: 80357 - protein, 9 aa, Homo sapiens
  light chain complementarity determining region 3 for antibody 40179
MQALQIPFT

SEQ ID NO: 80358 - protein, 12 aa, Homo sapiens
  heavy chain complementarity determining region 3 for antibody 40179
ARGRVGGNSFDQ

SEQ ID NO: 80359 - protein, 9 aa, Homo sapiens
  light chain complementarity determining region 3 for antibody 40180
HQYFSSPET

SEQ ID NO: 80360 - protein, 12 aa, Homo sapiens
  heavy chain complementarity determining region 3 for antibody 40180
TTYAFYGLGRSS

SEQ ID NO: 80361 - protein, 9 aa, Homo sapiens
  light chain complementarity determining region 3 for antibody 40181
QQSYSSLYT

SEQ ID NO: 80362 - protein, 12 aa, Homo sapiens
  heavy chain complementarity determining region 3 for antibody 40181
ARLRYGGSFFDF

SEQ ID NO: 80363 - protein, 9 aa, Homo sapiens
  light chain complementarity determining region 3 for antibody 40182
QQSYSIPWT

SEQ ID NO: 80364 - protein, 14 aa, Homo sapiens
  heavy chain complementarity determining region 3 for antibody 40182
ARVRNYYASGDWDY

SEQ ID NO: 80365 - protein, 9 aa, Homo sapiens
  light chain complementarity determining region 3 for antibody 40183
QQSHTTPLT

SEQ ID NO: 80366 - protein, 13 aa, Homo sapiens
  heavy chain complementarity determining region 3 for antibody 40183
ARDAYDGDWYFDI

SEQ ID NO: 80367 - protein, 8 aa, Homo sapiens
  light chain complementarity determining region 3 for antibody 40184
QQYGRSLT

SEQ ID NO: 80368 - protein, 17 aa, Homo sapiens
  heavy chain complementarity determining region 3 for antibody 40184
ASIYDSTGYYYGGYFQH

SEQ ID NO: 80369 - protein, 9 aa, Homo sapiens
  light chain complementarity determining region 3 for antibody 40185
LQDYNYPRT

SEQ ID NO: 80370 - protein, 18 aa, Homo sapiens
  heavy chain complementarity determining region 3 for antibody 40185
ARDESPKFGSNIYDAFDM

SEQ ID NO: 80371 - protein, 10 aa, Homo sapiens
  light chain complementarity determining region 3 for antibody 40186
QQYNNWPPWA

SEQ ID NO: 80372 - protein, 13 aa, Homo sapiens
  heavy chain complementarity determining region 3 for antibody 40186
ARTLGGSYAYLDF

SEQ ID NO: 80373 - protein, 10 aa, Homo sapiens
  light chain complementarity determining region 3 for antibody 40187
QQRSNWPPIT

SEQ ID NO: 80374 - protein, 17 aa, Homo sapiens
  heavy chain complementarity determining region 3 for antibody 40187
AAGYHSESLSADEVFDI

SEQ ID NO: 80375 - protein, 9 aa, Homo sapiens
  light chain complementarity determining region 3 for antibody 40188
QQRNDWLIT

SEQ ID NO: 80376 - protein, 12 aa, Homo sapiens
  heavy chain complementarity determining region 3 for antibody 40188
ARTSLTGTALDY

SEQ ID NO: 80377 - protein, 9 aa, Homo sapiens
  light chain complementarity determining region 3 for antibody 40189
HQYASPPLT

SEQ ID NO: 80378 - protein, 10 aa, Homo sapiens
  heavy chain complementarity determining region 3 for antibody 40189
AHGAGWTHDI

SEQ ID NO: 80379 - protein, 10 aa, Homo sapiens
  light chain complementarity determining region 3 for antibody 40190
QQYYISPQYT

SEQ ID NO: 80380 - protein, 17 aa, Homo sapiens
  heavy chain complementarity determining region 3 for antibody 40190
VREFINSRGDYTGALDL

SEQ ID NO: 80381 - protein, 9 aa, Homo sapiens
  light chain complementarity determining region 3 for antibody 40191
QQYDDSPLT

SEQ ID NO: 80382 - protein, 12 aa, Homo sapiens
  heavy chain complementarity determining region 3 for antibody 40191
ASGSKGFGESHY

SEQ ID NO: 80383 - protein, 9 aa, Homo sapiens
  light chain complementarity determining region 3 for antibody 40192
QQTYSPPFT

SEQ ID NO: 80384 - protein, 14 aa, Homo sapiens
  heavy chain complementarity determining region 3 for antibody 40192
ARGRDTSGYSGLDH

SEQ ID NO: 80385 - protein, 9 aa, Homo sapiens
  light chain complementarity determining region 3 for antibody 40193
QQGRNFPWT

SEQ ID NO: 80386 - protein, 10 aa, Homo sapiens
  heavy chain complementarity determining region 3 for antibody 40193
ARDHVWAFDS

SEQ ID NO: 80387 - protein, 9 aa, Homo sapiens
  light chain complementarity determining region 3 for antibody 40194
QQYNSYSST

SEQ ID NO: 80388 - protein, 17 aa, Homo sapiens
  heavy chain complementarity determining region 3 for antibody 40194
AKDIFFGIAVAGTAFDI

SEQ ID NO: 80389 - protein, 7 aa, Homo sapiens
  light chain complementarity determining region 3 for antibody 40195
QQYDSST

SEQ ID NO: 80390 - protein, 15 aa, Homo sapiens
  heavy chain complementarity determining region 3 for antibody 40195
ARIRMAVVLRDAFDI

SEQ ID NO: 80391 - protein, 9 aa, Homo sapiens
  light chain complementarity determining region 3 for antibody 40196
QQRSNWPFT

SEQ ID NO: 80392 - protein, 16 aa, Homo sapiens
  heavy chain complementarity determining region 3 for antibody 40196
ARELARRNTYYHAFEI

SEQ ID NO: 80393 - protein, 9 aa, Homo sapiens
  light chain complementarity determining region 3 for antibody 40197
QQNYNLPYT

SEQ ID NO: 80394 - protein, 11 aa, Homo sapiens
  heavy chain complementarity determining region 3 for antibody 40197
ARGLSPGLFDF

SEQ ID NO: 80395 - protein, 9 aa, Homo sapiens
  light chain complementarity determining region 3 for antibody 40198
QQGYSTPLI

SEQ ID NO: 80396 - protein, 15 aa, Homo sapiens
  heavy chain complementarity determining region 3 for antibody 40198
ARAQVIWGQLYYFDY

SEQ ID NO: 80397 - protein, 9 aa, Homo sapiens
  light chain complementarity determining region 3 for antibody 40199
QQYVDSPIT

SEQ ID NO: 80398 - protein, 17 aa, Homo sapiens
  heavy chain complementarity determining region 3 for antibody 40199
VRIGGASGLYVAEYFQH

SEQ ID NO: 80399 - protein, 10 aa, Homo sapiens
  light chain complementarity determining region 3 for antibody 40200
QQYGGSPRYT

SEQ ID NO: 80400 - protein, 16 aa, Homo sapiens
  heavy chain complementarity determining region 3 for antibody 40200
ARVIWVRGLMTPAFDY

SEQ ID NO: 80401 - protein, 10 aa, Homo sapiens
  light chain complementarity determining region 3 for antibody 40201
QQYGGSPQYT

SEQ ID NO: 80402 - protein, 15 aa, Homo sapiens
  heavy chain complementarity determining region 3 for antibody 40201
ARDDRFASRWHSLDS

SEQ ID NO: 80403 - protein, 9 aa, Homo sapiens
  light chain complementarity determining region 3 for antibody 40202
QQTYSTPRT

SEQ ID NO: 80404 - protein, 14 aa, Homo sapiens
  heavy chain complementarity determining region 3 for antibody 40202
ARVAHFHGVGPLDY

SEQ ID NO: 80405 - protein, 10 aa, Homo sapiens
  light chain complementarity determining region 3 for antibody 40203
QQSYRTPPFT

SEQ ID NO: 80406 - protein, 14 aa, Homo sapiens
  heavy chain complementarity determining region 3 for antibody 40203
AKVEPYGDNHRFDY

SEQ ID NO: 80407 - protein, 10 aa, Homo sapiens
  light chain complementarity determining region 3 for antibody 40204
QQRSTWPPIT

SEQ ID NO: 80408 - protein, 11 aa, Homo sapiens
  heavy chain complementarity determining region 3 for antibody 40204
TTEPRHYYFDY

SEQ ID NO: 80409 - protein, 9 aa, Homo sapiens
  light chain complementarity determining region 3 for antibody 40205
QQYRRSPST

SEQ ID NO: 80410 - protein, 17 aa, Homo sapiens
  heavy chain complementarity determining region 3 for antibody 40205
AGLSSRLGDGSPSLFDY

SEQ ID NO: 80411 - protein, 8 aa, Homo sapiens
  light chain complementarity determining region 3 for antibody 40206
QQYIHWWT

SEQ ID NO: 80412 - protein, 11 aa, Homo sapiens
  heavy chain complementarity determining region 3 for antibody 40206
ARLSVVNYFDY

SEQ ID NO: 80413 - protein, 9 aa, Homo sapiens
  light chain complementarity determining region 3 for antibody 40207
QQYGSSPFT

SEQ ID NO: 80414 - protein, 16 aa, Homo sapiens
  heavy chain complementarity determining region 3 for antibody 40207
VRFGPDTVTLRDAFDI

SEQ ID NO: 80415 - protein, 9 aa, Homo sapiens
  light chain complementarity determining region 3 for antibody 40208
QQSYSIPLT

SEQ ID NO: 80416 - protein, 12 aa, Homo sapiens
  heavy chain complementarity determining region 3 for antibody 40208
TWSSLVSLWFGD

SEQ ID NO: 80417 - protein, 9 aa, Homo sapiens
  light chain complementarity determining region 3 for antibody 40209
QQANSFPRT

SEQ ID NO: 80418 - protein, 16 aa, Homo sapiens
  heavy chain complementarity determining region 3 for antibody 40209
ARESYSCGGGSCYFDF

SEQ ID NO: 80419 - protein, 9 aa, Homo sapiens
  light chain complementarity determining region 3 for antibody 40210
QQYYSSPYT

SEQ ID NO: 80420 - protein, 23 aa, Homo sapiens
  heavy chain complementarity determining region 3 for antibody 40210
ARGVTDCSGRNCYGGEVINAFDV

SEQ ID NO: 80421 - protein, 9 aa, Homo sapiens
  light chain complementarity determining region 3 for antibody 40211
QQYGTSPWA

SEQ ID NO: 80422 - protein, 22 aa, Homo sapiens
  heavy chain complementarity determining region 3 for antibody 40211
TRVSIGIYDTVNGYYHPGPMDS

SEQ ID NO: 80423 - protein, 9 aa, Homo sapiens
  light chain complementarity determining region 3 for antibody 40212
QQYAGSPGT

SEQ ID NO: 80424 - protein, 8 aa, Homo sapiens
  heavy chain complementarity determining region 3 for antibody 40212
ARGLSLDS

SEQ ID NO: 80425 - protein, 8 aa, Homo sapiens
  light chain complementarity determining region 3 for antibody 40213
QQRSNSWT

SEQ ID NO: 80426 - protein, 12 aa, Homo sapiens
  heavy chain complementarity determining region 3 for antibody 40213
ARFPSYTSYFDY

SEQ ID NO: 80427 - protein, 9 aa, Homo sapiens
  light chain complementarity determining region 3 for antibody 40214
MQGTHWPPT

SEQ ID NO: 80428 - protein, 11 aa, Homo sapiens
  heavy chain complementarity determining region 3 for antibody 40214
ATGPQVTMPQD

SEQ ID NO: 80429 - protein, 8 aa, Homo sapiens
  light chain complementarity determining region 3 for antibody 40215
QQYGSSLT

SEQ ID NO: 80430 - protein, 12 aa, Homo sapiens
  heavy chain complementarity determining region 3 for antibody 40215
AREMSMENAFDI

SEQ ID NO: 80431 - protein, 10 aa, Homo sapiens
  light chain complementarity determining region 3 for antibody 40216
QQYGGSPLYT

SEQ ID NO: 80432 - protein, 18 aa, Homo sapiens
  heavy chain complementarity determining region 3 for antibody 40216
ARDHGTALRTSNLRAFDI

SEQ ID NO: 80433 - protein, 10 aa, Homo sapiens
  light chain complementarity determining region 3 for antibody 40217
QQRYNWPPYT

SEQ ID NO: 80434 - protein, 15 aa, Homo sapiens
  heavy chain complementarity determining region 3 for antibody 40217
ARGATSGYQEYYFDY

SEQ ID NO: 80435 - protein, 9 aa, Homo sapiens
  light chain complementarity determining region 3 for antibody 40218
QQRKNWPWT

SEQ ID NO: 80436 - protein, 12 aa, Homo sapiens
  heavy chain complementarity determining region 3 for antibody 40218
ARVGGPRLPLDY

SEQ ID NO: 80437 - protein, 9 aa, Homo sapiens
  light chain complementarity determining region 3 for antibody 40219
QQYGSSPLT

SEQ ID NO: 80438 - protein, 16 aa, Homo sapiens
  heavy chain complementarity determining region 3 for antibody 40219
ARGLPLVRGVISPMDV

SEQ ID NO: 80439 - protein, 9 aa, Homo sapiens
  light chain complementarity determining region 3 for antibody 40220
QQSYSSIRT

SEQ ID NO: 80440 - protein, 14 aa, Homo sapiens
  heavy chain complementarity determining region 3 for antibody 40220
ARRYCSGETCPEDY

SEQ ID NO: 80441 - protein, 9 aa, Homo sapiens
  light chain complementarity determining region 3 for antibody 40221
QQRNNWPVT

SEQ ID NO: 80442 - protein, 16 aa, Homo sapiens
  heavy chain complementarity determining region 3 for antibody 40221
AGTSISRAGPAQHFHY

SEQ ID NO: 80443 - protein, 8 aa, Homo sapiens
  light chain complementarity determining region 3 for antibody 40222
HQYGSKTT

SEQ ID NO: 80444 - protein, 11 aa, Homo sapiens
  heavy chain complementarity determining region 3 for antibody 40222
GRKPTGWPFDY

SEQ ID NO: 80445 - protein, 9 aa, Homo sapiens
  light chain complementarity determining region 3 for antibody 40223
QQYGSPPYT

SEQ ID NO: 80446 - protein, 12 aa, Homo sapiens
  heavy chain complementarity determining region 3 for antibody 40223
ATAPWGYGYSMG

SEQ ID NO: 80447 - protein, 9 aa, Homo sapiens
  light chain complementarity determining region 3 for antibody 40224
QQSHSTPIT

SEQ ID NO: 80448 - protein, 10 aa, Homo sapiens
  heavy chain complementarity determining region 3 for antibody 40224
SRSEGYGMDV

SEQ ID NO: 80449 - protein, 9 aa, Homo sapiens
  light chain complementarity determining region 3 for antibody 40225
QQFKIYPFT

SEQ ID NO: 80450 - protein, 14 aa, Homo sapiens
  heavy chain complementarity determining region 3 for antibody 40225
AKAKDSSGYHSFDY

SEQ ID NO: 80451 - protein, 9 aa, Homo sapiens
  light chain complementarity determining region 3 for antibody 40226
QKYNRVPFT

SEQ ID NO: 80452 - protein, 14 aa, Homo sapiens
  heavy chain complementarity determining region 3 for antibody 40226
AREIAGPGPQPLDY

SEQ ID NO: 80453 - protein, 8 aa, Homo sapiens
  light chain complementarity determining region 3 for antibody 40227
MQGVQPYP

SEQ ID NO: 80454 - protein, 7 aa, Homo sapiens
  heavy chain complementarity determining region 3 for antibody 40227
ATKMGDY

SEQ ID NO: 80455 - protein, 9 aa, Homo sapiens
  light chain complementarity determining region 3 for antibody 40228
QQYGSSPFT

SEQ ID NO: 80456 - protein, 18 aa, Homo sapiens
  heavy chain complementarity determining region 3 for antibody 40228
AARGANCGGDCYYWYFDL

SEQ ID NO: 80457 - protein, 9 aa, Homo sapiens
  light chain complementarity determining region 3 for antibody 40229
QQSYSKPVT

SEQ ID NO: 80458 - protein, 11 aa, Homo sapiens
  heavy chain complementarity determining region 3 for antibody 40229
ARGGNWEYFDY

SEQ ID NO: 80459 - protein, 9 aa, Homo sapiens
  light chain complementarity determining region 3 for antibody 40230
QQSFSTPRT

SEQ ID NO: 80460 - protein, 13 aa, Homo sapiens
  heavy chain complementarity determining region 3 for antibody 40230
ARDWSGSGYPLDY

SEQ ID NO: 80461 - protein, 10 aa, Homo sapiens
  light chain complementarity determining region 3 for antibody 40231
QQRSNWPPNT

SEQ ID NO: 80462 - protein, 12 aa, Homo sapiens
  heavy chain complementarity determining region 3 for antibody 40231
VKSGYSNGWYGH

SEQ ID NO: 80463 - protein, 10 aa, Homo sapiens
  light chain complementarity determining region 3 for antibody 40232
QQYNSYSLLT

SEQ ID NO: 80464 - protein, 13 aa, Homo sapiens
  heavy chain complementarity determining region 3 for antibody 40232
ARGGSVDQLLCHS

SEQ ID NO: 80465 - protein, 9 aa, Homo sapiens
  light chain complementarity determining region 3 for antibody 40233
QQYGSSPWT

SEQ ID NO: 80466 - protein, 15 aa, Homo sapiens
  heavy chain complementarity determining region 3 for antibody 40233
AREDVWGSGSAGFDY

SEQ ID NO: 80467 - protein, 9 aa, Homo sapiens
  light chain complementarity determining region 3 for antibody 40234
QQSYSTPYT

SEQ ID NO: 80468 - protein, 13 aa, Homo sapiens
  heavy chain complementarity determining region 3 for antibody 40234
ARVVEMATTIFDY

SEQ ID NO: 80469 - protein, 9 aa, Homo sapiens
  light chain complementarity determining region 3 for antibody 40235
QQSYSPPFT

SEQ ID NO: 80470 - protein, 14 aa, Homo sapiens
  heavy chain complementarity determining region 3 for antibody 40235
ARGRDTSGYSGVDY

SEQ ID NO: 80471 - protein, 9 aa, Homo sapiens
  light chain complementarity determining region 3 for antibody 40236
LQYNSFPYT

SEQ ID NO: 80472 - protein, 13 aa, Homo sapiens
  heavy chain complementarity determining region 3 for antibody 40236
AREAGFGESHFDY

SEQ ID NO: 80473 - protein, 9 aa, Homo sapiens
  light chain complementarity determining region 3 for antibody 40237
LQHNSFPYT

SEQ ID NO: 80474 - protein, 16 aa, Homo sapiens
  heavy chain complementarity determining region 3 for antibody 40237
ATFGPTKALRTVAFDL

SEQ ID NO: 80475 - protein, 10 aa, Homo sapiens
  light chain complementarity determining region 3 for antibody 40238
QQYYDWPPKT

SEQ ID NO: 80476 - protein, 14 aa, Homo sapiens
  heavy chain complementarity determining region 3 for antibody 40238
ARDRIDMLRGYLDN

SEQ ID NO: 80477 - protein, 10 aa, Homo sapiens [sequence omitted]

SEQ ID NO: 80478 - protein, 16 aa, Homo sapiens
  heavy chain complementarity determining region 3 for antibody 40239
AKTRDLLLGLAHPFEY

SEQ ID NO: 80479 - protein, 9 aa, Homo sapiens
  light chain complementarity determining region 3 for antibody 40240
QQYGRSPLT

SEQ ID NO: 80480 - protein, 11 aa, Homo sapiens
  heavy chain complementarity determining region 3 for antibody 40240
AREGNYKPHDY

SEQ ID NO: 80481 - protein, 9 aa, Homo sapiens
  light chain complementarity determining region 3 for antibody 40241
QQYDILPYT

SEQ ID NO: 80482 - protein, 20 aa, Homo sapiens
  heavy chain complementarity determining region 3 for antibody 40241
AREDGYDYDSESVPRNWLDP

SEQ ID NO: 80483 - protein, 11 aa, Homo sapiens
  light chain complementarity determining region 3 for antibody 40242
QQSHMTLRMYT

SEQ ID NO: 80484 - protein, 14 aa, Homo sapiens
  heavy chain complementarity determining region 3 for antibody 40242
ARPRGSGWVSAFDI

SEQ ID NO: 80485 - protein, 9 aa, Homo sapiens
  light chain complementarity determining region 3 for antibody 40243
QQLNSYPRT

SEQ ID NO: 80486 - protein, 13 aa, Homo sapiens
  heavy chain complementarity determining region 3 for antibody 40243
ARGRSRDRHPFDT

SEQ ID NO: 80487 - protein, 9 aa, Homo sapiens
  light chain complementarity determining region 3 for antibody 40244
QQLNSYPPT

SEQ ID NO: 80488 - protein, 14 aa, Homo sapiens
  heavy chain complementarity determining region 3 for antibody 40244
ARENSVAGARAYDY

SEQ ID NO: 80489 - protein, 8 aa, Homo sapiens
  light chain complementarity determining region 3 for antibody 40245
QHYRDSFP

SEQ ID NO: 80490 - protein, 13 aa, Homo sapiens
  heavy chain complementarity determining region 3 for antibody 40245
ATESGSYQGAFDI

SEQ ID NO: 80491 - protein, 9 aa, Homo sapiens
  light chain complementarity determining region 3 for antibody 40246
LQHDNFPPT

SEQ ID NO: 80492 - protein, 19 aa, Homo sapiens
  heavy chain complementarity determining region 3 for antibody 40246
ARDSNRNYGGKAGYYAMDV

SEQ ID NO: 80493 - protein, 9 aa, Homo sapiens
  light chain complementarity determining region 3 for antibody 40247
HQYGTSPRT

SEQ ID NO: 80494 - protein, 13 aa, Homo sapiens
  heavy chain complementarity determining region 3 for antibody 40247
ATESGKYQGGLDY

SEQ ID NO: 80495 - protein, 9 aa, Homo sapiens
  light chain complementarity determining region 3 for antibody 40248
HQYASSVVT

SEQ ID NO: 80496 - protein, 17 aa, Homo sapiens
  heavy chain complementarity determining region 3 for antibody 40248
ATPQQQLIQAITDRLDF

SEQ ID NO: 80497 - protein, 10 aa, Homo sapiens
  light chain complementarity determining region 3 for antibody 40249
QQYGRSPPGT

SEQ ID NO: 80498 - protein, 15 aa, Homo sapiens
  heavy chain complementarity determining region 3 for antibody 40249
ARGGRHRERAAAADL

SEQ ID NO: 80499 - protein, 10 aa, Homo sapiens
  light chain complementarity determining region 3 for antibody 40250
QQYGGSPPWT

SEQ ID NO: 80500 - protein, 14 aa, Homo sapiens
  heavy chain complementarity determining region 3 for antibody 40250
AKTSRLFEWLPLDY

SEQ ID NO: 80501 - protein, 9 aa, Homo sapiens
  light chain complementarity determining region 3 for antibody 40251
QQYDNRPFT

SEQ ID NO: 80502 - protein, 13 aa, Homo sapiens
  heavy chain complementarity determining region 3 for antibody 40251
ARDLVIGGGAFDY

SEQ ID NO: 80503 - protein, 9 aa, Homo sapiens
  light chain complementarity determining region 3 for antibody 40252
QQSYITPLT

SEQ ID NO: 80504 - protein, 14 aa, Homo sapiens
  heavy chain complementarity determining region 3 for antibody 40252
ARRGDSYGDNWFDP

SEQ ID NO: 80505 - protein, 9 aa, Homo sapiens
  light chain complementarity determining region 3 for antibody 40253
LQDYNYPQT

SEQ ID NO: 80506 - protein, 11 aa, Homo sapiens
  heavy chain complementarity determining region 3 for antibody 40253
ARDSRTSGMDV

SEQ ID NO: 80507 - protein, 10 aa, Homo sapiens
  light chain complementarity determining region 3 for antibody 40254
QQYNSFSPVT

SEQ ID NO: 80508 - protein, 14 aa, Homo sapiens
  heavy chain complementarity determining region 3 for antibody 40254
ARRVAVAGMWYFDL

SEQ ID NO: 80509 - protein, 10 aa, Homo sapiens
  light chain complementarity determining region 3 for antibody 40255
QQYGGSPRYS

SEQ ID NO: 80510 - protein, 10 aa, Homo sapiens
  heavy chain complementarity determining region 3 for antibody 40255
AASDTAQFRY

SEQ ID NO: 80511 - protein, 9 aa, Homo sapiens
  light chain complementarity determining region 3 for antibody 40256
QQYGASPLI

SEQ ID NO: 80512 - protein, 12 aa, Homo sapiens
  heavy chain complementarity determining region 3 for antibody 40256
ARMGGSYFAFLY

SEQ ID NO: 80513 - protein, 11 aa, Homo sapiens
  light chain complementarity determining region 3 for antibody 40257
QQYDTSPPGYT

SEQ ID NO: 80514 - protein, 14 aa, Homo sapiens
  heavy chain complementarity determining region 3 for antibody 40257
ARETSNSRKRSFDQ

SEQ ID NO: 80515 - protein, 9 aa, Homo sapiens
  light chain complementarity determining region 3 for antibody 40258
QQSYTTPWT

SEQ ID NO: 80516 - protein, 12 aa, Homo sapiens
  heavy chain complementarity determining region 3 for antibody 40258
AKGRDYEVKFDS

SEQ ID NO: 80517 - protein, 10 aa, Homo sapiens
  light chain complementarity determining region 3 for antibody 40259
QQSFTTSPYT

SEQ ID NO: 80518 - protein, 12 aa, Homo sapiens
  heavy chain complementarity determining region 3 for antibody 40259
ARESPAGTFFDH

SEQ ID NO: 80519 - protein, 8 aa, Homo sapiens
  light chain complementarity determining region 3 for antibody 40260
QQRSNWWT

SEQ ID NO: 80520 - protein, 11 aa, Homo sapiens
  heavy chain complementarity determining region 3 for antibody 40260
ARGNENYYFDY

SEQ ID NO: 80521 - protein, 9 aa, Homo sapiens
  light chain complementarity determining region 3 for antibody 40261
QQGYSNPLS

SEQ ID NO: 80522 - protein, 15 aa, Homo sapiens
  heavy chain complementarity determining region 3 for antibody 40261
ARAQVIWGQLYYFDA

SEQ ID NO: 80523 - protein, 9 aa, Homo sapiens
  light chain complementarity determining region 3 for antibody 40262
QQGYRPPFI

SEQ ID NO: 80524 - protein, 15 aa, Homo sapiens
  heavy chain complementarity determining region 3 for antibody 40262
TRAQVIWGQLYYFDY

SEQ ID NO: 80525 - protein, 12 aa, Homo sapiens
  light chain complementarity determining region 3 for antibody 40263
QHRSNWPPGPLT

SEQ ID NO: 80526 - protein, 15 aa, Homo sapiens
  heavy chain complementarity determining region 3 for antibody 40263
VKDSSGWYWDDVFDV

SEQ ID NO: 80527 - protein, 10 aa, Homo sapiens
  light chain complementarity determining region 3 for antibody 40264
QETYSTPSIT

SEQ ID NO: 80528 - protein, 15 aa, Homo sapiens
  heavy chain complementarity determining region 3 for antibody 40264
ARDPGWTQTSYYFDY

SEQ ID NO: 80529 - protein, 9 aa, Homo sapiens
  light chain complementarity determining region 3 for antibody 40265
MQGTHWPRT

SEQ ID NO: 80530 - protein, 10 aa, Homo sapiens
  heavy chain complementarity determining region 3 for antibody 40265
IHTGDAWGDY

SEQ ID NO: 80531 - protein, 9 aa, Homo sapiens
  light chain complementarity determining region 3 for antibody 40266
HHYGNSPRT

SEQ ID NO: 80532 - protein, 13 aa, Homo sapiens
  heavy chain complementarity determining region 3 for antibody 40266
ATESGSYYGGLDY

SEQ ID NO: 80533 - protein, 8 aa, Homo sapiens
  light chain complementarity determining region 3 for antibody 40267
QQYGSSPT

SEQ ID NO: 80534 - protein, 14 aa, Homo sapiens
  heavy chain complementarity determining region 3 for antibody 40267
ARGAGRSSSLPFDY

SEQ ID NO: 80535 - protein, 8 aa, Homo sapiens
  light chain complementarity determining region 3 for antibody 40268
QQYGSSPT

SEQ ID NO: 80536 - protein, 13 aa, Homo sapiens
  heavy chain complementarity determining region 3 for antibody 40268
AKIGRIGVWYFDL

SEQ ID NO: 80537 - protein, 8 aa, Homo sapiens
  light chain complementarity determining region 3 for antibody 40269
QQYGDLVT

SEQ ID NO: 80538 - protein, 12 aa, Homo sapiens
  heavy chain complementarity determining region 3 for antibody 40269
ARATWFGVRFDS

SEQ ID NO: 80539 - protein, 8 aa, Homo sapiens
  light chain complementarity determining region 3 for antibody 40270
QQYDTYAT

SEQ ID NO: 80540 - protein, 16 aa, Homo sapiens
  heavy chain complementarity determining region 3 for antibody 40270
ARASGPGHGTGIILDT

SEQ ID NO: 80541 - protein, 9 aa, Homo sapiens
  light chain complementarity determining region 3 for antibody 40271
QQYDNLRLS

SEQ ID NO: 80542 - protein, 11 aa, Homo sapiens
  heavy chain complementarity determining region 3 for antibody 40271
ARVSSGLGNDS

SEQ ID NO: 80543 - protein, 8 aa, Homo sapiens
  light chain complementarity determining region 3 for antibody 40272
QQYAFSLT

SEQ ID NO: 80544 - protein, 15 aa, Homo sapiens
  heavy chain complementarity determining region 3 for antibody 40272
ARDAYTSSGTGYLDP

SEQ ID NO: 80545 - protein, 9 aa, Homo sapiens
  light chain complementarity determining region 3 for antibody 40273
QQSYSTPYT

SEQ ID NO: 80546 - protein, 12 aa, Homo sapiens
  heavy chain complementarity determining region 3 for antibody 40273
VHKGGRGNPFDV

SEQ ID NO: 80547 - protein, 8 aa, Homo sapiens
  light chain complementarity determining region 3 for antibody 40274
QQSYITDT

SEQ ID NO: 80548 - protein, 16 aa, Homo sapiens
  heavy chain complementarity determining region 3 for antibody 40274
AHRPYWGSGSYYAFDY

SEQ ID NO: 80549 - protein, 8 aa, Homo sapiens
  light chain complementarity determining region 3 for antibody 40275
QQRSNWWT

SEQ ID NO: 80550 - protein, 19 aa, Homo sapiens
  heavy chain complementarity determining region 3 for antibody 40275
VQESPYCRGSDCRLYYFDH

SEQ ID NO: 80551 - protein, 10 aa, Homo sapiens
  light chain complementarity determining region 3 for antibody 40276
QQRSNWPPIT

SEQ ID NO: 80552 - protein, 10 aa, Homo sapiens
  heavy chain complementarity determining region 3 for antibody 40276
ASGLGIQLPY

SEQ ID NO: 80553 - protein, 9 aa, Homo sapiens
  light chain complementarity determining region 3 for antibody 40277
QHYNSYPLT

SEQ ID NO: 80554 - protein, 10 aa, Homo sapiens
  heavy chain complementarity determining region 3 for antibody 40277
SKDTDYVIDY

SEQ ID NO: 80555 - protein, 9 aa, Homo sapiens
  light chain complementarity determining region 3 for antibody 40278
QHLNSYPLT

SEQ ID NO: 80556 - protein, 17 aa, Homo sapiens
  heavy chain complementarity determining region 3 for antibody 40278
ARGGGYYSGSGTYPFDY

SEQ ID NO: 80557 - protein, 8 aa, Homo sapiens
  light chain complementarity determining region 3 for antibody 40279
MQALQTPG

SEQ ID NO: 80558 - protein, 19 aa, Homo sapiens
  heavy chain complementarity determining region 3 for antibody 40279
ANFGSGNFYNVRYYYGMDV

SEQ ID NO: 80559 - protein, 9 aa, Homo sapiens
  light chain complementarity determining region 3 for antibody 40280
LQHDNFPWT

SEQ ID NO: 80560 - protein, 12 aa, Homo sapiens
  heavy chain complementarity determining region 3 for antibody 40280
AKDLSDYYGPDY

SEQ ID NO: 80561 - protein, 9 aa, Homo sapiens
  light chain complementarity determining region 3 for antibody 40281
HQSSLSPQT

SEQ ID NO: 80562 - protein, 17 aa, Homo sapiens
  heavy chain complementarity determining region 3 for antibody 40281
ARHVGNAGVTDEDWMDP

SEQ ID NO: 80563 - protein, 9 aa, Homo sapiens
  light chain complementarity determining region 3 for antibody 40282
QQYNSYSYT

SEQ ID NO: 80564 - protein, 11 aa, Homo sapiens
  heavy chain complementarity determining region 3 for antibody 40282
AREVGGRGFDY

SEQ ID NO: 80565 - protein, 9 aa, Homo sapiens
  light chain complementarity determining region 3 for antibody 40283
QQYGGSLWT

SEQ ID NO: 80566 - protein, 14 aa, Homo sapiens
  heavy chain complementarity determining region 3 for antibody 40283
ARKKDLVYYYALDV

SEQ ID NO: 80567 - protein, 9 aa, Homo sapiens
  light chain complementarity determining region 3 for antibody 40284
QHYIASPLT

SEQ ID NO: 80568 - protein, 12 aa, Homo sapiens
  heavy chain complementarity determining region 3 for antibody 40284
ARWGDGYNGGFY

SEQ ID NO: 80569 - protein, 10 aa, Homo sapiens
  light chain complementarity determining region 3 for antibody 40285
QHYGSPPPLT

SEQ ID NO: 80570 - protein, 14 aa, Homo sapiens
  heavy chain complementarity determining region 3 for antibody 40285
ARGGISSYYHHFDS

SEQ ID NO: 80571 - protein, 9 aa, Homo sapiens
  light chain complementarity determining region 3 for antibody 40286
HQYATFPWT

SEQ ID NO: 80572 - protein, 14 aa, Homo sapiens
  heavy chain complementarity determining region 3 for antibody 40286
ARLGYGAYRAAFDV

SEQ ID NO: 80573 - protein, 9 aa, Homo sapiens
  light chain complementarity determining region 3 for antibody 40287
HQHAYAPLT

SEQ ID NO: 80574 - protein, 10 aa, Homo sapiens
  heavy chain complementarity determining region 3 for antibody 40287
ARTSGWLGDY

SEQ ID NO: 80575 - protein, 9 aa, Homo sapiens
  light chain complementarity determining region 3 for antibody 40288
QRYGFSLFT

SEQ ID NO: 80576 - protein, 17 aa, Homo sapiens
  heavy chain complementarity determining region 3 for antibody 40288
AKDFPSRQLAAAHWFDP

SEQ ID NO: 80577 - protein, 7 aa, Homo sapiens
  light chain complementarity determining region 3 for antibody 40289
QQYYNFV

SEQ ID NO: 80578 - protein, 14 aa, Homo sapiens
  heavy chain complementarity determining region 3 for antibody 40289
ARTIWRMVGARFDI

SEQ ID NO: 80579 - protein, 8 aa, Homo sapiens
  light chain complementarity determining region 3 for antibody 40290
QQYRDSFP

SEQ ID NO: 80580 - protein, 13 aa, Homo sapiens
  heavy chain complementarity determining region 3 for antibody 40290
ATESGRYQGAFDF

SEQ ID NO: 80581 - protein, 9 aa, Homo sapiens
  light chain complementarity determining region 3 for antibody 40291
QQYNSDSWT

SEQ ID NO: 80582 - protein, 13 aa, Homo sapiens
  heavy chain complementarity determining region 3 for antibody 40291
ARGPDYDPGCLDY

SEQ ID NO: 80583 - protein, 9 aa, Homo sapiens
  light chain complementarity determining region 3 for antibody 40292
QQYGSLPLT

SEQ ID NO: 80584 - protein, 15 aa, Homo sapiens
  heavy chain complementarity determining region 3 for antibody 40292
AHRPNYYDKAGAFDI

SEQ ID NO: 80585 - protein, 10 aa, Homo sapiens
  light chain complementarity determining region 3 for antibody 40293
QQYDNWPPYT

SEQ ID NO: 80586 - protein, 17 aa, Homo sapiens
  heavy chain complementarity determining region 3 for antibody 40293
AVVYYYVSSGSNSAFDI

SEQ ID NO: 80587 - protein, 9 aa, Homo sapiens
  light chain complementarity determining region 3 for antibody 40294
QQYDAYPRT

SEQ ID NO: 80588 - protein, 14 aa, Homo sapiens
  heavy chain complementarity determining region 3 for antibody 40294
ARGLAVASNTPGGY

SEQ ID NO: 80589 - protein, 9 aa, Homo sapiens
  light chain complementarity determining region 3 for antibody 40295
QQSYSPPFT

SEQ ID NO: 80590 - protein, 14 aa, Homo sapiens
  heavy chain complementarity determining region 3 for antibody 40295
ASSYDSSGYSAMDV

SEQ ID NO: 80591 - protein, 9 aa, Homo sapiens
  light chain complementarity determining region 3 for antibody 40296
QQSYITPLT

SEQ ID NO: 80592 - protein, 14 aa, Homo sapiens
  heavy chain complementarity determining region 3 for antibody 40296
ARRGDSYGDNWLDP

SEQ ID NO: 80593 - protein, 9 aa, Homo sapiens
  light chain complementarity determining region 3 for antibody 40297
QQSHSLALT

SEQ ID NO: 80594 - protein, 16 aa, Homo sapiens
  heavy chain complementarity determining region 3 for antibody 40297
AKDSVSGTGSFEAFEH

SEQ ID NO: 80595 - protein, 9 aa, Homo sapiens
  light chain complementarity determining region 3 for antibody 40298
QQSAHSPLT

SEQ ID NO: 80596 - protein, 10 aa, Homo sapiens
  heavy chain complementarity determining region 3 for antibody 40298
AKGDGWLPDS

SEQ ID NO: 80597 - protein, 9 aa, Homo sapiens
  light chain complementarity determining region 3 for antibody 40299
QHYGSSPRT

SEQ ID NO: 80598 - protein, 14 aa, Homo sapiens
  heavy chain complementarity determining region 3 for antibody 40299
VRGIAVAGLGYFDY

SEQ ID NO: 80599 - protein, 8 aa, Homo sapiens
  light chain complementarity determining region 3 for antibody 40300
QQYTDLLT

SEQ ID NO: 80600 - protein, 12 aa, Homo sapiens
  heavy chain complementarity determining region 3 for antibody 40300
ARDTAGGVMGQY

SEQ ID NO: 80601 - protein, 9 aa, Homo sapiens
  light chain complementarity determining region 3 for antibody 40301
QQYREYPYT

SEQ ID NO: 80602 - protein, 15 aa, Homo sapiens
  heavy chain complementarity determining region 3 for antibody 40301
ATDRGINWAYSRFDS

SEQ ID NO: 80603 - protein, 8 aa, Homo sapiens
  light chain complementarity determining region 3 for antibody 40302
QQYHRLLT

SEQ ID NO: 80604 - protein, 16 aa, Homo sapiens
  heavy chain complementarity determining region 3 for antibody 40302
GRARRGEGITFGLIDN

SEQ ID NO: 80605 - protein, 9 aa, Homo sapiens
  light chain complementarity determining region 3 for antibody 40303
QQYGSSPWT

SEQ ID NO: 80606 - protein, 14 aa, Homo sapiens
  heavy chain complementarity determining region 3 for antibody 40303
ARGRDGYNFLPMDY

SEQ ID NO: 80607 - protein, 10 aa, Homo sapiens
  light chain complementarity determining region 3 for antibody 40304
QQYGSSPPMS

SEQ ID NO: 80608 - protein, 14 aa, Homo sapiens
  heavy chain complementarity determining region 3 for antibody 40304
ARELVVVVAEYFDY

SEQ ID NO: 80609 - protein, 9 aa, Homo sapiens
  light chain complementarity determining region 3 for antibody 40305
QQYGSAPPD

SEQ ID NO: 80610 - protein, 14 aa, Homo sapiens
  heavy chain complementarity determining region 3 for antibody 40305
ARDHNIPHYWYFDL

SEQ ID NO: 80611 - protein, 8 aa, Homo sapiens
  light chain complementarity determining region 3 for antibody 40306
QQYGNSPA

SEQ ID NO: 80612 - protein, 16 aa, Homo sapiens
  heavy chain complementarity determining region 3 for antibody 40306
ARMQPIRLGAPDAFDI

SEQ ID NO: 80613 - protein, 9 aa, Homo sapiens
  light chain complementarity determining region 3 for antibody 40307
QQTYSPPFT

SEQ ID NO: 80614 - protein, 14 aa, Homo sapiens
  heavy chain complementarity determining region 3 for antibody 40307
AKGRDTSGYSAFDI

SEQ ID NO: 80615 - protein, 10 aa, Homo sapiens
  light chain complementarity determining region 3 for antibody 40308
QQRSNWPPYT

SEQ ID NO: 80616 - protein, 13 aa, Homo sapiens
  heavy chain complementarity determining region 3 for antibody 40308
AREGYYGSGEFDL

SEQ ID NO: 80617 - protein, 9 aa, Homo sapiens
  light chain complementarity determining region 3 for antibody 40309
QQLGSSPCT

SEQ ID NO: 80618 - protein, 18 aa, Homo sapiens
  heavy chain complementarity determining region 3 for antibody 40309
ARESRDTVLLPALNWFDP

SEQ ID NO: 80619 - protein, 8 aa, Homo sapiens
  light chain complementarity determining region 3 for antibody 40310
QQHGSSIT

SEQ ID NO: 80620 - protein, 14 aa, Homo sapiens
  heavy chain complementarity determining region 3 for antibody 40310
ARDPFVGIPDYFDY

SEQ ID NO: 80621 - protein, 9 aa, Homo sapiens
  light chain complementarity determining region 3 for antibody 40311
QQAKSFPLS

SEQ ID NO: 80622 - protein, 14 aa, Homo sapiens
  heavy chain complementarity determining region 3 for antibody 40311
ARGPVGIAATSFDF

SEQ ID NO: 80623 - protein, 9 aa, Homo sapiens
  light chain complementarity determining region 3 for antibody 40312
QKYNRAPWT

SEQ ID NO: 80624 - protein, 12 aa, Homo sapiens
  heavy chain complementarity determining region 3 for antibody 40312
ATRAGITAIPDY

SEQ ID NO: 80625 - protein, 10 aa, Homo sapiens
  light chain complementarity determining region 3 for antibody 40313
QHRSNWPLIT

SEQ ID NO: 80626 - protein, 16 aa, Homo sapiens
  heavy chain complementarity determining region 3 for antibody 40313
ARSSYESSGYRYYFDN

SEQ ID NO: 80627 - protein, 9 aa, Homo sapiens
  light chain complementarity determining region 3 for antibody 40314
LQHDEFPFT

SEQ ID NO: 80628 - protein, 18 aa, Homo sapiens
  heavy chain complementarity determining region 3 for antibody 40314
ARDSDKRLGEWGLYGLDV

SEQ ID NO: 80629 - protein, 9 aa, Homo sapiens
  light chain complementarity determining region 3 for antibody 40315
QRLDSYPVT

SEQ ID NO: 80630 - protein, 15 aa, Homo sapiens
  heavy chain complementarity determining region 3 for antibody 40315
ARDIYAGSYYGPCDI

SEQ ID NO: 80631 - protein, 9 aa, Homo sapiens
  light chain complementarity determining region 3 for antibody 40316
QQYGSSLWT

SEQ ID NO: 80632 - protein, 13 aa, Homo sapiens
  heavy chain complementarity determining region 3 for antibody 40316
ARDDLLADNGFDY

SEQ ID NO: 80633 - protein, 9 aa, Homo sapiens
  light chain complementarity determining region 3 for antibody 40317
QQYGSPPIT

SEQ ID NO: 80634 - protein, 15 aa, Homo sapiens
  heavy chain complementarity determining region 3 for antibody 40317
ARAMGLIWFGEKLDP

SEQ ID NO: 80635 - protein, 9 aa, Homo sapiens
  light chain complementarity determining region 3 for antibody 40318
QQYGSGGLT

SEQ ID NO: 80636 - protein, 15 aa, Homo sapiens
  heavy chain complementarity determining region 3 for antibody 40318
ARARLPDRMLYAFDV

SEQ ID NO: 80637 - protein, 9 aa, Homo sapiens
  light chain complementarity determining region 3 for antibody 40319
QQYGRSPRT

SEQ ID NO: 80638 - protein, 13 aa, Homo sapiens
  heavy chain complementarity determining region 3 for antibody 40319
ARDVKGRYYDGSD

SEQ ID NO: 80639 - protein, 10 aa, Homo sapiens
  light chain complementarity determining region 3 for antibody 40320
QQYGFSPPIT

SEQ ID NO: 80640 - protein, 16 aa, Homo sapiens
  heavy chain complementarity determining region 3 for antibody 40320
ARDALGYSSGVDAFDL

SEQ ID NO: 80641 - protein, 9 aa, Homo sapiens
  light chain complementarity determining region 3 for antibody 40321
QQYESSLWT

SEQ ID NO: 80642 - protein, 12 aa, Homo sapiens
  heavy chain complementarity determining region 3 for antibody 40321
ARDFGLYQEPDS

SEQ ID NO: 80643 - protein, 9 aa, Homo sapiens
  light chain complementarity determining region 3 for antibody 40322
QQSHSPPWT

SEQ ID NO: 80644 - protein, 13 aa, Homo sapiens
  heavy chain complementarity determining region 3 for antibody 40322
ARGVAAAGYQFDY

SEQ ID NO: 80645 - protein, 9 aa, Homo sapiens
  light chain complementarity determining region 3 for antibody 40323
QQSGSSPWT

SEQ ID NO: 80646 - protein, 13 aa, Homo sapiens
  heavy chain complementarity determining region 3 for antibody 40323
ARVNSGWSSTTDF

SEQ ID NO: 80647 - protein, 9 aa, Homo sapiens
  light chain complementarity determining region 3 for antibody 40324
QQSFRTLYT

SEQ ID NO: 80648 - protein, 10 aa, Homo sapiens
  heavy chain complementarity determining region 3 for antibody 40324
ARDRYGPFDF

SEQ ID NO: 80649 - protein, 9 aa, Homo sapiens
  light chain complementarity determining region 3 for antibody 40325
QQSDSTPYT

SEQ ID NO: 80650 - protein, 15 aa, Homo sapiens
  heavy chain complementarity determining region 3 for antibody 40325
ARLFLFRGFLVMLDY

SEQ ID NO: 80651 - protein, 9 aa, Homo sapiens
  light chain complementarity determining region 3 for antibody 40326
QQRDNWPRT

SEQ ID NO: 80652 - protein, 11 aa, Homo sapiens
  heavy chain complementarity determining region 3 for antibody 40326
ARARGSGSYNH

SEQ ID NO: 80653 - protein, 10 aa, Homo sapiens
  light chain complementarity determining region 3 for antibody 40327
QQLNSYPPFT

SEQ ID NO: 80654 - protein, 14 aa, Homo sapiens
  heavy chain complementarity determining region 3 for antibody 40327
AREAHDFWSGYLAY

SEQ ID NO: 80655 - protein, 9 aa, Homo sapiens
  light chain complementarity determining region 3 for antibody 40328
QHYGSSPIT

SEQ ID NO: 80656 - protein, 16 aa, Homo sapiens
  heavy chain complementarity determining region 3 for antibody 40328
ATGSSKGLLIRATFDY

SEQ ID NO: 80657 - protein, 10 aa, Homo sapiens
  light chain complementarity determining region 3 for antibody 40329
QHLETYSQLS

SEQ ID NO: 80658 - protein, 18 aa, Homo sapiens
  heavy chain complementarity determining region 3 for antibody 40329
VKFYVWILTGYSTDSVDI

SEQ ID NO: 80659 - protein, 9 aa, Homo sapiens
  light chain complementarity determining region 3 for antibody 40330
HQYDRSPLT

SEQ ID NO: 80660 - protein, 13 aa, Homo sapiens
  heavy chain complementarity determining region 3 for antibody 40330
ARRQTYTNYAFDI

SEQ ID NO: 80661 - protein, 10 aa, Homo sapiens
  light chain complementarity determining region 3 for antibody 40331
QRYGSSPLYA

SEQ ID NO: 80662 - protein, 12 aa, Homo sapiens
  heavy chain complementarity determining region 3 for antibody 40331
AGERDTTGCFDP

SEQ ID NO: 80663 - protein, 8 aa, Homo sapiens
  light chain complementarity determining region 3 for antibody 40332
QQYNSYYT

SEQ ID NO: 80664 - protein, 11 aa, Homo sapiens
  heavy chain complementarity determining region 3 for antibody 40332
TTHGRDPHLGY

SEQ ID NO: 80665 - protein, 9 aa, Homo sapiens
  light chain complementarity determining region 3 for antibody 40333
QQYNSYSKT

SEQ ID NO: 80666 - protein, 10 aa, Homo sapiens
  heavy chain complementarity determining region 3 for antibody 40333
ARDVVAGFDY

SEQ ID NO: 80667 - protein, 9 aa, Homo sapiens
  light chain complementarity determining region 3 for antibody 40334
QQYNSYPWT

SEQ ID NO: 80668 - protein, 24 aa, Homo sapiens
  heavy chain complementarity determining region 3 for antibody 40334
ARLRCDDYVWGSYRYCGDLFYFDS

SEQ ID NO: 80669 - protein, 9 aa, Homo sapiens
  light chain complementarity determining region 3 for antibody 40335
QQYNSYPWT

SEQ ID NO: 80670 - protein, 14 aa, Homo sapiens
  heavy chain complementarity determining region 3 for antibody 40335
AKEESSGWYRTADH

SEQ ID NO: 80671 - protein, 9 aa, Homo sapiens
  light chain complementarity determining region 3 for antibody 40336
QQYGSSPWT

SEQ ID NO: 80672 - protein, 17 aa, Homo sapiens
  heavy chain complementarity determining region 3 for antibody 40336
ARGGGSGWWIQPDGFDI

SEQ ID NO: 80673 - protein, 9 aa, Homo sapiens
  light chain complementarity determining region 3 for antibody 40337
QQYGSSPSS

SEQ ID NO: 80674 - protein, 15 aa, Homo sapiens
  heavy chain complementarity determining region 3 for antibody 40337
ARGIVRFLRVDAFDI

SEQ ID NO: 80675 - protein, 9 aa, Homo sapiens
  light chain complementarity determining region 3 for antibody 40338
QQYGSSPFT

SEQ ID NO: 80676 - protein, 10 aa, Homo sapiens
  heavy chain complementarity determining region 3 for antibody 40338
ARLKVGASDY

SEQ ID NO: 80677 - protein, 9 aa, Homo sapiens
  light chain complementarity determining region 3 for antibody 40339
QQYGSAPHT

SEQ ID NO: 80678 - protein, 12 aa, Homo sapiens
  heavy chain complementarity determining region 3 for antibody 40339
TALWYYSESSGH

SEQ ID NO: 80679 - protein, 9 aa, Homo sapiens
  light chain complementarity determining region 3 for antibody 40340
QQYGISPYT

SEQ ID NO: 80680 - protein, 13 aa, Homo sapiens
  heavy chain complementarity determining region 3 for antibody 40340
TTYWTTVLRVGGP

SEQ ID NO: 80681 - protein, 8 aa, Homo sapiens
  light chain complementarity determining region 3 for antibody 40341
QQYDYLPA

SEQ ID NO: 80682 - protein, 12 aa, Homo sapiens
  heavy chain complementarity determining region 3 for antibody 40341
ARSNWNIIAFDL

SEQ ID NO: 80683 - protein, 8 aa, Homo sapiens
  light chain complementarity determining region 3 for antibody 40342
QQYDGAPT

SEQ ID NO: 80684 - protein, 14 aa, Homo sapiens
  heavy chain complementarity determining region 3 for antibody 40342
ARRDCSGDYCYLDY

SEQ ID NO: 80685 - protein, 9 aa, Homo sapiens
  light chain complementarity determining region 3 for antibody 40343
QQGYSIPFT

SEQ ID NO: 80686 - protein, 8 aa, Homo sapiens
  heavy chain complementarity determining region 3 for antibody 40343
ARSAYCDS

SEQ ID NO: 80687 - protein, 9 aa, Homo sapiens
  light chain complementarity determining region 3 for antibody 40344
QKGNSLPFT

SEQ ID NO: 80688 - protein, 15 aa, Homo sapiens
  heavy chain complementarity determining region 3 for antibody 40344
AREAFDSGGRYRADY

SEQ ID NO: 80689 - protein, 9 aa, Homo sapiens
  light chain complementarity determining region 3 for antibody 40345
QRQNSAPLT

SEQ ID NO: 80690 - protein, 10 aa, Homo sapiens
  heavy chain complementarity determining region 3 for antibody 40345
ARDEGYFGTS

SEQ ID NO: 80691 - protein, 9 aa, Homo sapiens
  light chain complementarity determining region 3 for antibody 40346
QQYGSSPFT

SEQ ID NO: 80692 - protein, 20 aa, Homo sapiens
  heavy chain complementarity determining region 3 for antibody 40346
ARDDSRPGGHMSGWYGDLDS

SEQ ID NO: 80693 - protein, 8 aa, Homo sapiens
  light chain complementarity determining region 3 for antibody 40347
QQYASSPT

SEQ ID NO: 80694 - protein, 16 aa, Homo sapiens
  heavy chain complementarity determining region 3 for antibody 40347
ARAEMATITGGDALDI

SEQ ID NO: 80695 - protein, 9 aa, Homo sapiens
  light chain complementarity determining region 3 for antibody 40348
QQSHDMPWT

SEQ ID NO: 80696 - protein, 11 aa, Homo sapiens
  heavy chain complementarity determining region 3 for antibody 40348
ARDPGDWYFDL

SEQ ID NO: 80697 - protein, 9 aa, Homo sapiens
  light chain complementarity determining region 3 for antibody 40349
QQGYSTPLT

SEQ ID NO: 80698 - protein, 15 aa, Homo sapiens
  heavy chain complementarity determining region 3 for antibody 40349
ARAQVIWGQLYYFDY

SEQ ID NO: 80699 - protein, 9 aa, Homo sapiens
  light chain complementarity determining region 3 for antibody 40350
QQANSFPHT

SEQ ID NO: 80700 - protein, 9 aa, Homo sapiens
  heavy chain complementarity determining region 3 for antibody 40350
ASGNYFFDH

SEQ ID NO: 80701 - protein, 10 aa, Homo sapiens
  light chain complementarity determining region 3 for antibody 40351
QHYYSTSPIT

SEQ ID NO: 80702 - protein, 12 aa, Homo sapiens
  heavy chain complementarity determining region 3 for antibody 40351
ARGGYDGYYFVH

SEQ ID NO: 80703 - protein, 10 aa, Homo sapiens
  light chain complementarity determining region 3 for antibody 40352
QHYDNLPRFT

SEQ ID NO: 80704 - protein, 13 aa, Homo sapiens
  heavy chain complementarity determining region 3 for antibody 40352
TRATGHSGTDLGH

SEQ ID NO: 80705 - protein, 9 aa, Homo sapiens
  light chain complementarity determining region 3 for antibody 40353
MQALQIPGT

SEQ ID NO: 80706 - protein, 12 aa, Homo sapiens
  heavy chain complementarity determining region 3 for antibody 40353
ARLRGIAAEINY

SEQ ID NO: 80707 - protein, 9 aa, Homo sapiens
  light chain complementarity determining region 3 for antibody 40354
LQDHDYPLT

SEQ ID NO: 80708 - protein, 13 aa, Homo sapiens
  heavy chain complementarity determining region 3 for antibody 40354
AKTRARGNFNFDI

SEQ ID NO: 80709 - protein, 9 aa, Homo sapiens
  light chain complementarity determining region 3 for antibody 40355
HQYGTSRQT

SEQ ID NO: 80710 - protein, 15 aa, Homo sapiens
  heavy chain complementarity determining region 3 for antibody 40355
AREMIRGVSEDALDV

SEQ ID NO: 80711 - protein, 9 aa, Homo sapiens
  light chain complementarity determining region 3 for antibody 40356
HQYDSSPRT

SEQ ID NO: 80712 - protein, 13 aa, Homo sapiens
  heavy chain complementarity determining region 3 for antibody 40356
ARTGRVGGVEGAT

SEQ ID NO: 80713 - protein, 9 aa, Homo sapiens
  light chain complementarity determining region 3 for antibody 40357
HQSSSLPLT

SEQ ID NO: 80714 - protein, 16 aa, Homo sapiens
  heavy chain complementarity determining region 3 for antibody 40357
VRGGYRYSGPPDAFDI

SEQ ID NO: 80715 - protein, 9 aa, Homo sapiens
  light chain complementarity determining region 3 for antibody 40358
GQYGSRPRT

SEQ ID NO: 80716 - protein, 9 aa, Homo sapiens
  heavy chain complementarity determining region 3 for antibody 40358
AREWSAYDF

SEQ ID NO: 80717 - protein, 9 aa, Homo sapiens
  light chain complementarity determining region 3 for antibody 40359
QQYNSYSRA

SEQ ID NO: 80718 - protein, 16 aa, Homo sapiens
  heavy chain complementarity determining region 3 for antibody 40359
VNSDRRQLVLGVLIDY

SEQ ID NO: 80719 - protein, 8 aa, Homo sapiens
  light chain complementarity determining region 3 for antibody 40360
QQYKSYSA

SEQ ID NO: 80720 - protein, 15 aa, Homo sapiens
  heavy chain complementarity determining region 3 for antibody 40360
ARGQNLVRMHDALDF

SEQ ID NO: 80721 - protein, 9 aa, Homo sapiens
  light chain complementarity determining region 3 for antibody 40361
QQYGTSPLT

SEQ ID NO: 80722 - protein, 15 aa, Homo sapiens
  heavy chain complementarity determining region 3 for antibody 40361
VADYIDHSGFGHPDV

SEQ ID NO: 80723 - protein, 9 aa, Homo sapiens
  light chain complementarity determining region 3 for antibody 40362
QQYGSPLYT

SEQ ID NO: 80724 - protein, 17 aa, Homo sapiens
  heavy chain complementarity determining region 3 for antibody 40362
AKVLWSGDALHIGPFDF

SEQ ID NO: 80725 - protein, 10 aa, Homo sapiens
  light chain complementarity determining region 3 for antibody 40363
QQYGRSPSIT

SEQ ID NO: 80726 - protein, 15 aa, Homo sapiens
  heavy chain complementarity determining region 3 for antibody 40363
ARGALTAAALVYFDF

SEQ ID NO: 80727 - protein, 9 aa, Homo sapiens
  light chain complementarity determining region 3 for antibody 40364
QQYGNVPRT

SEQ ID NO: 80728 - protein, 8 aa, Homo sapiens
  heavy chain complementarity determining region 3 for antibody 40364
ARGEAVDC

SEQ ID NO: 80729 - protein, 8 aa, Homo sapiens
  light chain complementarity determining region 3 for antibody 40365
QQYANLWT

SEQ ID NO: 80730 - protein, 15 aa, Homo sapiens
  heavy chain complementarity determining region 3 for antibody 40365
ATTIAVPGLFRAFDL

SEQ ID NO: 80731 - protein, 9 aa, Homo sapiens
  light chain complementarity determining region 3 for antibody 40366
QQTYNAPYT

SEQ ID NO: 80732 - protein, 18 aa, Homo sapiens
  heavy chain complementarity determining region 3 for antibody 40366
AVLGYCTNSACYFALVDY

SEQ ID NO: 80733 - protein, 10 aa, Homo sapiens
  light chain complementarity determining region 3 for antibody 40367
QQSYSTSLYT

SEQ ID NO: 80734 - protein, 17 aa, Homo sapiens
  heavy chain complementarity determining region 3 for antibody 40367
AREKMQVGITFWRYFDV

SEQ ID NO: 80735 - protein, 9 aa, Homo sapiens
  light chain complementarity determining region 3 for antibody 40368
QQSYSTPRT

SEQ ID NO: 80736 - protein, 12 aa, Homo sapiens
  heavy chain complementarity determining region 3 for antibody 40368
TGEAPSRAWFDP

SEQ ID NO: 80737 - protein, 8 aa, Homo sapiens
  light chain complementarity determining region 3 for antibody 40369
QQSGRSLT

SEQ ID NO: 80738 - protein, 8 aa, Homo sapiens
  heavy chain complementarity determining region 3 for antibody 40369
TGHGSDSS

SEQ ID NO: 80739 - protein, 9 aa, Homo sapiens
  light chain complementarity determining region 3 for antibody 40370
QQSFSNPVT

SEQ ID NO: 80740 - protein, 18 aa, Homo sapiens
  heavy chain complementarity determining region 3 for antibody 40370
AREEDHYSSGTYYNIFDL

SEQ ID NO: 80741 - protein, 9 aa, Homo sapiens
  light chain complementarity determining region 3 for antibody 40371
QQRSGWPPT

SEQ ID NO: 80742 - protein, 15 aa, Homo sapiens
  heavy chain complementarity determining region 3 for antibody 40371
VTGSPFYYDNSGTDY

SEQ ID NO: 80743 - protein, 9 aa, Homo sapiens
  light chain complementarity determining region 3 for antibody 40372
QQRSDWRYT

SEQ ID NO: 80744 - protein, 17 aa, Homo sapiens
  heavy chain complementarity determining region 3 for antibody 40372
AKGRGYDDYYSYSGIDV

SEQ ID NO: 80745 - protein, 10 aa, Homo sapiens
  light chain complementarity determining region 3 for antibody 40373
QQRNNWPLFT

SEQ ID NO: 80746 - protein, 10 aa, Homo sapiens
  heavy chain complementarity determining region 3 for antibody 40373
VRDYLYAMDV

SEQ ID NO: 80747 - protein, 9 aa, Homo sapiens
  light chain complementarity determining region 3 for antibody 40374
QQGSNWPPS

SEQ ID NO: 80748 - protein, 13 aa, Homo sapiens
  heavy chain complementarity determining region 3 for antibody 40374
ARDFPGYPSNFDF

SEQ ID NO: 80749 - protein, 8 aa, Homo sapiens
  light chain complementarity determining region 3 for antibody 40375
QHHNIWLT

SEQ ID NO: 80750 - protein, 15 aa, Homo sapiens
  heavy chain complementarity determining region 3 for antibody 40375
ARDGDWRDGIRGFDF

SEQ ID NO: 80751 - protein, 9 aa, Homo sapiens
  light chain complementarity determining region 3 for antibody 40376
QHHGSTPLT

SEQ ID NO: 80752 - protein, 14 aa, Homo sapiens
  heavy chain complementarity determining region 3 for antibody 40376
ARASGDYYIEAFDV

SEQ ID NO: 80753 - protein, 8 aa, Homo sapiens
  light chain complementarity determining region 3 for antibody 40377
LQSNYYLT

SEQ ID NO: 80754 - protein, 15 aa, Homo sapiens
  heavy chain complementarity determining region 3 for antibody 40377
AKSTVTTASGGYIDS

SEQ ID NO: 80755 - protein, 9 aa, Homo sapiens
  light chain complementarity determining region 3 for antibody 40378
LQDSTFPPT

SEQ ID NO: 80756 - protein, 16 aa, Homo sapiens
  heavy chain complementarity determining region 3 for antibody 40378
ARSGFEVDVGSTVIDY

SEQ ID NO: 80757 - protein, 9 aa, Homo sapiens
  light chain complementarity determining region 3 for antibody 40379
HQYGTAPET

SEQ ID NO: 80758 - protein, 5 aa, Homo sapiens
  heavy chain complementarity determining region 3 for antibody 40379
VRWGH

SEQ ID NO: 80759 - protein, 7 aa, Homo sapiens
  light chain complementarity determining region 3 for antibody 40380
HQYGSSA

SEQ ID NO: 80760 - protein, 11 aa, Homo sapiens
  heavy chain complementarity determining region 3 for antibody 40380
ARIAAAGAFDI

SEQ ID NO: 80761 - protein, 8 aa, Homo sapiens
  light chain complementarity determining region 3 for antibody 40381
QQYNSYWT

SEQ ID NO: 80762 - protein, 11 aa, Homo sapiens
  heavy chain complementarity determining region 3 for antibody 40381
AHFGEWLSFDY

SEQ ID NO: 80763 - protein, 9 aa, Homo sapiens
  light chain complementarity determining region 3 for antibody 40382
QQYNSYPYT

SEQ ID NO: 80764 - protein, 20 aa, Homo sapiens
  heavy chain complementarity determining region 3 for antibody 40382
ARERQYCSGNTCYYPSVFDY

SEQ ID NO: 80765 - protein, 9 aa, Homo sapiens
  light chain complementarity determining region 3 for antibody 40383
QQYNSFPYT

SEQ ID NO: 80766 - protein, 17 aa, Homo sapiens
  heavy chain complementarity determining region 3 for antibody 40383
ARDTSALGPYGSGILDI

SEQ ID NO: 80767 - protein, 9 aa, Homo sapiens
  light chain complementarity determining region 3 for antibody 40384
QQYGTSLLT

SEQ ID NO: 80768 - protein, 11 aa, Homo sapiens
  heavy chain complementarity determining region 3 for antibody 40384
ARAYGFWAIDY

SEQ ID NO: 80769 - protein, 10 aa, Homo sapiens
  light chain complementarity determining region 3 for antibody 40385
QQYGSSPPWT

SEQ ID NO: 80770 - protein, 14 aa, Homo sapiens
  heavy chain complementarity determining region 3 for antibody 40385
ARGGNSGHYHQFDY

SEQ ID NO: 80771 - protein, 9 aa, Homo sapiens
  light chain complementarity determining region 3 for antibody 40386
QQYGFSSWT

SEQ ID NO: 80772 - protein, 13 aa, Homo sapiens
  heavy chain complementarity determining region 3 for antibody 40386
AKTSHDFNDAFDV

SEQ ID NO: 80773 - protein, 10 aa, Homo sapiens
  light chain complementarity determining region 3 for antibody 40387
QQYGDLPPIT

SEQ ID NO: 80774 - protein, 19 aa, Homo sapiens
  heavy chain complementarity determining region 3 for antibody 40387
ARAREGSYREENNYYGFDA

SEQ ID NO: 80775 - protein, 9 aa, Homo sapiens
  light chain complementarity determining region 3 for antibody 40388
QQTNKFPLT

SEQ ID NO: 80776 - protein, 18 aa, Homo sapiens
  heavy chain complementarity determining region 3 for antibody 40388
ATDAVLSPLVETATYFDH

SEQ ID NO: 80777 - protein, 9 aa, Homo sapiens
  light chain complementarity determining region 3 for antibody 40389
QQSYSTPYT

SEQ ID NO: 80778 - protein, 9 aa, Homo sapiens
  heavy chain complementarity determining region 3 for antibody 40389
ARGLRPLVS

SEQ ID NO: 80779 - protein, 9 aa, Homo sapiens
  light chain complementarity determining region 3 for antibody 40390
QQSYSTPRT

SEQ ID NO: 80780 - protein, 14 aa, Homo sapiens
  heavy chain complementarity determining region 3 for antibody 40390
AREVEAAAGRFLDY

SEQ ID NO: 80781 - protein, 9 aa, Homo sapiens
  light chain complementarity determining region 3 for antibody 40391
QQSYNTPIT

SEQ ID NO: 80782 - protein, 16 aa, Homo sapiens
  heavy chain complementarity determining region 3 for antibody 40391
ARGGDILTGSQWYFDV

SEQ ID NO: 80783 - protein, 10 aa, Homo sapiens
  light chain complementarity determining region 3 for antibody 40392
QQRYSWPPLT

SEQ ID NO: 80784 - protein, 15 aa, Homo sapiens
  heavy chain complementarity determining region 3 for antibody 40392
AKGSGLDPRQYYFDY

SEQ ID NO: 80785 - protein, 11 aa, Homo sapiens
  light chain complementarity determining region 3 for antibody 40393
QQRQPRSNWLT

SEQ ID NO: 80786 - protein, 15 aa, Homo sapiens
  heavy chain complementarity determining region 3 for antibody 40393
ARGGYSSSWYYWFDP

SEQ ID NO: 80787 - protein, 6 aa, Homo sapiens
  light chain complementarity determining region 3 for antibody 40394
QQNGMT

SEQ ID NO: 80788 - protein, 12 aa, Homo sapiens
  heavy chain complementarity determining region 3 for antibody 40394
ARLANSWYPYDY

SEQ ID NO: 80789 - protein, 9 aa, Homo sapiens
  light chain complementarity determining region 3 for antibody 40395
QQLHKSPWT

SEQ ID NO: 80790 - protein, 14 aa, Homo sapiens
  heavy chain complementarity determining region 3 for antibody 40395
ARAAPEYEWLVPDY

SEQ ID NO: 80791 - protein, 9 aa, Homo sapiens
  light chain complementarity determining region 3 for antibody 40396
QQGYSTPFT

SEQ ID NO: 80792 - protein, 15 aa, Homo sapiens
  heavy chain complementarity determining region 3 for antibody 40396
ARAQVIWGQLYYFDS

SEQ ID NO: 80793 - protein, 9 aa, Homo sapiens
  light chain complementarity determining region 3 for antibody 40397
QQGYSTPFT

SEQ ID NO: 80794 - protein, 15 aa, Homo sapiens
  heavy chain complementarity determining region 3 for antibody 40397
AKSQIIWGQLYYFDS

SEQ ID NO: 80795 - protein, 8 aa, Homo sapiens
  light chain complementarity determining region 3 for antibody 40398
QQFGDSQT

SEQ ID NO: 80796 - protein, 14 aa, Homo sapiens
  heavy chain complementarity determining region 3 for antibody 40398
ARDSEYNGPYLYQH

SEQ ID NO: 80797 - protein, 9 aa, Homo sapiens
  light chain complementarity determining region 3 for antibody 40399
QHYGTSPLT

SEQ ID NO: 80798 - protein, 16 aa, Homo sapiens
  heavy chain complementarity determining region 3 for antibody 40399
ASPVPTSWAVHDAFDI

SEQ ID NO: 80799 - protein, 10 aa, Homo sapiens
  light chain complementarity determining region 3 for antibody 40400
QHYGSSPRFT

SEQ ID NO: 80800 - protein, 10 aa, Homo sapiens
  heavy chain complementarity determining region 3 for antibody 40400
AASDTAQFRY

SEQ ID NO: 80801 - protein, 9 aa, Homo sapiens
  light chain complementarity determining region 3 for antibody 40401
MQALQTPRT

SEQ ID NO: 80802 - protein, 14 aa, Homo sapiens
  heavy chain complementarity determining region 3 for antibody 40401
ARDLGHDYGSGMDV

SEQ ID NO: 80803 - protein, 9 aa, Homo sapiens
  light chain complementarity determining region 3 for antibody 40402
MQALQSPRT

SEQ ID NO: 80804 - protein, 7 aa, Homo sapiens
  heavy chain complementarity determining region 3 for antibody 40402
MDGDYGF

SEQ ID NO: 80805 - protein, 9 aa, Homo sapiens
  light chain complementarity determining region 3 for antibody 40403
QQYNDWPGT

SEQ ID NO: 80806 - protein, 9 aa, Homo sapiens
  heavy chain complementarity determining region 3 for antibody 40403
ARGEVYFDS

SEQ ID NO: 80807 - protein, 8 aa, Homo sapiens
  light chain complementarity determining region 3 for antibody 40404
QQYHTFYT

SEQ ID NO: 80808 - protein, 14 aa, Homo sapiens
  heavy chain complementarity determining region 3 for antibody 40404
ARRNYCDDGCLFHP

SEQ ID NO: 80809 - protein, 9 aa, Homo sapiens
  light chain complementarity determining region 3 for antibody 40405
QQYGTSPWT

SEQ ID NO: 80810 - protein, 9 aa, Homo sapiens
  heavy chain complementarity determining region 3 for antibody 40405
ARGLDYWDF

SEQ ID NO: 80811 - protein, 9 aa, Homo sapiens
  light chain complementarity determining region 3 for antibody 40406
QQYGSSTFT

SEQ ID NO: 80812 - protein, 15 aa, Homo sapiens
  heavy chain complementarity determining region 3 for antibody 40406
ARRHSSSRHIKSIDY

SEQ ID NO: 80813 - protein, 9 aa, Homo sapiens
  light chain complementarity determining region 3 for antibody 40407
QQYGSSPRT

SEQ ID NO: 80814 - protein, 18 aa, Homo sapiens
  heavy chain complementarity determining region 3 for antibody 40407
ASYHIVVVVDADPDAFHI

SEQ ID NO: 80815 - protein, 9 aa, Homo sapiens
  light chain complementarity determining region 3 for antibody 40408
QQYGNSRIT

SEQ ID NO: 80816 - protein, 9 aa, Homo sapiens
  heavy chain complementarity determining region 3 for antibody 40408
ARGNWNYGY

SEQ ID NO: 80817 - protein, 9 aa, Homo sapiens
  light chain complementarity determining region 3 for antibody 40409
QQYGNSPFT

SEQ ID NO: 80818 - protein, 11 aa, Homo sapiens
  heavy chain complementarity determining region 3 for antibody 40409
GKDGTPGGLDY

SEQ ID NO: 80819 - protein, 9 aa, Homo sapiens
  light chain complementarity determining region 3 for antibody 40410
QQYDSYPYT

SEQ ID NO: 80820 - protein, 18 aa, Homo sapiens
  heavy chain complementarity determining region 3 for antibody 40410
ARGEFCSTTRCPNDAFDF

SEQ ID NO: 80821 - protein, 9 aa, Homo sapiens
  light chain complementarity determining region 3 for antibody 40411
QQYADSAIS

SEQ ID NO: 80822 - protein, 9 aa, Homo sapiens
  heavy chain complementarity determining region 3 for antibody 40411
GLFTGGRDY

SEQ ID NO: 80823 - protein, 10 aa, Homo sapiens
  light chain complementarity determining region 3 for antibody 40412
QQRYNWPPYT

SEQ ID NO: 80824 - protein, 11 aa, Homo sapiens
  heavy chain complementarity determining region 3 for antibody 40412
TRGVGSYPFDQ

SEQ ID NO: 80825 - protein, 9 aa, Homo sapiens
  light chain complementarity determining region 3 for antibody 40413
QQRSNWPPT

SEQ ID NO: 80826 - protein, 19 aa, Homo sapiens
  heavy chain complementarity determining region 3 for antibody 40413
ARDVSSADHYGPGKSWFDP

SEQ ID NO: 80827 - protein, 9 aa, Homo sapiens
  light chain complementarity determining region 3 for antibody 40414
QQGYSIPLL

SEQ ID NO: 80828 - protein, 15 aa, Homo sapiens
  heavy chain complementarity determining region 3 for antibody 40414
ARAQVIWGQLYYFDC

SEQ ID NO: 80829 - protein, 9 aa, Homo sapiens
  light chain complementarity determining region 3 for antibody 40415
QQANSFPLT

SEQ ID NO: 80830 - protein, 15 aa, Homo sapiens
  heavy chain complementarity determining region 3 for antibody 40415
AHSPYDTSGYRNFDY

SEQ ID NO: 80831 - protein, 9 aa, Homo sapiens
  light chain complementarity determining region 3 for antibody 40416
QKYNSAPFT

SEQ ID NO: 80832 - protein, 15 aa, Homo sapiens
  heavy chain complementarity determining region 3 for antibody 40416
TTPRGPIEALWYFDL

SEQ ID NO: 80833 - protein, 9 aa, Homo sapiens
  light chain complementarity determining region 3 for antibody 40417
QHYSSYSPT

SEQ ID NO: 80834 - protein, 13 aa, Homo sapiens
  heavy chain complementarity determining region 3 for antibody 40417
AKDRLKDKYYFDS

SEQ ID NO: 80835 - protein, 9 aa, Homo sapiens
  light chain complementarity determining region 3 for antibody 40418
QHYESSPWT

SEQ ID NO: 80836 - protein, 13 aa, Homo sapiens
  heavy chain complementarity determining region 3 for antibody 40418
ARERRQFAWYIDH

SEQ ID NO: 80837 - protein, 9 aa, Homo sapiens
  light chain complementarity determining region 3 for antibody 40419
QDYNSFPYS

SEQ ID NO: 80838 - protein, 17 aa, Homo sapiens
  heavy chain complementarity determining region 3 for antibody 40419
ARDRWYYGSGNYYPFDY

SEQ ID NO: 80839 - protein, 9 aa, Homo sapiens
  light chain complementarity determining region 3 for antibody 40420
LQDYSYPLK

SEQ ID NO: 80840 - protein, 14 aa, Homo sapiens
  heavy chain complementarity determining region 3 for antibody 40420
ARDRMLRGVGWLDS

SEQ ID NO: 80841 - protein, 9 aa, Homo sapiens
  light chain complementarity determining region 3 for antibody 40421
HQYSTSPRT

SEQ ID NO: 80842 - protein, 17 aa, Homo sapiens
  heavy chain complementarity determining region 3 for antibody 40421
VKPRETYSSGWVDAFEM

SEQ ID NO: 80843 - protein, 9 aa, Homo sapiens
  light chain complementarity determining region 3 for antibody 40422
HQRYSWPLT

SEQ ID NO: 80844 - protein, 11 aa, Homo sapiens
  heavy chain complementarity determining region 3 for antibody 40422
AASSYFGVFHH

SEQ ID NO: 80845 - protein, 9 aa, Homo sapiens
  light chain complementarity determining region 3 for antibody 40423
QQYGSSPYT

SEQ ID NO: 80846 - protein, 15 aa, Homo sapiens
  heavy chain complementarity determining region 3 for antibody 40423
ATESGLGDCSYWFDT

SEQ ID NO: 80847 - protein, 11 aa, Homo sapiens
  light chain complementarity determining region 3 for antibody 40424
QQYGSSPPMYT

SEQ ID NO: 80848 - protein, 19 aa, Homo sapiens
  heavy chain complementarity determining region 3 for antibody 40424
ARDGGLVVVPAATRSYFDF

SEQ ID NO: 80849 - protein, 9 aa, Homo sapiens
  light chain complementarity determining region 3 for antibody 40425
QQYGSSLWT

SEQ ID NO: 80850 - protein, 14 aa, Homo sapiens
  heavy chain complementarity determining region 3 for antibody 40425
ARGYFYGSGLGMDV

SEQ ID NO: 80851 - protein, 9 aa, Homo sapiens
  light chain complementarity determining region 3 for antibody 40426
QQYGGSPRT

SEQ ID NO: 80852 - protein, 22 aa, Homo sapiens
  heavy chain complementarity determining region 3 for antibody 40426
AKVGQLQTSDLLSGSYRGAFDV

SEQ ID NO: 80853 - protein, 10 aa, Homo sapiens
  light chain complementarity determining region 3 for antibody 40427
QQYDNLPPLT

SEQ ID NO: 80854 - protein, 11 aa, Homo sapiens
  heavy chain complementarity determining region 3 for antibody 40427
ARDAGGLGIDY

SEQ ID NO: 80855 - protein, 9 aa, Homo sapiens
  light chain complementarity determining region 3 for antibody 40428
QQYDNLPLT

SEQ ID NO: 80856 - protein, 17 aa, Homo sapiens
  heavy chain complementarity determining region 3 for antibody 40428
ARDQRAAARYRRSWFDP

SEQ ID NO: 80857 - protein, 9 aa, Homo sapiens
  light chain complementarity determining region 3 for antibody 40429
QQSYSTPLT

SEQ ID NO: 80858 - protein, 13 aa, Homo sapiens
  heavy chain complementarity determining region 3 for antibody 40429
ARVGVFGDTDFDS

SEQ ID NO: 80859 - protein, 10 aa, Homo sapiens
  light chain complementarity determining region 3 for antibody 40430
QQSFSTPPYT

SEQ ID NO: 80860 - protein, 20 aa, Homo sapiens
  heavy chain complementarity determining region 3 for antibody 40430
ATLNIRGGYGSGWSAEYFQH

SEQ ID NO: 80861 - protein, 9 aa, Homo sapiens
  light chain complementarity determining region 3 for antibody 40431
QQSFRTPRT

SEQ ID NO: 80862 - protein, 13 aa, Homo sapiens
  heavy chain complementarity determining region 3 for antibody 40431
AREFPRDYYGMDV

SEQ ID NO: 80863 - protein, 10 aa, Homo sapiens
  light chain complementarity determining region 3 for antibody 40432
QQRYDWPPYT

SEQ ID NO: 80864 - protein, 11 aa, Homo sapiens
  heavy chain complementarity determining region 3 for antibody 40432
ARGVGSYVFES

SEQ ID NO: 80865 - protein, 9 aa, Homo sapiens
  light chain complementarity determining region 3 for antibody 40433
QQRSNWPKT

SEQ ID NO: 80866 - protein, 10 aa, Homo sapiens
  heavy chain complementarity determining region 3 for antibody 40433
VCFTSSCPGY

SEQ ID NO: 80867 - protein, 9 aa, Homo sapiens
  light chain complementarity determining region 3 for antibody 40434
QQRSNWLYT

SEQ ID NO: 80868 - protein, 19 aa, Homo sapiens
  heavy chain complementarity determining region 3 for antibody 40434
AHSGATWFGELFPNYYFDY

SEQ ID NO: 80869 - protein, 8 aa, Homo sapiens
  light chain complementarity determining region 3 for antibody 40435
QQRNTWPT

SEQ ID NO: 80870 - protein, 18 aa, Homo sapiens
  heavy chain complementarity determining region 3 for antibody 40435
ARTYYDDSSGYSLLYFDL

SEQ ID NO: 80871 - protein, 8 aa, Homo sapiens
  light chain complementarity determining region 3 for antibody 40436
QQHVSSVS

SEQ ID NO: 80872 - protein, 13 aa, Homo sapiens
  heavy chain complementarity determining region 3 for antibody 40436
VRTWFGELSHFDF

SEQ ID NO: 80873 - protein, 9 aa, Homo sapiens
  light chain complementarity determining region 3 for antibody 40437
QQGYNTPFT

SEQ ID NO: 80874 - protein, 15 aa, Homo sapiens
  heavy chain complementarity determining region 3 for antibody 40437
AKAQVIWGQLYYFES

SEQ ID NO: 80875 - protein, 9 aa, Homo sapiens
  light chain complementarity determining region 3 for antibody 40438
QQASSFPYT

SEQ ID NO: 80876 - protein, 15 aa, Homo sapiens
  heavy chain complementarity determining region 3 for antibody 40438
ARHFAYGDTTGYFDL

SEQ ID NO: 80877 - protein, 9 aa, Homo sapiens
  light chain complementarity determining region 3 for antibody 40439
QHSYTTLYT

SEQ ID NO: 80878 - protein, 13 aa, Homo sapiens
  heavy chain complementarity determining region 3 for antibody 40439
ARMTPVAADAFDI

SEQ ID NO: 80879 - protein, 9 aa, Homo sapiens
  light chain complementarity determining region 3 for antibody 40440
MQGTHWLYT

SEQ ID NO: 80880 - protein, 8 aa, Homo sapiens
  heavy chain complementarity determining region 3 for antibody 40440
ARYYDRLV

SEQ ID NO: 80881 - protein, 9 aa, Homo sapiens
  light chain complementarity determining region 3 for antibody 40441
LQDYNYPRT

SEQ ID NO: 80882 - protein, 9 aa, Homo sapiens
  heavy chain complementarity determining region 3 for antibody 40441
ARGGGGIDY

SEQ ID NO: 80883 - protein, 9 aa, Homo sapiens
  light chain complementarity determining region 3 for antibody 40442
QQYSSYLYT

SEQ ID NO: 80884 - protein, 14 aa, Homo sapiens
  heavy chain complementarity determining region 3 for antibody 40442
ARCMIEAAFRNFDY

SEQ ID NO: 80885 - protein, 9 aa, Homo sapiens
  light chain complementarity determining region 3 for antibody 40443
QQYSNSPWT

SEQ ID NO: 80886 - protein, 17 aa, Homo sapiens
  heavy chain complementarity determining region 3 for antibody 40443
ARDGMPSKRWPDNFFDA

SEQ ID NO: 80887 - protein, 8 aa, Homo sapiens
  light chain complementarity determining region 3 for antibody 40444
QQYRDSFP

SEQ ID NO: 80888 - protein, 13 aa, Homo sapiens
  heavy chain complementarity determining region 3 for antibody 40444
ATESGRYQGAFDI

SEQ ID NO: 80889 - protein, 9 aa, Homo sapiens
  light chain complementarity determining region 3 for antibody 40445
QQYNSYSYT

SEQ ID NO: 80890 - protein, 21 aa, Homo sapiens
  heavy chain complementarity determining region 3 for antibody 40445
ARDAPPLEVYSSGYVFRGMDV

SEQ ID NO: 80891 - protein, 9 aa, Homo sapiens
  light chain complementarity determining region 3 for antibody 40446
QQYGTSPRT

SEQ ID NO: 80892 - protein, 16 aa, Homo sapiens
  heavy chain complementarity determining region 3 for antibody 40446
VKGGKLAASHLSALDI

SEQ ID NO: 80893 - protein, 9 aa, Homo sapiens
  light chain complementarity determining region 3 for antibody 40447
QQYGSSPYT

SEQ ID NO: 80894 - protein, 18 aa, Homo sapiens
  heavy chain complementarity determining region 3 for antibody 40447
ARGREFRSTFIKNWCFDF

SEQ ID NO: 80895 - protein, 9 aa, Homo sapiens
  light chain complementarity determining region 3 for antibody 40448
QQYGSSPRT

SEQ ID NO: 80896 - protein, 16 aa, Homo sapiens
  heavy chain complementarity determining region 3 for antibody 40448
AREGLYFDILGGPLDI

SEQ ID NO: 80897 - protein, 10 aa, Homo sapiens
  light chain complementarity determining region 3 for antibody 40449
QQYGSSPPIT

SEQ ID NO: 80898 - protein, 14 aa, Homo sapiens
  heavy chain complementarity determining region 3 for antibody 40449
ARDPVETDMINFDY

SEQ ID NO: 80899 - protein, 9 aa, Homo sapiens
  light chain complementarity determining region 3 for antibody 40450
QQYGSSPHT

SEQ ID NO: 80900 - protein, 13 aa, Homo sapiens
  heavy chain complementarity determining region 3 for antibody 40450
ASHRGYHFGYLDY

SEQ ID NO: 80901 - protein, 9 aa, Homo sapiens
  light chain complementarity determining region 3 for antibody 40451
QQYGSSPFT

SEQ ID NO: 80902 - protein, 19 aa, Homo sapiens
  heavy chain complementarity determining region 3 for antibody 40451
ARDPLDPDELGYFYYGLDV

SEQ ID NO: 80903 - protein, 9 aa, Homo sapiens
  light chain complementarity determining region 3 for antibody 40452
QQTYTSRVT

SEQ ID NO: 80904 - protein, 15 aa, Homo sapiens
  heavy chain complementarity determining region 3 for antibody 40452
ARDSFDGSYSGSFDY

SEQ ID NO: 80905 - protein, 9 aa, Homo sapiens
  light chain complementarity determining region 3 for antibody 40453
QQSYSTPYT

SEQ ID NO: 80906 - protein, 7 aa, Homo sapiens
  heavy chain complementarity determining region 3 for antibody 40453
ARDGIDY

SEQ ID NO: 80907 - protein, 9 aa, Homo sapiens
  light chain complementarity determining region 3 for antibody 40454
QQSFSTLLT

SEQ ID NO: 80908 - protein, 14 aa, Homo sapiens
  heavy chain complementarity determining region 3 for antibody 40454
ARDKRPRGLPALGY

SEQ ID NO: 80909 - protein, 8 aa, Homo sapiens
  light chain complementarity determining region 3 for antibody 40455
QQRSNWPT

SEQ ID NO: 80910 - protein, 24 aa, Homo sapiens
  heavy chain complementarity determining region 3 for antibody 40455
AREYFSVSGGYFMWGTEEQQYFDI

SEQ ID NO: 80911 - protein, 10 aa, Homo sapiens
  light chain complementarity determining region 3 for antibody 40456
QQRSNRPPLT

SEQ ID NO: 80912 - protein, 14 aa, Homo sapiens
  heavy chain complementarity determining region 3 for antibody 40456
ARDGSHYYGSGSFD

SEQ ID NO: 80913 - protein, 10 aa, Homo sapiens
  light chain complementarity determining region 3 for antibody 40457
QQLNTYPLFT

SEQ ID NO: 80914 - protein, 14 aa, Homo sapiens
  heavy chain complementarity determining region 3 for antibody 40457
ARDEPLRAGGLFDF

SEQ ID NO: 80915 - protein, 9 aa, Homo sapiens
  light chain complementarity determining region 3 for antibody 40458
QQGYSTPFT

SEQ ID NO: 80916 - protein, 15 aa, Homo sapiens
  heavy chain complementarity determining region 3 for antibody 40458
AKAQVIWGQLYYFDS

SEQ ID NO: 80917 - protein, 9 aa, Homo sapiens
  light chain complementarity determining region 3 for antibody 40459
QQFNNLPFT

SEQ ID NO: 80918 - protein, 15 aa, Homo sapiens
  heavy chain complementarity determining region 3 for antibody 40459
ARDVIGTYFVGGADY

SEQ ID NO: 80919 - protein, 9 aa, Homo sapiens
  light chain complementarity determining region 3 for antibody 40460
QQFDNLPQT

SEQ ID NO: 80920 - protein, 14 aa, Homo sapiens
  heavy chain complementarity determining region 3 for antibody 40460
KTDEILTMLKPFDY

SEQ ID NO: 80921 - protein, 9 aa, Homo sapiens
  light chain complementarity determining region 3 for antibody 40461
QKYNKVPLT

SEQ ID NO: 80922 - protein, 20 aa, Homo sapiens
  heavy chain complementarity determining region 3 for antibody 40461
ARGRYSRGWSNQYSYHALDV

SEQ ID NO: 80923 - protein, 9 aa, Homo sapiens
  light chain complementarity determining region 3 for antibody 40462
QHYISPSWT

SEQ ID NO: 80924 - protein, 12 aa, Homo sapiens
  heavy chain complementarity determining region 3 for antibody 40462
AMYLAGMSGVGC

SEQ ID NO: 80925 - protein, 8 aa, Homo sapiens
  light chain complementarity determining region 3 for antibody 40463
QHYDGPWT

SEQ ID NO: 80926 - protein, 11 aa, Homo sapiens
  heavy chain complementarity determining region 3 for antibody 40463
AASSYFGVFHH

SEQ ID NO: 80927 - protein, 9 aa, Homo sapiens
  light chain complementarity determining region 3 for antibody 40464
QEFKSPPWT

SEQ ID NO: 80928 - protein, 14 aa, Homo sapiens
  heavy chain complementarity determining region 3 for antibody 40464
ARAKDSSGFHAFDI

SEQ ID NO: 80929 - protein, 9 aa, Homo sapiens
  light chain complementarity determining region 3 for antibody 40465
HQYGTSPIT

SEQ ID NO: 80930 - protein, 15 aa, Homo sapiens
  heavy chain complementarity determining region 3 for antibody 40465
ASEYTSAWSRNFFDY

SEQ ID NO: 80931 - protein, 9 aa, Homo sapiens
  light chain complementarity determining region 3 for antibody 40466
HQSYSSPQT

SEQ ID NO: 80932 - protein, 12 aa, Homo sapiens
  heavy chain complementarity determining region 3 for antibody 40466
ARWRWQQSELES

SEQ ID NO: 80933 - protein, 10 aa, Homo sapiens
  light chain complementarity determining region 3 for antibody 40467
RQYGGSPPIT

SEQ ID NO: 80934 - protein, 18 aa, Homo sapiens
  heavy chain complementarity determining region 3 for antibody 40467
ARDEVYCTSTSCYDTFDY

SEQ ID NO: 80935 - protein, 8 aa, Homo sapiens
  light chain complementarity determining region 3 for antibody 40468
QYYHDSWT

SEQ ID NO: 80936 - protein, 9 aa, Homo sapiens
  heavy chain complementarity determining region 3 for antibody 40468
ATEEYYFSN

SEQ ID NO: 80937 - protein, 9 aa, Homo sapiens
  light chain complementarity determining region 3 for antibody 40469
QQYVSPPYT

SEQ ID NO: 80938 - protein, 20 aa, Homo sapiens
  heavy chain complementarity determining region 3 for antibody 40469
ARDLDISVLPGVTDDDGFDI

SEQ ID NO: 80939 - protein, 9 aa, Homo sapiens
  light chain complementarity determining region 3 for antibody 40470
QQYNSYSDT

SEQ ID NO: 80940 - protein, 13 aa, Homo sapiens
  heavy chain complementarity determining region 3 for antibody 40470
ARKGDQKSSAYDI

SEQ ID NO: 80941 - protein, 9 aa, Homo sapiens
  light chain complementarity determining region 3 for antibody 40471
QQYNRYPLT

SEQ ID NO: 80942 - protein, 11 aa, Homo sapiens
  heavy chain complementarity determining region 3 for antibody 40471
ATTRYDKILSE

SEQ ID NO: 80943 - protein, 10 aa, Homo sapiens
  light chain complementarity determining region 3 for antibody 40472
QQYNNWPPLT

SEQ ID NO: 80944 - protein, 8 aa, Homo sapiens
  heavy chain complementarity determining region 3 for antibody 40472
VRRFALDL

SEQ ID NO: 80945 - protein, 9 aa, Homo sapiens
  light chain complementarity determining region 3 for antibody 40473
QQYHDLPFT

SEQ ID NO: 80946 - protein, 18 aa, Homo sapiens
  heavy chain complementarity determining region 3 for antibody 40473
ARQIDYGDYASYHGYCDL

SEQ ID NO: 80947 - protein, 9 aa, Homo sapiens
  light chain complementarity determining region 3 for antibody 40474
QQYGSSSIT

SEQ ID NO: 80948 - protein, 13 aa, Homo sapiens
  heavy chain complementarity determining region 3 for antibody 40474
VKEFFMVFDAFDM

SEQ ID NO: 80949 - protein, 9 aa, Homo sapiens
  light chain complementarity determining region 3 for antibody 40475
QQYGSSPYT

SEQ ID NO: 80950 - protein, 15 aa, Homo sapiens
  heavy chain complementarity determining region 3 for antibody 40475
AILSRDDFKQYYFDY

SEQ ID NO: 80951 - protein, 9 aa, Homo sapiens
  light chain complementarity determining region 3 for antibody 40476
QQYGSSPWT

SEQ ID NO: 80952 - protein, 13 aa, Homo sapiens
  heavy chain complementarity determining region 3 for antibody 40476
ARVATREIWGFGY

SEQ ID NO: 80953 - protein, 9 aa, Homo sapiens
  light chain complementarity determining region 3 for antibody 40477
QQYGSSPWT

SEQ ID NO: 80954 - protein, 11 aa, Homo sapiens
  heavy chain complementarity determining region 3 for antibody 40477
ARDRGSGWYAY

SEQ ID NO: 80955 - protein, 9 aa, Homo sapiens
  light chain complementarity determining region 3 for antibody 40478
QQYGSSPIT

SEQ ID NO: 80956 - protein, 14 aa, Homo sapiens
  heavy chain complementarity determining region 3 for antibody 40478
ARVAVDTVPGEPGA

SEQ ID NO: 80957 - protein, 9 aa, Homo sapiens
  light chain complementarity determining region 3 for antibody 40479
QQYGSQPYT

SEQ ID NO: 80958 - protein, 13 aa, Homo sapiens
  heavy chain complementarity determining region 3 for antibody 40479
ARVAVPGKGYFQH

SEQ ID NO: 80959 - protein, 9 aa, Homo sapiens
  light chain complementarity determining region 3 for antibody 40480
QQYGRSPGT

SEQ ID NO: 80960 - protein, 19 aa, Homo sapiens
  heavy chain complementarity determining region 3 for antibody 40480
AHRLVVWFGELFGYDAFDI

SEQ ID NO: 80961 - protein, 10 aa, Homo sapiens
  light chain complementarity determining region 3 for antibody 40481
QQYGGSPLFS

SEQ ID NO: 80962 - protein, 12 aa, Homo sapiens
  heavy chain complementarity determining region 3 for antibody 40481
ARGDRDYDAFDV

SEQ ID NO: 80963 - protein, 6 aa, Homo sapiens
  light chain complementarity determining region 3 for antibody 40482
QQYGET

SEQ ID NO: 80964 - protein, 12 aa, Homo sapiens
  heavy chain complementarity determining region 3 for antibody 40482
ARDHSSGWSLSN

SEQ ID NO: 80965 - protein, 9 aa, Homo sapiens
  light chain complementarity determining region 3 for antibody 40483
QQYDTSPGT

SEQ ID NO: 80966 - protein, 16 aa, Homo sapiens
  heavy chain complementarity determining region 3 for antibody 40483
ARLSGDWGSAPHFFDT

SEQ ID NO: 80967 - protein, 9 aa, Homo sapiens
  light chain complementarity determining region 3 for antibody 40484
QQYDTFPLT

SEQ ID NO: 80968 - protein, 14 aa, Homo sapiens
  heavy chain complementarity determining region 3 for antibody 40484
AKAFGTTPADFFDS

SEQ ID NO: 80969 - protein, 9 aa, Homo sapiens
  light chain complementarity determining region 3 for antibody 40485
QQYDSLPIT

SEQ ID NO: 80970 - protein, 20 aa, Homo sapiens
  heavy chain complementarity determining region 3 for antibody 40485
ATLRRERQQVVPSLRDPFDI

SEQ ID NO: 80971 - protein, 9 aa, Homo sapiens
  light chain complementarity determining region 3 for antibody 40486
QQYDRSSVT

SEQ ID NO: 80972 - protein, 15 aa, Homo sapiens
  heavy chain complementarity determining region 3 for antibody 40486
VRAQVIWGQLYYFDY

SEQ ID NO: 80973 - protein, 9 aa, Homo sapiens
  light chain complementarity determining region 3 for antibody 40487
QQYDNLPPA

SEQ ID NO: 80974 - protein, 11 aa, Homo sapiens
  heavy chain complementarity determining region 3 for antibody 40487
TRDRGPVTCAY

SEQ ID NO: 80975 - protein, 9 aa, Homo sapiens
  light chain complementarity determining region 3 for antibody 40488
QQSYSVPFT

SEQ ID NO: 80976 - protein, 14 aa, Homo sapiens
  heavy chain complementarity determining region 3 for antibody 40488
ARGRDTSGYSGLDD

SEQ ID NO: 80977 - protein, 9 aa, Homo sapiens
  light chain complementarity determining region 3 for antibody 40489
QQSYSTPWT

SEQ ID NO: 80978 - protein, 11 aa, Homo sapiens
  heavy chain complementarity determining region 3 for antibody 40489
ARMRGGWYVES

SEQ ID NO: 80979 - protein, 9 aa, Homo sapiens
  light chain complementarity determining region 3 for antibody 40490
QQSYDNART

SEQ ID NO: 80980 - protein, 13 aa, Homo sapiens
  heavy chain complementarity determining region 3 for antibody 40490
ARRDAYNYSGLDY

SEQ ID NO: 80981 - protein, 9 aa, Homo sapiens
  light chain complementarity determining region 3 for antibody 40491
QQSDKFPLT

SEQ ID NO: 80982 - protein, 17 aa, Homo sapiens
  heavy chain complementarity determining region 3 for antibody 40491
ARDRARSSKWSWGGFDH

SEQ ID NO: 80983 - protein, 9 aa, Homo sapiens
  light chain complementarity determining region 3 for antibody 40492
QQRSNWPIT

SEQ ID NO: 80984 - protein, 14 aa, Homo sapiens
  heavy chain complementarity determining region 3 for antibody 40492
ARDGIMGGPSWFDS

SEQ ID NO: 80985 - protein, 8 aa, Homo sapiens
  light chain complementarity determining region 3 for antibody 40493
QQRSNWPA

SEQ ID NO: 80986 - protein, 20 aa, Homo sapiens
  heavy chain complementarity determining region 3 for antibody 40493
ARVWFGERTRGYYYYYGMDV

SEQ ID NO: 80987 - protein, 9 aa, Homo sapiens
  light chain complementarity determining region 3 for antibody 40494
QQRNLWPIT

SEQ ID NO: 80988 - protein, 15 aa, Homo sapiens
  heavy chain complementarity determining region 3 for antibody 40494
AKARVAAAGTGAFDL

SEQ ID NO: 80989 - protein, 9 aa, Homo sapiens
  light chain complementarity determining region 3 for antibody 40495
QQHGTSPWT

SEQ ID NO: 80990 - protein, 15 aa, Homo sapiens
  heavy chain complementarity determining region 3 for antibody 40495
ARDYFEGSYYGYFDH

SEQ ID NO: 80991 - protein, 9 aa, Homo sapiens
  light chain complementarity determining region 3 for antibody 40496
QQFNSWPLT

SEQ ID NO: 80992 - protein, 12 aa, Homo sapiens
  heavy chain complementarity determining region 3 for antibody 40496
ARDMVRGGWCDT

SEQ ID NO: 80993 - protein, 9 aa, Homo sapiens
  light chain complementarity determining region 3 for antibody 40497
QESYSTPWT

SEQ ID NO: 80994 - protein, 12 aa, Homo sapiens
  heavy chain complementarity determining region 3 for antibody 40497
ARESTGTTSFDY

SEQ ID NO: 80995 - protein, 9 aa, Homo sapiens
  light chain complementarity determining region 3 for antibody 40498
MQTLETPLT

SEQ ID NO: 80996 - protein, 11 aa, Homo sapiens
  heavy chain complementarity determining region 3 for antibody 40498
TRTDWERDLRD

SEQ ID NO: 80997 - protein, 9 aa, Homo sapiens
  light chain complementarity determining region 3 for antibody 40499
MQGSHWPLT

SEQ ID NO: 80998 - protein, 21 aa, Homo sapiens
  heavy chain complementarity determining region 3 for antibody 40499
ARLHRHYYDRSGNYVDDGFDV

SEQ ID NO: 80999 - protein, 9 aa, Homo sapiens
  light chain complementarity determining region 3 for antibody 40500
LQYNSYPRT

SEQ ID NO: 81000 - protein, 6 aa, Homo sapiens
  heavy chain complementarity determining region 3 for antibody 40500
SRQLDY

SEQ ID NO: 81001 - protein, 9 aa, Homo sapiens
  light chain complementarity determining region 3 for antibody 40501
LQYNNYPWA

SEQ ID NO: 81002 - protein, 15 aa, Homo sapiens
  heavy chain complementarity determining region 3 for antibody 40501
ARPTPESATYRGMDV

SEQ ID NO: 81003 - protein, 9 aa, Homo sapiens
  light chain complementarity determining region 3 for antibody 40502
LQHNTYPLT

SEQ ID NO: 81004 - protein, 14 aa, Homo sapiens
  heavy chain complementarity determining region 3 for antibody 40502
ARGRGWFADYGLDV

SEQ ID NO: 81005 - protein, 9 aa, Homo sapiens
  light chain complementarity determining region 3 for antibody 40503
LQHNNFPLT

SEQ ID NO: 81006 - protein, 15 aa, Homo sapiens
  heavy chain complementarity determining region 3 for antibody 40503
GRDLSIAGTDYGIDY

SEQ ID NO: 81007 - protein, 9 aa, Homo sapiens
  light chain complementarity determining region 3 for antibody 40504
LQDYNYPYT

SEQ ID NO: 81008 - protein, 12 aa, Homo sapiens
  heavy chain complementarity determining region 3 for antibody 40504
ARRNSGSYHFDY

SEQ ID NO: 81009 - protein, 9 aa, Homo sapiens
  light chain complementarity determining region 3 for antibody 40505
LQDYNYPRT

SEQ ID NO: 81010 - protein, 15 aa, Homo sapiens
  heavy chain complementarity determining region 3 for antibody 40505
AREADTTATRGYFDL

SEQ ID NO: 81011 - protein, 9 aa, Homo sapiens
  light chain complementarity determining region 3 for antibody 40506
HQRSNWPRT

SEQ ID NO: 81012 - protein, 8 aa, Homo sapiens
  heavy chain complementarity determining region 3 for antibody 40506
VRDGYKQR

SEQ ID NO: 81013 - protein, 8 aa, Homo sapiens
  light chain complementarity determining region 3 for antibody 40507
QYYGSSPG

SEQ ID NO: 81014 - protein, 9 aa, Homo sapiens
  heavy chain complementarity determining region 3 for antibody 40507
ARGYDAFDF

SEQ ID NO: 81015 - protein, 9 aa, Homo sapiens
  light chain complementarity determining region 3 for antibody 40508
QVYGSSPQT

SEQ ID NO: 81016 - protein, 18 aa, Homo sapiens
  heavy chain complementarity determining region 3 for antibody 40508
ARDGGGYNHGSSGAYLDY

SEQ ID NO: 81017 - protein, 9 aa, Homo sapiens
  light chain complementarity determining region 3 for antibody 40509
QQYNSDSAT

SEQ ID NO: 81018 - protein, 14 aa, Homo sapiens
  heavy chain complementarity determining region 3 for antibody 40509
ATKKHLVAPAGFHP

SEQ ID NO: 81019 - protein, 9 aa, Homo sapiens
  light chain complementarity determining region 3 for antibody 40510
QQYNNWPRT

SEQ ID NO: 81020 - protein, 16 aa, Homo sapiens
  heavy chain complementarity determining region 3 for antibody 40510
ARIETPAAQGPNSFDI

SEQ ID NO: 81021 - protein, 11 aa, Homo sapiens
  light chain complementarity determining region 3 for antibody 40511
QQYGTSPPRLT

SEQ ID NO: 81022 - protein, 9 aa, Homo sapiens
  heavy chain complementarity determining region 3 for antibody 40511
ARGSTALGY

SEQ ID NO: 81023 - protein, 9 aa, Homo sapiens
  light chain complementarity determining region 3 for antibody 40512
QQYGTSPFT

SEQ ID NO: 81024 - protein, 17 aa, Homo sapiens
  heavy chain complementarity determining region 3 for antibody 40512
AKSSKWLNNYYYFGLDL

SEQ ID NO: 81025 - protein, 9 aa, Homo sapiens
  light chain complementarity determining region 3 for antibody 40513
QQYGSSPWT

SEQ ID NO: 81026 - protein, 18 aa, Homo sapiens
  heavy chain complementarity determining region 3 for antibody 40513
ACSPAYGNYAGQNYGMDV

SEQ ID NO: 81027 - protein, 9 aa, Homo sapiens
  light chain complementarity determining region 3 for antibody 40514
QQYGSSPIT

SEQ ID NO: 81028 - protein, 15 aa, Homo sapiens
  heavy chain complementarity determining region 3 for antibody 40514
AREPRTSSGYMPSGY

SEQ ID NO: 81029 - protein, 9 aa, Homo sapiens
  light chain complementarity determining region 3 for antibody 40515
QQYGSSGCT

SEQ ID NO: 81030 - protein, 14 aa, Homo sapiens
  heavy chain complementarity determining region 3 for antibody 40515
ARDAPSYNYGAFDY

SEQ ID NO: 81031 - protein, 9 aa, Homo sapiens
  light chain complementarity determining region 3 for antibody 40516
QQYGDLPIT

SEQ ID NO: 81032 - protein, 16 aa, Homo sapiens
  heavy chain complementarity determining region 3 for antibody 40516
ARGGYQYYFDSSGLDY

SEQ ID NO: 81033 - protein, 9 aa, Homo sapiens
  light chain complementarity determining region 3 for antibody 40517
QQYGASPPT

SEQ ID NO: 81034 - protein, 26 aa, Homo sapiens
  heavy chain complementarity determining region 3 for antibody 40517
ASGPALPFLEWVARGRPPVAPLYFDS

SEQ ID NO: 81035 - protein, 8 aa, Homo sapiens
  light chain complementarity determining region 3 for antibody 40518
QQYELYWT

SEQ ID NO: 81036 - protein, 10 aa, Homo sapiens
  heavy chain complementarity determining region 3 for antibody 40518
ATRASFGPPY

SEQ ID NO: 81037 - protein, 9 aa, Homo sapiens
  light chain complementarity determining region 3 for antibody 40519
QQYDTYSYT

SEQ ID NO: 81038 - protein, 6 aa, Homo sapiens
  heavy chain complementarity determining region 3 for antibody 40519
GVWDNY

SEQ ID NO: 81039 - protein, 9 aa, Homo sapiens
  light chain complementarity determining region 3 for antibody 40520
QQYDSYPFT

SEQ ID NO: 81040 - protein, 16 aa, Homo sapiens
  heavy chain complementarity determining region 3 for antibody 40520
VRAHRDVGSWYRYFDL

SEQ ID NO: 81041 - protein, 9 aa, Homo sapiens
  light chain complementarity determining region 3 for antibody 40521
QQYDSPPPT

SEQ ID NO: 81042 - protein, 14 aa, Homo sapiens
  heavy chain complementarity determining region 3 for antibody 40521
GTGDYYDRSGLLDY

SEQ ID NO: 81043 - protein, 9 aa, Homo sapiens
  light chain complementarity determining region 3 for antibody 40522
QQYDNSPWT

SEQ ID NO: 81044 - protein, 16 aa, Homo sapiens
  heavy chain complementarity determining region 3 for antibody 40522
TTIYYNYYESPDVFDL

SEQ ID NO: 81045 - protein, 8 aa, Homo sapiens
  light chain complementarity determining region 3 for antibody 40523
QQYDLMYS

SEQ ID NO: 81046 - protein, 9 aa, Homo sapiens
  heavy chain complementarity determining region 3 for antibody 40523
ANLGAGLDY

SEQ ID NO: 81047 - protein, 9 aa, Homo sapiens
  light chain complementarity determining region 3 for antibody 40524
QQYAISPCT

SEQ ID NO: 81048 - protein, 12 aa, Homo sapiens
  heavy chain complementarity determining region 3 for antibody 40524
AQSVTAMRPFHS

SEQ ID NO: 81049 - protein, 9 aa, Homo sapiens
  light chain complementarity determining region 3 for antibody 40525
QQTFDTPWT

SEQ ID NO: 81050 - protein, 18 aa, Homo sapiens
  heavy chain complementarity determining region 3 for antibody 40525
ATDGIYCRAGSCYSEGLS

SEQ ID NO: 81051 - protein, 9 aa, Homo sapiens
  light chain complementarity determining region 3 for antibody 40526
QQSYSTPRT

SEQ ID NO: 81052 - protein, 13 aa, Homo sapiens
  heavy chain complementarity determining region 3 for antibody 40526
AKVAYMNSSPLTP

SEQ ID NO: 81053 - protein, 9 aa, Homo sapiens
  light chain complementarity determining region 3 for antibody 40527
QQSYSRPWT

SEQ ID NO: 81054 - protein, 17 aa, Homo sapiens
  heavy chain complementarity determining region 3 for antibody 40527
AKDKDYYDSSGTGPFDI

SEQ ID NO: 81055 - protein, 9 aa, Homo sapiens
  light chain complementarity determining region 3 for antibody 40528
QQSYSAPFT

SEQ ID NO: 81056 - protein, 21 aa, Homo sapiens
  heavy chain complementarity determining region 3 for antibody 40528
ARAVQSRGVRGIIILPDVFDI

SEQ ID NO: 81057 - protein, 9 aa, Homo sapiens
  light chain complementarity determining region 3 for antibody 40529
QQRSTWPLT

SEQ ID NO: 81058 - protein, 7 aa, Homo sapiens
  heavy chain complementarity determining region 3 for antibody 40529
VRDEWWP

SEQ ID NO: 81059 - protein, 10 aa, Homo sapiens
  light chain complementarity determining region 3 for antibody 40530
QQRSNWPPFT

SEQ ID NO: 81060 - protein, 18 aa, Homo sapiens
  heavy chain complementarity determining region 3 for antibody 40530
AIMLLGRAVVPTDEANDS

SEQ ID NO: 81061 - protein, 9 aa, Homo sapiens
  light chain complementarity determining region 3 for antibody 40531
QQRRNWPIT

SEQ ID NO: 81062 - protein, 15 aa, Homo sapiens
  heavy chain complementarity determining region 3 for antibody 40531
AREFPAPDVYHYFDC

SEQ ID NO: 81063 - protein, 11 aa, Homo sapiens
  light chain complementarity determining region 3 for antibody 40532
QQRNNFPAEYT

SEQ ID NO: 81064 - protein, 15 aa, Homo sapiens
  heavy chain complementarity determining region 3 for antibody 40532
AREGVERLTISAFDL

SEQ ID NO: 81065 - protein, 9 aa, Homo sapiens
  light chain complementarity determining region 3 for antibody 40533
QQLERSPWT

SEQ ID NO: 81066 - protein, 14 aa, Homo sapiens
  heavy chain complementarity determining region 3 for antibody 40533
ARAAPEYQWLVPED

SEQ ID NO: 81067 - protein, 10 aa, Homo sapiens
  light chain complementarity determining region 3 for antibody 40534
QQHGSSPKWT

SEQ ID NO: 81068 - protein, 9 aa, Homo sapiens
  heavy chain complementarity determining region 3 for antibody 40534
ARGEYSSTH

SEQ ID NO: 81069 - protein, 9 aa, Homo sapiens
  light chain complementarity determining region 3 for antibody 40535
QQFHSHPPT

SEQ ID NO: 81070 - protein, 18 aa, Homo sapiens
  heavy chain complementarity determining region 3 for antibody 40535
ARPPPHGFGGNYYYGMAV

SEQ ID NO: 81071 - protein, 9 aa, Homo sapiens
  light chain complementarity determining region 3 for antibody 40536
QQANTFPWT

SEQ ID NO: 81072 - protein, 19 aa, Homo sapiens
  heavy chain complementarity determining region 3 for antibody 40536
ARANGYCSGGSCYEYSFDY

SEQ ID NO: 81073 - protein, 10 aa, Homo sapiens
  light chain complementarity determining region 3 for antibody 40537
QLHGSSPKWT

SEQ ID NO: 81074 - protein, 9 aa, Homo sapiens
  heavy chain complementarity determining region 3 for antibody 40537
ARGEYSATH

SEQ ID NO: 81075 - protein, 10 aa, Homo sapiens
  light chain complementarity determining region 3 for antibody 40538
QERSTWPPRE

SEQ ID NO: 81076 - protein, 14 aa, Homo sapiens
  heavy chain complementarity determining region 3 for antibody 40538
AMRGLGSSGYYTDY

SEQ ID NO: 81077 - protein, 9 aa, Homo sapiens
  light chain complementarity determining region 3 for antibody 40539
MQGTHWPPN

SEQ ID NO: 81078 - protein, 14 aa, Homo sapiens
  heavy chain complementarity determining region 3 for antibody 40539
AKSPLESGVTDFDY

SEQ ID NO: 81079 - protein, 9 aa, Homo sapiens
  light chain complementarity determining region 3 for antibody 40540
LQYNSYPHT

SEQ ID NO: 81080 - protein, 16 aa, Homo sapiens
  heavy chain complementarity determining region 3 for antibody 40540
AKDDPYGGNSGSTFDI

SEQ ID NO: 81081 - protein, 9 aa, Homo sapiens
  light chain complementarity determining region 3 for antibody 40541
LQYNEFPYI

SEQ ID NO: 81082 - protein, 13 aa, Homo sapiens
  heavy chain complementarity determining region 3 for antibody 40541
ARSPYSSGWYPDF

SEQ ID NO: 81083 - protein, 9 aa, Homo sapiens
  light chain complementarity determining region 3 for antibody 40542
HQYGSSPRT

SEQ ID NO: 81084 - protein, 12 aa, Homo sapiens
  heavy chain complementarity determining region 3 for antibody 40542
AHFNWDRGTFDY

SEQ ID NO: 81085 - protein, 9 aa, Homo sapiens
  light chain complementarity determining region 3 for antibody 40543
HQYGSSPPT

SEQ ID NO: 81086 - protein, 16 aa, Homo sapiens
  heavy chain complementarity determining region 3 for antibody 40543
ARDFHPMAASDTAHDY

SEQ ID NO: 81087 - protein, 10 aa, Homo sapiens
  light chain complementarity determining region 3 for antibody 40544
HQYGSSPLYS

SEQ ID NO: 81088 - protein, 12 aa, Homo sapiens
  heavy chain complementarity determining region 3 for antibody 40544
AHSLTSLRAFDI

SEQ ID NO: 81089 - protein, 9 aa, Homo sapiens
  light chain complementarity determining region 3 for antibody 40545
QQYYSYPLT

SEQ ID NO: 81090 - protein, 14 aa, Homo sapiens
  heavy chain complementarity determining region 3 for antibody 40545
TRGRIDYGYSSFDY

SEQ ID NO: 81091 - protein, 9 aa, Homo sapiens
  light chain complementarity determining region 3 for antibody 40546
QQYVSSLIT

SEQ ID NO: 81092 - protein, 14 aa, Homo sapiens
  heavy chain complementarity determining region 3 for antibody 40546
ARALGFYGHDPFDI

SEQ ID NO: 81093 - protein, 9 aa, Homo sapiens
  light chain complementarity determining region 3 for antibody 40547
QQYNTYPWT

SEQ ID NO: 81094 - protein, 17 aa, Homo sapiens
  heavy chain complementarity determining region 3 for antibody 40547
ARTIYDTSWSSLGYFDY

SEQ ID NO: 81095 - protein, 9 aa, Homo sapiens
  light chain complementarity determining region 3 for antibody 40548
QQYNTYPPT

SEQ ID NO: 81096 - protein, 17 aa, Homo sapiens
  heavy chain complementarity determining region 3 for antibody 40548
AKDSSLWWDIVATTPDY

SEQ ID NO: 81097 - protein, 8 aa, Homo sapiens
  light chain complementarity determining region 3 for antibody 40549
QQYNNWYT

SEQ ID NO: 81098 - protein, 14 aa, Homo sapiens
  heavy chain complementarity determining region 3 for antibody 40549
AKEGDYDSSGYFDY

SEQ ID NO: 81099 - protein, 9 aa, Homo sapiens
  light chain complementarity determining region 3 for antibody 40550
QQYNNWPRT

SEQ ID NO: 81100 - protein, 17 aa, Homo sapiens
  heavy chain complementarity determining region 3 for antibody 40550
ARACGAGGGWHCGVFDD

SEQ ID NO: 81101 - protein, 9 aa, Homo sapiens
  light chain complementarity determining region 3 for antibody 40551
QQYGVSPFF

SEQ ID NO: 81102 - protein, 12 aa, Homo sapiens
  heavy chain complementarity determining region 3 for antibody 40551
ARGWNELDYFDY

SEQ ID NO: 81103 - protein, 9 aa, Homo sapiens
  light chain complementarity determining region 3 for antibody 40552
QQYGTSRWT

SEQ ID NO: 81104 - protein, 13 aa, Homo sapiens
  heavy chain complementarity determining region 3 for antibody 40552
ARSSSTWHVSEVY

SEQ ID NO: 81105 - protein, 9 aa, Homo sapiens
  light chain complementarity determining region 3 for antibody 40553
QQYGTSPWT

SEQ ID NO: 81106 - protein, 20 aa, Homo sapiens
  heavy chain complementarity determining region 3 for antibody 40553
AAARITMIEGLRGTYSGLDV

SEQ ID NO: 81107 - protein, 9 aa, Homo sapiens
  light chain complementarity determining region 3 for antibody 40554
QQYGTSPRT

SEQ ID NO: 81108 - protein, 16 aa, Homo sapiens
  heavy chain complementarity determining region 3 for antibody 40554
ARLPRLGSENSLAFDI

SEQ ID NO: 81109 - protein, 9 aa, Homo sapiens
  light chain complementarity determining region 3 for antibody 40555
QQYGSSPRT

SEQ ID NO: 81110 - protein, 12 aa, Homo sapiens
  heavy chain complementarity determining region 3 for antibody 40555
ARNPYGSGSMGY

SEQ ID NO: 81111 - protein, 9 aa, Homo sapiens
  light chain complementarity determining region 3 for antibody 40556
QQYGSSPGT

SEQ ID NO: 81112 - protein, 15 aa, Homo sapiens
  heavy chain complementarity determining region 3 for antibody 40556
ARGLFPMEDASGSYR

SEQ ID NO: 81113 - protein, 10 aa, Homo sapiens
  light chain complementarity determining region 3 for antibody 40557
QQYGSSPGLT

SEQ ID NO: 81114 - protein, 17 aa, Homo sapiens
  heavy chain complementarity determining region 3 for antibody 40557
ARGGDYGSFTAYSRIDH

SEQ ID NO: 81115 - protein, 9 aa, Homo sapiens
  light chain complementarity determining region 3 for antibody 40558
QQYGGLPLT

SEQ ID NO: 81116 - protein, 10 aa, Homo sapiens
  heavy chain complementarity determining region 3 for antibody 40558
SSIAADGKGY

SEQ ID NO: 81117 - protein, 9 aa, Homo sapiens
  light chain complementarity determining region 3 for antibody 40559
QQYGDSPLS

SEQ ID NO: 81118 - protein, 20 aa, Homo sapiens
  heavy chain complementarity determining region 3 for antibody 40559
ARTEMFYNHLTGYSTGAFDI

SEQ ID NO: 81119 - protein, 8 aa, Homo sapiens
  light chain complementarity determining region 3 for antibody 40560
QQYDVLYT

SEQ ID NO: 81120 - protein, 13 aa, Homo sapiens
  heavy chain complementarity determining region 3 for antibody 40560
VTGGVYSSGPLDF

SEQ ID NO: 81121 - protein, 9 aa, Homo sapiens
  light chain complementarity determining region 3 for antibody 40561
QQYDTYSGT

SEQ ID NO: 81122 - protein, 14 aa, Homo sapiens
  heavy chain complementarity determining region 3 for antibody 40561
ASSYIAGAGTYFDF

SEQ ID NO: 81123 - protein, 10 aa, Homo sapiens
  light chain complementarity determining region 3 for antibody 40562
QQYDTHPPIT

SEQ ID NO: 81124 - protein, 12 aa, Homo sapiens
  heavy chain complementarity determining region 3 for antibody 40562
ARYAWYRGSFDQ

SEQ ID NO: 81125 - protein, 9 aa, Homo sapiens
  light chain complementarity determining region 3 for antibody 40563
QQYDNSPWT

SEQ ID NO: 81126 - protein, 18 aa, Homo sapiens
  heavy chain complementarity determining region 3 for antibody 40563
ARPSHRHGSGWPDWFFDL

SEQ ID NO: 81127 - protein, 9 aa, Homo sapiens
  light chain complementarity determining region 3 for antibody 40564
QQYDNLPRT

SEQ ID NO: 81128 - protein, 18 aa, Homo sapiens
  heavy chain complementarity determining region 3 for antibody 40564
ARDRDAAMASYYYYGMDV

SEQ ID NO: 81129 - protein, 8 aa, Homo sapiens
  light chain complementarity determining region 3 for antibody 40565
QQYDNLPQ

SEQ ID NO: 81130 - protein, 12 aa, Homo sapiens
  heavy chain complementarity determining region 3 for antibody 40565
AKFAGSSDPFDF

SEQ ID NO: 81131 - protein, 9 aa, Homo sapiens
  light chain complementarity determining region 3 for antibody 40566
QQYDNFLVT

SEQ ID NO: 81132 - protein, 15 aa, Homo sapiens
  heavy chain complementarity determining region 3 for antibody 40566
ARGGVYRSGWYGFDF

SEQ ID NO: 81133 - protein, 9 aa, Homo sapiens
  light chain complementarity determining region 3 for antibody 40567
QQYDDFPFT

SEQ ID NO: 81134 - protein, 11 aa, Homo sapiens
  heavy chain complementarity determining region 3 for antibody 40567
AGRGFAGKWNL

SEQ ID NO: 81135 - protein, 9 aa, Homo sapiens
  light chain complementarity determining region 3 for antibody 40568
QQSYSTPYT

SEQ ID NO: 81136 - protein, 12 aa, Homo sapiens
  heavy chain complementarity determining region 3 for antibody 40568
TRDGTVTTDLQL

SEQ ID NO: 81137 - protein, 9 aa, Homo sapiens
  light chain complementarity determining region 3 for antibody 40569
QQSYSTPQT

SEQ ID NO: 81138 - protein, 12 aa, Homo sapiens
  heavy chain complementarity determining region 3 for antibody 40569
ARFLHYGDYPDY

SEQ ID NO: 81139 - protein, 9 aa, Homo sapiens
  light chain complementarity determining region 3 for antibody 40570
QQSYSTPFT

SEQ ID NO: 81140 - protein, 18 aa, Homo sapiens
  heavy chain complementarity determining region 3 for antibody 40570
ARDLRPAISSGWYDAFDI

SEQ ID NO: 81141 - protein, 10 aa, Homo sapiens
  light chain complementarity determining region 3 for antibody 40571
QQSYDSAPIT

SEQ ID NO: 81142 - protein, 11 aa, Homo sapiens
  heavy chain complementarity determining region 3 for antibody 40571
VTGGGYDGFDY

SEQ ID NO: 81143 - protein, 9 aa, Homo sapiens
  light chain complementarity determining region 3 for antibody 40572
QQSSSIPIT

SEQ ID NO: 81144 - protein, 19 aa, Homo sapiens
  heavy chain complementarity determining region 3 for antibody 40572
AKVGRNPNFSSGWYHHIDY

SEQ ID NO: 81145 - protein, 8 aa, Homo sapiens
  light chain complementarity determining region 3 for antibody 40573
QQSLSMLT

SEQ ID NO: 81146 - protein, 12 aa, Homo sapiens
  heavy chain complementarity determining region 3 for antibody 40573
AKCNAFFDFCGD

SEQ ID NO: 81147 - protein, 9 aa, Homo sapiens
  light chain complementarity determining region 3 for antibody 40574
QQSFETPRT

SEQ ID NO: 81148 - protein, 17 aa, Homo sapiens
  heavy chain complementarity determining region 3 for antibody 40574
AKDVHSRQGYYYYGMDV

SEQ ID NO: 81149 - protein, 9 aa, Homo sapiens
  light chain complementarity determining region 3 for antibody 40575
QQRSNWPVT

SEQ ID NO: 81150 - protein, 18 aa, Homo sapiens
  heavy chain complementarity determining region 3 for antibody 40575
ARENVWFGELIYYYGMDV

SEQ ID NO: 81151 - protein, 9 aa, Homo sapiens
  light chain complementarity determining region 3 for antibody 40576
QQRSNWPLT

SEQ ID NO: 81152 - protein, 18 aa, Homo sapiens
  heavy chain complementarity determining region 3 for antibody 40576
ARTLNLLRGVTQYNWFGP

SEQ ID NO: 81153 - protein, 9 aa, Homo sapiens
  light chain complementarity determining region 3 for antibody 40577
QQRSDWPIT

SEQ ID NO: 81154 - protein, 16 aa, Homo sapiens
  heavy chain complementarity determining region 3 for antibody 40577
ARDLDSSGLYERGSDP

SEQ ID NO: 81155 - protein, 10 aa, Homo sapiens
  light chain complementarity determining region 3 for antibody 40578
QQRSDWPIFT

SEQ ID NO: 81156 - protein, 15 aa, Homo sapiens
  heavy chain complementarity determining region 3 for antibody 40578
ARVLVGFGELLGFDL

SEQ ID NO: 81157 - protein, 9 aa, Homo sapiens
  light chain complementarity determining region 3 for antibody 40579
QQRNTWPPT

SEQ ID NO: 81158 - protein, 14 aa, Homo sapiens
  heavy chain complementarity determining region 3 for antibody 40579
ARDGGTGDYNQFDY

SEQ ID NO: 81159 - protein, 9 aa, Homo sapiens
  light chain complementarity determining region 3 for antibody 40580
QQRGDWPLT

SEQ ID NO: 81160 - protein, 17 aa, Homo sapiens
  heavy chain complementarity determining region 3 for antibody 40580
AIIPAAKAYYNSFDMDV

SEQ ID NO: 81161 - protein, 9 aa, Homo sapiens
  light chain complementarity determining region 3 for antibody 40581
QQLNSYPLS

SEQ ID NO: 81162 - protein, 14 aa, Homo sapiens
  heavy chain complementarity determining region 3 for antibody 40581
AREGFGYTNYWFDP

SEQ ID NO: 81163 - protein, 9 aa, Homo sapiens
  light chain complementarity determining region 3 for antibody 40582
QQFNIYPPT

SEQ ID NO: 81164 - protein, 15 aa, Homo sapiens
  heavy chain complementarity determining region 3 for antibody 40582
ARDSGIKVRQDYFDY

SEQ ID NO: 81165 - protein, 9 aa, Homo sapiens
  light chain complementarity determining region 3 for antibody 40583
QQFENSPYS

SEQ ID NO: 81166 - protein, 11 aa, Homo sapiens
  heavy chain complementarity determining region 3 for antibody 40583
AKVGTMRAFDY

SEQ ID NO: 81167 - protein, 9 aa, Homo sapiens
  light chain complementarity determining region 3 for antibody 40584
QQAYSTPPT

SEQ ID NO: 81168 - protein, 11 aa, Homo sapiens
  heavy chain complementarity determining region 3 for antibody 40584
ARAWGRDGMDV

SEQ ID NO: 81169 - protein, 9 aa, Homo sapiens
  light chain complementarity determining region 3 for antibody 40585
QHYVRSPLT

SEQ ID NO: 81170 - protein, 22 aa, Homo sapiens
  heavy chain complementarity determining region 3 for antibody 40585
ARWGGHCSQINCFPGAILPLDF

SEQ ID NO: 81171 - protein, 10 aa, Homo sapiens
  light chain complementarity determining region 3 for antibody 40586
QHYGSSPAWT

SEQ ID NO: 81172 - protein, 12 aa, Homo sapiens
  heavy chain complementarity determining region 3 for antibody 40586
ARAQTTVTTADF

SEQ ID NO: 81173 - protein, 10 aa, Homo sapiens
  light chain complementarity determining region 3 for antibody 40587
QHYGSSLMYT

SEQ ID NO: 81174 - protein, 14 aa, Homo sapiens
  heavy chain complementarity determining region 3 for antibody 40587
TTDRPHTGMVTFDY

SEQ ID NO: 81175 - protein, 9 aa, Homo sapiens
  light chain complementarity determining region 3 for antibody 40588
QHYAGSPLT

SEQ ID NO: 81176 - protein, 11 aa, Homo sapiens
  heavy chain complementarity determining region 3 for antibody 40588
ARKETSRALDV

SEQ ID NO: 81177 - protein, 9 aa, Homo sapiens
  light chain complementarity determining region 3 for antibody 40589
QHSLTTPRT

SEQ ID NO: 81178 - protein, 14 aa, Homo sapiens
  heavy chain complementarity determining region 3 for antibody 40589
ARQHGSLPGPPIDH

SEQ ID NO: 81179 - protein, 9 aa, Homo sapiens
  light chain complementarity determining region 3 for antibody 40590
MQVLQTPQT

SEQ ID NO: 81180 - protein, 20 aa, Homo sapiens
  heavy chain complementarity determining region 3 for antibody 40590
SSGGYFYDSPGSSVLDYFDH

SEQ ID NO: 81181 - protein, 9 aa, Homo sapiens
  light chain complementarity determining region 3 for antibody 40591
LQHNSYPFT

SEQ ID NO: 81182 - protein, 7 aa, Homo sapiens
  heavy chain complementarity determining region 3 for antibody 40591
ADVGWGV

SEQ ID NO: 81183 - protein, 9 aa, Homo sapiens
  light chain complementarity determining region 3 for antibody 40592
HQTYSTPYT

SEQ ID NO: 81184 - protein, 11 aa, Homo sapiens
  heavy chain complementarity determining region 3 for antibody 40592
EGVEMATIVDY

SEQ ID NO: 81185 - protein, 9 aa, Homo sapiens
  light chain complementarity determining region 3 for antibody 40593
HQSSGLEGT

SEQ ID NO: 81186 - protein, 18 aa, Homo sapiens
  heavy chain complementarity determining region 3 for antibody 40593
ARGSPREYSGYDAEALDL

SEQ ID NO: 81187 - protein, 9 aa, Homo sapiens
  light chain complementarity determining region 3 for antibody 40594
HEFKSAPWT

SEQ ID NO: 81188 - protein, 14 aa, Homo sapiens
  heavy chain complementarity determining region 3 for antibody 40594
ARARDASGFHAFDI

SEQ ID NO: 81189 - protein, 9 aa, Homo sapiens
  light chain complementarity determining region 3 for antibody 40595
QYYGSSLCS

SEQ ID NO: 81190 - protein, 19 aa, Homo sapiens
  heavy chain complementarity determining region 3 for antibody 40595
ARVRGFSLLVAVIPDAFDI

SEQ ID NO: 81191 - protein, 8 aa, Homo sapiens
  light chain complementarity determining region 3 for antibody 40596
QYFGTSWT

SEQ ID NO: 81192 - protein, 15 aa, Homo sapiens
  heavy chain complementarity determining region 3 for antibody 40596
VKAKIALAGEDIVDH

SEQ ID NO: 81193 - protein, 9 aa, Homo sapiens
  light chain complementarity determining region 3 for antibody 40597
QQYYSPPVT

SEQ ID NO: 81194 - protein, 16 aa, Homo sapiens
  heavy chain complementarity determining region 3 for antibody 40597
ARLTESSGYHDEGSDI

SEQ ID NO: 81195 - protein, 9 aa, Homo sapiens
  light chain complementarity determining region 3 for antibody 40598
QQYSSFPWT

SEQ ID NO: 81196 - protein, 17 aa, Homo sapiens
  heavy chain complementarity determining region 3 for antibody 40598
ARVPLPGCGGNCQPIDS

SEQ ID NO: 81197 - protein, 9 aa, Homo sapiens
  light chain complementarity determining region 3 for antibody 40599
QQYNTYPWT

SEQ ID NO: 81198 - protein, 12 aa, Homo sapiens
  heavy chain complementarity determining region 3 for antibody 40599
AKVNWPDSGNDS

SEQ ID NO: 81199 - protein, 10 aa, Homo sapiens
  light chain complementarity determining region 3 for antibody 40600
QQYNSESMYT

SEQ ID NO: 81200 - protein, 15 aa, Homo sapiens
  heavy chain complementarity determining region 3 for antibody 40600
TRQRWKAWGEDAFDI

SEQ ID NO: 81201 - protein, 9 aa, Homo sapiens
  light chain complementarity determining region 3 for antibody 40601
QQYNNWPVA

SEQ ID NO: 81202 - protein, 9 aa, Homo sapiens
  heavy chain complementarity determining region 3 for antibody 40601
VRDKWGIDY

SEQ ID NO: 81203 - protein, 9 aa, Homo sapiens
  light chain complementarity determining region 3 for antibody 40602
QQYNNWPRT

SEQ ID NO: 81204 - protein, 13 aa, Homo sapiens
  heavy chain complementarity determining region 3 for antibody 40602
ARWGIVGHDAPDI

SEQ ID NO: 81205 - protein, 9 aa, Homo sapiens
  light chain complementarity determining region 3 for antibody 40603
QQYNNWPRT

SEQ ID NO: 81206 - protein, 13 aa, Homo sapiens
  heavy chain complementarity determining region 3 for antibody 40603
ARGSENSPWDPHY

SEQ ID NO: 81207 - protein, 9 aa, Homo sapiens
  light chain complementarity determining region 3 for antibody 40604
QQYKTYPYT

SEQ ID NO: 81208 - protein, 14 aa, Homo sapiens
  heavy chain complementarity determining region 3 for antibody 40604
AKARYGSGYSDPDH

SEQ ID NO: 81209 - protein, 8 aa, Homo sapiens
  light chain complementarity determining region 3 for antibody 40605
QQYKSYST

SEQ ID NO: 81210 - protein, 16 aa, Homo sapiens
  heavy chain complementarity determining region 3 for antibody 40605
AVSLRGGSGWYGPIHH

SEQ ID NO: 81211 - protein, 9 aa, Homo sapiens
  light chain complementarity determining region 3 for antibody 40606
QQYHRYPHA

SEQ ID NO: 81212 - protein, 13 aa, Homo sapiens
  heavy chain complementarity determining region 3 for antibody 40606
VRDQGQELVPDDY

SEQ ID NO: 81213 - protein, 9 aa, Homo sapiens
  light chain complementarity determining region 3 for antibody 40607
QQYGSSSIT

SEQ ID NO: 81214 - protein, 21 aa, Homo sapiens
  heavy chain complementarity determining region 3 for antibody 40607
ARDAPVSRPYSSTWYSSAFDY

SEQ ID NO: 81215 - protein, 9 aa, Homo sapiens
  light chain complementarity determining region 3 for antibody 40608
QQYGSSPYT

SEQ ID NO: 81216 - protein, 13 aa, Homo sapiens
  heavy chain complementarity determining region 3 for antibody 40608
ARAKGSGWLPPGH

SEQ ID NO: 81217 - protein, 7 aa, Homo sapiens
  light chain complementarity determining region 3 for antibody 40609
QQYGSSP

SEQ ID NO: 81218 - protein, 15 aa, Homo sapiens
  heavy chain complementarity determining region 3 for antibody 40609
VRRLAAPGSGDAFDI

SEQ ID NO: 81219 - protein, 9 aa, Homo sapiens
  light chain complementarity determining region 3 for antibody 40610
QQYGSSPRT

SEQ ID NO: 81220 - protein, 17 aa, Homo sapiens
  heavy chain complementarity determining region 3 for antibody 40610
ARMASSDSSGYFGYFEL

SEQ ID NO: 81221 - protein, 9 aa, Homo sapiens
  light chain complementarity determining region 3 for antibody 40611
QQYGSSPLT

SEQ ID NO: 81222 - protein, 16 aa, Homo sapiens
  heavy chain complementarity determining region 3 for antibody 40611
AKPHSSGYYVKDAFDI

SEQ ID NO: 81223 - protein, 9 aa, Homo sapiens
  light chain complementarity determining region 3 for antibody 40612
QQYGRSPQT

SEQ ID NO: 81224 - protein, 16 aa, Homo sapiens
  heavy chain complementarity determining region 3 for antibody 40612
ARGSPTVEDFSWPSDL

SEQ ID NO: 81225 - protein, 8 aa, Homo sapiens
  light chain complementarity determining region 3 for antibody 40613
QQYGMSVT

SEQ ID NO: 81226 - protein, 17 aa, Homo sapiens
  heavy chain complementarity determining region 3 for antibody 40613
ARHAHDSDMSGFYPFEH

SEQ ID NO: 81227 - protein, 9 aa, Homo sapiens
  light chain complementarity determining region 3 for antibody 40614
QQYGDSPWT

SEQ ID NO: 81228 - protein, 13 aa, Homo sapiens
  heavy chain complementarity determining region 3 for antibody 40614
AREANIHSPAFDK

SEQ ID NO: 81229 - protein, 9 aa, Homo sapiens
  light chain complementarity determining region 3 for antibody 40615
QQYFDLPIT

SEQ ID NO: 81230 - protein, 15 aa, Homo sapiens
  heavy chain complementarity determining region 3 for antibody 40615
ARDPGRGGSWSRFDL

SEQ ID NO: 81231 - protein, 9 aa, Homo sapiens
  light chain complementarity determining region 3 for antibody 40616
QQYDTSPRT

SEQ ID NO: 81232 - protein, 13 aa, Homo sapiens
  heavy chain complementarity determining region 3 for antibody 40616
AREVGSGWYYFDY

SEQ ID NO: 81233 - protein, 9 aa, Homo sapiens
  light chain complementarity determining region 3 for antibody 40617
QQYDSYPPT

SEQ ID NO: 81234 - protein, 16 aa, Homo sapiens
  heavy chain complementarity determining region 3 for antibody 40617
ARGGGYSFGQWYYFDY

SEQ ID NO: 81235 - protein, 9 aa, Homo sapiens
  light chain complementarity determining region 3 for antibody 40618
QQYDNLPPT

SEQ ID NO: 81236 - protein, 17 aa, Homo sapiens
  heavy chain complementarity determining region 3 for antibody 40618
ARWKESARTTEAYYFDY

SEQ ID NO: 81237 - protein, 9 aa, Homo sapiens
  light chain complementarity determining region 3 for antibody 40619
QQYDGSPWT

SEQ ID NO: 81238 - protein, 12 aa, Homo sapiens
  heavy chain complementarity determining region 3 for antibody 40619
VRDGVGAPPFDY

SEQ ID NO: 81239 - protein, 9 aa, Homo sapiens
  light chain complementarity determining region 3 for antibody 40620
QQYAHSPLT

SEQ ID NO: 81240 - protein, 10 aa, Homo sapiens
  heavy chain complementarity determining region 3 for antibody 40620
AIGVGWLIDY

SEQ ID NO: 81241 - protein, 9 aa, Homo sapiens
  light chain complementarity determining region 3 for antibody 40621
QQTYSTPWT

SEQ ID NO: 81242 - protein, 18 aa, Homo sapiens
  heavy chain complementarity determining region 3 for antibody 40621
AKHTPGGSGWSGRDALDV

SEQ ID NO: 81243 - protein, 9 aa, Homo sapiens
  light chain complementarity determining region 3 for antibody 40622
QQSYTTTHK

SEQ ID NO: 81244 - protein, 20 aa, Homo sapiens
  heavy chain complementarity determining region 3 for antibody 40622
ARTRDNYGSASYYGYYGMDV

SEQ ID NO: 81245 - protein, 10 aa, Homo sapiens
  light chain complementarity determining region 3 for antibody 40623
QQSYSTPSLT

SEQ ID NO: 81246 - protein, 19 aa, Homo sapiens
  heavy chain complementarity determining region 3 for antibody 40623
ARDRDQNKDGSFNHSALDV

SEQ ID NO: 81247 - protein, 9 aa, Homo sapiens
  light chain complementarity determining region 3 for antibody 40624
QQSYSTPQT

SEQ ID NO: 81248 - protein, 12 aa, Homo sapiens
  heavy chain complementarity determining region 3 for antibody 40624
ARDVSAPAKTDY

SEQ ID NO: 81249 - protein, 9 aa, Homo sapiens
  light chain complementarity determining region 3 for antibody 40625
QQSYSTPFT

SEQ ID NO: 81250 - protein, 15 aa, Homo sapiens
  heavy chain complementarity determining region 3 for antibody 40625
AKGRLGGKGSGYLVY

SEQ ID NO: 81251 - protein, 8 aa, Homo sapiens
  light chain complementarity determining region 3 for antibody 40626
QQSYSSWT

SEQ ID NO: 81252 - protein, 15 aa, Homo sapiens
  heavy chain complementarity determining region 3 for antibody 40626
ARGGTGYYSGHFFDI

SEQ ID NO: 81253 - protein, 8 aa, Homo sapiens
  light chain complementarity determining region 3 for antibody 40627
QQSYSNPS

SEQ ID NO: 81254 - protein, 20 aa, Homo sapiens
  heavy chain complementarity determining region 3 for antibody 40627
ARSPTPPYTHLTGYQFYFDS

SEQ ID NO: 81255 - protein, 9 aa, Homo sapiens
  light chain complementarity determining region 3 for antibody 40628
QQSYSIPYT

SEQ ID NO: 81256 - protein, 13 aa, Homo sapiens
  heavy chain complementarity determining region 3 for antibody 40628
ARDLAMTTGLFDY

SEQ ID NO: 81257 - protein, 9 aa, Homo sapiens
  light chain complementarity determining region 3 for antibody 40629
QQSYSAPLT

SEQ ID NO: 81258 - protein, 14 aa, Homo sapiens
  heavy chain complementarity determining region 3 for antibody 40629
AKCRDSSGYSGFDL

SEQ ID NO: 81259 - protein, 9 aa, Homo sapiens
  light chain complementarity determining region 3 for antibody 40630
QQSYGTPRT

SEQ ID NO: 81260 - protein, 16 aa, Homo sapiens
  heavy chain complementarity determining region 3 for antibody 40630
ARDAGVVDGTGTYFDY

SEQ ID NO: 81261 - protein, 9 aa, Homo sapiens
  light chain complementarity determining region 3 for antibody 40631
QQSSSSPWT

SEQ ID NO: 81262 - protein, 11 aa, Homo sapiens
  heavy chain complementarity determining region 3 for antibody 40631
ARLGTWKDFDS

SEQ ID NO: 81263 - protein, 9 aa, Homo sapiens
  light chain complementarity determining region 3 for antibody 40632
QQSSNIPWT

SEQ ID NO: 81264 - protein, 16 aa, Homo sapiens
  heavy chain complementarity determining region 3 for antibody 40632
AKVATIEVRGAGALDL

SEQ ID NO: 81265 - protein, 8 aa, Homo sapiens
  light chain complementarity determining region 3 for antibody 40633
QQSDSSSS

SEQ ID NO: 81266 - protein, 14 aa, Homo sapiens
  heavy chain complementarity determining region 3 for antibody 40633
AKGPTVTTPYYFDA

SEQ ID NO: 81267 - protein, 9 aa, Homo sapiens
  light chain complementarity determining region 3 for antibody 40634
QQRTNWPLT

SEQ ID NO: 81268 - protein, 17 aa, Homo sapiens
  heavy chain complementarity determining region 3 for antibody 40634
VKGGIYGEFYYYYGMDV

SEQ ID NO: 81269 - protein, 8 aa, Homo sapiens
  light chain complementarity determining region 3 for antibody 40635
QQRSDSYT

SEQ ID NO: 81270 - protein, 14 aa, Homo sapiens
  heavy chain complementarity determining region 3 for antibody 40635
AGIYGDFPDNWFDP

SEQ ID NO: 81271 - protein, 9 aa, Homo sapiens
  light chain complementarity determining region 3 for antibody 40636
QQLNNYPWT

SEQ ID NO: 81272 - protein, 15 aa, Homo sapiens
  heavy chain complementarity determining region 3 for antibody 40636
VRLRGSSAFQRALDI

SEQ ID NO: 81273 - protein, 9 aa, Homo sapiens
  light chain complementarity determining region 3 for antibody 40637
QQGYSRLPT

SEQ ID NO: 81274 - protein, 18 aa, Homo sapiens
  heavy chain complementarity determining region 3 for antibody 40637
ARGYGSGSYFNYYYGMDV

SEQ ID NO: 81275 - protein, 9 aa, Homo sapiens
  light chain complementarity determining region 3 for antibody 40638
QQGSTYPLT

SEQ ID NO: 81276 - protein, 20 aa, Homo sapiens
  heavy chain complementarity determining region 3 for antibody 40638
ARYPRREHNYGTTGYYSFDS

SEQ ID NO: 81277 - protein, 9 aa, Homo sapiens
  light chain complementarity determining region 3 for antibody 40639
QQFYTTPRT

SEQ ID NO: 81278 - protein, 9 aa, Homo sapiens
  heavy chain complementarity determining region 3 for antibody 40639
ARLSDYFDI

SEQ ID NO: 81279 - protein, 8 aa, Homo sapiens
  light chain complementarity determining region 3 for antibody 40640
QQCNSSWT

SEQ ID NO: 81280 - protein, 13 aa, Homo sapiens
  heavy chain complementarity determining region 3 for antibody 40640
AKVKVVGVWLFDL

SEQ ID NO: 81281 - protein, 9 aa, Homo sapiens
  light chain complementarity determining region 3 for antibody 40641
QQCNKWPLT

SEQ ID NO: 81282 - protein, 15 aa, Homo sapiens
  heavy chain complementarity determining region 3 for antibody 40641
ARDGGSSSWNNYFDF

SEQ ID NO: 81283 - protein, 9 aa, Homo sapiens
  light chain complementarity determining region 3 for antibody 40642
QKYDSAPRT

SEQ ID NO: 81284 - protein, 11 aa, Homo sapiens
  heavy chain complementarity determining region 3 for antibody 40642
ARDRFVGAHFY

SEQ ID NO: 81285 - protein, 11 aa, Homo sapiens
  light chain complementarity determining region 3 for antibody 40643
QEVKSYPRRLT

SEQ ID NO: 81286 - protein, 15 aa, Homo sapiens
  heavy chain complementarity determining region 3 for antibody 40643
ARGAASFSGYDAFDI

SEQ ID NO: 81287 - protein, 8 aa, Homo sapiens
  light chain complementarity determining region 3 for antibody 40644
MQGSHWPS

SEQ ID NO: 81288 - protein, 8 aa, Homo sapiens
  heavy chain complementarity determining region 3 for antibody 40644
ATWGRSDF

SEQ ID NO: 81289 - protein, 9 aa, Homo sapiens
  light chain complementarity determining region 3 for antibody 40645
LQTNTYPRT

SEQ ID NO: 81290 - protein, 5 aa, Homo sapiens
  heavy chain complementarity determining region 3 for antibody 40645
AREDV

SEQ ID NO: 81291 - protein, 9 aa, Homo sapiens
  light chain complementarity determining region 3 for antibody 40646
LQSSGPPLT

SEQ ID NO: 81292 - protein, 11 aa, Homo sapiens
  heavy chain complementarity determining region 3 for antibody 40646
VRFFVVAGTVV

SEQ ID NO: 81293 - protein, 9 aa, Homo sapiens
  light chain complementarity determining region 3 for antibody 40647
LQHRGYPHT

SEQ ID NO: 81294 - protein, 15 aa, Homo sapiens
  heavy chain complementarity determining region 3 for antibody 40647
GRSKFYYESASQFDS

SEQ ID NO: 81295 - protein, 9 aa, Homo sapiens
  light chain complementarity determining region 3 for antibody 40648
LQHKSYPYT

SEQ ID NO: 81296 - protein, 17 aa, Homo sapiens
  heavy chain complementarity determining region 3 for antibody 40648
ARDFTYYYDSRGYDADY

SEQ ID NO: 81297 - protein, 9 aa, Homo sapiens
  light chain complementarity determining region 3 for antibody 40649
LQHDSYPPT

SEQ ID NO: 81298 - protein, 16 aa, Homo sapiens
  heavy chain complementarity determining region 3 for antibody 40649
ARDGLWFGELDWYFDL

SEQ ID NO: 81299 - protein, 9 aa, Homo sapiens
  light chain complementarity determining region 3 for antibody 40650
LQHARLPLT

SEQ ID NO: 81300 - protein, 19 aa, Homo sapiens
  heavy chain complementarity determining region 3 for antibody 40650
AKAPLPGYCGGGACYGVDY

SEQ ID NO: 81301 - protein, 9 aa, Homo sapiens
  light chain complementarity determining region 3 for antibody 40651
HQYDTYSWT

SEQ ID NO: 81302 - protein, 16 aa, Homo sapiens
  heavy chain complementarity determining region 3 for antibody 40651
ATGRGYELKTGWYFDL

SEQ ID NO: 81303 - protein, 9 aa, Homo sapiens
  light chain complementarity determining region 3 for antibody 40652
QRQDRAPLT

SEQ ID NO: 81304 - protein, 10 aa, Homo sapiens
  heavy chain complementarity determining region 3 for antibody 40652
ARDEGYFGTS

SEQ ID NO: 81305 - protein, 9 aa, Homo sapiens
  light chain complementarity determining region 3 for antibody 40653
QQYYNSLFT

SEQ ID NO: 81306 - protein, 20 aa, Homo sapiens
  heavy chain complementarity determining region 3 for antibody 40653
ARHAVGPCSGATCYLYAFDL

SEQ ID NO: 81307 - protein, 8 aa, Homo sapiens
  light chain complementarity determining region 3 for antibody 40654
QQYSSYLS

SEQ ID NO: 81308 - protein, 13 aa, Homo sapiens
  heavy chain complementarity determining region 3 for antibody 40654
ARMSSGSLTTLDH

SEQ ID NO: 81309 - protein, 8 aa, Homo sapiens
  light chain complementarity determining region 3 for antibody 40655
QQYSGFWT

SEQ ID NO: 81310 - protein, 21 aa, Homo sapiens
  heavy chain complementarity determining region 3 for antibody 40655
ARQHTYFGNSGFKFPEGYFDL

SEQ ID NO: 81311 - protein, 9 aa, Homo sapiens
  light chain complementarity determining region 3 for antibody 40656
QQYSDYPLT

SEQ ID NO: 81312 - protein, 13 aa, Homo sapiens
  heavy chain complementarity determining region 3 for antibody 40656
TRDISVRLDTGDY

SEQ ID NO: 81313 - protein, 9 aa, Homo sapiens
  light chain complementarity determining region 3 for antibody 40657
QQYNTYPYT

SEQ ID NO: 81314 - protein, 17 aa, Homo sapiens
  heavy chain complementarity determining region 3 for antibody 40657
AKDINPSHYGFSSVSDY

SEQ ID NO: 81315 - protein, 9 aa, Homo sapiens
  light chain complementarity determining region 3 for antibody 40658
QQYNTDSAA

SEQ ID NO: 81316 - protein, 16 aa, Homo sapiens
  heavy chain complementarity determining region 3 for antibody 40658
ARIQLKGSYYDRPLDY

SEQ ID NO: 81317 - protein, 9 aa, Homo sapiens
  light chain complementarity determining region 3 for antibody 40659
QQYNSYPPT

SEQ ID NO: 81318 - protein, 12 aa, Homo sapiens
  heavy chain complementarity determining region 3 for antibody 40659
ARDDGTGSHFDY

SEQ ID NO: 81319 - protein, 9 aa, Homo sapiens
  light chain complementarity determining region 3 for antibody 40660
QQYNNWPPS

SEQ ID NO: 81320 - protein, 15 aa, Homo sapiens
  heavy chain complementarity determining region 3 for antibody 40660
ARYPPSGWGNYYFDI

SEQ ID NO: 81321 - protein, 9 aa, Homo sapiens
  light chain complementarity determining region 3 for antibody 40661
QQYNDWPQT

SEQ ID NO: 81322 - protein, 19 aa, Homo sapiens
  heavy chain complementarity determining region 3 for antibody 40661
TRHRRFGSSYSNVWYSFDY

SEQ ID NO: 81323 - protein, 10 aa, Homo sapiens
  light chain complementarity determining region 3 for antibody 40662
QQYNDWPAFT

SEQ ID NO: 81324 - protein, 15 aa, Homo sapiens
  heavy chain complementarity determining region 3 for antibody 40662
SRPLSIGGLYSGSQY

SEQ ID NO: 81325 - protein, 9 aa, Homo sapiens
  light chain complementarity determining region 3 for antibody 40663
QQYGTPPRT

SEQ ID NO: 81326 - protein, 14 aa, Homo sapiens
  heavy chain complementarity determining region 3 for antibody 40663
AKDPSDDGGGYFDS

SEQ ID NO: 81327 - protein, 9 aa, Homo sapiens
  light chain complementarity determining region 3 for antibody 40664
QQYGSSPQT

SEQ ID NO: 81328 - protein, 16 aa, Homo sapiens
  heavy chain complementarity determining region 3 for antibody 40664
ARGSRGGPIILSDFDY

SEQ ID NO: 81329 - protein, 10 aa, Homo sapiens
  light chain complementarity determining region 3 for antibody 40665
QQYGSSPPGT

SEQ ID NO: 81330 - protein, 13 aa, Homo sapiens
  heavy chain complementarity determining region 3 for antibody 40665
ARKRGYSYGYLDY

SEQ ID NO: 81331 - protein, 10 aa, Homo sapiens
  light chain complementarity determining region 3 for antibody 40666
QQYGSSPEIT

SEQ ID NO: 81332 - protein, 12 aa, Homo sapiens
  heavy chain complementarity determining region 3 for antibody 40666
AHREFGHYYLDY

SEQ ID NO: 81333 - protein, 9 aa, Homo sapiens
  light chain complementarity determining region 3 for antibody 40667
QQYGSSPDT

SEQ ID NO: 81334 - protein, 18 aa, Homo sapiens
  heavy chain complementarity determining region 3 for antibody 40667
TKKTFSYDSSGLGDAFDI

SEQ ID NO: 81335 - protein, 8 aa, Homo sapiens
  light chain complementarity determining region 3 for antibody 40668
QQYGSSFT

SEQ ID NO: 81336 - protein, 11 aa, Homo sapiens
  heavy chain complementarity determining region 3 for antibody 40668
TTGLGSGGTNY

SEQ ID NO: 81337 - protein, 8 aa, Homo sapiens
  light chain complementarity determining region 3 for antibody 40669
QQYGSSFT

SEQ ID NO: 81338 - protein, 11 aa, Homo sapiens
  heavy chain complementarity determining region 3 for antibody 40669
ARMTSLGLFDY

SEQ ID NO: 81339 - protein, 9 aa, Homo sapiens
  light chain complementarity determining region 3 for antibody 40670
QQYGSPPYT

SEQ ID NO: 81340 - protein, 15 aa, Homo sapiens
  heavy chain complementarity determining region 3 for antibody 40670
ARASRGGYSGAPGDY

SEQ ID NO: 81341 - protein, 9 aa, Homo sapiens
  light chain complementarity determining region 3 for antibody 40671
QQYGSLSIT

SEQ ID NO: 81342 - protein, 16 aa, Homo sapiens
  heavy chain complementarity determining region 3 for antibody 40671
ARGRGYSAYVSYYFDY

SEQ ID NO: 81343 - protein, 8 aa, Homo sapiens
  light chain complementarity determining region 3 for antibody 40672
QQYGRSPT

SEQ ID NO: 81344 - protein, 17 aa, Homo sapiens
  heavy chain complementarity determining region 3 for antibody 40672
VTTVVEAAAGDYWFFGL

SEQ ID NO: 81345 - protein, 9 aa, Homo sapiens
  light chain complementarity determining region 3 for antibody 40673
QQYDTSPFT

SEQ ID NO: 81346 - protein, 13 aa, Homo sapiens
  heavy chain complementarity determining region 3 for antibody 40673
TRGRNYDRDGFDP

SEQ ID NO: 81347 - protein, 8 aa, Homo sapiens
  light chain complementarity determining region 3 for antibody 40674
QQYDNSPT

SEQ ID NO: 81348 - protein, 11 aa, Homo sapiens
  heavy chain complementarity determining region 3 for antibody 40674
AREKYSGGQDF

SEQ ID NO: 81349 - protein, 9 aa, Homo sapiens
  light chain complementarity determining region 3 for antibody 40675
QQYDDSPLT

SEQ ID NO: 81350 - protein, 12 aa, Homo sapiens
  heavy chain complementarity determining region 3 for antibody 40675
AGGSKGFGESRY

SEQ ID NO: 81351 - protein, 9 aa, Homo sapiens
  light chain complementarity determining region 3 for antibody 40676
QQYDDLPYT

SEQ ID NO: 81352 - protein, 13 aa, Homo sapiens
  heavy chain complementarity determining region 3 for antibody 40676
ARESSEGTRPLDH

SEQ ID NO: 81353 - protein, 9 aa, Homo sapiens
  light chain complementarity determining region 3 for antibody 40677
QQYDDLPRT

SEQ ID NO: 81354 - protein, 17 aa, Homo sapiens
  heavy chain complementarity determining region 3 for antibody 40677
TKDFFVRRTVALDAFDI

SEQ ID NO: 81355 - protein, 9 aa, Homo sapiens
  light chain complementarity determining region 3 for antibody 40678
QQYANLPYT

SEQ ID NO: 81356 - protein, 16 aa, Homo sapiens
  heavy chain complementarity determining region 3 for antibody 40678
ARASVDTALERGCFDI

SEQ ID NO: 81357 - protein, 9 aa, Homo sapiens
  light chain complementarity determining region 3 for antibody 40679
QQYAGSPWT

SEQ ID NO: 81358 - protein, 12 aa, Homo sapiens
  heavy chain complementarity determining region 3 for antibody 40679
VRSHYNTGRVDY

SEQ ID NO: 81359 - protein, 8 aa, Homo sapiens
  light chain complementarity determining region 3 for antibody 40680
QQTYSTLT

SEQ ID NO: 81360 - protein, 8 aa, Homo sapiens
  heavy chain complementarity determining region 3 for antibody 40680
ATGDNFDY

SEQ ID NO: 81361 - protein, 9 aa, Homo sapiens
  light chain complementarity determining region 3 for antibody 40681
QQSYSVPFT

SEQ ID NO: 81362 - protein, 14 aa, Homo sapiens
  heavy chain complementarity determining region 3 for antibody 40681
ARSRDTSGYSDFDH

SEQ ID NO: 81363 - protein, 9 aa, Homo sapiens
  light chain complementarity determining region 3 for antibody 40682
QQSYSTPYT

SEQ ID NO: 81364 - protein, 22 aa, Homo sapiens
  heavy chain complementarity determining region 3 for antibody 40682
AHIDPPPVDYFDSLGHVDAFDI

SEQ ID NO: 81365 - protein, 9 aa, Homo sapiens
  light chain complementarity determining region 3 for antibody 40683
QQSYSTPLT

SEQ ID NO: 81366 - protein, 16 aa, Homo sapiens
  heavy chain complementarity determining region 3 for antibody 40683
ARRVRVEGVTYYYLDY

SEQ ID NO: 81367 - protein, 9 aa, Homo sapiens
  light chain complementarity determining region 3 for antibody 40684
QQSYSTPIT

SEQ ID NO: 81368 - protein, 14 aa, Homo sapiens
  heavy chain complementarity determining region 3 for antibody 40684
ARAVVPAAIEWFDS

SEQ ID NO: 81369 - protein, 9 aa, Homo sapiens
  light chain complementarity determining region 3 for antibody 40685
QQSYRILWT

SEQ ID NO: 81370 - protein, 13 aa, Homo sapiens
  heavy chain complementarity determining region 3 for antibody 40685
ASRPFHFGQVMDV

SEQ ID NO: 81371 - protein, 9 aa, Homo sapiens
  light chain complementarity determining region 3 for antibody 40686
QQRSTWPYT

SEQ ID NO: 81372 - protein, 17 aa, Homo sapiens
  heavy chain complementarity determining region 3 for antibody 40686
ARHGCTGGSCQRSYFDT

SEQ ID NO: 81373 - protein, 8 aa, Homo sapiens
  light chain complementarity determining region 3 for antibody 40687
QQRSNWYT

SEQ ID NO: 81374 - protein, 18 aa, Homo sapiens
  heavy chain complementarity determining region 3 for antibody 40687
AKNHNLPSSSWLHDAFDV

SEQ ID NO: 81375 - protein, 9 aa, Homo sapiens
  light chain complementarity determining region 3 for antibody 40688
QQRSNWPPT

SEQ ID NO: 81376 - protein, 19 aa, Homo sapiens
  heavy chain complementarity determining region 3 for antibody 40688
AKDFGIGKFTIVVAGNFDY

SEQ ID NO: 81377 - protein, 10 aa, Homo sapiens
  light chain complementarity determining region 3 for antibody 40689
QQRSNWPPIT

SEQ ID NO: 81378 - protein, 13 aa, Homo sapiens
  heavy chain complementarity determining region 3 for antibody 40689
ARDYGDSYWHFDL

SEQ ID NO: 81379 - protein, 9 aa, Homo sapiens
  light chain complementarity determining region 3 for antibody 40690
QQNYNIPPT

SEQ ID NO: 81380 - protein, 14 aa, Homo sapiens
  heavy chain complementarity determining region 3 for antibody 40690
ARDRGDGSYYRFED

SEQ ID NO: 81381 - protein, 9 aa, Homo sapiens
  light chain complementarity determining region 3 for antibody 40691
QQKSAAPVT

SEQ ID NO: 81382 - protein, 17 aa, Homo sapiens
  heavy chain complementarity determining region 3 for antibody 40691
ARPVLRGSYGGTDAFEL

SEQ ID NO: 81383 - protein, 9 aa, Homo sapiens
  light chain complementarity determining region 3 for antibody 40692
QQGSNRPNA

SEQ ID NO: 81384 - protein, 12 aa, Homo sapiens
  heavy chain complementarity determining region 3 for antibody 40692
ARDLGSGRYFDY

SEQ ID NO: 81385 - protein, 10 aa, Homo sapiens
  light chain complementarity determining region 3 for antibody 40693
QHYGSSPPWT

SEQ ID NO: 81386 - protein, 15 aa, Homo sapiens
  heavy chain complementarity determining region 3 for antibody 40693
ARDPTMITVSRYFDL

SEQ ID NO: 81387 - protein, 9 aa, Homo sapiens
  light chain complementarity determining region 3 for antibody 40694
MQNTQWPLT

SEQ ID NO: 81388 - protein, 8 aa, Homo sapiens
  heavy chain complementarity determining region 3 for antibody 40694
VLGQDMGH

SEQ ID NO: 81389 - protein, 9 aa, Homo sapiens
  light chain complementarity determining region 3 for antibody 40695
MQGLQTPLT

SEQ ID NO: 81390 - protein, 12 aa, Homo sapiens
  heavy chain complementarity determining region 3 for antibody 40695
VRDRDYFGYFQF

SEQ ID NO: 81391 - protein, 9 aa, Homo sapiens
  light chain complementarity determining region 3 for antibody 40696
LQYGGSLWT

SEQ ID NO: 81392 - protein, 17 aa, Homo sapiens
  heavy chain complementarity determining region 3 for antibody 40696
ARIGYYYDGNGYAYDDY

SEQ ID NO: 81393 - protein, 11 aa, Homo sapiens
  light chain complementarity determining region 3 for antibody 40697
LQRSNWPPLFT

SEQ ID NO: 81394 - protein, 13 aa, Homo sapiens
  heavy chain complementarity determining region 3 for antibody 40697
ARVVSYRDYLFDF

SEQ ID NO: 81395 - protein, 10 aa, Homo sapiens
  light chain complementarity determining region 3 for antibody 40698
HQYGSSLSIT

SEQ ID NO: 81396 - protein, 13 aa, Homo sapiens
  heavy chain complementarity determining region 3 for antibody 40698
AREGDYGGLYFDY

SEQ ID NO: 81397 - protein, 9 aa, Homo sapiens
  light chain complementarity determining region 3 for antibody 40699
HQYGRSLWT

SEQ ID NO: 81398 - protein, 17 aa, Homo sapiens
  heavy chain complementarity determining region 3 for antibody 40699
ARYISGWHPERDYGLDV

SEQ ID NO: 81399 - protein, 9 aa, Homo sapiens
  light chain complementarity determining region 3 for antibody 40700
HQSSSLPRT

SEQ ID NO: 81400 - protein, 6 aa, Homo sapiens
  heavy chain complementarity determining region 3 for antibody 40700
TRDGVY

SEQ ID NO: 81401 - protein, 9 aa, Homo sapiens
  light chain complementarity determining region 3 for antibody 40701
HQSSSLPFT

SEQ ID NO: 81402 - protein, 11 aa, Homo sapiens
  heavy chain complementarity determining region 3 for antibody 40701
ARHAISSQFDS

SEQ ID NO: 81403 - protein, 8 aa, Homo sapiens
  light chain complementarity determining region 3 for antibody 40702
HQRSSPIT

SEQ ID NO: 81404 - protein, 12 aa, Homo sapiens
  heavy chain complementarity determining region 3 for antibody 40702
ATDYDTFVPYDY

SEQ ID NO: 81405 - protein, 9 aa, Homo sapiens
  light chain complementarity determining region 3 for antibody 40703
HQRSDWPLT

SEQ ID NO: 81406 - protein, 17 aa, Homo sapiens
  heavy chain complementarity determining region 3 for antibody 40703
VKSHCINDVCHGGNFQN

SEQ ID NO: 81407 - protein, 9 aa, Homo sapiens
  light chain complementarity determining region 3 for antibody 40704
QQYSNSPRT

SEQ ID NO: 81408 - protein, 15 aa, Homo sapiens
  heavy chain complementarity determining region 3 for antibody 40704
AGDLAGSRQGGWFDP

SEQ ID NO: 81409 - protein, 9 aa, Homo sapiens
  light chain complementarity determining region 3 for antibody 40705
QQYNSYSWT

SEQ ID NO: 81410 - protein, 11 aa, Homo sapiens
  heavy chain complementarity determining region 3 for antibody 40705
AREEGIQPFGY

SEQ ID NO: 81411 - protein, 9 aa, Homo sapiens
  light chain complementarity determining region 3 for antibody 40706
QQYNSYPIT

SEQ ID NO: 81412 - protein, 10 aa, Homo sapiens
  heavy chain complementarity determining region 3 for antibody 40706
ARTLVRFFDY

SEQ ID NO: 81413 - protein, 9 aa, Homo sapiens
  light chain complementarity determining region 3 for antibody 40707
QQYNSSPYT

SEQ ID NO: 81414 - protein, 6 aa, Homo sapiens
  heavy chain complementarity determining region 3 for antibody 40707
EWFPHR

SEQ ID NO: 81415 - protein, 9 aa, Homo sapiens
  light chain complementarity determining region 3 for antibody 40708
QQYNNWVLT

SEQ ID NO: 81416 - protein, 18 aa, Homo sapiens
  heavy chain complementarity determining region 3 for antibody 40708
ARGGYDYGWGSYGVYFDY

SEQ ID NO: 81417 - protein, 10 aa, Homo sapiens [sequence omitted]

SEQ ID NO: 81418 - protein, 16 aa, Homo sapiens
  heavy chain complementarity determining region 3 for antibody 40709
ARVPKGDWNLHSDMDV

SEQ ID NO: 81419 - protein, 8 aa, Homo sapiens
  light chain complementarity determining region 3 for antibody 40710
QQYNFYPS

SEQ ID NO: 81420 - protein, 12 aa, Homo sapiens
  heavy chain complementarity determining region 3 for antibody 40710
TREDSGDFYFDH

SEQ ID NO: 81421 - protein, 9 aa, Homo sapiens
  light chain complementarity determining region 3 for antibody 40711
QQYKTYPFT

SEQ ID NO: 81422 - protein, 14 aa, Homo sapiens
  heavy chain complementarity determining region 3 for antibody 40711
AKAKDSSGYHQFDS

SEQ ID NO: 81423 - protein, 9 aa, Homo sapiens
  light chain complementarity determining region 3 for antibody 40712
QQYGTSPFT

SEQ ID NO: 81424 - protein, 10 aa, Homo sapiens
  heavy chain complementarity determining region 3 for antibody 40712
ARDLGHAFDI

SEQ ID NO: 81425 - protein, 9 aa, Homo sapiens
  light chain complementarity determining region 3 for antibody 40713
QQYGSSVWT

SEQ ID NO: 81426 - protein, 16 aa, Homo sapiens
  heavy chain complementarity determining region 3 for antibody 40713
VRQGSWGVGVGWYVGY

SEQ ID NO: 81427 - protein, 9 aa, Homo sapiens
  light chain complementarity determining region 3 for antibody 40714
QQYGSSSST

SEQ ID NO: 81428 - protein, 7 aa, Homo sapiens
  heavy chain complementarity determining region 3 for antibody 40714
ASPYFDL

SEQ ID NO: 81429 - protein, 10 aa, Homo sapiens
  light chain complementarity determining region 3 for antibody 40715
QQYGSSPYVT

SEQ ID NO: 81430 - protein, 15 aa, Homo sapiens
  heavy chain complementarity determining region 3 for antibody 40715
ARDIGGDSGYGYFEY

SEQ ID NO: 81431 - protein, 9 aa, Homo sapiens
  light chain complementarity determining region 3 for antibody 40716
QQYGSSPVT

SEQ ID NO: 81432 - protein, 18 aa, Homo sapiens
  heavy chain complementarity determining region 3 for antibody 40716
AIPRPNRGIIISHDAFDI

SEQ ID NO: 81433 - protein, 8 aa, Homo sapiens
  light chain complementarity determining region 3 for antibody 40717
QQYGSSPT

SEQ ID NO: 81434 - protein, 10 aa, Homo sapiens
  heavy chain complementarity determining region 3 for antibody 40717
ARVARGGFDL

SEQ ID NO: 81435 - protein, 9 aa, Homo sapiens
  light chain complementarity determining region 3 for antibody 40718
QQYGSSPRT

SEQ ID NO: 81436 - protein, 12 aa, Homo sapiens
  heavy chain complementarity determining region 3 for antibody 40718
ARVLGGDEGFDI

SEQ ID NO: 81437 - protein, 9 aa, Homo sapiens
  light chain complementarity determining region 3 for antibody 40719
QQYGSSPPT

SEQ ID NO: 81438 - protein, 10 aa, Homo sapiens
  heavy chain complementarity determining region 3 for antibody 40719
ARGIHNGFDV

SEQ ID NO: 81439 - protein, 9 aa, Homo sapiens
  light chain complementarity determining region 3 for antibody 40720
QQYGSSPLG

SEQ ID NO: 81440 - protein, 16 aa, Homo sapiens
  heavy chain complementarity determining region 3 for antibody 40720
ARDYWTRRGDAGYFDY

SEQ ID NO: 81441 - protein, 8 aa, Homo sapiens
  light chain complementarity determining region 3 for antibody 40721
QQYGSSIT

SEQ ID NO: 81442 - protein, 15 aa, Homo sapiens
  heavy chain complementarity determining region 3 for antibody 40721
ARDRHGSDWVKRFDF

SEQ ID NO: 81443 - protein, 8 aa, Homo sapiens
  light chain complementarity determining region 3 for antibody 40722
QQYGSSFT

SEQ ID NO: 81444 - protein, 18 aa, Homo sapiens
  heavy chain complementarity determining region 3 for antibody 40722
IRARSYVDTSGYHGAFDR

SEQ ID NO: 81445 - protein, 8 aa, Homo sapiens
  light chain complementarity determining region 3 for antibody 40723
QQYGRSST

SEQ ID NO: 81446 - protein, 19 aa, Homo sapiens
  heavy chain complementarity determining region 3 for antibody 40723
AKGFWKTGLGESRSKFLDY

SEQ ID NO: 81447 - protein, 9 aa, Homo sapiens
  light chain complementarity determining region 3 for antibody 40724
QQYFNSPRT

SEQ ID NO: 81448 - protein, 15 aa, Homo sapiens
  heavy chain complementarity determining region 3 for antibody 40724
TREMNRYYYDSGDGY

SEQ ID NO: 81449 - protein, 9 aa, Homo sapiens
  light chain complementarity determining region 3 for antibody 40725
QQYENLPIT

SEQ ID NO: 81450 - protein, 12 aa, Homo sapiens
  heavy chain complementarity determining region 3 for antibody 40725
TTFYPGAGYFHH

SEQ ID NO: 81451 - protein, 9 aa, Homo sapiens
  light chain complementarity determining region 3 for antibody 40726
QQYDSSSVT

SEQ ID NO: 81452 - protein, 16 aa, Homo sapiens
  heavy chain complementarity determining region 3 for antibody 40726
ARGLPLVRGVFSPMDV

SEQ ID NO: 81453 - protein, 9 aa, Homo sapiens
  light chain complementarity determining region 3 for antibody 40727
QQYDNYPWT

SEQ ID NO: 81454 - protein, 11 aa, Homo sapiens
  heavy chain complementarity determining region 3 for antibody 40727
AHRTLTHGMDV

SEQ ID NO: 81455 - protein, 9 aa, Homo sapiens
  light chain complementarity determining region 3 for antibody 40728
QQYDNLPYT

SEQ ID NO: 81456 - protein, 15 aa, Homo sapiens
  heavy chain complementarity determining region 3 for antibody 40728
ARTRIAVAGEDAFDI

SEQ ID NO: 81457 - protein, 10 aa, Homo sapiens
  light chain complementarity determining region 3 for antibody 40729
QQYDDLFPVI

SEQ ID NO: 81458 - protein, 13 aa, Homo sapiens
  heavy chain complementarity determining region 3 for antibody 40729
VRDWAWGSGTGDY

SEQ ID NO: 81459 - protein, 10 aa, Homo sapiens
  light chain complementarity determining region 3 for antibody 40730
QQYANQPPIT

SEQ ID NO: 81460 - protein, 12 aa, Homo sapiens
  heavy chain complementarity determining region 3 for antibody 40730
ARVLDSLSPAFH

SEQ ID NO: 81461 - protein, 10 aa, Homo sapiens
  light chain complementarity determining region 3 for antibody 40731
QQTYTRPPYS

SEQ ID NO: 81462 - protein, 17 aa, Homo sapiens
  heavy chain complementarity determining region 3 for antibody 40731
ARTYTSTTENYYYGMDV

SEQ ID NO: 81463 - protein, 9 aa, Homo sapiens
  light chain complementarity determining region 3 for antibody 40732
QQSYTTPLT

SEQ ID NO: 81464 - protein, 15 aa, Homo sapiens
  heavy chain complementarity determining region 3 for antibody 40732
ARGRDGYIQEGHLQY

SEQ ID NO: 81465 - protein, 8 aa, Homo sapiens
  light chain complementarity determining region 3 for antibody 40733
QQSYSTWT

SEQ ID NO: 81466 - protein, 20 aa, Homo sapiens
  heavy chain complementarity determining region 3 for antibody 40733
ARVPRADFWSGYLTVDAFDI

SEQ ID NO: 81467 - protein, 9 aa, Homo sapiens
  light chain complementarity determining region 3 for antibody 40734
QQSYSTPVT

SEQ ID NO: 81468 - protein, 10 aa, Homo sapiens
  heavy chain complementarity determining region 3 for antibody 40734
ASLQSGGYYR

SEQ ID NO: 81469 - protein, 9 aa, Homo sapiens
  light chain complementarity determining region 3 for antibody 40735
QQSYSTPLT

SEQ ID NO: 81470 - protein, 15 aa, Homo sapiens
  heavy chain complementarity determining region 3 for antibody 40735
TRGRRDTSGYYYFDY

SEQ ID NO: 81471 - protein, 9 aa, Homo sapiens
  light chain complementarity determining region 3 for antibody 40736
QQSYSTLFT

SEQ ID NO: 81472 - protein, 14 aa, Homo sapiens
  heavy chain complementarity determining region 3 for antibody 40736
ARGVGATNWDWFDP

SEQ ID NO: 81473 - protein, 9 aa, Homo sapiens
  light chain complementarity determining region 3 for antibody 40737
QQSYSIRFT

SEQ ID NO: 81474 - protein, 12 aa, Homo sapiens
  heavy chain complementarity determining region 3 for antibody 40737
ANVVPYHGYYEY

SEQ ID NO: 81475 - protein, 9 aa, Homo sapiens
  light chain complementarity determining region 3 for antibody 40738
QQSYNFPVT

SEQ ID NO: 81476 - protein, 12 aa, Homo sapiens
  heavy chain complementarity determining region 3 for antibody 40738
ARLAAPYGDFDF

SEQ ID NO: 81477 - protein, 10 aa, Homo sapiens
  light chain complementarity determining region 3 for antibody 40739
QQSYGTPPHT

SEQ ID NO: 81478 - protein, 11 aa, Homo sapiens
  heavy chain complementarity determining region 3 for antibody 40739
AIENYAGATRL

SEQ ID NO: 81479 - protein, 9 aa, Homo sapiens
  light chain complementarity determining region 3 for antibody 40740
QQSFSTPLT

SEQ ID NO: 81480 - protein, 13 aa, Homo sapiens
  heavy chain complementarity determining region 3 for antibody 40740
ARVHYSSREAVDY

SEQ ID NO: 81481 - protein, 9 aa, Homo sapiens
  light chain complementarity determining region 3 for antibody 40741
QQRSNWPQT

SEQ ID NO: 81482 - protein, 13 aa, Homo sapiens
  heavy chain complementarity determining region 3 for antibody 40741
ARAAAVGTGDFHH

SEQ ID NO: 81483 - protein, 10 aa, Homo sapiens
  light chain complementarity determining region 3 for antibody 40742
QQRSNWPPVT

SEQ ID NO: 81484 - protein, 10 aa, Homo sapiens
  heavy chain complementarity determining region 3 for antibody 40742
ARGLYGDIDY

SEQ ID NO: 81485 - protein, 9 aa, Homo sapiens
  light chain complementarity determining region 3 for antibody 40743
QQRSNWPLT

SEQ ID NO: 81486 - protein, 13 aa, Homo sapiens
  heavy chain complementarity determining region 3 for antibody 40743
ARGVHHLGKSFDV

SEQ ID NO: 81487 - protein, 10 aa, Homo sapiens
  light chain complementarity determining region 3 for antibody 40744
QQRSNWPIFT

SEQ ID NO: 81488 - protein, 11 aa, Homo sapiens
  heavy chain complementarity determining region 3 for antibody 40744
ASPQVLGAFDL

SEQ ID NO: 81489 - protein, 10 aa, Homo sapiens
  light chain complementarity determining region 3 for antibody 40745
QQRSDWPPLT

SEQ ID NO: 81490 - protein, 10 aa, Homo sapiens
  heavy chain complementarity determining region 3 for antibody 40745
ARDYTMTFDY

SEQ ID NO: 81491 - protein, 9 aa, Homo sapiens
  light chain complementarity determining region 3 for antibody 40746
QQRSDWPFA

SEQ ID NO: 81492 - protein, 12 aa, Homo sapiens
  heavy chain complementarity determining region 3 for antibody 40746
ARDMDGFYGLDY

SEQ ID NO: 81493 - protein, 9 aa, Homo sapiens
  light chain complementarity determining region 3 for antibody 40747
QQRNNWRST

SEQ ID NO: 81494 - protein, 17 aa, Homo sapiens
  heavy chain complementarity determining region 3 for antibody 40747
ARDPGLSTGWGSGAFDI

SEQ ID NO: 81495 - protein, 9 aa, Homo sapiens
  light chain complementarity determining region 3 for antibody 40748
QQLNTYPRT

SEQ ID NO: 81496 - protein, 18 aa, Homo sapiens
  heavy chain complementarity determining region 3 for antibody 40748
ARGQLVVADWEFLYYFEN

SEQ ID NO: 81497 - protein, 9 aa, Homo sapiens
  light chain complementarity determining region 3 for antibody 40749
QQLNSYPRT

SEQ ID NO: 81498 - protein, 32 aa, Homo sapiens
  heavy chain complementarity determining region 3 for antibody 40749
ARGRRRGVIDSDPNPYRSGWYRGDYYYYAMDV

SEQ ID NO: 81499 - protein, 9 aa, Homo sapiens
  light chain complementarity determining region 3 for antibody 40750
QQLNSYPRT

SEQ ID NO: 81500 - protein, 11 aa, Homo sapiens
  heavy chain complementarity determining region 3 for antibody 40750
AKPVRGSSLDS

SEQ ID NO: 81501 - protein, 9 aa, Homo sapiens
  light chain complementarity determining region 3 for antibody 40751
QQLKSYPRT

SEQ ID NO: 81502 - protein, 17 aa, Homo sapiens
  heavy chain complementarity determining region 3 for antibody 40751
ARDRDSSGWSPLGWFDP

SEQ ID NO: 81503 - protein, 9 aa, Homo sapiens
  light chain complementarity determining region 3 for antibody 40752
QQGHSFPYT

SEQ ID NO: 81504 - protein, 18 aa, Homo sapiens
  heavy chain complementarity determining region 3 for antibody 40752
AREGSDYSDVYYYYGMDV

SEQ ID NO: 81505 - protein, 9 aa, Homo sapiens
  light chain complementarity determining region 3 for antibody 40753
QQFSHYEYT

SEQ ID NO: 81506 - protein, 18 aa, Homo sapiens
  heavy chain complementarity determining region 3 for antibody 40753
ARVVERCSGGKCHYVFDH

SEQ ID NO: 81507 - protein, 9 aa, Homo sapiens
  light chain complementarity determining region 3 for antibody 40754
QQFGGAPRT

SEQ ID NO: 81508 - protein, 16 aa, Homo sapiens
  heavy chain complementarity determining region 3 for antibody 40754
ARDPRGGVAVPADFNY

SEQ ID NO: 81509 - protein, 9 aa, Homo sapiens
  light chain complementarity determining region 3 for antibody 40755
QKYNSAPWT

SEQ ID NO: 81510 - protein, 14 aa, Homo sapiens
  heavy chain complementarity determining region 3 for antibody 40755
ARLLDTAMVTDFDY

SEQ ID NO: 81511 - protein, 9 aa, Homo sapiens
  light chain complementarity determining region 3 for antibody 40756
QKYNSAPQT

SEQ ID NO: 81512 - protein, 13 aa, Homo sapiens
  heavy chain complementarity determining region 3 for antibody 40756
AHSSGLEGPAFDI

SEQ ID NO: 81513 - protein, 9 aa, Homo sapiens
  light chain complementarity determining region 3 for antibody 40757
QKYDSAPRT

SEQ ID NO: 81514 - protein, 12 aa, Homo sapiens
  heavy chain complementarity determining region 3 for antibody 40757
ARGSTYDPTFDY

SEQ ID NO: 81515 - protein, 9 aa, Homo sapiens
  light chain complementarity determining region 3 for antibody 40758
QHYGNFLLT

SEQ ID NO: 81516 - protein, 12 aa, Homo sapiens
  heavy chain complementarity determining region 3 for antibody 40758
AIMGPPTPRESH

SEQ ID NO: 81517 - protein, 9 aa, Homo sapiens
  light chain complementarity determining region 3 for antibody 40759
QHYAASVRT

SEQ ID NO: 81518 - protein, 11 aa, Homo sapiens
  heavy chain complementarity determining region 3 for antibody 40759
VRDGTGGWMVY

SEQ ID NO: 81519 - protein, 9 aa, Homo sapiens
  light chain complementarity determining region 3 for antibody 40760
MQTLQTPAT

SEQ ID NO: 81520 - protein, 24 aa, Homo sapiens
  heavy chain complementarity determining region 3 for antibody 40760
AKDYQNAPYATARRDGYNFEGPQN

SEQ ID NO: 81521 - protein, 9 aa, Homo sapiens
  light chain complementarity determining region 3 for antibody 40761
MQRQAYPLT

SEQ ID NO: 81522 - protein, 13 aa, Homo sapiens
  heavy chain complementarity determining region 3 for antibody 40761
ARRAASTSWSFDF

SEQ ID NO: 81523 - protein, 9 aa, Homo sapiens
  light chain complementarity determining region 3 for antibody 40762
MQGTHLPFT

SEQ ID NO: 81524 - protein, 9 aa, Homo sapiens
  heavy chain complementarity determining region 3 for antibody 40762
ARNPRHLPF

SEQ ID NO: 81525 - protein, 10 aa, Homo sapiens
  light chain complementarity determining region 3 for antibody 40763
LQYDSLPRYT

SEQ ID NO: 81526 - protein, 13 aa, Homo sapiens
  heavy chain complementarity determining region 3 for antibody 40763
ARDHDFWTTYPDY

SEQ ID NO: 81527 - protein, 9 aa, Homo sapiens
  light chain complementarity determining region 3 for antibody 40764
LQHNSYPLT

SEQ ID NO: 81528 - protein, 13 aa, Homo sapiens
  heavy chain complementarity determining region 3 for antibody 40764
ATLHCTGGYCYDY

SEQ ID NO: 81529 - protein, 9 aa, Homo sapiens
  light chain complementarity determining region 3 for antibody 40765
LQHNSYPHT

SEQ ID NO: 81530 - protein, 17 aa, Homo sapiens
  heavy chain complementarity determining region 3 for antibody 40765
AREGEWVDTGSTGSFDY

SEQ ID NO: 81531 - protein, 9 aa, Homo sapiens
  light chain complementarity determining region 3 for antibody 40766
LQDDSYPWT

SEQ ID NO: 81532 - protein, 14 aa, Homo sapiens
  heavy chain complementarity determining region 3 for antibody 40766
ARSLGVRMLGYLDY

SEQ ID NO: 81533 - protein, 9 aa, Homo sapiens
  light chain complementarity determining region 3 for antibody 40767
KQFGSSPIT

SEQ ID NO: 81534 - protein, 10 aa, Homo sapiens
  heavy chain complementarity determining region 3 for antibody 40767
ATHSWWRFDY

SEQ ID NO: 81535 - protein, 8 aa, Homo sapiens
  light chain complementarity determining region 3 for antibody 40768
HQYGDPPT

SEQ ID NO: 81536 - protein, 16 aa, Homo sapiens
  heavy chain complementarity determining region 3 for antibody 40768
AKGSIGWNPEENWFDS

SEQ ID NO: 81537 - protein, 9 aa, Homo sapiens
  light chain complementarity determining region 3 for antibody 40769
HQSSGLKGT

SEQ ID NO: 81538 - protein, 18 aa, Homo sapiens
  heavy chain complementarity determining region 3 for antibody 40769
ARGSPRGYGGYDSEAFDI

SEQ ID NO: 81539 - protein, 9 aa, Homo sapiens
  light chain complementarity determining region 3 for antibody 40770
HQSGSLPIT

SEQ ID NO: 81540 - protein, 16 aa, Homo sapiens
  heavy chain complementarity determining region 3 for antibody 40770
ARVFGSGTYHSDYFDN

SEQ ID NO: 81541 - protein, 10 aa, Homo sapiens
  light chain complementarity determining region 3 for antibody 40771
HQRSSWPLLT

SEQ ID NO: 81542 - protein, 16 aa, Homo sapiens
  heavy chain complementarity determining region 3 for antibody 40771
AREMQHDLQHLGWLDP

SEQ ID NO: 81543 - protein, 9 aa, Homo sapiens
  light chain complementarity determining region 3 for antibody 40772
HHCDSSRYT

SEQ ID NO: 81544 - protein, 14 aa, Homo sapiens
  heavy chain complementarity determining region 3 for antibody 40772
AREYVDVSGYGLDY

SEQ ID NO: 81545 - protein, 11 aa, Homo sapiens
  light chain complementarity determining region 3 for antibody 40773
TQYNHWPLLYT

SEQ ID NO: 81546 - protein, 15 aa, Homo sapiens
  heavy chain complementarity determining region 3 for antibody 40773
AREERAPASLDYLDY

SEQ ID NO: 81547 - protein, 10 aa, Homo sapiens
  light chain complementarity determining region 3 for antibody 40774
QRYGRSPPYT

SEQ ID NO: 81548 - protein, 15 aa, Homo sapiens
  heavy chain complementarity determining region 3 for antibody 40774
ARDQWLLLPGGFFDS

SEQ ID NO: 81549 - protein, 9 aa, Homo sapiens
  light chain complementarity determining region 3 for antibody 40775
QQYVGSPWT

SEQ ID NO: 81550 - protein, 11 aa, Homo sapiens
  heavy chain complementarity determining region 3 for antibody 40775
ARGDYVGGFYF

SEQ ID NO: 81551 - protein, 9 aa, Homo sapiens
  light chain complementarity determining region 3 for antibody 40776
QQYTTSPGT

SEQ ID NO: 81552 - protein, 15 aa, Homo sapiens
  heavy chain complementarity determining region 3 for antibody 40776
ARAGLVLTDYWYFDL

SEQ ID NO: 81553 - protein, 9 aa, Homo sapiens
  light chain complementarity determining region 3 for antibody 40777
QQYSSSPIT

SEQ ID NO: 81554 - protein, 17 aa, Homo sapiens
  heavy chain complementarity determining region 3 for antibody 40777
ARDYYGSRTSLKGLVDY

SEQ ID NO: 81555 - protein, 10 aa, Homo sapiens
  light chain complementarity determining region 3 for antibody 40778
QQYSSPPMYT

SEQ ID NO: 81556 - protein, 10 aa, Homo sapiens
  heavy chain complementarity determining region 3 for antibody 40778
ASSILTGYPS

SEQ ID NO: 81557 - protein, 9 aa, Homo sapiens
  light chain complementarity determining region 3 for antibody 40779
QQYSSFPWT

SEQ ID NO: 81558 - protein, 16 aa, Homo sapiens
  heavy chain complementarity determining region 3 for antibody 40779
ARDGLPVTSKPYYFDY

SEQ ID NO: 81559 - protein, 9 aa, Homo sapiens
  light chain complementarity determining region 3 for antibody 40780
QQYNSSPLT

SEQ ID NO: 81560 - protein, 12 aa, Homo sapiens
  heavy chain complementarity determining region 3 for antibody 40780
AKARTGFDWFDP

SEQ ID NO: 81561 - protein, 9 aa, Homo sapiens
  light chain complementarity determining region 3 for antibody 40781
QQYNNWPRT

SEQ ID NO: 81562 - protein, 12 aa, Homo sapiens
  heavy chain complementarity determining region 3 for antibody 40781
ATWGWLLLKEDY

SEQ ID NO: 81563 - protein, 9 aa, Homo sapiens
  light chain complementarity determining region 3 for antibody 40782
QQYKNYPFT

SEQ ID NO: 81564 - protein, 14 aa, Homo sapiens
  heavy chain complementarity determining region 3 for antibody 40782
VRAKDSSGYDLFDY

SEQ ID NO: 81565 - protein, 10 aa, Homo sapiens
  light chain complementarity determining region 3 for antibody 40783
QQYKNWPPWT

SEQ ID NO: 81566 - protein, 18 aa, Homo sapiens
  heavy chain complementarity determining region 3 for antibody 40783
ARDRYYDSIGYYDWAFDV

SEQ ID NO: 81567 - protein, 9 aa, Homo sapiens
  light chain complementarity determining region 3 for antibody 40784
QQYHSYPGT

SEQ ID NO: 81568 - protein, 15 aa, Homo sapiens
  heavy chain complementarity determining region 3 for antibody 40784
ARLSIAGAGFRWFDP

SEQ ID NO: 81569 - protein, 8 aa, Homo sapiens
  light chain complementarity determining region 3 for antibody 40785
QQYHRGFT

SEQ ID NO: 81570 - protein, 12 aa, Homo sapiens
  heavy chain complementarity determining region 3 for antibody 40785
ARDRVESIRFDH

SEQ ID NO: 81571 - protein, 9 aa, Homo sapiens
  light chain complementarity determining region 3 for antibody 40786
QQYGVSPFF

SEQ ID NO: 81572 - protein, 19 aa, Homo sapiens
  heavy chain complementarity determining region 3 for antibody 40786
ARDSFWPGSGNYFGDILDS

SEQ ID NO: 81573 - protein, 9 aa, Homo sapiens
  light chain complementarity determining region 3 for antibody 40787
QQYGSSPYT

SEQ ID NO: 81574 - protein, 16 aa, Homo sapiens
  heavy chain complementarity determining region 3 for antibody 40787
ATRGPSHYGAGTYLAA

SEQ ID NO: 81575 - protein, 9 aa, Homo sapiens
  light chain complementarity determining region 3 for antibody 40788
QQYGSSPVT

SEQ ID NO: 81576 - protein, 15 aa, Homo sapiens
  heavy chain complementarity determining region 3 for antibody 40788
AKAPRQWLDVGWFDA

SEQ ID NO: 81577 - protein, 9 aa, Homo sapiens
  light chain complementarity determining region 3 for antibody 40789
QQYGSSPIT

SEQ ID NO: 81578 - protein, 16 aa, Homo sapiens
  heavy chain complementarity determining region 3 for antibody 40789
ARGLPLVRGVISPMDV

SEQ ID NO: 81579 - protein, 9 aa, Homo sapiens
  light chain complementarity determining region 3 for antibody 40790
QQYGSSPHN

SEQ ID NO: 81580 - protein, 14 aa, Homo sapiens
  heavy chain complementarity determining region 3 for antibody 40790
VRHAAPGRYDASDI

SEQ ID NO: 81581 - protein, 9 aa, Homo sapiens
  light chain complementarity determining region 3 for antibody 40791
QQYGSSLQT

SEQ ID NO: 81582 - protein, 19 aa, Homo sapiens
  heavy chain complementarity determining region 3 for antibody 40791
ARGSIDVRAGVEGLVWFDP

SEQ ID NO: 81583 - protein, 9 aa, Homo sapiens
  light chain complementarity determining region 3 for antibody 40792
QQYGSSGGT

SEQ ID NO: 81584 - protein, 17 aa, Homo sapiens
  heavy chain complementarity determining region 3 for antibody 40792
ARDSAPREGYFDDYFDS

SEQ ID NO: 81585 - protein, 8 aa, Homo sapiens
  light chain complementarity determining region 3 for antibody 40793
QQYGSLYT

SEQ ID NO: 81586 - protein, 16 aa, Homo sapiens
  heavy chain complementarity determining region 3 for antibody 40793
GRAPDRGSDFVDYFDY

SEQ ID NO: 81587 - protein, 8 aa, Homo sapiens
  light chain complementarity determining region 3 for antibody 40794
QQYGSLLT

SEQ ID NO: 81588 - protein, 17 aa, Homo sapiens
  heavy chain complementarity determining region 3 for antibody 40794
AKDIFFGIAVAGTAFDI

SEQ ID NO: 81589 - protein, 9 aa, Homo sapiens
  light chain complementarity determining region 3 for antibody 40795
QQYGPSPRT

SEQ ID NO: 81590 - protein, 14 aa, Homo sapiens
  heavy chain complementarity determining region 3 for antibody 40795
AREMPDPGAWYFDL

SEQ ID NO: 81591 - protein, 9 aa, Homo sapiens
  light chain complementarity determining region 3 for antibody 40796
QQYGNSPWT

SEQ ID NO: 81592 - protein, 17 aa, Homo sapiens
  heavy chain complementarity determining region 3 for antibody 40796
ALASVAVPGRIQWYFDL

SEQ ID NO: 81593 - protein, 10 aa, Homo sapiens
  light chain complementarity determining region 3 for antibody 40797
QQYGKPPLYT

SEQ ID NO: 81594 - protein, 10 aa, Homo sapiens
  heavy chain complementarity determining region 3 for antibody 40797
VRAGYYCLDY

SEQ ID NO: 81595 - protein, 10 aa, Homo sapiens
  light chain complementarity determining region 3 for antibody 40798
QQYGGSPRYR

SEQ ID NO: 81596 - protein, 10 aa, Homo sapiens
  heavy chain complementarity determining region 3 for antibody 40798
AASDTAQFRY

SEQ ID NO: 81597 - protein, 9 aa, Homo sapiens
  light chain complementarity determining region 3 for antibody 40799
QQYENLPPT

SEQ ID NO: 81598 - protein, 16 aa, Homo sapiens
  heavy chain complementarity determining region 3 for antibody 40799
ARDLHLGKLSLVAFDV

SEQ ID NO: 81599 - protein, 9 aa, Homo sapiens
  light chain complementarity determining region 3 for antibody 40800
QQYDYSPLT

SEQ ID NO: 81600 - protein, 18 aa, Homo sapiens
  heavy chain complementarity determining region 3 for antibody 40800
ARGRCGSFSCYVRYHMDV

SEQ ID NO: 81601 - protein, 9 aa, Homo sapiens
  light chain complementarity determining region 3 for antibody 40801
QQYDYLPIT

SEQ ID NO: 81602 - protein, 15 aa, Homo sapiens
  heavy chain complementarity determining region 3 for antibody 40801
ARPPHAFTGENYFSF

SEQ ID NO: 81603 - protein, 8 aa, Homo sapiens
  light chain complementarity determining region 3 for antibody 40802
QQYDYLPA

SEQ ID NO: 81604 - protein, 12 aa, Homo sapiens
  heavy chain complementarity determining region 3 for antibody 40802
ARSNWNIIAFDP

SEQ ID NO: 81605 - protein, 9 aa, Homo sapiens
  light chain complementarity determining region 3 for antibody 40803
QQYDAYPLT

SEQ ID NO: 81606 - protein, 13 aa, Homo sapiens
  heavy chain complementarity determining region 3 for antibody 40803
ARRDYSVSYTFDS

SEQ ID NO: 81607 - protein, 9 aa, Homo sapiens
  light chain complementarity determining region 3 for antibody 40804
QQYATSPYS

SEQ ID NO: 81608 - protein, 12 aa, Homo sapiens
  heavy chain complementarity determining region 3 for antibody 40804
AREPAEDYYLDF

SEQ ID NO: 81609 - protein, 9 aa, Homo sapiens
  light chain complementarity determining region 3 for antibody 40805
QQYASSSWT

SEQ ID NO: 81610 - protein, 16 aa, Homo sapiens
  heavy chain complementarity determining region 3 for antibody 40805
ARVSDMSGEYSLAFDI

SEQ ID NO: 81611 - protein, 6 aa, Homo sapiens
  light chain complementarity determining region 3 for antibody 40806
QQVAET

SEQ ID NO: 81612 - protein, 12 aa, Homo sapiens
  heavy chain complementarity determining region 3 for antibody 40806
ARDHPSGWALSH

SEQ ID NO: 81613 - protein, 10 aa, Homo sapiens
  light chain complementarity determining region 3 for antibody 40807
QQSYVTPPWT

SEQ ID NO: 81614 - protein, 22 aa, Homo sapiens
  heavy chain complementarity determining region 3 for antibody 40807
ARLYDSSSYYPLGSTVTDAFEI

SEQ ID NO: 81615 - protein, 9 aa, Homo sapiens
  light chain complementarity determining region 3 for antibody 40808
QQSYTTPYT

SEQ ID NO: 81616 - protein, 15 aa, Homo sapiens
  heavy chain complementarity determining region 3 for antibody 40808
ARDPAPVDEKNWYDP

SEQ ID NO: 81617 - protein, 9 aa, Homo sapiens
  light chain complementarity determining region 3 for antibody 40809
QQSYSTPRT

SEQ ID NO: 81618 - protein, 20 aa, Homo sapiens
  heavy chain complementarity determining region 3 for antibody 40809
ARDRGSGSYHIDEEYNWFDP

SEQ ID NO: 81619 - protein, 9 aa, Homo sapiens
  light chain complementarity determining region 3 for antibody 40810
QQSYSTPRT

SEQ ID NO: 81620 - protein, 13 aa, Homo sapiens
  heavy chain complementarity determining region 3 for antibody 40810
AKGGGWEQLHFDS

SEQ ID NO: 81621 - protein, 9 aa, Homo sapiens
  light chain complementarity determining region 3 for antibody 40811
QQSYSTPLT

SEQ ID NO: 81622 - protein, 13 aa, Homo sapiens
  heavy chain complementarity determining region 3 for antibody 40811
AGGYFDRNGYKEN

SEQ ID NO: 81623 - protein, 9 aa, Homo sapiens
  light chain complementarity determining region 3 for antibody 40812
QQSYSTLYT

SEQ ID NO: 81624 - protein, 13 aa, Homo sapiens
  heavy chain complementarity determining region 3 for antibody 40812
ARQYGDYGWYLDI

SEQ ID NO: 81625 - protein, 8 aa, Homo sapiens
  light chain complementarity determining region 3 for antibody 40813
QQSYSSPT

SEQ ID NO: 81626 - protein, 11 aa, Homo sapiens
  heavy chain complementarity determining region 3 for antibody 40813
VRDRPLNWFDP

SEQ ID NO: 81627 - protein, 9 aa, Homo sapiens
  light chain complementarity determining region 3 for antibody 40814
QQSYSIPFT

SEQ ID NO: 81628 - protein, 17 aa, Homo sapiens
  heavy chain complementarity determining region 3 for antibody 40814
AREKYYYHTDGYYPFDY

SEQ ID NO: 81629 - protein, 9 aa, Homo sapiens
  light chain complementarity determining region 3 for antibody 40815
QQSYSAPVT

SEQ ID NO: 81630 - protein, 10 aa, Homo sapiens
  heavy chain complementarity determining region 3 for antibody 40815
ASALGWESGY

SEQ ID NO: 81631 - protein, 10 aa, Homo sapiens
  light chain complementarity determining region 3 for antibody 40816
QQSYRTPQFT

SEQ ID NO: 81632 - protein, 13 aa, Homo sapiens
  heavy chain complementarity determining region 3 for antibody 40816
ARDPGEAVPAFDF

SEQ ID NO: 81633 - protein, 10 aa, Homo sapiens
  light chain complementarity determining region 3 for antibody 40817
QQSYRTPPIT

SEQ ID NO: 81634 - protein, 16 aa, Homo sapiens
  heavy chain complementarity determining region 3 for antibody 40817
ALLRYESNGYLQSLDY

SEQ ID NO: 81635 - protein, 9 aa, Homo sapiens
  light chain complementarity determining region 3 for antibody 40818
QQSYQLPPT

SEQ ID NO: 81636 - protein, 15 aa, Homo sapiens
  heavy chain complementarity determining region 3 for antibody 40818
ARQRIYDRTSFIFDY

SEQ ID NO: 81637 - protein, 9 aa, Homo sapiens
  light chain complementarity determining region 3 for antibody 40819
QQSYNTPYT

SEQ ID NO: 81638 - protein, 11 aa, Homo sapiens
  heavy chain complementarity determining region 3 for antibody 40819
AKQGEAGGMDV

SEQ ID NO: 81639 - protein, 9 aa, Homo sapiens
  light chain complementarity determining region 3 for antibody 40820
QQSNRTPYT

SEQ ID NO: 81640 - protein, 14 aa, Homo sapiens
  heavy chain complementarity determining region 3 for antibody 40820
ATEGPSRMGKFFDS

SEQ ID NO: 81641 - protein, 9 aa, Homo sapiens
  light chain complementarity determining region 3 for antibody 40821
QQSHTSPPT

SEQ ID NO: 81642 - protein, 15 aa, Homo sapiens
  heavy chain complementarity determining region 3 for antibody 40821
ARGSDLDDPPGAFDI

SEQ ID NO: 81643 - protein, 9 aa, Homo sapiens
  light chain complementarity determining region 3 for antibody 40822
QQRSTWPRT

SEQ ID NO: 81644 - protein, 9 aa, Homo sapiens
  heavy chain complementarity determining region 3 for antibody 40822
SREYGADHF

SEQ ID NO: 81645 - protein, 8 aa, Homo sapiens
  light chain complementarity determining region 3 for antibody 40823
QQRSNWVT

SEQ ID NO: 81646 - protein, 21 aa, Homo sapiens
  heavy chain complementarity determining region 3 for antibody 40823
ARNDPDNKEVGETYHYNYFEQ

SEQ ID NO: 81647 - protein, 8 aa, Homo sapiens
  light chain complementarity determining region 3 for antibody 40824
QQRSNWVT

SEQ ID NO: 81648 - protein, 21 aa, Homo sapiens
  heavy chain complementarity determining region 3 for antibody 40824
ARNDPDKKEGGQSYGYNYFEQ

SEQ ID NO: 81649 - protein, 9 aa, Homo sapiens
  light chain complementarity determining region 3 for antibody 40825
QQRSNWSWT

SEQ ID NO: 81650 - protein, 17 aa, Homo sapiens
  heavy chain complementarity determining region 3 for antibody 40825
ARDGSGAYGPPFTTFDY

SEQ ID NO: 81651 - protein, 9 aa, Homo sapiens
  light chain complementarity determining region 3 for antibody 40826
QQRSNWPLT

SEQ ID NO: 81652 - protein, 13 aa, Homo sapiens
  heavy chain complementarity determining region 3 for antibody 40826
ARSRPRIPTEFYS

SEQ ID NO: 81653 - protein, 9 aa, Homo sapiens
  light chain complementarity determining region 3 for antibody 40827
QQRANWPLT

SEQ ID NO: 81654 - protein, 14 aa, Homo sapiens
  heavy chain complementarity determining region 3 for antibody 40827
ASSLWAAAVHYFDY

SEQ ID NO: 81655 - protein, 9 aa, Homo sapiens
  light chain complementarity determining region 3 for antibody 40828
QQNYNLPPT

SEQ ID NO: 81656 - protein, 15 aa, Homo sapiens
  heavy chain complementarity determining region 3 for antibody 40828
ARAPSIGTGEQTFDY

SEQ ID NO: 81657 - protein, 9 aa, Homo sapiens
  light chain complementarity determining region 3 for antibody 40829
QQLNSFPLT

SEQ ID NO: 81658 - protein, 11 aa, Homo sapiens
  heavy chain complementarity determining region 3 for antibody 40829
GRHIVWSGMDV

SEQ ID NO: 81659 - protein, 9 aa, Homo sapiens
  light chain complementarity determining region 3 for antibody 40830
QQLHKSPWT

SEQ ID NO: 81660 - protein, 14 aa, Homo sapiens
  heavy chain complementarity determining region 3 for antibody 40830
ARAAPEYDWLVPDY

SEQ ID NO: 81661 - protein, 9 aa, Homo sapiens
  light chain complementarity determining region 3 for antibody 40831
QQHGSSPWT

SEQ ID NO: 81662 - protein, 15 aa, Homo sapiens
  heavy chain complementarity determining region 3 for antibody 40831
ARDNYEGSYYGPFDY

SEQ ID NO: 81663 - protein, 9 aa, Homo sapiens
  light chain complementarity determining region 3 for antibody 40832
QQGYSTPFT

SEQ ID NO: 81664 - protein, 15 aa, Homo sapiens
  heavy chain complementarity determining region 3 for antibody 40832
AKAQVIWGQLYYFDF

SEQ ID NO: 81665 - protein, 9 aa, Homo sapiens
  light chain complementarity determining region 3 for antibody 40833
QQFKNYPRT

SEQ ID NO: 81666 - protein, 16 aa, Homo sapiens
  heavy chain complementarity determining region 3 for antibody 40833
ARNLGYSDTEGRYFDY

SEQ ID NO: 81667 - protein, 9 aa, Homo sapiens
  light chain complementarity determining region 3 for antibody 40834
QQFHIYPLT

SEQ ID NO: 81668 - protein, 11 aa, Homo sapiens
  heavy chain complementarity determining region 3 for antibody 40834
ARAVEDDPIDY

SEQ ID NO: 81669 - protein, 9 aa, Homo sapiens
  light chain complementarity determining region 3 for antibody 40835
QQFDSVPLT

SEQ ID NO: 81670 - protein, 15 aa, Homo sapiens
  heavy chain complementarity determining region 3 for antibody 40835
TTVPGVHWFGEVKDF

SEQ ID NO: 81671 - protein, 10 aa, Homo sapiens
  light chain complementarity determining region 3 for antibody 40836
QQFANPLIFT

SEQ ID NO: 81672 - protein, 12 aa, Homo sapiens
  heavy chain complementarity determining region 3 for antibody 40836
AKWRYNAGSFDY

SEQ ID NO: 81673 - protein, 9 aa, Homo sapiens
  light chain complementarity determining region 3 for antibody 40837
QQATSFPRT

SEQ ID NO: 81674 - protein, 14 aa, Homo sapiens
  heavy chain complementarity determining region 3 for antibody 40837
VHSEIDATANAFDY

SEQ ID NO: 81675 - protein, 9 aa, Homo sapiens
  light chain complementarity determining region 3 for antibody 40838
QQASGFPHT

SEQ ID NO: 81676 - protein, 20 aa, Homo sapiens
  heavy chain complementarity determining region 3 for antibody 40838
ARMAVQFHDSGGFFRYYIDN

SEQ ID NO: 81677 - protein, 9 aa, Homo sapiens
  light chain complementarity determining region 3 for antibody 40839
QQANSFPPT

SEQ ID NO: 81678 - protein, 14 aa, Homo sapiens
  heavy chain complementarity determining region 3 for antibody 40839
ARDTSSSWHEYFQH

SEQ ID NO: 81679 - protein, 9 aa, Homo sapiens
  light chain complementarity determining region 3 for antibody 40840
QQAHSLPPT

SEQ ID NO: 81680 - protein, 10 aa, Homo sapiens
  heavy chain complementarity determining region 3 for antibody 40840
ARDLAFGIDY

SEQ ID NO: 81681 - protein, 10 aa, Homo sapiens
  light chain complementarity determining region 3 for antibody 40841
QNYDNSPPWT

SEQ ID NO: 81682 - protein, 9 aa, Homo sapiens
  heavy chain complementarity determining region 3 for antibody 40841
ARGPTPFDP

SEQ ID NO: 81683 - protein, 9 aa, Homo sapiens
  light chain complementarity determining region 3 for antibody 40842
QHYVNSPPT

SEQ ID NO: 81684 - protein, 15 aa, Homo sapiens
  heavy chain complementarity determining region 3 for antibody 40842
AVKGGGFGEVPIFDF

SEQ ID NO: 81685 - protein, 9 aa, Homo sapiens
  light chain complementarity determining region 3 for antibody 40843
QHYNQFSLT

SEQ ID NO: 81686 - protein, 16 aa, Homo sapiens
  heavy chain complementarity determining region 3 for antibody 40843
ARDHRTKSWPPRAFDI

SEQ ID NO: 81687 - protein, 9 aa, Homo sapiens
  light chain complementarity determining region 3 for antibody 40844
QHYNNYPYT

SEQ ID NO: 81688 - protein, 12 aa, Homo sapiens
  heavy chain complementarity determining region 3 for antibody 40844
ARVHDYEMVFDY

SEQ ID NO: 81689 - protein, 10 aa, Homo sapiens
  light chain complementarity determining region 3 for antibody 40845
QHYGDSYPWT

SEQ ID NO: 81690 - protein, 16 aa, Homo sapiens
  heavy chain complementarity determining region 3 for antibody 40845
TRVSSGWYWGPDAFDV

SEQ ID NO: 81691 - protein, 9 aa, Homo sapiens
  light chain complementarity determining region 3 for antibody 40846
QHRSNWPLT

SEQ ID NO: 81692 - protein, 10 aa, Homo sapiens
  heavy chain complementarity determining region 3 for antibody 40846
ARRFYGSENL

SEQ ID NO: 81693 - protein, 9 aa, Homo sapiens
  light chain complementarity determining region 3 for antibody 40847
QHRNSWPYT

SEQ ID NO: 81694 - protein, 15 aa, Homo sapiens
  heavy chain complementarity determining region 3 for antibody 40847
AKEGYYPDGSGYCPN

SEQ ID NO: 81695 - protein, 10 aa, Homo sapiens
  light chain complementarity determining region 3 for antibody 40848
QEYNTHSPWT

SEQ ID NO: 81696 - protein, 19 aa, Homo sapiens
  heavy chain complementarity determining region 3 for antibody 40848
TRPRAYFYDSNSYLGEFEY

SEQ ID NO: 81697 - protein, 10 aa, Homo sapiens
  light chain complementarity determining region 3 for antibody 40849
MQGTHWPPWT

SEQ ID NO: 81698 - protein, 7 aa, Homo sapiens
  heavy chain complementarity determining region 3 for antibody 40849
VRGTFDI

SEQ ID NO: 81699 - protein, 9 aa, Homo sapiens
  light chain complementarity determining region 3 for antibody 40850
MQALETPRT

SEQ ID NO: 81700 - protein, 17 aa, Homo sapiens
  heavy chain complementarity determining region 3 for antibody 40850
TRHGDHLGGYYNHGMDV

SEQ ID NO: 81701 - protein, 9 aa, Homo sapiens
  light chain complementarity determining region 3 for antibody 40851
LQSKTYPLT

SEQ ID NO: 81702 - protein, 8 aa, Homo sapiens
  heavy chain complementarity determining region 3 for antibody 40851
FRYNSGWE

SEQ ID NO: 81703 - protein, 9 aa, Homo sapiens
  light chain complementarity determining region 3 for antibody 40852
LQHNAFPYT

SEQ ID NO: 81704 - protein, 16 aa, Homo sapiens
  heavy chain complementarity determining region 3 for antibody 40852
TFFYYCSHTGICERNY

SEQ ID NO: 81705 - protein, 9 aa, Homo sapiens
  light chain complementarity determining region 3 for antibody 40853
LQDYNYPYT

SEQ ID NO: 81706 - protein, 14 aa, Homo sapiens
  heavy chain complementarity determining region 3 for antibody 40853
ARDISLGNPGGFDY

SEQ ID NO: 81707 - protein, 9 aa, Homo sapiens
  light chain complementarity determining region 3 for antibody 40854
HQYGTSPRT

SEQ ID NO: 81708 - protein, 13 aa, Homo sapiens
  heavy chain complementarity determining region 3 for antibody 40854
ATSEFSASYYFDI

SEQ ID NO: 81709 - protein, 8 aa, Homo sapiens
  light chain complementarity determining region 3 for antibody 40855
HQSSSRIT

SEQ ID NO: 81710 - protein, 8 aa, Homo sapiens
  heavy chain complementarity determining region 3 for antibody 40855
AATKAGGY

SEQ ID NO: 81711 - protein, 8 aa, Homo sapiens
  light chain complementarity determining region 3 for antibody 40856
HQSSGLPT

SEQ ID NO: 81712 - protein, 18 aa, Homo sapiens
  heavy chain complementarity determining region 3 for antibody 40856
ARDAITFGGVLLRGHFDY

SEQ ID NO: 81713 - protein, 9 aa, Homo sapiens
  light chain complementarity determining region 3 for antibody 40857
HHYGSSSGT

SEQ ID NO: 81714 - protein, 12 aa, Homo sapiens
  heavy chain complementarity determining region 3 for antibody 40857
ARGYDFWSGMDI

SEQ ID NO: 81715 - protein, 9 aa, Homo sapiens
  light chain complementarity determining region 3 for antibody 40858
QYYGAYPYT

SEQ ID NO: 81716 - protein, 14 aa, Homo sapiens
  heavy chain complementarity determining region 3 for antibody 40858
VKDIQTTGTTRLDY

SEQ ID NO: 81717 - protein, 9 aa, Homo sapiens
  light chain complementarity determining region 3 for antibody 40859
QQYYTLPYT

SEQ ID NO: 81718 - protein, 11 aa, Homo sapiens
  heavy chain complementarity determining region 3 for antibody 40859
ARGLSAGLFDY

SEQ ID NO: 81719 - protein, 9 aa, Homo sapiens
  light chain complementarity determining region 3 for antibody 40860
QQYSTYPYS

SEQ ID NO: 81720 - protein, 10 aa, Homo sapiens
  heavy chain complementarity determining region 3 for antibody 40860
ARQSPIHLGF

SEQ ID NO: 81721 - protein, 9 aa, Homo sapiens
  light chain complementarity determining region 3 for antibody 40861
QQYSTSPWT

SEQ ID NO: 81722 - protein, 11 aa, Homo sapiens
  heavy chain complementarity determining region 3 for antibody 40861
AVIIPPGVIDV

SEQ ID NO: 81723 - protein, 9 aa, Homo sapiens
  light chain complementarity determining region 3 for antibody 40862
QQYSSDSNT

SEQ ID NO: 81724 - protein, 13 aa, Homo sapiens
  heavy chain complementarity determining region 3 for antibody 40862
VRLRNSTGWCLGY

SEQ ID NO: 81725 - protein, 9 aa, Homo sapiens
  light chain complementarity determining region 3 for antibody 40863
QQYSHSPMT

SEQ ID NO: 81726 - protein, 13 aa, Homo sapiens
  heavy chain complementarity determining region 3 for antibody 40863
ASFITVAGRRLDY

SEQ ID NO: 81727 - protein, 9 aa, Homo sapiens
  light chain complementarity determining region 3 for antibody 40864
QQYNTYPHT

SEQ ID NO: 81728 - protein, 15 aa, Homo sapiens
  heavy chain complementarity determining region 3 for antibody 40864
ARDLDDYGATYGMDV

SEQ ID NO: 81729 - protein, 9 aa, Homo sapiens
  light chain complementarity determining region 3 for antibody 40865
QQYNSYPYT

SEQ ID NO: 81730 - protein, 13 aa, Homo sapiens
  heavy chain complementarity determining region 3 for antibody 40865
VHMGYSSSWPFDF

SEQ ID NO: 81731 - protein, 9 aa, Homo sapiens
  light chain complementarity determining region 3 for antibody 40866
QQYNSYPYT

SEQ ID NO: 81732 - protein, 8 aa, Homo sapiens
  heavy chain complementarity determining region 3 for antibody 40866
ARGLKIHL

SEQ ID NO: 81733 - protein, 9 aa, Homo sapiens
  light chain complementarity determining region 3 for antibody 40867
QQYNSYPFT

SEQ ID NO: 81734 - protein, 10 aa, Homo sapiens
  heavy chain complementarity determining region 3 for antibody 40867
AREDSSNFDY

SEQ ID NO: 81735 - protein, 10 aa, Homo sapiens
  light chain complementarity determining region 3 for antibody 40868
QQYNSWPPLT

SEQ ID NO: 81736 - protein, 14 aa, Homo sapiens
  heavy chain complementarity determining region 3 for antibody 40868
ARSQWEAPGTPPAV

SEQ ID NO: 81737 - protein, 10 aa, Homo sapiens
  light chain complementarity determining region 3 for antibody 40869
QQYNNWPPLT

SEQ ID NO: 81738 - protein, 14 aa, Homo sapiens
  heavy chain complementarity determining region 3 for antibody 40869
ARSQWAAPGTPPAY

SEQ ID NO: 81739 - protein, 9 aa, Homo sapiens
  light chain complementarity determining region 3 for antibody 40870
QQYKKYPWT

SEQ ID NO: 81740 - protein, 12 aa, Homo sapiens
  heavy chain complementarity determining region 3 for antibody 40870
ARATTVDYYFDY

SEQ ID NO: 81741 - protein, 9 aa, Homo sapiens
  light chain complementarity determining region 3 for antibody 40871
QQYKGYPWT

SEQ ID NO: 81742 - protein, 10 aa, Homo sapiens
  heavy chain complementarity determining region 3 for antibody 40871
ARDSGYGIEY

SEQ ID NO: 81743 - protein, 9 aa, Homo sapiens
  light chain complementarity determining region 3 for antibody 40872
QQYHTSRLS

SEQ ID NO: 81744 - protein, 16 aa, Homo sapiens
  heavy chain complementarity determining region 3 for antibody 40872
AMRGLGLNDAGTYFAL

SEQ ID NO: 81745 - protein, 9 aa, Homo sapiens
  light chain complementarity determining region 3 for antibody 40873
QQYHSYPLT

SEQ ID NO: 81746 - protein, 8 aa, Homo sapiens
  heavy chain complementarity determining region 3 for antibody 40873
TRGGDYDY

SEQ ID NO: 81747 - protein, 10 aa, Homo sapiens
  light chain complementarity determining region 3 for antibody 40874
QQYGTSSMYT

SEQ ID NO: 81748 - protein, 13 aa, Homo sapiens
  heavy chain complementarity determining region 3 for antibody 40874
AKHSGSQSYPLDY

SEQ ID NO: 81749 - protein, 9 aa, Homo sapiens
  light chain complementarity determining region 3 for antibody 40875
QQYGTSPLT

SEQ ID NO: 81750 - protein, 21 aa, Homo sapiens
  heavy chain complementarity determining region 3 for antibody 40875
AKDRQPLLFYFGSGSYYVPDH

SEQ ID NO: 81751 - protein, 9 aa, Homo sapiens
  light chain complementarity determining region 3 for antibody 40876
QQYGSSPYT

SEQ ID NO: 81752 - protein, 8 aa, Homo sapiens
  heavy chain complementarity determining region 3 for antibody 40876
ISYNSGWY

SEQ ID NO: 81753 - protein, 9 aa, Homo sapiens
  light chain complementarity determining region 3 for antibody 40877
QQYGSSPYT

SEQ ID NO: 81754 - protein, 20 aa, Homo sapiens
  heavy chain complementarity determining region 3 for antibody 40877
ARGSHIVVVTSIGAAEYFQH

SEQ ID NO: 81755 - protein, 9 aa, Homo sapiens
  light chain complementarity determining region 3 for antibody 40878
QQYGSSPRT

SEQ ID NO: 81756 - protein, 15 aa, Homo sapiens
  heavy chain complementarity determining region 3 for antibody 40878
ARDLGGSYQSGYFDL

SEQ ID NO: 81757 - protein, 10 aa, Homo sapiens
  light chain complementarity determining region 3 for antibody 40879
QQYGSSPPVT

SEQ ID NO: 81758 - protein, 19 aa, Homo sapiens
  heavy chain complementarity determining region 3 for antibody 40879
VRDNYDYWSGRPSAGYFDY

SEQ ID NO: 81759 - protein, 9 aa, Homo sapiens
  light chain complementarity determining region 3 for antibody 40880
QQYGSSPLT

SEQ ID NO: 81760 - protein, 14 aa, Homo sapiens
  heavy chain complementarity determining region 3 for antibody 40880
ASWGVLGSTHAFDI

SEQ ID NO: 81761 - protein, 9 aa, Homo sapiens
  light chain complementarity determining region 3 for antibody 40881
QQYGSSPLT

SEQ ID NO: 81762 - protein, 21 aa, Homo sapiens
  heavy chain complementarity determining region 3 for antibody 40881
ARVGRQYCSGGSCYSEVAPDY

SEQ ID NO: 81763 - protein, 9 aa, Homo sapiens
  light chain complementarity determining region 3 for antibody 40882
QQYGSSPGT

SEQ ID NO: 81764 - protein, 12 aa, Homo sapiens
  heavy chain complementarity determining region 3 for antibody 40882
ARGSPQWLVYDY

SEQ ID NO: 81765 - protein, 9 aa, Homo sapiens
  light chain complementarity determining region 3 for antibody 40883
QQYGSSPFT

SEQ ID NO: 81766 - protein, 7 aa, Homo sapiens
  heavy chain complementarity determining region 3 for antibody 40883
ARGGSDY

SEQ ID NO: 81767 - protein, 9 aa, Homo sapiens
  light chain complementarity determining region 3 for antibody 40884
QQYGSSPET

SEQ ID NO: 81768 - protein, 15 aa, Homo sapiens
  heavy chain complementarity determining region 3 for antibody 40884
VKDSSGWYWDDVFDV

SEQ ID NO: 81769 - protein, 10 aa, Homo sapiens
  light chain complementarity determining region 3 for antibody 40885
QQYGSSLSYT

SEQ ID NO: 81770 - protein, 23 aa, Homo sapiens
  heavy chain complementarity determining region 3 for antibody 40885
ARDPRGHPFVVPTAMVVNWYFDL

SEQ ID NO: 81771 - protein, 9 aa, Homo sapiens
  light chain complementarity determining region 3 for antibody 40886
QQYGSLPLT

SEQ ID NO: 81772 - protein, 13 aa, Homo sapiens
  heavy chain complementarity determining region 3 for antibody 40886
ARRKDGYNYCFDH

SEQ ID NO: 81773 - protein, 9 aa, Homo sapiens
  light chain complementarity determining region 3 for antibody 40887
QQYGRSPWT

SEQ ID NO: 81774 - protein, 18 aa, Homo sapiens
  heavy chain complementarity determining region 3 for antibody 40887
ATMPSLAEPGRIYWYFDL

SEQ ID NO: 81775 - protein, 9 aa, Homo sapiens
  light chain complementarity determining region 3 for antibody 40888
QQYGRSPLT

SEQ ID NO: 81776 - protein, 20 aa, Homo sapiens
  heavy chain complementarity determining region 3 for antibody 40888
ARAAYSSGWSEGAPIDYFDY

SEQ ID NO: 81777 - protein, 8 aa, Homo sapiens
  light chain complementarity determining region 3 for antibody 40889
QQYGRSAT

SEQ ID NO: 81778 - protein, 13 aa, Homo sapiens
  heavy chain complementarity determining region 3 for antibody 40889
AKIFVVAQWCFDL

SEQ ID NO: 81779 - protein, 9 aa, Homo sapiens
  light chain complementarity determining region 3 for antibody 40890
QQYGNSPLT

SEQ ID NO: 81780 - protein, 13 aa, Homo sapiens
  heavy chain complementarity determining region 3 for antibody 40890
AKHKSVYDGSGFI

SEQ ID NO: 81781 - protein, 9 aa, Homo sapiens
  light chain complementarity determining region 3 for antibody 40891
QQYGNSPFT

SEQ ID NO: 81782 - protein, 18 aa, Homo sapiens
  heavy chain complementarity determining region 3 for antibody 40891
AKGTLGSCNDASCYPLDY

SEQ ID NO: 81783 - protein, 9 aa, Homo sapiens
  light chain complementarity determining region 3 for antibody 40892
QQYGGSPST

SEQ ID NO: 81784 - protein, 11 aa, Homo sapiens
  heavy chain complementarity determining region 3 for antibody 40892
ARKPTGMAFDC

SEQ ID NO: 81785 - protein, 9 aa, Homo sapiens
  light chain complementarity determining region 3 for antibody 40893
QQYGDFPLT

SEQ ID NO: 81786 - protein, 18 aa, Homo sapiens
  heavy chain complementarity determining region 3 for antibody 40893
ARDMYRIGWELRPYGFDV

SEQ ID NO: 81787 - protein, 9 aa, Homo sapiens
  light chain complementarity determining region 3 for antibody 40894
QQYDYLPLT

SEQ ID NO: 81788 - protein, 10 aa, Homo sapiens
  heavy chain complementarity determining region 3 for antibody 40894
ARDWIRGTGY

SEQ ID NO: 81789 - protein, 9 aa, Homo sapiens
  light chain complementarity determining region 3 for antibody 40895
QQYDSSPRT

SEQ ID NO: 81790 - protein, 16 aa, Homo sapiens
  heavy chain complementarity determining region 3 for antibody 40895
ARIKVDSSSWYSSLDY

SEQ ID NO: 81791 - protein, 9 aa, Homo sapiens
  light chain complementarity determining region 3 for antibody 40896
QQYDNYPWT

SEQ ID NO: 81792 - protein, 13 aa, Homo sapiens
  heavy chain complementarity determining region 3 for antibody 40896
ARTSYGGGYGMDV

SEQ ID NO: 81793 - protein, 10 aa, Homo sapiens
  light chain complementarity determining region 3 for antibody 40897
QQYDNVPSIT

SEQ ID NO: 81794 - protein, 16 aa, Homo sapiens
  heavy chain complementarity determining region 3 for antibody 40897
ARVRHDYNYRGVPLDY

SEQ ID NO: 81795 - protein, 9 aa, Homo sapiens
  light chain complementarity determining region 3 for antibody 40898
QQYDNVPPT

SEQ ID NO: 81796 - protein, 19 aa, Homo sapiens
  heavy chain complementarity determining region 3 for antibody 40898
ARERQSDTSGDYGAPDFDF

SEQ ID NO: 81797 - protein, 9 aa, Homo sapiens
  light chain complementarity determining region 3 for antibody 40899
QQYDKFPHT

SEQ ID NO: 81798 - protein, 21 aa, Homo sapiens
  heavy chain complementarity determining region 3 for antibody 40899
SRSPSDPMMTFGGIIVPFFDY

SEQ ID NO: 81799 - protein, 9 aa, Homo sapiens
  light chain complementarity determining region 3 for antibody 40900
QQYASAPYT

SEQ ID NO: 81800 - protein, 19 aa, Homo sapiens
  heavy chain complementarity determining region 3 for antibody 40900
AKDMSHDLLTGYPNDAFDI

SEQ ID NO: 81801 - protein, 9 aa, Homo sapiens
  light chain complementarity determining region 3 for antibody 40901
QQTYSPPFT

SEQ ID NO: 81802 - protein, 13 aa, Homo sapiens
  heavy chain complementarity determining region 3 for antibody 40901
VRQSAYDQSGLDY

SEQ ID NO: 81803 - protein, 8 aa, Homo sapiens
  light chain complementarity determining region 3 for antibody 40902
QQTYNMWT

SEQ ID NO: 81804 - protein, 12 aa, Homo sapiens
  heavy chain complementarity determining region 3 for antibody 40902
ARVVPPAMYFDY

SEQ ID NO: 81805 - protein, 8 aa, Homo sapiens
  light chain complementarity determining region 3 for antibody 40903
QQSYSTPT

SEQ ID NO: 81806 - protein, 14 aa, Homo sapiens
  heavy chain complementarity determining region 3 for antibody 40903
ARVLGQQLVQAFDI

SEQ ID NO: 81807 - protein, 9 aa, Homo sapiens
  light chain complementarity determining region 3 for antibody 40904
QQSYSTPRS

SEQ ID NO: 81808 - protein, 14 aa, Homo sapiens
  heavy chain complementarity determining region 3 for antibody 40904
VRAGQYSTNWYGVD

SEQ ID NO: 81809 - protein, 10 aa, Homo sapiens
  light chain complementarity determining region 3 for antibody 40905
QQSYSTPPYT

SEQ ID NO: 81810 - protein, 15 aa, Homo sapiens
  heavy chain complementarity determining region 3 for antibody 40905
ARHSMVFGSSSPFDY

SEQ ID NO: 81811 - protein, 9 aa, Homo sapiens
  light chain complementarity determining region 3 for antibody 40906
QQSYSTPLT

SEQ ID NO: 81812 - protein, 10 aa, Homo sapiens
  heavy chain complementarity determining region 3 for antibody 40906
ARGVNSGWSS

SEQ ID NO: 81813 - protein, 9 aa, Homo sapiens
  light chain complementarity determining region 3 for antibody 40907
QQSYSLPLT

SEQ ID NO: 81814 - protein, 14 aa, Homo sapiens
  heavy chain complementarity determining region 3 for antibody 40907
ARDMERAVAAELDY

SEQ ID NO: 81815 - protein, 10 aa, Homo sapiens
  light chain complementarity determining region 3 for antibody 40908
QQSYSAPLYT

SEQ ID NO: 81816 - protein, 15 aa, Homo sapiens
  heavy chain complementarity determining region 3 for antibody 40908
VREATLFSQAHGFDL

SEQ ID NO: 81817 - protein, 9 aa, Homo sapiens
  light chain complementarity determining region 3 for antibody 40909
QQSNATPFT

SEQ ID NO: 81818 - protein, 11 aa, Homo sapiens
  heavy chain complementarity determining region 3 for antibody 40909
ATNALLSAFDI

SEQ ID NO: 81819 - protein, 9 aa, Homo sapiens
  light chain complementarity determining region 3 for antibody 40910
QQSFTTPPT

SEQ ID NO: 81820 - protein, 18 aa, Homo sapiens
  heavy chain complementarity determining region 3 for antibody 40910
AREVDVAVDRIMFNILDS

SEQ ID NO: 81821 - protein, 8 aa, Homo sapiens
  light chain complementarity determining region 3 for antibody 40911
QQRSDWVT

SEQ ID NO: 81822 - protein, 21 aa, Homo sapiens
  heavy chain complementarity determining region 3 for antibody 40911
ARHDPDNRQDGDTFAYNYFDQ

SEQ ID NO: 81823 - protein, 10 aa, Homo sapiens
  light chain complementarity determining region 3 for antibody 40912
QQRDNWPPWT

SEQ ID NO: 81824 - protein, 15 aa, Homo sapiens
  heavy chain complementarity determining region 3 for antibody 40912
ARDAPLGVGGRGFDI

SEQ ID NO: 81825 - protein, 9 aa, Homo sapiens
  light chain complementarity determining region 3 for antibody 40913
QQLNTYPIT

SEQ ID NO: 81826 - protein, 16 aa, Homo sapiens
  heavy chain complementarity determining region 3 for antibody 40913
ARLDSIRMVRGDALDI

SEQ ID NO: 81827 - protein, 9 aa, Homo sapiens
  light chain complementarity determining region 3 for antibody 40914
QQLNSNLFT

SEQ ID NO: 81828 - protein, 18 aa, Homo sapiens
  heavy chain complementarity determining region 3 for antibody 40914
ARVLSRAYCSSTVCPFDY

SEQ ID NO: 81829 - protein, 9 aa, Homo sapiens
  light chain complementarity determining region 3 for antibody 40915
QQLKTYPLT

SEQ ID NO: 81830 - protein, 20 aa, Homo sapiens
  heavy chain complementarity determining region 3 for antibody 40915
VRGAHIVVVTSFPWEDACGL

SEQ ID NO: 81831 - protein, 9 aa, Homo sapiens
  light chain complementarity determining region 3 for antibody 40916
QQLHALPWT

SEQ ID NO: 81832 - protein, 18 aa, Homo sapiens
  heavy chain complementarity determining region 3 for antibody 40916
ANDVGGYCSGGSCPGLDS

SEQ ID NO: 81833 - protein, 9 aa, Homo sapiens
  light chain complementarity determining region 3 for antibody 40917
QQIYSTPIT

SEQ ID NO: 81834 - protein, 16 aa, Homo sapiens
  heavy chain complementarity determining region 3 for antibody 40917
AKPNQSGWPLLGYFDY

SEQ ID NO: 81835 - protein, 9 aa, Homo sapiens
  light chain complementarity determining region 3 for antibody 40918
QQGYSTPLI

SEQ ID NO: 81836 - protein, 14 aa, Homo sapiens
  heavy chain complementarity determining region 3 for antibody 40918
AKDRGYSGYELIDY

SEQ ID NO: 81837 - protein, 9 aa, Homo sapiens
  light chain complementarity determining region 3 for antibody 40919
QQGYRTPFT

SEQ ID NO: 81838 - protein, 15 aa, Homo sapiens
  heavy chain complementarity determining region 3 for antibody 40919
AKAQVIWGQLYYFDY

SEQ ID NO: 81839 - protein, 9 aa, Homo sapiens
  light chain complementarity determining region 3 for antibody 40920
QQCGSSPFS

SEQ ID NO: 81840 - protein, 18 aa, Homo sapiens
  heavy chain complementarity determining region 3 for antibody 40920
ARGSRITMVRGIIHVAYS

SEQ ID NO: 81841 - protein, 9 aa, Homo sapiens
  light chain complementarity determining region 3 for antibody 40921
QQANSFPPT

SEQ ID NO: 81842 - protein, 13 aa, Homo sapiens
  heavy chain complementarity determining region 3 for antibody 40921
ARPVGPMGYYLDY

SEQ ID NO: 81843 - protein, 9 aa, Homo sapiens
  light chain complementarity determining region 3 for antibody 40922
QQANSFPIT

SEQ ID NO: 81844 - protein, 11 aa, Homo sapiens
  heavy chain complementarity determining region 3 for antibody 40922
ARGGYGSGLDY

SEQ ID NO: 81845 - protein, 9 aa, Homo sapiens
  light chain complementarity determining region 3 for antibody 40923
QKYNSAPFT

SEQ ID NO: 81846 - protein, 11 aa, Homo sapiens
  heavy chain complementarity determining region 3 for antibody 40923
VRDQNWGAFDP

SEQ ID NO: 81847 - protein, 9 aa, Homo sapiens
  light chain complementarity determining region 3 for antibody 40924
QKSYTAPWT

SEQ ID NO: 81848 - protein, 13 aa, Homo sapiens
  heavy chain complementarity determining region 3 for antibody 40924
ARWGPVGVGGLDY

SEQ ID NO: 81849 - protein, 9 aa, Homo sapiens
  light chain complementarity determining region 3 for antibody 40925
QHYIDWPLT

SEQ ID NO: 81850 - protein, 17 aa, Homo sapiens
  heavy chain complementarity determining region 3 for antibody 40925
ARDWDQVVVGQTHWFDP

SEQ ID NO: 81851 - protein, 11 aa, Homo sapiens
  light chain complementarity determining region 3 for antibody 40926
QHYGSSRRIFT

SEQ ID NO: 81852 - protein, 18 aa, Homo sapiens
  heavy chain complementarity determining region 3 for antibody 40926
ARVKLHFDTSGYDNAFDI

SEQ ID NO: 81853 - protein, 9 aa, Homo sapiens
  light chain complementarity determining region 3 for antibody 40927
QHYGSSQFT

SEQ ID NO: 81854 - protein, 21 aa, Homo sapiens
  heavy chain complementarity determining region 3 for antibody 40927
ARDMGGRRDSSGYYLVGYFDY

SEQ ID NO: 81855 - protein, 10 aa, Homo sapiens
  light chain complementarity determining region 3 for antibody 40928
QHYGSSPGLT

SEQ ID NO: 81856 - protein, 13 aa, Homo sapiens
  heavy chain complementarity determining region 3 for antibody 40928
STNRAVRGAMGHS

SEQ ID NO: 81857 - protein, 8 aa, Homo sapiens
  light chain complementarity determining region 3 for antibody 40929
QHYGNSPT

SEQ ID NO: 81858 - protein, 10 aa, Homo sapiens
  heavy chain complementarity determining region 3 for antibody 40929
ARYESGLLDY

SEQ ID NO: 81859 - protein, 9 aa, Homo sapiens
  light chain complementarity determining region 3 for antibody 40930
QHYGDSQAT

SEQ ID NO: 81860 - protein, 13 aa, Homo sapiens
  heavy chain complementarity determining region 3 for antibody 40930
AGHSGQYPGAFDC

SEQ ID NO: 81861 - protein, 7 aa, Homo sapiens
  light chain complementarity determining region 3 for antibody 40931
QHSTSRT

SEQ ID NO: 81862 - protein, 19 aa, Homo sapiens
  heavy chain complementarity determining region 3 for antibody 40931
AREADYPDGGGSNVATFDY

SEQ ID NO: 81863 - protein, 9 aa, Homo sapiens
  light chain complementarity determining region 3 for antibody 40932
QHHSHPLST

SEQ ID NO: 81864 - protein, 10 aa, Homo sapiens
  heavy chain complementarity determining region 3 for antibody 40932
ARDLSAALHT

SEQ ID NO: 81865 - protein, 9 aa, Homo sapiens
  light chain complementarity determining region 3 for antibody 40933
QHANSIPYT

SEQ ID NO: 81866 - protein, 14 aa, Homo sapiens
  heavy chain complementarity determining region 3 for antibody 40933
ARHEHQQPPRWFQH

SEQ ID NO: 81867 - protein, 9 aa, Homo sapiens
  light chain complementarity determining region 3 for antibody 40934
QESYSTSWT

SEQ ID NO: 81868 - protein, 17 aa, Homo sapiens
  heavy chain complementarity determining region 3 for antibody 40934
ARATHDYRNYGGYWFDP

SEQ ID NO: 81869 - protein, 9 aa, Homo sapiens
  light chain complementarity determining region 3 for antibody 40935
MQGTHWPPT

SEQ ID NO: 81870 - protein, 15 aa, Homo sapiens
  heavy chain complementarity determining region 3 for antibody 40935
AREVDKTTDTDGFDV

SEQ ID NO: 81871 - protein, 9 aa, Homo sapiens
  light chain complementarity determining region 3 for antibody 40936
MQGTHWPPT

SEQ ID NO: 81872 - protein, 14 aa, Homo sapiens
  heavy chain complementarity determining region 3 for antibody 40936
ARDLRQWLVSAFDI

SEQ ID NO: 81873 - protein, 10 aa, Homo sapiens
  light chain complementarity determining region 3 for antibody 40937
MQGTHWPPIT

SEQ ID NO: 81874 - protein, 8 aa, Homo sapiens
  heavy chain complementarity determining region 3 for antibody 40937
ARGETTDN

SEQ ID NO: 81875 - protein, 10 aa, Homo sapiens
  light chain complementarity determining region 3 for antibody 40938
MQATHWPLYT

SEQ ID NO: 81876 - protein, 11 aa, Homo sapiens
  heavy chain complementarity determining region 3 for antibody 40938
VRGVGRYRPDY

SEQ ID NO: 81877 - protein, 9 aa, Homo sapiens
  light chain complementarity determining region 3 for antibody 40939
MQATHWPLT

SEQ ID NO: 81878 - protein, 14 aa, Homo sapiens
  heavy chain complementarity determining region 3 for antibody 40939
AHAPDRVIPAVGNL

SEQ ID NO: 81879 - protein, 9 aa, Homo sapiens
  light chain complementarity determining region 3 for antibody 40940
MQALDTPIT

SEQ ID NO: 81880 - protein, 10 aa, Homo sapiens
  heavy chain complementarity determining region 3 for antibody 40940
ARYNSYDFEY

SEQ ID NO: 81881 - protein, 9 aa, Homo sapiens
  light chain complementarity determining region 3 for antibody 40941
LQSYNAPPT

SEQ ID NO: 81882 - protein, 16 aa, Homo sapiens
  heavy chain complementarity determining region 3 for antibody 40941
ARVAWVRGLMTPAFDY

SEQ ID NO: 81883 - protein, 9 aa, Homo sapiens
  light chain complementarity determining region 3 for antibody 40942
LQHNSFPYS

SEQ ID NO: 81884 - protein, 10 aa, Homo sapiens
  heavy chain complementarity determining region 3 for antibody 40942
NRGRDSAFDY

SEQ ID NO: 81885 - protein, 9 aa, Homo sapiens
  light chain complementarity determining region 3 for antibody 40943
LQHKTTPYT

SEQ ID NO: 81886 - protein, 15 aa, Homo sapiens
  heavy chain complementarity determining region 3 for antibody 40943
TTDQGNHTAYYRTDY

SEQ ID NO: 81887 - protein, 9 aa, Homo sapiens
  light chain complementarity determining region 3 for antibody 40944
LQDYNYPIT

SEQ ID NO: 81888 - protein, 12 aa, Homo sapiens
  heavy chain complementarity determining region 3 for antibody 40944
AGLKRGPWNFEF

SEQ ID NO: 81889 - protein, 9 aa, Homo sapiens
  light chain complementarity determining region 3 for antibody 40945
LHYGSDSNT

SEQ ID NO: 81890 - protein, 11 aa, Homo sapiens
  heavy chain complementarity determining region 3 for antibody 40945
AKDSPSGTFDY

SEQ ID NO: 81891 - protein, 9 aa, Homo sapiens
  light chain complementarity determining region 3 for antibody 40946
HQYGSVPRT

SEQ ID NO: 81892 - protein, 9 aa, Homo sapiens
  heavy chain complementarity determining region 3 for antibody 40946
AREYSSFEY

SEQ ID NO: 81893 - protein, 9 aa, Homo sapiens
  light chain complementarity determining region 3 for antibody 40947
HQSGSLPRT

SEQ ID NO: 81894 - protein, 14 aa, Homo sapiens
  heavy chain complementarity determining region 3 for antibody 40947
TTMGWDSGYDDRDY

SEQ ID NO: 81895 - protein, 8 aa, Homo sapiens
  light chain complementarity determining region 3 for antibody 40948
HQRSSWHT

SEQ ID NO: 81896 - protein, 13 aa, Homo sapiens
  heavy chain complementarity determining region 3 for antibody 40948
ATNSGSYPNCFDP

SEQ ID NO: 81897 - protein, 9 aa, Homo sapiens
  light chain complementarity determining region 3 for antibody 40949
HHSSSATLI

SEQ ID NO: 81898 - protein, 13 aa, Homo sapiens
  heavy chain complementarity determining region 3 for antibody 40949
ARHLPYSNGYFDY

SEQ ID NO: 81899 - protein, 8 aa, Homo sapiens
  light chain complementarity determining region 3 for antibody 40950
QYGSSPRT

SEQ ID NO: 81900 - protein, 14 aa, Homo sapiens
  heavy chain complementarity determining region 3 for antibody 40950
ARDGGVGAAGAFDI

SEQ ID NO: 81901 - protein, 8 aa, Homo sapiens
  light chain complementarity determining region 3 for antibody 40951
QQYVRSHT

SEQ ID NO: 81902 - protein, 11 aa, Homo sapiens
  heavy chain complementarity determining region 3 for antibody 40951
TTGGSYAPFDI

SEQ ID NO: 81903 - protein, 9 aa, Homo sapiens
  light chain complementarity determining region 3 for antibody 40952
QQYSSSPRT

SEQ ID NO: 81904 - protein, 14 aa, Homo sapiens
  heavy chain complementarity determining region 3 for antibody 40952
ARDSFGPEVVVDDY

SEQ ID NO: 81905 - protein, 9 aa, Homo sapiens
  light chain complementarity determining region 3 for antibody 40953
QQYSNYPVT

SEQ ID NO: 81906 - protein, 15 aa, Homo sapiens
  heavy chain complementarity determining region 3 for antibody 40953
TRGRTEPGAGYYFDY

SEQ ID NO: 81907 - protein, 9 aa, Homo sapiens
  light chain complementarity determining region 3 for antibody 40954
QQYSNSPRT

SEQ ID NO: 81908 - protein, 13 aa, Homo sapiens
  heavy chain complementarity determining region 3 for antibody 40954
ARARIFAAGSYDY

SEQ ID NO: 81909 - protein, 9 aa, Homo sapiens
  light chain complementarity determining region 3 for antibody 40955
QQYSGSLFT

SEQ ID NO: 81910 - protein, 10 aa, Homo sapiens
  heavy chain complementarity determining region 3 for antibody 40955
AAPDGGSYNH

SEQ ID NO: 81911 - protein, 8 aa, Homo sapiens
  light chain complementarity determining region 3 for antibody 40956
QQYNSYST

SEQ ID NO: 81912 - protein, 16 aa, Homo sapiens
  heavy chain complementarity determining region 3 for antibody 40956
ARDGLPLTSKPYHFDN

SEQ ID NO: 81913 - protein, 8 aa, Homo sapiens
  light chain complementarity determining region 3 for antibody 40957
QQYNSYST

SEQ ID NO: 81914 - protein, 22 aa, Homo sapiens
  heavy chain complementarity determining region 3 for antibody 40957
AHRRTLPRDCSAGSCYHGAFDY

SEQ ID NO: 81915 - protein, 10 aa, Homo sapiens
  light chain complementarity determining region 3 for antibody 40958
QQYNSYSPLT

SEQ ID NO: 81916 - protein, 12 aa, Homo sapiens
  heavy chain complementarity determining region 3 for antibody 40958
AHFNWDRGTFDY

SEQ ID NO: 81917 - protein, 8 aa, Homo sapiens
  light chain complementarity determining region 3 for antibody 40959
QQYNSYRT

SEQ ID NO: 81918 - protein, 13 aa, Homo sapiens
  heavy chain complementarity determining region 3 for antibody 40959
ARESGSGWPYFEY

SEQ ID NO: 81919 - protein, 9 aa, Homo sapiens
  light chain complementarity determining region 3 for antibody 40960
QQYNSYPPT

SEQ ID NO: 81920 - protein, 9 aa, Homo sapiens
  heavy chain complementarity determining region 3 for antibody 40960
VRGLATYDF

SEQ ID NO: 81921 - protein, 9 aa, Homo sapiens
  light chain complementarity determining region 3 for antibody 40961
QQYNSYPPA

SEQ ID NO: 81922 - protein, 14 aa, Homo sapiens
  heavy chain complementarity determining region 3 for antibody 40961
AHKSDVTHGYYFDY

SEQ ID NO: 81923 - protein, 8 aa, Homo sapiens
  light chain complementarity determining region 3 for antibody 40962
QQYNSGWT

SEQ ID NO: 81924 - protein, 13 aa, Homo sapiens
  heavy chain complementarity determining region 3 for antibody 40962
ASRHCNNGVCFDY

SEQ ID NO: 81925 - protein, 9 aa, Homo sapiens
  light chain complementarity determining region 3 for antibody 40963
QQYNSFPLT

SEQ ID NO: 81926 - protein, 17 aa, Homo sapiens
  heavy chain complementarity determining region 3 for antibody 40963
AREWRGQLVYPSSYFDL

SEQ ID NO: 81927 - protein, 8 aa, Homo sapiens
  light chain complementarity determining region 3 for antibody 40964
QQYNNWPT

SEQ ID NO: 81928 - protein, 10 aa, Homo sapiens
  heavy chain complementarity determining region 3 for antibody 40964
AIFGVTGTGY

SEQ ID NO: 81929 - protein, 9 aa, Homo sapiens
  light chain complementarity determining region 3 for antibody 40965
QQYNDWPWT

SEQ ID NO: 81930 - protein, 15 aa, Homo sapiens
  heavy chain complementarity determining region 3 for antibody 40965
ARVGYSFGKLSAFDI

SEQ ID NO: 81931 - protein, 10 aa, Homo sapiens
  light chain complementarity determining region 3 for antibody 40966
QQYNDWPAWT

SEQ ID NO: 81932 - protein, 14 aa, Homo sapiens
  heavy chain complementarity determining region 3 for antibody 40966
ARIWFGDLFRIFDY

SEQ ID NO: 81933 - protein, 10 aa, Homo sapiens
  light chain complementarity determining region 3 for antibody 40967
QQYKNWLPVT

SEQ ID NO: 81934 - protein, 12 aa, Homo sapiens
  heavy chain complementarity determining region 3 for antibody 40967
ARVIQGDYLIDY

SEQ ID NO: 81935 - protein, 9 aa, Homo sapiens
  light chain complementarity determining region 3 for antibody 40968
QQYHSSHRT

SEQ ID NO: 81936 - protein, 11 aa, Homo sapiens
  heavy chain complementarity determining region 3 for antibody 40968
ARDSRYRGYDL

SEQ ID NO: 81937 - protein, 9 aa, Homo sapiens
  light chain complementarity determining region 3 for antibody 40969
QQYGYSPLT

SEQ ID NO: 81938 - protein, 15 aa, Homo sapiens
  heavy chain complementarity determining region 3 for antibody 40969
ARSPYRSPGRNWFDP

SEQ ID NO: 81939 - protein, 8 aa, Homo sapiens
  light chain complementarity determining region 3 for antibody 40970
QQYGTSFT

SEQ ID NO: 81940 - protein, 9 aa, Homo sapiens
  heavy chain complementarity determining region 3 for antibody 40970
ARVDGYFDY

SEQ ID NO: 81941 - protein, 9 aa, Homo sapiens
  light chain complementarity determining region 3 for antibody 40971
QQYGSSSLT

SEQ ID NO: 81942 - protein, 8 aa, Homo sapiens
  heavy chain complementarity determining region 3 for antibody 40971
VTMGTTVA

SEQ ID NO: 81943 - protein, 9 aa, Homo sapiens
  light chain complementarity determining region 3 for antibody 40972
QQYGSSSIT

SEQ ID NO: 81944 - protein, 13 aa, Homo sapiens
  heavy chain complementarity determining region 3 for antibody 40972
VRLLSHRTLAGDY

SEQ ID NO: 81945 - protein, 9 aa, Homo sapiens
  light chain complementarity determining region 3 for antibody 40973
QQYGSSPYT

SEQ ID NO: 81946 - protein, 9 aa, Homo sapiens
  heavy chain complementarity determining region 3 for antibody 40973
ARPYESRFG

SEQ ID NO: 81947 - protein, 9 aa, Homo sapiens
  light chain complementarity determining region 3 for antibody 40974
QQYGSSPWT

SEQ ID NO: 81948 - protein, 18 aa, Homo sapiens
  heavy chain complementarity determining region 3 for antibody 40974
ARSPDSDWLSSTPFYFDY

SEQ ID NO: 81949 - protein, 9 aa, Homo sapiens
  light chain complementarity determining region 3 for antibody 40975
QQYGSSPWT

SEQ ID NO: 81950 - protein, 11 aa, Homo sapiens
  heavy chain complementarity determining region 3 for antibody 40975
AREGYYGPHDY

SEQ ID NO: 81951 - protein, 9 aa, Homo sapiens
  light chain complementarity determining region 3 for antibody 40976
QQYGSSPST

SEQ ID NO: 81952 - protein, 18 aa, Homo sapiens
  heavy chain complementarity determining region 3 for antibody 40976
ASASLRSIFGINLYYFQS

SEQ ID NO: 81953 - protein, 9 aa, Homo sapiens
  light chain complementarity determining region 3 for antibody 40977
QQYGSSPPT

SEQ ID NO: 81954 - protein, 15 aa, Homo sapiens
  heavy chain complementarity determining region 3 for antibody 40977
ARRISDSSGFFYVDN

SEQ ID NO: 81955 - protein, 9 aa, Homo sapiens
  light chain complementarity determining region 3 for antibody 40978
QQYGSSPKT

SEQ ID NO: 81956 - protein, 16 aa, Homo sapiens
  heavy chain complementarity determining region 3 for antibody 40978
ARERANQFGVNDAFDI

SEQ ID NO: 81957 - protein, 9 aa, Homo sapiens
  light chain complementarity determining region 3 for antibody 40979
QQYGSSPIT

SEQ ID NO: 81958 - protein, 13 aa, Homo sapiens
  heavy chain complementarity determining region 3 for antibody 40979
ARTQLWLGWYFDF

SEQ ID NO: 81959 - protein, 8 aa, Homo sapiens
  light chain complementarity determining region 3 for antibody 40980
QQYGSSIT

SEQ ID NO: 81960 - protein, 14 aa, Homo sapiens
  heavy chain complementarity determining region 3 for antibody 40980
TRSPGGGGGGYSQH

SEQ ID NO: 81961 - protein, 9 aa, Homo sapiens
  light chain complementarity determining region 3 for antibody 40981
QQYGRSRVT

SEQ ID NO: 81962 - protein, 11 aa, Homo sapiens
  heavy chain complementarity determining region 3 for antibody 40981
AAVTMHDAFDL

SEQ ID NO: 81963 - protein, 9 aa, Homo sapiens
  light chain complementarity determining region 3 for antibody 40982
QQYGNSSWT

SEQ ID NO: 81964 - protein, 20 aa, Homo sapiens
  heavy chain complementarity determining region 3 for antibody 40982
AREAHPHYYGSASYYPVFDA

SEQ ID NO: 81965 - protein, 8 aa, Homo sapiens
  light chain complementarity determining region 3 for antibody 40983
QQYGNSRT

SEQ ID NO: 81966 - protein, 15 aa, Homo sapiens
  heavy chain complementarity determining region 3 for antibody 40983
ARRPPPLTSPGVFDY

SEQ ID NO: 81967 - protein, 10 aa, Homo sapiens
  light chain complementarity determining region 3 for antibody 40984
QQYGGSPRYT

SEQ ID NO: 81968 - protein, 15 aa, Homo sapiens
  heavy chain complementarity determining region 3 for antibody 40984
ARLGWVRGDYGPIDY

SEQ ID NO: 81969 - protein, 11 aa, Homo sapiens
  light chain complementarity determining region 3 for antibody 40985
QQYGGSPPMYT

SEQ ID NO: 81970 - protein, 16 aa, Homo sapiens
  heavy chain complementarity determining region 3 for antibody 40985
VRAMFCGDWCYRGFDK

SEQ ID NO: 81971 - protein, 9 aa, Homo sapiens
  light chain complementarity determining region 3 for antibody 40986
QQYDYLPPT

SEQ ID NO: 81972 - protein, 11 aa, Homo sapiens
  heavy chain complementarity determining region 3 for antibody 40986
ARGTTFGTFNY

SEQ ID NO: 81973 - protein, 8 aa, Homo sapiens
  light chain complementarity determining region 3 for antibody 40987
QQYDTLFT

SEQ ID NO: 81974 - protein, 11 aa, Homo sapiens
  heavy chain complementarity determining region 3 for antibody 40987
ARFYRRGAFQF

SEQ ID NO: 81975 - protein, 9 aa, Homo sapiens
  light chain complementarity determining region 3 for antibody 40988
QQYDSAPDT

SEQ ID NO: 81976 - protein, 11 aa, Homo sapiens
  heavy chain complementarity determining region 3 for antibody 40988
AKDPSSGPSDY

SEQ ID NO: 81977 - protein, 9 aa, Homo sapiens
  light chain complementarity determining region 3 for antibody 40989
QQYDNLPIT

SEQ ID NO: 81978 - protein, 12 aa, Homo sapiens
  heavy chain complementarity determining region 3 for antibody 40989
AKDWSGSYIFDY

SEQ ID NO: 81979 - protein, 10 aa, Homo sapiens
  light chain complementarity determining region 3 for antibody 40990
QQYDNLLPNT

SEQ ID NO: 81980 - protein, 15 aa, Homo sapiens
  heavy chain complementarity determining region 3 for antibody 40990
ARDLGYCSGGSCFGY

SEQ ID NO: 81981 - protein, 9 aa, Homo sapiens
  light chain complementarity determining region 3 for antibody 40991
QQYAGSPYT

SEQ ID NO: 81982 - protein, 16 aa, Homo sapiens
  heavy chain complementarity determining region 3 for antibody 40991
ATSPRHHHSSAPPWDY

SEQ ID NO: 81983 - protein, 9 aa, Homo sapiens
  light chain complementarity determining region 3 for antibody 40992
QQTYETPIT

SEQ ID NO: 81984 - protein, 18 aa, Homo sapiens
  heavy chain complementarity determining region 3 for antibody 40992
ARDRAPRITMAPLDGMDV

SEQ ID NO: 81985 - protein, 9 aa, Homo sapiens
  light chain complementarity determining region 3 for antibody 40993
QQTHSFPLT

SEQ ID NO: 81986 - protein, 17 aa, Homo sapiens
  heavy chain complementarity determining region 3 for antibody 40993
AREGDSSGWYRDDAFDI

SEQ ID NO: 81987 - protein, 9 aa, Homo sapiens
  light chain complementarity determining region 3 for antibody 40994
QQSYTTPYT

SEQ ID NO: 81988 - protein, 13 aa, Homo sapiens
  heavy chain complementarity determining region 3 for antibody 40994
ARTNYYDSSGLYY

SEQ ID NO: 81989 - protein, 9 aa, Homo sapiens
  light chain complementarity determining region 3 for antibody 40995
QQSYSTPYT

SEQ ID NO: 81990 - protein, 12 aa, Homo sapiens
  heavy chain complementarity determining region 3 for antibody 40995
ARVQVEGYYLDY

SEQ ID NO: 81991 - protein, 9 aa, Homo sapiens
  light chain complementarity determining region 3 for antibody 40996
QQSYSTPRS

SEQ ID NO: 81992 - protein, 14 aa, Homo sapiens
  heavy chain complementarity determining region 3 for antibody 40996
TTADGSTIYDAFDF

SEQ ID NO: 81993 - protein, 10 aa, Homo sapiens
  light chain complementarity determining region 3 for antibody 40997
QQSYSTLAWT

SEQ ID NO: 81994 - protein, 17 aa, Homo sapiens
  heavy chain complementarity determining region 3 for antibody 40997
ARENRVGPGGVFIPIDH

SEQ ID NO: 81995 - protein, 9 aa, Homo sapiens
  light chain complementarity determining region 3 for antibody 40998
QQSYSSPRT

SEQ ID NO: 81996 - protein, 14 aa, Homo sapiens
  heavy chain complementarity determining region 3 for antibody 40998
ARDSVAGGPGVFDI

SEQ ID NO: 81997 - protein, 9 aa, Homo sapiens
  light chain complementarity determining region 3 for antibody 40999
QQSYSLPVT

SEQ ID NO: 81998 - protein, 15 aa, Homo sapiens
  heavy chain complementarity determining region 3 for antibody 40999
ATIIGSGTYRRGLNY

SEQ ID NO: 81999 - protein, 9 aa, Homo sapiens
  light chain complementarity determining region 3 for antibody 41000
QQSYSAPFT

SEQ ID NO: 82000 - protein, 9 aa, Homo sapiens
  heavy chain complementarity determining region 3 for antibody 41000
TKGSSALEY

SEQ ID NO: 82001 - protein, 8 aa, Homo sapiens
  light chain complementarity determining region 3 for antibody 41001
QQSYNTLT

SEQ ID NO: 82002 - protein, 16 aa, Homo sapiens
  heavy chain complementarity determining region 3 for antibody 41001
AHINPALPGTYEYFSH

SEQ ID NO: 82003 - protein, 9 aa, Homo sapiens
  light chain complementarity determining region 3 for antibody 41002
QQSTSTPKT

SEQ ID NO: 82004 - protein, 21 aa, Homo sapiens
  heavy chain complementarity determining region 3 for antibody 41002
ARDGGPYYDLLTGSYSHAFDI

SEQ ID NO: 82005 - protein, 9 aa, Homo sapiens
  light chain complementarity determining region 3 for antibody 41003
QQSHITPIT

SEQ ID NO: 82006 - protein, 10 aa, Homo sapiens
  heavy chain complementarity determining region 3 for antibody 41003
TRSEGYGMDV

SEQ ID NO: 82007 - protein, 9 aa, Homo sapiens
  light chain complementarity determining region 3 for antibody 41004
QQSHDFPYS

SEQ ID NO: 82008 - protein, 13 aa, Homo sapiens
  heavy chain complementarity determining region 3 for antibody 41004
ARLRDVNGWPFDY

SEQ ID NO: 82009 - protein, 9 aa, Homo sapiens
  light chain complementarity determining region 3 for antibody 41005
QQSFSSPRT

SEQ ID NO: 82010 - protein, 13 aa, Homo sapiens
  heavy chain complementarity determining region 3 for antibody 41005
ARDYLAGTYYFDY

SEQ ID NO: 82011 - protein, 9 aa, Homo sapiens
  light chain complementarity determining region 3 for antibody 41006
QQSFNVPRT

SEQ ID NO: 82012 - protein, 20 aa, Homo sapiens
  heavy chain complementarity determining region 3 for antibody 41006
VREGKDLRELRLPLALTFDY

SEQ ID NO: 82013 - protein, 9 aa, Homo sapiens
  light chain complementarity determining region 3 for antibody 41007
QQSFDSPLT

SEQ ID NO: 82014 - protein, 14 aa, Homo sapiens
  heavy chain complementarity determining region 3 for antibody 41007
AKVYDGNGNLGIDY

SEQ ID NO: 82015 - protein, 8 aa, Homo sapiens
  light chain complementarity determining region 3 for antibody 41008
QQRSNWPS

SEQ ID NO: 82016 - protein, 15 aa, Homo sapiens
  heavy chain complementarity determining region 3 for antibody 41008
TSGVGILYPSGLFDY

SEQ ID NO: 82017 - protein, 10 aa, Homo sapiens
  light chain complementarity determining region 3 for antibody 41009
QQRSNWPRRT

SEQ ID NO: 82018 - protein, 10 aa, Homo sapiens
  heavy chain complementarity determining region 3 for antibody 41009
AKEDGGDFDY

SEQ ID NO: 82019 - protein, 10 aa, Homo sapiens
  light chain complementarity determining region 3 for antibody 41010
QQRSNWPPLT

SEQ ID NO: 82020 - protein, 18 aa, Homo sapiens
  heavy chain complementarity determining region 3 for antibody 41010
ATSAGPEYSGSYYSRADY

SEQ ID NO: 82021 - protein, 9 aa, Homo sapiens
  light chain complementarity determining region 3 for antibody 41011
QQRSNWPLV

SEQ ID NO: 82022 - protein, 17 aa, Homo sapiens
  heavy chain complementarity determining region 3 for antibody 41011
AKDRSATIAAPMARDDY

SEQ ID NO: 82023 - protein, 9 aa, Homo sapiens
  light chain complementarity determining region 3 for antibody 41012
QQRSNWPLT

SEQ ID NO: 82024 - protein, 19 aa, Homo sapiens
  heavy chain complementarity determining region 3 for antibody 41012
ARMVTYCGGGTCYQNWFDP

SEQ ID NO: 82025 - protein, 9 aa, Homo sapiens
  light chain complementarity determining region 3 for antibody 41013
QQNLHLPLT

SEQ ID NO: 82026 - protein, 13 aa, Homo sapiens
  heavy chain complementarity determining region 3 for antibody 41013
SRGEERNTGEMDL

SEQ ID NO: 82027 - protein, 9 aa, Homo sapiens
  light chain complementarity determining region 3 for antibody 41014
QQFNVLPVI

SEQ ID NO: 82028 - protein, 15 aa, Homo sapiens
  heavy chain complementarity determining region 3 for antibody 41014
AKSRRRGARAWYYDL

SEQ ID NO: 82029 - protein, 9 aa, Homo sapiens
  light chain complementarity determining region 3 for antibody 41015
QQFKIYPFT

SEQ ID NO: 82030 - protein, 14 aa, Homo sapiens
  heavy chain complementarity determining region 3 for antibody 41015
AKAKDSSGYHCFDS

SEQ ID NO: 82031 - protein, 9 aa, Homo sapiens
  light chain complementarity determining region 3 for antibody 41016
QQFGSSGVT

SEQ ID NO: 82032 - protein, 6 aa, Homo sapiens
  heavy chain complementarity determining region 3 for antibody 41016
VVFAGH

SEQ ID NO: 82033 - protein, 9 aa, Homo sapiens
  light chain complementarity determining region 3 for antibody 41017
QQFDTSPVT

SEQ ID NO: 82034 - protein, 14 aa, Homo sapiens
  heavy chain complementarity determining region 3 for antibody 41017
ARIPIKGRGLTTDS

SEQ ID NO: 82035 - protein, 9 aa, Homo sapiens
  light chain complementarity determining region 3 for antibody 41018
QQCGTSPYT

SEQ ID NO: 82036 - protein, 18 aa, Homo sapiens
  heavy chain complementarity determining region 3 for antibody 41018
ATNYYDSSGYYGSWYFDL

SEQ ID NO: 82037 - protein, 8 aa, Homo sapiens
  light chain complementarity determining region 3 for antibody 41019
QQCADLLS

SEQ ID NO: 82038 - protein, 12 aa, Homo sapiens
  heavy chain complementarity determining region 3 for antibody 41019
ATYYFGSGSFDH

SEQ ID NO: 82039 - protein, 9 aa, Homo sapiens
  light chain complementarity determining region 3 for antibody 41020
QQAYSTPPT

SEQ ID NO: 82040 - protein, 12 aa, Homo sapiens
  heavy chain complementarity determining region 3 for antibody 41020
ARSLSASGPFDS

SEQ ID NO: 82041 - protein, 10 aa, Homo sapiens
  light chain complementarity determining region 3 for antibody 41021
QQANSFPWIT

SEQ ID NO: 82042 - protein, 18 aa, Homo sapiens
  heavy chain complementarity determining region 3 for antibody 41021
ARYWRSYYDSSTYHAFNV

SEQ ID NO: 82043 - protein, 9 aa, Homo sapiens
  light chain complementarity determining region 3 for antibody 41022
QQANSFPLT

SEQ ID NO: 82044 - protein, 14 aa, Homo sapiens
  heavy chain complementarity determining region 3 for antibody 41022
ARGIDIGAANSFDY

SEQ ID NO: 82045 - protein, 9 aa, Homo sapiens
  light chain complementarity determining region 3 for antibody 41023
QQANNFPYT

SEQ ID NO: 82046 - protein, 9 aa, Homo sapiens
  heavy chain complementarity determining region 3 for antibody 41023
ARGYVWFDY

SEQ ID NO: 82047 - protein, 10 aa, Homo sapiens
  light chain complementarity determining region 3 for antibody 41024
QQAGSLPPYT

SEQ ID NO: 82048 - protein, 16 aa, Homo sapiens
  heavy chain complementarity determining region 3 for antibody 41024
AKSPYPGGELIRWGDH

SEQ ID NO: 82049 - protein, 9 aa, Homo sapiens
  light chain complementarity determining region 3 for antibody 41025
QHYNNYSRR

SEQ ID NO: 82050 - protein, 10 aa, Homo sapiens
  heavy chain complementarity determining region 3 for antibody 41025
ASGRGGFDSD

SEQ ID NO: 82051 - protein, 10 aa, Homo sapiens
  light chain complementarity determining region 3 for antibody 41026
QHYGNLLMFP

SEQ ID NO: 82052 - protein, 21 aa, Homo sapiens
  heavy chain complementarity determining region 3 for antibody 41026
ARWRGPTAITMRGVGYYGMDV

SEQ ID NO: 82053 - protein, 8 aa, Homo sapiens
  light chain complementarity determining region 3 for antibody 41027
QHRSDWIT

SEQ ID NO: 82054 - protein, 15 aa, Homo sapiens
  heavy chain complementarity determining region 3 for antibody 41027
ARGEFTYCGGDCYDY

SEQ ID NO: 82055 - protein, 10 aa, Homo sapiens
  light chain complementarity determining region 3 for antibody 41028
QHLYNWPPLT

SEQ ID NO: 82056 - protein, 24 aa, Homo sapiens
  heavy chain complementarity determining region 3 for antibody 41028
ARVGRFAPFIMMFPTKTHCDGFDI

SEQ ID NO: 82057 - protein, 10 aa, Homo sapiens
  light chain complementarity determining region 3 for antibody 41029
QETYSTPLST

SEQ ID NO: 82058 - protein, 12 aa, Homo sapiens
  heavy chain complementarity determining region 3 for antibody 41029
ARSLGTPHYFDH

SEQ ID NO: 82059 - protein, 9 aa, Homo sapiens
  light chain complementarity determining region 3 for antibody 41030
QESHSSPWT

SEQ ID NO: 82060 - protein, 13 aa, Homo sapiens
  heavy chain complementarity determining region 3 for antibody 41030
ATTMGSTNDGYNF

SEQ ID NO: 82061 - protein, 9 aa, Homo sapiens
  light chain complementarity determining region 3 for antibody 41031
QEFASSPYT

SEQ ID NO: 82062 - protein, 11 aa, Homo sapiens
  heavy chain complementarity determining region 3 for antibody 41031
AKVGTVRSFDY

SEQ ID NO: 82063 - protein, 9 aa, Homo sapiens
  light chain complementarity determining region 3 for antibody 41032
MQHTLLPFT

SEQ ID NO: 82064 - protein, 14 aa, Homo sapiens
  heavy chain complementarity determining region 3 for antibody 41032
ARDLWYSGYDNFDF

SEQ ID NO: 82065 - protein, 9 aa, Homo sapiens
  light chain complementarity determining region 3 for antibody 41033
MQGTHWPGT

SEQ ID NO: 82066 - protein, 20 aa, Homo sapiens
  heavy chain complementarity determining region 3 for antibody 41033
TRGTMFGVVIVKLWYFGMDV

SEQ ID NO: 82067 - protein, 9 aa, Homo sapiens
  light chain complementarity determining region 3 for antibody 41034
MQGLQTPWT

SEQ ID NO: 82068 - protein, 19 aa, Homo sapiens
  heavy chain complementarity determining region 3 for antibody 41034
ARDSFYYETGNYFNDVFDM

SEQ ID NO: 82069 - protein, 9 aa, Homo sapiens
  light chain complementarity determining region 3 for antibody 41035
MQALQTPYT

SEQ ID NO: 82070 - protein, 17 aa, Homo sapiens
  heavy chain complementarity determining region 3 for antibody 41035
ARGDQAYGSQSYYKFVS

SEQ ID NO: 82071 - protein, 9 aa, Homo sapiens
  light chain complementarity determining region 3 for antibody 41036
LQYKSYPRT

SEQ ID NO: 82072 - protein, 6 aa, Homo sapiens
  heavy chain complementarity determining region 3 for antibody 41036
SRALDY

SEQ ID NO: 82073 - protein, 9 aa, Homo sapiens
  light chain complementarity determining region 3 for antibody 41037
LQYDSFPLA

SEQ ID NO: 82074 - protein, 14 aa, Homo sapiens
  heavy chain complementarity determining region 3 for antibody 41037
ATLGYAPNTPLWDY

SEQ ID NO: 82075 - protein, 9 aa, Homo sapiens
  light chain complementarity determining region 3 for antibody 41038
LQHNSFPPT

SEQ ID NO: 82076 - protein, 19 aa, Homo sapiens
  heavy chain complementarity determining region 3 for antibody 41038
LRWTNYFDNSGSHSTSFDT

SEQ ID NO: 82077 - protein, 9 aa, Homo sapiens
  light chain complementarity determining region 3 for antibody 41039
LQHKSYPLT

SEQ ID NO: 82078 - protein, 16 aa, Homo sapiens
  heavy chain complementarity determining region 3 for antibody 41039
ANLPLWFGDLGFDMDV

SEQ ID NO: 82079 - protein, 9 aa, Homo sapiens
  light chain complementarity determining region 3 for antibody 41040
LQHDNLPWT

SEQ ID NO: 82080 - protein, 14 aa, Homo sapiens
  heavy chain complementarity determining region 3 for antibody 41040
ARARKDFFQGGPDF

SEQ ID NO: 82081 - protein, 9 aa, Homo sapiens
  light chain complementarity determining region 3 for antibody 41041
LQDYNYPRT

SEQ ID NO: 82082 - protein, 19 aa, Homo sapiens
  heavy chain complementarity determining region 3 for antibody 41041
ARGPGGSSVYYGDVLYFDY

SEQ ID NO: 82083 - protein, 9 aa, Homo sapiens
  light chain complementarity determining region 3 for antibody 41042
LQDYIYPRT

SEQ ID NO: 82084 - protein, 11 aa, Homo sapiens
  heavy chain complementarity determining region 3 for antibody 41042
AISNYFYGLGV

SEQ ID NO: 82085 - protein, 9 aa, Homo sapiens
  light chain complementarity determining region 3 for antibody 41043
LQDYIYPLT

SEQ ID NO: 82086 - protein, 9 aa, Homo sapiens
  heavy chain complementarity determining region 3 for antibody 41043
ARDLGLKDY

SEQ ID NO: 82087 - protein, 8 aa, Homo sapiens
  light chain complementarity determining region 3 for antibody 41044
HQSSTLPT

SEQ ID NO: 82088 - protein, 8 aa, Homo sapiens
  heavy chain complementarity determining region 3 for antibody 41044
ARSRPAGY

SEQ ID NO: 82089 - protein, 9 aa, Homo sapiens
  light chain complementarity determining region 3 for antibody 41045
HQGGSLPQT

SEQ ID NO: 82090 - protein, 18 aa, Homo sapiens
  heavy chain complementarity determining region 3 for antibody 41045
AAATYSSSWKVGEDAFAI

SEQ ID NO: 82091 - protein, 9 aa, Homo sapiens
  light chain complementarity determining region 3 for antibody 41046
HHYGSSPQT

SEQ ID NO: 82092 - protein, 15 aa, Homo sapiens
  heavy chain complementarity determining region 3 for antibody 41046
ARGRSYYDSSGSNYF

SEQ ID NO: 82093 - protein, 9 aa, Homo sapiens
  light chain complementarity determining region 3 for antibody 41047
QRTYNAPWT

SEQ ID NO: 82094 - protein, 12 aa, Homo sapiens
  heavy chain complementarity determining region 3 for antibody 41047
ARELPFTNYFDF

SEQ ID NO: 82095 - protein, 9 aa, Homo sapiens
  light chain complementarity determining region 3 for antibody 41048
QQYYTHAIT

SEQ ID NO: 82096 - protein, 13 aa, Homo sapiens
  heavy chain complementarity determining region 3 for antibody 41048
ARHPTGFPNWFGP

SEQ ID NO: 82097 - protein, 9 aa, Homo sapiens
  light chain complementarity determining region 3 for antibody 41049
QQYYSPPWT

SEQ ID NO: 82098 - protein, 11 aa, Homo sapiens
  heavy chain complementarity determining region 3 for antibody 41049
ARGTGLYWFGP

SEQ ID NO: 82099 - protein, 9 aa, Homo sapiens
  light chain complementarity determining region 3 for antibody 41050
QQYYNIPYT

SEQ ID NO: 82100 - protein, 14 aa, Homo sapiens
  heavy chain complementarity determining region 3 for antibody 41050
ARALGSGYNGLLGH

SEQ ID NO: 82101 - protein, 9 aa, Homo sapiens
  light chain complementarity determining region 3 for antibody 41051
QQYYDSPRT

SEQ ID NO: 82102 - protein, 19 aa, Homo sapiens
  heavy chain complementarity determining region 3 for antibody 41051
ARGRSITLEGVIVIPGFDY

SEQ ID NO: 82103 - protein, 9 aa, Homo sapiens
  light chain complementarity determining region 3 for antibody 41052
QQYYDIPHT

SEQ ID NO: 82104 - protein, 11 aa, Homo sapiens
  heavy chain complementarity determining region 3 for antibody 41052
ARRSVPDALDS

SEQ ID NO: 82105 - protein, 10 aa, Homo sapiens
  light chain complementarity determining region 3 for antibody 41053
QQYNYWPRFT

SEQ ID NO: 82106 - protein, 15 aa, Homo sapiens
  heavy chain complementarity determining region 3 for antibody 41053
ARSLSVSGYYSGSDY

SEQ ID NO: 82107 - protein, 9 aa, Homo sapiens
  light chain complementarity determining region 3 for antibody 41054
QQYNTYPLT

SEQ ID NO: 82108 - protein, 12 aa, Homo sapiens
  heavy chain complementarity determining region 3 for antibody 41054
ACGFTMSRWGGY

SEQ ID NO: 82109 - protein, 8 aa, Homo sapiens
  light chain complementarity determining region 3 for antibody 41055
QQYNTYAT

SEQ ID NO: 82110 - protein, 16 aa, Homo sapiens
  heavy chain complementarity determining region 3 for antibody 41055
ARASGPGHGTGIILDT

SEQ ID NO: 82111 - protein, 9 aa, Homo sapiens
  light chain complementarity determining region 3 for antibody 41056
QQYNSYSRT

SEQ ID NO: 82112 - protein, 13 aa, Homo sapiens
  heavy chain complementarity determining region 3 for antibody 41056
VTNGGSYFGYFDY

SEQ ID NO: 82113 - protein, 9 aa, Homo sapiens
  light chain complementarity determining region 3 for antibody 41057
QQYNSYPWT

SEQ ID NO: 82114 - protein, 11 aa, Homo sapiens
  heavy chain complementarity determining region 3 for antibody 41057
ASDASSKSLAY

SEQ ID NO: 82115 - protein, 9 aa, Homo sapiens
  light chain complementarity determining region 3 for antibody 41058
QQYNSYPRT

SEQ ID NO: 82116 - protein, 13 aa, Homo sapiens
  heavy chain complementarity determining region 3 for antibody 41058
ARDQADRQQPDNY

SEQ ID NO: 82117 - protein, 9 aa, Homo sapiens
  light chain complementarity determining region 3 for antibody 41059
QQYNSYPLT

SEQ ID NO: 82118 - protein, 6 aa, Homo sapiens
  heavy chain complementarity determining region 3 for antibody 41059
EWFPHR

SEQ ID NO: 82119 - protein, 9 aa, Homo sapiens
  light chain complementarity determining region 3 for antibody 41060
QQYNSYPKT

SEQ ID NO: 82120 - protein, 15 aa, Homo sapiens
  heavy chain complementarity determining region 3 for antibody 41060
ARLKSLRGAIGAFDI

SEQ ID NO: 82121 - protein, 9 aa, Homo sapiens
  light chain complementarity determining region 3 for antibody 41061
QQYNNYPFT

SEQ ID NO: 82122 - protein, 11 aa, Homo sapiens
  heavy chain complementarity determining region 3 for antibody 41061
ARGSVGGNADF

SEQ ID NO: 82123 - protein, 9 aa, Homo sapiens
  light chain complementarity determining region 3 for antibody 41062
QQYNNWPRT

SEQ ID NO: 82124 - protein, 12 aa, Homo sapiens
  heavy chain complementarity determining region 3 for antibody 41062
ARRVAGTRHFDY

SEQ ID NO: 82125 - protein, 9 aa, Homo sapiens
  light chain complementarity determining region 3 for antibody 41063
QQYNNWPFT

SEQ ID NO: 82126 - protein, 9 aa, Homo sapiens
  heavy chain complementarity determining region 3 for antibody 41063
ARGAGSLDY

SEQ ID NO: 82127 - protein, 8 aa, Homo sapiens
  light chain complementarity determining region 3 for antibody 41064
QQYNGYPT

SEQ ID NO: 82128 - protein, 13 aa, Homo sapiens
  heavy chain complementarity determining region 3 for antibody 41064
AREPWELLPYFDY

SEQ ID NO: 82129 - protein, 9 aa, Homo sapiens
  light chain complementarity determining region 3 for antibody 41065
QQYNDYPWT

SEQ ID NO: 82130 - protein, 11 aa, Homo sapiens
  heavy chain complementarity determining region 3 for antibody 41065
ARGGTRRPEHF

SEQ ID NO: 82131 - protein, 9 aa, Homo sapiens
  light chain complementarity determining region 3 for antibody 41066
QQYKSYPYT

SEQ ID NO: 82132 - protein, 16 aa, Homo sapiens
  heavy chain complementarity determining region 3 for antibody 41066
EGYCVGRSCFSPKKDY

SEQ ID NO: 82133 - protein, 9 aa, Homo sapiens
  light chain complementarity determining region 3 for antibody 41067
QQYKSYPLT

SEQ ID NO: 82134 - protein, 10 aa, Homo sapiens
  heavy chain complementarity determining region 3 for antibody 41067
VRAAPYSYDN

SEQ ID NO: 82135 - protein, 10 aa, Homo sapiens
  light chain complementarity determining region 3 for antibody 41068
QQYKDFSMGT

SEQ ID NO: 82136 - protein, 22 aa, Homo sapiens
  heavy chain complementarity determining region 3 for antibody 41068
ARYQKDHYDVSGYYHRYWYFDL

SEQ ID NO: 82137 - protein, 8 aa, Homo sapiens
  light chain complementarity determining region 3 for antibody 41069
QQYIYWQT

SEQ ID NO: 82138 - protein, 13 aa, Homo sapiens
  heavy chain complementarity determining region 3 for antibody 41069
ARKGGGDYYYLPY

SEQ ID NO: 82139 - protein, 9 aa, Homo sapiens
  light chain complementarity determining region 3 for antibody 41070
QQYIRSPYT

SEQ ID NO: 82140 - protein, 14 aa, Homo sapiens
  heavy chain complementarity determining region 3 for antibody 41070
GRHPTTSSWGPFQH

SEQ ID NO: 82141 - protein, 9 aa, Homo sapiens
  light chain complementarity determining region 3 for antibody 41071
QQYGTSPFT

SEQ ID NO: 82142 - protein, 15 aa, Homo sapiens
  heavy chain complementarity determining region 3 for antibody 41071
ARQNDFLSGPGEFDP

SEQ ID NO: 82143 - protein, 9 aa, Homo sapiens
  light chain complementarity determining region 3 for antibody 41072
QQYGSSQWT

SEQ ID NO: 82144 - protein, 12 aa, Homo sapiens
  heavy chain complementarity determining region 3 for antibody 41072
SRGRGSGFYFGY

SEQ ID NO: 82145 - protein, 9 aa, Homo sapiens
  light chain complementarity determining region 3 for antibody 41073
QQYGSSPWT

SEQ ID NO: 82146 - protein, 13 aa, Homo sapiens
  heavy chain complementarity determining region 3 for antibody 41073
ARVDILTGYHFDY

SEQ ID NO: 82147 - protein, 9 aa, Homo sapiens
  light chain complementarity determining region 3 for antibody 41074
QQYGSSPWT

SEQ ID NO: 82148 - protein, 14 aa, Homo sapiens
  heavy chain complementarity determining region 3 for antibody 41074
ARDILLGGPGAFDV

SEQ ID NO: 82149 - protein, 9 aa, Homo sapiens
  light chain complementarity determining region 3 for antibody 41075
QQYGSSPRT

SEQ ID NO: 82150 - protein, 15 aa, Homo sapiens
  heavy chain complementarity determining region 3 for antibody 41075
ARAGTGFYADDAFDV

SEQ ID NO: 82151 - protein, 10 aa, Homo sapiens
  light chain complementarity determining region 3 for antibody 41076
QQYGSSPRIT

SEQ ID NO: 82152 - protein, 17 aa, Homo sapiens
  heavy chain complementarity determining region 3 for antibody 41076
ATDQYYHDSQKDHAFDI

SEQ ID NO: 82153 - protein, 9 aa, Homo sapiens
  light chain complementarity determining region 3 for antibody 41077
QQYGSSPLT

SEQ ID NO: 82154 - protein, 15 aa, Homo sapiens
  heavy chain complementarity determining region 3 for antibody 41077
ARYKTYCGGGCSFDD

SEQ ID NO: 82155 - protein, 9 aa, Homo sapiens
  light chain complementarity determining region 3 for antibody 41078
QQYGSSPFT

SEQ ID NO: 82156 - protein, 10 aa, Homo sapiens
  heavy chain complementarity determining region 3 for antibody 41078
AKGDGWLPDS

SEQ ID NO: 82157 - protein, 10 aa, Homo sapiens
  light chain complementarity determining region 3 for antibody 41079
QQYGRAPPLT

SEQ ID NO: 82158 - protein, 9 aa, Homo sapiens
  heavy chain complementarity determining region 3 for antibody 41079
ARELGYCDD

SEQ ID NO: 82159 - protein, 9 aa, Homo sapiens
  light chain complementarity determining region 3 for antibody 41080
QQYGNSPGT

SEQ ID NO: 82160 - protein, 14 aa, Homo sapiens
  heavy chain complementarity determining region 3 for antibody 41080
ARWGFRFLEYLVDY

SEQ ID NO: 82161 - protein, 10 aa, Homo sapiens
  light chain complementarity determining region 3 for antibody 41081
QQYGNSPALT

SEQ ID NO: 82162 - protein, 17 aa, Homo sapiens
  heavy chain complementarity determining region 3 for antibody 41081
ARESDLSSWSSYYGLEV

SEQ ID NO: 82163 - protein, 9 aa, Homo sapiens
  light chain complementarity determining region 3 for antibody 41082
QQYGLSMYT

SEQ ID NO: 82164 - protein, 14 aa, Homo sapiens
  heavy chain complementarity determining region 3 for antibody 41082
ATTNHLLYNDAFDI

SEQ ID NO: 82165 - protein, 9 aa, Homo sapiens
  light chain complementarity determining region 3 for antibody 41083
QQYGDSPWT

SEQ ID NO: 82166 - protein, 17 aa, Homo sapiens
  heavy chain complementarity determining region 3 for antibody 41083
AKGSIGWFGELLYIFVD

SEQ ID NO: 82167 - protein, 9 aa, Homo sapiens
  light chain complementarity determining region 3 for antibody 41084
QQYESYPWT

SEQ ID NO: 82168 - protein, 18 aa, Homo sapiens
  heavy chain complementarity determining region 3 for antibody 41084
VKDLHYHDSSGAYDAFDI

SEQ ID NO: 82169 - protein, 9 aa, Homo sapiens
  light chain complementarity determining region 3 for antibody 41085
QQYENVPVT

SEQ ID NO: 82170 - protein, 18 aa, Homo sapiens
  heavy chain complementarity determining region 3 for antibody 41085
AKDRSYFDYVSGSYRFDY

SEQ ID NO: 82171 - protein, 9 aa, Homo sapiens
  light chain complementarity determining region 3 for antibody 41086
QQYDTSSWT

SEQ ID NO: 82172 - protein, 12 aa, Homo sapiens
  heavy chain complementarity determining region 3 for antibody 41086
ARDPHDYSSFDY

SEQ ID NO: 82173 - protein, 10 aa, Homo sapiens
  light chain complementarity determining region 3 for antibody 41087
QQYDTLVRST

SEQ ID NO: 82174 - protein, 13 aa, Homo sapiens
  heavy chain complementarity determining region 3 for antibody 41087
ARTVAGTLFAFDT

SEQ ID NO: 82175 - protein, 8 aa, Homo sapiens
  light chain complementarity determining region 3 for antibody 41088
QQYDTLHT

SEQ ID NO: 82176 - protein, 10 aa, Homo sapiens
  heavy chain complementarity determining region 3 for antibody 41088
ARVRWGAFDI

SEQ ID NO: 82177 - protein, 9 aa, Homo sapiens
  light chain complementarity determining region 3 for antibody 41089
QQYDNLPLT

SEQ ID NO: 82178 - protein, 16 aa, Homo sapiens
  heavy chain complementarity determining region 3 for antibody 41089
ARGGPKRQRLHRGFDY

SEQ ID NO: 82179 - protein, 9 aa, Homo sapiens
  light chain complementarity determining region 3 for antibody 41090
QQYDGVPLT

SEQ ID NO: 82180 - protein, 14 aa, Homo sapiens
  heavy chain complementarity determining region 3 for antibody 41090
ARAASVLRFLEWSV

SEQ ID NO: 82181 - protein, 8 aa, Homo sapiens
  light chain complementarity determining region 3 for antibody 41091
QQYADFLT

SEQ ID NO: 82182 - protein, 13 aa, Homo sapiens
  heavy chain complementarity determining region 3 for antibody 41091
TRVFPWPTMAFDY

SEQ ID NO: 82183 - protein, 9 aa, Homo sapiens
  light chain complementarity determining region 3 for antibody 41092
QQTYSPPRT

SEQ ID NO: 82184 - protein, 12 aa, Homo sapiens
  heavy chain complementarity determining region 3 for antibody 41092
ARNGAGAYGMDV

SEQ ID NO: 82185 - protein, 9 aa, Homo sapiens
  light chain complementarity determining region 3 for antibody 41093
QQTYLIPYT

SEQ ID NO: 82186 - protein, 11 aa, Homo sapiens
  heavy chain complementarity determining region 3 for antibody 41093
ARGDWEDVFDI

SEQ ID NO: 82187 - protein, 9 aa, Homo sapiens
  light chain complementarity determining region 3 for antibody 41094
QQTNSIPYT

SEQ ID NO: 82188 - protein, 14 aa, Homo sapiens
  heavy chain complementarity determining region 3 for antibody 41094
ARSNSGWDYYGMDV

SEQ ID NO: 82189 - protein, 10 aa, Homo sapiens
  light chain complementarity determining region 3 for antibody 41095
QQTFSTLALT

SEQ ID NO: 82190 - protein, 14 aa, Homo sapiens
  heavy chain complementarity determining region 3 for antibody 41095
ATMTGRDFYNWFDP

SEQ ID NO: 82191 - protein, 9 aa, Homo sapiens
  light chain complementarity determining region 3 for antibody 41096
QQSYTTPLS

SEQ ID NO: 82192 - protein, 14 aa, Homo sapiens
  heavy chain complementarity determining region 3 for antibody 41096
ARSSDTSGYSRFDY

SEQ ID NO: 82193 - protein, 9 aa, Homo sapiens
  light chain complementarity determining region 3 for antibody 41097
QQSYTAPVS

SEQ ID NO: 82194 - protein, 10 aa, Homo sapiens
  heavy chain complementarity determining region 3 for antibody 41097
ASGLGWESAF

SEQ ID NO: 82195 - protein, 10 aa, Homo sapiens
  light chain complementarity determining region 3 for antibody 41098
QQSYSVPPYT

SEQ ID NO: 82196 - protein, 12 aa, Homo sapiens
  heavy chain complementarity determining region 3 for antibody 41098
ARGDGYNYELEY

SEQ ID NO: 82197 - protein, 9 aa, Homo sapiens
  light chain complementarity determining region 3 for antibody 41099
QQSYSTVWT

SEQ ID NO: 82198 - protein, 19 aa, Homo sapiens
  heavy chain complementarity determining region 3 for antibody 41099
ARGGLWNALRPSYYYIVDV

SEQ ID NO: 82199 - protein, 8 aa, Homo sapiens
  light chain complementarity determining region 3 for antibody 41100
QQSYSNPT

SEQ ID NO: 82200 - protein, 11 aa, Homo sapiens
  heavy chain complementarity determining region 3 for antibody 41100
ARDTGGYGMDV

SEQ ID NO: 82201 - protein, 9 aa, Homo sapiens
  light chain complementarity determining region 3 for antibody 41101
QQSYSNPRT

SEQ ID NO: 82202 - protein, 13 aa, Homo sapiens
  heavy chain complementarity determining region 3 for antibody 41101
ARDPSDTAREFDP

SEQ ID NO: 82203 - protein, 9 aa, Homo sapiens
  light chain complementarity determining region 3 for antibody 41102
QQSYNIVWT

SEQ ID NO: 82204 - protein, 19 aa, Homo sapiens
  heavy chain complementarity determining region 3 for antibody 41102
ARDSHFIMMVDAGHYGLDL

SEQ ID NO: 82205 - protein, 9 aa, Homo sapiens
  light chain complementarity determining region 3 for antibody 41103
QQSYIPPRT

SEQ ID NO: 82206 - protein, 21 aa, Homo sapiens
  heavy chain complementarity determining region 3 for antibody 41103
AQLAVGVPSTTGFGHYYGLDV

SEQ ID NO: 82207 - protein, 9 aa, Homo sapiens
  light chain complementarity determining region 3 for antibody 41104
QQSYGVPYT

SEQ ID NO: 82208 - protein, 21 aa, Homo sapiens
  heavy chain complementarity determining region 3 for antibody 41104
TTDFVDDKVWGSSRYKYSFVN

SEQ ID NO: 82209 - protein, 9 aa, Homo sapiens
  light chain complementarity determining region 3 for antibody 41105
QQSYGIPRT

SEQ ID NO: 82210 - protein, 15 aa, Homo sapiens
  heavy chain complementarity determining region 3 for antibody 41105
AKAQVIWGQLYYFES

SEQ ID NO: 82211 - protein, 9 aa, Homo sapiens
  light chain complementarity determining region 3 for antibody 41106
QQSSSSPPT

SEQ ID NO: 82212 - protein, 16 aa, Homo sapiens
  heavy chain complementarity determining region 3 for antibody 41106
ARDHELYSRSSGVFGY

SEQ ID NO: 82213 - protein, 9 aa, Homo sapiens
  light chain complementarity determining region 3 for antibody 41107
QQSHSTPLT

SEQ ID NO: 82214 - protein, 14 aa, Homo sapiens
  heavy chain complementarity determining region 3 for antibody 41107
ARNSGWYGSGYFDY

SEQ ID NO: 82215 - protein, 9 aa, Homo sapiens
  light chain complementarity determining region 3 for antibody 41108
QQSHSSPWT

SEQ ID NO: 82216 - protein, 11 aa, Homo sapiens
  heavy chain complementarity determining region 3 for antibody 41108
AREGMTAEIES

SEQ ID NO: 82217 - protein, 9 aa, Homo sapiens
  light chain complementarity determining region 3 for antibody 41109
QQSFTTPPT

SEQ ID NO: 82218 - protein, 18 aa, Homo sapiens
  heavy chain complementarity determining region 3 for antibody 41109
AREMDVAVDRVMFNILDY

SEQ ID NO: 82219 - protein, 10 aa, Homo sapiens
  light chain complementarity determining region 3 for antibody 41110
QQRYSWPPLT

SEQ ID NO: 82220 - protein, 17 aa, Homo sapiens
  heavy chain complementarity determining region 3 for antibody 41110
VKPRETYSSGWVDAFDT

SEQ ID NO: 82221 - protein, 10 aa, Homo sapiens
  light chain complementarity determining region 3 for antibody 41111
QQRYNWPPYT

SEQ ID NO: 82222 - protein, 11 aa, Homo sapiens
  heavy chain complementarity determining region 3 for antibody 41111
ARGVGSYPFDH

SEQ ID NO: 82223 - protein, 8 aa, Homo sapiens
  light chain complementarity determining region 3 for antibody 41112
QQRTNWCT

SEQ ID NO: 82224 - protein, 16 aa, Homo sapiens
  heavy chain complementarity determining region 3 for antibody 41112
AREGRGSGFFFWYFDL

SEQ ID NO: 82225 - protein, 9 aa, Homo sapiens
  light chain complementarity determining region 3 for antibody 41113
QQRSSWPFT

SEQ ID NO: 82226 - protein, 10 aa, Homo sapiens
  heavy chain complementarity determining region 3 for antibody 41113
ATGTPVPGFD

SEQ ID NO: 82227 - protein, 10 aa, Homo sapiens
  light chain complementarity determining region 3 for antibody 41114
QQRSNWPRYT

SEQ ID NO: 82228 - protein, 15 aa, Homo sapiens
  heavy chain complementarity determining region 3 for antibody 41114
ARHDGSGYSYAPDEI

SEQ ID NO: 82229 - protein, 9 aa, Homo sapiens
  light chain complementarity determining region 3 for antibody 41115
QQRSNWPQT

SEQ ID NO: 82230 - protein, 23 aa, Homo sapiens
  heavy chain complementarity determining region 3 for antibody 41115
ARGHTFYDYVWGSYRSSLNYFDY

SEQ ID NO: 82231 - protein, 10 aa, Homo sapiens
  light chain complementarity determining region 3 for antibody 41116
QQRSNWPPYT

SEQ ID NO: 82232 - protein, 16 aa, Homo sapiens
  heavy chain complementarity determining region 3 for antibody 41116
AAFSHLYDSAHMPFDY

SEQ ID NO: 82233 - protein, 10 aa, Homo sapiens
  light chain complementarity determining region 3 for antibody 41117
QQRSNWPPWT

SEQ ID NO: 82234 - protein, 11 aa, Homo sapiens
  heavy chain complementarity determining region 3 for antibody 41117
MRDLTMVAFDS

SEQ ID NO: 82235 - protein, 11 aa, Homo sapiens
  light chain complementarity determining region 3 for antibody 41118
QQRSNWPPVFT

SEQ ID NO: 82236 - protein, 14 aa, Homo sapiens
  heavy chain complementarity determining region 3 for antibody 41118
TRHPTVGGPVGFDT

SEQ ID NO: 82237 - protein, 10 aa, Homo sapiens
  light chain complementarity determining region 3 for antibody 41119
QQRSNWPPLT

SEQ ID NO: 82238 - protein, 13 aa, Homo sapiens
  heavy chain complementarity determining region 3 for antibody 41119
ARDISPAGSYLEH

SEQ ID NO: 82239 - protein, 11 aa, Homo sapiens
  light chain complementarity determining region 3 for antibody 41120
QQRSNWPPGIT

SEQ ID NO: 82240 - protein, 13 aa, Homo sapiens
  heavy chain complementarity determining region 3 for antibody 41120
ARDVSHGSSSFDL

SEQ ID NO: 82241 - protein, 9 aa, Homo sapiens
  light chain complementarity determining region 3 for antibody 41121
QQRSNWPLT

SEQ ID NO: 82242 - protein, 12 aa, Homo sapiens
  heavy chain complementarity determining region 3 for antibody 41121
AKTLSSQDQNDY

SEQ ID NO: 82243 - protein, 10 aa, Homo sapiens
  light chain complementarity determining region 3 for antibody 41122
QQRSNRPPLT

SEQ ID NO: 82244 - protein, 13 aa, Homo sapiens
  heavy chain complementarity determining region 3 for antibody 41122
ARGRAYYDSGADS

SEQ ID NO: 82245 - protein, 9 aa, Homo sapiens
  light chain complementarity determining region 3 for antibody 41123
QQLNRYPPA

SEQ ID NO: 82246 - protein, 18 aa, Homo sapiens
  heavy chain complementarity determining region 3 for antibody 41123
ATRRLYYFDSSGYYPFDY

SEQ ID NO: 82247 - protein, 7 aa, Homo sapiens
  light chain complementarity determining region 3 for antibody 41124
QQHRSFT

SEQ ID NO: 82248 - protein, 14 aa, Homo sapiens
  heavy chain complementarity determining region 3 for antibody 41124
AKVEPYGDNHRFDY

SEQ ID NO: 82249 - protein, 9 aa, Homo sapiens
  light chain complementarity determining region 3 for antibody 41125
QQHGSSPWT

SEQ ID NO: 82250 - protein, 15 aa, Homo sapiens
  heavy chain complementarity determining region 3 for antibody 41125
ARDSFEGSYYGSFDY

SEQ ID NO: 82251 - protein, 9 aa, Homo sapiens
  light chain complementarity determining region 3 for antibody 41126
QQGYTTQFT

SEQ ID NO: 82252 - protein, 16 aa, Homo sapiens
  heavy chain complementarity determining region 3 for antibody 41126
ARGVRDSDRWLGELDS

SEQ ID NO: 82253 - protein, 9 aa, Homo sapiens
  light chain complementarity determining region 3 for antibody 41127
QQFVTSPLT

SEQ ID NO: 82254 - protein, 12 aa, Homo sapiens
  heavy chain complementarity determining region 3 for antibody 41127
ARALSWDLPLDY

SEQ ID NO: 82255 - protein, 8 aa, Homo sapiens
  light chain complementarity determining region 3 for antibody 41128
QQFGDSQT

SEQ ID NO: 82256 - protein, 14 aa, Homo sapiens
  heavy chain complementarity determining region 3 for antibody 41128
ARDSEYNGPYLFQH

SEQ ID NO: 82257 - protein, 9 aa, Homo sapiens
  light chain complementarity determining region 3 for antibody 41129
QQAYTFPLT

SEQ ID NO: 82258 - protein, 20 aa, Homo sapiens
  heavy chain complementarity determining region 3 for antibody 41129
ARELELPLDGVVTAMGGFDV

SEQ ID NO: 82259 - protein, 9 aa, Homo sapiens
  light chain complementarity determining region 3 for antibody 41130
QQASTFPRT

SEQ ID NO: 82260 - protein, 12 aa, Homo sapiens
  heavy chain complementarity determining region 3 for antibody 41130
ARSPIRGVIFDH

SEQ ID NO: 82261 - protein, 9 aa, Homo sapiens
  light chain complementarity determining region 3 for antibody 41131
QQASSYPLT

SEQ ID NO: 82262 - protein, 15 aa, Homo sapiens
  heavy chain complementarity determining region 3 for antibody 41131
ARDATRTGTTPYFDY

SEQ ID NO: 82263 - protein, 9 aa, Homo sapiens
  light chain complementarity determining region 3 for antibody 41132
QQAHSFPRT

SEQ ID NO: 82264 - protein, 12 aa, Homo sapiens
  heavy chain complementarity determining region 3 for antibody 41132
ARAKWGGGYFDY

SEQ ID NO: 82265 - protein, 9 aa, Homo sapiens
  light chain complementarity determining region 3 for antibody 41133
QQADSFPWT

SEQ ID NO: 82266 - protein, 16 aa, Homo sapiens
  heavy chain complementarity determining region 3 for antibody 41133
ATWQGSGTHYRPYFDY

SEQ ID NO: 82267 - protein, 8 aa, Homo sapiens
  light chain complementarity determining region 3 for antibody 41134
QLYGRSPT

SEQ ID NO: 82268 - protein, 16 aa, Homo sapiens
  heavy chain complementarity determining region 3 for antibody 41134
ARDGHSSGWHVRYFDS

SEQ ID NO: 82269 - protein, 9 aa, Homo sapiens
  light chain complementarity determining region 3 for antibody 41135
QKYNSAPLT

SEQ ID NO: 82270 - protein, 16 aa, Homo sapiens
  heavy chain complementarity determining region 3 for antibody 41135
AATILWRGFDLRGLDP

SEQ ID NO: 82271 - protein, 9 aa, Homo sapiens
  light chain complementarity determining region 3 for antibody 41136
QHYKDYSGR

SEQ ID NO: 82272 - protein, 11 aa, Homo sapiens
  heavy chain complementarity determining region 3 for antibody 41136
VRRNDYGDPTK

SEQ ID NO: 82273 - protein, 9 aa, Homo sapiens
  light chain complementarity determining region 3 for antibody 41137
QHYGSSPNT

SEQ ID NO: 82274 - protein, 21 aa, Homo sapiens
  heavy chain complementarity determining region 3 for antibody 41137
AHSADDLSEVVTEARFDPYDV

SEQ ID NO: 82275 - protein, 8 aa, Homo sapiens
  light chain complementarity determining region 3 for antibody 41138
QHYDTSRT

SEQ ID NO: 82276 - protein, 16 aa, Homo sapiens
  heavy chain complementarity determining region 3 for antibody 41138
AREGYTSGWYPGSFES

SEQ ID NO: 82277 - protein, 11 aa, Homo sapiens
  light chain complementarity determining region 3 for antibody 41139
QHYDNLPPLYT

SEQ ID NO: 82278 - protein, 16 aa, Homo sapiens
  heavy chain complementarity determining region 3 for antibody 41139
ARDDMIVVGSPGAFDI

SEQ ID NO: 82279 - protein, 9 aa, Homo sapiens
  light chain complementarity determining region 3 for antibody 41140
QHRNGWPPT

SEQ ID NO: 82280 - protein, 13 aa, Homo sapiens
  heavy chain complementarity determining region 3 for antibody 41140
ARENYLLSWAFDY

SEQ ID NO: 82281 - protein, 9 aa, Homo sapiens
  light chain complementarity determining region 3 for antibody 41141
QHFGSSRFT

SEQ ID NO: 82282 - protein, 13 aa, Homo sapiens
  heavy chain complementarity determining region 3 for antibody 41141
ATSEFSASYYFDI

SEQ ID NO: 82283 - protein, 9 aa, Homo sapiens
  light chain complementarity determining region 3 for antibody 41142
MQGTHWPPT

SEQ ID NO: 82284 - protein, 13 aa, Homo sapiens
  heavy chain complementarity determining region 3 for antibody 41142
ARVHYSSREAVDY

SEQ ID NO: 82285 - protein, 10 aa, Homo sapiens
  light chain complementarity determining region 3 for antibody 41143
MQGSHWPPWT

SEQ ID NO: 82286 - protein, 11 aa, Homo sapiens
  heavy chain complementarity determining region 3 for antibody 41143
ARDHPGVGIDY

SEQ ID NO: 82287 - protein, 9 aa, Homo sapiens
  light chain complementarity determining region 3 for antibody 41144
MQGLETPPT

SEQ ID NO: 82288 - protein, 13 aa, Homo sapiens
  heavy chain complementarity determining region 3 for antibody 41144
ARQIGSFSYYYDL

SEQ ID NO: 82289 - protein, 9 aa, Homo sapiens
  light chain complementarity determining region 3 for antibody 41145
MQALQTPWT

SEQ ID NO: 82290 - protein, 15 aa, Homo sapiens
  heavy chain complementarity determining region 3 for antibody 41145
AAARLGELSLYPLDY

SEQ ID NO: 82291 - protein, 9 aa, Homo sapiens
  light chain complementarity determining region 3 for antibody 41146
MQALQTPLT

SEQ ID NO: 82292 - protein, 16 aa, Homo sapiens
  heavy chain complementarity determining region 3 for antibody 41146
ARVRNGNSGGWYGIVY

SEQ ID NO: 82293 - protein, 9 aa, Homo sapiens
  light chain complementarity determining region 3 for antibody 41147
LQYNSNPVT

SEQ ID NO: 82294 - protein, 19 aa, Homo sapiens
  heavy chain complementarity determining region 3 for antibody 41147
ASELRGGQYTTGYYPRFDF

SEQ ID NO: 82295 - protein, 9 aa, Homo sapiens
  light chain complementarity determining region 3 for antibody 41148
LQHYNYPST

SEQ ID NO: 82296 - protein, 21 aa, Homo sapiens
  heavy chain complementarity determining region 3 for antibody 41148
ARSNPREYSGYGYRPKYYFDH

SEQ ID NO: 82297 - protein, 9 aa, Homo sapiens
  light chain complementarity determining region 3 for antibody 41149
LQHNSYPQT

SEQ ID NO: 82298 - protein, 12 aa, Homo sapiens
  heavy chain complementarity determining region 3 for antibody 41149
GRGGDSAKVGDH

SEQ ID NO: 82299 - protein, 9 aa, Homo sapiens
  light chain complementarity determining region 3 for antibody 41150
LQHNSYPFT

SEQ ID NO: 82300 - protein, 13 aa, Homo sapiens
  heavy chain complementarity determining region 3 for antibody 41150
TRSNPAGGDTSDS

SEQ ID NO: 82301 - protein, 9 aa, Homo sapiens
  light chain complementarity determining region 3 for antibody 41151
LQHNSFPLT

SEQ ID NO: 82302 - protein, 16 aa, Homo sapiens
  heavy chain complementarity determining region 3 for antibody 41151
ARGPTKYSSSLEYFQH

SEQ ID NO: 82303 - protein, 9 aa, Homo sapiens
  light chain complementarity determining region 3 for antibody 41152
LQDYNYPHT

SEQ ID NO: 82304 - protein, 10 aa, Homo sapiens
  heavy chain complementarity determining region 3 for antibody 41152
ARRGLYFGES

SEQ ID NO: 82305 - protein, 9 aa, Homo sapiens
  light chain complementarity determining region 3 for antibody 41153
LQDSNYPWT

SEQ ID NO: 82306 - protein, 21 aa, Homo sapiens
  heavy chain complementarity determining region 3 for antibody 41153
ARDKPSSFDVNGHYSIGTYDF

SEQ ID NO: 82307 - protein, 9 aa, Homo sapiens
  light chain complementarity determining region 3 for antibody 41154
LQDHNYPYT

SEQ ID NO: 82308 - protein, 19 aa, Homo sapiens
  heavy chain complementarity determining region 3 for antibody 41154
ARAGLPSGSGGDNYSSAEY

SEQ ID NO: 82309 - protein, 9 aa, Homo sapiens
  light chain complementarity determining region 3 for antibody 41155
IQGSYWPYT

SEQ ID NO: 82310 - protein, 11 aa, Homo sapiens
  heavy chain complementarity determining region 3 for antibody 41155
ARDPAGGSYDM

SEQ ID NO: 82311 - protein, 9 aa, Homo sapiens
  light chain complementarity determining region 3 for antibody 41156
HQYGYAPRA

SEQ ID NO: 82312 - protein, 14 aa, Homo sapiens
  heavy chain complementarity determining region 3 for antibody 41156
ARDPGVVAFHYFDY

SEQ ID NO: 82313 - protein, 9 aa, Homo sapiens
  light chain complementarity determining region 3 for antibody 41157
HQYAYSPLT

SEQ ID NO: 82314 - protein, 10 aa, Homo sapiens
  heavy chain complementarity determining region 3 for antibody 41157
TTGGGYLVDY

SEQ ID NO: 82315 - protein, 9 aa, Homo sapiens
  light chain complementarity determining region 3 for antibody 41158
HQSSRLPRT

SEQ ID NO: 82316 - protein, 12 aa, Homo sapiens
  heavy chain complementarity determining region 3 for antibody 41158
TTMGYGVLPTDY

SEQ ID NO: 82317 - protein, 9 aa, Homo sapiens
  light chain complementarity determining region 3 for antibody 41159
HEFKSAPWT

SEQ ID NO: 82318 - protein, 14 aa, Homo sapiens
  heavy chain complementarity determining region 3 for antibody 41159
ARAKDASGFHAFDI

SEQ ID NO: 82319 - protein, 9 aa, Homo sapiens
  light chain complementarity determining region 3 for antibody 41160
QVYANFLWA

SEQ ID NO: 82320 - protein, 17 aa, Homo sapiens
  heavy chain complementarity determining region 3 for antibody 41160
AAERDWHADTAPGGFDP

SEQ ID NO: 82321 - protein, 8 aa, Homo sapiens
  light chain complementarity determining region 3 for antibody 41161
QRYDRSIT

SEQ ID NO: 82322 - protein, 16 aa, Homo sapiens
  heavy chain complementarity determining region 3 for antibody 41161
ARDFGTSVTSRGYFDF

SEQ ID NO: 82323 - protein, 10 aa, Homo sapiens
  light chain complementarity determining region 3 for antibody 41162
QQYYSTPPVT

SEQ ID NO: 82324 - protein, 18 aa, Homo sapiens
  heavy chain complementarity determining region 3 for antibody 41162
ARDITNESSGYSPLFVDL

SEQ ID NO: 82325 - protein, 9 aa, Homo sapiens
  light chain complementarity determining region 3 for antibody 41163
QQYVHLPLT

SEQ ID NO: 82326 - protein, 19 aa, Homo sapiens
  heavy chain complementarity determining region 3 for antibody 41163
TRGAHIVVVTSFHTYNVDY

SEQ ID NO: 82327 - protein, 10 aa, Homo sapiens
  light chain complementarity determining region 3 for antibody 41164
QQYSSSISYT

SEQ ID NO: 82328 - protein, 15 aa, Homo sapiens
  heavy chain complementarity determining region 3 for antibody 41164
ARGRYDSGGWGYFQL

SEQ ID NO: 82329 - protein, 9 aa, Homo sapiens
  light chain complementarity determining region 3 for antibody 41165
QQYRGSPIT

SEQ ID NO: 82330 - protein, 25 aa, Homo sapiens
  heavy chain complementarity determining region 3 for antibody 41165
ARLKFGADSDNDYIWGGYRFSYFAY

SEQ ID NO: 82331 - protein, 8 aa, Homo sapiens
  light chain complementarity determining region 3 for antibody 41166
QQYQTYWT

SEQ ID NO: 82332 - protein, 9 aa, Homo sapiens
  heavy chain complementarity determining region 3 for antibody 41166
VCLGMTPPV

SEQ ID NO: 82333 - protein, 9 aa, Homo sapiens
  light chain complementarity determining region 3 for antibody 41167
QQYNYYPLA

SEQ ID NO: 82334 - protein, 16 aa, Homo sapiens
  heavy chain complementarity determining region 3 for antibody 41167
ARAGSDYYGSGSYLEF

SEQ ID NO: 82335 - protein, 8 aa, Homo sapiens
  light chain complementarity determining region 3 for antibody 41168
QQYNYLLT

SEQ ID NO: 82336 - protein, 17 aa, Homo sapiens
  heavy chain complementarity determining region 3 for antibody 41168
AKGRPGTSVALAKVIDY

SEQ ID NO: 82337 - protein, 9 aa, Homo sapiens
  light chain complementarity determining region 3 for antibody 41169
QQYNVWPPT

SEQ ID NO: 82338 - protein, 14 aa, Homo sapiens
  heavy chain complementarity determining region 3 for antibody 41169
ARARSHGLLVYFDY

SEQ ID NO: 82339 - protein, 10 aa, Homo sapiens
  light chain complementarity determining region 3 for antibody 41170
QQYNSYSPWT

SEQ ID NO: 82340 - protein, 16 aa, Homo sapiens
  heavy chain complementarity determining region 3 for antibody 41170
ARDLVQQQLFPYYFDY

SEQ ID NO: 82341 - protein, 10 aa, Homo sapiens
  light chain complementarity determining region 3 for antibody 41171
QQYNSYSPLT

SEQ ID NO: 82342 - protein, 6 aa, Homo sapiens
  heavy chain complementarity determining region 3 for antibody 41171
TRSADY

SEQ ID NO: 82343 - protein, 9 aa, Homo sapiens
  light chain complementarity determining region 3 for antibody 41172
QQYNSYPWT

SEQ ID NO: 82344 - protein, 11 aa, Homo sapiens
  heavy chain complementarity determining region 3 for antibody 41172
ARGVGSYPFDS

SEQ ID NO: 82345 - protein, 9 aa, Homo sapiens
  light chain complementarity determining region 3 for antibody 41173
QQYNSYPWT

SEQ ID NO: 82346 - protein, 12 aa, Homo sapiens
  heavy chain complementarity determining region 3 for antibody 41173
AREFAGAGPFDY

SEQ ID NO: 82347 - protein, 9 aa, Homo sapiens
  light chain complementarity determining region 3 for antibody 41174
QQYNSYLLT

SEQ ID NO: 82348 - protein, 18 aa, Homo sapiens
  heavy chain complementarity determining region 3 for antibody 41174
ARHEAAGSFAGGWNPADS

SEQ ID NO: 82349 - protein, 10 aa, Homo sapiens
  light chain complementarity determining region 3 for antibody 41175
QQYNSWPPLT

SEQ ID NO: 82350 - protein, 14 aa, Homo sapiens
  heavy chain complementarity determining region 3 for antibody 41175
ARSQWGAPGTPPAY

SEQ ID NO: 82351 - protein, 9 aa, Homo sapiens
  light chain complementarity determining region 3 for antibody 41176
QQYNKWPLT

SEQ ID NO: 82352 - protein, 16 aa, Homo sapiens
  heavy chain complementarity determining region 3 for antibody 41176
ARLTESSGYHDEGFDI

SEQ ID NO: 82353 - protein, 9 aa, Homo sapiens
  light chain complementarity determining region 3 for antibody 41177
QQYNIFPYT

SEQ ID NO: 82354 - protein, 14 aa, Homo sapiens
  heavy chain complementarity determining region 3 for antibody 41177
AKERGYNGRTTFDY

SEQ ID NO: 82355 - protein, 9 aa, Homo sapiens
  light chain complementarity determining region 3 for antibody 41178
QQYNHYSYT

SEQ ID NO: 82356 - protein, 15 aa, Homo sapiens
  heavy chain complementarity determining region 3 for antibody 41178
AKVLHRQWLVAPFDS

SEQ ID NO: 82357 - protein, 9 aa, Homo sapiens
  light chain complementarity determining region 3 for antibody 41179
QQYNGPPLT

SEQ ID NO: 82358 - protein, 21 aa, Homo sapiens
  heavy chain complementarity determining region 3 for antibody 41179
AKDLHYLNTARPSDQAGGLDD

SEQ ID NO: 82359 - protein, 9 aa, Homo sapiens
  light chain complementarity determining region 3 for antibody 41180
QQYKNNPPT

SEQ ID NO: 82360 - protein, 16 aa, Homo sapiens
  heavy chain complementarity determining region 3 for antibody 41180
VRDHSHCRGDCFNFAY

SEQ ID NO: 82361 - protein, 9 aa, Homo sapiens
  light chain complementarity determining region 3 for antibody 41181
QQYISYPLT

SEQ ID NO: 82362 - protein, 13 aa, Homo sapiens
  heavy chain complementarity determining region 3 for antibody 41181
AKREGPNTGPFDY

SEQ ID NO: 82363 - protein, 9 aa, Homo sapiens
  light chain complementarity determining region 3 for antibody 41182
QQYHSYPVT

SEQ ID NO: 82364 - protein, 18 aa, Homo sapiens
  heavy chain complementarity determining region 3 for antibody 41182
ARDGVGDFGGNYYYAMDV

SEQ ID NO: 82365 - protein, 9 aa, Homo sapiens
  light chain complementarity determining region 3 for antibody 41183
QQYHGSSST

SEQ ID NO: 82366 - protein, 11 aa, Homo sapiens
  heavy chain complementarity determining region 3 for antibody 41183
VSGGNSAVFDY

SEQ ID NO: 82367 - protein, 9 aa, Homo sapiens
  light chain complementarity determining region 3 for antibody 41184
QQYHGSPWT

SEQ ID NO: 82368 - protein, 17 aa, Homo sapiens
  heavy chain complementarity determining region 3 for antibody 41184
ARGRIWAAVVTASWFDP

SEQ ID NO: 82369 - protein, 9 aa, Homo sapiens
  light chain complementarity determining region 3 for antibody 41185
QQYGTYPHT

SEQ ID NO: 82370 - protein, 9 aa, Homo sapiens
  heavy chain complementarity determining region 3 for antibody 41185
ARVSAGIDY

SEQ ID NO: 82371 - protein, 9 aa, Homo sapiens
  light chain complementarity determining region 3 for antibody 41186
QQYGTSPLT

SEQ ID NO: 82372 - protein, 13 aa, Homo sapiens
  heavy chain complementarity determining region 3 for antibody 41186
ARVDRGWYEGFGL

SEQ ID NO: 82373 - protein, 9 aa, Homo sapiens
  light chain complementarity determining region 3 for antibody 41187
QQYGTPPRT

SEQ ID NO: 82374 - protein, 16 aa, Homo sapiens
  heavy chain complementarity determining region 3 for antibody 41187
ARDTGGGWGEDNYFDP

SEQ ID NO: 82375 - protein, 10 aa, Homo sapiens
  light chain complementarity determining region 3 for antibody 41188
QQYGTAPPYT

SEQ ID NO: 82376 - protein, 16 aa, Homo sapiens
  heavy chain complementarity determining region 3 for antibody 41188
ARGWIGDVLWFGDLLY

SEQ ID NO: 82377 - protein, 9 aa, Homo sapiens
  light chain complementarity determining region 3 for antibody 41189
QQYGSSTWT

SEQ ID NO: 82378 - protein, 12 aa, Homo sapiens
  heavy chain complementarity determining region 3 for antibody 41189
ARESPFTNYFDF

SEQ ID NO: 82379 - protein, 10 aa, Homo sapiens
  light chain complementarity determining region 3 for antibody 41190
QQYGSSRMYT

SEQ ID NO: 82380 - protein, 13 aa, Homo sapiens
  heavy chain complementarity determining region 3 for antibody 41190
ARPVGPMGYYLDY

SEQ ID NO: 82381 - protein, 9 aa, Homo sapiens
  light chain complementarity determining region 3 for antibody 41191
QQYGSSPWT

SEQ ID NO: 82382 - protein, 11 aa, Homo sapiens
  heavy chain complementarity determining region 3 for antibody 41191
ATWAFLHGVDV

SEQ ID NO: 82383 - protein, 9 aa, Homo sapiens
  light chain complementarity determining region 3 for antibody 41192
QQYGSSPLT

SEQ ID NO: 82384 - protein, 12 aa, Homo sapiens
  heavy chain complementarity determining region 3 for antibody 41192
ETLGLMVFADDY

SEQ ID NO: 82385 - protein, 10 aa, Homo sapiens
  light chain complementarity determining region 3 for antibody 41193
QQYGSSPKYT

SEQ ID NO: 82386 - protein, 24 aa, Homo sapiens
  heavy chain complementarity determining region 3 for antibody 41193
ARDRGTGDSSGWYSSSYYYYAMDV

SEQ ID NO: 82387 - protein, 9 aa, Homo sapiens
  light chain complementarity determining region 3 for antibody 41194
QQYGSSPKT

SEQ ID NO: 82388 - protein, 18 aa, Homo sapiens
  heavy chain complementarity determining region 3 for antibody 41194
ARGGDRPGSGSYFSDFDY

SEQ ID NO: 82389 - protein, 9 aa, Homo sapiens
  light chain complementarity determining region 3 for antibody 41195
QQYEYLPVT

SEQ ID NO: 82390 - protein, 15 aa, Homo sapiens
  heavy chain complementarity determining region 3 for antibody 41195
TRVRETYYYDSNGDY

SEQ ID NO: 82391 - protein, 9 aa, Homo sapiens
  light chain complementarity determining region 3 for antibody 41196
QQYDVLPPS

SEQ ID NO: 82392 - protein, 21 aa, Homo sapiens
  heavy chain complementarity determining region 3 for antibody 41196
ARGLHIVVVTSIYRGFWYFGL

SEQ ID NO: 82393 - protein, 9 aa, Homo sapiens
  light chain complementarity determining region 3 for antibody 41197
QQYDRPPLT

SEQ ID NO: 82394 - protein, 16 aa, Homo sapiens
  heavy chain complementarity determining region 3 for antibody 41197
ATDLSYGSEMGYYFEH

SEQ ID NO: 82395 - protein, 9 aa, Homo sapiens
  light chain complementarity determining region 3 for antibody 41198
QQYDNVPYT

SEQ ID NO: 82396 - protein, 18 aa, Homo sapiens
  heavy chain complementarity determining region 3 for antibody 41198
AKDIVLERTVGVSEKLDS

SEQ ID NO: 82397 - protein, 8 aa, Homo sapiens
  light chain complementarity determining region 3 for antibody 41199
QQYDNPYT

SEQ ID NO: 82398 - protein, 9 aa, Homo sapiens
  heavy chain complementarity determining region 3 for antibody 41199
ATRMDDDIP

SEQ ID NO: 82399 - protein, 9 aa, Homo sapiens
  light chain complementarity determining region 3 for antibody 41200
QQYDNLPLT

SEQ ID NO: 82400 - protein, 16 aa, Homo sapiens
  heavy chain complementarity determining region 3 for antibody 41200
AREIGRGYGDPQYFDY

SEQ ID NO: 82401 - protein, 9 aa, Homo sapiens
  light chain complementarity determining region 3 for antibody 41201
QQYDNLPLT

SEQ ID NO: 82402 - protein, 19 aa, Homo sapiens
  heavy chain complementarity determining region 3 for antibody 41201
AHRQGPGSGYYLGGGGFDY

SEQ ID NO: 82403 - protein, 9 aa, Homo sapiens
  light chain complementarity determining region 3 for antibody 41202
QQYDFYPLT

SEQ ID NO: 82404 - protein, 15 aa, Homo sapiens
  heavy chain complementarity determining region 3 for antibody 41202
ANSLLWFGGSKFFDS

SEQ ID NO: 82405 - protein, 9 aa, Homo sapiens
  light chain complementarity determining region 3 for antibody 41203
QQYCSSPLT

SEQ ID NO: 82406 - protein, 22 aa, Homo sapiens
  heavy chain complementarity determining region 3 for antibody 41203
ARVWGLYYSSWYGPGHYYGMDV

SEQ ID NO: 82407 - protein, 9 aa, Homo sapiens
  light chain complementarity determining region 3 for antibody 41204
QQVNSHPVT

SEQ ID NO: 82408 - protein, 13 aa, Homo sapiens
  heavy chain complementarity determining region 3 for antibody 41204
AREIAGELLGNDY

SEQ ID NO: 82409 - protein, 10 aa, Homo sapiens
  light chain complementarity determining region 3 for antibody 41205
QQTYATPRGT

SEQ ID NO: 82410 - protein, 16 aa, Homo sapiens
  heavy chain complementarity determining region 3 for antibody 41205
VKDQRVIVGASNYFDY

SEQ ID NO: 82411 - protein, 9 aa, Homo sapiens
  light chain complementarity determining region 3 for antibody 41206
QQSYTTPRT

SEQ ID NO: 82412 - protein, 16 aa, Homo sapiens
  heavy chain complementarity determining region 3 for antibody 41206
ARESRIGHNPVLGFDL

SEQ ID NO: 82413 - protein, 9 aa, Homo sapiens
  light chain complementarity determining region 3 for antibody 41207
QQSYSTPYT

SEQ ID NO: 82414 - protein, 14 aa, Homo sapiens
  heavy chain complementarity determining region 3 for antibody 41207
AREWFGELVPWFDP

SEQ ID NO: 82415 - protein, 8 aa, Homo sapiens
  light chain complementarity determining region 3 for antibody 41208
QQSYSTPT

SEQ ID NO: 82416 - protein, 18 aa, Homo sapiens
  heavy chain complementarity determining region 3 for antibody 41208
AREGDYFVSGTSYNIFDY

SEQ ID NO: 82417 - protein, 10 aa, Homo sapiens
  light chain complementarity determining region 3 for antibody 41209
QQSYSTPSIT

SEQ ID NO: 82418 - protein, 14 aa, Homo sapiens
  heavy chain complementarity determining region 3 for antibody 41209
ASSISRSYYNWFDA

SEQ ID NO: 82419 - protein, 9 aa, Homo sapiens
  light chain complementarity determining region 3 for antibody 41210
QQSYSSPYT

SEQ ID NO: 82420 - protein, 14 aa, Homo sapiens
  heavy chain complementarity determining region 3 for antibody 41210
ARLGVAGANSGPDY

SEQ ID NO: 82421 - protein, 9 aa, Homo sapiens
  light chain complementarity determining region 3 for antibody 41211
QQSYSSPQT

SEQ ID NO: 82422 - protein, 13 aa, Homo sapiens
  heavy chain complementarity determining region 3 for antibody 41211
ARDSKDITDYLDF

SEQ ID NO: 82423 - protein, 9 aa, Homo sapiens
  light chain complementarity determining region 3 for antibody 41212
QQSYSSLFT

SEQ ID NO: 82424 - protein, 12 aa, Homo sapiens
  heavy chain complementarity determining region 3 for antibody 41212
ATLHYGDSFFDY

SEQ ID NO: 82425 - protein, 9 aa, Homo sapiens
  light chain complementarity determining region 3 for antibody 41213
QQSYSNPPT

SEQ ID NO: 82426 - protein, 18 aa, Homo sapiens
  heavy chain complementarity determining region 3 for antibody 41213
AREADVVVVKTIYNVFDI

SEQ ID NO: 82427 - protein, 9 aa, Homo sapiens
  light chain complementarity determining region 3 for antibody 41214
QQSYSFPRT

SEQ ID NO: 82428 - protein, 18 aa, Homo sapiens
  heavy chain complementarity determining region 3 for antibody 41214
ARDEARRSEFVPLYYFDY

SEQ ID NO: 82429 - protein, 9 aa, Homo sapiens
  light chain complementarity determining region 3 for antibody 41215
QQSYSFLYT

SEQ ID NO: 82430 - protein, 18 aa, Homo sapiens
  heavy chain complementarity determining region 3 for antibody 41215
ARDRGNDHGDLDGFYFDL

SEQ ID NO: 82431 - protein, 9 aa, Homo sapiens
  light chain complementarity determining region 3 for antibody 41216
QQSYRTPWT

SEQ ID NO: 82432 - protein, 14 aa, Homo sapiens
  heavy chain complementarity determining region 3 for antibody 41216
ARGQDYYDSARFDY

SEQ ID NO: 82433 - protein, 9 aa, Homo sapiens
  light chain complementarity determining region 3 for antibody 41217
QQSYRAPRT

SEQ ID NO: 82434 - protein, 22 aa, Homo sapiens
  heavy chain complementarity determining region 3 for antibody 41217
ARDSYIGAGSFDGPRPSQGFEL

SEQ ID NO: 82435 - protein, 9 aa, Homo sapiens
  light chain complementarity determining region 3 for antibody 41218
QQSYNTPWT

SEQ ID NO: 82436 - protein, 13 aa, Homo sapiens
  heavy chain complementarity determining region 3 for antibody 41218
ARAYPSWFGAFDI

SEQ ID NO: 82437 - protein, 9 aa, Homo sapiens
  light chain complementarity determining region 3 for antibody 41219
QQSYITLIT

SEQ ID NO: 82438 - protein, 12 aa, Homo sapiens
  heavy chain complementarity determining region 3 for antibody 41219
SRDPPTVNALDY

SEQ ID NO: 82439 - protein, 9 aa, Homo sapiens
  light chain complementarity determining region 3 for antibody 41220
QQSYISPRT

SEQ ID NO: 82440 - protein, 12 aa, Homo sapiens
  heavy chain complementarity determining region 3 for antibody 41220
ARDKAYSSGWDV

SEQ ID NO: 82441 - protein, 9 aa, Homo sapiens
  light chain complementarity determining region 3 for antibody 41221
QQSYHTPRT

SEQ ID NO: 82442 - protein, 17 aa, Homo sapiens
  heavy chain complementarity determining region 3 for antibody 41221
AREGNLGGIHHSSWMDV

SEQ ID NO: 82443 - protein, 9 aa, Homo sapiens
  light chain complementarity determining region 3 for antibody 41222
QQSSFSPLT

SEQ ID NO: 82444 - protein, 10 aa, Homo sapiens
  heavy chain complementarity determining region 3 for antibody 41222
ARGTGWLPDH

SEQ ID NO: 82445 - protein, 10 aa, Homo sapiens
  light chain complementarity determining region 3 for antibody 41223
QQSNNWPPWT

SEQ ID NO: 82446 - protein, 11 aa, Homo sapiens
  heavy chain complementarity determining region 3 for antibody 41223
ARTTAEGWFDP

SEQ ID NO: 82447 - protein, 9 aa, Homo sapiens
  light chain complementarity determining region 3 for antibody 41224
QQSFMTPWT

SEQ ID NO: 82448 - protein, 12 aa, Homo sapiens
  heavy chain complementarity determining region 3 for antibody 41224
ARAGPSTVTLDY

SEQ ID NO: 82449 - protein, 9 aa, Homo sapiens
  light chain complementarity determining region 3 for antibody 41225
QQSFDLPPT

SEQ ID NO: 82450 - protein, 16 aa, Homo sapiens
  heavy chain complementarity determining region 3 for antibody 41225
ARRQDYIWGKGGSFDI

SEQ ID NO: 82451 - protein, 9 aa, Homo sapiens
  light chain complementarity determining region 3 for antibody 41226
QQSDSIPRM

SEQ ID NO: 82452 - protein, 11 aa, Homo sapiens
  heavy chain complementarity determining region 3 for antibody 41226
TSAYLTVALDL

SEQ ID NO: 82453 - protein, 9 aa, Homo sapiens
  light chain complementarity determining region 3 for antibody 41227
QQSDSFPWT

SEQ ID NO: 82454 - protein, 13 aa, Homo sapiens
  heavy chain complementarity determining region 3 for antibody 41227
ARVETTMRDALDV

SEQ ID NO: 82455 - protein, 10 aa, Homo sapiens
  light chain complementarity determining region 3 for antibody 41228
QQRYNWPPFP

SEQ ID NO: 82456 - protein, 11 aa, Homo sapiens
  heavy chain complementarity determining region 3 for antibody 41228
ARGVGSYPFDS

SEQ ID NO: 82457 - protein, 8 aa, Homo sapiens
  light chain complementarity determining region 3 for antibody 41229
QQRSNWVT

SEQ ID NO: 82458 - protein, 21 aa, Homo sapiens
  heavy chain complementarity determining region 3 for antibody 41229
ARNDPDKKEGGQTYGYNYFDQ

SEQ ID NO: 82459 - protein, 11 aa, Homo sapiens
  light chain complementarity determining region 3 for antibody 41230
QQRSNWPPLYT

SEQ ID NO: 82460 - protein, 18 aa, Homo sapiens
  heavy chain complementarity determining region 3 for antibody 41230
AARGANCGGACYYWYFDV

SEQ ID NO: 82461 - protein, 8 aa, Homo sapiens
  light chain complementarity determining region 3 for antibody 41231
QQRSNWPG

SEQ ID NO: 82462 - protein, 11 aa, Homo sapiens
  heavy chain complementarity determining region 3 for antibody 41231
VRDGLRWNFDY

SEQ ID NO: 82463 - protein, 8 aa, Homo sapiens
  light chain complementarity determining region 3 for antibody 41232
QQRNDGVT

SEQ ID NO: 82464 - protein, 16 aa, Homo sapiens
  heavy chain complementarity determining region 3 for antibody 41232
GTCPRLYSSGWSELDN

SEQ ID NO: 82465 - protein, 9 aa, Homo sapiens
  light chain complementarity determining region 3 for antibody 41233
QQNDNLPPP

SEQ ID NO: 82466 - protein, 13 aa, Homo sapiens
  heavy chain complementarity determining region 3 for antibody 41233
ARDRGDGNWSFDL

SEQ ID NO: 82467 - protein, 10 aa, Homo sapiens
  light chain complementarity determining region 3 for antibody 41234
QQLDSHPPYT

SEQ ID NO: 82468 - protein, 13 aa, Homo sapiens
  heavy chain complementarity determining region 3 for antibody 41234
AKDRGNYVWFFDL

SEQ ID NO: 82469 - protein, 10 aa, Homo sapiens
  light chain complementarity determining region 3 for antibody 41235
QQHDNLPRFT

SEQ ID NO: 82470 - protein, 16 aa, Homo sapiens
  heavy chain complementarity determining region 3 for antibody 41235
ATGYKDYYDASGYFNY

SEQ ID NO: 82471 - protein, 9 aa, Homo sapiens
  light chain complementarity determining region 3 for antibody 41236
QQGYITPLT

SEQ ID NO: 82472 - protein, 19 aa, Homo sapiens
  heavy chain complementarity determining region 3 for antibody 41236
ATALGGDINTWYLNYNMDV

SEQ ID NO: 82473 - protein, 10 aa, Homo sapiens
  light chain complementarity determining region 3 for antibody 41237
QQGFSTRPIT

SEQ ID NO: 82474 - protein, 13 aa, Homo sapiens
  heavy chain complementarity determining region 3 for antibody 41237
VRDGNSSVWPMDS

SEQ ID NO: 82475 - protein, 9 aa, Homo sapiens
  light chain complementarity determining region 3 for antibody 41238
QQGDGHPYT

SEQ ID NO: 82476 - protein, 15 aa, Homo sapiens
  heavy chain complementarity determining region 3 for antibody 41238
ARDGWLRATKSFFNY

SEQ ID NO: 82477 - protein, 9 aa, Homo sapiens
  light chain complementarity determining region 3 for antibody 41239
QQFQSHPLA

SEQ ID NO: 82478 - protein, 21 aa, Homo sapiens
  heavy chain complementarity determining region 3 for antibody 41239
AKDVGYCGGGNCNRDYYGLDV

SEQ ID NO: 82479 - protein, 9 aa, Homo sapiens
  light chain complementarity determining region 3 for antibody 41240
QQFNTYPIT

SEQ ID NO: 82480 - protein, 18 aa, Homo sapiens
  heavy chain complementarity determining region 3 for antibody 41240
ARGPYCSGETCYSQYFDS

SEQ ID NO: 82481 - protein, 9 aa, Homo sapiens
  light chain complementarity determining region 3 for antibody 41241
QQFNSYPVT

SEQ ID NO: 82482 - protein, 16 aa, Homo sapiens
  heavy chain complementarity determining region 3 for antibody 41241
APRPPLRRFGHRPADF

SEQ ID NO: 82483 - protein, 9 aa, Homo sapiens
  light chain complementarity determining region 3 for antibody 41242
QQFDSYPLT

SEQ ID NO: 82484 - protein, 13 aa, Homo sapiens
  heavy chain complementarity determining region 3 for antibody 41242
ARSPSFDIAYFDF

SEQ ID NO: 82485 - protein, 9 aa, Homo sapiens
  light chain complementarity determining region 3 for antibody 41243
QQDDGLTLT

SEQ ID NO: 82486 - protein, 12 aa, Homo sapiens
  heavy chain complementarity determining region 3 for antibody 41243
ARALWPSNAFDI

SEQ ID NO: 82487 - protein, 10 aa, Homo sapiens
  light chain complementarity determining region 3 for antibody 41244
QNYNSALALT

SEQ ID NO: 82488 - protein, 15 aa, Homo sapiens
  heavy chain complementarity determining region 3 for antibody 41244
ARVSSGYLGPGYFDY

SEQ ID NO: 82489 - protein, 9 aa, Homo sapiens
  light chain complementarity determining region 3 for antibody 41245
QKYRSAPRA

SEQ ID NO: 82490 - protein, 14 aa, Homo sapiens
  heavy chain complementarity determining region 3 for antibody 41245
ARSGAVYYYHGMDV

SEQ ID NO: 82491 - protein, 9 aa, Homo sapiens
  light chain complementarity determining region 3 for antibody 41246
QKYNTDPRT

SEQ ID NO: 82492 - protein, 22 aa, Homo sapiens
  heavy chain complementarity determining region 3 for antibody 41246
AKDLGEDGSSWYDGHYYYGMDV

SEQ ID NO: 82493 - protein, 9 aa, Homo sapiens
  light chain complementarity determining region 3 for antibody 41247
QKYDRAPHT

SEQ ID NO: 82494 - protein, 14 aa, Homo sapiens
  heavy chain complementarity determining region 3 for antibody 41247
VRGRGHSGYDSLDY

SEQ ID NO: 82495 - protein, 9 aa, Homo sapiens
  light chain complementarity determining region 3 for antibody 41248
QHYNSFPFT

SEQ ID NO: 82496 - protein, 11 aa, Homo sapiens
  heavy chain complementarity determining region 3 for antibody 41248
ARGEDYDAQGY

SEQ ID NO: 82497 - protein, 9 aa, Homo sapiens
  light chain complementarity determining region 3 for antibody 41249
QHYDTSPWT

SEQ ID NO: 82498 - protein, 16 aa, Homo sapiens
  heavy chain complementarity determining region 3 for antibody 41249
GRDHELYGRSSGVTDY

SEQ ID NO: 82499 - protein, 9 aa, Homo sapiens
  light chain complementarity determining region 3 for antibody 41250
QHSNSYPLT

SEQ ID NO: 82500 - protein, 11 aa, Homo sapiens
  heavy chain complementarity determining region 3 for antibody 41250
TTDVGSGSHAH

SEQ ID NO: 82501 - protein, 9 aa, Homo sapiens
  light chain complementarity determining region 3 for antibody 41251
QHFDSSRFT

SEQ ID NO: 82502 - protein, 13 aa, Homo sapiens
  heavy chain complementarity determining region 3 for antibody 41251
ATSEFSASYYFDI

SEQ ID NO: 82503 - protein, 9 aa, Homo sapiens
  light chain complementarity determining region 3 for antibody 41252
MQGTHWPYT

SEQ ID NO: 82504 - protein, 14 aa, Homo sapiens
  heavy chain complementarity determining region 3 for antibody 41252
ARVDYGGNFAPAIH

SEQ ID NO: 82505 - protein, 9 aa, Homo sapiens
  light chain complementarity determining region 3 for antibody 41253
MQGTHWPQT

SEQ ID NO: 82506 - protein, 13 aa, Homo sapiens
  heavy chain complementarity determining region 3 for antibody 41253
ARTGQWLGGQYDY

SEQ ID NO: 82507 - protein, 9 aa, Homo sapiens
  light chain complementarity determining region 3 for antibody 41254
MQGLQTPLT

SEQ ID NO: 82508 - protein, 12 aa, Homo sapiens
  heavy chain complementarity determining region 3 for antibody 41254
VRDRDYFGYFQH

SEQ ID NO: 82509 - protein, 9 aa, Homo sapiens
  light chain complementarity determining region 3 for antibody 41255
MQGLLSPWT

SEQ ID NO: 82510 - protein, 12 aa, Homo sapiens
  heavy chain complementarity determining region 3 for antibody 41255
ATYRQHSSGVDF

SEQ ID NO: 82511 - protein, 10 aa, Homo sapiens
  light chain complementarity determining region 3 for antibody 41256
MQATHWPPFT

SEQ ID NO: 82512 - protein, 8 aa, Homo sapiens
  heavy chain complementarity determining region 3 for antibody 41256
VRALANSW

SEQ ID NO: 82513 - protein, 8 aa, Homo sapiens
  light chain complementarity determining region 3 for antibody 41257
MQARQTPT

SEQ ID NO: 82514 - protein, 16 aa, Homo sapiens
  heavy chain complementarity determining region 3 for antibody 41257
ARATAYSTYWYYGLDV

SEQ ID NO: 82515 - protein, 9 aa, Homo sapiens
  light chain complementarity determining region 3 for antibody 41258
MQAQQTPRT

SEQ ID NO: 82516 - protein, 13 aa, Homo sapiens
  heavy chain complementarity determining region 3 for antibody 41258
AKEREGDDYEFDY

SEQ ID NO: 82517 - protein, 9 aa, Homo sapiens
  light chain complementarity determining region 3 for antibody 41259
MQALQTPYT

SEQ ID NO: 82518 - protein, 15 aa, Homo sapiens
  heavy chain complementarity determining region 3 for antibody 41259
ARDNSGVGGKPLFDY

SEQ ID NO: 82519 - protein, 9 aa, Homo sapiens
  light chain complementarity determining region 3 for antibody 41260
MQALQTPFT

SEQ ID NO: 82520 - protein, 13 aa, Homo sapiens
  heavy chain complementarity determining region 3 for antibody 41260
ARGIYGGKDGMDV

SEQ ID NO: 82521 - protein, 9 aa, Homo sapiens
  light chain complementarity determining region 3 for antibody 41261
MQALETPYT

SEQ ID NO: 82522 - protein, 13 aa, Homo sapiens
  heavy chain complementarity determining region 3 for antibody 41261
AKSAFVRLGHFDY

SEQ ID NO: 82523 - protein, 9 aa, Homo sapiens
  light chain complementarity determining region 3 for antibody 41262
MQALETPLT

SEQ ID NO: 82524 - protein, 14 aa, Homo sapiens
  heavy chain complementarity determining region 3 for antibody 41262
ARGSASIGVRYFDS

SEQ ID NO: 82525 - protein, 9 aa, Homo sapiens
  light chain complementarity determining region 3 for antibody 41263
LQHSSGPWT

SEQ ID NO: 82526 - protein, 11 aa, Homo sapiens
  heavy chain complementarity determining region 3 for antibody 41263
ARVGRGGPNDY

SEQ ID NO: 82527 - protein, 10 aa, Homo sapiens
  light chain complementarity determining region 3 for antibody 41264
LQHRSYPRLT

SEQ ID NO: 82528 - protein, 17 aa, Homo sapiens
  heavy chain complementarity determining region 3 for antibody 41264
AKVDGSSGLYNVDAFDI

SEQ ID NO: 82529 - protein, 10 aa, Homo sapiens
  light chain complementarity determining region 3 for antibody 41265
LQFNSSPPTT

SEQ ID NO: 82530 - protein, 14 aa, Homo sapiens
  heavy chain complementarity determining region 3 for antibody 41265
TRSPGGGGGGYSQH

SEQ ID NO: 82531 - protein, 9 aa, Homo sapiens
  light chain complementarity determining region 3 for antibody 41266
LQDYNYPRT

SEQ ID NO: 82532 - protein, 18 aa, Homo sapiens
  heavy chain complementarity determining region 3 for antibody 41266
ARDWTYSDSNIYYDRFDY

SEQ ID NO: 82533 - protein, 9 aa, Homo sapiens
  light chain complementarity determining region 3 for antibody 41267
LQDYNYPRT

SEQ ID NO: 82534 - protein, 18 aa, Homo sapiens
  heavy chain complementarity determining region 3 for antibody 41267
ARDASPMYNNYWADAFDI

SEQ ID NO: 82535 - protein, 9 aa, Homo sapiens
  light chain complementarity determining region 3 for antibody 41268
HQSNSFPWT

SEQ ID NO: 82536 - protein, 13 aa, Homo sapiens
  heavy chain complementarity determining region 3 for antibody 41268
ARVIAQTATPFDY

SEQ ID NO: 82537 - protein, 10 aa, Homo sapiens
  light chain complementarity determining region 3 for antibody 41269
HQRSDWPPGT

SEQ ID NO: 82538 - protein, 19 aa, Homo sapiens
  heavy chain complementarity determining region 3 for antibody 41269
ARDIVVLDTDQYYYYGMDV

SEQ ID NO: 82539 - protein, 9 aa, Homo sapiens
  light chain complementarity determining region 3 for antibody 41270
HQRSDWPLT

SEQ ID NO: 82540 - protein, 12 aa, Homo sapiens
  heavy chain complementarity determining region 3 for antibody 41270
ATYRQHSTSVDY

SEQ ID NO: 82541 - protein, 9 aa, Homo sapiens
  light chain complementarity determining region 3 for antibody 41271
QYSYSSPRT

SEQ ID NO: 82542 - protein, 22 aa, Homo sapiens
  heavy chain complementarity determining region 3 for antibody 41271
AREGPDYSDSSGYSYHYYGLDV

SEQ ID NO: 82543 - protein, 8 aa, Homo sapiens
  light chain complementarity determining region 3 for antibody 41272
QQYYTYST

SEQ ID NO: 82544 - protein, 11 aa, Homo sapiens
  heavy chain complementarity determining region 3 for antibody 41272
TRDRWQWLATI

SEQ ID NO: 82545 - protein, 9 aa, Homo sapiens
  light chain complementarity determining region 3 for antibody 41273
QQYVSYPWT

SEQ ID NO: 82546 - protein, 11 aa, Homo sapiens
  heavy chain complementarity determining region 3 for antibody 41273
AKDSSNRPHTP

SEQ ID NO: 82547 - protein, 9 aa, Homo sapiens
  light chain complementarity determining region 3 for antibody 41274
QQYTNYPWT

SEQ ID NO: 82548 - protein, 14 aa, Homo sapiens
  heavy chain complementarity determining region 3 for antibody 41274
HSRASGFQLEYTDF

SEQ ID NO: 82549 - protein, 9 aa, Homo sapiens
  light chain complementarity determining region 3 for antibody 41275
QQYSSLPLT

SEQ ID NO: 82550 - protein, 23 aa, Homo sapiens
  heavy chain complementarity determining region 3 for antibody 41275
VKEGRGDVLTFLEWSPRRGLLDY

SEQ ID NO: 82551 - protein, 8 aa, Homo sapiens
  light chain complementarity determining region 3 for antibody 41276
QQYSDNFS

SEQ ID NO: 82552 - protein, 17 aa, Homo sapiens
  heavy chain complementarity determining region 3 for antibody 41276
TRDQWGVAVGARSPSRH

SEQ ID NO: 82553 - protein, 9 aa, Homo sapiens
  light chain complementarity determining region 3 for antibody 41277
QQYNYYSLT

SEQ ID NO: 82554 - protein, 7 aa, Homo sapiens
  heavy chain complementarity determining region 3 for antibody 41277
ARVPGHS

SEQ ID NO: 82555 - protein, 7 aa, Homo sapiens
  light chain complementarity determining region 3 for antibody 41278
QQYNVFT

SEQ ID NO: 82556 - protein, 9 aa, Homo sapiens
  heavy chain complementarity determining region 3 for antibody 41278
ARGRQWLDS

SEQ ID NO: 82557 - protein, 8 aa, Homo sapiens
  light chain complementarity determining region 3 for antibody 41279
QQYNSYYT

SEQ ID NO: 82558 - protein, 7 aa, Homo sapiens
  heavy chain complementarity determining region 3 for antibody 41279
ATVDFFF

SEQ ID NO: 82559 - protein, 8 aa, Homo sapiens
  light chain complementarity determining region 3 for antibody 41280
QQYNSYWT

SEQ ID NO: 82560 - protein, 19 aa, Homo sapiens
  heavy chain complementarity determining region 3 for antibody 41280
AREAGYCSGDSCIQGWFDP

SEQ ID NO: 82561 - protein, 8 aa, Homo sapiens
  light chain complementarity determining region 3 for antibody 41281
QQYNSYWT

SEQ ID NO: 82562 - protein, 13 aa, Homo sapiens
  heavy chain complementarity determining region 3 for antibody 41281
AKMGDTAMDYFDY

SEQ ID NO: 82563 - protein, 9 aa, Homo sapiens
  light chain complementarity determining region 3 for antibody 41282
QQYNSYSWT

SEQ ID NO: 82564 - protein, 9 aa, Homo sapiens
  heavy chain complementarity determining region 3 for antibody 41282
ARFYGSESH

SEQ ID NO: 82565 - protein, 9 aa, Homo sapiens
  light chain complementarity determining region 3 for antibody 41283
QQYNSYSWT

SEQ ID NO: 82566 - protein, 18 aa, Homo sapiens
  heavy chain complementarity determining region 3 for antibody 41283
ARDPGCGEDCYTVSGMDV

SEQ ID NO: 82567 - protein, 10 aa, Homo sapiens
  light chain complementarity determining region 3 for antibody 41284
QQYNSYSPYT

SEQ ID NO: 82568 - protein, 16 aa, Homo sapiens
  heavy chain complementarity determining region 3 for antibody 41284
VRGVEALGSSYTWFDP

SEQ ID NO: 82569 - protein, 9 aa, Homo sapiens
  light chain complementarity determining region 3 for antibody 41285
QQYNSYPYT

SEQ ID NO: 82570 - protein, 15 aa, Homo sapiens
  heavy chain complementarity determining region 3 for antibody 41285
ARGEGYSSRWYENLS

SEQ ID NO: 82571 - protein, 9 aa, Homo sapiens
  light chain complementarity determining region 3 for antibody 41286
QQYNSYLLT

SEQ ID NO: 82572 - protein, 8 aa, Homo sapiens
  heavy chain complementarity determining region 3 for antibody 41286
ARGRVPVS

SEQ ID NO: 82573 - protein, 9 aa, Homo sapiens
  light chain complementarity determining region 3 for antibody 41287
QQYNSSPLT

SEQ ID NO: 82574 - protein, 9 aa, Homo sapiens
  heavy chain complementarity determining region 3 for antibody 41287
SRWDGSLDY

SEQ ID NO: 82575 - protein, 8 aa, Homo sapiens
  light chain complementarity determining region 3 for antibody 41288
QQYNNYST

SEQ ID NO: 82576 - protein, 16 aa, Homo sapiens
  heavy chain complementarity determining region 3 for antibody 41288
AKEAHITMVRSIITGY

SEQ ID NO: 82577 - protein, 9 aa, Homo sapiens
  light chain complementarity determining region 3 for antibody 41289
QQYNNYSRA

SEQ ID NO: 82578 - protein, 10 aa, Homo sapiens
  heavy chain complementarity determining region 3 for antibody 41289
ARGPHWLCNY

SEQ ID NO: 82579 - protein, 9 aa, Homo sapiens
  light chain complementarity determining region 3 for antibody 41290
QQYNNWPFT

SEQ ID NO: 82580 - protein, 9 aa, Homo sapiens
  heavy chain complementarity determining region 3 for antibody 41290
TRGAGTLDY

SEQ ID NO: 82581 - protein, 11 aa, Homo sapiens
  light chain complementarity determining region 3 for antibody 41291
QQYNGYSPVFT

SEQ ID NO: 82582 - protein, 15 aa, Homo sapiens
  heavy chain complementarity determining region 3 for antibody 41291
ARERFCTSTNCPFDY

SEQ ID NO: 82583 - protein, 9 aa, Homo sapiens
  light chain complementarity determining region 3 for antibody 41292
QQYNDWPAT

SEQ ID NO: 82584 - protein, 9 aa, Homo sapiens
  heavy chain complementarity determining region 3 for antibody 41292
ARGEVYFDY

SEQ ID NO: 82585 - protein, 9 aa, Homo sapiens
  light chain complementarity determining region 3 for antibody 41293
QQYKTYSRT

SEQ ID NO: 82586 - protein, 18 aa, Homo sapiens
  heavy chain complementarity determining region 3 for antibody 41293
AHKTVWHDYDSKGGAFDI

SEQ ID NO: 82587 - protein, 9 aa, Homo sapiens
  light chain complementarity determining region 3 for antibody 41294
QQYKNYPFT

SEQ ID NO: 82588 - protein, 14 aa, Homo sapiens
  heavy chain complementarity determining region 3 for antibody 41294
AKAKDSSGYDLFDF

SEQ ID NO: 82589 - protein, 9 aa, Homo sapiens
  light chain complementarity determining region 3 for antibody 41295
QQYHSYPRT

SEQ ID NO: 82590 - protein, 16 aa, Homo sapiens
  heavy chain complementarity determining region 3 for antibody 41295
ARAYGDIEGRLTLIDH

SEQ ID NO: 82591 - protein, 9 aa, Homo sapiens
  light chain complementarity determining region 3 for antibody 41296
QQYHSYPPT

SEQ ID NO: 82592 - protein, 15 aa, Homo sapiens
  heavy chain complementarity determining region 3 for antibody 41296
ARGFSESYSRPYFDD

SEQ ID NO: 82593 - protein, 8 aa, Homo sapiens
  light chain complementarity determining region 3 for antibody 41297
QQYHSFRS

SEQ ID NO: 82594 - protein, 13 aa, Homo sapiens
  heavy chain complementarity determining region 3 for antibody 41297
ATSRGSGTSYDDY

SEQ ID NO: 82595 - protein, 8 aa, Homo sapiens
  light chain complementarity determining region 3 for antibody 41298
QQYGTSRN

SEQ ID NO: 82596 - protein, 21 aa, Homo sapiens
  heavy chain complementarity determining region 3 for antibody 41298
ARWKGQIRSDWDRDFYPPNDY

SEQ ID NO: 82597 - protein, 10 aa, Homo sapiens
  light chain complementarity determining region 3 for antibody 41299
QQYGTSPRLT

SEQ ID NO: 82598 - protein, 17 aa, Homo sapiens
  heavy chain complementarity determining region 3 for antibody 41299
ARTLEFGYGGNSGFLDF

SEQ ID NO: 82599 - protein, 9 aa, Homo sapiens
  light chain complementarity determining region 3 for antibody 41300
QQYGTSPGT

SEQ ID NO: 82600 - protein, 17 aa, Homo sapiens
  heavy chain complementarity determining region 3 for antibody 41300
ARGPLTPGGNGNGYWDY

SEQ ID NO: 82601 - protein, 9 aa, Homo sapiens
  light chain complementarity determining region 3 for antibody 41301
QQYGSSSWT

SEQ ID NO: 82602 - protein, 19 aa, Homo sapiens
  heavy chain complementarity determining region 3 for antibody 41301
ARRPATPRFLEWLPDASDI

SEQ ID NO: 82603 - protein, 9 aa, Homo sapiens
  light chain complementarity determining region 3 for antibody 41302
QQYGSSPYT

SEQ ID NO: 82604 - protein, 9 aa, Homo sapiens
  heavy chain complementarity determining region 3 for antibody 41302
ARGGVAMDV

SEQ ID NO: 82605 - protein, 9 aa, Homo sapiens
  light chain complementarity determining region 3 for antibody 41303
QQYGSSPLT

SEQ ID NO: 82606 - protein, 20 aa, Homo sapiens
  heavy chain complementarity determining region 3 for antibody 41303
TRVRYFDWLGIRTFYYYFDY

SEQ ID NO: 82607 - protein, 10 aa, Homo sapiens
  light chain complementarity determining region 3 for antibody 41304
QQYGSSPAWT

SEQ ID NO: 82608 - protein, 12 aa, Homo sapiens
  heavy chain complementarity determining region 3 for antibody 41304
ARAQTTVTTADS

SEQ ID NO: 82609 - protein, 10 aa, Homo sapiens
  light chain complementarity determining region 3 for antibody 41305
QQYGSSFGYT

SEQ ID NO: 82610 - protein, 13 aa, Homo sapiens
  heavy chain complementarity determining region 3 for antibody 41305
ARGFYDTTGPFDY

SEQ ID NO: 82611 - protein, 9 aa, Homo sapiens
  light chain complementarity determining region 3 for antibody 41306
QQYGRSPLT

SEQ ID NO: 82612 - protein, 16 aa, Homo sapiens
  heavy chain complementarity determining region 3 for antibody 41306
ARISDYADDFDDAFDV

SEQ ID NO: 82613 - protein, 9 aa, Homo sapiens
  light chain complementarity determining region 3 for antibody 41307
QQYGNSPRT

SEQ ID NO: 82614 - protein, 13 aa, Homo sapiens
  heavy chain complementarity determining region 3 for antibody 41307
ARVIAQTATPFDY

SEQ ID NO: 82615 - protein, 9 aa, Homo sapiens
  light chain complementarity determining region 3 for antibody 41308
QQYGNLPVT

SEQ ID NO: 82616 - protein, 15 aa, Homo sapiens
  heavy chain complementarity determining region 3 for antibody 41308
ARDQSDFWSGYYLDY

SEQ ID NO: 82617 - protein, 9 aa, Homo sapiens
  light chain complementarity determining region 3 for antibody 41309
QQYGGSVTT

SEQ ID NO: 82618 - protein, 15 aa, Homo sapiens
  heavy chain complementarity determining region 3 for antibody 41309
ARFFPNYYDSSYFDL

SEQ ID NO: 82619 - protein, 9 aa, Homo sapiens
  light chain complementarity determining region 3 for antibody 41310
QQYGDSLYT

SEQ ID NO: 82620 - protein, 19 aa, Homo sapiens
  heavy chain complementarity determining region 3 for antibody 41310
ARTGSHFYGSNSYYTAFDL

SEQ ID NO: 82621 - protein, 8 aa, Homo sapiens
  light chain complementarity determining region 3 for antibody 41311
QQYGDLVT

SEQ ID NO: 82622 - protein, 12 aa, Homo sapiens
  heavy chain complementarity determining region 3 for antibody 41311
ARAIWFGVRFDY

SEQ ID NO: 82623 - protein, 9 aa, Homo sapiens
  light chain complementarity determining region 3 for antibody 41312
QQYENLPLT

SEQ ID NO: 82624 - protein, 21 aa, Homo sapiens
  heavy chain complementarity determining region 3 for antibody 41312
ARVGHCSGGGCFSYDYHNMDV

SEQ ID NO: 82625 - protein, 8 aa, Homo sapiens
  light chain complementarity determining region 3 for antibody 41313
QQYDTYYS

SEQ ID NO: 82626 - protein, 12 aa, Homo sapiens
  heavy chain complementarity determining region 3 for antibody 41313
AKSLGGNSASDV

SEQ ID NO: 82627 - protein, 10 aa, Homo sapiens
  light chain complementarity determining region 3 for antibody 41314
QQYDSWPSLT

SEQ ID NO: 82628 - protein, 8 aa, Homo sapiens
  heavy chain complementarity determining region 3 for antibody 41314
NYGTGMSY

SEQ ID NO: 82629 - protein, 9 aa, Homo sapiens
  light chain complementarity determining region 3 for antibody 41315
QQYDSSPWT

SEQ ID NO: 82630 - protein, 12 aa, Homo sapiens
  heavy chain complementarity determining region 3 for antibody 41315
ARGLRLGWGLDY

SEQ ID NO: 82631 - protein, 9 aa, Homo sapiens
  light chain complementarity determining region 3 for antibody 41316
QQYDSLPRT

SEQ ID NO: 82632 - protein, 20 aa, Homo sapiens
  heavy chain complementarity determining region 3 for antibody 41316
ARDSRPGPLDFRSGRGPYAY

SEQ ID NO: 82633 - protein, 9 aa, Homo sapiens
  light chain complementarity determining region 3 for antibody 41317
QQYDSDSPT

SEQ ID NO: 82634 - protein, 13 aa, Homo sapiens
  heavy chain complementarity determining region 3 for antibody 41317
ARSYGYSNTWYDY

SEQ ID NO: 82635 - protein, 8 aa, Homo sapiens
  light chain complementarity determining region 3 for antibody 41318
QQYDNLVT

SEQ ID NO: 82636 - protein, 15 aa, Homo sapiens
  heavy chain complementarity determining region 3 for antibody 41318
ARHSGSYPASYGFDI

SEQ ID NO: 82637 - protein, 9 aa, Homo sapiens
  light chain complementarity determining region 3 for antibody 41319
QQYDNLPRT

SEQ ID NO: 82638 - protein, 17 aa, Homo sapiens
  heavy chain complementarity determining region 3 for antibody 41319
ASTYGDSARRSYWYFDL

SEQ ID NO: 82639 - protein, 10 aa, Homo sapiens
  light chain complementarity determining region 3 for antibody 41320
QQYDNLPPLI

SEQ ID NO: 82640 - protein, 17 aa, Homo sapiens
  heavy chain complementarity determining region 3 for antibody 41320
AKFTPAIYSYTYRGFDS

SEQ ID NO: 82641 - protein, 9 aa, Homo sapiens
  light chain complementarity determining region 3 for antibody 41321
QQYDNLPLT

SEQ ID NO: 82642 - protein, 15 aa, Homo sapiens
  heavy chain complementarity determining region 3 for antibody 41321
ARGLRAATGKDAFDF

SEQ ID NO: 82643 - protein, 9 aa, Homo sapiens
  light chain complementarity determining region 3 for antibody 41322
QQYDNLPLT

SEQ ID NO: 82644 - protein, 12 aa, Homo sapiens
  heavy chain complementarity determining region 3 for antibody 41322
ARCRSYVNWFDP

SEQ ID NO: 82645 - protein, 9 aa, Homo sapiens
  light chain complementarity determining region 3 for antibody 41323
QQYDNLPLT

SEQ ID NO: 82646 - protein, 15 aa, Homo sapiens
  heavy chain complementarity determining region 3 for antibody 41323
ARAYSSGWYADYFDC

SEQ ID NO: 82647 - protein, 9 aa, Homo sapiens
  light chain complementarity determining region 3 for antibody 41324
QQYDNLPIT

SEQ ID NO: 82648 - protein, 15 aa, Homo sapiens
  heavy chain complementarity determining region 3 for antibody 41324
ASHVVYGGLLVWFDP

SEQ ID NO: 82649 - protein, 9 aa, Homo sapiens
  light chain complementarity determining region 3 for antibody 41325
QQYDNFPLT

SEQ ID NO: 82650 - protein, 19 aa, Homo sapiens
  heavy chain complementarity determining region 3 for antibody 41325
ASPFAQRELSYAPTDAFDI

SEQ ID NO: 82651 - protein, 8 aa, Homo sapiens
  light chain complementarity determining region 3 for antibody 41326
QQYDGSRT

SEQ ID NO: 82652 - protein, 17 aa, Homo sapiens
  heavy chain complementarity determining region 3 for antibody 41326
ARDKGEVITGPFWYFDL

SEQ ID NO: 82653 - protein, 9 aa, Homo sapiens
  light chain complementarity determining region 3 for antibody 41327
QQYDDLPLT

SEQ ID NO: 82654 - protein, 23 aa, Homo sapiens
  heavy chain complementarity determining region 3 for antibody 41327
AGGQEIYSSGWYAKQWFYHGFDV

SEQ ID NO: 82655 - protein, 9 aa, Homo sapiens
  light chain complementarity determining region 3 for antibody 41328
QQYADLPIT

SEQ ID NO: 82656 - protein, 15 aa, Homo sapiens
  heavy chain complementarity determining region 3 for antibody 41328
ARDPGRGGSGSKFDY

SEQ ID NO: 82657 - protein, 9 aa, Homo sapiens
  light chain complementarity determining region 3 for antibody 41329
QQVNDFPLT

SEQ ID NO: 82658 - protein, 12 aa, Homo sapiens
  heavy chain complementarity determining region 3 for antibody 41329
AREGLRGVAHDY

SEQ ID NO: 82659 - protein, 9 aa, Homo sapiens
  light chain complementarity determining region 3 for antibody 41330
QQTYSTPIT

SEQ ID NO: 82660 - protein, 11 aa, Homo sapiens
  heavy chain complementarity determining region 3 for antibody 41330
TRGVGSYPFDQ

SEQ ID NO: 82661 - protein, 9 aa, Homo sapiens
  light chain complementarity determining region 3 for antibody 41331
QQTYSTLLT

SEQ ID NO: 82662 - protein, 14 aa, Homo sapiens
  heavy chain complementarity determining region 3 for antibody 41331
ASCSSTSCYRGFDS

SEQ ID NO: 82663 - protein, 9 aa, Homo sapiens
  light chain complementarity determining region 3 for antibody 41332
QQTFTTPLT

SEQ ID NO: 82664 - protein, 18 aa, Homo sapiens
  heavy chain complementarity determining region 3 for antibody 41332
ARDREHSGSRYQPGVVDI

SEQ ID NO: 82665 - protein, 9 aa, Homo sapiens
  light chain complementarity determining region 3 for antibody 41333
QQSYSTPRT

SEQ ID NO: 82666 - protein, 14 aa, Homo sapiens
  heavy chain complementarity determining region 3 for antibody 41333
VREVSRNRSTWFDY

SEQ ID NO: 82667 - protein, 9 aa, Homo sapiens
  light chain complementarity determining region 3 for antibody 41334
QQSYSTPRT

SEQ ID NO: 82668 - protein, 14 aa, Homo sapiens
  heavy chain complementarity determining region 3 for antibody 41334
TRSNYCSGGSCYAY

SEQ ID NO: 82669 - protein, 9 aa, Homo sapiens
  light chain complementarity determining region 3 for antibody 41335
QQSYSTPRT

SEQ ID NO: 82670 - protein, 14 aa, Homo sapiens
  heavy chain complementarity determining region 3 for antibody 41335
ARETEGSAWRLIDH

SEQ ID NO: 82671 - protein, 9 aa, Homo sapiens
  light chain complementarity determining region 3 for antibody 41336
QQSYSTPRT

SEQ ID NO: 82672 - protein, 10 aa, Homo sapiens
  heavy chain complementarity determining region 3 for antibody 41336
ARDFSGYFDF

SEQ ID NO: 82673 - protein, 9 aa, Homo sapiens
  light chain complementarity determining region 3 for antibody 41337
QQSYSTPKT

SEQ ID NO: 82674 - protein, 11 aa, Homo sapiens
  heavy chain complementarity determining region 3 for antibody 41337
TTSVYLTGLDY

SEQ ID NO: 82675 - protein, 9 aa, Homo sapiens
  light chain complementarity determining region 3 for antibody 41338
QQSYSTPKT

SEQ ID NO: 82676 - protein, 14 aa, Homo sapiens
  heavy chain complementarity determining region 3 for antibody 41338
AGQEHISGWEPIYY

SEQ ID NO: 82677 - protein, 9 aa, Homo sapiens
  light chain complementarity determining region 3 for antibody 41339
QQSYSTPIT

SEQ ID NO: 82678 - protein, 15 aa, Homo sapiens
  heavy chain complementarity determining region 3 for antibody 41339
ARNYYYDSSGWAFDY

SEQ ID NO: 82679 - protein, 9 aa, Homo sapiens
  light chain complementarity determining region 3 for antibody 41340
QQSYSTPFT

SEQ ID NO: 82680 - protein, 16 aa, Homo sapiens
  heavy chain complementarity determining region 3 for antibody 41340
VREVADSNTWGWHFDL

SEQ ID NO: 82681 - protein, 10 aa, Homo sapiens
  light chain complementarity determining region 3 for antibody 41341
QQSYSIPLGT

SEQ ID NO: 82682 - protein, 14 aa, Homo sapiens
  heavy chain complementarity determining region 3 for antibody 41341
ARVPDTALVPNLDL

SEQ ID NO: 82683 - protein, 9 aa, Homo sapiens
  light chain complementarity determining region 3 for antibody 41342
QQSYSAPYT

SEQ ID NO: 82684 - protein, 17 aa, Homo sapiens
  heavy chain complementarity determining region 3 for antibody 41342
ARGPMDFGDYGDGWFDP

SEQ ID NO: 82685 - protein, 9 aa, Homo sapiens
  light chain complementarity determining region 3 for antibody 41343
QQSSNPPYT

SEQ ID NO: 82686 - protein, 11 aa, Homo sapiens
  heavy chain complementarity determining region 3 for antibody 41343
ARSFSTSICDY

SEQ ID NO: 82687 - protein, 9 aa, Homo sapiens
  light chain complementarity determining region 3 for antibody 41344
QQSSHLPPT

SEQ ID NO: 82688 - protein, 19 aa, Homo sapiens
  heavy chain complementarity determining region 3 for antibody 41344
VRDSGSIVVVGSSSDAFDI

SEQ ID NO: 82689 - protein, 9 aa, Homo sapiens
  light chain complementarity determining region 3 for antibody 41345
QQSNTYPVT

SEQ ID NO: 82690 - protein, 12 aa, Homo sapiens
  heavy chain complementarity determining region 3 for antibody 41345
TRIYMNRWCLDY

SEQ ID NO: 82691 - protein, 9 aa, Homo sapiens
  light chain complementarity determining region 3 for antibody 41346
QQSNIIPGT

SEQ ID NO: 82692 - protein, 10 aa, Homo sapiens
  heavy chain complementarity determining region 3 for antibody 41346
VGAGVGPFDP

SEQ ID NO: 82693 - protein, 9 aa, Homo sapiens
  light chain complementarity determining region 3 for antibody 41347
QQSFTNPPT

SEQ ID NO: 82694 - protein, 18 aa, Homo sapiens
  heavy chain complementarity determining region 3 for antibody 41347
AREKDVFVGYLSYNWFDP

SEQ ID NO: 82695 - protein, 9 aa, Homo sapiens
  light chain complementarity determining region 3 for antibody 41348
QQSFSTPRT

SEQ ID NO: 82696 - protein, 20 aa, Homo sapiens
  heavy chain complementarity determining region 3 for antibody 41348
ARIFEWRREVAGVRYYGMDV

SEQ ID NO: 82697 - protein, 9 aa, Homo sapiens
  light chain complementarity determining region 3 for antibody 41349
QQSFSSPVT

SEQ ID NO: 82698 - protein, 18 aa, Homo sapiens
  heavy chain complementarity determining region 3 for antibody 41349
ARDRCSGVNCYSWWYFDL

SEQ ID NO: 82699 - protein, 9 aa, Homo sapiens
  light chain complementarity determining region 3 for antibody 41350
QQSDSIPYT

SEQ ID NO: 82700 - protein, 12 aa, Homo sapiens
  heavy chain complementarity determining region 3 for antibody 41350
VRGNPLVSGFDY

SEQ ID NO: 82701 - protein, 10 aa, Homo sapiens
  light chain complementarity determining region 3 for antibody 41351
QQRYNWPPYT

SEQ ID NO: 82702 - protein, 11 aa, Homo sapiens
  heavy chain complementarity determining region 3 for antibody 41351
ARGVGSYPFDS

SEQ ID NO: 82703 - protein, 8 aa, Homo sapiens
  light chain complementarity determining region 3 for antibody 41352
QQRSSWIT

SEQ ID NO: 82704 - protein, 20 aa, Homo sapiens
  heavy chain complementarity determining region 3 for antibody 41352
ARDQVFCSGGNCFGFDYFDP

SEQ ID NO: 82705 - protein, 9 aa, Homo sapiens
  light chain complementarity determining region 3 for antibody 41353
QQRSNWPQT

SEQ ID NO: 82706 - protein, 13 aa, Homo sapiens
  heavy chain complementarity determining region 3 for antibody 41353
AKLIRFPGIGTDV

SEQ ID NO: 82707 - protein, 10 aa, Homo sapiens
  light chain complementarity determining region 3 for antibody 41354
QQRSNWPPYT

SEQ ID NO: 82708 - protein, 18 aa, Homo sapiens
  heavy chain complementarity determining region 3 for antibody 41354
ARSGYCTNGVCYTGAFDL

SEQ ID NO: 82709 - protein, 10 aa, Homo sapiens
  light chain complementarity determining region 3 for antibody 41355
QQRSNWPPYT

SEQ ID NO: 82710 - protein, 13 aa, Homo sapiens
  heavy chain complementarity determining region 3 for antibody 41355
AREEVIGGSPFDF

SEQ ID NO: 82711 - protein, 9 aa, Homo sapiens
  light chain complementarity determining region 3 for antibody 41356
QQRSNWPPT

SEQ ID NO: 82712 - protein, 14 aa, Homo sapiens
  heavy chain complementarity determining region 3 for antibody 41356
ARFDFGGSYDAFDI

SEQ ID NO: 82713 - protein, 9 aa, Homo sapiens
  light chain complementarity determining region 3 for antibody 41357
QQRSNWPPT

SEQ ID NO: 82714 - protein, 14 aa, Homo sapiens
  heavy chain complementarity determining region 3 for antibody 41357
AKAIVGAILHAFDI

SEQ ID NO: 82715 - protein, 9 aa, Homo sapiens
  light chain complementarity determining region 3 for antibody 41358
QQRSNWPPL

SEQ ID NO: 82716 - protein, 18 aa, Homo sapiens
  heavy chain complementarity determining region 3 for antibody 41358
TRPAYGSGNYQLPWYFDS

SEQ ID NO: 82717 - protein, 10 aa, Homo sapiens
  light chain complementarity determining region 3 for antibody 41359
QQRSNWPPIT

SEQ ID NO: 82718 - protein, 17 aa, Homo sapiens
  heavy chain complementarity determining region 3 for antibody 41359
ARSRGITMVRGAYYFDY

SEQ ID NO: 82719 - protein, 10 aa, Homo sapiens
  light chain complementarity determining region 3 for antibody 41360
QQRSNWPPIT

SEQ ID NO: 82720 - protein, 17 aa, Homo sapiens
  heavy chain complementarity determining region 3 for antibody 41360
ARKGSGSASYPERPIDY

SEQ ID NO: 82721 - protein, 9 aa, Homo sapiens
  light chain complementarity determining region 3 for antibody 41361
QQRSNWHIT

SEQ ID NO: 82722 - protein, 16 aa, Homo sapiens
  heavy chain complementarity determining region 3 for antibody 41361
ARRRVTTYEWVVGFDI

SEQ ID NO: 82723 - protein, 9 aa, Homo sapiens
  light chain complementarity determining region 3 for antibody 41362
QQRSKWPIT

SEQ ID NO: 82724 - protein, 16 aa, Homo sapiens
  heavy chain complementarity determining region 3 for antibody 41362
ARGRGRGYSSGGTFDY

SEQ ID NO: 82725 - protein, 8 aa, Homo sapiens
  light chain complementarity determining region 3 for antibody 41363
QQRSDLIT

SEQ ID NO: 82726 - protein, 18 aa, Homo sapiens
  heavy chain complementarity determining region 3 for antibody 41363
AKATARHCSGYNCYYFDY

SEQ ID NO: 82727 - protein, 9 aa, Homo sapiens
  light chain complementarity determining region 3 for antibody 41364
QQRNSWPTT

SEQ ID NO: 82728 - protein, 14 aa, Homo sapiens
  heavy chain complementarity determining region 3 for antibody 41364
ARDPFSGSGVGFDF

SEQ ID NO: 82729 - protein, 10 aa, Homo sapiens
  light chain complementarity determining region 3 for antibody 41365
QQRASWPPAT

SEQ ID NO: 82730 - protein, 12 aa, Homo sapiens
  heavy chain complementarity determining region 3 for antibody 41365
TRAYPQYTVSIN

SEQ ID NO: 82731 - protein, 9 aa, Homo sapiens
  light chain complementarity determining region 3 for antibody 41366
QQNYGTPFT

SEQ ID NO: 82732 - protein, 11 aa, Homo sapiens
  heavy chain complementarity determining region 3 for antibody 41366
ARAMDDWYFDL

SEQ ID NO: 82733 - protein, 9 aa, Homo sapiens
  light chain complementarity determining region 3 for antibody 41367
QQLNSYPLT

SEQ ID NO: 82734 - protein, 16 aa, Homo sapiens
  heavy chain complementarity determining region 3 for antibody 41367
ARDFTDYGLQIKYFDY

SEQ ID NO: 82735 - protein, 9 aa, Homo sapiens
  light chain complementarity determining region 3 for antibody 41368
QQLNSFPLT

SEQ ID NO: 82736 - protein, 11 aa, Homo sapiens
  heavy chain complementarity determining region 3 for antibody 41368
GRHIVWSGIDV

SEQ ID NO: 82737 - protein, 9 aa, Homo sapiens
  light chain complementarity determining region 3 for antibody 41369
QQLDSYPFT

SEQ ID NO: 82738 - protein, 18 aa, Homo sapiens
  heavy chain complementarity determining region 3 for antibody 41369
ARERMVAAIPDDYYGMDV

SEQ ID NO: 82739 - protein, 9 aa, Homo sapiens
  light chain complementarity determining region 3 for antibody 41370
QQHGSSPLT

SEQ ID NO: 82740 - protein, 13 aa, Homo sapiens
  heavy chain complementarity determining region 3 for antibody 41370
ARVRYYGSGYFDY

SEQ ID NO: 82741 - protein, 9 aa, Homo sapiens
  light chain complementarity determining region 3 for antibody 41371
QQGYSTPLI

SEQ ID NO: 82742 - protein, 13 aa, Homo sapiens
  heavy chain complementarity determining region 3 for antibody 41371
AMQSPYSSGWYGD

SEQ ID NO: 82743 - protein, 9 aa, Homo sapiens
  light chain complementarity determining region 3 for antibody 41372
QQGYSSPWT

SEQ ID NO: 82744 - protein, 19 aa, Homo sapiens
  heavy chain complementarity determining region 3 for antibody 41372
ARDGDVVPTIFGVSNWFDP

SEQ ID NO: 82745 - protein, 9 aa, Homo sapiens
  light chain complementarity determining region 3 for antibody 41373
QQGYNFPLT

SEQ ID NO: 82746 - protein, 18 aa, Homo sapiens
  heavy chain complementarity determining region 3 for antibody 41373
ARKHTRSSIRDITDAFDL

SEQ ID NO: 82747 - protein, 9 aa, Homo sapiens
  light chain complementarity determining region 3 for antibody 41374
QQGSNWHRT

SEQ ID NO: 82748 - protein, 20 aa, Homo sapiens
  heavy chain complementarity determining region 3 for antibody 41374
ARELGGGNSPWNYYYYGMDV

SEQ ID NO: 82749 - protein, 9 aa, Homo sapiens
  light chain complementarity determining region 3 for antibody 41375
QQFNNYPLT

SEQ ID NO: 82750 - protein, 10 aa, Homo sapiens
  heavy chain complementarity determining region 3 for antibody 41375
ARDLTEGACS

SEQ ID NO: 82751 - protein, 9 aa, Homo sapiens
  light chain complementarity determining region 3 for antibody 41376
QQFNNYPLG

SEQ ID NO: 82752 - protein, 15 aa, Homo sapiens
  heavy chain complementarity determining region 3 for antibody 41376
AKEIWFGELSAAFDM

SEQ ID NO: 82753 - protein, 10 aa, Homo sapiens
  light chain complementarity determining region 3 for antibody 41377
QQCDILPPYT

SEQ ID NO: 82754 - protein, 11 aa, Homo sapiens
  heavy chain complementarity determining region 3 for antibody 41377
ARVRGSGLFDY

SEQ ID NO: 82755 - protein, 8 aa, Homo sapiens
  light chain complementarity determining region 3 for antibody 41378
QQCAILLS

SEQ ID NO: 82756 - protein, 12 aa, Homo sapiens
  heavy chain complementarity determining region 3 for antibody 41378
ARATWPSMGFHY

SEQ ID NO: 82757 - protein, 9 aa, Homo sapiens
  light chain complementarity determining region 3 for antibody 41379
QQANTFPLT

SEQ ID NO: 82758 - protein, 16 aa, Homo sapiens
  heavy chain complementarity determining region 3 for antibody 41379
AKVQIVQGSGWYYLDY

SEQ ID NO: 82759 - protein, 9 aa, Homo sapiens
  light chain complementarity determining region 3 for antibody 41380
QQANSFPWT

SEQ ID NO: 82760 - protein, 13 aa, Homo sapiens
  heavy chain complementarity determining region 3 for antibody 41380
ATESGKYQGGLDY

SEQ ID NO: 82761 - protein, 9 aa, Homo sapiens
  light chain complementarity determining region 3 for antibody 41381
QQANSFPPT

SEQ ID NO: 82762 - protein, 20 aa, Homo sapiens
  heavy chain complementarity determining region 3 for antibody 41381
ARIAQSWYSSGWYPSSHYDY

SEQ ID NO: 82763 - protein, 9 aa, Homo sapiens
  light chain complementarity determining region 3 for antibody 41382
QQANSFPLT

SEQ ID NO: 82764 - protein, 17 aa, Homo sapiens
  heavy chain complementarity determining region 3 for antibody 41382
ARASYYYGSGSYWYFDP

SEQ ID NO: 82765 - protein, 9 aa, Homo sapiens
  light chain complementarity determining region 3 for antibody 41383
QQANSFPFT

SEQ ID NO: 82766 - protein, 14 aa, Homo sapiens
  heavy chain complementarity determining region 3 for antibody 41383
ARRGIGDTFDAFDI

SEQ ID NO: 82767 - protein, 9 aa, Homo sapiens
  light chain complementarity determining region 3 for antibody 41384
QQANDIPYN

SEQ ID NO: 82768 - protein, 14 aa, Homo sapiens
  heavy chain complementarity determining region 3 for antibody 41384
ARAMVAGTLNYFDY

SEQ ID NO: 82769 - protein, 9 aa, Homo sapiens
  light chain complementarity determining region 3 for antibody 41385
QQAASLPHT

SEQ ID NO: 82770 - protein, 16 aa, Homo sapiens
  heavy chain complementarity determining region 3 for antibody 41385
ARDPGSSGSGWYYFDS

SEQ ID NO: 82771 - protein, 9 aa, Homo sapiens
  light chain complementarity determining region 3 for antibody 41386
QLYGSHSRT

SEQ ID NO: 82772 - protein, 22 aa, Homo sapiens
  heavy chain complementarity determining region 3 for antibody 41386
AREDVRRITMVRGVIIAGTLDF

SEQ ID NO: 82773 - protein, 9 aa, Homo sapiens
  light chain complementarity determining region 3 for antibody 41387
QLYGGSPYT

SEQ ID NO: 82774 - protein, 22 aa, Homo sapiens
  heavy chain complementarity determining region 3 for antibody 41387
VRCRPGDPKTFRRGGRQGPFDV

SEQ ID NO: 82775 - protein, 9 aa, Homo sapiens
  light chain complementarity determining region 3 for antibody 41388
QKYNSAPWT

SEQ ID NO: 82776 - protein, 16 aa, Homo sapiens
  heavy chain complementarity determining region 3 for antibody 41388
ARVQWVRGLTRDGMDV

SEQ ID NO: 82777 - protein, 9 aa, Homo sapiens
  light chain complementarity determining region 3 for antibody 41389
QKYNNAPIS

SEQ ID NO: 82778 - protein, 14 aa, Homo sapiens
  heavy chain complementarity determining region 3 for antibody 41389
ARPMSRNWNYPYEY

SEQ ID NO: 82779 - protein, 9 aa, Homo sapiens
  light chain complementarity determining region 3 for antibody 41390
QHYSSYPPT

SEQ ID NO: 82780 - protein, 24 aa, Homo sapiens
  heavy chain complementarity determining region 3 for antibody 41390
ARVWGETTVWAFPQKKTGAHYFDS

SEQ ID NO: 82781 - protein, 10 aa, Homo sapiens
  light chain complementarity determining region 3 for antibody 41391
QHYGTSSRYT

SEQ ID NO: 82782 - protein, 14 aa, Homo sapiens
  heavy chain complementarity determining region 3 for antibody 41391
AKGECSGPNCYVGN

SEQ ID NO: 82783 - protein, 9 aa, Homo sapiens
  light chain complementarity determining region 3 for antibody 41392
QHYGSSRFT

SEQ ID NO: 82784 - protein, 14 aa, Homo sapiens
  heavy chain complementarity determining region 3 for antibody 41392
VTAYDTSGYAPFDS

SEQ ID NO: 82785 - protein, 9 aa, Homo sapiens
  light chain complementarity determining region 3 for antibody 41393
QHYGSSAGT

SEQ ID NO: 82786 - protein, 20 aa, Homo sapiens
  heavy chain complementarity determining region 3 for antibody 41393
ARGDWEYYYESSGYAISLDQ

SEQ ID NO: 82787 - protein, 9 aa, Homo sapiens
  light chain complementarity determining region 3 for antibody 41394
QHYGGSLWT

SEQ ID NO: 82788 - protein, 15 aa, Homo sapiens
  heavy chain complementarity determining region 3 for antibody 41394
ARESGYSYGLSAFDI

SEQ ID NO: 82789 - protein, 9 aa, Homo sapiens
  light chain complementarity determining region 3 for antibody 41395
QHRSDGPFT

SEQ ID NO: 82790 - protein, 14 aa, Homo sapiens
  heavy chain complementarity determining region 3 for antibody 41395
AREMSRVSGDGLDV

SEQ ID NO: 82791 - protein, 8 aa, Homo sapiens
  light chain complementarity determining region 3 for antibody 41396
QETDSAPS

SEQ ID NO: 82792 - protein, 14 aa, Homo sapiens
  heavy chain complementarity determining region 3 for antibody 41396
ARRAVVVTATPLDV

SEQ ID NO: 82793 - protein, 8 aa, Homo sapiens
  light chain complementarity determining region 3 for antibody 41397
QESYTALT

SEQ ID NO: 82794 - protein, 15 aa, Homo sapiens
  heavy chain complementarity determining region 3 for antibody 41397
ARQGGQRVRGYYSDY

SEQ ID NO: 82795 - protein, 9 aa, Homo sapiens
  light chain complementarity determining region 3 for antibody 41398
MQGTHWPRT

SEQ ID NO: 82796 - protein, 6 aa, Homo sapiens
  heavy chain complementarity determining region 3 for antibody 41398
ARLTST

SEQ ID NO: 82797 - protein, 9 aa, Homo sapiens
  light chain complementarity determining region 3 for antibody 41399
MQGTHWPRT

SEQ ID NO: 82798 - protein, 14 aa, Homo sapiens
  heavy chain complementarity determining region 3 for antibody 41399
ARDRGDGSYYRFED

SEQ ID NO: 82799 - protein, 10 aa, Homo sapiens
  light chain complementarity determining region 3 for antibody 41400
MQGTHWPPYT

SEQ ID NO: 82800 - protein, 13 aa, Homo sapiens
  heavy chain complementarity determining region 3 for antibody 41400
ARDWAIWQQEFDY

SEQ ID NO: 82801 - protein, 9 aa, Homo sapiens
  light chain complementarity determining region 3 for antibody 41401
MQGTHWPLT

SEQ ID NO: 82802 - protein, 10 aa, Homo sapiens
  heavy chain complementarity determining region 3 for antibody 41401
ARDFGGPRDY

SEQ ID NO: 82803 - protein, 9 aa, Homo sapiens
  light chain complementarity determining region 3 for antibody 41402
MQGSYWLYT

SEQ ID NO: 82804 - protein, 11 aa, Homo sapiens
  heavy chain complementarity determining region 3 for antibody 41402
VATSPEMDSDY

SEQ ID NO: 82805 - protein, 9 aa, Homo sapiens
  light chain complementarity determining region 3 for antibody 41403
MQDTHWPRT

SEQ ID NO: 82806 - protein, 7 aa, Homo sapiens
  heavy chain complementarity determining region 3 for antibody 41403
ARDSTDF

SEQ ID NO: 82807 - protein, 10 aa, Homo sapiens
  light chain complementarity determining region 3 for antibody 41404
MQDTHWPPCT

SEQ ID NO: 82808 - protein, 16 aa, Homo sapiens
  heavy chain complementarity determining region 3 for antibody 41404
AKRVWFGELASAVFDG

SEQ ID NO: 82809 - protein, 8 aa, Homo sapiens
  light chain complementarity determining region 3 for antibody 41405
MQALQTPS

SEQ ID NO: 82810 - protein, 15 aa, Homo sapiens
  heavy chain complementarity determining region 3 for antibody 41405
AKNGDTGSYRGWFEP

SEQ ID NO: 82811 - protein, 9 aa, Homo sapiens
  light chain complementarity determining region 3 for antibody 41406
MQALQSPHT

SEQ ID NO: 82812 - protein, 18 aa, Homo sapiens
  heavy chain complementarity determining region 3 for antibody 41406
AKSPKYSGTYYYYDGMDV

SEQ ID NO: 82813 - protein, 9 aa, Homo sapiens
  light chain complementarity determining region 3 for antibody 41407
MHALETPFT

SEQ ID NO: 82814 - protein, 14 aa, Homo sapiens
  heavy chain complementarity determining region 3 for antibody 41407
ARDWGQEGLRWFDP

SEQ ID NO: 82815 - protein, 9 aa, Homo sapiens
  light chain complementarity determining region 3 for antibody 41408
LQTYSTPYT

SEQ ID NO: 82816 - protein, 13 aa, Homo sapiens
  heavy chain complementarity determining region 3 for antibody 41408
ATLRFFGGVPKDY

SEQ ID NO: 82817 - protein, 9 aa, Homo sapiens
  light chain complementarity determining region 3 for antibody 41409
LQHNYYPRT

SEQ ID NO: 82818 - protein, 19 aa, Homo sapiens
  heavy chain complementarity determining region 3 for antibody 41409
ATGDYYDSSGYHPEAIFGI

SEQ ID NO: 82819 - protein, 9 aa, Homo sapiens
  light chain complementarity determining region 3 for antibody 41410
LQHNTYPRT

SEQ ID NO: 82820 - protein, 12 aa, Homo sapiens
  heavy chain complementarity determining region 3 for antibody 41410
ARGSRTTGEIDY

SEQ ID NO: 82821 - protein, 9 aa, Homo sapiens
  light chain complementarity determining region 3 for antibody 41411
LQHNTDSWT

SEQ ID NO: 82822 - protein, 10 aa, Homo sapiens
  heavy chain complementarity determining region 3 for antibody 41411
ARRSTFYLDY

SEQ ID NO: 82823 - protein, 9 aa, Homo sapiens
  light chain complementarity determining region 3 for antibody 41412
LQHNSYPWT

SEQ ID NO: 82824 - protein, 12 aa, Homo sapiens
  heavy chain complementarity determining region 3 for antibody 41412
ARDDFGDERVDY

SEQ ID NO: 82825 - protein, 9 aa, Homo sapiens
  light chain complementarity determining region 3 for antibody 41413
LQHNSYPRT

SEQ ID NO: 82826 - protein, 11 aa, Homo sapiens
  heavy chain complementarity determining region 3 for antibody 41413
AVGWDSAKVGS

SEQ ID NO: 82827 - protein, 9 aa, Homo sapiens
  light chain complementarity determining region 3 for antibody 41414
LQHNSFPRT

SEQ ID NO: 82828 - protein, 16 aa, Homo sapiens
  heavy chain complementarity determining region 3 for antibody 41414
ARPGLPSSYGSSSYRH

SEQ ID NO: 82829 - protein, 9 aa, Homo sapiens
  light chain complementarity determining region 3 for antibody 41415
LQHNNYPPT

SEQ ID NO: 82830 - protein, 15 aa, Homo sapiens
  heavy chain complementarity determining region 3 for antibody 41415
ARDFYDSNGNGAFDI

SEQ ID NO: 82831 - protein, 9 aa, Homo sapiens
  light chain complementarity determining region 3 for antibody 41416
LQHHSYPFT

SEQ ID NO: 82832 - protein, 14 aa, Homo sapiens
  heavy chain complementarity determining region 3 for antibody 41416
AKDGDYGGNWGMDY

SEQ ID NO: 82833 - protein, 9 aa, Homo sapiens
  light chain complementarity determining region 3 for antibody 41417
LQHDHFPRT

SEQ ID NO: 82834 - protein, 15 aa, Homo sapiens
  heavy chain complementarity determining region 3 for antibody 41417
ARERRAGRFYYGMDV

SEQ ID NO: 82835 - protein, 9 aa, Homo sapiens
  light chain complementarity determining region 3 for antibody 41418
LQDYNYPYT

SEQ ID NO: 82836 - protein, 16 aa, Homo sapiens
  heavy chain complementarity determining region 3 for antibody 41418
ARDREPGIAVADALVD

SEQ ID NO: 82837 - protein, 9 aa, Homo sapiens
  light chain complementarity determining region 3 for antibody 41419
LQDYNYPPA

SEQ ID NO: 82838 - protein, 15 aa, Homo sapiens
  heavy chain complementarity determining region 3 for antibody 41419
ARAQVIWGQLYYFDS

SEQ ID NO: 82839 - protein, 9 aa, Homo sapiens
  light chain complementarity determining region 3 for antibody 41420
LQDYIYPPT

SEQ ID NO: 82840 - protein, 10 aa, Homo sapiens
  heavy chain complementarity determining region 3 for antibody 41420
ARDRGGGNCD

SEQ ID NO: 82841 - protein, 9 aa, Homo sapiens
  light chain complementarity determining region 3 for antibody 41421
LQDYDYPRT

SEQ ID NO: 82842 - protein, 19 aa, Homo sapiens
  heavy chain complementarity determining region 3 for antibody 41421
ARLSLLYANSPDYSYGMDV

SEQ ID NO: 82843 - protein, 9 aa, Homo sapiens
  light chain complementarity determining region 3 for antibody 41422
LQDYDYPRT

SEQ ID NO: 82844 - protein, 22 aa, Homo sapiens
  heavy chain complementarity determining region 3 for antibody 41422
ARDLSPISYSDTSRLYYDALDI

SEQ ID NO: 82845 - protein, 9 aa, Homo sapiens
  light chain complementarity determining region 3 for antibody 41423
HQYGSSPTT

SEQ ID NO: 82846 - protein, 14 aa, Homo sapiens
  heavy chain complementarity determining region 3 for antibody 41423
ARASGSGPGGWFDP

SEQ ID NO: 82847 - protein, 9 aa, Homo sapiens
  light chain complementarity determining region 3 for antibody 41424
HQYESYPWT

SEQ ID NO: 82848 - protein, 13 aa, Homo sapiens
  heavy chain complementarity determining region 3 for antibody 41424
VRQSSGTIKGVDV

SEQ ID NO: 82849 - protein, 9 aa, Homo sapiens
  light chain complementarity determining region 3 for antibody 41425
HQSSSLPWT

SEQ ID NO: 82850 - protein, 12 aa, Homo sapiens
  heavy chain complementarity determining region 3 for antibody 41425
ARALIRGGNLNY

SEQ ID NO: 82851 - protein, 9 aa, Homo sapiens
  light chain complementarity determining region 3 for antibody 41426
HNYNSAPLT

SEQ ID NO: 82852 - protein, 10 aa, Homo sapiens
  heavy chain complementarity determining region 3 for antibody 41426
ARDEGYFGTS

SEQ ID NO: 82853 - protein, 9 aa, Homo sapiens
  light chain complementarity determining region 3 for antibody 41427
RQRNSYPIT

SEQ ID NO: 82854 - protein, 11 aa, Homo sapiens
  heavy chain complementarity determining region 3 for antibody 41427
VRASSQYYLDY

SEQ ID NO: 82855 - protein, 9 aa, Homo sapiens
  light chain complementarity determining region 3 for antibody 41428
QRYDSYSET

SEQ ID NO: 82856 - protein, 16 aa, Homo sapiens
  heavy chain complementarity determining region 3 for antibody 41428
ARALTGRYSYGYRLDY

SEQ ID NO: 82857 - protein, 9 aa, Homo sapiens
  light chain complementarity determining region 3 for antibody 41429
QQYYTSPWT

SEQ ID NO: 82858 - protein, 14 aa, Homo sapiens
  heavy chain complementarity determining region 3 for antibody 41429
VRDIFPDFGDHGDY

SEQ ID NO: 82859 - protein, 9 aa, Homo sapiens
  light chain complementarity determining region 3 for antibody 41430
QQYYTFPLT

SEQ ID NO: 82860 - protein, 16 aa, Homo sapiens
  heavy chain complementarity determining region 3 for antibody 41430
ARSDSDYYDSRGYQVS

SEQ ID NO: 82861 - protein, 9 aa, Homo sapiens
  light chain complementarity determining region 3 for antibody 41431
QQYYSYPLT

SEQ ID NO: 82862 - protein, 14 aa, Homo sapiens
  heavy chain complementarity determining region 3 for antibody 41431
ARGRIDFGYSSFDY

SEQ ID NO: 82863 - protein, 8 aa, Homo sapiens
  light chain complementarity determining region 3 for antibody 41432
QQYVSSPT

SEQ ID NO: 82864 - protein, 18 aa, Homo sapiens
  heavy chain complementarity determining region 3 for antibody 41432
ARGGYYDFWSDYYGPLDF

SEQ ID NO: 82865 - protein, 9 aa, Homo sapiens
  light chain complementarity determining region 3 for antibody 41433
QQYVSSPRT

SEQ ID NO: 82866 - protein, 15 aa, Homo sapiens
  heavy chain complementarity determining region 3 for antibody 41433
AREPGITTADWYFDL

SEQ ID NO: 82867 - protein, 10 aa, Homo sapiens
  light chain complementarity determining region 3 for antibody 41434
QQYTTSPPWT

SEQ ID NO: 82868 - protein, 16 aa, Homo sapiens
  heavy chain complementarity determining region 3 for antibody 41434
ARRQWVRGLYKGGLDF

SEQ ID NO: 82869 - protein, 9 aa, Homo sapiens
  light chain complementarity determining region 3 for antibody 41435
QQYSSLLRT

SEQ ID NO: 82870 - protein, 18 aa, Homo sapiens
  heavy chain complementarity determining region 3 for antibody 41435
GRDLVTTFGGVIIIPMDV

SEQ ID NO: 82871 - protein, 9 aa, Homo sapiens
  light chain complementarity determining region 3 for antibody 41436
QQYSRSFVA

SEQ ID NO: 82872 - protein, 9 aa, Homo sapiens
  heavy chain complementarity determining region 3 for antibody 41436
AGPGVMSSV

SEQ ID NO: 82873 - protein, 9 aa, Homo sapiens
  light chain complementarity determining region 3 for antibody 41437
QQYRSYPLT

SEQ ID NO: 82874 - protein, 16 aa, Homo sapiens
  heavy chain complementarity determining region 3 for antibody 41437
ARNYGGGYGEASPMDS

SEQ ID NO: 82875 - protein, 9 aa, Homo sapiens
  light chain complementarity determining region 3 for antibody 41438
QQYRAYPLT

SEQ ID NO: 82876 - protein, 16 aa, Homo sapiens
  heavy chain complementarity determining region 3 for antibody 41438
VRGHYGSGDFPTGLDF

SEQ ID NO: 82877 - protein, 8 aa, Homo sapiens
  light chain complementarity determining region 3 for antibody 41439
QQYNTYST

SEQ ID NO: 82878 - protein, 20 aa, Homo sapiens
  heavy chain complementarity determining region 3 for antibody 41439
AREGGCTNDVCYKDRRLLDY

SEQ ID NO: 82879 - protein, 8 aa, Homo sapiens
  light chain complementarity determining region 3 for antibody 41440
QQYNSYWT

SEQ ID NO: 82880 - protein, 15 aa, Homo sapiens
  heavy chain complementarity determining region 3 for antibody 41440
ARVGDRSGSYSSFDY

SEQ ID NO: 82881 - protein, 8 aa, Homo sapiens
  light chain complementarity determining region 3 for antibody 41441
QQYNSYWT

SEQ ID NO: 82882 - protein, 17 aa, Homo sapiens
  heavy chain complementarity determining region 3 for antibody 41441
AHRRQYYDSSGYSESDY

SEQ ID NO: 82883 - protein, 10 aa, Homo sapiens
  light chain complementarity determining region 3 for antibody 41442
QQYNSYSPYT

SEQ ID NO: 82884 - protein, 7 aa, Homo sapiens
  heavy chain complementarity determining region 3 for antibody 41442
ARNYFDY

SEQ ID NO: 82885 - protein, 9 aa, Homo sapiens
  light chain complementarity determining region 3 for antibody 41443
QQYNSYPWT

SEQ ID NO: 82886 - protein, 9 aa, Homo sapiens
  heavy chain complementarity determining region 3 for antibody 41443
ARGEYSATH

SEQ ID NO: 82887 - protein, 11 aa, Homo sapiens
  light chain complementarity determining region 3 for antibody 41444
QQYNNWPPMYT

SEQ ID NO: 82888 - protein, 13 aa, Homo sapiens
  heavy chain complementarity determining region 3 for antibody 41444
GRDGLSWENAFDI

SEQ ID NO: 82889 - protein, 10 aa, Homo sapiens
  light chain complementarity determining region 3 for antibody 41445
QQYNDWPPWT

SEQ ID NO: 82890 - protein, 18 aa, Homo sapiens
  heavy chain complementarity determining region 3 for antibody 41445
VKVAHCVGACRWGGTLDY

SEQ ID NO: 82891 - protein, 10 aa, Homo sapiens
  light chain complementarity determining region 3 for antibody 41446
QQYKSYSTWT

SEQ ID NO: 82892 - protein, 9 aa, Homo sapiens
  heavy chain complementarity determining region 3 for antibody 41446
ARRALVLDY

SEQ ID NO: 82893 - protein, 9 aa, Homo sapiens
  light chain complementarity determining region 3 for antibody 41447
QQYKSYPYT

SEQ ID NO: 82894 - protein, 18 aa, Homo sapiens
  heavy chain complementarity determining region 3 for antibody 41447
ARGLKIHLWSHNGKYSDS

SEQ ID NO: 82895 - protein, 9 aa, Homo sapiens
  light chain complementarity determining region 3 for antibody 41448
QQYKSWPLT

SEQ ID NO: 82896 - protein, 14 aa, Homo sapiens
  heavy chain complementarity determining region 3 for antibody 41448
ARSPAAAGTGWLDP

SEQ ID NO: 82897 - protein, 9 aa, Homo sapiens
  light chain complementarity determining region 3 for antibody 41449
QQYKSSQWT

SEQ ID NO: 82898 - protein, 21 aa, Homo sapiens
  heavy chain complementarity determining region 3 for antibody 41449
ARDHAAFSDYRVRPNYYAMDV

SEQ ID NO: 82899 - protein, 9 aa, Homo sapiens
  light chain complementarity determining region 3 for antibody 41450
QQYKSDFWT

SEQ ID NO: 82900 - protein, 14 aa, Homo sapiens
  heavy chain complementarity determining region 3 for antibody 41450
ARDTANWNDVPLAY

SEQ ID NO: 82901 - protein, 8 aa, Homo sapiens
  light chain complementarity determining region 3 for antibody 41451
QQYHYWWT

SEQ ID NO: 82902 - protein, 16 aa, Homo sapiens
  heavy chain complementarity determining region 3 for antibody 41451
GRQGWYGSGHRGWFDP

SEQ ID NO: 82903 - protein, 8 aa, Homo sapiens
  light chain complementarity determining region 3 for antibody 41452
QQYHTYWT

SEQ ID NO: 82904 - protein, 19 aa, Homo sapiens
  heavy chain complementarity determining region 3 for antibody 41452
ARDNGDLFGSGDPMRAFDV

SEQ ID NO: 82905 - protein, 11 aa, Homo sapiens
  light chain complementarity determining region 3 for antibody 41453
QQYHTYPSAGT

SEQ ID NO: 82906 - protein, 13 aa, Homo sapiens
  heavy chain complementarity determining region 3 for antibody 41453
ARDPLEGDGLFDY

SEQ ID NO: 82907 - protein, 9 aa, Homo sapiens
  light chain complementarity determining region 3 for antibody 41454
QQYHSYSKT

SEQ ID NO: 82908 - protein, 17 aa, Homo sapiens
  heavy chain complementarity determining region 3 for antibody 41454
ARGRGGGSSWSPDYFDY

SEQ ID NO: 82909 - protein, 9 aa, Homo sapiens
  light chain complementarity determining region 3 for antibody 41455
QQYHSYPPI

SEQ ID NO: 82910 - protein, 18 aa, Homo sapiens
  heavy chain complementarity determining region 3 for antibody 41455
ASPLDHSGSGNFYYEMDV

SEQ ID NO: 82911 - protein, 9 aa, Homo sapiens
  light chain complementarity determining region 3 for antibody 41456
QQYHNYYVT

SEQ ID NO: 82912 - protein, 18 aa, Homo sapiens
  heavy chain complementarity determining region 3 for antibody 41456
ARAGGRIGCSGGRCPSDY

SEQ ID NO: 82913 - protein, 9 aa, Homo sapiens
  light chain complementarity determining region 3 for antibody 41457
QQYGTSLWT

SEQ ID NO: 82914 - protein, 10 aa, Homo sapiens
  heavy chain complementarity determining region 3 for antibody 41457
ARDVEGTFDH

SEQ ID NO: 82915 - protein, 9 aa, Homo sapiens
  light chain complementarity determining region 3 for antibody 41458
QQYGSSPYT

SEQ ID NO: 82916 - protein, 15 aa, Homo sapiens
  heavy chain complementarity determining region 3 for antibody 41458
ARSRQDGDYVYYFDY

SEQ ID NO: 82917 - protein, 9 aa, Homo sapiens
  light chain complementarity determining region 3 for antibody 41459
QQYGSSPRT

SEQ ID NO: 82918 - protein, 15 aa, Homo sapiens
  heavy chain complementarity determining region 3 for antibody 41459
ARVDSAMGGYYGMDV

SEQ ID NO: 82919 - protein, 10 aa, Homo sapiens
  light chain complementarity determining region 3 for antibody 41460
QQYGSSPPYT

SEQ ID NO: 82920 - protein, 9 aa, Homo sapiens
  heavy chain complementarity determining region 3 for antibody 41460
ARGYSFWVY

SEQ ID NO: 82921 - protein, 10 aa, Homo sapiens
  light chain complementarity determining region 3 for antibody 41461
QQYGSSPMYT

SEQ ID NO: 82922 - protein, 21 aa, Homo sapiens
  heavy chain complementarity determining region 3 for antibody 41461
ARNQWLLTSDTSYYYYYAMDV

SEQ ID NO: 82923 - protein, 10 aa, Homo sapiens
  light chain complementarity determining region 3 for antibody 41462
QQYGSSPLIT

SEQ ID NO: 82924 - protein, 20 aa, Homo sapiens
  heavy chain complementarity determining region 3 for antibody 41462
AHSYAPVWGSYRYHYYGMDV

SEQ ID NO: 82925 - protein, 9 aa, Homo sapiens
  light chain complementarity determining region 3 for antibody 41463
QQYGSSPHT

SEQ ID NO: 82926 - protein, 13 aa, Homo sapiens
  heavy chain complementarity determining region 3 for antibody 41463
ARGGQSWDWYFDV

SEQ ID NO: 82927 - protein, 9 aa, Homo sapiens
  light chain complementarity determining region 3 for antibody 41464
QQYGSSPGT

SEQ ID NO: 82928 - protein, 20 aa, Homo sapiens
  heavy chain complementarity determining region 3 for antibody 41464
ARESRYCNSASCPTSYYFNS

SEQ ID NO: 82929 - protein, 9 aa, Homo sapiens
  light chain complementarity determining region 3 for antibody 41465
QQYGSSGYT

SEQ ID NO: 82930 - protein, 15 aa, Homo sapiens
  heavy chain complementarity determining region 3 for antibody 41465
VRTKWEYYFYYGMDV

SEQ ID NO: 82931 - protein, 10 aa, Homo sapiens
  light chain complementarity determining region 3 for antibody 41466
QQYGSSFPII

SEQ ID NO: 82932 - protein, 18 aa, Homo sapiens
  heavy chain complementarity determining region 3 for antibody 41466
ATEGVYDVWSGYVQFFPH

SEQ ID NO: 82933 - protein, 10 aa, Homo sapiens
  light chain complementarity determining region 3 for antibody 41467
QQYGNSPPYT

SEQ ID NO: 82934 - protein, 15 aa, Homo sapiens
  heavy chain complementarity determining region 3 for antibody 41467
AREGPYGDYDDAFDI

SEQ ID NO: 82935 - protein, 10 aa, Homo sapiens
  light chain complementarity determining region 3 for antibody 41468
QQYGGSHPYT

SEQ ID NO: 82936 - protein, 11 aa, Homo sapiens
  heavy chain complementarity determining region 3 for antibody 41468
ARGPSGGNFDY

SEQ ID NO: 82937 - protein, 9 aa, Homo sapiens
  light chain complementarity determining region 3 for antibody 41469
QQYGASPLT

SEQ ID NO: 82938 - protein, 9 aa, Homo sapiens
  heavy chain complementarity determining region 3 for antibody 41469
ARDHDNSPL

SEQ ID NO: 82939 - protein, 9 aa, Homo sapiens
  light chain complementarity determining region 3 for antibody 41470
QQYDSYPLT

SEQ ID NO: 82940 - protein, 16 aa, Homo sapiens
  heavy chain complementarity determining region 3 for antibody 41470
ARDPLQYSSSWYYFDY

SEQ ID NO: 82941 - protein, 9 aa, Homo sapiens
  light chain complementarity determining region 3 for antibody 41471
QQYDSLPYT

SEQ ID NO: 82942 - protein, 11 aa, Homo sapiens
  heavy chain complementarity determining region 3 for antibody 41471
ARDPGWGAFDV

SEQ ID NO: 82943 - protein, 9 aa, Homo sapiens
  light chain complementarity determining region 3 for antibody 41472
QQYDSLPRT

SEQ ID NO: 82944 - protein, 12 aa, Homo sapiens
  heavy chain complementarity determining region 3 for antibody 41472
ARGRDDRGVFQH

SEQ ID NO: 82945 - protein, 9 aa, Homo sapiens
  light chain complementarity determining region 3 for antibody 41473
QQYDSFSYT

SEQ ID NO: 82946 - protein, 12 aa, Homo sapiens
  heavy chain complementarity determining region 3 for antibody 41473
ARDQAEHGYFDL

SEQ ID NO: 82947 - protein, 9 aa, Homo sapiens
  light chain complementarity determining region 3 for antibody 41474
QQYDNLSLT

SEQ ID NO: 82948 - protein, 11 aa, Homo sapiens
  heavy chain complementarity determining region 3 for antibody 41474
ARGVGSYPFDS

SEQ ID NO: 82949 - protein, 9 aa, Homo sapiens
  light chain complementarity determining region 3 for antibody 41475
QQYDNLPYT

SEQ ID NO: 82950 - protein, 13 aa, Homo sapiens
  heavy chain complementarity determining region 3 for antibody 41475
ARSRQLAAGAGDY

SEQ ID NO: 82951 - protein, 9 aa, Homo sapiens
  light chain complementarity determining region 3 for antibody 41476
QQYDNLPYT

SEQ ID NO: 82952 - protein, 16 aa, Homo sapiens
  heavy chain complementarity determining region 3 for antibody 41476
ARASVDTALERGCFDI

SEQ ID NO: 82953 - protein, 9 aa, Homo sapiens
  light chain complementarity determining region 3 for antibody 41477
QQYDNLPLT

SEQ ID NO: 82954 - protein, 22 aa, Homo sapiens
  heavy chain complementarity determining region 3 for antibody 41477
ARRLLTVRTTFRKEGRRGALDV

SEQ ID NO: 82955 - protein, 8 aa, Homo sapiens
  light chain complementarity determining region 3 for antibody 41478
QQYDNLLT

SEQ ID NO: 82956 - protein, 11 aa, Homo sapiens
  heavy chain complementarity determining region 3 for antibody 41478
AREYGSGSYQY

SEQ ID NO: 82957 - protein, 9 aa, Homo sapiens
  light chain complementarity determining region 3 for antibody 41479
QQYDLLPPT

SEQ ID NO: 82958 - protein, 21 aa, Homo sapiens
  heavy chain complementarity determining region 3 for antibody 41479
AKGLHIVVVTSILRGFWYFGL

SEQ ID NO: 82959 - protein, 8 aa, Homo sapiens
  light chain complementarity determining region 3 for antibody 41480
QQVVRSRT

SEQ ID NO: 82960 - protein, 24 aa, Homo sapiens
  heavy chain complementarity determining region 3 for antibody 41480
ARVPCPDDVCPSCEGCFPAHALDV

SEQ ID NO: 82961 - protein, 9 aa, Homo sapiens
  light chain complementarity determining region 3 for antibody 41481
QQVNDDPLT

SEQ ID NO: 82962 - protein, 15 aa, Homo sapiens
  heavy chain complementarity determining region 3 for antibody 41481
ATDPWGYSSERQFDN

SEQ ID NO: 82963 - protein, 9 aa, Homo sapiens
  light chain complementarity determining region 3 for antibody 41482
QQVFGTPKT

SEQ ID NO: 82964 - protein, 11 aa, Homo sapiens
  heavy chain complementarity determining region 3 for antibody 41482
ARDRWGTGMDV

SEQ ID NO: 82965 - protein, 9 aa, Homo sapiens
  light chain complementarity determining region 3 for antibody 41483
QQTYSSPHT

SEQ ID NO: 82966 - protein, 19 aa, Homo sapiens
  heavy chain complementarity determining region 3 for antibody 41483
ARQVGCLGTDLPGDCGLDV

SEQ ID NO: 82967 - protein, 8 aa, Homo sapiens
  light chain complementarity determining region 3 for antibody 41484
QQTYSSKT

SEQ ID NO: 82968 - protein, 18 aa, Homo sapiens
  heavy chain complementarity determining region 3 for antibody 41484
ARRHYYDGTAFRAEYFDD

SEQ ID NO: 82969 - protein, 9 aa, Homo sapiens
  light chain complementarity determining region 3 for antibody 41485
QQTYNTPWR

SEQ ID NO: 82970 - protein, 9 aa, Homo sapiens
  heavy chain complementarity determining region 3 for antibody 41485
ARDSTAAVY

SEQ ID NO: 82971 - protein, 8 aa, Homo sapiens
  light chain complementarity determining region 3 for antibody 41486
QQSYSTRT

SEQ ID NO: 82972 - protein, 18 aa, Homo sapiens
  heavy chain complementarity determining region 3 for antibody 41486
ARDPADGDNGYAWGGFDI

SEQ ID NO: 82973 - protein, 9 aa, Homo sapiens
  light chain complementarity determining region 3 for antibody 41487
QQSYSTPYT

SEQ ID NO: 82974 - protein, 15 aa, Homo sapiens
  heavy chain complementarity determining region 3 for antibody 41487
ARRGAIFGANNWFDP

SEQ ID NO: 82975 - protein, 9 aa, Homo sapiens
  light chain complementarity determining region 3 for antibody 41488
QQSYSTPWT

SEQ ID NO: 82976 - protein, 15 aa, Homo sapiens
  heavy chain complementarity determining region 3 for antibody 41488
ARLYPSSANYYRFDP

SEQ ID NO: 82977 - protein, 9 aa, Homo sapiens
  light chain complementarity determining region 3 for antibody 41489
QQSYSTPWT

SEQ ID NO: 82978 - protein, 16 aa, Homo sapiens
  heavy chain complementarity determining region 3 for antibody 41489
ARDHYYGSASHRAFDI

SEQ ID NO: 82979 - protein, 8 aa, Homo sapiens
  light chain complementarity determining region 3 for antibody 41490
QQSYSTPT

SEQ ID NO: 82980 - protein, 16 aa, Homo sapiens
  heavy chain complementarity determining region 3 for antibody 41490
ARVAYSSGDPSWYFDL

SEQ ID NO: 82981 - protein, 10 aa, Homo sapiens
  light chain complementarity determining region 3 for antibody 41491
QQSYSTPRDT

SEQ ID NO: 82982 - protein, 16 aa, Homo sapiens
  heavy chain complementarity determining region 3 for antibody 41491
ARVEYYYDRSGYFWDY

SEQ ID NO: 82983 - protein, 10 aa, Homo sapiens
  light chain complementarity determining region 3 for antibody 41492
QQSYSTPPWT

SEQ ID NO: 82984 - protein, 13 aa, Homo sapiens
  heavy chain complementarity determining region 3 for antibody 41492
ATDRGDGYNYLIS

SEQ ID NO: 82985 - protein, 9 aa, Homo sapiens
  light chain complementarity determining region 3 for antibody 41493
QQSYSTPPT

SEQ ID NO: 82986 - protein, 12 aa, Homo sapiens
  heavy chain complementarity determining region 3 for antibody 41493
TRDSGSYSDPDY

SEQ ID NO: 82987 - protein, 9 aa, Homo sapiens
  light chain complementarity determining region 3 for antibody 41494
QQSYSTPIT

SEQ ID NO: 82988 - protein, 10 aa, Homo sapiens
  heavy chain complementarity determining region 3 for antibody 41494
VRDISWEFSS

SEQ ID NO: 82989 - protein, 8 aa, Homo sapiens
  light chain complementarity determining region 3 for antibody 41495
QQSYSTLT

SEQ ID NO: 82990 - protein, 12 aa, Homo sapiens
  heavy chain complementarity determining region 3 for antibody 41495
VRQWTERGFLEN

SEQ ID NO: 82991 - protein, 10 aa, Homo sapiens
  light chain complementarity determining region 3 for antibody 41496
QQSYSTLMYT

SEQ ID NO: 82992 - protein, 14 aa, Homo sapiens
  heavy chain complementarity determining region 3 for antibody 41496
ARNEGHSRGYELDA

SEQ ID NO: 82993 - protein, 8 aa, Homo sapiens
  light chain complementarity determining region 3 for antibody 41497
QQSYSGVT

SEQ ID NO: 82994 - protein, 14 aa, Homo sapiens
  heavy chain complementarity determining region 3 for antibody 41497
AREGYGGISDAFDI

SEQ ID NO: 82995 - protein, 9 aa, Homo sapiens
  light chain complementarity determining region 3 for antibody 41498
QQSYRPPRT

SEQ ID NO: 82996 - protein, 21 aa, Homo sapiens
  heavy chain complementarity determining region 3 for antibody 41498
ARVTVRVPSTTGFGEYYGLDV

SEQ ID NO: 82997 - protein, 9 aa, Homo sapiens
  light chain complementarity determining region 3 for antibody 41499
QQSYNTPYT

SEQ ID NO: 82998 - protein, 11 aa, Homo sapiens
  heavy chain complementarity determining region 3 for antibody 41499
ARQGEAGGMDV

SEQ ID NO: 82999 - protein, 9 aa, Homo sapiens
  light chain complementarity determining region 3 for antibody 41500
QQSYNSPWT

SEQ ID NO: 83000 - protein, 18 aa, Homo sapiens
  heavy chain complementarity determining region 3 for antibody 41500
ARESSMSSTGPPLTWVDP

SEQ ID NO: 83001 - protein, 9 aa, Homo sapiens
  light chain complementarity determining region 3 for antibody 41501
QQSYKNPYT

SEQ ID NO: 83002 - protein, 10 aa, Homo sapiens
  heavy chain complementarity determining region 3 for antibody 41501
ARGAAAVIEH

SEQ ID NO: 83003 - protein, 9 aa, Homo sapiens
  light chain complementarity determining region 3 for antibody 41502
QQSYISPLT

SEQ ID NO: 83004 - protein, 14 aa, Homo sapiens
  heavy chain complementarity determining region 3 for antibody 41502
AKSRDTSGYSAFDY

SEQ ID NO: 83005 - protein, 9 aa, Homo sapiens
  light chain complementarity determining region 3 for antibody 41503
QQSYGTFLT

SEQ ID NO: 83006 - protein, 15 aa, Homo sapiens
  heavy chain complementarity determining region 3 for antibody 41503
ARIAYNSGWYTWFDP

SEQ ID NO: 83007 - protein, 9 aa, Homo sapiens
  light chain complementarity determining region 3 for antibody 41504
QQSYDIPLT

SEQ ID NO: 83008 - protein, 16 aa, Homo sapiens
  heavy chain complementarity determining region 3 for antibody 41504
ARENSILYNYYSGVDV

SEQ ID NO: 83009 - protein, 9 aa, Homo sapiens
  light chain complementarity determining region 3 for antibody 41505
QQSSITPPT

SEQ ID NO: 83010 - protein, 14 aa, Homo sapiens
  heavy chain complementarity determining region 3 for antibody 41505
ARGGYYFGSRWFDP

SEQ ID NO: 83011 - protein, 9 aa, Homo sapiens
  light chain complementarity determining region 3 for antibody 41506
QQSHSTPRT

SEQ ID NO: 83012 - protein, 16 aa, Homo sapiens
  heavy chain complementarity determining region 3 for antibody 41506
AKAPGKLLIIGDYFDV

SEQ ID NO: 83013 - protein, 9 aa, Homo sapiens
  light chain complementarity determining region 3 for antibody 41507
QQSHGFPYT

SEQ ID NO: 83014 - protein, 13 aa, Homo sapiens
  heavy chain complementarity determining region 3 for antibody 41507
ARLKDINGWPFDY

SEQ ID NO: 83015 - protein, 11 aa, Homo sapiens
  light chain complementarity determining region 3 for antibody 41508
QQSFSTPYTFT

SEQ ID NO: 83016 - protein, 12 aa, Homo sapiens
  heavy chain complementarity determining region 3 for antibody 41508
AGERDGTGCFDP

SEQ ID NO: 83017 - protein, 9 aa, Homo sapiens
  light chain complementarity determining region 3 for antibody 41509
QQSFSSPLT

SEQ ID NO: 83018 - protein, 14 aa, Homo sapiens
  heavy chain complementarity determining region 3 for antibody 41509
ARPRDNSGYFAFDL

SEQ ID NO: 83019 - protein, 8 aa, Homo sapiens
  light chain complementarity determining region 3 for antibody 41510
QQRYSWWT

SEQ ID NO: 83020 - protein, 16 aa, Homo sapiens
  heavy chain complementarity determining region 3 for antibody 41510
ATMGSASTVTTGAFQH

SEQ ID NO: 83021 - protein, 9 aa, Homo sapiens
  light chain complementarity determining region 3 for antibody 41511
QQRYSWPLT

SEQ ID NO: 83022 - protein, 13 aa, Homo sapiens
  heavy chain complementarity determining region 3 for antibody 41511
AGGYIYGYDYFDS

SEQ ID NO: 83023 - protein, 9 aa, Homo sapiens
  light chain complementarity determining region 3 for antibody 41512
QQRVIWPLS

SEQ ID NO: 83024 - protein, 19 aa, Homo sapiens
  heavy chain complementarity determining region 3 for antibody 41512
ARDPRHTEMENYYYYGMDV

SEQ ID NO: 83025 - protein, 10 aa, Homo sapiens
  light chain complementarity determining region 3 for antibody 41513
QQRTKWPALT

SEQ ID NO: 83026 - protein, 14 aa, Homo sapiens
  heavy chain complementarity determining region 3 for antibody 41513
ARETYNSISYSLNH

SEQ ID NO: 83027 - protein, 10 aa, Homo sapiens
  light chain complementarity determining region 3 for antibody 41514
QQRSTWPPYS

SEQ ID NO: 83028 - protein, 15 aa, Homo sapiens
  heavy chain complementarity determining region 3 for antibody 41514
AKEETPDAAGRHFDL

SEQ ID NO: 83029 - protein, 10 aa, Homo sapiens
  light chain complementarity determining region 3 for antibody 41515
QQRSNWPPIT

SEQ ID NO: 83030 - protein, 13 aa, Homo sapiens
  heavy chain complementarity determining region 3 for antibody 41515
NGDGYNYFRSYVH

SEQ ID NO: 83031 - protein, 9 aa, Homo sapiens
  light chain complementarity determining region 3 for antibody 41516
QQRSNWPNT

SEQ ID NO: 83032 - protein, 22 aa, Homo sapiens
  heavy chain complementarity determining region 3 for antibody 41516
AREGLCTSSSCYEVNHYNGMDV

SEQ ID NO: 83033 - protein, 9 aa, Homo sapiens
  light chain complementarity determining region 3 for antibody 41517
QQRSNWPLT

SEQ ID NO: 83034 - protein, 20 aa, Homo sapiens
  heavy chain complementarity determining region 3 for antibody 41517
ARYPRREHNYGTTGYYSFDS

SEQ ID NO: 83035 - protein, 9 aa, Homo sapiens
  light chain complementarity determining region 3 for antibody 41518
QQRSNWPLT

SEQ ID NO: 83036 - protein, 18 aa, Homo sapiens
  heavy chain complementarity determining region 3 for antibody 41518
ARGHYDILTGSGPNWFDP

SEQ ID NO: 83037 - protein, 8 aa, Homo sapiens
  light chain complementarity determining region 3 for antibody 41519
QQRSNWLT

SEQ ID NO: 83038 - protein, 11 aa, Homo sapiens
  heavy chain complementarity determining region 3 for antibody 41519
VHRFGRNYFDP

SEQ ID NO: 83039 - protein, 9 aa, Homo sapiens
  light chain complementarity determining region 3 for antibody 41520
QQRSNWFLT

SEQ ID NO: 83040 - protein, 19 aa, Homo sapiens
  heavy chain complementarity determining region 3 for antibody 41520
ARERQSDTSGDYGAPDFDF

SEQ ID NO: 83041 - protein, 8 aa, Homo sapiens
  light chain complementarity determining region 3 for antibody 41521
QQRIKWLT

SEQ ID NO: 83042 - protein, 14 aa, Homo sapiens
  heavy chain complementarity determining region 3 for antibody 41521
ARVDIAATGAPFDP

SEQ ID NO: 83043 - protein, 9 aa, Homo sapiens
  light chain complementarity determining region 3 for antibody 41522
QQLSSYPLT

SEQ ID NO: 83044 - protein, 17 aa, Homo sapiens
  heavy chain complementarity determining region 3 for antibody 41522
AKDLGEFMVRGGNSFDS

SEQ ID NO: 83045 - protein, 9 aa, Homo sapiens
  light chain complementarity determining region 3 for antibody 41523
QQLNSYLPA

SEQ ID NO: 83046 - protein, 18 aa, Homo sapiens
  heavy chain complementarity determining region 3 for antibody 41523
ARQLTIIRGLTRTWYFDL

SEQ ID NO: 83047 - protein, 8 aa, Homo sapiens
  light chain complementarity determining region 3 for antibody 41524
QQLNGDLF

SEQ ID NO: 83048 - protein, 15 aa, Homo sapiens
  heavy chain complementarity determining region 3 for antibody 41524
ARDLGLRFLEWFLNY

SEQ ID NO: 83049 - protein, 9 aa, Homo sapiens
  light chain complementarity determining region 3 for antibody 41525
QQLKSYPPT

SEQ ID NO: 83050 - protein, 15 aa, Homo sapiens
  heavy chain complementarity determining region 3 for antibody 41525
AKGYSSGWYESHYDY

SEQ ID NO: 83051 - protein, 7 aa, Homo sapiens
  light chain complementarity determining region 3 for antibody 41526
QQLKGIT

SEQ ID NO: 83052 - protein, 18 aa, Homo sapiens
  heavy chain complementarity determining region 3 for antibody 41526
AHRSSASAETVGGIYFDQ

SEQ ID NO: 83053 - protein, 9 aa, Homo sapiens
  light chain complementarity determining region 3 for antibody 41527
QQLITYPNT

SEQ ID NO: 83054 - protein, 21 aa, Homo sapiens
  heavy chain complementarity determining region 3 for antibody 41527
ARDLPPVDYVWGSYPDAGFDY

SEQ ID NO: 83055 - protein, 9 aa, Homo sapiens
  light chain complementarity determining region 3 for antibody 41528
QQHNYYPLT

SEQ ID NO: 83056 - protein, 5 aa, Homo sapiens
  heavy chain complementarity determining region 3 for antibody 41528
ASGPD

SEQ ID NO: 83057 - protein, 9 aa, Homo sapiens
  light chain complementarity determining region 3 for antibody 41529
QQGYNTPYT

SEQ ID NO: 83058 - protein, 14 aa, Homo sapiens
  heavy chain complementarity determining region 3 for antibody 41529
AKSASLDYYGAFDP

SEQ ID NO: 83059 - protein, 9 aa, Homo sapiens
  light chain complementarity determining region 3 for antibody 41530
QQGSSWPGT

SEQ ID NO: 83060 - protein, 16 aa, Homo sapiens
  heavy chain complementarity determining region 3 for antibody 41530
ARSQGGAVAADGEFDY

SEQ ID NO: 83061 - protein, 9 aa, Homo sapiens
  light chain complementarity determining region 3 for antibody 41531
QQFNSYPLT

SEQ ID NO: 83062 - protein, 16 aa, Homo sapiens
  heavy chain complementarity determining region 3 for antibody 41531
VRQGSWGVGVGWYVGY

SEQ ID NO: 83063 - protein, 10 aa, Homo sapiens
  light chain complementarity determining region 3 for antibody 41532
QQFNNWPPTT

SEQ ID NO: 83064 - protein, 16 aa, Homo sapiens
  heavy chain complementarity determining region 3 for antibody 41532
AREVPDRTSSGWSLDL

SEQ ID NO: 83065 - protein, 9 aa, Homo sapiens
  light chain complementarity determining region 3 for antibody 41533
QQCSISPLT

SEQ ID NO: 83066 - protein, 13 aa, Homo sapiens
  heavy chain complementarity determining region 3 for antibody 41533
ARGLSTTSWYSFY

SEQ ID NO: 83067 - protein, 9 aa, Homo sapiens
  light chain complementarity determining region 3 for antibody 41534
QQCDSWPHS

SEQ ID NO: 83068 - protein, 17 aa, Homo sapiens
  heavy chain complementarity determining region 3 for antibody 41534
ARGYSTDYYTRPEYFHY

SEQ ID NO: 83069 - protein, 9 aa, Homo sapiens
  light chain complementarity determining region 3 for antibody 41535
QQASSFPYT

SEQ ID NO: 83070 - protein, 12 aa, Homo sapiens
  heavy chain complementarity determining region 3 for antibody 41535
ATGGAGNALGAL

SEQ ID NO: 83071 - protein, 9 aa, Homo sapiens
  light chain complementarity determining region 3 for antibody 41536
QQASSFPLT

SEQ ID NO: 83072 - protein, 14 aa, Homo sapiens
  heavy chain complementarity determining region 3 for antibody 41536
ARARPSVTTSHFED

SEQ ID NO: 83073 - protein, 8 aa, Homo sapiens
  light chain complementarity determining region 3 for antibody 41537
QQASDPYT

SEQ ID NO: 83074 - protein, 12 aa, Homo sapiens
  heavy chain complementarity determining region 3 for antibody 41537
AKNSGVRRAFDI

SEQ ID NO: 83075 - protein, 9 aa, Homo sapiens
  light chain complementarity determining region 3 for antibody 41538
QQANSFPHT

SEQ ID NO: 83076 - protein, 14 aa, Homo sapiens
  heavy chain complementarity determining region 3 for antibody 41538
ARVLGLGVAGPYDY

SEQ ID NO: 83077 - protein, 9 aa, Homo sapiens
  light chain complementarity determining region 3 for antibody 41539
QQAKSFPFT

SEQ ID NO: 83078 - protein, 13 aa, Homo sapiens
  heavy chain complementarity determining region 3 for antibody 41539
ARDHGRFGEFIDY

SEQ ID NO: 83079 - protein, 9 aa, Homo sapiens
  light chain complementarity determining region 3 for antibody 41540
QQADRFPIT

SEQ ID NO: 83080 - protein, 13 aa, Homo sapiens
  heavy chain complementarity determining region 3 for antibody 41540
ARSGVGGDNGFDY

SEQ ID NO: 83081 - protein, 10 aa, Homo sapiens
  light chain complementarity determining region 3 for antibody 41541
QMYGGSPLLT

SEQ ID NO: 83082 - protein, 14 aa, Homo sapiens
  heavy chain complementarity determining region 3 for antibody 41541
ARDPALGAPDYLDH

SEQ ID NO: 83083 - protein, 11 aa, Homo sapiens
  light chain complementarity determining region 3 for antibody 41542
QMYDGSPPKYI

SEQ ID NO: 83084 - protein, 14 aa, Homo sapiens
  heavy chain complementarity determining region 3 for antibody 41542
ASHVTLTGTRGFDF

SEQ ID NO: 83085 - protein, 8 aa, Homo sapiens
  light chain complementarity determining region 3 for antibody 41543
QLFTGLPS

SEQ ID NO: 83086 - protein, 14 aa, Homo sapiens
  heavy chain complementarity determining region 3 for antibody 41543
ARMSSLAAPFGMDV

SEQ ID NO: 83087 - protein, 9 aa, Homo sapiens
  light chain complementarity determining region 3 for antibody 41544
QKYNSGSRT

SEQ ID NO: 83088 - protein, 13 aa, Homo sapiens
  heavy chain complementarity determining region 3 for antibody 41544
ARPFVPGYSGFVA

SEQ ID NO: 83089 - protein, 9 aa, Homo sapiens
  light chain complementarity determining region 3 for antibody 41545
QKYNSAPRT

SEQ ID NO: 83090 - protein, 18 aa, Homo sapiens
  heavy chain complementarity determining region 3 for antibody 41545
ARESSELPMTYYYYALDV

SEQ ID NO: 83091 - protein, 9 aa, Homo sapiens
  light chain complementarity determining region 3 for antibody 41546
QKYNSAPQT

SEQ ID NO: 83092 - protein, 17 aa, Homo sapiens
  heavy chain complementarity determining region 3 for antibody 41546
AKDVHSRQGYYYYGMDV

SEQ ID NO: 83093 - protein, 9 aa, Homo sapiens
  light chain complementarity determining region 3 for antibody 41547
QKYNSAPLT

SEQ ID NO: 83094 - protein, 18 aa, Homo sapiens
  heavy chain complementarity determining region 3 for antibody 41547
AREGWGSGLEGQGPGFDY

SEQ ID NO: 83095 - protein, 9 aa, Homo sapiens
  light chain complementarity determining region 3 for antibody 41548
QKYNSAPLT

SEQ ID NO: 83096 - protein, 14 aa, Homo sapiens
  heavy chain complementarity determining region 3 for antibody 41548
AKDWMGIFLYYFDS

SEQ ID NO: 83097 - protein, 9 aa, Homo sapiens
  light chain complementarity determining region 3 for antibody 41549
QHYGSSPRT

SEQ ID NO: 83098 - protein, 14 aa, Homo sapiens
  heavy chain complementarity determining region 3 for antibody 41549
VSENGGTMSWVPDS

SEQ ID NO: 83099 - protein, 6 aa, Homo sapiens
  light chain complementarity determining region 3 for antibody 41550
QHYGSS

SEQ ID NO: 83100 - protein, 15 aa, Homo sapiens
  heavy chain complementarity determining region 3 for antibody 41550
AKDHLTTVIKAYFDY

SEQ ID NO: 83101 - protein, 9 aa, Homo sapiens
  light chain complementarity determining region 3 for antibody 41551
QHYDVFPYS

SEQ ID NO: 83102 - protein, 8 aa, Homo sapiens
  heavy chain complementarity determining region 3 for antibody 41551
ARVAQQLS

SEQ ID NO: 83103 - protein, 9 aa, Homo sapiens
  light chain complementarity determining region 3 for antibody 41552
QHYASFPLT

SEQ ID NO: 83104 - protein, 17 aa, Homo sapiens
  heavy chain complementarity determining region 3 for antibody 41552
AKGATYCSDSSCYRFDS

SEQ ID NO: 83105 - protein, 9 aa, Homo sapiens
  light chain complementarity determining region 3 for antibody 41553
QHSFTLPRT

SEQ ID NO: 83106 - protein, 12 aa, Homo sapiens
  heavy chain complementarity determining region 3 for antibody 41553
ARARSEMGPAEY

SEQ ID NO: 83107 - protein, 9 aa, Homo sapiens
  light chain complementarity determining region 3 for antibody 41554
QEYNSYFRT

SEQ ID NO: 83108 - protein, 15 aa, Homo sapiens
  heavy chain complementarity determining region 3 for antibody 41554
ARDLYTGSYFPSFDI

SEQ ID NO: 83109 - protein, 9 aa, Homo sapiens
  light chain complementarity determining region 3 for antibody 41555
QESYSPPFT

SEQ ID NO: 83110 - protein, 15 aa, Homo sapiens
  heavy chain complementarity determining region 3 for antibody 41555
AKDIGTYSDNLTPDY

SEQ ID NO: 83111 - protein, 9 aa, Homo sapiens
  light chain complementarity determining region 3 for antibody 41556
MQVTHWPRT

SEQ ID NO: 83112 - protein, 18 aa, Homo sapiens
  heavy chain complementarity determining region 3 for antibody 41556
TQVYDIMTGSQFSSAFDV

SEQ ID NO: 83113 - protein, 9 aa, Homo sapiens
  light chain complementarity determining region 3 for antibody 41557
MQTLQTPRT

SEQ ID NO: 83114 - protein, 9 aa, Homo sapiens
  heavy chain complementarity determining region 3 for antibody 41557
ARAVPGMDV

SEQ ID NO: 83115 - protein, 9 aa, Homo sapiens
  light chain complementarity determining region 3 for antibody 41558
MQGTHWPGT

SEQ ID NO: 83116 - protein, 15 aa, Homo sapiens
  heavy chain complementarity determining region 3 for antibody 41558
AKDHSPYSSSSDFDY

SEQ ID NO: 83117 - protein, 9 aa, Homo sapiens
  light chain complementarity determining region 3 for antibody 41559
MQGLQTPWT

SEQ ID NO: 83118 - protein, 14 aa, Homo sapiens
  heavy chain complementarity determining region 3 for antibody 41559
AKDVRGPHGWYFDL

SEQ ID NO: 83119 - protein, 9 aa, Homo sapiens
  light chain complementarity determining region 3 for antibody 41560
MQETDWPRT

SEQ ID NO: 83120 - protein, 7 aa, Homo sapiens
  heavy chain complementarity determining region 3 for antibody 41560
TKDGFDI

SEQ ID NO: 83121 - protein, 9 aa, Homo sapiens
  light chain complementarity determining region 3 for antibody 41561
MQDTHWPPT

SEQ ID NO: 83122 - protein, 21 aa, Homo sapiens
  heavy chain complementarity determining region 3 for antibody 41561
SRGAWEKKTISSHPDDGAFDI

SEQ ID NO: 83123 - protein, 9 aa, Homo sapiens
  light chain complementarity determining region 3 for antibody 41562
MQALQTPWT

SEQ ID NO: 83124 - protein, 14 aa, Homo sapiens
  heavy chain complementarity determining region 3 for antibody 41562
ARDMSEISGWWLDP

SEQ ID NO: 83125 - protein, 9 aa, Homo sapiens
  light chain complementarity determining region 3 for antibody 41563
MQALQTPLT

SEQ ID NO: 83126 - protein, 12 aa, Homo sapiens
  heavy chain complementarity determining region 3 for antibody 41563
ARWDGSGWHWDF

SEQ ID NO: 83127 - protein, 8 aa, Homo sapiens
  light chain complementarity determining region 3 for antibody 41564
MQALQTNT

SEQ ID NO: 83128 - protein, 14 aa, Homo sapiens
  heavy chain complementarity determining region 3 for antibody 41564
ARVRSEVYSSSPDY

SEQ ID NO: 83129 - protein, 9 aa, Homo sapiens
  light chain complementarity determining region 3 for antibody 41565
MHALQAPLT

SEQ ID NO: 83130 - protein, 11 aa, Homo sapiens
  heavy chain complementarity determining region 3 for antibody 41565
AREASGSIFDY

SEQ ID NO: 83131 - protein, 9 aa, Homo sapiens
  light chain complementarity determining region 3 for antibody 41566
LQYNTYPYT

SEQ ID NO: 83132 - protein, 12 aa, Homo sapiens
  heavy chain complementarity determining region 3 for antibody 41566
TPARGSGLGMDV

SEQ ID NO: 83133 - protein, 9 aa, Homo sapiens
  light chain complementarity determining region 3 for antibody 41567
LQYNSNLWT

SEQ ID NO: 83134 - protein, 19 aa, Homo sapiens
  heavy chain complementarity determining region 3 for antibody 41567
ARDRSGNGSGYYSPYYFDF

SEQ ID NO: 83135 - protein, 9 aa, Homo sapiens
  light chain complementarity determining region 3 for antibody 41568
LQYKSYPRT

SEQ ID NO: 83136 - protein, 6 aa, Homo sapiens
  heavy chain complementarity determining region 3 for antibody 41568
TRALDY

SEQ ID NO: 83137 - protein, 9 aa, Homo sapiens
  light chain complementarity determining region 3 for antibody 41569
LQHNSYSYT

SEQ ID NO: 83138 - protein, 11 aa, Homo sapiens
  heavy chain complementarity determining region 3 for antibody 41569
ARHEGRELLGT

SEQ ID NO: 83139 - protein, 9 aa, Homo sapiens
  light chain complementarity determining region 3 for antibody 41570
LQHNSYPLT

SEQ ID NO: 83140 - protein, 13 aa, Homo sapiens
  heavy chain complementarity determining region 3 for antibody 41570
TAINTGTYVPGDY

SEQ ID NO: 83141 - protein, 9 aa, Homo sapiens
  light chain complementarity determining region 3 for antibody 41571
LQHDDLPYT

SEQ ID NO: 83142 - protein, 12 aa, Homo sapiens
  heavy chain complementarity determining region 3 for antibody 41571
AALIVGAWVGGI

SEQ ID NO: 83143 - protein, 9 aa, Homo sapiens
  light chain complementarity determining region 3 for antibody 41572
LQDFTYPYT

SEQ ID NO: 83144 - protein, 13 aa, Homo sapiens
  heavy chain complementarity determining region 3 for antibody 41572
ARQPTGYPNWFGP

SEQ ID NO: 83145 - protein, 10 aa, Homo sapiens
  light chain complementarity determining region 3 for antibody 41573
LLYGGSPLYT

SEQ ID NO: 83146 - protein, 18 aa, Homo sapiens
  heavy chain complementarity determining region 3 for antibody 41573
ARVRYRWNYAADSYYFDY

SEQ ID NO: 83147 - protein, 9 aa, Homo sapiens
  light chain complementarity determining region 3 for antibody 41574
LHDYNYPYT

SEQ ID NO: 83148 - protein, 10 aa, Homo sapiens
  heavy chain complementarity determining region 3 for antibody 41574
ARELGHTDAY

SEQ ID NO: 83149 - protein, 9 aa, Homo sapiens
  light chain complementarity determining region 3 for antibody 41575
HYYNSAPLT

SEQ ID NO: 83150 - protein, 10 aa, Homo sapiens
  heavy chain complementarity determining region 3 for antibody 41575
ARDEGYFGTS

SEQ ID NO: 83151 - protein, 8 aa, Homo sapiens
  light chain complementarity determining region 3 for antibody 41576
HQYSRYST

SEQ ID NO: 83152 - protein, 15 aa, Homo sapiens
  heavy chain complementarity determining region 3 for antibody 41576
ARPSYCGGDCYAQDY

SEQ ID NO: 83153 - protein, 9 aa, Homo sapiens
  light chain complementarity determining region 3 for antibody 41577
HQYGSSPRT

SEQ ID NO: 83154 - protein, 12 aa, Homo sapiens
  heavy chain complementarity determining region 3 for antibody 41577
ARESGVAGAFDH

SEQ ID NO: 83155 - protein, 9 aa, Homo sapiens
  light chain complementarity determining region 3 for antibody 41578
HQSYNFPQT

SEQ ID NO: 83156 - protein, 14 aa, Homo sapiens
  heavy chain complementarity determining region 3 for antibody 41578
ASSRDTSGYSSSDY

SEQ ID NO: 83157 - protein, 9 aa, Homo sapiens
  light chain complementarity determining region 3 for antibody 41579
HQSSSFPLT

SEQ ID NO: 83158 - protein, 12 aa, Homo sapiens
  heavy chain complementarity determining region 3 for antibody 41579
AKDAAVATYFEY

SEQ ID NO: 83159 - protein, 9 aa, Homo sapiens
  light chain complementarity determining region 3 for antibody 41580
HQRSNWPLT

SEQ ID NO: 83160 - protein, 15 aa, Homo sapiens
  heavy chain complementarity determining region 3 for antibody 41580
ARAFRTSGIYYNSDY

SEQ ID NO: 83161 - protein, 9 aa, Homo sapiens
  light chain complementarity determining region 3 for antibody 41581
HQCYSTPRT

SEQ ID NO: 83162 - protein, 14 aa, Homo sapiens
  heavy chain complementarity determining region 3 for antibody 41581
ARERPHASAGAFDI

SEQ ID NO: 83163 - protein, 9 aa, Homo sapiens
  light chain complementarity determining region 3 for antibody 41582
HQAHSYPLT

SEQ ID NO: 83164 - protein, 14 aa, Homo sapiens
  heavy chain complementarity determining region 3 for antibody 41582
ARRRRLRGSYYFDV

SEQ ID NO: 83165 - protein, 9 aa, Homo sapiens
  light chain complementarity determining region 3 for antibody 41583
HKYNSAPFT

SEQ ID NO: 83166 - protein, 18 aa, Homo sapiens
  heavy chain complementarity determining region 3 for antibody 41583
ARGGYCRNGNCHPTLYDY

SEQ ID NO: 83167 - protein, 9 aa, Homo sapiens
  light chain complementarity determining region 3 for antibody 41584
EQSYRAPPT

SEQ ID NO: 83168 - protein, 18 aa, Homo sapiens
  heavy chain complementarity determining region 3 for antibody 41584
AREEYNYVSGTAYTVMDV

SEQ ID NO: 83169 - protein, 9 aa, Homo sapiens
  light chain complementarity determining region 3 for antibody 41585
QYRSNWLFT

SEQ ID NO: 83170 - protein, 13 aa, Homo sapiens
  heavy chain complementarity determining region 3 for antibody 41585
VALSLAVADGADY

SEQ ID NO: 83171 - protein, 9 aa, Homo sapiens
  light chain complementarity determining region 3 for antibody 41586
QTYGRSRYT

SEQ ID NO: 83172 - protein, 14 aa, Homo sapiens
  heavy chain complementarity determining region 3 for antibody 41586
ASWLAAAGETALES

SEQ ID NO: 83173 - protein, 9 aa, Homo sapiens
  light chain complementarity determining region 3 for antibody 41587
QRYNSAPLT

SEQ ID NO: 83174 - protein, 13 aa, Homo sapiens
  heavy chain complementarity determining region 3 for antibody 41587
ARHMAGYYSAFDI

SEQ ID NO: 83175 - protein, 10 aa, Homo sapiens
  light chain complementarity determining region 3 for antibody 41588
QRYGASPPWT

SEQ ID NO: 83176 - protein, 14 aa, Homo sapiens
  heavy chain complementarity determining region 3 for antibody 41588
ASTIGYSDGPGGDY

SEQ ID NO: 83177 - protein, 9 aa, Homo sapiens
  light chain complementarity determining region 3 for antibody 41589
QRTYNAPQA

SEQ ID NO: 83178 - protein, 12 aa, Homo sapiens
  heavy chain complementarity determining region 3 for antibody 41589
AKVTQLPDHFDY

SEQ ID NO: 83179 - protein, 9 aa, Homo sapiens
  light chain complementarity determining region 3 for antibody 41590
QRLKNYPPT

SEQ ID NO: 83180 - protein, 8 aa, Homo sapiens
  heavy chain complementarity determining region 3 for antibody 41590
TRGGDFDY

SEQ ID NO: 83181 - protein, 6 aa, Homo sapiens
  light chain complementarity determining region 3 for antibody 41591
QRLDGN

SEQ ID NO: 83182 - protein, 18 aa, Homo sapiens
  heavy chain complementarity determining region 3 for antibody 41591
AREGWGSGLGGQGPGFDY

SEQ ID NO: 83183 - protein, 9 aa, Homo sapiens
  light chain complementarity determining region 3 for antibody 41592
QQYYSTLST

SEQ ID NO: 83184 - protein, 19 aa, Homo sapiens
  heavy chain complementarity determining region 3 for antibody 41592
ARAPQYCTSTFCSGGWFDP

SEQ ID NO: 83185 - protein, 7 aa, Homo sapiens
  light chain complementarity determining region 3 for antibody 41593
QQYYNFV

SEQ ID NO: 83186 - protein, 14 aa, Homo sapiens
  heavy chain complementarity determining region 3 for antibody 41593
ARTIWRTAGARFDI

SEQ ID NO: 83187 - protein, 9 aa, Homo sapiens
  light chain complementarity determining region 3 for antibody 41594
QQYVSSPRT

SEQ ID NO: 83188 - protein, 15 aa, Homo sapiens
  heavy chain complementarity determining region 3 for antibody 41594
VREPGITTADWYFDL

SEQ ID NO: 83189 - protein, 9 aa, Homo sapiens
  light chain complementarity determining region 3 for antibody 41595
QQYVNLPFT

SEQ ID NO: 83190 - protein, 16 aa, Homo sapiens
  heavy chain complementarity determining region 3 for antibody 41595
ARASVDTALERGCFDT

SEQ ID NO: 83191 - protein, 8 aa, Homo sapiens
  light chain complementarity determining region 3 for antibody 41596
QQYTDLLT

SEQ ID NO: 83192 - protein, 14 aa, Homo sapiens
  heavy chain complementarity determining region 3 for antibody 41596
ARYSSLSPPYGMDV

SEQ ID NO: 83193 - protein, 9 aa, Homo sapiens
  light chain complementarity determining region 3 for antibody 41597
QQYSRSPLT

SEQ ID NO: 83194 - protein, 14 aa, Homo sapiens
  heavy chain complementarity determining region 3 for antibody 41597
ARESIGGASTGFDY

SEQ ID NO: 83195 - protein, 8 aa, Homo sapiens
  light chain complementarity determining region 3 for antibody 41598
QQYQSYWS

SEQ ID NO: 83196 - protein, 10 aa, Homo sapiens
  heavy chain complementarity determining region 3 for antibody 41598
AREDFWRLDL

SEQ ID NO: 83197 - protein, 9 aa, Homo sapiens
  light chain complementarity determining region 3 for antibody 41599
QQYNTYPWT

SEQ ID NO: 83198 - protein, 17 aa, Homo sapiens
  heavy chain complementarity determining region 3 for antibody 41599
ARSVDDSSGYHTYYFDY

SEQ ID NO: 83199 - protein, 8 aa, Homo sapiens
  light chain complementarity determining region 3 for antibody 41600
QQYNTFPT

SEQ ID NO: 83200 - protein, 13 aa, Homo sapiens
  heavy chain complementarity determining region 3 for antibody 41600
AAGVVLTQNGLDV

SEQ ID NO: 83201 - protein, 8 aa, Homo sapiens
  light chain complementarity determining region 3 for antibody 41601
QQYNSYWT

SEQ ID NO: 83202 - protein, 24 aa, Homo sapiens
  heavy chain complementarity determining region 3 for antibody 41601
ARHREAVAGTLWRRGGLPSSYFDY

SEQ ID NO: 83203 - protein, 8 aa, Homo sapiens
  light chain complementarity determining region 3 for antibody 41602
QQYNSYST

SEQ ID NO: 83204 - protein, 15 aa, Homo sapiens
  heavy chain complementarity determining region 3 for antibody 41602
ARAPFCTSLACYFDS

SEQ ID NO: 83205 - protein, 9 aa, Homo sapiens
  light chain complementarity determining region 3 for antibody 41603
QQYNSYSRT

SEQ ID NO: 83206 - protein, 9 aa, Homo sapiens
  heavy chain complementarity determining region 3 for antibody 41603
ARGSGWLDY

SEQ ID NO: 83207 - protein, 9 aa, Homo sapiens
  light chain complementarity determining region 3 for antibody 41604
QQYNSYSRT

SEQ ID NO: 83208 - protein, 9 aa, Homo sapiens
  heavy chain complementarity determining region 3 for antibody 41604
ARGGSDSDY

SEQ ID NO: 83209 - protein, 9 aa, Homo sapiens
  light chain complementarity determining region 3 for antibody 41605
QQYNSYSGT

SEQ ID NO: 83210 - protein, 17 aa, Homo sapiens
  heavy chain complementarity determining region 3 for antibody 41605
ARRKMGRGNFRSNGFDI

SEQ ID NO: 83211 - protein, 10 aa, Homo sapiens
  light chain complementarity determining region 3 for antibody 41606
QQYNSYFSIT

SEQ ID NO: 83212 - protein, 17 aa, Homo sapiens
  heavy chain complementarity determining region 3 for antibody 41606
AREVRPGYPDSSEYFQH

SEQ ID NO: 83213 - protein, 10 aa, Homo sapiens
  light chain complementarity determining region 3 for antibody 41607
QQYNSWPPLT

SEQ ID NO: 83214 - protein, 14 aa, Homo sapiens
  heavy chain complementarity determining region 3 for antibody 41607
ARSKWAAPGTPPEY

SEQ ID NO: 83215 - protein, 8 aa, Homo sapiens
  light chain complementarity determining region 3 for antibody 41608
QQYNSQSS

SEQ ID NO: 83216 - protein, 16 aa, Homo sapiens
  heavy chain complementarity determining region 3 for antibody 41608
IKEKKTARVGFDALEM

SEQ ID NO: 83217 - protein, 9 aa, Homo sapiens
  light chain complementarity determining region 3 for antibody 41609
QQYNSNPPT

SEQ ID NO: 83218 - protein, 14 aa, Homo sapiens
  heavy chain complementarity determining region 3 for antibody 41609
ASPPDGMFDNYFAY

SEQ ID NO: 83219 - protein, 9 aa, Homo sapiens
  light chain complementarity determining region 3 for antibody 41610
QQYNSFPYT

SEQ ID NO: 83220 - protein, 9 aa, Homo sapiens
  heavy chain complementarity determining region 3 for antibody 41610
TRGPGLLWF

SEQ ID NO: 83221 - protein, 10 aa, Homo sapiens
  light chain complementarity determining region 3 for antibody 41611
QQYNNYATWT

SEQ ID NO: 83222 - protein, 13 aa, Homo sapiens
  heavy chain complementarity determining region 3 for antibody 41611
ARHKSVYDDSGFV

SEQ ID NO: 83223 - protein, 9 aa, Homo sapiens
  light chain complementarity determining region 3 for antibody 41612
QQYNNVPLT

SEQ ID NO: 83224 - protein, 12 aa, Homo sapiens
  heavy chain complementarity determining region 3 for antibody 41612
VRAIVLLTHYDY

SEQ ID NO: 83225 - protein, 9 aa, Homo sapiens
  light chain complementarity determining region 3 for antibody 41613
QQYKSFPWT

SEQ ID NO: 83226 - protein, 16 aa, Homo sapiens
  heavy chain complementarity determining region 3 for antibody 41613
ARLKRGGGSQQYYFDS

SEQ ID NO: 83227 - protein, 9 aa, Homo sapiens
  light chain complementarity determining region 3 for antibody 41614
QQYHSYPLT

SEQ ID NO: 83228 - protein, 16 aa, Homo sapiens
  heavy chain complementarity determining region 3 for antibody 41614
AKVGWDILAGYEYFDY

SEQ ID NO: 83229 - protein, 8 aa, Homo sapiens
  light chain complementarity determining region 3 for antibody 41615
QQYHNNSA

SEQ ID NO: 83230 - protein, 14 aa, Homo sapiens
  heavy chain complementarity determining region 3 for antibody 41615
ARPRNSNWLYYFDY

SEQ ID NO: 83231 - protein, 8 aa, Homo sapiens
  light chain complementarity determining region 3 for antibody 41616
QQYGSSWT

SEQ ID NO: 83232 - protein, 15 aa, Homo sapiens
  heavy chain complementarity determining region 3 for antibody 41616
ASSINPFGESMPLDY

SEQ ID NO: 83233 - protein, 9 aa, Homo sapiens
  light chain complementarity determining region 3 for antibody 41617
QQYGSSPRT

SEQ ID NO: 83234 - protein, 17 aa, Homo sapiens
  heavy chain complementarity determining region 3 for antibody 41617
TTDPQWLEPPPFVTNDY

SEQ ID NO: 83235 - protein, 9 aa, Homo sapiens
  light chain complementarity determining region 3 for antibody 41618
QQYGSSPRT

SEQ ID NO: 83236 - protein, 18 aa, Homo sapiens
  heavy chain complementarity determining region 3 for antibody 41618
AHRDRGGVAGTPNDAFDI

SEQ ID NO: 83237 - protein, 9 aa, Homo sapiens
  light chain complementarity determining region 3 for antibody 41619
QQYGSSPLT

SEQ ID NO: 83238 - protein, 15 aa, Homo sapiens
  heavy chain complementarity determining region 3 for antibody 41619
ARGHDFWSGYYPFDS

SEQ ID NO: 83239 - protein, 9 aa, Homo sapiens
  light chain complementarity determining region 3 for antibody 41620
QQYGSSPIT

SEQ ID NO: 83240 - protein, 13 aa, Homo sapiens
  heavy chain complementarity determining region 3 for antibody 41620
AKSQHLPDDILDY

SEQ ID NO: 83241 - protein, 9 aa, Homo sapiens
  light chain complementarity determining region 3 for antibody 41621
QQYGSSLYT

SEQ ID NO: 83242 - protein, 16 aa, Homo sapiens
  heavy chain complementarity determining region 3 for antibody 41621
ARAKHYGDYYYYGMDA

SEQ ID NO: 83243 - protein, 8 aa, Homo sapiens
  light chain complementarity determining region 3 for antibody 41622
QQYGSSAT

SEQ ID NO: 83244 - protein, 10 aa, Homo sapiens
  heavy chain complementarity determining region 3 for antibody 41622
ARRGLLFGES

SEQ ID NO: 83245 - protein, 9 aa, Homo sapiens
  light chain complementarity determining region 3 for antibody 41623
QQYGSALPT

SEQ ID NO: 83246 - protein, 15 aa, Homo sapiens
  heavy chain complementarity determining region 3 for antibody 41623
ARGKAAAGLKYLFDL

SEQ ID NO: 83247 - protein, 8 aa, Homo sapiens
  light chain complementarity determining region 3 for antibody 41624
QQYGNTLT

SEQ ID NO: 83248 - protein, 20 aa, Homo sapiens
  heavy chain complementarity determining region 3 for antibody 41624
AREVDGPRKWQQVLRYYFDL

SEQ ID NO: 83249 - protein, 8 aa, Homo sapiens
  light chain complementarity determining region 3 for antibody 41625
QQYGNSYT

SEQ ID NO: 83250 - protein, 16 aa, Homo sapiens
  heavy chain complementarity determining region 3 for antibody 41625
SRHFLDYHGSGSYVQH

SEQ ID NO: 83251 - protein, 10 aa, Homo sapiens
  light chain complementarity determining region 3 for antibody 41626
QQYGGSPQYT

SEQ ID NO: 83252 - protein, 15 aa, Homo sapiens
  heavy chain complementarity determining region 3 for antibody 41626
ARDDRFATKFHSLDN

SEQ ID NO: 83253 - protein, 9 aa, Homo sapiens
  light chain complementarity determining region 3 for antibody 41627
QQYGGSPNT

SEQ ID NO: 83254 - protein, 15 aa, Homo sapiens
  heavy chain complementarity determining region 3 for antibody 41627
AKFKADYGAKDYFDY

SEQ ID NO: 83255 - protein, 10 aa, Homo sapiens
  light chain complementarity determining region 3 for antibody 41628
QQYGGSPLYT

SEQ ID NO: 83256 - protein, 13 aa, Homo sapiens
  heavy chain complementarity determining region 3 for antibody 41628
AREERTTGTTFDY

SEQ ID NO: 83257 - protein, 10 aa, Homo sapiens
  light chain complementarity determining region 3 for antibody 41629
QQYGGSLSLS

SEQ ID NO: 83258 - protein, 17 aa, Homo sapiens
  heavy chain complementarity determining region 3 for antibody 41629
ARVDLSEQWLVLWFFDL

SEQ ID NO: 83259 - protein, 9 aa, Homo sapiens
  light chain complementarity determining region 3 for antibody 41630
QQYGASPWA

SEQ ID NO: 83260 - protein, 11 aa, Homo sapiens
  heavy chain complementarity determining region 3 for antibody 41630
ARKGFHAPLDV

SEQ ID NO: 83261 - protein, 9 aa, Homo sapiens
  light chain complementarity determining region 3 for antibody 41631
QQYFSYPYT

SEQ ID NO: 83262 - protein, 21 aa, Homo sapiens
  heavy chain complementarity determining region 3 for antibody 41631
YTVGVIPDYCTPPTCDIQWAY

SEQ ID NO: 83263 - protein, 9 aa, Homo sapiens
  light chain complementarity determining region 3 for antibody 41632
QQYESYLWT

SEQ ID NO: 83264 - protein, 17 aa, Homo sapiens
  heavy chain complementarity determining region 3 for antibody 41632
TTHLETNSGTYYHLLDY

SEQ ID NO: 83265 - protein, 10 aa, Homo sapiens
  light chain complementarity determining region 3 for antibody 41633
QQYDVLRGYT

SEQ ID NO: 83266 - protein, 11 aa, Homo sapiens
  heavy chain complementarity determining region 3 for antibody 41633
AAVTMHDAFDL

SEQ ID NO: 83267 - protein, 9 aa, Homo sapiens
  light chain complementarity determining region 3 for antibody 41634
QQYDVLPRT

SEQ ID NO: 83268 - protein, 16 aa, Homo sapiens
  heavy chain complementarity determining region 3 for antibody 41634
AKGRRVKSAYDCPFDH

SEQ ID NO: 83269 - protein, 9 aa, Homo sapiens
  light chain complementarity determining region 3 for antibody 41635
QQYDTYPRT

SEQ ID NO: 83270 - protein, 11 aa, Homo sapiens
  heavy chain complementarity determining region 3 for antibody 41635
ARGPTKDAFDF

SEQ ID NO: 83271 - protein, 8 aa, Homo sapiens
  light chain complementarity determining region 3 for antibody 41636
QQYDTLIT

SEQ ID NO: 83272 - protein, 14 aa, Homo sapiens
  heavy chain complementarity determining region 3 for antibody 41636
ARARGRQLFGLMPY

SEQ ID NO: 83273 - protein, 8 aa, Homo sapiens
  light chain complementarity determining region 3 for antibody 41637
QQYDTDYS

SEQ ID NO: 83274 - protein, 10 aa, Homo sapiens
  heavy chain complementarity determining region 3 for antibody 41637
ARRKLDGFDI

SEQ ID NO: 83275 - protein, 9 aa, Homo sapiens
  light chain complementarity determining region 3 for antibody 41638
QQYDSYSYT

SEQ ID NO: 83276 - protein, 22 aa, Homo sapiens
  heavy chain complementarity determining region 3 for antibody 41638
ARGYRYYDDVWGSYRPLGFFDL

SEQ ID NO: 83277 - protein, 9 aa, Homo sapiens
  light chain complementarity determining region 3 for antibody 41639
QQYDSHSYA

SEQ ID NO: 83278 - protein, 13 aa, Homo sapiens
  heavy chain complementarity determining region 3 for antibody 41639
ARDGDHSVYDLDY

SEQ ID NO: 83279 - protein, 10 aa, Homo sapiens
  light chain complementarity determining region 3 for antibody 41640
QQYDRSPMYT

SEQ ID NO: 83280 - protein, 21 aa, Homo sapiens
  heavy chain complementarity determining region 3 for antibody 41640
AKEQYSGSGTSVLHYYYGLDV

SEQ ID NO: 83281 - protein, 9 aa, Homo sapiens
  light chain complementarity determining region 3 for antibody 41641
QQYDNLRFT

SEQ ID NO: 83282 - protein, 17 aa, Homo sapiens
  heavy chain complementarity determining region 3 for antibody 41641
AREVITAAPGESDAFDI

SEQ ID NO: 83283 - protein, 9 aa, Homo sapiens
  light chain complementarity determining region 3 for antibody 41642
QQYDNLPYT

SEQ ID NO: 83284 - protein, 12 aa, Homo sapiens
  heavy chain complementarity determining region 3 for antibody 41642
ASALSGSYFVHH

SEQ ID NO: 83285 - protein, 11 aa, Homo sapiens
  light chain complementarity determining region 3 for antibody 41643
QQYDNLPLVYT

SEQ ID NO: 83286 - protein, 14 aa, Homo sapiens
  heavy chain complementarity determining region 3 for antibody 41643
GSQGEGTSGYRIDY

SEQ ID NO: 83287 - protein, 9 aa, Homo sapiens
  light chain complementarity determining region 3 for antibody 41644
QQYDNLPLT

SEQ ID NO: 83288 - protein, 12 aa, Homo sapiens
  heavy chain complementarity determining region 3 for antibody 41644
AREGGVAGNFDY

SEQ ID NO: 83289 - protein, 10 aa, Homo sapiens
  light chain complementarity determining region 3 for antibody 41645
QQYDDLPPIT

SEQ ID NO: 83290 - protein, 19 aa, Homo sapiens
  heavy chain complementarity determining region 3 for antibody 41645
ARAREGSYREENNYYGFDA

SEQ ID NO: 83291 - protein, 9 aa, Homo sapiens
  light chain complementarity determining region 3 for antibody 41646
QQYDDLPLT

SEQ ID NO: 83292 - protein, 12 aa, Homo sapiens
  heavy chain complementarity determining region 3 for antibody 41646
ARIPSTAMFFDV

SEQ ID NO: 83293 - protein, 9 aa, Homo sapiens
  light chain complementarity determining region 3 for antibody 41647
QQYDDFSLT

SEQ ID NO: 83294 - protein, 17 aa, Homo sapiens
  heavy chain complementarity determining region 3 for antibody 41647
ARHYNYDSSSYYVGFNY

SEQ ID NO: 83295 - protein, 10 aa, Homo sapiens
  light chain complementarity determining region 3 for antibody 41648
QQYASSTPYT

SEQ ID NO: 83296 - protein, 17 aa, Homo sapiens
  heavy chain complementarity determining region 3 for antibody 41648
AQYTKYYYDTSGYYVVT

SEQ ID NO: 83297 - protein, 9 aa, Homo sapiens
  light chain complementarity determining region 3 for antibody 41649
QQYASSPWT

SEQ ID NO: 83298 - protein, 15 aa, Homo sapiens
  heavy chain complementarity determining region 3 for antibody 41649
ARHRNGWRGEFYFDY

SEQ ID NO: 83299 - protein, 9 aa, Homo sapiens
  light chain complementarity determining region 3 for antibody 41650
QQTYSPPQT

SEQ ID NO: 83300 - protein, 24 aa, Homo sapiens
  heavy chain complementarity determining region 3 for antibody 41650
ARGSLEWYYDGSGYYYAPGDAFDI

SEQ ID NO: 83301 - protein, 9 aa, Homo sapiens
  light chain complementarity determining region 3 for antibody 41651
QQTYSPPFT

SEQ ID NO: 83302 - protein, 14 aa, Homo sapiens
  heavy chain complementarity determining region 3 for antibody 41651
ARGRDTSGYSGLDS

SEQ ID NO: 83303 - protein, 9 aa, Homo sapiens
  light chain complementarity determining region 3 for antibody 41652
QQTYSLPRT

SEQ ID NO: 83304 - protein, 23 aa, Homo sapiens
  heavy chain complementarity determining region 3 for antibody 41652
ATGHPGLGYSSWYRLPQYNWLDP

SEQ ID NO: 83305 - protein, 8 aa, Homo sapiens
  light chain complementarity determining region 3 for antibody 41653
QQTYSALT

SEQ ID NO: 83306 - protein, 14 aa, Homo sapiens
  heavy chain complementarity determining region 3 for antibody 41653
ARRVGAPSKDAFDI

SEQ ID NO: 83307 - protein, 9 aa, Homo sapiens
  light chain complementarity determining region 3 for antibody 41654
QQTYRTPLT

SEQ ID NO: 83308 - protein, 17 aa, Homo sapiens
  heavy chain complementarity determining region 3 for antibody 41654
VRATYFYDRSGYYRFDY

SEQ ID NO: 83309 - protein, 9 aa, Homo sapiens
  light chain complementarity determining region 3 for antibody 41655
QQTYITPLT

SEQ ID NO: 83310 - protein, 17 aa, Homo sapiens
  heavy chain complementarity determining region 3 for antibody 41655
ARDPGIAVAGLVPPIDY

SEQ ID NO: 83311 - protein, 9 aa, Homo sapiens
  light chain complementarity determining region 3 for antibody 41656
QQTFSPPLT

SEQ ID NO: 83312 - protein, 14 aa, Homo sapiens
  heavy chain complementarity determining region 3 for antibody 41656
ATSPRYSWSDVTDY

SEQ ID NO: 83313 - protein, 9 aa, Homo sapiens
  light chain complementarity determining region 3 for antibody 41657
QQSYWAPYT

SEQ ID NO: 83314 - protein, 17 aa, Homo sapiens
  heavy chain complementarity determining region 3 for antibody 41657
ACTPSIAAGGSYWYFDL

SEQ ID NO: 83315 - protein, 9 aa, Homo sapiens
  light chain complementarity determining region 3 for antibody 41658
QQSYSTPYT

SEQ ID NO: 83316 - protein, 20 aa, Homo sapiens
  heavy chain complementarity determining region 3 for antibody 41658
ARGGVAASGRRWGYYYGLDV

SEQ ID NO: 83317 - protein, 9 aa, Homo sapiens
  light chain complementarity determining region 3 for antibody 41659
QQSYSTPYT

SEQ ID NO: 83318 - protein, 14 aa, Homo sapiens
  heavy chain complementarity determining region 3 for antibody 41659
AKARHFDGSGSFDY

SEQ ID NO: 83319 - protein, 9 aa, Homo sapiens
  light chain complementarity determining region 3 for antibody 41660
QQSYSTPWT

SEQ ID NO: 83320 - protein, 15 aa, Homo sapiens
  heavy chain complementarity determining region 3 for antibody 41660
ARWGNDNGDYGRLDF

SEQ ID NO: 83321 - protein, 9 aa, Homo sapiens
  light chain complementarity determining region 3 for antibody 41661
QQSYSTPWT

SEQ ID NO: 83322 - protein, 14 aa, Homo sapiens
  heavy chain complementarity determining region 3 for antibody 41661
ARDVDSSGWFGPDY

SEQ ID NO: 83323 - protein, 9 aa, Homo sapiens
  light chain complementarity determining region 3 for antibody 41662
QQSYSTPRT

SEQ ID NO: 83324 - protein, 14 aa, Homo sapiens
  heavy chain complementarity determining region 3 for antibody 41662
ARGNGRYYYYGMDV

SEQ ID NO: 83325 - protein, 9 aa, Homo sapiens
  light chain complementarity determining region 3 for antibody 41663
QQSYSTPRT

SEQ ID NO: 83326 - protein, 15 aa, Homo sapiens
  heavy chain complementarity determining region 3 for antibody 41663
ARGEVGAGLKYLFDF

SEQ ID NO: 83327 - protein, 9 aa, Homo sapiens
  light chain complementarity determining region 3 for antibody 41664
QQSYSTPPT

SEQ ID NO: 83328 - protein, 12 aa, Homo sapiens
  heavy chain complementarity determining region 3 for antibody 41664
GLKTHNDGAFDV

SEQ ID NO: 83329 - protein, 9 aa, Homo sapiens
  light chain complementarity determining region 3 for antibody 41665
QQSYSTPLT

SEQ ID NO: 83330 - protein, 16 aa, Homo sapiens
  heavy chain complementarity determining region 3 for antibody 41665
AHSTGSGSYYADYFDF

SEQ ID NO: 83331 - protein, 9 aa, Homo sapiens
  light chain complementarity determining region 3 for antibody 41666
QQSYSSPQT

SEQ ID NO: 83332 - protein, 13 aa, Homo sapiens
  heavy chain complementarity determining region 3 for antibody 41666
AQRRIAAAGDFQH

SEQ ID NO: 83333 - protein, 9 aa, Homo sapiens
  light chain complementarity determining region 3 for antibody 41667
QQSYSPSLT

SEQ ID NO: 83334 - protein, 14 aa, Homo sapiens
  heavy chain complementarity determining region 3 for antibody 41667
ARQTPTMIRVGFDC

SEQ ID NO: 83335 - protein, 9 aa, Homo sapiens
  light chain complementarity determining region 3 for antibody 41668
QQSYSFPYS

SEQ ID NO: 83336 - protein, 16 aa, Homo sapiens
  heavy chain complementarity determining region 3 for antibody 41668
ARDNLLGDYSRSACDS

SEQ ID NO: 83337 - protein, 9 aa, Homo sapiens
  light chain complementarity determining region 3 for antibody 41669
QQSYRTPYT

SEQ ID NO: 83338 - protein, 13 aa, Homo sapiens
  heavy chain complementarity determining region 3 for antibody 41669
AGDKHWGINAFDI

SEQ ID NO: 83339 - protein, 9 aa, Homo sapiens
  light chain complementarity determining region 3 for antibody 41670
QQSYKTPWT

SEQ ID NO: 83340 - protein, 12 aa, Homo sapiens
  heavy chain complementarity determining region 3 for antibody 41670
VRVGPSTVTLEY

SEQ ID NO: 83341 - protein, 10 aa, Homo sapiens
  light chain complementarity determining region 3 for antibody 41671
QQSYIKSSIT

SEQ ID NO: 83342 - protein, 15 aa, Homo sapiens
  heavy chain complementarity determining region 3 for antibody 41671
ARYSFDGSYSGSFDY

SEQ ID NO: 83343 - protein, 10 aa, Homo sapiens
  light chain complementarity determining region 3 for antibody 41672
QQSYDTPPIT

SEQ ID NO: 83344 - protein, 11 aa, Homo sapiens
  heavy chain complementarity determining region 3 for antibody 41672
VRVTDSSGPGS

SEQ ID NO: 83345 - protein, 9 aa, Homo sapiens
  light chain complementarity determining region 3 for antibody 41673
QQSHTTPPT

SEQ ID NO: 83346 - protein, 18 aa, Homo sapiens
  heavy chain complementarity determining region 3 for antibody 41673
VQLSGYCRDHGYCPPFGY

SEQ ID NO: 83347 - protein, 9 aa, Homo sapiens
  light chain complementarity determining region 3 for antibody 41674
QQSHSAPLA

SEQ ID NO: 83348 - protein, 14 aa, Homo sapiens
  heavy chain complementarity determining region 3 for antibody 41674
AREERTRSWYYLDS

SEQ ID NO: 83349 - protein, 9 aa, Homo sapiens
  light chain complementarity determining region 3 for antibody 41675
QQSFTSPVT

SEQ ID NO: 83350 - protein, 14 aa, Homo sapiens
  heavy chain complementarity determining region 3 for antibody 41675
GRASTRAEGNWIDP

SEQ ID NO: 83351 - protein, 9 aa, Homo sapiens
  light chain complementarity determining region 3 for antibody 41676
QQSFSTPPT

SEQ ID NO: 83352 - protein, 12 aa, Homo sapiens
  heavy chain complementarity determining region 3 for antibody 41676
AINYYDGSGSFY

SEQ ID NO: 83353 - protein, 9 aa, Homo sapiens
  light chain complementarity determining region 3 for antibody 41677
QQSFRTPLT

SEQ ID NO: 83354 - protein, 19 aa, Homo sapiens
  heavy chain complementarity determining region 3 for antibody 41677
AKEQAGLGFGDYGYWYFDL

SEQ ID NO: 83355 - protein, 9 aa, Homo sapiens
  light chain complementarity determining region 3 for antibody 41678
QQSFGLPRT

SEQ ID NO: 83356 - protein, 23 aa, Homo sapiens
  heavy chain complementarity determining region 3 for antibody 41678
AKAADGSGAFSYSPRRGLVRFDP

SEQ ID NO: 83357 - protein, 9 aa, Homo sapiens
  light chain complementarity determining region 3 for antibody 41679
QQSDSTPIT

SEQ ID NO: 83358 - protein, 17 aa, Homo sapiens
  heavy chain complementarity determining region 3 for antibody 41679
ARDPLRLVTLQGGYFDY

SEQ ID NO: 83359 - protein, 9 aa, Homo sapiens
  light chain complementarity determining region 3 for antibody 41680
QQSDSFPYT

SEQ ID NO: 83360 - protein, 11 aa, Homo sapiens
  heavy chain complementarity determining region 3 for antibody 41680
ARRRTSDWFDD

SEQ ID NO: 83361 - protein, 8 aa, Homo sapiens
  light chain complementarity determining region 3 for antibody 41681
QQRYSSIT

SEQ ID NO: 83362 - protein, 12 aa, Homo sapiens
  heavy chain complementarity determining region 3 for antibody 41681
ARDADSNYDLDY

SEQ ID NO: 83363 - protein, 8 aa, Homo sapiens
  light chain complementarity determining region 3 for antibody 41682
QQRVKWLT

SEQ ID NO: 83364 - protein, 14 aa, Homo sapiens
  heavy chain complementarity determining region 3 for antibody 41682
ARVDIAATGAPFDP

SEQ ID NO: 83365 - protein, 9 aa, Homo sapiens
  light chain complementarity determining region 3 for antibody 41683
QQRSTWLYT

SEQ ID NO: 83366 - protein, 20 aa, Homo sapiens
  heavy chain complementarity determining region 3 for antibody 41683
ARDGSAGMAAVGTPYYGMDV

SEQ ID NO: 83367 - protein, 9 aa, Homo sapiens
  light chain complementarity determining region 3 for antibody 41684
QQRSNWPIT

SEQ ID NO: 83368 - protein, 17 aa, Homo sapiens
  heavy chain complementarity determining region 3 for antibody 41684
AHRRQYYDSSGYSESDY

SEQ ID NO: 83369 - protein, 9 aa, Homo sapiens
  light chain complementarity determining region 3 for antibody 41685
QQRSLWPIT

SEQ ID NO: 83370 - protein, 22 aa, Homo sapiens
  heavy chain complementarity determining region 3 for antibody 41685
ARDWGRGTPHGKMPDYNFGMDV

SEQ ID NO: 83371 - protein, 10 aa, Homo sapiens
  light chain complementarity determining region 3 for antibody 41686
QQRSKWPPWT

SEQ ID NO: 83372 - protein, 14 aa, Homo sapiens
  heavy chain complementarity determining region 3 for antibody 41686
ARDRAMVRGDGIDY

SEQ ID NO: 83373 - protein, 10 aa, Homo sapiens
  light chain complementarity determining region 3 for antibody 41687
QQRSKWPPLP

SEQ ID NO: 83374 - protein, 9 aa, Homo sapiens
  heavy chain complementarity determining region 3 for antibody 41687
ARVDGYFDY

SEQ ID NO: 83375 - protein, 9 aa, Homo sapiens
  light chain complementarity determining region 3 for antibody 41688
QQNFESPWT

SEQ ID NO: 83376 - protein, 18 aa, Homo sapiens
  heavy chain complementarity determining region 3 for antibody 41688
ATDGVYCRAGNCFSEGLA

SEQ ID NO: 83377 - protein, 9 aa, Homo sapiens
  light chain complementarity determining region 3 for antibody 41689
QQLNSYPST

SEQ ID NO: 83378 - protein, 20 aa, Homo sapiens
  heavy chain complementarity determining region 3 for antibody 41689
ARDSGDGSGWYVPAAEYFQY

SEQ ID NO: 83379 - protein, 10 aa, Homo sapiens
  light chain complementarity determining region 3 for antibody 41690
QQLNSYPPLT

SEQ ID NO: 83380 - protein, 10 aa, Homo sapiens
  heavy chain complementarity determining region 3 for antibody 41690
ASRDIAAAVA

SEQ ID NO: 83381 - protein, 9 aa, Homo sapiens
  light chain complementarity determining region 3 for antibody 41691
QQLNSYPLT

SEQ ID NO: 83382 - protein, 12 aa, Homo sapiens
  heavy chain complementarity determining region 3 for antibody 41691
VRDGMHNGNHDF

SEQ ID NO: 83383 - protein, 10 aa, Homo sapiens
  light chain complementarity determining region 3 for antibody 41692
QQLNSYPLFT

SEQ ID NO: 83384 - protein, 11 aa, Homo sapiens
  heavy chain complementarity determining region 3 for antibody 41692
ALMALEYYLDF

SEQ ID NO: 83385 - protein, 9 aa, Homo sapiens
  light chain complementarity determining region 3 for antibody 41693
QQHDRSALT

SEQ ID NO: 83386 - protein, 15 aa, Homo sapiens
  heavy chain complementarity determining region 3 for antibody 41693
ARSRGHLVATILPEY

SEQ ID NO: 83387 - protein, 9 aa, Homo sapiens
  light chain complementarity determining region 3 for antibody 41694
QQHDNLPLT

SEQ ID NO: 83388 - protein, 19 aa, Homo sapiens
  heavy chain complementarity determining region 3 for antibody 41694
ARHLLRGIAADGPKGWFDP

SEQ ID NO: 83389 - protein, 9 aa, Homo sapiens
  light chain complementarity determining region 3 for antibody 41695
QQGYSTPYT

SEQ ID NO: 83390 - protein, 13 aa, Homo sapiens
  heavy chain complementarity determining region 3 for antibody 41695
AREVFMKTPAFGL

SEQ ID NO: 83391 - protein, 9 aa, Homo sapiens
  light chain complementarity determining region 3 for antibody 41696
QQGYSAPLT

SEQ ID NO: 83392 - protein, 15 aa, Homo sapiens
  heavy chain complementarity determining region 3 for antibody 41696
VHSGSAYYNLDAFDI

SEQ ID NO: 83393 - protein, 9 aa, Homo sapiens
  light chain complementarity determining region 3 for antibody 41697
QQGYNFPIT

SEQ ID NO: 83394 - protein, 14 aa, Homo sapiens
  heavy chain complementarity determining region 3 for antibody 41697
ARRWGAGTYDVFHI

SEQ ID NO: 83395 - protein, 9 aa, Homo sapiens
  light chain complementarity determining region 3 for antibody 41698
QQGTSFPLT

SEQ ID NO: 83396 - protein, 14 aa, Homo sapiens
  heavy chain complementarity determining region 3 for antibody 41698
ARVRYASGTYYTES

SEQ ID NO: 83397 - protein, 11 aa, Homo sapiens
  light chain complementarity determining region 3 for antibody 41699
QQFHDLPRGLT

SEQ ID NO: 83398 - protein, 17 aa, Homo sapiens
  heavy chain complementarity determining region 3 for antibody 41699
VRDAFGGTRASRSKFDY

SEQ ID NO: 83399 - protein, 9 aa, Homo sapiens
  light chain complementarity determining region 3 for antibody 41700
QQFEISPYT

SEQ ID NO: 83400 - protein, 11 aa, Homo sapiens
  heavy chain complementarity determining region 3 for antibody 41700
ARVGTVRSFDY

SEQ ID NO: 83401 - protein, 9 aa, Homo sapiens
  light chain complementarity determining region 3 for antibody 41701
QQFDSLPIT

SEQ ID NO: 83402 - protein, 20 aa, Homo sapiens
  heavy chain complementarity determining region 3 for antibody 41701
ATLRRERQQLVPGLRDPFDI

SEQ ID NO: 83403 - protein, 10 aa, Homo sapiens
  light chain complementarity determining region 3 for antibody 41702
QQFDNLPMFT

SEQ ID NO: 83404 - protein, 15 aa, Homo sapiens
  heavy chain complementarity determining region 3 for antibody 41702
ARELDSGFYYDAFDI

SEQ ID NO: 83405 - protein, 9 aa, Homo sapiens
  light chain complementarity determining region 3 for antibody 41703
QQFDNLPLT

SEQ ID NO: 83406 - protein, 15 aa, Homo sapiens
  heavy chain complementarity determining region 3 for antibody 41703
ARGSSFRGARGWFDP

SEQ ID NO: 83407 - protein, 9 aa, Homo sapiens
  light chain complementarity determining region 3 for antibody 41704
QQDSNFPVT

SEQ ID NO: 83408 - protein, 14 aa, Homo sapiens
  heavy chain complementarity determining region 3 for antibody 41704
ARDHGRSFDSAFDV

SEQ ID NO: 83409 - protein, 9 aa, Homo sapiens
  light chain complementarity determining region 3 for antibody 41705
QQATSFPLT

SEQ ID NO: 83410 - protein, 14 aa, Homo sapiens
  heavy chain complementarity determining region 3 for antibody 41705
ARETTTIGQYYFDY

SEQ ID NO: 83411 - protein, 9 aa, Homo sapiens
  light chain complementarity determining region 3 for antibody 41706
QQANSYPLT

SEQ ID NO: 83412 - protein, 14 aa, Homo sapiens
  heavy chain complementarity determining region 3 for antibody 41706
TRGRIDYGYSSFDY

SEQ ID NO: 83413 - protein, 9 aa, Homo sapiens
  light chain complementarity determining region 3 for antibody 41707
QQANSFPYT

SEQ ID NO: 83414 - protein, 8 aa, Homo sapiens
  heavy chain complementarity determining region 3 for antibody 41707
ARGPGVGY

SEQ ID NO: 83415 - protein, 9 aa, Homo sapiens
  light chain complementarity determining region 3 for antibody 41708
QQANSFPLT

SEQ ID NO: 83416 - protein, 18 aa, Homo sapiens
  heavy chain complementarity determining region 3 for antibody 41708
MINPYYYGAWNYKGDFDI

SEQ ID NO: 83417 - protein, 9 aa, Homo sapiens
  light chain complementarity determining region 3 for antibody 41709
QQANSFPIT

SEQ ID NO: 83418 - protein, 16 aa, Homo sapiens
  heavy chain complementarity determining region 3 for antibody 41709
ARVSGDKRLGVYWFDP

SEQ ID NO: 83419 - protein, 9 aa, Homo sapiens
  light chain complementarity determining region 3 for antibody 41710
QQANSFPIT

SEQ ID NO: 83420 - protein, 18 aa, Homo sapiens
  heavy chain complementarity determining region 3 for antibody 41710
ARSVSYIVSRFAGAYFDY

SEQ ID NO: 83421 - protein, 9 aa, Homo sapiens
  light chain complementarity determining region 3 for antibody 41711
QQANSFPIT

SEQ ID NO: 83422 - protein, 15 aa, Homo sapiens
  heavy chain complementarity determining region 3 for antibody 41711
ARDRLYSGQYNWLDP

SEQ ID NO: 83423 - protein, 9 aa, Homo sapiens
  light chain complementarity determining region 3 for antibody 41712
QQANSFPIT

SEQ ID NO: 83424 - protein, 17 aa, Homo sapiens
  heavy chain complementarity determining region 3 for antibody 41712
AHRRQYYDSSGYSESDY

SEQ ID NO: 83425 - protein, 9 aa, Homo sapiens
  light chain complementarity determining region 3 for antibody 41713
QQANSFPFT

SEQ ID NO: 83426 - protein, 15 aa, Homo sapiens
  heavy chain complementarity determining region 3 for antibody 41713
ARPVEMATRRLFFDY

SEQ ID NO: 83427 - protein, 9 aa, Homo sapiens
  light chain complementarity determining region 3 for antibody 41714
QQAKSFPFT

SEQ ID NO: 83428 - protein, 11 aa, Homo sapiens
  heavy chain complementarity determining region 3 for antibody 41714
ATDVYGGYSDY

SEQ ID NO: 83429 - protein, 9 aa, Homo sapiens
  light chain complementarity determining region 3 for antibody 41715
QNYDSAPWT

SEQ ID NO: 83430 - protein, 14 aa, Homo sapiens
  heavy chain complementarity determining region 3 for antibody 41715
ARYISRAAVSRFDF

SEQ ID NO: 83431 - protein, 9 aa, Homo sapiens
  light chain complementarity determining region 3 for antibody 41716
QNYDDAPWT

SEQ ID NO: 83432 - protein, 16 aa, Homo sapiens
  heavy chain complementarity determining region 3 for antibody 41716
AKKGGPVKATGNYFDL

SEQ ID NO: 83433 - protein, 9 aa, Homo sapiens
  light chain complementarity determining region 3 for antibody 41717
QLRSNWLWT

SEQ ID NO: 83434 - protein, 20 aa, Homo sapiens
  heavy chain complementarity determining region 3 for antibody 41717
ATTDLHFYDNSGFYYGWFDP

SEQ ID NO: 83435 - protein, 10 aa, Homo sapiens
  light chain complementarity determining region 3 for antibody 41718
QKYNSGPPIT

SEQ ID NO: 83436 - protein, 14 aa, Homo sapiens
  heavy chain complementarity determining region 3 for antibody 41718
ARDQTRVGPTTFDF

SEQ ID NO: 83437 - protein, 9 aa, Homo sapiens
  light chain complementarity determining region 3 for antibody 41719
QKYNGAPWT

SEQ ID NO: 83438 - protein, 13 aa, Homo sapiens
  heavy chain complementarity determining region 3 for antibody 41719
AKDRHRVAGYFDY

SEQ ID NO: 83439 - protein, 9 aa, Homo sapiens
  light chain complementarity determining region 3 for antibody 41720
QKYDSAPLT

SEQ ID NO: 83440 - protein, 16 aa, Homo sapiens
  heavy chain complementarity determining region 3 for antibody 41720
AITYHDILTGSGWFDP

SEQ ID NO: 83441 - protein, 9 aa, Homo sapiens
  light chain complementarity determining region 3 for antibody 41721
QKLDAVPCT

SEQ ID NO: 83442 - protein, 15 aa, Homo sapiens
  heavy chain complementarity determining region 3 for antibody 41721
TRRGDLDGDTSGCDS

SEQ ID NO: 83443 - protein, 9 aa, Homo sapiens
  light chain complementarity determining region 3 for antibody 41722
QHYNDYPYT

SEQ ID NO: 83444 - protein, 18 aa, Homo sapiens
  heavy chain complementarity determining region 3 for antibody 41722
VRDFAYCGGDCYSGFFDY

SEQ ID NO: 83445 - protein, 10 aa, Homo sapiens
  light chain complementarity determining region 3 for antibody 41723
QHYGVSSRYT

SEQ ID NO: 83446 - protein, 12 aa, Homo sapiens
  heavy chain complementarity determining region 3 for antibody 41723
ARDAVGATASDY

SEQ ID NO: 83447 - protein, 11 aa, Homo sapiens
  light chain complementarity determining region 3 for antibody 41724
QHYGTSPPAYT

SEQ ID NO: 83448 - protein, 15 aa, Homo sapiens
  heavy chain complementarity determining region 3 for antibody 41724
AREVTSMIEPGGLDI

SEQ ID NO: 83449 - protein, 9 aa, Homo sapiens
  light chain complementarity determining region 3 for antibody 41725
QHYGGSPWT

SEQ ID NO: 83450 - protein, 13 aa, Homo sapiens
  heavy chain complementarity determining region 3 for antibody 41725
ARDRLGFGNFFDV

SEQ ID NO: 83451 - protein, 8 aa, Homo sapiens
  light chain complementarity determining region 3 for antibody 41726
QHYDNLPS

SEQ ID NO: 83452 - protein, 13 aa, Homo sapiens
  heavy chain complementarity determining region 3 for antibody 41726
TIDYYNPSGDFDY

SEQ ID NO: 83453 - protein, 9 aa, Homo sapiens
  light chain complementarity determining region 3 for antibody 41727
QHYDNLPGT

SEQ ID NO: 83454 - protein, 14 aa, Homo sapiens
  heavy chain complementarity determining region 3 for antibody 41727
ARKLFVRTAAEFDY

SEQ ID NO: 83455 - protein, 9 aa, Homo sapiens
  light chain complementarity determining region 3 for antibody 41728
QHYAGSPRT

SEQ ID NO: 83456 - protein, 16 aa, Homo sapiens
  heavy chain complementarity determining region 3 for antibody 41728
AKDPLFFDWYNDVFDI

SEQ ID NO: 83457 - protein, 9 aa, Homo sapiens
  light chain complementarity determining region 3 for antibody 41729
QHSYNPLWT

SEQ ID NO: 83458 - protein, 20 aa, Homo sapiens
  heavy chain complementarity determining region 3 for antibody 41729
ARSSPPGDFFDRSGFYYLDY

SEQ ID NO: 83459 - protein, 12 aa, Homo sapiens
  light chain complementarity determining region 3 for antibody 41730
QHRSNWPPGPLP

SEQ ID NO: 83460 - protein, 15 aa, Homo sapiens
  heavy chain complementarity determining region 3 for antibody 41730
VKDSSGWYWDDVFDV

SEQ ID NO: 83461 - protein, 10 aa, Homo sapiens
  light chain complementarity determining region 3 for antibody 41731
QERSNWPVVT

SEQ ID NO: 83462 - protein, 23 aa, Homo sapiens
  heavy chain complementarity determining region 3 for antibody 41731
ARGRTYYFDGSGYPDYYFYLMDV

SEQ ID NO: 83463 - protein, 9 aa, Homo sapiens
  light chain complementarity determining region 3 for antibody 41732
PQHDHFPRT

SEQ ID NO: 83464 - protein, 15 aa, Homo sapiens
  heavy chain complementarity determining region 3 for antibody 41732
ARERRAGRFYYGMDV

SEQ ID NO: 83465 - protein, 9 aa, Homo sapiens
  light chain complementarity determining region 3 for antibody 41733
MQVLQTPYT

SEQ ID NO: 83466 - protein, 5 aa, Homo sapiens
  heavy chain complementarity determining region 3 for antibody 41733
TRQGL

SEQ ID NO: 83467 - protein, 9 aa, Homo sapiens
  light chain complementarity determining region 3 for antibody 41734
MQTLQTPLT

SEQ ID NO: 83468 - protein, 11 aa, Homo sapiens
  heavy chain complementarity determining region 3 for antibody 41734
ARTHWQQEVRD

SEQ ID NO: 83469 - protein, 9 aa, Homo sapiens
  light chain complementarity determining region 3 for antibody 41735
MQGVHIPPT

SEQ ID NO: 83470 - protein, 13 aa, Homo sapiens
  heavy chain complementarity determining region 3 for antibody 41735
AKDIEGTSVWLDY

SEQ ID NO: 83471 - protein, 10 aa, Homo sapiens
  light chain complementarity determining region 3 for antibody 41736
MQGTHWPPGT

SEQ ID NO: 83472 - protein, 10 aa, Homo sapiens
  heavy chain complementarity determining region 3 for antibody 41736
VKGVPADWGI

SEQ ID NO: 83473 - protein, 9 aa, Homo sapiens
  light chain complementarity determining region 3 for antibody 41737
MQGIHWPLT

SEQ ID NO: 83474 - protein, 15 aa, Homo sapiens
  heavy chain complementarity determining region 3 for antibody 41737
TRPYSGYDPRDIFDI

SEQ ID NO: 83475 - protein, 9 aa, Homo sapiens
  light chain complementarity determining region 3 for antibody 41738
MQATYWPFT

SEQ ID NO: 83476 - protein, 14 aa, Homo sapiens
  heavy chain complementarity determining region 3 for antibody 41738
ARHEGKGGGYHFQH

SEQ ID NO: 83477 - protein, 9 aa, Homo sapiens
  light chain complementarity determining region 3 for antibody 41739
MQALQTRLT

SEQ ID NO: 83478 - protein, 19 aa, Homo sapiens
  heavy chain complementarity determining region 3 for antibody 41739
GRDRRGLAGGVGGAGGMDV

SEQ ID NO: 83479 - protein, 9 aa, Homo sapiens
  light chain complementarity determining region 3 for antibody 41740
MQALQTPFT

SEQ ID NO: 83480 - protein, 15 aa, Homo sapiens
  heavy chain complementarity determining region 3 for antibody 41740
ARDQDEAVPGRYFDF

SEQ ID NO: 83481 - protein, 9 aa, Homo sapiens
  light chain complementarity determining region 3 for antibody 41741
LQYNNYPRT

SEQ ID NO: 83482 - protein, 18 aa, Homo sapiens
  heavy chain complementarity determining region 3 for antibody 41741
ARDAGNYYYDTSGPYFDY

SEQ ID NO: 83483 - protein, 9 aa, Homo sapiens
  light chain complementarity determining region 3 for antibody 41742
LQTYTPPWT

SEQ ID NO: 83484 - protein, 18 aa, Homo sapiens
  heavy chain complementarity determining region 3 for antibody 41742
TTDEDYYDDSGDWIRGDY

SEQ ID NO: 83485 - protein, 9 aa, Homo sapiens
  light chain complementarity determining region 3 for antibody 41743
LQHNTYPYT

SEQ ID NO: 83486 - protein, 15 aa, Homo sapiens
  heavy chain complementarity determining region 3 for antibody 41743
ATPLGYASAWYRFDF

SEQ ID NO: 83487 - protein, 9 aa, Homo sapiens
  light chain complementarity determining region 3 for antibody 41744
LQHNTYPFT

SEQ ID NO: 83488 - protein, 17 aa, Homo sapiens
  heavy chain complementarity determining region 3 for antibody 41744
AKDRRDVSYYAPDAFDI

SEQ ID NO: 83489 - protein, 9 aa, Homo sapiens
  light chain complementarity determining region 3 for antibody 41745
LQHNSYPYT

SEQ ID NO: 83490 - protein, 15 aa, Homo sapiens
  heavy chain complementarity determining region 3 for antibody 41745
AREMGVAAGFNSFDY

SEQ ID NO: 83491 - protein, 9 aa, Homo sapiens
  light chain complementarity determining region 3 for antibody 41746
LQGTHWPYT

SEQ ID NO: 83492 - protein, 14 aa, Homo sapiens
  heavy chain complementarity determining region 3 for antibody 41746
ALVGSGRTHNSLDY

SEQ ID NO: 83493 - protein, 9 aa, Homo sapiens
  light chain complementarity determining region 3 for antibody 41747
LQDYNYPLT

SEQ ID NO: 83494 - protein, 18 aa, Homo sapiens
  heavy chain complementarity determining region 3 for antibody 41747
ARHVLSVGFRSSWFGFDY

SEQ ID NO: 83495 - protein, 9 aa, Homo sapiens
  light chain complementarity determining region 3 for antibody 41748
LQDYHYPQT

SEQ ID NO: 83496 - protein, 11 aa, Homo sapiens
  heavy chain complementarity determining region 3 for antibody 41748
ARDSRTSGMDV

SEQ ID NO: 83497 - protein, 9 aa, Homo sapiens
  light chain complementarity determining region 3 for antibody 41749
LHHYSFPRT

SEQ ID NO: 83498 - protein, 8 aa, Homo sapiens
  heavy chain complementarity determining region 3 for antibody 41749
ADIGSGIS

SEQ ID NO: 83499 - protein, 9 aa, Homo sapiens
  light chain complementarity determining region 3 for antibody 41750
LHHSVYPLS

SEQ ID NO: 83500 - protein, 10 aa, Homo sapiens
  heavy chain complementarity determining region 3 for antibody 41750
ARSQSGSLDF

SEQ ID NO: 83501 - protein, 8 aa, Homo sapiens
  light chain complementarity determining region 3 for antibody 41751
KQYNSYWT

SEQ ID NO: 83502 - protein, 16 aa, Homo sapiens
  heavy chain complementarity determining region 3 for antibody 41751
AKEFGSGSFGRRDFDS

SEQ ID NO: 83503 - protein, 9 aa, Homo sapiens
  light chain complementarity determining region 3 for antibody 41752
KQYGSSLWT

SEQ ID NO: 83504 - protein, 21 aa, Homo sapiens
  heavy chain complementarity determining region 3 for antibody 41752
AKDHTSYSDGSGYYRADYFHH

SEQ ID NO: 83505 - protein, 8 aa, Homo sapiens
  light chain complementarity determining region 3 for antibody 41753
HQYVTSHT

SEQ ID NO: 83506 - protein, 17 aa, Homo sapiens
  heavy chain complementarity determining region 3 for antibody 41753
ARVTSDYGLGSQGRFDY

SEQ ID NO: 83507 - protein, 9 aa, Homo sapiens
  light chain complementarity determining region 3 for antibody 41754
HQYSSSPWT

SEQ ID NO: 83508 - protein, 12 aa, Homo sapiens
  heavy chain complementarity determining region 3 for antibody 41754
ARPSNGYGGFDI

SEQ ID NO: 83509 - protein, 9 aa, Homo sapiens
  light chain complementarity determining region 3 for antibody 41755
HQSYSPPFT

SEQ ID NO: 83510 - protein, 14 aa, Homo sapiens
  heavy chain complementarity determining region 3 for antibody 41755
ARSYDTSGYSGFDY

SEQ ID NO: 83511 - protein, 9 aa, Homo sapiens
  light chain complementarity determining region 3 for antibody 41756
HQSSTLPQT

SEQ ID NO: 83512 - protein, 15 aa, Homo sapiens
  heavy chain complementarity determining region 3 for antibody 41756
GIVSGNRGWSDAFHI

SEQ ID NO: 83513 - protein, 11 aa, Homo sapiens
  light chain complementarity determining region 3 for antibody 41757
HQSSSLPHTIT

SEQ ID NO: 83514 - protein, 14 aa, Homo sapiens
  heavy chain complementarity determining region 3 for antibody 41757
ARHWGSSLLDPPSD

SEQ ID NO: 83515 - protein, 9 aa, Homo sapiens
  light chain complementarity determining region 3 for antibody 41758
HQSDSFPWT

SEQ ID NO: 83516 - protein, 14 aa, Homo sapiens
  heavy chain complementarity determining region 3 for antibody 41758
ARVTSTIIIDLLDY

SEQ ID NO: 83517 - protein, 9 aa, Homo sapiens
  light chain complementarity determining region 3 for antibody 41759
HQRYNWPLT

SEQ ID NO: 83518 - protein, 13 aa, Homo sapiens
  heavy chain complementarity determining region 3 for antibody 41759
ARVNRMAARYFDL

SEQ ID NO: 83519 - protein, 9 aa, Homo sapiens
  light chain complementarity determining region 3 for antibody 41760
HQRYAWPLT

SEQ ID NO: 83520 - protein, 13 aa, Homo sapiens
  heavy chain complementarity determining region 3 for antibody 41760
ARDFQSDGYYSDP

SEQ ID NO: 83521 - protein, 9 aa, Homo sapiens
  light chain complementarity determining region 3 for antibody 41761
HQGYSTPFT

SEQ ID NO: 83522 - protein, 15 aa, Homo sapiens
  heavy chain complementarity determining region 3 for antibody 41761
AKAQVIWGQLYYFES

SEQ ID NO: 83523 - protein, 10 aa, Homo sapiens
  light chain complementarity determining region 3 for antibody 41762
QYYDRSPLYT

SEQ ID NO: 83524 - protein, 16 aa, Homo sapiens
  heavy chain complementarity determining region 3 for antibody 41762
TKEQQWLGRTGTGFNY

SEQ ID NO: 83525 - protein, 9 aa, Homo sapiens
  light chain complementarity determining region 3 for antibody 41763
QQYYSYPLT

SEQ ID NO: 83526 - protein, 13 aa, Homo sapiens
  heavy chain complementarity determining region 3 for antibody 41763
ARSRDGYNFPFDH

SEQ ID NO: 83527 - protein, 9 aa, Homo sapiens
  light chain complementarity determining region 3 for antibody 41764
QQYVSSPWT

SEQ ID NO: 83528 - protein, 13 aa, Homo sapiens
  heavy chain complementarity determining region 3 for antibody 41764
ARAESWSGRLFDY

SEQ ID NO: 83529 - protein, 9 aa, Homo sapiens
  light chain complementarity determining region 3 for antibody 41765
QQYSSYSWT

SEQ ID NO: 83530 - protein, 9 aa, Homo sapiens
  heavy chain complementarity determining region 3 for antibody 41765
ARGAYYFDY

SEQ ID NO: 83531 - protein, 8 aa, Homo sapiens
  light chain complementarity determining region 3 for antibody 41766
QQYSSYFT

SEQ ID NO: 83532 - protein, 13 aa, Homo sapiens
  heavy chain complementarity determining region 3 for antibody 41766
VKEYSGYDSYFDY

SEQ ID NO: 83533 - protein, 10 aa, Homo sapiens
  light chain complementarity determining region 3 for antibody 41767
QQYSSWPVLT

SEQ ID NO: 83534 - protein, 13 aa, Homo sapiens
  heavy chain complementarity determining region 3 for antibody 41767
ARLGPLSYGYLDS

SEQ ID NO: 83535 - protein, 9 aa, Homo sapiens
  light chain complementarity determining region 3 for antibody 41768
QQYSSFPYT

SEQ ID NO: 83536 - protein, 14 aa, Homo sapiens
  heavy chain complementarity determining region 3 for antibody 41768
VRDHGYDSRNAFDI

SEQ ID NO: 83537 - protein, 9 aa, Homo sapiens
  light chain complementarity determining region 3 for antibody 41769
QQYSRSPQT

SEQ ID NO: 83538 - protein, 15 aa, Homo sapiens
  heavy chain complementarity determining region 3 for antibody 41769
ASNPTFDDSSGYIPY

SEQ ID NO: 83539 - protein, 9 aa, Homo sapiens
  light chain complementarity determining region 3 for antibody 41770
QQYSNSPRT

SEQ ID NO: 83540 - protein, 13 aa, Homo sapiens
  heavy chain complementarity determining region 3 for antibody 41770
AGHQQTWGGLISP

SEQ ID NO: 83541 - protein, 9 aa, Homo sapiens
  light chain complementarity determining region 3 for antibody 41771
QQYNTYSGA

SEQ ID NO: 83542 - protein, 13 aa, Homo sapiens
  heavy chain complementarity determining region 3 for antibody 41771
ARVRNGGLSYFDR

SEQ ID NO: 83543 - protein, 10 aa, Homo sapiens
  light chain complementarity determining region 3 for antibody 41772
QQYNTWPPWT

SEQ ID NO: 83544 - protein, 13 aa, Homo sapiens
  heavy chain complementarity determining region 3 for antibody 41772
AKDLATVITAFDV

SEQ ID NO: 83545 - protein, 9 aa, Homo sapiens
  light chain complementarity determining region 3 for antibody 41773
QQYNTFSWA

SEQ ID NO: 83546 - protein, 18 aa, Homo sapiens
  heavy chain complementarity determining region 3 for antibody 41773
ARDNIGRVDSARKWYFDL

SEQ ID NO: 83547 - protein, 8 aa, Homo sapiens
  light chain complementarity determining region 3 for antibody 41774
QQYNSYWT

SEQ ID NO: 83548 - protein, 15 aa, Homo sapiens
  heavy chain complementarity determining region 3 for antibody 41774
AHRRLSSNWYGLFDF

SEQ ID NO: 83549 - protein, 9 aa, Homo sapiens
  light chain complementarity determining region 3 for antibody 41775
QQYNSYSYT

SEQ ID NO: 83550 - protein, 15 aa, Homo sapiens
  heavy chain complementarity determining region 3 for antibody 41775
AKDFRYYGLVPAFDY

SEQ ID NO: 83551 - protein, 9 aa, Homo sapiens
  light chain complementarity determining region 3 for antibody 41776
QQYNSYSGT

SEQ ID NO: 83552 - protein, 13 aa, Homo sapiens
  heavy chain complementarity determining region 3 for antibody 41776
ARLGGTYSDAFDV

SEQ ID NO: 83553 - protein, 9 aa, Homo sapiens
  light chain complementarity determining region 3 for antibody 41777
QQYNSYPYT

SEQ ID NO: 83554 - protein, 14 aa, Homo sapiens
  heavy chain complementarity determining region 3 for antibody 41777
AADPRGYSGYSGGV

SEQ ID NO: 83555 - protein, 9 aa, Homo sapiens
  light chain complementarity determining region 3 for antibody 41778
QQYNSYPWT

SEQ ID NO: 83556 - protein, 18 aa, Homo sapiens
  heavy chain complementarity determining region 3 for antibody 41778
TRDLGYASGWYFQAYFQH

SEQ ID NO: 83557 - protein, 9 aa, Homo sapiens
  light chain complementarity determining region 3 for antibody 41779
QQYNSYPWT

SEQ ID NO: 83558 - protein, 5 aa, Homo sapiens
  heavy chain complementarity determining region 3 for antibody 41779
ARDFS

SEQ ID NO: 83559 - protein, 10 aa, Homo sapiens
  light chain complementarity determining region 3 for antibody 41780
QQYNSYPSWT

SEQ ID NO: 83560 - protein, 17 aa, Homo sapiens
  heavy chain complementarity determining region 3 for antibody 41780
ARGAERKILVTAAPFDF

SEQ ID NO: 83561 - protein, 9 aa, Homo sapiens
  light chain complementarity determining region 3 for antibody 41781
QQYNSYPPT

SEQ ID NO: 83562 - protein, 19 aa, Homo sapiens
  heavy chain complementarity determining region 3 for antibody 41781
ATVSGVTTKYNFYQYGMDV

SEQ ID NO: 83563 - protein, 9 aa, Homo sapiens
  light chain complementarity determining region 3 for antibody 41782
QQYNSYPLT

SEQ ID NO: 83564 - protein, 15 aa, Homo sapiens
  heavy chain complementarity determining region 3 for antibody 41782
AKYRGSSAHYSPFDC

SEQ ID NO: 83565 - protein, 9 aa, Homo sapiens
  light chain complementarity determining region 3 for antibody 41783
QQYNSYPHT

SEQ ID NO: 83566 - protein, 9 aa, Homo sapiens
  heavy chain complementarity determining region 3 for antibody 41783
ARDLPTPDY

SEQ ID NO: 83567 - protein, 8 aa, Homo sapiens
  light chain complementarity determining region 3 for antibody 41784
QQYNSPVT

SEQ ID NO: 83568 - protein, 15 aa, Homo sapiens
  heavy chain complementarity determining region 3 for antibody 41784
ARDILRSGPMVSLDY

SEQ ID NO: 83569 - protein, 10 aa, Homo sapiens
  light chain complementarity determining region 3 for antibody 41785
QQYNSNSIYT

SEQ ID NO: 83570 - protein, 16 aa, Homo sapiens
  heavy chain complementarity determining region 3 for antibody 41785
AREGEGAYGEDEYFHH

SEQ ID NO: 83571 - protein, 6 aa, Homo sapiens
  light chain complementarity determining region 3 for antibody 41786
QQYNSG

SEQ ID NO: 83572 - protein, 11 aa, Homo sapiens
  heavy chain complementarity determining region 3 for antibody 41786
AHVDMAMLTKG

SEQ ID NO: 83573 - protein, 9 aa, Homo sapiens
  light chain complementarity determining region 3 for antibody 41787
QQYNSDPWT

SEQ ID NO: 83574 - protein, 17 aa, Homo sapiens
  heavy chain complementarity determining region 3 for antibody 41787
ARGAVAGFQWFGDHFDY

SEQ ID NO: 83575 - protein, 10 aa, Homo sapiens
  light chain complementarity determining region 3 for antibody 41788
QQYNNWPPVT

SEQ ID NO: 83576 - protein, 10 aa, Homo sapiens
  heavy chain complementarity determining region 3 for antibody 41788
AKDDLGILDS

SEQ ID NO: 83577 - protein, 11 aa, Homo sapiens
  light chain complementarity determining region 3 for antibody 41789
QQYKSYSPGLT

SEQ ID NO: 83578 - protein, 12 aa, Homo sapiens
  heavy chain complementarity determining region 3 for antibody 41789
AKPLPASAYFDY

SEQ ID NO: 83579 - protein, 9 aa, Homo sapiens
  light chain complementarity determining region 3 for antibody 41790
QQYIAFPFT

SEQ ID NO: 83580 - protein, 14 aa, Homo sapiens
  heavy chain complementarity determining region 3 for antibody 41790
ARAPYSNLMTTQEW

SEQ ID NO: 83581 - protein, 9 aa, Homo sapiens
  light chain complementarity determining region 3 for antibody 41791
QQYHSNPVT

SEQ ID NO: 83582 - protein, 18 aa, Homo sapiens
  heavy chain complementarity determining region 3 for antibody 41791
ARDGVGAFGGNYYYAMDV

SEQ ID NO: 83583 - protein, 9 aa, Homo sapiens
  light chain complementarity determining region 3 for antibody 41792
QQYGTSSWT

SEQ ID NO: 83584 - protein, 16 aa, Homo sapiens
  heavy chain complementarity determining region 3 for antibody 41792
ARNGRTCSRGICSCDY

SEQ ID NO: 83585 - protein, 9 aa, Homo sapiens
  light chain complementarity determining region 3 for antibody 41793
QQYGTSPYT

SEQ ID NO: 83586 - protein, 16 aa, Homo sapiens
  heavy chain complementarity determining region 3 for antibody 41793
ARARWLQSSPNWSFDL

SEQ ID NO: 83587 - protein, 9 aa, Homo sapiens
  light chain complementarity determining region 3 for antibody 41794
QQYGTSPWT

SEQ ID NO: 83588 - protein, 17 aa, Homo sapiens
  heavy chain complementarity determining region 3 for antibody 41794
ARTGEHNVIVVMQYFNY

SEQ ID NO: 83589 - protein, 9 aa, Homo sapiens
  light chain complementarity determining region 3 for antibody 41795
QQYGSSPYT

SEQ ID NO: 83590 - protein, 14 aa, Homo sapiens
  heavy chain complementarity determining region 3 for antibody 41795
ARLHSSGYFVQFDY

SEQ ID NO: 83591 - protein, 9 aa, Homo sapiens
  light chain complementarity determining region 3 for antibody 41796
QQYGSSPVT

SEQ ID NO: 83592 - protein, 24 aa, Homo sapiens
  heavy chain complementarity determining region 3 for antibody 41796
ARQPRVTVSQGPKRVYFYYYGMDV

SEQ ID NO: 83593 - protein, 10 aa, Homo sapiens
  light chain complementarity determining region 3 for antibody 41797
QQYGSSPPYT

SEQ ID NO: 83594 - protein, 19 aa, Homo sapiens
  heavy chain complementarity determining region 3 for antibody 41797
ARDIFPRTIAAAGMNVFDI

SEQ ID NO: 83595 - protein, 9 aa, Homo sapiens
  light chain complementarity determining region 3 for antibody 41798
QQYGSSPLT

SEQ ID NO: 83596 - protein, 9 aa, Homo sapiens
  heavy chain complementarity determining region 3 for antibody 41798
ASALGYTAI

SEQ ID NO: 83597 - protein, 9 aa, Homo sapiens
  light chain complementarity determining region 3 for antibody 41799
QQYGSSPLA

SEQ ID NO: 83598 - protein, 13 aa, Homo sapiens
  heavy chain complementarity determining region 3 for antibody 41799
ARDGDGNGIDFDY

SEQ ID NO: 83599 - protein, 9 aa, Homo sapiens
  light chain complementarity determining region 3 for antibody 41800
QQYGSSPGT

SEQ ID NO: 83600 - protein, 12 aa, Homo sapiens
  heavy chain complementarity determining region 3 for antibody 41800
ARQFYYGHAFDI

SEQ ID NO: 83601 - protein, 8 aa, Homo sapiens
  light chain complementarity determining region 3 for antibody 41801
QQYGSSLT

SEQ ID NO: 83602 - protein, 12 aa, Homo sapiens
  heavy chain complementarity determining region 3 for antibody 41801
ARDNPDWLAVDY

SEQ ID NO: 83603 - protein, 8 aa, Homo sapiens
  light chain complementarity determining region 3 for antibody 41802
QQYGSLVT

SEQ ID NO: 83604 - protein, 13 aa, Homo sapiens
  heavy chain complementarity determining region 3 for antibody 41802
ARQPGYSSSWFDY

SEQ ID NO: 83605 - protein, 9 aa, Homo sapiens
  light chain complementarity determining region 3 for antibody 41803
QQYGRSPRT

SEQ ID NO: 83606 - protein, 13 aa, Homo sapiens
  heavy chain complementarity determining region 3 for antibody 41803
ASAGDLVPYCFDI

SEQ ID NO: 83607 - protein, 9 aa, Homo sapiens
  light chain complementarity determining region 3 for antibody 41804
QQYGRSPNT

SEQ ID NO: 83608 - protein, 13 aa, Homo sapiens
  heavy chain complementarity determining region 3 for antibody 41804
ATGLDIVSTGLDF

SEQ ID NO: 83609 - protein, 9 aa, Homo sapiens
  light chain complementarity determining region 3 for antibody 41805
QQYGNSPLT

SEQ ID NO: 83610 - protein, 12 aa, Homo sapiens
  heavy chain complementarity determining region 3 for antibody 41805
ARDVSAPAKTDY

SEQ ID NO: 83611 - protein, 9 aa, Homo sapiens
  light chain complementarity determining region 3 for antibody 41806
QQYGKSPLT

SEQ ID NO: 83612 - protein, 21 aa, Homo sapiens
  heavy chain complementarity determining region 3 for antibody 41806
ARGLPILRFLESFLRAPYFDY

SEQ ID NO: 83613 - protein, 10 aa, Homo sapiens
  light chain complementarity determining region 3 for antibody 41807
QQYGGSPTWT

SEQ ID NO: 83614 - protein, 17 aa, Homo sapiens
  heavy chain complementarity determining region 3 for antibody 41807
ARAPTGLYGNGYWYFGV

SEQ ID NO: 83615 - protein, 11 aa, Homo sapiens
  light chain complementarity determining region 3 for antibody 41808
QQYGGSPRMYT

SEQ ID NO: 83616 - protein, 17 aa, Homo sapiens
  heavy chain complementarity determining region 3 for antibody 41808
AYWNGLDSGWFSGPLDY

SEQ ID NO: 83617 - protein, 10 aa, Homo sapiens
  light chain complementarity determining region 3 for antibody 41809
QQYGGSPLFT

SEQ ID NO: 83618 - protein, 16 aa, Homo sapiens
  heavy chain complementarity determining region 3 for antibody 41809
ARDPRYIASGSNGMDV

SEQ ID NO: 83619 - protein, 9 aa, Homo sapiens
  light chain complementarity determining region 3 for antibody 41810
QQYGDSPRT

SEQ ID NO: 83620 - protein, 20 aa, Homo sapiens
  heavy chain complementarity determining region 3 for antibody 41810
ARDAPLLMSMVRGLRNIFDH

SEQ ID NO: 83621 - protein, 8 aa, Homo sapiens
  light chain complementarity determining region 3 for antibody 41811
QQYESLPA

SEQ ID NO: 83622 - protein, 10 aa, Homo sapiens
  heavy chain complementarity determining region 3 for antibody 41811
ARGTDYAFEY

SEQ ID NO: 83623 - protein, 8 aa, Homo sapiens
  light chain complementarity determining region 3 for antibody 41812
QQYENLYT

SEQ ID NO: 83624 - protein, 17 aa, Homo sapiens
  heavy chain complementarity determining region 3 for antibody 41812
ARGGVWGSNRSLGGFDY

SEQ ID NO: 83625 - protein, 9 aa, Homo sapiens
  light chain complementarity determining region 3 for antibody 41813
QQYDTYPWT

SEQ ID NO: 83626 - protein, 14 aa, Homo sapiens
  heavy chain complementarity determining region 3 for antibody 41813
AYSFGTITPGPFDY

SEQ ID NO: 83627 - protein, 9 aa, Homo sapiens
  light chain complementarity determining region 3 for antibody 41814
QQYDSYSWT

SEQ ID NO: 83628 - protein, 14 aa, Homo sapiens
  heavy chain complementarity determining region 3 for antibody 41814
ARGDSSGYLPHFGY

SEQ ID NO: 83629 - protein, 9 aa, Homo sapiens
  light chain complementarity determining region 3 for antibody 41815
QQYDSLPYT

SEQ ID NO: 83630 - protein, 16 aa, Homo sapiens
  heavy chain complementarity determining region 3 for antibody 41815
ARHPNTIFGLVRGFDP

SEQ ID NO: 83631 - protein, 9 aa, Homo sapiens
  light chain complementarity determining region 3 for antibody 41816
QQYDNLPYT

SEQ ID NO: 83632 - protein, 13 aa, Homo sapiens
  heavy chain complementarity determining region 3 for antibody 41816
ARQMRFPDYHMDV

SEQ ID NO: 83633 - protein, 8 aa, Homo sapiens
  light chain complementarity determining region 3 for antibody 41817
QQYDNLPS

SEQ ID NO: 83634 - protein, 14 aa, Homo sapiens
  heavy chain complementarity determining region 3 for antibody 41817
AKVPYGDYANAFDI

SEQ ID NO: 83635 - protein, 10 aa, Homo sapiens
  light chain complementarity determining region 3 for antibody 41818
QQYDNLPRVT

SEQ ID NO: 83636 - protein, 13 aa, Homo sapiens
  heavy chain complementarity determining region 3 for antibody 41818
ARGRGTGGGTTDP

SEQ ID NO: 83637 - protein, 10 aa, Homo sapiens
  light chain complementarity determining region 3 for antibody 41819
QQYDNLPPYT

SEQ ID NO: 83638 - protein, 13 aa, Homo sapiens
  heavy chain complementarity determining region 3 for antibody 41819
ARGSGGVHGLPAH

SEQ ID NO: 83639 - protein, 9 aa, Homo sapiens
  light chain complementarity determining region 3 for antibody 41820
QQYDNLPPT

SEQ ID NO: 83640 - protein, 17 aa, Homo sapiens
  heavy chain complementarity determining region 3 for antibody 41820
ARDPSVFRSDYDCYFDY

SEQ ID NO: 83641 - protein, 9 aa, Homo sapiens
  light chain complementarity determining region 3 for antibody 41821
QQYDNLPIT

SEQ ID NO: 83642 - protein, 14 aa, Homo sapiens
  heavy chain complementarity determining region 3 for antibody 41821
ASGRLRFLVGGMDV

SEQ ID NO: 83643 - protein, 9 aa, Homo sapiens
  light chain complementarity determining region 3 for antibody 41822
QQYDILPYT

SEQ ID NO: 83644 - protein, 13 aa, Homo sapiens
  heavy chain complementarity determining region 3 for antibody 41822
ARRVVTGQPGFDY

SEQ ID NO: 83645 - protein, 8 aa, Homo sapiens
  light chain complementarity determining region 3 for antibody 41823
QQYDHLCT

SEQ ID NO: 83646 - protein, 10 aa, Homo sapiens
  heavy chain complementarity determining region 3 for antibody 41823
TWVGVSWFAS

SEQ ID NO: 83647 - protein, 9 aa, Homo sapiens
  light chain complementarity determining region 3 for antibody 41824
QQYDDVPLT

SEQ ID NO: 83648 - protein, 15 aa, Homo sapiens
  heavy chain complementarity determining region 3 for antibody 41824
GRHRHIVVVTTGMDV

SEQ ID NO: 83649 - protein, 9 aa, Homo sapiens
  light chain complementarity determining region 3 for antibody 41825
QQYDDIPRT

SEQ ID NO: 83650 - protein, 11 aa, Homo sapiens
  heavy chain complementarity determining region 3 for antibody 41825
AREPYNGRYDL

SEQ ID NO: 83651 - protein, 11 aa, Homo sapiens
  light chain complementarity determining region 3 for antibody 41826
QQYDDFLRGFA

SEQ ID NO: 83652 - protein, 12 aa, Homo sapiens
  heavy chain complementarity determining region 3 for antibody 41826
AAPVRGTGFLDY

SEQ ID NO: 83653 - protein, 9 aa, Homo sapiens
  light chain complementarity determining region 3 for antibody 41827
QQYAGSPYT

SEQ ID NO: 83654 - protein, 15 aa, Homo sapiens
  heavy chain complementarity determining region 3 for antibody 41827
AKESSVRGVLLTIDY

SEQ ID NO: 83655 - protein, 9 aa, Homo sapiens
  light chain complementarity determining region 3 for antibody 41828
QQVNSFPYT

SEQ ID NO: 83656 - protein, 20 aa, Homo sapiens
  heavy chain complementarity determining region 3 for antibody 41828
ARGPHIVVVTSFPHHKWLDP

SEQ ID NO: 83657 - protein, 10 aa, Homo sapiens
  light chain complementarity determining region 3 for antibody 41829
QQVKGYPRIT

SEQ ID NO: 83658 - protein, 14 aa, Homo sapiens
  heavy chain complementarity determining region 3 for antibody 41829
AKAADSSGYSAFDI

SEQ ID NO: 83659 - protein, 9 aa, Homo sapiens
  light chain complementarity determining region 3 for antibody 41830
QQTYTTPWT

SEQ ID NO: 83660 - protein, 20 aa, Homo sapiens
  heavy chain complementarity determining region 3 for antibody 41830
ARDTALFCSSTTCYGRDFDY

SEQ ID NO: 83661 - protein, 10 aa, Homo sapiens
  light chain complementarity determining region 3 for antibody 41831
QQTYSSPPIT

SEQ ID NO: 83662 - protein, 18 aa, Homo sapiens
  heavy chain complementarity determining region 3 for antibody 41831
ARGGNTVFGVVLAAWFDP

SEQ ID NO: 83663 - protein, 9 aa, Homo sapiens
  light chain complementarity determining region 3 for antibody 41832
QQTYSPPLT

SEQ ID NO: 83664 - protein, 18 aa, Homo sapiens
  heavy chain complementarity determining region 3 for antibody 41832
ARDLGDCSTSSCYNALDV

SEQ ID NO: 83665 - protein, 13 aa, Homo sapiens
  light chain complementarity determining region 3 for antibody 41833
QQTYMLTNNGGVT

SEQ ID NO: 83666 - protein, 15 aa, Homo sapiens
  heavy chain complementarity determining region 3 for antibody 41833
ARDSFSGSYSGSFDY

SEQ ID NO: 83667 - protein, 9 aa, Homo sapiens
  light chain complementarity determining region 3 for antibody 41834
QQTYITSYT

SEQ ID NO: 83668 - protein, 14 aa, Homo sapiens
  heavy chain complementarity determining region 3 for antibody 41834
TRTPYHGDYEVFDF

SEQ ID NO: 83669 - protein, 9 aa, Homo sapiens
  light chain complementarity determining region 3 for antibody 41835
QQTYATPLT

SEQ ID NO: 83670 - protein, 14 aa, Homo sapiens
  heavy chain complementarity determining region 3 for antibody 41835
AAEDTTMVRDGFYI

SEQ ID NO: 83671 - protein, 9 aa, Homo sapiens
  light chain complementarity determining region 3 for antibody 41836
QQTFTTPWT

SEQ ID NO: 83672 - protein, 12 aa, Homo sapiens
  heavy chain complementarity determining region 3 for antibody 41836
ARGSGYSHAYRA

SEQ ID NO: 83673 - protein, 9 aa, Homo sapiens
  light chain complementarity determining region 3 for antibody 41837
QQTFTAPWT

SEQ ID NO: 83674 - protein, 21 aa, Homo sapiens
  heavy chain complementarity determining region 3 for antibody 41837
ARVKVAAGHKANTYYYNAMDV

SEQ ID NO: 83675 - protein, 9 aa, Homo sapiens
  light chain complementarity determining region 3 for antibody 41838
QQSYSTPYT

SEQ ID NO: 83676 - protein, 13 aa, Homo sapiens
  heavy chain complementarity determining region 3 for antibody 41838
ARAGAAVTTNLDY

SEQ ID NO: 83677 - protein, 9 aa, Homo sapiens
  light chain complementarity determining region 3 for antibody 41839
QQSYSTPWT

SEQ ID NO: 83678 - protein, 13 aa, Homo sapiens
  heavy chain complementarity determining region 3 for antibody 41839
VRFDCSGDRCYWS

SEQ ID NO: 83679 - protein, 9 aa, Homo sapiens
  light chain complementarity determining region 3 for antibody 41840
QQSYSTPQT

SEQ ID NO: 83680 - protein, 12 aa, Homo sapiens
  heavy chain complementarity determining region 3 for antibody 41840
ASRPWNDGAYNI

SEQ ID NO: 83681 - protein, 9 aa, Homo sapiens
  light chain complementarity determining region 3 for antibody 41841
QQSYSTPPT

SEQ ID NO: 83682 - protein, 20 aa, Homo sapiens
  heavy chain complementarity determining region 3 for antibody 41841
ARVPYDSSGYYSRNAEYFQH

SEQ ID NO: 83683 - protein, 9 aa, Homo sapiens
  light chain complementarity determining region 3 for antibody 41842
QQSYSTPLT

SEQ ID NO: 83684 - protein, 11 aa, Homo sapiens
  heavy chain complementarity determining region 3 for antibody 41842
ARSGSSWYFDF

SEQ ID NO: 83685 - protein, 9 aa, Homo sapiens
  light chain complementarity determining region 3 for antibody 41843
QQSYSTPKT

SEQ ID NO: 83686 - protein, 12 aa, Homo sapiens
  heavy chain complementarity determining region 3 for antibody 41843
AKNLMIRDPMRV

SEQ ID NO: 83687 - protein, 8 aa, Homo sapiens
  light chain complementarity determining region 3 for antibody 41844
QQSYSTPH

SEQ ID NO: 83688 - protein, 12 aa, Homo sapiens
  heavy chain complementarity determining region 3 for antibody 41844
ARDTGDFEVQVS

SEQ ID NO: 83689 - protein, 10 aa, Homo sapiens
  light chain complementarity determining region 3 for antibody 41845
QQSYSTLTWT

SEQ ID NO: 83690 - protein, 14 aa, Homo sapiens
  heavy chain complementarity determining region 3 for antibody 41845
ARDSFGPEVVVDDY

SEQ ID NO: 83691 - protein, 9 aa, Homo sapiens
  light chain complementarity determining region 3 for antibody 41846
QQSYSSPLT

SEQ ID NO: 83692 - protein, 15 aa, Homo sapiens
  heavy chain complementarity determining region 3 for antibody 41846
VRHAFGGSGWFYFDY

SEQ ID NO: 83693 - protein, 10 aa, Homo sapiens
  light chain complementarity determining region 3 for antibody 41847
QQSYSPPLFT

SEQ ID NO: 83694 - protein, 18 aa, Homo sapiens
  heavy chain complementarity determining region 3 for antibody 41847
TTETYCNDTTCYSPFFDY

SEQ ID NO: 83695 - protein, 9 aa, Homo sapiens
  light chain complementarity determining region 3 for antibody 41848
QQSYSLPIT

SEQ ID NO: 83696 - protein, 17 aa, Homo sapiens
  heavy chain complementarity determining region 3 for antibody 41848
TKDNGFRAAVVWTEFDH

SEQ ID NO: 83697 - protein, 9 aa, Homo sapiens
  light chain complementarity determining region 3 for antibody 41849
QQSYSIPRT

SEQ ID NO: 83698 - protein, 17 aa, Homo sapiens
  heavy chain complementarity determining region 3 for antibody 41849
ARGMFYDSNGYYYYFDY

SEQ ID NO: 83699 - protein, 9 aa, Homo sapiens
  light chain complementarity determining region 3 for antibody 41850
QQSYSIPIT

SEQ ID NO: 83700 - protein, 10 aa, Homo sapiens
  heavy chain complementarity determining region 3 for antibody 41850
ARGVHLGGDF

SEQ ID NO: 83701 - protein, 9 aa, Homo sapiens
  light chain complementarity determining region 3 for antibody 41851
QQSYSAPYI

SEQ ID NO: 83702 - protein, 24 aa, Homo sapiens
  heavy chain complementarity determining region 3 for antibody 41851
ARDLSARGYSNLESGAGGSVDFDY

SEQ ID NO: 83703 - protein, 9 aa, Homo sapiens
  light chain complementarity determining region 3 for antibody 41852
QQSYSAPHT

SEQ ID NO: 83704 - protein, 11 aa, Homo sapiens
  heavy chain complementarity determining region 3 for antibody 41852
SRDRRGSGVDP

SEQ ID NO: 83705 - protein, 9 aa, Homo sapiens
  light chain complementarity determining region 3 for antibody 41853
QQSYSAPAT

SEQ ID NO: 83706 - protein, 16 aa, Homo sapiens
  heavy chain complementarity determining region 3 for antibody 41853
ARLTEMSAGGYSWFAP

SEQ ID NO: 83707 - protein, 10 aa, Homo sapiens
  light chain complementarity determining region 3 for antibody 41854
QQSYRTPPYT

SEQ ID NO: 83708 - protein, 14 aa, Homo sapiens
  heavy chain complementarity determining region 3 for antibody 41854
TTDGGITARPIFAS

SEQ ID NO: 83709 - protein, 9 aa, Homo sapiens
  light chain complementarity determining region 3 for antibody 41855
QQSYNTWYT

SEQ ID NO: 83710 - protein, 19 aa, Homo sapiens
  heavy chain complementarity determining region 3 for antibody 41855
ARAREGSYREENNYYGFDA

SEQ ID NO: 83711 - protein, 9 aa, Homo sapiens
  light chain complementarity determining region 3 for antibody 41856
QQSYNTPWT

SEQ ID NO: 83712 - protein, 16 aa, Homo sapiens
  heavy chain complementarity determining region 3 for antibody 41856
ARLLQTGYTSGPYFDY

SEQ ID NO: 83713 - protein, 9 aa, Homo sapiens
  light chain complementarity determining region 3 for antibody 41857
QQSYNTPPT

SEQ ID NO: 83714 - protein, 9 aa, Homo sapiens
  heavy chain complementarity determining region 3 for antibody 41857
ARGEWLFDS

SEQ ID NO: 83715 - protein, 8 aa, Homo sapiens
  light chain complementarity determining region 3 for antibody 41858
QQSYNSWT

SEQ ID NO: 83716 - protein, 14 aa, Homo sapiens
  heavy chain complementarity determining region 3 for antibody 41858
AKEKNVRSRTSFDY

SEQ ID NO: 83717 - protein, 9 aa, Homo sapiens
  light chain complementarity determining region 3 for antibody 41859
QQSSTTPRT

SEQ ID NO: 83718 - protein, 22 aa, Homo sapiens
  heavy chain complementarity determining region 3 for antibody 41859
AREGLCTSSSCYVVNHDNGMDV

SEQ ID NO: 83719 - protein, 9 aa, Homo sapiens
  light chain complementarity determining region 3 for antibody 41860
QQSSHSPLT

SEQ ID NO: 83720 - protein, 10 aa, Homo sapiens
  heavy chain complementarity determining region 3 for antibody 41860
ATGEGWLPDQ

SEQ ID NO: 83721 - protein, 8 aa, Homo sapiens
  light chain complementarity determining region 3 for antibody 41861
QQSHSSRA

SEQ ID NO: 83722 - protein, 13 aa, Homo sapiens
  heavy chain complementarity determining region 3 for antibody 41861
ARSGLGRGVFIDH

SEQ ID NO: 83723 - protein, 9 aa, Homo sapiens
  light chain complementarity determining region 3 for antibody 41862
QQSHSSPRT

SEQ ID NO: 83724 - protein, 14 aa, Homo sapiens
  heavy chain complementarity determining region 3 for antibody 41862
AREGCNNTCCYMDY

SEQ ID NO: 83725 - protein, 9 aa, Homo sapiens
  light chain complementarity determining region 3 for antibody 41863
QQSHSHPYT

SEQ ID NO: 83726 - protein, 18 aa, Homo sapiens
  heavy chain complementarity determining region 3 for antibody 41863
ARITGRRDNDDWALWFDP

SEQ ID NO: 83727 - protein, 9 aa, Homo sapiens
  light chain complementarity determining region 3 for antibody 41864
QQSFSTPRT

SEQ ID NO: 83728 - protein, 19 aa, Homo sapiens
  heavy chain complementarity determining region 3 for antibody 41864
AKDWGGCSGTNCYMAYFDF

SEQ ID NO: 83729 - protein, 9 aa, Homo sapiens
  light chain complementarity determining region 3 for antibody 41865
QQSFRAPDT

SEQ ID NO: 83730 - protein, 19 aa, Homo sapiens
  heavy chain complementarity determining region 3 for antibody 41865
ATVSVFLLPVGLPNEYFHH

SEQ ID NO: 83731 - protein, 9 aa, Homo sapiens
  light chain complementarity determining region 3 for antibody 41866
QQSFATPYT

SEQ ID NO: 83732 - protein, 16 aa, Homo sapiens
  heavy chain complementarity determining region 3 for antibody 41866
AREGYYDTAGFYSRDY

SEQ ID NO: 83733 - protein, 9 aa, Homo sapiens
  light chain complementarity determining region 3 for antibody 41867
QQSEYPPLT

SEQ ID NO: 83734 - protein, 14 aa, Homo sapiens
  heavy chain complementarity determining region 3 for antibody 41867
STERIIGFGEADQL

SEQ ID NO: 83735 - protein, 9 aa, Homo sapiens
  light chain complementarity determining region 3 for antibody 41868
QQSDSIPFT

SEQ ID NO: 83736 - protein, 15 aa, Homo sapiens
  heavy chain complementarity determining region 3 for antibody 41868
ARDIVVATARDAFDI

SEQ ID NO: 83737 - protein, 8 aa, Homo sapiens
  light chain complementarity determining region 3 for antibody 41869
QQRSSWQT

SEQ ID NO: 83738 - protein, 23 aa, Homo sapiens
  heavy chain complementarity determining region 3 for antibody 41869
ARRMLHPGFYSDENGHSYGLFDE

SEQ ID NO: 83739 - protein, 9 aa, Homo sapiens
  light chain complementarity determining region 3 for antibody 41870
QQRSNWPYT

SEQ ID NO: 83740 - protein, 15 aa, Homo sapiens
  heavy chain complementarity determining region 3 for antibody 41870
AIHYYDSRGYSLGNY

SEQ ID NO: 83741 - protein, 12 aa, Homo sapiens
  light chain complementarity determining region 3 for antibody 41871
QQRSNWPPVSLT

SEQ ID NO: 83742 - protein, 15 aa, Homo sapiens
  heavy chain complementarity determining region 3 for antibody 41871
ARDRLHSSGNFYFDY

SEQ ID NO: 83743 - protein, 11 aa, Homo sapiens
  light chain complementarity determining region 3 for antibody 41872
QQRSNWPPTWT

SEQ ID NO: 83744 - protein, 13 aa, Homo sapiens
  heavy chain complementarity determining region 3 for antibody 41872
ARGLLGIPAAADY

SEQ ID NO: 83745 - protein, 11 aa, Homo sapiens
  light chain complementarity determining region 3 for antibody 41873
QQRSNWPPEYT

SEQ ID NO: 83746 - protein, 17 aa, Homo sapiens
  heavy chain complementarity determining region 3 for antibody 41873
ARHIAVAGTRQKGYVDH

SEQ ID NO: 83747 - protein, 9 aa, Homo sapiens
  light chain complementarity determining region 3 for antibody 41874
QQRSNWPIT

SEQ ID NO: 83748 - protein, 13 aa, Homo sapiens
  heavy chain complementarity determining region 3 for antibody 41874
ARISDRRARLPDL

SEQ ID NO: 83749 - protein, 10 aa, Homo sapiens
  light chain complementarity determining region 3 for antibody 41875
QQRSDWPPIT

SEQ ID NO: 83750 - protein, 15 aa, Homo sapiens
  heavy chain complementarity determining region 3 for antibody 41875
ARSSLQLWSKDYFDY

SEQ ID NO: 83751 - protein, 11 aa, Homo sapiens
  light chain complementarity determining region 3 for antibody 41876
QQRSDWPPEYT

SEQ ID NO: 83752 - protein, 15 aa, Homo sapiens
  heavy chain complementarity determining region 3 for antibody 41876
ARGNSGWYAGGAFQH

SEQ ID NO: 83753 - protein, 8 aa, Homo sapiens
  light chain complementarity determining region 3 for antibody 41877
QQRRNSGT

SEQ ID NO: 83754 - protein, 16 aa, Homo sapiens
  heavy chain complementarity determining region 3 for antibody 41877
ATGVPAVAAFRFYFDF

SEQ ID NO: 83755 - protein, 9 aa, Homo sapiens
  light chain complementarity determining region 3 for antibody 41878
QQRGNWPLT

SEQ ID NO: 83756 - protein, 12 aa, Homo sapiens
  heavy chain complementarity determining region 3 for antibody 41878
ARRGAGGSYFEY

SEQ ID NO: 83757 - protein, 9 aa, Homo sapiens
  light chain complementarity determining region 3 for antibody 41879
QQLNSYPYT

SEQ ID NO: 83758 - protein, 17 aa, Homo sapiens
  heavy chain complementarity determining region 3 for antibody 41879
AKDIFFAIAVAGTAFDI

SEQ ID NO: 83759 - protein, 8 aa, Homo sapiens
  light chain complementarity determining region 3 for antibody 41880
QQLNSYPT

SEQ ID NO: 83760 - protein, 13 aa, Homo sapiens
  heavy chain complementarity determining region 3 for antibody 41880
ARHVYTTVTPFDS

SEQ ID NO: 83761 - protein, 9 aa, Homo sapiens
  light chain complementarity determining region 3 for antibody 41881
QQLNSYPRT

SEQ ID NO: 83762 - protein, 13 aa, Homo sapiens
  heavy chain complementarity determining region 3 for antibody 41881
SKGSGPGAWLINF

SEQ ID NO: 83763 - protein, 9 aa, Homo sapiens
  light chain complementarity determining region 3 for antibody 41882
QQLNSYPPI

SEQ ID NO: 83764 - protein, 18 aa, Homo sapiens
  heavy chain complementarity determining region 3 for antibody 41882
VRNVRPRDWGSRWYPLDY

SEQ ID NO: 83765 - protein, 9 aa, Homo sapiens
  light chain complementarity determining region 3 for antibody 41883
QQLNSYPLT

SEQ ID NO: 83766 - protein, 15 aa, Homo sapiens
  heavy chain complementarity determining region 3 for antibody 41883
ARVRRRSASYYGMDV

SEQ ID NO: 83767 - protein, 9 aa, Homo sapiens
  light chain complementarity determining region 3 for antibody 41884
QQLNSYPLT

SEQ ID NO: 83768 - protein, 15 aa, Homo sapiens
  heavy chain complementarity determining region 3 for antibody 41884
ARLGGRLLRSAPFDY

SEQ ID NO: 83769 - protein, 9 aa, Homo sapiens
  light chain complementarity determining region 3 for antibody 41885
QQLNSNSWT

SEQ ID NO: 83770 - protein, 14 aa, Homo sapiens
  heavy chain complementarity determining region 3 for antibody 41885
ARVPLFGGFYYFDE

SEQ ID NO: 83771 - protein, 9 aa, Homo sapiens
  light chain complementarity determining region 3 for antibody 41886
QQLNSFPFT

SEQ ID NO: 83772 - protein, 12 aa, Homo sapiens
  heavy chain complementarity determining region 3 for antibody 41886
AIWGGAEGAVEY

SEQ ID NO: 83773 - protein, 9 aa, Homo sapiens
  light chain complementarity determining region 3 for antibody 41887
QQLNNYPFT

SEQ ID NO: 83774 - protein, 15 aa, Homo sapiens
  heavy chain complementarity determining region 3 for antibody 41887
ARDLGSGWRDNWFDL

SEQ ID NO: 83775 - protein, 9 aa, Homo sapiens
  light chain complementarity determining region 3 for antibody 41888
QQLNNFPIT

SEQ ID NO: 83776 - protein, 14 aa, Homo sapiens
  heavy chain complementarity determining region 3 for antibody 41888
ARVILVPGVIAFDY

SEQ ID NO: 83777 - protein, 9 aa, Homo sapiens
  light chain complementarity determining region 3 for antibody 41889
QQHGSSPPT

SEQ ID NO: 83778 - protein, 16 aa, Homo sapiens
  heavy chain complementarity determining region 3 for antibody 41889
ARSLVRGVTFTYFFDY

SEQ ID NO: 83779 - protein, 10 aa, Homo sapiens
  light chain complementarity determining region 3 for antibody 41890
QQHGSSPKWT

SEQ ID NO: 83780 - protein, 9 aa, Homo sapiens
  heavy chain complementarity determining region 3 for antibody 41890
ARGEYSATH

SEQ ID NO: 83781 - protein, 9 aa, Homo sapiens
  light chain complementarity determining region 3 for antibody 41891
QQGYTTPHT

SEQ ID NO: 83782 - protein, 12 aa, Homo sapiens
  heavy chain complementarity determining region 3 for antibody 41891
ARSPGGWGYFDL

SEQ ID NO: 83783 - protein, 9 aa, Homo sapiens
  light chain complementarity determining region 3 for antibody 41892
QQGYSFPLT

SEQ ID NO: 83784 - protein, 14 aa, Homo sapiens
  heavy chain complementarity determining region 3 for antibody 41892
ATDPQVDKPDHFDS

SEQ ID NO: 83785 - protein, 9 aa, Homo sapiens
  light chain complementarity determining region 3 for antibody 41893
QQFDNFPLT

SEQ ID NO: 83786 - protein, 18 aa, Homo sapiens
  heavy chain complementarity determining region 3 for antibody 41893
ARGDRSLGEYNGLDTFDS

SEQ ID NO: 83787 - protein, 9 aa, Homo sapiens
  light chain complementarity determining region 3 for antibody 41894
QQCYSIPDT

SEQ ID NO: 83788 - protein, 11 aa, Homo sapiens
  heavy chain complementarity determining region 3 for antibody 41894
ARDKLHYPFDY

SEQ ID NO: 83789 - protein, 10 aa, Homo sapiens
  light chain complementarity determining region 3 for antibody 41895
QQANTFPPWT

SEQ ID NO: 83790 - protein, 12 aa, Homo sapiens
  heavy chain complementarity determining region 3 for antibody 41895
ARNGDSSGYFNS

SEQ ID NO: 83791 - protein, 9 aa, Homo sapiens
  light chain complementarity determining region 3 for antibody 41896
QQANSFPRT

SEQ ID NO: 83792 - protein, 13 aa, Homo sapiens
  heavy chain complementarity determining region 3 for antibody 41896
ATSHDYGDSALDS

SEQ ID NO: 83793 - protein, 9 aa, Homo sapiens
  light chain complementarity determining region 3 for antibody 41897
QQANSFPLT

SEQ ID NO: 83794 - protein, 24 aa, Homo sapiens
  heavy chain complementarity determining region 3 for antibody 41897
ARPRGVMLRGPNMFSPVPYDPFDL

SEQ ID NO: 83795 - protein, 11 aa, Homo sapiens
  light chain complementarity determining region 3 for antibody 41898
QLRSNWPTGYT

SEQ ID NO: 83796 - protein, 12 aa, Homo sapiens
  heavy chain complementarity determining region 3 for antibody 41898
ARDGVGATHFDY

SEQ ID NO: 83797 - protein, 9 aa, Homo sapiens
  light chain complementarity determining region 3 for antibody 41899
QKYNSAPPT

SEQ ID NO: 83798 - protein, 14 aa, Homo sapiens
  heavy chain complementarity determining region 3 for antibody 41899
TSDLYDSDGYSHDH

SEQ ID NO: 83799 - protein, 9 aa, Homo sapiens
  light chain complementarity determining region 3 for antibody 41900
QKYNSAPLT

SEQ ID NO: 83800 - protein, 11 aa, Homo sapiens
  heavy chain complementarity determining region 3 for antibody 41900
ARKGTSAAVDY

SEQ ID NO: 83801 - protein, 9 aa, Homo sapiens
  light chain complementarity determining region 3 for antibody 41901
QKYNSAPFT

SEQ ID NO: 83802 - protein, 10 aa, Homo sapiens
  heavy chain complementarity determining region 3 for antibody 41901
ARDSLGSIDY

SEQ ID NO: 83803 - protein, 10 aa, Homo sapiens
  light chain complementarity determining region 3 for antibody 41902
QKYGPSPPWT

SEQ ID NO: 83804 - protein, 14 aa, Homo sapiens
  heavy chain complementarity determining region 3 for antibody 41902
ARGGTSGQYHQFDY

SEQ ID NO: 83805 - protein, 9 aa, Homo sapiens
  light chain complementarity determining region 3 for antibody 41903
QKYDTAPPT

SEQ ID NO: 83806 - protein, 16 aa, Homo sapiens
  heavy chain complementarity determining region 3 for antibody 41903
ARCRDFQDSDEYAFDV

SEQ ID NO: 83807 - protein, 9 aa, Homo sapiens
  light chain complementarity determining region 3 for antibody 41904
QHYNTYSRT

SEQ ID NO: 83808 - protein, 14 aa, Homo sapiens
  heavy chain complementarity determining region 3 for antibody 41904
ARERTPKQLGAFDI

SEQ ID NO: 83809 - protein, 8 aa, Homo sapiens
  light chain complementarity determining region 3 for antibody 41905
QHYGSSWT

SEQ ID NO: 83810 - protein, 16 aa, Homo sapiens
  heavy chain complementarity determining region 3 for antibody 41905
ARGRYSSGWYVWTLDY

SEQ ID NO: 83811 - protein, 8 aa, Homo sapiens
  light chain complementarity determining region 3 for antibody 41906
QHYGSSRT

SEQ ID NO: 83812 - protein, 8 aa, Homo sapiens
  heavy chain complementarity determining region 3 for antibody 41906
ARGGDLDY

SEQ ID NO: 83813 - protein, 8 aa, Homo sapiens
  light chain complementarity determining region 3 for antibody 41907
QHYDNLPS

SEQ ID NO: 83814 - protein, 14 aa, Homo sapiens
  heavy chain complementarity determining region 3 for antibody 41907
ATAPAWWFGDVKDF

SEQ ID NO: 83815 - protein, 11 aa, Homo sapiens
  light chain complementarity determining region 3 for antibody 41908
QHYDNFPPGIT

SEQ ID NO: 83816 - protein, 14 aa, Homo sapiens
  heavy chain complementarity determining region 3 for antibody 41908
ARVPNPGWELRFDY

SEQ ID NO: 83817 - protein, 9 aa, Homo sapiens
  light chain complementarity determining region 3 for antibody 41909
QHRSNWPPA

SEQ ID NO: 83818 - protein, 19 aa, Homo sapiens
  heavy chain complementarity determining region 3 for antibody 41909
ARGFIGAARTGFAHYYFDS

SEQ ID NO: 83819 - protein, 9 aa, Homo sapiens
  light chain complementarity determining region 3 for antibody 41910
QHRNNWPPS

SEQ ID NO: 83820 - protein, 17 aa, Homo sapiens
  heavy chain complementarity determining region 3 for antibody 41910
ASEGGFCYSTSCRYFDF

SEQ ID NO: 83821 - protein, 9 aa, Homo sapiens
  light chain complementarity determining region 3 for antibody 41911
QESFSTPGA

SEQ ID NO: 83822 - protein, 13 aa, Homo sapiens
  heavy chain complementarity determining region 3 for antibody 41911
ARRRGVINWYFDL

SEQ ID NO: 83823 - protein, 9 aa, Homo sapiens
  light chain complementarity determining region 3 for antibody 41912
MQTVQTPWT

SEQ ID NO: 83824 - protein, 16 aa, Homo sapiens
  heavy chain complementarity determining region 3 for antibody 41912
ARDQQLWGIRPRGFDS

SEQ ID NO: 83825 - protein, 9 aa, Homo sapiens
  light chain complementarity determining region 3 for antibody 41913
MQSTHWPFT

SEQ ID NO: 83826 - protein, 10 aa, Homo sapiens
  heavy chain complementarity determining region 3 for antibody 41913
ARIPRNSGCL

SEQ ID NO: 83827 - protein, 9 aa, Homo sapiens
  light chain complementarity determining region 3 for antibody 41914
MQGVHWPWT

SEQ ID NO: 83828 - protein, 12 aa, Homo sapiens
  heavy chain complementarity determining region 3 for antibody 41914
AKGPHIAAGGTL

SEQ ID NO: 83829 - protein, 9 aa, Homo sapiens
  light chain complementarity determining region 3 for antibody 41915
MQGTHWPPT

SEQ ID NO: 83830 - protein, 16 aa, Homo sapiens
  heavy chain complementarity determining region 3 for antibody 41915
ARENGDYDGKGGWFDP

SEQ ID NO: 83831 - protein, 9 aa, Homo sapiens
  light chain complementarity determining region 3 for antibody 41916
MQGTHWPPT

SEQ ID NO: 83832 - protein, 19 aa, Homo sapiens
  heavy chain complementarity determining region 3 for antibody 41916
ARDPYRQYDYGDLVPNFDY

SEQ ID NO: 83833 - protein, 9 aa, Homo sapiens
  light chain complementarity determining region 3 for antibody 41917
MQGTHLSHT

SEQ ID NO: 83834 - protein, 9 aa, Homo sapiens
  heavy chain complementarity determining region 3 for antibody 41917
ARGASAADY

SEQ ID NO: 83835 - protein, 9 aa, Homo sapiens
  light chain complementarity determining region 3 for antibody 41918
MQGLQTPYT

SEQ ID NO: 83836 - protein, 13 aa, Homo sapiens
  heavy chain complementarity determining region 3 for antibody 41918
TSGHESDNISPPY

SEQ ID NO: 83837 - protein, 9 aa, Homo sapiens
  light chain complementarity determining region 3 for antibody 41919
MQATHWPYA

SEQ ID NO: 83838 - protein, 10 aa, Homo sapiens
  heavy chain complementarity determining region 3 for antibody 41919
ARDLFRGPAA

SEQ ID NO: 83839 - protein, 9 aa, Homo sapiens
  light chain complementarity determining region 3 for antibody 41920
MQALQTRKT

SEQ ID NO: 83840 - protein, 12 aa, Homo sapiens
  heavy chain complementarity determining region 3 for antibody 41920
ARDRDSFAHTWY

SEQ ID NO: 83841 - protein, 9 aa, Homo sapiens
  light chain complementarity determining region 3 for antibody 41921
MQALQTPWT

SEQ ID NO: 83842 - protein, 16 aa, Homo sapiens
  heavy chain complementarity determining region 3 for antibody 41921
AREGYCDGVSCNLIDP

SEQ ID NO: 83843 - protein, 9 aa, Homo sapiens
  light chain complementarity determining region 3 for antibody 41922
MQALQTPRT

SEQ ID NO: 83844 - protein, 10 aa, Homo sapiens
  heavy chain complementarity determining region 3 for antibody 41922
ARDSDIGLDY

SEQ ID NO: 83845 - protein, 9 aa, Homo sapiens
  light chain complementarity determining region 3 for antibody 41923
MQALQTPLT

SEQ ID NO: 83846 - protein, 12 aa, Homo sapiens
  heavy chain complementarity determining region 3 for antibody 41923
AKDSAQKWELLD

SEQ ID NO: 83847 - protein, 9 aa, Homo sapiens
  light chain complementarity determining region 3 for antibody 41924
LQYYNYPHT

SEQ ID NO: 83848 - protein, 15 aa, Homo sapiens
  heavy chain complementarity determining region 3 for antibody 41924
VKAYTWSYRGPCYDF

SEQ ID NO: 83849 - protein, 9 aa, Homo sapiens
  light chain complementarity determining region 3 for antibody 41925
LQYNTFPCT

SEQ ID NO: 83850 - protein, 12 aa, Homo sapiens
  heavy chain complementarity determining region 3 for antibody 41925
ARGGSGGTAFDY

SEQ ID NO: 83851 - protein, 7 aa, Homo sapiens
  light chain complementarity determining region 3 for antibody 41926
LQYDSFS

SEQ ID NO: 83852 - protein, 15 aa, Homo sapiens
  heavy chain complementarity determining region 3 for antibody 41926
ATHRVCNGCHNWFDP

SEQ ID NO: 83853 - protein, 9 aa, Homo sapiens
  light chain complementarity determining region 3 for antibody 41927
LQHNSYPPT

SEQ ID NO: 83854 - protein, 17 aa, Homo sapiens
  heavy chain complementarity determining region 3 for antibody 41927
ARDAHYGDYRQTGAFDI

SEQ ID NO: 83855 - protein, 9 aa, Homo sapiens
  light chain complementarity determining region 3 for antibody 41928
LQHNSYPLT

SEQ ID NO: 83856 - protein, 21 aa, Homo sapiens
  heavy chain complementarity determining region 3 for antibody 41928
TLVGCSGGSCLIPPERYGMDV

SEQ ID NO: 83857 - protein, 9 aa, Homo sapiens
  light chain complementarity determining region 3 for antibody 41929
LQHNSFPPT

SEQ ID NO: 83858 - protein, 19 aa, Homo sapiens
  heavy chain complementarity determining region 3 for antibody 41929
LRWTNYYDNSGSHSTSFDP

SEQ ID NO: 83859 - protein, 9 aa, Homo sapiens
  light chain complementarity determining region 3 for antibody 41930
LQHNRYPHT

SEQ ID NO: 83860 - protein, 15 aa, Homo sapiens
  heavy chain complementarity determining region 3 for antibody 41930
ARSQFYYHTSDYFDY

SEQ ID NO: 83861 - protein, 9 aa, Homo sapiens
  light chain complementarity determining region 3 for antibody 41931
LQDYTYPIT

SEQ ID NO: 83862 - protein, 14 aa, Homo sapiens
  heavy chain complementarity determining region 3 for antibody 41931
SAYASGQVAMNFEY

SEQ ID NO: 83863 - protein, 9 aa, Homo sapiens
  light chain complementarity determining region 3 for antibody 41932
LQDYSYPYT

SEQ ID NO: 83864 - protein, 17 aa, Homo sapiens
  heavy chain complementarity determining region 3 for antibody 41932
AREKEADGSRNYYALEV

SEQ ID NO: 83865 - protein, 9 aa, Homo sapiens
  light chain complementarity determining region 3 for antibody 41933
LQDYSYPRT

SEQ ID NO: 83866 - protein, 9 aa, Homo sapiens
  heavy chain complementarity determining region 3 for antibody 41933
AREAWGYDY

SEQ ID NO: 83867 - protein, 9 aa, Homo sapiens
  light chain complementarity determining region 3 for antibody 41934
LQDYNYPWT

SEQ ID NO: 83868 - protein, 11 aa, Homo sapiens
  heavy chain complementarity determining region 3 for antibody 41934
ATSPGGRGGHY

SEQ ID NO: 83869 - protein, 9 aa, Homo sapiens
  light chain complementarity determining region 3 for antibody 41935
LQDYNYPQT

SEQ ID NO: 83870 - protein, 15 aa, Homo sapiens
  heavy chain complementarity determining region 3 for antibody 41935
ARVLVGFGELLGFDL

SEQ ID NO: 83871 - protein, 9 aa, Homo sapiens
  light chain complementarity determining region 3 for antibody 41936
LQDYMYPWT

SEQ ID NO: 83872 - protein, 13 aa, Homo sapiens
  heavy chain complementarity determining region 3 for antibody 41936
ARRASGMDWYFDL

SEQ ID NO: 83873 - protein, 9 aa, Homo sapiens
  light chain complementarity determining region 3 for antibody 41937
LQDFHYPLT

SEQ ID NO: 83874 - protein, 14 aa, Homo sapiens
  heavy chain complementarity determining region 3 for antibody 41937
ARDVFSNSGSLVDY

SEQ ID NO: 83875 - protein, 9 aa, Homo sapiens
  light chain complementarity determining region 3 for antibody 41938
LHYGNSRWT

SEQ ID NO: 83876 - protein, 13 aa, Homo sapiens
  heavy chain complementarity determining region 3 for antibody 41938
AREKKLVRGRLDS

SEQ ID NO: 83877 - protein, 9 aa, Homo sapiens
  light chain complementarity determining region 3 for antibody 41939
HQYNTYPWT

SEQ ID NO: 83878 - protein, 12 aa, Homo sapiens
  heavy chain complementarity determining region 3 for antibody 41939
VPPVSPYITLDS

SEQ ID NO: 83879 - protein, 9 aa, Homo sapiens
  light chain complementarity determining region 3 for antibody 41940
HQYGLSPRT

SEQ ID NO: 83880 - protein, 13 aa, Homo sapiens
  heavy chain complementarity determining region 3 for antibody 41940
VRTGRVAGVEGAS

SEQ ID NO: 83881 - protein, 9 aa, Homo sapiens
  light chain complementarity determining region 3 for antibody 41941
HQYDDVRPT

SEQ ID NO: 83882 - protein, 13 aa, Homo sapiens
  heavy chain complementarity determining region 3 for antibody 41941
VRSAYGAQGVFDY

SEQ ID NO: 83883 - protein, 9 aa, Homo sapiens
  light chain complementarity determining region 3 for antibody 41942
HQSSSLPVT

SEQ ID NO: 83884 - protein, 12 aa, Homo sapiens
  heavy chain complementarity determining region 3 for antibody 41942
ARGQFQLRIFDY

SEQ ID NO: 83885 - protein, 8 aa, Homo sapiens
  light chain complementarity determining region 3 for antibody 41943
HQPTSAHT

SEQ ID NO: 83886 - protein, 14 aa, Homo sapiens
  heavy chain complementarity determining region 3 for antibody 41943
ARARGYRGGWYFDL

SEQ ID NO: 83887 - protein, 9 aa, Homo sapiens
  light chain complementarity determining region 3 for antibody 41944
HQPHSLPYT

SEQ ID NO: 83888 - protein, 11 aa, Homo sapiens
  heavy chain complementarity determining region 3 for antibody 41944
ATGYSSSWYDF

SEQ ID NO: 83889 - protein, 9 aa, Homo sapiens
  light chain complementarity determining region 3 for antibody 41945
HQAYSPPQT

SEQ ID NO: 83890 - protein, 24 aa, Homo sapiens
  heavy chain complementarity determining region 3 for antibody 41945
ARGSLEWFYDSSGYYYAPGDALDV

SEQ ID NO: 83891 - protein, 9 aa, Homo sapiens
  light chain complementarity determining region 3 for antibody 41946
HHYGSSVQT

SEQ ID NO: 83892 - protein, 13 aa, Homo sapiens
  heavy chain complementarity determining region 3 for antibody 41946
TSQIVVVSRALDP

SEQ ID NO: 83893 - protein, 9 aa, Homo sapiens
  light chain complementarity determining region 3 for antibody 41947
EQYNRFPWT

SEQ ID NO: 83894 - protein, 11 aa, Homo sapiens
  heavy chain complementarity determining region 3 for antibody 41947
ARANYRGRFDY

SEQ ID NO: 83895 - protein, 9 aa, Homo sapiens
  light chain complementarity determining region 3 for antibody 41948
VQHNSYPRT

SEQ ID NO: 83896 - protein, 15 aa, Homo sapiens
  heavy chain complementarity determining region 3 for antibody 41948
AGRSGSIVTTIPLDS

SEQ ID NO: 83897 - protein, 8 aa, Homo sapiens
  light chain complementarity determining region 3 for antibody 41949
VQGTHWPP

SEQ ID NO: 83898 - protein, 12 aa, Homo sapiens
  heavy chain complementarity determining region 3 for antibody 41949
ARDYSTGDIPGY

SEQ ID NO: 83899 - protein, 8 aa, Homo sapiens
  light chain complementarity determining region 3 for antibody 41950
QYLIGYLV

SEQ ID NO: 83900 - protein, 12 aa, Homo sapiens
  heavy chain complementarity determining region 3 for antibody 41950
VKGVTGTHLFDS

SEQ ID NO: 83901 - protein, 9 aa, Homo sapiens
  light chain complementarity determining region 3 for antibody 41951
QRYGSSLYT

SEQ ID NO: 83902 - protein, 13 aa, Homo sapiens
  heavy chain complementarity determining region 3 for antibody 41951
ACEGIMALGEFDY

SEQ ID NO: 83903 - protein, 9 aa, Homo sapiens
  light chain complementarity determining region 3 for antibody 41952
QRLNNYPLT

SEQ ID NO: 83904 - protein, 16 aa, Homo sapiens
  heavy chain complementarity determining region 3 for antibody 41952
ARDLGGLQDPRGASHI

SEQ ID NO: 83905 - protein, 8 aa, Homo sapiens
  light chain complementarity determining region 3 for antibody 41953
QQYYSYWT

SEQ ID NO: 83906 - protein, 15 aa, Homo sapiens
  heavy chain complementarity determining region 3 for antibody 41953
ARGPAYYDDSGFFDF

SEQ ID NO: 83907 - protein, 9 aa, Homo sapiens
  light chain complementarity determining region 3 for antibody 41954
QQYYSPPWT

SEQ ID NO: 83908 - protein, 8 aa, Homo sapiens
  heavy chain complementarity determining region 3 for antibody 41954
ARDLASNH

SEQ ID NO: 83909 - protein, 9 aa, Homo sapiens
  light chain complementarity determining region 3 for antibody 41955
QQYYITPMT

SEQ ID NO: 83910 - protein, 12 aa, Homo sapiens
  heavy chain complementarity determining region 3 for antibody 41955
ARVTYILGPIDH

SEQ ID NO: 83911 - protein, 9 aa, Homo sapiens
  light chain complementarity determining region 3 for antibody 41956
QQYYGTART

SEQ ID NO: 83912 - protein, 11 aa, Homo sapiens
  heavy chain complementarity determining region 3 for antibody 41956
ARSGDGNWFES

SEQ ID NO: 83913 - protein, 9 aa, Homo sapiens
  light chain complementarity determining region 3 for antibody 41957
QQYVSSSLT

SEQ ID NO: 83914 - protein, 11 aa, Homo sapiens
  heavy chain complementarity determining region 3 for antibody 41957
AKYKGLAYFDY

SEQ ID NO: 83915 - protein, 9 aa, Homo sapiens
  light chain complementarity determining region 3 for antibody 41958
QQYVNSPYT

SEQ ID NO: 83916 - protein, 19 aa, Homo sapiens
  heavy chain complementarity determining region 3 for antibody 41958
AHKEDYRSGTGTAVDAFDV

SEQ ID NO: 83917 - protein, 9 aa, Homo sapiens
  light chain complementarity determining region 3 for antibody 41959
QQYSSYPLT

SEQ ID NO: 83918 - protein, 14 aa, Homo sapiens
  heavy chain complementarity determining region 3 for antibody 41959
AKDGDRSGDDAFDM

SEQ ID NO: 83919 - protein, 9 aa, Homo sapiens
  light chain complementarity determining region 3 for antibody 41960
QQYSRSPVT

SEQ ID NO: 83920 - protein, 18 aa, Homo sapiens
  heavy chain complementarity determining region 3 for antibody 41960
ARVVERCSGGKCHYVFDH

SEQ ID NO: 83921 - protein, 9 aa, Homo sapiens
  light chain complementarity determining region 3 for antibody 41961
QQYSNYPWA

SEQ ID NO: 83922 - protein, 20 aa, Homo sapiens
  heavy chain complementarity determining region 3 for antibody 41961
AVTLKISAHNTLILVGAFNI

SEQ ID NO: 83923 - protein, 8 aa, Homo sapiens
  light chain complementarity determining region 3 for antibody 41962
QQYSDWGT

SEQ ID NO: 83924 - protein, 11 aa, Homo sapiens
  heavy chain complementarity determining region 3 for antibody 41962
TRERFQWLATY

SEQ ID NO: 83925 - protein, 9 aa, Homo sapiens
  light chain complementarity determining region 3 for antibody 41963
QQYRSSPLT

SEQ ID NO: 83926 - protein, 15 aa, Homo sapiens
  heavy chain complementarity determining region 3 for antibody 41963
ARLDSGGYPLGAFDV

SEQ ID NO: 83927 - protein, 9 aa, Homo sapiens
  light chain complementarity determining region 3 for antibody 41964
QQYRDSPYT

SEQ ID NO: 83928 - protein, 15 aa, Homo sapiens
  heavy chain complementarity determining region 3 for antibody 41964
ARPSPAALGFDVFDI

SEQ ID NO: 83929 - protein, 10 aa, Homo sapiens
  light chain complementarity determining region 3 for antibody 41965
QQYNTYSLWT

SEQ ID NO: 83930 - protein, 10 aa, Homo sapiens
  heavy chain complementarity determining region 3 for antibody 41965
ATAEYEAFNF

SEQ ID NO: 83931 - protein, 9 aa, Homo sapiens
  light chain complementarity determining region 3 for antibody 41966
QQYNTFSGT

SEQ ID NO: 83932 - protein, 18 aa, Homo sapiens
  heavy chain complementarity determining region 3 for antibody 41966
ARGYYYDSSGHYSGKFDY

SEQ ID NO: 83933 - protein, 9 aa, Homo sapiens
  light chain complementarity determining region 3 for antibody 41967
QQYNTFPLT

SEQ ID NO: 83934 - protein, 12 aa, Homo sapiens
  heavy chain complementarity determining region 3 for antibody 41967
VVGVIMRAWIGH

SEQ ID NO: 83935 - protein, 9 aa, Homo sapiens
  light chain complementarity determining region 3 for antibody 41968
QQYNSYVWT

SEQ ID NO: 83936 - protein, 16 aa, Homo sapiens
  heavy chain complementarity determining region 3 for antibody 41968
ARSIVGGTWYYYGMDV

SEQ ID NO: 83937 - protein, 9 aa, Homo sapiens
  light chain complementarity determining region 3 for antibody 41969
QQYNSYSWT

SEQ ID NO: 83938 - protein, 15 aa, Homo sapiens
  heavy chain complementarity determining region 3 for antibody 41969
ARDMGISYYYHGLDV

SEQ ID NO: 83939 - protein, 9 aa, Homo sapiens
  light chain complementarity determining region 3 for antibody 41970
QQYNSYSRT

SEQ ID NO: 83940 - protein, 10 aa, Homo sapiens
  heavy chain complementarity determining region 3 for antibody 41970
ALLNVRGVNL

SEQ ID NO: 83941 - protein, 8 aa, Homo sapiens
  light chain complementarity determining region 3 for antibody 41971
QQYNSYSG

SEQ ID NO: 83942 - protein, 15 aa, Homo sapiens
  heavy chain complementarity determining region 3 for antibody 41971
ARDLHYGGDPAPIDY

SEQ ID NO: 83943 - protein, 9 aa, Homo sapiens
  light chain complementarity determining region 3 for antibody 41972
QQYNSYPWT

SEQ ID NO: 83944 - protein, 14 aa, Homo sapiens
  heavy chain complementarity determining region 3 for antibody 41972
AGIQGANLFYGMDV

SEQ ID NO: 83945 - protein, 9 aa, Homo sapiens
  light chain complementarity determining region 3 for antibody 41973
QQYNSHPYT

SEQ ID NO: 83946 - protein, 11 aa, Homo sapiens
  heavy chain complementarity determining region 3 for antibody 41973
AKEVGEQWLVY

SEQ ID NO: 83947 - protein, 9 aa, Homo sapiens
  light chain complementarity determining region 3 for antibody 41974
QQYNSHPWT

SEQ ID NO: 83948 - protein, 12 aa, Homo sapiens
  heavy chain complementarity determining region 3 for antibody 41974
AREGGAGGWFDP

SEQ ID NO: 83949 - protein, 9 aa, Homo sapiens
  light chain complementarity determining region 3 for antibody 41975
QQYNSFPPT

SEQ ID NO: 83950 - protein, 15 aa, Homo sapiens
  heavy chain complementarity determining region 3 for antibody 41975
AKDLGQQLVLYYFDF

SEQ ID NO: 83951 - protein, 9 aa, Homo sapiens
  light chain complementarity determining region 3 for antibody 41976
QQYNSFPIT

SEQ ID NO: 83952 - protein, 18 aa, Homo sapiens
  heavy chain complementarity determining region 3 for antibody 41976
ARGIYYFGSGSRREGFDP

SEQ ID NO: 83953 - protein, 9 aa, Homo sapiens
  light chain complementarity determining region 3 for antibody 41977
QQYNNYPYI

SEQ ID NO: 83954 - protein, 15 aa, Homo sapiens
  heavy chain complementarity determining region 3 for antibody 41977
ARGVEYSTWRRFFDF

SEQ ID NO: 83955 - protein, 9 aa, Homo sapiens
  light chain complementarity determining region 3 for antibody 41978
QQYNNYPFT

SEQ ID NO: 83956 - protein, 11 aa, Homo sapiens
  heavy chain complementarity determining region 3 for antibody 41978
TRGGIGGNFDY

SEQ ID NO: 83957 - protein, 9 aa, Homo sapiens
  light chain complementarity determining region 3 for antibody 41979
QQYNNWPLT

SEQ ID NO: 83958 - protein, 15 aa, Homo sapiens
  heavy chain complementarity determining region 3 for antibody 41979
VREGSGSSGFYGMDV

SEQ ID NO: 83959 - protein, 10 aa, Homo sapiens
  light chain complementarity determining region 3 for antibody 41980
QQYNMWPPYT

SEQ ID NO: 83960 - protein, 16 aa, Homo sapiens
  heavy chain complementarity determining region 3 for antibody 41980
AKEGVGIAARPCHFDY

SEQ ID NO: 83961 - protein, 8 aa, Homo sapiens
  light chain complementarity determining region 3 for antibody 41981
QQYNGFPT

SEQ ID NO: 83962 - protein, 15 aa, Homo sapiens
  heavy chain complementarity determining region 3 for antibody 41981
TTDFGVIAASDLFHY

SEQ ID NO: 83963 - protein, 9 aa, Homo sapiens
  light chain complementarity determining region 3 for antibody 41982
QQYKTFPIT

SEQ ID NO: 83964 - protein, 14 aa, Homo sapiens
  heavy chain complementarity determining region 3 for antibody 41982
ARAGKGWRSDAFDI

SEQ ID NO: 83965 - protein, 8 aa, Homo sapiens
  light chain complementarity determining region 3 for antibody 41983
QQYKSYST

SEQ ID NO: 83966 - protein, 11 aa, Homo sapiens
  heavy chain complementarity determining region 3 for antibody 41983
GHRFRSNYFDY

SEQ ID NO: 83967 - protein, 10 aa, Homo sapiens
  light chain complementarity determining region 3 for antibody 41984
QQYKSYSPWT

SEQ ID NO: 83968 - protein, 15 aa, Homo sapiens
  heavy chain complementarity determining region 3 for antibody 41984
ARDREEMTSVTTFDY

SEQ ID NO: 83969 - protein, 9 aa, Homo sapiens
  light chain complementarity determining region 3 for antibody 41985
QQYKRYAYT

SEQ ID NO: 83970 - protein, 14 aa, Homo sapiens
  heavy chain complementarity determining region 3 for antibody 41985
AKDGSGSYSTYFDH

SEQ ID NO: 83971 - protein, 8 aa, Homo sapiens
  light chain complementarity determining region 3 for antibody 41986
QQYHSYWT

SEQ ID NO: 83972 - protein, 18 aa, Homo sapiens
  heavy chain complementarity determining region 3 for antibody 41986
ARAGKRQQPNIENDVFDI

SEQ ID NO: 83973 - protein, 9 aa, Homo sapiens
  light chain complementarity determining region 3 for antibody 41987
QQYHSFPWT

SEQ ID NO: 83974 - protein, 18 aa, Homo sapiens
  heavy chain complementarity determining region 3 for antibody 41987
ATGVLVGAEGDYHYDIDA

SEQ ID NO: 83975 - protein, 8 aa, Homo sapiens
  light chain complementarity determining region 3 for antibody 41988
QQYHNRRT

SEQ ID NO: 83976 - protein, 17 aa, Homo sapiens
  heavy chain complementarity determining region 3 for antibody 41988
ARIRKDPVLLTDYGMDV

SEQ ID NO: 83977 - protein, 9 aa, Homo sapiens
  light chain complementarity determining region 3 for antibody 41989
QQYHAYPWT

SEQ ID NO: 83978 - protein, 14 aa, Homo sapiens
  heavy chain complementarity determining region 3 for antibody 41989
ARDRRSYVPGVFDM

SEQ ID NO: 83979 - protein, 9 aa, Homo sapiens
  light chain complementarity determining region 3 for antibody 41990
QQYGVSQLI

SEQ ID NO: 83980 - protein, 17 aa, Homo sapiens
  heavy chain complementarity determining region 3 for antibody 41990
ARFRGTGTYLTQPVVDH

SEQ ID NO: 83981 - protein, 10 aa, Homo sapiens
  light chain complementarity determining region 3 for antibody 41991
QQYGTSPPWT

SEQ ID NO: 83982 - protein, 16 aa, Homo sapiens
  heavy chain complementarity determining region 3 for antibody 41991
ARRQWVRGLFRGGLDY

SEQ ID NO: 83983 - protein, 8 aa, Homo sapiens
  light chain complementarity determining region 3 for antibody 41992
QQYGSSRT

SEQ ID NO: 83984 - protein, 23 aa, Homo sapiens
  heavy chain complementarity determining region 3 for antibody 41992
AREDYDILTGYPGLNHLNYALDV

SEQ ID NO: 83985 - protein, 9 aa, Homo sapiens
  light chain complementarity determining region 3 for antibody 41993
QQYGSSQYP

SEQ ID NO: 83986 - protein, 20 aa, Homo sapiens
  heavy chain complementarity determining region 3 for antibody 41993
ARFRTGDSSDSNPYFYAMDV

SEQ ID NO: 83987 - protein, 9 aa, Homo sapiens
  light chain complementarity determining region 3 for antibody 41994
QQYGSSQFT

SEQ ID NO: 83988 - protein, 21 aa, Homo sapiens
  heavy chain complementarity determining region 3 for antibody 41994
ARHLERPLGSRPEFLGRVFDF

SEQ ID NO: 83989 - protein, 7 aa, Homo sapiens
  light chain complementarity determining region 3 for antibody 41995
QQYGSSQ

SEQ ID NO: 83990 - protein, 14 aa, Homo sapiens
  heavy chain complementarity determining region 3 for antibody 41995
ARALDRYGDYEIDS

SEQ ID NO: 83991 - protein, 9 aa, Homo sapiens
  light chain complementarity determining region 3 for antibody 41996
QQYGSSPYP

SEQ ID NO: 83992 - protein, 18 aa, Homo sapiens
  heavy chain complementarity determining region 3 for antibody 41996
ARGGGLGATGYFVGAFDI

SEQ ID NO: 83993 - protein, 9 aa, Homo sapiens
  light chain complementarity determining region 3 for antibody 41997
QQYGSSPWT

SEQ ID NO: 83994 - protein, 14 aa, Homo sapiens
  heavy chain complementarity determining region 3 for antibody 41997
ARDSSSTSWGPIDY

SEQ ID NO: 83995 - protein, 9 aa, Homo sapiens
  light chain complementarity determining region 3 for antibody 41998
QQYGSSPWT

SEQ ID NO: 83996 - protein, 11 aa, Homo sapiens
  heavy chain complementarity determining region 3 for antibody 41998
ARDPAGGSYDM

SEQ ID NO: 83997 - protein, 10 aa, Homo sapiens
  light chain complementarity determining region 3 for antibody 41999
QQYGSSPVFT

SEQ ID NO: 83998 - protein, 16 aa, Homo sapiens
  heavy chain complementarity determining region 3 for antibody 41999
AKRDILTGSVGNWFDP

SEQ ID NO: 83999 - protein, 9 aa, Homo sapiens
  light chain complementarity determining region 3 for antibody 42000
QQYGSSPRT

SEQ ID NO: 84000 - protein, 11 aa, Homo sapiens
  heavy chain complementarity determining region 3 for antibody 42000
ARDAINWAFDY

SEQ ID NO: 84001 - protein, 10 aa, Homo sapiens
  light chain complementarity determining region 3 for antibody 42001
QQYGSSPPWT

SEQ ID NO: 84002 - protein, 14 aa, Homo sapiens
  heavy chain complementarity determining region 3 for antibody 42001
ATGGSSGYNQPFDS

SEQ ID NO: 84003 - protein, 10 aa, Homo sapiens
  light chain complementarity determining region 3 for antibody 42002
QQYGSSPPWT

SEQ ID NO: 84004 - protein, 24 aa, Homo sapiens
  heavy chain complementarity determining region 3 for antibody 42002
ARDGLGTISGVPENLYYYYFALDV

SEQ ID NO: 84005 - protein, 9 aa, Homo sapiens
  light chain complementarity determining region 3 for antibody 42003
QQYGSSPLT

SEQ ID NO: 84006 - protein, 15 aa, Homo sapiens
  heavy chain complementarity determining region 3 for antibody 42003
VKEAGAVAGPTHFDS

SEQ ID NO: 84007 - protein, 9 aa, Homo sapiens
  light chain complementarity determining region 3 for antibody 42004
QQYGSSPLT

SEQ ID NO: 84008 - protein, 16 aa, Homo sapiens
  heavy chain complementarity determining region 3 for antibody 42004
ASNLNVMAVLNDAFGI

SEQ ID NO: 84009 - protein, 10 aa, Homo sapiens
  light chain complementarity determining region 3 for antibody 42005
QQYGSSPKFT

SEQ ID NO: 84010 - protein, 16 aa, Homo sapiens
  heavy chain complementarity determining region 3 for antibody 42005
ARLFYSGATYSGAFDI

SEQ ID NO: 84011 - protein, 9 aa, Homo sapiens
  light chain complementarity determining region 3 for antibody 42006
QQYGSSPIT

SEQ ID NO: 84012 - protein, 19 aa, Homo sapiens
  heavy chain complementarity determining region 3 for antibody 42006
ARAGAFHDFWSGHLNWFDP

SEQ ID NO: 84013 - protein, 9 aa, Homo sapiens
  light chain complementarity determining region 3 for antibody 42007
QQYGSSPHT

SEQ ID NO: 84014 - protein, 14 aa, Homo sapiens
  heavy chain complementarity determining region 3 for antibody 42007
ARDRRLGGYRLLDH

SEQ ID NO: 84015 - protein, 9 aa, Homo sapiens
  light chain complementarity determining region 3 for antibody 42008
QQYGSHPNT

SEQ ID NO: 84016 - protein, 16 aa, Homo sapiens
  heavy chain complementarity determining region 3 for antibody 42008
ARQSDGSGYYSGTFDI

SEQ ID NO: 84017 - protein, 9 aa, Homo sapiens
  light chain complementarity determining region 3 for antibody 42009
QQYGSAPPD

SEQ ID NO: 84018 - protein, 14 aa, Homo sapiens
  heavy chain complementarity determining region 3 for antibody 42009
ARDHTMPHYWYFDL

SEQ ID NO: 84019 - protein, 9 aa, Homo sapiens
  light chain complementarity determining region 3 for antibody 42010
QQYGRSPYT

SEQ ID NO: 84020 - protein, 12 aa, Homo sapiens
  heavy chain complementarity determining region 3 for antibody 42010
ARAAAVGWHLDL

SEQ ID NO: 84021 - protein, 9 aa, Homo sapiens
  light chain complementarity determining region 3 for antibody 42011
QQYGRSAWT

SEQ ID NO: 84022 - protein, 15 aa, Homo sapiens
  heavy chain complementarity determining region 3 for antibody 42011
ARLHSSSFGNHAFDI

SEQ ID NO: 84023 - protein, 11 aa, Homo sapiens
  light chain complementarity determining region 3 for antibody 42012
QQYGPSGPEYT

SEQ ID NO: 84024 - protein, 13 aa, Homo sapiens
  heavy chain complementarity determining region 3 for antibody 42012
TIDYYNPSGDFDY

SEQ ID NO: 84025 - protein, 9 aa, Homo sapiens
  light chain complementarity determining region 3 for antibody 42013
QQYGNSPVT

SEQ ID NO: 84026 - protein, 23 aa, Homo sapiens
  heavy chain complementarity determining region 3 for antibody 42013
ARDMGASNIAVRPDKLKPQEFDY

SEQ ID NO: 84027 - protein, 9 aa, Homo sapiens
  light chain complementarity determining region 3 for antibody 42014
QQYGNSPLT

SEQ ID NO: 84028 - protein, 13 aa, Homo sapiens
  heavy chain complementarity determining region 3 for antibody 42014
AHSQWLVLDVFDF

SEQ ID NO: 84029 - protein, 10 aa, Homo sapiens
  light chain complementarity determining region 3 for antibody 42015
QQYGGSPVYI

SEQ ID NO: 84030 - protein, 16 aa, Homo sapiens
  heavy chain complementarity determining region 3 for antibody 42015
AKDRSSSLHRSTGFDF

SEQ ID NO: 84031 - protein, 10 aa, Homo sapiens
  light chain complementarity determining region 3 for antibody 42016
QQYGGSPRYT

SEQ ID NO: 84032 - protein, 16 aa, Homo sapiens
  heavy chain complementarity determining region 3 for antibody 42016
ARVTWVRGLMTPAFDY

SEQ ID NO: 84033 - protein, 10 aa, Homo sapiens
  light chain complementarity determining region 3 for antibody 42017
QQYGGSPPVT

SEQ ID NO: 84034 - protein, 17 aa, Homo sapiens
  heavy chain complementarity determining region 3 for antibody 42017
ARVQNYFNNSGWGDFDY

SEQ ID NO: 84035 - protein, 10 aa, Homo sapiens
  light chain complementarity determining region 3 for antibody 42018
QQYGGSPLIT

SEQ ID NO: 84036 - protein, 14 aa, Homo sapiens
  heavy chain complementarity determining region 3 for antibody 42018
ARDPQRGAPDYLDS

SEQ ID NO: 84037 - protein, 10 aa, Homo sapiens
  light chain complementarity determining region 3 for antibody 42019
QQYGGSPALT

SEQ ID NO: 84038 - protein, 11 aa, Homo sapiens
  heavy chain complementarity determining region 3 for antibody 42019
AKDALSAAIDV

SEQ ID NO: 84039 - protein, 9 aa, Homo sapiens
  light chain complementarity determining region 3 for antibody 42020
QQYGDSPYT

SEQ ID NO: 84040 - protein, 18 aa, Homo sapiens
  heavy chain complementarity determining region 3 for antibody 42020
ARTGVWFGEFLLPDAFDI

SEQ ID NO: 84041 - protein, 10 aa, Homo sapiens
  light chain complementarity determining region 3 for antibody 42021
QQYGDLPPIT

SEQ ID NO: 84042 - protein, 19 aa, Homo sapiens
  heavy chain complementarity determining region 3 for antibody 42021
ARAREGSYRQENNYYGFDA

SEQ ID NO: 84043 - protein, 9 aa, Homo sapiens
  light chain complementarity determining region 3 for antibody 42022
QQYFTYAWT

SEQ ID NO: 84044 - protein, 11 aa, Homo sapiens
  heavy chain complementarity determining region 3 for antibody 42022
AYRQVAVGFGY

SEQ ID NO: 84045 - protein, 9 aa, Homo sapiens
  light chain complementarity determining region 3 for antibody 42023
QQYESLPIT

SEQ ID NO: 84046 - protein, 18 aa, Homo sapiens
  heavy chain complementarity determining region 3 for antibody 42023
AREGREKVVRAAVWVFDK

SEQ ID NO: 84047 - protein, 9 aa, Homo sapiens
  light chain complementarity determining region 3 for antibody 42024
QQYDTYPWT

SEQ ID NO: 84048 - protein, 14 aa, Homo sapiens
  heavy chain complementarity determining region 3 for antibody 42024
ARPRTGHYSFFFDF

SEQ ID NO: 84049 - protein, 10 aa, Homo sapiens
  light chain complementarity determining region 3 for antibody 42025
QQYDNLPPYT

SEQ ID NO: 84050 - protein, 16 aa, Homo sapiens
  heavy chain complementarity determining region 3 for antibody 42025
AREKTEQWLVRGTFDY

SEQ ID NO: 84051 - protein, 10 aa, Homo sapiens
  light chain complementarity determining region 3 for antibody 42026
QQYDNLPPYT

SEQ ID NO: 84052 - protein, 14 aa, Homo sapiens
  heavy chain complementarity determining region 3 for antibody 42026
AKDMVGSYWDVGDY

SEQ ID NO: 84053 - protein, 10 aa, Homo sapiens
  light chain complementarity determining region 3 for antibody 42027
QQYDNLPMYT

SEQ ID NO: 84054 - protein, 10 aa, Homo sapiens
  heavy chain complementarity determining region 3 for antibody 42027
VSNGWYCLDS

SEQ ID NO: 84055 - protein, 10 aa, Homo sapiens
  light chain complementarity determining region 3 for antibody 42028
QQYDKWPPWT

SEQ ID NO: 84056 - protein, 12 aa, Homo sapiens
  heavy chain complementarity determining region 3 for antibody 42028
AKTLRERNELDF

SEQ ID NO: 84057 - protein, 9 aa, Homo sapiens
  light chain complementarity determining region 3 for antibody 42029
QQYDKAPVT

SEQ ID NO: 84058 - protein, 12 aa, Homo sapiens
  heavy chain complementarity determining region 3 for antibody 42029
ARDAMRGGDFDY

SEQ ID NO: 84059 - protein, 9 aa, Homo sapiens
  light chain complementarity determining region 3 for antibody 42030
QQYDISPFT

SEQ ID NO: 84060 - protein, 19 aa, Homo sapiens
  heavy chain complementarity determining region 3 for antibody 42030
ARQGVAAGLKFYYYYAMDV

SEQ ID NO: 84061 - protein, 10 aa, Homo sapiens
  light chain complementarity determining region 3 for antibody 42031
QQYDDSPPWT

SEQ ID NO: 84062 - protein, 14 aa, Homo sapiens
  heavy chain complementarity determining region 3 for antibody 42031
VRAGGGMSAGKFDY

SEQ ID NO: 84063 - protein, 9 aa, Homo sapiens
  light chain complementarity determining region 3 for antibody 42032
QQYDDSPIT

SEQ ID NO: 84064 - protein, 12 aa, Homo sapiens
  heavy chain complementarity determining region 3 for antibody 42032
ARAENYYWHFDL

SEQ ID NO: 84065 - protein, 8 aa, Homo sapiens
  light chain complementarity determining region 3 for antibody 42033
QQYASSYT

SEQ ID NO: 84066 - protein, 19 aa, Homo sapiens
  heavy chain complementarity determining region 3 for antibody 42033
ARHDRNIPAISGTMGHFDY

SEQ ID NO: 84067 - protein, 8 aa, Homo sapiens
  light chain complementarity determining region 3 for antibody 42034
QQYASPWA

SEQ ID NO: 84068 - protein, 12 aa, Homo sapiens
  heavy chain complementarity determining region 3 for antibody 42034
ARGRVDGSGGVD

SEQ ID NO: 84069 - protein, 9 aa, Homo sapiens
  light chain complementarity determining region 3 for antibody 42035
QQYAAAPIT

SEQ ID NO: 84070 - protein, 13 aa, Homo sapiens
  heavy chain complementarity determining region 3 for antibody 42035
AKGAGSGAYLIDY

SEQ ID NO: 84071 - protein, 9 aa, Homo sapiens
  light chain complementarity determining region 3 for antibody 42036
QQVNSFPRT

SEQ ID NO: 84072 - protein, 9 aa, Homo sapiens
  heavy chain complementarity determining region 3 for antibody 42036
ARDPDSSGP

SEQ ID NO: 84073 - protein, 9 aa, Homo sapiens
  light chain complementarity determining region 3 for antibody 42037
QQVLTYPPT

SEQ ID NO: 84074 - protein, 13 aa, Homo sapiens
  heavy chain complementarity determining region 3 for antibody 42037
AREQDSGYDPFDP

SEQ ID NO: 84075 - protein, 9 aa, Homo sapiens
  light chain complementarity determining region 3 for antibody 42038
QQVISYPFT

SEQ ID NO: 84076 - protein, 12 aa, Homo sapiens
  heavy chain complementarity determining region 3 for antibody 42038
ARPLAGDHGFDP

SEQ ID NO: 84077 - protein, 10 aa, Homo sapiens
  light chain complementarity determining region 3 for antibody 42039
QQTYSTPRWT

SEQ ID NO: 84078 - protein, 21 aa, Homo sapiens
  heavy chain complementarity determining region 3 for antibody 42039
ARDHNGGMAAAGVPHLNWLDS

SEQ ID NO: 84079 - protein, 9 aa, Homo sapiens
  light chain complementarity determining region 3 for antibody 42040
QQTYSPPQT

SEQ ID NO: 84080 - protein, 24 aa, Homo sapiens
  heavy chain complementarity determining region 3 for antibody 42040
ARGSLEWYYDSSGYYYAPGDAYDI

SEQ ID NO: 84081 - protein, 9 aa, Homo sapiens
  light chain complementarity determining region 3 for antibody 42041
QQTYNSPLT

SEQ ID NO: 84082 - protein, 16 aa, Homo sapiens
  heavy chain complementarity determining region 3 for antibody 42041
ATVRVGYDSGGYLFDY

SEQ ID NO: 84083 - protein, 9 aa, Homo sapiens
  light chain complementarity determining region 3 for antibody 42042
QQTNSFPLT

SEQ ID NO: 84084 - protein, 11 aa, Homo sapiens
  heavy chain complementarity determining region 3 for antibody 42042
ARHVNWWSSDY

SEQ ID NO: 84085 - protein, 9 aa, Homo sapiens
  light chain complementarity determining region 3 for antibody 42043
QQTHTPVFT

SEQ ID NO: 84086 - protein, 14 aa, Homo sapiens
  heavy chain complementarity determining region 3 for antibody 42043
AKELSAHDYSPLDS

SEQ ID NO: 84087 - protein, 9 aa, Homo sapiens
  light chain complementarity determining region 3 for antibody 42044
QQTFSVPWT

SEQ ID NO: 84088 - protein, 14 aa, Homo sapiens
  heavy chain complementarity determining region 3 for antibody 42044
VRGLWGSTPLRMDV

SEQ ID NO: 84089 - protein, 9 aa, Homo sapiens
  light chain complementarity determining region 3 for antibody 42045
QQSYTIPWT

SEQ ID NO: 84090 - protein, 15 aa, Homo sapiens
  heavy chain complementarity determining region 3 for antibody 42045
ARWGNDNGDYGRLDS

SEQ ID NO: 84091 - protein, 9 aa, Homo sapiens
  light chain complementarity determining region 3 for antibody 42046
QQSYTIPIT

SEQ ID NO: 84092 - protein, 15 aa, Homo sapiens
  heavy chain complementarity determining region 3 for antibody 42046
ARDPGIAAPQETFDV

SEQ ID NO: 84093 - protein, 9 aa, Homo sapiens
  light chain complementarity determining region 3 for antibody 42047
QQSYSTSLT

SEQ ID NO: 84094 - protein, 16 aa, Homo sapiens
  heavy chain complementarity determining region 3 for antibody 42047
ARGYSSGWHVGGPFGC

SEQ ID NO: 84095 - protein, 8 aa, Homo sapiens
  light chain complementarity determining region 3 for antibody 42048
QQSYSTRT

SEQ ID NO: 84096 - protein, 14 aa, Homo sapiens
  heavy chain complementarity determining region 3 for antibody 42048
VRADLGPAGYFFDF

SEQ ID NO: 84097 - protein, 9 aa, Homo sapiens
  light chain complementarity determining region 3 for antibody 42049
QQSYSTRLT

SEQ ID NO: 84098 - protein, 13 aa, Homo sapiens
  heavy chain complementarity determining region 3 for antibody 42049
ARDMIVVATSIDY

SEQ ID NO: 84099 - protein, 9 aa, Homo sapiens
  light chain complementarity determining region 3 for antibody 42050
QQSYSTPYT

SEQ ID NO: 84100 - protein, 15 aa, Homo sapiens
  heavy chain complementarity determining region 3 for antibody 42050
VRGYGYSSAFPSFDY

SEQ ID NO: 84101 - protein, 9 aa, Homo sapiens
  light chain complementarity determining region 3 for antibody 42051
QQSYSTPYT

SEQ ID NO: 84102 - protein, 18 aa, Homo sapiens
  heavy chain complementarity determining region 3 for antibody 42051
MIPRWRFGSGTYPHLFDS

SEQ ID NO: 84103 - protein, 9 aa, Homo sapiens
  light chain complementarity determining region 3 for antibody 42052
QQSYSTPYT

SEQ ID NO: 84104 - protein, 16 aa, Homo sapiens
  heavy chain complementarity determining region 3 for antibody 42052
ARYYSGSETWAKYFDD

SEQ ID NO: 84105 - protein, 9 aa, Homo sapiens
  light chain complementarity determining region 3 for antibody 42053
QQSYSTPYT

SEQ ID NO: 84106 - protein, 15 aa, Homo sapiens
  heavy chain complementarity determining region 3 for antibody 42053
ARGDPYVGNVTGFDS

SEQ ID NO: 84107 - protein, 9 aa, Homo sapiens
  light chain complementarity determining region 3 for antibody 42054
QQSYSTPRT

SEQ ID NO: 84108 - protein, 12 aa, Homo sapiens
  heavy chain complementarity determining region 3 for antibody 42054
TGEAPARAWFDP

SEQ ID NO: 84109 - protein, 9 aa, Homo sapiens
  light chain complementarity determining region 3 for antibody 42055
QQSYSTPRT

SEQ ID NO: 84110 - protein, 14 aa, Homo sapiens
  heavy chain complementarity determining region 3 for antibody 42055
AREVEGSGWRLIDY

SEQ ID NO: 84111 - protein, 9 aa, Homo sapiens
  light chain complementarity determining region 3 for antibody 42056
QQSYSTPLT

SEQ ID NO: 84112 - protein, 17 aa, Homo sapiens
  heavy chain complementarity determining region 3 for antibody 42056
ARRSGDSSGYPYGELDP

SEQ ID NO: 84113 - protein, 10 aa, Homo sapiens
  light chain complementarity determining region 3 for antibody 42057
QQSYSTPIFT

SEQ ID NO: 84114 - protein, 20 aa, Homo sapiens
  heavy chain complementarity determining region 3 for antibody 42057
AREWESPSVEVLADVAYFDY

SEQ ID NO: 84115 - protein, 9 aa, Homo sapiens
  light chain complementarity determining region 3 for antibody 42058
QQSYSTPFT

SEQ ID NO: 84116 - protein, 14 aa, Homo sapiens
  heavy chain complementarity determining region 3 for antibody 42058
ARDHGRDPLAAFDI

SEQ ID NO: 84117 - protein, 9 aa, Homo sapiens
  light chain complementarity determining region 3 for antibody 42059
QQSYSTPET

SEQ ID NO: 84118 - protein, 12 aa, Homo sapiens
  heavy chain complementarity determining region 3 for antibody 42059
VRDRASSGLLDS

SEQ ID NO: 84119 - protein, 9 aa, Homo sapiens
  light chain complementarity determining region 3 for antibody 42060
QQSYSTPCT

SEQ ID NO: 84120 - protein, 14 aa, Homo sapiens
  heavy chain complementarity determining region 3 for antibody 42060
AKAVLYDSSGFLEY

SEQ ID NO: 84121 - protein, 9 aa, Homo sapiens
  light chain complementarity determining region 3 for antibody 42061
QQSYSTLWT

SEQ ID NO: 84122 - protein, 13 aa, Homo sapiens
  heavy chain complementarity determining region 3 for antibody 42061
ARPYYYDKSGFDY

SEQ ID NO: 84123 - protein, 8 aa, Homo sapiens
  light chain complementarity determining region 3 for antibody 42062
QQSYSKPA

SEQ ID NO: 84124 - protein, 14 aa, Homo sapiens
  heavy chain complementarity determining region 3 for antibody 42062
ARVLDASYYYGMDV

SEQ ID NO: 84125 - protein, 9 aa, Homo sapiens
  light chain complementarity determining region 3 for antibody 42063
QQSYRSPIT

SEQ ID NO: 84126 - protein, 12 aa, Homo sapiens
  heavy chain complementarity determining region 3 for antibody 42063
ARWRWQQSEFDN

SEQ ID NO: 84127 - protein, 9 aa, Homo sapiens
  light chain complementarity determining region 3 for antibody 42064
QQSYNTPWT

SEQ ID NO: 84128 - protein, 13 aa, Homo sapiens
  heavy chain complementarity determining region 3 for antibody 42064
ARDQEGSYYGMDV

SEQ ID NO: 84129 - protein, 10 aa, Homo sapiens
  light chain complementarity determining region 3 for antibody 42065
QQSYNTPPIT

SEQ ID NO: 84130 - protein, 17 aa, Homo sapiens
  heavy chain complementarity determining region 3 for antibody 42065
ARDGRDSSGYSNWYFDL

SEQ ID NO: 84131 - protein, 9 aa, Homo sapiens
  light chain complementarity determining region 3 for antibody 42066
QQSYNMPYT

SEQ ID NO: 84132 - protein, 15 aa, Homo sapiens
  heavy chain complementarity determining region 3 for antibody 42066
ARDKWLQGDHDTFDM

SEQ ID NO: 84133 - protein, 9 aa, Homo sapiens
  light chain complementarity determining region 3 for antibody 42067
QQSYITPLT

SEQ ID NO: 84134 - protein, 24 aa, Homo sapiens
  heavy chain complementarity determining region 3 for antibody 42067
ARHVPSRPGYCSGNNCYSPSNIDP

SEQ ID NO: 84135 - protein, 9 aa, Homo sapiens
  light chain complementarity determining region 3 for antibody 42068
QQSYDSTRT

SEQ ID NO: 84136 - protein, 12 aa, Homo sapiens
  heavy chain complementarity determining region 3 for antibody 42068
ARSSGRSYGMDV

SEQ ID NO: 84137 - protein, 9 aa, Homo sapiens
  light chain complementarity determining region 3 for antibody 42069
QQSNSFPLT

SEQ ID NO: 84138 - protein, 15 aa, Homo sapiens
  heavy chain complementarity determining region 3 for antibody 42069
ARANDASGFPNPFDY

SEQ ID NO: 84139 - protein, 9 aa, Homo sapiens
  light chain complementarity determining region 3 for antibody 42070
QQSHSTPPA

SEQ ID NO: 84140 - protein, 17 aa, Homo sapiens
  heavy chain complementarity determining region 3 for antibody 42070
AKDTPEQQLVFEYAFDI

SEQ ID NO: 84141 - protein, 9 aa, Homo sapiens
  light chain complementarity determining region 3 for antibody 42071
QQSFTTPWT

SEQ ID NO: 84142 - protein, 13 aa, Homo sapiens
  heavy chain complementarity determining region 3 for antibody 42071
VRAADGTQGVFDY

SEQ ID NO: 84143 - protein, 9 aa, Homo sapiens
  light chain complementarity determining region 3 for antibody 42072
QQSFTNPPT

SEQ ID NO: 84144 - protein, 18 aa, Homo sapiens
  heavy chain complementarity determining region 3 for antibody 42072
AREKDVFVGYVSYNWFDP

SEQ ID NO: 84145 - protein, 8 aa, Homo sapiens
  light chain complementarity determining region 3 for antibody 42073
QQSFTIRT

SEQ ID NO: 84146 - protein, 13 aa, Homo sapiens
  heavy chain complementarity determining region 3 for antibody 42073
ARDRYSKMSGIDP

SEQ ID NO: 84147 - protein, 9 aa, Homo sapiens
  light chain complementarity determining region 3 for antibody 42074
QQSFTAPYT

SEQ ID NO: 84148 - protein, 18 aa, Homo sapiens
  heavy chain complementarity determining region 3 for antibody 42074
ARHTSDPSFMPLSFWFDP

SEQ ID NO: 84149 - protein, 9 aa, Homo sapiens
  light chain complementarity determining region 3 for antibody 42075
QQSFSTPYT

SEQ ID NO: 84150 - protein, 10 aa, Homo sapiens
  heavy chain complementarity determining region 3 for antibody 42075
VKEERQWLDN

SEQ ID NO: 84151 - protein, 9 aa, Homo sapiens
  light chain complementarity determining region 3 for antibody 42076
QQSFSSPLT

SEQ ID NO: 84152 - protein, 18 aa, Homo sapiens
  heavy chain complementarity determining region 3 for antibody 42076
ARGVVRRVGASTTYYFDY

SEQ ID NO: 84153 - protein, 9 aa, Homo sapiens
  light chain complementarity determining region 3 for antibody 42077
QQSFDIPYT

SEQ ID NO: 84154 - protein, 11 aa, Homo sapiens
  heavy chain complementarity determining region 3 for antibody 42077
AKGSFGSGLDT

SEQ ID NO: 84155 - protein, 9 aa, Homo sapiens
  light chain complementarity determining region 3 for antibody 42078
QQSDSLPLT

SEQ ID NO: 84156 - protein, 12 aa, Homo sapiens
  heavy chain complementarity determining region 3 for antibody 42078
ARVGIAARHFDY

SEQ ID NO: 84157 - protein, 9 aa, Homo sapiens
  light chain complementarity determining region 3 for antibody 42079
QQSDNLPPT

SEQ ID NO: 84158 - protein, 16 aa, Homo sapiens
  heavy chain complementarity determining region 3 for antibody 42079
ARDRRWDLQGADAFDI

SEQ ID NO: 84159 - protein, 9 aa, Homo sapiens
  light chain complementarity determining region 3 for antibody 42080
QQSDIVPVT

SEQ ID NO: 84160 - protein, 10 aa, Homo sapiens
  heavy chain complementarity determining region 3 for antibody 42080
ASGLGWESAY

SEQ ID NO: 84161 - protein, 8 aa, Homo sapiens
  light chain complementarity determining region 3 for antibody 42081
QQRYNWVT

SEQ ID NO: 84162 - protein, 15 aa, Homo sapiens
  heavy chain complementarity determining region 3 for antibody 42081
ARTDPDSTNHNYFDQ

SEQ ID NO: 84163 - protein, 10 aa, Homo sapiens
  light chain complementarity determining region 3 for antibody 42082
QQRYNWPPFT

SEQ ID NO: 84164 - protein, 11 aa, Homo sapiens
  heavy chain complementarity determining region 3 for antibody 42082
ARGVGSYPFDY

SEQ ID NO: 84165 - protein, 9 aa, Homo sapiens
  light chain complementarity determining region 3 for antibody 42083
QQRSNWPRT

SEQ ID NO: 84166 - protein, 10 aa, Homo sapiens
  heavy chain complementarity determining region 3 for antibody 42083
AKDRSGDLVY

SEQ ID NO: 84167 - protein, 9 aa, Homo sapiens
  light chain complementarity determining region 3 for antibody 42084
QQRSNWPPT

SEQ ID NO: 84168 - protein, 17 aa, Homo sapiens
  heavy chain complementarity determining region 3 for antibody 42084
AREGAYDDRNPGDLLDL

SEQ ID NO: 84169 - protein, 11 aa, Homo sapiens
  light chain complementarity determining region 3 for antibody 42085
QQRSDWPPEVT

SEQ ID NO: 84170 - protein, 16 aa, Homo sapiens
  heavy chain complementarity determining region 3 for antibody 42085
ARVLQGFEERETAFDV

SEQ ID NO: 84171 - protein, 9 aa, Homo sapiens
  light chain complementarity determining region 3 for antibody 42086
QQRSDWPLT

SEQ ID NO: 84172 - protein, 15 aa, Homo sapiens
  heavy chain complementarity determining region 3 for antibody 42086
ARRQSTGWSFDAFDI

SEQ ID NO: 84173 - protein, 9 aa, Homo sapiens
  light chain complementarity determining region 3 for antibody 42087
QQRSDWPLT

SEQ ID NO: 84174 - protein, 11 aa, Homo sapiens
  heavy chain complementarity determining region 3 for antibody 42087
ARDLYDHWLDY

SEQ ID NO: 84175 - protein, 10 aa, Homo sapiens
  light chain complementarity determining region 3 for antibody 42088
QQRNIWPPVT

SEQ ID NO: 84176 - protein, 12 aa, Homo sapiens
  heavy chain complementarity determining region 3 for antibody 42088
VRDITSGWAFDI

SEQ ID NO: 84177 - protein, 9 aa, Homo sapiens
  light chain complementarity determining region 3 for antibody 42089
QQLNSYPYT

SEQ ID NO: 84178 - protein, 18 aa, Homo sapiens
  heavy chain complementarity determining region 3 for antibody 42089
ALEAMRQRLISLHDALDV

SEQ ID NO: 84179 - protein, 9 aa, Homo sapiens
  light chain complementarity determining region 3 for antibody 42090
QQLNSYPWT

SEQ ID NO: 84180 - protein, 12 aa, Homo sapiens
  heavy chain complementarity determining region 3 for antibody 42090
ARSPFKFYGVDV

SEQ ID NO: 84181 - protein, 9 aa, Homo sapiens
  light chain complementarity determining region 3 for antibody 42091
QQLNSYPRT

SEQ ID NO: 84182 - protein, 21 aa, Homo sapiens
  heavy chain complementarity determining region 3 for antibody 42091
ARNGAGCSSTSCHYYYDGMDV

SEQ ID NO: 84183 - protein, 9 aa, Homo sapiens
  light chain complementarity determining region 3 for antibody 42092
QQLNSYPRT

SEQ ID NO: 84184 - protein, 11 aa, Homo sapiens
  heavy chain complementarity determining region 3 for antibody 42092
ARDIASAGFDY

SEQ ID NO: 84185 - protein, 9 aa, Homo sapiens
  light chain complementarity determining region 3 for antibody 42093
QQLNSYPLT

SEQ ID NO: 84186 - protein, 20 aa, Homo sapiens
  heavy chain complementarity determining region 3 for antibody 42093
ARRFVGYCNAPHCYSHAFDL

SEQ ID NO: 84187 - protein, 9 aa, Homo sapiens
  light chain complementarity determining region 3 for antibody 42094
QQLNSYPFT

SEQ ID NO: 84188 - protein, 19 aa, Homo sapiens
  heavy chain complementarity determining region 3 for antibody 42094
AKGPEAATPDYSYYYGMDV

SEQ ID NO: 84189 - protein, 9 aa, Homo sapiens
  light chain complementarity determining region 3 for antibody 42095
QQLHTYPRT

SEQ ID NO: 84190 - protein, 16 aa, Homo sapiens
  heavy chain complementarity determining region 3 for antibody 42095
AKDARRGIAVAGPLTY

SEQ ID NO: 84191 - protein, 9 aa, Homo sapiens
  light chain complementarity determining region 3 for antibody 42096
QQLDSYPLT

SEQ ID NO: 84192 - protein, 17 aa, Homo sapiens
  heavy chain complementarity determining region 3 for antibody 42096
ARTVPHSGTYQRGAFDI

SEQ ID NO: 84193 - protein, 10 aa, Homo sapiens
  light chain complementarity determining region 3 for antibody 42097
QQLDSSLPWT

SEQ ID NO: 84194 - protein, 13 aa, Homo sapiens
  heavy chain complementarity determining region 3 for antibody 42097
ARLIYVDYVFLDY

SEQ ID NO: 84195 - protein, 9 aa, Homo sapiens
  light chain complementarity determining region 3 for antibody 42098
QQIYSTPRT

SEQ ID NO: 84196 - protein, 20 aa, Homo sapiens
  heavy chain complementarity determining region 3 for antibody 42098
ARSTGNHYNSSGYYYSILDI

SEQ ID NO: 84197 - protein, 9 aa, Homo sapiens
  light chain complementarity determining region 3 for antibody 42099
QQHKSYLMP

SEQ ID NO: 84198 - protein, 19 aa, Homo sapiens
  heavy chain complementarity determining region 3 for antibody 42099
ARDSPRIAVMVLHNWYFDL

SEQ ID NO: 84199 - protein, 9 aa, Homo sapiens
  light chain complementarity determining region 3 for antibody 42100
QQGYTTPRT

SEQ ID NO: 84200 - protein, 16 aa, Homo sapiens
  heavy chain complementarity determining region 3 for antibody 42100
AREVIRTVVFLRAFDL

SEQ ID NO: 84201 - protein, 9 aa, Homo sapiens
  light chain complementarity determining region 3 for antibody 42101
QQGYSTPYT

SEQ ID NO: 84202 - protein, 12 aa, Homo sapiens
  heavy chain complementarity determining region 3 for antibody 42101
ASRKYNSGLFDY

SEQ ID NO: 84203 - protein, 9 aa, Homo sapiens
  light chain complementarity determining region 3 for antibody 42102
QQGYGIPRT

SEQ ID NO: 84204 - protein, 14 aa, Homo sapiens
  heavy chain complementarity determining region 3 for antibody 42102
ARRYCSGGSCPEDY

SEQ ID NO: 84205 - protein, 9 aa, Homo sapiens
  light chain complementarity determining region 3 for antibody 42103
QQFNNFPLT

SEQ ID NO: 84206 - protein, 15 aa, Homo sapiens
  heavy chain complementarity determining region 3 for antibody 42103
ARLTSVFNSGRNFDY

SEQ ID NO: 84207 - protein, 9 aa, Homo sapiens
  light chain complementarity determining region 3 for antibody 42104
QQFKSYPFT

SEQ ID NO: 84208 - protein, 14 aa, Homo sapiens
  heavy chain complementarity determining region 3 for antibody 42104
AKARDASGYHAFDY

SEQ ID NO: 84209 - protein, 10 aa, Homo sapiens
  light chain complementarity determining region 3 for antibody 42105
QQFGSTLTYS

SEQ ID NO: 84210 - protein, 11 aa, Homo sapiens
  heavy chain complementarity determining region 3 for antibody 42105
ARISSDDAFDI

SEQ ID NO: 84211 - protein, 11 aa, Homo sapiens
  light chain complementarity determining region 3 for antibody 42106
QQFDNFPPMYT

SEQ ID NO: 84212 - protein, 16 aa, Homo sapiens
  heavy chain complementarity determining region 3 for antibody 42106
ARDPSHGDQPIGAFDF

SEQ ID NO: 84213 - protein, 10 aa, Homo sapiens
  light chain complementarity determining region 3 for antibody 42107
QQCQSPPPIT

SEQ ID NO: 84214 - protein, 12 aa, Homo sapiens
  heavy chain complementarity determining region 3 for antibody 42107
ASYYFGSGTFDY

SEQ ID NO: 84215 - protein, 9 aa, Homo sapiens
  light chain complementarity determining region 3 for antibody 42108
QQCASFPFT

SEQ ID NO: 84216 - protein, 19 aa, Homo sapiens
  heavy chain complementarity determining region 3 for antibody 42108
ARTQMTSDSSGFELYYFDY

SEQ ID NO: 84217 - protein, 9 aa, Homo sapiens
  light chain complementarity determining region 3 for antibody 42109
QQAYSFPLT

SEQ ID NO: 84218 - protein, 20 aa, Homo sapiens
  heavy chain complementarity determining region 3 for antibody 42109
ARDGAFYSSVWPTLEYYFDY

SEQ ID NO: 84219 - protein, 8 aa, Homo sapiens
  light chain complementarity determining region 3 for antibody 42110
QQAYRGLS

SEQ ID NO: 84220 - protein, 15 aa, Homo sapiens
  heavy chain complementarity determining region 3 for antibody 42110
ARYYYNISGYYQLDY

SEQ ID NO: 84221 - protein, 9 aa, Homo sapiens
  light chain complementarity determining region 3 for antibody 42111
QQASSFPHT

SEQ ID NO: 84222 - protein, 11 aa, Homo sapiens
  heavy chain complementarity determining region 3 for antibody 42111
ARAESNIANDF

SEQ ID NO: 84223 - protein, 9 aa, Homo sapiens
  light chain complementarity determining region 3 for antibody 42112
QQARSFPYT

SEQ ID NO: 84224 - protein, 17 aa, Homo sapiens
  heavy chain complementarity determining region 3 for antibody 42112
ARGFEYVTNWFQFYLDI

SEQ ID NO: 84225 - protein, 9 aa, Homo sapiens
  light chain complementarity determining region 3 for antibody 42113
QQANSLPLT

SEQ ID NO: 84226 - protein, 17 aa, Homo sapiens
  heavy chain complementarity determining region 3 for antibody 42113
ARGRLPHNQQEDNWFDP

SEQ ID NO: 84227 - protein, 9 aa, Homo sapiens
  light chain complementarity determining region 3 for antibody 42114
QQANSFPYT

SEQ ID NO: 84228 - protein, 17 aa, Homo sapiens
  heavy chain complementarity determining region 3 for antibody 42114
ARDLGTGRTRTPWYFDL

SEQ ID NO: 84229 - protein, 9 aa, Homo sapiens
  light chain complementarity determining region 3 for antibody 42115
QQANSFPHT

SEQ ID NO: 84230 - protein, 14 aa, Homo sapiens
  heavy chain complementarity determining region 3 for antibody 42115
ARVLGLGAAGPYDY

SEQ ID NO: 84231 - protein, 9 aa, Homo sapiens
  light chain complementarity determining region 3 for antibody 42116
QQADSFPRT

SEQ ID NO: 84232 - protein, 15 aa, Homo sapiens
  heavy chain complementarity determining region 3 for antibody 42116
ARGRPSRLAVAGFHY

SEQ ID NO: 84233 - protein, 9 aa, Homo sapiens
  light chain complementarity determining region 3 for antibody 42117
QNYNSAPYT

SEQ ID NO: 84234 - protein, 8 aa, Homo sapiens
  heavy chain complementarity determining region 3 for antibody 42117
ARGLSYDC

SEQ ID NO: 84235 - protein, 9 aa, Homo sapiens
  light chain complementarity determining region 3 for antibody 42118
QNYHRPPFT

SEQ ID NO: 84236 - protein, 19 aa, Homo sapiens
  heavy chain complementarity determining region 3 for antibody 42118
ARRSSNLIGDKWLDDRFDF

SEQ ID NO: 84237 - protein, 10 aa, Homo sapiens
  light chain complementarity determining region 3 for antibody 42119
QLRSVWPSIT

SEQ ID NO: 84238 - protein, 20 aa, Homo sapiens
  heavy chain complementarity determining region 3 for antibody 42119
AKDRYYDSSGHYYGVNGFDY

SEQ ID NO: 84239 - protein, 9 aa, Homo sapiens
  light chain complementarity determining region 3 for antibody 42120
QKYNSVPLT

SEQ ID NO: 84240 - protein, 9 aa, Homo sapiens
  heavy chain complementarity determining region 3 for antibody 42120
ARHLGPNDY

SEQ ID NO: 84241 - protein, 9 aa, Homo sapiens
  light chain complementarity determining region 3 for antibody 42121
QKYNSAPVT

SEQ ID NO: 84242 - protein, 15 aa, Homo sapiens
  heavy chain complementarity determining region 3 for antibody 42121
AKNSHDGIGSYFFDY

SEQ ID NO: 84243 - protein, 9 aa, Homo sapiens
  light chain complementarity determining region 3 for antibody 42122
QKYNSAPRT

SEQ ID NO: 84244 - protein, 9 aa, Homo sapiens
  heavy chain complementarity determining region 3 for antibody 42122
ATGREIDLF

SEQ ID NO: 84245 - protein, 9 aa, Homo sapiens
  light chain complementarity determining region 3 for antibody 42123
QKYNSAPRT

SEQ ID NO: 84246 - protein, 14 aa, Homo sapiens
  heavy chain complementarity determining region 3 for antibody 42123
AKDKETSGLYGMDV

SEQ ID NO: 84247 - protein, 10 aa, Homo sapiens
  light chain complementarity determining region 3 for antibody 42124
QKYNSALRVT

SEQ ID NO: 84248 - protein, 15 aa, Homo sapiens
  heavy chain complementarity determining region 3 for antibody 42124
ARDSPIAAAKYYFDY

SEQ ID NO: 84249 - protein, 9 aa, Homo sapiens
  light chain complementarity determining region 3 for antibody 42125
QKYNNVPWT

SEQ ID NO: 84250 - protein, 9 aa, Homo sapiens
  heavy chain complementarity determining region 3 for antibody 42125
VASSTEFDY

SEQ ID NO: 84251 - protein, 9 aa, Homo sapiens
  light chain complementarity determining region 3 for antibody 42126
QKYDGVPPT

SEQ ID NO: 84252 - protein, 14 aa, Homo sapiens
  heavy chain complementarity determining region 3 for antibody 42126
TSPMYFYDGSGIDH

SEQ ID NO: 84253 - protein, 9 aa, Homo sapiens
  light chain complementarity determining region 3 for antibody 42127
QKLDSFPWT

SEQ ID NO: 84254 - protein, 13 aa, Homo sapiens
  heavy chain complementarity determining region 3 for antibody 42127
AAGTRTGYFGMDV

SEQ ID NO: 84255 - protein, 11 aa, Homo sapiens
  light chain complementarity determining region 3 for antibody 42128
QHYSSYGSTWT

SEQ ID NO: 84256 - protein, 13 aa, Homo sapiens
  heavy chain complementarity determining region 3 for antibody 42128
ARAGLGGLDAFHI

SEQ ID NO: 84257 - protein, 10 aa, Homo sapiens
  light chain complementarity determining region 3 for antibody 42129
QHYSNSPPWT

SEQ ID NO: 84258 - protein, 16 aa, Homo sapiens
  heavy chain complementarity determining region 3 for antibody 42129
ARRQWVRGLFRGGLDS

SEQ ID NO: 84259 - protein, 11 aa, Homo sapiens
  light chain complementarity determining region 3 for antibody 42130
QHYNTYSLTWT

SEQ ID NO: 84260 - protein, 14 aa, Homo sapiens
  heavy chain complementarity determining region 3 for antibody 42130
ARKAGYSSYWAFDC

SEQ ID NO: 84261 - protein, 8 aa, Homo sapiens
  light chain complementarity determining region 3 for antibody 42131
QHYGTSWT

SEQ ID NO: 84262 - protein, 17 aa, Homo sapiens
  heavy chain complementarity determining region 3 for antibody 42131
ARDPGGGLGDNYHFFDY

SEQ ID NO: 84263 - protein, 9 aa, Homo sapiens
  light chain complementarity determining region 3 for antibody 42132
QHYGTSPWT

SEQ ID NO: 84264 - protein, 14 aa, Homo sapiens
  heavy chain complementarity determining region 3 for antibody 42132
ARACRFDCLEASDS

SEQ ID NO: 84265 - protein, 10 aa, Homo sapiens
  light chain complementarity determining region 3 for antibody 42133
QHYGKPPLYT

SEQ ID NO: 84266 - protein, 10 aa, Homo sapiens
  heavy chain complementarity determining region 3 for antibody 42133
VRAGYYCLDY

SEQ ID NO: 84267 - protein, 7 aa, Homo sapiens
  light chain complementarity determining region 3 for antibody 42134
QHYDNLT

SEQ ID NO: 84268 - protein, 16 aa, Homo sapiens
  heavy chain complementarity determining region 3 for antibody 42134
ASPKPLSGYLIDAFDL

SEQ ID NO: 84269 - protein, 9 aa, Homo sapiens
  light chain complementarity determining region 3 for antibody 42135
QHYDNLPHT

SEQ ID NO: 84270 - protein, 23 aa, Homo sapiens
  heavy chain complementarity determining region 3 for antibody 42135
ARVPGLRRYYGILTGSRTRYFDY

SEQ ID NO: 84271 - protein, 10 aa, Homo sapiens
  light chain complementarity determining region 3 for antibody 42136
QHYDDSPPWT

SEQ ID NO: 84272 - protein, 14 aa, Homo sapiens
  heavy chain complementarity determining region 3 for antibody 42136
ARSGAGTAAGKFDY

SEQ ID NO: 84273 - protein, 9 aa, Homo sapiens
  light chain complementarity determining region 3 for antibody 42137
QHSYTTQWA

SEQ ID NO: 84274 - protein, 14 aa, Homo sapiens
  heavy chain complementarity determining region 3 for antibody 42137
ARVSDSGSYYYLDS

SEQ ID NO: 84275 - protein, 9 aa, Homo sapiens
  light chain complementarity determining region 3 for antibody 42138
QHRNNWPPA

SEQ ID NO: 84276 - protein, 17 aa, Homo sapiens
  heavy chain complementarity determining region 3 for antibody 42138
AREGGYCVGGGCRWFDL

SEQ ID NO: 84277 - protein, 9 aa, Homo sapiens
  light chain complementarity determining region 3 for antibody 42139
QHLNDSPRT

SEQ ID NO: 84278 - protein, 19 aa, Homo sapiens
  heavy chain complementarity determining region 3 for antibody 42139
ARDRRVAVTGVHNYYALEV

SEQ ID NO: 84279 - protein, 9 aa, Homo sapiens
  light chain complementarity determining region 3 for antibody 42140
QHFGSSRFT

SEQ ID NO: 84280 - protein, 11 aa, Homo sapiens
  heavy chain complementarity determining region 3 for antibody 42140
STGWTYFQFDS

SEQ ID NO: 84281 - protein, 9 aa, Homo sapiens
  light chain complementarity determining region 3 for antibody 42141
QEYDDDTRT

SEQ ID NO: 84282 - protein, 12 aa, Homo sapiens
  heavy chain complementarity determining region 3 for antibody 42141
ARAGSGWYYFDL

SEQ ID NO: 84283 - protein, 10 aa, Homo sapiens
  light chain complementarity determining region 3 for antibody 42142
QESYSPPRHT

SEQ ID NO: 84284 - protein, 13 aa, Homo sapiens
  heavy chain complementarity determining region 3 for antibody 42142
ARSGYYGSGEFDF

SEQ ID NO: 84285 - protein, 9 aa, Homo sapiens
  light chain complementarity determining region 3 for antibody 42143
MQSTHWPYT

SEQ ID NO: 84286 - protein, 12 aa, Homo sapiens
  heavy chain complementarity determining region 3 for antibody 42143
ARDKNNHDVLTY

SEQ ID NO: 84287 - protein, 9 aa, Homo sapiens
  light chain complementarity determining region 3 for antibody 42144
MQSTHWPHT

SEQ ID NO: 84288 - protein, 10 aa, Homo sapiens
  heavy chain complementarity determining region 3 for antibody 42144
VMAYDTRGFD

SEQ ID NO: 84289 - protein, 9 aa, Homo sapiens
  light chain complementarity determining region 3 for antibody 42145
MQPLQTPFT

SEQ ID NO: 84290 - protein, 15 aa, Homo sapiens
  heavy chain complementarity determining region 3 for antibody 42145
AREVIAPTTSDAFDI

SEQ ID NO: 84291 - protein, 9 aa, Homo sapiens
  light chain complementarity determining region 3 for antibody 42146
MQGTQWPHT

SEQ ID NO: 84292 - protein, 9 aa, Homo sapiens
  heavy chain complementarity determining region 3 for antibody 42146
VGWGNGLNP

SEQ ID NO: 84293 - protein, 10 aa, Homo sapiens
  light chain complementarity determining region 3 for antibody 42147
MQGTHWPRGT

SEQ ID NO: 84294 - protein, 12 aa, Homo sapiens
  heavy chain complementarity determining region 3 for antibody 42147
ARKAIAAGGTDC

SEQ ID NO: 84295 - protein, 9 aa, Homo sapiens
  light chain complementarity determining region 3 for antibody 42148
MQGTHWPFT

SEQ ID NO: 84296 - protein, 15 aa, Homo sapiens
  heavy chain complementarity determining region 3 for antibody 42148
ARDVRSHPVDNFFDY

SEQ ID NO: 84297 - protein, 9 aa, Homo sapiens
  light chain complementarity determining region 3 for antibody 42149
MQGTHPPIT

SEQ ID NO: 84298 - protein, 12 aa, Homo sapiens
  heavy chain complementarity determining region 3 for antibody 42149
PTEAPSTGRLDY

SEQ ID NO: 84299 - protein, 9 aa, Homo sapiens
  light chain complementarity determining region 3 for antibody 42150
MQGTFWPWT

SEQ ID NO: 84300 - protein, 14 aa, Homo sapiens
  heavy chain complementarity determining region 3 for antibody 42150
ARLGDAGSYGHFDL

SEQ ID NO: 84301 - protein, 9 aa, Homo sapiens
  light chain complementarity determining region 3 for antibody 42151
MQGLQTPWT

SEQ ID NO: 84302 - protein, 12 aa, Homo sapiens
  heavy chain complementarity determining region 3 for antibody 42151
ARDLGYTSGWRL

SEQ ID NO: 84303 - protein, 9 aa, Homo sapiens
  light chain complementarity determining region 3 for antibody 42152
MQGAHWPPT

SEQ ID NO: 84304 - protein, 11 aa, Homo sapiens
  heavy chain complementarity determining region 3 for antibody 42152
ARPSHTVTADY

SEQ ID NO: 84305 - protein, 10 aa, Homo sapiens
  light chain complementarity determining region 3 for antibody 42153
MQGAHWLPWT

SEQ ID NO: 84306 - protein, 13 aa, Homo sapiens
  heavy chain complementarity determining region 3 for antibody 42153
NVGMVGHTSPVDH

SEQ ID NO: 84307 - protein, 9 aa, Homo sapiens
  light chain complementarity determining region 3 for antibody 42154
MQALQVPLT

SEQ ID NO: 84308 - protein, 16 aa, Homo sapiens
  heavy chain complementarity determining region 3 for antibody 42154
ARDPDQDSSMENGMDV

SEQ ID NO: 84309 - protein, 8 aa, Homo sapiens
  light chain complementarity determining region 3 for antibody 42155
MQALQTYT

SEQ ID NO: 84310 - protein, 15 aa, Homo sapiens
  heavy chain complementarity determining region 3 for antibody 42155
AKDLRGDYNWEAFDI

SEQ ID NO: 84311 - protein, 10 aa, Homo sapiens
  light chain complementarity determining region 3 for antibody 42156
MQALQTPLRT

SEQ ID NO: 84312 - protein, 8 aa, Homo sapiens
  heavy chain complementarity determining region 3 for antibody 42156
ARRYYFDY

SEQ ID NO: 84313 - protein, 9 aa, Homo sapiens
  light chain complementarity determining region 3 for antibody 42157
MQALQSPPT

SEQ ID NO: 84314 - protein, 17 aa, Homo sapiens
  heavy chain complementarity determining region 3 for antibody 42157
AKKLELVVTGWAWGLYY

SEQ ID NO: 84315 - protein, 9 aa, Homo sapiens
  light chain complementarity determining region 3 for antibody 42158
MEGSYWPKT

SEQ ID NO: 84316 - protein, 11 aa, Homo sapiens
  heavy chain complementarity determining region 3 for antibody 42158
ARDPGWGAVDI

SEQ ID NO: 84317 - protein, 9 aa, Homo sapiens
  light chain complementarity determining region 3 for antibody 42159
LQYSSFPLT

SEQ ID NO: 84318 - protein, 16 aa, Homo sapiens
  heavy chain complementarity determining region 3 for antibody 42159
ARGWIGDVLWFGDLLY

SEQ ID NO: 84319 - protein, 9 aa, Homo sapiens
  light chain complementarity determining region 3 for antibody 42160
LQYNSFPYT

SEQ ID NO: 84320 - protein, 13 aa, Homo sapiens
  heavy chain complementarity determining region 3 for antibody 42160
ARGGRGIGGYPDY

SEQ ID NO: 84321 - protein, 10 aa, Homo sapiens
  light chain complementarity determining region 3 for antibody 42161
LQYKSYPRLT

SEQ ID NO: 84322 - protein, 17 aa, Homo sapiens
  heavy chain complementarity determining region 3 for antibody 42161
AKVDGSSGFYYDDAFDI

SEQ ID NO: 84323 - protein, 8 aa, Homo sapiens
  light chain complementarity determining region 3 for antibody 42162
LQYGVSRT

SEQ ID NO: 84324 - protein, 16 aa, Homo sapiens
  heavy chain complementarity determining region 3 for antibody 42162
ARQAGGSSLLDYYFDS

SEQ ID NO: 84325 - protein, 9 aa, Homo sapiens
  light chain complementarity determining region 3 for antibody 42163
LQYGNSPFT

SEQ ID NO: 84326 - protein, 18 aa, Homo sapiens
  heavy chain complementarity determining region 3 for antibody 42163
ARGLDIMATVDDVWYFDL

SEQ ID NO: 84327 - protein, 9 aa, Homo sapiens
  light chain complementarity determining region 3 for antibody 42164
LQHNSYPLI

SEQ ID NO: 84328 - protein, 14 aa, Homo sapiens
  heavy chain complementarity determining region 3 for antibody 42164
VRDGRGYSDDYFDC

SEQ ID NO: 84329 - protein, 10 aa, Homo sapiens
  light chain complementarity determining region 3 for antibody 42165
LQGTHRPYYT

SEQ ID NO: 84330 - protein, 18 aa, Homo sapiens
  heavy chain complementarity determining region 3 for antibody 42165
ARDGTEYCSGVNCYYFDY

SEQ ID NO: 84331 - protein, 8 aa, Homo sapiens
  light chain complementarity determining region 3 for antibody 42166
LQDYILWT

SEQ ID NO: 84332 - protein, 11 aa, Homo sapiens
  heavy chain complementarity determining region 3 for antibody 42166
ARADYGLPVDY

SEQ ID NO: 84333 - protein, 9 aa, Homo sapiens
  light chain complementarity determining region 3 for antibody 42167
LQDYGSPFT

SEQ ID NO: 84334 - protein, 15 aa, Homo sapiens
  heavy chain complementarity determining region 3 for antibody 42167
AHRLDHVDSAMNFDY

SEQ ID NO: 84335 - protein, 9 aa, Homo sapiens
  light chain complementarity determining region 3 for antibody 42168
LQDYDYPRT

SEQ ID NO: 84336 - protein, 19 aa, Homo sapiens
  heavy chain complementarity determining region 3 for antibody 42168
ARDSNPNERGQLWFDAYDI

SEQ ID NO: 84337 - protein, 9 aa, Homo sapiens
  light chain complementarity determining region 3 for antibody 42169
LQALHAPRT

SEQ ID NO: 84338 - protein, 18 aa, Homo sapiens
  heavy chain complementarity determining region 3 for antibody 42169
ARHSGLGLRPESYYGMDV

SEQ ID NO: 84339 - protein, 10 aa, Homo sapiens
  light chain complementarity determining region 3 for antibody 42170
LEYGNWPPLT

SEQ ID NO: 84340 - protein, 16 aa, Homo sapiens
  heavy chain complementarity determining region 3 for antibody 42170
ATMSRDYVSGSYYPDY

SEQ ID NO: 84341 - protein, 9 aa, Homo sapiens
  light chain complementarity determining region 3 for antibody 42171
HQYYSYPNT

SEQ ID NO: 84342 - protein, 9 aa, Homo sapiens
  heavy chain complementarity determining region 3 for antibody 42171
ARGWIQPDY

SEQ ID NO: 84343 - protein, 10 aa, Homo sapiens
  light chain complementarity determining region 3 for antibody 42172
HQYHTYPPWT

SEQ ID NO: 84344 - protein, 19 aa, Homo sapiens
  heavy chain complementarity determining region 3 for antibody 42172
VRDSSWGSIVGVTRGKFDY

SEQ ID NO: 84345 - protein, 9 aa, Homo sapiens
  light chain complementarity determining region 3 for antibody 42173
HQYGTSPWT

SEQ ID NO: 84346 - protein, 14 aa, Homo sapiens
  heavy chain complementarity determining region 3 for antibody 42173
ASDPPGRYYGAFDV

SEQ ID NO: 84347 - protein, 10 aa, Homo sapiens
  light chain complementarity determining region 3 for antibody 42174
HQYGTSPPYT

SEQ ID NO: 84348 - protein, 16 aa, Homo sapiens
  heavy chain complementarity determining region 3 for antibody 42174
ARGYTLVRGLNRYFDF

SEQ ID NO: 84349 - protein, 9 aa, Homo sapiens
  light chain complementarity determining region 3 for antibody 42175
HQYDSYSWT

SEQ ID NO: 84350 - protein, 16 aa, Homo sapiens
  heavy chain complementarity determining region 3 for antibody 42175
ATGRGYELKTGWYFDL

SEQ ID NO: 84351 - protein, 9 aa, Homo sapiens
  light chain complementarity determining region 3 for antibody 42176
HQYDKLPFT

SEQ ID NO: 84352 - protein, 15 aa, Homo sapiens
  heavy chain complementarity determining region 3 for antibody 42176
ARDSGIAAPRGIFDI

SEQ ID NO: 84353 - protein, 9 aa, Homo sapiens
  light chain complementarity determining region 3 for antibody 42177
HQYAKTPIT

SEQ ID NO: 84354 - protein, 13 aa, Homo sapiens
  heavy chain complementarity determining region 3 for antibody 42177
ARAQEFSTSCPGY

SEQ ID NO: 84355 - protein, 9 aa, Homo sapiens
  light chain complementarity determining region 3 for antibody 42178
HQSYSSPPT

SEQ ID NO: 84356 - protein, 16 aa, Homo sapiens
  heavy chain complementarity determining region 3 for antibody 42178
ARDSRQSGFVGSSFDI

SEQ ID NO: 84357 - protein, 9 aa, Homo sapiens
  light chain complementarity determining region 3 for antibody 42179
HQSYSAPPT

SEQ ID NO: 84358 - protein, 14 aa, Homo sapiens
  heavy chain complementarity determining region 3 for antibody 42179
TTCVPAASQNTEDY

SEQ ID NO: 84359 - protein, 8 aa, Homo sapiens
  light chain complementarity determining region 3 for antibody 42180
QVYGGSYT

SEQ ID NO: 84360 - protein, 12 aa, Homo sapiens
  heavy chain complementarity determining region 3 for antibody 42180
VLDGGSVHGFDI

SEQ ID NO: 84361 - protein, 9 aa, Homo sapiens
  light chain complementarity determining region 3 for antibody 42181
QRYSSFSRT

SEQ ID NO: 84362 - protein, 10 aa, Homo sapiens
  heavy chain complementarity determining region 3 for antibody 42181
ARDSDIGLDY

SEQ ID NO: 84363 - protein, 9 aa, Homo sapiens
  light chain complementarity determining region 3 for antibody 42182
QRYGSSPVT

SEQ ID NO: 84364 - protein, 21 aa, Homo sapiens
  heavy chain complementarity determining region 3 for antibody 42182
ARAPLGYCTGGTCNFGEYFQQ

SEQ ID NO: 84365 - protein, 9 aa, Homo sapiens
  light chain complementarity determining region 3 for antibody 42183
QRQNIAPLT

SEQ ID NO: 84366 - protein, 10 aa, Homo sapiens
  heavy chain complementarity determining region 3 for antibody 42183
ARDEGYFGTS

SEQ ID NO: 84367 - protein, 10 aa, Homo sapiens
  light chain complementarity determining region 3 for antibody 42184
QQYYSTLSYT

SEQ ID NO: 84368 - protein, 14 aa, Homo sapiens
  heavy chain complementarity determining region 3 for antibody 42184
ARDGTSGWYEDFDY

SEQ ID NO: 84369 - protein, 8 aa, Homo sapiens
  light chain complementarity determining region 3 for antibody 42185
QQYYDSPT

SEQ ID NO: 84370 - protein, 15 aa, Homo sapiens
  heavy chain complementarity determining region 3 for antibody 42185
ARGVGESGDYWVYKY

SEQ ID NO: 84371 - protein, 9 aa, Homo sapiens
  light chain complementarity determining region 3 for antibody 42186
QQYVTFPLT

SEQ ID NO: 84372 - protein, 17 aa, Homo sapiens
  heavy chain complementarity determining region 3 for antibody 42186
ARDRVLSTSWNWGGFDY

SEQ ID NO: 84373 - protein, 8 aa, Homo sapiens
  light chain complementarity determining region 3 for antibody 42187
QQYTSPWT

SEQ ID NO: 84374 - protein, 17 aa, Homo sapiens
  heavy chain complementarity determining region 3 for antibody 42187
AASPIAPKPWELLPADD

SEQ ID NO: 84375 - protein, 8 aa, Homo sapiens
  light chain complementarity determining region 3 for antibody 42188
QQYSSSIT

SEQ ID NO: 84376 - protein, 15 aa, Homo sapiens
  heavy chain complementarity determining region 3 for antibody 42188
VRDRSGARVSTYFDY

SEQ ID NO: 84377 - protein, 9 aa, Homo sapiens
  light chain complementarity determining region 3 for antibody 42189
QQYSSNRVT

SEQ ID NO: 84378 - protein, 13 aa, Homo sapiens
  heavy chain complementarity determining region 3 for antibody 42189
ARDRLGATDAFDI

SEQ ID NO: 84379 - protein, 10 aa, Homo sapiens
  light chain complementarity determining region 3 for antibody 42190
QQYSNPPLYS

SEQ ID NO: 84380 - protein, 10 aa, Homo sapiens
  heavy chain complementarity determining region 3 for antibody 42190
ARAGYYCLND

SEQ ID NO: 84381 - protein, 9 aa, Homo sapiens
  light chain complementarity determining region 3 for antibody 42191
QQYSISLFS

SEQ ID NO: 84382 - protein, 19 aa, Homo sapiens
  heavy chain complementarity determining region 3 for antibody 42191
VSGLGESGDHEGVGYTGDH

SEQ ID NO: 84383 - protein, 9 aa, Homo sapiens
  light chain complementarity determining region 3 for antibody 42192
QQYQTSTRT

SEQ ID NO: 84384 - protein, 15 aa, Homo sapiens
  heavy chain complementarity determining region 3 for antibody 42192
VRDGNVLSTGYPLDF

SEQ ID NO: 84385 - protein, 8 aa, Homo sapiens
  light chain complementarity determining region 3 for antibody 42193
QQYNVFWT

SEQ ID NO: 84386 - protein, 10 aa, Homo sapiens
  heavy chain complementarity determining region 3 for antibody 42193
ATDRRSVLSY

SEQ ID NO: 84387 - protein, 9 aa, Homo sapiens
  light chain complementarity determining region 3 for antibody 42194
QQYNTYPFT

SEQ ID NO: 84388 - protein, 19 aa, Homo sapiens
  heavy chain complementarity determining region 3 for antibody 42194
AHSGPFYYDSNNYYDYFYY

SEQ ID NO: 84389 - protein, 9 aa, Homo sapiens
  light chain complementarity determining region 3 for antibody 42195
QQYNTYPET

SEQ ID NO: 84390 - protein, 16 aa, Homo sapiens
  heavy chain complementarity determining region 3 for antibody 42195
AKRRAYSSSSPYDFAY

SEQ ID NO: 84391 - protein, 9 aa, Homo sapiens
  light chain complementarity determining region 3 for antibody 42196
QQYNSYSWT

SEQ ID NO: 84392 - protein, 13 aa, Homo sapiens
  heavy chain complementarity determining region 3 for antibody 42196
AREGCSGGSCHLS

SEQ ID NO: 84393 - protein, 10 aa, Homo sapiens
  light chain complementarity determining region 3 for antibody 42197
QQYNSYSPET

SEQ ID NO: 84394 - protein, 15 aa, Homo sapiens
  heavy chain complementarity determining region 3 for antibody 42197
ARERHSAFGYYGLDI

SEQ ID NO: 84395 - protein, 9 aa, Homo sapiens
  light chain complementarity determining region 3 for antibody 42198
QQYNSYSNT

SEQ ID NO: 84396 - protein, 14 aa, Homo sapiens
  heavy chain complementarity determining region 3 for antibody 42198
AREFSSSWSNYFDP

SEQ ID NO: 84397 - protein, 9 aa, Homo sapiens
  light chain complementarity determining region 3 for antibody 42199
QQYNSYSGT

SEQ ID NO: 84398 - protein, 14 aa, Homo sapiens
  heavy chain complementarity determining region 3 for antibody 42199
AKEYLPIPKRAFDI

SEQ ID NO: 84399 - protein, 9 aa, Homo sapiens
  light chain complementarity determining region 3 for antibody 42200
QQYNSYPYT

SEQ ID NO: 84400 - protein, 13 aa, Homo sapiens
  heavy chain complementarity determining region 3 for antibody 42200
ARRQTYTNYAFDI

SEQ ID NO: 84401 - protein, 9 aa, Homo sapiens
  light chain complementarity determining region 3 for antibody 42201
QQYNSYPYT

SEQ ID NO: 84402 - protein, 20 aa, Homo sapiens
  heavy chain complementarity determining region 3 for antibody 42201
ARDGGGVVLVPATTRGWFDP

SEQ ID NO: 84403 - protein, 9 aa, Homo sapiens
  light chain complementarity determining region 3 for antibody 42202
QQYNSYPWT

SEQ ID NO: 84404 - protein, 7 aa, Homo sapiens
  heavy chain complementarity determining region 3 for antibody 42202
ARKEAEI

SEQ ID NO: 84405 - protein, 9 aa, Homo sapiens
  light chain complementarity determining region 3 for antibody 42203
QQYNSYPWT

SEQ ID NO: 84406 - protein, 14 aa, Homo sapiens
  heavy chain complementarity determining region 3 for antibody 42203
ARDRNGSGNKPPHH

SEQ ID NO: 84407 - protein, 9 aa, Homo sapiens
  light chain complementarity determining region 3 for antibody 42204
QQYNSYPWT

SEQ ID NO: 84408 - protein, 15 aa, Homo sapiens
  heavy chain complementarity determining region 3 for antibody 42204
AKDRRFGEPPDGMDV

SEQ ID NO: 84409 - protein, 9 aa, Homo sapiens
  light chain complementarity determining region 3 for antibody 42205
QQYNSYPRT

SEQ ID NO: 84410 - protein, 20 aa, Homo sapiens
  heavy chain complementarity determining region 3 for antibody 42205
TRVHYFENNGYYIEAYYFDY

SEQ ID NO: 84411 - protein, 9 aa, Homo sapiens
  light chain complementarity determining region 3 for antibody 42206
QQYNSYPLT

SEQ ID NO: 84412 - protein, 9 aa, Homo sapiens
  heavy chain complementarity determining region 3 for antibody 42206
ARGGNSWRY

SEQ ID NO: 84413 - protein, 9 aa, Homo sapiens
  light chain complementarity determining region 3 for antibody 42207
QQYNSYPHT

SEQ ID NO: 84414 - protein, 15 aa, Homo sapiens
  heavy chain complementarity determining region 3 for antibody 42207
ARHRGGVRGPSGLDV

SEQ ID NO: 84415 - protein, 9 aa, Homo sapiens
  light chain complementarity determining region 3 for antibody 42208
QQYNSYPFT

SEQ ID NO: 84416 - protein, 20 aa, Homo sapiens
  heavy chain complementarity determining region 3 for antibody 42208
AHLSTSDDILTGYYHDIFDI

SEQ ID NO: 84417 - protein, 8 aa, Homo sapiens
  light chain complementarity determining region 3 for antibody 42209
QQYNSYGT

SEQ ID NO: 84418 - protein, 13 aa, Homo sapiens
  heavy chain complementarity determining region 3 for antibody 42209
AKTPYTTSWVVGS

SEQ ID NO: 84419 - protein, 10 aa, Homo sapiens
  light chain complementarity determining region 3 for antibody 42210
QQYNSYFTWT

SEQ ID NO: 84420 - protein, 15 aa, Homo sapiens
  heavy chain complementarity determining region 3 for antibody 42210
AHRPSELRWSNYFDY

SEQ ID NO: 84421 - protein, 8 aa, Homo sapiens
  light chain complementarity determining region 3 for antibody 42211
QQYNSSYT

SEQ ID NO: 84422 - protein, 13 aa, Homo sapiens
  heavy chain complementarity determining region 3 for antibody 42211
ARGGVLVTALLDS

SEQ ID NO: 84423 - protein, 9 aa, Homo sapiens
  light chain complementarity determining region 3 for antibody 42212
QQYNSSRWT

SEQ ID NO: 84424 - protein, 8 aa, Homo sapiens
  heavy chain complementarity determining region 3 for antibody 42212
ASVPGTGP

SEQ ID NO: 84425 - protein, 9 aa, Homo sapiens
  light chain complementarity determining region 3 for antibody 42213
QQYNSHPRT

SEQ ID NO: 84426 - protein, 18 aa, Homo sapiens
  heavy chain complementarity determining region 3 for antibody 42213
AREFLRYFDSSKAYNFDD

SEQ ID NO: 84427 - protein, 8 aa, Homo sapiens
  light chain complementarity determining region 3 for antibody 42214
QQYNSFWT

SEQ ID NO: 84428 - protein, 20 aa, Homo sapiens
  heavy chain complementarity determining region 3 for antibody 42214
ARHCNGGSCYDGDYYFGMDV

SEQ ID NO: 84429 - protein, 9 aa, Homo sapiens
  light chain complementarity determining region 3 for antibody 42215
QQYNNYPWT

SEQ ID NO: 84430 - protein, 10 aa, Homo sapiens
  heavy chain complementarity determining region 3 for antibody 42215
ARLVFPYFDF

SEQ ID NO: 84431 - protein, 9 aa, Homo sapiens
  light chain complementarity determining region 3 for antibody 42216
QQYNNWSYT

SEQ ID NO: 84432 - protein, 13 aa, Homo sapiens
  heavy chain complementarity determining region 3 for antibody 42216
ARQGSPGGDAFDV

SEQ ID NO: 84433 - protein, 9 aa, Homo sapiens
  light chain complementarity determining region 3 for antibody 42217
QQYNNWPRT

SEQ ID NO: 84434 - protein, 19 aa, Homo sapiens
  heavy chain complementarity determining region 3 for antibody 42217
ARGPYGSGTYYKKGPVGDY

SEQ ID NO: 84435 - protein, 9 aa, Homo sapiens
  light chain complementarity determining region 3 for antibody 42218
QQYNNWPLT

SEQ ID NO: 84436 - protein, 12 aa, Homo sapiens
  heavy chain complementarity determining region 3 for antibody 42218
ASDLISLTGTNY

SEQ ID NO: 84437 - protein, 8 aa, Homo sapiens
  light chain complementarity determining region 3 for antibody 42219
QQYNDWYT

SEQ ID NO: 84438 - protein, 20 aa, Homo sapiens
  heavy chain complementarity determining region 3 for antibody 42219
AKVRTAMRVAVISPLLDFDY

SEQ ID NO: 84439 - protein, 9 aa, Homo sapiens
  light chain complementarity determining region 3 for antibody 42220
QQYLGYPYT

SEQ ID NO: 84440 - protein, 18 aa, Homo sapiens
  heavy chain complementarity determining region 3 for antibody 42220
VRDLEVNSAGWYGGGFDY

SEQ ID NO: 84441 - protein, 9 aa, Homo sapiens
  light chain complementarity determining region 3 for antibody 42221
QQYLGSPYT

SEQ ID NO: 84442 - protein, 15 aa, Homo sapiens
  heavy chain complementarity determining region 3 for antibody 42221
ARHGYTGVAGEHLQH

SEQ ID NO: 84443 - protein, 9 aa, Homo sapiens
  light chain complementarity determining region 3 for antibody 42222
QQYKGYSYT

SEQ ID NO: 84444 - protein, 16 aa, Homo sapiens
  heavy chain complementarity determining region 3 for antibody 42222
ARATIRSNWFWTPFEY

SEQ ID NO: 84445 - protein, 9 aa, Homo sapiens
  light chain complementarity determining region 3 for antibody 42223
QQYINSPWT

SEQ ID NO: 84446 - protein, 19 aa, Homo sapiens
  heavy chain complementarity determining region 3 for antibody 42223
ARARDRSARNNFFSYAFDV

SEQ ID NO: 84447 - protein, 9 aa, Homo sapiens
  light chain complementarity determining region 3 for antibody 42224
QQYHSYSRT

SEQ ID NO: 84448 - protein, 12 aa, Homo sapiens
  heavy chain complementarity determining region 3 for antibody 42224
ARSHHFWSGYNY

SEQ ID NO: 84449 - protein, 10 aa, Homo sapiens
  light chain complementarity determining region 3 for antibody 42225
QQYHSSSPLT

SEQ ID NO: 84450 - protein, 13 aa, Homo sapiens
  heavy chain complementarity determining region 3 for antibody 42225
ARARGLTGTTWEH

SEQ ID NO: 84451 - protein, 8 aa, Homo sapiens
  light chain complementarity determining region 3 for antibody 42226
QQYHNLLS

SEQ ID NO: 84452 - protein, 17 aa, Homo sapiens
  heavy chain complementarity determining region 3 for antibody 42226
TRVGRYYDRSGYEYFQH

SEQ ID NO: 84453 - protein, 9 aa, Homo sapiens
  light chain complementarity determining region 3 for antibody 42227
QQYHKVPYT

SEQ ID NO: 84454 - protein, 16 aa, Homo sapiens
  heavy chain complementarity determining region 3 for antibody 42227
SRHPSPDYGDNSPLDY

SEQ ID NO: 84455 - protein, 9 aa, Homo sapiens
  light chain complementarity determining region 3 for antibody 42228
QQYGWSTWT

SEQ ID NO: 84456 - protein, 16 aa, Homo sapiens
  heavy chain complementarity determining region 3 for antibody 42228
GSSMLWRGFDLRGIES

SEQ ID NO: 84457 - protein, 9 aa, Homo sapiens
  light chain complementarity determining region 3 for antibody 42229
QQYGVSPRT

SEQ ID NO: 84458 - protein, 16 aa, Homo sapiens
  heavy chain complementarity determining region 3 for antibody 42229
ARLPPLGSENSLAFDL

SEQ ID NO: 84459 - protein, 10 aa, Homo sapiens
  light chain complementarity determining region 3 for antibody 42230
QQYGTSRLYT

SEQ ID NO: 84460 - protein, 14 aa, Homo sapiens
  heavy chain complementarity determining region 3 for antibody 42230
AKRRRIVGAYYFES

SEQ ID NO: 84461 - protein, 10 aa, Homo sapiens
  light chain complementarity determining region 3 for antibody 42231
QQYGSTLPLT

SEQ ID NO: 84462 - protein, 17 aa, Homo sapiens
  heavy chain complementarity determining region 3 for antibody 42231
ARSAYCNMTSCYRHFQH

SEQ ID NO: 84463 - protein, 9 aa, Homo sapiens
  light chain complementarity determining region 3 for antibody 42232
QQYGSSPYT

SEQ ID NO: 84464 - protein, 11 aa, Homo sapiens
  heavy chain complementarity determining region 3 for antibody 42232
ARHTHQDGFDP

SEQ ID NO: 84465 - protein, 9 aa, Homo sapiens
  light chain complementarity determining region 3 for antibody 42233
QQYGSSPWT

SEQ ID NO: 84466 - protein, 13 aa, Homo sapiens
  heavy chain complementarity determining region 3 for antibody 42233
ARHPLVRGVIIDY

SEQ ID NO: 84467 - protein, 9 aa, Homo sapiens
  light chain complementarity determining region 3 for antibody 42234
QQYGSSPWT

SEQ ID NO: 84468 - protein, 14 aa, Homo sapiens
  heavy chain complementarity determining region 3 for antibody 42234
ARGAGWLRDPSHDY

SEQ ID NO: 84469 - protein, 10 aa, Homo sapiens
  light chain complementarity determining region 3 for antibody 42235
QQYGSSPQNT

SEQ ID NO: 84470 - protein, 15 aa, Homo sapiens
  heavy chain complementarity determining region 3 for antibody 42235
ARAPGDYNLLSPLSD

SEQ ID NO: 84471 - protein, 11 aa, Homo sapiens
  light chain complementarity determining region 3 for antibody 42236
QQYGSSPPMYT

SEQ ID NO: 84472 - protein, 16 aa, Homo sapiens
  heavy chain complementarity determining region 3 for antibody 42236
VRVHGVYYYYYYGLGV

SEQ ID NO: 84473 - protein, 9 aa, Homo sapiens
  light chain complementarity determining region 3 for antibody 42237
QQYGSSPLT

SEQ ID NO: 84474 - protein, 12 aa, Homo sapiens
  heavy chain complementarity determining region 3 for antibody 42237
ARASWFLSVFDS

SEQ ID NO: 84475 - protein, 9 aa, Homo sapiens
  light chain complementarity determining region 3 for antibody 42238
QQYGSSPLT

SEQ ID NO: 84476 - protein, 18 aa, Homo sapiens
  heavy chain complementarity determining region 3 for antibody 42238
AKANWEFQVFAGAVWFEL

SEQ ID NO: 84477 - protein, 10 aa, Homo sapiens
  light chain complementarity determining region 3 for antibody 42239
QQYGSSPLLT

SEQ ID NO: 84478 - protein, 18 aa, Homo sapiens
  heavy chain complementarity determining region 3 for antibody 42239
AKAPPARSGYYRYWYFDL

SEQ ID NO: 84479 - protein, 9 aa, Homo sapiens
  light chain complementarity determining region 3 for antibody 42240
QQYGSSLWT

SEQ ID NO: 84480 - protein, 16 aa, Homo sapiens
  heavy chain complementarity determining region 3 for antibody 42240
ASGLRGMSHYYYDMNV

SEQ ID NO: 84481 - protein, 9 aa, Homo sapiens
  light chain complementarity determining region 3 for antibody 42241
QQYGSSLFT

SEQ ID NO: 84482 - protein, 19 aa, Homo sapiens
  heavy chain complementarity determining region 3 for antibody 42241
ATGLGESGDYEGRGYTRDY

SEQ ID NO: 84483 - protein, 9 aa, Homo sapiens
  light chain complementarity determining region 3 for antibody 42242
QQYGSQRYT

SEQ ID NO: 84484 - protein, 17 aa, Homo sapiens
  heavy chain complementarity determining region 3 for antibody 42242
AKDIFFGIAVAGTAFDI

SEQ ID NO: 84485 - protein, 10 aa, Homo sapiens
  light chain complementarity determining region 3 for antibody 42243
QQYGSPPGFT

SEQ ID NO: 84486 - protein, 16 aa, Homo sapiens
  heavy chain complementarity determining region 3 for antibody 42243
ARGVVVPRGRMGYFDY

SEQ ID NO: 84487 - protein, 9 aa, Homo sapiens
  light chain complementarity determining region 3 for antibody 42244
QQYGRSPIT

SEQ ID NO: 84488 - protein, 14 aa, Homo sapiens
  heavy chain complementarity determining region 3 for antibody 42244
AKDTSTETTSRFDY

SEQ ID NO: 84489 - protein, 9 aa, Homo sapiens
  light chain complementarity determining region 3 for antibody 42245
QQYGRFPIT

SEQ ID NO: 84490 - protein, 24 aa, Homo sapiens
  heavy chain complementarity determining region 3 for antibody 42245
ARGSNSTKRISLREVVTNIYGMDV

SEQ ID NO: 84491 - protein, 8 aa, Homo sapiens
  light chain complementarity determining region 3 for antibody 42246
QQYGNLIT

SEQ ID NO: 84492 - protein, 20 aa, Homo sapiens
  heavy chain complementarity determining region 3 for antibody 42246
ARHLGCGGDCPPDSFFGFEV

SEQ ID NO: 84493 - protein, 8 aa, Homo sapiens
  light chain complementarity determining region 3 for antibody 42247
QQYGNEFT

SEQ ID NO: 84494 - protein, 18 aa, Homo sapiens
  heavy chain complementarity determining region 3 for antibody 42247
AKATLASCTGVTCYPFDH

SEQ ID NO: 84495 - protein, 9 aa, Homo sapiens
  light chain complementarity determining region 3 for antibody 42248
QQYGNAPDT

SEQ ID NO: 84496 - protein, 8 aa, Homo sapiens
  heavy chain complementarity determining region 3 for antibody 42248
ASPIAEVQ

SEQ ID NO: 84497 - protein, 8 aa, Homo sapiens
  light chain complementarity determining region 3 for antibody 42249
QQYGGSLT

SEQ ID NO: 84498 - protein, 20 aa, Homo sapiens
  heavy chain complementarity determining region 3 for antibody 42249
ARRTGYCRGGTCYSDDAFDF

SEQ ID NO: 84499 - protein, 8 aa, Homo sapiens
  light chain complementarity determining region 3 for antibody 42250
QQYGGRYT

SEQ ID NO: 84500 - protein, 18 aa, Homo sapiens
  heavy chain complementarity determining region 3 for antibody 42250
ARAPIIMMLGGGPHGMDV

SEQ ID NO: 84501 - protein, 8 aa, Homo sapiens
  light chain complementarity determining region 3 for antibody 42251
QQYFTLSS

SEQ ID NO: 84502 - protein, 18 aa, Homo sapiens
  heavy chain complementarity determining region 3 for antibody 42251
ATRADNCGGDCYYWYFDL

SEQ ID NO: 84503 - protein, 9 aa, Homo sapiens
  light chain complementarity determining region 3 for antibody 42252
QQYEKVPPA

SEQ ID NO: 84504 - protein, 18 aa, Homo sapiens
  heavy chain complementarity determining region 3 for antibody 42252
ARSHTVVVSYYYYYAMDV

SEQ ID NO: 84505 - protein, 9 aa, Homo sapiens
  light chain complementarity determining region 3 for antibody 42253
QQYEGLPYT

SEQ ID NO: 84506 - protein, 15 aa, Homo sapiens
  heavy chain complementarity determining region 3 for antibody 42253
LRASYYSDSRGATQQ

SEQ ID NO: 84507 - protein, 8 aa, Homo sapiens
  light chain complementarity determining region 3 for antibody 42254
QQYDSYWT

SEQ ID NO: 84508 - protein, 13 aa, Homo sapiens
  heavy chain complementarity determining region 3 for antibody 42254
ATFPRWLQLEGLQ

SEQ ID NO: 84509 - protein, 9 aa, Homo sapiens
  light chain complementarity determining region 3 for antibody 42255
QQYDSYVGT

SEQ ID NO: 84510 - protein, 12 aa, Homo sapiens
  heavy chain complementarity determining region 3 for antibody 42255
AKAALYSGWYDS

SEQ ID NO: 84511 - protein, 9 aa, Homo sapiens
  light chain complementarity determining region 3 for antibody 42256
QQYDSYLYT

SEQ ID NO: 84512 - protein, 13 aa, Homo sapiens
  heavy chain complementarity determining region 3 for antibody 42256
GRVPTTVTRMIDY

SEQ ID NO: 84513 - protein, 9 aa, Homo sapiens
  light chain complementarity determining region 3 for antibody 42257
QQYDSLPLT

SEQ ID NO: 84514 - protein, 18 aa, Homo sapiens
  heavy chain complementarity determining region 3 for antibody 42257
ARDPARGGGWSYYHGMDV

SEQ ID NO: 84515 - protein, 9 aa, Homo sapiens
  light chain complementarity determining region 3 for antibody 42258
QQYDNWPRT

SEQ ID NO: 84516 - protein, 15 aa, Homo sapiens
  heavy chain complementarity determining region 3 for antibody 42258
ARGEEWLVLNRGFDL

SEQ ID NO: 84517 - protein, 9 aa, Homo sapiens
  light chain complementarity determining region 3 for antibody 42259
QQYDNVPYT

SEQ ID NO: 84518 - protein, 18 aa, Homo sapiens
  heavy chain complementarity determining region 3 for antibody 42259
TPEWIYYESGGYWTPFEY

SEQ ID NO: 84519 - protein, 8 aa, Homo sapiens
  light chain complementarity determining region 3 for antibody 42260
QQYDNMIT

SEQ ID NO: 84520 - protein, 12 aa, Homo sapiens
  heavy chain complementarity determining region 3 for antibody 42260
ARYNWGAWHFDF

SEQ ID NO: 84521 - protein, 9 aa, Homo sapiens
  light chain complementarity determining region 3 for antibody 42261
QQYDNLPYT

SEQ ID NO: 84522 - protein, 16 aa, Homo sapiens
  heavy chain complementarity determining region 3 for antibody 42261
TRARDGDFWSGYYSDY

SEQ ID NO: 84523 - protein, 9 aa, Homo sapiens
  light chain complementarity determining region 3 for antibody 42262
QQYDNLPPT

SEQ ID NO: 84524 - protein, 12 aa, Homo sapiens
  heavy chain complementarity determining region 3 for antibody 42262
ARDRVAGDAFDI

SEQ ID NO: 84525 - protein, 9 aa, Homo sapiens
  light chain complementarity determining region 3 for antibody 42263
QQYDNLPPT

SEQ ID NO: 84526 - protein, 15 aa, Homo sapiens
  heavy chain complementarity determining region 3 for antibody 42263
ARDRKRVGLTPPFEY

SEQ ID NO: 84527 - protein, 9 aa, Homo sapiens
  light chain complementarity determining region 3 for antibody 42264
QQYDNLPLT

SEQ ID NO: 84528 - protein, 15 aa, Homo sapiens
  heavy chain complementarity determining region 3 for antibody 42264
VRDRRRECWADCLDY

SEQ ID NO: 84529 - protein, 9 aa, Homo sapiens
  light chain complementarity determining region 3 for antibody 42265
QQYDNLPLT

SEQ ID NO: 84530 - protein, 20 aa, Homo sapiens
  heavy chain complementarity determining region 3 for antibody 42265
ARNPYCLGGSCDLAYYGMDV

SEQ ID NO: 84531 - protein, 9 aa, Homo sapiens
  light chain complementarity determining region 3 for antibody 42266
QQYDNLPLT

SEQ ID NO: 84532 - protein, 18 aa, Homo sapiens
  heavy chain complementarity determining region 3 for antibody 42266
ARHSEDTSSWFGHNWFDA

SEQ ID NO: 84533 - protein, 9 aa, Homo sapiens
  light chain complementarity determining region 3 for antibody 42267
QQYDNLPLT

SEQ ID NO: 84534 - protein, 17 aa, Homo sapiens
  heavy chain complementarity determining region 3 for antibody 42267
AKLISGIVGATFGYFQH

SEQ ID NO: 84535 - protein, 9 aa, Homo sapiens
  light chain complementarity determining region 3 for antibody 42268
QQYDLYSGT

SEQ ID NO: 84536 - protein, 14 aa, Homo sapiens
  heavy chain complementarity determining region 3 for antibody 42268
ASTYMAGAGTYFDF

SEQ ID NO: 84537 - protein, 9 aa, Homo sapiens
  light chain complementarity determining region 3 for antibody 42269
QQYDLLPPS

SEQ ID NO: 84538 - protein, 21 aa, Homo sapiens
  heavy chain complementarity determining region 3 for antibody 42269
ARGLHIVVVTSILRGFWYFGL

SEQ ID NO: 84539 - protein, 9 aa, Homo sapiens
  light chain complementarity determining region 3 for antibody 42270
QQYATSPLA

SEQ ID NO: 84540 - protein, 18 aa, Homo sapiens
  heavy chain complementarity determining region 3 for antibody 42270
ARPGYCTGGSCYFGAFDI

SEQ ID NO: 84541 - protein, 9 aa, Homo sapiens
  light chain complementarity determining region 3 for antibody 42271
QQYASSPRT

SEQ ID NO: 84542 - protein, 12 aa, Homo sapiens
  heavy chain complementarity determining region 3 for antibody 42271
ARESSGHSPLDP

SEQ ID NO: 84543 - protein, 10 aa, Homo sapiens
  light chain complementarity determining region 3 for antibody 42272
QQYAKTPPIT

SEQ ID NO: 84544 - protein, 12 aa, Homo sapiens
  heavy chain complementarity determining region 3 for antibody 42272
ARVLDSLSPVFH

SEQ ID NO: 84545 - protein, 9 aa, Homo sapiens
  light chain complementarity determining region 3 for antibody 42273
QQVNDFPLT

SEQ ID NO: 84546 - protein, 11 aa, Homo sapiens
  heavy chain complementarity determining region 3 for antibody 42273
GRHIAWRGIDV

SEQ ID NO: 84547 - protein, 9 aa, Homo sapiens
  light chain complementarity determining region 3 for antibody 42274
QQTYTTPPT

SEQ ID NO: 84548 - protein, 18 aa, Homo sapiens
  heavy chain complementarity determining region 3 for antibody 42274
ASPPADILTGYWIYGMDV

SEQ ID NO: 84549 - protein, 9 aa, Homo sapiens
  light chain complementarity determining region 3 for antibody 42275
QQTYSSPLT

SEQ ID NO: 84550 - protein, 16 aa, Homo sapiens
  heavy chain complementarity determining region 3 for antibody 42275
ATDLEARGYYQYFFGH

SEQ ID NO: 84551 - protein, 9 aa, Homo sapiens
  light chain complementarity determining region 3 for antibody 42276
QQTYRTPWT

SEQ ID NO: 84552 - protein, 11 aa, Homo sapiens
  heavy chain complementarity determining region 3 for antibody 42276
ATGPQVTMPQD

SEQ ID NO: 84553 - protein, 9 aa, Homo sapiens
  light chain complementarity determining region 3 for antibody 42277
QQTYRTPVT

SEQ ID NO: 84554 - protein, 17 aa, Homo sapiens
  heavy chain complementarity determining region 3 for antibody 42277
VRTGPIVEVPAAIPVDV

SEQ ID NO: 84555 - protein, 9 aa, Homo sapiens
  light chain complementarity determining region 3 for antibody 42278
QQTYNTPIT

SEQ ID NO: 84556 - protein, 22 aa, Homo sapiens
  heavy chain complementarity determining region 3 for antibody 42278
ATSHLEDPMGTTYYSYYRGFHV

SEQ ID NO: 84557 - protein, 9 aa, Homo sapiens
  light chain complementarity determining region 3 for antibody 42279
QQSYTVPFT

SEQ ID NO: 84558 - protein, 12 aa, Homo sapiens
  heavy chain complementarity determining region 3 for antibody 42279
AIASPETNTFDP

SEQ ID NO: 84559 - protein, 9 aa, Homo sapiens
  light chain complementarity determining region 3 for antibody 42280
QQSYTTPQT

SEQ ID NO: 84560 - protein, 19 aa, Homo sapiens
  heavy chain complementarity determining region 3 for antibody 42280
AREKNNYGPSIYYYYGLDV

SEQ ID NO: 84561 - protein, 9 aa, Homo sapiens
  light chain complementarity determining region 3 for antibody 42281
QQSYTSPWT

SEQ ID NO: 84562 - protein, 14 aa, Homo sapiens
  heavy chain complementarity determining region 3 for antibody 42281
VRFGGGYSYGYFDF

SEQ ID NO: 84563 - protein, 9 aa, Homo sapiens
  light chain complementarity determining region 3 for antibody 42282
QQSYTIPWT

SEQ ID NO: 84564 - protein, 23 aa, Homo sapiens
  heavy chain complementarity determining region 3 for antibody 42282
ARVHSFGAGTLSRNNRRGFGFDV

SEQ ID NO: 84565 - protein, 9 aa, Homo sapiens
  light chain complementarity determining region 3 for antibody 42283
QQSYSVPWT

SEQ ID NO: 84566 - protein, 18 aa, Homo sapiens
  heavy chain complementarity determining region 3 for antibody 42283
TRTGAGDGYNYANYGMDV

SEQ ID NO: 84567 - protein, 9 aa, Homo sapiens
  light chain complementarity determining region 3 for antibody 42284
QQSYSVPIT

SEQ ID NO: 84568 - protein, 14 aa, Homo sapiens
  heavy chain complementarity determining region 3 for antibody 42284
AKDVMSSSWFNMED

SEQ ID NO: 84569 - protein, 9 aa, Homo sapiens
  light chain complementarity determining region 3 for antibody 42285
QQSYSTPYT

SEQ ID NO: 84570 - protein, 12 aa, Homo sapiens
  heavy chain complementarity determining region 3 for antibody 42285
VKPVYNSGWYDF

SEQ ID NO: 84571 - protein, 9 aa, Homo sapiens
  light chain complementarity determining region 3 for antibody 42286
QQSYSTPYT

SEQ ID NO: 84572 - protein, 17 aa, Homo sapiens
  heavy chain complementarity determining region 3 for antibody 42286
ATLAANDFLNGADGFDV

SEQ ID NO: 84573 - protein, 9 aa, Homo sapiens
  light chain complementarity determining region 3 for antibody 42287
QQSYSTPYT

SEQ ID NO: 84574 - protein, 14 aa, Homo sapiens
  heavy chain complementarity determining region 3 for antibody 42287
ATIVYSNYDRWFDP

SEQ ID NO: 84575 - protein, 9 aa, Homo sapiens
  light chain complementarity determining region 3 for antibody 42288
QQSYSTPYT

SEQ ID NO: 84576 - protein, 14 aa, Homo sapiens
  heavy chain complementarity determining region 3 for antibody 42288
ARGTYKSIYYYLDY

SEQ ID NO: 84577 - protein, 9 aa, Homo sapiens
  light chain complementarity determining region 3 for antibody 42289
QQSYSTPYT

SEQ ID NO: 84578 - protein, 12 aa, Homo sapiens
  heavy chain complementarity determining region 3 for antibody 42289
ARAGHPGDAFDI

SEQ ID NO: 84579 - protein, 9 aa, Homo sapiens
  light chain complementarity determining region 3 for antibody 42290
QQSYSTPWT

SEQ ID NO: 84580 - protein, 14 aa, Homo sapiens
  heavy chain complementarity determining region 3 for antibody 42290
ARGRLRGGGTAGDY

SEQ ID NO: 84581 - protein, 9 aa, Homo sapiens
  light chain complementarity determining region 3 for antibody 42291
QQSYSTPWT

SEQ ID NO: 84582 - protein, 18 aa, Homo sapiens
  heavy chain complementarity determining region 3 for antibody 42291
ARGLIKILRGVLIEAFDI

SEQ ID NO: 84583 - protein, 9 aa, Homo sapiens
  light chain complementarity determining region 3 for antibody 42292
QQSYSTPWT

SEQ ID NO: 84584 - protein, 17 aa, Homo sapiens
  heavy chain complementarity determining region 3 for antibody 42292
AEGGRTGTYPTAGGFDY

SEQ ID NO: 84585 - protein, 9 aa, Homo sapiens
  light chain complementarity determining region 3 for antibody 42293
QQSYSTPRT

SEQ ID NO: 84586 - protein, 16 aa, Homo sapiens
  heavy chain complementarity determining region 3 for antibody 42293
ARSPPDNYTWSNWFGP

SEQ ID NO: 84587 - protein, 10 aa, Homo sapiens
  light chain complementarity determining region 3 for antibody 42294
QQSYSTPQLT

SEQ ID NO: 84588 - protein, 15 aa, Homo sapiens
  heavy chain complementarity determining region 3 for antibody 42294
ARESIEEGGNSYFHH

SEQ ID NO: 84589 - protein, 10 aa, Homo sapiens
  light chain complementarity determining region 3 for antibody 42295
QQSYSTPPYT

SEQ ID NO: 84590 - protein, 12 aa, Homo sapiens
  heavy chain complementarity determining region 3 for antibody 42295
ARSLVTLDSFQI

SEQ ID NO: 84591 - protein, 9 aa, Homo sapiens
  light chain complementarity determining region 3 for antibody 42296
QQSYSTPIT

SEQ ID NO: 84592 - protein, 20 aa, Homo sapiens
  heavy chain complementarity determining region 3 for antibody 42296
TRTAGGVVPSTYYYYYGMDV

SEQ ID NO: 84593 - protein, 9 aa, Homo sapiens
  light chain complementarity determining region 3 for antibody 42297
QQSYSTPFT

SEQ ID NO: 84594 - protein, 15 aa, Homo sapiens
  heavy chain complementarity determining region 3 for antibody 42297
ARDPHSSSWPDWFDP

SEQ ID NO: 84595 - protein, 9 aa, Homo sapiens
  light chain complementarity determining region 3 for antibody 42298
QQSYSTPFT

SEQ ID NO: 84596 - protein, 16 aa, Homo sapiens
  heavy chain complementarity determining region 3 for antibody 42298
AKDFEYNSGWSDAFDV

SEQ ID NO: 84597 - protein, 9 aa, Homo sapiens
  light chain complementarity determining region 3 for antibody 42299
QQSYSRPIT

SEQ ID NO: 84598 - protein, 12 aa, Homo sapiens
  heavy chain complementarity determining region 3 for antibody 42299
TRGKGSHIWFDP

SEQ ID NO: 84599 - protein, 9 aa, Homo sapiens
  light chain complementarity determining region 3 for antibody 42300
QQSYSPPFN

SEQ ID NO: 84600 - protein, 14 aa, Homo sapiens
  heavy chain complementarity determining region 3 for antibody 42300
ARGRDTSGYSGLDF

SEQ ID NO: 84601 - protein, 9 aa, Homo sapiens
  light chain complementarity determining region 3 for antibody 42301
QQSYSIPPT

SEQ ID NO: 84602 - protein, 13 aa, Homo sapiens
  heavy chain complementarity determining region 3 for antibody 42301
VRSGKVGTTRFDL

SEQ ID NO: 84603 - protein, 10 aa, Homo sapiens
  light chain complementarity determining region 3 for antibody 42302
QQSYRDPMYT

SEQ ID NO: 84604 - protein, 14 aa, Homo sapiens
  heavy chain complementarity determining region 3 for antibody 42302
ARRNIDGAGDAFDI

SEQ ID NO: 84605 - protein, 9 aa, Homo sapiens
  light chain complementarity determining region 3 for antibody 42303
QQSYNSPWT

SEQ ID NO: 84606 - protein, 14 aa, Homo sapiens
  heavy chain complementarity determining region 3 for antibody 42303
ARFGGGYSYGYFDF

SEQ ID NO: 84607 - protein, 9 aa, Homo sapiens
  light chain complementarity determining region 3 for antibody 42304
QQSYNSPWT

SEQ ID NO: 84608 - protein, 18 aa, Homo sapiens
  heavy chain complementarity determining region 3 for antibody 42304
ARESSMSSTGPPLTWFDP

SEQ ID NO: 84609 - protein, 9 aa, Homo sapiens
  light chain complementarity determining region 3 for antibody 42305
QQSYNIPLT

SEQ ID NO: 84610 - protein, 14 aa, Homo sapiens
  heavy chain complementarity determining region 3 for antibody 42305
ARYIILTGHDAYDI

SEQ ID NO: 84611 - protein, 9 aa, Homo sapiens
  light chain complementarity determining region 3 for antibody 42306
QQSYITPYT

SEQ ID NO: 84612 - protein, 13 aa, Homo sapiens
  heavy chain complementarity determining region 3 for antibody 42306
ARISSTWPPLFDY

SEQ ID NO: 84613 - protein, 9 aa, Homo sapiens
  light chain complementarity determining region 3 for antibody 42307
QQSYGTPPT

SEQ ID NO: 84614 - protein, 16 aa, Homo sapiens
  heavy chain complementarity determining region 3 for antibody 42307
AKDQRDTAMAHYFFDY

SEQ ID NO: 84615 - protein, 9 aa, Homo sapiens
  light chain complementarity determining region 3 for antibody 42308
QQSYGTPDS

SEQ ID NO: 84616 - protein, 19 aa, Homo sapiens
  heavy chain complementarity determining region 3 for antibody 42308
VRKFCSDGTCYRYDDYFDY

SEQ ID NO: 84617 - protein, 11 aa, Homo sapiens
  light chain complementarity determining region 3 for antibody 42309
QQSSGNPSIYT

SEQ ID NO: 84618 - protein, 12 aa, Homo sapiens
  heavy chain complementarity determining region 3 for antibody 42309
ARNSGIRRAFDI

SEQ ID NO: 84619 - protein, 9 aa, Homo sapiens
  light chain complementarity determining region 3 for antibody 42310
QQSNSYPRT

SEQ ID NO: 84620 - protein, 9 aa, Homo sapiens
  heavy chain complementarity determining region 3 for antibody 42310
ARGAKEFEY

SEQ ID NO: 84621 - protein, 9 aa, Homo sapiens
  light chain complementarity determining region 3 for antibody 42311
QQSHTAPFT

SEQ ID NO: 84622 - protein, 19 aa, Homo sapiens
  heavy chain complementarity determining region 3 for antibody 42311
ARAHGYCSGGTCYFYGMDV

SEQ ID NO: 84623 - protein, 9 aa, Homo sapiens
  light chain complementarity determining region 3 for antibody 42312
QQSHSMPRT

SEQ ID NO: 84624 - protein, 12 aa, Homo sapiens
  heavy chain complementarity determining region 3 for antibody 42312
ARTGYSYGSYDN

SEQ ID NO: 84625 - protein, 9 aa, Homo sapiens
  light chain complementarity determining region 3 for antibody 42313
QQSHSAPVT

SEQ ID NO: 84626 - protein, 10 aa, Homo sapiens
  heavy chain complementarity determining region 3 for antibody 42313
ASGLGWESGY

SEQ ID NO: 84627 - protein, 9 aa, Homo sapiens
  light chain complementarity determining region 3 for antibody 42314
QQSFYTPHT

SEQ ID NO: 84628 - protein, 14 aa, Homo sapiens
  heavy chain complementarity determining region 3 for antibody 42314
ARRDSYGYSLAFDI

SEQ ID NO: 84629 - protein, 9 aa, Homo sapiens
  light chain complementarity determining region 3 for antibody 42315
QQSFSTPRT

SEQ ID NO: 84630 - protein, 17 aa, Homo sapiens
  heavy chain complementarity determining region 3 for antibody 42315
TTHLETNSGTYYHLLDY

SEQ ID NO: 84631 - protein, 9 aa, Homo sapiens
  light chain complementarity determining region 3 for antibody 42316
QQSFSTPLT

SEQ ID NO: 84632 - protein, 20 aa, Homo sapiens
  heavy chain complementarity determining region 3 for antibody 42316
AREALSWVALGETPPCDFDY

SEQ ID NO: 84633 - protein, 9 aa, Homo sapiens
  light chain complementarity determining region 3 for antibody 42317
QQSFSTLYT

SEQ ID NO: 84634 - protein, 22 aa, Homo sapiens
  heavy chain complementarity determining region 3 for antibody 42317
ARDPYYYDDSSEVPKPEYYFDY

SEQ ID NO: 84635 - protein, 9 aa, Homo sapiens
  light chain complementarity determining region 3 for antibody 42318
QQSFRIPPT

SEQ ID NO: 84636 - protein, 14 aa, Homo sapiens
  heavy chain complementarity determining region 3 for antibody 42318
ARRKHLWANGPFDY

SEQ ID NO: 84637 - protein, 10 aa, Homo sapiens
  light chain complementarity determining region 3 for antibody 42319
QQRYNWPPYT

SEQ ID NO: 84638 - protein, 11 aa, Homo sapiens
  heavy chain complementarity determining region 3 for antibody 42319
SRGVGSYPFDH

SEQ ID NO: 84639 - protein, 10 aa, Homo sapiens
  light chain complementarity determining region 3 for antibody 42320
QQRTDRPPYS

SEQ ID NO: 84640 - protein, 15 aa, Homo sapiens
  heavy chain complementarity determining region 3 for antibody 42320
GRLLGDWELPRGNDY

SEQ ID NO: 84641 - protein, 10 aa, Homo sapiens
  light chain complementarity determining region 3 for antibody 42321
QQRSNWPSLT

SEQ ID NO: 84642 - protein, 19 aa, Homo sapiens
  heavy chain complementarity determining region 3 for antibody 42321
ARDPAGIANRRSVAGPPSY

SEQ ID NO: 84643 - protein, 9 aa, Homo sapiens
  light chain complementarity determining region 3 for antibody 42322
QQRSNWPRT

SEQ ID NO: 84644 - protein, 17 aa, Homo sapiens
  heavy chain complementarity determining region 3 for antibody 42322
AREGHYNVLNGQYTVDY

SEQ ID NO: 84645 - protein, 10 aa, Homo sapiens
  light chain complementarity determining region 3 for antibody 42323
QQRSNWPPWT

SEQ ID NO: 84646 - protein, 15 aa, Homo sapiens
  heavy chain complementarity determining region 3 for antibody 42323
ARLDDGWYDPFYFDY

SEQ ID NO: 84647 - protein, 9 aa, Homo sapiens
  light chain complementarity determining region 3 for antibody 42324
QQRSNWPLT

SEQ ID NO: 84648 - protein, 12 aa, Homo sapiens
  heavy chain complementarity determining region 3 for antibody 42324
ARVMVSGYYLDY

SEQ ID NO: 84649 - protein, 9 aa, Homo sapiens
  light chain complementarity determining region 3 for antibody 42325
QQRSNWPFT

SEQ ID NO: 84650 - protein, 16 aa, Homo sapiens
  heavy chain complementarity determining region 3 for antibody 42325
AKDTGGGWGEDNYFDP

SEQ ID NO: 84651 - protein, 10 aa, Homo sapiens
  light chain complementarity determining region 3 for antibody 42326
QQRSNWKRLT

SEQ ID NO: 84652 - protein, 16 aa, Homo sapiens
  heavy chain complementarity determining region 3 for antibody 42326
TKCHDFWNGYSYYFDY

SEQ ID NO: 84653 - protein, 8 aa, Homo sapiens
  light chain complementarity determining region 3 for antibody 42327
QQRSNSVT

SEQ ID NO: 84654 - protein, 11 aa, Homo sapiens
  heavy chain complementarity determining region 3 for antibody 42327
ARDFPRGAFDM

SEQ ID NO: 84655 - protein, 8 aa, Homo sapiens
  light chain complementarity determining region 3 for antibody 42328
QQRSIWWT

SEQ ID NO: 84656 - protein, 9 aa, Homo sapiens
  heavy chain complementarity determining region 3 for antibody 42328
VTAEHGIDF

SEQ ID NO: 84657 - protein, 8 aa, Homo sapiens
  light chain complementarity determining region 3 for antibody 42329
QQRSDWVT

SEQ ID NO: 84658 - protein, 21 aa, Homo sapiens
  heavy chain complementarity determining region 3 for antibody 42329
ARHDPDNRQGGDTFAYNYFDQ

SEQ ID NO: 84659 - protein, 9 aa, Homo sapiens
  light chain complementarity determining region 3 for antibody 42330
QQRSDWPLT

SEQ ID NO: 84660 - protein, 12 aa, Homo sapiens
  heavy chain complementarity determining region 3 for antibody 42330
AKGKVVPADFDY

SEQ ID NO: 84661 - protein, 9 aa, Homo sapiens
  light chain complementarity determining region 3 for antibody 42331
QQRNSYPIT

SEQ ID NO: 84662 - protein, 17 aa, Homo sapiens
  heavy chain complementarity determining region 3 for antibody 42331
ARNYFGSGNYRLGAFDF

SEQ ID NO: 84663 - protein, 10 aa, Homo sapiens
  light chain complementarity determining region 3 for antibody 42332
QQRGIWPDMT

SEQ ID NO: 84664 - protein, 14 aa, Homo sapiens
  heavy chain complementarity determining region 3 for antibody 42332
AKDNDPYVSGFGDL

SEQ ID NO: 84665 - protein, 9 aa, Homo sapiens
  light chain complementarity determining region 3 for antibody 42333
QQNNSHSWT

SEQ ID NO: 84666 - protein, 13 aa, Homo sapiens
  heavy chain complementarity determining region 3 for antibody 42333
ARMSFRYGYVFDY

SEQ ID NO: 84667 - protein, 11 aa, Homo sapiens
  light chain complementarity determining region 3 for antibody 42334
QQLNVYPRGFT

SEQ ID NO: 84668 - protein, 15 aa, Homo sapiens
  heavy chain complementarity determining region 3 for antibody 42334
ARGTSSAWPYDAFEI

SEQ ID NO: 84669 - protein, 9 aa, Homo sapiens
  light chain complementarity determining region 3 for antibody 42335
QQLNSYPST

SEQ ID NO: 84670 - protein, 20 aa, Homo sapiens
  heavy chain complementarity determining region 3 for antibody 42335
ARDSRENSDYYVPAAEYFHY

SEQ ID NO: 84671 - protein, 9 aa, Homo sapiens
  light chain complementarity determining region 3 for antibody 42336
QQLNSYPRT

SEQ ID NO: 84672 - protein, 19 aa, Homo sapiens
  heavy chain complementarity determining region 3 for antibody 42336
ARDWGTQMATSLWVGWFDP

SEQ ID NO: 84673 - protein, 9 aa, Homo sapiens
  light chain complementarity determining region 3 for antibody 42337
QQLNSYPPT

SEQ ID NO: 84674 - protein, 12 aa, Homo sapiens
  heavy chain complementarity determining region 3 for antibody 42337
ARDSGIAGADDC

SEQ ID NO: 84675 - protein, 9 aa, Homo sapiens
  light chain complementarity determining region 3 for antibody 42338
QQLNSLPIT

SEQ ID NO: 84676 - protein, 16 aa, Homo sapiens
  heavy chain complementarity determining region 3 for antibody 42338
ARAGATVTRSRYYFDC

SEQ ID NO: 84677 - protein, 9 aa, Homo sapiens
  light chain complementarity determining region 3 for antibody 42339
QQLNSFPLT

SEQ ID NO: 84678 - protein, 19 aa, Homo sapiens
  heavy chain complementarity determining region 3 for antibody 42339
ARGDFYYDSGSYYGGYFDH

SEQ ID NO: 84679 - protein, 9 aa, Homo sapiens
  light chain complementarity determining region 3 for antibody 42340
QQLKNYPPT

SEQ ID NO: 84680 - protein, 16 aa, Homo sapiens
  heavy chain complementarity determining region 3 for antibody 42340
ARGPVGEPGGVWYFDL

SEQ ID NO: 84681 - protein, 9 aa, Homo sapiens
  light chain complementarity determining region 3 for antibody 42341
QQLGSYPIT

SEQ ID NO: 84682 - protein, 13 aa, Homo sapiens
  heavy chain complementarity determining region 3 for antibody 42341
TSRSLNAGAPLDF

SEQ ID NO: 84683 - protein, 9 aa, Homo sapiens
  light chain complementarity determining region 3 for antibody 42342
QQLDSYPFT

SEQ ID NO: 84684 - protein, 19 aa, Homo sapiens
  heavy chain complementarity determining region 3 for antibody 42342
ARHPYCTGDRCAYPDALDI

SEQ ID NO: 84685 - protein, 9 aa, Homo sapiens
  light chain complementarity determining region 3 for antibody 42343
QQHGSSRLT

SEQ ID NO: 84686 - protein, 17 aa, Homo sapiens
  heavy chain complementarity determining region 3 for antibody 42343
AKDHREPYGSGWYYFDV

SEQ ID NO: 84687 - protein, 9 aa, Homo sapiens
  light chain complementarity determining region 3 for antibody 42344
QQGYNSPYT

SEQ ID NO: 84688 - protein, 17 aa, Homo sapiens
  heavy chain complementarity determining region 3 for antibody 42344
AKERHARGTYSGGYFDY

SEQ ID NO: 84689 - protein, 9 aa, Homo sapiens
  light chain complementarity determining region 3 for antibody 42345
QQGSSTPFT

SEQ ID NO: 84690 - protein, 15 aa, Homo sapiens
  heavy chain complementarity determining region 3 for antibody 42345
AKAQVIWGQLYYFES

SEQ ID NO: 84691 - protein, 9 aa, Homo sapiens
  light chain complementarity determining region 3 for antibody 42346
QQGNSFPRT

SEQ ID NO: 84692 - protein, 9 aa, Homo sapiens
  heavy chain complementarity determining region 3 for antibody 42346
ARGGRRVDY

SEQ ID NO: 84693 - protein, 9 aa, Homo sapiens
  light chain complementarity determining region 3 for antibody 42347
QQFGSSPYT

SEQ ID NO: 84694 - protein, 20 aa, Homo sapiens
  heavy chain complementarity determining region 3 for antibody 42347
AALARYYHDSTGVLELAFDI

SEQ ID NO: 84695 - protein, 11 aa, Homo sapiens
  light chain complementarity determining region 3 for antibody 42348
QQFGSPQPPWT

SEQ ID NO: 84696 - protein, 11 aa, Homo sapiens
  heavy chain complementarity determining region 3 for antibody 42348
ARDANYGLFDY

SEQ ID NO: 84697 - protein, 9 aa, Homo sapiens
  light chain complementarity determining region 3 for antibody 42349
QQFDNFPLT

SEQ ID NO: 84698 - protein, 19 aa, Homo sapiens
  heavy chain complementarity determining region 3 for antibody 42349
AKSRGSHRWKSGPLLLGDS

SEQ ID NO: 84699 - protein, 8 aa, Homo sapiens
  light chain complementarity determining region 3 for antibody 42350
QQCREFIT

SEQ ID NO: 84700 - protein, 12 aa, Homo sapiens
  heavy chain complementarity determining region 3 for antibody 42350
AMAPWNLVSFDS

SEQ ID NO: 84701 - protein, 9 aa, Homo sapiens
  light chain complementarity determining region 3 for antibody 42351
QQCGSSPWT

SEQ ID NO: 84702 - protein, 15 aa, Homo sapiens
  heavy chain complementarity determining region 3 for antibody 42351
ARRGRVRGPVEGFDC

SEQ ID NO: 84703 - protein, 9 aa, Homo sapiens
  light chain complementarity determining region 3 for antibody 42352
QQANSYPLT

SEQ ID NO: 84704 - protein, 12 aa, Homo sapiens
  heavy chain complementarity determining region 3 for antibody 42352
ARIATASNWFDL

SEQ ID NO: 84705 - protein, 9 aa, Homo sapiens
  light chain complementarity determining region 3 for antibody 42353
QQANSLPRT

SEQ ID NO: 84706 - protein, 14 aa, Homo sapiens
  heavy chain complementarity determining region 3 for antibody 42353
ARMNFYDTGGHFDI

SEQ ID NO: 84707 - protein, 9 aa, Homo sapiens
  light chain complementarity determining region 3 for antibody 42354
QQANRFPLT

SEQ ID NO: 84708 - protein, 13 aa, Homo sapiens
  heavy chain complementarity determining region 3 for antibody 42354
SKQSGGGSSGLDV

SEQ ID NO: 84709 - protein, 10 aa, Homo sapiens
  light chain complementarity determining region 3 for antibody 42355
QQANNFPLLT

SEQ ID NO: 84710 - protein, 11 aa, Homo sapiens
  heavy chain complementarity determining region 3 for antibody 42355
ARMDDDYHFDF

SEQ ID NO: 84711 - protein, 10 aa, Homo sapiens
  light chain complementarity determining region 3 for antibody 42356
QQADPLLALT

SEQ ID NO: 84712 - protein, 12 aa, Homo sapiens
  heavy chain complementarity determining region 3 for antibody 42356
AKGSDNYGYLDS

SEQ ID NO: 84713 - protein, 9 aa, Homo sapiens
  light chain complementarity determining region 3 for antibody 42357
QNCKSAPLT

SEQ ID NO: 84714 - protein, 17 aa, Homo sapiens
  heavy chain complementarity determining region 3 for antibody 42357
AKVSKTFGLFLRGYLDY

SEQ ID NO: 84715 - protein, 9 aa, Homo sapiens
  light chain complementarity determining region 3 for antibody 42358
QLTYITPYT

SEQ ID NO: 84716 - protein, 17 aa, Homo sapiens
  heavy chain complementarity determining region 3 for antibody 42358
TTAPHLVWGSGRYIGPA

SEQ ID NO: 84717 - protein, 9 aa, Homo sapiens
  light chain complementarity determining region 3 for antibody 42359
QKYNSDPFT

SEQ ID NO: 84718 - protein, 14 aa, Homo sapiens
  heavy chain complementarity determining region 3 for antibody 42359
AKVRGPPPTYAFNY

SEQ ID NO: 84719 - protein, 9 aa, Homo sapiens
  light chain complementarity determining region 3 for antibody 42360
QKYNSAPWT

SEQ ID NO: 84720 - protein, 14 aa, Homo sapiens
  heavy chain complementarity determining region 3 for antibody 42360
AKGVLPNYDWLLKS

SEQ ID NO: 84721 - protein, 10 aa, Homo sapiens
  light chain complementarity determining region 3 for antibody 42361
QKYNSAPQVT

SEQ ID NO: 84722 - protein, 16 aa, Homo sapiens
  heavy chain complementarity determining region 3 for antibody 42361
ARAWGGSGDHMYTLAS

SEQ ID NO: 84723 - protein, 9 aa, Homo sapiens
  light chain complementarity determining region 3 for antibody 42362
QKYNSAPQT

SEQ ID NO: 84724 - protein, 17 aa, Homo sapiens
  heavy chain complementarity determining region 3 for antibody 42362
AKDIFFAIAVAGTAFDI

SEQ ID NO: 84725 - protein, 9 aa, Homo sapiens
  light chain complementarity determining region 3 for antibody 42363
QKYNSAPFT

SEQ ID NO: 84726 - protein, 15 aa, Homo sapiens
  heavy chain complementarity determining region 3 for antibody 42363
AKDHGYSSGWGTLDK

SEQ ID NO: 84727 - protein, 9 aa, Homo sapiens
  light chain complementarity determining region 3 for antibody 42364
QKYNRVPWT

SEQ ID NO: 84728 - protein, 13 aa, Homo sapiens
  heavy chain complementarity determining region 3 for antibody 42364
ARRRGYSTDGSDF

SEQ ID NO: 84729 - protein, 9 aa, Homo sapiens
  light chain complementarity determining region 3 for antibody 42365
QKYNNALWT

SEQ ID NO: 84730 - protein, 14 aa, Homo sapiens
  heavy chain complementarity determining region 3 for antibody 42365
ARSPYYATSGPFDH

SEQ ID NO: 84731 - protein, 9 aa, Homo sapiens
  light chain complementarity determining region 3 for antibody 42366
QHYYGLPLT

SEQ ID NO: 84732 - protein, 8 aa, Homo sapiens
  heavy chain complementarity determining region 3 for antibody 42366
AAEYTFPV

SEQ ID NO: 84733 - protein, 9 aa, Homo sapiens
  light chain complementarity determining region 3 for antibody 42367
QHYNEWPPA

SEQ ID NO: 84734 - protein, 17 aa, Homo sapiens
  heavy chain complementarity determining region 3 for antibody 42367
AREGNLGGKHHSSWMDV

SEQ ID NO: 84735 - protein, 9 aa, Homo sapiens
  light chain complementarity determining region 3 for antibody 42368
QHYGTLSRA

SEQ ID NO: 84736 - protein, 14 aa, Homo sapiens
  heavy chain complementarity determining region 3 for antibody 42368
ARDPGVVPIHYFDY

SEQ ID NO: 84737 - protein, 10 aa, Homo sapiens
  light chain complementarity determining region 3 for antibody 42369
QHYGSSPQLT

SEQ ID NO: 84738 - protein, 12 aa, Homo sapiens
  heavy chain complementarity determining region 3 for antibody 42369
ARHGIEVPGLDS

SEQ ID NO: 84739 - protein, 9 aa, Homo sapiens
  light chain complementarity determining region 3 for antibody 42370
QHYDNLPVT

SEQ ID NO: 84740 - protein, 10 aa, Homo sapiens
  heavy chain complementarity determining region 3 for antibody 42370
GKADWNYVSY

SEQ ID NO: 84741 - protein, 10 aa, Homo sapiens
  light chain complementarity determining region 3 for antibody 42371
QHYDNLPSFT

SEQ ID NO: 84742 - protein, 11 aa, Homo sapiens
  heavy chain complementarity determining region 3 for antibody 42371
ARTQGSGPGGF

SEQ ID NO: 84743 - protein, 9 aa, Homo sapiens
  light chain complementarity determining region 3 for antibody 42372
QEYTSAPFT

SEQ ID NO: 84744 - protein, 15 aa, Homo sapiens
  heavy chain complementarity determining region 3 for antibody 42372
ARGEGDYRLRTPLGY

SEQ ID NO: 84745 - protein, 10 aa, Homo sapiens
  light chain complementarity determining region 3 for antibody 42373
QEYNRFSPWT

SEQ ID NO: 84746 - protein, 14 aa, Homo sapiens
  heavy chain complementarity determining region 3 for antibody 42373
ARDEGYLVPGFFDY

SEQ ID NO: 84747 - protein, 9 aa, Homo sapiens
  light chain complementarity determining region 3 for antibody 42374
MQVLQTPHV

SEQ ID NO: 84748 - protein, 12 aa, Homo sapiens
  heavy chain complementarity determining region 3 for antibody 42374
TKDRTGFPSLYY

SEQ ID NO: 84749 - protein, 9 aa, Homo sapiens
  light chain complementarity determining region 3 for antibody 42375
MQTVQTPWT

SEQ ID NO: 84750 - protein, 13 aa, Homo sapiens
  heavy chain complementarity determining region 3 for antibody 42375
ARGSRTRSVEMGY

SEQ ID NO: 84751 - protein, 9 aa, Homo sapiens
  light chain complementarity determining region 3 for antibody 42376
MQGTHWPPT

SEQ ID NO: 84752 - protein, 8 aa, Homo sapiens
  heavy chain complementarity determining region 3 for antibody 42376
ARGGYFDL

SEQ ID NO: 84753 - protein, 9 aa, Homo sapiens
  light chain complementarity determining region 3 for antibody 42377
MQGTHWPLT

SEQ ID NO: 84754 - protein, 14 aa, Homo sapiens
  heavy chain complementarity determining region 3 for antibody 42377
ARDPFIAVAGSGDY

SEQ ID NO: 84755 - protein, 9 aa, Homo sapiens
  light chain complementarity determining region 3 for antibody 42378
MQGSHYSWT

SEQ ID NO: 84756 - protein, 10 aa, Homo sapiens
  heavy chain complementarity determining region 3 for antibody 42378
ARDTFASIDY

SEQ ID NO: 84757 - protein, 9 aa, Homo sapiens
  light chain complementarity determining region 3 for antibody 42379
MQGSHWPMT

SEQ ID NO: 84758 - protein, 11 aa, Homo sapiens
  heavy chain complementarity determining region 3 for antibody 42379
ARGSHGHGMDV

SEQ ID NO: 84759 - protein, 9 aa, Homo sapiens
  light chain complementarity determining region 3 for antibody 42380
MQGSHWPLT

SEQ ID NO: 84760 - protein, 15 aa, Homo sapiens
  heavy chain complementarity determining region 3 for antibody 42380
ARDGGVNDDSGHYYV

SEQ ID NO: 84761 - protein, 9 aa, Homo sapiens
  light chain complementarity determining region 3 for antibody 42381
MQGLQTPWT

SEQ ID NO: 84762 - protein, 14 aa, Homo sapiens
  heavy chain complementarity determining region 3 for antibody 42381
AREDSAVGYYGMDV

SEQ ID NO: 84763 - protein, 9 aa, Homo sapiens
  light chain complementarity determining region 3 for antibody 42382
MQGLHWPFT

SEQ ID NO: 84764 - protein, 16 aa, Homo sapiens
  heavy chain complementarity determining region 3 for antibody 42382
AKAPGKLLIIGDYFDV

SEQ ID NO: 84765 - protein, 9 aa, Homo sapiens
  light chain complementarity determining region 3 for antibody 42383
MQAVQSPLT

SEQ ID NO: 84766 - protein, 16 aa, Homo sapiens
  heavy chain complementarity determining region 3 for antibody 42383
ARRFLSYGDYGDGFDI

SEQ ID NO: 84767 - protein, 9 aa, Homo sapiens
  light chain complementarity determining region 3 for antibody 42384
MQALRSPWT

SEQ ID NO: 84768 - protein, 12 aa, Homo sapiens
  heavy chain complementarity determining region 3 for antibody 42384
ANNGLEGGTFDH

SEQ ID NO: 84769 - protein, 9 aa, Homo sapiens
  light chain complementarity determining region 3 for antibody 42385
MQALQTPLT

SEQ ID NO: 84770 - protein, 13 aa, Homo sapiens
  heavy chain complementarity determining region 3 for antibody 42385
ASSSSGWGGVFDF

SEQ ID NO: 84771 - protein, 8 aa, Homo sapiens
  light chain complementarity determining region 3 for antibody 42386
MQALQTPG

SEQ ID NO: 84772 - protein, 9 aa, Homo sapiens
  heavy chain complementarity determining region 3 for antibody 42386
ATVDRYGSP

SEQ ID NO: 84773 - protein, 9 aa, Homo sapiens
  light chain complementarity determining region 3 for antibody 42387
MQALLSPRT

SEQ ID NO: 84774 - protein, 13 aa, Homo sapiens
  heavy chain complementarity determining region 3 for antibody 42387
ARDRLGFGNFFDV

SEQ ID NO: 84775 - protein, 9 aa, Homo sapiens
  light chain complementarity determining region 3 for antibody 42388
LQYSSNPLT

SEQ ID NO: 84776 - protein, 14 aa, Homo sapiens
  heavy chain complementarity determining region 3 for antibody 42388
ARDGSGVGRDWFDP

SEQ ID NO: 84777 - protein, 9 aa, Homo sapiens
  light chain complementarity determining region 3 for antibody 42389
LQYNSYLWT

SEQ ID NO: 84778 - protein, 11 aa, Homo sapiens
  heavy chain complementarity determining region 3 for antibody 42389
ARDRGYSGHDI

SEQ ID NO: 84779 - protein, 9 aa, Homo sapiens
  light chain complementarity determining region 3 for antibody 42390
LQYDNLPLT

SEQ ID NO: 84780 - protein, 16 aa, Homo sapiens
  heavy chain complementarity determining region 3 for antibody 42390
AGTTHTASVLFWSPRD

SEQ ID NO: 84781 - protein, 9 aa, Homo sapiens
  light chain complementarity determining region 3 for antibody 42391
LQVNTYPLT

SEQ ID NO: 84782 - protein, 15 aa, Homo sapiens
  heavy chain complementarity determining region 3 for antibody 42391
ARDPWGYGPRSHFDY

SEQ ID NO: 84783 - protein, 9 aa, Homo sapiens
  light chain complementarity determining region 3 for antibody 42392
LQRGDWPLT

SEQ ID NO: 84784 - protein, 16 aa, Homo sapiens
  heavy chain complementarity determining region 3 for antibody 42392
ARQEIDYQDYRGYFDY

SEQ ID NO: 84785 - protein, 9 aa, Homo sapiens
  light chain complementarity determining region 3 for antibody 42393
LQHNTFPRT

SEQ ID NO: 84786 - protein, 19 aa, Homo sapiens
  heavy chain complementarity determining region 3 for antibody 42393
ATVSTYPSGSLGILGTFDF

SEQ ID NO: 84787 - protein, 9 aa, Homo sapiens
  light chain complementarity determining region 3 for antibody 42394
LQHNSYPRT

SEQ ID NO: 84788 - protein, 15 aa, Homo sapiens
  heavy chain complementarity determining region 3 for antibody 42394
ARGFVVLTGYYGMDV

SEQ ID NO: 84789 - protein, 11 aa, Homo sapiens
  light chain complementarity determining region 3 for antibody 42395
LQHNSYPRLST

SEQ ID NO: 84790 - protein, 14 aa, Homo sapiens
  heavy chain complementarity determining region 3 for antibody 42395
ARDPDETTGFSFDY

SEQ ID NO: 84791 - protein, 9 aa, Homo sapiens
  light chain complementarity determining region 3 for antibody 42396
LQHNSYPLT

SEQ ID NO: 84792 - protein, 16 aa, Homo sapiens
  heavy chain complementarity determining region 3 for antibody 42396
GRAPDRGSDFVDYFDY

SEQ ID NO: 84793 - protein, 9 aa, Homo sapiens
  light chain complementarity determining region 3 for antibody 42397
LQHNNYPLT

SEQ ID NO: 84794 - protein, 22 aa, Homo sapiens
  heavy chain complementarity determining region 3 for antibody 42397
AKDQASTVVVVSRPWEVSDLTF

SEQ ID NO: 84795 - protein, 9 aa, Homo sapiens
  light chain complementarity determining region 3 for antibody 42398
LQHKTYPYT

SEQ ID NO: 84796 - protein, 15 aa, Homo sapiens
  heavy chain complementarity determining region 3 for antibody 42398
TTDQGNYTNYYSFDF

SEQ ID NO: 84797 - protein, 10 aa, Homo sapiens
  light chain complementarity determining region 3 for antibody 42399
LQGTHWPPLT

SEQ ID NO: 84798 - protein, 11 aa, Homo sapiens
  heavy chain complementarity determining region 3 for antibody 42399
ARGGYLQNLDA

SEQ ID NO: 84799 - protein, 9 aa, Homo sapiens
  light chain complementarity determining region 3 for antibody 42400
LQDYNYPRT

SEQ ID NO: 84800 - protein, 17 aa, Homo sapiens
  heavy chain complementarity determining region 3 for antibody 42400
ARDATGRIAAAGIFCGY

SEQ ID NO: 84801 - protein, 9 aa, Homo sapiens
  light chain complementarity determining region 3 for antibody 42401
LQDYDYPRT

SEQ ID NO: 84802 - protein, 18 aa, Homo sapiens
  heavy chain complementarity determining region 3 for antibody 42401
VRDNDYSDSRGYHDAYDV

SEQ ID NO: 84803 - protein, 9 aa, Homo sapiens
  light chain complementarity determining region 3 for antibody 42402
LQDSNYPPT

SEQ ID NO: 84804 - protein, 12 aa, Homo sapiens
  heavy chain complementarity determining region 3 for antibody 42402
AAVGLEGLGRVF

SEQ ID NO: 84805 - protein, 9 aa, Homo sapiens
  light chain complementarity determining region 3 for antibody 42403
LQAYDYPHT

SEQ ID NO: 84806 - protein, 11 aa, Homo sapiens
  heavy chain complementarity determining region 3 for antibody 42403
VRFFVVAGTVV

SEQ ID NO: 84807 - protein, 9 aa, Homo sapiens
  light chain complementarity determining region 3 for antibody 42404
LHHYSFPYT

SEQ ID NO: 84808 - protein, 15 aa, Homo sapiens
  heavy chain complementarity determining region 3 for antibody 42404
ARGGYSSSWYYWFDP

SEQ ID NO: 84809 - protein, 10 aa, Homo sapiens
  light chain complementarity determining region 3 for antibody 42405
HRYGRSPPYT

SEQ ID NO: 84810 - protein, 19 aa, Homo sapiens
  heavy chain complementarity determining region 3 for antibody 42405
VKGSGYSASWISSNDGFDV

SEQ ID NO: 84811 - protein, 9 aa, Homo sapiens
  light chain complementarity determining region 3 for antibody 42406
HQYGSWSWT

SEQ ID NO: 84812 - protein, 16 aa, Homo sapiens
  heavy chain complementarity determining region 3 for antibody 42406
VKDQRVIVGASNYFDY

SEQ ID NO: 84813 - protein, 9 aa, Homo sapiens
  light chain complementarity determining region 3 for antibody 42407
HQYGSSPWT

SEQ ID NO: 84814 - protein, 14 aa, Homo sapiens
  heavy chain complementarity determining region 3 for antibody 42407
ATESSGWYSGAVHL

SEQ ID NO: 84815 - protein, 11 aa, Homo sapiens
  light chain complementarity determining region 3 for antibody 42408
HQYDIVPPDGA

SEQ ID NO: 84816 - protein, 18 aa, Homo sapiens
  heavy chain complementarity determining region 3 for antibody 42408
ARVRSVGYGSGGSLLRDH

SEQ ID NO: 84817 - protein, 9 aa, Homo sapiens
  light chain complementarity determining region 3 for antibody 42409
HQSYSTPYT

SEQ ID NO: 84818 - protein, 20 aa, Homo sapiens
  heavy chain complementarity determining region 3 for antibody 42409
ARGRIGYDVLTESHLYGMDV

SEQ ID NO: 84819 - protein, 9 aa, Homo sapiens
  light chain complementarity determining region 3 for antibody 42410
HQSSSLPLT

SEQ ID NO: 84820 - protein, 15 aa, Homo sapiens
  heavy chain complementarity determining region 3 for antibody 42410
ARGQSDYYDNSGYNF

SEQ ID NO: 84821 - protein, 9 aa, Homo sapiens
  light chain complementarity determining region 3 for antibody 42411
HQSSSFPLT

SEQ ID NO: 84822 - protein, 9 aa, Homo sapiens
  heavy chain complementarity determining region 3 for antibody 42411
ARGGQDFDY

SEQ ID NO: 84823 - protein, 9 aa, Homo sapiens
  light chain complementarity determining region 3 for antibody 42412
HQFGSSPWT

SEQ ID NO: 84824 - protein, 18 aa, Homo sapiens
  heavy chain complementarity determining region 3 for antibody 42412
ATSVATTVDGYYYYALDV

SEQ ID NO: 84825 - protein, 10 aa, Homo sapiens
  light chain complementarity determining region 3 for antibody 42413
HFYGSPPPNT

SEQ ID NO: 84826 - protein, 18 aa, Homo sapiens
  heavy chain complementarity determining region 3 for antibody 42413
ARVGGTTYDASGHYPGDY

SEQ ID NO: 84827 - protein, 10 aa, Homo sapiens
  light chain complementarity determining region 3 for antibody 42414
VQGTHWPPYT

SEQ ID NO: 84828 - protein, 11 aa, Homo sapiens
  heavy chain complementarity determining region 3 for antibody 42414
ATDWGSSGWVR

SEQ ID NO: 84829 - protein, 9 aa, Homo sapiens
  light chain complementarity determining region 3 for antibody 42415
RQYDNIPNT

SEQ ID NO: 84830 - protein, 17 aa, Homo sapiens
  heavy chain complementarity determining region 3 for antibody 42415
AAYGDFYVSGFSGRSDY

SEQ ID NO: 84831 - protein, 11 aa, Homo sapiens
  light chain complementarity determining region 3 for antibody 42416
QWYDNIPPWFT

SEQ ID NO: 84832 - protein, 15 aa, Homo sapiens
  heavy chain complementarity determining region 3 for antibody 42416
ARGPGVLAVKGVFDH

SEQ ID NO: 84833 - protein, 8 aa, Homo sapiens
  light chain complementarity determining region 3 for antibody 42417
QRYGRSLT

SEQ ID NO: 84834 - protein, 12 aa, Homo sapiens
  heavy chain complementarity determining region 3 for antibody 42417
ARLWIGTGPFDN

SEQ ID NO: 84835 - protein, 9 aa, Homo sapiens
  light chain complementarity determining region 3 for antibody 42418
QQYYTYPWT

SEQ ID NO: 84836 - protein, 13 aa, Homo sapiens
  heavy chain complementarity determining region 3 for antibody 42418
ARDYYDSSGPVDC

SEQ ID NO: 84837 - protein, 9 aa, Homo sapiens
  light chain complementarity determining region 3 for antibody 42419
QQYYSYSYT

SEQ ID NO: 84838 - protein, 18 aa, Homo sapiens
  heavy chain complementarity determining region 3 for antibody 42419
AKDLVPQMAVAGRWYFQH

SEQ ID NO: 84839 - protein, 9 aa, Homo sapiens
  light chain complementarity determining region 3 for antibody 42420
QQYYSYPLT

SEQ ID NO: 84840 - protein, 21 aa, Homo sapiens
  heavy chain complementarity determining region 3 for antibody 42420
AKETIAVRAQRVTGLTGPFDI

SEQ ID NO: 84841 - protein, 9 aa, Homo sapiens
  light chain complementarity determining region 3 for antibody 42421
QQYYSSLYT

SEQ ID NO: 84842 - protein, 13 aa, Homo sapiens
  heavy chain complementarity determining region 3 for antibody 42421
ARAPGGPGEYLQH

SEQ ID NO: 84843 - protein, 11 aa, Homo sapiens
  light chain complementarity determining region 3 for antibody 42422
QQYYRWPPGWT

SEQ ID NO: 84844 - protein, 12 aa, Homo sapiens
  heavy chain complementarity determining region 3 for antibody 42422
AILYSSGTPLGY

SEQ ID NO: 84845 - protein, 9 aa, Homo sapiens
  light chain complementarity determining region 3 for antibody 42423
QQYYRTPYT

SEQ ID NO: 84846 - protein, 11 aa, Homo sapiens
  heavy chain complementarity determining region 3 for antibody 42423
ARNTLMAYIDY

SEQ ID NO: 84847 - protein, 9 aa, Homo sapiens
  light chain complementarity determining region 3 for antibody 42424
QQYYDYPFT

SEQ ID NO: 84848 - protein, 16 aa, Homo sapiens
  heavy chain complementarity determining region 3 for antibody 42424
ARDRPRESSPYCSFIF

SEQ ID NO: 84849 - protein, 9 aa, Homo sapiens
  light chain complementarity determining region 3 for antibody 42425
QQYVISPYT

SEQ ID NO: 84850 - protein, 14 aa, Homo sapiens
  heavy chain complementarity determining region 3 for antibody 42425
ARDPHAGSGSYFDY

SEQ ID NO: 84851 - protein, 11 aa, Homo sapiens
  light chain complementarity determining region 3 for antibody 42426
QQYVGSPPGYT

SEQ ID NO: 84852 - protein, 15 aa, Homo sapiens
  heavy chain complementarity determining region 3 for antibody 42426
AREVDKTTDTDGFDV

SEQ ID NO: 84853 - protein, 10 aa, Homo sapiens
  light chain complementarity determining region 3 for antibody 42427
QQYTGYSGYT

SEQ ID NO: 84854 - protein, 11 aa, Homo sapiens
  heavy chain complementarity determining region 3 for antibody 42427
ARQGAVAGNDY

SEQ ID NO: 84855 - protein, 8 aa, Homo sapiens
  light chain complementarity determining region 3 for antibody 42428
QQYSSSPT

SEQ ID NO: 84856 - protein, 18 aa, Homo sapiens
  heavy chain complementarity determining region 3 for antibody 42428
ATKQGYCSGCCCYATFDY

SEQ ID NO: 84857 - protein, 8 aa, Homo sapiens
  light chain complementarity determining region 3 for antibody 42429
QQYSSLWT

SEQ ID NO: 84858 - protein, 20 aa, Homo sapiens
  heavy chain complementarity determining region 3 for antibody 42429
ARPSEDALPWGPQGDWHYDL

SEQ ID NO: 84859 - protein, 9 aa, Homo sapiens
  light chain complementarity determining region 3 for antibody 42430
QQYQTYPLT

SEQ ID NO: 84860 - protein, 12 aa, Homo sapiens
  heavy chain complementarity determining region 3 for antibody 42430
ARTYAGQNAIGY

SEQ ID NO: 84861 - protein, 9 aa, Homo sapiens
  light chain complementarity determining region 3 for antibody 42431
QQYNTYSWT

SEQ ID NO: 84862 - protein, 11 aa, Homo sapiens
  heavy chain complementarity determining region 3 for antibody 42431
ARSLDWDPFDI

SEQ ID NO: 84863 - protein, 8 aa, Homo sapiens
  light chain complementarity determining region 3 for antibody 42432
QQYNSYWT

SEQ ID NO: 84864 - protein, 18 aa, Homo sapiens
  heavy chain complementarity determining region 3 for antibody 42432
ARAGIRQQMNIENDVFDI

SEQ ID NO: 84865 - protein, 9 aa, Homo sapiens
  light chain complementarity determining region 3 for antibody 42433
QQYNSYSYT

SEQ ID NO: 84866 - protein, 16 aa, Homo sapiens
  heavy chain complementarity determining region 3 for antibody 42433
AREVADSNSWGWHLDL

SEQ ID NO: 84867 - protein, 9 aa, Homo sapiens
  light chain complementarity determining region 3 for antibody 42434
QQYNSYSST

SEQ ID NO: 84868 - protein, 14 aa, Homo sapiens
  heavy chain complementarity determining region 3 for antibody 42434
ATKKNLVAPAGFDP

SEQ ID NO: 84869 - protein, 9 aa, Homo sapiens
  light chain complementarity determining region 3 for antibody 42435
QQYNSYSRT

SEQ ID NO: 84870 - protein, 6 aa, Homo sapiens
  heavy chain complementarity determining region 3 for antibody 42435
TSPGYS

SEQ ID NO: 84871 - protein, 12 aa, Homo sapiens
  light chain complementarity determining region 3 for antibody 42436
QQYNSYSRGGFT

SEQ ID NO: 84872 - protein, 16 aa, Homo sapiens
  heavy chain complementarity determining region 3 for antibody 42436
AKGSSGGPGQNNAFDF

SEQ ID NO: 84873 - protein, 9 aa, Homo sapiens
  light chain complementarity determining region 3 for antibody 42437
QQYNSYSPN

SEQ ID NO: 84874 - protein, 16 aa, Homo sapiens
  heavy chain complementarity determining region 3 for antibody 42437
ARGPRDYGGRQWYFNL

SEQ ID NO: 84875 - protein, 9 aa, Homo sapiens
  light chain complementarity determining region 3 for antibody 42438
QQYNSYPWT

SEQ ID NO: 84876 - protein, 16 aa, Homo sapiens
  heavy chain complementarity determining region 3 for antibody 42438
ANYYCRDDSCHYYFDY

SEQ ID NO: 84877 - protein, 9 aa, Homo sapiens
  light chain complementarity determining region 3 for antibody 42439
QQYNSYPRT

SEQ ID NO: 84878 - protein, 14 aa, Homo sapiens
  heavy chain complementarity determining region 3 for antibody 42439
AREKGRYGDYLFEN

SEQ ID NO: 84879 - protein, 9 aa, Homo sapiens
  light chain complementarity determining region 3 for antibody 42440
QQYNSYPLT

SEQ ID NO: 84880 - protein, 8 aa, Homo sapiens
  heavy chain complementarity determining region 3 for antibody 42440
ASPIAEVQ

SEQ ID NO: 84881 - protein, 9 aa, Homo sapiens
  light chain complementarity determining region 3 for antibody 42441
QQYNSYPLT

SEQ ID NO: 84882 - protein, 19 aa, Homo sapiens
  heavy chain complementarity determining region 3 for antibody 42441
AREFQPLYGDYGRGQRLDH

SEQ ID NO: 84883 - protein, 9 aa, Homo sapiens
  light chain complementarity determining region 3 for antibody 42442
QQYNSYPLT

SEQ ID NO: 84884 - protein, 13 aa, Homo sapiens
  heavy chain complementarity determining region 3 for antibody 42442
ARDLDYQQLVIDY

SEQ ID NO: 84885 - protein, 9 aa, Homo sapiens
  light chain complementarity determining region 3 for antibody 42443
QQYNSWPQK

SEQ ID NO: 84886 - protein, 9 aa, Homo sapiens
  heavy chain complementarity determining region 3 for antibody 42443
ARQGTWFDP

SEQ ID NO: 84887 - protein, 10 aa, Homo sapiens
  light chain complementarity determining region 3 for antibody 42444
QQYNRVPPLT

SEQ ID NO: 84888 - protein, 21 aa, Homo sapiens
  heavy chain complementarity determining region 3 for antibody 42444
ARSPLYYDSAWGTYRYQTLDY

SEQ ID NO: 84889 - protein, 8 aa, Homo sapiens
  light chain complementarity determining region 3 for antibody 42445
QQYNNYWM

SEQ ID NO: 84890 - protein, 16 aa, Homo sapiens
  heavy chain complementarity determining region 3 for antibody 42445
ALQRRSYSSDWYGVRY

SEQ ID NO: 84891 - protein, 9 aa, Homo sapiens
  light chain complementarity determining region 3 for antibody 42446
QQYNNWRDT

SEQ ID NO: 84892 - protein, 11 aa, Homo sapiens
  heavy chain complementarity determining region 3 for antibody 42446
AIRRYQLLVGT

SEQ ID NO: 84893 - protein, 10 aa, Homo sapiens [sequence omitted]

SEQ ID NO: 84894 - protein, 13 aa, Homo sapiens
  heavy chain complementarity determining region 3 for antibody 42447
ARRNGGSRDAFDV

SEQ ID NO: 84895 - protein, 9 aa, Homo sapiens
  light chain complementarity determining region 3 for antibody 42448
QQYKSYSPT

SEQ ID NO: 84896 - protein, 16 aa, Homo sapiens
  heavy chain complementarity determining region 3 for antibody 42448
ASGYGSGNYYTPPFDS

SEQ ID NO: 84897 - protein, 9 aa, Homo sapiens
  light chain complementarity determining region 3 for antibody 42449
QQYKSYPYT

SEQ ID NO: 84898 - protein, 19 aa, Homo sapiens
  heavy chain complementarity determining region 3 for antibody 42449
ARERFGDGSGSYGGSEFDY

SEQ ID NO: 84899 - protein, 9 aa, Homo sapiens
  light chain complementarity determining region 3 for antibody 42450
QQYKSYPPT

SEQ ID NO: 84900 - protein, 13 aa, Homo sapiens
  heavy chain complementarity determining region 3 for antibody 42450
ARSYSGSSVSHDY

SEQ ID NO: 84901 - protein, 7 aa, Homo sapiens
  light chain complementarity determining region 3 for antibody 42451
QQYKSMG

SEQ ID NO: 84902 - protein, 17 aa, Homo sapiens
  heavy chain complementarity determining region 3 for antibody 42451
TTDPASGDYDFWSGYDY

SEQ ID NO: 84903 - protein, 8 aa, Homo sapiens
  light chain complementarity determining region 3 for antibody 42452
QQYKSFST

SEQ ID NO: 84904 - protein, 24 aa, Homo sapiens
  heavy chain complementarity determining region 3 for antibody 42452
ARTVKDVLRFVEDPRPSEYNWFGP

SEQ ID NO: 84905 - protein, 10 aa, Homo sapiens
  light chain complementarity determining region 3 for antibody 42453
QQYKNWPSFT

SEQ ID NO: 84906 - protein, 13 aa, Homo sapiens
  heavy chain complementarity determining region 3 for antibody 42453
ARIPSKDYVVFDI

SEQ ID NO: 84907 - protein, 9 aa, Homo sapiens
  light chain complementarity determining region 3 for antibody 42454
QQYHTYPRT

SEQ ID NO: 84908 - protein, 13 aa, Homo sapiens
  heavy chain complementarity determining region 3 for antibody 42454
ASEGEGDWHAFDF

SEQ ID NO: 84909 - protein, 9 aa, Homo sapiens
  light chain complementarity determining region 3 for antibody 42455
QQYHSYPIT

SEQ ID NO: 84910 - protein, 15 aa, Homo sapiens
  heavy chain complementarity determining region 3 for antibody 42455
ARNTHTSGWADVFDI

SEQ ID NO: 84911 - protein, 9 aa, Homo sapiens
  light chain complementarity determining region 3 for antibody 42456
QQYHSSPLT

SEQ ID NO: 84912 - protein, 20 aa, Homo sapiens
  heavy chain complementarity determining region 3 for antibody 42456
ARHLTDWGALTGRPNDGFGV

SEQ ID NO: 84913 - protein, 8 aa, Homo sapiens
  light chain complementarity determining region 3 for antibody 42457
QQYGTSFT

SEQ ID NO: 84914 - protein, 15 aa, Homo sapiens
  heavy chain complementarity determining region 3 for antibody 42457
ARAQVIWGQLYYFDY

SEQ ID NO: 84915 - protein, 10 aa, Homo sapiens
  light chain complementarity determining region 3 for antibody 42458
QQYGSYTPRT

SEQ ID NO: 84916 - protein, 14 aa, Homo sapiens
  heavy chain complementarity determining region 3 for antibody 42458
VRDNLVGTDYYFDY

SEQ ID NO: 84917 - protein, 9 aa, Homo sapiens
  light chain complementarity determining region 3 for antibody 42459
QQYGSSPWT

SEQ ID NO: 84918 - protein, 12 aa, Homo sapiens
  heavy chain complementarity determining region 3 for antibody 42459
ARGGTVAGRNDY

SEQ ID NO: 84919 - protein, 9 aa, Homo sapiens
  light chain complementarity determining region 3 for antibody 42460
QQYGSSPRT

SEQ ID NO: 84920 - protein, 8 aa, Homo sapiens
  heavy chain complementarity determining region 3 for antibody 42460
ARGFQYDS

SEQ ID NO: 84921 - protein, 9 aa, Homo sapiens
  light chain complementarity determining region 3 for antibody 42461
QQYGSSPRT

SEQ ID NO: 84922 - protein, 17 aa, Homo sapiens
  heavy chain complementarity determining region 3 for antibody 42461
ARDRGGPIAVADDVFDI

SEQ ID NO: 84923 - protein, 9 aa, Homo sapiens
  light chain complementarity determining region 3 for antibody 42462
QQYGSSPRT

SEQ ID NO: 84924 - protein, 19 aa, Homo sapiens
  heavy chain complementarity determining region 3 for antibody 42462
AKGTRIGSGAFYTPFYFDS

SEQ ID NO: 84925 - protein, 10 aa, Homo sapiens
  light chain complementarity determining region 3 for antibody 42463
QQYGSSPPAT

SEQ ID NO: 84926 - protein, 11 aa, Homo sapiens
  heavy chain complementarity determining region 3 for antibody 42463
ARHGSEMELDS

SEQ ID NO: 84927 - protein, 9 aa, Homo sapiens
  light chain complementarity determining region 3 for antibody 42464
QQYGSSPLT

SEQ ID NO: 84928 - protein, 19 aa, Homo sapiens
  heavy chain complementarity determining region 3 for antibody 42464
ARETVITVFGVFIKGGMDV

SEQ ID NO: 84929 - protein, 9 aa, Homo sapiens
  light chain complementarity determining region 3 for antibody 42465
QQYGSSPIT

SEQ ID NO: 84930 - protein, 13 aa, Homo sapiens
  heavy chain complementarity determining region 3 for antibody 42465
ARDLGDGYNSIDH

SEQ ID NO: 84931 - protein, 9 aa, Homo sapiens
  light chain complementarity determining region 3 for antibody 42466
QQYGSSPFT

SEQ ID NO: 84932 - protein, 11 aa, Homo sapiens
  heavy chain complementarity determining region 3 for antibody 42466
ARGVGSYVFDS

SEQ ID NO: 84933 - protein, 9 aa, Homo sapiens
  light chain complementarity determining region 3 for antibody 42467
QQYGSSPET

SEQ ID NO: 84934 - protein, 25 aa, Homo sapiens
  heavy chain complementarity determining region 3 for antibody 42467
AREGGTFYFDTSGRLYDTTFYGMDV

SEQ ID NO: 84935 - protein, 9 aa, Homo sapiens
  light chain complementarity determining region 3 for antibody 42468
QQYGSSLYT

SEQ ID NO: 84936 - protein, 14 aa, Homo sapiens
  heavy chain complementarity determining region 3 for antibody 42468
ARGLSPTVTRPLYF

SEQ ID NO: 84937 - protein, 9 aa, Homo sapiens
  light chain complementarity determining region 3 for antibody 42469
QQYGSSLWT

SEQ ID NO: 84938 - protein, 22 aa, Homo sapiens
  heavy chain complementarity determining region 3 for antibody 42469
AKDAGPGYSPAAVGRGGSCLDH

SEQ ID NO: 84939 - protein, 10 aa, Homo sapiens
  light chain complementarity determining region 3 for antibody 42470
QQYGSSLTWT

SEQ ID NO: 84940 - protein, 12 aa, Homo sapiens
  heavy chain complementarity determining region 3 for antibody 42470
ARTYYGGWPFDY

SEQ ID NO: 84941 - protein, 8 aa, Homo sapiens
  light chain complementarity determining region 3 for antibody 42471
QQYGSSLT

SEQ ID NO: 84942 - protein, 14 aa, Homo sapiens
  heavy chain complementarity determining region 3 for antibody 42471
ATSRTGEAVGLFDH

SEQ ID NO: 84943 - protein, 9 aa, Homo sapiens
  light chain complementarity determining region 3 for antibody 42472
QQYGSSLFT

SEQ ID NO: 84944 - protein, 11 aa, Homo sapiens
  heavy chain complementarity determining region 3 for antibody 42472
ARDFEEKAADY

SEQ ID NO: 84945 - protein, 9 aa, Homo sapiens
  light chain complementarity determining region 3 for antibody 42473
QQYGSPPLT

SEQ ID NO: 84946 - protein, 12 aa, Homo sapiens
  heavy chain complementarity determining region 3 for antibody 42473
ARWGDGSTGGFY

SEQ ID NO: 84947 - protein, 9 aa, Homo sapiens
  light chain complementarity determining region 3 for antibody 42474
QQYGSLPLT

SEQ ID NO: 84948 - protein, 16 aa, Homo sapiens
  heavy chain complementarity determining region 3 for antibody 42474
ARDMWLGDQSAEYFQH

SEQ ID NO: 84949 - protein, 10 aa, Homo sapiens
  light chain complementarity determining region 3 for antibody 42475
QQYGSFLQWT

SEQ ID NO: 84950 - protein, 24 aa, Homo sapiens
  heavy chain complementarity determining region 3 for antibody 42475
GREVIYCGGDCPDPSYYYYNGMDV

SEQ ID NO: 84951 - protein, 9 aa, Homo sapiens
  light chain complementarity determining region 3 for antibody 42476
QQYGRSPLI

SEQ ID NO: 84952 - protein, 15 aa, Homo sapiens
  heavy chain complementarity determining region 3 for antibody 42476
ARHMIQWGVFAPLDP

SEQ ID NO: 84953 - protein, 10 aa, Homo sapiens
  light chain complementarity determining region 3 for antibody 42477
QQYGNSFPWT

SEQ ID NO: 84954 - protein, 16 aa, Homo sapiens
  heavy chain complementarity determining region 3 for antibody 42477
AARRPTLAVAGPSFDY

SEQ ID NO: 84955 - protein, 9 aa, Homo sapiens
  light chain complementarity determining region 3 for antibody 42478
QQYGHSQYT

SEQ ID NO: 84956 - protein, 8 aa, Homo sapiens
  heavy chain complementarity determining region 3 for antibody 42478
ARVRYFDY

SEQ ID NO: 84957 - protein, 9 aa, Homo sapiens
  light chain complementarity determining region 3 for antibody 42479
QQYGHLPPT

SEQ ID NO: 84958 - protein, 15 aa, Homo sapiens
  heavy chain complementarity determining region 3 for antibody 42479
AKGETSAGLKYLFDV

SEQ ID NO: 84959 - protein, 9 aa, Homo sapiens
  light chain complementarity determining region 3 for antibody 42480
QQYGGSPRT

SEQ ID NO: 84960 - protein, 20 aa, Homo sapiens
  heavy chain complementarity determining region 3 for antibody 42480
AKATQGYNWNFGLSNDPFDL

SEQ ID NO: 84961 - protein, 10 aa, Homo sapiens
  light chain complementarity determining region 3 for antibody 42481
QQYGGSPPYT

SEQ ID NO: 84962 - protein, 16 aa, Homo sapiens
  heavy chain complementarity determining region 3 for antibody 42481
VRVGTIFGLVRHYFDY

SEQ ID NO: 84963 - protein, 9 aa, Homo sapiens
  light chain complementarity determining region 3 for antibody 42482
QQYGGSFWT

SEQ ID NO: 84964 - protein, 17 aa, Homo sapiens
  heavy chain complementarity determining region 3 for antibody 42482
TTDRHRGGSQRPYGMDV

SEQ ID NO: 84965 - protein, 7 aa, Homo sapiens
  light chain complementarity determining region 3 for antibody 42483
QQYGGLT

SEQ ID NO: 84966 - protein, 16 aa, Homo sapiens
  heavy chain complementarity determining region 3 for antibody 42483
ARLLRGGYDFAYFFDY

SEQ ID NO: 84967 - protein, 9 aa, Homo sapiens
  light chain complementarity determining region 3 for antibody 42484
QQYDYLPPA

SEQ ID NO: 84968 - protein, 13 aa, Homo sapiens
  heavy chain complementarity determining region 3 for antibody 42484
AAQSFKRLVHFDY

SEQ ID NO: 84969 - protein, 8 aa, Homo sapiens
  light chain complementarity determining region 3 for antibody 42485
QQYDYLPA

SEQ ID NO: 84970 - protein, 11 aa, Homo sapiens
  heavy chain complementarity determining region 3 for antibody 42485
VRSAKVVAPPH

SEQ ID NO: 84971 - protein, 9 aa, Homo sapiens
  light chain complementarity determining region 3 for antibody 42486
QQYDVYPWT

SEQ ID NO: 84972 - protein, 13 aa, Homo sapiens
  heavy chain complementarity determining region 3 for antibody 42486
VKGEMARGVIVPY

SEQ ID NO: 84973 - protein, 9 aa, Homo sapiens
  light chain complementarity determining region 3 for antibody 42487
QQYDTYPLT

SEQ ID NO: 84974 - protein, 12 aa, Homo sapiens
  heavy chain complementarity determining region 3 for antibody 42487
ARDWSGTSPPDY

SEQ ID NO: 84975 - protein, 9 aa, Homo sapiens
  light chain complementarity determining region 3 for antibody 42488
QQYDTFPWT

SEQ ID NO: 84976 - protein, 11 aa, Homo sapiens
  heavy chain complementarity determining region 3 for antibody 42488
ARVMRGRTIDH

SEQ ID NO: 84977 - protein, 9 aa, Homo sapiens
  light chain complementarity determining region 3 for antibody 42489
QQYDTAPWT

SEQ ID NO: 84978 - protein, 17 aa, Homo sapiens
  heavy chain complementarity determining region 3 for antibody 42489
ARDANPAKRWPDNYFDP

SEQ ID NO: 84979 - protein, 9 aa, Homo sapiens
  light chain complementarity determining region 3 for antibody 42490
QQYDSSSYT

SEQ ID NO: 84980 - protein, 13 aa, Homo sapiens
  heavy chain complementarity determining region 3 for antibody 42490
VRQPIAAAGVIDH

SEQ ID NO: 84981 - protein, 9 aa, Homo sapiens
  light chain complementarity determining region 3 for antibody 42491
QQYDNWPGT

SEQ ID NO: 84982 - protein, 14 aa, Homo sapiens
  heavy chain complementarity determining region 3 for antibody 42491
ARGRTVTTVEYFDY

SEQ ID NO: 84983 - protein, 9 aa, Homo sapiens
  light chain complementarity determining region 3 for antibody 42492
QQYDNPIFT

SEQ ID NO: 84984 - protein, 15 aa, Homo sapiens
  heavy chain complementarity determining region 3 for antibody 42492
AREDGYNRVSWYLDL

SEQ ID NO: 84985 - protein, 9 aa, Homo sapiens
  light chain complementarity determining region 3 for antibody 42493
QQYDNLPYT

SEQ ID NO: 84986 - protein, 13 aa, Homo sapiens
  heavy chain complementarity determining region 3 for antibody 42493
ARGVNMVRGLLDS

SEQ ID NO: 84987 - protein, 9 aa, Homo sapiens
  light chain complementarity determining region 3 for antibody 42494
QQYDNLPYA

SEQ ID NO: 84988 - protein, 18 aa, Homo sapiens
  heavy chain complementarity determining region 3 for antibody 42494
AREHPPNIAVTGNWYFDL

SEQ ID NO: 84989 - protein, 8 aa, Homo sapiens
  light chain complementarity determining region 3 for antibody 42495
QQYDNLPT

SEQ ID NO: 84990 - protein, 14 aa, Homo sapiens
  heavy chain complementarity determining region 3 for antibody 42495
ARIGSTSWYGAFEI

SEQ ID NO: 84991 - protein, 9 aa, Homo sapiens
  light chain complementarity determining region 3 for antibody 42496
QQYDNLPLT

SEQ ID NO: 84992 - protein, 15 aa, Homo sapiens
  heavy chain complementarity determining region 3 for antibody 42496
ARLGWRVGTLGYLDS

SEQ ID NO: 84993 - protein, 8 aa, Homo sapiens
  light chain complementarity determining region 3 for antibody 42497
QQYDNLLT

SEQ ID NO: 84994 - protein, 13 aa, Homo sapiens
  heavy chain complementarity determining region 3 for antibody 42497
ARDYQWGYFYFDY

SEQ ID NO: 84995 - protein, 9 aa, Homo sapiens
  light chain complementarity determining region 3 for antibody 42498
QQYDIPPRT

SEQ ID NO: 84996 - protein, 17 aa, Homo sapiens
  heavy chain complementarity determining region 3 for antibody 42498
ARIPPLPSYHGYGAFDY

SEQ ID NO: 84997 - protein, 8 aa, Homo sapiens
  light chain complementarity determining region 3 for antibody 42499
QQYDHLPT

SEQ ID NO: 84998 - protein, 17 aa, Homo sapiens
  heavy chain complementarity determining region 3 for antibody 42499
AVPTLGDHDGLPAAFNV

SEQ ID NO: 84999 - protein, 11 aa, Homo sapiens
  light chain complementarity determining region 3 for antibody 42500
QQYDHLPPEGS

SEQ ID NO: 85000 - protein, 19 aa, Homo sapiens
  heavy chain complementarity determining region 3 for antibody 42500
ARGARDYSGSGNDSTNFEC

SEQ ID NO: 85001 - protein, 9 aa, Homo sapiens
  light chain complementarity determining region 3 for antibody 42501
QQYDDLPVT

SEQ ID NO: 85002 - protein, 20 aa, Homo sapiens
  heavy chain complementarity determining region 3 for antibody 42501
ARNAYCLGGSCDLSYYGMDV

SEQ ID NO: 85003 - protein, 9 aa, Homo sapiens
  light chain complementarity determining region 3 for antibody 42502
QQYDDLPIT

SEQ ID NO: 85004 - protein, 13 aa, Homo sapiens
  heavy chain complementarity determining region 3 for antibody 42502
ARASGYDVLTFEY

SEQ ID NO: 85005 - protein, 10 aa, Homo sapiens
  light chain complementarity determining region 3 for antibody 42503
QQYASSTPYT

SEQ ID NO: 85006 - protein, 17 aa, Homo sapiens
  heavy chain complementarity determining region 3 for antibody 42503
AQYTKYYYDSSGYYVVS

SEQ ID NO: 85007 - protein, 8 aa, Homo sapiens
  light chain complementarity determining region 3 for antibody 42504
QQYAGSFT

SEQ ID NO: 85008 - protein, 11 aa, Homo sapiens
  heavy chain complementarity determining region 3 for antibody 42504
STWFFLSDVDV

SEQ ID NO: 85009 - protein, 9 aa, Homo sapiens
  light chain complementarity determining region 3 for antibody 42505
QQTYTTRVT

SEQ ID NO: 85010 - protein, 15 aa, Homo sapiens
  heavy chain complementarity determining region 3 for antibody 42505
ARDSFDGSYSGSFDY

SEQ ID NO: 85011 - protein, 9 aa, Homo sapiens
  light chain complementarity determining region 3 for antibody 42506
QQTYTGRVT

SEQ ID NO: 85012 - protein, 15 aa, Homo sapiens
  heavy chain complementarity determining region 3 for antibody 42506
ARDSYDGSYSGSFDY

SEQ ID NO: 85013 - protein, 9 aa, Homo sapiens
  light chain complementarity determining region 3 for antibody 42507
QQTYSTPGT

SEQ ID NO: 85014 - protein, 18 aa, Homo sapiens
  heavy chain complementarity determining region 3 for antibody 42507
ARATKGSAYYYVPHYFDC

SEQ ID NO: 85015 - protein, 9 aa, Homo sapiens
  light chain complementarity determining region 3 for antibody 42508
QQTYSPVWT

SEQ ID NO: 85016 - protein, 19 aa, Homo sapiens
  heavy chain complementarity determining region 3 for antibody 42508
ARPSGGGHFDFWGQGVLEY

SEQ ID NO: 85017 - protein, 10 aa, Homo sapiens
  light chain complementarity determining region 3 for antibody 42509
QQTYETPRWT

SEQ ID NO: 85018 - protein, 21 aa, Homo sapiens
  heavy chain complementarity determining region 3 for antibody 42509
ARDQRGGIAAAGVPHKNCLDS

SEQ ID NO: 85019 - protein, 9 aa, Homo sapiens
  light chain complementarity determining region 3 for antibody 42510
QQTSTFPLT

SEQ ID NO: 85020 - protein, 16 aa, Homo sapiens
  heavy chain complementarity determining region 3 for antibody 42510
ARVVVSTSTLGRWFDP

SEQ ID NO: 85021 - protein, 9 aa, Homo sapiens
  light chain complementarity determining region 3 for antibody 42511
QQTHTAPYT

SEQ ID NO: 85022 - protein, 13 aa, Homo sapiens
  heavy chain complementarity determining region 3 for antibody 42511
ARARNYDRISLDF

SEQ ID NO: 85023 - protein, 9 aa, Homo sapiens
  light chain complementarity determining region 3 for antibody 42512
QQSYTVVDT

SEQ ID NO: 85024 - protein, 11 aa, Homo sapiens
  heavy chain complementarity determining region 3 for antibody 42512
ARDRTERVFDS

SEQ ID NO: 85025 - protein, 10 aa, Homo sapiens
  light chain complementarity determining region 3 for antibody 42513
QQSYTTPPWT

SEQ ID NO: 85026 - protein, 23 aa, Homo sapiens
  heavy chain complementarity determining region 3 for antibody 42513
VKDLQLSGYGPLAKLNSYNNMDV

SEQ ID NO: 85027 - protein, 9 aa, Homo sapiens
  light chain complementarity determining region 3 for antibody 42514
QQSYSVPWT

SEQ ID NO: 85028 - protein, 18 aa, Homo sapiens
  heavy chain complementarity determining region 3 for antibody 42514
ARTGAGDGYNYANYGMDV

SEQ ID NO: 85029 - protein, 9 aa, Homo sapiens
  light chain complementarity determining region 3 for antibody 42515
QQSYSTWWT

SEQ ID NO: 85030 - protein, 14 aa, Homo sapiens
  heavy chain complementarity determining region 3 for antibody 42515
AKAKDSSGYHYFDY

SEQ ID NO: 85031 - protein, 9 aa, Homo sapiens
  light chain complementarity determining region 3 for antibody 42516
QQSYSTPYT

SEQ ID NO: 85032 - protein, 16 aa, Homo sapiens
  heavy chain complementarity determining region 3 for antibody 42516
TRGPGGRDEYKDAFDI

SEQ ID NO: 85033 - protein, 9 aa, Homo sapiens
  light chain complementarity determining region 3 for antibody 42517
QQSYSTPYT

SEQ ID NO: 85034 - protein, 14 aa, Homo sapiens
  heavy chain complementarity determining region 3 for antibody 42517
ARDSSGWYNDFALY

SEQ ID NO: 85035 - protein, 9 aa, Homo sapiens
  light chain complementarity determining region 3 for antibody 42518
QQSYSTPVT

SEQ ID NO: 85036 - protein, 14 aa, Homo sapiens
  heavy chain complementarity determining region 3 for antibody 42518
ARISPLTTSYAFDI

SEQ ID NO: 85037 - protein, 9 aa, Homo sapiens
  light chain complementarity determining region 3 for antibody 42519
QQSYSTPST

SEQ ID NO: 85038 - protein, 15 aa, Homo sapiens
  heavy chain complementarity determining region 3 for antibody 42519
AAAGLDPYDSGSYWL

SEQ ID NO: 85039 - protein, 9 aa, Homo sapiens
  light chain complementarity determining region 3 for antibody 42520
QQSYSTPRT

SEQ ID NO: 85040 - protein, 9 aa, Homo sapiens
  heavy chain complementarity determining region 3 for antibody 42520
TTGGSRLGY

SEQ ID NO: 85041 - protein, 9 aa, Homo sapiens
  light chain complementarity determining region 3 for antibody 42521
QQSYSTPRT

SEQ ID NO: 85042 - protein, 13 aa, Homo sapiens
  heavy chain complementarity determining region 3 for antibody 42521
AVTALVTPGWVDY

SEQ ID NO: 85043 - protein, 9 aa, Homo sapiens
  light chain complementarity determining region 3 for antibody 42522
QQSYSTPRT

SEQ ID NO: 85044 - protein, 13 aa, Homo sapiens
  heavy chain complementarity determining region 3 for antibody 42522
AKYDSSVTDAFDI

SEQ ID NO: 85045 - protein, 10 aa, Homo sapiens
  light chain complementarity determining region 3 for antibody 42523
QQSYSTPPYT

SEQ ID NO: 85046 - protein, 14 aa, Homo sapiens
  heavy chain complementarity determining region 3 for antibody 42523
ARSTTAILGDAFDI

SEQ ID NO: 85047 - protein, 10 aa, Homo sapiens
  light chain complementarity determining region 3 for antibody 42524
QQSYSTPPWT

SEQ ID NO: 85048 - protein, 12 aa, Homo sapiens
  heavy chain complementarity determining region 3 for antibody 42524
ARVSPVRGVIDY

SEQ ID NO: 85049 - protein, 9 aa, Homo sapiens
  light chain complementarity determining region 3 for antibody 42525
QQSYSTPPT

SEQ ID NO: 85050 - protein, 18 aa, Homo sapiens
  heavy chain complementarity determining region 3 for antibody 42525
ARRKDEKGWYRGDDAFDV

SEQ ID NO: 85051 - protein, 9 aa, Homo sapiens
  light chain complementarity determining region 3 for antibody 42526
QQSYSTPLT

SEQ ID NO: 85052 - protein, 15 aa, Homo sapiens
  heavy chain complementarity determining region 3 for antibody 42526
ARHGYYYDPTNWFDP

SEQ ID NO: 85053 - protein, 9 aa, Homo sapiens
  light chain complementarity determining region 3 for antibody 42527
QQSYSTPLT

SEQ ID NO: 85054 - protein, 12 aa, Homo sapiens
  heavy chain complementarity determining region 3 for antibody 42527
ARERRPDGYFDY

SEQ ID NO: 85055 - protein, 9 aa, Homo sapiens
  light chain complementarity determining region 3 for antibody 42528
QQSYSTPLT

SEQ ID NO: 85056 - protein, 14 aa, Homo sapiens
  heavy chain complementarity determining region 3 for antibody 42528
ARALTADYAYGMDV

SEQ ID NO: 85057 - protein, 9 aa, Homo sapiens
  light chain complementarity determining region 3 for antibody 42529
QQSYSTPLT

SEQ ID NO: 85058 - protein, 18 aa, Homo sapiens
  heavy chain complementarity determining region 3 for antibody 42529
ANSHPFGSFYGDIEGMDV

SEQ ID NO: 85059 - protein, 9 aa, Homo sapiens
  light chain complementarity determining region 3 for antibody 42530
QQSYSTPLT

SEQ ID NO: 85060 - protein, 14 aa, Homo sapiens
  heavy chain complementarity determining region 3 for antibody 42530
AKCRDTSGYSGFDL

SEQ ID NO: 85061 - protein, 9 aa, Homo sapiens
  light chain complementarity determining region 3 for antibody 42531
QQSYSTPIT

SEQ ID NO: 85062 - protein, 17 aa, Homo sapiens
  heavy chain complementarity determining region 3 for antibody 42531
LGIPDLDNFEISSYSSL

SEQ ID NO: 85063 - protein, 9 aa, Homo sapiens
  light chain complementarity determining region 3 for antibody 42532
QQSYSTPFT

SEQ ID NO: 85064 - protein, 14 aa, Homo sapiens
  heavy chain complementarity determining region 3 for antibody 42532
ARSYDTSGYSALDY

SEQ ID NO: 85065 - protein, 9 aa, Homo sapiens
  light chain complementarity determining region 3 for antibody 42533
QQSYSTLWT

SEQ ID NO: 85066 - protein, 19 aa, Homo sapiens
  heavy chain complementarity determining region 3 for antibody 42533
ARTHTPTNYYDSSGYYFDY

SEQ ID NO: 85067 - protein, 9 aa, Homo sapiens
  light chain complementarity determining region 3 for antibody 42534
QQSYSSVWT

SEQ ID NO: 85068 - protein, 15 aa, Homo sapiens
  heavy chain complementarity determining region 3 for antibody 42534
ARLRKAFGDPNWFDP

SEQ ID NO: 85069 - protein, 9 aa, Homo sapiens
  light chain complementarity determining region 3 for antibody 42535
QQSYSLQLS

SEQ ID NO: 85070 - protein, 14 aa, Homo sapiens
  heavy chain complementarity determining region 3 for antibody 42535
ARGTTVLSVEAFDY

SEQ ID NO: 85071 - protein, 9 aa, Homo sapiens
  light chain complementarity determining region 3 for antibody 42536
QQSYSIPQT

SEQ ID NO: 85072 - protein, 13 aa, Homo sapiens
  heavy chain complementarity determining region 3 for antibody 42536
VTGRGRYGGSFEY

SEQ ID NO: 85073 - protein, 9 aa, Homo sapiens
  light chain complementarity determining region 3 for antibody 42537
QQSYSIPIT

SEQ ID NO: 85074 - protein, 15 aa, Homo sapiens
  heavy chain complementarity determining region 3 for antibody 42537
AKCAEYQLLANWFDP

SEQ ID NO: 85075 - protein, 10 aa, Homo sapiens
  light chain complementarity determining region 3 for antibody 42538
QQSYNSPPWT

SEQ ID NO: 85076 - protein, 17 aa, Homo sapiens
  heavy chain complementarity determining region 3 for antibody 42538
ATDRLHWFGEFLSYFDS

SEQ ID NO: 85077 - protein, 8 aa, Homo sapiens
  light chain complementarity determining region 3 for antibody 42539
QQSYNFRS

SEQ ID NO: 85078 - protein, 13 aa, Homo sapiens
  heavy chain complementarity determining region 3 for antibody 42539
AKDRGGTLGWLDP

SEQ ID NO: 85079 - protein, 9 aa, Homo sapiens
  light chain complementarity determining region 3 for antibody 42540
QQSYITPHT

SEQ ID NO: 85080 - protein, 17 aa, Homo sapiens
  heavy chain complementarity determining region 3 for antibody 42540
ARVVPGSGTYYGGAFDI

SEQ ID NO: 85081 - protein, 10 aa, Homo sapiens
  light chain complementarity determining region 3 for antibody 42541
QQSYGTPMYT

SEQ ID NO: 85082 - protein, 12 aa, Homo sapiens
  heavy chain complementarity determining region 3 for antibody 42541
ARETTVADYFDS

SEQ ID NO: 85083 - protein, 9 aa, Homo sapiens
  light chain complementarity determining region 3 for antibody 42542
QQSYGTLQT

SEQ ID NO: 85084 - protein, 18 aa, Homo sapiens
  heavy chain complementarity determining region 3 for antibody 42542
AHYGSGSYWSSLEDAFDI

SEQ ID NO: 85085 - protein, 9 aa, Homo sapiens
  light chain complementarity determining region 3 for antibody 42543
QQSYGLPQT

SEQ ID NO: 85086 - protein, 19 aa, Homo sapiens
  heavy chain complementarity determining region 3 for antibody 42543
ARVGLEIPPAIRRGEWFDP

SEQ ID NO: 85087 - protein, 9 aa, Homo sapiens
  light chain complementarity determining region 3 for antibody 42544
QQSSSTPFT

SEQ ID NO: 85088 - protein, 14 aa, Homo sapiens
  heavy chain complementarity determining region 3 for antibody 42544
AKDRIYNDFGQFDY

SEQ ID NO: 85089 - protein, 9 aa, Homo sapiens
  light chain complementarity determining region 3 for antibody 42545
QQSSNTPPT

SEQ ID NO: 85090 - protein, 22 aa, Homo sapiens
  heavy chain complementarity determining region 3 for antibody 42545
ARFGRMYYDILTGYSESDAFDI

SEQ ID NO: 85091 - protein, 9 aa, Homo sapiens
  light chain complementarity determining region 3 for antibody 42546
QQSNSVPPT

SEQ ID NO: 85092 - protein, 15 aa, Homo sapiens
  heavy chain complementarity determining region 3 for antibody 42546
AKLKLNWAFNDAFDI

SEQ ID NO: 85093 - protein, 10 aa, Homo sapiens
  light chain complementarity determining region 3 for antibody 42547
QQSNSTPPFT

SEQ ID NO: 85094 - protein, 14 aa, Homo sapiens
  heavy chain complementarity determining region 3 for antibody 42547
ARGGSSDYDHHFDY

SEQ ID NO: 85095 - protein, 10 aa, Homo sapiens
  light chain complementarity determining region 3 for antibody 42548
QQSNSFRALT

SEQ ID NO: 85096 - protein, 18 aa, Homo sapiens
  heavy chain complementarity determining region 3 for antibody 42548
VTDVYDILTGTYRGNVDY

SEQ ID NO: 85097 - protein, 9 aa, Homo sapiens
  light chain complementarity determining region 3 for antibody 42549
QQSNSFPYT

SEQ ID NO: 85098 - protein, 14 aa, Homo sapiens
  heavy chain complementarity determining region 3 for antibody 42549
GGSEALTGKGEIDY

SEQ ID NO: 85099 - protein, 9 aa, Homo sapiens
  light chain complementarity determining region 3 for antibody 42550
QQSHSTPYT

SEQ ID NO: 85100 - protein, 24 aa, Homo sapiens
  heavy chain complementarity determining region 3 for antibody 42550
ARVPCPDDICPSCEGCFPAQALDV

SEQ ID NO: 85101 - protein, 9 aa, Homo sapiens
  light chain complementarity determining region 3 for antibody 42551
QQSFSTPRT

SEQ ID NO: 85102 - protein, 12 aa, Homo sapiens
  heavy chain complementarity determining region 3 for antibody 42551
ARGGYTTFPLDY

SEQ ID NO: 85103 - protein, 9 aa, Homo sapiens
  light chain complementarity determining region 3 for antibody 42552
QQSFSDPFT

SEQ ID NO: 85104 - protein, 17 aa, Homo sapiens
  heavy chain complementarity determining region 3 for antibody 42552
TTQNYDDSNSYYWYFDL

SEQ ID NO: 85105 - protein, 9 aa, Homo sapiens
  light chain complementarity determining region 3 for antibody 42553
QQSESYPLT

SEQ ID NO: 85106 - protein, 12 aa, Homo sapiens
  heavy chain complementarity determining region 3 for antibody 42553
VRVGSNDWRYDY

SEQ ID NO: 85107 - protein, 9 aa, Homo sapiens
  light chain complementarity determining region 3 for antibody 42554
QQSDTLPLT

SEQ ID NO: 85108 - protein, 22 aa, Homo sapiens
  heavy chain complementarity determining region 3 for antibody 42554
ARSKGALVGATYVSPRGNCFDS

SEQ ID NO: 85109 - protein, 9 aa, Homo sapiens
  light chain complementarity determining region 3 for antibody 42555
QQSDSYSRT

SEQ ID NO: 85110 - protein, 12 aa, Homo sapiens
  heavy chain complementarity determining region 3 for antibody 42555
AREALISDAFDV

SEQ ID NO: 85111 - protein, 9 aa, Homo sapiens
  light chain complementarity determining region 3 for antibody 42556
QQSDSTPYT

SEQ ID NO: 85112 - protein, 10 aa, Homo sapiens
  heavy chain complementarity determining region 3 for antibody 42556
ATEYSGGPDY

SEQ ID NO: 85113 - protein, 9 aa, Homo sapiens
  light chain complementarity determining region 3 for antibody 42557
QQRSSWPLT

SEQ ID NO: 85114 - protein, 10 aa, Homo sapiens
  heavy chain complementarity determining region 3 for antibody 42557
AKEGSDALHM

SEQ ID NO: 85115 - protein, 9 aa, Homo sapiens
  light chain complementarity determining region 3 for antibody 42558
QQRSSWPIT

SEQ ID NO: 85116 - protein, 15 aa, Homo sapiens
  heavy chain complementarity determining region 3 for antibody 42558
ARELPVTNVYHYYDY

SEQ ID NO: 85117 - protein, 8 aa, Homo sapiens
  light chain complementarity determining region 3 for antibody 42559
QQRSNWYT

SEQ ID NO: 85118 - protein, 18 aa, Homo sapiens
  heavy chain complementarity determining region 3 for antibody 42559
AKNHDLPSSSWLHDAFDV

SEQ ID NO: 85119 - protein, 9 aa, Homo sapiens
  light chain complementarity determining region 3 for antibody 42560
QQRSNWPST

SEQ ID NO: 85120 - protein, 10 aa, Homo sapiens
  heavy chain complementarity determining region 3 for antibody 42560
SRGGGPKSDH

SEQ ID NO: 85121 - protein, 9 aa, Homo sapiens
  light chain complementarity determining region 3 for antibody 42561
QQRSNWPST

SEQ ID NO: 85122 - protein, 14 aa, Homo sapiens
  heavy chain complementarity determining region 3 for antibody 42561
AREVEATGGRFLDY

SEQ ID NO: 85123 - protein, 10 aa, Homo sapiens
  light chain complementarity determining region 3 for antibody 42562
QQRSNWPRLT

SEQ ID NO: 85124 - protein, 16 aa, Homo sapiens
  heavy chain complementarity determining region 3 for antibody 42562
AKDLKGRWLERYYFDY

SEQ ID NO: 85125 - protein, 11 aa, Homo sapiens
  light chain complementarity determining region 3 for antibody 42563
QQRSNWPPRLT

SEQ ID NO: 85126 - protein, 11 aa, Homo sapiens
  heavy chain complementarity determining region 3 for antibody 42563
ARVFENWDSDY

SEQ ID NO: 85127 - protein, 10 aa, Homo sapiens
  light chain complementarity determining region 3 for antibody 42564
QQRSNWPPLT

SEQ ID NO: 85128 - protein, 13 aa, Homo sapiens
  heavy chain complementarity determining region 3 for antibody 42564
AKDARRVDNYFDY

SEQ ID NO: 85129 - protein, 10 aa, Homo sapiens
  light chain complementarity determining region 3 for antibody 42565
QQRSNWPPLT

SEQ ID NO: 85130 - protein, 21 aa, Homo sapiens
  heavy chain complementarity determining region 3 for antibody 42565
AHAGVGITMYGVIYYYYGMDV

SEQ ID NO: 85131 - protein, 10 aa, Homo sapiens
  light chain complementarity determining region 3 for antibody 42566
QQRSNWPPIT

SEQ ID NO: 85132 - protein, 11 aa, Homo sapiens
  heavy chain complementarity determining region 3 for antibody 42566
ATSPNITMGAN

SEQ ID NO: 85133 - protein, 9 aa, Homo sapiens
  light chain complementarity determining region 3 for antibody 42567
QQRSNWPLT

SEQ ID NO: 85134 - protein, 8 aa, Homo sapiens
  heavy chain complementarity determining region 3 for antibody 42567
ARAFGLDY

SEQ ID NO: 85135 - protein, 10 aa, Homo sapiens
  light chain complementarity determining region 3 for antibody 42568
QQRSNWPIFT

SEQ ID NO: 85136 - protein, 16 aa, Homo sapiens
  heavy chain complementarity determining region 3 for antibody 42568
AKRTYTSLGTLDWFDP

SEQ ID NO: 85137 - protein, 9 aa, Homo sapiens
  light chain complementarity determining region 3 for antibody 42569
QQRSNWPGT

SEQ ID NO: 85138 - protein, 17 aa, Homo sapiens
  heavy chain complementarity determining region 3 for antibody 42569
AKDIFFGIAVAGTAFDI

SEQ ID NO: 85139 - protein, 8 aa, Homo sapiens
  light chain complementarity determining region 3 for antibody 42570
QQRSFWYT

SEQ ID NO: 85140 - protein, 12 aa, Homo sapiens
  heavy chain complementarity determining region 3 for antibody 42570
VQDLGGGLVGPS

SEQ ID NO: 85141 - protein, 11 aa, Homo sapiens
  light chain complementarity determining region 3 for antibody 42571
QQRGNWPPIFT

SEQ ID NO: 85142 - protein, 16 aa, Homo sapiens
  heavy chain complementarity determining region 3 for antibody 42571
ARGRLTSTGTWNFPDY

SEQ ID NO: 85143 - protein, 8 aa, Homo sapiens
  light chain complementarity determining region 3 for antibody 42572
QQRGDWPT

SEQ ID NO: 85144 - protein, 17 aa, Homo sapiens
  heavy chain complementarity determining region 3 for antibody 42572
ARDVGPRRRLLHNAFDI

SEQ ID NO: 85145 - protein, 9 aa, Homo sapiens
  light chain complementarity determining region 3 for antibody 42573
QQNGKAPLT

SEQ ID NO: 85146 - protein, 15 aa, Homo sapiens
  heavy chain complementarity determining region 3 for antibody 42573
LRESSLHYDSGILDY

SEQ ID NO: 85147 - protein, 9 aa, Homo sapiens
  light chain complementarity determining region 3 for antibody 42574
QQLSSNQLT

SEQ ID NO: 85148 - protein, 18 aa, Homo sapiens
  heavy chain complementarity determining region 3 for antibody 42574
ARGKRAEHYFDWLLYFDN

SEQ ID NO: 85149 - protein, 9 aa, Homo sapiens
  light chain complementarity determining region 3 for antibody 42575
QQLNTYPLS

SEQ ID NO: 85150 - protein, 25 aa, Homo sapiens
  heavy chain complementarity determining region 3 for antibody 42575
AKVRPRSFHPNAGGDNRFYYYGMDV

SEQ ID NO: 85151 - protein, 9 aa, Homo sapiens
  light chain complementarity determining region 3 for antibody 42576
QQLNSYPYT

SEQ ID NO: 85152 - protein, 18 aa, Homo sapiens
  heavy chain complementarity determining region 3 for antibody 42576
ARFPSGNRRRGTIYALDV

SEQ ID NO: 85153 - protein, 9 aa, Homo sapiens
  light chain complementarity determining region 3 for antibody 42577
QQLNSYPWT

SEQ ID NO: 85154 - protein, 15 aa, Homo sapiens
  heavy chain complementarity determining region 3 for antibody 42577
ARDKDSGSGRDAFDI

SEQ ID NO: 85155 - protein, 9 aa, Homo sapiens
  light chain complementarity determining region 3 for antibody 42578
QQLNSYPRT

SEQ ID NO: 85156 - protein, 16 aa, Homo sapiens
  heavy chain complementarity determining region 3 for antibody 42578
ARDQHTMPVVVKPWDV

SEQ ID NO: 85157 - protein, 9 aa, Homo sapiens
  light chain complementarity determining region 3 for antibody 42579
QQLNSYPIT

SEQ ID NO: 85158 - protein, 21 aa, Homo sapiens
  heavy chain complementarity determining region 3 for antibody 42579
AKELVPYTSGWYGVEPRYCDY

SEQ ID NO: 85159 - protein, 9 aa, Homo sapiens
  light chain complementarity determining region 3 for antibody 42580
QQLNSYPIT

SEQ ID NO: 85160 - protein, 14 aa, Homo sapiens
  heavy chain complementarity determining region 3 for antibody 42580
AKDGDYGGNWGMDY

SEQ ID NO: 85161 - protein, 10 aa, Homo sapiens
  light chain complementarity determining region 3 for antibody 42581
QQLNSDPLFT

SEQ ID NO: 85162 - protein, 15 aa, Homo sapiens
  heavy chain complementarity determining region 3 for antibody 42581
AKSAGFLGVSGEIDY

SEQ ID NO: 85163 - protein, 9 aa, Homo sapiens
  light chain complementarity determining region 3 for antibody 42582
QQLESYPRT

SEQ ID NO: 85164 - protein, 17 aa, Homo sapiens
  heavy chain complementarity determining region 3 for antibody 42582
ARDGDSSGWSPLGWFDS

SEQ ID NO: 85165 - protein, 9 aa, Homo sapiens
  light chain complementarity determining region 3 for antibody 42583
QQLDTYPIT

SEQ ID NO: 85166 - protein, 12 aa, Homo sapiens
  heavy chain complementarity determining region 3 for antibody 42583
AGGRTVTTALDV

SEQ ID NO: 85167 - protein, 9 aa, Homo sapiens
  light chain complementarity determining region 3 for antibody 42584
QQIDRSPYT

SEQ ID NO: 85168 - protein, 17 aa, Homo sapiens
  heavy chain complementarity determining region 3 for antibody 42584
ARIYTGREDYVDEAFDI

SEQ ID NO: 85169 - protein, 9 aa, Homo sapiens
  light chain complementarity determining region 3 for antibody 42585
QQHDSLPIT

SEQ ID NO: 85170 - protein, 15 aa, Homo sapiens
  heavy chain complementarity determining region 3 for antibody 42585
ARDPSRLVVGGYFDH

SEQ ID NO: 85171 - protein, 9 aa, Homo sapiens
  light chain complementarity determining region 3 for antibody 42586
QQGYSTPLI

SEQ ID NO: 85172 - protein, 19 aa, Homo sapiens
  heavy chain complementarity determining region 3 for antibody 42586
ARHVMEPQGHWLVPHAMDV

SEQ ID NO: 85173 - protein, 9 aa, Homo sapiens
  light chain complementarity determining region 3 for antibody 42587
QQGYSTPLI

SEQ ID NO: 85174 - protein, 17 aa, Homo sapiens
  heavy chain complementarity determining region 3 for antibody 42587
AREGAYDDRSPGDLLDL

SEQ ID NO: 85175 - protein, 9 aa, Homo sapiens
  light chain complementarity determining region 3 for antibody 42588
QQGNSFPWT

SEQ ID NO: 85176 - protein, 14 aa, Homo sapiens
  heavy chain complementarity determining region 3 for antibody 42588
ARVAIERFPEEPGA

SEQ ID NO: 85177 - protein, 9 aa, Homo sapiens
  light chain complementarity determining region 3 for antibody 42589
QQFYSVPLT

SEQ ID NO: 85178 - protein, 13 aa, Homo sapiens
  heavy chain complementarity determining region 3 for antibody 42589
GRMDPGIAATPDH

SEQ ID NO: 85179 - protein, 9 aa, Homo sapiens
  light chain complementarity determining region 3 for antibody 42590
QQFNSYPLT

SEQ ID NO: 85180 - protein, 15 aa, Homo sapiens
  heavy chain complementarity determining region 3 for antibody 42590
AKDPWGYSSRRRFDS

SEQ ID NO: 85181 - protein, 9 aa, Homo sapiens
  light chain complementarity determining region 3 for antibody 42591
QQFGDPIYT

SEQ ID NO: 85182 - protein, 21 aa, Homo sapiens
  heavy chain complementarity determining region 3 for antibody 42591
ARDGGGGYDDNSDQYYSYFDY

SEQ ID NO: 85183 - protein, 9 aa, Homo sapiens
  light chain complementarity determining region 3 for antibody 42592
QQFDTSPLT

SEQ ID NO: 85184 - protein, 13 aa, Homo sapiens
  heavy chain complementarity determining region 3 for antibody 42592
ARFTSGWHDAFDI

SEQ ID NO: 85185 - protein, 9 aa, Homo sapiens
  light chain complementarity determining region 3 for antibody 42593
QQCVDSPWT

SEQ ID NO: 85186 - protein, 12 aa, Homo sapiens
  heavy chain complementarity determining region 3 for antibody 42593
AHRKGGEDWFDP

SEQ ID NO: 85187 - protein, 9 aa, Homo sapiens
  light chain complementarity determining region 3 for antibody 42594
QQCNSYPLT

SEQ ID NO: 85188 - protein, 17 aa, Homo sapiens
  heavy chain complementarity determining region 3 for antibody 42594
TRSSYDTSGYYLEPFDY

SEQ ID NO: 85189 - protein, 10 aa, Homo sapiens
  light chain complementarity determining region 3 for antibody 42595
QQCGTSPPWT

SEQ ID NO: 85190 - protein, 12 aa, Homo sapiens
  heavy chain complementarity determining region 3 for antibody 42595
ARGGSSGYQLDY

SEQ ID NO: 85191 - protein, 10 aa, Homo sapiens
  light chain complementarity determining region 3 for antibody 42596
QQCGSSPPIT

SEQ ID NO: 85192 - protein, 19 aa, Homo sapiens
  heavy chain complementarity determining region 3 for antibody 42596
ARDLFSDNSGDFLPDYFDY

SEQ ID NO: 85193 - protein, 9 aa, Homo sapiens
  light chain complementarity determining region 3 for antibody 42597
QQASSFPPT

SEQ ID NO: 85194 - protein, 20 aa, Homo sapiens
  heavy chain complementarity determining region 3 for antibody 42597
ARDPSDCTRTSCRGGSTFDY

SEQ ID NO: 85195 - protein, 10 aa, Homo sapiens
  light chain complementarity determining region 3 for antibody 42598
QQANTFPPWT

SEQ ID NO: 85196 - protein, 12 aa, Homo sapiens
  heavy chain complementarity determining region 3 for antibody 42598
ARNGDSSGYYNT

SEQ ID NO: 85197 - protein, 9 aa, Homo sapiens
  light chain complementarity determining region 3 for antibody 42599
QQANSFPYT

SEQ ID NO: 85198 - protein, 14 aa, Homo sapiens
  heavy chain complementarity determining region 3 for antibody 42599
ARALDRYGDYEIDS

SEQ ID NO: 85199 - protein, 8 aa, Homo sapiens
  light chain complementarity determining region 3 for antibody 42600
QQANSFPS

SEQ ID NO: 85200 - protein, 16 aa, Homo sapiens
  heavy chain complementarity determining region 3 for antibody 42600
TLDEGPYQGGGYYFPY

SEQ ID NO: 85201 - protein, 9 aa, Homo sapiens
  light chain complementarity determining region 3 for antibody 42601
QQANSFPRT

SEQ ID NO: 85202 - protein, 10 aa, Homo sapiens
  heavy chain complementarity determining region 3 for antibody 42601
ARDTFGSVDY

SEQ ID NO: 85203 - protein, 9 aa, Homo sapiens
  light chain complementarity determining region 3 for antibody 42602
QQANSFPFT

SEQ ID NO: 85204 - protein, 18 aa, Homo sapiens
  heavy chain complementarity determining region 3 for antibody 42602
ARDLEEIVVRGVGDGFEI

SEQ ID NO: 85205 - protein, 10 aa, Homo sapiens
  light chain complementarity determining region 3 for antibody 42603
QQANSFLSWT

SEQ ID NO: 85206 - protein, 12 aa, Homo sapiens
  heavy chain complementarity determining region 3 for antibody 42603
ARILRSIRAFDI

SEQ ID NO: 85207 - protein, 9 aa, Homo sapiens
  light chain complementarity determining region 3 for antibody 42604
QQAKSFPYT

SEQ ID NO: 85208 - protein, 14 aa, Homo sapiens
  heavy chain complementarity determining region 3 for antibody 42604
ARRLVGAPDNWFDP

SEQ ID NO: 85209 - protein, 9 aa, Homo sapiens
  light chain complementarity determining region 3 for antibody 42605
QQADSFPTS

SEQ ID NO: 85210 - protein, 18 aa, Homo sapiens
  heavy chain complementarity determining region 3 for antibody 42605
ARDSEYFGSGHYQWRFDP

SEQ ID NO: 85211 - protein, 9 aa, Homo sapiens
  light chain complementarity determining region 3 for antibody 42606
QQADSFPIT

SEQ ID NO: 85212 - protein, 17 aa, Homo sapiens
  heavy chain complementarity determining region 3 for antibody 42606
AVGPAPYNWTHGPFFDQ

SEQ ID NO: 85213 - protein, 9 aa, Homo sapiens
  light chain complementarity determining region 3 for antibody 42607
QQADSFFLT

SEQ ID NO: 85214 - protein, 16 aa, Homo sapiens
  heavy chain complementarity determining region 3 for antibody 42607
ARDLQAMAGTSRAFDI

SEQ ID NO: 85215 - protein, 8 aa, Homo sapiens
  light chain complementarity determining region 3 for antibody 42608
QNYDSVVT

SEQ ID NO: 85216 - protein, 12 aa, Homo sapiens
  heavy chain complementarity determining region 3 for antibody 42608
AKIVSGYGHFDS

SEQ ID NO: 85217 - protein, 8 aa, Homo sapiens
  light chain complementarity determining region 3 for antibody 42609
QNMTVPLT

SEQ ID NO: 85218 - protein, 15 aa, Homo sapiens
  heavy chain complementarity determining region 3 for antibody 42609
ASGSCTNGVCYNSDY

SEQ ID NO: 85219 - protein, 10 aa, Homo sapiens
  light chain complementarity determining region 3 for antibody 42610
QKYYIAPTWT

SEQ ID NO: 85220 - protein, 16 aa, Homo sapiens
  heavy chain complementarity determining region 3 for antibody 42610
ARGAEDYGAGHDAFDI

SEQ ID NO: 85221 - protein, 9 aa, Homo sapiens
  light chain complementarity determining region 3 for antibody 42611
QKYNSAPLT

SEQ ID NO: 85222 - protein, 16 aa, Homo sapiens
  heavy chain complementarity determining region 3 for antibody 42611
ARQAENKAGGQEAFDI

SEQ ID NO: 85223 - protein, 9 aa, Homo sapiens
  light chain complementarity determining region 3 for antibody 42612
QKYNSAPLT

SEQ ID NO: 85224 - protein, 18 aa, Homo sapiens
  heavy chain complementarity determining region 3 for antibody 42612
ARESLMGYGYSDYYAMDV

SEQ ID NO: 85225 - protein, 9 aa, Homo sapiens
  light chain complementarity determining region 3 for antibody 42613
QKYNNAPLT

SEQ ID NO: 85226 - protein, 12 aa, Homo sapiens
  heavy chain complementarity determining region 3 for antibody 42613
ANGAMATITFDY

SEQ ID NO: 85227 - protein, 9 aa, Homo sapiens
  light chain complementarity determining region 3 for antibody 42614
QKYDSVPLT

SEQ ID NO: 85228 - protein, 20 aa, Homo sapiens
  heavy chain complementarity determining region 3 for antibody 42614
ATVFRGLGNSAHFVGGAFDI

SEQ ID NO: 85229 - protein, 9 aa, Homo sapiens
  light chain complementarity determining region 3 for antibody 42615
QHYNNWPVT

SEQ ID NO: 85230 - protein, 15 aa, Homo sapiens
  heavy chain complementarity determining region 3 for antibody 42615
ASVATAGSWTWYFDL

SEQ ID NO: 85231 - protein, 10 aa, Homo sapiens
  light chain complementarity determining region 3 for antibody 42616
QHYKSYSGLT

SEQ ID NO: 85232 - protein, 15 aa, Homo sapiens
  heavy chain complementarity determining region 3 for antibody 42616
ARSLGRLTGDNWFDP

SEQ ID NO: 85233 - protein, 9 aa, Homo sapiens
  light chain complementarity determining region 3 for antibody 42617
QHYGGSRYT

SEQ ID NO: 85234 - protein, 14 aa, Homo sapiens
  heavy chain complementarity determining region 3 for antibody 42617
ARHTSVGVDRPLHY

SEQ ID NO: 85235 - protein, 10 aa, Homo sapiens
  light chain complementarity determining region 3 for antibody 42618
QHYGGSPLFS

SEQ ID NO: 85236 - protein, 15 aa, Homo sapiens
  heavy chain complementarity determining region 3 for antibody 42618
GRRRLWPGVGDAFDL

SEQ ID NO: 85237 - protein, 9 aa, Homo sapiens
  light chain complementarity determining region 3 for antibody 42619
QHYGDSLFT

SEQ ID NO: 85238 - protein, 12 aa, Homo sapiens
  heavy chain complementarity determining region 3 for antibody 42619
ATFNYGKNWFDH

SEQ ID NO: 85239 - protein, 9 aa, Homo sapiens
  light chain complementarity determining region 3 for antibody 42620
QHRRSWPLT

SEQ ID NO: 85240 - protein, 14 aa, Homo sapiens
  heavy chain complementarity determining region 3 for antibody 42620
AKDMGSFSWHALHY

SEQ ID NO: 85241 - protein, 9 aa, Homo sapiens
  light chain complementarity determining region 3 for antibody 42621
QHLDTYPWT

SEQ ID NO: 85242 - protein, 11 aa, Homo sapiens
  heavy chain complementarity determining region 3 for antibody 42621
ARSVNYNGMDV

SEQ ID NO: 85243 - protein, 9 aa, Homo sapiens
  light chain complementarity determining region 3 for antibody 42622
QHLDGYPLT

SEQ ID NO: 85244 - protein, 17 aa, Homo sapiens
  heavy chain complementarity determining region 3 for antibody 42622
ARDSRGFQYGQWEYFQL

SEQ ID NO: 85245 - protein, 9 aa, Homo sapiens
  light chain complementarity determining region 3 for antibody 42623
QHHATYPLT

SEQ ID NO: 85246 - protein, 14 aa, Homo sapiens
  heavy chain complementarity determining region 3 for antibody 42623
GRGHDGPNDGYVGL

SEQ ID NO: 85247 - protein, 9 aa, Homo sapiens
  light chain complementarity determining region 3 for antibody 42624
QEYKSSSHS

SEQ ID NO: 85248 - protein, 17 aa, Homo sapiens
  heavy chain complementarity determining region 3 for antibody 42624
ARMAYYDSSGFYGYFDL

SEQ ID NO: 85249 - protein, 9 aa, Homo sapiens
  light chain complementarity determining region 3 for antibody 42625
QESFSPTRT

SEQ ID NO: 85250 - protein, 17 aa, Homo sapiens
  heavy chain complementarity determining region 3 for antibody 42625
ARDLAVAAKGARGAFDI

SEQ ID NO: 85251 - protein, 9 aa, Homo sapiens
  light chain complementarity determining region 3 for antibody 42626
MQVAHWPGT

SEQ ID NO: 85252 - protein, 14 aa, Homo sapiens
  heavy chain complementarity determining region 3 for antibody 42626
ARGGTSGQYHQFDY

SEQ ID NO: 85253 - protein, 9 aa, Homo sapiens
  light chain complementarity determining region 3 for antibody 42627
MQTTHWPHT

SEQ ID NO: 85254 - protein, 20 aa, Homo sapiens
  heavy chain complementarity determining region 3 for antibody 42627
ARDPGYKFGYRAGAPVKIDY

SEQ ID NO: 85255 - protein, 9 aa, Homo sapiens
  light chain complementarity determining region 3 for antibody 42628
MQPLQTPIT

SEQ ID NO: 85256 - protein, 12 aa, Homo sapiens
  heavy chain complementarity determining region 3 for antibody 42628
ARRTANSASLDF

SEQ ID NO: 85257 - protein, 9 aa, Homo sapiens
  light chain complementarity determining region 3 for antibody 42629
MQNTHWPPT

SEQ ID NO: 85258 - protein, 18 aa, Homo sapiens
  heavy chain complementarity determining region 3 for antibody 42629
ARTFFYASGNDFNDPFDI

SEQ ID NO: 85259 - protein, 9 aa, Homo sapiens
  light chain complementarity determining region 3 for antibody 42630
MQGTHWPWT

SEQ ID NO: 85260 - protein, 6 aa, Homo sapiens
  heavy chain complementarity determining region 3 for antibody 42630
VRTSSY

SEQ ID NO: 85261 - protein, 9 aa, Homo sapiens
  light chain complementarity determining region 3 for antibody 42631
MQGTHWPWT

SEQ ID NO: 85262 - protein, 10 aa, Homo sapiens
  heavy chain complementarity determining region 3 for antibody 42631
AKLIQHSSDQ

SEQ ID NO: 85263 - protein, 10 aa, Homo sapiens
  light chain complementarity determining region 3 for antibody 42632
MQGTHWPPYT

SEQ ID NO: 85264 - protein, 15 aa, Homo sapiens
  heavy chain complementarity determining region 3 for antibody 42632
ARTEYIWGSDGAFDI

SEQ ID NO: 85265 - protein, 8 aa, Homo sapiens
  light chain complementarity determining region 3 for antibody 42633
MQGTHRYT

SEQ ID NO: 85266 - protein, 15 aa, Homo sapiens
  heavy chain complementarity determining region 3 for antibody 42633
SRCGTTTCPQSAMDV

SEQ ID NO: 85267 - protein, 9 aa, Homo sapiens
  light chain complementarity determining region 3 for antibody 42634
MQGLQTPWT

SEQ ID NO: 85268 - protein, 11 aa, Homo sapiens
  heavy chain complementarity determining region 3 for antibody 42634
ARGASHSRLDY

SEQ ID NO: 85269 - protein, 9 aa, Homo sapiens
  light chain complementarity determining region 3 for antibody 42635
MQATHWPWT

SEQ ID NO: 85270 - protein, 15 aa, Homo sapiens
  heavy chain complementarity determining region 3 for antibody 42635
AITSSTSWKGRAFDI

SEQ ID NO: 85271 - protein, 9 aa, Homo sapiens
  light chain complementarity determining region 3 for antibody 42636
MQATHWPTT

SEQ ID NO: 85272 - protein, 10 aa, Homo sapiens
  heavy chain complementarity determining region 3 for antibody 42636
ATIGEGSFGK

SEQ ID NO: 85273 - protein, 10 aa, Homo sapiens
  light chain complementarity determining region 3 for antibody 42637
MQATHWPPFT

SEQ ID NO: 85274 - protein, 8 aa, Homo sapiens
  heavy chain complementarity determining region 3 for antibody 42637
ARYLSVGN

SEQ ID NO: 85275 - protein, 9 aa, Homo sapiens
  light chain complementarity determining region 3 for antibody 42638
MHGIFWPWT

SEQ ID NO: 85276 - protein, 10 aa, Homo sapiens
  heavy chain complementarity determining region 3 for antibody 42638
ARDSLGSIDY

SEQ ID NO: 85277 - protein, 9 aa, Homo sapiens
  light chain complementarity determining region 3 for antibody 42639
LQYNIYPYT

SEQ ID NO: 85278 - protein, 12 aa, Homo sapiens
  heavy chain complementarity determining region 3 for antibody 42639
ARGGSADWYFDL

SEQ ID NO: 85279 - protein, 9 aa, Homo sapiens
  light chain complementarity determining region 3 for antibody 42640
LQYDSYPWT

SEQ ID NO: 85280 - protein, 13 aa, Homo sapiens
  heavy chain complementarity determining region 3 for antibody 42640
GRHSSGTIKGVDV

SEQ ID NO: 85281 - protein, 9 aa, Homo sapiens
  light chain complementarity determining region 3 for antibody 42641
LQNDNYSFS

SEQ ID NO: 85282 - protein, 22 aa, Homo sapiens
  heavy chain complementarity determining region 3 for antibody 42641
AHSAVHWFGSRAYYPSPYYFDF

SEQ ID NO: 85283 - protein, 9 aa, Homo sapiens
  light chain complementarity determining region 3 for antibody 42642
LQHYTYPRT

SEQ ID NO: 85284 - protein, 17 aa, Homo sapiens
  heavy chain complementarity determining region 3 for antibody 42642
AKSFYPHYIYSADPFDS

SEQ ID NO: 85285 - protein, 9 aa, Homo sapiens
  light chain complementarity determining region 3 for antibody 42643
LQHSIDPWT

SEQ ID NO: 85286 - protein, 7 aa, Homo sapiens
  heavy chain complementarity determining region 3 for antibody 42643
ARGGSDY

SEQ ID NO: 85287 - protein, 9 aa, Homo sapiens
  light chain complementarity determining region 3 for antibody 42644
LQHNSYPWT

SEQ ID NO: 85288 - protein, 14 aa, Homo sapiens
  heavy chain complementarity determining region 3 for antibody 42644
VKDPGWLVVDAFDF

SEQ ID NO: 85289 - protein, 9 aa, Homo sapiens
  light chain complementarity determining region 3 for antibody 42645
LQHNRYPWT

SEQ ID NO: 85290 - protein, 19 aa, Homo sapiens
  heavy chain complementarity determining region 3 for antibody 42645
ARHVGCLGTPAPGDCGMDV

SEQ ID NO: 85291 - protein, 9 aa, Homo sapiens
  light chain complementarity determining region 3 for antibody 42646
LQHKSYPRT

SEQ ID NO: 85292 - protein, 8 aa, Homo sapiens
  heavy chain complementarity determining region 3 for antibody 42646
VRDNWCDY

SEQ ID NO: 85293 - protein, 9 aa, Homo sapiens
  light chain complementarity determining region 3 for antibody 42647
LQHDSYPWT

SEQ ID NO: 85294 - protein, 11 aa, Homo sapiens
  heavy chain complementarity determining region 3 for antibody 42647
ARNYGYSSPDN

SEQ ID NO: 85295 - protein, 9 aa, Homo sapiens
  light chain complementarity determining region 3 for antibody 42648
LQDYNYPLT

SEQ ID NO: 85296 - protein, 18 aa, Homo sapiens
  heavy chain complementarity determining region 3 for antibody 42648
ARRWYFYGSGTPAWYFDY

SEQ ID NO: 85297 - protein, 9 aa, Homo sapiens
  light chain complementarity determining region 3 for antibody 42649
LQDYDHAYT

SEQ ID NO: 85298 - protein, 15 aa, Homo sapiens
  heavy chain complementarity determining region 3 for antibody 42649
ARDSQYRANWVGLDP

SEQ ID NO: 85299 - protein, 9 aa, Homo sapiens
  light chain complementarity determining region 3 for antibody 42650
LHYGSYSNT

SEQ ID NO: 85300 - protein, 11 aa, Homo sapiens
  heavy chain complementarity determining region 3 for antibody 42650
AKDSPSGTFDY

SEQ ID NO: 85301 - protein, 10 aa, Homo sapiens
  light chain complementarity determining region 3 for antibody 42651
HQYSRSPPWT

SEQ ID NO: 85302 - protein, 11 aa, Homo sapiens
  heavy chain complementarity determining region 3 for antibody 42651
VKDRGAIMGDF

SEQ ID NO: 85303 - protein, 10 aa, Homo sapiens
  light chain complementarity determining region 3 for antibody 42652
HQYNDWPPAT

SEQ ID NO: 85304 - protein, 14 aa, Homo sapiens
  heavy chain complementarity determining region 3 for antibody 42652
ARGSQHQLYGFFDL

SEQ ID NO: 85305 - protein, 9 aa, Homo sapiens
  light chain complementarity determining region 3 for antibody 42653
HQYGTSPRT

SEQ ID NO: 85306 - protein, 13 aa, Homo sapiens
  heavy chain complementarity determining region 3 for antibody 42653
ATESGSYYGGLDY

SEQ ID NO: 85307 - protein, 9 aa, Homo sapiens
  light chain complementarity determining region 3 for antibody 42654
HQYGSSPYT

SEQ ID NO: 85308 - protein, 9 aa, Homo sapiens
  heavy chain complementarity determining region 3 for antibody 42654
AREVEGFDI

SEQ ID NO: 85309 - protein, 9 aa, Homo sapiens
  light chain complementarity determining region 3 for antibody 42655
HQYGSSPRT

SEQ ID NO: 85310 - protein, 13 aa, Homo sapiens
  heavy chain complementarity determining region 3 for antibody 42655
VRSPGGGTNHIDY

SEQ ID NO: 85311 - protein, 9 aa, Homo sapiens
  light chain complementarity determining region 3 for antibody 42656
HQYGPAPQT

SEQ ID NO: 85312 - protein, 15 aa, Homo sapiens
  heavy chain complementarity determining region 3 for antibody 42656
ARGRNYFDSSGSEYF

SEQ ID NO: 85313 - protein, 9 aa, Homo sapiens
  light chain complementarity determining region 3 for antibody 42657
HQSTSSPWT

SEQ ID NO: 85314 - protein, 14 aa, Homo sapiens
  heavy chain complementarity determining region 3 for antibody 42657
ARVRGMAATGHFDY

SEQ ID NO: 85315 - protein, 9 aa, Homo sapiens
  light chain complementarity determining region 3 for antibody 42658
HQSSTLPRT

SEQ ID NO: 85316 - protein, 14 aa, Homo sapiens
  heavy chain complementarity determining region 3 for antibody 42658
ARDLRETMAGEFAF

SEQ ID NO: 85317 - protein, 9 aa, Homo sapiens
  light chain complementarity determining region 3 for antibody 42659
HQSSSFPLT

SEQ ID NO: 85318 - protein, 12 aa, Homo sapiens
  heavy chain complementarity determining region 3 for antibody 42659
AKDAAVATYFDY

SEQ ID NO: 85319 - protein, 9 aa, Homo sapiens
  light chain complementarity determining region 3 for antibody 42660
HQSNTPPWT

SEQ ID NO: 85320 - protein, 18 aa, Homo sapiens
  heavy chain complementarity determining region 3 for antibody 42660
VKVAHCVGDCKWGGTLDH

SEQ ID NO: 85321 - protein, 9 aa, Homo sapiens
  light chain complementarity determining region 3 for antibody 42661
EQYGTPPLT

SEQ ID NO: 85322 - protein, 13 aa, Homo sapiens
  heavy chain complementarity determining region 3 for antibody 42661
ASHSRGWYRVFDW

SEQ ID NO: 85323 - protein, 9 aa, Homo sapiens
  light chain complementarity determining region 3 for antibody 42662
QRYNSYSGT

SEQ ID NO: 85324 - protein, 14 aa, Homo sapiens
  heavy chain complementarity determining region 3 for antibody 42662
AKEYLPIPKRAFDI

SEQ ID NO: 85325 - protein, 10 aa, Homo sapiens
  light chain complementarity determining region 3 for antibody 42663
QRYGNSPPYT

SEQ ID NO: 85326 - protein, 17 aa, Homo sapiens
  heavy chain complementarity determining region 3 for antibody 42663
ASQLMIHGPATTWAFDI

SEQ ID NO: 85327 - protein, 9 aa, Homo sapiens
  light chain complementarity determining region 3 for antibody 42664
QRVDSLPFS

SEQ ID NO: 85328 - protein, 15 aa, Homo sapiens
  heavy chain complementarity determining region 3 for antibody 42664
AREAFTSSGRYRADY

SEQ ID NO: 85329 - protein, 8 aa, Homo sapiens
  light chain complementarity determining region 3 for antibody 42665
QQYYTFWT

SEQ ID NO: 85330 - protein, 11 aa, Homo sapiens
  heavy chain complementarity determining region 3 for antibody 42665
ARGVGSYPFDS

SEQ ID NO: 85331 - protein, 9 aa, Homo sapiens
  light chain complementarity determining region 3 for antibody 42666
QQYYSYPLT

SEQ ID NO: 85332 - protein, 19 aa, Homo sapiens
  heavy chain complementarity determining region 3 for antibody 42666
ATEKNFYASGTSRGDAFDI

SEQ ID NO: 85333 - protein, 9 aa, Homo sapiens
  light chain complementarity determining region 3 for antibody 42667
QQYYNTPYT

SEQ ID NO: 85334 - protein, 14 aa, Homo sapiens
  heavy chain complementarity determining region 3 for antibody 42667
ARGGTLGTADKFDV

SEQ ID NO: 85335 - protein, 9 aa, Homo sapiens
  light chain complementarity determining region 3 for antibody 42668
QQYYNFPLT

SEQ ID NO: 85336 - protein, 16 aa, Homo sapiens
  heavy chain complementarity determining region 3 for antibody 42668
AREDSGSVFSSSGMDV

SEQ ID NO: 85337 - protein, 9 aa, Homo sapiens
  light chain complementarity determining region 3 for antibody 42669
QQYTSPPWT

SEQ ID NO: 85338 - protein, 14 aa, Homo sapiens
  heavy chain complementarity determining region 3 for antibody 42669
ARSPRTTMPPPWDY

SEQ ID NO: 85339 - protein, 8 aa, Homo sapiens
  light chain complementarity determining region 3 for antibody 42670
QQYTNSLT

SEQ ID NO: 85340 - protein, 9 aa, Homo sapiens
  heavy chain complementarity determining region 3 for antibody 42670
TTGGHYYGS

SEQ ID NO: 85341 - protein, 8 aa, Homo sapiens
  light chain complementarity determining region 3 for antibody 42671
QQYSTLPT

SEQ ID NO: 85342 - protein, 15 aa, Homo sapiens
  heavy chain complementarity determining region 3 for antibody 42671
AGGPPFDSGGYYFDH

SEQ ID NO: 85343 - protein, 9 aa, Homo sapiens
  light chain complementarity determining region 3 for antibody 42672
QQYSSYPLT

SEQ ID NO: 85344 - protein, 11 aa, Homo sapiens
  heavy chain complementarity determining region 3 for antibody 42672
SLGGGIAVSHV

SEQ ID NO: 85345 - protein, 8 aa, Homo sapiens
  light chain complementarity determining region 3 for antibody 42673
QQYSRSRT

SEQ ID NO: 85346 - protein, 19 aa, Homo sapiens
  heavy chain complementarity determining region 3 for antibody 42673
ARDGVTCSGGSCIETAVDS

SEQ ID NO: 85347 - protein, 10 aa, Homo sapiens
  light chain complementarity determining region 3 for antibody 42674
QQYSPSPPWT

SEQ ID NO: 85348 - protein, 16 aa, Homo sapiens
  heavy chain complementarity determining region 3 for antibody 42674
ARRQWVRGLFRGGLDS

SEQ ID NO: 85349 - protein, 8 aa, Homo sapiens
  light chain complementarity determining region 3 for antibody 42675
QQYSNSSA

SEQ ID NO: 85350 - protein, 16 aa, Homo sapiens
  heavy chain complementarity determining region 3 for antibody 42675
ASERGGYSDYDPTFDY

SEQ ID NO: 85351 - protein, 11 aa, Homo sapiens
  light chain complementarity determining region 3 for antibody 42676
QQYSKWPPMYT

SEQ ID NO: 85352 - protein, 12 aa, Homo sapiens
  heavy chain complementarity determining region 3 for antibody 42676
VKDGDTDYYLDL

SEQ ID NO: 85353 - protein, 9 aa, Homo sapiens
  light chain complementarity determining region 3 for antibody 42677
QQYSKSPIT

SEQ ID NO: 85354 - protein, 12 aa, Homo sapiens
  heavy chain complementarity determining region 3 for antibody 42677
ATGGWFGQSFEF

SEQ ID NO: 85355 - protein, 9 aa, Homo sapiens
  light chain complementarity determining region 3 for antibody 42678
QQYSGYSGT

SEQ ID NO: 85356 - protein, 14 aa, Homo sapiens
  heavy chain complementarity determining region 3 for antibody 42678
ARRGAPTTRGHFDY

SEQ ID NO: 85357 - protein, 9 aa, Homo sapiens
  light chain complementarity determining region 3 for antibody 42679
QQYNTYSYT

SEQ ID NO: 85358 - protein, 17 aa, Homo sapiens
  heavy chain complementarity determining region 3 for antibody 42679
ATDPTQILSRVPYYFDN

SEQ ID NO: 85359 - protein, 9 aa, Homo sapiens
  light chain complementarity determining region 3 for antibody 42680
QQYNTYSLT

SEQ ID NO: 85360 - protein, 12 aa, Homo sapiens
  heavy chain complementarity determining region 3 for antibody 42680
AKQWLVLSCVVY

SEQ ID NO: 85361 - protein, 8 aa, Homo sapiens
  light chain complementarity determining region 3 for antibody 42681
QQYNTYSG

SEQ ID NO: 85362 - protein, 15 aa, Homo sapiens
  heavy chain complementarity determining region 3 for antibody 42681
ARVTGSYGPYDAFDI

SEQ ID NO: 85363 - protein, 7 aa, Homo sapiens
  light chain complementarity determining region 3 for antibody 42682
QQYNSYT

SEQ ID NO: 85364 - protein, 19 aa, Homo sapiens
  heavy chain complementarity determining region 3 for antibody 42682
ARVVYDSRDTKSVEDAFDI

SEQ ID NO: 85365 - protein, 9 aa, Homo sapiens
  light chain complementarity determining region 3 for antibody 42683
QQYNSYSRT

SEQ ID NO: 85366 - protein, 15 aa, Homo sapiens
  heavy chain complementarity determining region 3 for antibody 42683
ATTKENSFDSSGYYY

SEQ ID NO: 85367 - protein, 9 aa, Homo sapiens
  light chain complementarity determining region 3 for antibody 42684
QQYNSYSRT

SEQ ID NO: 85368 - protein, 15 aa, Homo sapiens
  heavy chain complementarity determining region 3 for antibody 42684
ARGRGVAAAGTDMGY

SEQ ID NO: 85369 - protein, 9 aa, Homo sapiens
  light chain complementarity determining region 3 for antibody 42685
QQYNSYSPT

SEQ ID NO: 85370 - protein, 17 aa, Homo sapiens
  heavy chain complementarity determining region 3 for antibody 42685
ARLGISEKFTWGSYFDY

SEQ ID NO: 85371 - protein, 9 aa, Homo sapiens
  light chain complementarity determining region 3 for antibody 42686
QQYNSYPYT

SEQ ID NO: 85372 - protein, 21 aa, Homo sapiens
  heavy chain complementarity determining region 3 for antibody 42686
AKDNPRRSMVEAGYHFYGMDV

SEQ ID NO: 85373 - protein, 9 aa, Homo sapiens
  light chain complementarity determining region 3 for antibody 42687
QQYNSYPWT

SEQ ID NO: 85374 - protein, 13 aa, Homo sapiens
  heavy chain complementarity determining region 3 for antibody 42687
ATSSGDFYKDFDY

SEQ ID NO: 85375 - protein, 9 aa, Homo sapiens
  light chain complementarity determining region 3 for antibody 42688
QQYNSYPWT

SEQ ID NO: 85376 - protein, 19 aa, Homo sapiens
  heavy chain complementarity determining region 3 for antibody 42688
ARGPSVPTRNLYYYHGMDV

SEQ ID NO: 85377 - protein, 9 aa, Homo sapiens
  light chain complementarity determining region 3 for antibody 42689
QQYNSYPVT

SEQ ID NO: 85378 - protein, 12 aa, Homo sapiens
  heavy chain complementarity determining region 3 for antibody 42689
ARDRGRGLGIDY

SEQ ID NO: 85379 - protein, 8 aa, Homo sapiens
  light chain complementarity determining region 3 for antibody 42690
QQYNSYPT

SEQ ID NO: 85380 - protein, 21 aa, Homo sapiens
  heavy chain complementarity determining region 3 for antibody 42690
TRDGALSDLLTGYYIPNYFDY

SEQ ID NO: 85381 - protein, 9 aa, Homo sapiens
  light chain complementarity determining region 3 for antibody 42691
QQYNSYPRT

SEQ ID NO: 85382 - protein, 12 aa, Homo sapiens
  heavy chain complementarity determining region 3 for antibody 42691
ARDLLATGTFDS

SEQ ID NO: 85383 - protein, 9 aa, Homo sapiens
  light chain complementarity determining region 3 for antibody 42692
QQYNSYLLS

SEQ ID NO: 85384 - protein, 21 aa, Homo sapiens
  heavy chain complementarity determining region 3 for antibody 42692
ARGGVVTGMPTDRDPEYYFDY

SEQ ID NO: 85385 - protein, 9 aa, Homo sapiens
  light chain complementarity determining region 3 for antibody 42693
QQYNSYAYS

SEQ ID NO: 85386 - protein, 12 aa, Homo sapiens
  heavy chain complementarity determining region 3 for antibody 42693
AARYSGFDPFDY

SEQ ID NO: 85387 - protein, 8 aa, Homo sapiens
  light chain complementarity determining region 3 for antibody 42694
QQYNSYAT

SEQ ID NO: 85388 - protein, 13 aa, Homo sapiens
  heavy chain complementarity determining region 3 for antibody 42694
TTNFADSLDAFDL

SEQ ID NO: 85389 - protein, 8 aa, Homo sapiens
  light chain complementarity determining region 3 for antibody 42695
QQYNSPGT

SEQ ID NO: 85390 - protein, 21 aa, Homo sapiens
  heavy chain complementarity determining region 3 for antibody 42695
ARVGLSYYDTNRPWGGRAFDI

SEQ ID NO: 85391 - protein, 8 aa, Homo sapiens
  light chain complementarity determining region 3 for antibody 42696
QQYNSLWT

SEQ ID NO: 85392 - protein, 18 aa, Homo sapiens
  heavy chain complementarity determining region 3 for antibody 42696
TLTTRYSSGWYLGRVVDY

SEQ ID NO: 85393 - protein, 8 aa, Homo sapiens
  light chain complementarity determining region 3 for antibody 42697
QQYNRYST

SEQ ID NO: 85394 - protein, 12 aa, Homo sapiens
  heavy chain complementarity determining region 3 for antibody 42697
AGTRGGTSIYSS

SEQ ID NO: 85395 - protein, 9 aa, Homo sapiens
  light chain complementarity determining region 3 for antibody 42698
QQYNNYPYT

SEQ ID NO: 85396 - protein, 15 aa, Homo sapiens
  heavy chain complementarity determining region 3 for antibody 42698
ARVGYSSGWDPALQH

SEQ ID NO: 85397 - protein, 9 aa, Homo sapiens
  light chain complementarity determining region 3 for antibody 42699
QQYNNYLYT

SEQ ID NO: 85398 - protein, 14 aa, Homo sapiens
  heavy chain complementarity determining region 3 for antibody 42699
AKNQVGPTISWFDP

SEQ ID NO: 85399 - protein, 9 aa, Homo sapiens
  light chain complementarity determining region 3 for antibody 42700
QQYNNWPYS

SEQ ID NO: 85400 - protein, 18 aa, Homo sapiens
  heavy chain complementarity determining region 3 for antibody 42700
ARVGVRYLFDSTNRAYDI

SEQ ID NO: 85401 - protein, 11 aa, Homo sapiens
  light chain complementarity determining region 3 for antibody 42701
QQYNNWPPMYT

SEQ ID NO: 85402 - protein, 13 aa, Homo sapiens
  heavy chain complementarity determining region 3 for antibody 42701
ARDPPGPDGAFNL

SEQ ID NO: 85403 - protein, 8 aa, Homo sapiens
  light chain complementarity determining region 3 for antibody 42702
QQYNNQWT

SEQ ID NO: 85404 - protein, 12 aa, Homo sapiens
  heavy chain complementarity determining region 3 for antibody 42702
VRDDGSGSYPDA

SEQ ID NO: 85405 - protein, 10 aa, Homo sapiens
  light chain complementarity determining region 3 for antibody 42703
QQYNDWPAFT

SEQ ID NO: 85406 - protein, 12 aa, Homo sapiens
  heavy chain complementarity determining region 3 for antibody 42703
ANLEAVLGWFES

SEQ ID NO: 85407 - protein, 8 aa, Homo sapiens
  light chain complementarity determining region 3 for antibody 42704
QQYKVSLT

SEQ ID NO: 85408 - protein, 17 aa, Homo sapiens
  heavy chain complementarity determining region 3 for antibody 42704
AREDCTDYSCYPFWFDP

SEQ ID NO: 85409 - protein, 11 aa, Homo sapiens
  light chain complementarity determining region 3 for antibody 42705
QQYKTYSLGLT

SEQ ID NO: 85410 - protein, 21 aa, Homo sapiens
  heavy chain complementarity determining region 3 for antibody 42705
ARDAPVSRPYSSGWYSSAFDY

SEQ ID NO: 85411 - protein, 9 aa, Homo sapiens
  light chain complementarity determining region 3 for antibody 42706
QQYKTYPIT

SEQ ID NO: 85412 - protein, 15 aa, Homo sapiens
  heavy chain complementarity determining region 3 for antibody 42706
RTTLLVVITEDYFDY

SEQ ID NO: 85413 - protein, 9 aa, Homo sapiens
  light chain complementarity determining region 3 for antibody 42707
QQYKSYSRT

SEQ ID NO: 85414 - protein, 17 aa, Homo sapiens
  heavy chain complementarity determining region 3 for antibody 42707
AHDQYDFWSDPPPTFDY

SEQ ID NO: 85415 - protein, 9 aa, Homo sapiens
  light chain complementarity determining region 3 for antibody 42708
QQYKSYPYT

SEQ ID NO: 85416 - protein, 14 aa, Homo sapiens
  heavy chain complementarity determining region 3 for antibody 42708
AKEKYWSGYSDLDY

SEQ ID NO: 85417 - protein, 9 aa, Homo sapiens
  light chain complementarity determining region 3 for antibody 42709
QQYKSYPFT

SEQ ID NO: 85418 - protein, 11 aa, Homo sapiens
  heavy chain complementarity determining region 3 for antibody 42709
ARGSHGHGMDV

SEQ ID NO: 85419 - protein, 9 aa, Homo sapiens
  light chain complementarity determining region 3 for antibody 42710
QQYKDPSWT

SEQ ID NO: 85420 - protein, 12 aa, Homo sapiens
  heavy chain complementarity determining region 3 for antibody 42710
AMYFEGMGGVGS

SEQ ID NO: 85421 - protein, 9 aa, Homo sapiens
  light chain complementarity determining region 3 for antibody 42711
QQYHSYSYT

SEQ ID NO: 85422 - protein, 12 aa, Homo sapiens
  heavy chain complementarity determining region 3 for antibody 42711
AKDDFERPHGTY

SEQ ID NO: 85423 - protein, 9 aa, Homo sapiens
  light chain complementarity determining region 3 for antibody 42712
QQYHNYPRT

SEQ ID NO: 85424 - protein, 9 aa, Homo sapiens
  heavy chain complementarity determining region 3 for antibody 42712
STGMATLLY

SEQ ID NO: 85425 - protein, 10 aa, Homo sapiens
  light chain complementarity determining region 3 for antibody 42713
QQYHNLLSLT

SEQ ID NO: 85426 - protein, 21 aa, Homo sapiens
  heavy chain complementarity determining region 3 for antibody 42713
ARDPARYCSGGSCYRAGYFDL

SEQ ID NO: 85427 - protein, 9 aa, Homo sapiens
  light chain complementarity determining region 3 for antibody 42714
QQYHDSPIT

SEQ ID NO: 85428 - protein, 16 aa, Homo sapiens
  heavy chain complementarity determining region 3 for antibody 42714
ARGLPLVRGVISPMDV

SEQ ID NO: 85429 - protein, 9 aa, Homo sapiens
  light chain complementarity determining region 3 for antibody 42715
QQYGTSPAT

SEQ ID NO: 85430 - protein, 23 aa, Homo sapiens
  heavy chain complementarity determining region 3 for antibody 42715
ARGGLVVVPPSTGYLYTYSPLDI

SEQ ID NO: 85431 - protein, 9 aa, Homo sapiens
  light chain complementarity determining region 3 for antibody 42716
QQYGSTEFT

SEQ ID NO: 85432 - protein, 16 aa, Homo sapiens
  heavy chain complementarity determining region 3 for antibody 42716
ARTPGIEAAEGWYFDL

SEQ ID NO: 85433 - protein, 9 aa, Homo sapiens
  light chain complementarity determining region 3 for antibody 42717
QQYGSSRWT

SEQ ID NO: 85434 - protein, 18 aa, Homo sapiens
  heavy chain complementarity determining region 3 for antibody 42717
ARGPDHGSSDTVNYFFDL

SEQ ID NO: 85435 - protein, 8 aa, Homo sapiens
  light chain complementarity determining region 3 for antibody 42718
QQYGSSPT

SEQ ID NO: 85436 - protein, 14 aa, Homo sapiens
  heavy chain complementarity determining region 3 for antibody 42718
ARESPVAGSDGFHF

SEQ ID NO: 85437 - protein, 10 aa, Homo sapiens
  light chain complementarity determining region 3 for antibody 42719
QQYGSSPRYT

SEQ ID NO: 85438 - protein, 10 aa, Homo sapiens
  heavy chain complementarity determining region 3 for antibody 42719
ARRAMGEFDS

SEQ ID NO: 85439 - protein, 9 aa, Homo sapiens
  light chain complementarity determining region 3 for antibody 42720
QQYGSSPRT

SEQ ID NO: 85440 - protein, 25 aa, Homo sapiens
  heavy chain complementarity determining region 3 for antibody 42720
ARLRIDRLRLPGAMRGPLYDCGLNV

SEQ ID NO: 85441 - protein, 10 aa, Homo sapiens
  light chain complementarity determining region 3 for antibody 42721
QQYGSSPPIT

SEQ ID NO: 85442 - protein, 20 aa, Homo sapiens
  heavy chain complementarity determining region 3 for antibody 42721
ARRNRTYDSESNLWLYYFDY

SEQ ID NO: 85443 - protein, 9 aa, Homo sapiens
  light chain complementarity determining region 3 for antibody 42722
QQYGSSPIT

SEQ ID NO: 85444 - protein, 13 aa, Homo sapiens
  heavy chain complementarity determining region 3 for antibody 42722
VRSFQWLVGVFDL

SEQ ID NO: 85445 - protein, 9 aa, Homo sapiens
  light chain complementarity determining region 3 for antibody 42723
QQYGSSPDT

SEQ ID NO: 85446 - protein, 12 aa, Homo sapiens
  heavy chain complementarity determining region 3 for antibody 42723
ARNYYDSGRLEY

SEQ ID NO: 85447 - protein, 9 aa, Homo sapiens
  light chain complementarity determining region 3 for antibody 42724
QQYGSSLVT

SEQ ID NO: 85448 - protein, 17 aa, Homo sapiens
  heavy chain complementarity determining region 3 for antibody 42724
VRDWRWYRGTFPYYFDE

SEQ ID NO: 85449 - protein, 10 aa, Homo sapiens
  light chain complementarity determining region 3 for antibody 42725
QQYGSSLPYT

SEQ ID NO: 85450 - protein, 14 aa, Homo sapiens
  heavy chain complementarity determining region 3 for antibody 42725
ARGLPGISSWYFTN

SEQ ID NO: 85451 - protein, 9 aa, Homo sapiens
  light chain complementarity determining region 3 for antibody 42726
QQYGSIVKT

SEQ ID NO: 85452 - protein, 18 aa, Homo sapiens
  heavy chain complementarity determining region 3 for antibody 42726
TRDQYTSDWKERDEFFQH

SEQ ID NO: 85453 - protein, 9 aa, Homo sapiens
  light chain complementarity determining region 3 for antibody 42727
QQYGSAPFT

SEQ ID NO: 85454 - protein, 18 aa, Homo sapiens
  heavy chain complementarity determining region 3 for antibody 42727
AKAPLRACRGPSCYPLDP

SEQ ID NO: 85455 - protein, 8 aa, Homo sapiens
  light chain complementarity determining region 3 for antibody 42728
QQYGRSQT

SEQ ID NO: 85456 - protein, 17 aa, Homo sapiens
  heavy chain complementarity determining region 3 for antibody 42728
ARAYFYSNSGYLDGFDL

SEQ ID NO: 85457 - protein, 10 aa, Homo sapiens
  light chain complementarity determining region 3 for antibody 42729
QQYGRSPPFT

SEQ ID NO: 85458 - protein, 13 aa, Homo sapiens
  heavy chain complementarity determining region 3 for antibody 42729
ATGYSSGWPFFDY

SEQ ID NO: 85459 - protein, 10 aa, Homo sapiens
  light chain complementarity determining region 3 for antibody 42730
QQYGNWPPFT

SEQ ID NO: 85460 - protein, 14 aa, Homo sapiens
  heavy chain complementarity determining region 3 for antibody 42730
ARDQTPRAMAVFDY

SEQ ID NO: 85461 - protein, 9 aa, Homo sapiens
  light chain complementarity determining region 3 for antibody 42731
QQYGNSPYT

SEQ ID NO: 85462 - protein, 25 aa, Homo sapiens
  heavy chain complementarity determining region 3 for antibody 42731
ARDSDLGEYDEDGYYFPFKYYGMDV

SEQ ID NO: 85463 - protein, 9 aa, Homo sapiens
  light chain complementarity determining region 3 for antibody 42732
QQYGNSPDT

SEQ ID NO: 85464 - protein, 14 aa, Homo sapiens
  heavy chain complementarity determining region 3 for antibody 42732
ACLIVVALPDVTDI

SEQ ID NO: 85465 - protein, 9 aa, Homo sapiens
  light chain complementarity determining region 3 for antibody 42733
QQYGLAPFT

SEQ ID NO: 85466 - protein, 16 aa, Homo sapiens
  heavy chain complementarity determining region 3 for antibody 42733
GKDGGYYYDSSGYLGN

SEQ ID NO: 85467 - protein, 9 aa, Homo sapiens
  light chain complementarity determining region 3 for antibody 42734
QQYGISPRT

SEQ ID NO: 85468 - protein, 18 aa, Homo sapiens
  heavy chain complementarity determining region 3 for antibody 42734
ARDMEEGIEDFGDSAPGH

SEQ ID NO: 85469 - protein, 9 aa, Homo sapiens
  light chain complementarity determining region 3 for antibody 42735
QQYGGPPVT

SEQ ID NO: 85470 - protein, 16 aa, Homo sapiens
  heavy chain complementarity determining region 3 for antibody 42735
AKGDSTIDNYHYGMDV

SEQ ID NO: 85471 - protein, 10 aa, Homo sapiens
  light chain complementarity determining region 3 for antibody 42736
QQYGDLPPLT

SEQ ID NO: 85472 - protein, 16 aa, Homo sapiens
  heavy chain complementarity determining region 3 for antibody 42736
AREIRVIPGSYYGMDV

SEQ ID NO: 85473 - protein, 11 aa, Homo sapiens
  light chain complementarity determining region 3 for antibody 42737
QQYGASPRMYT

SEQ ID NO: 85474 - protein, 17 aa, Homo sapiens
  heavy chain complementarity determining region 3 for antibody 42737
AIWFGRNSGWFSGPFDF

SEQ ID NO: 85475 - protein, 9 aa, Homo sapiens
  light chain complementarity determining region 3 for antibody 42738
QQYFISPYT

SEQ ID NO: 85476 - protein, 12 aa, Homo sapiens
  heavy chain complementarity determining region 3 for antibody 42738
VRPYYYDSSDDH

SEQ ID NO: 85477 - protein, 9 aa, Homo sapiens
  light chain complementarity determining region 3 for antibody 42739
QQYENFPLT

SEQ ID NO: 85478 - protein, 13 aa, Homo sapiens
  heavy chain complementarity determining region 3 for antibody 42739
ARDVSHGSSSFDL

SEQ ID NO: 85479 - protein, 8 aa, Homo sapiens
  light chain complementarity determining region 3 for antibody 42740
QQYDTYWT

SEQ ID NO: 85480 - protein, 8 aa, Homo sapiens
  heavy chain complementarity determining region 3 for antibody 42740
ARGRLGDL

SEQ ID NO: 85481 - protein, 10 aa, Homo sapiens
  light chain complementarity determining region 3 for antibody 42741
QQYDTSPPWT

SEQ ID NO: 85482 - protein, 11 aa, Homo sapiens
  heavy chain complementarity determining region 3 for antibody 42741
AREYDDTQFDF

SEQ ID NO: 85483 - protein, 8 aa, Homo sapiens
  light chain complementarity determining region 3 for antibody 42742
QQYDTLIS

SEQ ID NO: 85484 - protein, 19 aa, Homo sapiens
  heavy chain complementarity determining region 3 for antibody 42742
VRDQGHSVWGNNRSPGGDY

SEQ ID NO: 85485 - protein, 9 aa, Homo sapiens
  light chain complementarity determining region 3 for antibody 42743
QQYDSYPRT

SEQ ID NO: 85486 - protein, 9 aa, Homo sapiens
  heavy chain complementarity determining region 3 for antibody 42743
ARYGSELGY

SEQ ID NO: 85487 - protein, 10 aa, Homo sapiens
  light chain complementarity determining region 3 for antibody 42744
QQYDSSPPLT

SEQ ID NO: 85488 - protein, 16 aa, Homo sapiens
  heavy chain complementarity determining region 3 for antibody 42744
ATDISYGSEMGYYFDY

SEQ ID NO: 85489 - protein, 9 aa, Homo sapiens
  light chain complementarity determining region 3 for antibody 42745
QQYDRAPFT

SEQ ID NO: 85490 - protein, 16 aa, Homo sapiens
  heavy chain complementarity determining region 3 for antibody 42745
ARAEGLQWFPLNYFDY

SEQ ID NO: 85491 - protein, 9 aa, Homo sapiens
  light chain complementarity determining region 3 for antibody 42746
QQYDNLPYT

SEQ ID NO: 85492 - protein, 7 aa, Homo sapiens
  heavy chain complementarity determining region 3 for antibody 42746
ARLGHPY

SEQ ID NO: 85493 - protein, 9 aa, Homo sapiens
  light chain complementarity determining region 3 for antibody 42747
QQYDNLPVT

SEQ ID NO: 85494 - protein, 17 aa, Homo sapiens
  heavy chain complementarity determining region 3 for antibody 42747
ARAPGIVRTTVHWYFDL

SEQ ID NO: 85495 - protein, 10 aa, Homo sapiens
  light chain complementarity determining region 3 for antibody 42748
QQYDNLPSVT

SEQ ID NO: 85496 - protein, 25 aa, Homo sapiens
  heavy chain complementarity determining region 3 for antibody 42748
ARRDITMVWGATLSPDSGINYAFDI

SEQ ID NO: 85497 - protein, 9 aa, Homo sapiens
  light chain complementarity determining region 3 for antibody 42749
QQYDNLPRT

SEQ ID NO: 85498 - protein, 19 aa, Homo sapiens
  heavy chain complementarity determining region 3 for antibody 42749
VRGLDRFCSSSSCSRLFDC

SEQ ID NO: 85499 - protein, 9 aa, Homo sapiens
  light chain complementarity determining region 3 for antibody 42750
QQYDNLPRT

SEQ ID NO: 85500 - protein, 19 aa, Homo sapiens
  heavy chain complementarity determining region 3 for antibody 42750
ARSPGGSIAATGSWAYFDD

SEQ ID NO: 85501 - protein, 11 aa, Homo sapiens
  light chain complementarity determining region 3 for antibody 42751
QQYDNLPPSGT

SEQ ID NO: 85502 - protein, 17 aa, Homo sapiens
  heavy chain complementarity determining region 3 for antibody 42751
ASGKGRYTYGGRGGIDF

SEQ ID NO: 85503 - protein, 9 aa, Homo sapiens
  light chain complementarity determining region 3 for antibody 42752
QQYDNLPIT

SEQ ID NO: 85504 - protein, 24 aa, Homo sapiens
  heavy chain complementarity determining region 3 for antibody 42752
ARHRMRRYDFWNGPSVHYYYAMDV

SEQ ID NO: 85505 - protein, 11 aa, Homo sapiens
  light chain complementarity determining region 3 for antibody 42753
QQYDNLPFAYT

SEQ ID NO: 85506 - protein, 21 aa, Homo sapiens
  heavy chain complementarity determining region 3 for antibody 42753
ARNDPDKKEGGQTYGYNYFEQ

SEQ ID NO: 85507 - protein, 9 aa, Homo sapiens
  light chain complementarity determining region 3 for antibody 42754
QQYDNLLLT

SEQ ID NO: 85508 - protein, 14 aa, Homo sapiens
  heavy chain complementarity determining region 3 for antibody 42754
ARDRVGSSWYGAGY

SEQ ID NO: 85509 - protein, 9 aa, Homo sapiens
  light chain complementarity determining region 3 for antibody 42755
QQYDNFPFT

SEQ ID NO: 85510 - protein, 21 aa, Homo sapiens
  heavy chain complementarity determining region 3 for antibody 42755
AKDRRRILVAGTRNYYYGMDV

SEQ ID NO: 85511 - protein, 9 aa, Homo sapiens
  light chain complementarity determining region 3 for antibody 42756
QQYDHLPLT

SEQ ID NO: 85512 - protein, 13 aa, Homo sapiens
  heavy chain complementarity determining region 3 for antibody 42756
ARAIYAQWLTFDF

SEQ ID NO: 85513 - protein, 9 aa, Homo sapiens
  light chain complementarity determining region 3 for antibody 42757
QQYDGSPWT

SEQ ID NO: 85514 - protein, 22 aa, Homo sapiens
  heavy chain complementarity determining region 3 for antibody 42757
ARRRPTDITKFRQRGRQWAFEI

SEQ ID NO: 85515 - protein, 9 aa, Homo sapiens
  light chain complementarity determining region 3 for antibody 42758
QQYDDLPVT

SEQ ID NO: 85516 - protein, 12 aa, Homo sapiens
  heavy chain complementarity determining region 3 for antibody 42758
ARNIASRNNYDS

SEQ ID NO: 85517 - protein, 9 aa, Homo sapiens
  light chain complementarity determining region 3 for antibody 42759
QQYASSPPT

SEQ ID NO: 85518 - protein, 17 aa, Homo sapiens
  heavy chain complementarity determining region 3 for antibody 42759
ARGGGYYSGSGTYPFDY

SEQ ID NO: 85519 - protein, 9 aa, Homo sapiens
  light chain complementarity determining region 3 for antibody 42760
QQYADYPVT

SEQ ID NO: 85520 - protein, 20 aa, Homo sapiens
  heavy chain complementarity determining region 3 for antibody 42760
SSGGYFYDSPGSSVLDYFDY

SEQ ID NO: 85521 - protein, 9 aa, Homo sapiens
  light chain complementarity determining region 3 for antibody 42761
QQVYNTPYT

SEQ ID NO: 85522 - protein, 12 aa, Homo sapiens
  heavy chain complementarity determining region 3 for antibody 42761
ARQNVPYFYDEY

SEQ ID NO: 85523 - protein, 9 aa, Homo sapiens
  light chain complementarity determining region 3 for antibody 42762
QQTKSLPIT

SEQ ID NO: 85524 - protein, 16 aa, Homo sapiens
  heavy chain complementarity determining region 3 for antibody 42762
ARERANQFGVNDAFDI

SEQ ID NO: 85525 - protein, 9 aa, Homo sapiens
  light chain complementarity determining region 3 for antibody 42763
QQTFGTPQT

SEQ ID NO: 85526 - protein, 17 aa, Homo sapiens
  heavy chain complementarity determining region 3 for antibody 42763
ARGFEQWLIQKGYYFDA

SEQ ID NO: 85527 - protein, 9 aa, Homo sapiens
  light chain complementarity determining region 3 for antibody 42764
QQTDRAPLT

SEQ ID NO: 85528 - protein, 13 aa, Homo sapiens
  heavy chain complementarity determining region 3 for antibody 42764
VRDKVEGPTILDY

SEQ ID NO: 85529 - protein, 9 aa, Homo sapiens
  light chain complementarity determining region 3 for antibody 42765
QQSYTTPYT

SEQ ID NO: 85530 - protein, 9 aa, Homo sapiens
  heavy chain complementarity determining region 3 for antibody 42765
ARGAGVFDY

SEQ ID NO: 85531 - protein, 9 aa, Homo sapiens
  light chain complementarity determining region 3 for antibody 42766
QQSYTTPYT

SEQ ID NO: 85532 - protein, 15 aa, Homo sapiens
  heavy chain complementarity determining region 3 for antibody 42766
ARDAFRGDYGGKAEY

SEQ ID NO: 85533 - protein, 9 aa, Homo sapiens
  light chain complementarity determining region 3 for antibody 42767
QQSYTIPIT

SEQ ID NO: 85534 - protein, 15 aa, Homo sapiens
  heavy chain complementarity determining region 3 for antibody 42767
AKGIYGGNRIDAFDI

SEQ ID NO: 85535 - protein, 9 aa, Homo sapiens
  light chain complementarity determining region 3 for antibody 42768
QQSYTAPIT

SEQ ID NO: 85536 - protein, 10 aa, Homo sapiens
  heavy chain complementarity determining region 3 for antibody 42768
AHSSGYDYDY

SEQ ID NO: 85537 - protein, 9 aa, Homo sapiens
  light chain complementarity determining region 3 for antibody 42769
QQSYSTWYT

SEQ ID NO: 85538 - protein, 14 aa, Homo sapiens
  heavy chain complementarity determining region 3 for antibody 42769
ARQTRYTNSWYFDY

SEQ ID NO: 85539 - protein, 8 aa, Homo sapiens
  light chain complementarity determining region 3 for antibody 42770
QQSYSTQT

SEQ ID NO: 85540 - protein, 16 aa, Homo sapiens
  heavy chain complementarity determining region 3 for antibody 42770
ATKRGSDYVNHDSFDD

SEQ ID NO: 85541 - protein, 9 aa, Homo sapiens
  light chain complementarity determining region 3 for antibody 42771
QQSYSTPWT

SEQ ID NO: 85542 - protein, 15 aa, Homo sapiens
  heavy chain complementarity determining region 3 for antibody 42771
ARVESVAGSREYFQH

SEQ ID NO: 85543 - protein, 8 aa, Homo sapiens
  light chain complementarity determining region 3 for antibody 42772
QQSYSTPT

SEQ ID NO: 85544 - protein, 15 aa, Homo sapiens
  heavy chain complementarity determining region 3 for antibody 42772
ARRAVKDYLLDYFDY

SEQ ID NO: 85545 - protein, 9 aa, Homo sapiens
  light chain complementarity determining region 3 for antibody 42773
QQSYSTPRP

SEQ ID NO: 85546 - protein, 15 aa, Homo sapiens
  heavy chain complementarity determining region 3 for antibody 42773
ARDAIYDFWSGYYSL

SEQ ID NO: 85547 - protein, 9 aa, Homo sapiens
  light chain complementarity determining region 3 for antibody 42774
QQSYSTPQT

SEQ ID NO: 85548 - protein, 14 aa, Homo sapiens
  heavy chain complementarity determining region 3 for antibody 42774
AKSFSSGWPSRFDY

SEQ ID NO: 85549 - protein, 9 aa, Homo sapiens
  light chain complementarity determining region 3 for antibody 42775
QQSYSTPQT

SEQ ID NO: 85550 - protein, 15 aa, Homo sapiens
  heavy chain complementarity determining region 3 for antibody 42775
AKAQVIWGQLYYFES

SEQ ID NO: 85551 - protein, 9 aa, Homo sapiens
  light chain complementarity determining region 3 for antibody 42776
QQSYSTPPT

SEQ ID NO: 85552 - protein, 17 aa, Homo sapiens
  heavy chain complementarity determining region 3 for antibody 42776
VQVSSPYYYGSGGQFEY

SEQ ID NO: 85553 - protein, 9 aa, Homo sapiens
  light chain complementarity determining region 3 for antibody 42777
QQSYSTPPT

SEQ ID NO: 85554 - protein, 11 aa, Homo sapiens
  heavy chain complementarity determining region 3 for antibody 42777
ARVFYYSPLDP

SEQ ID NO: 85555 - protein, 9 aa, Homo sapiens
  light chain complementarity determining region 3 for antibody 42778
QQSYSTPFT

SEQ ID NO: 85556 - protein, 13 aa, Homo sapiens
  heavy chain complementarity determining region 3 for antibody 42778
ARDRLLVGGAFDL

SEQ ID NO: 85557 - protein, 9 aa, Homo sapiens
  light chain complementarity determining region 3 for antibody 42779
QQSYSTLWT

SEQ ID NO: 85558 - protein, 13 aa, Homo sapiens
  heavy chain complementarity determining region 3 for antibody 42779
ARGQLSSWWFIDY

SEQ ID NO: 85559 - protein, 8 aa, Homo sapiens
  light chain complementarity determining region 3 for antibody 42780
QQSYSTLT

SEQ ID NO: 85560 - protein, 16 aa, Homo sapiens
  heavy chain complementarity determining region 3 for antibody 42780
AKDPGRVSVSGSEFAS

SEQ ID NO: 85561 - protein, 10 aa, Homo sapiens
  light chain complementarity determining region 3 for antibody 42781
QQSYSTLMYN

SEQ ID NO: 85562 - protein, 15 aa, Homo sapiens
  heavy chain complementarity determining region 3 for antibody 42781
ARGSAAGSRADRFYL

SEQ ID NO: 85563 - protein, 9 aa, Homo sapiens
  light chain complementarity determining region 3 for antibody 42782
QQSYSTFYT

SEQ ID NO: 85564 - protein, 20 aa, Homo sapiens
  heavy chain complementarity determining region 3 for antibody 42782
ARGPDVSGKSAYPYYYGLDV
